United States Patent 11,492,591 (UNIVERSAL DONOR STEM CELLS AND RELATED METHODS) - sequence listing, part 23

SEQ ID NO: 740844 - DNA, 20 bp, Artificial
  CRISPR gRNA sequence
cacttctagaacttcagcct

SEQ ID NO: 740845 - DNA, 20 bp, Artificial
  CRISPR gRNA sequence
acttctagaacttcagcctc

SEQ ID NO: 740846 - DNA, 20 bp, Artificial
  CRISPR gRNA sequence
gaacttcagcctcaggaatt

SEQ ID NO: 740847 - DNA, 20 bp, Artificial
  CRISPR gRNA sequence
aacttcagcctcaggaattt

SEQ ID NO: 740848 - DNA, 20 bp, Artificial
  CRISPR gRNA sequence
acttcagcctcaggaatttg

SEQ ID NO: 740849 - DNA, 20 bp, Artificial
  CRISPR gRNA sequence
agcctcaggaatttggggac

SEQ ID NO: 740850 - DNA, 20 bp, Artificial
  CRISPR gRNA sequence
tttggggacaagtttctctt

SEQ ID NO: 740851 - DNA, 20 bp, Artificial
  CRISPR gRNA sequence
acaagtttctctttggtcaa

SEQ ID NO: 740852 - DNA, 20 bp, Artificial
  CRISPR gRNA sequence
aagtttctctttggtcaata

SEQ ID NO: 740853 - DNA, 20 bp, Artificial
  CRISPR gRNA sequence
tctttggtcaatagagttga

SEQ ID NO: 740854 - DNA, 20 bp, Artificial
  CRISPR gRNA sequence
gtcaatagagttgatggcat

SEQ ID NO: 740855 - DNA, 20 bp, Artificial
  CRISPR gRNA sequence
tcaatagagttgatggcatt

SEQ ID NO: 740856 - DNA, 20 bp, Artificial
  CRISPR gRNA sequence
attaggatcgaacatcccca

SEQ ID NO: 740857 - DNA, 20 bp, Artificial
  CRISPR gRNA sequence
acatccccaaagcctgtctt

SEQ ID NO: 740858 - DNA, 20 bp, Artificial
  CRISPR gRNA sequence
cccaaagcctgtcttgagct

SEQ ID NO: 740859 - DNA, 20 bp, Artificial
  CRISPR gRNA sequence
ccaaagcctgtcttgagctg

SEQ ID NO: 740860 - DNA, 20 bp, Artificial
  CRISPR gRNA sequence
caaagcctgtcttgagctga

SEQ ID NO: 740861 - DNA, 20 bp, Artificial
  CRISPR gRNA sequence
aaagcctgtcttgagctgag

SEQ ID NO: 740862 - DNA, 20 bp, Artificial
  CRISPR gRNA sequence
agcctgtcttgagctgaggg

SEQ ID NO: 740863 - DNA, 20 bp, Artificial
  CRISPR gRNA sequence
gcctgtcttgagctgagggg

SEQ ID NO: 740864 - DNA, 20 bp, Artificial
  CRISPR gRNA sequence
cctgtcttgagctgagggga

SEQ ID NO: 740865 - DNA, 20 bp, Artificial
  CRISPR gRNA sequence
ctgtcttgagctgaggggag

SEQ ID NO: 740866 - DNA, 20 bp, Artificial
  CRISPR gRNA sequence
gaggggttctcttctcttcc

SEQ ID NO: 740867 - DNA, 20 bp, Artificial
  CRISPR gRNA sequence
ggttctcttctcttcccagt

SEQ ID NO: 740868 - DNA, 20 bp, Artificial
  CRISPR gRNA sequence
gttctcttctcttcccagtt

SEQ ID NO: 740869 - DNA, 20 bp, Artificial
  CRISPR gRNA sequence
tctcttctcttcccagttgg

SEQ ID NO: 740870 - DNA, 20 bp, Artificial
  CRISPR gRNA sequence
cttctcttcccagttgggag

SEQ ID NO: 740871 - DNA, 20 bp, Artificial
  CRISPR gRNA sequence
ttctcttcccagttgggagt

SEQ ID NO: 740872 - DNA, 20 bp, Artificial
  CRISPR gRNA sequence
tgggagtgggataacttctg

SEQ ID NO: 740873 - DNA, 20 bp, Artificial
  CRISPR gRNA sequence
ctgaagacccctgcaactct

SEQ ID NO: 740874 - DNA, 20 bp, Artificial
  CRISPR gRNA sequence
cccctgcaactcttagattc

SEQ ID NO: 740875 - DNA, 20 bp, Artificial
  CRISPR gRNA sequence
gcaactcttagattctagat

SEQ ID NO: 740876 - DNA, 20 bp, Artificial
  CRISPR gRNA sequence
ttagattctagatgagttgc

SEQ ID NO: 740877 - DNA, 20 bp, Artificial
  CRISPR gRNA sequence
gattctagatgagttgcaag

SEQ ID NO: 740878 - DNA, 20 bp, Artificial
  CRISPR gRNA sequence
attctagatgagttgcaagc

SEQ ID NO: 740879 - DNA, 20 bp, Artificial
  CRISPR gRNA sequence
acttccttcaacctgtcttg

SEQ ID NO: 740880 - DNA, 20 bp, Artificial
  CRISPR gRNA sequence
gatcatccctttcaaacacc

SEQ ID NO: 740881 - DNA, 20 bp, Artificial
  CRISPR gRNA sequence
tcatccctttcaaacaccta

SEQ ID NO: 740882 - DNA, 20 bp, Artificial
  CRISPR gRNA sequence
catccctttcaaacacctag

SEQ ID NO: 740883 - DNA, 20 bp, Artificial
  CRISPR gRNA sequence
tccctttcaaacacctagag

SEQ ID NO: 740884 - DNA, 20 bp, Artificial
  CRISPR gRNA sequence
acctagaggagctttgtgtt

SEQ ID NO: 740885 - DNA, 20 bp, Artificial
  CRISPR gRNA sequence
gagctttgtgtttggtgttg

SEQ ID NO: 740886 - DNA, 20 bp, Artificial
  CRISPR gRNA sequence
agctttgtgtttggtgttgc

SEQ ID NO: 740887 - DNA, 20 bp, Artificial
  CRISPR gRNA sequence
gtgtttggtgttgcaggtac

SEQ ID NO: 740888 - DNA, 20 bp, Artificial
  CRISPR gRNA sequence
tgtttggtgttgcaggtacc

SEQ ID NO: 740889 - DNA, 20 bp, Artificial
  CRISPR gRNA sequence
gtttggtgttgcaggtaccg

SEQ ID NO: 740890 - DNA, 20 bp, Artificial
  CRISPR gRNA sequence
tggtgttgcaggtaccgggg

SEQ ID NO: 740891 - DNA, 20 bp, Artificial
  CRISPR gRNA sequence
ggtgttgcaggtaccggggc

SEQ ID NO: 740892 - DNA, 20 bp, Artificial
  CRISPR gRNA sequence
caggtaccggggcaggaact

SEQ ID NO: 740893 - DNA, 20 bp, Artificial
  CRISPR gRNA sequence
aggtaccggggcaggaactt

SEQ ID NO: 740894 - DNA, 20 bp, Artificial
  CRISPR gRNA sequence
ggttccctgaacacaccctc

SEQ ID NO: 740895 - DNA, 20 bp, Artificial
  CRISPR gRNA sequence
gttccctgaacacaccctcc

SEQ ID NO: 740896 - DNA, 20 bp, Artificial
  CRISPR gRNA sequence
cctgaacacaccctccaggc

SEQ ID NO: 740897 - DNA, 20 bp, Artificial
  CRISPR gRNA sequence
ctgaacacaccctccaggcc

SEQ ID NO: 740898 - DNA, 20 bp, Artificial
  CRISPR gRNA sequence
accctccaggccaggctgca

SEQ ID NO: 740899 - DNA, 20 bp, Artificial
  CRISPR gRNA sequence
ctccaggccaggctgcatgg

SEQ ID NO: 740900 - DNA, 20 bp, Artificial
  CRISPR gRNA sequence
ctgcatggcagcttcctgcc

SEQ ID NO: 740901 - DNA, 20 bp, Artificial
  CRISPR gRNA sequence
gcatggcagcttcctgccca

SEQ ID NO: 740902 - DNA, 20 bp, Artificial
  CRISPR gRNA sequence
gcccagagcacaccaataca

SEQ ID NO: 740903 - DNA, 20 bp, Artificial
  CRISPR gRNA sequence
gtccccatcccctctgcccc

SEQ ID NO: 740904 - DNA, 20 bp, Artificial
  CRISPR gRNA sequence
atcccctctgcccctagacc

SEQ ID NO: 740905 - DNA, 20 bp, Artificial
  CRISPR gRNA sequence
cccagcccactgcaccactc

SEQ ID NO: 740906 - DNA, 20 bp, Artificial
  CRISPR gRNA sequence
ccagcccactgcaccactct

SEQ ID NO: 740907 - DNA, 20 bp, Artificial
  CRISPR gRNA sequence
tgcaccactctgggacccct

SEQ ID NO: 740908 - DNA, 20 bp, Artificial
  CRISPR gRNA sequence
cccctcagcctctgcccttg

SEQ ID NO: 740909 - DNA, 20 bp, Artificial
  CRISPR gRNA sequence
gcctctgcccttgtggcctg

SEQ ID NO: 740910 - DNA, 20 bp, Artificial
  CRISPR gRNA sequence
tctgcccttgtggcctgcag

SEQ ID NO: 740911 - DNA, 20 bp, Artificial
  CRISPR gRNA sequence
tgtggcctgcagcggcctaa

SEQ ID NO: 740912 - DNA, 20 bp, Artificial
  CRISPR gRNA sequence
cggcctaacagctttctcct

SEQ ID NO: 740913 - DNA, 20 bp, Artificial
  CRISPR gRNA sequence
gcctaacagctttctccttg

SEQ ID NO: 740914 - DNA, 20 bp, Artificial
  CRISPR gRNA sequence
tttctccttggagttctctg

SEQ ID NO: 740915 - DNA, 20 bp, Artificial
  CRISPR gRNA sequence
ttctccttggagttctctgc

SEQ ID NO: 740916 - DNA, 20 bp, Artificial
  CRISPR gRNA sequence
tccttggagttctctgcggg

SEQ ID NO: 740917 - DNA, 20 bp, Artificial
  CRISPR gRNA sequence
ccttggagttctctgcgggc

SEQ ID NO: 740918 - DNA, 20 bp, Artificial
  CRISPR gRNA sequence
ttggagttctctgcgggcag

SEQ ID NO: 740919 - DNA, 20 bp, Artificial
  CRISPR gRNA sequence
tggagttctctgcgggcagg

SEQ ID NO: 740920 - DNA, 20 bp, Artificial
  CRISPR gRNA sequence
ttctctgcgggcaggaggca

SEQ ID NO: 740921 - DNA, 20 bp, Artificial
  CRISPR gRNA sequence
gcgggcaggaggcacagctc

SEQ ID NO: 740922 - DNA, 20 bp, Artificial
  CRISPR gRNA sequence
cgggcaggaggcacagctca

SEQ ID NO: 740923 - DNA, 20 bp, Artificial
  CRISPR gRNA sequence
gggcaggaggcacagctcaa

SEQ ID NO: 740924 - DNA, 20 bp, Artificial
  CRISPR gRNA sequence
gaggcacagctcaagggctg

SEQ ID NO: 740925 - DNA, 20 bp, Artificial
  CRISPR gRNA sequence
cacagctcaagggctgtggc

SEQ ID NO: 740926 - DNA, 20 bp, Artificial
  CRISPR gRNA sequence
acagctcaagggctgtggct

SEQ ID NO: 740927 - DNA, 20 bp, Artificial
  CRISPR gRNA sequence
cagctcaagggctgtggctg

SEQ ID NO: 740928 - DNA, 20 bp, Artificial
  CRISPR gRNA sequence
tcaagggctgtggctggggc

SEQ ID NO: 740929 - DNA, 20 bp, Artificial
  CRISPR gRNA sequence
caagggctgtggctggggct

SEQ ID NO: 740930 - DNA, 20 bp, Artificial
  CRISPR gRNA sequence
gtggctggggctgggcccgc

SEQ ID NO: 740931 - DNA, 20 bp, Artificial
  CRISPR gRNA sequence
gcatgtctcactgtctgccc

SEQ ID NO: 740932 - DNA, 20 bp, Artificial
  CRISPR gRNA sequence
gtctcactgtctgccccaga

SEQ ID NO: 740933 - DNA, 20 bp, Artificial
  CRISPR gRNA sequence
cttcctccctgtccccatcc

SEQ ID NO: 740934 - DNA, 20 bp, Artificial
  CRISPR gRNA sequence
tccctgtccccatcctggcc

SEQ ID NO: 740935 - DNA, 20 bp, Artificial
  CRISPR gRNA sequence
ccctgtccccatcctggccc

SEQ ID NO: 740936 - DNA, 20 bp, Artificial
  CRISPR gRNA sequence
cctggcccaggctgaccact

SEQ ID NO: 740937 - DNA, 20 bp, Artificial
  CRISPR gRNA sequence
aggctgaccactgagacccg

SEQ ID NO: 740938 - DNA, 20 bp, Artificial
  CRISPR gRNA sequence
ggctgaccactgagacccga

SEQ ID NO: 740939 - DNA, 20 bp, Artificial
  CRISPR gRNA sequence
tgaccactgagacccgaagg

SEQ ID NO: 740940 - DNA, 20 bp, Artificial
  CRISPR gRNA sequence
gaccactgagacccgaaggt

SEQ ID NO: 740941 - DNA, 20 bp, Artificial
  CRISPR gRNA sequence
ggtgggtgcatgacacatct

SEQ ID NO: 740942 - DNA, 20 bp, Artificial
  CRISPR gRNA sequence
gggtgcatgacacatctgag

SEQ ID NO: 740943 - DNA, 20 bp, Artificial
  CRISPR gRNA sequence
atgacacatctgagcagaat

SEQ ID NO: 740944 - DNA, 20 bp, Artificial
  CRISPR gRNA sequence
gacacatctgagcagaatca

SEQ ID NO: 740945 - DNA, 20 bp, Artificial
  CRISPR gRNA sequence
atctgagcagaatcagagct

SEQ ID NO: 740946 - DNA, 20 bp, Artificial
  CRISPR gRNA sequence
gaatcagagctcagcctgct

SEQ ID NO: 740947 - DNA, 20 bp, Artificial
  CRISPR gRNA sequence
cagagctcagcctgctgagt

SEQ ID NO: 740948 - DNA, 20 bp, Artificial
  CRISPR gRNA sequence
agagctcagcctgctgagtc

SEQ ID NO: 740949 - DNA, 20 bp, Artificial
  CRISPR gRNA sequence
gagctcagcctgctgagtcg

SEQ ID NO: 740950 - DNA, 20 bp, Artificial
  CRISPR gRNA sequence
ctcagcctgctgagtcgggg

SEQ ID NO: 740951 - DNA, 20 bp, Artificial
  CRISPR gRNA sequence
agcctgctgagtcggggtgg

SEQ ID NO: 740952 - DNA, 20 bp, Artificial
  CRISPR gRNA sequence
gcctgctgagtcggggtggc

SEQ ID NO: 740953 - DNA, 20 bp, Artificial
  CRISPR gRNA sequence
ctgctgagtcggggtggcag

SEQ ID NO: 740954 - DNA, 20 bp, Artificial
  CRISPR gRNA sequence
gagtcggggtggcaggagaa

SEQ ID NO: 740955 - DNA, 20 bp, Artificial
  CRISPR gRNA sequence
aggagaacagccaatctgca

SEQ ID NO: 740956 - DNA, 20 bp, Artificial
  CRISPR gRNA sequence
agccaatctgcacagatgtg

SEQ ID NO: 740957 - DNA, 20 bp, Artificial
  CRISPR gRNA sequence
gccaatctgcacagatgtgc

SEQ ID NO: 740958 - DNA, 20 bp, Artificial
  CRISPR gRNA sequence
ctgcacagatgtgcaggctt

SEQ ID NO: 740959 - DNA, 20 bp, Artificial
  CRISPR gRNA sequence
cacagatgtgcaggcttcag

SEQ ID NO: 740960 - DNA, 20 bp, Artificial
  CRISPR gRNA sequence
agatgtgcaggcttcagcag

SEQ ID NO: 740961 - DNA, 20 bp, Artificial
  CRISPR gRNA sequence
gtgcaggcttcagcagcaga

SEQ ID NO: 740962 - DNA, 20 bp, Artificial
  CRISPR gRNA sequence
caggcttcagcagcagatgg

SEQ ID NO: 740963 - DNA, 20 bp, Artificial
  CRISPR gRNA sequence
ggcttcagcagcagatggca

SEQ ID NO: 740964 - DNA, 20 bp, Artificial
  CRISPR gRNA sequence
gcttcagcagcagatggcag

SEQ ID NO: 740965 - DNA, 20 bp, Artificial
  CRISPR gRNA sequence
atggcagaggctcttctgac

SEQ ID NO: 740966 - DNA, 20 bp, Artificial
  CRISPR gRNA sequence
gctcttctgaccagctgctc

SEQ ID NO: 740967 - DNA, 20 bp, Artificial
  CRISPR gRNA sequence
ctcttctgaccagctgctct

SEQ ID NO: 740968 - DNA, 20 bp, Artificial
  CRISPR gRNA sequence
ttctgaccagctgctctagg

SEQ ID NO: 740969 - DNA, 20 bp, Artificial
  CRISPR gRNA sequence
agctgctctaggcagctaaa

SEQ ID NO: 740970 - DNA, 20 bp, Artificial
  CRISPR gRNA sequence
gctgctctaggcagctaaac

SEQ ID NO: 740971 - DNA, 20 bp, Artificial
  CRISPR gRNA sequence
ctgctctaggcagctaaaca

SEQ ID NO: 740972 - DNA, 20 bp, Artificial
  CRISPR gRNA sequence
taaacagggcccctactgca

SEQ ID NO: 740973 - DNA, 20 bp, Artificial
  CRISPR gRNA sequence
acagggcccctactgcacag

SEQ ID NO: 740974 - DNA, 20 bp, Artificial
  CRISPR gRNA sequence
tgcacagaagtatctcttcc

SEQ ID NO: 740975 - DNA, 20 bp, Artificial
  CRISPR gRNA sequence
cagaagtatctcttcctgga

SEQ ID NO: 740976 - DNA, 20 bp, Artificial
  CRISPR gRNA sequence
agtatctcttcctggatagc

SEQ ID NO: 740977 - DNA, 20 bp, Artificial
  CRISPR gRNA sequence
ctcttcctggatagccggcc

SEQ ID NO: 740978 - DNA, 20 bp, Artificial
  CRISPR gRNA sequence
tcttcctggatagccggccc

SEQ ID NO: 740979 - DNA, 20 bp, Artificial
  CRISPR gRNA sequence
tcctggatagccggcccagg

SEQ ID NO: 740980 - DNA, 20 bp, Artificial
  CRISPR gRNA sequence
ccggcccaggaagttttctc

SEQ ID NO: 740981 - DNA, 20 bp, Artificial
  CRISPR gRNA sequence
gcccaggaagttttctcaag

SEQ ID NO: 740982 - DNA, 20 bp, Artificial
  CRISPR gRNA sequence
cccaggaagttttctcaaga

SEQ ID NO: 740983 - DNA, 20 bp, Artificial
  CRISPR gRNA sequence
ttttctcaagaaggtctcca

SEQ ID NO: 740984 - DNA, 20 bp, Artificial
  CRISPR gRNA sequence
tttctcaagaaggtctccat

SEQ ID NO: 740985 - DNA, 20 bp, Artificial
  CRISPR gRNA sequence
ccttacctgtccatccgcac

SEQ ID NO: 740986 - DNA, 20 bp, Artificial
  CRISPR gRNA sequence
tgtccatccgcaccagctcc

SEQ ID NO: 740987 - DNA, 20 bp, Artificial
  CRISPR gRNA sequence
gtccatccgcaccagctcct

SEQ ID NO: 740988 - DNA, 20 bp, Artificial
  CRISPR gRNA sequence
cgcaccagctcctgggcacc

SEQ ID NO: 740989 - DNA, 20 bp, Artificial
  CRISPR gRNA sequence
gcaccagctcctgggcacct

SEQ ID NO: 740990 - DNA, 20 bp, Artificial
  CRISPR gRNA sequence
caccagctcctgggcaccta

SEQ ID NO: 740991 - DNA, 20 bp, Artificial
  CRISPR gRNA sequence
agctcctgggcacctaggga

SEQ ID NO: 740992 - DNA, 20 bp, Artificial
  CRISPR gRNA sequence
cctgggcacctagggacaga

SEQ ID NO: 740993 - DNA, 20 bp, Artificial
  CRISPR gRNA sequence
ggcacctagggacagacaga

SEQ ID NO: 740994 - DNA, 20 bp, Artificial
  CRISPR gRNA sequence
cacctagggacagacagaca

SEQ ID NO: 740995 - DNA, 20 bp, Artificial
  CRISPR gRNA sequence
ctagggacagacagacagag

SEQ ID NO: 740996 - DNA, 20 bp, Artificial
  CRISPR gRNA sequence
ggacagacagacagagaagc

SEQ ID NO: 740997 - DNA, 20 bp, Artificial
  CRISPR gRNA sequence
acagacagagaagctggtca

SEQ ID NO: 740998 - DNA, 20 bp, Artificial
  CRISPR gRNA sequence
gacagagaagctggtcatgg

SEQ ID NO: 740999 - DNA, 20 bp, Artificial
  CRISPR gRNA sequence
acagagaagctggtcatgga

SEQ ID NO: 741000 - DNA, 20 bp, Artificial
  CRISPR gRNA sequence
cagagaagctggtcatggaa

SEQ ID NO: 741001 - DNA, 20 bp, Artificial
  CRISPR gRNA sequence
agaagctggtcatggaaggg

SEQ ID NO: 741002 - DNA, 20 bp, Artificial
  CRISPR gRNA sequence
gaagctggtcatggaaggga

SEQ ID NO: 741003 - DNA, 20 bp, Artificial
  CRISPR gRNA sequence
tacaacatccctgcccctgc

SEQ ID NO: 741004 - DNA, 20 bp, Artificial
  CRISPR gRNA sequence
aacatccctgcccctgctgg

SEQ ID NO: 741005 - DNA, 20 bp, Artificial
  CRISPR gRNA sequence
ccctgctggcagatgccctg

SEQ ID NO: 741006 - DNA, 20 bp, Artificial
  CRISPR gRNA sequence
cctgctggcagatgccctgc

SEQ ID NO: 741007 - DNA, 20 bp, Artificial
  CRISPR gRNA sequence
ctgctggcagatgccctgca

SEQ ID NO: 741008 - DNA, 20 bp, Artificial
  CRISPR gRNA sequence
ggcagatgccctgcagggaa

SEQ ID NO: 741009 - DNA, 20 bp, Artificial
  CRISPR gRNA sequence
gcagatgccctgcagggaac

SEQ ID NO: 741010 - DNA, 20 bp, Artificial
  CRISPR gRNA sequence
agatgccctgcagggaacag

SEQ ID NO: 741011 - DNA, 20 bp, Artificial
  CRISPR gRNA sequence
gccctgcagggaacaggagc

SEQ ID NO: 741012 - DNA, 20 bp, Artificial
  CRISPR gRNA sequence
gcagggaacaggagcgagcc

SEQ ID NO: 741013 - DNA, 20 bp, Artificial
  CRISPR gRNA sequence
cagggaacaggagcgagccc

SEQ ID NO: 741014 - DNA, 20 bp, Artificial
  CRISPR gRNA sequence
gggaacaggagcgagcccag

SEQ ID NO: 741015 - DNA, 20 bp, Artificial
  CRISPR gRNA sequence
ggaacaggagcgagcccagg

SEQ ID NO: 741016 - DNA, 20 bp, Artificial
  CRISPR gRNA sequence
gaacaggagcgagcccagga

SEQ ID NO: 741017 - DNA, 20 bp, Artificial
  CRISPR gRNA sequence
gagcccaggagggccctgca

SEQ ID NO: 741018 - DNA, 20 bp, Artificial
  CRISPR gRNA sequence
aggagggccctgcacagctc

SEQ ID NO: 741019 - DNA, 20 bp, Artificial
  CRISPR gRNA sequence
ggactccatttcttttcaca

SEQ ID NO: 741020 - DNA, 20 bp, Artificial
  CRISPR gRNA sequence
gactccatttcttttcacat

SEQ ID NO: 741021 - DNA, 20 bp, Artificial
  CRISPR gRNA sequence
cttttcacatgggtgctgtc

SEQ ID NO: 741022 - DNA, 20 bp, Artificial
  CRISPR gRNA sequence
tcacatgggtgctgtccagc

SEQ ID NO: 741023 - DNA, 20 bp, Artificial
  CRISPR gRNA sequence
aagcgatctgcgtgtctgtc

SEQ ID NO: 741024 - DNA, 20 bp, Artificial
  CRISPR gRNA sequence
cgatctgcgtgtctgtccag

SEQ ID NO: 741025 - DNA, 20 bp, Artificial
  CRISPR gRNA sequence
ctgcgtgtctgtccagcaga

SEQ ID NO: 741026 - DNA, 20 bp, Artificial
  CRISPR gRNA sequence
tgcgtgtctgtccagcagat

SEQ ID NO: 741027 - DNA, 20 bp, Artificial
  CRISPR gRNA sequence
gcgtgtctgtccagcagatg

SEQ ID NO: 741028 - DNA, 20 bp, Artificial
  CRISPR gRNA sequence
ccagcagatggggcctccat

SEQ ID NO: 741029 - DNA, 20 bp, Artificial
  CRISPR gRNA sequence
cagcagatggggcctccatg

SEQ ID NO: 741030 - DNA, 20 bp, Artificial
  CRISPR gRNA sequence
agcagatggggcctccatga

SEQ ID NO: 741031 - DNA, 20 bp, Artificial
  CRISPR gRNA sequence
gcagatggggcctccatgag

SEQ ID NO: 741032 - DNA, 20 bp, Artificial
  CRISPR gRNA sequence
gaaactctatctgcattttc

SEQ ID NO: 741033 - DNA, 20 bp, Artificial
  CRISPR gRNA sequence
aaactctatctgcattttcc

SEQ ID NO: 741034 - DNA, 20 bp, Artificial
  CRISPR gRNA sequence
actctatctgcattttccag

SEQ ID NO: 741035 - DNA, 20 bp, Artificial
  CRISPR gRNA sequence
tctgcattttccaggagtgt

SEQ ID NO: 741036 - DNA, 20 bp, Artificial
  CRISPR gRNA sequence
gtaagaacgctatctgccat

SEQ ID NO: 741037 - DNA, 20 bp, Artificial
  CRISPR gRNA sequence
taagaacgctatctgccatc

SEQ ID NO: 741038 - DNA, 20 bp, Artificial
  CRISPR gRNA sequence
agaacgctatctgccatcag

SEQ ID NO: 741039 - DNA, 20 bp, Artificial
  CRISPR gRNA sequence
tatctgccatcaggagacca

SEQ ID NO: 741040 - DNA, 20 bp, Artificial
  CRISPR gRNA sequence
atctgccatcaggagaccaa

SEQ ID NO: 741041 - DNA, 20 bp, Artificial
  CRISPR gRNA sequence
tgccatcaggagaccaaagg

SEQ ID NO: 741042 - DNA, 20 bp, Artificial
  CRISPR gRNA sequence
atcaggagaccaaaggcagc

SEQ ID NO: 741043 - DNA, 20 bp, Artificial
  CRISPR gRNA sequence
gcagccagcgctttctccta

SEQ ID NO: 741044 - DNA, 20 bp, Artificial
  CRISPR gRNA sequence
ctcctatggcttgacttaca

SEQ ID NO: 741045 - DNA, 20 bp, Artificial
  CRISPR gRNA sequence
tggcttgacttacacagtgt

SEQ ID NO: 741046 - DNA, 20 bp, Artificial
  CRISPR gRNA sequence
cttacacagtgtcagacctt

SEQ ID NO: 741047 - DNA, 20 bp, Artificial
  CRISPR gRNA sequence
ttacacagtgtcagaccttc

SEQ ID NO: 741048 - DNA, 20 bp, Artificial
  CRISPR gRNA sequence
gtgtcagaccttcaggattt

SEQ ID NO: 741049 - DNA, 20 bp, Artificial
  CRISPR gRNA sequence
accttcaggatttaagtatc

SEQ ID NO: 741050 - DNA, 20 bp, Artificial
  CRISPR gRNA sequence
caggatttaagtatcgagca

SEQ ID NO: 741051 - DNA, 20 bp, Artificial
  CRISPR gRNA sequence
aggatttaagtatcgagcaa

SEQ ID NO: 741052 - DNA, 20 bp, Artificial
  CRISPR gRNA sequence
caactcttgaatttgctaac

SEQ ID NO: 741053 - DNA, 20 bp, Artificial
  CRISPR gRNA sequence
tctcttgtttgaacatttgc

SEQ ID NO: 741054 - DNA, 20 bp, Artificial
  CRISPR gRNA sequence
ctcttgtttgaacatttgcc

SEQ ID NO: 741055 - DNA, 20 bp, Artificial
  CRISPR gRNA sequence
tttgaacatttgccaggttc

SEQ ID NO: 741056 - DNA, 20 bp, Artificial
  CRISPR gRNA sequence
atttgccaggttctggtctt

SEQ ID NO: 741057 - DNA, 20 bp, Artificial
  CRISPR gRNA sequence
ggtctttagccatgacttac

SEQ ID NO: 741058 - DNA, 20 bp, Artificial
  CRISPR gRNA sequence
gtctttagccatgacttact

SEQ ID NO: 741059 - DNA, 20 bp, Artificial
  CRISPR gRNA sequence
tttagccatgacttactggg

SEQ ID NO: 741060 - DNA, 20 bp, Artificial
  CRISPR gRNA sequence
ttagccatgacttactgggt

SEQ ID NO: 741061 - DNA, 20 bp, Artificial
  CRISPR gRNA sequence
agccatgacttactgggtgg

SEQ ID NO: 741062 - DNA, 20 bp, Artificial
  CRISPR gRNA sequence
cttactgggtgggagtgttt

SEQ ID NO: 741063 - DNA, 20 bp, Artificial
  CRISPR gRNA sequence
ttactgggtgggagtgttta

SEQ ID NO: 741064 - DNA, 20 bp, Artificial
  CRISPR gRNA sequence
tgggtgggagtgtttaaggt

SEQ ID NO: 741065 - DNA, 20 bp, Artificial
  CRISPR gRNA sequence
gtttaaggtcagttcctaat

SEQ ID NO: 741066 - DNA, 20 bp, Artificial
  CRISPR gRNA sequence
ttaaggtcagttcctaatta

SEQ ID NO: 741067 - DNA, 20 bp, Artificial
  CRISPR gRNA sequence
taaggtcagttcctaattag

SEQ ID NO: 741068 - DNA, 20 bp, Artificial
  CRISPR gRNA sequence
aaggtcagttcctaattaga

SEQ ID NO: 741069 - DNA, 20 bp, Artificial
  CRISPR gRNA sequence
gttcctaattagagggctcc

SEQ ID NO: 741070 - DNA, 20 bp, Artificial
  CRISPR gRNA sequence
ctatcccctacattgcctaa

SEQ ID NO: 741071 - DNA, 20 bp, Artificial
  CRISPR gRNA sequence
tatcccctacattgcctaat

SEQ ID NO: 741072 - DNA, 20 bp, Artificial
  CRISPR gRNA sequence
atcccctacattgcctaata

SEQ ID NO: 741073 - DNA, 20 bp, Artificial
  CRISPR gRNA sequence
ccctacattgcctaataggg

SEQ ID NO: 741074 - DNA, 20 bp, Artificial
  CRISPR gRNA sequence
tgcctaatagggtggcattc

SEQ ID NO: 741075 - DNA, 20 bp, Artificial
  CRISPR gRNA sequence
gcctaatagggtggcattct

SEQ ID NO: 741076 - DNA, 20 bp, Artificial
  CRISPR gRNA sequence
cctaatagggtggcattcta

SEQ ID NO: 741077 - DNA, 20 bp, Artificial
  CRISPR gRNA sequence
ctaatagggtggcattctag

SEQ ID NO: 741078 - DNA, 20 bp, Artificial
  CRISPR gRNA sequence
gcattctaggggacatctct

SEQ ID NO: 741079 - DNA, 20 bp, Artificial
  CRISPR gRNA sequence
cattctaggggacatctctc

SEQ ID NO: 741080 - DNA, 20 bp, Artificial
  CRISPR gRNA sequence
attctaggggacatctctca

SEQ ID NO: 741081 - DNA, 20 bp, Artificial
  CRISPR gRNA sequence
atctctcagggaaaccttac

SEQ ID NO: 741082 - DNA, 20 bp, Artificial
  CRISPR gRNA sequence
tctctcagggaaaccttaca

SEQ ID NO: 741083 - DNA, 20 bp, Artificial
  CRISPR gRNA sequence
agggaaaccttacaaggtgc

SEQ ID NO: 741084 - DNA, 20 bp, Artificial
  CRISPR gRNA sequence
gcaagtccccgatcacttcc

SEQ ID NO: 741085 - DNA, 20 bp, Artificial
  CRISPR gRNA sequence
tcactttctgcttctcatcc

SEQ ID NO: 741086 - DNA, 20 bp, Artificial
  CRISPR gRNA sequence
caagttgctgccgcttgcct

SEQ ID NO: 741087 - DNA, 20 bp, Artificial
  CRISPR gRNA sequence
gctgccgcttgcctcagcct

SEQ ID NO: 741088 - DNA, 20 bp, Artificial
  CRISPR gRNA sequence
ctgccgcttgcctcagcctt

SEQ ID NO: 741089 - DNA, 20 bp, Artificial
  CRISPR gRNA sequence
ggacaccccaccccccaaac

SEQ ID NO: 741090 - DNA, 20 bp, Artificial
  CRISPR gRNA sequence
cccccaaactggccaccaat

SEQ ID NO: 741091 - DNA, 20 bp, Artificial
  CRISPR gRNA sequence
aactggccaccaattagatg

SEQ ID NO: 741092 - DNA, 20 bp, Artificial
  CRISPR gRNA sequence
cccaacttccctctttcatg

SEQ ID NO: 741093 - DNA, 20 bp, Artificial
  CRISPR gRNA sequence
cagcaccccatgtcctccca

SEQ ID NO: 741094 - DNA, 20 bp, Artificial
  CRISPR gRNA sequence
ccacagatgcttctcgtttt

SEQ ID NO: 741095 - DNA, 20 bp, Artificial
  CRISPR gRNA sequence
cacagatgcttctcgtttta

SEQ ID NO: 741096 - DNA, 20 bp, Artificial
  CRISPR gRNA sequence
cagatgcttctcgttttaag

SEQ ID NO: 741097 - DNA, 20 bp, Artificial
  CRISPR gRNA sequence
agatttactgctgattacga

SEQ ID NO: 741098 - DNA, 20 bp, Artificial
  CRISPR gRNA sequence
gatttactgctgattacgat

SEQ ID NO: 741099 - DNA, 20 bp, Artificial
  CRISPR gRNA sequence
atttactgctgattacgatg

SEQ ID NO: 741100 - DNA, 20 bp, Artificial
  CRISPR gRNA sequence
tgctgattacgatggggaaa

SEQ ID NO: 741101 - DNA, 20 bp, Artificial
  CRISPR gRNA sequence
gattacgatggggaaacaga

SEQ ID NO: 741102 - DNA, 20 bp, Artificial
  CRISPR gRNA sequence
tacgatggggaaacagatgg

SEQ ID NO: 741103 - DNA, 20 bp, Artificial
  CRISPR gRNA sequence
acgatggggaaacagatggt

SEQ ID NO: 741104 - DNA, 20 bp, Artificial
  CRISPR gRNA sequence
cgatggggaaacagatggtg

SEQ ID NO: 741105 - DNA, 20 bp, Artificial
  CRISPR gRNA sequence
gatggggaaacagatggtgg

SEQ ID NO: 741106 - DNA, 20 bp, Artificial
  CRISPR gRNA sequence
tggggaaacagatggtgggg

SEQ ID NO: 741107 - DNA, 20 bp, Artificial
  CRISPR gRNA sequence
ggggaaacagatggtggggg

SEQ ID NO: 741108 - DNA, 20 bp, Artificial
  CRISPR gRNA sequence
gggaaacagatggtggggga

SEQ ID NO: 741109 - DNA, 20 bp, Artificial
  CRISPR gRNA sequence
ggaaacagatggtgggggag

SEQ ID NO: 741110 - DNA, 20 bp, Artificial
  CRISPR gRNA sequence
gtgggggaggggcacaacaa

SEQ ID NO: 741111 - DNA, 20 bp, Artificial
  CRISPR gRNA sequence
gcacaacaacagaacaaaca

SEQ ID NO: 741112 - DNA, 20 bp, Artificial
  CRISPR gRNA sequence
cacaacaacagaacaaacac

SEQ ID NO: 741113 - DNA, 20 bp, Artificial
  CRISPR gRNA sequence
acaacaacagaacaaacaca

SEQ ID NO: 741114 - DNA, 20 bp, Artificial
  CRISPR gRNA sequence
acaacagaacaaacacaggg

SEQ ID NO: 741115 - DNA, 20 bp, Artificial
  CRISPR gRNA sequence
aacacagggaagttacccaa

SEQ ID NO: 741116 - DNA, 20 bp, Artificial
  CRISPR gRNA sequence
cctgaaatctattcaaacca

SEQ ID NO: 741117 - DNA, 20 bp, Artificial
  CRISPR gRNA sequence
caaaccatggctattgctta

SEQ ID NO: 741118 - DNA, 20 bp, Artificial
  CRISPR gRNA sequence
tattgcttacagccgactca

SEQ ID NO: 741119 - DNA, 20 bp, Artificial
  CRISPR gRNA sequence
attgcttacagccgactcat

SEQ ID NO: 741120 - DNA, 20 bp, Artificial
  CRISPR gRNA sequence
cttacagccgactcatgggt

SEQ ID NO: 741121 - DNA, 20 bp, Artificial
  CRISPR gRNA sequence
ttacagccgactcatgggtc

SEQ ID NO: 741122 - DNA, 20 bp, Artificial
  CRISPR gRNA sequence
ctcatgggtcaggcttcgtg

SEQ ID NO: 741123 - DNA, 20 bp, Artificial
  CRISPR gRNA sequence
tcatgggtcaggcttcgtgc

SEQ ID NO: 741124 - DNA, 20 bp, Artificial
  CRISPR gRNA sequence
aggcttcgtgcaggtgcaca

SEQ ID NO: 741125 - DNA, 20 bp, Artificial
  CRISPR gRNA sequence
ggcttcgtgcaggtgcacac

SEQ ID NO: 741126 - DNA, 20 bp, Artificial
  CRISPR gRNA sequence
tcatcctctgtgccaccctt

SEQ ID NO: 741127 - DNA, 20 bp, Artificial
  CRISPR gRNA sequence
catcctctgtgccacccttt

SEQ ID NO: 741128 - DNA, 20 bp, Artificial
  CRISPR gRNA sequence
atcctctgtgccaccctttg

SEQ ID NO: 741129 - DNA, 20 bp, Artificial
  CRISPR gRNA sequence
tctgtgccaccctttggggt

SEQ ID NO: 741130 - DNA, 20 bp, Artificial
  CRISPR gRNA sequence
ctgtgccaccctttggggtg

SEQ ID NO: 741131 - DNA, 20 bp, Artificial
  CRISPR gRNA sequence
tgtgccaccctttggggtga

SEQ ID NO: 741132 - DNA, 20 bp, Artificial
  CRISPR gRNA sequence
ccctttggggtgagggttgt

SEQ ID NO: 741133 - DNA, 20 bp, Artificial
  CRISPR gRNA sequence
gagggttgttggtcccattt

SEQ ID NO: 741134 - DNA, 20 bp, Artificial
  CRISPR gRNA sequence
gggttgttggtcccatttta

SEQ ID NO: 741135 - DNA, 20 bp, Artificial
  CRISPR gRNA sequence
tgttggtcccattttagagc

SEQ ID NO: 741136 - DNA, 20 bp, Artificial
  CRISPR gRNA sequence
gttggtcccattttagagct

SEQ ID NO: 741137 - DNA, 20 bp, Artificial
  CRISPR gRNA sequence
ttggtcccattttagagctg

SEQ ID NO: 741138 - DNA, 20 bp, Artificial
  CRISPR gRNA sequence
attttagagctggggaaact

SEQ ID NO: 741139 - DNA, 20 bp, Artificial
  CRISPR gRNA sequence
ttttagagctggggaaactg

SEQ ID NO: 741140 - DNA, 20 bp, Artificial
  CRISPR gRNA sequence
gagctggggaaactgaggct

SEQ ID NO: 741141 - DNA, 20 bp, Artificial
  CRISPR gRNA sequence
ggaaactgaggctcagtcca

SEQ ID NO: 741142 - DNA, 20 bp, Artificial
  CRISPR gRNA sequence
aactgaggctcagtccaaag

SEQ ID NO: 741143 - DNA, 20 bp, Artificial
  CRISPR gRNA sequence
actgaggctcagtccaaagc

SEQ ID NO: 741144 - DNA, 20 bp, Artificial
  CRISPR gRNA sequence
aggctcagtccaaagcagga

SEQ ID NO: 741145 - DNA, 20 bp, Artificial
  CRISPR gRNA sequence
ggatggaaatccacacctgt

SEQ ID NO: 741146 - DNA, 20 bp, Artificial
  CRISPR gRNA sequence
tccacacctgttggcctctc

SEQ ID NO: 741147 - DNA, 20 bp, Artificial
  CRISPR gRNA sequence
tccagcaaactgccgtcctc

SEQ ID NO: 741148 - DNA, 20 bp, Artificial
  CRISPR gRNA sequence
ccagcaaactgccgtcctca

SEQ ID NO: 741149 - DNA, 20 bp, Artificial
  CRISPR gRNA sequence
actgccgtcctcaaggctcc

SEQ ID NO: 741150 - DNA, 20 bp, Artificial
  CRISPR gRNA sequence
tttccttttctttttttcct

SEQ ID NO: 741151 - DNA, 20 bp, Artificial
  CRISPR gRNA sequence
tccttttctttttttcctga

SEQ ID NO: 741152 - DNA, 20 bp, Artificial
  CRISPR gRNA sequence
cctgagagtgcctcattcct

SEQ ID NO: 741153 - DNA, 20 bp, Artificial
  CRISPR gRNA sequence
gagagtgcctcattcctgag

SEQ ID NO: 741154 - DNA, 20 bp, Artificial
  CRISPR gRNA sequence
agagtgcctcattcctgagc

SEQ ID NO: 741155 - DNA, 20 bp, Artificial
  CRISPR gRNA sequence
tcattcctgagcaggctctc

SEQ ID NO: 741156 - DNA, 20 bp, Artificial
  CRISPR gRNA sequence
cattcctgagcaggctctct

SEQ ID NO: 741157 - DNA, 20 bp, Artificial
  CRISPR gRNA sequence
cctgagcaggctctctgggc

SEQ ID NO: 741158 - DNA, 20 bp, Artificial
  CRISPR gRNA sequence
tctctgggccagccttccac

SEQ ID NO: 741159 - DNA, 20 bp, Artificial
  CRISPR gRNA sequence
ctctgggccagccttccacc

SEQ ID NO: 741160 - DNA, 20 bp, Artificial
  CRISPR gRNA sequence
tctgggccagccttccacca

SEQ ID NO: 741161 - DNA, 20 bp, Artificial
  CRISPR gRNA sequence
tgggccagccttccaccagg

SEQ ID NO: 741162 - DNA, 20 bp, Artificial
  CRISPR gRNA sequence
gggccagccttccaccaggg

SEQ ID NO: 741163 - DNA, 20 bp, Artificial
  CRISPR gRNA sequence
ggccagccttccaccaggga

SEQ ID NO: 741164 - DNA, 20 bp, Artificial
  CRISPR gRNA sequence
gccttccaccagggagggca

SEQ ID NO: 741165 - DNA, 20 bp, Artificial
  CRISPR gRNA sequence
gctccccctgccctgctgcc

SEQ ID NO: 741166 - DNA, 20 bp, Artificial
  CRISPR gRNA sequence
cagcgttgctcttctgttcc

SEQ ID NO: 741167 - DNA, 20 bp, Artificial
  CRISPR gRNA sequence
tacctgcccccacccacccc

SEQ ID NO: 741168 - DNA, 20 bp, Artificial
  CRISPR gRNA sequence
cccccacccacccccagcca

SEQ ID NO: 741169 - DNA, 20 bp, Artificial
  CRISPR gRNA sequence
ccccacccacccccagccat

SEQ ID NO: 741170 - DNA, 20 bp, Artificial
  CRISPR gRNA sequence
cccagccatgggtattcctg

SEQ ID NO: 741171 - DNA, 20 bp, Artificial
  CRISPR gRNA sequence
ccagccatgggtattcctgc

SEQ ID NO: 741172 - DNA, 20 bp, Artificial
  CRISPR gRNA sequence
gccatgggtattcctgcagg

SEQ ID NO: 741173 - DNA, 20 bp, Artificial
  CRISPR gRNA sequence
ccatgggtattcctgcaggt

SEQ ID NO: 741174 - DNA, 20 bp, Artificial
  CRISPR gRNA sequence
gtattcctgcaggtaggttg

SEQ ID NO: 741175 - DNA, 20 bp, Artificial
  CRISPR gRNA sequence
aggtaggttgtggtgtgttc

SEQ ID NO: 741176 - DNA, 20 bp, Artificial
  CRISPR gRNA sequence
ggtaggttgtggtgtgttct

SEQ ID NO: 741177 - DNA, 20 bp, Artificial
  CRISPR gRNA sequence
taggttgtggtgtgttctag

SEQ ID NO: 741178 - DNA, 20 bp, Artificial
  CRISPR gRNA sequence
ggttgtggtgtgttctagga

SEQ ID NO: 741179 - DNA, 20 bp, Artificial
  CRISPR gRNA sequence
gttgtggtgtgttctaggag

SEQ ID NO: 741180 - DNA, 20 bp, Artificial
  CRISPR gRNA sequence
ggtgtgttctaggagaggaa

SEQ ID NO: 741181 - DNA, 20 bp, Artificial
  CRISPR gRNA sequence
gtgtgttctaggagaggaat

SEQ ID NO: 741182 - DNA, 20 bp, Artificial
  CRISPR gRNA sequence
tgtgttctaggagaggaata

SEQ ID NO: 741183 - DNA, 20 bp, Artificial
  CRISPR gRNA sequence
gtgttctaggagaggaatag

SEQ ID NO: 741184 - DNA, 20 bp, Artificial
  CRISPR gRNA sequence
gttctaggagaggaataggg

SEQ ID NO: 741185 - DNA, 20 bp, Artificial
  CRISPR gRNA sequence
gaggaataggggagttctga

SEQ ID NO: 741186 - DNA, 20 bp, Artificial
  CRISPR gRNA sequence
aataggggagttctgaaagc

SEQ ID NO: 741187 - DNA, 20 bp, Artificial
  CRISPR gRNA sequence
ataggggagttctgaaagca

SEQ ID NO: 741188 - DNA, 20 bp, Artificial
  CRISPR gRNA sequence
taggggagttctgaaagcaa

SEQ ID NO: 741189 - DNA, 20 bp, Artificial
  CRISPR gRNA sequence
ggagttctgaaagcaagggt

SEQ ID NO: 741190 - DNA, 20 bp, Artificial
  CRISPR gRNA sequence
gagttctgaaagcaagggtg

SEQ ID NO: 741191 - DNA, 20 bp, Artificial
  CRISPR gRNA sequence
ttctgaaagcaagggtgagg

SEQ ID NO: 741192 - DNA, 20 bp, Artificial
  CRISPR gRNA sequence
aagcaagggtgaggtggcca

SEQ ID NO: 741193 - DNA, 20 bp, Artificial
  CRISPR gRNA sequence
gtgaggtggccacagccccc

SEQ ID NO: 741194 - DNA, 20 bp, Artificial
  CRISPR gRNA sequence
agcccccgagtgacccacta

SEQ ID NO: 741195 - DNA, 20 bp, Artificial
  CRISPR gRNA sequence
gcccccgagtgacccactat

SEQ ID NO: 741196 - DNA, 20 bp, Artificial
  CRISPR gRNA sequence
cccccgagtgacccactatg

SEQ ID NO: 741197 - DNA, 20 bp, Artificial
  CRISPR gRNA sequence
acccactatggggcttcacg

SEQ ID NO: 741198 - DNA, 20 bp, Artificial
  CRISPR gRNA sequence
cccactatggggcttcacgt

SEQ ID NO: 741199 - DNA, 20 bp, Artificial
  CRISPR gRNA sequence
ccactatggggcttcacgtg

SEQ ID NO: 741200 - DNA, 20 bp, Artificial
  CRISPR gRNA sequence
cactatggggcttcacgtgg

SEQ ID NO: 741201 - DNA, 20 bp, Artificial
  CRISPR gRNA sequence
gggcttcacgtgggggcccc

SEQ ID NO: 741202 - DNA, 20 bp, Artificial
  CRISPR gRNA sequence
ggcttcacgtgggggccccc

SEQ ID NO: 741203 - DNA, 20 bp, Artificial
  CRISPR gRNA sequence
acgtgggggcccccgggaat

SEQ ID NO: 741204 - DNA, 20 bp, Artificial
  CRISPR gRNA sequence
cgtgggggcccccgggaatg

SEQ ID NO: 741205 - DNA, 20 bp, Artificial
  CRISPR gRNA sequence
gtgggggcccccgggaatga

SEQ ID NO: 741206 - DNA, 20 bp, Artificial
  CRISPR gRNA sequence
tgggggcccccgggaatgag

SEQ ID NO: 741207 - DNA, 20 bp, Artificial
  CRISPR gRNA sequence
ggggcccccgggaatgaggg

SEQ ID NO: 741208 - DNA, 20 bp, Artificial
  CRISPR gRNA sequence
gggcccccgggaatgagggg

SEQ ID NO: 741209 - DNA, 20 bp, Artificial
  CRISPR gRNA sequence
ggcccccgggaatgagggga

SEQ ID NO: 741210 - DNA, 20 bp, Artificial
  CRISPR gRNA sequence
cccccgggaatgaggggagg

SEQ ID NO: 741211 - DNA, 20 bp, Artificial
  CRISPR gRNA sequence
ccccgggaatgaggggaggg

SEQ ID NO: 741212 - DNA, 20 bp, Artificial
  CRISPR gRNA sequence
cccgggaatgaggggaggga

SEQ ID NO: 741213 - DNA, 20 bp, Artificial
  CRISPR gRNA sequence
tgaggggagggagggatgac

SEQ ID NO: 741214 - DNA, 20 bp, Artificial
  CRISPR gRNA sequence
gggagggatgacaagttgtt

SEQ ID NO: 741215 - DNA, 20 bp, Artificial
  CRISPR gRNA sequence
ggagggatgacaagttgtta

SEQ ID NO: 741216 - DNA, 20 bp, Artificial
  CRISPR gRNA sequence
gagggatgacaagttgttaa

SEQ ID NO: 741217 - DNA, 20 bp, Artificial
  CRISPR gRNA sequence
gatgacaagttgttaagggc

SEQ ID NO: 741218 - DNA, 20 bp, Artificial
  CRISPR gRNA sequence
aagttgttaagggccggcca

SEQ ID NO: 741219 - DNA, 20 bp, Artificial
  CRISPR gRNA sequence
agttgttaagggccggccac

SEQ ID NO: 741220 - DNA, 20 bp, Artificial
  CRISPR gRNA sequence
aagggccggccacaggaaat

SEQ ID NO: 741221 - DNA, 20 bp, Artificial
  CRISPR gRNA sequence
ggccacaggaaataagttgc

SEQ ID NO: 741222 - DNA, 20 bp, Artificial
  CRISPR gRNA sequence
ggaaataagttgcgagccaa

SEQ ID NO: 741223 - DNA, 20 bp, Artificial
  CRISPR gRNA sequence
gttgcgagccaaaagccacc

SEQ ID NO: 741224 - DNA, 20 bp, Artificial
  CRISPR gRNA sequence
agccaaaagccacctggcac

SEQ ID NO: 741225 - DNA, 20 bp, Artificial
  CRISPR gRNA sequence
ccaaaagccacctggcacca

SEQ ID NO: 741226 - DNA, 20 bp, Artificial
  CRISPR gRNA sequence
gcaccagagcaatcctttct

SEQ ID NO: 741227 - DNA, 20 bp, Artificial
  CRISPR gRNA sequence
tcctttctcagttacctctg

SEQ ID NO: 741228 - DNA, 20 bp, Artificial
  CRISPR gRNA sequence
ttctcagttacctctgtagc

SEQ ID NO: 741229 - DNA, 20 bp, Artificial
  CRISPR gRNA sequence
tctcagttacctctgtagcc

SEQ ID NO: 741230 - DNA, 20 bp, Artificial
  CRISPR gRNA sequence
cagttacctctgtagccagg

SEQ ID NO: 741231 - DNA, 20 bp, Artificial
  CRISPR gRNA sequence
tacctctgtagccaggcaga

SEQ ID NO: 741232 - DNA, 20 bp, Artificial
  CRISPR gRNA sequence
acctctgtagccaggcagac

SEQ ID NO: 741233 - DNA, 20 bp, Artificial
  CRISPR gRNA sequence
tctgtagccaggcagacggg

SEQ ID NO: 741234 - DNA, 20 bp, Artificial
  CRISPR gRNA sequence
tgtagccaggcagacgggaa

SEQ ID NO: 741235 - DNA, 20 bp, Artificial
  CRISPR gRNA sequence
gtagccaggcagacgggaag

SEQ ID NO: 741236 - DNA, 20 bp, Artificial
  CRISPR gRNA sequence
ccaggcagacgggaagaggc

SEQ ID NO: 741237 - DNA, 20 bp, Artificial
  CRISPR gRNA sequence
caggcagacgggaagaggcc

SEQ ID NO: 741238 - DNA, 20 bp, Artificial
  CRISPR gRNA sequence
aggcagacgggaagaggcca

SEQ ID NO: 741239 - DNA, 20 bp, Artificial
  CRISPR gRNA sequence
gcagacgggaagaggccagg

SEQ ID NO: 741240 - DNA, 20 bp, Artificial
  CRISPR gRNA sequence
cagacgggaagaggccaggg

SEQ ID NO: 741241 - DNA, 20 bp, Artificial
  CRISPR gRNA sequence
agacgggaagaggccaggga

SEQ ID NO: 741242 - DNA, 20 bp, Artificial
  CRISPR gRNA sequence
gacgggaagaggccagggag

SEQ ID NO: 741243 - DNA, 20 bp, Artificial
  CRISPR gRNA sequence
cgggaagaggccagggaggg

SEQ ID NO: 741244 - DNA, 20 bp, Artificial
  CRISPR gRNA sequence
gggaagaggccagggagggg

SEQ ID NO: 741245 - DNA, 20 bp, Artificial
  CRISPR gRNA sequence
agaggccagggaggggaggc

SEQ ID NO: 741246 - DNA, 20 bp, Artificial
  CRISPR gRNA sequence
gaggccagggaggggaggca

SEQ ID NO: 741247 - DNA, 20 bp, Artificial
  CRISPR gRNA sequence
aggccagggaggggaggcaa

SEQ ID NO: 741248 - DNA, 20 bp, Artificial
  CRISPR gRNA sequence
ggcaagggtaaaaaactccc

SEQ ID NO: 741249 - DNA, 20 bp, Artificial
  CRISPR gRNA sequence
aaaactccctagccccttct

SEQ ID NO: 741250 - DNA, 20 bp, Artificial
  CRISPR gRNA sequence
aactccctagccccttcttg

SEQ ID NO: 741251 - DNA, 20 bp, Artificial
  CRISPR gRNA sequence
actccctagccccttcttgg

SEQ ID NO: 741252 - DNA, 20 bp, Artificial
  CRISPR gRNA sequence
tagccccttcttggaggact

SEQ ID NO: 741253 - DNA, 20 bp, Artificial
  CRISPR gRNA sequence
ttggaggactcagactaacc

SEQ ID NO: 741254 - DNA, 20 bp, Artificial
  CRISPR gRNA sequence
actcagactaaccaagactc

SEQ ID NO: 741255 - DNA, 20 bp, Artificial
  CRISPR gRNA sequence
ctcagactaaccaagactca

SEQ ID NO: 741256 - DNA, 20 bp, Artificial
  CRISPR gRNA sequence
tcagactaaccaagactcaa

SEQ ID NO: 741257 - DNA, 20 bp, Artificial
  CRISPR gRNA sequence
gactaaccaagactcaaggg

SEQ ID NO: 741258 - DNA, 20 bp, Artificial
  CRISPR gRNA sequence
actaaccaagactcaagggc

SEQ ID NO: 741259 - DNA, 20 bp, Artificial
  CRISPR gRNA sequence
ctaaccaagactcaagggca

SEQ ID NO: 741260 - DNA, 20 bp, Artificial
  CRISPR gRNA sequence
ccaagactcaagggcagggt

SEQ ID NO: 741261 - DNA, 20 bp, Artificial
  CRISPR gRNA sequence
caagactcaagggcagggtc

SEQ ID NO: 741262 - DNA, 20 bp, Artificial
  CRISPR gRNA sequence
tcaagggcagggtcaggaac

SEQ ID NO: 741263 - DNA, 20 bp, Artificial
  CRISPR gRNA sequence
caagggcagggtcaggaact

SEQ ID NO: 741264 - DNA, 20 bp, Artificial
  CRISPR gRNA sequence
ggcagggtcaggaactaggc

SEQ ID NO: 741265 - DNA, 20 bp, Artificial
  CRISPR gRNA sequence
gcagggtcaggaactaggca

SEQ ID NO: 741266 - DNA, 20 bp, Artificial
  CRISPR gRNA sequence
cagggtcaggaactaggcaa

SEQ ID NO: 741267 - DNA, 20 bp, Artificial
  CRISPR gRNA sequence
agggtcaggaactaggcaag

SEQ ID NO: 741268 - DNA, 20 bp, Artificial
  CRISPR gRNA sequence
aggcaaggggcactgtcacc

SEQ ID NO: 741269 - DNA, 20 bp, Artificial
  CRISPR gRNA sequence
aaggggcactgtcacctggc

SEQ ID NO: 741270 - DNA, 20 bp, Artificial
  CRISPR gRNA sequence
aggggcactgtcacctggcc

SEQ ID NO: 741271 - DNA, 20 bp, Artificial
  CRISPR gRNA sequence
ggggcactgtcacctggcca

SEQ ID NO: 741272 - DNA, 20 bp, Artificial
  CRISPR gRNA sequence
gcactgtcacctggccaggg

SEQ ID NO: 741273 - DNA, 20 bp, Artificial
  CRISPR gRNA sequence
cactgtcacctggccagggt

SEQ ID NO: 741274 - DNA, 20 bp, Artificial
  CRISPR gRNA sequence
ctgtcacctggccagggtgg

SEQ ID NO: 741275 - DNA, 20 bp, Artificial
  CRISPR gRNA sequence
tgtcacctggccagggtggg

SEQ ID NO: 741276 - DNA, 20 bp, Artificial
  CRISPR gRNA sequence
ctggccagggtgggaggtga

SEQ ID NO: 741277 - DNA, 20 bp, Artificial
  CRISPR gRNA sequence
atgtttgtgcccatgactta

SEQ ID NO: 741278 - DNA, 20 bp, Artificial
  CRISPR gRNA sequence
tgtgcccatgacttaaagcc

SEQ ID NO: 741279 - DNA, 20 bp, Artificial
  CRISPR gRNA sequence
cccaccacttatttgctgtg

SEQ ID NO: 741280 - DNA, 20 bp, Artificial
  CRISPR gRNA sequence
ttatttgctgtgtggttcct

SEQ ID NO: 741281 - DNA, 20 bp, Artificial
  CRISPR gRNA sequence
tatttgctgtgtggttcctt

SEQ ID NO: 741282 - DNA, 20 bp, Artificial
  CRISPR gRNA sequence
tgctgtgtggttccttaggc

SEQ ID NO: 741283 - DNA, 20 bp, Artificial
  CRISPR gRNA sequence
ctgtgcctccgtttgcccat

SEQ ID NO: 741284 - DNA, 20 bp, Artificial
  CRISPR gRNA sequence
ccgtttgcccatcagtaaaa

SEQ ID NO: 741285 - DNA, 20 bp, Artificial
  CRISPR gRNA sequence
cgtttgcccatcagtaaaat

SEQ ID NO: 741286 - DNA, 20 bp, Artificial
  CRISPR gRNA sequence
gtttgcccatcagtaaaatg

SEQ ID NO: 741287 - DNA, 20 bp, Artificial
  CRISPR gRNA sequence
catcagtaaaatggggacaa

SEQ ID NO: 741288 - DNA, 20 bp, Artificial
  CRISPR gRNA sequence
cagtaaaatggggacaatgg

SEQ ID NO: 741289 - DNA, 20 bp, Artificial
  CRISPR gRNA sequence
agtaaaatggggacaatggt

SEQ ID NO: 741290 - DNA, 20 bp, Artificial
  CRISPR gRNA sequence
caatggtaggaccaaattct

SEQ ID NO: 741291 - DNA, 20 bp, Artificial
  CRISPR gRNA sequence
caaattcttggacttgcaat

SEQ ID NO: 741292 - DNA, 20 bp, Artificial
  CRISPR gRNA sequence
aaattcttggacttgcaatg

SEQ ID NO: 741293 - DNA, 20 bp, Artificial
  CRISPR gRNA sequence
attcttggacttgcaatgag

SEQ ID NO: 741294 - DNA, 20 bp, Artificial
  CRISPR gRNA sequence
ttggacttgcaatgaggagt

SEQ ID NO: 741295 - DNA, 20 bp, Artificial
  CRISPR gRNA sequence
acttgcaatgaggagtaagt

SEQ ID NO: 741296 - DNA, 20 bp, Artificial
  CRISPR gRNA sequence
ttgcaatgaggagtaagtga

SEQ ID NO: 741297 - DNA, 20 bp, Artificial
  CRISPR gRNA sequence
gtgagagcatttttattata

SEQ ID NO: 741298 - DNA, 20 bp, Artificial
  CRISPR gRNA sequence
agagcatttttattatatgg

SEQ ID NO: 741299 - DNA, 20 bp, Artificial
  CRISPR gRNA sequence
tatggtggacttctattccc

SEQ ID NO: 741300 - DNA, 20 bp, Artificial
  CRISPR gRNA sequence
gtggacttctattccctgga

SEQ ID NO: 741301 - DNA, 20 bp, Artificial
  CRISPR gRNA sequence
ggacttctattccctggaaa

SEQ ID NO: 741302 - DNA, 20 bp, Artificial
  CRISPR gRNA sequence
ctggaaagagcatgcgttga

SEQ ID NO: 741303 - DNA, 20 bp, Artificial
  CRISPR gRNA sequence
gagcatgcgttgaaagctct

SEQ ID NO: 741304 - DNA, 20 bp, Artificial
  CRISPR gRNA sequence
gcgttgaaagctctgagatt

SEQ ID NO: 741305 - DNA, 20 bp, Artificial
  CRISPR gRNA sequence
aaagctctgagattgagtcc

SEQ ID NO: 741306 - DNA, 20 bp, Artificial
  CRISPR gRNA sequence
tcctagctctgccacttact

SEQ ID NO: 741307 - DNA, 20 bp, Artificial
  CRISPR gRNA sequence
ttactaagttacgtaacatt

SEQ ID NO: 741308 - DNA, 20 bp, Artificial
  CRISPR gRNA sequence
taagttacgtaacattcagt

SEQ ID NO: 741309 - DNA, 20 bp, Artificial
  CRISPR gRNA sequence
ttatgtaaccccactgatct

SEQ ID NO: 741310 - DNA, 20 bp, Artificial
  CRISPR gRNA sequence
ctgatcttagccttctcatc

SEQ ID NO: 741311 - DNA, 20 bp, Artificial
  CRISPR gRNA sequence
ttagccttctcatctggaaa

SEQ ID NO: 741312 - DNA, 20 bp, Artificial
  CRISPR gRNA sequence
ccttctcatctggaaaaaga

SEQ ID NO: 741313 - DNA, 20 bp, Artificial
  CRISPR gRNA sequence
cttctcatctggaaaaagaa

SEQ ID NO: 741314 - DNA, 20 bp, Artificial
  CRISPR gRNA sequence
ttctcatctggaaaaagaaa

SEQ ID NO: 741315 - DNA, 20 bp, Artificial
  CRISPR gRNA sequence
atctggaaaaagaaagggtt

SEQ ID NO: 741316 - DNA, 20 bp, Artificial
  CRISPR gRNA sequence
gaaaaagaaagggttgagct

SEQ ID NO: 741317 - DNA, 20 bp, Artificial
  CRISPR gRNA sequence
ggttgagctaagttgtctgt

SEQ ID NO: 741318 - DNA, 20 bp, Artificial
  CRISPR gRNA sequence
cttccacttctgatattcca

SEQ ID NO: 741319 - DNA, 20 bp, Artificial
  CRISPR gRNA sequence
attgctactaattacaaaac

SEQ ID NO: 741320 - DNA, 20 bp, Artificial
  CRISPR gRNA sequence
aagcacgcccataccttaaa

SEQ ID NO: 741321 - DNA, 20 bp, Artificial
  CRISPR gRNA sequence
agcacgcccataccttaaac

SEQ ID NO: 741322 - DNA, 20 bp, Artificial
  CRISPR gRNA sequence
ataccttaaacaggtccccc

SEQ ID NO: 741323 - DNA, 20 bp, Artificial
  CRISPR gRNA sequence
taccttaaacaggtccccca

SEQ ID NO: 741324 - DNA, 20 bp, Artificial
  CRISPR gRNA sequence
caggtcccccaaggatctct

SEQ ID NO: 741325 - DNA, 20 bp, Artificial
  CRISPR gRNA sequence
gtcccccaaggatctctgag

SEQ ID NO: 741326 - DNA, 20 bp, Artificial
  CRISPR gRNA sequence
ccccaaggatctctgagtgg

SEQ ID NO: 741327 - DNA, 20 bp, Artificial
  CRISPR gRNA sequence
ggcagcaacttgcttttata

SEQ ID NO: 741328 - DNA, 20 bp, Artificial
  CRISPR gRNA sequence
ttgcttttataaagcaactt

SEQ ID NO: 741329 - DNA, 20 bp, Artificial
  CRISPR gRNA sequence
actgcatatgatcattcatt

SEQ ID NO: 741330 - DNA, 20 bp, Artificial
  CRISPR gRNA sequence
gcatatgatcattcattcag

SEQ ID NO: 741331 - DNA, 20 bp, Artificial
  CRISPR gRNA sequence
tcattcagaagacatgtatt

SEQ ID NO: 741332 - DNA, 20 bp, Artificial
  CRISPR gRNA sequence
gaagacatgtattgagtgcc

SEQ ID NO: 741333 - DNA, 20 bp, Artificial
  CRISPR gRNA sequence
acatgtattgagtgccgagc

SEQ ID NO: 741334 - DNA, 20 bp, Artificial
  CRISPR gRNA sequence
agtgccgagccagcactgcc

SEQ ID NO: 741335 - DNA, 20 bp, Artificial
  CRISPR gRNA sequence
gtgccgagccagcactgcct

SEQ ID NO: 741336 - DNA, 20 bp, Artificial
  CRISPR gRNA sequence
gccgagccagcactgcctgg

SEQ ID NO: 741337 - DNA, 20 bp, Artificial
  CRISPR gRNA sequence
ccagcactgcctgggagcca

SEQ ID NO: 741338 - DNA, 20 bp, Artificial
  CRISPR gRNA sequence
cagcactgcctgggagccaa

SEQ ID NO: 741339 - DNA, 20 bp, Artificial
  CRISPR gRNA sequence
agcactgcctgggagccaaa

SEQ ID NO: 741340 - DNA, 20 bp, Artificial
  CRISPR gRNA sequence
gcactgcctgggagccaaag

SEQ ID NO: 741341 - DNA, 20 bp, Artificial
  CRISPR gRNA sequence
tgcctgggagccaaaggggc

SEQ ID NO: 741342 - DNA, 20 bp, Artificial
  CRISPR gRNA sequence
ctgggagccaaaggggctgg

SEQ ID NO: 741343 - DNA, 20 bp, Artificial
  CRISPR gRNA sequence
tgggagccaaaggggctggt

SEQ ID NO: 741344 - DNA, 20 bp, Artificial
  CRISPR gRNA sequence
caaaggggctggtgggcact

SEQ ID NO: 741345 - DNA, 20 bp, Artificial
  CRISPR gRNA sequence
gctggtgggcacttggcccc

SEQ ID NO: 741346 - DNA, 20 bp, Artificial
  CRISPR gRNA sequence
gggcacttggcccccggaaa

SEQ ID NO: 741347 - DNA, 20 bp, Artificial
  CRISPR gRNA sequence
atggcatgcctcctttctct

SEQ ID NO: 741348 - DNA, 20 bp, Artificial
  CRISPR gRNA sequence
tttctctcggccatttcgcc

SEQ ID NO: 741349 - DNA, 20 bp, Artificial
  CRISPR gRNA sequence
cggccatttcgcccagctcc

SEQ ID NO: 741350 - DNA, 20 bp, Artificial
  CRISPR gRNA sequence
ccatttcgcccagctcctgg

SEQ ID NO: 741351 - DNA, 20 bp, Artificial
  CRISPR gRNA sequence
catttcgcccagctcctggc

SEQ ID NO: 741352 - DNA, 20 bp, Artificial
  CRISPR gRNA sequence
ttcgcccagctcctggcggg

SEQ ID NO: 741353 - DNA, 20 bp, Artificial
  CRISPR gRNA sequence
ccagctcctggcgggaagtg

SEQ ID NO: 741354 - DNA, 20 bp, Artificial
  CRISPR gRNA sequence
gctcccaactctcaaatgaa

SEQ ID NO: 741355 - DNA, 20 bp, Artificial
  CRISPR gRNA sequence
ctcccaactctcaaatgaaa

SEQ ID NO: 741356 - DNA, 20 bp, Artificial
  CRISPR gRNA sequence
catcgtgcctttgcgaatcc

SEQ ID NO: 741357 - DNA, 20 bp, Artificial
  CRISPR gRNA sequence
atcgtgcctttgcgaatccc

SEQ ID NO: 741358 - DNA, 20 bp, Artificial
  CRISPR gRNA sequence
tcgtgcctttgcgaatccca

SEQ ID NO: 741359 - DNA, 20 bp, Artificial
  CRISPR gRNA sequence
cgtgcctttgcgaatcccag

SEQ ID NO: 741360 - DNA, 20 bp, Artificial
  CRISPR gRNA sequence
gcgaatcccaggggctgaac

SEQ ID NO: 741361 - DNA, 20 bp, Artificial
  CRISPR gRNA sequence
cgaatcccaggggctgaact

SEQ ID NO: 741362 - DNA, 20 bp, Artificial
  CRISPR gRNA sequence
gaatcccaggggctgaactg

SEQ ID NO: 741363 - DNA, 20 bp, Artificial
  CRISPR gRNA sequence
aatcccaggggctgaactgg

SEQ ID NO: 741364 - DNA, 20 bp, Artificial
  CRISPR gRNA sequence
ccaggggctgaactgggggc

SEQ ID NO: 741365 - DNA, 20 bp, Artificial
  CRISPR gRNA sequence
aggggctgaactgggggctg

SEQ ID NO: 741366 - DNA, 20 bp, Artificial
  CRISPR gRNA sequence
ggctgaactgggggctggag

SEQ ID NO: 741367 - DNA, 20 bp, Artificial
  CRISPR gRNA sequence
gctgaactgggggctggagc

SEQ ID NO: 741368 - DNA, 20 bp, Artificial
  CRISPR gRNA sequence
ctcgcaccgtccacccaccc

SEQ ID NO: 741369 - DNA, 20 bp, Artificial
  CRISPR gRNA sequence
tcgcaccgtccacccacccc

SEQ ID NO: 741370 - DNA, 20 bp, Artificial
  CRISPR gRNA sequence
caccgtccacccaccccagg

SEQ ID NO: 741371 - DNA, 20 bp, Artificial
  CRISPR gRNA sequence
accgtccacccaccccaggc

SEQ ID NO: 741372 - DNA, 20 bp, Artificial
  CRISPR gRNA sequence
ccgtccacccaccccaggca

SEQ ID NO: 741373 - DNA, 20 bp, Artificial
  CRISPR gRNA sequence
gtccacccaccccaggcagg

SEQ ID NO: 741374 - DNA, 20 bp, Artificial
  CRISPR gRNA sequence
tccacccaccccaggcaggg

SEQ ID NO: 741375 - DNA, 20 bp, Artificial
  CRISPR gRNA sequence
caggcagggaggaatactca

SEQ ID NO: 741376 - DNA, 20 bp, Artificial
  CRISPR gRNA sequence
gcagggaggaatactcacgg

SEQ ID NO: 741377 - DNA, 20 bp, Artificial
  CRISPR gRNA sequence
ggaggaatactcacggcggt

SEQ ID NO: 741378 - DNA, 20 bp, Artificial
  CRISPR gRNA sequence
aggaatactcacggcggttg

SEQ ID NO: 741379 - DNA, 20 bp, Artificial
  CRISPR gRNA sequence
ggaatactcacggcggttgg

SEQ ID NO: 741380 - DNA, 20 bp, Artificial
  CRISPR gRNA sequence
aggctgcctgcctttgcttg

SEQ ID NO: 741381 - DNA, 20 bp, Artificial
  CRISPR gRNA sequence
gcctgcctttgcttgtagac

SEQ ID NO: 741382 - DNA, 20 bp, Artificial
  CRISPR gRNA sequence
cctgcctttgcttgtagacc

SEQ ID NO: 741383 - DNA, 20 bp, Artificial
  CRISPR gRNA sequence
tgcctttgcttgtagaccag

SEQ ID NO: 741384 - DNA, 20 bp, Artificial
  CRISPR gRNA sequence
ctttgcttgtagaccaggag

SEQ ID NO: 741385 - DNA, 20 bp, Artificial
  CRISPR gRNA sequence
tttgcttgtagaccaggagc

SEQ ID NO: 741386 - DNA, 20 bp, Artificial
  CRISPR gRNA sequence
ttgtagaccaggagcaggat

SEQ ID NO: 741387 - DNA, 20 bp, Artificial
  CRISPR gRNA sequence
tgtagaccaggagcaggatg

SEQ ID NO: 741388 - DNA, 20 bp, Artificial
  CRISPR gRNA sequence
gtagaccaggagcaggatga

SEQ ID NO: 741389 - DNA, 20 bp, Artificial
  CRISPR gRNA sequence
tagaccaggagcaggatgag

SEQ ID NO: 741390 - DNA, 20 bp, Artificial
  CRISPR gRNA sequence
agaccaggagcaggatgagg

SEQ ID NO: 741391 - DNA, 20 bp, Artificial
  CRISPR gRNA sequence
accaggagcaggatgagggg

SEQ ID NO: 741392 - DNA, 20 bp, Artificial
  CRISPR gRNA sequence
ccaggagcaggatgaggggg

SEQ ID NO: 741393 - DNA, 20 bp, Artificial
  CRISPR gRNA sequence
ggagcaggatgagggggagg

SEQ ID NO: 741394 - DNA, 20 bp, Artificial
  CRISPR gRNA sequence
agcaggatgagggggaggca

SEQ ID NO: 741395 - DNA, 20 bp, Artificial
  CRISPR gRNA sequence
gcaggatgagggggaggcag

SEQ ID NO: 741396 - DNA, 20 bp, Artificial
  CRISPR gRNA sequence
ggcagaggattcctacgatg

SEQ ID NO: 741397 - DNA, 20 bp, Artificial
  CRISPR gRNA sequence
gcagaggattcctacgatgc

SEQ ID NO: 741398 - DNA, 20 bp, Artificial
  CRISPR gRNA sequence
tcctacgatgcaggcacccg

SEQ ID NO: 741399 - DNA, 20 bp, Artificial
  CRISPR gRNA sequence
acgatgcaggcacccgtagc

SEQ ID NO: 741400 - DNA, 20 bp, Artificial
  CRISPR gRNA sequence
cgatgcaggcacccgtagcc

SEQ ID NO: 741401 - DNA, 20 bp, Artificial
  CRISPR gRNA sequence
gatgcaggcacccgtagcca

SEQ ID NO: 741402 - DNA, 20 bp, Artificial
  CRISPR gRNA sequence
ggcacccgtagccagggctg

SEQ ID NO: 741403 - DNA, 20 bp, Artificial
  CRISPR gRNA sequence
gctgcagccgtgatgtctga

SEQ ID NO: 741404 - DNA, 20 bp, Artificial
  CRISPR gRNA sequence
ctgcagccgtgatgtctgaa

SEQ ID NO: 741405 - DNA, 20 bp, Artificial
  CRISPR gRNA sequence
tgcagccgtgatgtctgaaa

SEQ ID NO: 741406 - DNA, 20 bp, Artificial
  CRISPR gRNA sequence
agccgtgatgtctgaaaggg

SEQ ID NO: 741407 - DNA, 20 bp, Artificial
  CRISPR gRNA sequence
ccgtgatgtctgaaagggca

SEQ ID NO: 741408 - DNA, 20 bp, Artificial
  CRISPR gRNA sequence
gtgatgtctgaaagggcaga

SEQ ID NO: 741409 - DNA, 20 bp, Artificial
  CRISPR gRNA sequence
tgatgtctgaaagggcagag

SEQ ID NO: 741410 - DNA, 20 bp, Artificial
  CRISPR gRNA sequence
tgtctgaaagggcagagagg

SEQ ID NO: 741411 - DNA, 20 bp, Artificial
  CRISPR gRNA sequence
gaaagggcagagaggtagcc

SEQ ID NO: 741412 - DNA, 20 bp, Artificial
  CRISPR gRNA sequence
aaagggcagagaggtagcca

SEQ ID NO: 741413 - DNA, 20 bp, Artificial
  CRISPR gRNA sequence
gcagagaggtagccaaggtg

SEQ ID NO: 741414 - DNA, 20 bp, Artificial
  CRISPR gRNA sequence
ccattcccattgctcctcct

SEQ ID NO: 741415 - DNA, 20 bp, Artificial
  CRISPR gRNA sequence
gctcctcctgagcataaact

SEQ ID NO: 741416 - DNA, 20 bp, Artificial
  CRISPR gRNA sequence
ctcctcctgagcataaactg

SEQ ID NO: 741417 - DNA, 20 bp, Artificial
  CRISPR gRNA sequence
cctgagcataaactgaggct

SEQ ID NO: 741418 - DNA, 20 bp, Artificial
  CRISPR gRNA sequence
tgagcataaactgaggctca

SEQ ID NO: 741419 - DNA, 20 bp, Artificial
  CRISPR gRNA sequence
agcataaactgaggctcaga

SEQ ID NO: 741420 - DNA, 20 bp, Artificial
  CRISPR gRNA sequence
gcataaactgaggctcagag

SEQ ID NO: 741421 - DNA, 20 bp, Artificial
  CRISPR gRNA sequence
cataaactgaggctcagaga

SEQ ID NO: 741422 - DNA, 20 bp, Artificial
  CRISPR gRNA sequence
aaactgaggctcagagaggg

SEQ ID NO: 741423 - DNA, 20 bp, Artificial
  CRISPR gRNA sequence
aactgaggctcagagaggga

SEQ ID NO: 741424 - DNA, 20 bp, Artificial
  CRISPR gRNA sequence
gaggctcagagagggaaggc

SEQ ID NO: 741425 - DNA, 20 bp, Artificial
  CRISPR gRNA sequence
aggctcagagagggaaggcc

SEQ ID NO: 741426 - DNA, 20 bp, Artificial
  CRISPR gRNA sequence
ctcagagagggaaggccagg

SEQ ID NO: 741427 - DNA, 20 bp, Artificial
  CRISPR gRNA sequence
agagagggaaggccaggaag

SEQ ID NO: 741428 - DNA, 20 bp, Artificial
  CRISPR gRNA sequence
gagagggaaggccaggaagc

SEQ ID NO: 741429 - DNA, 20 bp, Artificial
  CRISPR gRNA sequence
gagggaaggccaggaagcag

SEQ ID NO: 741430 - DNA, 20 bp, Artificial
  CRISPR gRNA sequence
gcaggagacccgcctttccc

SEQ ID NO: 741431 - DNA, 20 bp, Artificial
  CRISPR gRNA sequence
aggagacccgcctttcccca

SEQ ID NO: 741432 - DNA, 20 bp, Artificial
  CRISPR gRNA sequence
cgcctttccccagagtccca

SEQ ID NO: 741433 - DNA, 20 bp, Artificial
  CRISPR gRNA sequence
tttccccagagtcccacagc

SEQ ID NO: 741434 - DNA, 20 bp, Artificial
  CRISPR gRNA sequence
gagtcccacagctagacccc

SEQ ID NO: 741435 - DNA, 20 bp, Artificial
  CRISPR gRNA sequence
gctagacccccagcaaccta

SEQ ID NO: 741436 - DNA, 20 bp, Artificial
  CRISPR gRNA sequence
tagacccccagcaacctaca

SEQ ID NO: 741437 - DNA, 20 bp, Artificial
  CRISPR gRNA sequence
agacccccagcaacctacag

SEQ ID NO: 741438 - DNA, 20 bp, Artificial
  CRISPR gRNA sequence
cccagcaacctacagaggca

SEQ ID NO: 741439 - DNA, 20 bp, Artificial
  CRISPR gRNA sequence
agcaacctacagaggcatgg

SEQ ID NO: 741440 - DNA, 20 bp, Artificial
  CRISPR gRNA sequence
cctacagaggcatggaagat

SEQ ID NO: 741441 - DNA, 20 bp, Artificial
  CRISPR gRNA sequence
ctacagaggcatggaagata

SEQ ID NO: 741442 - DNA, 20 bp, Artificial
  CRISPR gRNA sequence
cagaggcatggaagataagg

SEQ ID NO: 741443 - DNA, 20 bp, Artificial
  CRISPR gRNA sequence
ataaggcggttctcctttca

SEQ ID NO: 741444 - DNA, 20 bp, Artificial
  CRISPR gRNA sequence
aaggcggttctcctttcaaa

SEQ ID NO: 741445 - DNA, 20 bp, Artificial
  CRISPR gRNA sequence
ggcggttctcctttcaaaga

SEQ ID NO: 741446 - DNA, 20 bp, Artificial
  CRISPR gRNA sequence
tgcctgccgccctatgcccc

SEQ ID NO: 741447 - DNA, 20 bp, Artificial
  CRISPR gRNA sequence
cctgccgccctatgcccctg

SEQ ID NO: 741448 - DNA, 20 bp, Artificial
  CRISPR gRNA sequence
ccctatgcccctggagcact

SEQ ID NO: 741449 - DNA, 20 bp, Artificial
  CRISPR gRNA sequence
cccctggagcactcagaaac

SEQ ID NO: 741450 - DNA, 20 bp, Artificial
  CRISPR gRNA sequence
gaaacaagacctgtcaccta

SEQ ID NO: 741451 - DNA, 20 bp, Artificial
  CRISPR gRNA sequence
aagacctgtcacctacagct

SEQ ID NO: 741452 - DNA, 20 bp, Artificial
  CRISPR gRNA sequence
agacctgtcacctacagctc

SEQ ID NO: 741453 - DNA, 20 bp, Artificial
  CRISPR gRNA sequence
cctgtcacctacagctcagg

SEQ ID NO: 741454 - DNA, 20 bp, Artificial
  CRISPR gRNA sequence
acctacagctcaggcagctc

SEQ ID NO: 741455 - DNA, 20 bp, Artificial
  CRISPR gRNA sequence
cctacagctcaggcagctcc

SEQ ID NO: 741456 - DNA, 20 bp, Artificial
  CRISPR gRNA sequence
cagctcaggcagctccaggc

SEQ ID NO: 741457 - DNA, 20 bp, Artificial
  CRISPR gRNA sequence
gctcaggcagctccaggcaa

SEQ ID NO: 741458 - DNA, 20 bp, Artificial
  CRISPR gRNA sequence
tcaggcagctccaggcaaga

SEQ ID NO: 741459 - DNA, 20 bp, Artificial
  CRISPR gRNA sequence
caggcagctccaggcaagag

SEQ ID NO: 741460 - DNA, 20 bp, Artificial
  CRISPR gRNA sequence
aggcagctccaggcaagaga

SEQ ID NO: 741461 - DNA, 20 bp, Artificial
  CRISPR gRNA sequence
gctccaggcaagagagggaa

SEQ ID NO: 741462 - DNA, 20 bp, Artificial
  CRISPR gRNA sequence
tccaggcaagagagggaaca

SEQ ID NO: 741463 - DNA, 20 bp, Artificial
  CRISPR gRNA sequence
agggaacagagtcctcatcc

SEQ ID NO: 741464 - DNA, 20 bp, Artificial
  CRISPR gRNA sequence
gagtcctcatcccagcccac

SEQ ID NO: 741465 - DNA, 20 bp, Artificial
  CRISPR gRNA sequence
agtcctcatcccagcccaca

SEQ ID NO: 741466 - DNA, 20 bp, Artificial
  CRISPR gRNA sequence
tcatcccagcccacaaggta

SEQ ID NO: 741467 - DNA, 20 bp, Artificial
  CRISPR gRNA sequence
cccagcccacaaggtacagc

SEQ ID NO: 741468 - DNA, 20 bp, Artificial
  CRISPR gRNA sequence
aggtacagctggaacaccct

SEQ ID NO: 741469 - DNA, 20 bp, Artificial
  CRISPR gRNA sequence
agctggaacacccttggcta

SEQ ID NO: 741470 - DNA, 20 bp, Artificial
  CRISPR gRNA sequence
gctggaacacccttggctac

SEQ ID NO: 741471 - DNA, 20 bp, Artificial
  CRISPR gRNA sequence
gctacaggttgttctctgaa

SEQ ID NO: 741472 - DNA, 20 bp, Artificial
  CRISPR gRNA sequence
ctacaggttgttctctgaaa

SEQ ID NO: 741473 - DNA, 20 bp, Artificial
  CRISPR gRNA sequence
tacaggttgttctctgaaaa

SEQ ID NO: 741474 - DNA, 20 bp, Artificial
  CRISPR gRNA sequence
caggttgttctctgaaaagg

SEQ ID NO: 741475 - DNA, 20 bp, Artificial
  CRISPR gRNA sequence
ggttgttctctgaaaaggga

SEQ ID NO: 741476 - DNA, 20 bp, Artificial
  CRISPR gRNA sequence
tgttctctgaaaagggagag

SEQ ID NO: 741477 - DNA, 20 bp, Artificial
  CRISPR gRNA sequence
gttctctgaaaagggagagc

SEQ ID NO: 741478 - DNA, 20 bp, Artificial
  CRISPR gRNA sequence
ttctctgaaaagggagagca

SEQ ID NO: 741479 - DNA, 20 bp, Artificial
  CRISPR gRNA sequence
aagggagagcagggccttcg

SEQ ID NO: 741480 - DNA, 20 bp, Artificial
  CRISPR gRNA sequence
ccttcgcagaccccatgcca

SEQ ID NO: 741481 - DNA, 20 bp, Artificial
  CRISPR gRNA sequence
ttcgcagaccccatgccaca

SEQ ID NO: 741482 - DNA, 20 bp, Artificial
  CRISPR gRNA sequence
gaccccatgccacagagctc

SEQ ID NO: 741483 - DNA, 20 bp, Artificial
  CRISPR gRNA sequence
accccatgccacagagctca

SEQ ID NO: 741484 - DNA, 20 bp, Artificial
  CRISPR gRNA sequence
gccacagagctcaaggtcaa

SEQ ID NO: 741485 - DNA, 20 bp, Artificial
  CRISPR gRNA sequence
acagagctcaaggtcaaaag

SEQ ID NO: 741486 - DNA, 20 bp, Artificial
  CRISPR gRNA sequence
ctcaaggtcaaaagaagcct

SEQ ID NO: 741487 - DNA, 20 bp, Artificial
  CRISPR gRNA sequence
aaaagaagcctaagtgatga

SEQ ID NO: 741488 - DNA, 20 bp, Artificial
  CRISPR gRNA sequence
agtgatgaaagttttgaaaa

SEQ ID NO: 741489 - DNA, 20 bp, Artificial
  CRISPR gRNA sequence
atgaaagttttgaaaataga

SEQ ID NO: 741490 - DNA, 20 bp, Artificial
  CRISPR gRNA sequence
aaagttttgaaaatagacag

SEQ ID NO: 741491 - DNA, 20 bp, Artificial
  CRISPR gRNA sequence
ttgaaaatagacagtggtga

SEQ ID NO: 741492 - DNA, 20 bp, Artificial
  CRISPR gRNA sequence
taattaatgccaccaaactg

SEQ ID NO: 741493 - DNA, 20 bp, Artificial
  CRISPR gRNA sequence
aattaatgccaccaaactgt

SEQ ID NO: 741494 - DNA, 20 bp, Artificial
  CRISPR gRNA sequence
accaaactgtaggcttaaaa

SEQ ID NO: 741495 - DNA, 20 bp, Artificial
  CRISPR gRNA sequence
taggcttaaaatggttgaaa

SEQ ID NO: 741496 - DNA, 20 bp, Artificial
  CRISPR gRNA sequence
ttatatatgttttatcataa

SEQ ID NO: 741497 - DNA, 20 bp, Artificial
  CRISPR gRNA sequence
gttttatcataatagataaa

SEQ ID NO: 741498 - DNA, 20 bp, Artificial
  CRISPR gRNA sequence
taaaaagccccaactcatcc

SEQ ID NO: 741499 - DNA, 20 bp, Artificial
  CRISPR gRNA sequence
aaaagccccaactcatccca

SEQ ID NO: 741500 - DNA, 20 bp, Artificial
  CRISPR gRNA sequence
aactcatcccagagactcct

SEQ ID NO: 741501 - DNA, 20 bp, Artificial
  CRISPR gRNA sequence
tcccagagactccttagctc

SEQ ID NO: 741502 - DNA, 20 bp, Artificial
  CRISPR gRNA sequence
cccagagactccttagctct

SEQ ID NO: 741503 - DNA, 20 bp, Artificial
  CRISPR gRNA sequence
gagactccttagctctggga

SEQ ID NO: 741504 - DNA, 20 bp, Artificial
  CRISPR gRNA sequence
agactccttagctctgggat

SEQ ID NO: 741505 - DNA, 20 bp, Artificial
  CRISPR gRNA sequence
gactccttagctctgggatg

SEQ ID NO: 741506 - DNA, 20 bp, Artificial
  CRISPR gRNA sequence
tagctctgggatggggcctc

SEQ ID NO: 741507 - DNA, 20 bp, Artificial
  CRISPR gRNA sequence
accccttgatctcaccacac

SEQ ID NO: 741508 - DNA, 20 bp, Artificial
  CRISPR gRNA sequence
tgatctcaccacacaagtca

SEQ ID NO: 741509 - DNA, 20 bp, Artificial
  CRISPR gRNA sequence
gatctcaccacacaagtcac

SEQ ID NO: 741510 - DNA, 20 bp, Artificial
  CRISPR gRNA sequence
tctcaccacacaagtcacag

SEQ ID NO: 741511 - DNA, 20 bp, Artificial
  CRISPR gRNA sequence
caagtcacaggagaaacacc

SEQ ID NO: 741512 - DNA, 20 bp, Artificial
  CRISPR gRNA sequence
aagtcacaggagaaacaccc

SEQ ID NO: 741513 - DNA, 20 bp, Artificial
  CRISPR gRNA sequence
agtcacaggagaaacacccg

SEQ ID NO: 741514 - DNA, 20 bp, Artificial
  CRISPR gRNA sequence
acaggagaaacacccggggt

SEQ ID NO: 741515 - DNA, 20 bp, Artificial
  CRISPR gRNA sequence
gaaacacccggggtgagaac

SEQ ID NO: 741516 - DNA, 20 bp, Artificial
  CRISPR gRNA sequence
acttattaaactaccaaaaa

SEQ ID NO: 741517 - DNA, 20 bp, Artificial
  CRISPR gRNA sequence
taaactaccaaaaaaagtac

SEQ ID NO: 741518 - DNA, 20 bp, Artificial
  CRISPR gRNA sequence
tctcctcctccccttgtacc

SEQ ID NO: 741519 - DNA, 20 bp, Artificial
  CRISPR gRNA sequence
ttgtaccaagaccccctctg

SEQ ID NO: 741520 - DNA, 20 bp, Artificial
  CRISPR gRNA sequence
gtaccaagaccccctctgaa

SEQ ID NO: 741521 - DNA, 20 bp, Artificial
  CRISPR gRNA sequence
aagagatcatccctgtgtgc

SEQ ID NO: 741522 - DNA, 20 bp, Artificial
  CRISPR gRNA sequence
gtgtgccggtttttgtgtta

SEQ ID NO: 741523 - DNA, 20 bp, Artificial
  CRISPR gRNA sequence
cggtttttgtgttatggtcc

SEQ ID NO: 741524 - DNA, 20 bp, Artificial
  CRISPR gRNA sequence
agttatattccctgcaaata

SEQ ID NO: 741525 - DNA, 20 bp, Artificial
  CRISPR gRNA sequence
tatattccctgcaaatacag

SEQ ID NO: 741526 - DNA, 20 bp, Artificial
  CRISPR gRNA sequence
ccctgcaaatacagcagacg

SEQ ID NO: 741527 - DNA, 20 bp, Artificial
  CRISPR gRNA sequence
atgacaatgcttttcccact

SEQ ID NO: 741528 - DNA, 20 bp, Artificial
  CRISPR gRNA sequence
aatgcttttcccactgagca

SEQ ID NO: 741529 - DNA, 20 bp, Artificial
  CRISPR gRNA sequence
ttttcccactgagcacagct

SEQ ID NO: 741530 - DNA, 20 bp, Artificial
  CRISPR gRNA sequence
ctcccctgcctcattctgct

SEQ ID NO: 741531 - DNA, 20 bp, Artificial
  CRISPR gRNA sequence
cccctgcctcattctgctta

SEQ ID NO: 741532 - DNA, 20 bp, Artificial
  CRISPR gRNA sequence
ctgcttagagttttatcaca

SEQ ID NO: 741533 - DNA, 20 bp, Artificial
  CRISPR gRNA sequence
ggctcccactaaatttattg

SEQ ID NO: 741534 - DNA, 20 bp, Artificial
  CRISPR gRNA sequence
tcccactaaatttattgaag

SEQ ID NO: 741535 - DNA, 20 bp, Artificial
  CRISPR gRNA sequence
ttattgaagcagtcccctgt

SEQ ID NO: 741536 - DNA, 20 bp, Artificial
  CRISPR gRNA sequence
ttgaagcagtcccctgttgg

SEQ ID NO: 741537 - DNA, 20 bp, Artificial
  CRISPR gRNA sequence
agacatgttgtttccatttt

SEQ ID NO: 741538 - DNA, 20 bp, Artificial
  CRISPR gRNA sequence
tttcagcataactaataatg

SEQ ID NO: 741539 - DNA, 20 bp, Artificial
  CRISPR gRNA sequence
tagcaatgaacttgtgcacg

SEQ ID NO: 741540 - DNA, 20 bp, Artificial
  CRISPR gRNA sequence
atgaacttgtgcacgcagcc

SEQ ID NO: 741541 - DNA, 20 bp, Artificial
  CRISPR gRNA sequence
tgcacgcagcctggctcact

SEQ ID NO: 741542 - DNA, 20 bp, Artificial
  CRISPR gRNA sequence
cgcagcctggctcactcagc

SEQ ID NO: 741543 - DNA, 20 bp, Artificial
  CRISPR gRNA sequence
gcagcctggctcactcagca

SEQ ID NO: 741544 - DNA, 20 bp, Artificial
  CRISPR gRNA sequence
tcactcagcaaggaaatctg

SEQ ID NO: 741545 - DNA, 20 bp, Artificial
  CRISPR gRNA sequence
ggaaatctgtagtaaattcc

SEQ ID NO: 741546 - DNA, 20 bp, Artificial
  CRISPR gRNA sequence
aatctgtagtaaattcctag

SEQ ID NO: 741547 - DNA, 20 bp, Artificial
  CRISPR gRNA sequence
tagtaaattcctagcggtca

SEQ ID NO: 741548 - DNA, 20 bp, Artificial
  CRISPR gRNA sequence
ttcctagcggtcaaagtgct

SEQ ID NO: 741549 - DNA, 20 bp, Artificial
  CRISPR gRNA sequence
gcggtcaaagtgctgagcca

SEQ ID NO: 741550 - DNA, 20 bp, Artificial
  CRISPR gRNA sequence
ggtcaaagtgctgagccaaa

SEQ ID NO: 741551 - DNA, 20 bp, Artificial
  CRISPR gRNA sequence
agagtatgtgcattttcttt

SEQ ID NO: 741552 - DNA, 20 bp, Artificial
  CRISPR gRNA sequence
gagtatgtgcattttctttt

SEQ ID NO: 741553 - DNA, 20 bp, Artificial
  CRISPR gRNA sequence
ttgctaaattgccctccaaa

SEQ ID NO: 741554 - DNA, 20 bp, Artificial
  CRISPR gRNA sequence
tgctaaattgccctccaaaa

SEQ ID NO: 741555 - DNA, 20 bp, Artificial
  CRISPR gRNA sequence
cctccaaaaaggtgtacacg

SEQ ID NO: 741556 - DNA, 20 bp, Artificial
  CRISPR gRNA sequence
acgaagcttcgctgtcccaa

SEQ ID NO: 741557 - DNA, 20 bp, Artificial
  CRISPR gRNA sequence
cttcgctgtcccaacagcat

SEQ ID NO: 741558 - DNA, 20 bp, Artificial
  CRISPR gRNA sequence
ttcgctgtcccaacagcatg

SEQ ID NO: 741559 - DNA, 20 bp, Artificial
  CRISPR gRNA sequence
cgctgtcccaacagcatgag

SEQ ID NO: 741560 - DNA, 20 bp, Artificial
  CRISPR gRNA sequence
gctgtcccaacagcatgagg

SEQ ID NO: 741561 - DNA, 20 bp, Artificial
  CRISPR gRNA sequence
tgaggaggtttgatttattt

SEQ ID NO: 741562 - DNA, 20 bp, Artificial
  CRISPR gRNA sequence
gaggaggtttgatttatttc

SEQ ID NO: 741563 - DNA, 20 bp, Artificial
  CRISPR gRNA sequence
aggaggtttgatttatttca

SEQ ID NO: 741564 - DNA, 20 bp, Artificial
  CRISPR gRNA sequence
ttcagggcatctgctgactg

SEQ ID NO: 741565 - DNA, 20 bp, Artificial
  CRISPR gRNA sequence
tcagggcatctgctgactgc

SEQ ID NO: 741566 - DNA, 20 bp, Artificial
  CRISPR gRNA sequence
agggcatctgctgactgcag

SEQ ID NO: 741567 - DNA, 20 bp, Artificial
  CRISPR gRNA sequence
atctgctgactgcaggagtt

SEQ ID NO: 741568 - DNA, 20 bp, Artificial
  CRISPR gRNA sequence
gctgactgcaggagtttagc

SEQ ID NO: 741569 - DNA, 20 bp, Artificial
  CRISPR gRNA sequence
ctgactgcaggagtttagct

SEQ ID NO: 741570 - DNA, 20 bp, Artificial
  CRISPR gRNA sequence
tgcaggagtttagctgggaa

SEQ ID NO: 741571 - DNA, 20 bp, Artificial
  CRISPR gRNA sequence
gctgggaacagacgtgccct

SEQ ID NO: 741572 - DNA, 20 bp, Artificial
  CRISPR gRNA sequence
acgcatttccttcccaattt

SEQ ID NO: 741573 - DNA, 20 bp, Artificial
  CRISPR gRNA sequence
ttcccaattttagcctttcc

SEQ ID NO: 741574 - DNA, 20 bp, Artificial
  CRISPR gRNA sequence
tcccaattttagcctttccc

SEQ ID NO: 741575 - DNA, 20 bp, Artificial
  CRISPR gRNA sequence
cccaattttagcctttccca

SEQ ID NO: 741576 - DNA, 20 bp, Artificial
  CRISPR gRNA sequence
ttagcctttcccagggccaa

SEQ ID NO: 741577 - DNA, 20 bp, Artificial
  CRISPR gRNA sequence
cctttcccagggccaaaaga

SEQ ID NO: 741578 - DNA, 20 bp, Artificial
  CRISPR gRNA sequence
ctttcccagggccaaaagat

SEQ ID NO: 741579 - DNA, 20 bp, Artificial
  CRISPR gRNA sequence
cccagggccaaaagatgggc

SEQ ID NO: 741580 - DNA, 20 bp, Artificial
  CRISPR gRNA sequence
ccagggccaaaagatgggct

SEQ ID NO: 741581 - DNA, 20 bp, Artificial
  CRISPR gRNA sequence
tgggctgggataccttgtca

SEQ ID NO: 741582 - DNA, 20 bp, Artificial
  CRISPR gRNA sequence
acagtgtcaacttcgcccca

SEQ ID NO: 741583 - DNA, 20 bp, Artificial
  CRISPR gRNA sequence
agtgtcaacttcgccccaaa

SEQ ID NO: 741584 - DNA, 20 bp, Artificial
  CRISPR gRNA sequence
acttcgccccaaagagctct

SEQ ID NO: 741585 - DNA, 20 bp, Artificial
  CRISPR gRNA sequence
ttcgccccaaagagctctga

SEQ ID NO: 741586 - DNA, 20 bp, Artificial
  CRISPR gRNA sequence
tcgccccaaagagctctgag

SEQ ID NO: 741587 - DNA, 20 bp, Artificial
  CRISPR gRNA sequence
aaagagctctgagaggtaaa

SEQ ID NO: 741588 - DNA, 20 bp, Artificial
  CRISPR gRNA sequence
ctctgagaggtaaatggctg

SEQ ID NO: 741589 - DNA, 20 bp, Artificial
  CRISPR gRNA sequence
ttgcctttccgctatttgtt

SEQ ID NO: 741590 - DNA, 20 bp, Artificial
  CRISPR gRNA sequence
tgcctttccgctatttgttt

SEQ ID NO: 741591 - DNA, 20 bp, Artificial
  CRISPR gRNA sequence
ccgctatttgtttgggaata

SEQ ID NO: 741592 - DNA, 20 bp, Artificial
  CRISPR gRNA sequence
cgctatttgtttgggaataa

SEQ ID NO: 741593 - DNA, 20 bp, Artificial
  CRISPR gRNA sequence
tgttttgctctacaatccga

SEQ ID NO: 741594 - DNA, 20 bp, Artificial
  CRISPR gRNA sequence
tacaatccgacagcgtaaac

SEQ ID NO: 741595 - DNA, 20 bp, Artificial
  CRISPR gRNA sequence
cgacagcgtaaacaagcttt

SEQ ID NO: 741596 - DNA, 20 bp, Artificial
  CRISPR gRNA sequence
gacagcgtaaacaagctttc

SEQ ID NO: 741597 - DNA, 20 bp, Artificial
  CRISPR gRNA sequence
cagcgtaaacaagctttcag

SEQ ID NO: 741598 - DNA, 20 bp, Artificial
  CRISPR gRNA sequence
agcgtaaacaagctttcagg

SEQ ID NO: 741599 - DNA, 20 bp, Artificial
  CRISPR gRNA sequence
ggtttgttcatactgcaaat

SEQ ID NO: 741600 - DNA, 20 bp, Artificial
  CRISPR gRNA sequence
aaatgagaacaaactgtttt

SEQ ID NO: 741601 - DNA, 20 bp, Artificial
  CRISPR gRNA sequence
caaactgttttcagtcactt

SEQ ID NO: 741602 - DNA, 20 bp, Artificial
  CRISPR gRNA sequence
actgttttcagtcactttag

SEQ ID NO: 741603 - DNA, 20 bp, Artificial
  CRISPR gRNA sequence
gtcactttagaagtacccac

SEQ ID NO: 741604 - DNA, 20 bp, Artificial
  CRISPR gRNA sequence
tttagaagtacccactggta

SEQ ID NO: 741605 - DNA, 20 bp, Artificial
  CRISPR gRNA sequence
ttagaagtacccactggtac

SEQ ID NO: 741606 - DNA, 20 bp, Artificial
  CRISPR gRNA sequence
agtacccactggtacaggaa

SEQ ID NO: 741607 - DNA, 20 bp, Artificial
  CRISPR gRNA sequence
cagttgctatgctaattaca

SEQ ID NO: 741608 - DNA, 20 bp, Artificial
  CRISPR gRNA sequence
tgctatgctaattacaaagc

SEQ ID NO: 741609 - DNA, 20 bp, Artificial
  CRISPR gRNA sequence
gcaagttccgctccacatta

SEQ ID NO: 741610 - DNA, 20 bp, Artificial
  CRISPR gRNA sequence
agttccgctccacattacag

SEQ ID NO: 741611 - DNA, 20 bp, Artificial
  CRISPR gRNA sequence
gttccgctccacattacagc

SEQ ID NO: 741612 - DNA, 20 bp, Artificial
  CRISPR gRNA sequence
acattacagcaggttccctg

SEQ ID NO: 741613 - DNA, 20 bp, Artificial
  CRISPR gRNA sequence
agcaggttccctgcagatct

SEQ ID NO: 741614 - DNA, 20 bp, Artificial
  CRISPR gRNA sequence
ggttccctgcagatcttagc

SEQ ID NO: 741615 - DNA, 20 bp, Artificial
  CRISPR gRNA sequence
gttccctgcagatcttagca

SEQ ID NO: 741616 - DNA, 20 bp, Artificial
  CRISPR gRNA sequence
agcaaggctgcattttgacg

SEQ ID NO: 741617 - DNA, 20 bp, Artificial
  CRISPR gRNA sequence
attttgacgtggaatattga

SEQ ID NO: 741618 - DNA, 20 bp, Artificial
  CRISPR gRNA sequence
gacgtggaatattgaaagta

SEQ ID NO: 741619 - DNA, 20 bp, Artificial
  CRISPR gRNA sequence
agtaaagacattctataacc

SEQ ID NO: 741620 - DNA, 20 bp, Artificial
  CRISPR gRNA sequence
attctataacccagacacct

SEQ ID NO: 741621 - DNA, 20 bp, Artificial
  CRISPR gRNA sequence
gtatttcaaaacccccatca

SEQ ID NO: 741622 - DNA, 20 bp, Artificial
  CRISPR gRNA sequence
tatttcaaaacccccatcaa

SEQ ID NO: 741623 - DNA, 20 bp, Artificial
  CRISPR gRNA sequence
cccatcaaaggaccttattg

SEQ ID NO: 741624 - DNA, 20 bp, Artificial
  CRISPR gRNA sequence
ccatcaaaggaccttattgt

SEQ ID NO: 741625 - DNA, 20 bp, Artificial
  CRISPR gRNA sequence
ccttattgtgggcaatattt

SEQ ID NO: 741626 - DNA, 20 bp, Artificial
  CRISPR gRNA sequence
tattgtgggcaatatttgag

SEQ ID NO: 741627 - DNA, 20 bp, Artificial
  CRISPR gRNA sequence
gtgggcaatatttgagaagc

SEQ ID NO: 741628 - DNA, 20 bp, Artificial
  CRISPR gRNA sequence
tatttgagaagccagttgca

SEQ ID NO: 741629 - DNA, 20 bp, Artificial
  CRISPR gRNA sequence
agttgcaaagcactctcttc

SEQ ID NO: 741630 - DNA, 20 bp, Artificial
  CRISPR gRNA sequence
gcactctcttctagtgatca

SEQ ID NO: 741631 - DNA, 20 bp, Artificial
  CRISPR gRNA sequence
ctctcttctagtgatcaaag

SEQ ID NO: 741632 - DNA, 20 bp, Artificial
  CRISPR gRNA sequence
tctcttctagtgatcaaagc

SEQ ID NO: 741633 - DNA, 20 bp, Artificial
  CRISPR gRNA sequence
tgatcaaagcaggtctcctc

SEQ ID NO: 741634 - DNA, 20 bp, Artificial
  CRISPR gRNA sequence
caaagcaggtctcctctgga

SEQ ID NO: 741635 - DNA, 20 bp, Artificial
  CRISPR gRNA sequence
gcaggtctcctctggacggc

SEQ ID NO: 741636 - DNA, 20 bp, Artificial
  CRISPR gRNA sequence
gtctcctctggacggctagt

SEQ ID NO: 741637 - DNA, 20 bp, Artificial
  CRISPR gRNA sequence
gctagtaagcaacattttgt

SEQ ID NO: 741638 - DNA, 20 bp, Artificial
  CRISPR gRNA sequence
caacattttgtgagctttgc

SEQ ID NO: 741639 - DNA, 20 bp, Artificial
  CRISPR gRNA sequence
aacattttgtgagctttgcc

SEQ ID NO: 741640 - DNA, 20 bp, Artificial
  CRISPR gRNA sequence
acctgttccctatctgcctt

SEQ ID NO: 741641 - DNA, 20 bp, Artificial
  CRISPR gRNA sequence
ctgttccctatctgcctttg

SEQ ID NO: 741642 - DNA, 20 bp, Artificial
  CRISPR gRNA sequence
tgttccctatctgcctttgg

SEQ ID NO: 741643 - DNA, 20 bp, Artificial
  CRISPR gRNA sequence
gttccctatctgcctttgga

SEQ ID NO: 741644 - DNA, 20 bp, Artificial
  CRISPR gRNA sequence
cctatctgcctttggagggt

SEQ ID NO: 741645 - DNA, 20 bp, Artificial
  CRISPR gRNA sequence
ctgcctttggagggtgagct

SEQ ID NO: 741646 - DNA, 20 bp, Artificial
  CRISPR gRNA sequence
ctttggagggtgagcttggc

SEQ ID NO: 741647 - DNA, 20 bp, Artificial
  CRISPR gRNA sequence
ccctgcctaacttctatccc

SEQ ID NO: 741648 - DNA, 20 bp, Artificial
  CRISPR gRNA sequence
cctgcctaacttctatcccc

SEQ ID NO: 741649 - DNA, 20 bp, Artificial
  CRISPR gRNA sequence
gcctaacttctatccccagg

SEQ ID NO: 741650 - DNA, 20 bp, Artificial
  CRISPR gRNA sequence
ctaacttctatccccaggta

SEQ ID NO: 741651 - DNA, 20 bp, Artificial
  CRISPR gRNA sequence
aggtagagatttcccctatg

SEQ ID NO: 741652 - DNA, 20 bp, Artificial
  CRISPR gRNA sequence
cccctatgtggaccctctat

SEQ ID NO: 741653 - DNA, 20 bp, Artificial
  CRISPR gRNA sequence
atgtggaccctctatcagat

SEQ ID NO: 741654 - DNA, 20 bp, Artificial
  CRISPR gRNA sequence
tgtggaccctctatcagatc

SEQ ID NO: 741655 - DNA, 20 bp, Artificial
  CRISPR gRNA sequence
tcaggacttaatttcacttt

SEQ ID NO: 741656 - DNA, 20 bp, Artificial
  CRISPR gRNA sequence
aggacttaatttcactttga

SEQ ID NO: 741657 - DNA, 20 bp, Artificial
  CRISPR gRNA sequence
taatttcactttgagagcct

SEQ ID NO: 741658 - DNA, 20 bp, Artificial
  CRISPR gRNA sequence
aatttcactttgagagcctg

SEQ ID NO: 741659 - DNA, 20 bp, Artificial
  CRISPR gRNA sequence
cctgaggcttccttacgatc

SEQ ID NO: 741660 - DNA, 20 bp, Artificial
  CRISPR gRNA sequence
ctgaggcttccttacgatct

SEQ ID NO: 741661 - DNA, 20 bp, Artificial
  CRISPR gRNA sequence
gcttccttacgatctgggct

SEQ ID NO: 741662 - DNA, 20 bp, Artificial
  CRISPR gRNA sequence
cttacgatctgggctgagtt

SEQ ID NO: 741663 - DNA, 20 bp, Artificial
  CRISPR gRNA sequence
ttacgatctgggctgagttg

SEQ ID NO: 741664 - DNA, 20 bp, Artificial
  CRISPR gRNA sequence
gatctgggctgagttgaggc

SEQ ID NO: 741665 - DNA, 20 bp, Artificial
  CRISPR gRNA sequence
atctgggctgagttgaggct

SEQ ID NO: 741666 - DNA, 20 bp, Artificial
  CRISPR gRNA sequence
tctgggctgagttgaggctg

SEQ ID NO: 741667 - DNA, 20 bp, Artificial
  CRISPR gRNA sequence
gggctgagttgaggctgggg

SEQ ID NO: 741668 - DNA, 20 bp, Artificial
  CRISPR gRNA sequence
gctgagttgaggctggggca

SEQ ID NO: 741669 - DNA, 20 bp, Artificial
  CRISPR gRNA sequence
ctgagttgaggctggggcag

SEQ ID NO: 741670 - DNA, 20 bp, Artificial
  CRISPR gRNA sequence
tgagttgaggctggggcaga

SEQ ID NO: 741671 - DNA, 20 bp, Artificial
  CRISPR gRNA sequence
gagttgaggctggggcagag

SEQ ID NO: 741672 - DNA, 20 bp, Artificial
  CRISPR gRNA sequence
gaggctggggcagaggggcg

SEQ ID NO: 741673 - DNA, 20 bp, Artificial
  CRISPR gRNA sequence
ggctggggcagaggggcgca

SEQ ID NO: 741674 - DNA, 20 bp, Artificial
  CRISPR gRNA sequence
gctggggcagaggggcgcag

SEQ ID NO: 741675 - DNA, 20 bp, Artificial
  CRISPR gRNA sequence
ggcagaggggcgcagaggtt

SEQ ID NO: 741676 - DNA, 20 bp, Artificial
  CRISPR gRNA sequence
gcagaggggcgcagaggttt

SEQ ID NO: 741677 - DNA, 20 bp, Artificial
  CRISPR gRNA sequence
cagaggggcgcagaggtttg

SEQ ID NO: 741678 - DNA, 20 bp, Artificial
  CRISPR gRNA sequence
gggcgcagaggtttggggac

SEQ ID NO: 741679 - DNA, 20 bp, Artificial
  CRISPR gRNA sequence
gaggtttggggacaagtctg

SEQ ID NO: 741680 - DNA, 20 bp, Artificial
  CRISPR gRNA sequence
tggggacaagtctgtggatc

SEQ ID NO: 741681 - DNA, 20 bp, Artificial
  CRISPR gRNA sequence
gtggatccagctgctttctg

SEQ ID NO: 741682 - DNA, 20 bp, Artificial
  CRISPR gRNA sequence
ccagctgctttctgaagccg

SEQ ID NO: 741683 - DNA, 20 bp, Artificial
  CRISPR gRNA sequence
cagctgctttctgaagccgt

SEQ ID NO: 741684 - DNA, 20 bp, Artificial
  CRISPR gRNA sequence
tgaagccgtaggcatctctg

SEQ ID NO: 741685 - DNA, 20 bp, Artificial
  CRISPR gRNA sequence
aagccgtaggcatctctgca

SEQ ID NO: 741686 - DNA, 20 bp, Artificial
  CRISPR gRNA sequence
gtaggcatctctgcagagct

SEQ ID NO: 741687 - DNA, 20 bp, Artificial
  CRISPR gRNA sequence
tgcagagctcagcctcgcca

SEQ ID NO: 741688 - DNA, 20 bp, Artificial
  CRISPR gRNA sequence
agttccccaccccttccccc

SEQ ID NO: 741689 - DNA, 20 bp, Artificial
  CRISPR gRNA sequence
cccaccccttcccccaagcg

SEQ ID NO: 741690 - DNA, 20 bp, Artificial
  CRISPR gRNA sequence
ccccttcccccaagcgtggc

SEQ ID NO: 741691 - DNA, 20 bp, Artificial
  CRISPR gRNA sequence
ccccaagcgtggccagtgcc

SEQ ID NO: 741692 - DNA, 20 bp, Artificial
  CRISPR gRNA sequence
cccaagcgtggccagtgcct

SEQ ID NO: 741693 - DNA, 20 bp, Artificial
  CRISPR gRNA sequence
agcgtggccagtgcctgggc

SEQ ID NO: 741694 - DNA, 20 bp, Artificial
  CRISPR gRNA sequence
agtgcctgggctggcactca

SEQ ID NO: 741695 - DNA, 20 bp, Artificial
  CRISPR gRNA sequence
gtgcctgggctggcactcac

SEQ ID NO: 741696 - DNA, 20 bp, Artificial
  CRISPR gRNA sequence
tgcctgggctggcactcaca

SEQ ID NO: 741697 - DNA, 20 bp, Artificial
  CRISPR gRNA sequence
gcctgggctggcactcacag

SEQ ID NO: 741698 - DNA, 20 bp, Artificial
  CRISPR gRNA sequence
tgggctggcactcacagggg

SEQ ID NO: 741699 - DNA, 20 bp, Artificial
  CRISPR gRNA sequence
gggctggcactcacagggga

SEQ ID NO: 741700 - DNA, 20 bp, Artificial
  CRISPR gRNA sequence
ctggcactcacaggggaagg

SEQ ID NO: 741701 - DNA, 20 bp, Artificial
  CRISPR gRNA sequence
tggcactcacaggggaaggc

SEQ ID NO: 741702 - DNA, 20 bp, Artificial
  CRISPR gRNA sequence
aggcatactcactcaccatc

SEQ ID NO: 741703 - DNA, 20 bp, Artificial
  CRISPR gRNA sequence
gcatactcactcaccatcca

SEQ ID NO: 741704 - DNA, 20 bp, Artificial
  CRISPR gRNA sequence
actcactcaccatccagagc

SEQ ID NO: 741705 - DNA, 20 bp, Artificial
  CRISPR gRNA sequence
ctcactcaccatccagagcc

SEQ ID NO: 741706 - DNA, 20 bp, Artificial
  CRISPR gRNA sequence
atccagagccaggcttatcc

SEQ ID NO: 741707 - DNA, 20 bp, Artificial
  CRISPR gRNA sequence
tccagagccaggcttatcct

SEQ ID NO: 741708 - DNA, 20 bp, Artificial
  CRISPR gRNA sequence
agagccaggcttatcctggg

SEQ ID NO: 741709 - DNA, 20 bp, Artificial
  CRISPR gRNA sequence
gagccaggcttatcctggga

SEQ ID NO: 741710 - DNA, 20 bp, Artificial
  CRISPR gRNA sequence
gcttatcctgggaaggtgat

SEQ ID NO: 741711 - DNA, 20 bp, Artificial
  CRISPR gRNA sequence
cttatcctgggaaggtgatc

SEQ ID NO: 741712 - DNA, 20 bp, Artificial
  CRISPR gRNA sequence
ctgggaaggtgatcaggcgc

SEQ ID NO: 741713 - DNA, 20 bp, Artificial
  CRISPR gRNA sequence
ggaaggtgatcaggcgctgg

SEQ ID NO: 741714 - DNA, 20 bp, Artificial
  CRISPR gRNA sequence
aaggtgatcaggcgctggca

SEQ ID NO: 741715 - DNA, 20 bp, Artificial
  CRISPR gRNA sequence
aggtgatcaggcgctggcag

SEQ ID NO: 741716 - DNA, 20 bp, Artificial
  CRISPR gRNA sequence
tgatcaggcgctggcagagg

SEQ ID NO: 741717 - DNA, 20 bp, Artificial
  CRISPR gRNA sequence
gtagctgccgacaccgcact

SEQ ID NO: 741718 - DNA, 20 bp, Artificial
  CRISPR gRNA sequence
tagctgccgacaccgcacta

SEQ ID NO: 741719 - DNA, 20 bp, Artificial
  CRISPR gRNA sequence
gctgccgacaccgcactaag

SEQ ID NO: 741720 - DNA, 20 bp, Artificial
  CRISPR gRNA sequence
caccgcactaaggagtgtgc

SEQ ID NO: 741721 - DNA, 20 bp, Artificial
  CRISPR gRNA sequence
accgcactaaggagtgtgcc

SEQ ID NO: 741722 - DNA, 20 bp, Artificial
  CRISPR gRNA sequence
gagtgtgccaggccctgaca

SEQ ID NO: 741723 - DNA, 20 bp, Artificial
  CRISPR gRNA sequence
tgtgccaggccctgacacag

SEQ ID NO: 741724 - DNA, 20 bp, Artificial
  CRISPR gRNA sequence
gtgccaggccctgacacagc

SEQ ID NO: 741725 - DNA, 20 bp, Artificial
  CRISPR gRNA sequence
tgccaggccctgacacagca

SEQ ID NO: 741726 - DNA, 20 bp, Artificial
  CRISPR gRNA sequence
caggccctgacacagcaggg

SEQ ID NO: 741727 - DNA, 20 bp, Artificial
  CRISPR gRNA sequence
aggccctgacacagcagggt

SEQ ID NO: 741728 - DNA, 20 bp, Artificial
  CRISPR gRNA sequence
cctgacacagcagggtggga

SEQ ID NO: 741729 - DNA, 20 bp, Artificial
  CRISPR gRNA sequence
ctgacacagcagggtgggat

SEQ ID NO: 741730 - DNA, 20 bp, Artificial
  CRISPR gRNA sequence
gacacagcagggtgggatgg

SEQ ID NO: 741731 - DNA, 20 bp, Artificial
  CRISPR gRNA sequence
acacagcagggtgggatggg

SEQ ID NO: 741732 - DNA, 20 bp, Artificial
  CRISPR gRNA sequence
cacagcagggtgggatggga

SEQ ID NO: 741733 - DNA, 20 bp, Artificial
  CRISPR gRNA sequence
acagcagggtgggatgggag

SEQ ID NO: 741734 - DNA, 20 bp, Artificial
  CRISPR gRNA sequence
agggtgggatgggaggggcc

SEQ ID NO: 741735 - DNA, 20 bp, Artificial
  CRISPR gRNA sequence
tgggaggggcctggcctgct

SEQ ID NO: 741736 - DNA, 20 bp, Artificial
  CRISPR gRNA sequence
gggaggggcctggcctgctc

SEQ ID NO: 741737 - DNA, 20 bp, Artificial
  CRISPR gRNA sequence
aggggcctggcctgctcagg

SEQ ID NO: 741738 - DNA, 20 bp, Artificial
  CRISPR gRNA sequence
ctgctcaggcggcctttgtc

SEQ ID NO: 741739 - DNA, 20 bp, Artificial
  CRISPR gRNA sequence
tgctcaggcggcctttgtcc

SEQ ID NO: 741740 - DNA, 20 bp, Artificial
  CRISPR gRNA sequence
gctcaggcggcctttgtcca

SEQ ID NO: 741741 - DNA, 20 bp, Artificial
  CRISPR gRNA sequence
gcctttgtccagggcctgcc

SEQ ID NO: 741742 - DNA, 20 bp, Artificial
  CRISPR gRNA sequence
tttgtccagggcctgcctgg

SEQ ID NO: 741743 - DNA, 20 bp, Artificial
  CRISPR gRNA sequence
agggcctgcctggtagccca

SEQ ID NO: 741744 - DNA, 20 bp, Artificial
  CRISPR gRNA sequence
gggcctgcctggtagcccac

SEQ ID NO: 741745 - DNA, 20 bp, Artificial
  CRISPR gRNA sequence
ggcctgcctggtagcccacg

SEQ ID NO: 741746 - DNA, 20 bp, Artificial
  CRISPR gRNA sequence
tggtagcccacggggatata

SEQ ID NO: 741747 - DNA, 20 bp, Artificial
  CRISPR gRNA sequence
gtagcccacggggatatatg

SEQ ID NO: 741748 - DNA, 20 bp, Artificial
  CRISPR gRNA sequence
tagcccacggggatatatgg

SEQ ID NO: 741749 - DNA, 20 bp, Artificial
  CRISPR gRNA sequence
gcccacggggatatatggag

SEQ ID NO: 741750 - DNA, 20 bp, Artificial
  CRISPR gRNA sequence
cccacggggatatatggagg

SEQ ID NO: 741751 - DNA, 20 bp, Artificial
  CRISPR gRNA sequence
ccacggggatatatggagga

SEQ ID NO: 741752 - DNA, 20 bp, Artificial
  CRISPR gRNA sequence
acggggatatatggaggagg

SEQ ID NO: 741753 - DNA, 20 bp, Artificial
  CRISPR gRNA sequence
gatatatggaggagggagtt

SEQ ID NO: 741754 - DNA, 20 bp, Artificial
  CRISPR gRNA sequence
gaggagggagttcggctgct

SEQ ID NO: 741755 - DNA, 20 bp, Artificial
  CRISPR gRNA sequence
aggagggagttcggctgctg

SEQ ID NO: 741756 - DNA, 20 bp, Artificial
  CRISPR gRNA sequence
ggagggagttcggctgctga

SEQ ID NO: 741757 - DNA, 20 bp, Artificial
  CRISPR gRNA sequence
ggagttcggctgctgagggt

SEQ ID NO: 741758 - DNA, 20 bp, Artificial
  CRISPR gRNA sequence
gagttcggctgctgagggtt

SEQ ID NO: 741759 - DNA, 20 bp, Artificial
  CRISPR gRNA sequence
ctgctgagggttgggctgcc

SEQ ID NO: 741760 - DNA, 20 bp, Artificial
  CRISPR gRNA sequence
ggttgggctgcctggtttcc

SEQ ID NO: 741761 - DNA, 20 bp, Artificial
  CRISPR gRNA sequence
gttgggctgcctggtttccc

SEQ ID NO: 741762 - DNA, 20 bp, Artificial
  CRISPR gRNA sequence
ttgggctgcctggtttccca

SEQ ID NO: 741763 - DNA, 20 bp, Artificial
  CRISPR gRNA sequence
gggctgcctggtttcccagg

SEQ ID NO: 741764 - DNA, 20 bp, Artificial
  CRISPR gRNA sequence
ggctgcctggtttcccaggg

SEQ ID NO: 741765 - DNA, 20 bp, Artificial
  CRISPR gRNA sequence
tgcctggtttcccagggagg

SEQ ID NO: 741766 - DNA, 20 bp, Artificial
  CRISPR gRNA sequence
tggtttcccagggaggaagc

SEQ ID NO: 741767 - DNA, 20 bp, Artificial
  CRISPR gRNA sequence
ggtttcccagggaggaagct

SEQ ID NO: 741768 - DNA, 20 bp, Artificial
  CRISPR gRNA sequence
ccagggaggaagctgggtga

SEQ ID NO: 741769 - DNA, 20 bp, Artificial
  CRISPR gRNA sequence
gggaggaagctgggtgaaag

SEQ ID NO: 741770 - DNA, 20 bp, Artificial
  CRISPR gRNA sequence
ggaagctgggtgaaagcaga

SEQ ID NO: 741771 - DNA, 20 bp, Artificial
  CRISPR gRNA sequence
gacagcacattctgctgcgc

SEQ ID NO: 741772 - DNA, 20 bp, Artificial
  CRISPR gRNA sequence
acagcacattctgctgcgct

SEQ ID NO: 741773 - DNA, 20 bp, Artificial
  CRISPR gRNA sequence
cagcacattctgctgcgctg

SEQ ID NO: 741774 - DNA, 20 bp, Artificial
  CRISPR gRNA sequence
agcacattctgctgcgctgg

SEQ ID NO: 741775 - DNA, 20 bp, Artificial
  CRISPR gRNA sequence
gcacattctgctgcgctggg

SEQ ID NO: 741776 - DNA, 20 bp, Artificial
  CRISPR gRNA sequence
cattctgctgcgctgggggg

SEQ ID NO: 741777 - DNA, 20 bp, Artificial
  CRISPR gRNA sequence
attctgctgcgctggggggt

SEQ ID NO: 741778 - DNA, 20 bp, Artificial
  CRISPR gRNA sequence
ctgctgcgctggggggtggg

SEQ ID NO: 741779 - DNA, 20 bp, Artificial
  CRISPR gRNA sequence
ctgcgctggggggtgggaag

SEQ ID NO: 741780 - DNA, 20 bp, Artificial
  CRISPR gRNA sequence
ggggggtgggaagaagttca

SEQ ID NO: 741781 - DNA, 20 bp, Artificial
  CRISPR gRNA sequence
gggggtgggaagaagttcaa

SEQ ID NO: 741782 - DNA, 20 bp, Artificial
  CRISPR gRNA sequence
ggggtgggaagaagttcaaa

SEQ ID NO: 741783 - DNA, 20 bp, Artificial
  CRISPR gRNA sequence
ggtgggaagaagttcaaagg

SEQ ID NO: 741784 - DNA, 20 bp, Artificial
  CRISPR gRNA sequence
gaagaagttcaaagggagat

SEQ ID NO: 741785 - DNA, 20 bp, Artificial
  CRISPR gRNA sequence
tcaaagggagatgagctgcc

SEQ ID NO: 741786 - DNA, 20 bp, Artificial
  CRISPR gRNA sequence
gctgcctagaccccttctct

SEQ ID NO: 741787 - DNA, 20 bp, Artificial
  CRISPR gRNA sequence
accccttctctgagctcact

SEQ ID NO: 741788 - DNA, 20 bp, Artificial
  CRISPR gRNA sequence
ctgagctcactgagaaacca

SEQ ID NO: 741789 - DNA, 20 bp, Artificial
  CRISPR gRNA sequence
actgagaaaccacagcccct

SEQ ID NO: 741790 - DNA, 20 bp, Artificial
  CRISPR gRNA sequence
accacagcccctcagcaatg

SEQ ID NO: 741791 - DNA, 20 bp, Artificial
  CRISPR gRNA sequence
ccacagcccctcagcaatgc

SEQ ID NO: 741792 - DNA, 20 bp, Artificial
  CRISPR gRNA sequence
acagcccctcagcaatgcag

SEQ ID NO: 741793 - DNA, 20 bp, Artificial
  CRISPR gRNA sequence
tcagcaatgcaggagctcct

SEQ ID NO: 741794 - DNA, 20 bp, Artificial
  CRISPR gRNA sequence
cagcaatgcaggagctcctt

SEQ ID NO: 741795 - DNA, 20 bp, Artificial
  CRISPR gRNA sequence
tccttgggcaccaacttctc

SEQ ID NO: 741796 - DNA, 20 bp, Artificial
  CRISPR gRNA sequence
ctagtctcattcccctacct

SEQ ID NO: 741797 - DNA, 20 bp, Artificial
  CRISPR gRNA sequence
tagtctcattcccctacctc

SEQ ID NO: 741798 - DNA, 20 bp, Artificial
  CRISPR gRNA sequence
tgtactttcatgttatttca

SEQ ID NO: 741799 - DNA, 20 bp, Artificial
  CRISPR gRNA sequence
tttcatgttatttcatagtc

SEQ ID NO: 741800 - DNA, 20 bp, Artificial
  CRISPR gRNA sequence
aagctacactcttacttccc

SEQ ID NO: 741801 - DNA, 20 bp, Artificial
  CRISPR gRNA sequence
agctacactcttacttccca

SEQ ID NO: 741802 - DNA, 20 bp, Artificial
  CRISPR gRNA sequence
tacttcccaaggataacatt

SEQ ID NO: 741803 - DNA, 20 bp, Artificial
  CRISPR gRNA sequence
cttcccaaggataacattaa

SEQ ID NO: 741804 - DNA, 20 bp, Artificial
  CRISPR gRNA sequence
ttcccaaggataacattaag

SEQ ID NO: 741805 - DNA, 20 bp, Artificial
  CRISPR gRNA sequence
caaggataacattaagaggc

SEQ ID NO: 741806 - DNA, 20 bp, Artificial
  CRISPR gRNA sequence
taacattaagaggctggcac

SEQ ID NO: 741807 - DNA, 20 bp, Artificial
  CRISPR gRNA sequence
aacattaagaggctggcact

SEQ ID NO: 741808 - DNA, 20 bp, Artificial
  CRISPR gRNA sequence
acattaagaggctggcactg

SEQ ID NO: 741809 - DNA, 20 bp, Artificial
  CRISPR gRNA sequence
taagaggctggcactggggc

SEQ ID NO: 741810 - DNA, 20 bp, Artificial
  CRISPR gRNA sequence
aagaggctggcactggggct

SEQ ID NO: 741811 - DNA, 20 bp, Artificial
  CRISPR gRNA sequence
gctggcactggggctgggca

SEQ ID NO: 741812 - DNA, 20 bp, Artificial
  CRISPR gRNA sequence
ggcactggggctgggcatag

SEQ ID NO: 741813 - DNA, 20 bp, Artificial
  CRISPR gRNA sequence
gtggctcaatcctgtaatcc

SEQ ID NO: 741814 - DNA, 20 bp, Artificial
  CRISPR gRNA sequence
atcctgtaatcccagcactt

SEQ ID NO: 741815 - DNA, 20 bp, Artificial
  CRISPR gRNA sequence
tcctgtaatcccagcacttt

SEQ ID NO: 741816 - DNA, 20 bp, Artificial
  CRISPR gRNA sequence
cctgtaatcccagcactttg

SEQ ID NO: 741817 - DNA, 20 bp, Artificial
  CRISPR gRNA sequence
tgtaatcccagcactttggg

SEQ ID NO: 741818 - DNA, 20 bp, Artificial
  CRISPR gRNA sequence
tcccagcactttggggagcc

SEQ ID NO: 741819 - DNA, 20 bp, Artificial
  CRISPR gRNA sequence
cccagcactttggggagcca

SEQ ID NO: 741820 - DNA, 20 bp, Artificial
  CRISPR gRNA sequence
agcactttggggagccaagg

SEQ ID NO: 741821 - DNA, 20 bp, Artificial
  CRISPR gRNA sequence
gcactttggggagccaaggc

SEQ ID NO: 741822 - DNA, 20 bp, Artificial
  CRISPR gRNA sequence
ctttggggagccaaggcggg

SEQ ID NO: 741823 - DNA, 20 bp, Artificial
  CRISPR gRNA sequence
ccaaggcgggtagatcactt

SEQ ID NO: 741824 - DNA, 20 bp, Artificial
  CRISPR gRNA sequence
gcgggtagatcacttgagcc

SEQ ID NO: 741825 - DNA, 20 bp, Artificial
  CRISPR gRNA sequence
cgggtagatcacttgagccc

SEQ ID NO: 741826 - DNA, 20 bp, Artificial
  CRISPR gRNA sequence
ggtagatcacttgagcccag

SEQ ID NO: 741827 - DNA, 20 bp, Artificial
  CRISPR gRNA sequence
tcacttgagcccaggagttc

SEQ ID NO: 741828 - DNA, 20 bp, Artificial
  CRISPR gRNA sequence
tgagcccaggagttcgagac

SEQ ID NO: 741829 - DNA, 20 bp, Artificial
  CRISPR gRNA sequence
cgagaccagcctgaccaaca

SEQ ID NO: 741830 - DNA, 20 bp, Artificial
  CRISPR gRNA sequence
gcatgttctaattttgctct

SEQ ID NO: 741831 - DNA, 20 bp, Artificial
  CRISPR gRNA sequence
tttgctcttggcctgtttgt

SEQ ID NO: 741832 - DNA, 20 bp, Artificial
  CRISPR gRNA sequence
cctgtttgttggtttgaaaa

SEQ ID NO: 741833 - DNA, 20 bp, Artificial
  CRISPR gRNA sequence
ctgtttgttggtttgaaaaa

SEQ ID NO: 741834 - DNA, 20 bp, Artificial
  CRISPR gRNA sequence
tgtttgttggtttgaaaaaa

SEQ ID NO: 741835 - DNA, 20 bp, Artificial
  CRISPR gRNA sequence
ttgttggtttgaaaaaaggg

SEQ ID NO: 741836 - DNA, 20 bp, Artificial
  CRISPR gRNA sequence
ggtttgaaaaaagggtagct

SEQ ID NO: 741837 - DNA, 20 bp, Artificial
  CRISPR gRNA sequence
aaaaagggtagctgagtaaa

SEQ ID NO: 741838 - DNA, 20 bp, Artificial
  CRISPR gRNA sequence
agctgagtaaaaagtcactg

SEQ ID NO: 741839 - DNA, 20 bp, Artificial
  CRISPR gRNA sequence
aaaaagtcactgtagccttt

SEQ ID NO: 741840 - DNA, 20 bp, Artificial
  CRISPR gRNA sequence
agtcactgtagcctttgagt

SEQ ID NO: 741841 - DNA, 20 bp, Artificial
  CRISPR gRNA sequence
gtcactgtagcctttgagtt

SEQ ID NO: 741842 - DNA, 20 bp, Artificial
  CRISPR gRNA sequence
gcctttgagttgggttttgt

SEQ ID NO: 741843 - DNA, 20 bp, Artificial
  CRISPR gRNA sequence
cctttgagttgggttttgtt

SEQ ID NO: 741844 - DNA, 20 bp, Artificial
  CRISPR gRNA sequence
gttgggttttgttgggtccg

SEQ ID NO: 741845 - DNA, 20 bp, Artificial
  CRISPR gRNA sequence
gttttgttgggtccgtggtt

SEQ ID NO: 741846 - DNA, 20 bp, Artificial
  CRISPR gRNA sequence
ggtttagctgatccccattc

SEQ ID NO: 741847 - DNA, 20 bp, Artificial
  CRISPR gRNA sequence
agctgatccccattccggct

SEQ ID NO: 741848 - DNA, 20 bp, Artificial
  CRISPR gRNA sequence
gctgatccccattccggctt

SEQ ID NO: 741849 - DNA, 20 bp, Artificial
  CRISPR gRNA sequence
ggtcctcgtgcatgtcctcc

SEQ ID NO: 741850 - DNA, 20 bp, Artificial
  CRISPR gRNA sequence
cctggatgcctttgtatctc

SEQ ID NO: 741851 - DNA, 20 bp, Artificial
  CRISPR gRNA sequence
ctggatgcctttgtatctcc

SEQ ID NO: 741852 - DNA, 20 bp, Artificial
  CRISPR gRNA sequence
tggatgcctttgtatctcca

SEQ ID NO: 741853 - DNA, 20 bp, Artificial
  CRISPR gRNA sequence
gcctttgtatctccagggcc

SEQ ID NO: 741854 - DNA, 20 bp, Artificial
  CRISPR gRNA sequence
tttgtatctccagggcctag

SEQ ID NO: 741855 - DNA, 20 bp, Artificial
  CRISPR gRNA sequence
ttgtatctccagggcctagc

SEQ ID NO: 741856 - DNA, 20 bp, Artificial
  CRISPR gRNA sequence
tgtatctccagggcctagca

SEQ ID NO: 741857 - DNA, 20 bp, Artificial
  CRISPR gRNA sequence
gtatctccagggcctagcag

SEQ ID NO: 741858 - DNA, 20 bp, Artificial
  CRISPR gRNA sequence
ctccagggcctagcaggggc

SEQ ID NO: 741859 - DNA, 20 bp, Artificial
  CRISPR gRNA sequence
tagcaggggctggtccccac

SEQ ID NO: 741860 - DNA, 20 bp, Artificial
  CRISPR gRNA sequence
cactggatgtctgacacata

SEQ ID NO: 741861 - DNA, 20 bp, Artificial
  CRISPR gRNA sequence
actggatgtctgacacatac

SEQ ID NO: 741862 - DNA, 20 bp, Artificial
  CRISPR gRNA sequence
ctggatgtctgacacataca

SEQ ID NO: 741863 - DNA, 20 bp, Artificial
  CRISPR gRNA sequence
tgtctgacacatacagggta

SEQ ID NO: 741864 - DNA, 20 bp, Artificial
  CRISPR gRNA sequence
tctgacacatacagggtata

SEQ ID NO: 741865 - DNA, 20 bp, Artificial
  CRISPR gRNA sequence
ctgacacatacagggtatag

SEQ ID NO: 741866 - DNA, 20 bp, Artificial
  CRISPR gRNA sequence
tgacacatacagggtataga

SEQ ID NO: 741867 - DNA, 20 bp, Artificial
  CRISPR gRNA sequence
gacacatacagggtatagag

SEQ ID NO: 741868 - DNA, 20 bp, Artificial
  CRISPR gRNA sequence
atacagggtatagaggggtg

SEQ ID NO: 741869 - DNA, 20 bp, Artificial
  CRISPR gRNA sequence
cagggtatagaggggtgtgg

SEQ ID NO: 741870 - DNA, 20 bp, Artificial
  CRISPR gRNA sequence
tatagaggggtgtggaagcc

SEQ ID NO: 741871 - DNA, 20 bp, Artificial
  CRISPR gRNA sequence
tggaagccaagacctcttct

SEQ ID NO: 741872 - DNA, 20 bp, Artificial
  CRISPR gRNA sequence
aagccaagacctcttctcag

SEQ ID NO: 741873 - DNA, 20 bp, Artificial
  CRISPR gRNA sequence
gccaagacctcttctcagaa

SEQ ID NO: 741874 - DNA, 20 bp, Artificial
  CRISPR gRNA sequence
ccaagacctcttctcagaag

SEQ ID NO: 741875 - DNA, 20 bp, Artificial
  CRISPR gRNA sequence
caagacctcttctcagaaga

SEQ ID NO: 741876 - DNA, 20 bp, Artificial
  CRISPR gRNA sequence
agacctcttctcagaagagg

SEQ ID NO: 741877 - DNA, 20 bp, Artificial
  CRISPR gRNA sequence
gacctcttctcagaagaggg

SEQ ID NO: 741878 - DNA, 20 bp, Artificial
  CRISPR gRNA sequence
tgcccttgcattttgtctcc

SEQ ID NO: 741879 - DNA, 20 bp, Artificial
  CRISPR gRNA sequence
gcattttgtctccaagctgc

SEQ ID NO: 741880 - DNA, 20 bp, Artificial
  CRISPR gRNA sequence
cattttgtctccaagctgct

SEQ ID NO: 741881 - DNA, 20 bp, Artificial
  CRISPR gRNA sequence
ggtattctcacccaacctct

SEQ ID NO: 741882 - DNA, 20 bp, Artificial
  CRISPR gRNA sequence
ctcacccaacctctcagcgc

SEQ ID NO: 741883 - DNA, 20 bp, Artificial
  CRISPR gRNA sequence
tcacccaacctctcagcgcc

SEQ ID NO: 741884 - DNA, 20 bp, Artificial
  CRISPR gRNA sequence
ctctcagcgccaggcaccct

SEQ ID NO: 741885 - DNA, 20 bp, Artificial
  CRISPR gRNA sequence
tctcagcgccaggcaccctt

SEQ ID NO: 741886 - DNA, 20 bp, Artificial
  CRISPR gRNA sequence
ctcagcgccaggcaccctta

SEQ ID NO: 741887 - DNA, 20 bp, Artificial
  CRISPR gRNA sequence
agcgccaggcacccttaggg

SEQ ID NO: 741888 - DNA, 20 bp, Artificial
  CRISPR gRNA sequence
ggcagtgccctcttaccctg

SEQ ID NO: 741889 - DNA, 20 bp, Artificial
  CRISPR gRNA sequence
gcagtgccctcttaccctgt

SEQ ID NO: 741890 - DNA, 20 bp, Artificial
  CRISPR gRNA sequence
cagtgccctcttaccctgta

SEQ ID NO: 741891 - DNA, 20 bp, Artificial
  CRISPR gRNA sequence
taccctgtagggcacctctc

SEQ ID NO: 741892 - DNA, 20 bp, Artificial
  CRISPR gRNA sequence
ctgtagggcacctctctggc

SEQ ID NO: 741893 - DNA, 20 bp, Artificial
  CRISPR gRNA sequence
ggcacctctctggcaagcac

SEQ ID NO: 741894 - DNA, 20 bp, Artificial
  CRISPR gRNA sequence
gcacctctctggcaagcacc

SEQ ID NO: 741895 - DNA, 20 bp, Artificial
  CRISPR gRNA sequence
cacctctctggcaagcaccg

SEQ ID NO: 741896 - DNA, 20 bp, Artificial
  CRISPR gRNA sequence
acctctctggcaagcaccgg

SEQ ID NO: 741897 - DNA, 20 bp, Artificial
  CRISPR gRNA sequence
cctctctggcaagcaccggg

SEQ ID NO: 741898 - DNA, 20 bp, Artificial
  CRISPR gRNA sequence
gctacccactgcactgcccc

SEQ ID NO: 741899 - DNA, 20 bp, Artificial
  CRISPR gRNA sequence
cccactgcactgccccaagc

SEQ ID NO: 741900 - DNA, 20 bp, Artificial
  CRISPR gRNA sequence
ccactgcactgccccaagct

SEQ ID NO: 741901 - DNA, 20 bp, Artificial
  CRISPR gRNA sequence
ctgcactgccccaagctggg

SEQ ID NO: 741902 - DNA, 20 bp, Artificial
  CRISPR gRNA sequence
cactgccccaagctgggaag

SEQ ID NO: 741903 - DNA, 20 bp, Artificial
  CRISPR gRNA sequence
actgccccaagctgggaaga

SEQ ID NO: 741904 - DNA, 20 bp, Artificial
  CRISPR gRNA sequence
ccccaagctgggaagaaggt

SEQ ID NO: 741905 - DNA, 20 bp, Artificial
  CRISPR gRNA sequence
ctgggaagaaggtgagtatg

SEQ ID NO: 741906 - DNA, 20 bp, Artificial
  CRISPR gRNA sequence
gggaagaaggtgagtatgca

SEQ ID NO: 741907 - DNA, 20 bp, Artificial
  CRISPR gRNA sequence
gaaggtgagtatgcagagct

SEQ ID NO: 741908 - DNA, 20 bp, Artificial
  CRISPR gRNA sequence
ggtgagtatgcagagctaag

SEQ ID NO: 741909 - DNA, 20 bp, Artificial
  CRISPR gRNA sequence
gtgagtatgcagagctaagc

SEQ ID NO: 741910 - DNA, 20 bp, Artificial
  CRISPR gRNA sequence
tgcagagctaagcaggcctg

SEQ ID NO: 741911 - DNA, 20 bp, Artificial
  CRISPR gRNA sequence
gagctaagcaggcctgcagc

SEQ ID NO: 741912 - DNA, 20 bp, Artificial
  CRISPR gRNA sequence
gcaggcctgcagccagatcc

SEQ ID NO: 741913 - DNA, 20 bp, Artificial
  CRISPR gRNA sequence
agatcccagctatgctaccc

SEQ ID NO: 741914 - DNA, 20 bp, Artificial
  CRISPR gRNA sequence
gatcccagctatgctaccct

SEQ ID NO: 741915 - DNA, 20 bp, Artificial
  CRISPR gRNA sequence
tatgctaccctgggctatgt

SEQ ID NO: 741916 - DNA, 20 bp, Artificial
  CRISPR gRNA sequence
taccctgggctatgtgagct

SEQ ID NO: 741917 - DNA, 20 bp, Artificial
  CRISPR gRNA sequence
accctgggctatgtgagctt

SEQ ID NO: 741918 - DNA, 20 bp, Artificial
  CRISPR gRNA sequence
tgggctatgtgagcttgggc

SEQ ID NO: 741919 - DNA, 20 bp, Artificial
  CRISPR gRNA sequence
ctatgtgagcttgggcaagt

SEQ ID NO: 741920 - DNA, 20 bp, Artificial
  CRISPR gRNA sequence
ggcaagttagcatacatctc

SEQ ID NO: 741921 - DNA, 20 bp, Artificial
  CRISPR gRNA sequence
gcaagttagcatacatctct

SEQ ID NO: 741922 - DNA, 20 bp, Artificial
  CRISPR gRNA sequence
tctctaggcctctctttcca

SEQ ID NO: 741923 - DNA, 20 bp, Artificial
  CRISPR gRNA sequence
ggcctctctttccatggata

SEQ ID NO: 741924 - DNA, 20 bp, Artificial
  CRISPR gRNA sequence
cctctctttccatggataca

SEQ ID NO: 741925 - DNA, 20 bp, Artificial
  CRISPR gRNA sequence
ctctttccatggatacagag

SEQ ID NO: 741926 - DNA, 20 bp, Artificial
  CRISPR gRNA sequence
ttccatggatacagagaaga

SEQ ID NO: 741927 - DNA, 20 bp, Artificial
  CRISPR gRNA sequence
agatggtgatgcctacttca

SEQ ID NO: 741928 - DNA, 20 bp, Artificial
  CRISPR gRNA sequence
atggtgatgcctacttcata

SEQ ID NO: 741929 - DNA, 20 bp, Artificial
  CRISPR gRNA sequence
ctacttcatagagttcttat

SEQ ID NO: 741930 - DNA, 20 bp, Artificial
  CRISPR gRNA sequence
agttcttataagaattccct

SEQ ID NO: 741931 - DNA, 20 bp, Artificial
  CRISPR gRNA sequence
gttcttataagaattccctg

SEQ ID NO: 741932 - DNA, 20 bp, Artificial
  CRISPR gRNA sequence
ttataagaattccctgaggc

SEQ ID NO: 741933 - DNA, 20 bp, Artificial
  CRISPR gRNA sequence
tataagaattccctgaggct

SEQ ID NO: 741934 - DNA, 20 bp, Artificial
  CRISPR gRNA sequence
gaattccctgaggctaggca

SEQ ID NO: 741935 - DNA, 20 bp, Artificial
  CRISPR gRNA sequence
ttccctgaggctaggcatgg

SEQ ID NO: 741936 - DNA, 20 bp, Artificial
  CRISPR gRNA sequence
gtggctcacacctgtaatcc

SEQ ID NO: 741937 - DNA, 20 bp, Artificial
  CRISPR gRNA sequence
cacctgtaatcccagcactt

SEQ ID NO: 741938 - DNA, 20 bp, Artificial
  CRISPR gRNA sequence
cctgtaatcccagcactttg

SEQ ID NO: 741939 - DNA, 20 bp, Artificial
  CRISPR gRNA sequence
ctgtaatcccagcactttgg

SEQ ID NO: 741940 - DNA, 20 bp, Artificial
  CRISPR gRNA sequence
atcccagcactttggaggtc

SEQ ID NO: 741941 - DNA, 20 bp, Artificial
  CRISPR gRNA sequence
tcccagcactttggaggtca

SEQ ID NO: 741942 - DNA, 20 bp, Artificial
  CRISPR gRNA sequence
cagcactttggaggtcaagg

SEQ ID NO: 741943 - DNA, 20 bp, Artificial
  CRISPR gRNA sequence
agcactttggaggtcaaggt

SEQ ID NO: 741944 - DNA, 20 bp, Artificial
  CRISPR gRNA sequence
actttggaggtcaaggtggg

SEQ ID NO: 741945 - DNA, 20 bp, Artificial
  CRISPR gRNA sequence
tcaaggtgggaagatcaatt

SEQ ID NO: 741946 - DNA, 20 bp, Artificial
  CRISPR gRNA sequence
gtgggaagatcaattgagcc

SEQ ID NO: 741947 - DNA, 20 bp, Artificial
  CRISPR gRNA sequence
tgggaagatcaattgagccc

SEQ ID NO: 741948 - DNA, 20 bp, Artificial
  CRISPR gRNA sequence
ggaagatcaattgagcccag

SEQ ID NO: 741949 - DNA, 20 bp, Artificial
  CRISPR gRNA sequence
tcaattgagcccaggagttc

SEQ ID NO: 741950 - DNA, 20 bp, Artificial
  CRISPR gRNA sequence
tgagcccaggagttcaagac

SEQ ID NO: 741951 - DNA, 20 bp, Artificial
  CRISPR gRNA sequence
ccaggagttcaagaccagcc

SEQ ID NO: 741952 - DNA, 20 bp, Artificial
  CRISPR gRNA sequence
caggagttcaagaccagcct

SEQ ID NO: 741953 - DNA, 20 bp, Artificial
  CRISPR gRNA sequence
caagaccagcctgggcaaca

SEQ ID NO: 741954 - DNA, 20 bp, Artificial
  CRISPR gRNA sequence
accagcctgggcaacatagc

SEQ ID NO: 741955 - DNA, 20 bp, Artificial
  CRISPR gRNA sequence
cagcctgggcaacatagcga

SEQ ID NO: 741956 - DNA, 20 bp, Artificial
  CRISPR gRNA sequence
cgagagtgcatctctaccaa

SEQ ID NO: 741957 - DNA, 20 bp, Artificial
  CRISPR gRNA sequence
aagtgatttttttgattttt

SEQ ID NO: 741958 - DNA, 20 bp, Artificial
  CRISPR gRNA sequence
agtgatttttttgatttttt

SEQ ID NO: 741959 - DNA, 20 bp, Artificial
  CRISPR gRNA sequence
atttttttgattttttggga

SEQ ID NO: 741960 - DNA, 20 bp, Artificial
  CRISPR gRNA sequence
ttttttgattttttgggaca

SEQ ID NO: 741961 - DNA, 20 bp, Artificial
  CRISPR gRNA sequence
cagagtctcgctctgtcacc

SEQ ID NO: 741962 - DNA, 20 bp, Artificial
  CRISPR gRNA sequence
agagtctcgctctgtcaccc

SEQ ID NO: 741963 - DNA, 20 bp, Artificial
  CRISPR gRNA sequence
tctcgctctgtcacccaggc

SEQ ID NO: 741964 - DNA, 20 bp, Artificial
  CRISPR gRNA sequence
tcgctctgtcacccaggctg

SEQ ID NO: 741965 - DNA, 20 bp, Artificial
  CRISPR gRNA sequence
ctgtcacccaggctggagtg

SEQ ID NO: 741966 - DNA, 20 bp, Artificial
  CRISPR gRNA sequence
tcacccaggctggagtgcag

SEQ ID NO: 741967 - DNA, 20 bp, Artificial
  CRISPR gRNA sequence
ggagtgcagtggtgtgatct

SEQ ID NO: 741968 - DNA, 20 bp, Artificial
  CRISPR gRNA sequence
tcactgcaacttctgcctcc

SEQ ID NO: 741969 - DNA, 20 bp, Artificial
  CRISPR gRNA sequence
cactgcaacttctgcctccc

SEQ ID NO: 741970 - DNA, 20 bp, Artificial
  CRISPR gRNA sequence
aacttctgcctcccaggttc

SEQ ID NO: 741971 - DNA, 20 bp, Artificial
  CRISPR gRNA sequence
ttctgcctcccaggttcaag

SEQ ID NO: 741972 - DNA, 20 bp, Artificial
  CRISPR gRNA sequence
ttcaagcagctctcatgtct

SEQ ID NO: 741973 - DNA, 20 bp, Artificial
  CRISPR gRNA sequence
ctctcatgtctcagcctccc

SEQ ID NO: 741974 - DNA, 20 bp, Artificial
  CRISPR gRNA sequence
tcatgtctcagcctcccgag

SEQ ID NO: 741975 - DNA, 20 bp, Artificial
  CRISPR gRNA sequence
gtctcagcctcccgagtagc

SEQ ID NO: 741976 - DNA, 20 bp, Artificial
  CRISPR gRNA sequence
tctcagcctcccgagtagct

SEQ ID NO: 741977 - DNA, 20 bp, Artificial
  CRISPR gRNA sequence
ctcccgagtagctgggatta

SEQ ID NO: 741978 - DNA, 20 bp, Artificial
  CRISPR gRNA sequence
acagatgcctgccaccatgc

SEQ ID NO: 741979 - DNA, 20 bp, Artificial
  CRISPR gRNA sequence
cagatgcctgccaccatgcc

SEQ ID NO: 741980 - DNA, 20 bp, Artificial
  CRISPR gRNA sequence
ccaccatgccaggcaaattt

SEQ ID NO: 741981 - DNA, 20 bp, Artificial
  CRISPR gRNA sequence
caccatgccaggcaaatttt

SEQ ID NO: 741982 - DNA, 20 bp, Artificial
  CRISPR gRNA sequence
ttttgggttgtttttttttt

SEQ ID NO: 741983 - DNA, 20 bp, Artificial
  CRISPR gRNA sequence
gggttgttttttttttgaga

SEQ ID NO: 741984 - DNA, 20 bp, Artificial
  CRISPR gRNA sequence
gttgttttttttttgagatg

SEQ ID NO: 741985 - DNA, 20 bp, Artificial
  CRISPR gRNA sequence
gagatggagtcttgctctat

SEQ ID NO: 741986 - DNA, 20 bp, Artificial
  CRISPR gRNA sequence
atggagtcttgctctatcag

SEQ ID NO: 741987 - DNA, 20 bp, Artificial
  CRISPR gRNA sequence
tggagtcttgctctatcagc

SEQ ID NO: 741988 - DNA, 20 bp, Artificial
  CRISPR gRNA sequence
gtcttgctctatcagcaggc

SEQ ID NO: 741989 - DNA, 20 bp, Artificial
  CRISPR gRNA sequence
cttgctctatcagcaggctg

SEQ ID NO: 741990 - DNA, 20 bp, Artificial
  CRISPR gRNA sequence
tctatcagcaggctggagtg

SEQ ID NO: 741991 - DNA, 20 bp, Artificial
  CRISPR gRNA sequence
atcagcaggctggagtgcag

SEQ ID NO: 741992 - DNA, 20 bp, Artificial
  CRISPR gRNA sequence
ggagtgcagtggcgcgatct

SEQ ID NO: 741993 - DNA, 20 bp, Artificial
  CRISPR gRNA sequence
tcactgtaacctctgactcc

SEQ ID NO: 741994 - DNA, 20 bp, Artificial
  CRISPR gRNA sequence
cactgtaacctctgactccc

SEQ ID NO: 741995 - DNA, 20 bp, Artificial
  CRISPR gRNA sequence
aacctctgactcccgggttc

SEQ ID NO: 741996 - DNA, 20 bp, Artificial
  CRISPR gRNA sequence
ttcaagcgattctcttgcct

SEQ ID NO: 741997 - DNA, 20 bp, Artificial
  CRISPR gRNA sequence
ttctcttgcctcagcctctt

SEQ ID NO: 741998 - DNA, 20 bp, Artificial
  CRISPR gRNA sequence
tcttgcctcagcctcttgag

SEQ ID NO: 741999 - DNA, 20 bp, Artificial
  CRISPR gRNA sequence
gcctcagcctcttgagtagc

SEQ ID NO: 742000 - DNA, 20 bp, Artificial
  CRISPR gRNA sequence
cctcagcctcttgagtagct

SEQ ID NO: 742001 - DNA, 20 bp, Artificial
  CRISPR gRNA sequence
ctcttgagtagctgggacta

SEQ ID NO: 742002 - DNA, 20 bp, Artificial
  CRISPR gRNA sequence
tcttgagtagctgggactac

SEQ ID NO: 742003 - DNA, 20 bp, Artificial
  CRISPR gRNA sequence
caggcgtgcaccaccatgcc

SEQ ID NO: 742004 - DNA, 20 bp, Artificial
  CRISPR gRNA sequence
ctggctaatttttgtgtttt

SEQ ID NO: 742005 - DNA, 20 bp, Artificial
  CRISPR gRNA sequence
gctaatttttgtgtttttag

SEQ ID NO: 742006 - DNA, 20 bp, Artificial
  CRISPR gRNA sequence
taatttttgtgtttttagta

SEQ ID NO: 742007 - DNA, 20 bp, Artificial
  CRISPR gRNA sequence
ttttgtgtttttagtagaga

SEQ ID NO: 742008 - DNA, 20 bp, Artificial
  CRISPR gRNA sequence
tttgtgtttttagtagagat

SEQ ID NO: 742009 - DNA, 20 bp, Artificial
  CRISPR gRNA sequence
ttgtgtttttagtagagatg

SEQ ID NO: 742010 - DNA, 20 bp, Artificial
  CRISPR gRNA sequence
gagatggggtttcaccctgt

SEQ ID NO: 742011 - DNA, 20 bp, Artificial
  CRISPR gRNA sequence
tggggtttcaccctgttggc

SEQ ID NO: 742012 - DNA, 20 bp, Artificial
  CRISPR gRNA sequence
ggggtttcaccctgttggcc

SEQ ID NO: 742013 - DNA, 20 bp, Artificial
  CRISPR gRNA sequence
tttcaccctgttggccaggc

SEQ ID NO: 742014 - DNA, 20 bp, Artificial
  CRISPR gRNA sequence
ccaggctggtctcgaactcc

SEQ ID NO: 742015 - DNA, 20 bp, Artificial
  CRISPR gRNA sequence
ggtctcgaactcctggcctc

SEQ ID NO: 742016 - DNA, 20 bp, Artificial
  CRISPR gRNA sequence
ctgcctgccttgacctccta

SEQ ID NO: 742017 - DNA, 20 bp, Artificial
  CRISPR gRNA sequence
gccttgacctcctaaagtgc

SEQ ID NO: 742018 - DNA, 20 bp, Artificial
  CRISPR gRNA sequence
ccttgacctcctaaagtgct

SEQ ID NO: 742019 - DNA, 20 bp, Artificial
  CRISPR gRNA sequence
ctcctaaagtgctgggatta

SEQ ID NO: 742020 - DNA, 20 bp, Artificial
  CRISPR gRNA sequence
tcctaaagtgctgggattac

SEQ ID NO: 742021 - DNA, 20 bp, Artificial
  CRISPR gRNA sequence
agtgctgggattacaggcgt

SEQ ID NO: 742022 - DNA, 20 bp, Artificial
  CRISPR gRNA sequence
aataatttttaaaaattcac

SEQ ID NO: 742023 - DNA, 20 bp, Artificial
  CRISPR gRNA sequence
ttttaaaaattcaccagaca

SEQ ID NO: 742024 - DNA, 20 bp, Artificial
  CRISPR gRNA sequence
gacatggtgatgcgtgcctg

SEQ ID NO: 742025 - DNA, 20 bp, Artificial
  CRISPR gRNA sequence
gtgatgcgtgcctgtagtcc

SEQ ID NO: 742026 - DNA, 20 bp, Artificial
  CRISPR gRNA sequence
tgcctgtagtcccagctact

SEQ ID NO: 742027 - DNA, 20 bp, Artificial
  CRISPR gRNA sequence
gcctgtagtcccagctactt

SEQ ID NO: 742028 - DNA, 20 bp, Artificial
  CRISPR gRNA sequence
ctgtagtcccagctacttgg

SEQ ID NO: 742029 - DNA, 20 bp, Artificial
  CRISPR gRNA sequence
cccagctacttgggagaatg

SEQ ID NO: 742030 - DNA, 20 bp, Artificial
  CRISPR gRNA sequence
agctacttgggagaatgaag

SEQ ID NO: 742031 - DNA, 20 bp, Artificial
  CRISPR gRNA sequence
gctacttgggagaatgaagc

SEQ ID NO: 742032 - DNA, 20 bp, Artificial
  CRISPR gRNA sequence
acttgggagaatgaagcagg

SEQ ID NO: 742033 - DNA, 20 bp, Artificial
  CRISPR gRNA sequence
gcaggaagatcacttgcatc

SEQ ID NO: 742034 - DNA, 20 bp, Artificial
  CRISPR gRNA sequence
ggaagatcacttgcatctgg

SEQ ID NO: 742035 - DNA, 20 bp, Artificial
  CRISPR gRNA sequence
tcacttgcatctggaagttt

SEQ ID NO: 742036 - DNA, 20 bp, Artificial
  CRISPR gRNA sequence
cacttgcatctggaagtttg

SEQ ID NO: 742037 - DNA, 20 bp, Artificial
  CRISPR gRNA sequence
catctggaagtttgaggctt

SEQ ID NO: 742038 - DNA, 20 bp, Artificial
  CRISPR gRNA sequence
tggaagtttgaggcttcagt

SEQ ID NO: 742039 - DNA, 20 bp, Artificial
  CRISPR gRNA sequence
gtgattgcaccactgcattc

SEQ ID NO: 742040 - DNA, 20 bp, Artificial
  CRISPR gRNA sequence
gcaccactgcattccagcct

SEQ ID NO: 742041 - DNA, 20 bp, Artificial
  CRISPR gRNA sequence
ctgcattccagcctgagtga

SEQ ID NO: 742042 - DNA, 20 bp, Artificial
  CRISPR gRNA sequence
gcattccagcctgagtgaca

SEQ ID NO: 742043 - DNA, 20 bp, Artificial
  CRISPR gRNA sequence
attccagcctgagtgacaga

SEQ ID NO: 742044 - DNA, 20 bp, Artificial
  CRISPR gRNA sequence
tccagcctgagtgacagaga

SEQ ID NO: 742045 - DNA, 20 bp, Artificial
  CRISPR gRNA sequence
cagcctgagtgacagagaga

SEQ ID NO: 742046 - DNA, 20 bp, Artificial
  CRISPR gRNA sequence
caaaaaaaaaaaaaattcct

SEQ ID NO: 742047 - DNA, 20 bp, Artificial
  CRISPR gRNA sequence
aaaaaaaaaaaaaattcctg

SEQ ID NO: 742048 - DNA, 20 bp, Artificial
  CRISPR gRNA sequence
aaaaaaaaaattcctgaggc

SEQ ID NO: 742049 - DNA, 20 bp, Artificial
  CRISPR gRNA sequence
aaaaaaaaattcctgaggcc

SEQ ID NO: 742050 - DNA, 20 bp, Artificial
  CRISPR gRNA sequence
aaaattcctgaggccaggcg

SEQ ID NO: 742051 - DNA, 20 bp, Artificial
  CRISPR gRNA sequence
gtgactcacacctgtaatcc

SEQ ID NO: 742052 - DNA, 20 bp, Artificial
  CRISPR gRNA sequence
cacctgtaatcccagcactt

SEQ ID NO: 742053 - DNA, 20 bp, Artificial
  CRISPR gRNA sequence
acctgtaatcccagcacttt

SEQ ID NO: 742054 - DNA, 20 bp, Artificial
  CRISPR gRNA sequence
ctgtaatcccagcactttgg

SEQ ID NO: 742055 - DNA, 20 bp, Artificial
  CRISPR gRNA sequence
tgtaatcccagcactttggg

SEQ ID NO: 742056 - DNA, 20 bp, Artificial
  CRISPR gRNA sequence
tcccagcactttgggaggcc

SEQ ID NO: 742057 - DNA, 20 bp, Artificial
  CRISPR gRNA sequence
cccagcactttgggaggccg

SEQ ID NO: 742058 - DNA, 20 bp, Artificial
  CRISPR gRNA sequence
agcactttgggaggccgagg

SEQ ID NO: 742059 - DNA, 20 bp, Artificial
  CRISPR gRNA sequence
ctttgggaggccgaggcagt

SEQ ID NO: 742060 - DNA, 20 bp, Artificial
  CRISPR gRNA sequence
gaggcagttagatcatttgt

SEQ ID NO: 742061 - DNA, 20 bp, Artificial
  CRISPR gRNA sequence
gcagttagatcatttgtcag

SEQ ID NO: 742062 - DNA, 20 bp, Artificial
  CRISPR gRNA sequence
agatcatttgtcagtagttt

SEQ ID NO: 742063 - DNA, 20 bp, Artificial
  CRISPR gRNA sequence
atttgtcagtagtttgagac

SEQ ID NO: 742064 - DNA, 20 bp, Artificial
  CRISPR gRNA sequence
tcagtagtttgagaccagcc

SEQ ID NO: 742065 - DNA, 20 bp, Artificial
  CRISPR gRNA sequence
tgagaccagcctggccaaca

SEQ ID NO: 742066 - DNA, 20 bp, Artificial
  CRISPR gRNA sequence
tggccaacatggtgaaaccc

SEQ ID NO: 742067 - DNA, 20 bp, Artificial
  CRISPR gRNA sequence
tccactaaaaatacaaaaat

SEQ ID NO: 742068 - DNA, 20 bp, Artificial
  CRISPR gRNA sequence
ctaaaaatacaaaaattagc

SEQ ID NO: 742069 - DNA, 20 bp, Artificial
  CRISPR gRNA sequence
taaaaatacaaaaattagcc

SEQ ID NO: 742070 - DNA, 20 bp, Artificial
  CRISPR gRNA sequence
caaaaattagccaggcattg

SEQ ID NO: 742071 - DNA, 20 bp, Artificial
  CRISPR gRNA sequence
gcacgcctgtaatctcatcc

SEQ ID NO: 742072 - DNA, 20 bp, Artificial
  CRISPR gRNA sequence
gtaatctcatcctagctact

SEQ ID NO: 742073 - DNA, 20 bp, Artificial
  CRISPR gRNA sequence
taatctcatcctagctactc

SEQ ID NO: 742074 - DNA, 20 bp, Artificial
  CRISPR gRNA sequence
atctcatcctagctactcgg

SEQ ID NO: 742075 - DNA, 20 bp, Artificial
  CRISPR gRNA sequence
tctcatcctagctactcggg

SEQ ID NO: 742076 - DNA, 20 bp, Artificial
  CRISPR gRNA sequence
tcctagctactcgggaggct

SEQ ID NO: 742077 - DNA, 20 bp, Artificial
  CRISPR gRNA sequence
cctagctactcgggaggctg

SEQ ID NO: 742078 - DNA, 20 bp, Artificial
  CRISPR gRNA sequence
agctactcgggaggctgagg

SEQ ID NO: 742079 - DNA, 20 bp, Artificial
  CRISPR gRNA sequence
tactcgggaggctgaggcag

SEQ ID NO: 742080 - DNA, 20 bp, Artificial
  CRISPR gRNA sequence
gcagaagaatcgcttgaatc

SEQ ID NO: 742081 - DNA, 20 bp, Artificial
  CRISPR gRNA sequence
cagaagaatcgcttgaatcc

SEQ ID NO: 742082 - DNA, 20 bp, Artificial
  CRISPR gRNA sequence
gaagaatcgcttgaatccgg

SEQ ID NO: 742083 - DNA, 20 bp, Artificial
  CRISPR gRNA sequence
aagaatcgcttgaatccggg

SEQ ID NO: 742084 - DNA, 20 bp, Artificial
  CRISPR gRNA sequence
aatcgcttgaatccgggagg

SEQ ID NO: 742085 - DNA, 20 bp, Artificial
  CRISPR gRNA sequence
tcgcttgaatccgggaggcg

SEQ ID NO: 742086 - DNA, 20 bp, Artificial
  CRISPR gRNA sequence
cgcttgaatccgggaggcgg

SEQ ID NO: 742087 - DNA, 20 bp, Artificial
  CRISPR gRNA sequence
aatccgggaggcggaggttg

SEQ ID NO: 742088 - DNA, 20 bp, Artificial
  CRISPR gRNA sequence
cgggaggcggaggttgcagt

SEQ ID NO: 742089 - DNA, 20 bp, Artificial
  CRISPR gRNA sequence
ggcggaggttgcagtgagcc

SEQ ID NO: 742090 - DNA, 20 bp, Artificial
  CRISPR gRNA sequence
cagatcgcgccactgcactc

SEQ ID NO: 742091 - DNA, 20 bp, Artificial
  CRISPR gRNA sequence
cgcgccactgcactccagcc

SEQ ID NO: 742092 - DNA, 20 bp, Artificial
  CRISPR gRNA sequence
gcgccactgcactccagcct

SEQ ID NO: 742093 - DNA, 20 bp, Artificial
  CRISPR gRNA sequence
ctgcactccagcctgggtaa

SEQ ID NO: 742094 - DNA, 20 bp, Artificial
  CRISPR gRNA sequence
gcactccagcctgggtaaca

SEQ ID NO: 742095 - DNA, 20 bp, Artificial
  CRISPR gRNA sequence
aacagagtgaaaccgtgttt

SEQ ID NO: 742096 - DNA, 20 bp, Artificial
  CRISPR gRNA sequence
atatatatatatatatccct

SEQ ID NO: 742097 - DNA, 20 bp, Artificial
  CRISPR gRNA sequence
ctgagataataatacttaaa

SEQ ID NO: 742098 - DNA, 20 bp, Artificial
  CRISPR gRNA sequence
taataatacttaaaaagact

SEQ ID NO: 742099 - DNA, 20 bp, Artificial
  CRISPR gRNA sequence
atacttaaaaagacttagtc

SEQ ID NO: 742100 - DNA, 20 bp, Artificial
  CRISPR gRNA sequence
aaaagacttagtccagtgcc

SEQ ID NO: 742101 - DNA, 20 bp, Artificial
  CRISPR gRNA sequence
acttagtccagtgcccagca

SEQ ID NO: 742102 - DNA, 20 bp, Artificial
  CRISPR gRNA sequence
tagtccagtgcccagcacag

SEQ ID NO: 742103 - DNA, 20 bp, Artificial
  CRISPR gRNA sequence
agtccagtgcccagcacagt

SEQ ID NO: 742104 - DNA, 20 bp, Artificial
  CRISPR gRNA sequence
tgcccagcacagtgggaact

SEQ ID NO: 742105 - DNA, 20 bp, Artificial
  CRISPR gRNA sequence
gcccagcacagtgggaactc

SEQ ID NO: 742106 - DNA, 20 bp, Artificial
  CRISPR gRNA sequence
agcacagtgggaactcagga

SEQ ID NO: 742107 - DNA, 20 bp, Artificial
  CRISPR gRNA sequence
gcacagtgggaactcaggaa

SEQ ID NO: 742108 - DNA, 20 bp, Artificial
  CRISPR gRNA sequence
cagtgggaactcaggaaagg

SEQ ID NO: 742109 - DNA, 20 bp, Artificial
  CRISPR gRNA sequence
tcctcctccctcccctgcaa

SEQ ID NO: 742110 - DNA, 20 bp, Artificial
  CRISPR gRNA sequence
ctcctccctcccctgcaaca

SEQ ID NO: 742111 - DNA, 20 bp, Artificial
  CRISPR gRNA sequence
cctgcaacagagaacatctg

SEQ ID NO: 742112 - DNA, 20 bp, Artificial
  CRISPR gRNA sequence
cagagaacatctgaagaaca

SEQ ID NO: 742113 - DNA, 20 bp, Artificial
  CRISPR gRNA sequence
atctgaagaacatagaaaca

SEQ ID NO: 742114 - DNA, 20 bp, Artificial
  CRISPR gRNA sequence
gaacatagaaacacagaaca

SEQ ID NO: 742115 - DNA, 20 bp, Artificial
  CRISPR gRNA sequence
acacagaacacagaaatctg

SEQ ID NO: 742116 - DNA, 20 bp, Artificial
  CRISPR gRNA sequence
cagaacacagaaatctgaag

SEQ ID NO: 742117 - DNA, 20 bp, Artificial
  CRISPR gRNA sequence
aatctgaagtagtttaattc

SEQ ID NO: 742118 - DNA, 20 bp, Artificial
  CRISPR gRNA sequence
atctgaagtagtttaattct

SEQ ID NO: 742119 - DNA, 20 bp, Artificial
  CRISPR gRNA sequence
aagtagtttaattctaggcc

SEQ ID NO: 742120 - DNA, 20 bp, Artificial
  CRISPR gRNA sequence
gtagtttaattctaggccaa

SEQ ID NO: 742121 - DNA, 20 bp, Artificial
  CRISPR gRNA sequence
tagtttaattctaggccaag

SEQ ID NO: 742122 - DNA, 20 bp, Artificial
  CRISPR gRNA sequence
ttctaggccaagaggacccc

SEQ ID NO: 742123 - DNA, 20 bp, Artificial
  CRISPR gRNA sequence
agaggacccccagccttccc

SEQ ID NO: 742124 - DNA, 20 bp, Artificial
  CRISPR gRNA sequence
cccccagccttcccaagcca

SEQ ID NO: 742125 - DNA, 20 bp, Artificial
  CRISPR gRNA sequence
ccccagccttcccaagccat

SEQ ID NO: 742126 - DNA, 20 bp, Artificial
  CRISPR gRNA sequence
cccagccttcccaagccata

SEQ ID NO: 742127 - DNA, 20 bp, Artificial
  CRISPR gRNA sequence
ccagccttcccaagccatag

SEQ ID NO: 742128 - DNA, 20 bp, Artificial
  CRISPR gRNA sequence
cagccttcccaagccatagg

SEQ ID NO: 742129 - DNA, 20 bp, Artificial
  CRISPR gRNA sequence
cttcccaagccatagggggc

SEQ ID NO: 742130 - DNA, 20 bp, Artificial
  CRISPR gRNA sequence
cccaagccatagggggctgg

SEQ ID NO: 742131 - DNA, 20 bp, Artificial
  CRISPR gRNA sequence
ccaagccatagggggctggt

SEQ ID NO: 742132 - DNA, 20 bp, Artificial
  CRISPR gRNA sequence
agccatagggggctggtggg

SEQ ID NO: 742133 - DNA, 20 bp, Artificial
  CRISPR gRNA sequence
gccatagggggctggtgggc

SEQ ID NO: 742134 - DNA, 20 bp, Artificial
  CRISPR gRNA sequence
ccatagggggctggtgggca

SEQ ID NO: 742135 - DNA, 20 bp, Artificial
  CRISPR gRNA sequence
tagggggctggtgggcaggg

SEQ ID NO: 742136 - DNA, 20 bp, Artificial
  CRISPR gRNA sequence
ctggtgggcagggcggcact

SEQ ID NO: 742137 - DNA, 20 bp, Artificial
  CRISPR gRNA sequence
cagggcggcacttagctgcc

SEQ ID NO: 742138 - DNA, 20 bp, Artificial
  CRISPR gRNA sequence
agggcggcacttagctgcct

SEQ ID NO: 742139 - DNA, 20 bp, Artificial
  CRISPR gRNA sequence
gggcggcacttagctgcctg

SEQ ID NO: 742140 - DNA, 20 bp, Artificial
  CRISPR gRNA sequence
acttagctgcctggggcacc

SEQ ID NO: 742141 - DNA, 20 bp, Artificial
  CRISPR gRNA sequence
gggcacccagtacctgtcat

SEQ ID NO: 742142 - DNA, 20 bp, Artificial
  CRISPR gRNA sequence
ggcacccagtacctgtcatg

SEQ ID NO: 742143 - DNA, 20 bp, Artificial
  CRISPR gRNA sequence
ctgtcatgaggcacttgccc

SEQ ID NO: 742144 - DNA, 20 bp, Artificial
  CRISPR gRNA sequence
tgaggcacttgccctggcca

SEQ ID NO: 742145 - DNA, 20 bp, Artificial
  CRISPR gRNA sequence
gaggcacttgccctggccaa

SEQ ID NO: 742146 - DNA, 20 bp, Artificial
  CRISPR gRNA sequence
cctggccaaaggtcactgcc

SEQ ID NO: 742147 - DNA, 20 bp, Artificial
  CRISPR gRNA sequence
ctggccaaaggtcactgcca

SEQ ID NO: 742148 - DNA, 20 bp, Artificial
  CRISPR gRNA sequence
caaaggtcactgccaaggca

SEQ ID NO: 742149 - DNA, 20 bp, Artificial
  CRISPR gRNA sequence
ctgccaaggcacagccactc

SEQ ID NO: 742150 - DNA, 20 bp, Artificial
  CRISPR gRNA sequence
gccaaggcacagccactcca

SEQ ID NO: 742151 - DNA, 20 bp, Artificial
  CRISPR gRNA sequence
caaggcacagccactccaga

SEQ ID NO: 742152 - DNA, 20 bp, Artificial
  CRISPR gRNA sequence
cacagccactccagagagtc

SEQ ID NO: 742153 - DNA, 20 bp, Artificial
  CRISPR gRNA sequence
cagccactccagagagtcaa

SEQ ID NO: 742154 - DNA, 20 bp, Artificial
  CRISPR gRNA sequence
agccactccagagagtcaag

SEQ ID NO: 742155 - DNA, 20 bp, Artificial
  CRISPR gRNA sequence
ccactccagagagtcaagag

SEQ ID NO: 742156 - DNA, 20 bp, Artificial
  CRISPR gRNA sequence
ctccagagagtcaagaggag

SEQ ID NO: 742157 - DNA, 20 bp, Artificial
  CRISPR gRNA sequence
ccagagagtcaagaggagca

SEQ ID NO: 742158 - DNA, 20 bp, Artificial
  CRISPR gRNA sequence
gtcaagaggagcagagactc

SEQ ID NO: 742159 - DNA, 20 bp, Artificial
  CRISPR gRNA sequence
caagaggagcagagactcca

SEQ ID NO: 742160 - DNA, 20 bp, Artificial
  CRISPR gRNA sequence
gaggagcagagactccagag

SEQ ID NO: 742161 - DNA, 20 bp, Artificial
  CRISPR gRNA sequence
agcagagactccagagcaga

SEQ ID NO: 742162 - DNA, 20 bp, Artificial
  CRISPR gRNA sequence
agagactccagagcagatgg

SEQ ID NO: 742163 - DNA, 20 bp, Artificial
  CRISPR gRNA sequence
gagactccagagcagatgga

SEQ ID NO: 742164 - DNA, 20 bp, Artificial
  CRISPR gRNA sequence
gactccagagcagatggaag

SEQ ID NO: 742165 - DNA, 20 bp, Artificial
  CRISPR gRNA sequence
ctccagagcagatggaagga

SEQ ID NO: 742166 - DNA, 20 bp, Artificial
  CRISPR gRNA sequence
cagagcagatggaaggagag

SEQ ID NO: 742167 - DNA, 20 bp, Artificial
  CRISPR gRNA sequence
agagcagatggaaggagagt

SEQ ID NO: 742168 - DNA, 20 bp, Artificial
  CRISPR gRNA sequence
atggaaggagagtgggcttc

SEQ ID NO: 742169 - DNA, 20 bp, Artificial
  CRISPR gRNA sequence
tggaaggagagtgggcttct

SEQ ID NO: 742170 - DNA, 20 bp, Artificial
  CRISPR gRNA sequence
ggaaggagagtgggcttctg

SEQ ID NO: 742171 - DNA, 20 bp, Artificial
  CRISPR gRNA sequence
gggcttctggggattgcacc

SEQ ID NO: 742172 - DNA, 20 bp, Artificial
  CRISPR gRNA sequence
ggcttctggggattgcacca

SEQ ID NO: 742173 - DNA, 20 bp, Artificial
  CRISPR gRNA sequence
cttctggggattgcaccaag

SEQ ID NO: 742174 - DNA, 20 bp, Artificial
  CRISPR gRNA sequence
ttctggggattgcaccaagg

SEQ ID NO: 742175 - DNA, 20 bp, Artificial
  CRISPR gRNA sequence
tggggattgcaccaaggagg

SEQ ID NO: 742176 - DNA, 20 bp, Artificial
  CRISPR gRNA sequence
ggattgcaccaaggaggaag

SEQ ID NO: 742177 - DNA, 20 bp, Artificial
  CRISPR gRNA sequence
ttgcaccaaggaggaagcag

SEQ ID NO: 742178 - DNA, 20 bp, Artificial
  CRISPR gRNA sequence
tgcaccaaggaggaagcaga

SEQ ID NO: 742179 - DNA, 20 bp, Artificial
  CRISPR gRNA sequence
gcaccaaggaggaagcagaa

SEQ ID NO: 742180 - DNA, 20 bp, Artificial
  CRISPR gRNA sequence
gaggaagcagaagggatgtg

SEQ ID NO: 742181 - DNA, 20 bp, Artificial
  CRISPR gRNA sequence
gaagcagaagggatgtgcag

SEQ ID NO: 742182 - DNA, 20 bp, Artificial
  CRISPR gRNA sequence
gcagaagggatgtgcagcag

SEQ ID NO: 742183 - DNA, 20 bp, Artificial
  CRISPR gRNA sequence
agggatgtgcagcagcagaa

SEQ ID NO: 742184 - DNA, 20 bp, Artificial
  CRISPR gRNA sequence
gggatgtgcagcagcagaaa

SEQ ID NO: 742185 - DNA, 20 bp, Artificial
  CRISPR gRNA sequence
gatgtgcagcagcagaaaag

SEQ ID NO: 742186 - DNA, 20 bp, Artificial
  CRISPR gRNA sequence
atgtgcagcagcagaaaagg

SEQ ID NO: 742187 - DNA, 20 bp, Artificial
  CRISPR gRNA sequence
gtgcagcagcagaaaaggag

SEQ ID NO: 742188 - DNA, 20 bp, Artificial
  CRISPR gRNA sequence
tgcagcagcagaaaaggagg

SEQ ID NO: 742189 - DNA, 20 bp, Artificial
  CRISPR gRNA sequence
cagcagaaaaggaggaggac

SEQ ID NO: 742190 - DNA, 20 bp, Artificial
  CRISPR gRNA sequence
agcagaaaaggaggaggacc

SEQ ID NO: 742191 - DNA, 20 bp, Artificial
  CRISPR gRNA sequence
gcagaaaaggaggaggaccg

SEQ ID NO: 742192 - DNA, 20 bp, Artificial
  CRISPR gRNA sequence
cagaaaaggaggaggaccgg

SEQ ID NO: 742193 - DNA, 20 bp, Artificial
  CRISPR gRNA sequence
agaaaaggaggaggaccggg

SEQ ID NO: 742194 - DNA, 20 bp, Artificial
  CRISPR gRNA sequence
gaggaggaccggggggttct

SEQ ID NO: 742195 - DNA, 20 bp, Artificial
  CRISPR gRNA sequence
aggaggaccggggggttctg

SEQ ID NO: 742196 - DNA, 20 bp, Artificial
  CRISPR gRNA sequence
ggaggaccggggggttctga

SEQ ID NO: 742197 - DNA, 20 bp, Artificial
  CRISPR gRNA sequence
accggggggttctgagggct

SEQ ID NO: 742198 - DNA, 20 bp, Artificial
  CRISPR gRNA sequence
ccggggggttctgagggctt

SEQ ID NO: 742199 - DNA, 20 bp, Artificial
  CRISPR gRNA sequence
cggggggttctgagggcttg

SEQ ID NO: 742200 - DNA, 20 bp, Artificial
  CRISPR gRNA sequence
ttctgagggcttggggtgat

SEQ ID NO: 742201 - DNA, 20 bp, Artificial
  CRISPR gRNA sequence
tctgagggcttggggtgatg

SEQ ID NO: 742202 - DNA, 20 bp, Artificial
  CRISPR gRNA sequence
agggcttggggtgatgaggc

SEQ ID NO: 742203 - DNA, 20 bp, Artificial
  CRISPR gRNA sequence
ggcttggggtgatgaggcca

SEQ ID NO: 742204 - DNA, 20 bp, Artificial
  CRISPR gRNA sequence
gatgaggccagagttccaaa

SEQ ID NO: 742205 - DNA, 20 bp, Artificial
  CRISPR gRNA sequence
atgaggccagagttccaaac

SEQ ID NO: 742206 - DNA, 20 bp, Artificial
  CRISPR gRNA sequence
tgaggccagagttccaaaca

SEQ ID NO: 742207 - DNA, 20 bp, Artificial
  CRISPR gRNA sequence
ccagagttccaaacagggtc

SEQ ID NO: 742208 - DNA, 20 bp, Artificial
  CRISPR gRNA sequence
cagagttccaaacagggtct

SEQ ID NO: 742209 - DNA, 20 bp, Artificial
  CRISPR gRNA sequence
ttccaaacagggtctgggtg

SEQ ID NO: 742210 - DNA, 20 bp, Artificial
  CRISPR gRNA sequence
tccaaacagggtctgggtgc

SEQ ID NO: 742211 - DNA, 20 bp, Artificial
  CRISPR gRNA sequence
acagggtctgggtgcaggat

SEQ ID NO: 742212 - DNA, 20 bp, Artificial
  CRISPR gRNA sequence
cagggtctgggtgcaggatg

SEQ ID NO: 742213 - DNA, 20 bp, Artificial
  CRISPR gRNA sequence
gtctgggtgcaggatgagga

SEQ ID NO: 742214 - DNA, 20 bp, Artificial
  CRISPR gRNA sequence
tgggtgcaggatgaggacag

SEQ ID NO: 742215 - DNA, 20 bp, Artificial
  CRISPR gRNA sequence
aggatgaggacagaagaaaa

SEQ ID NO: 742216 - DNA, 20 bp, Artificial
  CRISPR gRNA sequence
gatgaggacagaagaaaaca

SEQ ID NO: 742217 - DNA, 20 bp, Artificial
  CRISPR gRNA sequence
gaagaaaacagagaacccaa

SEQ ID NO: 742218 - DNA, 20 bp, Artificial
  CRISPR gRNA sequence
aagaaaacagagaacccaaa

SEQ ID NO: 742219 - DNA, 20 bp, Artificial
  CRISPR gRNA sequence
agaaaacagagaacccaaaa

SEQ ID NO: 742220 - DNA, 20 bp, Artificial
  CRISPR gRNA sequence
gaaaacagagaacccaaaag

SEQ ID NO: 742221 - DNA, 20 bp, Artificial
  CRISPR gRNA sequence
acagagaacccaaaaggggc

SEQ ID NO: 742222 - DNA, 20 bp, Artificial
  CRISPR gRNA sequence
agagaacccaaaaggggcaa

SEQ ID NO: 742223 - DNA, 20 bp, Artificial
  CRISPR gRNA sequence
gagaacccaaaaggggcaag

SEQ ID NO: 742224 - DNA, 20 bp, Artificial
  CRISPR gRNA sequence
acccaaaaggggcaagaggt

SEQ ID NO: 742225 - DNA, 20 bp, Artificial
  CRISPR gRNA sequence
gtcccttactttcactatcc

SEQ ID NO: 742226 - DNA, 20 bp, Artificial
  CRISPR gRNA sequence
tcccttactttcactatcct

SEQ ID NO: 742227 - DNA, 20 bp, Artificial
  CRISPR gRNA sequence
ccttactttcactatcctgg

SEQ ID NO: 742228 - DNA, 20 bp, Artificial
  CRISPR gRNA sequence
cttactttcactatcctggg

SEQ ID NO: 742229 - DNA, 20 bp, Artificial
  CRISPR gRNA sequence
tactttcactatcctgggag

SEQ ID NO: 742230 - DNA, 20 bp, Artificial
  CRISPR gRNA sequence
actttcactatcctgggagg

SEQ ID NO: 742231 - DNA, 20 bp, Artificial
  CRISPR gRNA sequence
tcactatcctgggaggagga

SEQ ID NO: 742232 - DNA, 20 bp, Artificial
  CRISPR gRNA sequence
cactatcctgggaggaggat

SEQ ID NO: 742233 - DNA, 20 bp, Artificial
  CRISPR gRNA sequence
aggaggatgggtacaccaca

SEQ ID NO: 742234 - DNA, 20 bp, Artificial
  CRISPR gRNA sequence
ggatgggtacaccacacagt

SEQ ID NO: 742235 - DNA, 20 bp, Artificial
  CRISPR gRNA sequence
gggtacaccacacagttgga

SEQ ID NO: 742236 - DNA, 20 bp, Artificial
  CRISPR gRNA sequence
ggatggtgcatctttgcctg

SEQ ID NO: 742237 - DNA, 20 bp, Artificial
  CRISPR gRNA sequence
gatggtgcatctttgcctgt

SEQ ID NO: 742238 - DNA, 20 bp, Artificial
  CRISPR gRNA sequence
tctttgcctgtgggaacaaa

SEQ ID NO: 742239 - DNA, 20 bp, Artificial
  CRISPR gRNA sequence
ttgcctgtgggaacaaacag

SEQ ID NO: 742240 - DNA, 20 bp, Artificial
  CRISPR gRNA sequence
tgcctgtgggaacaaacaga

SEQ ID NO: 742241 - DNA, 20 bp, Artificial
  CRISPR gRNA sequence
gcctgtgggaacaaacagaa

SEQ ID NO: 742242 - DNA, 20 bp, Artificial
  CRISPR gRNA sequence
ggaacaaacagaagggccat

SEQ ID NO: 742243 - DNA, 20 bp, Artificial
  CRISPR gRNA sequence
gaacaaacagaagggccatt

SEQ ID NO: 742244 - DNA, 20 bp, Artificial
  CRISPR gRNA sequence
caaacagaagggccattagg

SEQ ID NO: 742245 - DNA, 20 bp, Artificial
  CRISPR gRNA sequence
aaacagaagggccattaggt

SEQ ID NO: 742246 - DNA, 20 bp, Artificial
  CRISPR gRNA sequence
aagggccattaggtgggtgt

SEQ ID NO: 742247 - DNA, 20 bp, Artificial
  CRISPR gRNA sequence
agggccattaggtgggtgtc

SEQ ID NO: 742248 - DNA, 20 bp, Artificial
  CRISPR gRNA sequence
cattaggtgggtgtcaggcc

SEQ ID NO: 742249 - DNA, 20 bp, Artificial
  CRISPR gRNA sequence
attaggtgggtgtcaggccc

SEQ ID NO: 742250 - DNA, 20 bp, Artificial
  CRISPR gRNA sequence
taggtgggtgtcaggcccag

SEQ ID NO: 742251 - DNA, 20 bp, Artificial
  CRISPR gRNA sequence
aggtgggtgtcaggcccagg

SEQ ID NO: 742252 - DNA, 20 bp, Artificial
  CRISPR gRNA sequence
gggtgtcaggcccaggaggc

SEQ ID NO: 742253 - DNA, 20 bp, Artificial
  CRISPR gRNA sequence
ggtgtcaggcccaggaggcc

SEQ ID NO: 742254 - DNA, 20 bp, Artificial
  CRISPR gRNA sequence
gtgtcaggcccaggaggcca

SEQ ID NO: 742255 - DNA, 20 bp, Artificial
  CRISPR gRNA sequence
gtcaggcccaggaggccagg

SEQ ID NO: 742256 - DNA, 20 bp, Artificial
  CRISPR gRNA sequence
tcaggcccaggaggccaggg

SEQ ID NO: 742257 - DNA, 20 bp, Artificial
  CRISPR gRNA sequence
ggaggccagggaggcttgtc

SEQ ID NO: 742258 - DNA, 20 bp, Artificial
  CRISPR gRNA sequence
gaggccagggaggcttgtcc

SEQ ID NO: 742259 - DNA, 20 bp, Artificial
  CRISPR gRNA sequence
ccagggaggcttgtccaggc

SEQ ID NO: 742260 - DNA, 20 bp, Artificial
  CRISPR gRNA sequence
ccagtgtccccctcctgccc

SEQ ID NO: 742261 - DNA, 20 bp, Artificial
  CRISPR gRNA sequence
cagtgtccccctcctgcccc

SEQ ID NO: 742262 - DNA, 20 bp, Artificial
  CRISPR gRNA sequence
cctgccccaggttctcacgc

SEQ ID NO: 742263 - DNA, 20 bp, Artificial
  CRISPR gRNA sequence
ttctcacgctagtgcctact

SEQ ID NO: 742264 - DNA, 20 bp, Artificial
  CRISPR gRNA sequence
tcacgctagtgcctactcgg

SEQ ID NO: 742265 - DNA, 20 bp, Artificial
  CRISPR gRNA sequence
tagtgcctactcggcagtgt

SEQ ID NO: 742266 - DNA, 20 bp, Artificial
  CRISPR gRNA sequence
cctactcggcagtgttggcc

SEQ ID NO: 742267 - DNA, 20 bp, Artificial
  CRISPR gRNA sequence
actcggcagtgttggcccag

SEQ ID NO: 742268 - DNA, 20 bp, Artificial
  CRISPR gRNA sequence
cggcagtgttggcccagtgg

SEQ ID NO: 742269 - DNA, 20 bp, Artificial
  CRISPR gRNA sequence
gtgtgcacccacacacaccc

SEQ ID NO: 742270 - DNA, 20 bp, Artificial
  CRISPR gRNA sequence
gcccattttcatgccactcc

SEQ ID NO: 742271 - DNA, 20 bp, Artificial
  CRISPR gRNA sequence
cccattttcatgccactccc

SEQ ID NO: 742272 - DNA, 20 bp, Artificial
  CRISPR gRNA sequence
ccattttcatgccactccca

SEQ ID NO: 742273 - DNA, 20 bp, Artificial
  CRISPR gRNA sequence
cattttcatgccactcccag

SEQ ID NO: 742274 - DNA, 20 bp, Artificial
  CRISPR gRNA sequence
aggggcatgtgaatacccgc

SEQ ID NO: 742275 - DNA, 20 bp, Artificial
  CRISPR gRNA sequence
ccacacctctatccgaacca

SEQ ID NO: 742276 - DNA, 20 bp, Artificial
  CRISPR gRNA sequence
cacacctctatccgaaccat

SEQ ID NO: 742277 - DNA, 20 bp, Artificial
  CRISPR gRNA sequence
cccttgcactctcacctgaa

SEQ ID NO: 742278 - DNA, 20 bp, Artificial
  CRISPR gRNA sequence
tgcactctcacctgaacaga

SEQ ID NO: 742279 - DNA, 20 bp, Artificial
  CRISPR gRNA sequence
cacacgcatatattctccaa

SEQ ID NO: 742280 - DNA, 20 bp, Artificial
  CRISPR gRNA sequence
tatattctccaacagccatt

SEQ ID NO: 742281 - DNA, 20 bp, Artificial
  CRISPR gRNA sequence
cagccattcagccatccact

SEQ ID NO: 742282 - DNA, 20 bp, Artificial
  CRISPR gRNA sequence
ccatccactgagtcatgccc

SEQ ID NO: 742283 - DNA, 20 bp, Artificial
  CRISPR gRNA sequence
catccactgagtcatgcccc

SEQ ID NO: 742284 - DNA, 20 bp, Artificial
  CRISPR gRNA sequence
atccactgagtcatgcccca

SEQ ID NO: 742285 - DNA, 20 bp, Artificial
  CRISPR gRNA sequence
tcatgccccagggcaccaat

SEQ ID NO: 742286 - DNA, 20 bp, Artificial
  CRISPR gRNA sequence
cccactgatgcctataccca

SEQ ID NO: 742287 - DNA, 20 bp, Artificial
  CRISPR gRNA sequence
actgatgcctatacccacag

SEQ ID NO: 742288 - DNA, 20 bp, Artificial
  CRISPR gRNA sequence
agcagccatgatgtcatcat

SEQ ID NO: 742289 - DNA, 20 bp, Artificial
  CRISPR gRNA sequence
agccatgatgtcatcatgag

SEQ ID NO: 742290 - DNA, 20 bp, Artificial
  CRISPR gRNA sequence
atcatgagcagtcacactcc

SEQ ID NO: 742291 - DNA, 20 bp, Artificial
  CRISPR gRNA sequence
gagcagtcacactcccagcc

SEQ ID NO: 742292 - DNA, 20 bp, Artificial
  CRISPR gRNA sequence
agcagtcacactcccagccc

SEQ ID NO: 742293 - DNA, 20 bp, Artificial
  CRISPR gRNA sequence
actcccagcccaggtaccta

SEQ ID NO: 742294 - DNA, 20 bp, Artificial
  CRISPR gRNA sequence
ctacagcctcacacattaaa

SEQ ID NO: 742295 - DNA, 20 bp, Artificial
  CRISPR gRNA sequence
aaaagtctcactgtcacaaa

SEQ ID NO: 742296 - DNA, 20 bp, Artificial
  CRISPR gRNA sequence
aagtctcactgtcacaaatg

SEQ ID NO: 742297 - DNA, 20 bp, Artificial
  CRISPR gRNA sequence
ctcactgtcacaaatggagc

SEQ ID NO: 742298 - DNA, 20 bp, Artificial
  CRISPR gRNA sequence
tcactgtcacaaatggagcc

SEQ ID NO: 742299 - DNA, 20 bp, Artificial
  CRISPR gRNA sequence
accctccctctccatcactc

SEQ ID NO: 742300 - DNA, 20 bp, Artificial
  CRISPR gRNA sequence
catctcacccacacactccc

SEQ ID NO: 742301 - DNA, 20 bp, Artificial
  CRISPR gRNA sequence
tctcacccacacactccctg

SEQ ID NO: 742302 - DNA, 20 bp, Artificial
  CRISPR gRNA sequence
ccacacactccctggagtgc

SEQ ID NO: 742303 - DNA, 20 bp, Artificial
  CRISPR gRNA sequence
gagtgccagtgttacccatg

SEQ ID NO: 742304 - DNA, 20 bp, Artificial
  CRISPR gRNA sequence
atgcagcctcacactctgcc

SEQ ID NO: 742305 - DNA, 20 bp, Artificial
  CRISPR gRNA sequence
gcctcacactctgcccagca

SEQ ID NO: 742306 - DNA, 20 bp, Artificial
  CRISPR gRNA sequence
gcccagcacagtgtcatgaa

SEQ ID NO: 742307 - DNA, 20 bp, Artificial
  CRISPR gRNA sequence
gtcatgaatggtcacaccat

SEQ ID NO: 742308 - DNA, 20 bp, Artificial
  CRISPR gRNA sequence
tgaatggtcacaccatcaga

SEQ ID NO: 742309 - DNA, 20 bp, Artificial
  CRISPR gRNA sequence
gaatggtcacaccatcagac

SEQ ID NO: 742310 - DNA, 20 bp, Artificial
  CRISPR gRNA sequence
tggtcacaccatcagacagg

SEQ ID NO: 742311 - DNA, 20 bp, Artificial
  CRISPR gRNA sequence
aggcagccctccacacacgc

SEQ ID NO: 742312 - DNA, 20 bp, Artificial
  CRISPR gRNA sequence
ggcagccctccacacacgcc

SEQ ID NO: 742313 - DNA, 20 bp, Artificial
  CRISPR gRNA sequence
acacgccaggctgtcacgtg

SEQ ID NO: 742314 - DNA, 20 bp, Artificial
  CRISPR gRNA sequence
cacgccaggctgtcacgtgc

SEQ ID NO: 742315 - DNA, 20 bp, Artificial
  CRISPR gRNA sequence
ccctcacctgtctgcacctg

SEQ ID NO: 742316 - DNA, 20 bp, Artificial
  CRISPR gRNA sequence
tgtctgcacctgcagctcca

SEQ ID NO: 742317 - DNA, 20 bp, Artificial
  CRISPR gRNA sequence
cctgcagctccatggcacca

SEQ ID NO: 742318 - DNA, 20 bp, Artificial
  CRISPR gRNA sequence
caccatggaccctgtgctcc

SEQ ID NO: 742319 - DNA, 20 bp, Artificial
  CRISPR gRNA sequence
catggaccctgtgctccgag

SEQ ID NO: 742320 - DNA, 20 bp, Artificial
  CRISPR gRNA sequence
ggaccctgtgctccgagtgg

SEQ ID NO: 742321 - DNA, 20 bp, Artificial
  CRISPR gRNA sequence
tggtgcctgatctccaccac

SEQ ID NO: 742322 - DNA, 20 bp, Artificial
  CRISPR gRNA sequence
ggtgcctgatctccaccacc

SEQ ID NO: 742323 - DNA, 20 bp, Artificial
  CRISPR gRNA sequence
gcctgatctccaccaccagg

SEQ ID NO: 742324 - DNA, 20 bp, Artificial
  CRISPR gRNA sequence
tgatctccaccaccaggcag

SEQ ID NO: 742325 - DNA, 20 bp, Artificial
  CRISPR gRNA sequence
tctccaccaccaggcagcag

SEQ ID NO: 742326 - DNA, 20 bp, Artificial
  CRISPR gRNA sequence
tccaccaccaggcagcagta

SEQ ID NO: 742327 - DNA, 20 bp, Artificial
  CRISPR gRNA sequence
ccaccaccaggcagcagtag

SEQ ID NO: 742328 - DNA, 20 bp, Artificial
  CRISPR gRNA sequence
cagcagtagaggccgctatc

SEQ ID NO: 742329 - DNA, 20 bp, Artificial
  CRISPR gRNA sequence
cagtagaggccgctatccag

SEQ ID NO: 742330 - DNA, 20 bp, Artificial
  CRISPR gRNA sequence
agtagaggccgctatccagc

SEQ ID NO: 742331 - DNA, 20 bp, Artificial
  CRISPR gRNA sequence
gtagaggccgctatccagca

SEQ ID NO: 742332 - DNA, 20 bp, Artificial
  CRISPR gRNA sequence
aggccgctatccagcagggt

SEQ ID NO: 742333 - DNA, 20 bp, Artificial
  CRISPR gRNA sequence
ggccgctatccagcagggtc

SEQ ID NO: 742334 - DNA, 20 bp, Artificial
  CRISPR gRNA sequence
cagcagggtcaggttgcgca

SEQ ID NO: 742335 - DNA, 20 bp, Artificial
  CRISPR gRNA sequence
ggtcaggttgcgcatggtga

SEQ ID NO: 742336 - DNA, 20 bp, Artificial
  CRISPR gRNA sequence
tcaggttgcgcatggtgatg

SEQ ID NO: 742337 - DNA, 20 bp, Artificial
  CRISPR gRNA sequence
ggttgcgcatggtgatggag

SEQ ID NO: 742338 - DNA, 20 bp, Artificial
  CRISPR gRNA sequence
tggtgatggagaagttgcca

SEQ ID NO: 742339 - DNA, 20 bp, Artificial
  CRISPR gRNA sequence
tgatggagaagttgccatgg

SEQ ID NO: 742340 - DNA, 20 bp, Artificial
  CRISPR gRNA sequence
ggagaagttgccatggtggt

SEQ ID NO: 742341 - DNA, 20 bp, Artificial
  CRISPR gRNA sequence
agaagttgccatggtggtcg

SEQ ID NO: 742342 - DNA, 20 bp, Artificial
  CRISPR gRNA sequence
gaagttgccatggtggtcgg

SEQ ID NO: 742343 - DNA, 20 bp, Artificial
  CRISPR gRNA sequence
tggtggtcggaggccgactc

SEQ ID NO: 742344 - DNA, 20 bp, Artificial
  CRISPR gRNA sequence
cggaggccgactccagcccg

SEQ ID NO: 742345 - DNA, 20 bp, Artificial
  CRISPR gRNA sequence
cgactccagcccgtggcgct

SEQ ID NO: 742346 - DNA, 20 bp, Artificial
  CRISPR gRNA sequence
tccagcccgtggcgctgagc

SEQ ID NO: 742347 - DNA, 20 bp, Artificial
  CRISPR gRNA sequence
ccagcccgtggcgctgagcc

SEQ ID NO: 742348 - DNA, 20 bp, Artificial
  CRISPR gRNA sequence
cgtggcgctgagccaggtcg

SEQ ID NO: 742349 - DNA, 20 bp, Artificial
  CRISPR gRNA sequence
gcgctgagccaggtcgtggc

SEQ ID NO: 742350 - DNA, 20 bp, Artificial
  CRISPR gRNA sequence
agccaggtcgtggctggtgt

SEQ ID NO: 742351 - DNA, 20 bp, Artificial
  CRISPR gRNA sequence
caggtcgtggctggtgttgg

SEQ ID NO: 742352 - DNA, 20 bp, Artificial
  CRISPR gRNA sequence
cgtggctggtgttggcagcc

SEQ ID NO: 742353 - DNA, 20 bp, Artificial
  CRISPR gRNA sequence
ggctggtgttggcagcctgg

SEQ ID NO: 742354 - DNA, 20 bp, Artificial
  CRISPR gRNA sequence
tggcagcctggtggcctcca

SEQ ID NO: 742355 - DNA, 20 bp, Artificial
  CRISPR gRNA sequence
gcctggtggcctccatggtg

SEQ ID NO: 742356 - DNA, 20 bp, Artificial
  CRISPR gRNA sequence
cctggtggcctccatggtgc

SEQ ID NO: 742357 - DNA, 20 bp, Artificial
  CRISPR gRNA sequence
tggcctccatggtgcaggtg

SEQ ID NO: 742358 - DNA, 20 bp, Artificial
  CRISPR gRNA sequence
ggcctccatggtgcaggtga

SEQ ID NO: 742359 - DNA, 20 bp, Artificial
  CRISPR gRNA sequence
catggtgcaggtgaaggtcc

SEQ ID NO: 742360 - DNA, 20 bp, Artificial
  CRISPR gRNA sequence
aggtgaaggtcctggaacgt

SEQ ID NO: 742361 - DNA, 20 bp, Artificial
  CRISPR gRNA sequence
ggtgaaggtcctggaacgtg

SEQ ID NO: 742362 - DNA, 20 bp, Artificial
  CRISPR gRNA sequence
ggtcctggaacgtgaggttg

SEQ ID NO: 742363 - DNA, 20 bp, Artificial
  CRISPR gRNA sequence
ctggaacgtgaggttgcgga

SEQ ID NO: 742364 - DNA, 20 bp, Artificial
  CRISPR gRNA sequence
tggaacgtgaggttgcggat

SEQ ID NO: 742365 - DNA, 20 bp, Artificial
  CRISPR gRNA sequence
acgtgaggttgcggatgggc

SEQ ID NO: 742366 - DNA, 20 bp, Artificial
  CRISPR gRNA sequence
tgcggatgggccggcgctct

SEQ ID NO: 742367 - DNA, 20 bp, Artificial
  CRISPR gRNA sequence
ggatgggccggcgctctgag

SEQ ID NO: 742368 - DNA, 20 bp, Artificial
  CRISPR gRNA sequence
gatgggccggcgctctgagc

SEQ ID NO: 742369 - DNA, 20 bp, Artificial
  CRISPR gRNA sequence
aggtctgcacctcgcccctc

SEQ ID NO: 742370 - DNA, 20 bp, Artificial
  CRISPR gRNA sequence
gcacctcgcccctcgagctg

SEQ ID NO: 742371 - DNA, 20 bp, Artificial
  CRISPR gRNA sequence
agctgcggtaccacgtcttg

SEQ ID NO: 742372 - DNA, 20 bp, Artificial
  CRISPR gRNA sequence
tgcggtaccacgtcttgtag

SEQ ID NO: 742373 - DNA, 20 bp, Artificial
  CRISPR gRNA sequence
gcggtaccacgtcttgtaga

SEQ ID NO: 742374 - DNA, 20 bp, Artificial
  CRISPR gRNA sequence
cacatcgtgccctttgtcca

SEQ ID NO: 742375 - DNA, 20 bp, Artificial
  CRISPR gRNA sequence
acatcgtgccctttgtccac

SEQ ID NO: 742376 - DNA, 20 bp, Artificial
  CRISPR gRNA sequence
catcgtgccctttgtccaca

SEQ ID NO: 742377 - DNA, 20 bp, Artificial
  CRISPR gRNA sequence
gccctttgtccacagggccc

SEQ ID NO: 742378 - DNA, 20 bp, Artificial
  CRISPR gRNA sequence
cctttgtccacagggcccaa

SEQ ID NO: 742379 - DNA, 20 bp, Artificial
  CRISPR gRNA sequence
ccacagggcccaagagcctg

SEQ ID NO: 742380 - DNA, 20 bp, Artificial
  CRISPR gRNA sequence
cacagggcccaagagcctgc

SEQ ID NO: 742381 - DNA, 20 bp, Artificial
  CRISPR gRNA sequence
gggcccaagagcctgcaggt

SEQ ID NO: 742382 - DNA, 20 bp, Artificial
  CRISPR gRNA sequence
ggcccaagagcctgcaggtg

SEQ ID NO: 742383 - DNA, 20 bp, Artificial
  CRISPR gRNA sequence
gcccaagagcctgcaggtga

SEQ ID NO: 742384 - DNA, 20 bp, Artificial
  CRISPR gRNA sequence
gagggtgacgttctgcccct

SEQ ID NO: 742385 - DNA, 20 bp, Artificial
  CRISPR gRNA sequence
agggtgacgttctgcccctc

SEQ ID NO: 742386 - DNA, 20 bp, Artificial
  CRISPR gRNA sequence
tgacgttctgcccctcggga

SEQ ID NO: 742387 - DNA, 20 bp, Artificial
  CRISPR gRNA sequence
tgcccctcgggacagacata

SEQ ID NO: 742388 - DNA, 20 bp, Artificial
  CRISPR gRNA sequence
gcccctcgggacagacatac

SEQ ID NO: 742389 - DNA, 20 bp, Artificial
  CRISPR gRNA sequence
cccctcgggacagacataca

SEQ ID NO: 742390 - DNA, 20 bp, Artificial
  CRISPR gRNA sequence
ggacagacatacagggaata

SEQ ID NO: 742391 - DNA, 20 bp, Artificial
  CRISPR gRNA sequence
gacatacagggaatacggcg

SEQ ID NO: 742392 - DNA, 20 bp, Artificial
  CRISPR gRNA sequence
aatacggcgtggcgaccttg

SEQ ID NO: 742393 - DNA, 20 bp, Artificial
  CRISPR gRNA sequence
atacggcgtggcgaccttga

SEQ ID NO: 742394 - DNA, 20 bp, Artificial
  CRISPR gRNA sequence
gcgaccttgaaggctgccac

SEQ ID NO: 742395 - DNA, 20 bp, Artificial
  CRISPR gRNA sequence
aggctgccaccggacctgct

SEQ ID NO: 742396 - DNA, 20 bp, Artificial
  CRISPR gRNA sequence
gctgccaccggacctgctca

SEQ ID NO: 742397 - DNA, 20 bp, Artificial
  CRISPR gRNA sequence
tgccaccggacctgctcaga

SEQ ID NO: 742398 - DNA, 20 bp, Artificial
  CRISPR gRNA sequence
ccaccggacctgctcagaga

SEQ ID NO: 742399 - DNA, 20 bp, Artificial
  CRISPR gRNA sequence
caccggacctgctcagagag

SEQ ID NO: 742400 - DNA, 20 bp, Artificial
  CRISPR gRNA sequence
ccggacctgctcagagagag

SEQ ID NO: 742401 - DNA, 20 bp, Artificial
  CRISPR gRNA sequence
ggacctgctcagagagagga

SEQ ID NO: 742402 - DNA, 20 bp, Artificial
  CRISPR gRNA sequence
gccctgtcacctgactgatc

SEQ ID NO: 742403 - DNA, 20 bp, Artificial
  CRISPR gRNA sequence
gactgatccagtgctactcc

SEQ ID NO: 742404 - DNA, 20 bp, Artificial
  CRISPR gRNA sequence
agtgctactcctggcaaccc

SEQ ID NO: 742405 - DNA, 20 bp, Artificial
  CRISPR gRNA sequence
tgctactcctggcaacccca

SEQ ID NO: 742406 - DNA, 20 bp, Artificial
  CRISPR gRNA sequence
tactcctggcaaccccagag

SEQ ID NO: 742407 - DNA, 20 bp, Artificial
  CRISPR gRNA sequence
actcctggcaaccccagagc

SEQ ID NO: 742408 - DNA, 20 bp, Artificial
  CRISPR gRNA sequence
ctcctggcaaccccagagcg

SEQ ID NO: 742409 - DNA, 20 bp, Artificial
  CRISPR gRNA sequence
ctggcaaccccagagcgggg

SEQ ID NO: 742410 - DNA, 20 bp, Artificial
  CRISPR gRNA sequence
cccagagcggggaagaacct

SEQ ID NO: 742411 - DNA, 20 bp, Artificial
  CRISPR gRNA sequence
ccttagcctctgctacttcc

SEQ ID NO: 742412 - DNA, 20 bp, Artificial
  CRISPR gRNA sequence
cctctgctacttcccagcca

SEQ ID NO: 742413 - DNA, 20 bp, Artificial
  CRISPR gRNA sequence
ctctgctacttcccagccac

SEQ ID NO: 742414 - DNA, 20 bp, Artificial
  CRISPR gRNA sequence
gctacttcccagccacaggc

SEQ ID NO: 742415 - DNA, 20 bp, Artificial
  CRISPR gRNA sequence
ctacttcccagccacaggcc

SEQ ID NO: 742416 - DNA, 20 bp, Artificial
  CRISPR gRNA sequence
tacttcccagccacaggcca

SEQ ID NO: 742417 - DNA, 20 bp, Artificial
  CRISPR gRNA sequence
acttcccagccacaggccag

SEQ ID NO: 742418 - DNA, 20 bp, Artificial
  CRISPR gRNA sequence
gccacaggccaggggcatgt

SEQ ID NO: 742419 - DNA, 20 bp, Artificial
  CRISPR gRNA sequence
gcatgtcagctgacctccct

SEQ ID NO: 742420 - DNA, 20 bp, Artificial
  CRISPR gRNA sequence
tcacaaaccccactccatcc

SEQ ID NO: 742421 - DNA, 20 bp, Artificial
  CRISPR gRNA sequence
cacaaaccccactccatcct

SEQ ID NO: 742422 - DNA, 20 bp, Artificial
  CRISPR gRNA sequence
cactccatcctaggctgttg

SEQ ID NO: 742423 - DNA, 20 bp, Artificial
  CRISPR gRNA sequence
actccatcctaggctgttgt

SEQ ID NO: 742424 - DNA, 20 bp, Artificial
  CRISPR gRNA sequence
ctccatcctaggctgttgta

SEQ ID NO: 742425 - DNA, 20 bp, Artificial
  CRISPR gRNA sequence
tccatcctaggctgttgtag

SEQ ID NO: 742426 - DNA, 20 bp, Artificial
  CRISPR gRNA sequence
ccatcctaggctgttgtagg

SEQ ID NO: 742427 - DNA, 20 bp, Artificial
  CRISPR gRNA sequence
atcctaggctgttgtagggg

SEQ ID NO: 742428 - DNA, 20 bp, Artificial
  CRISPR gRNA sequence
ggctgttgtagggggagtca

SEQ ID NO: 742429 - DNA, 20 bp, Artificial
  CRISPR gRNA sequence
tgttgtagggggagtcacag

SEQ ID NO: 742430 - DNA, 20 bp, Artificial
  CRISPR gRNA sequence
gtcacagaagcttccccaac

SEQ ID NO: 742431 - DNA, 20 bp, Artificial
  CRISPR gRNA sequence
tcacagaagcttccccaact

SEQ ID NO: 742432 - DNA, 20 bp, Artificial
  CRISPR gRNA sequence
cacagaagcttccccaacta

SEQ ID NO: 742433 - DNA, 20 bp, Artificial
  CRISPR gRNA sequence
acagaagcttccccaactag

SEQ ID NO: 742434 - DNA, 20 bp, Artificial
  CRISPR gRNA sequence
tccccaactaggggtgctcc

SEQ ID NO: 742435 - DNA, 20 bp, Artificial
  CRISPR gRNA sequence
ctaggggtgctcctggatgc

SEQ ID NO: 742436 - DNA, 20 bp, Artificial
  CRISPR gRNA sequence
gggtgctcctggatgctgga

SEQ ID NO: 742437 - DNA, 20 bp, Artificial
  CRISPR gRNA sequence
ggtgctcctggatgctggac

SEQ ID NO: 742438 - DNA, 20 bp, Artificial
  CRISPR gRNA sequence
gtgctcctggatgctggaca

SEQ ID NO: 742439 - DNA, 20 bp, Artificial
  CRISPR gRNA sequence
ctcctggatgctggacaggg

SEQ ID NO: 742440 - DNA, 20 bp, Artificial
  CRISPR gRNA sequence
tcctggatgctggacagggc

SEQ ID NO: 742441 - DNA, 20 bp, Artificial
  CRISPR gRNA sequence
cctggatgctggacagggca

SEQ ID NO: 742442 - DNA, 20 bp, Artificial
  CRISPR gRNA sequence
tggatgctggacagggcagg

SEQ ID NO: 742443 - DNA, 20 bp, Artificial
  CRISPR gRNA sequence
gatgctggacagggcaggga

SEQ ID NO: 742444 - DNA, 20 bp, Artificial
  CRISPR gRNA sequence
ggacagggcagggagagact

SEQ ID NO: 742445 - DNA, 20 bp, Artificial
  CRISPR gRNA sequence
acagggcagggagagacttg

SEQ ID NO: 742446 - DNA, 20 bp, Artificial
  CRISPR gRNA sequence
cagggcagggagagacttgg

SEQ ID NO: 742447 - DNA, 20 bp, Artificial
  CRISPR gRNA sequence
agggcagggagagacttgga

SEQ ID NO: 742448 - DNA, 20 bp, Artificial
  CRISPR gRNA sequence
gcagggagagacttggaggg

SEQ ID NO: 742449 - DNA, 20 bp, Artificial
  CRISPR gRNA sequence
agacttggagggcagtgatg

SEQ ID NO: 742450 - DNA, 20 bp, Artificial
  CRISPR gRNA sequence
ttggagggcagtgatgcagt

SEQ ID NO: 742451 - DNA, 20 bp, Artificial
  CRISPR gRNA sequence
tggagggcagtgatgcagtc

SEQ ID NO: 742452 - DNA, 20 bp, Artificial
  CRISPR gRNA sequence
gtcgggtgtgtccctcttcc

SEQ ID NO: 742453 - DNA, 20 bp, Artificial
  CRISPR gRNA sequence
gggtgtgtccctcttcccag

SEQ ID NO: 742454 - DNA, 20 bp, Artificial
  CRISPR gRNA sequence
gtgtgtccctcttcccagta

SEQ ID NO: 742455 - DNA, 20 bp, Artificial
  CRISPR gRNA sequence
agagtatatgcaaaacctgt

SEQ ID NO: 742456 - DNA, 20 bp, Artificial
  CRISPR gRNA sequence
gagtatatgcaaaacctgtt

SEQ ID NO: 742457 - DNA, 20 bp, Artificial
  CRISPR gRNA sequence
tatatgcaaaacctgttggg

SEQ ID NO: 742458 - DNA, 20 bp, Artificial
  CRISPR gRNA sequence
atatgcaaaacctgttgggt

SEQ ID NO: 742459 - DNA, 20 bp, Artificial
  CRISPR gRNA sequence
atgcaaaacctgttgggtgg

SEQ ID NO: 742460 - DNA, 20 bp, Artificial
  CRISPR gRNA sequence
tgcaaaacctgttgggtggg

SEQ ID NO: 742461 - DNA, 20 bp, Artificial
  CRISPR gRNA sequence
aaaacctgttgggtgggagg

SEQ ID NO: 742462 - DNA, 20 bp, Artificial
  CRISPR gRNA sequence
aaacctgttgggtgggaggc

SEQ ID NO: 742463 - DNA, 20 bp, Artificial
  CRISPR gRNA sequence
ctgttgggtgggaggcaggt

SEQ ID NO: 742464 - DNA, 20 bp, Artificial
  CRISPR gRNA sequence
tgttgggtgggaggcaggtt

SEQ ID NO: 742465 - DNA, 20 bp, Artificial
  CRISPR gRNA sequence
gttgggtgggaggcaggttg

SEQ ID NO: 742466 - DNA, 20 bp, Artificial
  CRISPR gRNA sequence
tgggtgggaggcaggttggg

SEQ ID NO: 742467 - DNA, 20 bp, Artificial
  CRISPR gRNA sequence
gtgggaggcaggttggggag

SEQ ID NO: 742468 - DNA, 20 bp, Artificial
  CRISPR gRNA sequence
tgggaggcaggttggggagc

SEQ ID NO: 742469 - DNA, 20 bp, Artificial
  CRISPR gRNA sequence
gaggcaggttggggagcagg

SEQ ID NO: 742470 - DNA, 20 bp, Artificial
  CRISPR gRNA sequence
aggcaggttggggagcagga

SEQ ID NO: 742471 - DNA, 20 bp, Artificial
  CRISPR gRNA sequence
agcaggaaggctgtttcgaa

SEQ ID NO: 742472 - DNA, 20 bp, Artificial
  CRISPR gRNA sequence
aggaaggctgtttcgaacag

SEQ ID NO: 742473 - DNA, 20 bp, Artificial
  CRISPR gRNA sequence
gaacagcagctccttgtcct

SEQ ID NO: 742474 - DNA, 20 bp, Artificial
  CRISPR gRNA sequence
ccttgtccttggccgctctg

SEQ ID NO: 742475 - DNA, 20 bp, Artificial
  CRISPR gRNA sequence
cttgtccttggccgctctgt

SEQ ID NO: 742476 - DNA, 20 bp, Artificial
  CRISPR gRNA sequence
ttgtccttggccgctctgta

SEQ ID NO: 742477 - DNA, 20 bp, Artificial
  CRISPR gRNA sequence
tgtccttggccgctctgtag

SEQ ID NO: 742478 - DNA, 20 bp, Artificial
  CRISPR gRNA sequence
cctctgccccttcctactcc

SEQ ID NO: 742479 - DNA, 20 bp, Artificial
  CRISPR gRNA sequence
ctctgccccttcctactcct

SEQ ID NO: 742480 - DNA, 20 bp, Artificial
  CRISPR gRNA sequence
acatgccttcccatccttgc

SEQ ID NO: 742481 - DNA, 20 bp, Artificial
  CRISPR gRNA sequence
catgccttcccatccttgcc

SEQ ID NO: 742482 - DNA, 20 bp, Artificial
  CRISPR gRNA sequence
atgccttcccatccttgcca

SEQ ID NO: 742483 - DNA, 20 bp, Artificial
  CRISPR gRNA sequence
gccttcccatccttgccagg

SEQ ID NO: 742484 - DNA, 20 bp, Artificial
  CRISPR gRNA sequence
catccttgccagggagcact

SEQ ID NO: 742485 - DNA, 20 bp, Artificial
  CRISPR gRNA sequence
tccttgccagggagcactaa

SEQ ID NO: 742486 - DNA, 20 bp, Artificial
  CRISPR gRNA sequence
cttgccagggagcactaaga

SEQ ID NO: 742487 - DNA, 20 bp, Artificial
  CRISPR gRNA sequence
aagagagcacctgcgtgtgc

SEQ ID NO: 742488 - DNA, 20 bp, Artificial
  CRISPR gRNA sequence
agagagcacctgcgtgtgca

SEQ ID NO: 742489 - DNA, 20 bp, Artificial
  CRISPR gRNA sequence
gcacctgcgtgtgcaaggcc

SEQ ID NO: 742490 - DNA, 20 bp, Artificial
  CRISPR gRNA sequence
cacctgcgtgtgcaaggcct

SEQ ID NO: 742491 - DNA, 20 bp, Artificial
  CRISPR gRNA sequence
tgcgtgtgcaaggcctgggc

SEQ ID NO: 742492 - DNA, 20 bp, Artificial
  CRISPR gRNA sequence
gcgtgtgcaaggcctgggcc

SEQ ID NO: 742493 - DNA, 20 bp, Artificial
  CRISPR gRNA sequence
tcacctgcatgctgaatgca

SEQ ID NO: 742494 - DNA, 20 bp, Artificial
  CRISPR gRNA sequence
tgaatgcatggcctcccctt

SEQ ID NO: 742495 - DNA, 20 bp, Artificial
  CRISPR gRNA sequence
atgcatggcctccccttgag

SEQ ID NO: 742496 - DNA, 20 bp, Artificial
  CRISPR gRNA sequence
tggcctccccttgagcagac

SEQ ID NO: 742497 - DNA, 20 bp, Artificial
  CRISPR gRNA sequence
ggcctccccttgagcagacg

SEQ ID NO: 742498 - DNA, 20 bp, Artificial
  CRISPR gRNA sequence
gacgaggcctgcattcccga

SEQ ID NO: 742499 - DNA, 20 bp, Artificial
  CRISPR gRNA sequence
gaggcctgcattcccgacag

SEQ ID NO: 742500 - DNA, 20 bp, Artificial
  CRISPR gRNA sequence
ttcccgacagcagaacccca

SEQ ID NO: 742501 - DNA, 20 bp, Artificial
  CRISPR gRNA sequence
gacagcagaaccccatggca

SEQ ID NO: 742502 - DNA, 20 bp, Artificial
  CRISPR gRNA sequence
acagcagaaccccatggcaa

SEQ ID NO: 742503 - DNA, 20 bp, Artificial
  CRISPR gRNA sequence
tggcaaaggcaatccaatgc

SEQ ID NO: 742504 - DNA, 20 bp, Artificial
  CRISPR gRNA sequence
ggcaatccaatgccagccct

SEQ ID NO: 742505 - DNA, 20 bp, Artificial
  CRISPR gRNA sequence
gcaatccaatgccagccctc

SEQ ID NO: 742506 - DNA, 20 bp, Artificial
  CRISPR gRNA sequence
caatccaatgccagccctca

SEQ ID NO: 742507 - DNA, 20 bp, Artificial
  CRISPR gRNA sequence
atgccagccctcagggcact

SEQ ID NO: 742508 - DNA, 20 bp, Artificial
  CRISPR gRNA sequence
gccagccctcagggcacttg

SEQ ID NO: 742509 - DNA, 20 bp, Artificial
  CRISPR gRNA sequence
ccagccctcagggcacttgg

SEQ ID NO: 742510 - DNA, 20 bp, Artificial
  CRISPR gRNA sequence
agccctcagggcacttggag

SEQ ID NO: 742511 - DNA, 20 bp, Artificial
  CRISPR gRNA sequence
gccctcagggcacttggagg

SEQ ID NO: 742512 - DNA, 20 bp, Artificial
  CRISPR gRNA sequence
ccctcagggcacttggagga

SEQ ID NO: 742513 - DNA, 20 bp, Artificial
  CRISPR gRNA sequence
ctcagggcacttggaggagg

SEQ ID NO: 742514 - DNA, 20 bp, Artificial
  CRISPR gRNA sequence
tcagggcacttggaggaggg

SEQ ID NO: 742515 - DNA, 20 bp, Artificial
  CRISPR gRNA sequence
cacttggaggagggaggaaa

SEQ ID NO: 742516 - DNA, 20 bp, Artificial
  CRISPR gRNA sequence
ggagggaggaaacagccttc

SEQ ID NO: 742517 - DNA, 20 bp, Artificial
  CRISPR gRNA sequence
gagggaggaaacagccttct

SEQ ID NO: 742518 - DNA, 20 bp, Artificial
  CRISPR gRNA sequence
agggaggaaacagccttctg

SEQ ID NO: 742519 - DNA, 20 bp, Artificial
  CRISPR gRNA sequence
aggaaacagccttctgggga

SEQ ID NO: 742520 - DNA, 20 bp, Artificial
  CRISPR gRNA sequence
aacagccttctggggacagt

SEQ ID NO: 742521 - DNA, 20 bp, Artificial
  CRISPR gRNA sequence
acagccttctggggacagtc

SEQ ID NO: 742522 - DNA, 20 bp, Artificial
  CRISPR gRNA sequence
cagccttctggggacagtca

SEQ ID NO: 742523 - DNA, 20 bp, Artificial
  CRISPR gRNA sequence
ggacagtcagggacttcctg

SEQ ID NO: 742524 - DNA, 20 bp, Artificial
  CRISPR gRNA sequence
gacagtcagggacttcctga

SEQ ID NO: 742525 - DNA, 20 bp, Artificial
  CRISPR gRNA sequence
cagtcagggacttcctgaag

SEQ ID NO: 742526 - DNA, 20 bp, Artificial
  CRISPR gRNA sequence
agtcagggacttcctgaagg

SEQ ID NO: 742527 - DNA, 20 bp, Artificial
  CRISPR gRNA sequence
gtcagggacttcctgaagga

SEQ ID NO: 742528 - DNA, 20 bp, Artificial
  CRISPR gRNA sequence
cagggacttcctgaaggagg

SEQ ID NO: 742529 - DNA, 20 bp, Artificial
  CRISPR gRNA sequence
gggacttcctgaaggaggga

SEQ ID NO: 742530 - DNA, 20 bp, Artificial
  CRISPR gRNA sequence
cctgaaggagggagagtctt

SEQ ID NO: 742531 - DNA, 20 bp, Artificial
  CRISPR gRNA sequence
ggagggagagtctttggact

SEQ ID NO: 742532 - DNA, 20 bp, Artificial
  CRISPR gRNA sequence
gagtctttggacttggtgca

SEQ ID NO: 742533 - DNA, 20 bp, Artificial
  CRISPR gRNA sequence
ctttggacttggtgcataga

SEQ ID NO: 742534 - DNA, 20 bp, Artificial
  CRISPR gRNA sequence
tttggacttggtgcatagat

SEQ ID NO: 742535 - DNA, 20 bp, Artificial
  CRISPR gRNA sequence
ttggtgcatagataggattt

SEQ ID NO: 742536 - DNA, 20 bp, Artificial
  CRISPR gRNA sequence
tgcatagataggatttcagc

SEQ ID NO: 742537 - DNA, 20 bp, Artificial
  CRISPR gRNA sequence
atagataggatttcagccag

SEQ ID NO: 742538 - DNA, 20 bp, Artificial
  CRISPR gRNA sequence
ataggatttcagccagtaga

SEQ ID NO: 742539 - DNA, 20 bp, Artificial
  CRISPR gRNA sequence
taggatttcagccagtagaa

SEQ ID NO: 742540 - DNA, 20 bp, Artificial
  CRISPR gRNA sequence
aggatttcagccagtagaaa

SEQ ID NO: 742541 - DNA, 20 bp, Artificial
  CRISPR gRNA sequence
agccagtagaaagggtgtcc

SEQ ID NO: 742542 - DNA, 20 bp, Artificial
  CRISPR gRNA sequence
gccagtagaaagggtgtcct

SEQ ID NO: 742543 - DNA, 20 bp, Artificial
  CRISPR gRNA sequence
gtagaaagggtgtcctaggc

SEQ ID NO: 742544 - DNA, 20 bp, Artificial
  CRISPR gRNA sequence
aaagggtgtcctaggcaaga

SEQ ID NO: 742545 - DNA, 20 bp, Artificial
  CRISPR gRNA sequence
taggcaagatagtgtgaaaa

SEQ ID NO: 742546 - DNA, 20 bp, Artificial
  CRISPR gRNA sequence
aggcaagatagtgtgaaaat

SEQ ID NO: 742547 - DNA, 20 bp, Artificial
  CRISPR gRNA sequence
agtgtgaaaatgggaaaacc

SEQ ID NO: 742548 - DNA, 20 bp, Artificial
  CRISPR gRNA sequence
aatgggaaaacccagtgtct

SEQ ID NO: 742549 - DNA, 20 bp, Artificial
  CRISPR gRNA sequence
atgggaaaacccagtgtctg

SEQ ID NO: 742550 - DNA, 20 bp, Artificial
  CRISPR gRNA sequence
tgggaaaacccagtgtctga

SEQ ID NO: 742551 - DNA, 20 bp, Artificial
  CRISPR gRNA sequence
aaacccagtgtctgagggac

SEQ ID NO: 742552 - DNA, 20 bp, Artificial
  CRISPR gRNA sequence
aacccagtgtctgagggacc

SEQ ID NO: 742553 - DNA, 20 bp, Artificial
  CRISPR gRNA sequence
cagtgtctgagggaccggga

SEQ ID NO: 742554 - DNA, 20 bp, Artificial
  CRISPR gRNA sequence
gtgtctgagggaccgggaca

SEQ ID NO: 742555 - DNA, 20 bp, Artificial
  CRISPR gRNA sequence
gtctgagggaccgggacaga

SEQ ID NO: 742556 - DNA, 20 bp, Artificial
  CRISPR gRNA sequence
ccgggacagagagtatatga

SEQ ID NO: 742557 - DNA, 20 bp, Artificial
  CRISPR gRNA sequence
cgggacagagagtatatgaa

SEQ ID NO: 742558 - DNA, 20 bp, Artificial
  CRISPR gRNA sequence
ctcatccatgcacgtccttc

SEQ ID NO: 742559 - DNA, 20 bp, Artificial
  CRISPR gRNA sequence
cacgtccttccagccaaact

SEQ ID NO: 742560 - DNA, 20 bp, Artificial
  CRISPR gRNA sequence
gccaaacttagaaaactgtc

SEQ ID NO: 742561 - DNA, 20 bp, Artificial
  CRISPR gRNA sequence
gaaaactgtctagttctgtt

SEQ ID NO: 742562 - DNA, 20 bp, Artificial
  CRISPR gRNA sequence
tctgtttggtttttttcacc

SEQ ID NO: 742563 - DNA, 20 bp, Artificial
  CRISPR gRNA sequence
tttttttcaccaagcaaatg

SEQ ID NO: 742564 - DNA, 20 bp, Artificial
  CRISPR gRNA sequence
aagcaaatgaagcaattccc

SEQ ID NO: 742565 - DNA, 20 bp, Artificial
  CRISPR gRNA sequence
tttgccttatcccaatcctc

SEQ ID NO: 742566 - DNA, 20 bp, Artificial
  CRISPR gRNA sequence
ccaatcctccagcatttaat

SEQ ID NO: 742567 - DNA, 20 bp, Artificial
  CRISPR gRNA sequence
caatcctccagcatttaatt

SEQ ID NO: 742568 - DNA, 20 bp, Artificial
  CRISPR gRNA sequence
gggttgaccctcaaaaccat

SEQ ID NO: 742569 - DNA, 20 bp, Artificial
  CRISPR gRNA sequence
aaaccatgagcttttgaaaa

SEQ ID NO: 742570 - DNA, 20 bp, Artificial
  CRISPR gRNA sequence
agcttttgaaaacagaatat

SEQ ID NO: 742571 - DNA, 20 bp, Artificial
  CRISPR gRNA sequence
tttgaaaacagaatattgga

SEQ ID NO: 742572 - DNA, 20 bp, Artificial
  CRISPR gRNA sequence
tgaaaacagaatattggata

SEQ ID NO: 742573 - DNA, 20 bp, Artificial
  CRISPR gRNA sequence
gaaaacagaatattggatag

SEQ ID NO: 742574 - DNA, 20 bp, Artificial
  CRISPR gRNA sequence
gcgtttctatctaactgtat

SEQ ID NO: 742575 - DNA, 20 bp, Artificial
  CRISPR gRNA sequence
ctatctaactgtatgagcct

SEQ ID NO: 742576 - DNA, 20 bp, Artificial
  CRISPR gRNA sequence
cctcagtttcctcctctgtg

SEQ ID NO: 742577 - DNA, 20 bp, Artificial
  CRISPR gRNA sequence
agtttcctcctctgtgcagt

SEQ ID NO: 742578 - DNA, 20 bp, Artificial
  CRISPR gRNA sequence
ctgtgcagtgagaaaactat

SEQ ID NO: 742579 - DNA, 20 bp, Artificial
  CRISPR gRNA sequence
gaaaactattggctacaatg

SEQ ID NO: 742580 - DNA, 20 bp, Artificial
  CRISPR gRNA sequence
aaaactattggctacaatgc

SEQ ID NO: 742581 - DNA, 20 bp, Artificial
  CRISPR gRNA sequence
aaactattggctacaatgca

SEQ ID NO: 742582 - DNA, 20 bp, Artificial
  CRISPR gRNA sequence
gctacaatgcagggttgcaa

SEQ ID NO: 742583 - DNA, 20 bp, Artificial
  CRISPR gRNA sequence
ctacaatgcagggttgcaaa

SEQ ID NO: 742584 - DNA, 20 bp, Artificial
  CRISPR gRNA sequence
atgcagggttgcaaaaggac

SEQ ID NO: 742585 - DNA, 20 bp, Artificial
  CRISPR gRNA sequence
gggttgcaaaaggactagat

SEQ ID NO: 742586 - DNA, 20 bp, Artificial
  CRISPR gRNA sequence
ggttgcaaaaggactagatg

SEQ ID NO: 742587 - DNA, 20 bp, Artificial
  CRISPR gRNA sequence
gttgcaaaaggactagatga

SEQ ID NO: 742588 - DNA, 20 bp, Artificial
  CRISPR gRNA sequence
caaaaggactagatgaggga

SEQ ID NO: 742589 - DNA, 20 bp, Artificial
  CRISPR gRNA sequence
ggactagatgagggaaagat

SEQ ID NO: 742590 - DNA, 20 bp, Artificial
  CRISPR gRNA sequence
tgagggaaagatgagaacac

SEQ ID NO: 742591 - DNA, 20 bp, Artificial
  CRISPR gRNA sequence
aagatgagaacacaagatgt

SEQ ID NO: 742592 - DNA, 20 bp, Artificial
  CRISPR gRNA sequence
gtgagctctaatgccctctg

SEQ ID NO: 742593 - DNA, 20 bp, Artificial
  CRISPR gRNA sequence
aatgccctctgcagacatct

SEQ ID NO: 742594 - DNA, 20 bp, Artificial
  CRISPR gRNA sequence
atgccctctgcagacatctg

SEQ ID NO: 742595 - DNA, 20 bp, Artificial
  CRISPR gRNA sequence
tgccctctgcagacatctga

SEQ ID NO: 742596 - DNA, 20 bp, Artificial
  CRISPR gRNA sequence
ctctgcagacatctgaggga

SEQ ID NO: 742597 - DNA, 20 bp, Artificial
  CRISPR gRNA sequence
tagctataattattatgcgt

SEQ ID NO: 742598 - DNA, 20 bp, Artificial
  CRISPR gRNA sequence
ttatttatttatttgttttt

SEQ ID NO: 742599 - DNA, 20 bp, Artificial
  CRISPR gRNA sequence
ttatttatttgtttttgaga

SEQ ID NO: 742600 - DNA, 20 bp, Artificial
  CRISPR gRNA sequence
atttatttgtttttgagacg

SEQ ID NO: 742601 - DNA, 20 bp, Artificial
  CRISPR gRNA sequence
cggagtctccctctgttgcc

SEQ ID NO: 742602 - DNA, 20 bp, Artificial
  CRISPR gRNA sequence
ggagtctccctctgttgccc

SEQ ID NO: 742603 - DNA, 20 bp, Artificial
  CRISPR gRNA sequence
ccaggctgaccttgaactcc

SEQ ID NO: 742604 - DNA, 20 bp, Artificial
  CRISPR gRNA sequence
gaccttgaactcctggcttc

SEQ ID NO: 742605 - DNA, 20 bp, Artificial
  CRISPR gRNA sequence
ttcaagcaattctcctgcct

SEQ ID NO: 742606 - DNA, 20 bp, Artificial
  CRISPR gRNA sequence
tctcctgccttggcctctca

SEQ ID NO: 742607 - DNA, 20 bp, Artificial
  CRISPR gRNA sequence
gccttggcctctcaaagtct

SEQ ID NO: 742608 - DNA, 20 bp, Artificial
  CRISPR gRNA sequence
ccttggcctctcaaagtctt

SEQ ID NO: 742609 - DNA, 20 bp, Artificial
  CRISPR gRNA sequence
tctcaaagtcttgggattac

SEQ ID NO: 742610 - DNA, 20 bp, Artificial
  CRISPR gRNA sequence
caagtgtgacccactacgcc

SEQ ID NO: 742611 - DNA, 20 bp, Artificial
  CRISPR gRNA sequence
tgtgacccactacgcccggc

SEQ ID NO: 742612 - DNA, 20 bp, Artificial
  CRISPR gRNA sequence
gacccactacgcccggccag

SEQ ID NO: 742613 - DNA, 20 bp, Artificial
  CRISPR gRNA sequence
agtggtatttttattttaaa

SEQ ID NO: 742614 - DNA, 20 bp, Artificial
  CRISPR gRNA sequence
ttttattttaaatggcatgt

SEQ ID NO: 742615 - DNA, 20 bp, Artificial
  CRISPR gRNA sequence
tttattttaaatggcatgtc

SEQ ID NO: 742616 - DNA, 20 bp, Artificial
  CRISPR gRNA sequence
aatggcatgtcaggctgttg

SEQ ID NO: 742617 - DNA, 20 bp, Artificial
  CRISPR gRNA sequence
atggcatgtcaggctgttgt

SEQ ID NO: 742618 - DNA, 20 bp, Artificial
  CRISPR gRNA sequence
atgtcaggctgttgtgggtc

SEQ ID NO: 742619 - DNA, 20 bp, Artificial
  CRISPR gRNA sequence
tcaggctgttgtgggtctag

SEQ ID NO: 742620 - DNA, 20 bp, Artificial
  CRISPR gRNA sequence
aggctgttgtgggtctagca

SEQ ID NO: 742621 - DNA, 20 bp, Artificial
  CRISPR gRNA sequence
gctgttgtgggtctagcaga

SEQ ID NO: 742622 - DNA, 20 bp, Artificial
  CRISPR gRNA sequence
ctgttgtgggtctagcagag

SEQ ID NO: 742623 - DNA, 20 bp, Artificial
  CRISPR gRNA sequence
tgttgtgggtctagcagaga

SEQ ID NO: 742624 - DNA, 20 bp, Artificial
  CRISPR gRNA sequence
tgtgggtctagcagagaggg

SEQ ID NO: 742625 - DNA, 20 bp, Artificial
  CRISPR gRNA sequence
gtgggtctagcagagaggga

SEQ ID NO: 742626 - DNA, 20 bp, Artificial
  CRISPR gRNA sequence
gggtctagcagagagggaag

SEQ ID NO: 742627 - DNA, 20 bp, Artificial
  CRISPR gRNA sequence
ggtctagcagagagggaagg

SEQ ID NO: 742628 - DNA, 20 bp, Artificial
  CRISPR gRNA sequence
gtctagcagagagggaagga

SEQ ID NO: 742629 - DNA, 20 bp, Artificial
  CRISPR gRNA sequence
agcagagagggaaggagggt

SEQ ID NO: 742630 - DNA, 20 bp, Artificial
  CRISPR gRNA sequence
aggagggttagaactatgta

SEQ ID NO: 742631 - DNA, 20 bp, Artificial
  CRISPR gRNA sequence
atacatccttttcattgccc

SEQ ID NO: 742632 - DNA, 20 bp, Artificial
  CRISPR gRNA sequence
atccttttcattgccccagc

SEQ ID NO: 742633 - DNA, 20 bp, Artificial
  CRISPR gRNA sequence
tccttttcattgccccagcc

SEQ ID NO: 742634 - DNA, 20 bp, Artificial
  CRISPR gRNA sequence
ccttttcattgccccagcca

SEQ ID NO: 742635 - DNA, 20 bp, Artificial
  CRISPR gRNA sequence
cttttcattgccccagccag

SEQ ID NO: 742636 - DNA, 20 bp, Artificial
  CRISPR gRNA sequence
ccccagccaggggcattgcc

SEQ ID NO: 742637 - DNA, 20 bp, Artificial
  CRISPR gRNA sequence
tataatgccacatcctcctt

SEQ ID NO: 742638 - DNA, 20 bp, Artificial
  CRISPR gRNA sequence
agatgccccttccctgccct

SEQ ID NO: 742639 - DNA, 20 bp, Artificial
  CRISPR gRNA sequence
atgccccttccctgccctta

SEQ ID NO: 742640 - DNA, 20 bp, Artificial
  CRISPR gRNA sequence
ccttccctgcccttagagcc

SEQ ID NO: 742641 - DNA, 20 bp, Artificial
  CRISPR gRNA sequence
cttccctgcccttagagccc

SEQ ID NO: 742642 - DNA, 20 bp, Artificial
  CRISPR gRNA sequence
cccttagagcccaggaccct

SEQ ID NO: 742643 - DNA, 20 bp, Artificial
  CRISPR gRNA sequence
ttagagcccaggaccctcgg

SEQ ID NO: 742644 - DNA, 20 bp, Artificial
  CRISPR gRNA sequence
gagcccaggaccctcggcgg

SEQ ID NO: 742645 - DNA, 20 bp, Artificial
  CRISPR gRNA sequence
agcccaggaccctcggcggc

SEQ ID NO: 742646 - DNA, 20 bp, Artificial
  CRISPR gRNA sequence
caggaccctcggcggcaggc

SEQ ID NO: 742647 - DNA, 20 bp, Artificial
  CRISPR gRNA sequence
aggaccctcggcggcaggct

SEQ ID NO: 742648 - DNA, 20 bp, Artificial
  CRISPR gRNA sequence
ggcggcaggctgggacccac

SEQ ID NO: 742649 - DNA, 20 bp, Artificial
  CRISPR gRNA sequence
ggcaggctgggacccactgg

SEQ ID NO: 742650 - DNA, 20 bp, Artificial
  CRISPR gRNA sequence
caggctgggacccactggaa

SEQ ID NO: 742651 - DNA, 20 bp, Artificial
  CRISPR gRNA sequence
ggacccactggaagagctga

SEQ ID NO: 742652 - DNA, 20 bp, Artificial
  CRISPR gRNA sequence
gaagagctgaaagccttgcc

SEQ ID NO: 742653 - DNA, 20 bp, Artificial
  CRISPR gRNA sequence
agctgaaagccttgcccagc

SEQ ID NO: 742654 - DNA, 20 bp, Artificial
  CRISPR gRNA sequence
gctgaaagccttgcccagcc

SEQ ID NO: 742655 - DNA, 20 bp, Artificial
  CRISPR gRNA sequence
tgaaagccttgcccagccag

SEQ ID NO: 742656 - DNA, 20 bp, Artificial
  CRISPR gRNA sequence
gaaagccttgcccagccagg

SEQ ID NO: 742657 - DNA, 20 bp, Artificial
  CRISPR gRNA sequence
aaagccttgcccagccagga

SEQ ID NO: 742658 - DNA, 20 bp, Artificial
  CRISPR gRNA sequence
agccttgcccagccaggagg

SEQ ID NO: 742659 - DNA, 20 bp, Artificial
  CRISPR gRNA sequence
gccttgcccagccaggaggg

SEQ ID NO: 742660 - DNA, 20 bp, Artificial
  CRISPR gRNA sequence
ttgcccagccaggagggagg

SEQ ID NO: 742661 - DNA, 20 bp, Artificial
  CRISPR gRNA sequence
cagccaggagggaggcagcc

SEQ ID NO: 742662 - DNA, 20 bp, Artificial
  CRISPR gRNA sequence
ccaggagggaggcagcctgg

SEQ ID NO: 742663 - DNA, 20 bp, Artificial
  CRISPR gRNA sequence
caggagggaggcagcctggt

SEQ ID NO: 742664 - DNA, 20 bp, Artificial
  CRISPR gRNA sequence
aggagggaggcagcctggtg

SEQ ID NO: 742665 - DNA, 20 bp, Artificial
  CRISPR gRNA sequence
aggcagcctggtggggcttc

SEQ ID NO: 742666 - DNA, 20 bp, Artificial
  CRISPR gRNA sequence
gcagcctggtggggcttctg

SEQ ID NO: 742667 - DNA, 20 bp, Artificial
  CRISPR gRNA sequence
cctggtggggcttctggagc

SEQ ID NO: 742668 - DNA, 20 bp, Artificial
  CRISPR gRNA sequence
gtggggcttctggagctggc

SEQ ID NO: 742669 - DNA, 20 bp, Artificial
  CRISPR gRNA sequence
tggagctggccagcctgtac

SEQ ID NO: 742670 - DNA, 20 bp, Artificial
  CRISPR gRNA sequence
ctggccagcctgtactggac

SEQ ID NO: 742671 - DNA, 20 bp, Artificial
  CRISPR gRNA sequence
gccagcctgtactggaccag

SEQ ID NO: 742672 - DNA, 20 bp, Artificial
  CRISPR gRNA sequence
tgtactggaccagtagctgt

SEQ ID NO: 742673 - DNA, 20 bp, Artificial
  CRISPR gRNA sequence
accagtagctgtgagccact

SEQ ID NO: 742674 - DNA, 20 bp, Artificial
  CRISPR gRNA sequence
ctgtgagccacttagacgct

SEQ ID NO: 742675 - DNA, 20 bp, Artificial
  CRISPR gRNA sequence
gagccccgactcctcactca

SEQ ID NO: 742676 - DNA, 20 bp, Artificial
  CRISPR gRNA sequence
tcactcacagatgtttttcc

SEQ ID NO: 742677 - DNA, 20 bp, Artificial
  CRISPR gRNA sequence
cagaaatgaaaacatctccc

SEQ ID NO: 742678 - DNA, 20 bp, Artificial
  CRISPR gRNA sequence
aaatgaaaacatctccctgg

SEQ ID NO: 742679 - DNA, 20 bp, Artificial
  CRISPR gRNA sequence
atgaaaacatctccctggca

SEQ ID NO: 742680 - DNA, 20 bp, Artificial
  CRISPR gRNA sequence
aacatctccctggcagagtt

SEQ ID NO: 742681 - DNA, 20 bp, Artificial
  CRISPR gRNA sequence
acatctccctggcagagttg

SEQ ID NO: 742682 - DNA, 20 bp, Artificial
  CRISPR gRNA sequence
ccctggcagagttgaggcaa

SEQ ID NO: 742683 - DNA, 20 bp, Artificial
  CRISPR gRNA sequence
ggcagagttgaggcaacggt

SEQ ID NO: 742684 - DNA, 20 bp, Artificial
  CRISPR gRNA sequence
ggttagtaataattcacatg

SEQ ID NO: 742685 - DNA, 20 bp, Artificial
  CRISPR gRNA sequence
attcacatgaagtgttctgt

SEQ ID NO: 742686 - DNA, 20 bp, Artificial
  CRISPR gRNA sequence
gtgttctgtaagtgccatgc

SEQ ID NO: 742687 - DNA, 20 bp, Artificial
  CRISPR gRNA sequence
ttctgtaagtgccatgcgag

SEQ ID NO: 742688 - DNA, 20 bp, Artificial
  CRISPR gRNA sequence
gtaagtgccatgcgagtagt

SEQ ID NO: 742689 - DNA, 20 bp, Artificial
  CRISPR gRNA sequence
ccatgcgagtagtcggcgct

SEQ ID NO: 742690 - DNA, 20 bp, Artificial
  CRISPR gRNA sequence
agtagtcggcgcttggtact

SEQ ID NO: 742691 - DNA, 20 bp, Artificial
  CRISPR gRNA sequence
gtagtcggcgcttggtactt

SEQ ID NO: 742692 - DNA, 20 bp, Artificial
  CRISPR gRNA sequence
agtcggcgcttggtacttgg

SEQ ID NO: 742693 - DNA, 20 bp, Artificial
  CRISPR gRNA sequence
ggcgcttggtacttgggagc

SEQ ID NO: 742694 - DNA, 20 bp, Artificial
  CRISPR gRNA sequence
cttggtacttgggagctaga

SEQ ID NO: 742695 - DNA, 20 bp, Artificial
  CRISPR gRNA sequence
ttggtacttgggagctagac

SEQ ID NO: 742696 - DNA, 20 bp, Artificial
  CRISPR gRNA sequence
agacaggtctctaattcatt

SEQ ID NO: 742697 - DNA, 20 bp, Artificial
  CRISPR gRNA sequence
aggtctctaattcattcagc

SEQ ID NO: 742698 - DNA, 20 bp, Artificial
  CRISPR gRNA sequence
tctaattcattcagcaagtc

SEQ ID NO: 742699 - DNA, 20 bp, Artificial
  CRISPR gRNA sequence
aattcattcagcaagtcaag

SEQ ID NO: 742700 - DNA, 20 bp, Artificial
  CRISPR gRNA sequence
gcaagtcaagaagtgcctcc

SEQ ID NO: 742701 - DNA, 20 bp, Artificial
  CRISPR gRNA sequence
caagtcaagaagtgcctcct

SEQ ID NO: 742702 - DNA, 20 bp, Artificial
  CRISPR gRNA sequence
agtcaagaagtgcctcctag

SEQ ID NO: 742703 - DNA, 20 bp, Artificial
  CRISPR gRNA sequence
aagaagtgcctcctaggagt

SEQ ID NO: 742704 - DNA, 20 bp, Artificial
  CRISPR gRNA sequence
aagtgcctcctaggagtgag

SEQ ID NO: 742705 - DNA, 20 bp, Artificial
  CRISPR gRNA sequence
cctcctaggagtgagaagca

SEQ ID NO: 742706 - DNA, 20 bp, Artificial
  CRISPR gRNA sequence
cctaggagtgagaagcacag

SEQ ID NO: 742707 - DNA, 20 bp, Artificial
  CRISPR gRNA sequence
ctaggagtgagaagcacagt

SEQ ID NO: 742708 - DNA, 20 bp, Artificial
  CRISPR gRNA sequence
gagtgagaagcacagtggga

SEQ ID NO: 742709 - DNA, 20 bp, Artificial
  CRISPR gRNA sequence
gtgagaagcacagtgggatg

SEQ ID NO: 742710 - DNA, 20 bp, Artificial
  CRISPR gRNA sequence
agaagcacagtgggatggag

SEQ ID NO: 742711 - DNA, 20 bp, Artificial
  CRISPR gRNA sequence
gcacagtgggatggagaagc

SEQ ID NO: 742712 - DNA, 20 bp, Artificial
  CRISPR gRNA sequence
ggatggagaagccagcttta

SEQ ID NO: 742713 - DNA, 20 bp, Artificial
  CRISPR gRNA sequence
gctttaaagtctttcctgct

SEQ ID NO: 742714 - DNA, 20 bp, Artificial
  CRISPR gRNA sequence
ctttaaagtctttcctgcta

SEQ ID NO: 742715 - DNA, 20 bp, Artificial
  CRISPR gRNA sequence
aacaacttgtgatccgatcc

SEQ ID NO: 742716 - DNA, 20 bp, Artificial
  CRISPR gRNA sequence
acaacttgtgatccgatcct

SEQ ID NO: 742717 - DNA, 20 bp, Artificial
  CRISPR gRNA sequence
caacttgtgatccgatcctg

SEQ ID NO: 742718 - DNA, 20 bp, Artificial
  CRISPR gRNA sequence
tcctggggcgcttgtgttta

SEQ ID NO: 742719 - DNA, 20 bp, Artificial
  CRISPR gRNA sequence
cctggggcgcttgtgtttaa

SEQ ID NO: 742720 - DNA, 20 bp, Artificial
  CRISPR gRNA sequence
tggggcgcttgtgtttaaag

SEQ ID NO: 742721 - DNA, 20 bp, Artificial
  CRISPR gRNA sequence
gggcgcttgtgtttaaagga

SEQ ID NO: 742722 - DNA, 20 bp, Artificial
  CRISPR gRNA sequence
tgtttaaaggagagtctcca

SEQ ID NO: 742723 - DNA, 20 bp, Artificial
  CRISPR gRNA sequence
gtttaaaggagagtctccaa

SEQ ID NO: 742724 - DNA, 20 bp, Artificial
  CRISPR gRNA sequence
gagagtctccaaaggcacca

SEQ ID NO: 742725 - DNA, 20 bp, Artificial
  CRISPR gRNA sequence
aaaggcaccaaagccccaaa

SEQ ID NO: 742726 - DNA, 20 bp, Artificial
  CRISPR gRNA sequence
gccccaaacggcatgtctgc

SEQ ID NO: 742727 - DNA, 20 bp, Artificial
  CRISPR gRNA sequence
cccaaacggcatgtctgcaa

SEQ ID NO: 742728 - DNA, 20 bp, Artificial
  CRISPR gRNA sequence
aaacggcatgtctgcaagag

SEQ ID NO: 742729 - DNA, 20 bp, Artificial
  CRISPR gRNA sequence
acggcatgtctgcaagagtg

SEQ ID NO: 742730 - DNA, 20 bp, Artificial
  CRISPR gRNA sequence
tgtctgcaagagtggagttt

SEQ ID NO: 742731 - DNA, 20 bp, Artificial
  CRISPR gRNA sequence
gtctgcaagagtggagtttt

SEQ ID NO: 742732 - DNA, 20 bp, Artificial
  CRISPR gRNA sequence
tgcaagagtggagttttagg

SEQ ID NO: 742733 - DNA, 20 bp, Artificial
  CRISPR gRNA sequence
caagagtggagttttaggca

SEQ ID NO: 742734 - DNA, 20 bp, Artificial
  CRISPR gRNA sequence
agagtggagttttaggcaga

SEQ ID NO: 742735 - DNA, 20 bp, Artificial
  CRISPR gRNA sequence
ggagttttaggcagagagcc

SEQ ID NO: 742736 - DNA, 20 bp, Artificial
  CRISPR gRNA sequence
tttaggcagagagccaagtc

SEQ ID NO: 742737 - DNA, 20 bp, Artificial
  CRISPR gRNA sequence
ttaggcagagagccaagtct

SEQ ID NO: 742738 - DNA, 20 bp, Artificial
  CRISPR gRNA sequence
aggcagagagccaagtctgg

SEQ ID NO: 742739 - DNA, 20 bp, Artificial
  CRISPR gRNA sequence
agagccaagtctgggagccc

SEQ ID NO: 742740 - DNA, 20 bp, Artificial
  CRISPR gRNA sequence
gtctgggagccccagatttt

SEQ ID NO: 742741 - DNA, 20 bp, Artificial
  CRISPR gRNA sequence
ctgggagccccagatttttg

SEQ ID NO: 742742 - DNA, 20 bp, Artificial
  CRISPR gRNA sequence
cagatttttggagtcattgt

SEQ ID NO: 742743 - DNA, 20 bp, Artificial
  CRISPR gRNA sequence
agatttttggagtcattgtc

SEQ ID NO: 742744 - DNA, 20 bp, Artificial
  CRISPR gRNA sequence
gatttttggagtcattgtca

SEQ ID NO: 742745 - DNA, 20 bp, Artificial
  CRISPR gRNA sequence
tttggagtcattgtcagggt

SEQ ID NO: 742746 - DNA, 20 bp, Artificial
  CRISPR gRNA sequence
ggagtcattgtcagggtgag

SEQ ID NO: 742747 - DNA, 20 bp, Artificial
  CRISPR gRNA sequence
agtcattgtcagggtgagca

SEQ ID NO: 742748 - DNA, 20 bp, Artificial
  CRISPR gRNA sequence
gtcagggtgagcagagattt

SEQ ID NO: 742749 - DNA, 20 bp, Artificial
  CRISPR gRNA sequence
cagagatttcagaacttctt

SEQ ID NO: 742750 - DNA, 20 bp, Artificial
  CRISPR gRNA sequence
gatttcagaacttctttggc

SEQ ID NO: 742751 - DNA, 20 bp, Artificial
  CRISPR gRNA sequence
agaacttctttggcaagata

SEQ ID NO: 742752 - DNA, 20 bp, Artificial
  CRISPR gRNA sequence
gaacttctttggcaagatac

SEQ ID NO: 742753 - DNA, 20 bp, Artificial
  CRISPR gRNA sequence
caagatacaggtctcctttt

SEQ ID NO: 742754 - DNA, 20 bp, Artificial
  CRISPR gRNA sequence
aagatacaggtctccttttc

SEQ ID NO: 742755 - DNA, 20 bp, Artificial
  CRISPR gRNA sequence
atacaggtctccttttcagg

SEQ ID NO: 742756 - DNA, 20 bp, Artificial
  CRISPR gRNA sequence
ctccttttcaggcagaaaca

SEQ ID NO: 742757 - DNA, 20 bp, Artificial
  CRISPR gRNA sequence
ccttttcaggcagaaacaca

SEQ ID NO: 742758 - DNA, 20 bp, Artificial
  CRISPR gRNA sequence
caggcagaaacacagagacc

SEQ ID NO: 742759 - DNA, 20 bp, Artificial
  CRISPR gRNA sequence
cagaaacacagagacccaga

SEQ ID NO: 742760 - DNA, 20 bp, Artificial
  CRISPR gRNA sequence
agaaacacagagacccagaa

SEQ ID NO: 742761 - DNA, 20 bp, Artificial
  CRISPR gRNA sequence
gaaacacagagacccagaaa

SEQ ID NO: 742762 - DNA, 20 bp, Artificial
  CRISPR gRNA sequence
cacagagacccagaaaggga

SEQ ID NO: 742763 - DNA, 20 bp, Artificial
  CRISPR gRNA sequence
agagacccagaaagggaaag

SEQ ID NO: 742764 - DNA, 20 bp, Artificial
  CRISPR gRNA sequence
acccagaaagggaaagtggt

SEQ ID NO: 742765 - DNA, 20 bp, Artificial
  CRISPR gRNA sequence
aagggaaagtggttggactg

SEQ ID NO: 742766 - DNA, 20 bp, Artificial
  CRISPR gRNA sequence
gtggttggactgaagttcca

SEQ ID NO: 742767 - DNA, 20 bp, Artificial
  CRISPR gRNA sequence
ggactgaagttccaaagttc

SEQ ID NO: 742768 - DNA, 20 bp, Artificial
  CRISPR gRNA sequence
actgaagttccaaagttcca

SEQ ID NO: 742769 - DNA, 20 bp, Artificial
  CRISPR gRNA sequence
ctgaagttccaaagttccag

SEQ ID NO: 742770 - DNA, 20 bp, Artificial
  CRISPR gRNA sequence
tgaagttccaaagttccaga

SEQ ID NO: 742771 - DNA, 20 bp, Artificial
  CRISPR gRNA sequence
ttccagagggtatgatctca

SEQ ID NO: 742772 - DNA, 20 bp, Artificial
  CRISPR gRNA sequence
gagggtatgatctcaaagcc

SEQ ID NO: 742773 - DNA, 20 bp, Artificial
  CRISPR gRNA sequence
gggtatgatctcaaagcctg

SEQ ID NO: 742774 - DNA, 20 bp, Artificial
  CRISPR gRNA sequence
tgatctcaaagcctggagca

SEQ ID NO: 742775 - DNA, 20 bp, Artificial
  CRISPR gRNA sequence
gatctcaaagcctggagcat

SEQ ID NO: 742776 - DNA, 20 bp, Artificial
  CRISPR gRNA sequence
atctcaaagcctggagcatg

SEQ ID NO: 742777 - DNA, 20 bp, Artificial
  CRISPR gRNA sequence
tctcaaagcctggagcatgg

SEQ ID NO: 742778 - DNA, 20 bp, Artificial
  CRISPR gRNA sequence
gcctggagcatgggggactt

SEQ ID NO: 742779 - DNA, 20 bp, Artificial
  CRISPR gRNA sequence
cctggagcatgggggacttc

SEQ ID NO: 742780 - DNA, 20 bp, Artificial
  CRISPR gRNA sequence
atgggggacttcaggtaacg

SEQ ID NO: 742781 - DNA, 20 bp, Artificial
  CRISPR gRNA sequence
tgggggacttcaggtaacgc

SEQ ID NO: 742782 - DNA, 20 bp, Artificial
  CRISPR gRNA sequence
acttcaggtaacgcaggatc

SEQ ID NO: 742783 - DNA, 20 bp, Artificial
  CRISPR gRNA sequence
cttcaggtaacgcaggatct

SEQ ID NO: 742784 - DNA, 20 bp, Artificial
  CRISPR gRNA sequence
caggtaacgcaggatctagg

SEQ ID NO: 742785 - DNA, 20 bp, Artificial
  CRISPR gRNA sequence
gatctaggcagaaccgtaat

SEQ ID NO: 742786 - DNA, 20 bp, Artificial
  CRISPR gRNA sequence
ctaggcagaaccgtaataag

SEQ ID NO: 742787 - DNA, 20 bp, Artificial
  CRISPR gRNA sequence
agaaccgtaataagaagaca

SEQ ID NO: 742788 - DNA, 20 bp, Artificial
  CRISPR gRNA sequence
catgtgttgtgcactacgct

SEQ ID NO: 742789 - DNA, 20 bp, Artificial
  CRISPR gRNA sequence
atgtgttgtgcactacgcta

SEQ ID NO: 742790 - DNA, 20 bp, Artificial
  CRISPR gRNA sequence
tgtgttgtgcactacgctaa

SEQ ID NO: 742791 - DNA, 20 bp, Artificial
  CRISPR gRNA sequence
gcactacgctaagggtttca

SEQ ID NO: 742792 - DNA, 20 bp, Artificial
  CRISPR gRNA sequence
cactacgctaagggtttcat

SEQ ID NO: 742793 - DNA, 20 bp, Artificial
  CRISPR gRNA sequence
ggcatatctaacaatgccat

SEQ ID NO: 742794 - DNA, 20 bp, Artificial
  CRISPR gRNA sequence
gcatatctaacaatgccata

SEQ ID NO: 742795 - DNA, 20 bp, Artificial
  CRISPR gRNA sequence
ttattcccattgcactgatg

SEQ ID NO: 742796 - DNA, 20 bp, Artificial
  CRISPR gRNA sequence
attgcactgatgaagaaact

SEQ ID NO: 742797 - DNA, 20 bp, Artificial
  CRISPR gRNA sequence
ttgcactgatgaagaaacta

SEQ ID NO: 742798 - DNA, 20 bp, Artificial
  CRISPR gRNA sequence
ctgatgaagaaactaaggca

SEQ ID NO: 742799 - DNA, 20 bp, Artificial
  CRISPR gRNA sequence
gatgaagaaactaaggcaca

SEQ ID NO: 742800 - DNA, 20 bp, Artificial
  CRISPR gRNA sequence
gtaactcactgatgatcaca

SEQ ID NO: 742801 - DNA, 20 bp, Artificial
  CRISPR gRNA sequence
ctcactgatgatcacacagc

SEQ ID NO: 742802 - DNA, 20 bp, Artificial
  CRISPR gRNA sequence
ctgatgatcacacagcaagc

SEQ ID NO: 742803 - DNA, 20 bp, Artificial
  CRISPR gRNA sequence
atcacacagcaagcaagtgc

SEQ ID NO: 742804 - DNA, 20 bp, Artificial
  CRISPR gRNA sequence
cacacagcaagcaagtgcta

SEQ ID NO: 742805 - DNA, 20 bp, Artificial
  CRISPR gRNA sequence
cagcaagcaagtgctagagc

SEQ ID NO: 742806 - DNA, 20 bp, Artificial
  CRISPR gRNA sequence
gctagagctagaattaaact

SEQ ID NO: 742807 - DNA, 20 bp, Artificial
  CRISPR gRNA sequence
tagaattaaactcagacaca

SEQ ID NO: 742808 - DNA, 20 bp, Artificial
  CRISPR gRNA sequence
acactatactgatgaaaaaa

SEQ ID NO: 742809 - DNA, 20 bp, Artificial
  CRISPR gRNA sequence
cactatactgatgaaaaaaa

SEQ ID NO: 742810 - DNA, 20 bp, Artificial
  CRISPR gRNA sequence
atactgatgaaaaaaaaggc

SEQ ID NO: 742811 - DNA, 20 bp, Artificial
  CRISPR gRNA sequence
tgaaaaaaaaggccagaaac

SEQ ID NO: 742812 - DNA, 20 bp, Artificial
  CRISPR gRNA sequence
gaaaaaaaaggccagaaact

SEQ ID NO: 742813 - DNA, 20 bp, Artificial
  CRISPR gRNA sequence
aaaaaaaggccagaaactgg

SEQ ID NO: 742814 - DNA, 20 bp, Artificial
  CRISPR gRNA sequence
ggccagaaactgggagccca

SEQ ID NO: 742815 - DNA, 20 bp, Artificial
  CRISPR gRNA sequence
gccagaaactgggagcccac

SEQ ID NO: 742816 - DNA, 20 bp, Artificial
  CRISPR gRNA sequence
gggagcccacaggccacatc

SEQ ID NO: 742817 - DNA, 20 bp, Artificial
  CRISPR gRNA sequence
agccttcacacatatttcat

SEQ ID NO: 742818 - DNA, 20 bp, Artificial
  CRISPR gRNA sequence
aaaatctttttaattttctt

SEQ ID NO: 742819 - DNA, 20 bp, Artificial
  CRISPR gRNA sequence
tctttttaattttcttgaga

SEQ ID NO: 742820 - DNA, 20 bp, Artificial
  CRISPR gRNA sequence
agatggcaacatttaaaaac

SEQ ID NO: 742821 - DNA, 20 bp, Artificial
  CRISPR gRNA sequence
gatggcaacatttaaaaacc

SEQ ID NO: 742822 - DNA, 20 bp, Artificial
  CRISPR gRNA sequence
gacatgaaaattctgacttc

SEQ ID NO: 742823 - DNA, 20 bp, Artificial
  CRISPR gRNA sequence
ttctgacttccagctctcct

SEQ ID NO: 742824 - DNA, 20 bp, Artificial
  CRISPR gRNA sequence
tccagctctccttagaaaat

SEQ ID NO: 742825 - DNA, 20 bp, Artificial
  CRISPR gRNA sequence
agctctccttagaaaatcag

SEQ ID NO: 742826 - DNA, 20 bp, Artificial
  CRISPR gRNA sequence
atcagaagataatgctaaac

SEQ ID NO: 742827 - DNA, 20 bp, Artificial
  CRISPR gRNA sequence
atgctaaaccagctttccca

SEQ ID NO: 742828 - DNA, 20 bp, Artificial
  CRISPR gRNA sequence
tgctaaaccagctttcccac

SEQ ID NO: 742829 - DNA, 20 bp, Artificial
  CRISPR gRNA sequence
gctaaaccagctttcccaca

SEQ ID NO: 742830 - DNA, 20 bp, Artificial
  CRISPR gRNA sequence
ctttcccacagggcaactgt

SEQ ID NO: 742831 - DNA, 20 bp, Artificial
  CRISPR gRNA sequence
cccacagggcaactgtcagc

SEQ ID NO: 742832 - DNA, 20 bp, Artificial
  CRISPR gRNA sequence
ccacagggcaactgtcagct

SEQ ID NO: 742833 - DNA, 20 bp, Artificial
  CRISPR gRNA sequence
cacagggcaactgtcagctg

SEQ ID NO: 742834 - DNA, 20 bp, Artificial
  CRISPR gRNA sequence
ggcaactgtcagctggggct

SEQ ID NO: 742835 - DNA, 20 bp, Artificial
  CRISPR gRNA sequence
aactgtcagctggggctcag

SEQ ID NO: 742836 - DNA, 20 bp, Artificial
  CRISPR gRNA sequence
tgtcagctggggctcagtag

SEQ ID NO: 742837 - DNA, 20 bp, Artificial
  CRISPR gRNA sequence
tggggctcagtagcagcttt

SEQ ID NO: 742838 - DNA, 20 bp, Artificial
  CRISPR gRNA sequence
ggggctcagtagcagctttt

SEQ ID NO: 742839 - DNA, 20 bp, Artificial
  CRISPR gRNA sequence
gggctcagtagcagcttttg

SEQ ID NO: 742840 - DNA, 20 bp, Artificial
  CRISPR gRNA sequence
ggctcagtagcagcttttgg

SEQ ID NO: 742841 - DNA, 20 bp, Artificial
  CRISPR gRNA sequence
gctcagtagcagcttttggg

SEQ ID NO: 742842 - DNA, 20 bp, Artificial
  CRISPR gRNA sequence
tagcagcttttggggggcac

SEQ ID NO: 742843 - DNA, 20 bp, Artificial
  CRISPR gRNA sequence
tttggggggcaccggcactc

SEQ ID NO: 742844 - DNA, 20 bp, Artificial
  CRISPR gRNA sequence
gcaccggcactccagttcgc

SEQ ID NO: 742845 - DNA, 20 bp, Artificial
  CRISPR gRNA sequence
accggcactccagttcgcca

SEQ ID NO: 742846 - DNA, 20 bp, Artificial
  CRISPR gRNA sequence
tactccctaataattccacc

SEQ ID NO: 742847 - DNA, 20 bp, Artificial
  CRISPR gRNA sequence
cctgcttcactctctcaccg

SEQ ID NO: 742848 - DNA, 20 bp, Artificial
  CRISPR gRNA sequence
actctctcaccgtggtttct

SEQ ID NO: 742849 - DNA, 20 bp, Artificial
  CRISPR gRNA sequence
accgtggtttcttggtcctg

SEQ ID NO: 742850 - DNA, 20 bp, Artificial
  CRISPR gRNA sequence
tcttggtcctgtggacattt

SEQ ID NO: 742851 - DNA, 20 bp, Artificial
  CRISPR gRNA sequence
catttgagtttgtgatgaat

SEQ ID NO: 742852 - DNA, 20 bp, Artificial
  CRISPR gRNA sequence
gagtttgtgatgaatgagtg

SEQ ID NO: 742853 - DNA, 20 bp, Artificial
  CRISPR gRNA sequence
gatgaatgagtgtggcttct

SEQ ID NO: 742854 - DNA, 20 bp, Artificial
  CRISPR gRNA sequence
atgaatgagtgtggcttctt

SEQ ID NO: 742855 - DNA, 20 bp, Artificial
  CRISPR gRNA sequence
atgagtgtggcttcttgggc

SEQ ID NO: 742856 - DNA, 20 bp, Artificial
  CRISPR gRNA sequence
gtgtggcttcttgggctagc

SEQ ID NO: 742857 - DNA, 20 bp, Artificial
  CRISPR gRNA sequence
gcttcttgggctagctggca

SEQ ID NO: 742858 - DNA, 20 bp, Artificial
  CRISPR gRNA sequence
cttcttgggctagctggcat

SEQ ID NO: 742859 - DNA, 20 bp, Artificial
  CRISPR gRNA sequence
tatgctacaaatctgaccca

SEQ ID NO: 742860 - DNA, 20 bp, Artificial
  CRISPR gRNA sequence
caaatctgacccacagactc

SEQ ID NO: 742861 - DNA, 20 bp, Artificial
  CRISPR gRNA sequence
aatctgacccacagactcaa

SEQ ID NO: 742862 - DNA, 20 bp, Artificial
  CRISPR gRNA sequence
tctgacccacagactcaaga

SEQ ID NO: 742863 - DNA, 20 bp, Artificial
  CRISPR gRNA sequence
ctgacccacagactcaagag

SEQ ID NO: 742864 - DNA, 20 bp, Artificial
  CRISPR gRNA sequence
gacccacagactcaagagag

SEQ ID NO: 742865 - DNA, 20 bp, Artificial
  CRISPR gRNA sequence
aagagaggagatgatccacc

SEQ ID NO: 742866 - DNA, 20 bp, Artificial
  CRISPR gRNA sequence
agagaggagatgatccaccc

SEQ ID NO: 742867 - DNA, 20 bp, Artificial
  CRISPR gRNA sequence
gagaggagatgatccaccca

SEQ ID NO: 742868 - DNA, 20 bp, Artificial
  CRISPR gRNA sequence
gatgatccacccagggtccc

SEQ ID NO: 742869 - DNA, 20 bp, Artificial
  CRISPR gRNA sequence
atgatccacccagggtcccc

SEQ ID NO: 742870 - DNA, 20 bp, Artificial
  CRISPR gRNA sequence
tgatccacccagggtcccca

SEQ ID NO: 742871 - DNA, 20 bp, Artificial
  CRISPR gRNA sequence
ccacccagggtccccaggga

SEQ ID NO: 742872 - DNA, 20 bp, Artificial
  CRISPR gRNA sequence
cagggtccccagggaaagcc

SEQ ID NO: 742873 - DNA, 20 bp, Artificial
  CRISPR gRNA sequence
ggtccccagggaaagcctgg

SEQ ID NO: 742874 - DNA, 20 bp, Artificial
  CRISPR gRNA sequence
ccagggaaagcctggcagtg

SEQ ID NO: 742875 - DNA, 20 bp, Artificial
  CRISPR gRNA sequence
cagggaaagcctggcagtgc

SEQ ID NO: 742876 - DNA, 20 bp, Artificial
  CRISPR gRNA sequence
agggaaagcctggcagtgca

SEQ ID NO: 742877 - DNA, 20 bp, Artificial
  CRISPR gRNA sequence
aagcctggcagtgcagggac

SEQ ID NO: 742878 - DNA, 20 bp, Artificial
  CRISPR gRNA sequence
acccactgcccttacccctg

SEQ ID NO: 742879 - DNA, 20 bp, Artificial
  CRISPR gRNA sequence
cactgcccttacccctgcag

SEQ ID NO: 742880 - DNA, 20 bp, Artificial
  CRISPR gRNA sequence
actgcccttacccctgcagc

SEQ ID NO: 742881 - DNA, 20 bp, Artificial
  CRISPR gRNA sequence
ccttacccctgcagcaggct

SEQ ID NO: 742882 - DNA, 20 bp, Artificial
  CRISPR gRNA sequence
tacccctgcagcaggctcag

SEQ ID NO: 742883 - DNA, 20 bp, Artificial
  CRISPR gRNA sequence
ctgcagcaggctcagtggaa

SEQ ID NO: 742884 - DNA, 20 bp, Artificial
  CRISPR gRNA sequence
tgcagcaggctcagtggaaa

SEQ ID NO: 742885 - DNA, 20 bp, Artificial
  CRISPR gRNA sequence
cagcaggctcagtggaaaag

SEQ ID NO: 742886 - DNA, 20 bp, Artificial
  CRISPR gRNA sequence
gctcagtggaaaaggagccc

SEQ ID NO: 742887 - DNA, 20 bp, Artificial
  CRISPR gRNA sequence
ctcagtggaaaaggagcccc

SEQ ID NO: 742888 - DNA, 20 bp, Artificial
  CRISPR gRNA sequence
agtggaaaaggagccccagg

SEQ ID NO: 742889 - DNA, 20 bp, Artificial
  CRISPR gRNA sequence
aaaaggagccccaggaagct

SEQ ID NO: 742890 - DNA, 20 bp, Artificial
  CRISPR gRNA sequence
aggaagcttggctgtgcccc

SEQ ID NO: 742891 - DNA, 20 bp, Artificial
  CRISPR gRNA sequence
gcccctggttttgtccgtgc

SEQ ID NO: 742892 - DNA, 20 bp, Artificial
  CRISPR gRNA sequence
tggttttgtccgtgctggcc

SEQ ID NO: 742893 - DNA, 20 bp, Artificial
  CRISPR gRNA sequence
tggacttccccttcacacct

SEQ ID NO: 742894 - DNA, 20 bp, Artificial
  CRISPR gRNA sequence
acttccccttcacacctgag

SEQ ID NO: 742895 - DNA, 20 bp, Artificial
  CRISPR gRNA sequence
cttccccttcacacctgagt

SEQ ID NO: 742896 - DNA, 20 bp, Artificial
  CRISPR gRNA sequence
ttccccttcacacctgagtg

SEQ ID NO: 742897 - DNA, 20 bp, Artificial
  CRISPR gRNA sequence
cccttcacacctgagtgggg

SEQ ID NO: 742898 - DNA, 20 bp, Artificial
  CRISPR gRNA sequence
ccttcacacctgagtggggt

SEQ ID NO: 742899 - DNA, 20 bp, Artificial
  CRISPR gRNA sequence
acacctgagtggggtgggtg

SEQ ID NO: 742900 - DNA, 20 bp, Artificial
  CRISPR gRNA sequence
tgggtgtagctgcaaaacta

SEQ ID NO: 742901 - DNA, 20 bp, Artificial
  CRISPR gRNA sequence
ctgcaaaactatggctctgc

SEQ ID NO: 742902 - DNA, 20 bp, Artificial
  CRISPR gRNA sequence
tgcaaaactatggctctgcc

SEQ ID NO: 742903 - DNA, 20 bp, Artificial
  CRISPR gRNA sequence
actatggctctgccgggaaa

SEQ ID NO: 742904 - DNA, 20 bp, Artificial
  CRISPR gRNA sequence
atggctctgccgggaaacag

SEQ ID NO: 742905 - DNA, 20 bp, Artificial
  CRISPR gRNA sequence
ctctgccgggaaacagaagt

SEQ ID NO: 742906 - DNA, 20 bp, Artificial
  CRISPR gRNA sequence
tctgccgggaaacagaagtg

SEQ ID NO: 742907 - DNA, 20 bp, Artificial
  CRISPR gRNA sequence
tgccgggaaacagaagtgag

SEQ ID NO: 742908 - DNA, 20 bp, Artificial
  CRISPR gRNA sequence
gccgggaaacagaagtgagg

SEQ ID NO: 742909 - DNA, 20 bp, Artificial
  CRISPR gRNA sequence
aaacagaagtgaggaggacc

SEQ ID NO: 742910 - DNA, 20 bp, Artificial
  CRISPR gRNA sequence
aacagaagtgaggaggacct

SEQ ID NO: 742911 - DNA, 20 bp, Artificial
  CRISPR gRNA sequence
acagaagtgaggaggaccta

SEQ ID NO: 742912 - DNA, 20 bp, Artificial
  CRISPR gRNA sequence
aagtgaggaggacctaggga

SEQ ID NO: 742913 - DNA, 20 bp, Artificial
  CRISPR gRNA sequence
agtgaggaggacctagggaa

SEQ ID NO: 742914 - DNA, 20 bp, Artificial
  CRISPR gRNA sequence
gtgaggaggacctagggaaa

SEQ ID NO: 742915 - DNA, 20 bp, Artificial
  CRISPR gRNA sequence
agggctctcccacgtactcc

SEQ ID NO: 742916 - DNA, 20 bp, Artificial
  CRISPR gRNA sequence
gggctctcccacgtactccc

SEQ ID NO: 742917 - DNA, 20 bp, Artificial
  CRISPR gRNA sequence
ctctcccacgtactcccagg

SEQ ID NO: 742918 - DNA, 20 bp, Artificial
  CRISPR gRNA sequence
gaagaaacaaaacctgcccc

SEQ ID NO: 742919 - DNA, 20 bp, Artificial
  CRISPR gRNA sequence
aagaaacaaaacctgcccca

SEQ ID NO: 742920 - DNA, 20 bp, Artificial
  CRISPR gRNA sequence
agaaacaaaacctgccccaa

SEQ ID NO: 742921 - DNA, 20 bp, Artificial
  CRISPR gRNA sequence
gaaacaaaacctgccccaag

SEQ ID NO: 742922 - DNA, 20 bp, Artificial
  CRISPR gRNA sequence
aaacaaaacctgccccaagg

SEQ ID NO: 742923 - DNA, 20 bp, Artificial
  CRISPR gRNA sequence
ccctgtgctgcccccttccc

SEQ ID NO: 742924 - DNA, 20 bp, Artificial
  CRISPR gRNA sequence
tgtgctgcccccttccccag

SEQ ID NO: 742925 - DNA, 20 bp, Artificial
  CRISPR gRNA sequence
gtgctgcccccttccccagc

SEQ ID NO: 742926 - DNA, 20 bp, Artificial
  CRISPR gRNA sequence
cccttccccagcaggccatg

SEQ ID NO: 742927 - DNA, 20 bp, Artificial
  CRISPR gRNA sequence
ttccccagcaggccatgtgg

SEQ ID NO: 742928 - DNA, 20 bp, Artificial
  CRISPR gRNA sequence
tccccagcaggccatgtggc

SEQ ID NO: 742929 - DNA, 20 bp, Artificial
  CRISPR gRNA sequence
ggccatgtggcaggtcccac

SEQ ID NO: 742930 - DNA, 20 bp, Artificial
  CRISPR gRNA sequence
ggtcccaccagcacctctcc

SEQ ID NO: 742931 - DNA, 20 bp, Artificial
  CRISPR gRNA sequence
cctgacatcacctcctaccc

SEQ ID NO: 742932 - DNA, 20 bp, Artificial
  CRISPR gRNA sequence
tgacatcacctcctacccca

SEQ ID NO: 742933 - DNA, 20 bp, Artificial
  CRISPR gRNA sequence
ctcctaccccagagccaccc

SEQ ID NO: 742934 - DNA, 20 bp, Artificial
  CRISPR gRNA sequence
tcctaccccagagccacccc

SEQ ID NO: 742935 - DNA, 20 bp, Artificial
  CRISPR gRNA sequence
cctaccccagagccacccca

SEQ ID NO: 742936 - DNA, 20 bp, Artificial
  CRISPR gRNA sequence
ccccagagccaccccagggc

SEQ ID NO: 742937 - DNA, 20 bp, Artificial
  CRISPR gRNA sequence
cccagagccaccccagggct

SEQ ID NO: 742938 - DNA, 20 bp, Artificial
  CRISPR gRNA sequence
cagagccaccccagggctgg

SEQ ID NO: 742939 - DNA, 20 bp, Artificial
  CRISPR gRNA sequence
ccagggctgggagctgaatt

SEQ ID NO: 742940 - DNA, 20 bp, Artificial
  CRISPR gRNA sequence
ctgggagctgaattcagctc

SEQ ID NO: 742941 - DNA, 20 bp, Artificial
  CRISPR gRNA sequence
gctgaattcagctccagctt

SEQ ID NO: 742942 - DNA, 20 bp, Artificial
  CRISPR gRNA sequence
ttcagctccagcttcagcta

SEQ ID NO: 742943 - DNA, 20 bp, Artificial
  CRISPR gRNA sequence
agctccagcttcagctacgg

SEQ ID NO: 742944 - DNA, 20 bp, Artificial
  CRISPR gRNA sequence
gctacggtagtatttaccac

SEQ ID NO: 742945 - DNA, 20 bp, Artificial
  CRISPR gRNA sequence
taccaccagcacacatacct

SEQ ID NO: 742946 - DNA, 20 bp, Artificial
  CRISPR gRNA sequence
accaccagcacacatacctt

SEQ ID NO: 742947 - DNA, 20 bp, Artificial
  CRISPR gRNA sequence
ccaccagcacacataccttg

SEQ ID NO: 742948 - DNA, 20 bp, Artificial
  CRISPR gRNA sequence
caccagcacacataccttgg

SEQ ID NO: 742949 - DNA, 20 bp, Artificial
  CRISPR gRNA sequence
agcacacataccttgggggc

SEQ ID NO: 742950 - DNA, 20 bp, Artificial
  CRISPR gRNA sequence
cataccttgggggctggcca

SEQ ID NO: 742951 - DNA, 20 bp, Artificial
  CRISPR gRNA sequence
ataccttgggggctggccaa

SEQ ID NO: 742952 - DNA, 20 bp, Artificial
  CRISPR gRNA sequence
taccttgggggctggccaaa

SEQ ID NO: 742953 - DNA, 20 bp, Artificial
  CRISPR gRNA sequence
ttgggggctggccaaagggc

SEQ ID NO: 742954 - DNA, 20 bp, Artificial
  CRISPR gRNA sequence
ggctggccaaagggctggct

SEQ ID NO: 742955 - DNA, 20 bp, Artificial
  CRISPR gRNA sequence
tggccaaagggctggctcag

SEQ ID NO: 742956 - DNA, 20 bp, Artificial
  CRISPR gRNA sequence
aagggctggctcagcagaca

SEQ ID NO: 742957 - DNA, 20 bp, Artificial
  CRISPR gRNA sequence
agggctggctcagcagacac

SEQ ID NO: 742958 - DNA, 20 bp, Artificial
  CRISPR gRNA sequence
gggctggctcagcagacacg

SEQ ID NO: 742959 - DNA, 20 bp, Artificial
  CRISPR gRNA sequence
gctcagcagacacggggctg

SEQ ID NO: 742960 - DNA, 20 bp, Artificial
  CRISPR gRNA sequence
ctcagcagacacggggctgc

SEQ ID NO: 742961 - DNA, 20 bp, Artificial
  CRISPR gRNA sequence
gcagacacggggctgcaggc

SEQ ID NO: 742962 - DNA, 20 bp, Artificial
  CRISPR gRNA sequence
agacacggggctgcaggcca

SEQ ID NO: 742963 - DNA, 20 bp, Artificial
  CRISPR gRNA sequence
gacacggggctgcaggccag

SEQ ID NO: 742964 - DNA, 20 bp, Artificial
  CRISPR gRNA sequence
cacggggctgcaggccagag

SEQ ID NO: 742965 - DNA, 20 bp, Artificial
  CRISPR gRNA sequence
acggggctgcaggccagagg

SEQ ID NO: 742966 - DNA, 20 bp, Artificial
  CRISPR gRNA sequence
cggggctgcaggccagagga

SEQ ID NO: 742967 - DNA, 20 bp, Artificial
  CRISPR gRNA sequence
ctgcaggccagaggagggta

SEQ ID NO: 742968 - DNA, 20 bp, Artificial
  CRISPR gRNA sequence
caggccagaggagggtatgg

SEQ ID NO: 742969 - DNA, 20 bp, Artificial
  CRISPR gRNA sequence
aggccagaggagggtatggc

SEQ ID NO: 742970 - DNA, 20 bp, Artificial
  CRISPR gRNA sequence
ggccagaggagggtatggca

SEQ ID NO: 742971 - DNA, 20 bp, Artificial
  CRISPR gRNA sequence
cagaggagggtatggcaggg

SEQ ID NO: 742972 - DNA, 20 bp, Artificial
  CRISPR gRNA sequence
agaggagggtatggcagggc

SEQ ID NO: 742973 - DNA, 20 bp, Artificial
  CRISPR gRNA sequence
ggagggtatggcagggcagg

SEQ ID NO: 742974 - DNA, 20 bp, Artificial
  CRISPR gRNA sequence
agggtatggcagggcaggca

SEQ ID NO: 742975 - DNA, 20 bp, Artificial
  CRISPR gRNA sequence
gtatggcagggcaggcagag

SEQ ID NO: 742976 - DNA, 20 bp, Artificial
  CRISPR gRNA sequence
atggcagggcaggcagagta

SEQ ID NO: 742977 - DNA, 20 bp, Artificial
  CRISPR gRNA sequence
cagggcaggcagagtagagc

SEQ ID NO: 742978 - DNA, 20 bp, Artificial
  CRISPR gRNA sequence
ggcaggcagagtagagctgg

SEQ ID NO: 742979 - DNA, 20 bp, Artificial
  CRISPR gRNA sequence
cagagtagagctggcagcca

SEQ ID NO: 742980 - DNA, 20 bp, Artificial
  CRISPR gRNA sequence
gtagagctggcagccaaagc

SEQ ID NO: 742981 - DNA, 20 bp, Artificial
  CRISPR gRNA sequence
cagccaaagcaagatgcgca

SEQ ID NO: 742982 - DNA, 20 bp, Artificial
  CRISPR gRNA sequence
aaagcaagatgcgcaaagct

SEQ ID NO: 742983 - DNA, 20 bp, Artificial
  CRISPR gRNA sequence
caagatgcgcaaagctgagc

SEQ ID NO: 742984 - DNA, 20 bp, Artificial
  CRISPR gRNA sequence
aagatgcgcaaagctgagct

SEQ ID NO: 742985 - DNA, 20 bp, Artificial
  CRISPR gRNA sequence
atgcgcaaagctgagctggg

SEQ ID NO: 742986 - DNA, 20 bp, Artificial
  CRISPR gRNA sequence
tgcgcaaagctgagctgggt

SEQ ID NO: 742987 - DNA, 20 bp, Artificial
  CRISPR gRNA sequence
gcgcaaagctgagctgggtg

SEQ ID NO: 742988 - DNA, 20 bp, Artificial
  CRISPR gRNA sequence
aaagctgagctgggtggggt

SEQ ID NO: 742989 - DNA, 20 bp, Artificial
  CRISPR gRNA sequence
aagctgagctgggtggggtt

SEQ ID NO: 742990 - DNA, 20 bp, Artificial
  CRISPR gRNA sequence
agctgagctgggtggggttg

SEQ ID NO: 742991 - DNA, 20 bp, Artificial
  CRISPR gRNA sequence
gctgagctgggtggggttgg

SEQ ID NO: 742992 - DNA, 20 bp, Artificial
  CRISPR gRNA sequence
gggtggggttgggggccctc

SEQ ID NO: 742993 - DNA, 20 bp, Artificial
  CRISPR gRNA sequence
tggggttgggggccctcaag

SEQ ID NO: 742994 - DNA, 20 bp, Artificial
  CRISPR gRNA sequence
gttgggggccctcaagtgga

SEQ ID NO: 742995 - DNA, 20 bp, Artificial
  CRISPR gRNA sequence
tgggggccctcaagtggaca

SEQ ID NO: 742996 - DNA, 20 bp, Artificial
  CRISPR gRNA sequence
gggggccctcaagtggacag

SEQ ID NO: 742997 - DNA, 20 bp, Artificial
  CRISPR gRNA sequence
ccctcaagtggacagaggtg

SEQ ID NO: 742998 - DNA, 20 bp, Artificial
  CRISPR gRNA sequence
aagtggacagaggtgtggac

SEQ ID NO: 742999 - DNA, 20 bp, Artificial
  CRISPR gRNA sequence
tggacagaggtgtggacaag

SEQ ID NO: 743000 - DNA, 20 bp, Artificial
  CRISPR gRNA sequence
ggacagaggtgtggacaagt

SEQ ID NO: 743001 - DNA, 20 bp, Artificial
  CRISPR gRNA sequence
gacagaggtgtggacaagtg

SEQ ID NO: 743002 - DNA, 20 bp, Artificial
  CRISPR gRNA sequence
gaggtgtggacaagtggggc

SEQ ID NO: 743003 - DNA, 20 bp, Artificial
  CRISPR gRNA sequence
gtggacaagtggggctagcg

SEQ ID NO: 743004 - DNA, 20 bp, Artificial
  CRISPR gRNA sequence
agtggggctagcgtggttgt

SEQ ID NO: 743005 - DNA, 20 bp, Artificial
  CRISPR gRNA sequence
gctagcgtggttgttggcct

SEQ ID NO: 743006 - DNA, 20 bp, Artificial
  CRISPR gRNA sequence
gcctgagtgtccctgtgaac

SEQ ID NO: 743007 - DNA, 20 bp, Artificial
  CRISPR gRNA sequence
cctgagtgtccctgtgaaca

SEQ ID NO: 743008 - DNA, 20 bp, Artificial
  CRISPR gRNA sequence
gagtgtccctgtgaacaagg

SEQ ID NO: 743009 - DNA, 20 bp, Artificial
  CRISPR gRNA sequence
agtgtccctgtgaacaaggt

SEQ ID NO: 743010 - DNA, 20 bp, Artificial
  CRISPR gRNA sequence
gtgtccctgtgaacaaggtg

SEQ ID NO: 743011 - DNA, 20 bp, Artificial
  CRISPR gRNA sequence
tccctgtgaacaaggtgggg

SEQ ID NO: 743012 - DNA, 20 bp, Artificial
  CRISPR gRNA sequence
ccctgtgaacaaggtggggc

SEQ ID NO: 743013 - DNA, 20 bp, Artificial
  CRISPR gRNA sequence
cctgtgaacaaggtggggca

SEQ ID NO: 743014 - DNA, 20 bp, Artificial
  CRISPR gRNA sequence
aacaaggtggggcagggcac

SEQ ID NO: 743015 - DNA, 20 bp, Artificial
  CRISPR gRNA sequence
acaaggtggggcagggcacc

SEQ ID NO: 743016 - DNA, 20 bp, Artificial
  CRISPR gRNA sequence
ggtggggcagggcaccaggc

SEQ ID NO: 743017 - DNA, 20 bp, Artificial
  CRISPR gRNA sequence
gtggggcagggcaccaggct

SEQ ID NO: 743018 - DNA, 20 bp, Artificial
  CRISPR gRNA sequence
ggggcagggcaccaggctgg

SEQ ID NO: 743019 - DNA, 20 bp, Artificial
  CRISPR gRNA sequence
ggcaccaggctgggagccct

SEQ ID NO: 743020 - DNA, 20 bp, Artificial
  CRISPR gRNA sequence
gcaccaggctgggagccctc

SEQ ID NO: 743021 - DNA, 20 bp, Artificial
  CRISPR gRNA sequence
caccaggctgggagccctca

SEQ ID NO: 743022 - DNA, 20 bp, Artificial
  CRISPR gRNA sequence
gctgggagccctcagggtct

SEQ ID NO: 743023 - DNA, 20 bp, Artificial
  CRISPR gRNA sequence
agccctcagggtctaagcaa

SEQ ID NO: 743024 - DNA, 20 bp, Artificial
  CRISPR gRNA sequence
gccctcagggtctaagcaat

SEQ ID NO: 743025 - DNA, 20 bp, Artificial
  CRISPR gRNA sequence
ccctcagggtctaagcaatg

SEQ ID NO: 743026 - DNA, 20 bp, Artificial
  CRISPR gRNA sequence
agcaatggggttaatgaccc

SEQ ID NO: 743027 - DNA, 20 bp, Artificial
  CRISPR gRNA sequence
gcaatggggttaatgacccc

SEQ ID NO: 743028 - DNA, 20 bp, Artificial
  CRISPR gRNA sequence
tgaccccaggattgtaccca

SEQ ID NO: 743029 - DNA, 20 bp, Artificial
  CRISPR gRNA sequence
gattgtacccatagcacccg

SEQ ID NO: 743030 - DNA, 20 bp, Artificial
  CRISPR gRNA sequence
tgtacccatagcacccgcag

SEQ ID NO: 743031 - DNA, 20 bp, Artificial
  CRISPR gRNA sequence
acccatagcacccgcagcag

SEQ ID NO: 743032 - DNA, 20 bp, Artificial
  CRISPR gRNA sequence
cccatagcacccgcagcagt

SEQ ID NO: 743033 - DNA, 20 bp, Artificial
  CRISPR gRNA sequence
ccatagcacccgcagcagta

SEQ ID NO: 743034 - DNA, 20 bp, Artificial
  CRISPR gRNA sequence
tagcacccgcagcagtaggg

SEQ ID NO: 743035 - DNA, 20 bp, Artificial
  CRISPR gRNA sequence
agcacccgcagcagtaggga

SEQ ID NO: 743036 - DNA, 20 bp, Artificial
  CRISPR gRNA sequence
gcacccgcagcagtagggaa

SEQ ID NO: 743037 - DNA, 20 bp, Artificial
  CRISPR gRNA sequence
agggaagggatgttctcccc

SEQ ID NO: 743038 - DNA, 20 bp, Artificial
  CRISPR gRNA sequence
ggaagggatgttctcccctg

SEQ ID NO: 743039 - DNA, 20 bp, Artificial
  CRISPR gRNA sequence
gaagggatgttctcccctgg

SEQ ID NO: 743040 - DNA, 20 bp, Artificial
  CRISPR gRNA sequence
cccctggaggcaacttcctt

SEQ ID NO: 743041 - DNA, 20 bp, Artificial
  CRISPR gRNA sequence
ggcaacttccttgagatgca

SEQ ID NO: 743042 - DNA, 20 bp, Artificial
  CRISPR gRNA sequence
aacttccttgagatgcacgg

SEQ ID NO: 743043 - DNA, 20 bp, Artificial
  CRISPR gRNA sequence
acttccttgagatgcacggc

SEQ ID NO: 743044 - DNA, 20 bp, Artificial
  CRISPR gRNA sequence
tccttgagatgcacggcggg

SEQ ID NO: 743045 - DNA, 20 bp, Artificial
  CRISPR gRNA sequence
ccttgagatgcacggcgggt

SEQ ID NO: 743046 - DNA, 20 bp, Artificial
  CRISPR gRNA sequence
tgcacggcgggtgggtgcat

SEQ ID NO: 743047 - DNA, 20 bp, Artificial
  CRISPR gRNA sequence
cacggcgggtgggtgcatca

SEQ ID NO: 743048 - DNA, 20 bp, Artificial
  CRISPR gRNA sequence
cggcgggtgggtgcatcaga

SEQ ID NO: 743049 - DNA, 20 bp, Artificial
  CRISPR gRNA sequence
gggtgggtgcatcagagaga

SEQ ID NO: 743050 - DNA, 20 bp, Artificial
  CRISPR gRNA sequence
tgggtgcatcagagagaaag

SEQ ID NO: 743051 - DNA, 20 bp, Artificial
  CRISPR gRNA sequence
ggtgcatcagagagaaagca

SEQ ID NO: 743052 - DNA, 20 bp, Artificial
  CRISPR gRNA sequence
atcagagagaaagcagagtt

SEQ ID NO: 743053 - DNA, 20 bp, Artificial
  CRISPR gRNA sequence
tcagagagaaagcagagttc

SEQ ID NO: 743054 - DNA, 20 bp, Artificial
  CRISPR gRNA sequence
cagagagaaagcagagttca

SEQ ID NO: 743055 - DNA, 20 bp, Artificial
  CRISPR gRNA sequence
gagagaaagcagagttcagg

SEQ ID NO: 743056 - DNA, 20 bp, Artificial
  CRISPR gRNA sequence
aaagcagagttcagggagta

SEQ ID NO: 743057 - DNA, 20 bp, Artificial
  CRISPR gRNA sequence
aagcagagttcagggagtac

SEQ ID NO: 743058 - DNA, 20 bp, Artificial
  CRISPR gRNA sequence
gcagagttcagggagtacgg

SEQ ID NO: 743059 - DNA, 20 bp, Artificial
  CRISPR gRNA sequence
agagttcagggagtacggga

SEQ ID NO: 743060 - DNA, 20 bp, Artificial
  CRISPR gRNA sequence
gagttcagggagtacgggag

SEQ ID NO: 743061 - DNA, 20 bp, Artificial
  CRISPR gRNA sequence
agttcagggagtacgggaga

SEQ ID NO: 743062 - DNA, 20 bp, Artificial
  CRISPR gRNA sequence
gttcagggagtacgggagag

SEQ ID NO: 743063 - DNA, 20 bp, Artificial
  CRISPR gRNA sequence
ttcagggagtacgggagagg

SEQ ID NO: 743064 - DNA, 20 bp, Artificial
  CRISPR gRNA sequence
cctccccacccctcacacac

SEQ ID NO: 743065 - DNA, 20 bp, Artificial
  CRISPR gRNA sequence
cacactggccacccatccca

SEQ ID NO: 743066 - DNA, 20 bp, Artificial
  CRISPR gRNA sequence
acactggccacccatcccac

SEQ ID NO: 743067 - DNA, 20 bp, Artificial
  CRISPR gRNA sequence
cacccatcccacaggtccca

SEQ ID NO: 743068 - DNA, 20 bp, Artificial
  CRISPR gRNA sequence
acccatcccacaggtcccaa

SEQ ID NO: 743069 - DNA, 20 bp, Artificial
  CRISPR gRNA sequence
ccatcccacaggtcccaaag

SEQ ID NO: 743070 - DNA, 20 bp, Artificial
  CRISPR gRNA sequence
caaaggagttgttccccttt

SEQ ID NO: 743071 - DNA, 20 bp, Artificial
  CRISPR gRNA sequence
gttgttccccttttagaaaa

SEQ ID NO: 743072 - DNA, 20 bp, Artificial
  CRISPR gRNA sequence
cttttagaaaaaagctgtct

SEQ ID NO: 743073 - DNA, 20 bp, Artificial
  CRISPR gRNA sequence
ttttagaaaaaagctgtctt

SEQ ID NO: 743074 - DNA, 20 bp, Artificial
  CRISPR gRNA sequence
aaaaagctgtcttaggattc

SEQ ID NO: 743075 - DNA, 20 bp, Artificial
  CRISPR gRNA sequence
gctgtcttaggattcaagtt

SEQ ID NO: 743076 - DNA, 20 bp, Artificial
  CRISPR gRNA sequence
ctgtcttaggattcaagttt

SEQ ID NO: 743077 - DNA, 20 bp, Artificial
  CRISPR gRNA sequence
tgtcttaggattcaagtttg

SEQ ID NO: 743078 - DNA, 20 bp, Artificial
  CRISPR gRNA sequence
tcttaggattcaagtttggg

SEQ ID NO: 743079 - DNA, 20 bp, Artificial
  CRISPR gRNA sequence
taggattcaagtttggggag

SEQ ID NO: 743080 - DNA, 20 bp, Artificial
  CRISPR gRNA sequence
aggattcaagtttggggagc

SEQ ID NO: 743081 - DNA, 20 bp, Artificial
  CRISPR gRNA sequence
ggattcaagtttggggagca

SEQ ID NO: 743082 - DNA, 20 bp, Artificial
  CRISPR gRNA sequence
gattcaagtttggggagcag

SEQ ID NO: 743083 - DNA, 20 bp, Artificial
  CRISPR gRNA sequence
ttcaagtttggggagcaggg

SEQ ID NO: 743084 - DNA, 20 bp, Artificial
  CRISPR gRNA sequence
tcaagtttggggagcagggg

SEQ ID NO: 743085 - DNA, 20 bp, Artificial
  CRISPR gRNA sequence
ggggagcaggggaggatgtt

SEQ ID NO: 743086 - DNA, 20 bp, Artificial
  CRISPR gRNA sequence
ggggaggatgttcagttttc

SEQ ID NO: 743087 - DNA, 20 bp, Artificial
  CRISPR gRNA sequence
aggatgttcagttttcaagc

SEQ ID NO: 743088 - DNA, 20 bp, Artificial
  CRISPR gRNA sequence
gatgttcagttttcaagcaa

SEQ ID NO: 743089 - DNA, 20 bp, Artificial
  CRISPR gRNA sequence
atgttcagttttcaagcaag

SEQ ID NO: 743090 - DNA, 20 bp, Artificial
  CRISPR gRNA sequence
tgttcagttttcaagcaaga

SEQ ID NO: 743091 - DNA, 20 bp, Artificial
  CRISPR gRNA sequence
cagttttcaagcaagagggc

SEQ ID NO: 743092 - DNA, 20 bp, Artificial
  CRISPR gRNA sequence
tttcaagcaagagggccaga

SEQ ID NO: 743093 - DNA, 20 bp, Artificial
  CRISPR gRNA sequence
ttcaagcaagagggccagac

SEQ ID NO: 743094 - DNA, 20 bp, Artificial
  CRISPR gRNA sequence
caagcaagagggccagacag

SEQ ID NO: 743095 - DNA, 20 bp, Artificial
  CRISPR gRNA sequence
agcaagagggccagacagga

SEQ ID NO: 743096 - DNA, 20 bp, Artificial
  CRISPR gRNA sequence
gcaagagggccagacaggag

SEQ ID NO: 743097 - DNA, 20 bp, Artificial
  CRISPR gRNA sequence
caagagggccagacaggaga

SEQ ID NO: 743098 - DNA, 20 bp, Artificial
  CRISPR gRNA sequence
gggccagacaggagagggtc

SEQ ID NO: 743099 - DNA, 20 bp, Artificial
  CRISPR gRNA sequence
ggccagacaggagagggtcc

SEQ ID NO: 743100 - DNA, 20 bp, Artificial
  CRISPR gRNA sequence
gacaggagagggtccaggac

SEQ ID NO: 743101 - DNA, 20 bp, Artificial
  CRISPR gRNA sequence
ggagagggtccaggacaagc

SEQ ID NO: 743102 - DNA, 20 bp, Artificial
  CRISPR gRNA sequence
agagggtccaggacaagcca

SEQ ID NO: 743103 - DNA, 20 bp, Artificial
  CRISPR gRNA sequence
gagggtccaggacaagccag

SEQ ID NO: 743104 - DNA, 20 bp, Artificial
  CRISPR gRNA sequence
agggtccaggacaagccaga

SEQ ID NO: 743105 - DNA, 20 bp, Artificial
  CRISPR gRNA sequence
tccaggacaagccagaggga

SEQ ID NO: 743106 - DNA, 20 bp, Artificial
  CRISPR gRNA sequence
ccaggacaagccagagggac

SEQ ID NO: 743107 - DNA, 20 bp, Artificial
  CRISPR gRNA sequence
ccagagggacaggacaaacc

SEQ ID NO: 743108 - DNA, 20 bp, Artificial
  CRISPR gRNA sequence
cagagggacaggacaaacca

SEQ ID NO: 743109 - DNA, 20 bp, Artificial
  CRISPR gRNA sequence
agagggacaggacaaaccaa

SEQ ID NO: 743110 - DNA, 20 bp, Artificial
  CRISPR gRNA sequence
caggacaaaccaagggtcca

SEQ ID NO: 743111 - DNA, 20 bp, Artificial
  CRISPR gRNA sequence
aggacaaaccaagggtccac

SEQ ID NO: 743112 - DNA, 20 bp, Artificial
  CRISPR gRNA sequence
ggacaaaccaagggtccaca

SEQ ID NO: 743113 - DNA, 20 bp, Artificial
  CRISPR gRNA sequence
gacaaaccaagggtccacag

SEQ ID NO: 743114 - DNA, 20 bp, Artificial
  CRISPR gRNA sequence
gggtccacaggggtttgtcc

SEQ ID NO: 743115 - DNA, 20 bp, Artificial
  CRISPR gRNA sequence
ggtccacaggggtttgtcct

SEQ ID NO: 743116 - DNA, 20 bp, Artificial
  CRISPR gRNA sequence
gtccacaggggtttgtcctg

SEQ ID NO: 743117 - DNA, 20 bp, Artificial
  CRISPR gRNA sequence
ccacaggggtttgtcctggg

SEQ ID NO: 743118 - DNA, 20 bp, Artificial
  CRISPR gRNA sequence
cacaggggtttgtcctgggg

SEQ ID NO: 743119 - DNA, 20 bp, Artificial
  CRISPR gRNA sequence
acaggggtttgtcctgggga

SEQ ID NO: 743120 - DNA, 20 bp, Artificial
  CRISPR gRNA sequence
aggggtttgtcctggggagg

SEQ ID NO: 743121 - DNA, 20 bp, Artificial
  CRISPR gRNA sequence
ggggtttgtcctggggaggg

SEQ ID NO: 743122 - DNA, 20 bp, Artificial
  CRISPR gRNA sequence
gggtttgtcctggggaggga

SEQ ID NO: 743123 - DNA, 20 bp, Artificial
  CRISPR gRNA sequence
tttgtcctggggagggaggg

SEQ ID NO: 743124 - DNA, 20 bp, Artificial
  CRISPR gRNA sequence
ttgtcctggggagggaggga

SEQ ID NO: 743125 - DNA, 20 bp, Artificial
  CRISPR gRNA sequence
cctggggagggagggaaggc

SEQ ID NO: 743126 - DNA, 20 bp, Artificial
  CRISPR gRNA sequence
acaccccatttactgtgtct

SEQ ID NO: 743127 - DNA, 20 bp, Artificial
  CRISPR gRNA sequence
atttactgtgtctgagactc

SEQ ID NO: 743128 - DNA, 20 bp, Artificial
  CRISPR gRNA sequence
actgtgtctgagactccagc

SEQ ID NO: 743129 - DNA, 20 bp, Artificial
  CRISPR gRNA sequence
ctgtgtctgagactccagct

SEQ ID NO: 743130 - DNA, 20 bp, Artificial
  CRISPR gRNA sequence
tctgagactccagctgggac

SEQ ID NO: 743131 - DNA, 20 bp, Artificial
  CRISPR gRNA sequence
ctgagactccagctgggaca

SEQ ID NO: 743132 - DNA, 20 bp, Artificial
  CRISPR gRNA sequence
tccagctgggacaaggccca

SEQ ID NO: 743133 - DNA, 20 bp, Artificial
  CRISPR gRNA sequence
agctgggacaaggcccacag

SEQ ID NO: 743134 - DNA, 20 bp, Artificial
  CRISPR gRNA sequence
ggcccacagcagcctgtcgt

SEQ ID NO: 743135 - DNA, 20 bp, Artificial
  CRISPR gRNA sequence
gcccacagcagcctgtcgtt

SEQ ID NO: 743136 - DNA, 20 bp, Artificial
  CRISPR gRNA sequence
ccacagcagcctgtcgttag

SEQ ID NO: 743137 - DNA, 20 bp, Artificial
  CRISPR gRNA sequence
cacagcagcctgtcgttagg

SEQ ID NO: 743138 - DNA, 20 bp, Artificial
  CRISPR gRNA sequence
tgtcgttaggaggacactcg

SEQ ID NO: 743139 - DNA, 20 bp, Artificial
  CRISPR gRNA sequence
gtcgttaggaggacactcga

SEQ ID NO: 743140 - DNA, 20 bp, Artificial
  CRISPR gRNA sequence
taggaggacactcgaaggca

SEQ ID NO: 743141 - DNA, 20 bp, Artificial
  CRISPR gRNA sequence
ggacactcgaaggcatggca

SEQ ID NO: 743142 - DNA, 20 bp, Artificial
  CRISPR gRNA sequence
gacactcgaaggcatggcat

SEQ ID NO: 743143 - DNA, 20 bp, Artificial
  CRISPR gRNA sequence
acactcgaaggcatggcatg

SEQ ID NO: 743144 - DNA, 20 bp, Artificial
  CRISPR gRNA sequence
cactcgaaggcatggcatgg

SEQ ID NO: 743145 - DNA, 20 bp, Artificial
  CRISPR gRNA sequence
ctcgaaggcatggcatgggg

SEQ ID NO: 743146 - DNA, 20 bp, Artificial
  CRISPR gRNA sequence
cgaaggcatggcatggggga

SEQ ID NO: 743147 - DNA, 20 bp, Artificial
  CRISPR gRNA sequence
gaaggcatggcatgggggag

SEQ ID NO: 743148 - DNA, 20 bp, Artificial
  CRISPR gRNA sequence
aaggcatggcatgggggaga

SEQ ID NO: 743149 - DNA, 20 bp, Artificial
  CRISPR gRNA sequence
aggcatggcatgggggagag

SEQ ID NO: 743150 - DNA, 20 bp, Artificial
  CRISPR gRNA sequence
catggcatgggggagagggg

SEQ ID NO: 743151 - DNA, 20 bp, Artificial
  CRISPR gRNA sequence
tgggggagaggggcagcgca

SEQ ID NO: 743152 - DNA, 20 bp, Artificial
  CRISPR gRNA sequence
gaggggcagcgcacagcacg

SEQ ID NO: 743153 - DNA, 20 bp, Artificial
  CRISPR gRNA sequence
ggggcagcgcacagcacgca

SEQ ID NO: 743154 - DNA, 20 bp, Artificial
  CRISPR gRNA sequence
gggcagcgcacagcacgcag

SEQ ID NO: 743155 - DNA, 20 bp, Artificial
  CRISPR gRNA sequence
ggcagcgcacagcacgcaga

SEQ ID NO: 743156 - DNA, 20 bp, Artificial
  CRISPR gRNA sequence
gcagcgcacagcacgcagag

SEQ ID NO: 743157 - DNA, 20 bp, Artificial
  CRISPR gRNA sequence
aggggcctgcacgtgccccg

SEQ ID NO: 743158 - DNA, 20 bp, Artificial
  CRISPR gRNA sequence
tgcacatgcctgtgtgttgt

SEQ ID NO: 743159 - DNA, 20 bp, Artificial
  CRISPR gRNA sequence
gcacatgcctgtgtgttgtc

SEQ ID NO: 743160 - DNA, 20 bp, Artificial
  CRISPR gRNA sequence
cacatgcctgtgtgttgtca

SEQ ID NO: 743161 - DNA, 20 bp, Artificial
  CRISPR gRNA sequence
atgcctgtgtgttgtcaggg

SEQ ID NO: 743162 - DNA, 20 bp, Artificial
  CRISPR gRNA sequence
gtgttgtcagggaagctgtg

SEQ ID NO: 743163 - DNA, 20 bp, Artificial
  CRISPR gRNA sequence
gtcagggaagctgtgcagcc

SEQ ID NO: 743164 - DNA, 20 bp, Artificial
  CRISPR gRNA sequence
cggctaaaattacaattctt

SEQ ID NO: 743165 - DNA, 20 bp, Artificial
  CRISPR gRNA sequence
taaaattacaattctttggc

SEQ ID NO: 743166 - DNA, 20 bp, Artificial
  CRISPR gRNA sequence
aaattacaattctttggcga

SEQ ID NO: 743167 - DNA, 20 bp, Artificial
  CRISPR gRNA sequence
aattacaattctttggcgag

SEQ ID NO: 743168 - DNA, 20 bp, Artificial
  CRISPR gRNA sequence
gagaggatgttgcttattgt

SEQ ID NO: 743169 - DNA, 20 bp, Artificial
  CRISPR gRNA sequence
agaggatgttgcttattgtc

SEQ ID NO: 743170 - DNA, 20 bp, Artificial
  CRISPR gRNA sequence
aggatgttgcttattgtcag

SEQ ID NO: 743171 - DNA, 20 bp, Artificial
  CRISPR gRNA sequence
atgttgcttattgtcaggag

SEQ ID NO: 743172 - DNA, 20 bp, Artificial
  CRISPR gRNA sequence
ttgtcaggagcagatccttt

SEQ ID NO: 743173 - DNA, 20 bp, Artificial
  CRISPR gRNA sequence
agcagatccttttggacacc

SEQ ID NO: 743174 - DNA, 20 bp, Artificial
  CRISPR gRNA sequence
gcagatccttttggacacct

SEQ ID NO: 743175 - DNA, 20 bp, Artificial
  CRISPR gRNA sequence
ttggacacctgggtcattgt

SEQ ID NO: 743176 - DNA, 20 bp, Artificial
  CRISPR gRNA sequence
ggacacctgggtcattgtcg

SEQ ID NO: 743177 - DNA, 20 bp, Artificial
  CRISPR gRNA sequence
cctgggtcattgtcggagac

SEQ ID NO: 743178 - DNA, 20 bp, Artificial
  CRISPR gRNA sequence
ctgggtcattgtcggagacc

SEQ ID NO: 743179 - DNA, 20 bp, Artificial
  CRISPR gRNA sequence
tcattgtcggagaccgggaa

SEQ ID NO: 743180 - DNA, 20 bp, Artificial
  CRISPR gRNA sequence
ttgtcggagaccgggaaaag

SEQ ID NO: 743181 - DNA, 20 bp, Artificial
  CRISPR gRNA sequence
tgtcggagaccgggaaaagt

SEQ ID NO: 743182 - DNA, 20 bp, Artificial
  CRISPR gRNA sequence
cggagaccgggaaaagtggg

SEQ ID NO: 743183 - DNA, 20 bp, Artificial
  CRISPR gRNA sequence
ggagaccgggaaaagtgggt

SEQ ID NO: 743184 - DNA, 20 bp, Artificial
  CRISPR gRNA sequence
gagaccgggaaaagtgggtg

SEQ ID NO: 743185 - DNA, 20 bp, Artificial
  CRISPR gRNA sequence
gaccgggaaaagtgggtggg

SEQ ID NO: 743186 - DNA, 20 bp, Artificial
  CRISPR gRNA sequence
accgggaaaagtgggtgggg

SEQ ID NO: 743187 - DNA, 20 bp, Artificial
  CRISPR gRNA sequence
ggaaaagtgggtggggagga

SEQ ID NO: 743188 - DNA, 20 bp, Artificial
  CRISPR gRNA sequence
tgggtggggaggaaagcccc

SEQ ID NO: 743189 - DNA, 20 bp, Artificial
  CRISPR gRNA sequence
gggaggaaagcccctggctc

SEQ ID NO: 743190 - DNA, 20 bp, Artificial
  CRISPR gRNA sequence
ggaggaaagcccctggctcc

SEQ ID NO: 743191 - DNA, 20 bp, Artificial
  CRISPR gRNA sequence
gaggaaagcccctggctcca

SEQ ID NO: 743192 - DNA, 20 bp, Artificial
  CRISPR gRNA sequence
gaaagcccctggctccaggg

SEQ ID NO: 743193 - DNA, 20 bp, Artificial
  CRISPR gRNA sequence
cctggctccagggtggccaa

SEQ ID NO: 743194 - DNA, 20 bp, Artificial
  CRISPR gRNA sequence
ccagggtggccaaaagcatg

SEQ ID NO: 743195 - DNA, 20 bp, Artificial
  CRISPR gRNA sequence
cagggtggccaaaagcatgt

SEQ ID NO: 743196 - DNA, 20 bp, Artificial
  CRISPR gRNA sequence
gtggccaaaagcatgtggga

SEQ ID NO: 743197 - DNA, 20 bp, Artificial
  CRISPR gRNA sequence
tggccaaaagcatgtgggac

SEQ ID NO: 743198 - DNA, 20 bp, Artificial
  CRISPR gRNA sequence
tgtgggacaggaaaatgacc

SEQ ID NO: 743199 - DNA, 20 bp, Artificial
  CRISPR gRNA sequence
gtgggacaggaaaatgaccc

SEQ ID NO: 743200 - DNA, 20 bp, Artificial
  CRISPR gRNA sequence
tgggacaggaaaatgacccg

SEQ ID NO: 743201 - DNA, 20 bp, Artificial
  CRISPR gRNA sequence
caggaaaatgacccggggcc

SEQ ID NO: 743202 - DNA, 20 bp, Artificial
  CRISPR gRNA sequence
aggaaaatgacccggggcct

SEQ ID NO: 743203 - DNA, 20 bp, Artificial
  CRISPR gRNA sequence
atgacccggggcctgggcct

SEQ ID NO: 743204 - DNA, 20 bp, Artificial
  CRISPR gRNA sequence
gcctgggcctgagcatgtgc

SEQ ID NO: 743205 - DNA, 20 bp, Artificial
  CRISPR gRNA sequence
cctgggcctgagcatgtgcc

SEQ ID NO: 743206 - DNA, 20 bp, Artificial
  CRISPR gRNA sequence
gggcctgagcatgtgccagg

SEQ ID NO: 743207 - DNA, 20 bp, Artificial
  CRISPR gRNA sequence
ggcctgagcatgtgccaggc

SEQ ID NO: 743208 - DNA, 20 bp, Artificial
  CRISPR gRNA sequence
tgtgccaggcgggaaccgtc

SEQ ID NO: 743209 - DNA, 20 bp, Artificial
  CRISPR gRNA sequence
ccagttgccgtgctgctgtc

SEQ ID NO: 743210 - DNA, 20 bp, Artificial
  CRISPR gRNA sequence
gccgtgctgctgtcaagacc

SEQ ID NO: 743211 - DNA, 20 bp, Artificial
  CRISPR gRNA sequence
ccgtgctgctgtcaagaccc

SEQ ID NO: 743212 - DNA, 20 bp, Artificial
  CRISPR gRNA sequence
cgccacccgccacctgccac

SEQ ID NO: 743213 - DNA, 20 bp, Artificial
  CRISPR gRNA sequence
gccacccgccacctgccacc

SEQ ID NO: 743214 - DNA, 20 bp, Artificial
  CRISPR gRNA sequence
cccgccacctgccaccaggt

SEQ ID NO: 743215 - DNA, 20 bp, Artificial
  CRISPR gRNA sequence
ccgccacctgccaccaggta

SEQ ID NO: 743216 - DNA, 20 bp, Artificial
  CRISPR gRNA sequence
gccacctgccaccaggtaag

SEQ ID NO: 743217 - DNA, 20 bp, Artificial
  CRISPR gRNA sequence
ccacctgccaccaggtaagg

SEQ ID NO: 743218 - DNA, 20 bp, Artificial
  CRISPR gRNA sequence
cctgccaccaggtaaggagg

SEQ ID NO: 743219 - DNA, 20 bp, Artificial
  CRISPR gRNA sequence
ctgccaccaggtaaggaggc

SEQ ID NO: 743220 - DNA, 20 bp, Artificial
  CRISPR gRNA sequence
tgccaccaggtaaggaggca

SEQ ID NO: 743221 - DNA, 20 bp, Artificial
  CRISPR gRNA sequence
ggtaaggaggcagggccacc

SEQ ID NO: 743222 - DNA, 20 bp, Artificial
  CRISPR gRNA sequence
taaggaggcagggccaccta

SEQ ID NO: 743223 - DNA, 20 bp, Artificial
  CRISPR gRNA sequence
aaggaggcagggccacctag

SEQ ID NO: 743224 - DNA, 20 bp, Artificial
  CRISPR gRNA sequence
gaggcagggccacctagagg

SEQ ID NO: 743225 - DNA, 20 bp, Artificial
  CRISPR gRNA sequence
ggcagggccacctagaggaa

SEQ ID NO: 743226 - DNA, 20 bp, Artificial
  CRISPR gRNA sequence
gaggaagagtgccgtgaacc

SEQ ID NO: 743227 - DNA, 20 bp, Artificial
  CRISPR gRNA sequence
aggaagagtgccgtgaacct

SEQ ID NO: 743228 - DNA, 20 bp, Artificial
  CRISPR gRNA sequence
agagtgccgtgaacctggga

SEQ ID NO: 743229 - DNA, 20 bp, Artificial
  CRISPR gRNA sequence
ccgtgaacctgggaaagcct

SEQ ID NO: 743230 - DNA, 20 bp, Artificial
  CRISPR gRNA sequence
acctgggaaagcctgagtct

SEQ ID NO: 743231 - DNA, 20 bp, Artificial
  CRISPR gRNA sequence
cctgggaaagcctgagtctc

SEQ ID NO: 743232 - DNA, 20 bp, Artificial
  CRISPR gRNA sequence
tgggaaagcctgagtctcag

SEQ ID NO: 743233 - DNA, 20 bp, Artificial
  CRISPR gRNA sequence
tcaggagtaaaactctcgct

SEQ ID NO: 743234 - DNA, 20 bp, Artificial
  CRISPR gRNA sequence
tcgcttggattgcaacgtcc

SEQ ID NO: 743235 - DNA, 20 bp, Artificial
  CRISPR gRNA sequence
cgcttggattgcaacgtcct

SEQ ID NO: 743236 - DNA, 20 bp, Artificial
  CRISPR gRNA sequence
gcttggattgcaacgtcctg

SEQ ID NO: 743237 - DNA, 20 bp, Artificial
  CRISPR gRNA sequence
attgcaacgtcctggggcct

SEQ ID NO: 743238 - DNA, 20 bp, Artificial
  CRISPR gRNA sequence
ctggggcctcagtgtccact

SEQ ID NO: 743239 - DNA, 20 bp, Artificial
  CRISPR gRNA sequence
gtgccctcattgtgtgccct

SEQ ID NO: 743240 - DNA, 20 bp, Artificial
  CRISPR gRNA sequence
tgccctcattgtgtgccctt

SEQ ID NO: 743241 - DNA, 20 bp, Artificial
  CRISPR gRNA sequence
cctcattgtgtgcccttggg

SEQ ID NO: 743242 - DNA, 20 bp, Artificial
  CRISPR gRNA sequence
ggcagatcccacccttctct

SEQ ID NO: 743243 - DNA, 20 bp, Artificial
  CRISPR gRNA sequence
ccgtttcttcatcttaacct

SEQ ID NO: 743244 - DNA, 20 bp, Artificial
  CRISPR gRNA sequence
cgtttcttcatcttaacctg

SEQ ID NO: 743245 - DNA, 20 bp, Artificial
  CRISPR gRNA sequence
gtttcttcatcttaacctga

SEQ ID NO: 743246 - DNA, 20 bp, Artificial
  CRISPR gRNA sequence
catcttaacctgagggctgc

SEQ ID NO: 743247 - DNA, 20 bp, Artificial
  CRISPR gRNA sequence
ctgccagctctaaaatcctg

SEQ ID NO: 743248 - DNA, 20 bp, Artificial
  CRISPR gRNA sequence
tgccagctctaaaatcctgt

SEQ ID NO: 743249 - DNA, 20 bp, Artificial
  CRISPR gRNA sequence
cagctctaaaatcctgtggg

SEQ ID NO: 743250 - DNA, 20 bp, Artificial
  CRISPR gRNA sequence
agctctaaaatcctgtgggc

SEQ ID NO: 743251 - DNA, 20 bp, Artificial
  CRISPR gRNA sequence
ctctaaaatcctgtgggcag

SEQ ID NO: 743252 - DNA, 20 bp, Artificial
  CRISPR gRNA sequence
tctaaaatcctgtgggcagg

SEQ ID NO: 743253 - DNA, 20 bp, Artificial
  CRISPR gRNA sequence
ctaaaatcctgtgggcagga

SEQ ID NO: 743254 - DNA, 20 bp, Artificial
  CRISPR gRNA sequence
aaatcctgtgggcaggaggg

SEQ ID NO: 743255 - DNA, 20 bp, Artificial
  CRISPR gRNA sequence
atcctgtgggcaggagggaa

SEQ ID NO: 743256 - DNA, 20 bp, Artificial
  CRISPR gRNA sequence
tatgaccatgtattatgtgc

SEQ ID NO: 743257 - DNA, 20 bp, Artificial
  CRISPR gRNA sequence
atgaccatgtattatgtgct

SEQ ID NO: 743258 - DNA, 20 bp, Artificial
  CRISPR gRNA sequence
ttatgtgctaggctcttgct

SEQ ID NO: 743259 - DNA, 20 bp, Artificial
  CRISPR gRNA sequence
catcttatacctgtcacatt

SEQ ID NO: 743260 - DNA, 20 bp, Artificial
  CRISPR gRNA sequence
ttctcataacacccccaaca

SEQ ID NO: 743261 - DNA, 20 bp, Artificial
  CRISPR gRNA sequence
tctcataacacccccaacat

SEQ ID NO: 743262 - DNA, 20 bp, Artificial
  CRISPR gRNA sequence
cataacacccccaacatggg

SEQ ID NO: 743263 - DNA, 20 bp, Artificial
  CRISPR gRNA sequence
gtggtatcatccctatttta

SEQ ID NO: 743264 - DNA, 20 bp, Artificial
  CRISPR gRNA sequence
atcatccctattttaaagat

SEQ ID NO: 743265 - DNA, 20 bp, Artificial
  CRISPR gRNA sequence
tcatccctattttaaagatg

SEQ ID NO: 743266 - DNA, 20 bp, Artificial
  CRISPR gRNA sequence
ctattttaaagatgaggaaa

SEQ ID NO: 743267 - DNA, 20 bp, Artificial
  CRISPR gRNA sequence
taaagatgaggaaacagact

SEQ ID NO: 743268 - DNA, 20 bp, Artificial
  CRISPR gRNA sequence
aagatgaggaaacagactca

SEQ ID NO: 743269 - DNA, 20 bp, Artificial
  CRISPR gRNA sequence
atgaggaaacagactcagag

SEQ ID NO: 743270 - DNA, 20 bp, Artificial
  CRISPR gRNA sequence
ctcagagaagtgacttgccc

SEQ ID NO: 743271 - DNA, 20 bp, Artificial
  CRISPR gRNA sequence
tcagagaagtgacttgccca

SEQ ID NO: 743272 - DNA, 20 bp, Artificial
  CRISPR gRNA sequence
gtgacttgcccaaggccaca

SEQ ID NO: 743273 - DNA, 20 bp, Artificial
  CRISPR gRNA sequence
ccacacagtgctgtgtgact

SEQ ID NO: 743274 - DNA, 20 bp, Artificial
  CRISPR gRNA sequence
cagtgctgtgtgactgagct

SEQ ID NO: 743275 - DNA, 20 bp, Artificial
  CRISPR gRNA sequence
ctgagctgagattcacacct

SEQ ID NO: 743276 - DNA, 20 bp, Artificial
  CRISPR gRNA sequence
gctgagattcacaccttgga

SEQ ID NO: 743277 - DNA, 20 bp, Artificial
  CRISPR gRNA sequence
ctgagattcacaccttggac

SEQ ID NO: 743278 - DNA, 20 bp, Artificial
  CRISPR gRNA sequence
gattcacaccttggacaggc

SEQ ID NO: 743279 - DNA, 20 bp, Artificial
  CRISPR gRNA sequence
ccttggacaggccagcactg

SEQ ID NO: 743280 - DNA, 20 bp, Artificial
  CRISPR gRNA sequence
ggacaggccagcactgcaga

SEQ ID NO: 743281 - DNA, 20 bp, Artificial
  CRISPR gRNA sequence
gacaggccagcactgcagac

SEQ ID NO: 743282 - DNA, 20 bp, Artificial
  CRISPR gRNA sequence
aggccagcactgcagacagg

SEQ ID NO: 743283 - DNA, 20 bp, Artificial
  CRISPR gRNA sequence
gccagcactgcagacaggaa

SEQ ID NO: 743284 - DNA, 20 bp, Artificial
  CRISPR gRNA sequence
ggaagagccacccacctctc

SEQ ID NO: 743285 - DNA, 20 bp, Artificial
  CRISPR gRNA sequence
cccacctctccagaaccctc

SEQ ID NO: 743286 - DNA, 20 bp, Artificial
  CRISPR gRNA sequence
acctctccagaaccctccag

SEQ ID NO: 743287 - DNA, 20 bp, Artificial
  CRISPR gRNA sequence
cctctccagaaccctccagt

SEQ ID NO: 743288 - DNA, 20 bp, Artificial
  CRISPR gRNA sequence
ctccagaaccctccagtggg

SEQ ID NO: 743289 - DNA, 20 bp, Artificial
  CRISPR gRNA sequence
tccagaaccctccagtgggc

SEQ ID NO: 743290 - DNA, 20 bp, Artificial
  CRISPR gRNA sequence
agaaccctccagtgggcagg

SEQ ID NO: 743291 - DNA, 20 bp, Artificial
  CRISPR gRNA sequence
gaaccctccagtgggcaggc

SEQ ID NO: 743292 - DNA, 20 bp, Artificial
  CRISPR gRNA sequence
aaccctccagtgggcaggcg

SEQ ID NO: 743293 - DNA, 20 bp, Artificial
  CRISPR gRNA sequence
ggggctgatgcctcatcctt

SEQ ID NO: 743294 - DNA, 20 bp, Artificial
  CRISPR gRNA sequence
tgcctcatccttcagctatt

SEQ ID NO: 743295 - DNA, 20 bp, Artificial
  CRISPR gRNA sequence
gcaacattcctgctctgcct

SEQ ID NO: 743296 - DNA, 20 bp, Artificial
  CRISPR gRNA sequence
tcctgctctgcctcagaccc

SEQ ID NO: 743297 - DNA, 20 bp, Artificial
  CRISPR gRNA sequence
tcattccacaaatatttacc

SEQ ID NO: 743298 - DNA, 20 bp, Artificial
  CRISPR gRNA sequence
cattccacaaatatttacca

SEQ ID NO: 743299 - DNA, 20 bp, Artificial
  CRISPR gRNA sequence
tatttaccaaggtcctaaca

SEQ ID NO: 743300 - DNA, 20 bp, Artificial
  CRISPR gRNA sequence
atttaccaaggtcctaacat

SEQ ID NO: 743301 - DNA, 20 bp, Artificial
  CRISPR gRNA sequence
accaaggtcctaacatgggc

SEQ ID NO: 743302 - DNA, 20 bp, Artificial
  CRISPR gRNA sequence
ccaaggtcctaacatgggcc

SEQ ID NO: 743303 - DNA, 20 bp, Artificial
  CRISPR gRNA sequence
gtcctaacatgggccaggcc

SEQ ID NO: 743304 - DNA, 20 bp, Artificial
  CRISPR gRNA sequence
tcctaacatgggccaggccc

SEQ ID NO: 743305 - DNA, 20 bp, Artificial
  CRISPR gRNA sequence
taacatgggccaggcccagg

SEQ ID NO: 743306 - DNA, 20 bp, Artificial
  CRISPR gRNA sequence
aacatgggccaggcccaggc

SEQ ID NO: 743307 - DNA, 20 bp, Artificial
  CRISPR gRNA sequence
acatgggccaggcccaggca

SEQ ID NO: 743308 - DNA, 20 bp, Artificial
  CRISPR gRNA sequence
atgggccaggcccaggcagg

SEQ ID NO: 743309 - DNA, 20 bp, Artificial
  CRISPR gRNA sequence
tgggccaggcccaggcaggg

SEQ ID NO: 743310 - DNA, 20 bp, Artificial
  CRISPR gRNA sequence
aggcccaggcagggaggctg

SEQ ID NO: 743311 - DNA, 20 bp, Artificial
  CRISPR gRNA sequence
ggcccaggcagggaggctgt

SEQ ID NO: 743312 - DNA, 20 bp, Artificial
  CRISPR gRNA sequence
gcccaggcagggaggctgtg

SEQ ID NO: 743313 - DNA, 20 bp, Artificial
  CRISPR gRNA sequence
gcagggaggctgtggggatg

SEQ ID NO: 743314 - DNA, 20 bp, Artificial
  CRISPR gRNA sequence
agggaggctgtggggatgca

SEQ ID NO: 743315 - DNA, 20 bp, Artificial
  CRISPR gRNA sequence
gtggggatgcagagttccat

SEQ ID NO: 743316 - DNA, 20 bp, Artificial
  CRISPR gRNA sequence
tggggatgcagagttccatc

SEQ ID NO: 743317 - DNA, 20 bp, Artificial
  CRISPR gRNA sequence
ggggatgcagagttccatca

SEQ ID NO: 743318 - DNA, 20 bp, Artificial
  CRISPR gRNA sequence
gggatgcagagttccatcag

SEQ ID NO: 743319 - DNA, 20 bp, Artificial
  CRISPR gRNA sequence
ttccatcaggggcatctgct

SEQ ID NO: 743320 - DNA, 20 bp, Artificial
  CRISPR gRNA sequence
aggggcatctgctcagaact

SEQ ID NO: 743321 - DNA, 20 bp, Artificial
  CRISPR gRNA sequence
ggggcatctgctcagaactt

SEQ ID NO: 743322 - DNA, 20 bp, Artificial
  CRISPR gRNA sequence
atctgctcagaacttgggcc

SEQ ID NO: 743323 - DNA, 20 bp, Artificial
  CRISPR gRNA sequence
ttgggcctggacctgtgcct

SEQ ID NO: 743324 - DNA, 20 bp, Artificial
  CRISPR gRNA sequence
ggacctgtgcctgagatttc

SEQ ID NO: 743325 - DNA, 20 bp, Artificial
  CRISPR gRNA sequence
gtgcctgagatttctagctg

SEQ ID NO: 743326 - DNA, 20 bp, Artificial
  CRISPR gRNA sequence
atttctagctgtggcaccct

SEQ ID NO: 743327 - DNA, 20 bp, Artificial
  CRISPR gRNA sequence
accctcagatgtttctgtcc

SEQ ID NO: 743328 - DNA, 20 bp, Artificial
  CRISPR gRNA sequence
agatgtttctgtcccagtac

SEQ ID NO: 743329 - DNA, 20 bp, Artificial
  CRISPR gRNA sequence
gatgtttctgtcccagtaca

SEQ ID NO: 743330 - DNA, 20 bp, Artificial
  CRISPR gRNA sequence
atgtttctgtcccagtacaa

SEQ ID NO: 743331 - DNA, 20 bp, Artificial
  CRISPR gRNA sequence
ttctgtcccagtacaaggga

SEQ ID NO: 743332 - DNA, 20 bp, Artificial
  CRISPR gRNA sequence
tctgtcccagtacaagggaa

SEQ ID NO: 743333 - DNA, 20 bp, Artificial
  CRISPR gRNA sequence
tgtcccagtacaagggaaag

SEQ ID NO: 743334 - DNA, 20 bp, Artificial
  CRISPR gRNA sequence
caagggaaaggagctcttgt

SEQ ID NO: 743335 - DNA, 20 bp, Artificial
  CRISPR gRNA sequence
agctcttgttggcatcttct

SEQ ID NO: 743336 - DNA, 20 bp, Artificial
  CRISPR gRNA sequence
ttggcatcttctcagaatgc

SEQ ID NO: 743337 - DNA, 20 bp, Artificial
  CRISPR gRNA sequence
gaccttcacctctctccacc

SEQ ID NO: 743338 - DNA, 20 bp, Artificial
  CRISPR gRNA sequence
cttcacctctctccacccag

SEQ ID NO: 743339 - DNA, 20 bp, Artificial
  CRISPR gRNA sequence
ttcacctctctccacccagc

SEQ ID NO: 743340 - DNA, 20 bp, Artificial
  CRISPR gRNA sequence
tctctccacccagcaggccc

SEQ ID NO: 743341 - DNA, 20 bp, Artificial
  CRISPR gRNA sequence
ctctccacccagcaggcccc

SEQ ID NO: 743342 - DNA, 20 bp, Artificial
  CRISPR gRNA sequence
aggccccgggtgacccctgt

SEQ ID NO: 743343 - DNA, 20 bp, Artificial
  CRISPR gRNA sequence
gtgacccctgtgagtgtgca

SEQ ID NO: 743344 - DNA, 20 bp, Artificial
  CRISPR gRNA sequence
tgacccctgtgagtgtgcac

SEQ ID NO: 743345 - DNA, 20 bp, Artificial
  CRISPR gRNA sequence
ccctgtgagtgtgcacggga

SEQ ID NO: 743346 - DNA, 20 bp, Artificial
  CRISPR gRNA sequence
cctgtgagtgtgcacgggat

SEQ ID NO: 743347 - DNA, 20 bp, Artificial
  CRISPR gRNA sequence
gtgcacgggatgggtgtgtg

SEQ ID NO: 743348 - DNA, 20 bp, Artificial
  CRISPR gRNA sequence
tgcacgggatgggtgtgtgt

SEQ ID NO: 743349 - DNA, 20 bp, Artificial
  CRISPR gRNA sequence
gggatgggtgtgtgtgggtg

SEQ ID NO: 743350 - DNA, 20 bp, Artificial
  CRISPR gRNA sequence
tgggtgtgtgtgggtgtgga

SEQ ID NO: 743351 - DNA, 20 bp, Artificial
  CRISPR gRNA sequence
gggtgtgtgtgggtgtggac

SEQ ID NO: 743352 - DNA, 20 bp, Artificial
  CRISPR gRNA sequence
ggcctgtgtatttttcatga

SEQ ID NO: 743353 - DNA, 20 bp, Artificial
  CRISPR gRNA sequence
gcctgtgtatttttcatgac

SEQ ID NO: 743354 - DNA, 20 bp, Artificial
  CRISPR gRNA sequence
cctgtgtatttttcatgaca

SEQ ID NO: 743355 - DNA, 20 bp, Artificial
  CRISPR gRNA sequence
tatttttcatgacagggcgt

SEQ ID NO: 743356 - DNA, 20 bp, Artificial
  CRISPR gRNA sequence
ttcatgacagggcgtgagct

SEQ ID NO: 743357 - DNA, 20 bp, Artificial
  CRISPR gRNA sequence
cagggcgtgagcttagccca

SEQ ID NO: 743358 - DNA, 20 bp, Artificial
  CRISPR gRNA sequence
gagcttagcccacagtcgcc

SEQ ID NO: 743359 - DNA, 20 bp, Artificial
  CRISPR gRNA sequence
agcttagcccacagtcgcca

SEQ ID NO: 743360 - DNA, 20 bp, Artificial
  CRISPR gRNA sequence
cagtcgccaaggcaacgccc

SEQ ID NO: 743361 - DNA, 20 bp, Artificial
  CRISPR gRNA sequence
caaggcaacgccctagcctt

SEQ ID NO: 743362 - DNA, 20 bp, Artificial
  CRISPR gRNA sequence
aggcaacgccctagcctttg

SEQ ID NO: 743363 - DNA, 20 bp, Artificial
  CRISPR gRNA sequence
ggcaacgccctagcctttgg

SEQ ID NO: 743364 - DNA, 20 bp, Artificial
  CRISPR gRNA sequence
aacgccctagcctttggagg

SEQ ID NO: 743365 - DNA, 20 bp, Artificial
  CRISPR gRNA sequence
acgccctagcctttggaggt

SEQ ID NO: 743366 - DNA, 20 bp, Artificial
  CRISPR gRNA sequence
agcctttggaggtgggaccc

SEQ ID NO: 743367 - DNA, 20 bp, Artificial
  CRISPR gRNA sequence
ttggaggtgggacccaagct

SEQ ID NO: 743368 - DNA, 20 bp, Artificial
  CRISPR gRNA sequence
aggtgggacccaagcttggt

SEQ ID NO: 743369 - DNA, 20 bp, Artificial
  CRISPR gRNA sequence
gggacccaagcttggttagt

SEQ ID NO: 743370 - DNA, 20 bp, Artificial
  CRISPR gRNA sequence
ggacccaagcttggttagtc

SEQ ID NO: 743371 - DNA, 20 bp, Artificial
  CRISPR gRNA sequence
caagcttggttagtcgggcc

SEQ ID NO: 743372 - DNA, 20 bp, Artificial
  CRISPR gRNA sequence
aagcttggttagtcgggcct

SEQ ID NO: 743373 - DNA, 20 bp, Artificial
  CRISPR gRNA sequence
cttggttagtcgggcctagg

SEQ ID NO: 743374 - DNA, 20 bp, Artificial
  CRISPR gRNA sequence
cctaggaagccccacccaaa

SEQ ID NO: 743375 - DNA, 20 bp, Artificial
  CRISPR gRNA sequence
ccaaacagctgaactctgac

SEQ ID NO: 743376 - DNA, 20 bp, Artificial
  CRISPR gRNA sequence
gctgaactctgaccagctgc

SEQ ID NO: 743377 - DNA, 20 bp, Artificial
  CRISPR gRNA sequence
tgaactctgaccagctgcta

SEQ ID NO: 743378 - DNA, 20 bp, Artificial
  CRISPR gRNA sequence
gaactctgaccagctgctag

SEQ ID NO: 743379 - DNA, 20 bp, Artificial
  CRISPR gRNA sequence
accagctgctagaggttgtc

SEQ ID NO: 743380 - DNA, 20 bp, Artificial
  CRISPR gRNA sequence
gctagaggttgtcaagtaaa

SEQ ID NO: 743381 - DNA, 20 bp, Artificial
  CRISPR gRNA sequence
cagttattaattgcctgctg

SEQ ID NO: 743382 - DNA, 20 bp, Artificial
  CRISPR gRNA sequence
tattaattgcctgctgtggc

SEQ ID NO: 743383 - DNA, 20 bp, Artificial
  CRISPR gRNA sequence
tgctgtggctggccctgcac

SEQ ID NO: 743384 - DNA, 20 bp, Artificial
  CRISPR gRNA sequence
tggccctgcactagatgcaa

SEQ ID NO: 743385 - DNA, 20 bp, Artificial
  CRISPR gRNA sequence
ggccctgcactagatgcaaa

SEQ ID NO: 743386 - DNA, 20 bp, Artificial
  CRISPR gRNA sequence
gatgcaaaaggtcccgtcct

SEQ ID NO: 743387 - DNA, 20 bp, Artificial
  CRISPR gRNA sequence
aggtcccgtccttggtctca

SEQ ID NO: 743388 - DNA, 20 bp, Artificial
  CRISPR gRNA sequence
ggtcccgtccttggtctcac

SEQ ID NO: 743389 - DNA, 20 bp, Artificial
  CRISPR gRNA sequence
tggtctcacaggacatccca

SEQ ID NO: 743390 - DNA, 20 bp, Artificial
  CRISPR gRNA sequence
gtctcacaggacatcccaaa

SEQ ID NO: 743391 - DNA, 20 bp, Artificial
  CRISPR gRNA sequence
acaggacatcccaaagagaa

SEQ ID NO: 743392 - DNA, 20 bp, Artificial
  CRISPR gRNA sequence
caggacatcccaaagagaat

SEQ ID NO: 743393 - DNA, 20 bp, Artificial
  CRISPR gRNA sequence
atcccaaagagaatgggacc

SEQ ID NO: 743394 - DNA, 20 bp, Artificial
  CRISPR gRNA sequence
aagagaatgggacctggttc

SEQ ID NO: 743395 - DNA, 20 bp, Artificial
  CRISPR gRNA sequence
acctggttccagctccccgc

SEQ ID NO: 743396 - DNA, 20 bp, Artificial
  CRISPR gRNA sequence
cctggttccagctccccgcc

SEQ ID NO: 743397 - DNA, 20 bp, Artificial
  CRISPR gRNA sequence
ccccgccaggccccatcccc

SEQ ID NO: 743398 - DNA, 20 bp, Artificial
  CRISPR gRNA sequence
cccgccaggccccatccccc

SEQ ID NO: 743399 - DNA, 20 bp, Artificial
  CRISPR gRNA sequence
ccaggccccatcccccagga

SEQ ID NO: 743400 - DNA, 20 bp, Artificial
  CRISPR gRNA sequence
ccatcccccaggatggtcca

SEQ ID NO: 743401 - DNA, 20 bp, Artificial
  CRISPR gRNA sequence
catcccccaggatggtccac

SEQ ID NO: 743402 - DNA, 20 bp, Artificial
  CRISPR gRNA sequence
ccccaggatggtccacaggc

SEQ ID NO: 743403 - DNA, 20 bp, Artificial
  CRISPR gRNA sequence
cccaggatggtccacaggct

SEQ ID NO: 743404 - DNA, 20 bp, Artificial
  CRISPR gRNA sequence
ccaggatggtccacaggctg

SEQ ID NO: 743405 - DNA, 20 bp, Artificial
  CRISPR gRNA sequence
gatggtccacaggctggggc

SEQ ID NO: 743406 - DNA, 20 bp, Artificial
  CRISPR gRNA sequence
atggtccacaggctggggct

SEQ ID NO: 743407 - DNA, 20 bp, Artificial
  CRISPR gRNA sequence
tggtccacaggctggggctg

SEQ ID NO: 743408 - DNA, 20 bp, Artificial
  CRISPR gRNA sequence
acaggctggggctggggctg

SEQ ID NO: 743409 - DNA, 20 bp, Artificial
  CRISPR gRNA sequence
caggctggggctggggctgt

SEQ ID NO: 743410 - DNA, 20 bp, Artificial
  CRISPR gRNA sequence
tggggctggggctgtaggaa

SEQ ID NO: 743411 - DNA, 20 bp, Artificial
  CRISPR gRNA sequence
gactatgttctgtctttatc

SEQ ID NO: 743412 - DNA, 20 bp, Artificial
  CRISPR gRNA sequence
gttctgtctttatcaagatg

SEQ ID NO: 743413 - DNA, 20 bp, Artificial
  CRISPR gRNA sequence
tctgtctttatcaagatgca

SEQ ID NO: 743414 - DNA, 20 bp, Artificial
  CRISPR gRNA sequence
ctgtctttatcaagatgcag

SEQ ID NO: 743415 - DNA, 20 bp, Artificial
  CRISPR gRNA sequence
tgtctttatcaagatgcaga

SEQ ID NO: 743416 - DNA, 20 bp, Artificial
  CRISPR gRNA sequence
tatcaagatgcagagggaaa

SEQ ID NO: 743417 - DNA, 20 bp, Artificial
  CRISPR gRNA sequence
tcaagatgcagagggaaaca

SEQ ID NO: 743418 - DNA, 20 bp, Artificial
  CRISPR gRNA sequence
caagatgcagagggaaacag

SEQ ID NO: 743419 - DNA, 20 bp, Artificial
  CRISPR gRNA sequence
tgcagagggaaacagaggca

SEQ ID NO: 743420 - DNA, 20 bp, Artificial
  CRISPR gRNA sequence
aaacagaggcatggatcaat

SEQ ID NO: 743421 - DNA, 20 bp, Artificial
  CRISPR gRNA sequence
aacagaggcatggatcaatc

SEQ ID NO: 743422 - DNA, 20 bp, Artificial
  CRISPR gRNA sequence
aggcatggatcaatcaggac

SEQ ID NO: 743423 - DNA, 20 bp, Artificial
  CRISPR gRNA sequence
ggcatggatcaatcaggact

SEQ ID NO: 743424 - DNA, 20 bp, Artificial
  CRISPR gRNA sequence
gcatggatcaatcaggactg

SEQ ID NO: 743425 - DNA, 20 bp, Artificial
  CRISPR gRNA sequence
caatcaggactggggctgcc

SEQ ID NO: 743426 - DNA, 20 bp, Artificial
  CRISPR gRNA sequence
aatcaggactggggctgcca

SEQ ID NO: 743427 - DNA, 20 bp, Artificial
  CRISPR gRNA sequence
ggactggggctgccaaggct

SEQ ID NO: 743428 - DNA, 20 bp, Artificial
  CRISPR gRNA sequence
tggggctgccaaggctaaga

SEQ ID NO: 743429 - DNA, 20 bp, Artificial
  CRISPR gRNA sequence
ggggctgccaaggctaagaa

SEQ ID NO: 743430 - DNA, 20 bp, Artificial
  CRISPR gRNA sequence
gctgccaaggctaagaaagg

SEQ ID NO: 743431 - DNA, 20 bp, Artificial
  CRISPR gRNA sequence
gctaagaaaggaagcgtcac

SEQ ID NO: 743432 - DNA, 20 bp, Artificial
  CRISPR gRNA sequence
ctaagaaaggaagcgtcaca

SEQ ID NO: 743433 - DNA, 20 bp, Artificial
  CRISPR gRNA sequence
aaaggaagcgtcacaaggca

SEQ ID NO: 743434 - DNA, 20 bp, Artificial
  CRISPR gRNA sequence
aaggaagcgtcacaaggcat

SEQ ID NO: 743435 - DNA, 20 bp, Artificial
  CRISPR gRNA sequence
agcgtcacaaggcataggct

SEQ ID NO: 743436 - DNA, 20 bp, Artificial
  CRISPR gRNA sequence
gcgtcacaaggcataggctc

SEQ ID NO: 743437 - DNA, 20 bp, Artificial
  CRISPR gRNA sequence
cgtcacaaggcataggctca

SEQ ID NO: 743438 - DNA, 20 bp, Artificial
  CRISPR gRNA sequence
aggcataggctcagggcctg

SEQ ID NO: 743439 - DNA, 20 bp, Artificial
  CRISPR gRNA sequence
ataggctcagggcctgaagc

SEQ ID NO: 743440 - DNA, 20 bp, Artificial
  CRISPR gRNA sequence
gctcagggcctgaagccagc

SEQ ID NO: 743441 - DNA, 20 bp, Artificial
  CRISPR gRNA sequence
tgaagccagcaagtctgccc

SEQ ID NO: 743442 - DNA, 20 bp, Artificial
  CRISPR gRNA sequence
gaagccagcaagtctgccct

SEQ ID NO: 743443 - DNA, 20 bp, Artificial
  CRISPR gRNA sequence
aagccagcaagtctgccctg

SEQ ID NO: 743444 - DNA, 20 bp, Artificial
  CRISPR gRNA sequence
aagtctgccctggggctttc

SEQ ID NO: 743445 - DNA, 20 bp, Artificial
  CRISPR gRNA sequence
ctgccctggggctttctggc

SEQ ID NO: 743446 - DNA, 20 bp, Artificial
  CRISPR gRNA sequence
cctggggctttctggccagt

SEQ ID NO: 743447 - DNA, 20 bp, Artificial
  CRISPR gRNA sequence
ctggggctttctggccagtg

SEQ ID NO: 743448 - DNA, 20 bp, Artificial
  CRISPR gRNA sequence
ctttctggccagtgaggaca

SEQ ID NO: 743449 - DNA, 20 bp, Artificial
  CRISPR gRNA sequence
tttctggccagtgaggacaa

SEQ ID NO: 743450 - DNA, 20 bp, Artificial
  CRISPR gRNA sequence
ttctggccagtgaggacaaa

SEQ ID NO: 743451 - DNA, 20 bp, Artificial
  CRISPR gRNA sequence
agtgaggacaaagggcatct

SEQ ID NO: 743452 - DNA, 20 bp, Artificial
  CRISPR gRNA sequence
tttattgatacctgcccccg

SEQ ID NO: 743453 - DNA, 20 bp, Artificial
  CRISPR gRNA sequence
ttattgatacctgcccccgc

SEQ ID NO: 743454 - DNA, 20 bp, Artificial
  CRISPR gRNA sequence
ttgatacctgcccccgcagg

SEQ ID NO: 743455 - DNA, 20 bp, Artificial
  CRISPR gRNA sequence
caggaagtgtccattcacat

SEQ ID NO: 743456 - DNA, 20 bp, Artificial
  CRISPR gRNA sequence
gtgtccattcacatcagacc

SEQ ID NO: 743457 - DNA, 20 bp, Artificial
  CRISPR gRNA sequence
tgtccattcacatcagacca

SEQ ID NO: 743458 - DNA, 20 bp, Artificial
  CRISPR gRNA sequence
gtccattcacatcagaccaa

SEQ ID NO: 743459 - DNA, 20 bp, Artificial
  CRISPR gRNA sequence
tccattcacatcagaccaag

SEQ ID NO: 743460 - DNA, 20 bp, Artificial
  CRISPR gRNA sequence
ccattcacatcagaccaagg

SEQ ID NO: 743461 - DNA, 20 bp, Artificial
  CRISPR gRNA sequence
tcacatcagaccaagggggc

SEQ ID NO: 743462 - DNA, 20 bp, Artificial
  CRISPR gRNA sequence
cacatcagaccaagggggct

SEQ ID NO: 743463 - DNA, 20 bp, Artificial
  CRISPR gRNA sequence
atcagaccaagggggctggg

SEQ ID NO: 743464 - DNA, 20 bp, Artificial
  CRISPR gRNA sequence
tcagaccaagggggctggga

SEQ ID NO: 743465 - DNA, 20 bp, Artificial
  CRISPR gRNA sequence
cagaccaagggggctgggaa

SEQ ID NO: 743466 - DNA, 20 bp, Artificial
  CRISPR gRNA sequence
agaccaagggggctgggaag

SEQ ID NO: 743467 - DNA, 20 bp, Artificial
  CRISPR gRNA sequence
ccaagggggctgggaagggg

SEQ ID NO: 743468 - DNA, 20 bp, Artificial
  CRISPR gRNA sequence
gggggctgggaaggggaagc

SEQ ID NO: 743469 - DNA, 20 bp, Artificial
  CRISPR gRNA sequence
ggggctgggaaggggaagcc

SEQ ID NO: 743470 - DNA, 20 bp, Artificial
  CRISPR gRNA sequence
ggggaagccaggctctattg

SEQ ID NO: 743471 - DNA, 20 bp, Artificial
  CRISPR gRNA sequence
gggaagccaggctctattga

SEQ ID NO: 743472 - DNA, 20 bp, Artificial
  CRISPR gRNA sequence
aagccaggctctattgaagg

SEQ ID NO: 743473 - DNA, 20 bp, Artificial
  CRISPR gRNA sequence
ccaggctctattgaaggaag

SEQ ID NO: 743474 - DNA, 20 bp, Artificial
  CRISPR gRNA sequence
attgaaggaagcggcacttc

SEQ ID NO: 743475 - DNA, 20 bp, Artificial
  CRISPR gRNA sequence
aagcggcacttccagcacct

SEQ ID NO: 743476 - DNA, 20 bp, Artificial
  CRISPR gRNA sequence
agcggcacttccagcacctt

SEQ ID NO: 743477 - DNA, 20 bp, Artificial
  CRISPR gRNA sequence
gcacttccagcaccttggga

SEQ ID NO: 743478 - DNA, 20 bp, Artificial
  CRISPR gRNA sequence
tgggaaagcctccgtgcatc

SEQ ID NO: 743479 - DNA, 20 bp, Artificial
  CRISPR gRNA sequence
gggaaagcctccgtgcatcc

SEQ ID NO: 743480 - DNA, 20 bp, Artificial
  CRISPR gRNA sequence
ggaaagcctccgtgcatccg

SEQ ID NO: 743481 - DNA, 20 bp, Artificial
  CRISPR gRNA sequence
agcctccgtgcatccggggc

SEQ ID NO: 743482 - DNA, 20 bp, Artificial
  CRISPR gRNA sequence
cctccgtgcatccggggctg

SEQ ID NO: 743483 - DNA, 20 bp, Artificial
  CRISPR gRNA sequence
cgtgcatccggggctggagc

SEQ ID NO: 743484 - DNA, 20 bp, Artificial
  CRISPR gRNA sequence
tgcatccggggctggagctg

SEQ ID NO: 743485 - DNA, 20 bp, Artificial
  CRISPR gRNA sequence
gcatccggggctggagctgg

SEQ ID NO: 743486 - DNA, 20 bp, Artificial
  CRISPR gRNA sequence
ccggggctggagctggaggc

SEQ ID NO: 743487 - DNA, 20 bp, Artificial
  CRISPR gRNA sequence
tggaggctagcatgcctccc

SEQ ID NO: 743488 - DNA, 20 bp, Artificial
  CRISPR gRNA sequence
ggaggctagcatgcctcccc

SEQ ID NO: 743489 - DNA, 20 bp, Artificial
  CRISPR gRNA sequence
gaggctagcatgcctcccca

SEQ ID NO: 743490 - DNA, 20 bp, Artificial
  CRISPR gRNA sequence
ggctagcatgcctccccagg

SEQ ID NO: 743491 - DNA, 20 bp, Artificial
  CRISPR gRNA sequence
gctagcatgcctccccaggg

SEQ ID NO: 743492 - DNA, 20 bp, Artificial
  CRISPR gRNA sequence
ctagcatgcctccccaggga

SEQ ID NO: 743493 - DNA, 20 bp, Artificial
  CRISPR gRNA sequence
atgcctccccagggagggcc

SEQ ID NO: 743494 - DNA, 20 bp, Artificial
  CRISPR gRNA sequence
tgcctccccagggagggcct

SEQ ID NO: 743495 - DNA, 20 bp, Artificial
  CRISPR gRNA sequence
ctccccagggagggcctagg

SEQ ID NO: 743496 - DNA, 20 bp, Artificial
  CRISPR gRNA sequence
ccagggagggcctaggcagc

SEQ ID NO: 743497 - DNA, 20 bp, Artificial
  CRISPR gRNA sequence
ggagggcctaggcagctggc

SEQ ID NO: 743498 - DNA, 20 bp, Artificial
  CRISPR gRNA sequence
agggcctaggcagctggcca

SEQ ID NO: 743499 - DNA, 20 bp, Artificial
  CRISPR gRNA sequence
gggcctaggcagctggccag

SEQ ID NO: 743500 - DNA, 20 bp, Artificial
  CRISPR gRNA sequence
aggcagctggccagaggtcc

SEQ ID NO: 743501 - DNA, 20 bp, Artificial
  CRISPR gRNA sequence
tggccagaggtcccggcccg

SEQ ID NO: 743502 - DNA, 20 bp, Artificial
  CRISPR gRNA sequence
ccggcccgtggatgcttctg

SEQ ID NO: 743503 - DNA, 20 bp, Artificial
  CRISPR gRNA sequence
ttctgtggatgaacccctcc

SEQ ID NO: 743504 - DNA, 20 bp, Artificial
  CRISPR gRNA sequence
tgaacccctcccagactccc

SEQ ID NO: 743505 - DNA, 20 bp, Artificial
  CRISPR gRNA sequence
gaacccctcccagactcccc

SEQ ID NO: 743506 - DNA, 20 bp, Artificial
  CRISPR gRNA sequence
ccagactccccaggcccttt

SEQ ID NO: 743507 - DNA, 20 bp, Artificial
  CRISPR gRNA sequence
agactccccaggcccttttg

SEQ ID NO: 743508 - DNA, 20 bp, Artificial
  CRISPR gRNA sequence
gactccccaggcccttttgg

SEQ ID NO: 743509 - DNA, 20 bp, Artificial
  CRISPR gRNA sequence
ctccccaggcccttttggag

SEQ ID NO: 743510 - DNA, 20 bp, Artificial
  CRISPR gRNA sequence
tccccaggcccttttggagg

SEQ ID NO: 743511 - DNA, 20 bp, Artificial
  CRISPR gRNA sequence
ttttggaggaggactgtgtg

SEQ ID NO: 743512 - DNA, 20 bp, Artificial
  CRISPR gRNA sequence
gaggaggactgtgtgcagct

SEQ ID NO: 743513 - DNA, 20 bp, Artificial
  CRISPR gRNA sequence
aggaggactgtgtgcagctc

SEQ ID NO: 743514 - DNA, 20 bp, Artificial
  CRISPR gRNA sequence
ctgtgtgcagctcaggctcc

SEQ ID NO: 743515 - DNA, 20 bp, Artificial
  CRISPR gRNA sequence
gcagctcaggctcccggctc

SEQ ID NO: 743516 - DNA, 20 bp, Artificial
  CRISPR gRNA sequence
ctcaggctcccggctccagc

SEQ ID NO: 743517 - DNA, 20 bp, Artificial
  CRISPR gRNA sequence
cctcacgcttctatgctgtg

SEQ ID NO: 743518 - DNA, 20 bp, Artificial
  CRISPR gRNA sequence
ctatgctgtgaagacgtcct

SEQ ID NO: 743519 - DNA, 20 bp, Artificial
  CRISPR gRNA sequence
tatgctgtgaagacgtcctc

SEQ ID NO: 743520 - DNA, 20 bp, Artificial
  CRISPR gRNA sequence
atgctgtgaagacgtcctca

SEQ ID NO: 743521 - DNA, 20 bp, Artificial
  CRISPR gRNA sequence
gtgaagacgtcctcagggtc

SEQ ID NO: 743522 - DNA, 20 bp, Artificial
  CRISPR gRNA sequence
acgtcctcagggtccagctc

SEQ ID NO: 743523 - DNA, 20 bp, Artificial
  CRISPR gRNA sequence
tgccccctactactctgtgc

SEQ ID NO: 743524 - DNA, 20 bp, Artificial
  CRISPR gRNA sequence
gccccctactactctgtgcc

SEQ ID NO: 743525 - DNA, 20 bp, Artificial
  CRISPR gRNA sequence
tctgtgccaggcatcattct

SEQ ID NO: 743526 - DNA, 20 bp, Artificial
  CRISPR gRNA sequence
attctaagtgcttgtttgtt

SEQ ID NO: 743527 - DNA, 20 bp, Artificial
  CRISPR gRNA sequence
taagtgcttgtttgtttggt

SEQ ID NO: 743528 - DNA, 20 bp, Artificial
  CRISPR gRNA sequence
tgttgttgttgttgttgttt

SEQ ID NO: 743529 - DNA, 20 bp, Artificial
  CRISPR gRNA sequence
gttgttgttgttgtttgaga

SEQ ID NO: 743530 - DNA, 20 bp, Artificial
  CRISPR gRNA sequence
tgttgttgttgtttgagatg

SEQ ID NO: 743531 - DNA, 20 bp, Artificial
  CRISPR gRNA sequence
tggagtctcgctctgttgcc

SEQ ID NO: 743532 - DNA, 20 bp, Artificial
  CRISPR gRNA sequence
ggagtctcgctctgttgccc

SEQ ID NO: 743533 - DNA, 20 bp, Artificial
  CRISPR gRNA sequence
tctcgctctgttgcccaggc

SEQ ID NO: 743534 - DNA, 20 bp, Artificial
  CRISPR gRNA sequence
tcgctctgttgcccaggctg

SEQ ID NO: 743535 - DNA, 20 bp, Artificial
  CRISPR gRNA sequence
ctgttgcccaggctggagtt

SEQ ID NO: 743536 - DNA, 20 bp, Artificial
  CRISPR gRNA sequence
ttgcccaggctggagttcag

SEQ ID NO: 743537 - DNA, 20 bp, Artificial
  CRISPR gRNA sequence
ggagttcagtggtgcaatct

SEQ ID NO: 743538 - DNA, 20 bp, Artificial
  CRISPR gRNA sequence
tcactgcaacctccgcctcc

SEQ ID NO: 743539 - DNA, 20 bp, Artificial
  CRISPR gRNA sequence
cactgcaacctccgcctccc

SEQ ID NO: 743540 - DNA, 20 bp, Artificial
  CRISPR gRNA sequence
aacctccgcctcccaggttg

SEQ ID NO: 743541 - DNA, 20 bp, Artificial
  CRISPR gRNA sequence
ttgaagcaactctcctgcct

SEQ ID NO: 743542 - DNA, 20 bp, Artificial
  CRISPR gRNA sequence
ctctcctgcctcagcctccc

SEQ ID NO: 743543 - DNA, 20 bp, Artificial
  CRISPR gRNA sequence
tcctgcctcagcctcccgag

SEQ ID NO: 743544 - DNA, 20 bp, Artificial
  CRISPR gRNA sequence
gcctcagcctcccgagtagc

SEQ ID NO: 743545 - DNA, 20 bp, Artificial
  CRISPR gRNA sequence
cctcagcctcccgagtagct

SEQ ID NO: 743546 - DNA, 20 bp, Artificial
  CRISPR gRNA sequence
ctcccgagtagctgggacta

SEQ ID NO: 743547 - DNA, 20 bp, Artificial
  CRISPR gRNA sequence
tcccgagtagctgggactac

SEQ ID NO: 743548 - DNA, 20 bp, Artificial
  CRISPR gRNA sequence
caggcacccgccaccacgcc

SEQ ID NO: 743549 - DNA, 20 bp, Artificial
  CRISPR gRNA sequence
ctggctaatttttgtatttt

SEQ ID NO: 743550 - DNA, 20 bp, Artificial
  CRISPR gRNA sequence
gctaatttttgtatttttag

SEQ ID NO: 743551 - DNA, 20 bp, Artificial
  CRISPR gRNA sequence
taatttttgtatttttagta

SEQ ID NO: 743552 - DNA, 20 bp, Artificial
  CRISPR gRNA sequence
ttttgtatttttagtagaga

SEQ ID NO: 743553 - DNA, 20 bp, Artificial
  CRISPR gRNA sequence
tttgtatttttagtagagac

SEQ ID NO: 743554 - DNA, 20 bp, Artificial
  CRISPR gRNA sequence
ttgtatttttagtagagacg

SEQ ID NO: 743555 - DNA, 20 bp, Artificial
  CRISPR gRNA sequence
gagacggggtttcaccacgt

SEQ ID NO: 743556 - DNA, 20 bp, Artificial
  CRISPR gRNA sequence
cggggtttcaccacgttggc

SEQ ID NO: 743557 - DNA, 20 bp, Artificial
  CRISPR gRNA sequence
ggggtttcaccacgttggcc

SEQ ID NO: 743558 - DNA, 20 bp, Artificial
  CRISPR gRNA sequence
tttcaccacgttggccaggc

SEQ ID NO: 743559 - DNA, 20 bp, Artificial
  CRISPR gRNA sequence
ccacccgcctcgtcctcccc

SEQ ID NO: 743560 - DNA, 20 bp, Artificial
  CRISPR gRNA sequence
gcctcgtcctccccaagtgc

SEQ ID NO: 743561 - DNA, 20 bp, Artificial
  CRISPR gRNA sequence
cctcgtcctccccaagtgct

SEQ ID NO: 743562 - DNA, 20 bp, Artificial
  CRISPR gRNA sequence
ctccccaagtgctgggatta

SEQ ID NO: 743563 - DNA, 20 bp, Artificial
  CRISPR gRNA sequence
tccccaagtgctgggattac

SEQ ID NO: 743564 - DNA, 20 bp, Artificial
  CRISPR gRNA sequence
cccaagtgctgggattacag

SEQ ID NO: 743565 - DNA, 20 bp, Artificial
  CRISPR gRNA sequence
agtgctgggattacaggagt

SEQ ID NO: 743566 - DNA, 20 bp, Artificial
  CRISPR gRNA sequence
caggagtgagccactgtgcc

SEQ ID NO: 743567 - DNA, 20 bp, Artificial
  CRISPR gRNA sequence
agccactgtgcctggccgtt

SEQ ID NO: 743568 - DNA, 20 bp, Artificial
  CRISPR gRNA sequence
actgtgcctggccgtttggt

SEQ ID NO: 743569 - DNA, 20 bp, Artificial
  CRISPR gRNA sequence
gccgtttggttggttttctt

SEQ ID NO: 743570 - DNA, 20 bp, Artificial
  CRISPR gRNA sequence
tttggttggttttctttagt

SEQ ID NO: 743571 - DNA, 20 bp, Artificial
  CRISPR gRNA sequence
gttggttttctttagtgagc

SEQ ID NO: 743572 - DNA, 20 bp, Artificial
  CRISPR gRNA sequence
ttggttttctttagtgagct

SEQ ID NO: 743573 - DNA, 20 bp, Artificial
  CRISPR gRNA sequence
tggttttctttagtgagcta

SEQ ID NO: 743574 - DNA, 20 bp, Artificial
  CRISPR gRNA sequence
ctagggtcttgctcttcact

SEQ ID NO: 743575 - DNA, 20 bp, Artificial
  CRISPR gRNA sequence
tagggtcttgctcttcactc

SEQ ID NO: 743576 - DNA, 20 bp, Artificial
  CRISPR gRNA sequence
gtcttgctcttcactcaggc

SEQ ID NO: 743577 - DNA, 20 bp, Artificial
  CRISPR gRNA sequence
tcttcactcaggctggaatg

SEQ ID NO: 743578 - DNA, 20 bp, Artificial
  CRISPR gRNA sequence
ggctggaatgcagtgacaat

SEQ ID NO: 743579 - DNA, 20 bp, Artificial
  CRISPR gRNA sequence
atgcagtgacaatgagatca

SEQ ID NO: 743580 - DNA, 20 bp, Artificial
  CRISPR gRNA sequence
ccactgtaacctcgaactca

SEQ ID NO: 743581 - DNA, 20 bp, Artificial
  CRISPR gRNA sequence
cactgtaacctcgaactcat

SEQ ID NO: 743582 - DNA, 20 bp, Artificial
  CRISPR gRNA sequence
aacctcgaactcatgggctc

SEQ ID NO: 743583 - DNA, 20 bp, Artificial
  CRISPR gRNA sequence
tcccacccctgcctcccaac

SEQ ID NO: 743584 - DNA, 20 bp, Artificial
  CRISPR gRNA sequence
cccacccctgcctcccaact

SEQ ID NO: 743585 - DNA, 20 bp, Artificial
  CRISPR gRNA sequence
ctgcctcccaactaggacta

SEQ ID NO: 743586 - DNA, 20 bp, Artificial
  CRISPR gRNA sequence
cagacacatgccactatgcc

SEQ ID NO: 743587 - DNA, 20 bp, Artificial
  CRISPR gRNA sequence
gctaatttttaaatttttca

SEQ ID NO: 743588 - DNA, 20 bp, Artificial
  CRISPR gRNA sequence
ttttaaatttttcatagtga

SEQ ID NO: 743589 - DNA, 20 bp, Artificial
  CRISPR gRNA sequence
tttaaatttttcatagtgat

SEQ ID NO: 743590 - DNA, 20 bp, Artificial
  CRISPR gRNA sequence
ttaaatttttcatagtgatg

SEQ ID NO: 743591 - DNA, 20 bp, Artificial
  CRISPR gRNA sequence
tggggtctcgttatgttgtc

SEQ ID NO: 743592 - DNA, 20 bp, Artificial
  CRISPR gRNA sequence
ggggtctcgttatgttgtcc

SEQ ID NO: 743593 - DNA, 20 bp, Artificial
  CRISPR gRNA sequence
tctcgttatgttgtccaggc

SEQ ID NO: 743594 - DNA, 20 bp, Artificial
  CRISPR gRNA sequence
tgttgtccaggctggtcccc

SEQ ID NO: 743595 - DNA, 20 bp, Artificial
  CRISPR gRNA sequence
gtcccctggcttgaaactcc

SEQ ID NO: 743596 - DNA, 20 bp, Artificial
  CRISPR gRNA sequence
ggcttgaaactcctggcttc

SEQ ID NO: 743597 - DNA, 20 bp, Artificial
  CRISPR gRNA sequence
cttgaaactcctggcttcaa

SEQ ID NO: 743598 - DNA, 20 bp, Artificial
  CRISPR gRNA sequence
ttcaagagatcctcccacct

SEQ ID NO: 743599 - DNA, 20 bp, Artificial
  CRISPR gRNA sequence
cctcccacctcagcctccca

SEQ ID NO: 743600 - DNA, 20 bp, Artificial
  CRISPR gRNA sequence
acctcagcctcccaaagtgc

SEQ ID NO: 743601 - DNA, 20 bp, Artificial
  CRISPR gRNA sequence
cctcagcctcccaaagtgct

SEQ ID NO: 743602 - DNA, 20 bp, Artificial
  CRISPR gRNA sequence
ctcccaaagtgctgggatta

SEQ ID NO: 743603 - DNA, 20 bp, Artificial
  CRISPR gRNA sequence
tcccaaagtgctgggattac

SEQ ID NO: 743604 - DNA, 20 bp, Artificial
  CRISPR gRNA sequence
agtgctgggattacaggcat

SEQ ID NO: 743605 - DNA, 20 bp, Artificial
  CRISPR gRNA sequence
caggcatgagccactgtgct

SEQ ID NO: 743606 - DNA, 20 bp, Artificial
  CRISPR gRNA sequence
tcattctaaacacttttaca

SEQ ID NO: 743607 - DNA, 20 bp, Artificial
  CRISPR gRNA sequence
ctaaacacttttacatagat

SEQ ID NO: 743608 - DNA, 20 bp, Artificial
  CRISPR gRNA sequence
atgtaatccttccaccctat

SEQ ID NO: 743609 - DNA, 20 bp, Artificial
  CRISPR gRNA sequence
tgtaatccttccaccctatg

SEQ ID NO: 743610 - DNA, 20 bp, Artificial
  CRISPR gRNA sequence
aatccttccaccctatgagg

SEQ ID NO: 743611 - DNA, 20 bp, Artificial
  CRISPR gRNA sequence
atccttccaccctatgaggt

SEQ ID NO: 743612 - DNA, 20 bp, Artificial
  CRISPR gRNA sequence
ccaccctatgaggtaggtac

SEQ ID NO: 743613 - DNA, 20 bp, Artificial
  CRISPR gRNA sequence
ctagtatcatctccatttta

SEQ ID NO: 743614 - DNA, 20 bp, Artificial
  CRISPR gRNA sequence
atcatctccattttacagat

SEQ ID NO: 743615 - DNA, 20 bp, Artificial
  CRISPR gRNA sequence
ccattttacagatgagaaaa

SEQ ID NO: 743616 - DNA, 20 bp, Artificial
  CRISPR gRNA sequence
ttttacagatgagaaaacgg

SEQ ID NO: 743617 - DNA, 20 bp, Artificial
  CRISPR gRNA sequence
cagatgagaaaacggaagca

SEQ ID NO: 743618 - DNA, 20 bp, Artificial
  CRISPR gRNA sequence
gatgagaaaacggaagcaca

SEQ ID NO: 743619 - DNA, 20 bp, Artificial
  CRISPR gRNA sequence
tgagaaaacggaagcacaga

SEQ ID NO: 743620 - DNA, 20 bp, Artificial
  CRISPR gRNA sequence
aaacggaagcacagagagat

SEQ ID NO: 743621 - DNA, 20 bp, Artificial
  CRISPR gRNA sequence
agagattagtatcttgccca

SEQ ID NO: 743622 - DNA, 20 bp, Artificial
  CRISPR gRNA sequence
cccacagcctcacaactaat

SEQ ID NO: 743623 - DNA, 20 bp, Artificial
  CRISPR gRNA sequence
gcctcacaactaataagtga

SEQ ID NO: 743624 - DNA, 20 bp, Artificial
  CRISPR gRNA sequence
caactaataagtgatggtgt

SEQ ID NO: 743625 - DNA, 20 bp, Artificial
  CRISPR gRNA sequence
aactaataagtgatggtgtc

SEQ ID NO: 743626 - DNA, 20 bp, Artificial
  CRISPR gRNA sequence
atggtgtcaggatctgaacc

SEQ ID NO: 743627 - DNA, 20 bp, Artificial
  CRISPR gRNA sequence
tggtgtcaggatctgaaccc

SEQ ID NO: 743628 - DNA, 20 bp, Artificial
  CRISPR gRNA sequence
tgtcaggatctgaacccagg

SEQ ID NO: 743629 - DNA, 20 bp, Artificial
  CRISPR gRNA sequence
aggatctgaacccaggtagt

SEQ ID NO: 743630 - DNA, 20 bp, Artificial
  CRISPR gRNA sequence
gaacccaggtagtcagcctc

SEQ ID NO: 743631 - DNA, 20 bp, Artificial
  CRISPR gRNA sequence
acccaggtagtcagcctctg

SEQ ID NO: 743632 - DNA, 20 bp, Artificial
  CRISPR gRNA sequence
cccaggtagtcagcctctgg

SEQ ID NO: 743633 - DNA, 20 bp, Artificial
  CRISPR gRNA sequence
gtagtcagcctctggaggtc

SEQ ID NO: 743634 - DNA, 20 bp, Artificial
  CRISPR gRNA sequence
ggtgccatctgactactctc

SEQ ID NO: 743635 - DNA, 20 bp, Artificial
  CRISPR gRNA sequence
tgccatctgactactctcta

SEQ ID NO: 743636 - DNA, 20 bp, Artificial
  CRISPR gRNA sequence
tctgactactctctagagaa

SEQ ID NO: 743637 - DNA, 20 bp, Artificial
  CRISPR gRNA sequence
tgactactctctagagaata

SEQ ID NO: 743638 - DNA, 20 bp, Artificial
  CRISPR gRNA sequence
gactactctctagagaatag

SEQ ID NO: 743639 - DNA, 20 bp, Artificial
  CRISPR gRNA sequence
tactctctagagaatagagg

SEQ ID NO: 743640 - DNA, 20 bp, Artificial
  CRISPR gRNA sequence
ctctagagaatagaggtagc

SEQ ID NO: 743641 - DNA, 20 bp, Artificial
  CRISPR gRNA sequence
tctagagaatagaggtagct

SEQ ID NO: 743642 - DNA, 20 bp, Artificial
  CRISPR gRNA sequence
ctagagaatagaggtagctg

SEQ ID NO: 743643 - DNA, 20 bp, Artificial
  CRISPR gRNA sequence
agaggtagctggggactgac

SEQ ID NO: 743644 - DNA, 20 bp, Artificial
  CRISPR gRNA sequence
aggtagctggggactgactg

SEQ ID NO: 743645 - DNA, 20 bp, Artificial
  CRISPR gRNA sequence
ggtagctggggactgactgg

SEQ ID NO: 743646 - DNA, 20 bp, Artificial
  CRISPR gRNA sequence
gaggccccacctccttcttg

SEQ ID NO: 743647 - DNA, 20 bp, Artificial
  CRISPR gRNA sequence
ccccacctccttcttgaaga

SEQ ID NO: 743648 - DNA, 20 bp, Artificial
  CRISPR gRNA sequence
acaaatgtcatgaccaatga

SEQ ID NO: 743649 - DNA, 20 bp, Artificial
  CRISPR gRNA sequence
tgtcatgaccaatgaaagcc

SEQ ID NO: 743650 - DNA, 20 bp, Artificial
  CRISPR gRNA sequence
caatgaaagcccagcttgcc

SEQ ID NO: 743651 - DNA, 20 bp, Artificial
  CRISPR gRNA sequence
gcctggccacgtctaccaca

SEQ ID NO: 743652 - DNA, 20 bp, Artificial
  CRISPR gRNA sequence
ctaccacatagttttacttt

SEQ ID NO: 743653 - DNA, 20 bp, Artificial
  CRISPR gRNA sequence
aaataacattgaatcatata

SEQ ID NO: 743654 - DNA, 20 bp, Artificial
  CRISPR gRNA sequence
taacattgaatcatatatag

SEQ ID NO: 743655 - DNA, 20 bp, Artificial
  CRISPR gRNA sequence
acattgaatcatatatagaa

SEQ ID NO: 743656 - DNA, 20 bp, Artificial
  CRISPR gRNA sequence
cattgaatcatatatagaag

SEQ ID NO: 743657 - DNA, 20 bp, Artificial
  CRISPR gRNA sequence
tattccctttacaattattt

SEQ ID NO: 743658 - DNA, 20 bp, Artificial
  CRISPR gRNA sequence
tttcagtcctgattacatca

SEQ ID NO: 743659 - DNA, 20 bp, Artificial
  CRISPR gRNA sequence
tcagtcctgattacatcaaa

SEQ ID NO: 743660 - DNA, 20 bp, Artificial
  CRISPR gRNA sequence
tcctgattacatcaaagaga

SEQ ID NO: 743661 - DNA, 20 bp, Artificial
  CRISPR gRNA sequence
ttacatcaaagagaaagtct

SEQ ID NO: 743662 - DNA, 20 bp, Artificial
  CRISPR gRNA sequence
attttattttaattttttgc

SEQ ID NO: 743663 - DNA, 20 bp, Artificial
  CRISPR gRNA sequence
ttttattttaattttttgca

SEQ ID NO: 743664 - DNA, 20 bp, Artificial
  CRISPR gRNA sequence
tttattttaattttttgcaa

SEQ ID NO: 743665 - DNA, 20 bp, Artificial
  CRISPR gRNA sequence
ttttaattttttgcaaggga

SEQ ID NO: 743666 - DNA, 20 bp, Artificial
  CRISPR gRNA sequence
taattttttgcaagggaaag

SEQ ID NO: 743667 - DNA, 20 bp, Artificial
  CRISPR gRNA sequence
ttttttgcaagggaaagcag

SEQ ID NO: 743668 - DNA, 20 bp, Artificial
  CRISPR gRNA sequence
caagggaaagcagcagtttt

SEQ ID NO: 743669 - DNA, 20 bp, Artificial
  CRISPR gRNA sequence
agcagcagttttcagactcc

SEQ ID NO: 743670 - DNA, 20 bp, Artificial
  CRISPR gRNA sequence
tttcagactccgagccttcc

SEQ ID NO: 743671 - DNA, 20 bp, Artificial
  CRISPR gRNA sequence
ttcagactccgagccttccc

SEQ ID NO: 743672 - DNA, 20 bp, Artificial
  CRISPR gRNA sequence
ctccgagccttcccaggcta

SEQ ID NO: 743673 - DNA, 20 bp, Artificial
  CRISPR gRNA sequence
cccaggctaaagtttccaac

SEQ ID NO: 743674 - DNA, 20 bp, Artificial
  CRISPR gRNA sequence
tagaattcaatacccttata

SEQ ID NO: 743675 - DNA, 20 bp, Artificial
  CRISPR gRNA sequence
tttcctgttacgttctttta

SEQ ID NO: 743676 - DNA, 20 bp, Artificial
  CRISPR gRNA sequence
ggttttgttctatttatgac

SEQ ID NO: 743677 - DNA, 20 bp, Artificial
  CRISPR gRNA sequence
ctatttatgacaagtgatac

SEQ ID NO: 743678 - DNA, 20 bp, Artificial
  CRISPR gRNA sequence
tactggctttccactaatga

SEQ ID NO: 743679 - DNA, 20 bp, Artificial
  CRISPR gRNA sequence
ccactaatgacagcgataaa

SEQ ID NO: 743680 - DNA, 20 bp, Artificial
  CRISPR gRNA sequence
cgataaaaagtttcctttta

SEQ ID NO: 743681 - DNA, 20 bp, Artificial
  CRISPR gRNA sequence
agatctacatactcaaataa

SEQ ID NO: 743682 - DNA, 20 bp, Artificial
  CRISPR gRNA sequence
acatactcaaataaaagaat

SEQ ID NO: 743683 - DNA, 20 bp, Artificial
  CRISPR gRNA sequence
tactcaaataaaagaatgag

SEQ ID NO: 743684 - DNA, 20 bp, Artificial
  CRISPR gRNA sequence
taaaagaatgagtagattta

SEQ ID NO: 743685 - DNA, 20 bp, Artificial
  CRISPR gRNA sequence
gtagatttaaagaaaaaaat

SEQ ID NO: 743686 - DNA, 20 bp, Artificial
  CRISPR gRNA sequence
aaaataagtaaatattatga

SEQ ID NO: 743687 - DNA, 20 bp, Artificial
  CRISPR gRNA sequence
aaataagtaaatattatgaa

SEQ ID NO: 743688 - DNA, 20 bp, Artificial
  CRISPR gRNA sequence
taagtaaatattatgaaagg

SEQ ID NO: 743689 - DNA, 20 bp, Artificial
  CRISPR gRNA sequence
attatgaaaggcagacactg

SEQ ID NO: 743690 - DNA, 20 bp, Artificial
  CRISPR gRNA sequence
tatgaaaggcagacactgca

SEQ ID NO: 743691 - DNA, 20 bp, Artificial
  CRISPR gRNA sequence
cagacactgcagagatcaca

SEQ ID NO: 743692 - DNA, 20 bp, Artificial
  CRISPR gRNA sequence
agacactgcagagatcacaa

SEQ ID NO: 743693 - DNA, 20 bp, Artificial
  CRISPR gRNA sequence
gcagagatcacaaaggtgat

SEQ ID NO: 743694 - DNA, 20 bp, Artificial
  CRISPR gRNA sequence
aggtgataagcaaatgactg

SEQ ID NO: 743695 - DNA, 20 bp, Artificial
  CRISPR gRNA sequence
gataagcaaatgactgaagc

SEQ ID NO: 743696 - DNA, 20 bp, Artificial
  CRISPR gRNA sequence
ataagcaaatgactgaagct

SEQ ID NO: 743697 - DNA, 20 bp, Artificial
  CRISPR gRNA sequence
taagcaaatgactgaagcta

SEQ ID NO: 743698 - DNA, 20 bp, Artificial
  CRISPR gRNA sequence
aagctagggaaacaccatca

SEQ ID NO: 743699 - DNA, 20 bp, Artificial
  CRISPR gRNA sequence
accatcatggaattaacctt

SEQ ID NO: 743700 - DNA, 20 bp, Artificial
  CRISPR gRNA sequence
catcatggaattaaccttca

SEQ ID NO: 743701 - DNA, 20 bp, Artificial
  CRISPR gRNA sequence
atcatggaattaaccttcag

SEQ ID NO: 743702 - DNA, 20 bp, Artificial
  CRISPR gRNA sequence
catggaattaaccttcagag

SEQ ID NO: 743703 - DNA, 20 bp, Artificial
  CRISPR gRNA sequence
atggaattaaccttcagagg

SEQ ID NO: 743704 - DNA, 20 bp, Artificial
  CRISPR gRNA sequence
tggaattaaccttcagagga

SEQ ID NO: 743705 - DNA, 20 bp, Artificial
  CRISPR gRNA sequence
aattaaccttcagaggaggg

SEQ ID NO: 743706 - DNA, 20 bp, Artificial
  CRISPR gRNA sequence
aaccttcagaggagggtggt

SEQ ID NO: 743707 - DNA, 20 bp, Artificial
  CRISPR gRNA sequence
ggagggtggtcagcctcact

SEQ ID NO: 743708 - DNA, 20 bp, Artificial
  CRISPR gRNA sequence
cacccaacctgtccattgca

SEQ ID NO: 743709 - DNA, 20 bp, Artificial
  CRISPR gRNA sequence
acctgtccattgcacagaca

SEQ ID NO: 743710 - DNA, 20 bp, Artificial
  CRISPR gRNA sequence
cctgtccattgcacagacaa

SEQ ID NO: 743711 - DNA, 20 bp, Artificial
  CRISPR gRNA sequence
ctgtccattgcacagacaaa

SEQ ID NO: 743712 - DNA, 20 bp, Artificial
  CRISPR gRNA sequence
tgtccattgcacagacaaag

SEQ ID NO: 743713 - DNA, 20 bp, Artificial
  CRISPR gRNA sequence
ccattgcacagacaaagggg

SEQ ID NO: 743714 - DNA, 20 bp, Artificial
  CRISPR gRNA sequence
tgtgtttgtgttcccatgat

SEQ ID NO: 743715 - DNA, 20 bp, Artificial
  CRISPR gRNA sequence
gtgttcccatgatgagtgaa

SEQ ID NO: 743716 - DNA, 20 bp, Artificial
  CRISPR gRNA sequence
ttcccatgatgagtgaacag

SEQ ID NO: 743717 - DNA, 20 bp, Artificial
  CRISPR gRNA sequence
cccatgatgagtgaacagca

SEQ ID NO: 743718 - DNA, 20 bp, Artificial
  CRISPR gRNA sequence
ccatgatgagtgaacagcag

SEQ ID NO: 743719 - DNA, 20 bp, Artificial
  CRISPR gRNA sequence
tgatgagtgaacagcagagg

SEQ ID NO: 743720 - DNA, 20 bp, Artificial
  CRISPR gRNA sequence
gatgagtgaacagcagaggc

SEQ ID NO: 743721 - DNA, 20 bp, Artificial
  CRISPR gRNA sequence
atgagtgaacagcagaggca

SEQ ID NO: 743722 - DNA, 20 bp, Artificial
  CRISPR gRNA sequence
gcagaggcagggtttgaccc

SEQ ID NO: 743723 - DNA, 20 bp, Artificial
  CRISPR gRNA sequence
cagaggcagggtttgacccc

SEQ ID NO: 743724 - DNA, 20 bp, Artificial
  CRISPR gRNA sequence
ggtttgaccccaggtcccca

SEQ ID NO: 743725 - DNA, 20 bp, Artificial
  CRISPR gRNA sequence
gtttgaccccaggtccccat

SEQ ID NO: 743726 - DNA, 20 bp, Artificial
  CRISPR gRNA sequence
cccaggtccccatgggaaat

SEQ ID NO: 743727 - DNA, 20 bp, Artificial
  CRISPR gRNA sequence
atgggaaataagatcctacg

SEQ ID NO: 743728 - DNA, 20 bp, Artificial
  CRISPR gRNA sequence
gaaataagatcctacgcaga

SEQ ID NO: 743729 - DNA, 20 bp, Artificial
  CRISPR gRNA sequence
aaataagatcctacgcagaa

SEQ ID NO: 743730 - DNA, 20 bp, Artificial
  CRISPR gRNA sequence
gatcctacgcagaaaggcta

SEQ ID NO: 743731 - DNA, 20 bp, Artificial
  CRISPR gRNA sequence
atcctacgcagaaaggctaa

SEQ ID NO: 743732 - DNA, 20 bp, Artificial
  CRISPR gRNA sequence
acgcagaaaggctaaaggaa

SEQ ID NO: 743733 - DNA, 20 bp, Artificial
  CRISPR gRNA sequence
cgcagaaaggctaaaggaat

SEQ ID NO: 743734 - DNA, 20 bp, Artificial
  CRISPR gRNA sequence
gctaaaggaatgggcttgct

SEQ ID NO: 743735 - DNA, 20 bp, Artificial
  CRISPR gRNA sequence
aggaatgggcttgcttggct

SEQ ID NO: 743736 - DNA, 20 bp, Artificial
  CRISPR gRNA sequence
atgggcttgcttggcttggt

SEQ ID NO: 743737 - DNA, 20 bp, Artificial
  CRISPR gRNA sequence
ggcttgcttggcttggtaag

SEQ ID NO: 743738 - DNA, 20 bp, Artificial
  CRISPR gRNA sequence
ttgcttggcttggtaagtag

SEQ ID NO: 743739 - DNA, 20 bp, Artificial
  CRISPR gRNA sequence
gcttggcttggtaagtagca

SEQ ID NO: 743740 - DNA, 20 bp, Artificial
  CRISPR gRNA sequence
tagcagagcaacctcattat

SEQ ID NO: 743741 - DNA, 20 bp, Artificial
  CRISPR gRNA sequence
ctcattattggattactgat

SEQ ID NO: 743742 - DNA, 20 bp, Artificial
  CRISPR gRNA sequence
ttattggattactgatgaga

SEQ ID NO: 743743 - DNA, 20 bp, Artificial
  CRISPR gRNA sequence
tggattactgatgagaaaga

SEQ ID NO: 743744 - DNA, 20 bp, Artificial
  CRISPR gRNA sequence
attactgatgagaaagatgg

SEQ ID NO: 743745 - DNA, 20 bp, Artificial
  CRISPR gRNA sequence
gtggccactgtctttgtctt

SEQ ID NO: 743746 - DNA, 20 bp, Artificial
  CRISPR gRNA sequence
actgtctttgtctttggtga

SEQ ID NO: 743747 - DNA, 20 bp, Artificial
  CRISPR gRNA sequence
tctttgtctttggtgatggc

SEQ ID NO: 743748 - DNA, 20 bp, Artificial
  CRISPR gRNA sequence
tctttggtgatggccagcca

SEQ ID NO: 743749 - DNA, 20 bp, Artificial
  CRISPR gRNA sequence
tgatggccagccaaagtgaa

SEQ ID NO: 743750 - DNA, 20 bp, Artificial
  CRISPR gRNA sequence
gtgaatggaccgaatgtaaa

SEQ ID NO: 743751 - DNA, 20 bp, Artificial
  CRISPR gRNA sequence
tggaccgaatgtaaaaagat

SEQ ID NO: 743752 - DNA, 20 bp, Artificial
  CRISPR gRNA sequence
aatgtaaaaagatcagatgt

SEQ ID NO: 743753 - DNA, 20 bp, Artificial
  CRISPR gRNA sequence
taaaaagatcagatgtaaga

SEQ ID NO: 743754 - DNA, 20 bp, Artificial
  CRISPR gRNA sequence
agatgtaagaaagatccacc

SEQ ID NO: 743755 - DNA, 20 bp, Artificial
  CRISPR gRNA sequence
taagaaagatccaccaagat

SEQ ID NO: 743756 - DNA, 20 bp, Artificial
  CRISPR gRNA sequence
tccaccaagataagcaaacc

SEQ ID NO: 743757 - DNA, 20 bp, Artificial
  CRISPR gRNA sequence
ccaccaagataagcaaaccc

SEQ ID NO: 743758 - DNA, 20 bp, Artificial
  CRISPR gRNA sequence
caccaagataagcaaaccca

SEQ ID NO: 743759 - DNA, 20 bp, Artificial
  CRISPR gRNA sequence
aagataagcaaacccagggc

SEQ ID NO: 743760 - DNA, 20 bp, Artificial
  CRISPR gRNA sequence
agataagcaaacccagggcc

SEQ ID NO: 743761 - DNA, 20 bp, Artificial
  CRISPR gRNA sequence
ccagggccaggcttgccttc

SEQ ID NO: 743762 - DNA, 20 bp, Artificial
  CRISPR gRNA sequence
ccccatctcctgacaacttt

SEQ ID NO: 743763 - DNA, 20 bp, Artificial
  CRISPR gRNA sequence
catctcctgacaactttaag

SEQ ID NO: 743764 - DNA, 20 bp, Artificial
  CRISPR gRNA sequence
tctcctgacaactttaagaa

SEQ ID NO: 743765 - DNA, 20 bp, Artificial
  CRISPR gRNA sequence
aactttaagaagagaacctg

SEQ ID NO: 743766 - DNA, 20 bp, Artificial
  CRISPR gRNA sequence
actttaagaagagaacctgt

SEQ ID NO: 743767 - DNA, 20 bp, Artificial
  CRISPR gRNA sequence
agaacctgtaggcacctcca

SEQ ID NO: 743768 - DNA, 20 bp, Artificial
  CRISPR gRNA sequence
gaacctgtaggcacctccat

SEQ ID NO: 743769 - DNA, 20 bp, Artificial
  CRISPR gRNA sequence
aggcacctccatgggcattt

SEQ ID NO: 743770 - DNA, 20 bp, Artificial
  CRISPR gRNA sequence
ccatgggcatttcagactgt

SEQ ID NO: 743771 - DNA, 20 bp, Artificial
  CRISPR gRNA sequence
catgggcatttcagactgtg

SEQ ID NO: 743772 - DNA, 20 bp, Artificial
  CRISPR gRNA sequence
atgggcatttcagactgtga

SEQ ID NO: 743773 - DNA, 20 bp, Artificial
  CRISPR gRNA sequence
tttcagactgtgagggccta

SEQ ID NO: 743774 - DNA, 20 bp, Artificial
  CRISPR gRNA sequence
ttcagactgtgagggcctac

SEQ ID NO: 743775 - DNA, 20 bp, Artificial
  CRISPR gRNA sequence
tcagactgtgagggcctaca

SEQ ID NO: 743776 - DNA, 20 bp, Artificial
  CRISPR gRNA sequence
cagactgtgagggcctacag

SEQ ID NO: 743777 - DNA, 20 bp, Artificial
  CRISPR gRNA sequence
tgagggcctacaggggctca

SEQ ID NO: 743778 - DNA, 20 bp, Artificial
  CRISPR gRNA sequence
gagggcctacaggggctcac

SEQ ID NO: 743779 - DNA, 20 bp, Artificial
  CRISPR gRNA sequence
ggcctacaggggctcacagg

SEQ ID NO: 743780 - DNA, 20 bp, Artificial
  CRISPR gRNA sequence
tacaggggctcacaggtagc

SEQ ID NO: 743781 - DNA, 20 bp, Artificial
  CRISPR gRNA sequence
ggctcacaggtagctggacg

SEQ ID NO: 743782 - DNA, 20 bp, Artificial
  CRISPR gRNA sequence
cccatgcacccttcatactc

SEQ ID NO: 743783 - DNA, 20 bp, Artificial
  CRISPR gRNA sequence
ccatgcacccttcatactcc

SEQ ID NO: 743784 - DNA, 20 bp, Artificial
  CRISPR gRNA sequence
acccttcatactccaggctt

SEQ ID NO: 743785 - DNA, 20 bp, Artificial
  CRISPR gRNA sequence
ccttcatactccaggctttg

SEQ ID NO: 743786 - DNA, 20 bp, Artificial
  CRISPR gRNA sequence
actccaggctttggagaatc

SEQ ID NO: 743787 - DNA, 20 bp, Artificial
  CRISPR gRNA sequence
ggctttggagaatctagtcc

SEQ ID NO: 743788 - DNA, 20 bp, Artificial
  CRISPR gRNA sequence
tggagaatctagtcccagtg

SEQ ID NO: 743789 - DNA, 20 bp, Artificial
  CRISPR gRNA sequence
gaagctcaccaatgccttcc

SEQ ID NO: 743790 - DNA, 20 bp, Artificial
  CRISPR gRNA sequence
aagctcaccaatgccttccc

SEQ ID NO: 743791 - DNA, 20 bp, Artificial
  CRISPR gRNA sequence
accaatgccttcccaggccc

SEQ ID NO: 743792 - DNA, 20 bp, Artificial
  CRISPR gRNA sequence
ccaatgccttcccaggccct

SEQ ID NO: 743793 - DNA, 20 bp, Artificial
  CRISPR gRNA sequence
ccaggccctgggcactccat

SEQ ID NO: 743794 - DNA, 20 bp, Artificial
  CRISPR gRNA sequence
caggccctgggcactccatt

SEQ ID NO: 743795 - DNA, 20 bp, Artificial
  CRISPR gRNA sequence
gggcactccattaggccctg

SEQ ID NO: 743796 - DNA, 20 bp, Artificial
  CRISPR gRNA sequence
gcactccattaggccctgta

SEQ ID NO: 743797 - DNA, 20 bp, Artificial
  CRISPR gRNA sequence
actccattaggccctgtaga

SEQ ID NO: 743798 - DNA, 20 bp, Artificial
  CRISPR gRNA sequence
cattaggccctgtagagagc

SEQ ID NO: 743799 - DNA, 20 bp, Artificial
  CRISPR gRNA sequence
taggccctgtagagagcaag

SEQ ID NO: 743800 - DNA, 20 bp, Artificial
  CRISPR gRNA sequence
cctgtagagagcaagcagct

SEQ ID NO: 743801 - DNA, 20 bp, Artificial
  CRISPR gRNA sequence
tagagagcaagcagcttaga

SEQ ID NO: 743802 - DNA, 20 bp, Artificial
  CRISPR gRNA sequence
gagcaagcagcttagataga

SEQ ID NO: 743803 - DNA, 20 bp, Artificial
  CRISPR gRNA sequence
cagcttagatagaaagccaa

SEQ ID NO: 743804 - DNA, 20 bp, Artificial
  CRISPR gRNA sequence
gatagaaagccaatggcatg

SEQ ID NO: 743805 - DNA, 20 bp, Artificial
  CRISPR gRNA sequence
agccaatggcatgtggcctg

SEQ ID NO: 743806 - DNA, 20 bp, Artificial
  CRISPR gRNA sequence
caatggcatgtggcctgcag

SEQ ID NO: 743807 - DNA, 20 bp, Artificial
  CRISPR gRNA sequence
gcatgtggcctgcagaagcc

SEQ ID NO: 743808 - DNA, 20 bp, Artificial
  CRISPR gRNA sequence
agaaataccataatattaca

SEQ ID NO: 743809 - DNA, 20 bp, Artificial
  CRISPR gRNA sequence
taatattacacagtattcac

SEQ ID NO: 743810 - DNA, 20 bp, Artificial
  CRISPR gRNA sequence
aatattacacagtattcacg

SEQ ID NO: 743811 - DNA, 20 bp, Artificial
  CRISPR gRNA sequence
tattacacagtattcacgag

SEQ ID NO: 743812 - DNA, 20 bp, Artificial
  CRISPR gRNA sequence
acacagtattcacgaggagc

SEQ ID NO: 743813 - DNA, 20 bp, Artificial
  CRISPR gRNA sequence
cacagtattcacgaggagcc

SEQ ID NO: 743814 - DNA, 20 bp, Artificial
  CRISPR gRNA sequence
gaggagccgggtgctgtgtt

SEQ ID NO: 743815 - DNA, 20 bp, Artificial
  CRISPR gRNA sequence
tgtgttaagtgttcgttcat

SEQ ID NO: 743816 - DNA, 20 bp, Artificial
  CRISPR gRNA sequence
gttcgttcattggctcttca

SEQ ID NO: 743817 - DNA, 20 bp, Artificial
  CRISPR gRNA sequence
gctcttcacagttgccctcc

SEQ ID NO: 743818 - DNA, 20 bp, Artificial
  CRISPR gRNA sequence
ctcttcacagttgccctcca

SEQ ID NO: 743819 - DNA, 20 bp, Artificial
  CRISPR gRNA sequence
tcttcacagttgccctccaa

SEQ ID NO: 743820 - DNA, 20 bp, Artificial
  CRISPR gRNA sequence
ttcacagttgccctccaagg

SEQ ID NO: 743821 - DNA, 20 bp, Artificial
  CRISPR gRNA sequence
tcacagttgccctccaaggg

SEQ ID NO: 743822 - DNA, 20 bp, Artificial
  CRISPR gRNA sequence
cagttgccctccaagggagg

SEQ ID NO: 743823 - DNA, 20 bp, Artificial
  CRISPR gRNA sequence
gtggtatcatcttcccactt

SEQ ID NO: 743824 - DNA, 20 bp, Artificial
  CRISPR gRNA sequence
ggtatcatcttcccacttta

SEQ ID NO: 743825 - DNA, 20 bp, Artificial
  CRISPR gRNA sequence
gtatcatcttcccactttag

SEQ ID NO: 743826 - DNA, 20 bp, Artificial
  CRISPR gRNA sequence
tatcatcttcccactttaga

SEQ ID NO: 743827 - DNA, 20 bp, Artificial
  CRISPR gRNA sequence
tcatcttcccactttagagg

SEQ ID NO: 743828 - DNA, 20 bp, Artificial
  CRISPR gRNA sequence
catcttcccactttagaggg

SEQ ID NO: 743829 - DNA, 20 bp, Artificial
  CRISPR gRNA sequence
atcttcccactttagaggga

SEQ ID NO: 743830 - DNA, 20 bp, Artificial
  CRISPR gRNA sequence
tcttcccactttagagggag

SEQ ID NO: 743831 - DNA, 20 bp, Artificial
  CRISPR gRNA sequence
tagagggaggggaacttgct

SEQ ID NO: 743832 - DNA, 20 bp, Artificial
  CRISPR gRNA sequence
agagggaggggaacttgctc

SEQ ID NO: 743833 - DNA, 20 bp, Artificial
  CRISPR gRNA sequence
gagggaggggaacttgctca

SEQ ID NO: 743834 - DNA, 20 bp, Artificial
  CRISPR gRNA sequence
gggaggggaacttgctcagg

SEQ ID NO: 743835 - DNA, 20 bp, Artificial
  CRISPR gRNA sequence
gaataacttgtccaatatca

SEQ ID NO: 743836 - DNA, 20 bp, Artificial
  CRISPR gRNA sequence
ataacttgtccaatatcaca

SEQ ID NO: 743837 - DNA, 20 bp, Artificial
  CRISPR gRNA sequence
acttgtccaatatcacagag

SEQ ID NO: 743838 - DNA, 20 bp, Artificial
  CRISPR gRNA sequence
caatatcacagagcagtaaa

SEQ ID NO: 743839 - DNA, 20 bp, Artificial
  CRISPR gRNA sequence
agagcagtaaatggccatct

SEQ ID NO: 743840 - DNA, 20 bp, Artificial
  CRISPR gRNA sequence
gagcagtaaatggccatctt

SEQ ID NO: 743841 - DNA, 20 bp, Artificial
  CRISPR gRNA sequence
aaatggccatcttgggattt

SEQ ID NO: 743842 - DNA, 20 bp, Artificial
  CRISPR gRNA sequence
gccatcttgggatttaagcc

SEQ ID NO: 743843 - DNA, 20 bp, Artificial
  CRISPR gRNA sequence
ccatcttgggatttaagcct

SEQ ID NO: 743844 - DNA, 20 bp, Artificial
  CRISPR gRNA sequence
tgggatttaagcctaggtct

SEQ ID NO: 743845 - DNA, 20 bp, Artificial
  CRISPR gRNA sequence
ctaggtctgagtgactcaca

SEQ ID NO: 743846 - DNA, 20 bp, Artificial
  CRISPR gRNA sequence
ctgagtgactcacaaagccc

SEQ ID NO: 743847 - DNA, 20 bp, Artificial
  CRISPR gRNA sequence
gagtgactcacaaagcccaa

SEQ ID NO: 743848 - DNA, 20 bp, Artificial
  CRISPR gRNA sequence
actcacaaagcccaagagtt

SEQ ID NO: 743849 - DNA, 20 bp, Artificial
  CRISPR gRNA sequence
acaaagcccaagagttaagc

SEQ ID NO: 743850 - DNA, 20 bp, Artificial
  CRISPR gRNA sequence
caaagcccaagagttaagca

SEQ ID NO: 743851 - DNA, 20 bp, Artificial
  CRISPR gRNA sequence
aaagcccaagagttaagcaa

SEQ ID NO: 743852 - DNA, 20 bp, Artificial
  CRISPR gRNA sequence
aagcccaagagttaagcaag

SEQ ID NO: 743853 - DNA, 20 bp, Artificial
  CRISPR gRNA sequence
gagttaagcaaggggctgta

SEQ ID NO: 743854 - DNA, 20 bp, Artificial
  CRISPR gRNA sequence
ttaagcaaggggctgtacgg

SEQ ID NO: 743855 - DNA, 20 bp, Artificial
  CRISPR gRNA sequence
aaggggctgtacggaagccc

SEQ ID NO: 743856 - DNA, 20 bp, Artificial
  CRISPR gRNA sequence
agccctggcatgcatgtccc

SEQ ID NO: 743857 - DNA, 20 bp, Artificial
  CRISPR gRNA sequence
gtccctggctttgccatata

SEQ ID NO: 743858 - DNA, 20 bp, Artificial
  CRISPR gRNA sequence
tccctggctttgccatatac

SEQ ID NO: 743859 - DNA, 20 bp, Artificial
  CRISPR gRNA sequence
tttgccatatacaggcatgc

SEQ ID NO: 743860 - DNA, 20 bp, Artificial
  CRISPR gRNA sequence
ttgccatatacaggcatgct

SEQ ID NO: 743861 - DNA, 20 bp, Artificial
  CRISPR gRNA sequence
atacaggcatgctgggactg

SEQ ID NO: 743862 - DNA, 20 bp, Artificial
  CRISPR gRNA sequence
ggcatgctgggactgcagct

SEQ ID NO: 743863 - DNA, 20 bp, Artificial
  CRISPR gRNA sequence
gcatgctgggactgcagcta

SEQ ID NO: 743864 - DNA, 20 bp, Artificial
  CRISPR gRNA sequence
catgctgggactgcagctaa

SEQ ID NO: 743865 - DNA, 20 bp, Artificial
  CRISPR gRNA sequence
actgcagctaagggcatctg

SEQ ID NO: 743866 - DNA, 20 bp, Artificial
  CRISPR gRNA sequence
ctgcagctaagggcatctgt

SEQ ID NO: 743867 - DNA, 20 bp, Artificial
  CRISPR gRNA sequence
tgcagctaagggcatctgtg

SEQ ID NO: 743868 - DNA, 20 bp, Artificial
  CRISPR gRNA sequence
aagggcatctgtggggccac

SEQ ID NO: 743869 - DNA, 20 bp, Artificial
  CRISPR gRNA sequence
ggcatctgtggggccactgg

SEQ ID NO: 743870 - DNA, 20 bp, Artificial
  CRISPR gRNA sequence
tgtggggccactggaagcca

SEQ ID NO: 743871 - DNA, 20 bp, Artificial
  CRISPR gRNA sequence
gaagccacagtgctgatccc

SEQ ID NO: 743872 - DNA, 20 bp, Artificial
  CRISPR gRNA sequence
atccctggcccaccctcccc

SEQ ID NO: 743873 - DNA, 20 bp, Artificial
  CRISPR gRNA sequence
tccctggcccaccctcccct

SEQ ID NO: 743874 - DNA, 20 bp, Artificial
  CRISPR gRNA sequence
cctggcccaccctcccctgg

SEQ ID NO: 743875 - DNA, 20 bp, Artificial
  CRISPR gRNA sequence
cccaccctcccctgggagac

SEQ ID NO: 743876 - DNA, 20 bp, Artificial
  CRISPR gRNA sequence
ctgggagaccagactgaccc

SEQ ID NO: 743877 - DNA, 20 bp, Artificial
  CRISPR gRNA sequence
tgggagaccagactgaccct

SEQ ID NO: 743878 - DNA, 20 bp, Artificial
  CRISPR gRNA sequence
ccagactgaccctgggtcat

SEQ ID NO: 743879 - DNA, 20 bp, Artificial
  CRISPR gRNA sequence
actgaccctgggtcattggt

SEQ ID NO: 743880 - DNA, 20 bp, Artificial
  CRISPR gRNA sequence
cctgggtcattggttggcta

SEQ ID NO: 743881 - DNA, 20 bp, Artificial
  CRISPR gRNA sequence
gtcattggttggctaaagcc

SEQ ID NO: 743882 - DNA, 20 bp, Artificial
  CRISPR gRNA sequence
tcattggttggctaaagcct

SEQ ID NO: 743883 - DNA, 20 bp, Artificial
  CRISPR gRNA sequence
cattggttggctaaagcctg

SEQ ID NO: 743884 - DNA, 20 bp, Artificial
  CRISPR gRNA sequence
tggctaaagcctggggcctc

SEQ ID NO: 743885 - DNA, 20 bp, Artificial
  CRISPR gRNA sequence
aaagcctggggcctcaagtt

SEQ ID NO: 743886 - DNA, 20 bp, Artificial
  CRISPR gRNA sequence
ggggcctcaagtttggtatg

SEQ ID NO: 743887 - DNA, 20 bp, Artificial
  CRISPR gRNA sequence
gggcctcaagtttggtatgt

SEQ ID NO: 743888 - DNA, 20 bp, Artificial
  CRISPR gRNA sequence
ggcctcaagtttggtatgtg

SEQ ID NO: 743889 - DNA, 20 bp, Artificial
  CRISPR gRNA sequence
tggggctcgctcactgccaa

SEQ ID NO: 743890 - DNA, 20 bp, Artificial
  CRISPR gRNA sequence
ggggctcgctcactgccaac

SEQ ID NO: 743891 - DNA, 20 bp, Artificial
  CRISPR gRNA sequence
actgccaacgggttctcctt

SEQ ID NO: 743892 - DNA, 20 bp, Artificial
  CRISPR gRNA sequence
ctgccaacgggttctccttg

SEQ ID NO: 743893 - DNA, 20 bp, Artificial
  CRISPR gRNA sequence
ctttcttcctttcatctgct

SEQ ID NO: 743894 - DNA, 20 bp, Artificial
  CRISPR gRNA sequence
tttcttcctttcatctgctc

SEQ ID NO: 743895 - DNA, 20 bp, Artificial
  CRISPR gRNA sequence
aacaccccatacactgtgtg

SEQ ID NO: 743896 - DNA, 20 bp, Artificial
  CRISPR gRNA sequence
ccccatacactgtgtgcgga

SEQ ID NO: 743897 - DNA, 20 bp, Artificial
  CRISPR gRNA sequence
cccatacactgtgtgcggat

SEQ ID NO: 743898 - DNA, 20 bp, Artificial
  CRISPR gRNA sequence
ccatacactgtgtgcggata

SEQ ID NO: 743899 - DNA, 20 bp, Artificial
  CRISPR gRNA sequence
atacactgtgtgcggatagg

SEQ ID NO: 743900 - DNA, 20 bp, Artificial
  CRISPR gRNA sequence
tacactgtgtgcggataggg

SEQ ID NO: 743901 - DNA, 20 bp, Artificial
  CRISPR gRNA sequence
ggatagggaggtgacccctt

SEQ ID NO: 743902 - DNA, 20 bp, Artificial
  CRISPR gRNA sequence
aggtgacccctttagcgtct

SEQ ID NO: 743903 - DNA, 20 bp, Artificial
  CRISPR gRNA sequence
tgacccctttagcgtctcag

SEQ ID NO: 743904 - DNA, 20 bp, Artificial
  CRISPR gRNA sequence
ctcagcagcacactcctgcc

SEQ ID NO: 743905 - DNA, 20 bp, Artificial
  CRISPR gRNA sequence
ctgcctggaccaccctctcc

SEQ ID NO: 743906 - DNA, 20 bp, Artificial
  CRISPR gRNA sequence
tgcctggaccaccctctccc

SEQ ID NO: 743907 - DNA, 20 bp, Artificial
  CRISPR gRNA sequence
ctggaccaccctctcccagg

SEQ ID NO: 743908 - DNA, 20 bp, Artificial
  CRISPR gRNA sequence
tggaccaccctctcccagga

SEQ ID NO: 743909 - DNA, 20 bp, Artificial
  CRISPR gRNA sequence
ccaccctctcccaggaaggt

SEQ ID NO: 743910 - DNA, 20 bp, Artificial
  CRISPR gRNA sequence
ctcccaggaaggtcagaccc

SEQ ID NO: 743911 - DNA, 20 bp, Artificial
  CRISPR gRNA sequence
ccaggaaggtcagaccccag

SEQ ID NO: 743912 - DNA, 20 bp, Artificial
  CRISPR gRNA sequence
agcggaacctttgccctgct

SEQ ID NO: 743913 - DNA, 20 bp, Artificial
  CRISPR gRNA sequence
gcggaacctttgccctgctt

SEQ ID NO: 743914 - DNA, 20 bp, Artificial
  CRISPR gRNA sequence
gaacctttgccctgcttggg

SEQ ID NO: 743915 - DNA, 20 bp, Artificial
  CRISPR gRNA sequence
cctttgccctgcttgggtgg

SEQ ID NO: 743916 - DNA, 20 bp, Artificial
  CRISPR gRNA sequence
tgggtggaagcatgaacaac

SEQ ID NO: 743917 - DNA, 20 bp, Artificial
  CRISPR gRNA sequence
ggaagcatgaacaactagta

SEQ ID NO: 743918 - DNA, 20 bp, Artificial
  CRISPR gRNA sequence
catgaacaactagtacagct

SEQ ID NO: 743919 - DNA, 20 bp, Artificial
  CRISPR gRNA sequence
aacaactagtacagctcagc

SEQ ID NO: 743920 - DNA, 20 bp, Artificial
  CRISPR gRNA sequence
acaactagtacagctcagca

SEQ ID NO: 743921 - DNA, 20 bp, Artificial
  CRISPR gRNA sequence
caactagtacagctcagcaa

SEQ ID NO: 743922 - DNA, 20 bp, Artificial
  CRISPR gRNA sequence
acagctcagcaagggactcc

SEQ ID NO: 743923 - DNA, 20 bp, Artificial
  CRISPR gRNA sequence
caagggactcccagtattgc

SEQ ID NO: 743924 - DNA, 20 bp, Artificial
  CRISPR gRNA sequence
ctcccagtattgctggccct

SEQ ID NO: 743925 - DNA, 20 bp, Artificial
  CRISPR gRNA sequence
tcccagtattgctggccctt

SEQ ID NO: 743926 - DNA, 20 bp, Artificial
  CRISPR gRNA sequence
tgctggcccttgggtgtccc

SEQ ID NO: 743927 - DNA, 20 bp, Artificial
  CRISPR gRNA sequence
cccttgggtgtccctggcat

SEQ ID NO: 743928 - DNA, 20 bp, Artificial
  CRISPR gRNA sequence
ccttgggtgtccctggcatt

SEQ ID NO: 743929 - DNA, 20 bp, Artificial
  CRISPR gRNA sequence
tgggtgtccctggcattggg

SEQ ID NO: 743930 - DNA, 20 bp, Artificial
  CRISPR gRNA sequence
gggtagatgacccctcatgc

SEQ ID NO: 743931 - DNA, 20 bp, Artificial
  CRISPR gRNA sequence
ggtagatgacccctcatgcc

SEQ ID NO: 743932 - DNA, 20 bp, Artificial
  CRISPR gRNA sequence
gtagatgacccctcatgcca

SEQ ID NO: 743933 - DNA, 20 bp, Artificial
  CRISPR gRNA sequence
tgacccctcatgccagggac

SEQ ID NO: 743934 - DNA, 20 bp, Artificial
  CRISPR gRNA sequence
tcatgccagggactggcctc

SEQ ID NO: 743935 - DNA, 20 bp, Artificial
  CRISPR gRNA sequence
catgccagggactggcctca

SEQ ID NO: 743936 - DNA, 20 bp, Artificial
  CRISPR gRNA sequence
aaggctgttcctctctactc

SEQ ID NO: 743937 - DNA, 20 bp, Artificial
  CRISPR gRNA sequence
ggctgttcctctctactcca

SEQ ID NO: 743938 - DNA, 20 bp, Artificial
  CRISPR gRNA sequence
cctctctactccagagcctc

SEQ ID NO: 743939 - DNA, 20 bp, Artificial
  CRISPR gRNA sequence
ctctctactccagagcctct

SEQ ID NO: 743940 - DNA, 20 bp, Artificial
  CRISPR gRNA sequence
tctactccagagcctctggg

SEQ ID NO: 743941 - DNA, 20 bp, Artificial
  CRISPR gRNA sequence
actccagagcctctgggcag

SEQ ID NO: 743942 - DNA, 20 bp, Artificial
  CRISPR gRNA sequence
ctccagagcctctgggcagt

SEQ ID NO: 743943 - DNA, 20 bp, Artificial
  CRISPR gRNA sequence
agcctctgggcagtgggttg

SEQ ID NO: 743944 - DNA, 20 bp, Artificial
  CRISPR gRNA sequence
cagtgggttgtggatttcct

SEQ ID NO: 743945 - DNA, 20 bp, Artificial
  CRISPR gRNA sequence
gtgggttgtggatttcctaa

SEQ ID NO: 743946 - DNA, 20 bp, Artificial
  CRISPR gRNA sequence
agagctgaccattgctgcgt

SEQ ID NO: 743947 - DNA, 20 bp, Artificial
  CRISPR gRNA sequence
agctgaccattgctgcgtca

SEQ ID NO: 743948 - DNA, 20 bp, Artificial
  CRISPR gRNA sequence
gctgaccattgctgcgtcag

SEQ ID NO: 743949 - DNA, 20 bp, Artificial
  CRISPR gRNA sequence
attgctgcgtcagaggcttg

SEQ ID NO: 743950 - DNA, 20 bp, Artificial
  CRISPR gRNA sequence
gcgtcagaggcttgcagcac

SEQ ID NO: 743951 - DNA, 20 bp, Artificial
  CRISPR gRNA sequence
cgtcagaggcttgcagcact

SEQ ID NO: 743952 - DNA, 20 bp, Artificial
  CRISPR gRNA sequence
gcagcactgggttactcaac

SEQ ID NO: 743953 - DNA, 20 bp, Artificial
  CRISPR gRNA sequence
cagcactgggttactcaaca

SEQ ID NO: 743954 - DNA, 20 bp, Artificial
  CRISPR gRNA sequence
ggttactcaacaaggccctg

SEQ ID NO: 743955 - DNA, 20 bp, Artificial
  CRISPR gRNA sequence
ctcaacaaggccctgcagcc

SEQ ID NO: 743956 - DNA, 20 bp, Artificial
  CRISPR gRNA sequence
ctgcagcctggtttgctatg

SEQ ID NO: 743957 - DNA, 20 bp, Artificial
  CRISPR gRNA sequence
tgcagcctggtttgctatga

SEQ ID NO: 743958 - DNA, 20 bp, Artificial
  CRISPR gRNA sequence
cagcctggtttgctatgaag

SEQ ID NO: 743959 - DNA, 20 bp, Artificial
  CRISPR gRNA sequence
cctggtttgctatgaaggag

SEQ ID NO: 743960 - DNA, 20 bp, Artificial
  CRISPR gRNA sequence
gtttgctatgaaggagaaga

SEQ ID NO: 743961 - DNA, 20 bp, Artificial
  CRISPR gRNA sequence
tttgctatgaaggagaagat

SEQ ID NO: 743962 - DNA, 20 bp, Artificial
  CRISPR gRNA sequence
ttgctatgaaggagaagatg

SEQ ID NO: 743963 - DNA, 20 bp, Artificial
  CRISPR gRNA sequence
aagatggggtctctcgtccc

SEQ ID NO: 743964 - DNA, 20 bp, Artificial
  CRISPR gRNA sequence
gggtctctcgtccctagccc

SEQ ID NO: 743965 - DNA, 20 bp, Artificial
  CRISPR gRNA sequence
cccagtgcacttaaatgtgc

SEQ ID NO: 743966 - DNA, 20 bp, Artificial
  CRISPR gRNA sequence
gcacttaaatgtgctagtcc

SEQ ID NO: 743967 - DNA, 20 bp, Artificial
  CRISPR gRNA sequence
acttaaatgtgctagtccca

SEQ ID NO: 743968 - DNA, 20 bp, Artificial
  CRISPR gRNA sequence
cttaaatgtgctagtcccag

SEQ ID NO: 743969 - DNA, 20 bp, Artificial
  CRISPR gRNA sequence
aatgtgctagtcccagaggt

SEQ ID NO: 743970 - DNA, 20 bp, Artificial
  CRISPR gRNA sequence
atgtgctagtcccagaggtt

SEQ ID NO: 743971 - DNA, 20 bp, Artificial
  CRISPR gRNA sequence
gtgctagtcccagaggttgg

SEQ ID NO: 743972 - DNA, 20 bp, Artificial
  CRISPR gRNA sequence
tcccagaggttgggagtcct

SEQ ID NO: 743973 - DNA, 20 bp, Artificial
  CRISPR gRNA sequence
agaggttgggagtcctgagt

SEQ ID NO: 743974 - DNA, 20 bp, Artificial
  CRISPR gRNA sequence
ggagtcctgagtcagcctgt

SEQ ID NO: 743975 - DNA, 20 bp, Artificial
  CRISPR gRNA sequence
gagtcctgagtcagcctgtg

SEQ ID NO: 743976 - DNA, 20 bp, Artificial
  CRISPR gRNA sequence
cctgagtcagcctgtgagga

SEQ ID NO: 743977 - DNA, 20 bp, Artificial
  CRISPR gRNA sequence
ctgagtcagcctgtgaggac

SEQ ID NO: 743978 - DNA, 20 bp, Artificial
  CRISPR gRNA sequence
tgagtcagcctgtgaggaca

SEQ ID NO: 743979 - DNA, 20 bp, Artificial
  CRISPR gRNA sequence
tcagcctgtgaggacagggc

SEQ ID NO: 743980 - DNA, 20 bp, Artificial
  CRISPR gRNA sequence
cagcctgtgaggacagggca

SEQ ID NO: 743981 - DNA, 20 bp, Artificial
  CRISPR gRNA sequence
ctgtgaggacagggcaagga

SEQ ID NO: 743982 - DNA, 20 bp, Artificial
  CRISPR gRNA sequence
ggcaaggacagtaactgcct

SEQ ID NO: 743983 - DNA, 20 bp, Artificial
  CRISPR gRNA sequence
gcaaggacagtaactgcctc

SEQ ID NO: 743984 - DNA, 20 bp, Artificial
  CRISPR gRNA sequence
acagtaactgcctcgggtcc

SEQ ID NO: 743985 - DNA, 20 bp, Artificial
  CRISPR gRNA sequence
cagtaactgcctcgggtcct

SEQ ID NO: 743986 - DNA, 20 bp, Artificial
  CRISPR gRNA sequence
tcgggtcctgggaatgtctg

SEQ ID NO: 743987 - DNA, 20 bp, Artificial
  CRISPR gRNA sequence
cgggtcctgggaatgtctgt

SEQ ID NO: 743988 - DNA, 20 bp, Artificial
  CRISPR gRNA sequence
gggtcctgggaatgtctgtg

SEQ ID NO: 743989 - DNA, 20 bp, Artificial
  CRISPR gRNA sequence
tcctgggaatgtctgtgggg

SEQ ID NO: 743990 - DNA, 20 bp, Artificial
  CRISPR gRNA sequence
tgggaatgtctgtggggaag

SEQ ID NO: 743991 - DNA, 20 bp, Artificial
  CRISPR gRNA sequence
ggaatgtctgtggggaagaa

SEQ ID NO: 743992 - DNA, 20 bp, Artificial
  CRISPR gRNA sequence
gaatgtctgtggggaagaag

SEQ ID NO: 743993 - DNA, 20 bp, Artificial
  CRISPR gRNA sequence
gaagaggctctgctaccctt

SEQ ID NO: 743994 - DNA, 20 bp, Artificial
  CRISPR gRNA sequence
ctgctacccttgagatctgc

SEQ ID NO: 743995 - DNA, 20 bp, Artificial
  CRISPR gRNA sequence
tgctacccttgagatctgct

SEQ ID NO: 743996 - DNA, 20 bp, Artificial
  CRISPR gRNA sequence
ccttgagatctgctgggtcc

SEQ ID NO: 743997 - DNA, 20 bp, Artificial
  CRISPR gRNA sequence
tctgctgggtcctggtccct

SEQ ID NO: 743998 - DNA, 20 bp, Artificial
  CRISPR gRNA sequence
ctctccacccatctcaccct

SEQ ID NO: 743999 - DNA, 20 bp, Artificial
  CRISPR gRNA sequence
ccacccatctcaccctgagt

SEQ ID NO: 744000 - DNA, 20 bp, Artificial
  CRISPR gRNA sequence
cacccatctcaccctgagtc

SEQ ID NO: 744001 - DNA, 20 bp, Artificial
  CRISPR gRNA sequence
atctcaccctgagtcaggcc

SEQ ID NO: 744002 - DNA, 20 bp, Artificial
  CRISPR gRNA sequence
tctcaccctgagtcaggccc

SEQ ID NO: 744003 - DNA, 20 bp, Artificial
  CRISPR gRNA sequence
accctgagtcaggcccagga

SEQ ID NO: 744004 - DNA, 20 bp, Artificial
  CRISPR gRNA sequence
ccctgagtcaggcccaggaa

SEQ ID NO: 744005 - DNA, 20 bp, Artificial
  CRISPR gRNA sequence
cctgagtcaggcccaggaaa

SEQ ID NO: 744006 - DNA, 20 bp, Artificial
  CRISPR gRNA sequence
ctgagtcaggcccaggaaag

SEQ ID NO: 744007 - DNA, 20 bp, Artificial
  CRISPR gRNA sequence
gcccaggaaaggggtatctt

SEQ ID NO: 744008 - DNA, 20 bp, Artificial
  CRISPR gRNA sequence
ggggtatctttggtgtttcc

SEQ ID NO: 744009 - DNA, 20 bp, Artificial
  CRISPR gRNA sequence
gggtatctttggtgtttcct

SEQ ID NO: 744010 - DNA, 20 bp, Artificial
  CRISPR gRNA sequence
ttcatcactaccattctcct

SEQ ID NO: 744011 - DNA, 20 bp, Artificial
  CRISPR gRNA sequence
actaccattctcctcagtgc

SEQ ID NO: 744012 - DNA, 20 bp, Artificial
  CRISPR gRNA sequence
ctcagtgctggcccaacccc

SEQ ID NO: 744013 - DNA, 20 bp, Artificial
  CRISPR gRNA sequence
cagtgctggcccaaccccaa

SEQ ID NO: 744014 - DNA, 20 bp, Artificial
  CRISPR gRNA sequence
gctggcccaaccccaagagc

SEQ ID NO: 744015 - DNA, 20 bp, Artificial
  CRISPR gRNA sequence
tggcccaaccccaagagctg

SEQ ID NO: 744016 - DNA, 20 bp, Artificial
  CRISPR gRNA sequence
caaccccaagagctggagaa

SEQ ID NO: 744017 - DNA, 20 bp, Artificial
  CRISPR gRNA sequence
aaccccaagagctggagaac

SEQ ID NO: 744018 - DNA, 20 bp, Artificial
  CRISPR gRNA sequence
ccaagagctggagaacaggc

SEQ ID NO: 744019 - DNA, 20 bp, Artificial
  CRISPR gRNA sequence
gctggagaacaggctggccc

SEQ ID NO: 744020 - DNA, 20 bp, Artificial
  CRISPR gRNA sequence
ccactctatctcactttccc

SEQ ID NO: 744021 - DNA, 20 bp, Artificial
  CRISPR gRNA sequence
atctcactttccctggcata

SEQ ID NO: 744022 - DNA, 20 bp, Artificial
  CRISPR gRNA sequence
tctcactttccctggcataa

SEQ ID NO: 744023 - DNA, 20 bp, Artificial
  CRISPR gRNA sequence
tggcataaaggctttgacct

SEQ ID NO: 744024 - DNA, 20 bp, Artificial
  CRISPR gRNA sequence
ggcataaaggctttgacctt

SEQ ID NO: 744025 - DNA, 20 bp, Artificial
  CRISPR gRNA sequence
ttgaccttgggcaacatacc

SEQ ID NO: 744026 - DNA, 20 bp, Artificial
  CRISPR gRNA sequence
tgaccttgggcaacataccc

SEQ ID NO: 744027 - DNA, 20 bp, Artificial
  CRISPR gRNA sequence
gaccttgggcaacataccca

SEQ ID NO: 744028 - DNA, 20 bp, Artificial
  CRISPR gRNA sequence
gcaacatacccagggcaacc

SEQ ID NO: 744029 - DNA, 20 bp, Artificial
  CRISPR gRNA sequence
cccagggcaacccagcacct

SEQ ID NO: 744030 - DNA, 20 bp, Artificial
  CRISPR gRNA sequence
agggcaacccagcacctcgg

SEQ ID NO: 744031 - DNA, 20 bp, Artificial
  CRISPR gRNA sequence
gggcaacccagcacctcggc

SEQ ID NO: 744032 - DNA, 20 bp, Artificial
  CRISPR gRNA sequence
aacccagcacctcggcaggc

SEQ ID NO: 744033 - DNA, 20 bp, Artificial
  CRISPR gRNA sequence
tgatcaatcttctcaactta

SEQ ID NO: 744034 - DNA, 20 bp, Artificial
  CRISPR gRNA sequence
ctgctgaccatgcctgcaac

SEQ ID NO: 744035 - DNA, 20 bp, Artificial
  CRISPR gRNA sequence
tgctgaccatgcctgcaacc

SEQ ID NO: 744036 - DNA, 20 bp, Artificial
  CRISPR gRNA sequence
ctcccatctgctatctccct

SEQ ID NO: 744037 - DNA, 20 bp, Artificial
  CRISPR gRNA sequence
tccctcagtgcacactgtcc

SEQ ID NO: 744038 - DNA, 20 bp, Artificial
  CRISPR gRNA sequence
ccctcagtgcacactgtcct

SEQ ID NO: 744039 - DNA, 20 bp, Artificial
  CRISPR gRNA sequence
cctcagtgcacactgtccta

SEQ ID NO: 744040 - DNA, 20 bp, Artificial
  CRISPR gRNA sequence
tcagtgcacactgtcctagg

SEQ ID NO: 744041 - DNA, 20 bp, Artificial
  CRISPR gRNA sequence
tgcacactgtcctagggagt

SEQ ID NO: 744042 - DNA, 20 bp, Artificial
  CRISPR gRNA sequence
gcacactgtcctagggagtt

SEQ ID NO: 744043 - DNA, 20 bp, Artificial
  CRISPR gRNA sequence
agttgggtgaatatctatta

SEQ ID NO: 744044 - DNA, 20 bp, Artificial
  CRISPR gRNA sequence
attatagtgtgtccatgtca

SEQ ID NO: 744045 - DNA, 20 bp, Artificial
  CRISPR gRNA sequence
agtgtgtccatgtcacagtt

SEQ ID NO: 744046 - DNA, 20 bp, Artificial
  CRISPR gRNA sequence
atgtcacagttcagaatcct

SEQ ID NO: 744047 - DNA, 20 bp, Artificial
  CRISPR gRNA sequence
tgtcacagttcagaatcctg

SEQ ID NO: 744048 - DNA, 20 bp, Artificial
  CRISPR gRNA sequence
agttcagaatcctgaggtcc

SEQ ID NO: 744049 - DNA, 20 bp, Artificial
  CRISPR gRNA sequence
ttcagaatcctgaggtccca

SEQ ID NO: 744050 - DNA, 20 bp, Artificial
  CRISPR gRNA sequence
cagagcaattcaaatgcttc

SEQ ID NO: 744051 - DNA, 20 bp, Artificial
  CRISPR gRNA sequence
caaatgcttctggctccttt

SEQ ID NO: 744052 - DNA, 20 bp, Artificial
  CRISPR gRNA sequence
atgcttctggctcctttcag

SEQ ID NO: 744053 - DNA, 20 bp, Artificial
  CRISPR gRNA sequence
ttctggctcctttcagtgga

SEQ ID NO: 744054 - DNA, 20 bp, Artificial
  CRISPR gRNA sequence
ctcctttcagtggaaagctg

SEQ ID NO: 744055 - DNA, 20 bp, Artificial
  CRISPR gRNA sequence
tttcagtggaaagctgcagc

SEQ ID NO: 744056 - DNA, 20 bp, Artificial
  CRISPR gRNA sequence
cctaaatcatctccctgtgc

SEQ ID NO: 744057 - DNA, 20 bp, Artificial
  CRISPR gRNA sequence
ctaaatcatctccctgtgct

SEQ ID NO: 744058 - DNA, 20 bp, Artificial
  CRISPR gRNA sequence
tcatctccctgtgctgggcc

SEQ ID NO: 744059 - DNA, 20 bp, Artificial
  CRISPR gRNA sequence
catctccctgtgctgggccc

SEQ ID NO: 744060 - DNA, 20 bp, Artificial
  CRISPR gRNA sequence
ctccctgtgctgggcccagg

SEQ ID NO: 744061 - DNA, 20 bp, Artificial
  CRISPR gRNA sequence
ccctgtgctgggcccaggaa

SEQ ID NO: 744062 - DNA, 20 bp, Artificial
  CRISPR gRNA sequence
cccaggaagagatgaccctt

SEQ ID NO: 744063 - DNA, 20 bp, Artificial
  CRISPR gRNA sequence
tttagtataccatgttgttt

SEQ ID NO: 744064 - DNA, 20 bp, Artificial
  CRISPR gRNA sequence
agtataccatgttgtttgag

SEQ ID NO: 744065 - DNA, 20 bp, Artificial
  CRISPR gRNA sequence
accatgttgtttgagtagcc

SEQ ID NO: 744066 - DNA, 20 bp, Artificial
  CRISPR gRNA sequence
gtttgagtagccaagacctc

SEQ ID NO: 744067 - DNA, 20 bp, Artificial
  CRISPR gRNA sequence
tttgagtagccaagacctct

SEQ ID NO: 744068 - DNA, 20 bp, Artificial
  CRISPR gRNA sequence
tgagtagccaagacctctgg

SEQ ID NO: 744069 - DNA, 20 bp, Artificial
  CRISPR gRNA sequence
agccaagacctctgggagta

SEQ ID NO: 744070 - DNA, 20 bp, Artificial
  CRISPR gRNA sequence
gccaagacctctgggagtaa

SEQ ID NO: 744071 - DNA, 20 bp, Artificial
  CRISPR gRNA sequence
cctctgggagtaaaggcccc

SEQ ID NO: 744072 - DNA, 20 bp, Artificial
  CRISPR gRNA sequence
gtaaaggcccctggccatat

SEQ ID NO: 744073 - DNA, 20 bp, Artificial
  CRISPR gRNA sequence
ccctggccatataagcaata

SEQ ID NO: 744074 - DNA, 20 bp, Artificial
  CRISPR gRNA sequence
cctggccatataagcaatat

SEQ ID NO: 744075 - DNA, 20 bp, Artificial
  CRISPR gRNA sequence
ctggccatataagcaatata

SEQ ID NO: 744076 - DNA, 20 bp, Artificial
  CRISPR gRNA sequence
tggccatataagcaatatag

SEQ ID NO: 744077 - DNA, 20 bp, Artificial
  CRISPR gRNA sequence
ccatataagcaatatagggg

SEQ ID NO: 744078 - DNA, 20 bp, Artificial
  CRISPR gRNA sequence
catataagcaatatagggga

SEQ ID NO: 744079 - DNA, 20 bp, Artificial
  CRISPR gRNA sequence
aatataggggaaggcgtcct

SEQ ID NO: 744080 - DNA, 20 bp, Artificial
  CRISPR gRNA sequence
aaggcgtcctgagctcctct

SEQ ID NO: 744081 - DNA, 20 bp, Artificial
  CRISPR gRNA sequence
aggcgtcctgagctcctctt

SEQ ID NO: 744082 - DNA, 20 bp, Artificial
  CRISPR gRNA sequence
ggcgtcctgagctcctcttg

SEQ ID NO: 744083 - DNA, 20 bp, Artificial
  CRISPR gRNA sequence
tcttggggcctctctgctac

SEQ ID NO: 744084 - DNA, 20 bp, Artificial
  CRISPR gRNA sequence
cttggggcctctctgctact

SEQ ID NO: 744085 - DNA, 20 bp, Artificial
  CRISPR gRNA sequence
tctgctactgggtgctctgc

SEQ ID NO: 744086 - DNA, 20 bp, Artificial
  CRISPR gRNA sequence
ctactgggtgctctgcaagc

SEQ ID NO: 744087 - DNA, 20 bp, Artificial
  CRISPR gRNA sequence
tactgggtgctctgcaagct

SEQ ID NO: 744088 - DNA, 20 bp, Artificial
  CRISPR gRNA sequence
caagctgggtccctgtgccc

SEQ ID NO: 744089 - DNA, 20 bp, Artificial
  CRISPR gRNA sequence
gtccctgtgccctggatctc

SEQ ID NO: 744090 - DNA, 20 bp, Artificial
  CRISPR gRNA sequence
tctagaaatgtttctcaaat

SEQ ID NO: 744091 - DNA, 20 bp, Artificial
  CRISPR gRNA sequence
ctagaaatgtttctcaaatt

SEQ ID NO: 744092 - DNA, 20 bp, Artificial
  CRISPR gRNA sequence
tagaaatgtttctcaaattg

SEQ ID NO: 744093 - DNA, 20 bp, Artificial
  CRISPR gRNA sequence
ctcaaattggggctgctgaa

SEQ ID NO: 744094 - DNA, 20 bp, Artificial
  CRISPR gRNA sequence
caaattggggctgctgaaca

SEQ ID NO: 744095 - DNA, 20 bp, Artificial
  CRISPR gRNA sequence
aaattggggctgctgaacag

SEQ ID NO: 744096 - DNA, 20 bp, Artificial
  CRISPR gRNA sequence
aattggggctgctgaacaga

SEQ ID NO: 744097 - DNA, 20 bp, Artificial
  CRISPR gRNA sequence
tggggctgctgaacagaggg

SEQ ID NO: 744098 - DNA, 20 bp, Artificial
  CRISPR gRNA sequence
ctgctgaacagagggcagcc

SEQ ID NO: 744099 - DNA, 20 bp, Artificial
  CRISPR gRNA sequence
gaacagagggcagcccagcc

SEQ ID NO: 744100 - DNA, 20 bp, Artificial
  CRISPR gRNA sequence
agagggcagcccagccaagt

SEQ ID NO: 744101 - DNA, 20 bp, Artificial
  CRISPR gRNA sequence
gagggcagcccagccaagtg

SEQ ID NO: 744102 - DNA, 20 bp, Artificial
  CRISPR gRNA sequence
agggcagcccagccaagtga

SEQ ID NO: 744103 - DNA, 20 bp, Artificial
  CRISPR gRNA sequence
gcagcccagccaagtgaggg

SEQ ID NO: 744104 - DNA, 20 bp, Artificial
  CRISPR gRNA sequence
cagcccagccaagtgagggc

SEQ ID NO: 744105 - DNA, 20 bp, Artificial
  CRISPR gRNA sequence
cccagccaagtgagggcagg

SEQ ID NO: 744106 - DNA, 20 bp, Artificial
  CRISPR gRNA sequence
agccaagtgagggcaggaag

SEQ ID NO: 744107 - DNA, 20 bp, Artificial
  CRISPR gRNA sequence
gccaagtgagggcaggaagt

SEQ ID NO: 744108 - DNA, 20 bp, Artificial
  CRISPR gRNA sequence
agtgagggcaggaagtgggc

SEQ ID NO: 744109 - DNA, 20 bp, Artificial
  CRISPR gRNA sequence
agggcaggaagtgggcaaga

SEQ ID NO: 744110 - DNA, 20 bp, Artificial
  CRISPR gRNA sequence
gcaggaagtgggcaagaaag

SEQ ID NO: 744111 - DNA, 20 bp, Artificial
  CRISPR gRNA sequence
caggaagtgggcaagaaagc

SEQ ID NO: 744112 - DNA, 20 bp, Artificial
  CRISPR gRNA sequence
gaagtgggcaagaaagcagg

SEQ ID NO: 744113 - DNA, 20 bp, Artificial
  CRISPR gRNA sequence
aagtgggcaagaaagcagga

SEQ ID NO: 744114 - DNA, 20 bp, Artificial
  CRISPR gRNA sequence
agtgggcaagaaagcaggaa

SEQ ID NO: 744115 - DNA, 20 bp, Artificial
  CRISPR gRNA sequence
agaaagcaggaagggtctca

SEQ ID NO: 744116 - DNA, 20 bp, Artificial
  CRISPR gRNA sequence
gaaagcaggaagggtctcac

SEQ ID NO: 744117 - DNA, 20 bp, Artificial
  CRISPR gRNA sequence
aaagcaggaagggtctcaca

SEQ ID NO: 744118 - DNA, 20 bp, Artificial
  CRISPR gRNA sequence
gaagggtctcacagggccac

SEQ ID NO: 744119 - DNA, 20 bp, Artificial
  CRISPR gRNA sequence
aagggtctcacagggccacc

SEQ ID NO: 744120 - DNA, 20 bp, Artificial
  CRISPR gRNA sequence
agggtctcacagggccacca

SEQ ID NO: 744121 - DNA, 20 bp, Artificial
  CRISPR gRNA sequence
ggtctcacagggccaccagg

SEQ ID NO: 744122 - DNA, 20 bp, Artificial
  CRISPR gRNA sequence
gtctcacagggccaccaggg

SEQ ID NO: 744123 - DNA, 20 bp, Artificial
  CRISPR gRNA sequence
tctcacagggccaccaggga

SEQ ID NO: 744124 - DNA, 20 bp, Artificial
  CRISPR gRNA sequence
cacagggccaccagggaggg

SEQ ID NO: 744125 - DNA, 20 bp, Artificial
  CRISPR gRNA sequence
ggccaccagggagggcagtg

SEQ ID NO: 744126 - DNA, 20 bp, Artificial
  CRISPR gRNA sequence
gccaccagggagggcagtgc

SEQ ID NO: 744127 - DNA, 20 bp, Artificial
  CRISPR gRNA sequence
ccaccagggagggcagtgca

SEQ ID NO: 744128 - DNA, 20 bp, Artificial
  CRISPR gRNA sequence
ccagggagggcagtgcaggg

SEQ ID NO: 744129 - DNA, 20 bp, Artificial
  CRISPR gRNA sequence
cagggagggcagtgcagggc

SEQ ID NO: 744130 - DNA, 20 bp, Artificial
  CRISPR gRNA sequence
ggagggcagtgcagggcagg

SEQ ID NO: 744131 - DNA, 20 bp, Artificial
  CRISPR gRNA sequence
gcagggcaggtggcccatga

SEQ ID NO: 744132 - DNA, 20 bp, Artificial
  CRISPR gRNA sequence
cagggcaggtggcccatgac

SEQ ID NO: 744133 - DNA, 20 bp, Artificial
  CRISPR gRNA sequence
ggcaggtggcccatgacagg

SEQ ID NO: 744134 - DNA, 20 bp, Artificial
  CRISPR gRNA sequence
gcaggtggcccatgacaggt

SEQ ID NO: 744135 - DNA, 20 bp, Artificial
  CRISPR gRNA sequence
gcccatgacaggtgggatgc

SEQ ID NO: 744136 - DNA, 20 bp, Artificial
  CRISPR gRNA sequence
ccaccatcctctgttccttc

SEQ ID NO: 744137 - DNA, 20 bp, Artificial
  CRISPR gRNA sequence
ccatcctctgttccttctgg

SEQ ID NO: 744138 - DNA, 20 bp, Artificial
  CRISPR gRNA sequence
tggaagccatgccctgccat

SEQ ID NO: 744139 - DNA, 20 bp, Artificial
  CRISPR gRNA sequence
ccatgccctgccatgagcca

SEQ ID NO: 744140 - DNA, 20 bp, Artificial
  CRISPR gRNA sequence
cctgccatgagccatggcct

SEQ ID NO: 744141 - DNA, 20 bp, Artificial
  CRISPR gRNA sequence
tgagccatggccttggtgct

SEQ ID NO: 744142 - DNA, 20 bp, Artificial
  CRISPR gRNA sequence
ctccctctgactgtcacctt

SEQ ID NO: 744143 - DNA, 20 bp, Artificial
  CRISPR gRNA sequence
cctctgactgtcaccttgag

SEQ ID NO: 744144 - DNA, 20 bp, Artificial
  CRISPR gRNA sequence
accttgagaagcatccaccc

SEQ ID NO: 744145 - DNA, 20 bp, Artificial
  CRISPR gRNA sequence
ccttgagaagcatccaccct

SEQ ID NO: 744146 - DNA, 20 bp, Artificial
  CRISPR gRNA sequence
cttgagaagcatccaccctg

SEQ ID NO: 744147 - DNA, 20 bp, Artificial
  CRISPR gRNA sequence
gaagcatccaccctggggct

SEQ ID NO: 744148 - DNA, 20 bp, Artificial
  CRISPR gRNA sequence
aagcatccaccctggggctt

SEQ ID NO: 744149 - DNA, 20 bp, Artificial
  CRISPR gRNA sequence
agcatccaccctggggctta

SEQ ID NO: 744150 - DNA, 20 bp, Artificial
  CRISPR gRNA sequence
atccaccctggggcttaggg

SEQ ID NO: 744151 - DNA, 20 bp, Artificial
  CRISPR gRNA sequence
gcagctgtgtctgtgacatg

SEQ ID NO: 744152 - DNA, 20 bp, Artificial
  CRISPR gRNA sequence
agctgtgtctgtgacatgtg

SEQ ID NO: 744153 - DNA, 20 bp, Artificial
  CRISPR gRNA sequence
tgtggagccctcctcctcct

SEQ ID NO: 744154 - DNA, 20 bp, Artificial
  CRISPR gRNA sequence
tggagccctcctcctcctca

SEQ ID NO: 744155 - DNA, 20 bp, Artificial
  CRISPR gRNA sequence
ggagccctcctcctcctcag

SEQ ID NO: 744156 - DNA, 20 bp, Artificial
  CRISPR gRNA sequence
cctcctcctcctcagaggcc

SEQ ID NO: 744157 - DNA, 20 bp, Artificial
  CRISPR gRNA sequence
ctcctcctcctcagaggccc

SEQ ID NO: 744158 - DNA, 20 bp, Artificial
  CRISPR gRNA sequence
tcctcctcagaggcccaggc

SEQ ID NO: 744159 - DNA, 20 bp, Artificial
  CRISPR gRNA sequence
agaggcccaggccagcctcc

SEQ ID NO: 744160 - DNA, 20 bp, Artificial
  CRISPR gRNA sequence
caggccagcctccaagtgct

SEQ ID NO: 744161 - DNA, 20 bp, Artificial
  CRISPR gRNA sequence
ccagcctccaagtgctgaga

SEQ ID NO: 744162 - DNA, 20 bp, Artificial
  CRISPR gRNA sequence
cctccaagtgctgagatagc

SEQ ID NO: 744163 - DNA, 20 bp, Artificial
  CRISPR gRNA sequence
ctgagatagccagctgcctg

SEQ ID NO: 744164 - DNA, 20 bp, Artificial
  CRISPR gRNA sequence
tgagatagccagctgcctgt

SEQ ID NO: 744165 - DNA, 20 bp, Artificial
  CRISPR gRNA sequence
gccagctgcctgtgggcacc

SEQ ID NO: 744166 - DNA, 20 bp, Artificial
  CRISPR gRNA sequence
ccagctgcctgtgggcaccc

SEQ ID NO: 744167 - DNA, 20 bp, Artificial
  CRISPR gRNA sequence
ctgtgggcacccaggttgct

SEQ ID NO: 744168 - DNA, 20 bp, Artificial
  CRISPR gRNA sequence
tgtgggcacccaggttgcta

SEQ ID NO: 744169 - DNA, 20 bp, Artificial
  CRISPR gRNA sequence
caggttgctaaggtatcttc

SEQ ID NO: 744170 - DNA, 20 bp, Artificial
  CRISPR gRNA sequence
aggttgctaaggtatcttcc

SEQ ID NO: 744171 - DNA, 20 bp, Artificial
  CRISPR gRNA sequence
gctaaggtatcttccaggtt

SEQ ID NO: 744172 - DNA, 20 bp, Artificial
  CRISPR gRNA sequence
ttctattccatcctgcccac

SEQ ID NO: 744173 - DNA, 20 bp, Artificial
  CRISPR gRNA sequence
tctattccatcctgcccact

SEQ ID NO: 744174 - DNA, 20 bp, Artificial
  CRISPR gRNA sequence
gcccactgggtccctgtgcc

SEQ ID NO: 744175 - DNA, 20 bp, Artificial
  CRISPR gRNA sequence
cctccctcctgcctccctcc

SEQ ID NO: 744176 - DNA, 20 bp, Artificial
  CRISPR gRNA sequence
tgcatgactcatactttccc

SEQ ID NO: 744177 - DNA, 20 bp, Artificial
  CRISPR gRNA sequence
gcatgactcatactttccct

SEQ ID NO: 744178 - DNA, 20 bp, Artificial
  CRISPR gRNA sequence
ttccctgggccctccctata

SEQ ID NO: 744179 - DNA, 20 bp, Artificial
  CRISPR gRNA sequence
tgggccctccctataaagtt

SEQ ID NO: 744180 - DNA, 20 bp, Artificial
  CRISPR gRNA sequence
ccctataaagtttggttcca

SEQ ID NO: 744181 - DNA, 20 bp, Artificial
  CRISPR gRNA sequence
cctataaagtttggttccac

SEQ ID NO: 744182 - DNA, 20 bp, Artificial
  CRISPR gRNA sequence
ttggttccacaggctctttg

SEQ ID NO: 744183 - DNA, 20 bp, Artificial
  CRISPR gRNA sequence
ggttccacaggctctttgaa

SEQ ID NO: 744184 - DNA, 20 bp, Artificial
  CRISPR gRNA sequence
acaggctctttgaagagatc

SEQ ID NO: 744185 - DNA, 20 bp, Artificial
  CRISPR gRNA sequence
ttgaagagatccagcctctt

SEQ ID NO: 744186 - DNA, 20 bp, Artificial
  CRISPR gRNA sequence
agatccagcctcttcagctc

SEQ ID NO: 744187 - DNA, 20 bp, Artificial
  CRISPR gRNA sequence
gatccagcctcttcagctct

SEQ ID NO: 744188 - DNA, 20 bp, Artificial
  CRISPR gRNA sequence
ccagcctcttcagctctggg

SEQ ID NO: 744189 - DNA, 20 bp, Artificial
  CRISPR gRNA sequence
cagcctcttcagctctgggc

SEQ ID NO: 744190 - DNA, 20 bp, Artificial
  CRISPR gRNA sequence
ctcttcagctctgggcaggc

SEQ ID NO: 744191 - DNA, 20 bp, Artificial
  CRISPR gRNA sequence
agctctgggcaggcaagaac

SEQ ID NO: 744192 - DNA, 20 bp, Artificial
  CRISPR gRNA sequence
gctctgggcaggcaagaact

SEQ ID NO: 744193 - DNA, 20 bp, Artificial
  CRISPR gRNA sequence
gcaggcaagaactaggcaac

SEQ ID NO: 744194 - DNA, 20 bp, Artificial
  CRISPR gRNA sequence
caggcaagaactaggcaacc

SEQ ID NO: 744195 - DNA, 20 bp, Artificial
  CRISPR gRNA sequence
agaactaggcaaccaggcca

SEQ ID NO: 744196 - DNA, 20 bp, Artificial
  CRISPR gRNA sequence
gaactaggcaaccaggccat

SEQ ID NO: 744197 - DNA, 20 bp, Artificial
  CRISPR gRNA sequence
ggcaaccaggccatgggtac

SEQ ID NO: 744198 - DNA, 20 bp, Artificial
  CRISPR gRNA sequence
gcaaccaggccatgggtacc

SEQ ID NO: 744199 - DNA, 20 bp, Artificial
  CRISPR gRNA sequence
caaccaggccatgggtacca

SEQ ID NO: 744200 - DNA, 20 bp, Artificial
  CRISPR gRNA sequence
ggtaccagggcctctgcccc

SEQ ID NO: 744201 - DNA, 20 bp, Artificial
  CRISPR gRNA sequence
cagggcctctgcccccagcc

SEQ ID NO: 744202 - DNA, 20 bp, Artificial
  CRISPR gRNA sequence
agggcctctgcccccagccc

SEQ ID NO: 744203 - DNA, 20 bp, Artificial
  CRISPR gRNA sequence
ggcctctgcccccagcccgg

SEQ ID NO: 744204 - DNA, 20 bp, Artificial
  CRISPR gRNA sequence
cagcccgggagcccctgtgt

SEQ ID NO: 744205 - DNA, 20 bp, Artificial
  CRISPR gRNA sequence
agcccgggagcccctgtgtt

SEQ ID NO: 744206 - DNA, 20 bp, Artificial
  CRISPR gRNA sequence
gcccgggagcccctgtgttg

SEQ ID NO: 744207 - DNA, 20 bp, Artificial
  CRISPR gRNA sequence
gggagcccctgtgttggggc

SEQ ID NO: 744208 - DNA, 20 bp, Artificial
  CRISPR gRNA sequence
ggagcccctgtgttggggcc

SEQ ID NO: 744209 - DNA, 20 bp, Artificial
  CRISPR gRNA sequence
atactatctgaacatgctga

SEQ ID NO: 744210 - DNA, 20 bp, Artificial
  CRISPR gRNA sequence
atctgaacatgctgacagtc

SEQ ID NO: 744211 - DNA, 20 bp, Artificial
  CRISPR gRNA sequence
catgctgacagtctggactt

SEQ ID NO: 744212 - DNA, 20 bp, Artificial
  CRISPR gRNA sequence
gctgacagtctggactttgg

SEQ ID NO: 744213 - DNA, 20 bp, Artificial
  CRISPR gRNA sequence
ctgacagtctggactttgga

SEQ ID NO: 744214 - DNA, 20 bp, Artificial
  CRISPR gRNA sequence
tgacagtctggactttggaa

SEQ ID NO: 744215 - DNA, 20 bp, Artificial
  CRISPR gRNA sequence
gacagtctggactttggaag

SEQ ID NO: 744216 - DNA, 20 bp, Artificial
  CRISPR gRNA sequence
tggactttggaaggggaaaa

SEQ ID NO: 744217 - DNA, 20 bp, Artificial
  CRISPR gRNA sequence
gaaaatggtgcttccctgtg

SEQ ID NO: 744218 - DNA, 20 bp, Artificial
  CRISPR gRNA sequence
aaaatggtgcttccctgtgt

SEQ ID NO: 744219 - DNA, 20 bp, Artificial
  CRISPR gRNA sequence
ctgtgtgggcttctgtgttt

SEQ ID NO: 744220 - DNA, 20 bp, Artificial
  CRISPR gRNA sequence
tgggcttctgtgtttgagct

SEQ ID NO: 744221 - DNA, 20 bp, Artificial
  CRISPR gRNA sequence
gggcttctgtgtttgagctg

SEQ ID NO: 744222 - DNA, 20 bp, Artificial
  CRISPR gRNA sequence
gtgtttgagctgaggaaact

SEQ ID NO: 744223 - DNA, 20 bp, Artificial
  CRISPR gRNA sequence
tgtttgagctgaggaaactg

SEQ ID NO: 744224 - DNA, 20 bp, Artificial
  CRISPR gRNA sequence
tgagctgaggaaactgaggc

SEQ ID NO: 744225 - DNA, 20 bp, Artificial
  CRISPR gRNA sequence
agctgaggaaactgaggcca

SEQ ID NO: 744226 - DNA, 20 bp, Artificial
  CRISPR gRNA sequence
ctgaggaaactgaggccaga

SEQ ID NO: 744227 - DNA, 20 bp, Artificial
  CRISPR gRNA sequence
gagagatgccgtaatttatc

SEQ ID NO: 744228 - DNA, 20 bp, Artificial
  CRISPR gRNA sequence
agagatgccgtaatttatcc

SEQ ID NO: 744229 - DNA, 20 bp, Artificial
  CRISPR gRNA sequence
gagatgccgtaatttatcca

SEQ ID NO: 744230 - DNA, 20 bp, Artificial
  CRISPR gRNA sequence
ccgtaatttatccagggacc

SEQ ID NO: 744231 - DNA, 20 bp, Artificial
  CRISPR gRNA sequence
taatttatccagggacccag

SEQ ID NO: 744232 - DNA, 20 bp, Artificial
  CRISPR gRNA sequence
aatttatccagggacccaga

SEQ ID NO: 744233 - DNA, 20 bp, Artificial
  CRISPR gRNA sequence
atttatccagggacccagaa

SEQ ID NO: 744234 - DNA, 20 bp, Artificial
  CRISPR gRNA sequence
tttatccagggacccagaag

SEQ ID NO: 744235 - DNA, 20 bp, Artificial
  CRISPR gRNA sequence
agggacccagaaggggctca

SEQ ID NO: 744236 - DNA, 20 bp, Artificial
  CRISPR gRNA sequence
cccagaaggggctcatagct

SEQ ID NO: 744237 - DNA, 20 bp, Artificial
  CRISPR gRNA sequence
aggggctcatagctgagctg

SEQ ID NO: 744238 - DNA, 20 bp, Artificial
  CRISPR gRNA sequence
gggctcatagctgagctgaa

SEQ ID NO: 744239 - DNA, 20 bp, Artificial
  CRISPR gRNA sequence
agagtgtcccacatcctccc

SEQ ID NO: 744240 - DNA, 20 bp, Artificial
  CRISPR gRNA sequence
tcctccccagtactccacac

SEQ ID NO: 744241 - DNA, 20 bp, Artificial
  CRISPR gRNA sequence
agtactccacactggtccct

SEQ ID NO: 744242 - DNA, 20 bp, Artificial
  CRISPR gRNA sequence
actccacactggtccctgag

SEQ ID NO: 744243 - DNA, 20 bp, Artificial
  CRISPR gRNA sequence
ccacactggtccctgagtgg

SEQ ID NO: 744244 - DNA, 20 bp, Artificial
  CRISPR gRNA sequence
tccctgagtggcagccttgc

SEQ ID NO: 744245 - DNA, 20 bp, Artificial
  CRISPR gRNA sequence
ccctgagtggcagccttgct

SEQ ID NO: 744246 - DNA, 20 bp, Artificial
  CRISPR gRNA sequence
gagtggcagccttgctagga

SEQ ID NO: 744247 - DNA, 20 bp, Artificial
  CRISPR gRNA sequence
tggcagccttgctaggatgg

SEQ ID NO: 744248 - DNA, 20 bp, Artificial
  CRISPR gRNA sequence
ggcagccttgctaggatggc

SEQ ID NO: 744249 - DNA, 20 bp, Artificial
  CRISPR gRNA sequence
cttgctaggatggcaggaat

SEQ ID NO: 744250 - DNA, 20 bp, Artificial
  CRISPR gRNA sequence
atcagctgaccacttattcc

SEQ ID NO: 744251 - DNA, 20 bp, Artificial
  CRISPR gRNA sequence
tcagctgaccacttattcct

SEQ ID NO: 744252 - DNA, 20 bp, Artificial
  CRISPR gRNA sequence
accacttattcctgggccat

SEQ ID NO: 744253 - DNA, 20 bp, Artificial
  CRISPR gRNA sequence
ttcctgggccatcagaccct

SEQ ID NO: 744254 - DNA, 20 bp, Artificial
  CRISPR gRNA sequence
gggccatcagacccttagaa

SEQ ID NO: 744255 - DNA, 20 bp, Artificial
  CRISPR gRNA sequence
ggccatcagacccttagaat

SEQ ID NO: 744256 - DNA, 20 bp, Artificial
  CRISPR gRNA sequence
gccatcagacccttagaata

SEQ ID NO: 744257 - DNA, 20 bp, Artificial
  CRISPR gRNA sequence
cagacccttagaatagggac

SEQ ID NO: 744258 - DNA, 20 bp, Artificial
  CRISPR gRNA sequence
agacccttagaatagggacc

SEQ ID NO: 744259 - DNA, 20 bp, Artificial
  CRISPR gRNA sequence
cccttagaatagggaccagg

SEQ ID NO: 744260 - DNA, 20 bp, Artificial
  CRISPR gRNA sequence
ccttagaatagggaccaggt

SEQ ID NO: 744261 - DNA, 20 bp, Artificial
  CRISPR gRNA sequence
tagaatagggaccaggtggg

SEQ ID NO: 744262 - DNA, 20 bp, Artificial
  CRISPR gRNA sequence
agtgctgcctctgtgtctga

SEQ ID NO: 744263 - DNA, 20 bp, Artificial
  CRISPR gRNA sequence
gctgcctctgtgtctgaaag

SEQ ID NO: 744264 - DNA, 20 bp, Artificial
  CRISPR gRNA sequence
gaaagtggacccaccgtgac

SEQ ID NO: 744265 - DNA, 20 bp, Artificial
  CRISPR gRNA sequence
gacccaccgtgaccagtgcc

SEQ ID NO: 744266 - DNA, 20 bp, Artificial
  CRISPR gRNA sequence
accagtgcccagtgcccacc

SEQ ID NO: 744267 - DNA, 20 bp, Artificial
  CRISPR gRNA sequence
ccagtgcccagtgcccacca

SEQ ID NO: 744268 - DNA, 20 bp, Artificial
  CRISPR gRNA sequence
gcccagtgcccaccaaggct

SEQ ID NO: 744269 - DNA, 20 bp, Artificial
  CRISPR gRNA sequence
agtgcccaccaaggctcagc

SEQ ID NO: 744270 - DNA, 20 bp, Artificial
  CRISPR gRNA sequence
gtgcccaccaaggctcagcc

SEQ ID NO: 744271 - DNA, 20 bp, Artificial
  CRISPR gRNA sequence
tgcccaccaaggctcagcca

SEQ ID NO: 744272 - DNA, 20 bp, Artificial
  CRISPR gRNA sequence
gcccaccaaggctcagccag

SEQ ID NO: 744273 - DNA, 20 bp, Artificial
  CRISPR gRNA sequence
ggctcagccaggggtttcac

SEQ ID NO: 744274 - DNA, 20 bp, Artificial
  CRISPR gRNA sequence
gctcagccaggggtttcacc

SEQ ID NO: 744275 - DNA, 20 bp, Artificial
  CRISPR gRNA sequence
ctcagccaggggtttcacca

SEQ ID NO: 744276 - DNA, 20 bp, Artificial
  CRISPR gRNA sequence
ccaggggtttcaccagggca

SEQ ID NO: 744277 - DNA, 20 bp, Artificial
  CRISPR gRNA sequence
caggggtttcaccagggcat

SEQ ID NO: 744278 - DNA, 20 bp, Artificial
  CRISPR gRNA sequence
aggggtttcaccagggcatg

SEQ ID NO: 744279 - DNA, 20 bp, Artificial
  CRISPR gRNA sequence
ttcaccagggcatggggcac

SEQ ID NO: 744280 - DNA, 20 bp, Artificial
  CRISPR gRNA sequence
cagggcatggggcactggct

SEQ ID NO: 744281 - DNA, 20 bp, Artificial
  CRISPR gRNA sequence
ctctgtgtcctctgcaacac

SEQ ID NO: 744282 - DNA, 20 bp, Artificial
  CRISPR gRNA sequence
ctgtgtcctctgcaacacta

SEQ ID NO: 744283 - DNA, 20 bp, Artificial
  CRISPR gRNA sequence
ctctgcaacactagagccct

SEQ ID NO: 744284 - DNA, 20 bp, Artificial
  CRISPR gRNA sequence
caacactagagccctgagac

SEQ ID NO: 744285 - DNA, 20 bp, Artificial
  CRISPR gRNA sequence
acactagagccctgagacta

SEQ ID NO: 744286 - DNA, 20 bp, Artificial
  CRISPR gRNA sequence
cactagagccctgagactag

SEQ ID NO: 744287 - DNA, 20 bp, Artificial
  CRISPR gRNA sequence
actagagccctgagactaga

SEQ ID NO: 744288 - DNA, 20 bp, Artificial
  CRISPR gRNA sequence
ctagagccctgagactagag

SEQ ID NO: 744289 - DNA, 20 bp, Artificial
  CRISPR gRNA sequence
gagccctgagactagagggg

SEQ ID NO: 744290 - DNA, 20 bp, Artificial
  CRISPR gRNA sequence
cctgagactagaggggcaga

SEQ ID NO: 744291 - DNA, 20 bp, Artificial
  CRISPR gRNA sequence
ctagaggggcagaaagatgc

SEQ ID NO: 744292 - DNA, 20 bp, Artificial
  CRISPR gRNA sequence
agaaagatgccagctgtcaa

SEQ ID NO: 744293 - DNA, 20 bp, Artificial
  CRISPR gRNA sequence
agatgccagctgtcaaaagc

SEQ ID NO: 744294 - DNA, 20 bp, Artificial
  CRISPR gRNA sequence
caaaagccagtgatatccac

SEQ ID NO: 744295 - DNA, 20 bp, Artificial
  CRISPR gRNA sequence
cctgtgcctctccttctttg

SEQ ID NO: 744296 - DNA, 20 bp, Artificial
  CRISPR gRNA sequence
gtgcctctccttctttgcag

SEQ ID NO: 744297 - DNA, 20 bp, Artificial
  CRISPR gRNA sequence
tgcagaagctacctgtgccc

SEQ ID NO: 744298 - DNA, 20 bp, Artificial
  CRISPR gRNA sequence
gcagaagctacctgtgccct

SEQ ID NO: 744299 - DNA, 20 bp, Artificial
  CRISPR gRNA sequence
tacctgtgccctgggttctc

SEQ ID NO: 744300 - DNA, 20 bp, Artificial
  CRISPR gRNA sequence
acctgtgccctgggttctct

SEQ ID NO: 744301 - DNA, 20 bp, Artificial
  CRISPR gRNA sequence
tgtgccctgggttctctggg

SEQ ID NO: 744302 - DNA, 20 bp, Artificial
  CRISPR gRNA sequence
gtgccctgggttctctgggc

SEQ ID NO: 744303 - DNA, 20 bp, Artificial
  CRISPR gRNA sequence
tgccctgggttctctgggca

SEQ ID NO: 744304 - DNA, 20 bp, Artificial
  CRISPR gRNA sequence
cctgggttctctgggcaggg

SEQ ID NO: 744305 - DNA, 20 bp, Artificial
  CRISPR gRNA sequence
ctgggttctctgggcaggga

SEQ ID NO: 744306 - DNA, 20 bp, Artificial
  CRISPR gRNA sequence
tgggttctctgggcagggaa

SEQ ID NO: 744307 - DNA, 20 bp, Artificial
  CRISPR gRNA sequence
ttctctgggcagggaagggc

SEQ ID NO: 744308 - DNA, 20 bp, Artificial
  CRISPR gRNA sequence
ctgggcagggaagggctgga

SEQ ID NO: 744309 - DNA, 20 bp, Artificial
  CRISPR gRNA sequence
tgggcagggaagggctggac

SEQ ID NO: 744310 - DNA, 20 bp, Artificial
  CRISPR gRNA sequence
gcagggaagggctggacagg

SEQ ID NO: 744311 - DNA, 20 bp, Artificial
  CRISPR gRNA sequence
agggctggacaggcagccct

SEQ ID NO: 744312 - DNA, 20 bp, Artificial
  CRISPR gRNA sequence
gggctggacaggcagccctc

SEQ ID NO: 744313 - DNA, 20 bp, Artificial
  CRISPR gRNA sequence
ggctggacaggcagccctca

SEQ ID NO: 744314 - DNA, 20 bp, Artificial
  CRISPR gRNA sequence
gctggacaggcagccctcag

SEQ ID NO: 744315 - DNA, 20 bp, Artificial
  CRISPR gRNA sequence
gacaggcagccctcagggga

SEQ ID NO: 744316 - DNA, 20 bp, Artificial
  CRISPR gRNA sequence
ggacagccctgcctgccact

SEQ ID NO: 744317 - DNA, 20 bp, Artificial
  CRISPR gRNA sequence
gacagccctgcctgccactt

SEQ ID NO: 744318 - DNA, 20 bp, Artificial
  CRISPR gRNA sequence
agccctgcctgccacttggg

SEQ ID NO: 744319 - DNA, 20 bp, Artificial
  CRISPR gRNA sequence
cctgccacttgggcagctgt

SEQ ID NO: 744320 - DNA, 20 bp, Artificial
  CRISPR gRNA sequence
tgccacttgggcagctgtca

SEQ ID NO: 744321 - DNA, 20 bp, Artificial
  CRISPR gRNA sequence
tgggcagctgtcagagcatg

SEQ ID NO: 744322 - DNA, 20 bp, Artificial
  CRISPR gRNA sequence
atgcagatgtgcccgatgcc

SEQ ID NO: 744323 - DNA, 20 bp, Artificial
  CRISPR gRNA sequence
agatgtgcccgatgcctagc

SEQ ID NO: 744324 - DNA, 20 bp, Artificial
  CRISPR gRNA sequence
gatgtgcccgatgcctagct

SEQ ID NO: 744325 - DNA, 20 bp, Artificial
  CRISPR gRNA sequence
atgtgcccgatgcctagctg

SEQ ID NO: 744326 - DNA, 20 bp, Artificial
  CRISPR gRNA sequence
cgatgcctagctggggcact

SEQ ID NO: 744327 - DNA, 20 bp, Artificial
  CRISPR gRNA sequence
cctagctggggcacttggca

SEQ ID NO: 744328 - DNA, 20 bp, Artificial
  CRISPR gRNA sequence
agttgccactgcaccctgcc

SEQ ID NO: 744329 - DNA, 20 bp, Artificial
  CRISPR gRNA sequence
gttgccactgcaccctgcct

SEQ ID NO: 744330 - DNA, 20 bp, Artificial
  CRISPR gRNA sequence
ttgccactgcaccctgccta

SEQ ID NO: 744331 - DNA, 20 bp, Artificial
  CRISPR gRNA sequence
tgccactgcaccctgcctag

SEQ ID NO: 744332 - DNA, 20 bp, Artificial
  CRISPR gRNA sequence
tgcaccctgcctaggggtcc

SEQ ID NO: 744333 - DNA, 20 bp, Artificial
  CRISPR gRNA sequence
accctgcctaggggtcccag

SEQ ID NO: 744334 - DNA, 20 bp, Artificial
  CRISPR gRNA sequence
ctaggggtcccagcagcctc

SEQ ID NO: 744335 - DNA, 20 bp, Artificial
  CRISPR gRNA sequence
taggggtcccagcagcctct

SEQ ID NO: 744336 - DNA, 20 bp, Artificial
  CRISPR gRNA sequence
gggtcccagcagcctctggg

SEQ ID NO: 744337 - DNA, 20 bp, Artificial
  CRISPR gRNA sequence
tcccagcagcctctgggcgg

SEQ ID NO: 744338 - DNA, 20 bp, Artificial
  CRISPR gRNA sequence
cccagcagcctctgggcggt

SEQ ID NO: 744339 - DNA, 20 bp, Artificial
  CRISPR gRNA sequence
agcagcctctgggcggtggg

SEQ ID NO: 744340 - DNA, 20 bp, Artificial
  CRISPR gRNA sequence
cagcctctgggcggtgggtg

SEQ ID NO: 744341 - DNA, 20 bp, Artificial
  CRISPR gRNA sequence
cctctgggcggtgggtggag

SEQ ID NO: 744342 - DNA, 20 bp, Artificial
  CRISPR gRNA sequence
ctctgggcggtgggtggagt

SEQ ID NO: 744343 - DNA, 20 bp, Artificial
  CRISPR gRNA sequence
tctgggcggtgggtggagtg

SEQ ID NO: 744344 - DNA, 20 bp, Artificial
  CRISPR gRNA sequence
ggtgggtggagtggggtgca

SEQ ID NO: 744345 - DNA, 20 bp, Artificial
  CRISPR gRNA sequence
gagtggggtgcacggtcaca

SEQ ID NO: 744346 - DNA, 20 bp, Artificial
  CRISPR gRNA sequence
agtggggtgcacggtcacac

SEQ ID NO: 744347 - DNA, 20 bp, Artificial
  CRISPR gRNA sequence
ggtgcacggtcacacaggct

SEQ ID NO: 744348 - DNA, 20 bp, Artificial
  CRISPR gRNA sequence
tgcacggtcacacaggctga

SEQ ID NO: 744349 - DNA, 20 bp, Artificial
  CRISPR gRNA sequence
gcacggtcacacaggctgag

SEQ ID NO: 744350 - DNA, 20 bp, Artificial
  CRISPR gRNA sequence
cacggtcacacaggctgaga

SEQ ID NO: 744351 - DNA, 20 bp, Artificial
  CRISPR gRNA sequence
acacaggctgagagggcccc

SEQ ID NO: 744352 - DNA, 20 bp, Artificial
  CRISPR gRNA sequence
cacaggctgagagggccccc

SEQ ID NO: 744353 - DNA, 20 bp, Artificial
  CRISPR gRNA sequence
cccaggacgcccccatccca

SEQ ID NO: 744354 - DNA, 20 bp, Artificial
  CRISPR gRNA sequence
ccatcccacagttcccactc

SEQ ID NO: 744355 - DNA, 20 bp, Artificial
  CRISPR gRNA sequence
tccagtctgctgtcttctcc

SEQ ID NO: 744356 - DNA, 20 bp, Artificial
  CRISPR gRNA sequence
gtcttctcccagctttttcc

SEQ ID NO: 744357 - DNA, 20 bp, Artificial
  CRISPR gRNA sequence
ccgcctcccccgaccttacc

SEQ ID NO: 744358 - DNA, 20 bp, Artificial
  CRISPR gRNA sequence
cgcctcccccgaccttacct

SEQ ID NO: 744359 - DNA, 20 bp, Artificial
  CRISPR gRNA sequence
gcctcccccgaccttaccta

SEQ ID NO: 744360 - DNA, 20 bp, Artificial
  CRISPR gRNA sequence
cccgaccttacctagggacg

SEQ ID NO: 744361 - DNA, 20 bp, Artificial
  CRISPR gRNA sequence
accttacctagggacgcagc

SEQ ID NO: 744362 - DNA, 20 bp, Artificial
  CRISPR gRNA sequence
ccttacctagggacgcagcc

SEQ ID NO: 744363 - DNA, 20 bp, Artificial
  CRISPR gRNA sequence
tacctagggacgcagccagg

SEQ ID NO: 744364 - DNA, 20 bp, Artificial
  CRISPR gRNA sequence
cctagggacgcagccaggaa

SEQ ID NO: 744365 - DNA, 20 bp, Artificial
  CRISPR gRNA sequence
tagggacgcagccaggaaga

SEQ ID NO: 744366 - DNA, 20 bp, Artificial
  CRISPR gRNA sequence
acgcagccaggaagagagcg

SEQ ID NO: 744367 - DNA, 20 bp, Artificial
  CRISPR gRNA sequence
gcagccaggaagagagcgaa

SEQ ID NO: 744368 - DNA, 20 bp, Artificial
  CRISPR gRNA sequence
gccaggaagagagcgaagag

SEQ ID NO: 744369 - DNA, 20 bp, Artificial
  CRISPR gRNA sequence
ccaggaagagagcgaagagc

SEQ ID NO: 744370 - DNA, 20 bp, Artificial
  CRISPR gRNA sequence
caggaagagagcgaagagca

SEQ ID NO: 744371 - DNA, 20 bp, Artificial
  CRISPR gRNA sequence
gagcgaagagcagggatccc

SEQ ID NO: 744372 - DNA, 20 bp, Artificial
  CRISPR gRNA sequence
agagcagggatccccagcgc

SEQ ID NO: 744373 - DNA, 20 bp, Artificial
  CRISPR gRNA sequence
ggatccccagcgccagctgc

SEQ ID NO: 744374 - DNA, 20 bp, Artificial
  CRISPR gRNA sequence
cagcgccagctgccggcctc

SEQ ID NO: 744375 - DNA, 20 bp, Artificial
  CRISPR gRNA sequence
agcgccagctgccggcctcc

SEQ ID NO: 744376 - DNA, 20 bp, Artificial
  CRISPR gRNA sequence
gcgccagctgccggcctcca

SEQ ID NO: 744377 - DNA, 20 bp, Artificial
  CRISPR gRNA sequence
gctgccggcctccagggccg

SEQ ID NO: 744378 - DNA, 20 bp, Artificial
  CRISPR gRNA sequence
ctgccggcctccagggccgt

SEQ ID NO: 744379 - DNA, 20 bp, Artificial
  CRISPR gRNA sequence
tgccggcctccagggccgtg

SEQ ID NO: 744380 - DNA, 20 bp, Artificial
  CRISPR gRNA sequence
ggggacgcccatgtcgccgt

SEQ ID NO: 744381 - DNA, 20 bp, Artificial
  CRISPR gRNA sequence
ccatgtcgccgtcggacgcg

SEQ ID NO: 744382 - DNA, 20 bp, Artificial
  CRISPR gRNA sequence
atgtcgccgtcggacgcgca

SEQ ID NO: 744383 - DNA, 20 bp, Artificial
  CRISPR gRNA sequence
tgtcgccgtcggacgcgcag

SEQ ID NO: 744384 - DNA, 20 bp, Artificial
  CRISPR gRNA sequence
cggacgcgcagaggaacttc

SEQ ID NO: 744385 - DNA, 20 bp, Artificial
  CRISPR gRNA sequence
cgcagaggaacttctggtgc

SEQ ID NO: 744386 - DNA, 20 bp, Artificial
  CRISPR gRNA sequence
gcagaggaacttctggtgcc

SEQ ID NO: 744387 - DNA, 20 bp, Artificial
  CRISPR gRNA sequence
cagaggaacttctggtgccg

SEQ ID NO: 744388 - DNA, 20 bp, Artificial
  CRISPR gRNA sequence
gaggaacttctggtgccggg

SEQ ID NO: 744389 - DNA, 20 bp, Artificial
  CRISPR gRNA sequence
gaacttctggtgccggggag

SEQ ID NO: 744390 - DNA, 20 bp, Artificial
  CRISPR gRNA sequence
aacttctggtgccggggagc

SEQ ID NO: 744391 - DNA, 20 bp, Artificial
  CRISPR gRNA sequence
ttctggtgccggggagcggg

SEQ ID NO: 744392 - DNA, 20 bp, Artificial
  CRISPR gRNA sequence
tctggtgccggggagcgggc

SEQ ID NO: 744393 - DNA, 20 bp, Artificial
  CRISPR gRNA sequence
gccggggagcgggcgggacg

SEQ ID NO: 744394 - DNA, 20 bp, Artificial
  CRISPR gRNA sequence
gggagcgggcgggacgcggc

SEQ ID NO: 744395 - DNA, 20 bp, Artificial
  CRISPR gRNA sequence
cgggcgggacgcggccggcg

SEQ ID NO: 744396 - DNA, 20 bp, Artificial
  CRISPR gRNA sequence
gggcgggacgcggccggcgc

SEQ ID NO: 744397 - DNA, 20 bp, Artificial
  CRISPR gRNA sequence
ggcgggacgcggccggcgcg

SEQ ID NO: 744398 - DNA, 20 bp, Artificial
  CRISPR gRNA sequence
gggacgcggccggcgcgggg

SEQ ID NO: 744399 - DNA, 20 bp, Artificial
  CRISPR gRNA sequence
cggggaagcctcccgcgact

SEQ ID NO: 744400 - DNA, 20 bp, Artificial
  CRISPR gRNA sequence
agcctcccgcgactgagtgc

SEQ ID NO: 744401 - DNA, 20 bp, Artificial
  CRISPR gRNA sequence
tcccgcgactgagtgcgagc

SEQ ID NO: 744402 - DNA, 20 bp, Artificial
  CRISPR gRNA sequence
gcgactgagtgcgagcgagt

SEQ ID NO: 744403 - DNA, 20 bp, Artificial
  CRISPR gRNA sequence
gtgcgagcgagtgagcgctg

SEQ ID NO: 744404 - DNA, 20 bp, Artificial
  CRISPR gRNA sequence
tgcgagcgagtgagcgctgc

SEQ ID NO: 744405 - DNA, 20 bp, Artificial
  CRISPR gRNA sequence
gagcgagtgagcgctgcggg

SEQ ID NO: 744406 - DNA, 20 bp, Artificial
  CRISPR gRNA sequence
gtgagcgctgcgggcggccc

SEQ ID NO: 744407 - DNA, 20 bp, Artificial
  CRISPR gRNA sequence
gcggccccagcgccgtgctc

SEQ ID NO: 744408 - DNA, 20 bp, Artificial
  CRISPR gRNA sequence
cggccccagcgccgtgctcc

SEQ ID NO: 744409 - DNA, 20 bp, Artificial
  CRISPR gRNA sequence
aggcacccgcccccttcgcg

SEQ ID NO: 744410 - DNA, 20 bp, Artificial
  CRISPR gRNA sequence
cccccttcgcgcagcgcccc

SEQ ID NO: 744411 - DNA, 20 bp, Artificial
  CRISPR gRNA sequence
ccccttcgcgcagcgccccc

SEQ ID NO: 744412 - DNA, 20 bp, Artificial
  CRISPR gRNA sequence
cccttcgcgcagcgcccccg

SEQ ID NO: 744413 - DNA, 20 bp, Artificial
  CRISPR gRNA sequence
ccttcgcgcagcgcccccgg

SEQ ID NO: 744414 - DNA, 20 bp, Artificial
  CRISPR gRNA sequence
cttcgcgcagcgcccccggg

SEQ ID NO: 744415 - DNA, 20 bp, Artificial
  CRISPR gRNA sequence
agcgcccccggggggccgtg

SEQ ID NO: 744416 - DNA, 20 bp, Artificial
  CRISPR gRNA sequence
gcgcccccggggggccgtgt

SEQ ID NO: 744417 - DNA, 20 bp, Artificial
  CRISPR gRNA sequence
cgcccccggggggccgtgtg

SEQ ID NO: 744418 - DNA, 20 bp, Artificial
  CRISPR gRNA sequence
gcccccggggggccgtgtgg

SEQ ID NO: 744419 - DNA, 20 bp, Artificial
  CRISPR gRNA sequence
tgtgggggaactgcctctcc

SEQ ID NO: 744420 - DNA, 20 bp, Artificial
  CRISPR gRNA sequence
gtgggggaactgcctctccg

SEQ ID NO: 744421 - DNA, 20 bp, Artificial
  CRISPR gRNA sequence
tgggggaactgcctctccga

SEQ ID NO: 744422 - DNA, 20 bp, Artificial
  CRISPR gRNA sequence
ctgcctctccgagggccgcg

SEQ ID NO: 744423 - DNA, 20 bp, Artificial
  CRISPR gRNA sequence
tgcctctccgagggccgcgt

SEQ ID NO: 744424 - DNA, 20 bp, Artificial
  CRISPR gRNA sequence
cctctccgagggccgcgtgg

SEQ ID NO: 744425 - DNA, 20 bp, Artificial
  CRISPR gRNA sequence
ctctccgagggccgcgtggg

SEQ ID NO: 744426 - DNA, 20 bp, Artificial
  CRISPR gRNA sequence
tctccgagggccgcgtggga

SEQ ID NO: 744427 - DNA, 20 bp, Artificial
  CRISPR gRNA sequence
ctccgagggccgcgtgggag

SEQ ID NO: 744428 - DNA, 20 bp, Artificial
  CRISPR gRNA sequence
gccgcgtgggaggggcttcc

SEQ ID NO: 744429 - DNA, 20 bp, Artificial
  CRISPR gRNA sequence
cgcgtgggaggggcttcccg

SEQ ID NO: 744430 - DNA, 20 bp, Artificial
  CRISPR gRNA sequence
gcgtgggaggggcttcccgg

SEQ ID NO: 744431 - DNA, 20 bp, Artificial
  CRISPR gRNA sequence
gggaggggcttcccggaggc

SEQ ID NO: 744432 - DNA, 20 bp, Artificial
  CRISPR gRNA sequence
cttcccggaggccggccccg

SEQ ID NO: 744433 - DNA, 20 bp, Artificial
  CRISPR gRNA sequence
ttcccggaggccggccccgt

SEQ ID NO: 744434 - DNA, 20 bp, Artificial
  CRISPR gRNA sequence
ccggaggccggccccgtggg

SEQ ID NO: 744435 - DNA, 20 bp, Artificial
  CRISPR gRNA sequence
cggaggccggccccgtgggt

SEQ ID NO: 744436 - DNA, 20 bp, Artificial
  CRISPR gRNA sequence
ggaggccggccccgtgggtg

SEQ ID NO: 744437 - DNA, 20 bp, Artificial
  CRISPR gRNA sequence
aggccggccccgtgggtggg

SEQ ID NO: 744438 - DNA, 20 bp, Artificial
  CRISPR gRNA sequence
cggccccgtgggtggggagc

SEQ ID NO: 744439 - DNA, 20 bp, Artificial
  CRISPR gRNA sequence
tggctccccacccacggggc

SEQ ID NO: 744440 - DNA, 20 bp, Artificial
  CRISPR gRNA sequence
ccacccacggggccggcctc

SEQ ID NO: 744441 - DNA, 20 bp, Artificial
  CRISPR gRNA sequence
cacccacggggccggcctcc

SEQ ID NO: 744442 - DNA, 20 bp, Artificial
  CRISPR gRNA sequence
ccacggggccggcctccggg

SEQ ID NO: 744443 - DNA, 20 bp, Artificial
  CRISPR gRNA sequence
tccgggaagcccctcccacg

SEQ ID NO: 744444 - DNA, 20 bp, Artificial
  CRISPR gRNA sequence
agcccctcccacgcggccct

SEQ ID NO: 744445 - DNA, 20 bp, Artificial
  CRISPR gRNA sequence
cccctcccacgcggccctcg

SEQ ID NO: 744446 - DNA, 20 bp, Artificial
  CRISPR gRNA sequence
cctcccacgcggccctcgga

SEQ ID NO: 744447 - DNA, 20 bp, Artificial
  CRISPR gRNA sequence
ctcccacgcggccctcggag

SEQ ID NO: 744448 - DNA, 20 bp, Artificial
  CRISPR gRNA sequence
ccacgcggccctcggagagg

SEQ ID NO: 744449 - DNA, 20 bp, Artificial
  CRISPR gRNA sequence
ggagaggcagttcccccaca

SEQ ID NO: 744450 - DNA, 20 bp, Artificial
  CRISPR gRNA sequence
agttcccccacacggccccc

SEQ ID NO: 744451 - DNA, 20 bp, Artificial
  CRISPR gRNA sequence
gttcccccacacggcccccc

SEQ ID NO: 744452 - DNA, 20 bp, Artificial
  CRISPR gRNA sequence
ttcccccacacggccccccg

SEQ ID NO: 744453 - DNA, 20 bp, Artificial
  CRISPR gRNA sequence
tcccccacacggccccccgg

SEQ ID NO: 744454 - DNA, 20 bp, Artificial
  CRISPR gRNA sequence
ccccccgggggcgctgcgcg

SEQ ID NO: 744455 - DNA, 20 bp, Artificial
  CRISPR gRNA sequence
cccccgggggcgctgcgcga

SEQ ID NO: 744456 - DNA, 20 bp, Artificial
  CRISPR gRNA sequence
ccccgggggcgctgcgcgaa

SEQ ID NO: 744457 - DNA, 20 bp, Artificial
  CRISPR gRNA sequence
cccgggggcgctgcgcgaag

SEQ ID NO: 744458 - DNA, 20 bp, Artificial
  CRISPR gRNA sequence
ccgggggcgctgcgcgaagg

SEQ ID NO: 744459 - DNA, 20 bp, Artificial
  CRISPR gRNA sequence
ggggcgctgcgcgaaggggg

SEQ ID NO: 744460 - DNA, 20 bp, Artificial
  CRISPR gRNA sequence
gggcgctgcgcgaagggggc

SEQ ID NO: 744461 - DNA, 20 bp, Artificial
  CRISPR gRNA sequence
gcgcgaagggggcgggtgcc

SEQ ID NO: 744462 - DNA, 20 bp, Artificial
  CRISPR gRNA sequence
gcgaagggggcgggtgcctg

SEQ ID NO: 744463 - DNA, 20 bp, Artificial
  CRISPR gRNA sequence
gggggcgggtgcctggagca

SEQ ID NO: 744464 - DNA, 20 bp, Artificial
  CRISPR gRNA sequence
gggtgcctggagcacggcgc

SEQ ID NO: 744465 - DNA, 20 bp, Artificial
  CRISPR gRNA sequence
ggtgcctggagcacggcgct

SEQ ID NO: 744466 - DNA, 20 bp, Artificial
  CRISPR gRNA sequence
gtgcctggagcacggcgctg

SEQ ID NO: 744467 - DNA, 20 bp, Artificial
  CRISPR gRNA sequence
cacggcgctggggccgcccg

SEQ ID NO: 744468 - DNA, 20 bp, Artificial
  CRISPR gRNA sequence
agcgctcactcgctcgcact

SEQ ID NO: 744469 - DNA, 20 bp, Artificial
  CRISPR gRNA sequence
cactcgctcgcactcagtcg

SEQ ID NO: 744470 - DNA, 20 bp, Artificial
  CRISPR gRNA sequence
actcgctcgcactcagtcgc

SEQ ID NO: 744471 - DNA, 20 bp, Artificial
  CRISPR gRNA sequence
tcgctcgcactcagtcgcgg

SEQ ID NO: 744472 - DNA, 20 bp, Artificial
  CRISPR gRNA sequence
cgctcgcactcagtcgcggg

SEQ ID NO: 744473 - DNA, 20 bp, Artificial
  CRISPR gRNA sequence
cgcgggaggcttccccgcgc

SEQ ID NO: 744474 - DNA, 20 bp, Artificial
  CRISPR gRNA sequence
gccgcgtcccgcccgctccc

SEQ ID NO: 744475 - DNA, 20 bp, Artificial
  CRISPR gRNA sequence
tcccgcccgctccccggcac

SEQ ID NO: 744476 - DNA, 20 bp, Artificial
  CRISPR gRNA sequence
cgcccgctccccggcaccag

SEQ ID NO: 744477 - DNA, 20 bp, Artificial
  CRISPR gRNA sequence
aagttcctctgcgcgtccga

SEQ ID NO: 744478 - DNA, 20 bp, Artificial
  CRISPR gRNA sequence
ctgcgcgtccgacggcgaca

SEQ ID NO: 744479 - DNA, 20 bp, Artificial
  CRISPR gRNA sequence
tgcgcgtccgacggcgacat

SEQ ID NO: 744480 - DNA, 20 bp, Artificial
  CRISPR gRNA sequence
cggcgacatgggcgtcccca

SEQ ID NO: 744481 - DNA, 20 bp, Artificial
  CRISPR gRNA sequence
catgggcgtccccacggccc

SEQ ID NO: 744482 - DNA, 20 bp, Artificial
  CRISPR gRNA sequence
tgggcgtccccacggccctg

SEQ ID NO: 744483 - DNA, 20 bp, Artificial
  CRISPR gRNA sequence
gggcgtccccacggccctgg

SEQ ID NO: 744484 - DNA, 20 bp, Artificial
  CRISPR gRNA sequence
gtccccacggccctggaggc

SEQ ID NO: 744485 - DNA, 20 bp, Artificial
  CRISPR gRNA sequence
cccacggccctggaggccgg

SEQ ID NO: 744486 - DNA, 20 bp, Artificial
  CRISPR gRNA sequence
cggccctggaggccggcagc

SEQ ID NO: 744487 - DNA, 20 bp, Artificial
  CRISPR gRNA sequence
tggaggccggcagctggcgc

SEQ ID NO: 744488 - DNA, 20 bp, Artificial
  CRISPR gRNA sequence
ggaggccggcagctggcgct

SEQ ID NO: 744489 - DNA, 20 bp, Artificial
  CRISPR gRNA sequence
gaggccggcagctggcgctg

SEQ ID NO: 744490 - DNA, 20 bp, Artificial
  CRISPR gRNA sequence
cctgctcttcgctctcttcc

SEQ ID NO: 744491 - DNA, 20 bp, Artificial
  CRISPR gRNA sequence
tctcttcctggctgcgtccc

SEQ ID NO: 744492 - DNA, 20 bp, Artificial
  CRISPR gRNA sequence
ctcttcctggctgcgtccct

SEQ ID NO: 744493 - DNA, 20 bp, Artificial
  CRISPR gRNA sequence
tcctggctgcgtccctaggt

SEQ ID NO: 744494 - DNA, 20 bp, Artificial
  CRISPR gRNA sequence
cctggctgcgtccctaggta

SEQ ID NO: 744495 - DNA, 20 bp, Artificial
  CRISPR gRNA sequence
gctgcgtccctaggtaaggt

SEQ ID NO: 744496 - DNA, 20 bp, Artificial
  CRISPR gRNA sequence
ctgcgtccctaggtaaggtc

SEQ ID NO: 744497 - DNA, 20 bp, Artificial
  CRISPR gRNA sequence
tgcgtccctaggtaaggtcg

SEQ ID NO: 744498 - DNA, 20 bp, Artificial
  CRISPR gRNA sequence
gcgtccctaggtaaggtcgg

SEQ ID NO: 744499 - DNA, 20 bp, Artificial
  CRISPR gRNA sequence
gtccctaggtaaggtcgggg

SEQ ID NO: 744500 - DNA, 20 bp, Artificial
  CRISPR gRNA sequence
tccctaggtaaggtcggggg

SEQ ID NO: 744501 - DNA, 20 bp, Artificial
  CRISPR gRNA sequence
ctaggtaaggtcgggggagg

SEQ ID NO: 744502 - DNA, 20 bp, Artificial
  CRISPR gRNA sequence
taggtaaggtcgggggaggc

SEQ ID NO: 744503 - DNA, 20 bp, Artificial
  CRISPR gRNA sequence
aggtaaggtcgggggaggcg

SEQ ID NO: 744504 - DNA, 20 bp, Artificial
  CRISPR gRNA sequence
ggtcgggggaggcggggcgc

SEQ ID NO: 744505 - DNA, 20 bp, Artificial
  CRISPR gRNA sequence
gtcgggggaggcggggcgct

SEQ ID NO: 744506 - DNA, 20 bp, Artificial
  CRISPR gRNA sequence
ggaggcggggcgctgggaaa

SEQ ID NO: 744507 - DNA, 20 bp, Artificial
  CRISPR gRNA sequence
gcggggcgctgggaaaaagc

SEQ ID NO: 744508 - DNA, 20 bp, Artificial
  CRISPR gRNA sequence
cggggcgctgggaaaaagct

SEQ ID NO: 744509 - DNA, 20 bp, Artificial
  CRISPR gRNA sequence
gggcgctgggaaaaagctgg

SEQ ID NO: 744510 - DNA, 20 bp, Artificial
  CRISPR gRNA sequence
cgctgggaaaaagctgggag

SEQ ID NO: 744511 - DNA, 20 bp, Artificial
  CRISPR gRNA sequence
gggaaaaagctgggagaaga

SEQ ID NO: 744512 - DNA, 20 bp, Artificial
  CRISPR gRNA sequence
aaaaagctgggagaagacag

SEQ ID NO: 744513 - DNA, 20 bp, Artificial
  CRISPR gRNA sequence
gctgggagaagacagcagac

SEQ ID NO: 744514 - DNA, 20 bp, Artificial
  CRISPR gRNA sequence
tgggagaagacagcagactg

SEQ ID NO: 744515 - DNA, 20 bp, Artificial
  CRISPR gRNA sequence
gagaagacagcagactggag

SEQ ID NO: 744516 - DNA, 20 bp, Artificial
  CRISPR gRNA sequence
agaagacagcagactggagt

SEQ ID NO: 744517 - DNA, 20 bp, Artificial
  CRISPR gRNA sequence
gcagactggagtgggaactg

SEQ ID NO: 744518 - DNA, 20 bp, Artificial
  CRISPR gRNA sequence
cagactggagtgggaactgt

SEQ ID NO: 744519 - DNA, 20 bp, Artificial
  CRISPR gRNA sequence
ctggagtgggaactgtggga

SEQ ID NO: 744520 - DNA, 20 bp, Artificial
  CRISPR gRNA sequence
tggagtgggaactgtgggat

SEQ ID NO: 744521 - DNA, 20 bp, Artificial
  CRISPR gRNA sequence
ggagtgggaactgtgggatg

SEQ ID NO: 744522 - DNA, 20 bp, Artificial
  CRISPR gRNA sequence
gagtgggaactgtgggatgg

SEQ ID NO: 744523 - DNA, 20 bp, Artificial
  CRISPR gRNA sequence
actgtgggatgggggcgtcc

SEQ ID NO: 744524 - DNA, 20 bp, Artificial
  CRISPR gRNA sequence
ctgtgggatgggggcgtcct

SEQ ID NO: 744525 - DNA, 20 bp, Artificial
  CRISPR gRNA sequence
tgtgggatgggggcgtcctg

SEQ ID NO: 744526 - DNA, 20 bp, Artificial
  CRISPR gRNA sequence
gtgggatgggggcgtcctgg

SEQ ID NO: 744527 - DNA, 20 bp, Artificial
  CRISPR gRNA sequence
gggcgtcctgggggccctct

SEQ ID NO: 744528 - DNA, 20 bp, Artificial
  CRISPR gRNA sequence
accccactccacccaccgcc

SEQ ID NO: 744529 - DNA, 20 bp, Artificial
  CRISPR gRNA sequence
cccactccacccaccgccca

SEQ ID NO: 744530 - DNA, 20 bp, Artificial
  CRISPR gRNA sequence
ccactccacccaccgcccag

SEQ ID NO: 744531 - DNA, 20 bp, Artificial
  CRISPR gRNA sequence
acccaccgcccagaggctgc

SEQ ID NO: 744532 - DNA, 20 bp, Artificial
  CRISPR gRNA sequence
cccaccgcccagaggctgct

SEQ ID NO: 744533 - DNA, 20 bp, Artificial
  CRISPR gRNA sequence
ccagaggctgctgggacccc

SEQ ID NO: 744534 - DNA, 20 bp, Artificial
  CRISPR gRNA sequence
cagaggctgctgggacccct

SEQ ID NO: 744535 - DNA, 20 bp, Artificial
  CRISPR gRNA sequence
aggctgctgggacccctagg

SEQ ID NO: 744536 - DNA, 20 bp, Artificial
  CRISPR gRNA sequence
ggctgctgggacccctaggc

SEQ ID NO: 744537 - DNA, 20 bp, Artificial
  CRISPR gRNA sequence
gctgctgggacccctaggca

SEQ ID NO: 744538 - DNA, 20 bp, Artificial
  CRISPR gRNA sequence
tgggacccctaggcagggtg

SEQ ID NO: 744539 - DNA, 20 bp, Artificial
  CRISPR gRNA sequence
gacccctaggcagggtgcag

SEQ ID NO: 744540 - DNA, 20 bp, Artificial
  CRISPR gRNA sequence
ggtgcagtggcaactgtgcc

SEQ ID NO: 744541 - DNA, 20 bp, Artificial
  CRISPR gRNA sequence
ggcaactgtgccaagtgccc

SEQ ID NO: 744542 - DNA, 20 bp, Artificial
  CRISPR gRNA sequence
actgtgccaagtgccccagc

SEQ ID NO: 744543 - DNA, 20 bp, Artificial
  CRISPR gRNA sequence
ctgtgccaagtgccccagct

SEQ ID NO: 744544 - DNA, 20 bp, Artificial
  CRISPR gRNA sequence
caagtgccccagctaggcat

SEQ ID NO: 744545 - DNA, 20 bp, Artificial
  CRISPR gRNA sequence
aagtgccccagctaggcatc

SEQ ID NO: 744546 - DNA, 20 bp, Artificial
  CRISPR gRNA sequence
ggcacatctgcatgctctga

SEQ ID NO: 744547 - DNA, 20 bp, Artificial
  CRISPR gRNA sequence
gcatgctctgacagctgccc

SEQ ID NO: 744548 - DNA, 20 bp, Artificial
  CRISPR gRNA sequence
tgctctgacagctgcccaag

SEQ ID NO: 744549 - DNA, 20 bp, Artificial
  CRISPR gRNA sequence
tctgacagctgcccaagtgg

SEQ ID NO: 744550 - DNA, 20 bp, Artificial
  CRISPR gRNA sequence
ctgacagctgcccaagtggc

SEQ ID NO: 744551 - DNA, 20 bp, Artificial
  CRISPR gRNA sequence
acagctgcccaagtggcagg

SEQ ID NO: 744552 - DNA, 20 bp, Artificial
  CRISPR gRNA sequence
cagctgcccaagtggcaggc

SEQ ID NO: 744553 - DNA, 20 bp, Artificial
  CRISPR gRNA sequence
agctgcccaagtggcaggca

SEQ ID NO: 744554 - DNA, 20 bp, Artificial
  CRISPR gRNA sequence
ggcaggcagggctgtcccct

SEQ ID NO: 744555 - DNA, 20 bp, Artificial
  CRISPR gRNA sequence
gcaggcagggctgtcccctg

SEQ ID NO: 744556 - DNA, 20 bp, Artificial
  CRISPR gRNA sequence
caggcagggctgtcccctga

SEQ ID NO: 744557 - DNA, 20 bp, Artificial
  CRISPR gRNA sequence
tcccctgagggctgcctgtc

SEQ ID NO: 744558 - DNA, 20 bp, Artificial
  CRISPR gRNA sequence
ctgtccagcccttccctgcc

SEQ ID NO: 744559 - DNA, 20 bp, Artificial
  CRISPR gRNA sequence
gtccagcccttccctgccca

SEQ ID NO: 744560 - DNA, 20 bp, Artificial
  CRISPR gRNA sequence
ccttccctgcccagagaacc

SEQ ID NO: 744561 - DNA, 20 bp, Artificial
  CRISPR gRNA sequence
cttccctgcccagagaaccc

SEQ ID NO: 744562 - DNA, 20 bp, Artificial
  CRISPR gRNA sequence
ttccctgcccagagaaccca

SEQ ID NO: 744563 - DNA, 20 bp, Artificial
  CRISPR gRNA sequence
tgcccagagaacccagggca

SEQ ID NO: 744564 - DNA, 20 bp, Artificial
  CRISPR gRNA sequence
gcccagagaacccagggcac

SEQ ID NO: 744565 - DNA, 20 bp, Artificial
  CRISPR gRNA sequence
cagagaacccagggcacagg

SEQ ID NO: 744566 - DNA, 20 bp, Artificial
  CRISPR gRNA sequence
gggcacaggtagcttctgca

SEQ ID NO: 744567 - DNA, 20 bp, Artificial
  CRISPR gRNA sequence
cacaggtagcttctgcaaag

SEQ ID NO: 744568 - DNA, 20 bp, Artificial
  CRISPR gRNA sequence
acaggtagcttctgcaaaga

SEQ ID NO: 744569 - DNA, 20 bp, Artificial
  CRISPR gRNA sequence
aggtagcttctgcaaagaag

SEQ ID NO: 744570 - DNA, 20 bp, Artificial
  CRISPR gRNA sequence
gtagcttctgcaaagaagga

SEQ ID NO: 744571 - DNA, 20 bp, Artificial
  CRISPR gRNA sequence
tagcttctgcaaagaaggag

SEQ ID NO: 744572 - DNA, 20 bp, Artificial
  CRISPR gRNA sequence
tctgcaaagaaggagaggca

SEQ ID NO: 744573 - DNA, 20 bp, Artificial
  CRISPR gRNA sequence
ctgcaaagaaggagaggcac

SEQ ID NO: 744574 - DNA, 20 bp, Artificial
  CRISPR gRNA sequence
tgcaaagaaggagaggcaca

SEQ ID NO: 744575 - DNA, 20 bp, Artificial
  CRISPR gRNA sequence
aaagaaggagaggcacaggg

SEQ ID NO: 744576 - DNA, 20 bp, Artificial
  CRISPR gRNA sequence
aagaaggagaggcacagggt

SEQ ID NO: 744577 - DNA, 20 bp, Artificial
  CRISPR gRNA sequence
agaaggagaggcacagggtg

SEQ ID NO: 744578 - DNA, 20 bp, Artificial
  CRISPR gRNA sequence
gaaggagaggcacagggtgg

SEQ ID NO: 744579 - DNA, 20 bp, Artificial
  CRISPR gRNA sequence
ggagaggcacagggtggggg

SEQ ID NO: 744580 - DNA, 20 bp, Artificial
  CRISPR gRNA sequence
aggcacagggtgggggcggt

SEQ ID NO: 744581 - DNA, 20 bp, Artificial
  CRISPR gRNA sequence
tgggggcggtcagtgtgttc

SEQ ID NO: 744582 - DNA, 20 bp, Artificial
  CRISPR gRNA sequence
gggcggtcagtgtgttctgg

SEQ ID NO: 744583 - DNA, 20 bp, Artificial
  CRISPR gRNA sequence
tgtgttctggtggatatcac

SEQ ID NO: 744584 - DNA, 20 bp, Artificial
  CRISPR gRNA sequence
tggatatcactggcttttga

SEQ ID NO: 744585 - DNA, 20 bp, Artificial
  CRISPR gRNA sequence
tatcactggcttttgacagc

SEQ ID NO: 744586 - DNA, 20 bp, Artificial
  CRISPR gRNA sequence
ctggcatctttctgcccctc

SEQ ID NO: 744587 - DNA, 20 bp, Artificial
  CRISPR gRNA sequence
tctttctgcccctctagtct

SEQ ID NO: 744588 - DNA, 20 bp, Artificial
  CRISPR gRNA sequence
ctttctgcccctctagtctc

SEQ ID NO: 744589 - DNA, 20 bp, Artificial
  CRISPR gRNA sequence
tttctgcccctctagtctca

SEQ ID NO: 744590 - DNA, 20 bp, Artificial
  CRISPR gRNA sequence
cccctctagtctcagggctc

SEQ ID NO: 744591 - DNA, 20 bp, Artificial
  CRISPR gRNA sequence
gtctcagggctctagtgttg

SEQ ID NO: 744592 - DNA, 20 bp, Artificial
  CRISPR gRNA sequence
ctcagggctctagtgttgca

SEQ ID NO: 744593 - DNA, 20 bp, Artificial
  CRISPR gRNA sequence
tcagggctctagtgttgcag

SEQ ID NO: 744594 - DNA, 20 bp, Artificial
  CRISPR gRNA sequence
ctctagtgttgcagaggaca

SEQ ID NO: 744595 - DNA, 20 bp, Artificial
  CRISPR gRNA sequence
ctagtgttgcagaggacaca

SEQ ID NO: 744596 - DNA, 20 bp, Artificial
  CRISPR gRNA sequence
tagtgttgcagaggacacag

SEQ ID NO: 744597 - DNA, 20 bp, Artificial
  CRISPR gRNA sequence
agtgttgcagaggacacaga

SEQ ID NO: 744598 - DNA, 20 bp, Artificial
  CRISPR gRNA sequence
tgcagaggacacagagggcg

SEQ ID NO: 744599 - DNA, 20 bp, Artificial
  CRISPR gRNA sequence
cacagagggcgtggtatgct

SEQ ID NO: 744600 - DNA, 20 bp, Artificial
  CRISPR gRNA sequence
gagggcgtggtatgctcagc

SEQ ID NO: 744601 - DNA, 20 bp, Artificial
  CRISPR gRNA sequence
tcagccagtgccccatgccc

SEQ ID NO: 744602 - DNA, 20 bp, Artificial
  CRISPR gRNA sequence
ccatgccctggtgaaacccc

SEQ ID NO: 744603 - DNA, 20 bp, Artificial
  CRISPR gRNA sequence
ccctggtgaaacccctggct

SEQ ID NO: 744604 - DNA, 20 bp, Artificial
  CRISPR gRNA sequence
tgaaacccctggctgagcct

SEQ ID NO: 744605 - DNA, 20 bp, Artificial
  CRISPR gRNA sequence
aacccctggctgagccttgg

SEQ ID NO: 744606 - DNA, 20 bp, Artificial
  CRISPR gRNA sequence
acccctggctgagccttggt

SEQ ID NO: 744607 - DNA, 20 bp, Artificial
  CRISPR gRNA sequence
ggctgagccttggtgggcac

SEQ ID NO: 744608 - DNA, 20 bp, Artificial
  CRISPR gRNA sequence
gctgagccttggtgggcact

SEQ ID NO: 744609 - DNA, 20 bp, Artificial
  CRISPR gRNA sequence
ccttggtgggcactgggcac

SEQ ID NO: 744610 - DNA, 20 bp, Artificial
  CRISPR gRNA sequence
tgggcactgggcactggtca

SEQ ID NO: 744611 - DNA, 20 bp, Artificial
  CRISPR gRNA sequence
gcactgggcactggtcacgg

SEQ ID NO: 744612 - DNA, 20 bp, Artificial
  CRISPR gRNA sequence
cactgggcactggtcacggt

SEQ ID NO: 744613 - DNA, 20 bp, Artificial
  CRISPR gRNA sequence
ggtcacggtgggtccacttt

SEQ ID NO: 744614 - DNA, 20 bp, Artificial
  CRISPR gRNA sequence
ggtgggtccactttcagaca

SEQ ID NO: 744615 - DNA, 20 bp, Artificial
  CRISPR gRNA sequence
tgggtccactttcagacaca

SEQ ID NO: 744616 - DNA, 20 bp, Artificial
  CRISPR gRNA sequence
gggtccactttcagacacag

SEQ ID NO: 744617 - DNA, 20 bp, Artificial
  CRISPR gRNA sequence
tccactttcagacacagagg

SEQ ID NO: 744618 - DNA, 20 bp, Artificial
  CRISPR gRNA sequence
cagaggcagcactgcccacc

SEQ ID NO: 744619 - DNA, 20 bp, Artificial
  CRISPR gRNA sequence
gcccacctggtccctattct

SEQ ID NO: 744620 - DNA, 20 bp, Artificial
  CRISPR gRNA sequence
cccacctggtccctattcta

SEQ ID NO: 744621 - DNA, 20 bp, Artificial
  CRISPR gRNA sequence
ccacctggtccctattctaa

SEQ ID NO: 744622 - DNA, 20 bp, Artificial
  CRISPR gRNA sequence
tccctattctaagggtctga

SEQ ID NO: 744623 - DNA, 20 bp, Artificial
  CRISPR gRNA sequence
attctaagggtctgatggcc

SEQ ID NO: 744624 - DNA, 20 bp, Artificial
  CRISPR gRNA sequence
ttctaagggtctgatggccc

SEQ ID NO: 744625 - DNA, 20 bp, Artificial
  CRISPR gRNA sequence
gggtctgatggcccaggaat

SEQ ID NO: 744626 - DNA, 20 bp, Artificial
  CRISPR gRNA sequence
tctgatggcccaggaataag

SEQ ID NO: 744627 - DNA, 20 bp, Artificial
  CRISPR gRNA sequence
atggcccaggaataagtggt

SEQ ID NO: 744628 - DNA, 20 bp, Artificial
  CRISPR gRNA sequence
tcagctgattcctgccatcc

SEQ ID NO: 744629 - DNA, 20 bp, Artificial
  CRISPR gRNA sequence
ctgattcctgccatcctagc

SEQ ID NO: 744630 - DNA, 20 bp, Artificial
  CRISPR gRNA sequence
tgattcctgccatcctagca

SEQ ID NO: 744631 - DNA, 20 bp, Artificial
  CRISPR gRNA sequence
atcctagcaaggctgccact

SEQ ID NO: 744632 - DNA, 20 bp, Artificial
  CRISPR gRNA sequence
tcctagcaaggctgccactc

SEQ ID NO: 744633 - DNA, 20 bp, Artificial
  CRISPR gRNA sequence
cctagcaaggctgccactca

SEQ ID NO: 744634 - DNA, 20 bp, Artificial
  CRISPR gRNA sequence
caaggctgccactcagggac

SEQ ID NO: 744635 - DNA, 20 bp, Artificial
  CRISPR gRNA sequence
ctgccactcagggaccagtg

SEQ ID NO: 744636 - DNA, 20 bp, Artificial
  CRISPR gRNA sequence
gccactcagggaccagtgtg

SEQ ID NO: 744637 - DNA, 20 bp, Artificial
  CRISPR gRNA sequence
cagggaccagtgtggagtac

SEQ ID NO: 744638 - DNA, 20 bp, Artificial
  CRISPR gRNA sequence
agggaccagtgtggagtact

SEQ ID NO: 744639 - DNA, 20 bp, Artificial
  CRISPR gRNA sequence
gggaccagtgtggagtactg

SEQ ID NO: 744640 - DNA, 20 bp, Artificial
  CRISPR gRNA sequence
gaccagtgtggagtactggg

SEQ ID NO: 744641 - DNA, 20 bp, Artificial
  CRISPR gRNA sequence
accagtgtggagtactgggg

SEQ ID NO: 744642 - DNA, 20 bp, Artificial
  CRISPR gRNA sequence
gtggagtactggggaggatg

SEQ ID NO: 744643 - DNA, 20 bp, Artificial
  CRISPR gRNA sequence
tggagtactggggaggatgt

SEQ ID NO: 744644 - DNA, 20 bp, Artificial
  CRISPR gRNA sequence
ggaggatgtgggacactctt

SEQ ID NO: 744645 - DNA, 20 bp, Artificial
  CRISPR gRNA sequence
atgtgggacactcttcagct

SEQ ID NO: 744646 - DNA, 20 bp, Artificial
  CRISPR gRNA sequence
acactcttcagctcagctat

SEQ ID NO: 744647 - DNA, 20 bp, Artificial
  CRISPR gRNA sequence
gctcagctatgagccccttc

SEQ ID NO: 744648 - DNA, 20 bp, Artificial
  CRISPR gRNA sequence
ctcagctatgagccccttct

SEQ ID NO: 744649 - DNA, 20 bp, Artificial
  CRISPR gRNA sequence
atgagccccttctgggtccc

SEQ ID NO: 744650 - DNA, 20 bp, Artificial
  CRISPR gRNA sequence
ctgggtccctggataaatta

SEQ ID NO: 744651 - DNA, 20 bp, Artificial
  CRISPR gRNA sequence
gataaattacggcatctctc

SEQ ID NO: 744652 - DNA, 20 bp, Artificial
  CRISPR gRNA sequence
ttacggcatctctctggcct

SEQ ID NO: 744653 - DNA, 20 bp, Artificial
  CRISPR gRNA sequence
ctctctggcctcagtttcct

SEQ ID NO: 744654 - DNA, 20 bp, Artificial
  CRISPR gRNA sequence
cagtttcctcagctcaaaca

SEQ ID NO: 744655 - DNA, 20 bp, Artificial
  CRISPR gRNA sequence
tttcctcagctcaaacacag

SEQ ID NO: 744656 - DNA, 20 bp, Artificial
  CRISPR gRNA sequence
ctcaaacacagaagcccaca

SEQ ID NO: 744657 - DNA, 20 bp, Artificial
  CRISPR gRNA sequence
tcaaacacagaagcccacac

SEQ ID NO: 744658 - DNA, 20 bp, Artificial
  CRISPR gRNA sequence
caaacacagaagcccacaca

SEQ ID NO: 744659 - DNA, 20 bp, Artificial
  CRISPR gRNA sequence
acacagaagcccacacaggg

SEQ ID NO: 744660 - DNA, 20 bp, Artificial
  CRISPR gRNA sequence
agcaccattttccccttcca

SEQ ID NO: 744661 - DNA, 20 bp, Artificial
  CRISPR gRNA sequence
cattttccccttccaaagtc

SEQ ID NO: 744662 - DNA, 20 bp, Artificial
  CRISPR gRNA sequence
ccttccaaagtccagactgt

SEQ ID NO: 744663 - DNA, 20 bp, Artificial
  CRISPR gRNA sequence
gtccagactgtcagcatgtt

SEQ ID NO: 744664 - DNA, 20 bp, Artificial
  CRISPR gRNA sequence
agactgtcagcatgttcaga

SEQ ID NO: 744665 - DNA, 20 bp, Artificial
  CRISPR gRNA sequence
agcatgttcagatagtatcc

SEQ ID NO: 744666 - DNA, 20 bp, Artificial
  CRISPR gRNA sequence
atagtatcctggccccaaca

SEQ ID NO: 744667 - DNA, 20 bp, Artificial
  CRISPR gRNA sequence
tagtatcctggccccaacac

SEQ ID NO: 744668 - DNA, 20 bp, Artificial
  CRISPR gRNA sequence
agtatcctggccccaacaca

SEQ ID NO: 744669 - DNA, 20 bp, Artificial
  CRISPR gRNA sequence
gtatcctggccccaacacag

SEQ ID NO: 744670 - DNA, 20 bp, Artificial
  CRISPR gRNA sequence
ggccccaacacaggggctcc

SEQ ID NO: 744671 - DNA, 20 bp, Artificial
  CRISPR gRNA sequence
gccccaacacaggggctccc

SEQ ID NO: 744672 - DNA, 20 bp, Artificial
  CRISPR gRNA sequence
caacacaggggctcccgggc

SEQ ID NO: 744673 - DNA, 20 bp, Artificial
  CRISPR gRNA sequence
aacacaggggctcccgggct

SEQ ID NO: 744674 - DNA, 20 bp, Artificial
  CRISPR gRNA sequence
acacaggggctcccgggctg

SEQ ID NO: 744675 - DNA, 20 bp, Artificial
  CRISPR gRNA sequence
cacaggggctcccgggctgg

SEQ ID NO: 744676 - DNA, 20 bp, Artificial
  CRISPR gRNA sequence
aggggctcccgggctggggg

SEQ ID NO: 744677 - DNA, 20 bp, Artificial
  CRISPR gRNA sequence
gggctcccgggctgggggca

SEQ ID NO: 744678 - DNA, 20 bp, Artificial
  CRISPR gRNA sequence
ggctcccgggctgggggcag

SEQ ID NO: 744679 - DNA, 20 bp, Artificial
  CRISPR gRNA sequence
cgggctgggggcagaggccc

SEQ ID NO: 744680 - DNA, 20 bp, Artificial
  CRISPR gRNA sequence
ggcagaggccctggtaccca

SEQ ID NO: 744681 - DNA, 20 bp, Artificial
  CRISPR gRNA sequence
aggccctggtacccatggcc

SEQ ID NO: 744682 - DNA, 20 bp, Artificial
  CRISPR gRNA sequence
gtacccatggcctggttgcc

SEQ ID NO: 744683 - DNA, 20 bp, Artificial
  CRISPR gRNA sequence
ttgcctagttcttgcctgcc

SEQ ID NO: 744684 - DNA, 20 bp, Artificial
  CRISPR gRNA sequence
gcctagttcttgcctgccca

SEQ ID NO: 744685 - DNA, 20 bp, Artificial
  CRISPR gRNA sequence
ttcttgcctgcccagagctg

SEQ ID NO: 744686 - DNA, 20 bp, Artificial
  CRISPR gRNA sequence
cttgcctgcccagagctgaa

SEQ ID NO: 744687 - DNA, 20 bp, Artificial
  CRISPR gRNA sequence
ttgcctgcccagagctgaag

SEQ ID NO: 744688 - DNA, 20 bp, Artificial
  CRISPR gRNA sequence
ctgcccagagctgaagaggc

SEQ ID NO: 744689 - DNA, 20 bp, Artificial
  CRISPR gRNA sequence
gaagaggctggatctcttca

SEQ ID NO: 744690 - DNA, 20 bp, Artificial
  CRISPR gRNA sequence
agaggctggatctcttcaaa

SEQ ID NO: 744691 - DNA, 20 bp, Artificial
  CRISPR gRNA sequence
ggatctcttcaaagagcctg

SEQ ID NO: 744692 - DNA, 20 bp, Artificial
  CRISPR gRNA sequence
gcctgtggaaccaaacttta

SEQ ID NO: 744693 - DNA, 20 bp, Artificial
  CRISPR gRNA sequence
cctgtggaaccaaactttat

SEQ ID NO: 744694 - DNA, 20 bp, Artificial
  CRISPR gRNA sequence
ctgtggaaccaaactttata

SEQ ID NO: 744695 - DNA, 20 bp, Artificial
  CRISPR gRNA sequence
gtggaaccaaactttatagg

SEQ ID NO: 744696 - DNA, 20 bp, Artificial
  CRISPR gRNA sequence
tggaaccaaactttataggg

SEQ ID NO: 744697 - DNA, 20 bp, Artificial
  CRISPR gRNA sequence
ggaaccaaactttataggga

SEQ ID NO: 744698 - DNA, 20 bp, Artificial
  CRISPR gRNA sequence
caaactttatagggagggcc

SEQ ID NO: 744699 - DNA, 20 bp, Artificial
  CRISPR gRNA sequence
aaactttatagggagggccc

SEQ ID NO: 744700 - DNA, 20 bp, Artificial
  CRISPR gRNA sequence
aactttatagggagggccca

SEQ ID NO: 744701 - DNA, 20 bp, Artificial
  CRISPR gRNA sequence
ttatagggagggcccaggga

SEQ ID NO: 744702 - DNA, 20 bp, Artificial
  CRISPR gRNA sequence
ggagggcccagggaaagtat

SEQ ID NO: 744703 - DNA, 20 bp, Artificial
  CRISPR gRNA sequence
cagggaaagtatgagtcatg

SEQ ID NO: 744704 - DNA, 20 bp, Artificial
  CRISPR gRNA sequence
agggaaagtatgagtcatgc

SEQ ID NO: 744705 - DNA, 20 bp, Artificial
  CRISPR gRNA sequence
gggaaagtatgagtcatgca

SEQ ID NO: 744706 - DNA, 20 bp, Artificial
  CRISPR gRNA sequence
gtatgagtcatgcagggact

SEQ ID NO: 744707 - DNA, 20 bp, Artificial
  CRISPR gRNA sequence
atgagtcatgcagggactcg

SEQ ID NO: 744708 - DNA, 20 bp, Artificial
  CRISPR gRNA sequence
tgagtcatgcagggactcgg

SEQ ID NO: 744709 - DNA, 20 bp, Artificial
  CRISPR gRNA sequence
gagtcatgcagggactcgga

SEQ ID NO: 744710 - DNA, 20 bp, Artificial
  CRISPR gRNA sequence
gtcatgcagggactcggagg

SEQ ID NO: 744711 - DNA, 20 bp, Artificial
  CRISPR gRNA sequence
tcatgcagggactcggaggg

SEQ ID NO: 744712 - DNA, 20 bp, Artificial
  CRISPR gRNA sequence
tgcagggactcggagggagg

SEQ ID NO: 744713 - DNA, 20 bp, Artificial
  CRISPR gRNA sequence
gcagggactcggagggaggc

SEQ ID NO: 744714 - DNA, 20 bp, Artificial
  CRISPR gRNA sequence
agggactcggagggaggcag

SEQ ID NO: 744715 - DNA, 20 bp, Artificial
  CRISPR gRNA sequence
gggactcggagggaggcagg

SEQ ID NO: 744716 - DNA, 20 bp, Artificial
  CRISPR gRNA sequence
ggactcggagggaggcagga

SEQ ID NO: 744717 - DNA, 20 bp, Artificial
  CRISPR gRNA sequence
actcggagggaggcaggagg

SEQ ID NO: 744718 - DNA, 20 bp, Artificial
  CRISPR gRNA sequence
ctcggagggaggcaggaggg

SEQ ID NO: 744719 - DNA, 20 bp, Artificial
  CRISPR gRNA sequence
ggagggaggcaggagggagg

SEQ ID NO: 744720 - DNA, 20 bp, Artificial
  CRISPR gRNA sequence
agggaggcaggagggaggtg

SEQ ID NO: 744721 - DNA, 20 bp, Artificial
  CRISPR gRNA sequence
gggaggcaggagggaggtgg

SEQ ID NO: 744722 - DNA, 20 bp, Artificial
  CRISPR gRNA sequence
ggaggcaggagggaggtgga

SEQ ID NO: 744723 - DNA, 20 bp, Artificial
  CRISPR gRNA sequence
caggagggaggtggagggct

SEQ ID NO: 744724 - DNA, 20 bp, Artificial
  CRISPR gRNA sequence
gggaggtggagggcttggca

SEQ ID NO: 744725 - DNA, 20 bp, Artificial
  CRISPR gRNA sequence
ggaggtggagggcttggcac

SEQ ID NO: 744726 - DNA, 20 bp, Artificial
  CRISPR gRNA sequence
gaggtggagggcttggcaca

SEQ ID NO: 744727 - DNA, 20 bp, Artificial
  CRISPR gRNA sequence
gagggcttggcacagggacc

SEQ ID NO: 744728 - DNA, 20 bp, Artificial
  CRISPR gRNA sequence
ggcttggcacagggacccag

SEQ ID NO: 744729 - DNA, 20 bp, Artificial
  CRISPR gRNA sequence
gcttggcacagggacccagt

SEQ ID NO: 744730 - DNA, 20 bp, Artificial
  CRISPR gRNA sequence
tggcacagggacccagtggg

SEQ ID NO: 744731 - DNA, 20 bp, Artificial
  CRISPR gRNA sequence
ggcacagggacccagtgggc

SEQ ID NO: 744732 - DNA, 20 bp, Artificial
  CRISPR gRNA sequence
cagggacccagtgggcagga

SEQ ID NO: 744733 - DNA, 20 bp, Artificial
  CRISPR gRNA sequence
acccagtgggcaggatggaa

SEQ ID NO: 744734 - DNA, 20 bp, Artificial
  CRISPR gRNA sequence
cagtgggcaggatggaatag

SEQ ID NO: 744735 - DNA, 20 bp, Artificial
  CRISPR gRNA sequence
agtgggcaggatggaataga

SEQ ID NO: 744736 - DNA, 20 bp, Artificial
  CRISPR gRNA sequence
tgggcaggatggaatagaag

SEQ ID NO: 744737 - DNA, 20 bp, Artificial
  CRISPR gRNA sequence
ggcaggatggaatagaagga

SEQ ID NO: 744738 - DNA, 20 bp, Artificial
  CRISPR gRNA sequence
gcaggatggaatagaaggag

SEQ ID NO: 744739 - DNA, 20 bp, Artificial
  CRISPR gRNA sequence
caggatggaatagaaggaga

SEQ ID NO: 744740 - DNA, 20 bp, Artificial
  CRISPR gRNA sequence
ggaatagaaggagagggtga

SEQ ID NO: 744741 - DNA, 20 bp, Artificial
  CRISPR gRNA sequence
gaatagaaggagagggtgat

SEQ ID NO: 744742 - DNA, 20 bp, Artificial
  CRISPR gRNA sequence
gaaggagagggtgataggat

SEQ ID NO: 744743 - DNA, 20 bp, Artificial
  CRISPR gRNA sequence
aggagagggtgataggataa

SEQ ID NO: 744744 - DNA, 20 bp, Artificial
  CRISPR gRNA sequence
ggagagggtgataggataag

SEQ ID NO: 744745 - DNA, 20 bp, Artificial
  CRISPR gRNA sequence
gagagggtgataggataaga

SEQ ID NO: 744746 - DNA, 20 bp, Artificial
  CRISPR gRNA sequence
gagggtgataggataagagg

SEQ ID NO: 744747 - DNA, 20 bp, Artificial
  CRISPR gRNA sequence
gggtgataggataagaggga

SEQ ID NO: 744748 - DNA, 20 bp, Artificial
  CRISPR gRNA sequence
ggtgataggataagagggag

SEQ ID NO: 744749 - DNA, 20 bp, Artificial
  CRISPR gRNA sequence
tgataggataagagggagag

SEQ ID NO: 744750 - DNA, 20 bp, Artificial
  CRISPR gRNA sequence
gataggataagagggagagg

SEQ ID NO: 744751 - DNA, 20 bp, Artificial
  CRISPR gRNA sequence
taggataagagggagaggag

SEQ ID NO: 744752 - DNA, 20 bp, Artificial
  CRISPR gRNA sequence
aggataagagggagaggagg

SEQ ID NO: 744753 - DNA, 20 bp, Artificial
  CRISPR gRNA sequence
ggagaggaggaggctgaacc

SEQ ID NO: 744754 - DNA, 20 bp, Artificial
  CRISPR gRNA sequence
gaggaggaggctgaacctgg

SEQ ID NO: 744755 - DNA, 20 bp, Artificial
  CRISPR gRNA sequence
gctgaacctggaagatacct

SEQ ID NO: 744756 - DNA, 20 bp, Artificial
  CRISPR gRNA sequence
tggaagataccttagcaacc

SEQ ID NO: 744757 - DNA, 20 bp, Artificial
  CRISPR gRNA sequence
ggaagataccttagcaacct

SEQ ID NO: 744758 - DNA, 20 bp, Artificial
  CRISPR gRNA sequence
cttagcaacctgggtgccca

SEQ ID NO: 744759 - DNA, 20 bp, Artificial
  CRISPR gRNA sequence
ttagcaacctgggtgcccac

SEQ ID NO: 744760 - DNA, 20 bp, Artificial
  CRISPR gRNA sequence
gcaacctgggtgcccacagg

SEQ ID NO: 744761 - DNA, 20 bp, Artificial
  CRISPR gRNA sequence
cctgggtgcccacaggcagc

SEQ ID NO: 744762 - DNA, 20 bp, Artificial
  CRISPR gRNA sequence
ccacaggcagctggctatct

SEQ ID NO: 744763 - DNA, 20 bp, Artificial
  CRISPR gRNA sequence
cagctggctatctcagcact

SEQ ID NO: 744764 - DNA, 20 bp, Artificial
  CRISPR gRNA sequence
gctggctatctcagcacttg

SEQ ID NO: 744765 - DNA, 20 bp, Artificial
  CRISPR gRNA sequence
ctggctatctcagcacttgg

SEQ ID NO: 744766 - DNA, 20 bp, Artificial
  CRISPR gRNA sequence
ctatctcagcacttggaggc

SEQ ID NO: 744767 - DNA, 20 bp, Artificial
  CRISPR gRNA sequence
tcagcacttggaggctggcc

SEQ ID NO: 744768 - DNA, 20 bp, Artificial
  CRISPR gRNA sequence
cagcacttggaggctggcct

SEQ ID NO: 744769 - DNA, 20 bp, Artificial
  CRISPR gRNA sequence
ggaggctggcctgggcctct

SEQ ID NO: 744770 - DNA, 20 bp, Artificial
  CRISPR gRNA sequence
gaggctggcctgggcctctg

SEQ ID NO: 744771 - DNA, 20 bp, Artificial
  CRISPR gRNA sequence
ggctggcctgggcctctgag

SEQ ID NO: 744772 - DNA, 20 bp, Artificial
  CRISPR gRNA sequence
gctggcctgggcctctgagg

SEQ ID NO: 744773 - DNA, 20 bp, Artificial
  CRISPR gRNA sequence
tggcctgggcctctgaggag

SEQ ID NO: 744774 - DNA, 20 bp, Artificial
  CRISPR gRNA sequence
ggcctgggcctctgaggagg

SEQ ID NO: 744775 - DNA, 20 bp, Artificial
  CRISPR gRNA sequence
cctgggcctctgaggaggag

SEQ ID NO: 744776 - DNA, 20 bp, Artificial
  CRISPR gRNA sequence
ctgggcctctgaggaggagg

SEQ ID NO: 744777 - DNA, 20 bp, Artificial
  CRISPR gRNA sequence
tgggcctctgaggaggagga

SEQ ID NO: 744778 - DNA, 20 bp, Artificial
  CRISPR gRNA sequence
gaggagggctccacatgtca

SEQ ID NO: 744779 - DNA, 20 bp, Artificial
  CRISPR gRNA sequence
ggctccacatgtcacagaca

SEQ ID NO: 744780 - DNA, 20 bp, Artificial
  CRISPR gRNA sequence
gtcacagacacagctgccct

SEQ ID NO: 744781 - DNA, 20 bp, Artificial
  CRISPR gRNA sequence
gacacagctgccctaagccc

SEQ ID NO: 744782 - DNA, 20 bp, Artificial
  CRISPR gRNA sequence
acacagctgccctaagcccc

SEQ ID NO: 744783 - DNA, 20 bp, Artificial
  CRISPR gRNA sequence
cacagctgccctaagcccca

SEQ ID NO: 744784 - DNA, 20 bp, Artificial
  CRISPR gRNA sequence
agctgccctaagccccaggg

SEQ ID NO: 744785 - DNA, 20 bp, Artificial
  CRISPR gRNA sequence
ccccagggtggatgcttctc

SEQ ID NO: 744786 - DNA, 20 bp, Artificial
  CRISPR gRNA sequence
cccagggtggatgcttctca

SEQ ID NO: 744787 - DNA, 20 bp, Artificial
  CRISPR gRNA sequence
gtggatgcttctcaaggtga

SEQ ID NO: 744788 - DNA, 20 bp, Artificial
  CRISPR gRNA sequence
atgcttctcaaggtgacagt

SEQ ID NO: 744789 - DNA, 20 bp, Artificial
  CRISPR gRNA sequence
gcttctcaaggtgacagtca

SEQ ID NO: 744790 - DNA, 20 bp, Artificial
  CRISPR gRNA sequence
cttctcaaggtgacagtcag

SEQ ID NO: 744791 - DNA, 20 bp, Artificial
  CRISPR gRNA sequence
ttctcaaggtgacagtcaga

SEQ ID NO: 744792 - DNA, 20 bp, Artificial
  CRISPR gRNA sequence
ctcaaggtgacagtcagagg

SEQ ID NO: 744793 - DNA, 20 bp, Artificial
  CRISPR gRNA sequence
tcaaggtgacagtcagaggg

SEQ ID NO: 744794 - DNA, 20 bp, Artificial
  CRISPR gRNA sequence
aaggtgacagtcagagggag

SEQ ID NO: 744795 - DNA, 20 bp, Artificial
  CRISPR gRNA sequence
aggtgacagtcagagggagg

SEQ ID NO: 744796 - DNA, 20 bp, Artificial
  CRISPR gRNA sequence
gtgacagtcagagggaggag

SEQ ID NO: 744797 - DNA, 20 bp, Artificial
  CRISPR gRNA sequence
agtcagagggaggaggagaa

SEQ ID NO: 744798 - DNA, 20 bp, Artificial
  CRISPR gRNA sequence
gtcagagggaggaggagaat

SEQ ID NO: 744799 - DNA, 20 bp, Artificial
  CRISPR gRNA sequence
cagagggaggaggagaatgg

SEQ ID NO: 744800 - DNA, 20 bp, Artificial
  CRISPR gRNA sequence
agagggaggaggagaatggg

SEQ ID NO: 744801 - DNA, 20 bp, Artificial
  CRISPR gRNA sequence
gggaggaggagaatgggagg

SEQ ID NO: 744802 - DNA, 20 bp, Artificial
  CRISPR gRNA sequence
gaggagaatgggaggtggaa

SEQ ID NO: 744803 - DNA, 20 bp, Artificial
  CRISPR gRNA sequence
agaatgggaggtggaatgga

SEQ ID NO: 744804 - DNA, 20 bp, Artificial
  CRISPR gRNA sequence
ggaggtggaatggacagtct

SEQ ID NO: 744805 - DNA, 20 bp, Artificial
  CRISPR gRNA sequence
gaatggacagtctcagcacc

SEQ ID NO: 744806 - DNA, 20 bp, Artificial
  CRISPR gRNA sequence
aatggacagtctcagcacca

SEQ ID NO: 744807 - DNA, 20 bp, Artificial
  CRISPR gRNA sequence
cagtctcagcaccaaggcca

SEQ ID NO: 744808 - DNA, 20 bp, Artificial
  CRISPR gRNA sequence
agcaccaaggccatggctca

SEQ ID NO: 744809 - DNA, 20 bp, Artificial
  CRISPR gRNA sequence
accaaggccatggctcatgg

SEQ ID NO: 744810 - DNA, 20 bp, Artificial
  CRISPR gRNA sequence
ccaaggccatggctcatggc

SEQ ID NO: 744811 - DNA, 20 bp, Artificial
  CRISPR gRNA sequence
caaggccatggctcatggca

SEQ ID NO: 744812 - DNA, 20 bp, Artificial
  CRISPR gRNA sequence
ccatggctcatggcagggca

SEQ ID NO: 744813 - DNA, 20 bp, Artificial
  CRISPR gRNA sequence
tcatggcagggcatggcttc

SEQ ID NO: 744814 - DNA, 20 bp, Artificial
  CRISPR gRNA sequence
tggcagggcatggcttccag

SEQ ID NO: 744815 - DNA, 20 bp, Artificial
  CRISPR gRNA sequence
ggcagggcatggcttccaga

SEQ ID NO: 744816 - DNA, 20 bp, Artificial
  CRISPR gRNA sequence
ggcatggcttccagaaggaa

SEQ ID NO: 744817 - DNA, 20 bp, Artificial
  CRISPR gRNA sequence
catggcttccagaaggaaca

SEQ ID NO: 744818 - DNA, 20 bp, Artificial
  CRISPR gRNA sequence
atggcttccagaaggaacag

SEQ ID NO: 744819 - DNA, 20 bp, Artificial
  CRISPR gRNA sequence
cttccagaaggaacagagga

SEQ ID NO: 744820 - DNA, 20 bp, Artificial
  CRISPR gRNA sequence
ccagaaggaacagaggatgg

SEQ ID NO: 744821 - DNA, 20 bp, Artificial
  CRISPR gRNA sequence
gaaggaacagaggatggtgg

SEQ ID NO: 744822 - DNA, 20 bp, Artificial
  CRISPR gRNA sequence
aaggaacagaggatggtggc

SEQ ID NO: 744823 - DNA, 20 bp, Artificial
  CRISPR gRNA sequence
gaacagaggatggtggcagg

SEQ ID NO: 744824 - DNA, 20 bp, Artificial
  CRISPR gRNA sequence
aacagaggatggtggcaggc

SEQ ID NO: 744825 - DNA, 20 bp, Artificial
  CRISPR gRNA sequence
gaggatggtggcaggcaggc

SEQ ID NO: 744826 - DNA, 20 bp, Artificial
  CRISPR gRNA sequence
atggtggcaggcaggcaagc

SEQ ID NO: 744827 - DNA, 20 bp, Artificial
  CRISPR gRNA sequence
agccagcatcccacctgtca

SEQ ID NO: 744828 - DNA, 20 bp, Artificial
  CRISPR gRNA sequence
gccagcatcccacctgtcat

SEQ ID NO: 744829 - DNA, 20 bp, Artificial
  CRISPR gRNA sequence
ctgccctgcactgccctccc

SEQ ID NO: 744830 - DNA, 20 bp, Artificial
  CRISPR gRNA sequence
ccctgcactgccctccctgg

SEQ ID NO: 744831 - DNA, 20 bp, Artificial
  CRISPR gRNA sequence
gccctccctggtggccctgt

SEQ ID NO: 744832 - DNA, 20 bp, Artificial
  CRISPR gRNA sequence
gcccacttcctgccctcact

SEQ ID NO: 744833 - DNA, 20 bp, Artificial
  CRISPR gRNA sequence
acttcctgccctcacttggc

SEQ ID NO: 744834 - DNA, 20 bp, Artificial
  CRISPR gRNA sequence
cttcctgccctcacttggct

SEQ ID NO: 744835 - DNA, 20 bp, Artificial
  CRISPR gRNA sequence
tggctgggctgccctctgtt

SEQ ID NO: 744836 - DNA, 20 bp, Artificial
  CRISPR gRNA sequence
ctgggctgccctctgttcag

SEQ ID NO: 744837 - DNA, 20 bp, Artificial
  CRISPR gRNA sequence
ctgttcagcagccccaattt

SEQ ID NO: 744838 - DNA, 20 bp, Artificial
  CRISPR gRNA sequence
cccaatttgagaaacatttc

SEQ ID NO: 744839 - DNA, 20 bp, Artificial
  CRISPR gRNA sequence
caatttgagaaacatttcta

SEQ ID NO: 744840 - DNA, 20 bp, Artificial
  CRISPR gRNA sequence
gagaaacatttctagagatc

SEQ ID NO: 744841 - DNA, 20 bp, Artificial
  CRISPR gRNA sequence
agaaacatttctagagatcc

SEQ ID NO: 744842 - DNA, 20 bp, Artificial
  CRISPR gRNA sequence
gaaacatttctagagatcca

SEQ ID NO: 744843 - DNA, 20 bp, Artificial
  CRISPR gRNA sequence
atttctagagatccagggca

SEQ ID NO: 744844 - DNA, 20 bp, Artificial
  CRISPR gRNA sequence
tttctagagatccagggcac

SEQ ID NO: 744845 - DNA, 20 bp, Artificial
  CRISPR gRNA sequence
ttctagagatccagggcaca

SEQ ID NO: 744846 - DNA, 20 bp, Artificial
  CRISPR gRNA sequence
agatccagggcacagggacc

SEQ ID NO: 744847 - DNA, 20 bp, Artificial
  CRISPR gRNA sequence
gggcacagggacccagcttg

SEQ ID NO: 744848 - DNA, 20 bp, Artificial
  CRISPR gRNA sequence
gcacagggacccagcttgca

SEQ ID NO: 744849 - DNA, 20 bp, Artificial
  CRISPR gRNA sequence
gacccagcttgcagagcacc

SEQ ID NO: 744850 - DNA, 20 bp, Artificial
  CRISPR gRNA sequence
ccagcttgcagagcacccag

SEQ ID NO: 744851 - DNA, 20 bp, Artificial
  CRISPR gRNA sequence
gcttgcagagcacccagtag

SEQ ID NO: 744852 - DNA, 20 bp, Artificial
  CRISPR gRNA sequence
ttgcagagcacccagtagca

SEQ ID NO: 744853 - DNA, 20 bp, Artificial
  CRISPR gRNA sequence
gcagagcacccagtagcaga

SEQ ID NO: 744854 - DNA, 20 bp, Artificial
  CRISPR gRNA sequence
cagagcacccagtagcagag

SEQ ID NO: 744855 - DNA, 20 bp, Artificial
  CRISPR gRNA sequence
cccagtagcagagaggcccc

SEQ ID NO: 744856 - DNA, 20 bp, Artificial
  CRISPR gRNA sequence
cagtagcagagaggccccaa

SEQ ID NO: 744857 - DNA, 20 bp, Artificial
  CRISPR gRNA sequence
agtagcagagaggccccaag

SEQ ID NO: 744858 - DNA, 20 bp, Artificial
  CRISPR gRNA sequence
tagcagagaggccccaagag

SEQ ID NO: 744859 - DNA, 20 bp, Artificial
  CRISPR gRNA sequence
gagaggccccaagaggagct

SEQ ID NO: 744860 - DNA, 20 bp, Artificial
  CRISPR gRNA sequence
agaggccccaagaggagctc

SEQ ID NO: 744861 - DNA, 20 bp, Artificial
  CRISPR gRNA sequence
cttcccctatattgcttata

SEQ ID NO: 744862 - DNA, 20 bp, Artificial
  CRISPR gRNA sequence
ccctatattgcttatatggc

SEQ ID NO: 744863 - DNA, 20 bp, Artificial
  CRISPR gRNA sequence
cctatattgcttatatggcc

SEQ ID NO: 744864 - DNA, 20 bp, Artificial
  CRISPR gRNA sequence
ctatattgcttatatggcca

SEQ ID NO: 744865 - DNA, 20 bp, Artificial
  CRISPR gRNA sequence
tatattgcttatatggccag

SEQ ID NO: 744866 - DNA, 20 bp, Artificial
  CRISPR gRNA sequence
tggccaggggcctttactcc

SEQ ID NO: 744867 - DNA, 20 bp, Artificial
  CRISPR gRNA sequence
gccaggggcctttactccca

SEQ ID NO: 744868 - DNA, 20 bp, Artificial
  CRISPR gRNA sequence
ccaggggcctttactcccag

SEQ ID NO: 744869 - DNA, 20 bp, Artificial
  CRISPR gRNA sequence
gcctttactcccagaggtct

SEQ ID NO: 744870 - DNA, 20 bp, Artificial
  CRISPR gRNA sequence
tcttggctactcaaacaaca

SEQ ID NO: 744871 - DNA, 20 bp, Artificial
  CRISPR gRNA sequence
tcaaacaacatggtatacta

SEQ ID NO: 744872 - DNA, 20 bp, Artificial
  CRISPR gRNA sequence
caaacaacatggtatactaa

SEQ ID NO: 744873 - DNA, 20 bp, Artificial
  CRISPR gRNA sequence
aaacaacatggtatactaaa

SEQ ID NO: 744874 - DNA, 20 bp, Artificial
  CRISPR gRNA sequence
actaaagggtcatctcttcc

SEQ ID NO: 744875 - DNA, 20 bp, Artificial
  CRISPR gRNA sequence
ctaaagggtcatctcttcct

SEQ ID NO: 744876 - DNA, 20 bp, Artificial
  CRISPR gRNA sequence
gggtcatctcttcctgggcc

SEQ ID NO: 744877 - DNA, 20 bp, Artificial
  CRISPR gRNA sequence
atctcttcctgggcccagca

SEQ ID NO: 744878 - DNA, 20 bp, Artificial
  CRISPR gRNA sequence
tctcttcctgggcccagcac

SEQ ID NO: 744879 - DNA, 20 bp, Artificial
  CRISPR gRNA sequence
ctcttcctgggcccagcaca

SEQ ID NO: 744880 - DNA, 20 bp, Artificial
  CRISPR gRNA sequence
cttcctgggcccagcacagg

SEQ ID NO: 744881 - DNA, 20 bp, Artificial
  CRISPR gRNA sequence
cccagcacagggagatgatt

SEQ ID NO: 744882 - DNA, 20 bp, Artificial
  CRISPR gRNA sequence
ccagcacagggagatgattt

SEQ ID NO: 744883 - DNA, 20 bp, Artificial
  CRISPR gRNA sequence
cacagggagatgatttaggc

SEQ ID NO: 744884 - DNA, 20 bp, Artificial
  CRISPR gRNA sequence
gagatgatttaggctggctg

SEQ ID NO: 744885 - DNA, 20 bp, Artificial
  CRISPR gRNA sequence
tggctgcagctttccactga

SEQ ID NO: 744886 - DNA, 20 bp, Artificial
  CRISPR gRNA sequence
ggctgcagctttccactgaa

SEQ ID NO: 744887 - DNA, 20 bp, Artificial
  CRISPR gRNA sequence
ctgcagctttccactgaaag

SEQ ID NO: 744888 - DNA, 20 bp, Artificial
  CRISPR gRNA sequence
agctttccactgaaaggagc

SEQ ID NO: 744889 - DNA, 20 bp, Artificial
  CRISPR gRNA sequence
tttccactgaaaggagccag

SEQ ID NO: 744890 - DNA, 20 bp, Artificial
  CRISPR gRNA sequence
cagaagcatttgaattgctc

SEQ ID NO: 744891 - DNA, 20 bp, Artificial
  CRISPR gRNA sequence
agaagcatttgaattgctct

SEQ ID NO: 744892 - DNA, 20 bp, Artificial
  CRISPR gRNA sequence
tttgaattgctctgggacct

SEQ ID NO: 744893 - DNA, 20 bp, Artificial
  CRISPR gRNA sequence
ttgaattgctctgggacctc

SEQ ID NO: 744894 - DNA, 20 bp, Artificial
  CRISPR gRNA sequence
caggattctgaactgtgaca

SEQ ID NO: 744895 - DNA, 20 bp, Artificial
  CRISPR gRNA sequence
gtgacatggacacactataa

SEQ ID NO: 744896 - DNA, 20 bp, Artificial
  CRISPR gRNA sequence
tagatattcacccaactccc

SEQ ID NO: 744897 - DNA, 20 bp, Artificial
  CRISPR gRNA sequence
agatattcacccaactccct

SEQ ID NO: 744898 - DNA, 20 bp, Artificial
  CRISPR gRNA sequence
attcacccaactccctagga

SEQ ID NO: 744899 - DNA, 20 bp, Artificial
  CRISPR gRNA sequence
tccctaggacagtgtgcact

SEQ ID NO: 744900 - DNA, 20 bp, Artificial
  CRISPR gRNA sequence
ccctaggacagtgtgcactg

SEQ ID NO: 744901 - DNA, 20 bp, Artificial
  CRISPR gRNA sequence
cctaggacagtgtgcactga

SEQ ID NO: 744902 - DNA, 20 bp, Artificial
  CRISPR gRNA sequence
taggacagtgtgcactgagg

SEQ ID NO: 744903 - DNA, 20 bp, Artificial
  CRISPR gRNA sequence
acagtgtgcactgagggaga

SEQ ID NO: 744904 - DNA, 20 bp, Artificial
  CRISPR gRNA sequence
gtgtgcactgagggagatag

SEQ ID NO: 744905 - DNA, 20 bp, Artificial
  CRISPR gRNA sequence
gcactgagggagatagcaga

SEQ ID NO: 744906 - DNA, 20 bp, Artificial
  CRISPR gRNA sequence
cactgagggagatagcagat

SEQ ID NO: 744907 - DNA, 20 bp, Artificial
  CRISPR gRNA sequence
ctgagggagatagcagatgg

SEQ ID NO: 744908 - DNA, 20 bp, Artificial
  CRISPR gRNA sequence
tgagggagatagcagatggg

SEQ ID NO: 744909 - DNA, 20 bp, Artificial
  CRISPR gRNA sequence
gagatagcagatgggaggcc

SEQ ID NO: 744910 - DNA, 20 bp, Artificial
  CRISPR gRNA sequence
gcagatgggaggcctggttg

SEQ ID NO: 744911 - DNA, 20 bp, Artificial
  CRISPR gRNA sequence
cagatgggaggcctggttgc

SEQ ID NO: 744912 - DNA, 20 bp, Artificial
  CRISPR gRNA sequence
gggaggcctggttgcaggca

SEQ ID NO: 744913 - DNA, 20 bp, Artificial
  CRISPR gRNA sequence
ggcctggttgcaggcatggt

SEQ ID NO: 744914 - DNA, 20 bp, Artificial
  CRISPR gRNA sequence
ctggttgcaggcatggtcag

SEQ ID NO: 744915 - DNA, 20 bp, Artificial
  CRISPR gRNA sequence
tggttgcaggcatggtcagc

SEQ ID NO: 744916 - DNA, 20 bp, Artificial
  CRISPR gRNA sequence
gcatggtcagcaggatctgt

SEQ ID NO: 744917 - DNA, 20 bp, Artificial
  CRISPR gRNA sequence
gtcagcaggatctgtaagtt

SEQ ID NO: 744918 - DNA, 20 bp, Artificial
  CRISPR gRNA sequence
agcaggatctgtaagttgag

SEQ ID NO: 744919 - DNA, 20 bp, Artificial
  CRISPR gRNA sequence
aagttgagaagattgatcac

SEQ ID NO: 744920 - DNA, 20 bp, Artificial
  CRISPR gRNA sequence
agattgatcaccagcctgcc

SEQ ID NO: 744921 - DNA, 20 bp, Artificial
  CRISPR gRNA sequence
gattgatcaccagcctgccg

SEQ ID NO: 744922 - DNA, 20 bp, Artificial
  CRISPR gRNA sequence
tcaccagcctgccgaggtgc

SEQ ID NO: 744923 - DNA, 20 bp, Artificial
  CRISPR gRNA sequence
caccagcctgccgaggtgct

SEQ ID NO: 744924 - DNA, 20 bp, Artificial
  CRISPR gRNA sequence
gccgaggtgctgggttgccc

SEQ ID NO: 744925 - DNA, 20 bp, Artificial
  CRISPR gRNA sequence
ccgaggtgctgggttgccct

SEQ ID NO: 744926 - DNA, 20 bp, Artificial
  CRISPR gRNA sequence
ttgccctgggtatgttgccc

SEQ ID NO: 744927 - DNA, 20 bp, Artificial
  CRISPR gRNA sequence
tgccctgggtatgttgccca

SEQ ID NO: 744928 - DNA, 20 bp, Artificial
  CRISPR gRNA sequence
gggtatgttgcccaaggtca

SEQ ID NO: 744929 - DNA, 20 bp, Artificial
  CRISPR gRNA sequence
caaggtcaaagcctttatgc

SEQ ID NO: 744930 - DNA, 20 bp, Artificial
  CRISPR gRNA sequence
aaggtcaaagcctttatgcc

SEQ ID NO: 744931 - DNA, 20 bp, Artificial
  CRISPR gRNA sequence
aggtcaaagcctttatgcca

SEQ ID NO: 744932 - DNA, 20 bp, Artificial
  CRISPR gRNA sequence
caaagcctttatgccaggga

SEQ ID NO: 744933 - DNA, 20 bp, Artificial
  CRISPR gRNA sequence
gcctttatgccagggaaagt

SEQ ID NO: 744934 - DNA, 20 bp, Artificial
  CRISPR gRNA sequence
ttatgccagggaaagtgaga

SEQ ID NO: 744935 - DNA, 20 bp, Artificial
  CRISPR gRNA sequence
atgccagggaaagtgagata

SEQ ID NO: 744936 - DNA, 20 bp, Artificial
  CRISPR gRNA sequence
ccagggaaagtgagatagag

SEQ ID NO: 744937 - DNA, 20 bp, Artificial
  CRISPR gRNA sequence
ggaaagtgagatagagtggc

SEQ ID NO: 744938 - DNA, 20 bp, Artificial
  CRISPR gRNA sequence
gaaagtgagatagagtggcc

SEQ ID NO: 744939 - DNA, 20 bp, Artificial
  CRISPR gRNA sequence
aaagtgagatagagtggccg

SEQ ID NO: 744940 - DNA, 20 bp, Artificial
  CRISPR gRNA sequence
tgagatagagtggccggggc

SEQ ID NO: 744941 - DNA, 20 bp, Artificial
  CRISPR gRNA sequence
gccggggccagcctgttctc

SEQ ID NO: 744942 - DNA, 20 bp, Artificial
  CRISPR gRNA sequence
ccagcctgttctccagctct

SEQ ID NO: 744943 - DNA, 20 bp, Artificial
  CRISPR gRNA sequence
cagcctgttctccagctctt

SEQ ID NO: 744944 - DNA, 20 bp, Artificial
  CRISPR gRNA sequence
agcctgttctccagctcttg

SEQ ID NO: 744945 - DNA, 20 bp, Artificial
  CRISPR gRNA sequence
tgttctccagctcttggggt

SEQ ID NO: 744946 - DNA, 20 bp, Artificial
  CRISPR gRNA sequence
gttctccagctcttggggtt

SEQ ID NO: 744947 - DNA, 20 bp, Artificial
  CRISPR gRNA sequence
tccagctcttggggttgggc

SEQ ID NO: 744948 - DNA, 20 bp, Artificial
  CRISPR gRNA sequence
cttggggttgggccagcact

SEQ ID NO: 744949 - DNA, 20 bp, Artificial
  CRISPR gRNA sequence
ttggggttgggccagcactg

SEQ ID NO: 744950 - DNA, 20 bp, Artificial
  CRISPR gRNA sequence
ggggttgggccagcactgag

SEQ ID NO: 744951 - DNA, 20 bp, Artificial
  CRISPR gRNA sequence
tgggccagcactgaggagaa

SEQ ID NO: 744952 - DNA, 20 bp, Artificial
  CRISPR gRNA sequence
gccagcactgaggagaatgg

SEQ ID NO: 744953 - DNA, 20 bp, Artificial
  CRISPR gRNA sequence
gagaatggtagtgatgaatg

SEQ ID NO: 744954 - DNA, 20 bp, Artificial
  CRISPR gRNA sequence
gtagtgatgaatgtggtgtt

SEQ ID NO: 744955 - DNA, 20 bp, Artificial
  CRISPR gRNA sequence
gtgatgaatgtggtgttcag

SEQ ID NO: 744956 - DNA, 20 bp, Artificial
  CRISPR gRNA sequence
gaatgtggtgttcagaagcc

SEQ ID NO: 744957 - DNA, 20 bp, Artificial
  CRISPR gRNA sequence
aatgtggtgttcagaagccc

SEQ ID NO: 744958 - DNA, 20 bp, Artificial
  CRISPR gRNA sequence
cagaagcccaggaaacacca

SEQ ID NO: 744959 - DNA, 20 bp, Artificial
  CRISPR gRNA sequence
caccaaagatacccctttcc

SEQ ID NO: 744960 - DNA, 20 bp, Artificial
  CRISPR gRNA sequence
accaaagatacccctttcct

SEQ ID NO: 744961 - DNA, 20 bp, Artificial
  CRISPR gRNA sequence
cccctttcctgggcctgact

SEQ ID NO: 744962 - DNA, 20 bp, Artificial
  CRISPR gRNA sequence
ccctttcctgggcctgactc

SEQ ID NO: 744963 - DNA, 20 bp, Artificial
  CRISPR gRNA sequence
cctttcctgggcctgactca

SEQ ID NO: 744964 - DNA, 20 bp, Artificial
  CRISPR gRNA sequence
tcctgggcctgactcagggt

SEQ ID NO: 744965 - DNA, 20 bp, Artificial
  CRISPR gRNA sequence
gggcctgactcagggtgaga

SEQ ID NO: 744966 - DNA, 20 bp, Artificial
  CRISPR gRNA sequence
ggcctgactcagggtgagat

SEQ ID NO: 744967 - DNA, 20 bp, Artificial
  CRISPR gRNA sequence
ctgactcagggtgagatggg

SEQ ID NO: 744968 - DNA, 20 bp, Artificial
  CRISPR gRNA sequence
gactcagggtgagatgggtg

SEQ ID NO: 744969 - DNA, 20 bp, Artificial
  CRISPR gRNA sequence
ctcagggtgagatgggtgga

SEQ ID NO: 744970 - DNA, 20 bp, Artificial
  CRISPR gRNA sequence
tcagggtgagatgggtggag

SEQ ID NO: 744971 - DNA, 20 bp, Artificial
  CRISPR gRNA sequence
gatgggtggagaggtacact

SEQ ID NO: 744972 - DNA, 20 bp, Artificial
  CRISPR gRNA sequence
atgggtggagaggtacactt

SEQ ID NO: 744973 - DNA, 20 bp, Artificial
  CRISPR gRNA sequence
tgggtggagaggtacactta

SEQ ID NO: 744974 - DNA, 20 bp, Artificial
  CRISPR gRNA sequence
ggagaggtacacttagggac

SEQ ID NO: 744975 - DNA, 20 bp, Artificial
  CRISPR gRNA sequence
gagaggtacacttagggacc

SEQ ID NO: 744976 - DNA, 20 bp, Artificial
  CRISPR gRNA sequence
tacacttagggaccaggacc

SEQ ID NO: 744977 - DNA, 20 bp, Artificial
  CRISPR gRNA sequence
acttagggaccaggacccag

SEQ ID NO: 744978 - DNA, 20 bp, Artificial
  CRISPR gRNA sequence
accaggacccagcagatctc

SEQ ID NO: 744979 - DNA, 20 bp, Artificial
  CRISPR gRNA sequence
ccaggacccagcagatctca

SEQ ID NO: 744980 - DNA, 20 bp, Artificial
  CRISPR gRNA sequence
caggacccagcagatctcaa

SEQ ID NO: 744981 - DNA, 20 bp, Artificial
  CRISPR gRNA sequence
gacccagcagatctcaaggg

SEQ ID NO: 744982 - DNA, 20 bp, Artificial
  CRISPR gRNA sequence
ccagcagatctcaagggtag

SEQ ID NO: 744983 - DNA, 20 bp, Artificial
  CRISPR gRNA sequence
agcagatctcaagggtagca

SEQ ID NO: 744984 - DNA, 20 bp, Artificial
  CRISPR gRNA sequence
gcagagcctcttcttcccca

SEQ ID NO: 744985 - DNA, 20 bp, Artificial
  CRISPR gRNA sequence
ttcttccccacagacattcc

SEQ ID NO: 744986 - DNA, 20 bp, Artificial
  CRISPR gRNA sequence
tcttccccacagacattccc

SEQ ID NO: 744987 - DNA, 20 bp, Artificial
  CRISPR gRNA sequence
cacagacattcccaggaccc

SEQ ID NO: 744988 - DNA, 20 bp, Artificial
  CRISPR gRNA sequence
acagacattcccaggacccg

SEQ ID NO: 744989 - DNA, 20 bp, Artificial
  CRISPR gRNA sequence
gacattcccaggacccgagg

SEQ ID NO: 744990 - DNA, 20 bp, Artificial
  CRISPR gRNA sequence
ctgtccttgccctgtcctca

SEQ ID NO: 744991 - DNA, 20 bp, Artificial
  CRISPR gRNA sequence
tgtccttgccctgtcctcac

SEQ ID NO: 744992 - DNA, 20 bp, Artificial
  CRISPR gRNA sequence
cctgtcctcacaggctgact

SEQ ID NO: 744993 - DNA, 20 bp, Artificial
  CRISPR gRNA sequence
ctgtcctcacaggctgactc

SEQ ID NO: 744994 - DNA, 20 bp, Artificial
  CRISPR gRNA sequence
gactcaggactcccaacctc

SEQ ID NO: 744995 - DNA, 20 bp, Artificial
  CRISPR gRNA sequence
actcaggactcccaacctct

SEQ ID NO: 744996 - DNA, 20 bp, Artificial
  CRISPR gRNA sequence
ggactcccaacctctgggac

SEQ ID NO: 744997 - DNA, 20 bp, Artificial
  CRISPR gRNA sequence
cctctgggactagcacattt

SEQ ID NO: 744998 - DNA, 20 bp, Artificial
  CRISPR gRNA sequence
actagcacatttaagtgcac

SEQ ID NO: 744999 - DNA, 20 bp, Artificial
  CRISPR gRNA sequence
ctagcacatttaagtgcact

SEQ ID NO: 745000 - DNA, 20 bp, Artificial
  CRISPR gRNA sequence
tagcacatttaagtgcactg

SEQ ID NO: 745001 - DNA, 20 bp, Artificial
  CRISPR gRNA sequence
acatttaagtgcactggggc

SEQ ID NO: 745002 - DNA, 20 bp, Artificial
  CRISPR gRNA sequence
catttaagtgcactggggct

SEQ ID NO: 745003 - DNA, 20 bp, Artificial
  CRISPR gRNA sequence
atttaagtgcactggggcta

SEQ ID NO: 745004 - DNA, 20 bp, Artificial
  CRISPR gRNA sequence
agtgcactggggctagggac

SEQ ID NO: 745005 - DNA, 20 bp, Artificial
  CRISPR gRNA sequence
tgcactggggctagggacga

SEQ ID NO: 745006 - DNA, 20 bp, Artificial
  CRISPR gRNA sequence
agaccccatcttctccttca

SEQ ID NO: 745007 - DNA, 20 bp, Artificial
  CRISPR gRNA sequence
tcttctccttcatagcaaac

SEQ ID NO: 745008 - DNA, 20 bp, Artificial
  CRISPR gRNA sequence
cttctccttcatagcaaacc

SEQ ID NO: 745009 - DNA, 20 bp, Artificial
  CRISPR gRNA sequence
cttcatagcaaaccaggctg

SEQ ID NO: 745010 - DNA, 20 bp, Artificial
  CRISPR gRNA sequence
ttcatagcaaaccaggctgc

SEQ ID NO: 745011 - DNA, 20 bp, Artificial
  CRISPR gRNA sequence
tcatagcaaaccaggctgca

SEQ ID NO: 745012 - DNA, 20 bp, Artificial
  CRISPR gRNA sequence
ccaggctgcagggccttgtt

SEQ ID NO: 745013 - DNA, 20 bp, Artificial
  CRISPR gRNA sequence
cagggccttgttgagtaacc

SEQ ID NO: 745014 - DNA, 20 bp, Artificial
  CRISPR gRNA sequence
gttgagtaacccagtgctgc

SEQ ID NO: 745015 - DNA, 20 bp, Artificial
  CRISPR gRNA sequence
agtgctgcaagcctctgacg

SEQ ID NO: 745016 - DNA, 20 bp, Artificial
  CRISPR gRNA sequence
gcaagcctctgacgcagcaa

SEQ ID NO: 745017 - DNA, 20 bp, Artificial
  CRISPR gRNA sequence
gcctctgacgcagcaatggt

SEQ ID NO: 745018 - DNA, 20 bp, Artificial
  CRISPR gRNA sequence
acgcagcaatggtcagctct

SEQ ID NO: 745019 - DNA, 20 bp, Artificial
  CRISPR gRNA sequence
cgcagcaatggtcagctctt

SEQ ID NO: 745020 - DNA, 20 bp, Artificial
  CRISPR gRNA sequence
gaaatccacaacccactgcc

SEQ ID NO: 745021 - DNA, 20 bp, Artificial
  CRISPR gRNA sequence
aatccacaacccactgccca

SEQ ID NO: 745022 - DNA, 20 bp, Artificial
  CRISPR gRNA sequence
atccacaacccactgcccag

SEQ ID NO: 745023 - DNA, 20 bp, Artificial
  CRISPR gRNA sequence
aacccactgcccagaggctc

SEQ ID NO: 745024 - DNA, 20 bp, Artificial
  CRISPR gRNA sequence
cccactgcccagaggctctg

SEQ ID NO: 745025 - DNA, 20 bp, Artificial
  CRISPR gRNA sequence
actgcccagaggctctggag

SEQ ID NO: 745026 - DNA, 20 bp, Artificial
  CRISPR gRNA sequence
tgcccagaggctctggagta

SEQ ID NO: 745027 - DNA, 20 bp, Artificial
  CRISPR gRNA sequence
cccagaggctctggagtaga

SEQ ID NO: 745028 - DNA, 20 bp, Artificial
  CRISPR gRNA sequence
ccagaggctctggagtagag

SEQ ID NO: 745029 - DNA, 20 bp, Artificial
  CRISPR gRNA sequence
ggctctggagtagagaggaa

SEQ ID NO: 745030 - DNA, 20 bp, Artificial
  CRISPR gRNA sequence
gagtagagaggaacagcctt

SEQ ID NO: 745031 - DNA, 20 bp, Artificial
  CRISPR gRNA sequence
agtagagaggaacagccttg

SEQ ID NO: 745032 - DNA, 20 bp, Artificial
  CRISPR gRNA sequence
gagaggaacagccttgaggc

SEQ ID NO: 745033 - DNA, 20 bp, Artificial
  CRISPR gRNA sequence
acagccttgaggccagtccc

SEQ ID NO: 745034 - DNA, 20 bp, Artificial
  CRISPR gRNA sequence
ttgaggccagtccctggcat

SEQ ID NO: 745035 - DNA, 20 bp, Artificial
  CRISPR gRNA sequence
tgaggccagtccctggcatg

SEQ ID NO: 745036 - DNA, 20 bp, Artificial
  CRISPR gRNA sequence
gaggccagtccctggcatga

SEQ ID NO: 745037 - DNA, 20 bp, Artificial
  CRISPR gRNA sequence
aggccagtccctggcatgag

SEQ ID NO: 745038 - DNA, 20 bp, Artificial
  CRISPR gRNA sequence
aggggtcatctacccaatgc

SEQ ID NO: 745039 - DNA, 20 bp, Artificial
  CRISPR gRNA sequence
ggggtcatctacccaatgcc

SEQ ID NO: 745040 - DNA, 20 bp, Artificial
  CRISPR gRNA sequence
gggtcatctacccaatgcca

SEQ ID NO: 745041 - DNA, 20 bp, Artificial
  CRISPR gRNA sequence
acccaatgccagggacaccc

SEQ ID NO: 745042 - DNA, 20 bp, Artificial
  CRISPR gRNA sequence
cccaatgccagggacaccca

SEQ ID NO: 745043 - DNA, 20 bp, Artificial
  CRISPR gRNA sequence
ccaatgccagggacacccaa

SEQ ID NO: 745044 - DNA, 20 bp, Artificial
  CRISPR gRNA sequence
tgccagggacacccaagggc

SEQ ID NO: 745045 - DNA, 20 bp, Artificial
  CRISPR gRNA sequence
cacccaagggccagcaatac

SEQ ID NO: 745046 - DNA, 20 bp, Artificial
  CRISPR gRNA sequence
acccaagggccagcaatact

SEQ ID NO: 745047 - DNA, 20 bp, Artificial
  CRISPR gRNA sequence
ccaagggccagcaatactgg

SEQ ID NO: 745048 - DNA, 20 bp, Artificial
  CRISPR gRNA sequence
aatactgggagtcccttgct

SEQ ID NO: 745049 - DNA, 20 bp, Artificial
  CRISPR gRNA sequence
agtcccttgctgagctgtac

SEQ ID NO: 745050 - DNA, 20 bp, Artificial
  CRISPR gRNA sequence
agttgttcatgcttccaccc

SEQ ID NO: 745051 - DNA, 20 bp, Artificial
  CRISPR gRNA sequence
tgttcatgcttccacccaag

SEQ ID NO: 745052 - DNA, 20 bp, Artificial
  CRISPR gRNA sequence
gttcatgcttccacccaagc

SEQ ID NO: 745053 - DNA, 20 bp, Artificial
  CRISPR gRNA sequence
ttcatgcttccacccaagca

SEQ ID NO: 745054 - DNA, 20 bp, Artificial
  CRISPR gRNA sequence
gcttccacccaagcagggca

SEQ ID NO: 745055 - DNA, 20 bp, Artificial
  CRISPR gRNA sequence
cttccacccaagcagggcaa

SEQ ID NO: 745056 - DNA, 20 bp, Artificial
  CRISPR gRNA sequence
aagcagggcaaaggttccgc

SEQ ID NO: 745057 - DNA, 20 bp, Artificial
  CRISPR gRNA sequence
agcagggcaaaggttccgct

SEQ ID NO: 745058 - DNA, 20 bp, Artificial
  CRISPR gRNA sequence
gcagggcaaaggttccgctg

SEQ ID NO: 745059 - DNA, 20 bp, Artificial
  CRISPR gRNA sequence
ccgctggggtctgaccttcc

SEQ ID NO: 745060 - DNA, 20 bp, Artificial
  CRISPR gRNA sequence
cgctggggtctgaccttcct

SEQ ID NO: 745061 - DNA, 20 bp, Artificial
  CRISPR gRNA sequence
ctggggtctgaccttcctgg

SEQ ID NO: 745062 - DNA, 20 bp, Artificial
  CRISPR gRNA sequence
ggggtctgaccttcctggga

SEQ ID NO: 745063 - DNA, 20 bp, Artificial
  CRISPR gRNA sequence
gggtctgaccttcctgggag

SEQ ID NO: 745064 - DNA, 20 bp, Artificial
  CRISPR gRNA sequence
ggtctgaccttcctgggaga

SEQ ID NO: 745065 - DNA, 20 bp, Artificial
  CRISPR gRNA sequence
ctgaccttcctgggagaggg

SEQ ID NO: 745066 - DNA, 20 bp, Artificial
  CRISPR gRNA sequence
cttcctgggagagggtggtc

SEQ ID NO: 745067 - DNA, 20 bp, Artificial
  CRISPR gRNA sequence
ttcctgggagagggtggtcc

SEQ ID NO: 745068 - DNA, 20 bp, Artificial
  CRISPR gRNA sequence
ctgggagagggtggtccagg

SEQ ID NO: 745069 - DNA, 20 bp, Artificial
  CRISPR gRNA sequence
tgggagagggtggtccaggc

SEQ ID NO: 745070 - DNA, 20 bp, Artificial
  CRISPR gRNA sequence
ggagagggtggtccaggcag

SEQ ID NO: 745071 - DNA, 20 bp, Artificial
  CRISPR gRNA sequence
ccaggcaggagtgtgctgct

SEQ ID NO: 745072 - DNA, 20 bp, Artificial
  CRISPR gRNA sequence
agtgtgctgctgagacgcta

SEQ ID NO: 745073 - DNA, 20 bp, Artificial
  CRISPR gRNA sequence
gtgtgctgctgagacgctaa

SEQ ID NO: 745074 - DNA, 20 bp, Artificial
  CRISPR gRNA sequence
tgtgctgctgagacgctaaa

SEQ ID NO: 745075 - DNA, 20 bp, Artificial
  CRISPR gRNA sequence
gtgctgctgagacgctaaag

SEQ ID NO: 745076 - DNA, 20 bp, Artificial
  CRISPR gRNA sequence
gtcacctccctatccgcaca

SEQ ID NO: 745077 - DNA, 20 bp, Artificial
  CRISPR gRNA sequence
ccctatccgcacacagtgta

SEQ ID NO: 745078 - DNA, 20 bp, Artificial
  CRISPR gRNA sequence
cctatccgcacacagtgtat

SEQ ID NO: 745079 - DNA, 20 bp, Artificial
  CRISPR gRNA sequence
ctatccgcacacagtgtatg

SEQ ID NO: 745080 - DNA, 20 bp, Artificial
  CRISPR gRNA sequence
gcacacagtgtatggggtgt

SEQ ID NO: 745081 - DNA, 20 bp, Artificial
  CRISPR gRNA sequence
cacacagtgtatggggtgtt

SEQ ID NO: 745082 - DNA, 20 bp, Artificial
  CRISPR gRNA sequence
gtgtatggggtgttaggcct

SEQ ID NO: 745083 - DNA, 20 bp, Artificial
  CRISPR gRNA sequence
tatggggtgttaggcctgag

SEQ ID NO: 745084 - DNA, 20 bp, Artificial
  CRISPR gRNA sequence
tgttaggcctgagcagatga

SEQ ID NO: 745085 - DNA, 20 bp, Artificial
  CRISPR gRNA sequence
gttaggcctgagcagatgaa

SEQ ID NO: 745086 - DNA, 20 bp, Artificial
  CRISPR gRNA sequence
aggcctgagcagatgaaagg

SEQ ID NO: 745087 - DNA, 20 bp, Artificial
  CRISPR gRNA sequence
ctgagcagatgaaaggaaga

SEQ ID NO: 745088 - DNA, 20 bp, Artificial
  CRISPR gRNA sequence
tgagcagatgaaaggaagaa

SEQ ID NO: 745089 - DNA, 20 bp, Artificial
  CRISPR gRNA sequence
gagcagatgaaaggaagaaa

SEQ ID NO: 745090 - DNA, 20 bp, Artificial
  CRISPR gRNA sequence
aaaggaagaaagggatcctc

SEQ ID NO: 745091 - DNA, 20 bp, Artificial
  CRISPR gRNA sequence
aaggaagaaagggatcctca

SEQ ID NO: 745092 - DNA, 20 bp, Artificial
  CRISPR gRNA sequence
ggaagaaagggatcctcaag

SEQ ID NO: 745093 - DNA, 20 bp, Artificial
  CRISPR gRNA sequence
gatcctcaaggagaacccgt

SEQ ID NO: 745094 - DNA, 20 bp, Artificial
  CRISPR gRNA sequence
cctcaaggagaacccgttgg

SEQ ID NO: 745095 - DNA, 20 bp, Artificial
  CRISPR gRNA sequence
aaggagaacccgttggcagt

SEQ ID NO: 745096 - DNA, 20 bp, Artificial
  CRISPR gRNA sequence
agaacccgttggcagtgagc

SEQ ID NO: 745097 - DNA, 20 bp, Artificial
  CRISPR gRNA sequence
gagccccacataccaaactt

SEQ ID NO: 745098 - DNA, 20 bp, Artificial
  CRISPR gRNA sequence
agccccacataccaaacttg

SEQ ID NO: 745099 - DNA, 20 bp, Artificial
  CRISPR gRNA sequence
acataccaaacttgaggccc

SEQ ID NO: 745100 - DNA, 20 bp, Artificial
  CRISPR gRNA sequence
cataccaaacttgaggcccc

SEQ ID NO: 745101 - DNA, 20 bp, Artificial
  CRISPR gRNA sequence
aaacttgaggccccaggctt

SEQ ID NO: 745102 - DNA, 20 bp, Artificial
  CRISPR gRNA sequence
gctttagccaaccaatgacc

SEQ ID NO: 745103 - DNA, 20 bp, Artificial
  CRISPR gRNA sequence
ctttagccaaccaatgaccc

SEQ ID NO: 745104 - DNA, 20 bp, Artificial
  CRISPR gRNA sequence
tttagccaaccaatgaccca

SEQ ID NO: 745105 - DNA, 20 bp, Artificial
  CRISPR gRNA sequence
gccaaccaatgacccagggt

SEQ ID NO: 745106 - DNA, 20 bp, Artificial
  CRISPR gRNA sequence
ccaatgacccagggtcagtc

SEQ ID NO: 745107 - DNA, 20 bp, Artificial
  CRISPR gRNA sequence
ccagggtcagtctggtctcc

SEQ ID NO: 745108 - DNA, 20 bp, Artificial
  CRISPR gRNA sequence
cagggtcagtctggtctccc

SEQ ID NO: 745109 - DNA, 20 bp, Artificial
  CRISPR gRNA sequence
agggtcagtctggtctccca

SEQ ID NO: 745110 - DNA, 20 bp, Artificial
  CRISPR gRNA sequence
gggtcagtctggtctcccag

SEQ ID NO: 745111 - DNA, 20 bp, Artificial
  CRISPR gRNA sequence
gtcagtctggtctcccaggg

SEQ ID NO: 745112 - DNA, 20 bp, Artificial
  CRISPR gRNA sequence
tcagtctggtctcccagggg

SEQ ID NO: 745113 - DNA, 20 bp, Artificial
  CRISPR gRNA sequence
cagtctggtctcccagggga

SEQ ID NO: 745114 - DNA, 20 bp, Artificial
  CRISPR gRNA sequence
tctggtctcccaggggaggg

SEQ ID NO: 745115 - DNA, 20 bp, Artificial
  CRISPR gRNA sequence
ctggtctcccaggggagggt

SEQ ID NO: 745116 - DNA, 20 bp, Artificial
  CRISPR gRNA sequence
tctcccaggggagggtgggc

SEQ ID NO: 745117 - DNA, 20 bp, Artificial
  CRISPR gRNA sequence
ctcccaggggagggtgggcc

SEQ ID NO: 745118 - DNA, 20 bp, Artificial
  CRISPR gRNA sequence
tcccaggggagggtgggcca

SEQ ID NO: 745119 - DNA, 20 bp, Artificial
  CRISPR gRNA sequence
ggggagggtgggccagggat

SEQ ID NO: 745120 - DNA, 20 bp, Artificial
  CRISPR gRNA sequence
tgggccagggatcagcactg

SEQ ID NO: 745121 - DNA, 20 bp, Artificial
  CRISPR gRNA sequence
gggatcagcactgtggcttc

SEQ ID NO: 745122 - DNA, 20 bp, Artificial
  CRISPR gRNA sequence
atcagcactgtggcttccag

SEQ ID NO: 745123 - DNA, 20 bp, Artificial
  CRISPR gRNA sequence
tgtggcttccagtggcccca

SEQ ID NO: 745124 - DNA, 20 bp, Artificial
  CRISPR gRNA sequence
agtggccccacagatgccct

SEQ ID NO: 745125 - DNA, 20 bp, Artificial
  CRISPR gRNA sequence
cccacagatgcccttagctg

SEQ ID NO: 745126 - DNA, 20 bp, Artificial
  CRISPR gRNA sequence
gatgcccttagctgcagtcc

SEQ ID NO: 745127 - DNA, 20 bp, Artificial
  CRISPR gRNA sequence
agtcccagcatgcctgtata

SEQ ID NO: 745128 - DNA, 20 bp, Artificial
  CRISPR gRNA sequence
cagcatgcctgtatatggca

SEQ ID NO: 745129 - DNA, 20 bp, Artificial
  CRISPR gRNA sequence
atgcctgtatatggcaaagc

SEQ ID NO: 745130 - DNA, 20 bp, Artificial
  CRISPR gRNA sequence
tgcctgtatatggcaaagcc

SEQ ID NO: 745131 - DNA, 20 bp, Artificial
  CRISPR gRNA sequence
gcctgtatatggcaaagcca

SEQ ID NO: 745132 - DNA, 20 bp, Artificial
  CRISPR gRNA sequence
aaagccagggacatgcatgc

SEQ ID NO: 745133 - DNA, 20 bp, Artificial
  CRISPR gRNA sequence
aagccagggacatgcatgcc

SEQ ID NO: 745134 - DNA, 20 bp, Artificial
  CRISPR gRNA sequence
agccagggacatgcatgcca

SEQ ID NO: 745135 - DNA, 20 bp, Artificial
  CRISPR gRNA sequence
tgcatgccagggcttccgta

SEQ ID NO: 745136 - DNA, 20 bp, Artificial
  CRISPR gRNA sequence
acagccccttgcttaactct

SEQ ID NO: 745137 - DNA, 20 bp, Artificial
  CRISPR gRNA sequence
cagccccttgcttaactctt

SEQ ID NO: 745138 - DNA, 20 bp, Artificial
  CRISPR gRNA sequence
gcttaactcttgggctttgt

SEQ ID NO: 745139 - DNA, 20 bp, Artificial
  CRISPR gRNA sequence
cttgggctttgtgagtcact

SEQ ID NO: 745140 - DNA, 20 bp, Artificial
  CRISPR gRNA sequence
ctttgtgagtcactcagacc

SEQ ID NO: 745141 - DNA, 20 bp, Artificial
  CRISPR gRNA sequence
tttgtgagtcactcagacct

SEQ ID NO: 745142 - DNA, 20 bp, Artificial
  CRISPR gRNA sequence
cagacctaggcttaaatccc

SEQ ID NO: 745143 - DNA, 20 bp, Artificial
  CRISPR gRNA sequence
cctaggcttaaatcccaaga

SEQ ID NO: 745144 - DNA, 20 bp, Artificial
  CRISPR gRNA sequence
catttactgctctgtgatat

SEQ ID NO: 745145 - DNA, 20 bp, Artificial
  CRISPR gRNA sequence
actgctctgtgatattggac

SEQ ID NO: 745146 - DNA, 20 bp, Artificial
  CRISPR gRNA sequence
gtgatattggacaagttatt

SEQ ID NO: 745147 - DNA, 20 bp, Artificial
  CRISPR gRNA sequence
acaagttattcagtctccct

SEQ ID NO: 745148 - DNA, 20 bp, Artificial
  CRISPR gRNA sequence
gttattcagtctccctgagc

SEQ ID NO: 745149 - DNA, 20 bp, Artificial
  CRISPR gRNA sequence
agcaagttcccctccctcta

SEQ ID NO: 745150 - DNA, 20 bp, Artificial
  CRISPR gRNA sequence
aagttcccctccctctaaag

SEQ ID NO: 745151 - DNA, 20 bp, Artificial
  CRISPR gRNA sequence
agttcccctccctctaaagt

SEQ ID NO: 745152 - DNA, 20 bp, Artificial
  CRISPR gRNA sequence
tcccctccctctaaagtggg

SEQ ID NO: 745153 - DNA, 20 bp, Artificial
  CRISPR gRNA sequence
gaagatgataccacctccct

SEQ ID NO: 745154 - DNA, 20 bp, Artificial
  CRISPR gRNA sequence
agatgataccacctcccttg

SEQ ID NO: 745155 - DNA, 20 bp, Artificial
  CRISPR gRNA sequence
gatgataccacctcccttgg

SEQ ID NO: 745156 - DNA, 20 bp, Artificial
  CRISPR gRNA sequence
atgataccacctcccttgga

SEQ ID NO: 745157 - DNA, 20 bp, Artificial
  CRISPR gRNA sequence
tcccttggagggcaactgtg

SEQ ID NO: 745158 - DNA, 20 bp, Artificial
  CRISPR gRNA sequence
ccttggagggcaactgtgaa

SEQ ID NO: 745159 - DNA, 20 bp, Artificial
  CRISPR gRNA sequence
caatgaacgaacacttaaca

SEQ ID NO: 745160 - DNA, 20 bp, Artificial
  CRISPR gRNA sequence
cgaacacttaacacagcacc

SEQ ID NO: 745161 - DNA, 20 bp, Artificial
  CRISPR gRNA sequence
gtgaatactgtgtaatatta

SEQ ID NO: 745162 - DNA, 20 bp, Artificial
  CRISPR gRNA sequence
tgtaatattatggtatttct

SEQ ID NO: 745163 - DNA, 20 bp, Artificial
  CRISPR gRNA sequence
atggtatttcttggcttctg

SEQ ID NO: 745164 - DNA, 20 bp, Artificial
  CRISPR gRNA sequence
tggtatttcttggcttctgc

SEQ ID NO: 745165 - DNA, 20 bp, Artificial
  CRISPR gRNA sequence
ttctgcaggccacatgccat

SEQ ID NO: 745166 - DNA, 20 bp, Artificial
  CRISPR gRNA sequence
atgccattggctttctatct

SEQ ID NO: 745167 - DNA, 20 bp, Artificial
  CRISPR gRNA sequence
tctaagctgcttgctctcta

SEQ ID NO: 745168 - DNA, 20 bp, Artificial
  CRISPR gRNA sequence
ctaagctgcttgctctctac

SEQ ID NO: 745169 - DNA, 20 bp, Artificial
  CRISPR gRNA sequence
taagctgcttgctctctaca

SEQ ID NO: 745170 - DNA, 20 bp, Artificial
  CRISPR gRNA sequence
ttgctctctacagggcctaa

SEQ ID NO: 745171 - DNA, 20 bp, Artificial
  CRISPR gRNA sequence
gctctctacagggcctaatg

SEQ ID NO: 745172 - DNA, 20 bp, Artificial
  CRISPR gRNA sequence
acagggcctaatggagtgcc

SEQ ID NO: 745173 - DNA, 20 bp, Artificial
  CRISPR gRNA sequence
cagggcctaatggagtgccc

SEQ ID NO: 745174 - DNA, 20 bp, Artificial
  CRISPR gRNA sequence
agggcctaatggagtgccca

SEQ ID NO: 745175 - DNA, 20 bp, Artificial
  CRISPR gRNA sequence
ctaatggagtgcccagggcc

SEQ ID NO: 745176 - DNA, 20 bp, Artificial
  CRISPR gRNA sequence
taatggagtgcccagggcct

SEQ ID NO: 745177 - DNA, 20 bp, Artificial
  CRISPR gRNA sequence
tggagtgcccagggcctggg

SEQ ID NO: 745178 - DNA, 20 bp, Artificial
  CRISPR gRNA sequence
ggagtgcccagggcctggga

SEQ ID NO: 745179 - DNA, 20 bp, Artificial
  CRISPR gRNA sequence
cccagggcctgggaaggcat

SEQ ID NO: 745180 - DNA, 20 bp, Artificial
  CRISPR gRNA sequence
gggcctgggaaggcattggt

SEQ ID NO: 745181 - DNA, 20 bp, Artificial
  CRISPR gRNA sequence
aaggcattggtgagcttcac

SEQ ID NO: 745182 - DNA, 20 bp, Artificial
  CRISPR gRNA sequence
aggcattggtgagcttcact

SEQ ID NO: 745183 - DNA, 20 bp, Artificial
  CRISPR gRNA sequence
ttggtgagcttcactgggac

SEQ ID NO: 745184 - DNA, 20 bp, Artificial
  CRISPR gRNA sequence
cactgggactagattctcca

SEQ ID NO: 745185 - DNA, 20 bp, Artificial
  CRISPR gRNA sequence
ggactagattctccaaagcc

SEQ ID NO: 745186 - DNA, 20 bp, Artificial
  CRISPR gRNA sequence
actagattctccaaagcctg

SEQ ID NO: 745187 - DNA, 20 bp, Artificial
  CRISPR gRNA sequence
tctccaaagcctggagtatg

SEQ ID NO: 745188 - DNA, 20 bp, Artificial
  CRISPR gRNA sequence
ctccaaagcctggagtatga

SEQ ID NO: 745189 - DNA, 20 bp, Artificial
  CRISPR gRNA sequence
tccaaagcctggagtatgaa

SEQ ID NO: 745190 - DNA, 20 bp, Artificial
  CRISPR gRNA sequence
cctggagtatgaagggtgca

SEQ ID NO: 745191 - DNA, 20 bp, Artificial
  CRISPR gRNA sequence
ctggagtatgaagggtgcat

SEQ ID NO: 745192 - DNA, 20 bp, Artificial
  CRISPR gRNA sequence
aagggtgcatgggctgcgtc

SEQ ID NO: 745193 - DNA, 20 bp, Artificial
  CRISPR gRNA sequence
ggctgcgtccagctacctgt

SEQ ID NO: 745194 - DNA, 20 bp, Artificial
  CRISPR gRNA sequence
cagctacctgtgagcccctg

SEQ ID NO: 745195 - DNA, 20 bp, Artificial
  CRISPR gRNA sequence
agctacctgtgagcccctgt

SEQ ID NO: 745196 - DNA, 20 bp, Artificial
  CRISPR gRNA sequence
tgagcccctgtaggccctca

SEQ ID NO: 745197 - DNA, 20 bp, Artificial
  CRISPR gRNA sequence
ctcacagtctgaaatgccca

SEQ ID NO: 745198 - DNA, 20 bp, Artificial
  CRISPR gRNA sequence
cacagtctgaaatgcccatg

SEQ ID NO: 745199 - DNA, 20 bp, Artificial
  CRISPR gRNA sequence
acagtctgaaatgcccatgg

SEQ ID NO: 745200 - DNA, 20 bp, Artificial
  CRISPR gRNA sequence
aatgcccatggaggtgccta

SEQ ID NO: 745201 - DNA, 20 bp, Artificial
  CRISPR gRNA sequence
atgcccatggaggtgcctac

SEQ ID NO: 745202 - DNA, 20 bp, Artificial
  CRISPR gRNA sequence
gcctacaggttctcttctta

SEQ ID NO: 745203 - DNA, 20 bp, Artificial
  CRISPR gRNA sequence
ggttctcttcttaaagttgt

SEQ ID NO: 745204 - DNA, 20 bp, Artificial
  CRISPR gRNA sequence
gttctcttcttaaagttgtc

SEQ ID NO: 745205 - DNA, 20 bp, Artificial
  CRISPR gRNA sequence
tctcttcttaaagttgtcag

SEQ ID NO: 745206 - DNA, 20 bp, Artificial
  CRISPR gRNA sequence
ttcttaaagttgtcaggaga

SEQ ID NO: 745207 - DNA, 20 bp, Artificial
  CRISPR gRNA sequence
tcttaaagttgtcaggagat

SEQ ID NO: 745208 - DNA, 20 bp, Artificial
  CRISPR gRNA sequence
cttaaagttgtcaggagatg

SEQ ID NO: 745209 - DNA, 20 bp, Artificial
  CRISPR gRNA sequence
gatggggacattgcaacttg

SEQ ID NO: 745210 - DNA, 20 bp, Artificial
  CRISPR gRNA sequence
atggggacattgcaacttga

SEQ ID NO: 745211 - DNA, 20 bp, Artificial
  CRISPR gRNA sequence
ggacattgcaacttgaaggc

SEQ ID NO: 745212 - DNA, 20 bp, Artificial
  CRISPR gRNA sequence
ttgcaacttgaaggcaagcc

SEQ ID NO: 745213 - DNA, 20 bp, Artificial
  CRISPR gRNA sequence
cttgaaggcaagcctggccc

SEQ ID NO: 745214 - DNA, 20 bp, Artificial
  CRISPR gRNA sequence
ttgaaggcaagcctggccct

SEQ ID NO: 745215 - DNA, 20 bp, Artificial
  CRISPR gRNA sequence
ggccctgggtttgcttatct

SEQ ID NO: 745216 - DNA, 20 bp, Artificial
  CRISPR gRNA sequence
cctgggtttgcttatcttgg

SEQ ID NO: 745217 - DNA, 20 bp, Artificial
  CRISPR gRNA sequence
acatctgatctttttacatt

SEQ ID NO: 745218 - DNA, 20 bp, Artificial
  CRISPR gRNA sequence
tacattcggtccattcactt

SEQ ID NO: 745219 - DNA, 20 bp, Artificial
  CRISPR gRNA sequence
ttcggtccattcactttggc

SEQ ID NO: 745220 - DNA, 20 bp, Artificial
  CRISPR gRNA sequence
actttggctggccatcacca

SEQ ID NO: 745221 - DNA, 20 bp, Artificial
  CRISPR gRNA sequence
gctggccatcaccaaagaca

SEQ ID NO: 745222 - DNA, 20 bp, Artificial
  CRISPR gRNA sequence
gccatcaccaaagacaaaga

SEQ ID NO: 745223 - DNA, 20 bp, Artificial
  CRISPR gRNA sequence
atcaccaaagacaaagacag

SEQ ID NO: 745224 - DNA, 20 bp, Artificial
  CRISPR gRNA sequence
gtggccaccatctttctcat

SEQ ID NO: 745225 - DNA, 20 bp, Artificial
  CRISPR gRNA sequence
ctcatcagtaatccaataat

SEQ ID NO: 745226 - DNA, 20 bp, Artificial
  CRISPR gRNA sequence
tcatcagtaatccaataatg

SEQ ID NO: 745227 - DNA, 20 bp, Artificial
  CRISPR gRNA sequence
aggttgctctgctacttacc

SEQ ID NO: 745228 - DNA, 20 bp, Artificial
  CRISPR gRNA sequence
gctctgctacttaccaagcc

SEQ ID NO: 745229 - DNA, 20 bp, Artificial
  CRISPR gRNA sequence
tgctacttaccaagccaagc

SEQ ID NO: 745230 - DNA, 20 bp, Artificial
  CRISPR gRNA sequence
gccaagcaagcccattcctt

SEQ ID NO: 745231 - DNA, 20 bp, Artificial
  CRISPR gRNA sequence
attcctttagcctttctgcg

SEQ ID NO: 745232 - DNA, 20 bp, Artificial
  CRISPR gRNA sequence
ttcctttagcctttctgcgt

SEQ ID NO: 745233 - DNA, 20 bp, Artificial
  CRISPR gRNA sequence
gcgtaggatcttatttccca

SEQ ID NO: 745234 - DNA, 20 bp, Artificial
  CRISPR gRNA sequence
cgtaggatcttatttcccat

SEQ ID NO: 745235 - DNA, 20 bp, Artificial
  CRISPR gRNA sequence
gtaggatcttatttcccatg

SEQ ID NO: 745236 - DNA, 20 bp, Artificial
  CRISPR gRNA sequence
tcttatttcccatggggacc

SEQ ID NO: 745237 - DNA, 20 bp, Artificial
  CRISPR gRNA sequence
cttatttcccatggggacct

SEQ ID NO: 745238 - DNA, 20 bp, Artificial
  CRISPR gRNA sequence
ttatttcccatggggacctg

SEQ ID NO: 745239 - DNA, 20 bp, Artificial
  CRISPR gRNA sequence
cctctgctgttcactcatca

SEQ ID NO: 745240 - DNA, 20 bp, Artificial
  CRISPR gRNA sequence
ctctgctgttcactcatcat

SEQ ID NO: 745241 - DNA, 20 bp, Artificial
  CRISPR gRNA sequence
cttcccctttgtctgtgcaa

SEQ ID NO: 745242 - DNA, 20 bp, Artificial
  CRISPR gRNA sequence
ccctttgtctgtgcaatgga

SEQ ID NO: 745243 - DNA, 20 bp, Artificial
  CRISPR gRNA sequence
cctttgtctgtgcaatggac

SEQ ID NO: 745244 - DNA, 20 bp, Artificial
  CRISPR gRNA sequence
tgtctgtgcaatggacaggt

SEQ ID NO: 745245 - DNA, 20 bp, Artificial
  CRISPR gRNA sequence
gtctgtgcaatggacaggtt

SEQ ID NO: 745246 - DNA, 20 bp, Artificial
  CRISPR gRNA sequence
aatggacaggttgggtgacg

SEQ ID NO: 745247 - DNA, 20 bp, Artificial
  CRISPR gRNA sequence
caggttgggtgacgtggtct

SEQ ID NO: 745248 - DNA, 20 bp, Artificial
  CRISPR gRNA sequence
ttgggtgacgtggtctcagt

SEQ ID NO: 745249 - DNA, 20 bp, Artificial
  CRISPR gRNA sequence
tgggtgacgtggtctcagtg

SEQ ID NO: 745250 - DNA, 20 bp, Artificial
  CRISPR gRNA sequence
aggctgaccaccctcctctg

SEQ ID NO: 745251 - DNA, 20 bp, Artificial
  CRISPR gRNA sequence
ggctgaccaccctcctctga

SEQ ID NO: 745252 - DNA, 20 bp, Artificial
  CRISPR gRNA sequence
tctgaaggttaattccatga

SEQ ID NO: 745253 - DNA, 20 bp, Artificial
  CRISPR gRNA sequence
attccatgatggtgtttccc

SEQ ID NO: 745254 - DNA, 20 bp, Artificial
  CRISPR gRNA sequence
tgatggtgtttccctagctt

SEQ ID NO: 745255 - DNA, 20 bp, Artificial
  CRISPR gRNA sequence
tatcacctttgtgatctctg

SEQ ID NO: 745256 - DNA, 20 bp, Artificial
  CRISPR gRNA sequence
atctactcattcttttattt

SEQ ID NO: 745257 - DNA, 20 bp, Artificial
  CRISPR gRNA sequence
cattcttttatttgagtatg

SEQ ID NO: 745258 - DNA, 20 bp, Artificial
  CRISPR gRNA sequence
ttgagtatgtagatctttaa

SEQ ID NO: 745259 - DNA, 20 bp, Artificial
  CRISPR gRNA sequence
tgagtatgtagatctttaaa

SEQ ID NO: 745260 - DNA, 20 bp, Artificial
  CRISPR gRNA sequence
aaactttttatcgctgtcat

SEQ ID NO: 745261 - DNA, 20 bp, Artificial
  CRISPR gRNA sequence
ctttttatcgctgtcattag

SEQ ID NO: 745262 - DNA, 20 bp, Artificial
  CRISPR gRNA sequence
ttatcgctgtcattagtgga

SEQ ID NO: 745263 - DNA, 20 bp, Artificial
  CRISPR gRNA sequence
cgctgtcattagtggaaagc

SEQ ID NO: 745264 - DNA, 20 bp, Artificial
  CRISPR gRNA sequence
ccagtatcacttgtcataaa

SEQ ID NO: 745265 - DNA, 20 bp, Artificial
  CRISPR gRNA sequence
taaatagaacaaaaccataa

SEQ ID NO: 745266 - DNA, 20 bp, Artificial
  CRISPR gRNA sequence
aaaaccataaaagaacgtaa

SEQ ID NO: 745267 - DNA, 20 bp, Artificial
  CRISPR gRNA sequence
aaaccataaaagaacgtaac

SEQ ID NO: 745268 - DNA, 20 bp, Artificial
  CRISPR gRNA sequence
acgtaacaggaaaaccatat

SEQ ID NO: 745269 - DNA, 20 bp, Artificial
  CRISPR gRNA sequence
cgtaacaggaaaaccatata

SEQ ID NO: 745270 - DNA, 20 bp, Artificial
  CRISPR gRNA sequence
gtaacaggaaaaccatataa

SEQ ID NO: 745271 - DNA, 20 bp, Artificial
  CRISPR gRNA sequence
catataagggtattgaattc

SEQ ID NO: 745272 - DNA, 20 bp, Artificial
  CRISPR gRNA sequence
taagggtattgaattctagt

SEQ ID NO: 745273 - DNA, 20 bp, Artificial
  CRISPR gRNA sequence
tgaattctagttggaaactt

SEQ ID NO: 745274 - DNA, 20 bp, Artificial
  CRISPR gRNA sequence
tctagttggaaactttagcc

SEQ ID NO: 745275 - DNA, 20 bp, Artificial
  CRISPR gRNA sequence
ctagttggaaactttagcct

SEQ ID NO: 745276 - DNA, 20 bp, Artificial
  CRISPR gRNA sequence
gttggaaactttagcctggg

SEQ ID NO: 745277 - DNA, 20 bp, Artificial
  CRISPR gRNA sequence
ttggaaactttagcctggga

SEQ ID NO: 745278 - DNA, 20 bp, Artificial
  CRISPR gRNA sequence
aactttagcctgggaaggct

SEQ ID NO: 745279 - DNA, 20 bp, Artificial
  CRISPR gRNA sequence
ctttagcctgggaaggctcg

SEQ ID NO: 745280 - DNA, 20 bp, Artificial
  CRISPR gRNA sequence
aaaataaaataaaatttaaa

SEQ ID NO: 745281 - DNA, 20 bp, Artificial
  CRISPR gRNA sequence
aaaataaaatttaaaaagaa

SEQ ID NO: 745282 - DNA, 20 bp, Artificial
  CRISPR gRNA sequence
aaataaaatttaaaaagaaa

SEQ ID NO: 745283 - DNA, 20 bp, Artificial
  CRISPR gRNA sequence
ataaaatttaaaaagaaaag

SEQ ID NO: 745284 - DNA, 20 bp, Artificial
  CRISPR gRNA sequence
atttaaaaagaaaaggagat

SEQ ID NO: 745285 - DNA, 20 bp, Artificial
  CRISPR gRNA sequence
aaggagattagcaaatgttt

SEQ ID NO: 745286 - DNA, 20 bp, Artificial
  CRISPR gRNA sequence
ggagattagcaaatgtttta

SEQ ID NO: 745287 - DNA, 20 bp, Artificial
  CRISPR gRNA sequence
caaatgttttagagacatat

SEQ ID NO: 745288 - DNA, 20 bp, Artificial
  CRISPR gRNA sequence
agacatattagcatcaaact

SEQ ID NO: 745289 - DNA, 20 bp, Artificial
  CRISPR gRNA sequence
gactttctctttgatgtaat

SEQ ID NO: 745290 - DNA, 20 bp, Artificial
  CRISPR gRNA sequence
actttctctttgatgtaatc

SEQ ID NO: 745291 - DNA, 20 bp, Artificial
  CRISPR gRNA sequence
tcaggactgaaataattgta

SEQ ID NO: 745292 - DNA, 20 bp, Artificial
  CRISPR gRNA sequence
caggactgaaataattgtaa

SEQ ID NO: 745293 - DNA, 20 bp, Artificial
  CRISPR gRNA sequence
aggactgaaataattgtaaa

SEQ ID NO: 745294 - DNA, 20 bp, Artificial
  CRISPR gRNA sequence
gttatttaatgtaaaaccaa

SEQ ID NO: 745295 - DNA, 20 bp, Artificial
  CRISPR gRNA sequence
aaaccaaaagtaaaactatg

SEQ ID NO: 745296 - DNA, 20 bp, Artificial
  CRISPR gRNA sequence
ccaaaagtaaaactatgtgg

SEQ ID NO: 745297 - DNA, 20 bp, Artificial
  CRISPR gRNA sequence
gtaaaactatgtggtagacg

SEQ ID NO: 745298 - DNA, 20 bp, Artificial
  CRISPR gRNA sequence
aactatgtggtagacgtggc

SEQ ID NO: 745299 - DNA, 20 bp, Artificial
  CRISPR gRNA sequence
actatgtggtagacgtggcc

SEQ ID NO: 745300 - DNA, 20 bp, Artificial
  CRISPR gRNA sequence
tgtggtagacgtggccaggc

SEQ ID NO: 745301 - DNA, 20 bp, Artificial
  CRISPR gRNA sequence
gtagacgtggccaggcaagc

SEQ ID NO: 745302 - DNA, 20 bp, Artificial
  CRISPR gRNA sequence
tagacgtggccaggcaagct

SEQ ID NO: 745303 - DNA, 20 bp, Artificial
  CRISPR gRNA sequence
caggcaagctgggctttcat

SEQ ID NO: 745304 - DNA, 20 bp, Artificial
  CRISPR gRNA sequence
catgacatttgtccgtcttc

SEQ ID NO: 745305 - DNA, 20 bp, Artificial
  CRISPR gRNA sequence
gacatttgtccgtcttcaag

SEQ ID NO: 745306 - DNA, 20 bp, Artificial
  CRISPR gRNA sequence
acatttgtccgtcttcaaga

SEQ ID NO: 745307 - DNA, 20 bp, Artificial
  CRISPR gRNA sequence
atttgtccgtcttcaagaag

SEQ ID NO: 745308 - DNA, 20 bp, Artificial
  CRISPR gRNA sequence
tttgtccgtcttcaagaagg

SEQ ID NO: 745309 - DNA, 20 bp, Artificial
  CRISPR gRNA sequence
gtccgtcttcaagaaggagg

SEQ ID NO: 745310 - DNA, 20 bp, Artificial
  CRISPR gRNA sequence
tccgtcttcaagaaggaggt

SEQ ID NO: 745311 - DNA, 20 bp, Artificial
  CRISPR gRNA sequence
ccgtcttcaagaaggaggtg

SEQ ID NO: 745312 - DNA, 20 bp, Artificial
  CRISPR gRNA sequence
caagaaggaggtggggcctc

SEQ ID NO: 745313 - DNA, 20 bp, Artificial
  CRISPR gRNA sequence
aaggaggtggggcctccagt

SEQ ID NO: 745314 - DNA, 20 bp, Artificial
  CRISPR gRNA sequence
tggggcctccagtcagtccc

SEQ ID NO: 745315 - DNA, 20 bp, Artificial
  CRISPR gRNA sequence
ccccagctacctctattctc

SEQ ID NO: 745316 - DNA, 20 bp, Artificial
  CRISPR gRNA sequence
ccagctacctctattctcta

SEQ ID NO: 745317 - DNA, 20 bp, Artificial
  CRISPR gRNA sequence
agctacctctattctctaga

SEQ ID NO: 745318 - DNA, 20 bp, Artificial
  CRISPR gRNA sequence
tacctctattctctagagag

SEQ ID NO: 745319 - DNA, 20 bp, Artificial
  CRISPR gRNA sequence
tctattctctagagagtagt

SEQ ID NO: 745320 - DNA, 20 bp, Artificial
  CRISPR gRNA sequence
ttctctagagagtagtcaga

SEQ ID NO: 745321 - DNA, 20 bp, Artificial
  CRISPR gRNA sequence
agagagtagtcagatggcac

SEQ ID NO: 745322 - DNA, 20 bp, Artificial
  CRISPR gRNA sequence
gtcagatggcaccagacctc

SEQ ID NO: 745323 - DNA, 20 bp, Artificial
  CRISPR gRNA sequence
cagatggcaccagacctcca

SEQ ID NO: 745324 - DNA, 20 bp, Artificial
  CRISPR gRNA sequence
agatggcaccagacctccag

SEQ ID NO: 745325 - DNA, 20 bp, Artificial
  CRISPR gRNA sequence
acctccagaggctgactacc

SEQ ID NO: 745326 - DNA, 20 bp, Artificial
  CRISPR gRNA sequence
cctccagaggctgactacct

SEQ ID NO: 745327 - DNA, 20 bp, Artificial
  CRISPR gRNA sequence
agaggctgactacctgggtt

SEQ ID NO: 745328 - DNA, 20 bp, Artificial
  CRISPR gRNA sequence
atcctgacaccatcacttat

SEQ ID NO: 745329 - DNA, 20 bp, Artificial
  CRISPR gRNA sequence
caccatcacttattagttgt

SEQ ID NO: 745330 - DNA, 20 bp, Artificial
  CRISPR gRNA sequence
accatcacttattagttgtg

SEQ ID NO: 745331 - DNA, 20 bp, Artificial
  CRISPR gRNA sequence
acttattagttgtgaggctg

SEQ ID NO: 745332 - DNA, 20 bp, Artificial
  CRISPR gRNA sequence
cttattagttgtgaggctgt

SEQ ID NO: 745333 - DNA, 20 bp, Artificial
  CRISPR gRNA sequence
ttagttgtgaggctgtgggc

SEQ ID NO: 745334 - DNA, 20 bp, Artificial
  CRISPR gRNA sequence
ccgttttctcatctgtaaaa

SEQ ID NO: 745335 - DNA, 20 bp, Artificial
  CRISPR gRNA sequence
gttttctcatctgtaaaatg

SEQ ID NO: 745336 - DNA, 20 bp, Artificial
  CRISPR gRNA sequence
ctgtaaaatggagatgatac

SEQ ID NO: 745337 - DNA, 20 bp, Artificial
  CRISPR gRNA sequence
tgatactagtacctacctca

SEQ ID NO: 745338 - DNA, 20 bp, Artificial
  CRISPR gRNA sequence
gatactagtacctacctcat

SEQ ID NO: 745339 - DNA, 20 bp, Artificial
  CRISPR gRNA sequence
atactagtacctacctcata

SEQ ID NO: 745340 - DNA, 20 bp, Artificial
  CRISPR gRNA sequence
ctagtacctacctcataggg

SEQ ID NO: 745341 - DNA, 20 bp, Artificial
  CRISPR gRNA sequence
gtacctacctcatagggtgg

SEQ ID NO: 745342 - DNA, 20 bp, Artificial
  CRISPR gRNA sequence
tacctacctcatagggtgga

SEQ ID NO: 745343 - DNA, 20 bp, Artificial
  CRISPR gRNA sequence
acataaactaatctatgtaa

SEQ ID NO: 745344 - DNA, 20 bp, Artificial
  CRISPR gRNA sequence
ctaatctatgtaaaagtgtt

SEQ ID NO: 745345 - DNA, 20 bp, Artificial
  CRISPR gRNA sequence
tatgtaaaagtgtttagaat

SEQ ID NO: 745346 - DNA, 20 bp, Artificial
  CRISPR gRNA sequence
atgtaaaagtgtttagaatg

SEQ ID NO: 745347 - DNA, 20 bp, Artificial
  CRISPR gRNA sequence
aaagtgtttagaatgaggcc

SEQ ID NO: 745348 - DNA, 20 bp, Artificial
  CRISPR gRNA sequence
gtttagaatgaggccgagca

SEQ ID NO: 745349 - DNA, 20 bp, Artificial
  CRISPR gRNA sequence
tagaatgaggccgagcacag

SEQ ID NO: 745350 - DNA, 20 bp, Artificial
  CRISPR gRNA sequence
gtggctcatgcctgtaatcc

SEQ ID NO: 745351 - DNA, 20 bp, Artificial
  CRISPR gRNA sequence
tgcctgtaatcccagcactt

SEQ ID NO: 745352 - DNA, 20 bp, Artificial
  CRISPR gRNA sequence
gcctgtaatcccagcacttt

SEQ ID NO: 745353 - DNA, 20 bp, Artificial
  CRISPR gRNA sequence
ctgtaatcccagcactttgg

SEQ ID NO: 745354 - DNA, 20 bp, Artificial
  CRISPR gRNA sequence
tgtaatcccagcactttggg

SEQ ID NO: 745355 - DNA, 20 bp, Artificial
  CRISPR gRNA sequence
tcccagcactttgggaggct

SEQ ID NO: 745356 - DNA, 20 bp, Artificial
  CRISPR gRNA sequence
cccagcactttgggaggctg

SEQ ID NO: 745357 - DNA, 20 bp, Artificial
  CRISPR gRNA sequence
agcactttgggaggctgagg

SEQ ID NO: 745358 - DNA, 20 bp, Artificial
  CRISPR gRNA sequence
gcactttgggaggctgaggt

SEQ ID NO: 745359 - DNA, 20 bp, Artificial
  CRISPR gRNA sequence
actttgggaggctgaggtgg

SEQ ID NO: 745360 - DNA, 20 bp, Artificial
  CRISPR gRNA sequence
ctttgggaggctgaggtggg

SEQ ID NO: 745361 - DNA, 20 bp, Artificial
  CRISPR gRNA sequence
tgaggtgggaggatctcttg

SEQ ID NO: 745362 - DNA, 20 bp, Artificial
  CRISPR gRNA sequence
gtgggaggatctcttgaagc

SEQ ID NO: 745363 - DNA, 20 bp, Artificial
  CRISPR gRNA sequence
tgggaggatctcttgaagcc

SEQ ID NO: 745364 - DNA, 20 bp, Artificial
  CRISPR gRNA sequence
ggaggatctcttgaagccag

SEQ ID NO: 745365 - DNA, 20 bp, Artificial
  CRISPR gRNA sequence
ctcttgaagccaggagtttc

SEQ ID NO: 745366 - DNA, 20 bp, Artificial
  CRISPR gRNA sequence
tgaagccaggagtttcaagc

SEQ ID NO: 745367 - DNA, 20 bp, Artificial
  CRISPR gRNA sequence
gaagccaggagtttcaagcc

SEQ ID NO: 745368 - DNA, 20 bp, Artificial
  CRISPR gRNA sequence
aagccaggagtttcaagcca

SEQ ID NO: 745369 - DNA, 20 bp, Artificial
  CRISPR gRNA sequence
agccaggagtttcaagccag

SEQ ID NO: 745370 - DNA, 20 bp, Artificial
  CRISPR gRNA sequence
ggagtttcaagccaggggac

SEQ ID NO: 745371 - DNA, 20 bp, Artificial
  CRISPR gRNA sequence
ttcaagccaggggaccagcc

SEQ ID NO: 745372 - DNA, 20 bp, Artificial
  CRISPR gRNA sequence
accagcctggacaacataac

SEQ ID NO: 745373 - DNA, 20 bp, Artificial
  CRISPR gRNA sequence
actatgaaaaatttaaaaat

SEQ ID NO: 745374 - DNA, 20 bp, Artificial
  CRISPR gRNA sequence
tgaaaaatttaaaaattagc

SEQ ID NO: 745375 - DNA, 20 bp, Artificial
  CRISPR gRNA sequence
gaaaaatttaaaaattagct

SEQ ID NO: 745376 - DNA, 20 bp, Artificial
  CRISPR gRNA sequence
atttaaaaattagctgggca

SEQ ID NO: 745377 - DNA, 20 bp, Artificial
  CRISPR gRNA sequence
taaaaattagctgggcatag

SEQ ID NO: 745378 - DNA, 20 bp, Artificial
  CRISPR gRNA sequence
ggcatagtggcatgtgtctg

SEQ ID NO: 745379 - DNA, 20 bp, Artificial
  CRISPR gRNA sequence
gtggcatgtgtctgtagtcc

SEQ ID NO: 745380 - DNA, 20 bp, Artificial
  CRISPR gRNA sequence
catgtgtctgtagtcctagt

SEQ ID NO: 745381 - DNA, 20 bp, Artificial
  CRISPR gRNA sequence
atgtgtctgtagtcctagtt

SEQ ID NO: 745382 - DNA, 20 bp, Artificial
  CRISPR gRNA sequence
gtgtctgtagtcctagttgg

SEQ ID NO: 745383 - DNA, 20 bp, Artificial
  CRISPR gRNA sequence
tgtctgtagtcctagttggg

SEQ ID NO: 745384 - DNA, 20 bp, Artificial
  CRISPR gRNA sequence
ctgtagtcctagttgggagg

SEQ ID NO: 745385 - DNA, 20 bp, Artificial
  CRISPR gRNA sequence
tgtagtcctagttgggaggc

SEQ ID NO: 745386 - DNA, 20 bp, Artificial
  CRISPR gRNA sequence
gtagtcctagttgggaggca

SEQ ID NO: 745387 - DNA, 20 bp, Artificial
  CRISPR gRNA sequence
tagtcctagttgggaggcag

SEQ ID NO: 745388 - DNA, 20 bp, Artificial
  CRISPR gRNA sequence
tcctagttgggaggcagggg

SEQ ID NO: 745389 - DNA, 20 bp, Artificial
  CRISPR gRNA sequence
cctagttgggaggcaggggt

SEQ ID NO: 745390 - DNA, 20 bp, Artificial
  CRISPR gRNA sequence
tagttgggaggcaggggtgg

SEQ ID NO: 745391 - DNA, 20 bp, Artificial
  CRISPR gRNA sequence
agttgggaggcaggggtggg

SEQ ID NO: 745392 - DNA, 20 bp, Artificial
  CRISPR gRNA sequence
caggggtgggaggataactt

SEQ ID NO: 745393 - DNA, 20 bp, Artificial
  CRISPR gRNA sequence
ggaggataacttgagcccat

SEQ ID NO: 745394 - DNA, 20 bp, Artificial
  CRISPR gRNA sequence
taacttgagcccatgagttc

SEQ ID NO: 745395 - DNA, 20 bp, Artificial
  CRISPR gRNA sequence
aacttgagcccatgagttcg

SEQ ID NO: 745396 - DNA, 20 bp, Artificial
  CRISPR gRNA sequence
agcccatgagttcgaggtta

SEQ ID NO: 745397 - DNA, 20 bp, Artificial
  CRISPR gRNA sequence
ccatgagttcgaggttacag

SEQ ID NO: 745398 - DNA, 20 bp, Artificial
  CRISPR gRNA sequence
catgagttcgaggttacagt

SEQ ID NO: 745399 - DNA, 20 bp, Artificial
  CRISPR gRNA sequence
atctcattgtcactgcattc

SEQ ID NO: 745400 - DNA, 20 bp, Artificial
  CRISPR gRNA sequence
ttgtcactgcattccagcct

SEQ ID NO: 745401 - DNA, 20 bp, Artificial
  CRISPR gRNA sequence
actgcattccagcctgagtg

SEQ ID NO: 745402 - DNA, 20 bp, Artificial
  CRISPR gRNA sequence
tgcattccagcctgagtgaa

SEQ ID NO: 745403 - DNA, 20 bp, Artificial
  CRISPR gRNA sequence
ttccagcctgagtgaagagc

SEQ ID NO: 745404 - DNA, 20 bp, Artificial
  CRISPR gRNA sequence
ctgagtgaagagcaagaccc

SEQ ID NO: 745405 - DNA, 20 bp, Artificial
  CRISPR gRNA sequence
agcaagaccctagctcacta

SEQ ID NO: 745406 - DNA, 20 bp, Artificial
  CRISPR gRNA sequence
actaaagaaaaccaaccaaa

SEQ ID NO: 745407 - DNA, 20 bp, Artificial
  CRISPR gRNA sequence
aagaaaaccaaccaaacggc

SEQ ID NO: 745408 - DNA, 20 bp, Artificial
  CRISPR gRNA sequence
agaaaaccaaccaaacggcc

SEQ ID NO: 745409 - DNA, 20 bp, Artificial
  CRISPR gRNA sequence
accaaccaaacggccaggca

SEQ ID NO: 745410 - DNA, 20 bp, Artificial
  CRISPR gRNA sequence
aaccaaacggccaggcacag

SEQ ID NO: 745411 - DNA, 20 bp, Artificial
  CRISPR gRNA sequence
gtggctcactcctgtaatcc

SEQ ID NO: 745412 - DNA, 20 bp, Artificial
  CRISPR gRNA sequence
actcctgtaatcccagcact

SEQ ID NO: 745413 - DNA, 20 bp, Artificial
  CRISPR gRNA sequence
ctcctgtaatcccagcactt

SEQ ID NO: 745414 - DNA, 20 bp, Artificial
  CRISPR gRNA sequence
tcctgtaatcccagcacttg

SEQ ID NO: 745415 - DNA, 20 bp, Artificial
  CRISPR gRNA sequence
ctgtaatcccagcacttggg

SEQ ID NO: 745416 - DNA, 20 bp, Artificial
  CRISPR gRNA sequence
tgtaatcccagcacttgggg

SEQ ID NO: 745417 - DNA, 20 bp, Artificial
  CRISPR gRNA sequence
tcccagcacttggggaggac

SEQ ID NO: 745418 - DNA, 20 bp, Artificial
  CRISPR gRNA sequence
cccagcacttggggaggacg

SEQ ID NO: 745419 - DNA, 20 bp, Artificial
  CRISPR gRNA sequence
agcacttggggaggacgagg

SEQ ID NO: 745420 - DNA, 20 bp, Artificial
  CRISPR gRNA sequence
gcacttggggaggacgaggc

SEQ ID NO: 745421 - DNA, 20 bp, Artificial
  CRISPR gRNA sequence
cttggggaggacgaggcggg

SEQ ID NO: 745422 - DNA, 20 bp, Artificial
  CRISPR gRNA sequence
acgaggcgggtggatcacat

SEQ ID NO: 745423 - DNA, 20 bp, Artificial
  CRISPR gRNA sequence
cgaggcgggtggatcacatg

SEQ ID NO: 745424 - DNA, 20 bp, Artificial
  CRISPR gRNA sequence
gcgggtggatcacatgaggt

SEQ ID NO: 745425 - DNA, 20 bp, Artificial
  CRISPR gRNA sequence
cgggtggatcacatgaggtc

SEQ ID NO: 745426 - DNA, 20 bp, Artificial
  CRISPR gRNA sequence
ggtggatcacatgaggtcag

SEQ ID NO: 745427 - DNA, 20 bp, Artificial
  CRISPR gRNA sequence
tcacatgaggtcaggagttc

SEQ ID NO: 745428 - DNA, 20 bp, Artificial
  CRISPR gRNA sequence
tgaggtcaggagttcaagac

SEQ ID NO: 745429 - DNA, 20 bp, Artificial
  CRISPR gRNA sequence
tcaggagttcaagaccagcc

SEQ ID NO: 745430 - DNA, 20 bp, Artificial
  CRISPR gRNA sequence
caagaccagcctggccaacg

SEQ ID NO: 745431 - DNA, 20 bp, Artificial
  CRISPR gRNA sequence
tctactaaaaatacaaaaat

SEQ ID NO: 745432 - DNA, 20 bp, Artificial
  CRISPR gRNA sequence
ctaaaaatacaaaaattagc

SEQ ID NO: 745433 - DNA, 20 bp, Artificial
  CRISPR gRNA sequence
taaaaatacaaaaattagcc

SEQ ID NO: 745434 - DNA, 20 bp, Artificial
  CRISPR gRNA sequence
atacaaaaattagccaggcg

SEQ ID NO: 745435 - DNA, 20 bp, Artificial
  CRISPR gRNA sequence
caaaaattagccaggcgtgg

SEQ ID NO: 745436 - DNA, 20 bp, Artificial
  CRISPR gRNA sequence
aaattagccaggcgtggtgg

SEQ ID NO: 745437 - DNA, 20 bp, Artificial
  CRISPR gRNA sequence
aattagccaggcgtggtggc

SEQ ID NO: 745438 - DNA, 20 bp, Artificial
  CRISPR gRNA sequence
ggcgtggtggcgggtgcctg

SEQ ID NO: 745439 - DNA, 20 bp, Artificial
  CRISPR gRNA sequence
gtggcgggtgcctgtagtcc

SEQ ID NO: 745440 - DNA, 20 bp, Artificial
  CRISPR gRNA sequence
tgcctgtagtcccagctact

SEQ ID NO: 745441 - DNA, 20 bp, Artificial
  CRISPR gRNA sequence
gcctgtagtcccagctactc

SEQ ID NO: 745442 - DNA, 20 bp, Artificial
  CRISPR gRNA sequence
ctgtagtcccagctactcgg

SEQ ID NO: 745443 - DNA, 20 bp, Artificial
  CRISPR gRNA sequence
tgtagtcccagctactcggg

SEQ ID NO: 745444 - DNA, 20 bp, Artificial
  CRISPR gRNA sequence
tcccagctactcgggaggct

SEQ ID NO: 745445 - DNA, 20 bp, Artificial
  CRISPR gRNA sequence
cccagctactcgggaggctg

SEQ ID NO: 745446 - DNA, 20 bp, Artificial
  CRISPR gRNA sequence
agctactcgggaggctgagg

SEQ ID NO: 745447 - DNA, 20 bp, Artificial
  CRISPR gRNA sequence
gctactcgggaggctgaggc

SEQ ID NO: 745448 - DNA, 20 bp, Artificial
  CRISPR gRNA sequence
tactcgggaggctgaggcag

SEQ ID NO: 745449 - DNA, 20 bp, Artificial
  CRISPR gRNA sequence
ctcgggaggctgaggcagga

SEQ ID NO: 745450 - DNA, 20 bp, Artificial
  CRISPR gRNA sequence
gcaggagagttgcttcaacc

SEQ ID NO: 745451 - DNA, 20 bp, Artificial
  CRISPR gRNA sequence
caggagagttgcttcaacct

SEQ ID NO: 745452 - DNA, 20 bp, Artificial
  CRISPR gRNA sequence
ggagagttgcttcaacctgg

SEQ ID NO: 745453 - DNA, 20 bp, Artificial
  CRISPR gRNA sequence
gagagttgcttcaacctggg

SEQ ID NO: 745454 - DNA, 20 bp, Artificial
  CRISPR gRNA sequence
agttgcttcaacctgggagg

SEQ ID NO: 745455 - DNA, 20 bp, Artificial
  CRISPR gRNA sequence
ttgcttcaacctgggaggcg

SEQ ID NO: 745456 - DNA, 20 bp, Artificial
  CRISPR gRNA sequence
tgcttcaacctgggaggcgg

SEQ ID NO: 745457 - DNA, 20 bp, Artificial
  CRISPR gRNA sequence
aacctgggaggcggaggttg

SEQ ID NO: 745458 - DNA, 20 bp, Artificial
  CRISPR gRNA sequence
tgggaggcggaggttgcagt

SEQ ID NO: 745459 - DNA, 20 bp, Artificial
  CRISPR gRNA sequence
ggcggaggttgcagtgagct

SEQ ID NO: 745460 - DNA, 20 bp, Artificial
  CRISPR gRNA sequence
gagattgcaccactgaactc

SEQ ID NO: 745461 - DNA, 20 bp, Artificial
  CRISPR gRNA sequence
tgcaccactgaactccagcc

SEQ ID NO: 745462 - DNA, 20 bp, Artificial
  CRISPR gRNA sequence
gcaccactgaactccagcct

SEQ ID NO: 745463 - DNA, 20 bp, Artificial
  CRISPR gRNA sequence
ctgaactccagcctgggcaa

SEQ ID NO: 745464 - DNA, 20 bp, Artificial
  CRISPR gRNA sequence
gaactccagcctgggcaaca

SEQ ID NO: 745465 - DNA, 20 bp, Artificial
  CRISPR gRNA sequence
tccagcctgggcaacagagc

SEQ ID NO: 745466 - DNA, 20 bp, Artificial
  CRISPR gRNA sequence
aacaacaacaacaacaacaa

SEQ ID NO: 745467 - DNA, 20 bp, Artificial
  CRISPR gRNA sequence
caacaacaacaacagcaaca

SEQ ID NO: 745468 - DNA, 20 bp, Artificial
  CRISPR gRNA sequence
acaaagccaaccaaacaaac

SEQ ID NO: 745469 - DNA, 20 bp, Artificial
  CRISPR gRNA sequence
caaccaaacaaacaagcact

SEQ ID NO: 745470 - DNA, 20 bp, Artificial
  CRISPR gRNA sequence
caagcacttagaatgatgcc

SEQ ID NO: 745471 - DNA, 20 bp, Artificial
  CRISPR gRNA sequence
acttagaatgatgcctggca

SEQ ID NO: 745472 - DNA, 20 bp, Artificial
  CRISPR gRNA sequence
ttagaatgatgcctggcaca

SEQ ID NO: 745473 - DNA, 20 bp, Artificial
  CRISPR gRNA sequence
gaatgatgcctggcacagag

SEQ ID NO: 745474 - DNA, 20 bp, Artificial
  CRISPR gRNA sequence
tgatgcctggcacagagtag

SEQ ID NO: 745475 - DNA, 20 bp, Artificial
  CRISPR gRNA sequence
gatgcctggcacagagtagt

SEQ ID NO: 745476 - DNA, 20 bp, Artificial
  CRISPR gRNA sequence
atgcctggcacagagtagta

SEQ ID NO: 745477 - DNA, 20 bp, Artificial
  CRISPR gRNA sequence
tgcctggcacagagtagtag

SEQ ID NO: 745478 - DNA, 20 bp, Artificial
  CRISPR gRNA sequence
gcctggcacagagtagtagg

SEQ ID NO: 745479 - DNA, 20 bp, Artificial
  CRISPR gRNA sequence
acagagtagtagggggcaaa

SEQ ID NO: 745480 - DNA, 20 bp, Artificial
  CRISPR gRNA sequence
agtagggggcaaaaagactt

SEQ ID NO: 745481 - DNA, 20 bp, Artificial
  CRISPR gRNA sequence
gggggcaaaaagacttgagc

SEQ ID NO: 745482 - DNA, 20 bp, Artificial
  CRISPR gRNA sequence
aaagacttgagctggaccct

SEQ ID NO: 745483 - DNA, 20 bp, Artificial
  CRISPR gRNA sequence
aagacttgagctggaccctg

SEQ ID NO: 745484 - DNA, 20 bp, Artificial
  CRISPR gRNA sequence
ggaccctgaggacgtcttca

SEQ ID NO: 745485 - DNA, 20 bp, Artificial
  CRISPR gRNA sequence
ctgaggacgtcttcacagca

SEQ ID NO: 745486 - DNA, 20 bp, Artificial
  CRISPR gRNA sequence
aggacgtcttcacagcatag

SEQ ID NO: 745487 - DNA, 20 bp, Artificial
  CRISPR gRNA sequence
tcttcacagcatagaagcgt

SEQ ID NO: 745488 - DNA, 20 bp, Artificial
  CRISPR gRNA sequence
cttcacagcatagaagcgtg

SEQ ID NO: 745489 - DNA, 20 bp, Artificial
  CRISPR gRNA sequence
ttcacagcatagaagcgtga

SEQ ID NO: 745490 - DNA, 20 bp, Artificial
  CRISPR gRNA sequence
acagcatagaagcgtgaggg

SEQ ID NO: 745491 - DNA, 20 bp, Artificial
  CRISPR gRNA sequence
catagaagcgtgagggtggc

SEQ ID NO: 745492 - DNA, 20 bp, Artificial
  CRISPR gRNA sequence
gaagcgtgagggtggctggc

SEQ ID NO: 745493 - DNA, 20 bp, Artificial
  CRISPR gRNA sequence
agcgtgagggtggctggctg

SEQ ID NO: 745494 - DNA, 20 bp, Artificial
  CRISPR gRNA sequence
tgagggtggctggctggagc

SEQ ID NO: 745495 - DNA, 20 bp, Artificial
  CRISPR gRNA sequence
gagggtggctggctggagcc

SEQ ID NO: 745496 - DNA, 20 bp, Artificial
  CRISPR gRNA sequence
gggtggctggctggagccgg

SEQ ID NO: 745497 - DNA, 20 bp, Artificial
  CRISPR gRNA sequence
ctggctggagccgggagcct

SEQ ID NO: 745498 - DNA, 20 bp, Artificial
  CRISPR gRNA sequence
ccgggagcctgagctgcaca

SEQ ID NO: 745499 - DNA, 20 bp, Artificial
  CRISPR gRNA sequence
tgcacacagtcctcctccaa

SEQ ID NO: 745500 - DNA, 20 bp, Artificial
  CRISPR gRNA sequence
gcacacagtcctcctccaaa

SEQ ID NO: 745501 - DNA, 20 bp, Artificial
  CRISPR gRNA sequence
cacacagtcctcctccaaaa

SEQ ID NO: 745502 - DNA, 20 bp, Artificial
  CRISPR gRNA sequence
agtcctcctccaaaagggcc

SEQ ID NO: 745503 - DNA, 20 bp, Artificial
  CRISPR gRNA sequence
gtcctcctccaaaagggcct

SEQ ID NO: 745504 - DNA, 20 bp, Artificial
  CRISPR gRNA sequence
tcctcctccaaaagggcctg

SEQ ID NO: 745505 - DNA, 20 bp, Artificial
  CRISPR gRNA sequence
ctcctccaaaagggcctggg

SEQ ID NO: 745506 - DNA, 20 bp, Artificial
  CRISPR gRNA sequence
ccaaaagggcctggggagtc

SEQ ID NO: 745507 - DNA, 20 bp, Artificial
  CRISPR gRNA sequence
caaaagggcctggggagtct

SEQ ID NO: 745508 - DNA, 20 bp, Artificial
  CRISPR gRNA sequence
aaagggcctggggagtctgg

SEQ ID NO: 745509 - DNA, 20 bp, Artificial
  CRISPR gRNA sequence
aagggcctggggagtctggg

SEQ ID NO: 745510 - DNA, 20 bp, Artificial
  CRISPR gRNA sequence
agggcctggggagtctggga

SEQ ID NO: 745511 - DNA, 20 bp, Artificial
  CRISPR gRNA sequence
gggcctggggagtctgggag

SEQ ID NO: 745512 - DNA, 20 bp, Artificial
  CRISPR gRNA sequence
gtctgggaggggttcatcca

SEQ ID NO: 745513 - DNA, 20 bp, Artificial
  CRISPR gRNA sequence
tgggaggggttcatccacag

SEQ ID NO: 745514 - DNA, 20 bp, Artificial
  CRISPR gRNA sequence
ttcatccacagaagcatcca

SEQ ID NO: 745515 - DNA, 20 bp, Artificial
  CRISPR gRNA sequence
tcatccacagaagcatccac

SEQ ID NO: 745516 - DNA, 20 bp, Artificial
  CRISPR gRNA sequence
ccacagaagcatccacgggc

SEQ ID NO: 745517 - DNA, 20 bp, Artificial
  CRISPR gRNA sequence
cacagaagcatccacgggcc

SEQ ID NO: 745518 - DNA, 20 bp, Artificial
  CRISPR gRNA sequence
catccacgggccgggacctc

SEQ ID NO: 745519 - DNA, 20 bp, Artificial
  CRISPR gRNA sequence
cacgggccgggacctctggc

SEQ ID NO: 745520 - DNA, 20 bp, Artificial
  CRISPR gRNA sequence
gggacctctggccagctgcc

SEQ ID NO: 745521 - DNA, 20 bp, Artificial
  CRISPR gRNA sequence
ggacctctggccagctgcct

SEQ ID NO: 745522 - DNA, 20 bp, Artificial
  CRISPR gRNA sequence
ccagctgcctaggccctccc

SEQ ID NO: 745523 - DNA, 20 bp, Artificial
  CRISPR gRNA sequence
cagctgcctaggccctccct

SEQ ID NO: 745524 - DNA, 20 bp, Artificial
  CRISPR gRNA sequence
agctgcctaggccctccctg

SEQ ID NO: 745525 - DNA, 20 bp, Artificial
  CRISPR gRNA sequence
ctgcctaggccctccctggg

SEQ ID NO: 745526 - DNA, 20 bp, Artificial
  CRISPR gRNA sequence
tgcctaggccctccctgggg

SEQ ID NO: 745527 - DNA, 20 bp, Artificial
  CRISPR gRNA sequence
ccctccctggggaggcatgc

SEQ ID NO: 745528 - DNA, 20 bp, Artificial
  CRISPR gRNA sequence
tggggaggcatgctagcctc

SEQ ID NO: 745529 - DNA, 20 bp, Artificial
  CRISPR gRNA sequence
ggcatgctagcctccagctc

SEQ ID NO: 745530 - DNA, 20 bp, Artificial
  CRISPR gRNA sequence
ctagcctccagctccagccc

SEQ ID NO: 745531 - DNA, 20 bp, Artificial
  CRISPR gRNA sequence
cagctccagccccggatgca

SEQ ID NO: 745532 - DNA, 20 bp, Artificial
  CRISPR gRNA sequence
gctccagccccggatgcacg

SEQ ID NO: 745533 - DNA, 20 bp, Artificial
  CRISPR gRNA sequence
ctccagccccggatgcacgg

SEQ ID NO: 745534 - DNA, 20 bp, Artificial
  CRISPR gRNA sequence
ggatgcacggaggctttccc

SEQ ID NO: 745535 - DNA, 20 bp, Artificial
  CRISPR gRNA sequence
gatgcacggaggctttccca

SEQ ID NO: 745536 - DNA, 20 bp, Artificial
  CRISPR gRNA sequence
cggaggctttcccaaggtgc

SEQ ID NO: 745537 - DNA, 20 bp, Artificial
  CRISPR gRNA sequence
aggctttcccaaggtgctgg

SEQ ID NO: 745538 - DNA, 20 bp, Artificial
  CRISPR gRNA sequence
ggaagtgccgcttccttcaa

SEQ ID NO: 745539 - DNA, 20 bp, Artificial
  CRISPR gRNA sequence
aagtgccgcttccttcaata

SEQ ID NO: 745540 - DNA, 20 bp, Artificial
  CRISPR gRNA sequence
ccgcttccttcaatagagcc

SEQ ID NO: 745541 - DNA, 20 bp, Artificial
  CRISPR gRNA sequence
agagcctggcttccccttcc

SEQ ID NO: 745542 - DNA, 20 bp, Artificial
  CRISPR gRNA sequence
cttccccttcccagccccct

SEQ ID NO: 745543 - DNA, 20 bp, Artificial
  CRISPR gRNA sequence
cccccttggtctgatgtgaa

SEQ ID NO: 745544 - DNA, 20 bp, Artificial
  CRISPR gRNA sequence
atgtgaatggacacttcctg

SEQ ID NO: 745545 - DNA, 20 bp, Artificial
  CRISPR gRNA sequence
tgtgaatggacacttcctgc

SEQ ID NO: 745546 - DNA, 20 bp, Artificial
  CRISPR gRNA sequence
gtgaatggacacttcctgcg

SEQ ID NO: 745547 - DNA, 20 bp, Artificial
  CRISPR gRNA sequence
tgaatggacacttcctgcgg

SEQ ID NO: 745548 - DNA, 20 bp, Artificial
  CRISPR gRNA sequence
atggacacttcctgcggggg

SEQ ID NO: 745549 - DNA, 20 bp, Artificial
  CRISPR gRNA sequence
tggacacttcctgcgggggc

SEQ ID NO: 745550 - DNA, 20 bp, Artificial
  CRISPR gRNA sequence
aggtatcaataaacacatct

SEQ ID NO: 745551 - DNA, 20 bp, Artificial
  CRISPR gRNA sequence
gagatgccctttgtcctcac

SEQ ID NO: 745552 - DNA, 20 bp, Artificial
  CRISPR gRNA sequence
tgccctttgtcctcactggc

SEQ ID NO: 745553 - DNA, 20 bp, Artificial
  CRISPR gRNA sequence
ctttgtcctcactggccaga

SEQ ID NO: 745554 - DNA, 20 bp, Artificial
  CRISPR gRNA sequence
cctcactggccagaaagccc

SEQ ID NO: 745555 - DNA, 20 bp, Artificial
  CRISPR gRNA sequence
ctcactggccagaaagcccc

SEQ ID NO: 745556 - DNA, 20 bp, Artificial
  CRISPR gRNA sequence
tcactggccagaaagcccca

SEQ ID NO: 745557 - DNA, 20 bp, Artificial
  CRISPR gRNA sequence
ctggccagaaagccccaggg

SEQ ID NO: 745558 - DNA, 20 bp, Artificial
  CRISPR gRNA sequence
aagccccagggcagacttgc

SEQ ID NO: 745559 - DNA, 20 bp, Artificial
  CRISPR gRNA sequence
cagggcagacttgctggctt

SEQ ID NO: 745560 - DNA, 20 bp, Artificial
  CRISPR gRNA sequence
agggcagacttgctggcttc

SEQ ID NO: 745561 - DNA, 20 bp, Artificial
  CRISPR gRNA sequence
acttgctggcttcaggccct

SEQ ID NO: 745562 - DNA, 20 bp, Artificial
  CRISPR gRNA sequence
ccttgtgacgcttcctttct

SEQ ID NO: 745563 - DNA, 20 bp, Artificial
  CRISPR gRNA sequence
gacgcttcctttcttagcct

SEQ ID NO: 745564 - DNA, 20 bp, Artificial
  CRISPR gRNA sequence
gcttcctttcttagccttgg

SEQ ID NO: 745565 - DNA, 20 bp, Artificial
  CRISPR gRNA sequence
tttcttagccttggcagccc

SEQ ID NO: 745566 - DNA, 20 bp, Artificial
  CRISPR gRNA sequence
tttccctctgcatcttgata

SEQ ID NO: 745567 - DNA, 20 bp, Artificial
  CRISPR gRNA sequence
cctctgcatcttgataaaga

SEQ ID NO: 745568 - DNA, 20 bp, Artificial
  CRISPR gRNA sequence
atcttgataaagacagaaca

SEQ ID NO: 745569 - DNA, 20 bp, Artificial
  CRISPR gRNA sequence
cagaacatagtcttttccta

SEQ ID NO: 745570 - DNA, 20 bp, Artificial
  CRISPR gRNA sequence
atagtcttttcctacagccc

SEQ ID NO: 745571 - DNA, 20 bp, Artificial
  CRISPR gRNA sequence
ttttcctacagccccagccc

SEQ ID NO: 745572 - DNA, 20 bp, Artificial
  CRISPR gRNA sequence
acagccccagccccagcctg

SEQ ID NO: 745573 - DNA, 20 bp, Artificial
  CRISPR gRNA sequence
ccccagcctgtggaccatcc

SEQ ID NO: 745574 - DNA, 20 bp, Artificial
  CRISPR gRNA sequence
cccagcctgtggaccatcct

SEQ ID NO: 745575 - DNA, 20 bp, Artificial
  CRISPR gRNA sequence
ccagcctgtggaccatcctg

SEQ ID NO: 745576 - DNA, 20 bp, Artificial
  CRISPR gRNA sequence
cagcctgtggaccatcctgg

SEQ ID NO: 745577 - DNA, 20 bp, Artificial
  CRISPR gRNA sequence
ctgtggaccatcctggggga

SEQ ID NO: 745578 - DNA, 20 bp, Artificial
  CRISPR gRNA sequence
tgtggaccatcctgggggat

SEQ ID NO: 745579 - DNA, 20 bp, Artificial
  CRISPR gRNA sequence
gtggaccatcctgggggatg

SEQ ID NO: 745580 - DNA, 20 bp, Artificial
  CRISPR gRNA sequence
ccatcctgggggatggggcc

SEQ ID NO: 745581 - DNA, 20 bp, Artificial
  CRISPR gRNA sequence
tcctgggggatggggcctgg

SEQ ID NO: 745582 - DNA, 20 bp, Artificial
  CRISPR gRNA sequence
cctgggggatggggcctggc

SEQ ID NO: 745583 - DNA, 20 bp, Artificial
  CRISPR gRNA sequence
ctgggggatggggcctggcg

SEQ ID NO: 745584 - DNA, 20 bp, Artificial
  CRISPR gRNA sequence
gggggatggggcctggcggg

SEQ ID NO: 745585 - DNA, 20 bp, Artificial
  CRISPR gRNA sequence
gatggggcctggcggggagc

SEQ ID NO: 745586 - DNA, 20 bp, Artificial
  CRISPR gRNA sequence
gcctggcggggagctggaac

SEQ ID NO: 745587 - DNA, 20 bp, Artificial
  CRISPR gRNA sequence
cctggcggggagctggaacc

SEQ ID NO: 745588 - DNA, 20 bp, Artificial
  CRISPR gRNA sequence
gaaccaggtcccattctctt

SEQ ID NO: 745589 - DNA, 20 bp, Artificial
  CRISPR gRNA sequence
aaccaggtcccattctcttt

SEQ ID NO: 745590 - DNA, 20 bp, Artificial
  CRISPR gRNA sequence
ttctctttgggatgtcctgt

SEQ ID NO: 745591 - DNA, 20 bp, Artificial
  CRISPR gRNA sequence
ttgggatgtcctgtgagacc

SEQ ID NO: 745592 - DNA, 20 bp, Artificial
  CRISPR gRNA sequence
tgggatgtcctgtgagacca

SEQ ID NO: 745593 - DNA, 20 bp, Artificial
  CRISPR gRNA sequence
atgtcctgtgagaccaagga

SEQ ID NO: 745594 - DNA, 20 bp, Artificial
  CRISPR gRNA sequence
tgtcctgtgagaccaaggac

SEQ ID NO: 745595 - DNA, 20 bp, Artificial
  CRISPR gRNA sequence
aggacgggaccttttgcatc

SEQ ID NO: 745596 - DNA, 20 bp, Artificial
  CRISPR gRNA sequence
gggaccttttgcatctagtg

SEQ ID NO: 745597 - DNA, 20 bp, Artificial
  CRISPR gRNA sequence
ggaccttttgcatctagtgc

SEQ ID NO: 745598 - DNA, 20 bp, Artificial
  CRISPR gRNA sequence
gaccttttgcatctagtgca

SEQ ID NO: 745599 - DNA, 20 bp, Artificial
  CRISPR gRNA sequence
ttttgcatctagtgcagggc

SEQ ID NO: 745600 - DNA, 20 bp, Artificial
  CRISPR gRNA sequence
atctagtgcagggccagcca

SEQ ID NO: 745601 - DNA, 20 bp, Artificial
  CRISPR gRNA sequence
tagtgcagggccagccacag

SEQ ID NO: 745602 - DNA, 20 bp, Artificial
  CRISPR gRNA sequence
agtgcagggccagccacagc

SEQ ID NO: 745603 - DNA, 20 bp, Artificial
  CRISPR gRNA sequence
actgtttacttgacaacctc

SEQ ID NO: 745604 - DNA, 20 bp, Artificial
  CRISPR gRNA sequence
gtttacttgacaacctctag

SEQ ID NO: 745605 - DNA, 20 bp, Artificial
  CRISPR gRNA sequence
acttgacaacctctagcagc

SEQ ID NO: 745606 - DNA, 20 bp, Artificial
  CRISPR gRNA sequence
gacaacctctagcagctggt

SEQ ID NO: 745607 - DNA, 20 bp, Artificial
  CRISPR gRNA sequence
caacctctagcagctggtca

SEQ ID NO: 745608 - DNA, 20 bp, Artificial
  CRISPR gRNA sequence
tctagcagctggtcagagtt

SEQ ID NO: 745609 - DNA, 20 bp, Artificial
  CRISPR gRNA sequence
ctggtcagagttcagctgtt

SEQ ID NO: 745610 - DNA, 20 bp, Artificial
  CRISPR gRNA sequence
tggtcagagttcagctgttt

SEQ ID NO: 745611 - DNA, 20 bp, Artificial
  CRISPR gRNA sequence
tcagagttcagctgtttggg

SEQ ID NO: 745612 - DNA, 20 bp, Artificial
  CRISPR gRNA sequence
cagagttcagctgtttgggt

SEQ ID NO: 745613 - DNA, 20 bp, Artificial
  CRISPR gRNA sequence
agagttcagctgtttgggtg

SEQ ID NO: 745614 - DNA, 20 bp, Artificial
  CRISPR gRNA sequence
gctgtttgggtggggcttcc

SEQ ID NO: 745615 - DNA, 20 bp, Artificial
  CRISPR gRNA sequence
ctgtttgggtggggcttcct

SEQ ID NO: 745616 - DNA, 20 bp, Artificial
  CRISPR gRNA sequence
cttcctaggcccgactaacc

SEQ ID NO: 745617 - DNA, 20 bp, Artificial
  CRISPR gRNA sequence
taggcccgactaaccaagct

SEQ ID NO: 745618 - DNA, 20 bp, Artificial
  CRISPR gRNA sequence
aggcccgactaaccaagctt

SEQ ID NO: 745619 - DNA, 20 bp, Artificial
  CRISPR gRNA sequence
aagcttgggtcccacctcca

SEQ ID NO: 745620 - DNA, 20 bp, Artificial
  CRISPR gRNA sequence
agcttgggtcccacctccaa

SEQ ID NO: 745621 - DNA, 20 bp, Artificial
  CRISPR gRNA sequence
tgggtcccacctccaaaggc

SEQ ID NO: 745622 - DNA, 20 bp, Artificial
  CRISPR gRNA sequence
gggtcccacctccaaaggct

SEQ ID NO: 745623 - DNA, 20 bp, Artificial
  CRISPR gRNA sequence
ggtcccacctccaaaggcta

SEQ ID NO: 745624 - DNA, 20 bp, Artificial
  CRISPR gRNA sequence
caaaggctagggcgttgcct

SEQ ID NO: 745625 - DNA, 20 bp, Artificial
  CRISPR gRNA sequence
gggcgttgccttggcgactg

SEQ ID NO: 745626 - DNA, 20 bp, Artificial
  CRISPR gRNA sequence
ggcgttgccttggcgactgt

SEQ ID NO: 745627 - DNA, 20 bp, Artificial
  CRISPR gRNA sequence
tgccttggcgactgtgggct

SEQ ID NO: 745628 - DNA, 20 bp, Artificial
  CRISPR gRNA sequence
gccctgtcatgaaaaataca

SEQ ID NO: 745629 - DNA, 20 bp, Artificial
  CRISPR gRNA sequence
ccctgtcatgaaaaatacac

SEQ ID NO: 745630 - DNA, 20 bp, Artificial
  CRISPR gRNA sequence
acccatcccgtgcacactca

SEQ ID NO: 745631 - DNA, 20 bp, Artificial
  CRISPR gRNA sequence
cccatcccgtgcacactcac

SEQ ID NO: 745632 - DNA, 20 bp, Artificial
  CRISPR gRNA sequence
ccatcccgtgcacactcaca

SEQ ID NO: 745633 - DNA, 20 bp, Artificial
  CRISPR gRNA sequence
catcccgtgcacactcacag

SEQ ID NO: 745634 - DNA, 20 bp, Artificial
  CRISPR gRNA sequence
gcacactcacaggggtcacc

SEQ ID NO: 745635 - DNA, 20 bp, Artificial
  CRISPR gRNA sequence
cacactcacaggggtcaccc

SEQ ID NO: 745636 - DNA, 20 bp, Artificial
  CRISPR gRNA sequence
acactcacaggggtcacccg

SEQ ID NO: 745637 - DNA, 20 bp, Artificial
  CRISPR gRNA sequence
aggggtcacccggggcctgc

SEQ ID NO: 745638 - DNA, 20 bp, Artificial
  CRISPR gRNA sequence
ggggtcacccggggcctgct

SEQ ID NO: 745639 - DNA, 20 bp, Artificial
  CRISPR gRNA sequence
gtcacccggggcctgctggg

SEQ ID NO: 745640 - DNA, 20 bp, Artificial
  CRISPR gRNA sequence
cacccggggcctgctgggtg

SEQ ID NO: 745641 - DNA, 20 bp, Artificial
  CRISPR gRNA sequence
cccggggcctgctgggtgga

SEQ ID NO: 745642 - DNA, 20 bp, Artificial
  CRISPR gRNA sequence
cggggcctgctgggtggaga

SEQ ID NO: 745643 - DNA, 20 bp, Artificial
  CRISPR gRNA sequence
ggggcctgctgggtggagag

SEQ ID NO: 745644 - DNA, 20 bp, Artificial
  CRISPR gRNA sequence
ctgctgggtggagagaggtg

SEQ ID NO: 745645 - DNA, 20 bp, Artificial
  CRISPR gRNA sequence
tgctgggtggagagaggtga

SEQ ID NO: 745646 - DNA, 20 bp, Artificial
  CRISPR gRNA sequence
gaggtgaaggtcacaaaaac

SEQ ID NO: 745647 - DNA, 20 bp, Artificial
  CRISPR gRNA sequence
gtcacaaaaactggcattct

SEQ ID NO: 745648 - DNA, 20 bp, Artificial
  CRISPR gRNA sequence
acaaaaactggcattctgag

SEQ ID NO: 745649 - DNA, 20 bp, Artificial
  CRISPR gRNA sequence
cattctgagaagatgccaac

SEQ ID NO: 745650 - DNA, 20 bp, Artificial
  CRISPR gRNA sequence
ttctgagaagatgccaacaa

SEQ ID NO: 745651 - DNA, 20 bp, Artificial
  CRISPR gRNA sequence
agagctcctttcccttgtac

SEQ ID NO: 745652 - DNA, 20 bp, Artificial
  CRISPR gRNA sequence
gagctcctttcccttgtact

SEQ ID NO: 745653 - DNA, 20 bp, Artificial
  CRISPR gRNA sequence
tcctttcccttgtactggga

SEQ ID NO: 745654 - DNA, 20 bp, Artificial
  CRISPR gRNA sequence
gtactgggacagaaacatct

SEQ ID NO: 745655 - DNA, 20 bp, Artificial
  CRISPR gRNA sequence
tactgggacagaaacatctg

SEQ ID NO: 745656 - DNA, 20 bp, Artificial
  CRISPR gRNA sequence
actgggacagaaacatctga

SEQ ID NO: 745657 - DNA, 20 bp, Artificial
  CRISPR gRNA sequence
agaaacatctgagggtgcca

SEQ ID NO: 745658 - DNA, 20 bp, Artificial
  CRISPR gRNA sequence
acatctgagggtgccacagc

SEQ ID NO: 745659 - DNA, 20 bp, Artificial
  CRISPR gRNA sequence
ggtgccacagctagaaatct

SEQ ID NO: 745660 - DNA, 20 bp, Artificial
  CRISPR gRNA sequence
gtgccacagctagaaatctc

SEQ ID NO: 745661 - DNA, 20 bp, Artificial
  CRISPR gRNA sequence
acagctagaaatctcaggca

SEQ ID NO: 745662 - DNA, 20 bp, Artificial
  CRISPR gRNA sequence
cagctagaaatctcaggcac

SEQ ID NO: 745663 - DNA, 20 bp, Artificial
  CRISPR gRNA sequence
agaaatctcaggcacaggtc

SEQ ID NO: 745664 - DNA, 20 bp, Artificial
  CRISPR gRNA sequence
gaaatctcaggcacaggtcc

SEQ ID NO: 745665 - DNA, 20 bp, Artificial
  CRISPR gRNA sequence
tcaggcacaggtccaggccc

SEQ ID NO: 745666 - DNA, 20 bp, Artificial
  CRISPR gRNA sequence
caggtccaggcccaagttct

SEQ ID NO: 745667 - DNA, 20 bp, Artificial
  CRISPR gRNA sequence
gtccaggcccaagttctgag

SEQ ID NO: 745668 - DNA, 20 bp, Artificial
  CRISPR gRNA sequence
ttctgagcagatgcccctga

SEQ ID NO: 745669 - DNA, 20 bp, Artificial
  CRISPR gRNA sequence
gatggaactctgcatcccca

SEQ ID NO: 745670 - DNA, 20 bp, Artificial
  CRISPR gRNA sequence
atccccacagcctccctgcc

SEQ ID NO: 745671 - DNA, 20 bp, Artificial
  CRISPR gRNA sequence
tccccacagcctccctgcct

SEQ ID NO: 745672 - DNA, 20 bp, Artificial
  CRISPR gRNA sequence
acagcctccctgcctgggcc

SEQ ID NO: 745673 - DNA, 20 bp, Artificial
  CRISPR gRNA sequence
tgcctgggcctggcccatgt

SEQ ID NO: 745674 - DNA, 20 bp, Artificial
  CRISPR gRNA sequence
gcctgggcctggcccatgtt

SEQ ID NO: 745675 - DNA, 20 bp, Artificial
  CRISPR gRNA sequence
cctggcccatgttaggacct

SEQ ID NO: 745676 - DNA, 20 bp, Artificial
  CRISPR gRNA sequence
aggaccttggtaaatatttg

SEQ ID NO: 745677 - DNA, 20 bp, Artificial
  CRISPR gRNA sequence
ggtaaatatttgtggaatga

SEQ ID NO: 745678 - DNA, 20 bp, Artificial
  CRISPR gRNA sequence
gaatgaaagaatgatgtttt

SEQ ID NO: 745679 - DNA, 20 bp, Artificial
  CRISPR gRNA sequence
aaagaatgatgttttcagct

SEQ ID NO: 745680 - DNA, 20 bp, Artificial
  CRISPR gRNA sequence
aagaatgatgttttcagctt

SEQ ID NO: 745681 - DNA, 20 bp, Artificial
  CRISPR gRNA sequence
gatgttttcagcttgggtct

SEQ ID NO: 745682 - DNA, 20 bp, Artificial
  CRISPR gRNA sequence
atgttttcagcttgggtctg

SEQ ID NO: 745683 - DNA, 20 bp, Artificial
  CRISPR gRNA sequence
ttttcagcttgggtctgagg

SEQ ID NO: 745684 - DNA, 20 bp, Artificial
  CRISPR gRNA sequence
ttcagcttgggtctgaggca

SEQ ID NO: 745685 - DNA, 20 bp, Artificial
  CRISPR gRNA sequence
agcttgggtctgaggcagag

SEQ ID NO: 745686 - DNA, 20 bp, Artificial
  CRISPR gRNA sequence
gcttgggtctgaggcagagc

SEQ ID NO: 745687 - DNA, 20 bp, Artificial
  CRISPR gRNA sequence
ggcagagcaggaatgttgca

SEQ ID NO: 745688 - DNA, 20 bp, Artificial
  CRISPR gRNA sequence
cagagcaggaatgttgcacg

SEQ ID NO: 745689 - DNA, 20 bp, Artificial
  CRISPR gRNA sequence
agagcaggaatgttgcacgg

SEQ ID NO: 745690 - DNA, 20 bp, Artificial
  CRISPR gRNA sequence
gagcaggaatgttgcacgga

SEQ ID NO: 745691 - DNA, 20 bp, Artificial
  CRISPR gRNA sequence
ggaatgttgcacggagggcg

SEQ ID NO: 745692 - DNA, 20 bp, Artificial
  CRISPR gRNA sequence
aatgttgcacggagggcgtg

SEQ ID NO: 745693 - DNA, 20 bp, Artificial
  CRISPR gRNA sequence
atgttgcacggagggcgtgg

SEQ ID NO: 745694 - DNA, 20 bp, Artificial
  CRISPR gRNA sequence
agggcgtggaggtcaatgca

SEQ ID NO: 745695 - DNA, 20 bp, Artificial
  CRISPR gRNA sequence
cgtggaggtcaatgcacggt

SEQ ID NO: 745696 - DNA, 20 bp, Artificial
  CRISPR gRNA sequence
gtcagttcattttttctaaa

SEQ ID NO: 745697 - DNA, 20 bp, Artificial
  CRISPR gRNA sequence
tcattttttctaaatagctg

SEQ ID NO: 745698 - DNA, 20 bp, Artificial
  CRISPR gRNA sequence
cattttttctaaatagctga

SEQ ID NO: 745699 - DNA, 20 bp, Artificial
  CRISPR gRNA sequence
tttctaaatagctgaaggat

SEQ ID NO: 745700 - DNA, 20 bp, Artificial
  CRISPR gRNA sequence
ttctaaatagctgaaggatg

SEQ ID NO: 745701 - DNA, 20 bp, Artificial
  CRISPR gRNA sequence
atagctgaaggatgaggcat

SEQ ID NO: 745702 - DNA, 20 bp, Artificial
  CRISPR gRNA sequence
catcagccccgcctgcccac

SEQ ID NO: 745703 - DNA, 20 bp, Artificial
  CRISPR gRNA sequence
tcagccccgcctgcccactg

SEQ ID NO: 745704 - DNA, 20 bp, Artificial
  CRISPR gRNA sequence
cagccccgcctgcccactgg

SEQ ID NO: 745705 - DNA, 20 bp, Artificial
  CRISPR gRNA sequence
agccccgcctgcccactgga

SEQ ID NO: 745706 - DNA, 20 bp, Artificial
  CRISPR gRNA sequence
gcctgcccactggagggttc

SEQ ID NO: 745707 - DNA, 20 bp, Artificial
  CRISPR gRNA sequence
ctgcccactggagggttctg

SEQ ID NO: 745708 - DNA, 20 bp, Artificial
  CRISPR gRNA sequence
gcccactggagggttctgga

SEQ ID NO: 745709 - DNA, 20 bp, Artificial
  CRISPR gRNA sequence
cccactggagggttctggag

SEQ ID NO: 745710 - DNA, 20 bp, Artificial
  CRISPR gRNA sequence
actggagggttctggagagg

SEQ ID NO: 745711 - DNA, 20 bp, Artificial
  CRISPR gRNA sequence
ctggagggttctggagaggt

SEQ ID NO: 745712 - DNA, 20 bp, Artificial
  CRISPR gRNA sequence
gagggttctggagaggtggg

SEQ ID NO: 745713 - DNA, 20 bp, Artificial
  CRISPR gRNA sequence
tgggtggctcttcctgtctg

SEQ ID NO: 745714 - DNA, 20 bp, Artificial
  CRISPR gRNA sequence
gctcttcctgtctgcagtgc

SEQ ID NO: 745715 - DNA, 20 bp, Artificial
  CRISPR gRNA sequence
tctgcagtgctggcctgtcc

SEQ ID NO: 745716 - DNA, 20 bp, Artificial
  CRISPR gRNA sequence
ctgcagtgctggcctgtcca

SEQ ID NO: 745717 - DNA, 20 bp, Artificial
  CRISPR gRNA sequence
cctgtccaaggtgtgaatct

SEQ ID NO: 745718 - DNA, 20 bp, Artificial
  CRISPR gRNA sequence
ccaaggtgtgaatctcagct

SEQ ID NO: 745719 - DNA, 20 bp, Artificial
  CRISPR gRNA sequence
tgaatctcagctcagtcaca

SEQ ID NO: 745720 - DNA, 20 bp, Artificial
  CRISPR gRNA sequence
ctcagtcacacagcactgtg

SEQ ID NO: 745721 - DNA, 20 bp, Artificial
  CRISPR gRNA sequence
cacacagcactgtgtggcct

SEQ ID NO: 745722 - DNA, 20 bp, Artificial
  CRISPR gRNA sequence
acacagcactgtgtggcctt

SEQ ID NO: 745723 - DNA, 20 bp, Artificial
  CRISPR gRNA sequence
agcactgtgtggccttgggc

SEQ ID NO: 745724 - DNA, 20 bp, Artificial
  CRISPR gRNA sequence
cttgggcaagtcacttctct

SEQ ID NO: 745725 - DNA, 20 bp, Artificial
  CRISPR gRNA sequence
ctgtttcctcatctttaaaa

SEQ ID NO: 745726 - DNA, 20 bp, Artificial
  CRISPR gRNA sequence
tgtttcctcatctttaaaat

SEQ ID NO: 745727 - DNA, 20 bp, Artificial
  CRISPR gRNA sequence
gtttcctcatctttaaaata

SEQ ID NO: 745728 - DNA, 20 bp, Artificial
  CRISPR gRNA sequence
agggatgataccacccatgt

SEQ ID NO: 745729 - DNA, 20 bp, Artificial
  CRISPR gRNA sequence
gggatgataccacccatgtt

SEQ ID NO: 745730 - DNA, 20 bp, Artificial
  CRISPR gRNA sequence
ggatgataccacccatgttg

SEQ ID NO: 745731 - DNA, 20 bp, Artificial
  CRISPR gRNA sequence
gatgataccacccatgttgg

SEQ ID NO: 745732 - DNA, 20 bp, Artificial
  CRISPR gRNA sequence
acccatgttgggggtgttat

SEQ ID NO: 745733 - DNA, 20 bp, Artificial
  CRISPR gRNA sequence
gttatgagaactaaatgtga

SEQ ID NO: 745734 - DNA, 20 bp, Artificial
  CRISPR gRNA sequence
ttatgagaactaaatgtgac

SEQ ID NO: 745735 - DNA, 20 bp, Artificial
  CRISPR gRNA sequence
gaactaaatgtgacaggtat

SEQ ID NO: 745736 - DNA, 20 bp, Artificial
  CRISPR gRNA sequence
tgtgacaggtataagatgct

SEQ ID NO: 745737 - DNA, 20 bp, Artificial
  CRISPR gRNA sequence
acaggtataagatgctcagc

SEQ ID NO: 745738 - DNA, 20 bp, Artificial
  CRISPR gRNA sequence
aggtataagatgctcagcaa

SEQ ID NO: 745739 - DNA, 20 bp, Artificial
  CRISPR gRNA sequence
taagatgctcagcaagagcc

SEQ ID NO: 745740 - DNA, 20 bp, Artificial
  CRISPR gRNA sequence
agagcctagcacataataca

SEQ ID NO: 745741 - DNA, 20 bp, Artificial
  CRISPR gRNA sequence
agcacataatacatggtcat

SEQ ID NO: 745742 - DNA, 20 bp, Artificial
  CRISPR gRNA sequence
cataatacatggtcataaga

SEQ ID NO: 745743 - DNA, 20 bp, Artificial
  CRISPR gRNA sequence
cagctcttccctcctgccca

SEQ ID NO: 745744 - DNA, 20 bp, Artificial
  CRISPR gRNA sequence
agctcttccctcctgcccac

SEQ ID NO: 745745 - DNA, 20 bp, Artificial
  CRISPR gRNA sequence
ccctcctgcccacaggattt

SEQ ID NO: 745746 - DNA, 20 bp, Artificial
  CRISPR gRNA sequence
ctcctgcccacaggatttta

SEQ ID NO: 745747 - DNA, 20 bp, Artificial
  CRISPR gRNA sequence
tgcccacaggattttagagc

SEQ ID NO: 745748 - DNA, 20 bp, Artificial
  CRISPR gRNA sequence
ccacaggattttagagctgg

SEQ ID NO: 745749 - DNA, 20 bp, Artificial
  CRISPR gRNA sequence
attttagagctggcagccct

SEQ ID NO: 745750 - DNA, 20 bp, Artificial
  CRISPR gRNA sequence
ttttagagctggcagccctc

SEQ ID NO: 745751 - DNA, 20 bp, Artificial
  CRISPR gRNA sequence
gagctggcagccctcaggtt

SEQ ID NO: 745752 - DNA, 20 bp, Artificial
  CRISPR gRNA sequence
gcagccctcaggttaagatg

SEQ ID NO: 745753 - DNA, 20 bp, Artificial
  CRISPR gRNA sequence
ctcaggttaagatgaagaaa

SEQ ID NO: 745754 - DNA, 20 bp, Artificial
  CRISPR gRNA sequence
caggttaagatgaagaaacg

SEQ ID NO: 745755 - DNA, 20 bp, Artificial
  CRISPR gRNA sequence
aggttaagatgaagaaacgg

SEQ ID NO: 745756 - DNA, 20 bp, Artificial
  CRISPR gRNA sequence
aagatgaagaaacggaggct

SEQ ID NO: 745757 - DNA, 20 bp, Artificial
  CRISPR gRNA sequence
gatgaagaaacggaggctca

SEQ ID NO: 745758 - DNA, 20 bp, Artificial
  CRISPR gRNA sequence
gaagaaacggaggctcagag

SEQ ID NO: 745759 - DNA, 20 bp, Artificial
  CRISPR gRNA sequence
aagaaacggaggctcagaga

SEQ ID NO: 745760 - DNA, 20 bp, Artificial
  CRISPR gRNA sequence
agaaacggaggctcagagaa

SEQ ID NO: 745761 - DNA, 20 bp, Artificial
  CRISPR gRNA sequence
aacggaggctcagagaaggg

SEQ ID NO: 745762 - DNA, 20 bp, Artificial
  CRISPR gRNA sequence
acggaggctcagagaagggt

SEQ ID NO: 745763 - DNA, 20 bp, Artificial
  CRISPR gRNA sequence
gagaagggtgggatctgccc

SEQ ID NO: 745764 - DNA, 20 bp, Artificial
  CRISPR gRNA sequence
agaagggtgggatctgccca

SEQ ID NO: 745765 - DNA, 20 bp, Artificial
  CRISPR gRNA sequence
gaagggtgggatctgcccaa

SEQ ID NO: 745766 - DNA, 20 bp, Artificial
  CRISPR gRNA sequence
tctgcccaagggcacacaat

SEQ ID NO: 745767 - DNA, 20 bp, Artificial
  CRISPR gRNA sequence
ctgcccaagggcacacaatg

SEQ ID NO: 745768 - DNA, 20 bp, Artificial
  CRISPR gRNA sequence
tgcccaagggcacacaatga

SEQ ID NO: 745769 - DNA, 20 bp, Artificial
  CRISPR gRNA sequence
cacacaatgagggcacaact

SEQ ID NO: 745770 - DNA, 20 bp, Artificial
  CRISPR gRNA sequence
acaatgagggcacaactaag

SEQ ID NO: 745771 - DNA, 20 bp, Artificial
  CRISPR gRNA sequence
ggcacaactaagtggacact

SEQ ID NO: 745772 - DNA, 20 bp, Artificial
  CRISPR gRNA sequence
gcacaactaagtggacactg

SEQ ID NO: 745773 - DNA, 20 bp, Artificial
  CRISPR gRNA sequence
ctaagtggacactgaggccc

SEQ ID NO: 745774 - DNA, 20 bp, Artificial
  CRISPR gRNA sequence
taagtggacactgaggcccc

SEQ ID NO: 745775 - DNA, 20 bp, Artificial
  CRISPR gRNA sequence
gccccaggacgttgcaatcc

SEQ ID NO: 745776 - DNA, 20 bp, Artificial
  CRISPR gRNA sequence
caggacgttgcaatccaagc

SEQ ID NO: 745777 - DNA, 20 bp, Artificial
  CRISPR gRNA sequence
ggacgttgcaatccaagcga

SEQ ID NO: 745778 - DNA, 20 bp, Artificial
  CRISPR gRNA sequence
caagcgagagttttactcct

SEQ ID NO: 745779 - DNA, 20 bp, Artificial
  CRISPR gRNA sequence
agagttttactcctgagact

SEQ ID NO: 745780 - DNA, 20 bp, Artificial
  CRISPR gRNA sequence
gagttttactcctgagactc

SEQ ID NO: 745781 - DNA, 20 bp, Artificial
  CRISPR gRNA sequence
tcctgagactcaggctttcc

SEQ ID NO: 745782 - DNA, 20 bp, Artificial
  CRISPR gRNA sequence
cctgagactcaggctttccc

SEQ ID NO: 745783 - DNA, 20 bp, Artificial
  CRISPR gRNA sequence
ctcaggctttcccaggttca

SEQ ID NO: 745784 - DNA, 20 bp, Artificial
  CRISPR gRNA sequence
ggttcacggcactcttcctc

SEQ ID NO: 745785 - DNA, 20 bp, Artificial
  CRISPR gRNA sequence
gttcacggcactcttcctct

SEQ ID NO: 745786 - DNA, 20 bp, Artificial
  CRISPR gRNA sequence
cacggcactcttcctctagg

SEQ ID NO: 745787 - DNA, 20 bp, Artificial
  CRISPR gRNA sequence
ggtggccctgcctccttacc

SEQ ID NO: 745788 - DNA, 20 bp, Artificial
  CRISPR gRNA sequence
ggccctgcctccttacctgg

SEQ ID NO: 745789 - DNA, 20 bp, Artificial
  CRISPR gRNA sequence
cctgcctccttacctggtgg

SEQ ID NO: 745790 - DNA, 20 bp, Artificial
  CRISPR gRNA sequence
ctgcctccttacctggtggc

SEQ ID NO: 745791 - DNA, 20 bp, Artificial
  CRISPR gRNA sequence
cctccttacctggtggcagg

SEQ ID NO: 745792 - DNA, 20 bp, Artificial
  CRISPR gRNA sequence
ccttacctggtggcaggtgg

SEQ ID NO: 745793 - DNA, 20 bp, Artificial
  CRISPR gRNA sequence
cttacctggtggcaggtggc

SEQ ID NO: 745794 - DNA, 20 bp, Artificial
  CRISPR gRNA sequence
acctggtggcaggtggcggg

SEQ ID NO: 745795 - DNA, 20 bp, Artificial
  CRISPR gRNA sequence
tggtggcaggtggcgggtgg

SEQ ID NO: 745796 - DNA, 20 bp, Artificial
  CRISPR gRNA sequence
ggtggcaggtggcgggtggc

SEQ ID NO: 745797 - DNA, 20 bp, Artificial
  CRISPR gRNA sequence
ggcaggtggcgggtggcggg

SEQ ID NO: 745798 - DNA, 20 bp, Artificial
  CRISPR gRNA sequence
gcaggtggcgggtggcgggc

SEQ ID NO: 745799 - DNA, 20 bp, Artificial
  CRISPR gRNA sequence
caggtggcgggtggcgggcg

SEQ ID NO: 745800 - DNA, 20 bp, Artificial
  CRISPR gRNA sequence
aggtggcgggtggcgggcgg

SEQ ID NO: 745801 - DNA, 20 bp, Artificial
  CRISPR gRNA sequence
ggtggcgggtggcgggcggg

SEQ ID NO: 745802 - DNA, 20 bp, Artificial
  CRISPR gRNA sequence
cgggtggcgggcggggggcc

SEQ ID NO: 745803 - DNA, 20 bp, Artificial
  CRISPR gRNA sequence
gggtggcgggcggggggcct

SEQ ID NO: 745804 - DNA, 20 bp, Artificial
  CRISPR gRNA sequence
gcggggggcctgggtcttga

SEQ ID NO: 745805 - DNA, 20 bp, Artificial
  CRISPR gRNA sequence
gggggcctgggtcttgacag

SEQ ID NO: 745806 - DNA, 20 bp, Artificial
  CRISPR gRNA sequence
cctgggtcttgacagcagca

SEQ ID NO: 745807 - DNA, 20 bp, Artificial
  CRISPR gRNA sequence
cttgacagcagcacggcaac

SEQ ID NO: 745808 - DNA, 20 bp, Artificial
  CRISPR gRNA sequence
acagcagcacggcaactgga

SEQ ID NO: 745809 - DNA, 20 bp, Artificial
  CRISPR gRNA sequence
gcaactggacggttcccgcc

SEQ ID NO: 745810 - DNA, 20 bp, Artificial
  CRISPR gRNA sequence
gttcccgcctggcacatgct

SEQ ID NO: 745811 - DNA, 20 bp, Artificial
  CRISPR gRNA sequence
ttcccgcctggcacatgctc

SEQ ID NO: 745812 - DNA, 20 bp, Artificial
  CRISPR gRNA sequence
gcctggcacatgctcaggcc

SEQ ID NO: 745813 - DNA, 20 bp, Artificial
  CRISPR gRNA sequence
cctggcacatgctcaggccc

SEQ ID NO: 745814 - DNA, 20 bp, Artificial
  CRISPR gRNA sequence
acatgctcaggcccaggccc

SEQ ID NO: 745815 - DNA, 20 bp, Artificial
  CRISPR gRNA sequence
catgctcaggcccaggcccc

SEQ ID NO: 745816 - DNA, 20 bp, Artificial
  CRISPR gRNA sequence
tttcctgtcccacatgcttt

SEQ ID NO: 745817 - DNA, 20 bp, Artificial
  CRISPR gRNA sequence
ccacatgcttttggccaccc

SEQ ID NO: 745818 - DNA, 20 bp, Artificial
  CRISPR gRNA sequence
acatgcttttggccaccctg

SEQ ID NO: 745819 - DNA, 20 bp, Artificial
  CRISPR gRNA sequence
gcttttggccaccctggagc

SEQ ID NO: 745820 - DNA, 20 bp, Artificial
  CRISPR gRNA sequence
cttttggccaccctggagcc

SEQ ID NO: 745821 - DNA, 20 bp, Artificial
  CRISPR gRNA sequence
ttttggccaccctggagcca

SEQ ID NO: 745822 - DNA, 20 bp, Artificial
  CRISPR gRNA sequence
tttggccaccctggagccag

SEQ ID NO: 745823 - DNA, 20 bp, Artificial
  CRISPR gRNA sequence
tcctccccacccacttttcc

SEQ ID NO: 745824 - DNA, 20 bp, Artificial
  CRISPR gRNA sequence
cccggtctccgacaatgacc

SEQ ID NO: 745825 - DNA, 20 bp, Artificial
  CRISPR gRNA sequence
ccggtctccgacaatgaccc

SEQ ID NO: 745826 - DNA, 20 bp, Artificial
  CRISPR gRNA sequence
acaatgacccaggtgtccaa

SEQ ID NO: 745827 - DNA, 20 bp, Artificial
  CRISPR gRNA sequence
caatgacccaggtgtccaaa

SEQ ID NO: 745828 - DNA, 20 bp, Artificial
  CRISPR gRNA sequence
aaggatctgctcctgacaat

SEQ ID NO: 745829 - DNA, 20 bp, Artificial
  CRISPR gRNA sequence
taagcaacatcctctcgcca

SEQ ID NO: 745830 - DNA, 20 bp, Artificial
  CRISPR gRNA sequence
tcgccaaagaattgtaattt

SEQ ID NO: 745831 - DNA, 20 bp, Artificial
  CRISPR gRNA sequence
caaagaattgtaattttagc

SEQ ID NO: 745832 - DNA, 20 bp, Artificial
  CRISPR gRNA sequence
aaagaattgtaattttagcc

SEQ ID NO: 745833 - DNA, 20 bp, Artificial
  CRISPR gRNA sequence
gtaattttagccgggctgca

SEQ ID NO: 745834 - DNA, 20 bp, Artificial
  CRISPR gRNA sequence
acagcttccctgacaacaca

SEQ ID NO: 745835 - DNA, 20 bp, Artificial
  CRISPR gRNA sequence
cagcttccctgacaacacac

SEQ ID NO: 745836 - DNA, 20 bp, Artificial
  CRISPR gRNA sequence
acaacacacaggcatgtgca

SEQ ID NO: 745837 - DNA, 20 bp, Artificial
  CRISPR gRNA sequence
cacaggcatgtgcacagatg

SEQ ID NO: 745838 - DNA, 20 bp, Artificial
  CRISPR gRNA sequence
caggcatgtgcacagatgtg

SEQ ID NO: 745839 - DNA, 20 bp, Artificial
  CRISPR gRNA sequence
gtgcacagatgtggagtccg

SEQ ID NO: 745840 - DNA, 20 bp, Artificial
  CRISPR gRNA sequence
tgcacagatgtggagtccgc

SEQ ID NO: 745841 - DNA, 20 bp, Artificial
  CRISPR gRNA sequence
gcacagatgtggagtccgcg

SEQ ID NO: 745842 - DNA, 20 bp, Artificial
  CRISPR gRNA sequence
tggagtccgcggggcacgtg

SEQ ID NO: 745843 - DNA, 20 bp, Artificial
  CRISPR gRNA sequence
ggagtccgcggggcacgtgc

SEQ ID NO: 745844 - DNA, 20 bp, Artificial
  CRISPR gRNA sequence
ctcccccatgccatgccttc

SEQ ID NO: 745845 - DNA, 20 bp, Artificial
  CRISPR gRNA sequence
ttcgagtgtcctcctaacga

SEQ ID NO: 745846 - DNA, 20 bp, Artificial
  CRISPR gRNA sequence
tcgagtgtcctcctaacgac

SEQ ID NO: 745847 - DNA, 20 bp, Artificial
  CRISPR gRNA sequence
ctcctaacgacaggctgctg

SEQ ID NO: 745848 - DNA, 20 bp, Artificial
  CRISPR gRNA sequence
tcctaacgacaggctgctgt

SEQ ID NO: 745849 - DNA, 20 bp, Artificial
  CRISPR gRNA sequence
ggctgctgtgggccttgtcc

SEQ ID NO: 745850 - DNA, 20 bp, Artificial
  CRISPR gRNA sequence
gctgtgggccttgtcccagc

SEQ ID NO: 745851 - DNA, 20 bp, Artificial
  CRISPR gRNA sequence
tgtgggccttgtcccagctg

SEQ ID NO: 745852 - DNA, 20 bp, Artificial
  CRISPR gRNA sequence
ccttgtcccagctggagtct

SEQ ID NO: 745853 - DNA, 20 bp, Artificial
  CRISPR gRNA sequence
cccagctggagtctcagaca

SEQ ID NO: 745854 - DNA, 20 bp, Artificial
  CRISPR gRNA sequence
ggagtctcagacacagtaaa

SEQ ID NO: 745855 - DNA, 20 bp, Artificial
  CRISPR gRNA sequence
gagtctcagacacagtaaat

SEQ ID NO: 745856 - DNA, 20 bp, Artificial
  CRISPR gRNA sequence
agtctcagacacagtaaatg

SEQ ID NO: 745857 - DNA, 20 bp, Artificial
  CRISPR gRNA sequence
acagtaaatggggtgttttc

SEQ ID NO: 745858 - DNA, 20 bp, Artificial
  CRISPR gRNA sequence
tctggccttccctccctccc

SEQ ID NO: 745859 - DNA, 20 bp, Artificial
  CRISPR gRNA sequence
ctggccttccctccctcccc

SEQ ID NO: 745860 - DNA, 20 bp, Artificial
  CRISPR gRNA sequence
ctccccaggacaaacccctg

SEQ ID NO: 745861 - DNA, 20 bp, Artificial
  CRISPR gRNA sequence
gacaaacccctgtggaccct

SEQ ID NO: 745862 - DNA, 20 bp, Artificial
  CRISPR gRNA sequence
cttggtttgtcctgtccctc

SEQ ID NO: 745863 - DNA, 20 bp, Artificial
  CRISPR gRNA sequence
cctgtccctctggcttgtcc

SEQ ID NO: 745864 - DNA, 20 bp, Artificial
  CRISPR gRNA sequence
gtcctggaccctctcctgtc

SEQ ID NO: 745865 - DNA, 20 bp, Artificial
  CRISPR gRNA sequence
gctccccaaacttgaatcct

SEQ ID NO: 745866 - DNA, 20 bp, Artificial
  CRISPR gRNA sequence
cccaaacttgaatcctaaga

SEQ ID NO: 745867 - DNA, 20 bp, Artificial
  CRISPR gRNA sequence
ctaagacagcttttttctaa

SEQ ID NO: 745868 - DNA, 20 bp, Artificial
  CRISPR gRNA sequence
taagacagcttttttctaaa

SEQ ID NO: 745869 - DNA, 20 bp, Artificial
  CRISPR gRNA sequence
aagacagcttttttctaaaa

SEQ ID NO: 745870 - DNA, 20 bp, Artificial
  CRISPR gRNA sequence
agacagcttttttctaaaag

SEQ ID NO: 745871 - DNA, 20 bp, Artificial
  CRISPR gRNA sequence
taaaaggggaacaactcctt

SEQ ID NO: 745872 - DNA, 20 bp, Artificial
  CRISPR gRNA sequence
aaaaggggaacaactccttt

SEQ ID NO: 745873 - DNA, 20 bp, Artificial
  CRISPR gRNA sequence
aacaactcctttgggacctg

SEQ ID NO: 745874 - DNA, 20 bp, Artificial
  CRISPR gRNA sequence
acaactcctttgggacctgt

SEQ ID NO: 745875 - DNA, 20 bp, Artificial
  CRISPR gRNA sequence
ctcctttgggacctgtggga

SEQ ID NO: 745876 - DNA, 20 bp, Artificial
  CRISPR gRNA sequence
tcctttgggacctgtgggat

SEQ ID NO: 745877 - DNA, 20 bp, Artificial
  CRISPR gRNA sequence
tttgggacctgtgggatggg

SEQ ID NO: 745878 - DNA, 20 bp, Artificial
  CRISPR gRNA sequence
ggacctgtgggatgggtggc

SEQ ID NO: 745879 - DNA, 20 bp, Artificial
  CRISPR gRNA sequence
gggatgggtggccagtgtgt

SEQ ID NO: 745880 - DNA, 20 bp, Artificial
  CRISPR gRNA sequence
ggatgggtggccagtgtgtg

SEQ ID NO: 745881 - DNA, 20 bp, Artificial
  CRISPR gRNA sequence
gatgggtggccagtgtgtga

SEQ ID NO: 745882 - DNA, 20 bp, Artificial
  CRISPR gRNA sequence
atgggtggccagtgtgtgag

SEQ ID NO: 745883 - DNA, 20 bp, Artificial
  CRISPR gRNA sequence
ggtggccagtgtgtgagggg

SEQ ID NO: 745884 - DNA, 20 bp, Artificial
  CRISPR gRNA sequence
gtggccagtgtgtgaggggt

SEQ ID NO: 745885 - DNA, 20 bp, Artificial
  CRISPR gRNA sequence
tggccagtgtgtgaggggtg

SEQ ID NO: 745886 - DNA, 20 bp, Artificial
  CRISPR gRNA sequence
gccagtgtgtgaggggtggg

SEQ ID NO: 745887 - DNA, 20 bp, Artificial
  CRISPR gRNA sequence
ccagtgtgtgaggggtgggg

SEQ ID NO: 745888 - DNA, 20 bp, Artificial
  CRISPR gRNA sequence
gtgtgaggggtggggaggtg

SEQ ID NO: 745889 - DNA, 20 bp, Artificial
  CRISPR gRNA sequence
tgtgaggggtggggaggtgt

SEQ ID NO: 745890 - DNA, 20 bp, Artificial
  CRISPR gRNA sequence
gtgaggggtggggaggtgtg

SEQ ID NO: 745891 - DNA, 20 bp, Artificial
  CRISPR gRNA sequence
tgaggggtggggaggtgtgg

SEQ ID NO: 745892 - DNA, 20 bp, Artificial
  CRISPR gRNA sequence
gtggggaggtgtgggggatt

SEQ ID NO: 745893 - DNA, 20 bp, Artificial
  CRISPR gRNA sequence
acccacccgccgtgcatctc

SEQ ID NO: 745894 - DNA, 20 bp, Artificial
  CRISPR gRNA sequence
cccacccgccgtgcatctca

SEQ ID NO: 745895 - DNA, 20 bp, Artificial
  CRISPR gRNA sequence
acccgccgtgcatctcaagg

SEQ ID NO: 745896 - DNA, 20 bp, Artificial
  CRISPR gRNA sequence
catctcaaggaagttgcctc

SEQ ID NO: 745897 - DNA, 20 bp, Artificial
  CRISPR gRNA sequence
atctcaaggaagttgcctcc

SEQ ID NO: 745898 - DNA, 20 bp, Artificial
  CRISPR gRNA sequence
tctcaaggaagttgcctcca

SEQ ID NO: 745899 - DNA, 20 bp, Artificial
  CRISPR gRNA sequence
ctcaaggaagttgcctccag

SEQ ID NO: 745900 - DNA, 20 bp, Artificial
  CRISPR gRNA sequence
caaggaagttgcctccaggg

SEQ ID NO: 745901 - DNA, 20 bp, Artificial
  CRISPR gRNA sequence
acatcccttccctactgctg

SEQ ID NO: 745902 - DNA, 20 bp, Artificial
  CRISPR gRNA sequence
catcccttccctactgctgc

SEQ ID NO: 745903 - DNA, 20 bp, Artificial
  CRISPR gRNA sequence
ccctactgctgcgggtgcta

SEQ ID NO: 745904 - DNA, 20 bp, Artificial
  CRISPR gRNA sequence
cctactgctgcgggtgctat

SEQ ID NO: 745905 - DNA, 20 bp, Artificial
  CRISPR gRNA sequence
gggtgctatgggtacaatcc

SEQ ID NO: 745906 - DNA, 20 bp, Artificial
  CRISPR gRNA sequence
ggtgctatgggtacaatcct

SEQ ID NO: 745907 - DNA, 20 bp, Artificial
  CRISPR gRNA sequence
gtgctatgggtacaatcctg

SEQ ID NO: 745908 - DNA, 20 bp, Artificial
  CRISPR gRNA sequence
gggtcattaaccccattgct

SEQ ID NO: 745909 - DNA, 20 bp, Artificial
  CRISPR gRNA sequence
aaccccattgcttagaccct

SEQ ID NO: 745910 - DNA, 20 bp, Artificial
  CRISPR gRNA sequence
accccattgcttagaccctg

SEQ ID NO: 745911 - DNA, 20 bp, Artificial
  CRISPR gRNA sequence
ccccattgcttagaccctga

SEQ ID NO: 745912 - DNA, 20 bp, Artificial
  CRISPR gRNA sequence
gcttagaccctgagggctcc

SEQ ID NO: 745913 - DNA, 20 bp, Artificial
  CRISPR gRNA sequence
gaccctgagggctcccagcc

SEQ ID NO: 745914 - DNA, 20 bp, Artificial
  CRISPR gRNA sequence
gccctgccccaccttgttca

SEQ ID NO: 745915 - DNA, 20 bp, Artificial
  CRISPR gRNA sequence
ccctgccccaccttgttcac

SEQ ID NO: 745916 - DNA, 20 bp, Artificial
  CRISPR gRNA sequence
cctgccccaccttgttcaca

SEQ ID NO: 745917 - DNA, 20 bp, Artificial
  CRISPR gRNA sequence
accttgttcacagggacact

SEQ ID NO: 745918 - DNA, 20 bp, Artificial
  CRISPR gRNA sequence
ccttgttcacagggacactc

SEQ ID NO: 745919 - DNA, 20 bp, Artificial
  CRISPR gRNA sequence
actcaggccaacaaccacgc

SEQ ID NO: 745920 - DNA, 20 bp, Artificial
  CRISPR gRNA sequence
gtccacacctctgtccactt

SEQ ID NO: 745921 - DNA, 20 bp, Artificial
  CRISPR gRNA sequence
tccacacctctgtccacttg

SEQ ID NO: 745922 - DNA, 20 bp, Artificial
  CRISPR gRNA sequence
ccacacctctgtccacttga

SEQ ID NO: 745923 - DNA, 20 bp, Artificial
  CRISPR gRNA sequence
tgagggcccccaaccccacc

SEQ ID NO: 745924 - DNA, 20 bp, Artificial
  CRISPR gRNA sequence
gcccccaaccccacccagct

SEQ ID NO: 745925 - DNA, 20 bp, Artificial
  CRISPR gRNA sequence
cagctttgcgcatcttgctt

SEQ ID NO: 745926 - DNA, 20 bp, Artificial
  CRISPR gRNA sequence
gcgcatcttgctttggctgc

SEQ ID NO: 745927 - DNA, 20 bp, Artificial
  CRISPR gRNA sequence
tgccctgccataccctcctc

SEQ ID NO: 745928 - DNA, 20 bp, Artificial
  CRISPR gRNA sequence
ccataccctcctctggcctg

SEQ ID NO: 745929 - DNA, 20 bp, Artificial
  CRISPR gRNA sequence
cctgcagccccgtgtctgct

SEQ ID NO: 745930 - DNA, 20 bp, Artificial
  CRISPR gRNA sequence
cagccccgtgtctgctgagc

SEQ ID NO: 745931 - DNA, 20 bp, Artificial
  CRISPR gRNA sequence
tgtctgctgagccagccctt

SEQ ID NO: 745932 - DNA, 20 bp, Artificial
  CRISPR gRNA sequence
tgctgagccagccctttggc

SEQ ID NO: 745933 - DNA, 20 bp, Artificial
  CRISPR gRNA sequence
cagccctttggccagccccc

SEQ ID NO: 745934 - DNA, 20 bp, Artificial
  CRISPR gRNA sequence
agccctttggccagccccca

SEQ ID NO: 745935 - DNA, 20 bp, Artificial
  CRISPR gRNA sequence
agcccccaaggtatgtgtgc

SEQ ID NO: 745936 - DNA, 20 bp, Artificial
  CRISPR gRNA sequence
ccccaaggtatgtgtgctgg

SEQ ID NO: 745937 - DNA, 20 bp, Artificial
  CRISPR gRNA sequence
gctggtggtaaatactaccg

SEQ ID NO: 745938 - DNA, 20 bp, Artificial
  CRISPR gRNA sequence
ggtaaatactaccgtagctg

SEQ ID NO: 745939 - DNA, 20 bp, Artificial
  CRISPR gRNA sequence
aatactaccgtagctgaagc

SEQ ID NO: 745940 - DNA, 20 bp, Artificial
  CRISPR gRNA sequence
tactaccgtagctgaagctg

SEQ ID NO: 745941 - DNA, 20 bp, Artificial
  CRISPR gRNA sequence
gctgaagctggagctgaatt

SEQ ID NO: 745942 - DNA, 20 bp, Artificial
  CRISPR gRNA sequence
ctggagctgaattcagctcc

SEQ ID NO: 745943 - DNA, 20 bp, Artificial
  CRISPR gRNA sequence
ctgaattcagctcccagccc

SEQ ID NO: 745944 - DNA, 20 bp, Artificial
  CRISPR gRNA sequence
tgaattcagctcccagccct

SEQ ID NO: 745945 - DNA, 20 bp, Artificial
  CRISPR gRNA sequence
gaattcagctcccagccctg

SEQ ID NO: 745946 - DNA, 20 bp, Artificial
  CRISPR gRNA sequence
ttcagctcccagccctgggg

SEQ ID NO: 745947 - DNA, 20 bp, Artificial
  CRISPR gRNA sequence
tcccagccctggggtggctc

SEQ ID NO: 745948 - DNA, 20 bp, Artificial
  CRISPR gRNA sequence
cccagccctggggtggctct

SEQ ID NO: 745949 - DNA, 20 bp, Artificial
  CRISPR gRNA sequence
ccagccctggggtggctctg

SEQ ID NO: 745950 - DNA, 20 bp, Artificial
  CRISPR gRNA sequence
gccctggggtggctctgggg

SEQ ID NO: 745951 - DNA, 20 bp, Artificial
  CRISPR gRNA sequence
ccctggggtggctctggggt

SEQ ID NO: 745952 - DNA, 20 bp, Artificial
  CRISPR gRNA sequence
ctggggtggctctggggtag

SEQ ID NO: 745953 - DNA, 20 bp, Artificial
  CRISPR gRNA sequence
tggggtggctctggggtagg

SEQ ID NO: 745954 - DNA, 20 bp, Artificial
  CRISPR gRNA sequence
tctggggtaggaggtgatgt

SEQ ID NO: 745955 - DNA, 20 bp, Artificial
  CRISPR gRNA sequence
ctggggtaggaggtgatgtc

SEQ ID NO: 745956 - DNA, 20 bp, Artificial
  CRISPR gRNA sequence
gtaggaggtgatgtcaggca

SEQ ID NO: 745957 - DNA, 20 bp, Artificial
  CRISPR gRNA sequence
taggaggtgatgtcaggcaa

SEQ ID NO: 745958 - DNA, 20 bp, Artificial
  CRISPR gRNA sequence
aggaggtgatgtcaggcaaa

SEQ ID NO: 745959 - DNA, 20 bp, Artificial
  CRISPR gRNA sequence
gaggtgatgtcaggcaaagg

SEQ ID NO: 745960 - DNA, 20 bp, Artificial
  CRISPR gRNA sequence
tgatgtcaggcaaagggaga

SEQ ID NO: 745961 - DNA, 20 bp, Artificial
  CRISPR gRNA sequence
gatgtcaggcaaagggagaa

SEQ ID NO: 745962 - DNA, 20 bp, Artificial
  CRISPR gRNA sequence
atgtcaggcaaagggagaaa

SEQ ID NO: 745963 - DNA, 20 bp, Artificial
  CRISPR gRNA sequence
tgtcaggcaaagggagaaag

SEQ ID NO: 745964 - DNA, 20 bp, Artificial
  CRISPR gRNA sequence
caggcaaagggagaaagggg

SEQ ID NO: 745965 - DNA, 20 bp, Artificial
  CRISPR gRNA sequence
gcaaagggagaaaggggcag

SEQ ID NO: 745966 - DNA, 20 bp, Artificial
  CRISPR gRNA sequence
agggagaaaggggcagaagc

SEQ ID NO: 745967 - DNA, 20 bp, Artificial
  CRISPR gRNA sequence
gggagaaaggggcagaagct

SEQ ID NO: 745968 - DNA, 20 bp, Artificial
  CRISPR gRNA sequence
gagaaaggggcagaagctgg

SEQ ID NO: 745969 - DNA, 20 bp, Artificial
  CRISPR gRNA sequence
gaaaggggcagaagctggga

SEQ ID NO: 745970 - DNA, 20 bp, Artificial
  CRISPR gRNA sequence
aaaggggcagaagctgggag

SEQ ID NO: 745971 - DNA, 20 bp, Artificial
  CRISPR gRNA sequence
gcagaagctgggagaggtgc

SEQ ID NO: 745972 - DNA, 20 bp, Artificial
  CRISPR gRNA sequence
gaagctgggagaggtgctgg

SEQ ID NO: 745973 - DNA, 20 bp, Artificial
  CRISPR gRNA sequence
aagctgggagaggtgctggt

SEQ ID NO: 745974 - DNA, 20 bp, Artificial
  CRISPR gRNA sequence
tgctggtgggacctgccaca

SEQ ID NO: 745975 - DNA, 20 bp, Artificial
  CRISPR gRNA sequence
ggacctgccacatggcctgc

SEQ ID NO: 745976 - DNA, 20 bp, Artificial
  CRISPR gRNA sequence
gacctgccacatggcctgct

SEQ ID NO: 745977 - DNA, 20 bp, Artificial
  CRISPR gRNA sequence
acctgccacatggcctgctg

SEQ ID NO: 745978 - DNA, 20 bp, Artificial
  CRISPR gRNA sequence
tgccacatggcctgctgggg

SEQ ID NO: 745979 - DNA, 20 bp, Artificial
  CRISPR gRNA sequence
gccacatggcctgctgggga

SEQ ID NO: 745980 - DNA, 20 bp, Artificial
  CRISPR gRNA sequence
ccacatggcctgctggggaa

SEQ ID NO: 745981 - DNA, 20 bp, Artificial
  CRISPR gRNA sequence
cacatggcctgctggggaag

SEQ ID NO: 745982 - DNA, 20 bp, Artificial
  CRISPR gRNA sequence
acatggcctgctggggaagg

SEQ ID NO: 745983 - DNA, 20 bp, Artificial
  CRISPR gRNA sequence
tggcctgctggggaaggggg

SEQ ID NO: 745984 - DNA, 20 bp, Artificial
  CRISPR gRNA sequence
tgctggggaagggggcagca

SEQ ID NO: 745985 - DNA, 20 bp, Artificial
  CRISPR gRNA sequence
gctggggaagggggcagcac

SEQ ID NO: 745986 - DNA, 20 bp, Artificial
  CRISPR gRNA sequence
ctggggaagggggcagcaca

SEQ ID NO: 745987 - DNA, 20 bp, Artificial
  CRISPR gRNA sequence
ggggcagcacagggccccct

SEQ ID NO: 745988 - DNA, 20 bp, Artificial
  CRISPR gRNA sequence
gggcagcacagggccccctt

SEQ ID NO: 745989 - DNA, 20 bp, Artificial
  CRISPR gRNA sequence
ggcagcacagggcccccttg

SEQ ID NO: 745990 - DNA, 20 bp, Artificial
  CRISPR gRNA sequence
agcacagggcccccttgggg

SEQ ID NO: 745991 - DNA, 20 bp, Artificial
  CRISPR gRNA sequence
gcacagggcccccttggggc

SEQ ID NO: 745992 - DNA, 20 bp, Artificial
  CRISPR gRNA sequence
gggcaggttttgtttcttcc

SEQ ID NO: 745993 - DNA, 20 bp, Artificial
  CRISPR gRNA sequence
ggcaggttttgtttcttcct

SEQ ID NO: 745994 - DNA, 20 bp, Artificial
  CRISPR gRNA sequence
caggttttgtttcttcctgg

SEQ ID NO: 745995 - DNA, 20 bp, Artificial
  CRISPR gRNA sequence
tgtttcttcctgggagtacg

SEQ ID NO: 745996 - DNA, 20 bp, Artificial
  CRISPR gRNA sequence
gtttcttcctgggagtacgt

SEQ ID NO: 745997 - DNA, 20 bp, Artificial
  CRISPR gRNA sequence
ttcttcctgggagtacgtgg

SEQ ID NO: 745998 - DNA, 20 bp, Artificial
  CRISPR gRNA sequence
cttcctgggagtacgtggga

SEQ ID NO: 745999 - DNA, 20 bp, Artificial
  CRISPR gRNA sequence
acgtgggagagccctttccc

SEQ ID NO: 746000 - DNA, 20 bp, Artificial
  CRISPR gRNA sequence
cgtgggagagccctttccct

SEQ ID NO: 746001 - DNA, 20 bp, Artificial
  CRISPR gRNA sequence
tcctcctcacttctgtttcc

SEQ ID NO: 746002 - DNA, 20 bp, Artificial
  CRISPR gRNA sequence
tcctcacttctgtttcccgg

SEQ ID NO: 746003 - DNA, 20 bp, Artificial
  CRISPR gRNA sequence
ctcacttctgtttcccggca

SEQ ID NO: 746004 - DNA, 20 bp, Artificial
  CRISPR gRNA sequence
tctgtttcccggcagagcca

SEQ ID NO: 746005 - DNA, 20 bp, Artificial
  CRISPR gRNA sequence
ccggcagagccatagttttg

SEQ ID NO: 746006 - DNA, 20 bp, Artificial
  CRISPR gRNA sequence
gcagctacacccaccccact

SEQ ID NO: 746007 - DNA, 20 bp, Artificial
  CRISPR gRNA sequence
cagctacacccaccccactc

SEQ ID NO: 746008 - DNA, 20 bp, Artificial
  CRISPR gRNA sequence
acccaccccactcaggtgtg

SEQ ID NO: 746009 - DNA, 20 bp, Artificial
  CRISPR gRNA sequence
cccaccccactcaggtgtga

SEQ ID NO: 746010 - DNA, 20 bp, Artificial
  CRISPR gRNA sequence
ccaccccactcaggtgtgaa

SEQ ID NO: 746011 - DNA, 20 bp, Artificial
  CRISPR gRNA sequence
caccccactcaggtgtgaag

SEQ ID NO: 746012 - DNA, 20 bp, Artificial
  CRISPR gRNA sequence
cccactcaggtgtgaagggg

SEQ ID NO: 746013 - DNA, 20 bp, Artificial
  CRISPR gRNA sequence
tcaggtgtgaaggggaagtc

SEQ ID NO: 746014 - DNA, 20 bp, Artificial
  CRISPR gRNA sequence
caggtgtgaaggggaagtcc

SEQ ID NO: 746015 - DNA, 20 bp, Artificial
  CRISPR gRNA sequence
tgtgaaggggaagtccaggc

SEQ ID NO: 746016 - DNA, 20 bp, Artificial
  CRISPR gRNA sequence
aggggaagtccaggccagca

SEQ ID NO: 746017 - DNA, 20 bp, Artificial
  CRISPR gRNA sequence
caggccagcacggacaaaac

SEQ ID NO: 746018 - DNA, 20 bp, Artificial
  CRISPR gRNA sequence
aggccagcacggacaaaacc

SEQ ID NO: 746019 - DNA, 20 bp, Artificial
  CRISPR gRNA sequence
ggccagcacggacaaaacca

SEQ ID NO: 746020 - DNA, 20 bp, Artificial
  CRISPR gRNA sequence
gccagcacggacaaaaccag

SEQ ID NO: 746021 - DNA, 20 bp, Artificial
  CRISPR gRNA sequence
cacggacaaaaccaggggca

SEQ ID NO: 746022 - DNA, 20 bp, Artificial
  CRISPR gRNA sequence
acaaaaccaggggcacagcc

SEQ ID NO: 746023 - DNA, 20 bp, Artificial
  CRISPR gRNA sequence
aggggcacagccaagcttcc

SEQ ID NO: 746024 - DNA, 20 bp, Artificial
  CRISPR gRNA sequence
ggggcacagccaagcttcct

SEQ ID NO: 746025 - DNA, 20 bp, Artificial
  CRISPR gRNA sequence
gggcacagccaagcttcctg

SEQ ID NO: 746026 - DNA, 20 bp, Artificial
  CRISPR gRNA sequence
cctggggctccttttccact

SEQ ID NO: 746027 - DNA, 20 bp, Artificial
  CRISPR gRNA sequence
cttttccactgagcctgctg

SEQ ID NO: 746028 - DNA, 20 bp, Artificial
  CRISPR gRNA sequence
ttttccactgagcctgctgc

SEQ ID NO: 746029 - DNA, 20 bp, Artificial
  CRISPR gRNA sequence
tttccactgagcctgctgca

SEQ ID NO: 746030 - DNA, 20 bp, Artificial
  CRISPR gRNA sequence
ttccactgagcctgctgcag

SEQ ID NO: 746031 - DNA, 20 bp, Artificial
  CRISPR gRNA sequence
actgagcctgctgcaggggt

SEQ ID NO: 746032 - DNA, 20 bp, Artificial
  CRISPR gRNA sequence
ctgagcctgctgcaggggta

SEQ ID NO: 746033 - DNA, 20 bp, Artificial
  CRISPR gRNA sequence
tgagcctgctgcaggggtaa

SEQ ID NO: 746034 - DNA, 20 bp, Artificial
  CRISPR gRNA sequence
gcctgctgcaggggtaaggg

SEQ ID NO: 746035 - DNA, 20 bp, Artificial
  CRISPR gRNA sequence
tgctgcaggggtaagggcag

SEQ ID NO: 746036 - DNA, 20 bp, Artificial
  CRISPR gRNA sequence
gctgcaggggtaagggcagt

SEQ ID NO: 746037 - DNA, 20 bp, Artificial
  CRISPR gRNA sequence
caggggtaagggcagtgggt

SEQ ID NO: 746038 - DNA, 20 bp, Artificial
  CRISPR gRNA sequence
gggtaagggcagtgggttag

SEQ ID NO: 746039 - DNA, 20 bp, Artificial
  CRISPR gRNA sequence
gtaagggcagtgggttagca

SEQ ID NO: 746040 - DNA, 20 bp, Artificial
  CRISPR gRNA sequence
taagggcagtgggttagcag

SEQ ID NO: 746041 - DNA, 20 bp, Artificial
  CRISPR gRNA sequence
agggcagtgggttagcagag

SEQ ID NO: 746042 - DNA, 20 bp, Artificial
  CRISPR gRNA sequence
ggcagtgggttagcagagga

SEQ ID NO: 746043 - DNA, 20 bp, Artificial
  CRISPR gRNA sequence
gtgggttagcagaggagagt

SEQ ID NO: 746044 - DNA, 20 bp, Artificial
  CRISPR gRNA sequence
gttagcagaggagagttggc

SEQ ID NO: 746045 - DNA, 20 bp, Artificial
  CRISPR gRNA sequence
ttggctagtccctgcactgc

SEQ ID NO: 746046 - DNA, 20 bp, Artificial
  CRISPR gRNA sequence
tggctagtccctgcactgcc

SEQ ID NO: 746047 - DNA, 20 bp, Artificial
  CRISPR gRNA sequence
ctgcactgccaggctttccc

SEQ ID NO: 746048 - DNA, 20 bp, Artificial
  CRISPR gRNA sequence
tgcactgccaggctttccct

SEQ ID NO: 746049 - DNA, 20 bp, Artificial
  CRISPR gRNA sequence
gcactgccaggctttccctg

SEQ ID NO: 746050 - DNA, 20 bp, Artificial
  CRISPR gRNA sequence
caggctttccctggggaccc

SEQ ID NO: 746051 - DNA, 20 bp, Artificial
  CRISPR gRNA sequence
aggctttccctggggaccct

SEQ ID NO: 746052 - DNA, 20 bp, Artificial
  CRISPR gRNA sequence
ctttccctggggaccctggg

SEQ ID NO: 746053 - DNA, 20 bp, Artificial
  CRISPR gRNA sequence
ggtggatcatctcctctctt

SEQ ID NO: 746054 - DNA, 20 bp, Artificial
  CRISPR gRNA sequence
catctcctctcttgagtctg

SEQ ID NO: 746055 - DNA, 20 bp, Artificial
  CRISPR gRNA sequence
atctcctctcttgagtctgt

SEQ ID NO: 746056 - DNA, 20 bp, Artificial
  CRISPR gRNA sequence
cctctcttgagtctgtgggt

SEQ ID NO: 746057 - DNA, 20 bp, Artificial
  CRISPR gRNA sequence
gagtctgtgggtcagatttg

SEQ ID NO: 746058 - DNA, 20 bp, Artificial
  CRISPR gRNA sequence
gggtcagatttgtagcataa

SEQ ID NO: 746059 - DNA, 20 bp, Artificial
  CRISPR gRNA sequence
ggtcagatttgtagcataat

SEQ ID NO: 746060 - DNA, 20 bp, Artificial
  CRISPR gRNA sequence
gatttgtagcataatgggtt

SEQ ID NO: 746061 - DNA, 20 bp, Artificial
  CRISPR gRNA sequence
atttgtagcataatgggttt

SEQ ID NO: 746062 - DNA, 20 bp, Artificial
  CRISPR gRNA sequence
tgtagcataatgggtttggg

SEQ ID NO: 746063 - DNA, 20 bp, Artificial
  CRISPR gRNA sequence
agcataatgggtttgggcag

SEQ ID NO: 746064 - DNA, 20 bp, Artificial
  CRISPR gRNA sequence
cataatgggtttgggcagta

SEQ ID NO: 746065 - DNA, 20 bp, Artificial
  CRISPR gRNA sequence
tgggcagtagagtcccatgc

SEQ ID NO: 746066 - DNA, 20 bp, Artificial
  CRISPR gRNA sequence
cagtagagtcccatgccagc

SEQ ID NO: 746067 - DNA, 20 bp, Artificial
  CRISPR gRNA sequence
agtcccatgccagctagccc

SEQ ID NO: 746068 - DNA, 20 bp, Artificial
  CRISPR gRNA sequence
cccatgccagctagcccaag

SEQ ID NO: 746069 - DNA, 20 bp, Artificial
  CRISPR gRNA sequence
atcacaaactcaaatgtcca

SEQ ID NO: 746070 - DNA, 20 bp, Artificial
  CRISPR gRNA sequence
tcacaaactcaaatgtccac

SEQ ID NO: 746071 - DNA, 20 bp, Artificial
  CRISPR gRNA sequence
actcaaatgtccacaggacc

SEQ ID NO: 746072 - DNA, 20 bp, Artificial
  CRISPR gRNA sequence
tccacaggaccaagaaacca

SEQ ID NO: 746073 - DNA, 20 bp, Artificial
  CRISPR gRNA sequence
caggaccaagaaaccacggt

SEQ ID NO: 746074 - DNA, 20 bp, Artificial
  CRISPR gRNA sequence
ggaccaagaaaccacggtga

SEQ ID NO: 746075 - DNA, 20 bp, Artificial
  CRISPR gRNA sequence
accaagaaaccacggtgaga

SEQ ID NO: 746076 - DNA, 20 bp, Artificial
  CRISPR gRNA sequence
gaaaccacggtgagagagtg

SEQ ID NO: 746077 - DNA, 20 bp, Artificial
  CRISPR gRNA sequence
accacggtgagagagtgaag

SEQ ID NO: 746078 - DNA, 20 bp, Artificial
  CRISPR gRNA sequence
ccacggtgagagagtgaagc

SEQ ID NO: 746079 - DNA, 20 bp, Artificial
  CRISPR gRNA sequence
ggtgagagagtgaagcaggc

SEQ ID NO: 746080 - DNA, 20 bp, Artificial
  CRISPR gRNA sequence
gtgagagagtgaagcaggcc

SEQ ID NO: 746081 - DNA, 20 bp, Artificial
  CRISPR gRNA sequence
agagagtgaagcaggccagg

SEQ ID NO: 746082 - DNA, 20 bp, Artificial
  CRISPR gRNA sequence
agcaggccaggtggaattat

SEQ ID NO: 746083 - DNA, 20 bp, Artificial
  CRISPR gRNA sequence
gcaggccaggtggaattatt

SEQ ID NO: 746084 - DNA, 20 bp, Artificial
  CRISPR gRNA sequence
caggccaggtggaattatta

SEQ ID NO: 746085 - DNA, 20 bp, Artificial
  CRISPR gRNA sequence
ggccaggtggaattattagg

SEQ ID NO: 746086 - DNA, 20 bp, Artificial
  CRISPR gRNA sequence
caggtggaattattagggag

SEQ ID NO: 746087 - DNA, 20 bp, Artificial
  CRISPR gRNA sequence
ggaattattagggagtagta

SEQ ID NO: 746088 - DNA, 20 bp, Artificial
  CRISPR gRNA sequence
ttattagggagtagtacgga

SEQ ID NO: 746089 - DNA, 20 bp, Artificial
  CRISPR gRNA sequence
ggagtagtacggacggactc

SEQ ID NO: 746090 - DNA, 20 bp, Artificial
  CRISPR gRNA sequence
acggacggactctggcgaac

SEQ ID NO: 746091 - DNA, 20 bp, Artificial
  CRISPR gRNA sequence
ggacggactctggcgaactg

SEQ ID NO: 746092 - DNA, 20 bp, Artificial
  CRISPR gRNA sequence
actctggcgaactggagtgc

SEQ ID NO: 746093 - DNA, 20 bp, Artificial
  CRISPR gRNA sequence
ggagtgccggtgccccccaa

SEQ ID NO: 746094 - DNA, 20 bp, Artificial
  CRISPR gRNA sequence
gccccccaaaagctgctact

SEQ ID NO: 746095 - DNA, 20 bp, Artificial
  CRISPR gRNA sequence
caaaagctgctactgagccc

SEQ ID NO: 746096 - DNA, 20 bp, Artificial
  CRISPR gRNA sequence
tgctactgagccccagctga

SEQ ID NO: 746097 - DNA, 20 bp, Artificial
  CRISPR gRNA sequence
cccagctgacagttgccctg

SEQ ID NO: 746098 - DNA, 20 bp, Artificial
  CRISPR gRNA sequence
ccagctgacagttgccctgt

SEQ ID NO: 746099 - DNA, 20 bp, Artificial
  CRISPR gRNA sequence
ctgacagttgccctgtggga

SEQ ID NO: 746100 - DNA, 20 bp, Artificial
  CRISPR gRNA sequence
cagttgccctgtgggaaagc

SEQ ID NO: 746101 - DNA, 20 bp, Artificial
  CRISPR gRNA sequence
gccctgtgggaaagctggtt

SEQ ID NO: 746102 - DNA, 20 bp, Artificial
  CRISPR gRNA sequence
gcattatcttctgattttct

SEQ ID NO: 746103 - DNA, 20 bp, Artificial
  CRISPR gRNA sequence
cattatcttctgattttcta

SEQ ID NO: 746104 - DNA, 20 bp, Artificial
  CRISPR gRNA sequence
ttatcttctgattttctaag

SEQ ID NO: 746105 - DNA, 20 bp, Artificial
  CRISPR gRNA sequence
atcttctgattttctaagga

SEQ ID NO: 746106 - DNA, 20 bp, Artificial
  CRISPR gRNA sequence
tctgattttctaaggagagc

SEQ ID NO: 746107 - DNA, 20 bp, Artificial
  CRISPR gRNA sequence
gattttctaaggagagctgg

SEQ ID NO: 746108 - DNA, 20 bp, Artificial
  CRISPR gRNA sequence
ttctaaggagagctggaagt

SEQ ID NO: 746109 - DNA, 20 bp, Artificial
  CRISPR gRNA sequence
gaattttcatgtcaaattcc

SEQ ID NO: 746110 - DNA, 20 bp, Artificial
  CRISPR gRNA sequence
tttttaaatgttgccatctc

SEQ ID NO: 746111 - DNA, 20 bp, Artificial
  CRISPR gRNA sequence
gccatctcaagaaaattaaa

SEQ ID NO: 746112 - DNA, 20 bp, Artificial
  CRISPR gRNA sequence
aagaaaattaaaaagatttt

SEQ ID NO: 746113 - DNA, 20 bp, Artificial
  CRISPR gRNA sequence
agaaaattaaaaagattttg

SEQ ID NO: 746114 - DNA, 20 bp, Artificial
  CRISPR gRNA sequence
gatccaatgaaatatgtgtg

SEQ ID NO: 746115 - DNA, 20 bp, Artificial
  CRISPR gRNA sequence
atccaatgaaatatgtgtga

SEQ ID NO: 746116 - DNA, 20 bp, Artificial
  CRISPR gRNA sequence
aatgaaatatgtgtgaaggc

SEQ ID NO: 746117 - DNA, 20 bp, Artificial
  CRISPR gRNA sequence
atatgtgtgaaggctggatg

SEQ ID NO: 746118 - DNA, 20 bp, Artificial
  CRISPR gRNA sequence
tgaaggctggatgtggcctg

SEQ ID NO: 746119 - DNA, 20 bp, Artificial
  CRISPR gRNA sequence
gaaggctggatgtggcctgt

SEQ ID NO: 746120 - DNA, 20 bp, Artificial
  CRISPR gRNA sequence
ggatgtggcctgtgggctcc

SEQ ID NO: 746121 - DNA, 20 bp, Artificial
  CRISPR gRNA sequence
gcctgtgggctcccagtttc

SEQ ID NO: 746122 - DNA, 20 bp, Artificial
  CRISPR gRNA sequence
tttctggccttttttttcat

SEQ ID NO: 746123 - DNA, 20 bp, Artificial
  CRISPR gRNA sequence
ggccttttttttcatcagta

SEQ ID NO: 746124 - DNA, 20 bp, Artificial
  CRISPR gRNA sequence
agtatagtgtctatgtgtct

SEQ ID NO: 746125 - DNA, 20 bp, Artificial
  CRISPR gRNA sequence
tatgtgtctgagtttaattc

SEQ ID NO: 746126 - DNA, 20 bp, Artificial
  CRISPR gRNA sequence
tctgagtttaattctagctc

SEQ ID NO: 746127 - DNA, 20 bp, Artificial
  CRISPR gRNA sequence
cttgcttgctgtgtgatcat

SEQ ID NO: 746128 - DNA, 20 bp, Artificial
  CRISPR gRNA sequence
cttgctgtgtgatcatcagt

SEQ ID NO: 746129 - DNA, 20 bp, Artificial
  CRISPR gRNA sequence
tgatcatcagtgagttacgt

SEQ ID NO: 746130 - DNA, 20 bp, Artificial
  CRISPR gRNA sequence
tacgtaagttctctgtgcct

SEQ ID NO: 746131 - DNA, 20 bp, Artificial
  CRISPR gRNA sequence
ctgtgccttagtttcttcat

SEQ ID NO: 746132 - DNA, 20 bp, Artificial
  CRISPR gRNA sequence
tagtttcttcatcagtgcaa

SEQ ID NO: 746133 - DNA, 20 bp, Artificial
  CRISPR gRNA sequence
agtttcttcatcagtgcaat

SEQ ID NO: 746134 - DNA, 20 bp, Artificial
  CRISPR gRNA sequence
ggaataaaaacaatacctta

SEQ ID NO: 746135 - DNA, 20 bp, Artificial
  CRISPR gRNA sequence
acaataccttatggcattgt

SEQ ID NO: 746136 - DNA, 20 bp, Artificial
  CRISPR gRNA sequence
agatatgcccatgaaaccct

SEQ ID NO: 746137 - DNA, 20 bp, Artificial
  CRISPR gRNA sequence
tgcccatgaaacccttagcg

SEQ ID NO: 746138 - DNA, 20 bp, Artificial
  CRISPR gRNA sequence
catgctgtgtcttcttatta

SEQ ID NO: 746139 - DNA, 20 bp, Artificial
  CRISPR gRNA sequence
cttcttattacggttctgcc

SEQ ID NO: 746140 - DNA, 20 bp, Artificial
  CRISPR gRNA sequence
cctagatcctgcgttacctg

SEQ ID NO: 746141 - DNA, 20 bp, Artificial
  CRISPR gRNA sequence
acctgaagtcccccatgctc

SEQ ID NO: 746142 - DNA, 20 bp, Artificial
  CRISPR gRNA sequence
cctgaagtcccccatgctcc

SEQ ID NO: 746143 - DNA, 20 bp, Artificial
  CRISPR gRNA sequence
tcccccatgctccaggcttt

SEQ ID NO: 746144 - DNA, 20 bp, Artificial
  CRISPR gRNA sequence
ggctttgagatcataccctc

SEQ ID NO: 746145 - DNA, 20 bp, Artificial
  CRISPR gRNA sequence
gatcataccctctggaactt

SEQ ID NO: 746146 - DNA, 20 bp, Artificial
  CRISPR gRNA sequence
cctctggaactttggaactt

SEQ ID NO: 746147 - DNA, 20 bp, Artificial
  CRISPR gRNA sequence
gtccaaccactttccctttc

SEQ ID NO: 746148 - DNA, 20 bp, Artificial
  CRISPR gRNA sequence
tccaaccactttccctttct

SEQ ID NO: 746149 - DNA, 20 bp, Artificial
  CRISPR gRNA sequence
tctctgtgtttctgcctgaa

SEQ ID NO: 746150 - DNA, 20 bp, Artificial
  CRISPR gRNA sequence
ctctgtgtttctgcctgaaa

SEQ ID NO: 746151 - DNA, 20 bp, Artificial
  CRISPR gRNA sequence
ctgtgtttctgcctgaaaag

SEQ ID NO: 746152 - DNA, 20 bp, Artificial
  CRISPR gRNA sequence
aggagacctgtatcttgcca

SEQ ID NO: 746153 - DNA, 20 bp, Artificial
  CRISPR gRNA sequence
agacctgtatcttgccaaag

SEQ ID NO: 746154 - DNA, 20 bp, Artificial
  CRISPR gRNA sequence
tgacaatgactccaaaaatc

SEQ ID NO: 746155 - DNA, 20 bp, Artificial
  CRISPR gRNA sequence
gacaatgactccaaaaatct

SEQ ID NO: 746156 - DNA, 20 bp, Artificial
  CRISPR gRNA sequence
acaatgactccaaaaatctg

SEQ ID NO: 746157 - DNA, 20 bp, Artificial
  CRISPR gRNA sequence
ctccaaaaatctggggctcc

SEQ ID NO: 746158 - DNA, 20 bp, Artificial
  CRISPR gRNA sequence
aaatctggggctcccagact

SEQ ID NO: 746159 - DNA, 20 bp, Artificial
  CRISPR gRNA sequence
tgcctaaaactccactcttg

SEQ ID NO: 746160 - DNA, 20 bp, Artificial
  CRISPR gRNA sequence
actcttgcagacatgccgtt

SEQ ID NO: 746161 - DNA, 20 bp, Artificial
  CRISPR gRNA sequence
ctcttgcagacatgccgttt

SEQ ID NO: 746162 - DNA, 20 bp, Artificial
  CRISPR gRNA sequence
tcttgcagacatgccgtttg

SEQ ID NO: 746163 - DNA, 20 bp, Artificial
  CRISPR gRNA sequence
agacatgccgtttggggctt

SEQ ID NO: 746164 - DNA, 20 bp, Artificial
  CRISPR gRNA sequence
gtttggggctttggtgcctt

SEQ ID NO: 746165 - DNA, 20 bp, Artificial
  CRISPR gRNA sequence
ttggggctttggtgcctttg

SEQ ID NO: 746166 - DNA, 20 bp, Artificial
  CRISPR gRNA sequence
ggagactctcctttaaacac

SEQ ID NO: 746167 - DNA, 20 bp, Artificial
  CRISPR gRNA sequence
tcctttaaacacaagcgccc

SEQ ID NO: 746168 - DNA, 20 bp, Artificial
  CRISPR gRNA sequence
cctttaaacacaagcgcccc

SEQ ID NO: 746169 - DNA, 20 bp, Artificial
  CRISPR gRNA sequence
aaacacaagcgccccaggat

SEQ ID NO: 746170 - DNA, 20 bp, Artificial
  CRISPR gRNA sequence
gcgccccaggatcggatcac

SEQ ID NO: 746171 - DNA, 20 bp, Artificial
  CRISPR gRNA sequence
atcggatcacaagttgttat

SEQ ID NO: 746172 - DNA, 20 bp, Artificial
  CRISPR gRNA sequence
gttatcagtcattcacacct

SEQ ID NO: 746173 - DNA, 20 bp, Artificial
  CRISPR gRNA sequence
atcagtcattcacaccttag

SEQ ID NO: 746174 - DNA, 20 bp, Artificial
  CRISPR gRNA sequence
tcagtcattcacaccttagc

SEQ ID NO: 746175 - DNA, 20 bp, Artificial
  CRISPR gRNA sequence
tcattcacaccttagcagga

SEQ ID NO: 746176 - DNA, 20 bp, Artificial
  CRISPR gRNA sequence
ccttagcaggaaagacttta

SEQ ID NO: 746177 - DNA, 20 bp, Artificial
  CRISPR gRNA sequence
agcaggaaagactttaaagc

SEQ ID NO: 746178 - DNA, 20 bp, Artificial
  CRISPR gRNA sequence
cccactgtgcttctcactcc

SEQ ID NO: 746179 - DNA, 20 bp, Artificial
  CRISPR gRNA sequence
ccactgtgcttctcactcct

SEQ ID NO: 746180 - DNA, 20 bp, Artificial
  CRISPR gRNA sequence
actgtgcttctcactcctag

SEQ ID NO: 746181 - DNA, 20 bp, Artificial
  CRISPR gRNA sequence
ctgtgcttctcactcctagg

SEQ ID NO: 746182 - DNA, 20 bp, Artificial
  CRISPR gRNA sequence
tcttgacttgctgaatgaat

SEQ ID NO: 746183 - DNA, 20 bp, Artificial
  CRISPR gRNA sequence
ttgacttgctgaatgaatta

SEQ ID NO: 746184 - DNA, 20 bp, Artificial
  CRISPR gRNA sequence
gaatgaattagagacctgtc

SEQ ID NO: 746185 - DNA, 20 bp, Artificial
  CRISPR gRNA sequence
tagagacctgtctagctccc

SEQ ID NO: 746186 - DNA, 20 bp, Artificial
  CRISPR gRNA sequence
ctgtctagctcccaagtacc

SEQ ID NO: 746187 - DNA, 20 bp, Artificial
  CRISPR gRNA sequence
ccaagcgccgactactcgca

SEQ ID NO: 746188 - DNA, 20 bp, Artificial
  CRISPR gRNA sequence
gactactcgcatggcactta

SEQ ID NO: 746189 - DNA, 20 bp, Artificial
  CRISPR gRNA sequence
aaccgttgcctcaactctgc

SEQ ID NO: 746190 - DNA, 20 bp, Artificial
  CRISPR gRNA sequence
accgttgcctcaactctgcc

SEQ ID NO: 746191 - DNA, 20 bp, Artificial
  CRISPR gRNA sequence
ccgttgcctcaactctgcca

SEQ ID NO: 746192 - DNA, 20 bp, Artificial
  CRISPR gRNA sequence
gttgcctcaactctgccagg

SEQ ID NO: 746193 - DNA, 20 bp, Artificial
  CRISPR gRNA sequence
cagggagatgttttcatttc

SEQ ID NO: 746194 - DNA, 20 bp, Artificial
  CRISPR gRNA sequence
agggagatgttttcatttct

SEQ ID NO: 746195 - DNA, 20 bp, Artificial
  CRISPR gRNA sequence
tttctgggaaaaacatctgt

SEQ ID NO: 746196 - DNA, 20 bp, Artificial
  CRISPR gRNA sequence
tgggaaaaacatctgtgagt

SEQ ID NO: 746197 - DNA, 20 bp, Artificial
  CRISPR gRNA sequence
gggaaaaacatctgtgagtg

SEQ ID NO: 746198 - DNA, 20 bp, Artificial
  CRISPR gRNA sequence
gaaaaacatctgtgagtgag

SEQ ID NO: 746199 - DNA, 20 bp, Artificial
  CRISPR gRNA sequence
aacatctgtgagtgaggagt

SEQ ID NO: 746200 - DNA, 20 bp, Artificial
  CRISPR gRNA sequence
acatctgtgagtgaggagtc

SEQ ID NO: 746201 - DNA, 20 bp, Artificial
  CRISPR gRNA sequence
catctgtgagtgaggagtcg

SEQ ID NO: 746202 - DNA, 20 bp, Artificial
  CRISPR gRNA sequence
gtgagtgaggagtcggggct

SEQ ID NO: 746203 - DNA, 20 bp, Artificial
  CRISPR gRNA sequence
ggagtcggggctcagcgtct

SEQ ID NO: 746204 - DNA, 20 bp, Artificial
  CRISPR gRNA sequence
gtcggggctcagcgtctaag

SEQ ID NO: 746205 - DNA, 20 bp, Artificial
  CRISPR gRNA sequence
ctcagcgtctaagtggctca

SEQ ID NO: 746206 - DNA, 20 bp, Artificial
  CRISPR gRNA sequence
tctaagtggctcacagctac

SEQ ID NO: 746207 - DNA, 20 bp, Artificial
  CRISPR gRNA sequence
gtggctcacagctactggtc

SEQ ID NO: 746208 - DNA, 20 bp, Artificial
  CRISPR gRNA sequence
tcacagctactggtccagta

SEQ ID NO: 746209 - DNA, 20 bp, Artificial
  CRISPR gRNA sequence
cacagctactggtccagtac

SEQ ID NO: 746210 - DNA, 20 bp, Artificial
  CRISPR gRNA sequence
gctactggtccagtacaggc

SEQ ID NO: 746211 - DNA, 20 bp, Artificial
  CRISPR gRNA sequence
ctggtccagtacaggctggc

SEQ ID NO: 746212 - DNA, 20 bp, Artificial
  CRISPR gRNA sequence
cagtacaggctggccagctc

SEQ ID NO: 746213 - DNA, 20 bp, Artificial
  CRISPR gRNA sequence
tacaggctggccagctccag

SEQ ID NO: 746214 - DNA, 20 bp, Artificial
  CRISPR gRNA sequence
gccagctccagaagccccac

SEQ ID NO: 746215 - DNA, 20 bp, Artificial
  CRISPR gRNA sequence
ccagctccagaagccccacc

SEQ ID NO: 746216 - DNA, 20 bp, Artificial
  CRISPR gRNA sequence
ccaccaggctgcctccctcc

SEQ ID NO: 746217 - DNA, 20 bp, Artificial
  CRISPR gRNA sequence
caggctgcctccctcctggc

SEQ ID NO: 746218 - DNA, 20 bp, Artificial
  CRISPR gRNA sequence
aggctgcctccctcctggct

SEQ ID NO: 746219 - DNA, 20 bp, Artificial
  CRISPR gRNA sequence
tgcctccctcctggctgggc

SEQ ID NO: 746220 - DNA, 20 bp, Artificial
  CRISPR gRNA sequence
gcctccctcctggctgggca

SEQ ID NO: 746221 - DNA, 20 bp, Artificial
  CRISPR gRNA sequence
tcctggctgggcaaggcttt

SEQ ID NO: 746222 - DNA, 20 bp, Artificial
  CRISPR gRNA sequence
ggcaaggctttcagctcttc

SEQ ID NO: 746223 - DNA, 20 bp, Artificial
  CRISPR gRNA sequence
aaggctttcagctcttccag

SEQ ID NO: 746224 - DNA, 20 bp, Artificial
  CRISPR gRNA sequence
aggctttcagctcttccagt

SEQ ID NO: 746225 - DNA, 20 bp, Artificial
  CRISPR gRNA sequence
tcagctcttccagtgggtcc

SEQ ID NO: 746226 - DNA, 20 bp, Artificial
  CRISPR gRNA sequence
gtgggtcccagcctgccgcc

SEQ ID NO: 746227 - DNA, 20 bp, Artificial
  CRISPR gRNA sequence
tgggtcccagcctgccgccg

SEQ ID NO: 746228 - DNA, 20 bp, Artificial
  CRISPR gRNA sequence
gggtcccagcctgccgccga

SEQ ID NO: 746229 - DNA, 20 bp, Artificial
  CRISPR gRNA sequence
cagcctgccgccgagggtcc

SEQ ID NO: 746230 - DNA, 20 bp, Artificial
  CRISPR gRNA sequence
agcctgccgccgagggtcct

SEQ ID NO: 746231 - DNA, 20 bp, Artificial
  CRISPR gRNA sequence
cgccgagggtcctgggctct

SEQ ID NO: 746232 - DNA, 20 bp, Artificial
  CRISPR gRNA sequence
gccgagggtcctgggctcta

SEQ ID NO: 746233 - DNA, 20 bp, Artificial
  CRISPR gRNA sequence
ccgagggtcctgggctctaa

SEQ ID NO: 746234 - DNA, 20 bp, Artificial
  CRISPR gRNA sequence
agggtcctgggctctaaggg

SEQ ID NO: 746235 - DNA, 20 bp, Artificial
  CRISPR gRNA sequence
gggtcctgggctctaagggc

SEQ ID NO: 746236 - DNA, 20 bp, Artificial
  CRISPR gRNA sequence
ggtcctgggctctaagggca

SEQ ID NO: 746237 - DNA, 20 bp, Artificial
  CRISPR gRNA sequence
cctgggctctaagggcaggg

SEQ ID NO: 746238 - DNA, 20 bp, Artificial
  CRISPR gRNA sequence
ctgggctctaagggcaggga

SEQ ID NO: 746239 - DNA, 20 bp, Artificial
  CRISPR gRNA sequence
tgggctctaagggcagggaa

SEQ ID NO: 746240 - DNA, 20 bp, Artificial
  CRISPR gRNA sequence
gggctctaagggcagggaag

SEQ ID NO: 746241 - DNA, 20 bp, Artificial
  CRISPR gRNA sequence
gggcagggaaggggcatctg

SEQ ID NO: 746242 - DNA, 20 bp, Artificial
  CRISPR gRNA sequence
ggcagggaaggggcatctga

SEQ ID NO: 746243 - DNA, 20 bp, Artificial
  CRISPR gRNA sequence
cagggaaggggcatctgaag

SEQ ID NO: 746244 - DNA, 20 bp, Artificial
  CRISPR gRNA sequence
agggaaggggcatctgaagg

SEQ ID NO: 746245 - DNA, 20 bp, Artificial
  CRISPR gRNA sequence
ggggcatctgaaggaggatg

SEQ ID NO: 746246 - DNA, 20 bp, Artificial
  CRISPR gRNA sequence
aggaggatgtggcattatat

SEQ ID NO: 746247 - DNA, 20 bp, Artificial
  CRISPR gRNA sequence
atgtggcattatattggttc

SEQ ID NO: 746248 - DNA, 20 bp, Artificial
  CRISPR gRNA sequence
tgtggcattatattggttct

SEQ ID NO: 746249 - DNA, 20 bp, Artificial
  CRISPR gRNA sequence
ttggttctgggcaatgcccc

SEQ ID NO: 746250 - DNA, 20 bp, Artificial
  CRISPR gRNA sequence
ttctgggcaatgcccctggc

SEQ ID NO: 746251 - DNA, 20 bp, Artificial
  CRISPR gRNA sequence
tctgggcaatgcccctggct

SEQ ID NO: 746252 - DNA, 20 bp, Artificial
  CRISPR gRNA sequence
ctgggcaatgcccctggctg

SEQ ID NO: 746253 - DNA, 20 bp, Artificial
  CRISPR gRNA sequence
cccctggctggggcaatgaa

SEQ ID NO: 746254 - DNA, 20 bp, Artificial
  CRISPR gRNA sequence
ccctggctggggcaatgaaa

SEQ ID NO: 746255 - DNA, 20 bp, Artificial
  CRISPR gRNA sequence
gggcaatgaaaaggatgtat

SEQ ID NO: 746256 - DNA, 20 bp, Artificial
  CRISPR gRNA sequence
atgaaaaggatgtatcagtt

SEQ ID NO: 746257 - DNA, 20 bp, Artificial
  CRISPR gRNA sequence
atcagtttggattctgtaca

SEQ ID NO: 746258 - DNA, 20 bp, Artificial
  CRISPR gRNA sequence
aaccctccttccctctctgc

SEQ ID NO: 746259 - DNA, 20 bp, Artificial
  CRISPR gRNA sequence
cctctctgctagacccacaa

SEQ ID NO: 746260 - DNA, 20 bp, Artificial
  CRISPR gRNA sequence
atttaaaataaaaataccac

SEQ ID NO: 746261 - DNA, 20 bp, Artificial
  CRISPR gRNA sequence
aaaataaaaataccactggc

SEQ ID NO: 746262 - DNA, 20 bp, Artificial
  CRISPR gRNA sequence
aaataaaaataccactggcc

SEQ ID NO: 746263 - DNA, 20 bp, Artificial
  CRISPR gRNA sequence
aaaataccactggccgggcg

SEQ ID NO: 746264 - DNA, 20 bp, Artificial
  CRISPR gRNA sequence
ataccactggccgggcgtag

SEQ ID NO: 746265 - DNA, 20 bp, Artificial
  CRISPR gRNA sequence
taccactggccgggcgtagt

SEQ ID NO: 746266 - DNA, 20 bp, Artificial
  CRISPR gRNA sequence
tgggtcacacttgtaatccc

SEQ ID NO: 746267 - DNA, 20 bp, Artificial
  CRISPR gRNA sequence
acttgtaatcccaagacttt

SEQ ID NO: 746268 - DNA, 20 bp, Artificial
  CRISPR gRNA sequence
ttgtaatcccaagactttga

SEQ ID NO: 746269 - DNA, 20 bp, Artificial
  CRISPR gRNA sequence
tgtaatcccaagactttgag

SEQ ID NO: 746270 - DNA, 20 bp, Artificial
  CRISPR gRNA sequence
tcccaagactttgagaggcc

SEQ ID NO: 746271 - DNA, 20 bp, Artificial
  CRISPR gRNA sequence
cccaagactttgagaggcca

SEQ ID NO: 746272 - DNA, 20 bp, Artificial
  CRISPR gRNA sequence
aagactttgagaggccaagg

SEQ ID NO: 746273 - DNA, 20 bp, Artificial
  CRISPR gRNA sequence
agactttgagaggccaaggc

SEQ ID NO: 746274 - DNA, 20 bp, Artificial
  CRISPR gRNA sequence
actttgagaggccaaggcag

SEQ ID NO: 746275 - DNA, 20 bp, Artificial
  CRISPR gRNA sequence
caaggcaggagaattgcttg

SEQ ID NO: 746276 - DNA, 20 bp, Artificial
  CRISPR gRNA sequence
gcaggagaattgcttgaagc

SEQ ID NO: 746277 - DNA, 20 bp, Artificial
  CRISPR gRNA sequence
caggagaattgcttgaagcc

SEQ ID NO: 746278 - DNA, 20 bp, Artificial
  CRISPR gRNA sequence
ggagaattgcttgaagccag

SEQ ID NO: 746279 - DNA, 20 bp, Artificial
  CRISPR gRNA sequence
ttgcttgaagccaggagttc

SEQ ID NO: 746280 - DNA, 20 bp, Artificial
  CRISPR gRNA sequence
tgcttgaagccaggagttca

SEQ ID NO: 746281 - DNA, 20 bp, Artificial
  CRISPR gRNA sequence
tgaagccaggagttcaaggt

SEQ ID NO: 746282 - DNA, 20 bp, Artificial
  CRISPR gRNA sequence
ccaggagttcaaggtcagcc

SEQ ID NO: 746283 - DNA, 20 bp, Artificial
  CRISPR gRNA sequence
caggagttcaaggtcagcct

SEQ ID NO: 746284 - DNA, 20 bp, Artificial
  CRISPR gRNA sequence
ttcaaggtcagcctgggcaa

SEQ ID NO: 746285 - DNA, 20 bp, Artificial
  CRISPR gRNA sequence
caaggtcagcctgggcaaca

SEQ ID NO: 746286 - DNA, 20 bp, Artificial
  CRISPR gRNA sequence
aaggtcagcctgggcaacag

SEQ ID NO: 746287 - DNA, 20 bp, Artificial
  CRISPR gRNA sequence
aggtcagcctgggcaacaga

SEQ ID NO: 746288 - DNA, 20 bp, Artificial
  CRISPR gRNA sequence
gtcagcctgggcaacagagg

SEQ ID NO: 746289 - DNA, 20 bp, Artificial
  CRISPR gRNA sequence
acaccaacgcataataatta

SEQ ID NO: 746290 - DNA, 20 bp, Artificial
  CRISPR gRNA sequence
taataattatagctatccct

SEQ ID NO: 746291 - DNA, 20 bp, Artificial
  CRISPR gRNA sequence
agctatccctcagatgtctg

SEQ ID NO: 746292 - DNA, 20 bp, Artificial
  CRISPR gRNA sequence
ctatccctcagatgtctgca

SEQ ID NO: 746293 - DNA, 20 bp, Artificial
  CRISPR gRNA sequence
tatccctcagatgtctgcag

SEQ ID NO: 746294 - DNA, 20 bp, Artificial
  CRISPR gRNA sequence
atccctcagatgtctgcaga

SEQ ID NO: 746295 - DNA, 20 bp, Artificial
  CRISPR gRNA sequence
cagatgtctgcagagggcat

SEQ ID NO: 746296 - DNA, 20 bp, Artificial
  CRISPR gRNA sequence
gatgtctgcagagggcatta

SEQ ID NO: 746297 - DNA, 20 bp, Artificial
  CRISPR gRNA sequence
gttctcatctttccctcatc

SEQ ID NO: 746298 - DNA, 20 bp, Artificial
  CRISPR gRNA sequence
ccttttgcaaccctgcattg

SEQ ID NO: 746299 - DNA, 20 bp, Artificial
  CRISPR gRNA sequence
caaccctgcattgtagccaa

SEQ ID NO: 746300 - DNA, 20 bp, Artificial
  CRISPR gRNA sequence
ccaatagttttctcactgca

SEQ ID NO: 746301 - DNA, 20 bp, Artificial
  CRISPR gRNA sequence
aatagttttctcactgcaca

SEQ ID NO: 746302 - DNA, 20 bp, Artificial
  CRISPR gRNA sequence
atagttttctcactgcacag

SEQ ID NO: 746303 - DNA, 20 bp, Artificial
  CRISPR gRNA sequence
agttttctcactgcacagag

SEQ ID NO: 746304 - DNA, 20 bp, Artificial
  CRISPR gRNA sequence
gttttctcactgcacagagg

SEQ ID NO: 746305 - DNA, 20 bp, Artificial
  CRISPR gRNA sequence
actgcacagaggaggaaact

SEQ ID NO: 746306 - DNA, 20 bp, Artificial
  CRISPR gRNA sequence
ctgcacagaggaggaaactg

SEQ ID NO: 746307 - DNA, 20 bp, Artificial
  CRISPR gRNA sequence
ggaggaaactgaggctcata

SEQ ID NO: 746308 - DNA, 20 bp, Artificial
  CRISPR gRNA sequence
gaaactgaggctcatacagt

SEQ ID NO: 746309 - DNA, 20 bp, Artificial
  CRISPR gRNA sequence
ctgaggctcatacagttaga

SEQ ID NO: 746310 - DNA, 20 bp, Artificial
  CRISPR gRNA sequence
catacagttagatagaaacg

SEQ ID NO: 746311 - DNA, 20 bp, Artificial
  CRISPR gRNA sequence
atccaatattctgttttcaa

SEQ ID NO: 746312 - DNA, 20 bp, Artificial
  CRISPR gRNA sequence
attctgttttcaaaagctca

SEQ ID NO: 746313 - DNA, 20 bp, Artificial
  CRISPR gRNA sequence
tttcaaaagctcatggtttt

SEQ ID NO: 746314 - DNA, 20 bp, Artificial
  CRISPR gRNA sequence
ttcaaaagctcatggttttg

SEQ ID NO: 746315 - DNA, 20 bp, Artificial
  CRISPR gRNA sequence
tcaaaagctcatggttttga

SEQ ID NO: 746316 - DNA, 20 bp, Artificial
  CRISPR gRNA sequence
gggtcaacccaattaaatgc

SEQ ID NO: 746317 - DNA, 20 bp, Artificial
  CRISPR gRNA sequence
gtcaacccaattaaatgctg

SEQ ID NO: 746318 - DNA, 20 bp, Artificial
  CRISPR gRNA sequence
tcaacccaattaaatgctgg

SEQ ID NO: 746319 - DNA, 20 bp, Artificial
  CRISPR gRNA sequence
ccaattaaatgctggaggat

SEQ ID NO: 746320 - DNA, 20 bp, Artificial
  CRISPR gRNA sequence
caattaaatgctggaggatt

SEQ ID NO: 746321 - DNA, 20 bp, Artificial
  CRISPR gRNA sequence
aaatgctggaggattgggat

SEQ ID NO: 746322 - DNA, 20 bp, Artificial
  CRISPR gRNA sequence
aatgctggaggattgggata

SEQ ID NO: 746323 - DNA, 20 bp, Artificial
  CRISPR gRNA sequence
tggaggattgggataaggca

SEQ ID NO: 746324 - DNA, 20 bp, Artificial
  CRISPR gRNA sequence
aggattgggataaggcaaag

SEQ ID NO: 746325 - DNA, 20 bp, Artificial
  CRISPR gRNA sequence
tgggataaggcaaagtggac

SEQ ID NO: 746326 - DNA, 20 bp, Artificial
  CRISPR gRNA sequence
gggataaggcaaagtggacc

SEQ ID NO: 746327 - DNA, 20 bp, Artificial
  CRISPR gRNA sequence
ggataaggcaaagtggacca

SEQ ID NO: 746328 - DNA, 20 bp, Artificial
  CRISPR gRNA sequence
agggaattgcttcatttgct

SEQ ID NO: 746329 - DNA, 20 bp, Artificial
  CRISPR gRNA sequence
gcttggtgaaaaaaaccaaa

SEQ ID NO: 746330 - DNA, 20 bp, Artificial
  CRISPR gRNA sequence
tgaaaaaaaccaaacagaac

SEQ ID NO: 746331 - DNA, 20 bp, Artificial
  CRISPR gRNA sequence
aaaaaccaaacagaactaga

SEQ ID NO: 746332 - DNA, 20 bp, Artificial
  CRISPR gRNA sequence
acagaactagacagttttct

SEQ ID NO: 746333 - DNA, 20 bp, Artificial
  CRISPR gRNA sequence
actagacagttttctaagtt

SEQ ID NO: 746334 - DNA, 20 bp, Artificial
  CRISPR gRNA sequence
gacagttttctaagtttggc

SEQ ID NO: 746335 - DNA, 20 bp, Artificial
  CRISPR gRNA sequence
agttttctaagtttggctgg

SEQ ID NO: 746336 - DNA, 20 bp, Artificial
  CRISPR gRNA sequence
gttttctaagtttggctgga

SEQ ID NO: 746337 - DNA, 20 bp, Artificial
  CRISPR gRNA sequence
tttggctggaaggacgtgca

SEQ ID NO: 746338 - DNA, 20 bp, Artificial
  CRISPR gRNA sequence
ctggaaggacgtgcatggat

SEQ ID NO: 746339 - DNA, 20 bp, Artificial
  CRISPR gRNA sequence
ctttcatatactctctgtcc

SEQ ID NO: 746340 - DNA, 20 bp, Artificial
  CRISPR gRNA sequence
tactctctgtcccggtccct

SEQ ID NO: 746341 - DNA, 20 bp, Artificial
  CRISPR gRNA sequence
tgtcccggtccctcagacac

SEQ ID NO: 746342 - DNA, 20 bp, Artificial
  CRISPR gRNA sequence
gtcccggtccctcagacact

SEQ ID NO: 746343 - DNA, 20 bp, Artificial
  CRISPR gRNA sequence
cattttcacactatcttgcc

SEQ ID NO: 746344 - DNA, 20 bp, Artificial
  CRISPR gRNA sequence
attttcacactatcttgcct

SEQ ID NO: 746345 - DNA, 20 bp, Artificial
  CRISPR gRNA sequence
gcctaggacaccctttctac

SEQ ID NO: 746346 - DNA, 20 bp, Artificial
  CRISPR gRNA sequence
tgaaatcctatctatgcacc

SEQ ID NO: 746347 - DNA, 20 bp, Artificial
  CRISPR gRNA sequence
ctatctatgcaccaagtcca

SEQ ID NO: 746348 - DNA, 20 bp, Artificial
  CRISPR gRNA sequence
tccaaagactctccctcctt

SEQ ID NO: 746349 - DNA, 20 bp, Artificial
  CRISPR gRNA sequence
ccaaagactctccctccttc

SEQ ID NO: 746350 - DNA, 20 bp, Artificial
  CRISPR gRNA sequence
aagactctccctccttcagg

SEQ ID NO: 746351 - DNA, 20 bp, Artificial
  CRISPR gRNA sequence
aggaagtccctgactgtccc

SEQ ID NO: 746352 - DNA, 20 bp, Artificial
  CRISPR gRNA sequence
aagtccctgactgtccccag

SEQ ID NO: 746353 - DNA, 20 bp, Artificial
  CRISPR gRNA sequence
agtccctgactgtccccaga

SEQ ID NO: 746354 - DNA, 20 bp, Artificial
  CRISPR gRNA sequence
ggctgtttcctccctcctcc

SEQ ID NO: 746355 - DNA, 20 bp, Artificial
  CRISPR gRNA sequence
ctccctcctccaagtgccct

SEQ ID NO: 746356 - DNA, 20 bp, Artificial
  CRISPR gRNA sequence
tccctcctccaagtgccctg

SEQ ID NO: 746357 - DNA, 20 bp, Artificial
  CRISPR gRNA sequence
ccctcctccaagtgccctga

SEQ ID NO: 746358 - DNA, 20 bp, Artificial
  CRISPR gRNA sequence
cctccaagtgccctgagggc

SEQ ID NO: 746359 - DNA, 20 bp, Artificial
  CRISPR gRNA sequence
agtgccctgagggctggcat

SEQ ID NO: 746360 - DNA, 20 bp, Artificial
  CRISPR gRNA sequence
gcattggattgcctttgcca

SEQ ID NO: 746361 - DNA, 20 bp, Artificial
  CRISPR gRNA sequence
cattggattgcctttgccat

SEQ ID NO: 746362 - DNA, 20 bp, Artificial
  CRISPR gRNA sequence
attggattgcctttgccatg

SEQ ID NO: 746363 - DNA, 20 bp, Artificial
  CRISPR gRNA sequence
ttgccatggggttctgctgt

SEQ ID NO: 746364 - DNA, 20 bp, Artificial
  CRISPR gRNA sequence
tgccatggggttctgctgtc

SEQ ID NO: 746365 - DNA, 20 bp, Artificial
  CRISPR gRNA sequence
gggttctgctgtcgggaatg

SEQ ID NO: 746366 - DNA, 20 bp, Artificial
  CRISPR gRNA sequence
ggttctgctgtcgggaatgc

SEQ ID NO: 746367 - DNA, 20 bp, Artificial
  CRISPR gRNA sequence
aatgcaggcctcgtctgctc

SEQ ID NO: 746368 - DNA, 20 bp, Artificial
  CRISPR gRNA sequence
atgcaggcctcgtctgctca

SEQ ID NO: 746369 - DNA, 20 bp, Artificial
  CRISPR gRNA sequence
tgcaggcctcgtctgctcaa

SEQ ID NO: 746370 - DNA, 20 bp, Artificial
  CRISPR gRNA sequence
gcaggcctcgtctgctcaag

SEQ ID NO: 746371 - DNA, 20 bp, Artificial
  CRISPR gRNA sequence
aggcctcgtctgctcaaggg

SEQ ID NO: 746372 - DNA, 20 bp, Artificial
  CRISPR gRNA sequence
ggcctcgtctgctcaagggg

SEQ ID NO: 746373 - DNA, 20 bp, Artificial
  CRISPR gRNA sequence
tcaaggggaggccatgcatt

SEQ ID NO: 746374 - DNA, 20 bp, Artificial
  CRISPR gRNA sequence
gaggccatgcattcagcatg

SEQ ID NO: 746375 - DNA, 20 bp, Artificial
  CRISPR gRNA sequence
aggccatgcattcagcatgc

SEQ ID NO: 746376 - DNA, 20 bp, Artificial
  CRISPR gRNA sequence
catgcattcagcatgcaggt

SEQ ID NO: 746377 - DNA, 20 bp, Artificial
  CRISPR gRNA sequence
ttcagcatgcaggtgagatg

SEQ ID NO: 746378 - DNA, 20 bp, Artificial
  CRISPR gRNA sequence
tgcaggtgagatgcagcacc

SEQ ID NO: 746379 - DNA, 20 bp, Artificial
  CRISPR gRNA sequence
gtgagatgcagcacctggcc

SEQ ID NO: 746380 - DNA, 20 bp, Artificial
  CRISPR gRNA sequence
tgagatgcagcacctggccc

SEQ ID NO: 746381 - DNA, 20 bp, Artificial
  CRISPR gRNA sequence
tggcccaggccttgcacacg

SEQ ID NO: 746382 - DNA, 20 bp, Artificial
  CRISPR gRNA sequence
ggcccaggccttgcacacgc

SEQ ID NO: 746383 - DNA, 20 bp, Artificial
  CRISPR gRNA sequence
tgcacacgcaggtgctctct

SEQ ID NO: 746384 - DNA, 20 bp, Artificial
  CRISPR gRNA sequence
ggtgctctcttagtgctccc

SEQ ID NO: 746385 - DNA, 20 bp, Artificial
  CRISPR gRNA sequence
ctctcttagtgctccctggc

SEQ ID NO: 746386 - DNA, 20 bp, Artificial
  CRISPR gRNA sequence
tctcttagtgctccctggca

SEQ ID NO: 746387 - DNA, 20 bp, Artificial
  CRISPR gRNA sequence
ttagtgctccctggcaagga

SEQ ID NO: 746388 - DNA, 20 bp, Artificial
  CRISPR gRNA sequence
tagtgctccctggcaaggat

SEQ ID NO: 746389 - DNA, 20 bp, Artificial
  CRISPR gRNA sequence
tgctccctggcaaggatggg

SEQ ID NO: 746390 - DNA, 20 bp, Artificial
  CRISPR gRNA sequence
gctccctggcaaggatggga

SEQ ID NO: 746391 - DNA, 20 bp, Artificial
  CRISPR gRNA sequence
caaggatgggaaggcatgtt

SEQ ID NO: 746392 - DNA, 20 bp, Artificial
  CRISPR gRNA sequence
tgggaaggcatgttcagtcc

SEQ ID NO: 746393 - DNA, 20 bp, Artificial
  CRISPR gRNA sequence
gggaaggcatgttcagtcct

SEQ ID NO: 746394 - DNA, 20 bp, Artificial
  CRISPR gRNA sequence
gaaggcatgttcagtcctag

SEQ ID NO: 746395 - DNA, 20 bp, Artificial
  CRISPR gRNA sequence
ggcatgttcagtcctaggag

SEQ ID NO: 746396 - DNA, 20 bp, Artificial
  CRISPR gRNA sequence
gcatgttcagtcctaggagt

SEQ ID NO: 746397 - DNA, 20 bp, Artificial
  CRISPR gRNA sequence
tgttcagtcctaggagtagg

SEQ ID NO: 746398 - DNA, 20 bp, Artificial
  CRISPR gRNA sequence
gttcagtcctaggagtagga

SEQ ID NO: 746399 - DNA, 20 bp, Artificial
  CRISPR gRNA sequence
ttcagtcctaggagtaggaa

SEQ ID NO: 746400 - DNA, 20 bp, Artificial
  CRISPR gRNA sequence
tcagtcctaggagtaggaag

SEQ ID NO: 746401 - DNA, 20 bp, Artificial
  CRISPR gRNA sequence
gtcctaggagtaggaagggg

SEQ ID NO: 746402 - DNA, 20 bp, Artificial
  CRISPR gRNA sequence
cctaggagtaggaaggggca

SEQ ID NO: 746403 - DNA, 20 bp, Artificial
  CRISPR gRNA sequence
ctaggagtaggaaggggcag

SEQ ID NO: 746404 - DNA, 20 bp, Artificial
  CRISPR gRNA sequence
ggaaggggcagaggtgttga

SEQ ID NO: 746405 - DNA, 20 bp, Artificial
  CRISPR gRNA sequence
agaggtgttgatggccccta

SEQ ID NO: 746406 - DNA, 20 bp, Artificial
  CRISPR gRNA sequence
aggtgttgatggcccctaca

SEQ ID NO: 746407 - DNA, 20 bp, Artificial
  CRISPR gRNA sequence
tgttgatggcccctacagag

SEQ ID NO: 746408 - DNA, 20 bp, Artificial
  CRISPR gRNA sequence
atggcccctacagagcggcc

SEQ ID NO: 746409 - DNA, 20 bp, Artificial
  CRISPR gRNA sequence
tggcccctacagagcggcca

SEQ ID NO: 746410 - DNA, 20 bp, Artificial
  CRISPR gRNA sequence
cctacagagcggccaaggac

SEQ ID NO: 746411 - DNA, 20 bp, Artificial
  CRISPR gRNA sequence
ctacagagcggccaaggaca

SEQ ID NO: 746412 - DNA, 20 bp, Artificial
  CRISPR gRNA sequence
acagagcggccaaggacaag

SEQ ID NO: 746413 - DNA, 20 bp, Artificial
  CRISPR gRNA sequence
caaggagctgctgttcgaaa

SEQ ID NO: 746414 - DNA, 20 bp, Artificial
  CRISPR gRNA sequence
ccaacctgcctcccacccaa

SEQ ID NO: 746415 - DNA, 20 bp, Artificial
  CRISPR gRNA sequence
caacctgcctcccacccaac

SEQ ID NO: 746416 - DNA, 20 bp, Artificial
  CRISPR gRNA sequence
aggttttgcatatactctac

SEQ ID NO: 746417 - DNA, 20 bp, Artificial
  CRISPR gRNA sequence
ggttttgcatatactctact

SEQ ID NO: 746418 - DNA, 20 bp, Artificial
  CRISPR gRNA sequence
tttgcatatactctactggg

SEQ ID NO: 746419 - DNA, 20 bp, Artificial
  CRISPR gRNA sequence
tgcatatactctactgggaa

SEQ ID NO: 746420 - DNA, 20 bp, Artificial
  CRISPR gRNA sequence
gcatatactctactgggaag

SEQ ID NO: 746421 - DNA, 20 bp, Artificial
  CRISPR gRNA sequence
catatactctactgggaaga

SEQ ID NO: 746422 - DNA, 20 bp, Artificial
  CRISPR gRNA sequence
cgactgcatcactgccctcc

SEQ ID NO: 746423 - DNA, 20 bp, Artificial
  CRISPR gRNA sequence
aagtctctccctgccctgtc

SEQ ID NO: 746424 - DNA, 20 bp, Artificial
  CRISPR gRNA sequence
tccctgccctgtccagcatc

SEQ ID NO: 746425 - DNA, 20 bp, Artificial
  CRISPR gRNA sequence
ccctgccctgtccagcatcc

SEQ ID NO: 746426 - DNA, 20 bp, Artificial
  CRISPR gRNA sequence
ctgccctgtccagcatccag

SEQ ID NO: 746427 - DNA, 20 bp, Artificial
  CRISPR gRNA sequence
ccagcatccaggagcacccc

SEQ ID NO: 746428 - DNA, 20 bp, Artificial
  CRISPR gRNA sequence
catccaggagcacccctagt

SEQ ID NO: 746429 - DNA, 20 bp, Artificial
  CRISPR gRNA sequence
atccaggagcacccctagtt

SEQ ID NO: 746430 - DNA, 20 bp, Artificial
  CRISPR gRNA sequence
tccaggagcacccctagttg

SEQ ID NO: 746431 - DNA, 20 bp, Artificial
  CRISPR gRNA sequence
aggagcacccctagttgggg

SEQ ID NO: 746432 - DNA, 20 bp, Artificial
  CRISPR gRNA sequence
ttctgtgactccccctacaa

SEQ ID NO: 746433 - DNA, 20 bp, Artificial
  CRISPR gRNA sequence
tgactccccctacaacagcc

SEQ ID NO: 746434 - DNA, 20 bp, Artificial
  CRISPR gRNA sequence
gactccccctacaacagcct

SEQ ID NO: 746435 - DNA, 20 bp, Artificial
  CRISPR gRNA sequence
ccccctacaacagcctagga

SEQ ID NO: 746436 - DNA, 20 bp, Artificial
  CRISPR gRNA sequence
ccctacaacagcctaggatg

SEQ ID NO: 746437 - DNA, 20 bp, Artificial
  CRISPR gRNA sequence
tacaacagcctaggatggag

SEQ ID NO: 746438 - DNA, 20 bp, Artificial
  CRISPR gRNA sequence
acaacagcctaggatggagt

SEQ ID NO: 746439 - DNA, 20 bp, Artificial
  CRISPR gRNA sequence
caacagcctaggatggagtg

SEQ ID NO: 746440 - DNA, 20 bp, Artificial
  CRISPR gRNA sequence
gtggggtttgtgaacaaatg

SEQ ID NO: 746441 - DNA, 20 bp, Artificial
  CRISPR gRNA sequence
gggtttgtgaacaaatgcag

SEQ ID NO: 746442 - DNA, 20 bp, Artificial
  CRISPR gRNA sequence
ggtttgtgaacaaatgcaga

SEQ ID NO: 746443 - DNA, 20 bp, Artificial
  CRISPR gRNA sequence
ttgtgaacaaatgcagaagg

SEQ ID NO: 746444 - DNA, 20 bp, Artificial
  CRISPR gRNA sequence
acaaatgcagaaggcagtct

SEQ ID NO: 746445 - DNA, 20 bp, Artificial
  CRISPR gRNA sequence
caaatgcagaaggcagtctt

SEQ ID NO: 746446 - DNA, 20 bp, Artificial
  CRISPR gRNA sequence
aaatgcagaaggcagtctta

SEQ ID NO: 746447 - DNA, 20 bp, Artificial
  CRISPR gRNA sequence
atgcagaaggcagtcttagg

SEQ ID NO: 746448 - DNA, 20 bp, Artificial
  CRISPR gRNA sequence
tgcagaaggcagtcttaggg

SEQ ID NO: 746449 - DNA, 20 bp, Artificial
  CRISPR gRNA sequence
gaaggcagtcttagggaggt

SEQ ID NO: 746450 - DNA, 20 bp, Artificial
  CRISPR gRNA sequence
gaggtcagctgacatgcccc

SEQ ID NO: 746451 - DNA, 20 bp, Artificial
  CRISPR gRNA sequence
gctgacatgcccctggcctg

SEQ ID NO: 746452 - DNA, 20 bp, Artificial
  CRISPR gRNA sequence
acatgcccctggcctgtggc

SEQ ID NO: 746453 - DNA, 20 bp, Artificial
  CRISPR gRNA sequence
catgcccctggcctgtggct

SEQ ID NO: 746454 - DNA, 20 bp, Artificial
  CRISPR gRNA sequence
gcccctggcctgtggctggg

SEQ ID NO: 746455 - DNA, 20 bp, Artificial
  CRISPR gRNA sequence
cctggcctgtggctgggaag

SEQ ID NO: 746456 - DNA, 20 bp, Artificial
  CRISPR gRNA sequence
ggcctgtggctgggaagtag

SEQ ID NO: 746457 - DNA, 20 bp, Artificial
  CRISPR gRNA sequence
cctgtggctgggaagtagca

SEQ ID NO: 746458 - DNA, 20 bp, Artificial
  CRISPR gRNA sequence
ctgtggctgggaagtagcag

SEQ ID NO: 746459 - DNA, 20 bp, Artificial
  CRISPR gRNA sequence
gctgggaagtagcagaggct

SEQ ID NO: 746460 - DNA, 20 bp, Artificial
  CRISPR gRNA sequence
ctgggaagtagcagaggcta

SEQ ID NO: 746461 - DNA, 20 bp, Artificial
  CRISPR gRNA sequence
gctaaggttcttccccgctc

SEQ ID NO: 746462 - DNA, 20 bp, Artificial
  CRISPR gRNA sequence
ctaaggttcttccccgctct

SEQ ID NO: 746463 - DNA, 20 bp, Artificial
  CRISPR gRNA sequence
taaggttcttccccgctctg

SEQ ID NO: 746464 - DNA, 20 bp, Artificial
  CRISPR gRNA sequence
cttccccgctctggggttgc

SEQ ID NO: 746465 - DNA, 20 bp, Artificial
  CRISPR gRNA sequence
ttccccgctctggggttgcc

SEQ ID NO: 746466 - DNA, 20 bp, Artificial
  CRISPR gRNA sequence
ccccgctctggggttgccag

SEQ ID NO: 746467 - DNA, 20 bp, Artificial
  CRISPR gRNA sequence
cgctctggggttgccaggag

SEQ ID NO: 746468 - DNA, 20 bp, Artificial
  CRISPR gRNA sequence
ggggttgccaggagtagcac

SEQ ID NO: 746469 - DNA, 20 bp, Artificial
  CRISPR gRNA sequence
tgccaggagtagcactggat

SEQ ID NO: 746470 - DNA, 20 bp, Artificial
  CRISPR gRNA sequence
aggagtagcactggatcagt

SEQ ID NO: 746471 - DNA, 20 bp, Artificial
  CRISPR gRNA sequence
ggagtagcactggatcagtc

SEQ ID NO: 746472 - DNA, 20 bp, Artificial
  CRISPR gRNA sequence
gcactggatcagtcaggtga

SEQ ID NO: 746473 - DNA, 20 bp, Artificial
  CRISPR gRNA sequence
cactggatcagtcaggtgac

SEQ ID NO: 746474 - DNA, 20 bp, Artificial
  CRISPR gRNA sequence
actggatcagtcaggtgaca

SEQ ID NO: 746475 - DNA, 20 bp, Artificial
  CRISPR gRNA sequence
gacagggctctcctctctct

SEQ ID NO: 746476 - DNA, 20 bp, Artificial
  CRISPR gRNA sequence
agggctctcctctctctgag

SEQ ID NO: 746477 - DNA, 20 bp, Artificial
  CRISPR gRNA sequence
gggctctcctctctctgagc

SEQ ID NO: 746478 - DNA, 20 bp, Artificial
  CRISPR gRNA sequence
ctcctctctctgagcaggtc

SEQ ID NO: 746479 - DNA, 20 bp, Artificial
  CRISPR gRNA sequence
ctctctctgagcaggtccgg

SEQ ID NO: 746480 - DNA, 20 bp, Artificial
  CRISPR gRNA sequence
tctctgagcaggtccggtgg

SEQ ID NO: 746481 - DNA, 20 bp, Artificial
  CRISPR gRNA sequence
caggtccggtggcagccttc

SEQ ID NO: 746482 - DNA, 20 bp, Artificial
  CRISPR gRNA sequence
aggtccggtggcagccttca

SEQ ID NO: 746483 - DNA, 20 bp, Artificial
  CRISPR gRNA sequence
attccctgtatgtctgtccc

SEQ ID NO: 746484 - DNA, 20 bp, Artificial
  CRISPR gRNA sequence
ttccctgtatgtctgtcccg

SEQ ID NO: 746485 - DNA, 20 bp, Artificial
  CRISPR gRNA sequence
tccctgtatgtctgtcccga

SEQ ID NO: 746486 - DNA, 20 bp, Artificial
  CRISPR gRNA sequence
ccctgtatgtctgtcccgag

SEQ ID NO: 746487 - DNA, 20 bp, Artificial
  CRISPR gRNA sequence
tgtatgtctgtcccgagggg

SEQ ID NO: 746488 - DNA, 20 bp, Artificial
  CRISPR gRNA sequence
cagaacgtcaccctcacctg

SEQ ID NO: 746489 - DNA, 20 bp, Artificial
  CRISPR gRNA sequence
agaacgtcaccctcacctgc

SEQ ID NO: 746490 - DNA, 20 bp, Artificial
  CRISPR gRNA sequence
caccctcacctgcaggctct

SEQ ID NO: 746491 - DNA, 20 bp, Artificial
  CRISPR gRNA sequence
accctcacctgcaggctctt

SEQ ID NO: 746492 - DNA, 20 bp, Artificial
  CRISPR gRNA sequence
ctgcaggctcttgggccctg

SEQ ID NO: 746493 - DNA, 20 bp, Artificial
  CRISPR gRNA sequence
gctcttgggccctgtggaca

SEQ ID NO: 746494 - DNA, 20 bp, Artificial
  CRISPR gRNA sequence
ctcttgggccctgtggacaa

SEQ ID NO: 746495 - DNA, 20 bp, Artificial
  CRISPR gRNA sequence
tcttgggccctgtggacaaa

SEQ ID NO: 746496 - DNA, 20 bp, Artificial
  CRISPR gRNA sequence
ggcacgatgtgaccttctac

SEQ ID NO: 746497 - DNA, 20 bp, Artificial
  CRISPR gRNA sequence
atgtgaccttctacaagacg

SEQ ID NO: 746498 - DNA, 20 bp, Artificial
  CRISPR gRNA sequence
ttctacaagacgtggtaccg

SEQ ID NO: 746499 - DNA, 20 bp, Artificial
  CRISPR gRNA sequence
aagacgtggtaccgcagctc

SEQ ID NO: 746500 - DNA, 20 bp, Artificial
  CRISPR gRNA sequence
agacgtggtaccgcagctcg

SEQ ID NO: 746501 - DNA, 20 bp, Artificial
  CRISPR gRNA sequence
gacgtggtaccgcagctcga

SEQ ID NO: 746502 - DNA, 20 bp, Artificial
  CRISPR gRNA sequence
acgtggtaccgcagctcgag

SEQ ID NO: 746503 - DNA, 20 bp, Artificial
  CRISPR gRNA sequence
ggtaccgcagctcgaggggc

SEQ ID NO: 746504 - DNA, 20 bp, Artificial
  CRISPR gRNA sequence
gtaccgcagctcgaggggcg

SEQ ID NO: 746505 - DNA, 20 bp, Artificial
  CRISPR gRNA sequence
gcagctcgaggggcgaggtg

SEQ ID NO: 746506 - DNA, 20 bp, Artificial
  CRISPR gRNA sequence
gggcgaggtgcagacctgct

SEQ ID NO: 746507 - DNA, 20 bp, Artificial
  CRISPR gRNA sequence
gcgaggtgcagacctgctca

SEQ ID NO: 746508 - DNA, 20 bp, Artificial
  CRISPR gRNA sequence
tgcagacctgctcagagcgc

SEQ ID NO: 746509 - DNA, 20 bp, Artificial
  CRISPR gRNA sequence
ccatccgcaacctcacgttc

SEQ ID NO: 746510 - DNA, 20 bp, Artificial
  CRISPR gRNA sequence
catccgcaacctcacgttcc

SEQ ID NO: 746511 - DNA, 20 bp, Artificial
  CRISPR gRNA sequence
caggaccttcacctgcacca

SEQ ID NO: 746512 - DNA, 20 bp, Artificial
  CRISPR gRNA sequence
ggaccttcacctgcaccatg

SEQ ID NO: 746513 - DNA, 20 bp, Artificial
  CRISPR gRNA sequence
gaccttcacctgcaccatgg

SEQ ID NO: 746514 - DNA, 20 bp, Artificial
  CRISPR gRNA sequence
acctgcaccatggaggccac

SEQ ID NO: 746515 - DNA, 20 bp, Artificial
  CRISPR gRNA sequence
cctgcaccatggaggccacc

SEQ ID NO: 746516 - DNA, 20 bp, Artificial
  CRISPR gRNA sequence
ggccaccaggctgccaacac

SEQ ID NO: 746517 - DNA, 20 bp, Artificial
  CRISPR gRNA sequence
tgccaacaccagccacgacc

SEQ ID NO: 746518 - DNA, 20 bp, Artificial
  CRISPR gRNA sequence
acaccagccacgacctggct

SEQ ID NO: 746519 - DNA, 20 bp, Artificial
  CRISPR gRNA sequence
cacgacctggctcagcgcca

SEQ ID NO: 746520 - DNA, 20 bp, Artificial
  CRISPR gRNA sequence
acgacctggctcagcgccac

SEQ ID NO: 746521 - DNA, 20 bp, Artificial
  CRISPR gRNA sequence
cctggctcagcgccacgggc

SEQ ID NO: 746522 - DNA, 20 bp, Artificial
  CRISPR gRNA sequence
tggctcagcgccacgggctg

SEQ ID NO: 746523 - DNA, 20 bp, Artificial
  CRISPR gRNA sequence
tcagcgccacgggctggagt

SEQ ID NO: 746524 - DNA, 20 bp, Artificial
  CRISPR gRNA sequence
gagtcggcctccgaccacca

SEQ ID NO: 746525 - DNA, 20 bp, Artificial
  CRISPR gRNA sequence
catgcgcaacctgaccctgc

SEQ ID NO: 746526 - DNA, 20 bp, Artificial
  CRISPR gRNA sequence
cgcaacctgaccctgctgga

SEQ ID NO: 746527 - DNA, 20 bp, Artificial
  CRISPR gRNA sequence
aacctgaccctgctggatag

SEQ ID NO: 746528 - DNA, 20 bp, Artificial
  CRISPR gRNA sequence
tagcggcctctactgctgcc

SEQ ID NO: 746529 - DNA, 20 bp, Artificial
  CRISPR gRNA sequence
cggcctctactgctgcctgg

SEQ ID NO: 746530 - DNA, 20 bp, Artificial
  CRISPR gRNA sequence
cctctactgctgcctggtgg

SEQ ID NO: 746531 - DNA, 20 bp, Artificial
  CRISPR gRNA sequence
tctactgctgcctggtggtg

SEQ ID NO: 746532 - DNA, 20 bp, Artificial
  CRISPR gRNA sequence
tgctgcctggtggtggagat

SEQ ID NO: 746533 - DNA, 20 bp, Artificial
  CRISPR gRNA sequence
gctgcctggtggtggagatc

SEQ ID NO: 746534 - DNA, 20 bp, Artificial
  CRISPR gRNA sequence
ggagatcaggcaccaccact

SEQ ID NO: 746535 - DNA, 20 bp, Artificial
  CRISPR gRNA sequence
agatcaggcaccaccactcg

SEQ ID NO: 746536 - DNA, 20 bp, Artificial
  CRISPR gRNA sequence
aggcaccaccactcggagca

SEQ ID NO: 746537 - DNA, 20 bp, Artificial
  CRISPR gRNA sequence
ggcaccaccactcggagcac

SEQ ID NO: 746538 - DNA, 20 bp, Artificial
  CRISPR gRNA sequence
gcaccaccactcggagcaca

SEQ ID NO: 746539 - DNA, 20 bp, Artificial
  CRISPR gRNA sequence
cactcggagcacagggtcca

SEQ ID NO: 746540 - DNA, 20 bp, Artificial
  CRISPR gRNA sequence
gcacagggtccatggtgcca

SEQ ID NO: 746541 - DNA, 20 bp, Artificial
  CRISPR gRNA sequence
acagggtccatggtgccatg

SEQ ID NO: 746542 - DNA, 20 bp, Artificial
  CRISPR gRNA sequence
tccatggtgccatggagctg

SEQ ID NO: 746543 - DNA, 20 bp, Artificial
  CRISPR gRNA sequence
ccatggtgccatggagctgc

SEQ ID NO: 746544 - DNA, 20 bp, Artificial
  CRISPR gRNA sequence
gtgccatggagctgcaggtg

SEQ ID NO: 746545 - DNA, 20 bp, Artificial
  CRISPR gRNA sequence
catggagctgcaggtgcaga

SEQ ID NO: 746546 - DNA, 20 bp, Artificial
  CRISPR gRNA sequence
atggagctgcaggtgcagac

SEQ ID NO: 746547 - DNA, 20 bp, Artificial
  CRISPR gRNA sequence
agctgcaggtgcagacaggt

SEQ ID NO: 746548 - DNA, 20 bp, Artificial
  CRISPR gRNA sequence
gctgcaggtgcagacaggtg

SEQ ID NO: 746549 - DNA, 20 bp, Artificial
  CRISPR gRNA sequence
ctgcaggtgcagacaggtga

SEQ ID NO: 746550 - DNA, 20 bp, Artificial
  CRISPR gRNA sequence
tgagggcatcctgcacgtga

SEQ ID NO: 746551 - DNA, 20 bp, Artificial
  CRISPR gRNA sequence
gcatcctgcacgtgacagcc

SEQ ID NO: 746552 - DNA, 20 bp, Artificial
  CRISPR gRNA sequence
acgtgacagcctggcgtgtg

SEQ ID NO: 746553 - DNA, 20 bp, Artificial
  CRISPR gRNA sequence
gtgacagcctggcgtgtgtg

SEQ ID NO: 746554 - DNA, 20 bp, Artificial
  CRISPR gRNA sequence
tgacagcctggcgtgtgtgg

SEQ ID NO: 746555 - DNA, 20 bp, Artificial
  CRISPR gRNA sequence
gacagcctggcgtgtgtgga

SEQ ID NO: 746556 - DNA, 20 bp, Artificial
  CRISPR gRNA sequence
gtggagggctgcctgtctga

SEQ ID NO: 746557 - DNA, 20 bp, Artificial
  CRISPR gRNA sequence
gaccattcatgacactgtgc

SEQ ID NO: 746558 - DNA, 20 bp, Artificial
  CRISPR gRNA sequence
accattcatgacactgtgct

SEQ ID NO: 746559 - DNA, 20 bp, Artificial
  CRISPR gRNA sequence
attcatgacactgtgctggg

SEQ ID NO: 746560 - DNA, 20 bp, Artificial
  CRISPR gRNA sequence
tcatgacactgtgctgggca

SEQ ID NO: 746561 - DNA, 20 bp, Artificial
  CRISPR gRNA sequence
cactgtgctgggcagagtgt

SEQ ID NO: 746562 - DNA, 20 bp, Artificial
  CRISPR gRNA sequence
actgtgctgggcagagtgtg

SEQ ID NO: 746563 - DNA, 20 bp, Artificial
  CRISPR gRNA sequence
gggcagagtgtgaggctgca

SEQ ID NO: 746564 - DNA, 20 bp, Artificial
  CRISPR gRNA sequence
ggcagagtgtgaggctgcat

SEQ ID NO: 746565 - DNA, 20 bp, Artificial
  CRISPR gRNA sequence
tgaggctgcatgggtaacac

SEQ ID NO: 746566 - DNA, 20 bp, Artificial
  CRISPR gRNA sequence
catgggtaacactggcactc

SEQ ID NO: 746567 - DNA, 20 bp, Artificial
  CRISPR gRNA sequence
atgggtaacactggcactcc

SEQ ID NO: 746568 - DNA, 20 bp, Artificial
  CRISPR gRNA sequence
tgggtaacactggcactcca

SEQ ID NO: 746569 - DNA, 20 bp, Artificial
  CRISPR gRNA sequence
ggtaacactggcactccagg

SEQ ID NO: 746570 - DNA, 20 bp, Artificial
  CRISPR gRNA sequence
ctggcactccagggagtgtg

SEQ ID NO: 746571 - DNA, 20 bp, Artificial
  CRISPR gRNA sequence
tggcactccagggagtgtgt

SEQ ID NO: 746572 - DNA, 20 bp, Artificial
  CRISPR gRNA sequence
actccagggagtgtgtgggt

SEQ ID NO: 746573 - DNA, 20 bp, Artificial
  CRISPR gRNA sequence
cagggagtgtgtgggtgaga

SEQ ID NO: 746574 - DNA, 20 bp, Artificial
  CRISPR gRNA sequence
agggagtgtgtgggtgagat

SEQ ID NO: 746575 - DNA, 20 bp, Artificial
  CRISPR gRNA sequence
gggagtgtgtgggtgagatg

SEQ ID NO: 746576 - DNA, 20 bp, Artificial
  CRISPR gRNA sequence
agtgtgtgggtgagatgggg

SEQ ID NO: 746577 - DNA, 20 bp, Artificial
  CRISPR gRNA sequence
gtgggtgagatggggtggtc

SEQ ID NO: 746578 - DNA, 20 bp, Artificial
  CRISPR gRNA sequence
tgggtgagatggggtggtca

SEQ ID NO: 746579 - DNA, 20 bp, Artificial
  CRISPR gRNA sequence
gggtgagatggggtggtcaa

SEQ ID NO: 746580 - DNA, 20 bp, Artificial
  CRISPR gRNA sequence
atggggtggtcaagggtgtg

SEQ ID NO: 746581 - DNA, 20 bp, Artificial
  CRISPR gRNA sequence
ggggtggtcaagggtgtgtg

SEQ ID NO: 746582 - DNA, 20 bp, Artificial
  CRISPR gRNA sequence
ggtcaagggtgtgtggagtg

SEQ ID NO: 746583 - DNA, 20 bp, Artificial
  CRISPR gRNA sequence
gtcaagggtgtgtggagtgt

SEQ ID NO: 746584 - DNA, 20 bp, Artificial
  CRISPR gRNA sequence
gtgtgtggagtgtgggtttg

SEQ ID NO: 746585 - DNA, 20 bp, Artificial
  CRISPR gRNA sequence
gtggagtgtgggtttgtagt

SEQ ID NO: 746586 - DNA, 20 bp, Artificial
  CRISPR gRNA sequence
agtgtgggtttgtagttagc

SEQ ID NO: 746587 - DNA, 20 bp, Artificial
  CRISPR gRNA sequence
tgtgggtttgtagttagctg

SEQ ID NO: 746588 - DNA, 20 bp, Artificial
  CRISPR gRNA sequence
tttgtagttagctggagtga

SEQ ID NO: 746589 - DNA, 20 bp, Artificial
  CRISPR gRNA sequence
tgtagttagctggagtgatg

SEQ ID NO: 746590 - DNA, 20 bp, Artificial
  CRISPR gRNA sequence
tagttagctggagtgatgga

SEQ ID NO: 746591 - DNA, 20 bp, Artificial
  CRISPR gRNA sequence
agttagctggagtgatggag

SEQ ID NO: 746592 - DNA, 20 bp, Artificial
  CRISPR gRNA sequence
gttagctggagtgatggaga

SEQ ID NO: 746593 - DNA, 20 bp, Artificial
  CRISPR gRNA sequence
tagctggagtgatggagagg

SEQ ID NO: 746594 - DNA, 20 bp, Artificial
  CRISPR gRNA sequence
agctggagtgatggagaggg

SEQ ID NO: 746595 - DNA, 20 bp, Artificial
  CRISPR gRNA sequence
gctggagtgatggagaggga

SEQ ID NO: 746596 - DNA, 20 bp, Artificial
  CRISPR gRNA sequence
atggagagggagggtgtacc

SEQ ID NO: 746597 - DNA, 20 bp, Artificial
  CRISPR gRNA sequence
gtacctggctccatttgtga

SEQ ID NO: 746598 - DNA, 20 bp, Artificial
  CRISPR gRNA sequence
ctggctccatttgtgacagt

SEQ ID NO: 746599 - DNA, 20 bp, Artificial
  CRISPR gRNA sequence
agtgagactttttaatgtgt

SEQ ID NO: 746600 - DNA, 20 bp, Artificial
  CRISPR gRNA sequence
gtgagactttttaatgtgtg

SEQ ID NO: 746601 - DNA, 20 bp, Artificial
  CRISPR gRNA sequence
ctttttaatgtgtgaggctg

SEQ ID NO: 746602 - DNA, 20 bp, Artificial
  CRISPR gRNA sequence
tttttaatgtgtgaggctgt

SEQ ID NO: 746603 - DNA, 20 bp, Artificial
  CRISPR gRNA sequence
tgtgtgaggctgtaggtacc

SEQ ID NO: 746604 - DNA, 20 bp, Artificial
  CRISPR gRNA sequence
gtgtgaggctgtaggtacct

SEQ ID NO: 746605 - DNA, 20 bp, Artificial
  CRISPR gRNA sequence
gaggctgtaggtacctgggc

SEQ ID NO: 746606 - DNA, 20 bp, Artificial
  CRISPR gRNA sequence
aggctgtaggtacctgggct

SEQ ID NO: 746607 - DNA, 20 bp, Artificial
  CRISPR gRNA sequence
gctgtaggtacctgggctgg

SEQ ID NO: 746608 - DNA, 20 bp, Artificial
  CRISPR gRNA sequence
gactgctcatgatgacatca

SEQ ID NO: 746609 - DNA, 20 bp, Artificial
  CRISPR gRNA sequence
tgatgacatcatggctgctg

SEQ ID NO: 746610 - DNA, 20 bp, Artificial
  CRISPR gRNA sequence
gatgacatcatggctgctgt

SEQ ID NO: 746611 - DNA, 20 bp, Artificial
  CRISPR gRNA sequence
catcatggctgctgtgggta

SEQ ID NO: 746612 - DNA, 20 bp, Artificial
  CRISPR gRNA sequence
atcatggctgctgtgggtat

SEQ ID NO: 746613 - DNA, 20 bp, Artificial
  CRISPR gRNA sequence
gctgctgtgggtataggcat

SEQ ID NO: 746614 - DNA, 20 bp, Artificial
  CRISPR gRNA sequence
gctgtgggtataggcatcag

SEQ ID NO: 746615 - DNA, 20 bp, Artificial
  CRISPR gRNA sequence
ctgtgggtataggcatcagt

SEQ ID NO: 746616 - DNA, 20 bp, Artificial
  CRISPR gRNA sequence
taggcatcagtgggactgat

SEQ ID NO: 746617 - DNA, 20 bp, Artificial
  CRISPR gRNA sequence
agtgggactgattggtgccc

SEQ ID NO: 746618 - DNA, 20 bp, Artificial
  CRISPR gRNA sequence
gtgggactgattggtgccct

SEQ ID NO: 746619 - DNA, 20 bp, Artificial
  CRISPR gRNA sequence
tgggactgattggtgccctg

SEQ ID NO: 746620 - DNA, 20 bp, Artificial
  CRISPR gRNA sequence
tggtgccctggggcatgact

SEQ ID NO: 746621 - DNA, 20 bp, Artificial
  CRISPR gRNA sequence
tgccctggggcatgactcag

SEQ ID NO: 746622 - DNA, 20 bp, Artificial
  CRISPR gRNA sequence
ctggggcatgactcagtgga

SEQ ID NO: 746623 - DNA, 20 bp, Artificial
  CRISPR gRNA sequence
tgactcagtggatggctgaa

SEQ ID NO: 746624 - DNA, 20 bp, Artificial
  CRISPR gRNA sequence
gtggatggctgaatggctgt

SEQ ID NO: 746625 - DNA, 20 bp, Artificial
  CRISPR gRNA sequence
ggatggctgaatggctgttg

SEQ ID NO: 746626 - DNA, 20 bp, Artificial
  CRISPR gRNA sequence
cgtgtgtgtgtctgtctgtt

SEQ ID NO: 746627 - DNA, 20 bp, Artificial
  CRISPR gRNA sequence
gtgtgtgtgtctgtctgttc

SEQ ID NO: 746628 - DNA, 20 bp, Artificial
  CRISPR gRNA sequence
gtgtgtctgtctgttcaggt

SEQ ID NO: 746629 - DNA, 20 bp, Artificial
  CRISPR gRNA sequence
gtgtctgtctgttcaggtga

SEQ ID NO: 746630 - DNA, 20 bp, Artificial
  CRISPR gRNA sequence
gtctgttcaggtgagagtgc

SEQ ID NO: 746631 - DNA, 20 bp, Artificial
  CRISPR gRNA sequence
tctgttcaggtgagagtgca

SEQ ID NO: 746632 - DNA, 20 bp, Artificial
  CRISPR gRNA sequence
ctgttcaggtgagagtgcaa

SEQ ID NO: 746633 - DNA, 20 bp, Artificial
  CRISPR gRNA sequence
ggtgagagtgcaagggccca

SEQ ID NO: 746634 - DNA, 20 bp, Artificial
  CRISPR gRNA sequence
gagtgcaagggcccatggtt

SEQ ID NO: 746635 - DNA, 20 bp, Artificial
  CRISPR gRNA sequence
gcaagggcccatggttcgga

SEQ ID NO: 746636 - DNA, 20 bp, Artificial
  CRISPR gRNA sequence
aagggcccatggttcggata

SEQ ID NO: 746637 - DNA, 20 bp, Artificial
  CRISPR gRNA sequence
agggcccatggttcggatag

SEQ ID NO: 746638 - DNA, 20 bp, Artificial
  CRISPR gRNA sequence
ccatggttcggatagaggtg

SEQ ID NO: 746639 - DNA, 20 bp, Artificial
  CRISPR gRNA sequence
catggttcggatagaggtgt

SEQ ID NO: 746640 - DNA, 20 bp, Artificial
  CRISPR gRNA sequence
tcggatagaggtgtgggcac

SEQ ID NO: 746641 - DNA, 20 bp, Artificial
  CRISPR gRNA sequence
gatagaggtgtgggcaccag

SEQ ID NO: 746642 - DNA, 20 bp, Artificial
  CRISPR gRNA sequence
atagaggtgtgggcaccagc

SEQ ID NO: 746643 - DNA, 20 bp, Artificial
  CRISPR gRNA sequence
agcgggtattcacatgcccc

SEQ ID NO: 746644 - DNA, 20 bp, Artificial
  CRISPR gRNA sequence
gcgggtattcacatgcccct

SEQ ID NO: 746645 - DNA, 20 bp, Artificial
  CRISPR gRNA sequence
gggtattcacatgcccctgg

SEQ ID NO: 746646 - DNA, 20 bp, Artificial
  CRISPR gRNA sequence
tattcacatgcccctgggag

SEQ ID NO: 746647 - DNA, 20 bp, Artificial
  CRISPR gRNA sequence
ccctgggagtggcatgaaaa

SEQ ID NO: 746648 - DNA, 20 bp, Artificial
  CRISPR gRNA sequence
cctgggagtggcatgaaaat

SEQ ID NO: 746649 - DNA, 20 bp, Artificial
  CRISPR gRNA sequence
gggagtggcatgaaaatggg

SEQ ID NO: 746650 - DNA, 20 bp, Artificial
  CRISPR gRNA sequence
ggagtggcatgaaaatgggc

SEQ ID NO: 746651 - DNA, 20 bp, Artificial
  CRISPR gRNA sequence
gagtggcatgaaaatgggca

SEQ ID NO: 746652 - DNA, 20 bp, Artificial
  CRISPR gRNA sequence
ggcatgaaaatgggcagggt

SEQ ID NO: 746653 - DNA, 20 bp, Artificial
  CRISPR gRNA sequence
tgggcagggtgagaacatgc

SEQ ID NO: 746654 - DNA, 20 bp, Artificial
  CRISPR gRNA sequence
gggcagggtgagaacatgcc

SEQ ID NO: 746655 - DNA, 20 bp, Artificial
  CRISPR gRNA sequence
ggcagggtgagaacatgcca

SEQ ID NO: 746656 - DNA, 20 bp, Artificial
  CRISPR gRNA sequence
agaacatgccagggtgtgtg

SEQ ID NO: 746657 - DNA, 20 bp, Artificial
  CRISPR gRNA sequence
gaacatgccagggtgtgtgt

SEQ ID NO: 746658 - DNA, 20 bp, Artificial
  CRISPR gRNA sequence
tgtgtgggtgcacacgtgtg

SEQ ID NO: 746659 - DNA, 20 bp, Artificial
  CRISPR gRNA sequence
gtgtgggtgcacacgtgtgc

SEQ ID NO: 746660 - DNA, 20 bp, Artificial
  CRISPR gRNA sequence
acacgtgtgcaggctgccac

SEQ ID NO: 746661 - DNA, 20 bp, Artificial
  CRISPR gRNA sequence
cacgtgtgcaggctgccact

SEQ ID NO: 746662 - DNA, 20 bp, Artificial
  CRISPR gRNA sequence
gccactgggccaacactgcc

SEQ ID NO: 746663 - DNA, 20 bp, Artificial
  CRISPR gRNA sequence
actgggccaacactgccgag

SEQ ID NO: 746664 - DNA, 20 bp, Artificial
  CRISPR gRNA sequence
ctgggccaacactgccgagt

SEQ ID NO: 746665 - DNA, 20 bp, Artificial
  CRISPR gRNA sequence
caacactgccgagtaggcac

SEQ ID NO: 746666 - DNA, 20 bp, Artificial
  CRISPR gRNA sequence
tgccgagtaggcactagcgt

SEQ ID NO: 746667 - DNA, 20 bp, Artificial
  CRISPR gRNA sequence
taggcactagcgtgagaacc

SEQ ID NO: 746668 - DNA, 20 bp, Artificial
  CRISPR gRNA sequence
aggcactagcgtgagaacct

SEQ ID NO: 746669 - DNA, 20 bp, Artificial
  CRISPR gRNA sequence
ggcactagcgtgagaacctg

SEQ ID NO: 746670 - DNA, 20 bp, Artificial
  CRISPR gRNA sequence
actagcgtgagaacctgggg

SEQ ID NO: 746671 - DNA, 20 bp, Artificial
  CRISPR gRNA sequence
ctagcgtgagaacctggggc

SEQ ID NO: 746672 - DNA, 20 bp, Artificial
  CRISPR gRNA sequence
agcgtgagaacctggggcag

SEQ ID NO: 746673 - DNA, 20 bp, Artificial
  CRISPR gRNA sequence
gcgtgagaacctggggcagg

SEQ ID NO: 746674 - DNA, 20 bp, Artificial
  CRISPR gRNA sequence
cgtgagaacctggggcagga

SEQ ID NO: 746675 - DNA, 20 bp, Artificial
  CRISPR gRNA sequence
gtgagaacctggggcaggag

SEQ ID NO: 746676 - DNA, 20 bp, Artificial
  CRISPR gRNA sequence
tgagaacctggggcaggagg

SEQ ID NO: 746677 - DNA, 20 bp, Artificial
  CRISPR gRNA sequence
ctggggcaggagggggacac

SEQ ID NO: 746678 - DNA, 20 bp, Artificial
  CRISPR gRNA sequence
gcaggagggggacactggcc

SEQ ID NO: 746679 - DNA, 20 bp, Artificial
  CRISPR gRNA sequence
agggggacactggcctggac

SEQ ID NO: 746680 - DNA, 20 bp, Artificial
  CRISPR gRNA sequence
ctggcctggacaagcctccc

SEQ ID NO: 746681 - DNA, 20 bp, Artificial
  CRISPR gRNA sequence
gacaagcctccctggcctcc

SEQ ID NO: 746682 - DNA, 20 bp, Artificial
  CRISPR gRNA sequence
acaagcctccctggcctcct

SEQ ID NO: 746683 - DNA, 20 bp, Artificial
  CRISPR gRNA sequence
tgggcctgacacccacctaa

SEQ ID NO: 746684 - DNA, 20 bp, Artificial
  CRISPR gRNA sequence
ggcccttctgtttgttccca

SEQ ID NO: 746685 - DNA, 20 bp, Artificial
  CRISPR gRNA sequence
gcccttctgtttgttcccac

SEQ ID NO: 746686 - DNA, 20 bp, Artificial
  CRISPR gRNA sequence
tctgtttgttcccacaggca

SEQ ID NO: 746687 - DNA, 20 bp, Artificial
  CRISPR gRNA sequence
agatgcaccatccaactgtg

SEQ ID NO: 746688 - DNA, 20 bp, Artificial
  CRISPR gRNA sequence
tggtgtacccatcctcctcc

SEQ ID NO: 746689 - DNA, 20 bp, Artificial
  CRISPR gRNA sequence
ggtgtacccatcctcctccc

SEQ ID NO: 746690 - DNA, 20 bp, Artificial
  CRISPR gRNA sequence
tacccatcctcctcccagga

SEQ ID NO: 746691 - DNA, 20 bp, Artificial
  CRISPR gRNA sequence
tcctcctcccaggatagtga

SEQ ID NO: 746692 - DNA, 20 bp, Artificial
  CRISPR gRNA sequence
cctcccaggatagtgaaagt

SEQ ID NO: 746693 - DNA, 20 bp, Artificial
  CRISPR gRNA sequence
ctcccaggatagtgaaagta

SEQ ID NO: 746694 - DNA, 20 bp, Artificial
  CRISPR gRNA sequence
tcccaggatagtgaaagtaa

SEQ ID NO: 746695 - DNA, 20 bp, Artificial
  CRISPR gRNA sequence
gaccaacctcttgccccttt

SEQ ID NO: 746696 - DNA, 20 bp, Artificial
  CRISPR gRNA sequence
accaacctcttgcccctttt

SEQ ID NO: 746697 - DNA, 20 bp, Artificial
  CRISPR gRNA sequence
ttctgtcctcatcctgcacc

SEQ ID NO: 746698 - DNA, 20 bp, Artificial
  CRISPR gRNA sequence
tcctgcacccagaccctgtt

SEQ ID NO: 746699 - DNA, 20 bp, Artificial
  CRISPR gRNA sequence
ccagaccctgtttggaactc

SEQ ID NO: 746700 - DNA, 20 bp, Artificial
  CRISPR gRNA sequence
aactctggcctcatcacccc

SEQ ID NO: 746701 - DNA, 20 bp, Artificial
  CRISPR gRNA sequence
gcctcatcaccccaagccct

SEQ ID NO: 746702 - DNA, 20 bp, Artificial
  CRISPR gRNA sequence
cccaagccctcagaaccccc

SEQ ID NO: 746703 - DNA, 20 bp, Artificial
  CRISPR gRNA sequence
catcccttctgcttcctcct

SEQ ID NO: 746704 - DNA, 20 bp, Artificial
  CRISPR gRNA sequence
ttcctccttggtgcaatccc

SEQ ID NO: 746705 - DNA, 20 bp, Artificial
  CRISPR gRNA sequence
ctccttggtgcaatccccag

SEQ ID NO: 746706 - DNA, 20 bp, Artificial
  CRISPR gRNA sequence
cactctccttccatctgctc

SEQ ID NO: 746707 - DNA, 20 bp, Artificial
  CRISPR gRNA sequence
ctctccttccatctgctctg

SEQ ID NO: 746708 - DNA, 20 bp, Artificial
  CRISPR gRNA sequence
ctctgctcctcttgactctc

SEQ ID NO: 746709 - DNA, 20 bp, Artificial
  CRISPR gRNA sequence
ctgctcctcttgactctctg

SEQ ID NO: 746710 - DNA, 20 bp, Artificial
  CRISPR gRNA sequence
ctcctcttgactctctggag

SEQ ID NO: 746711 - DNA, 20 bp, Artificial
  CRISPR gRNA sequence
tctctggagtggctgtgcct

SEQ ID NO: 746712 - DNA, 20 bp, Artificial
  CRISPR gRNA sequence
ctggagtggctgtgccttgg

SEQ ID NO: 746713 - DNA, 20 bp, Artificial
  CRISPR gRNA sequence
tgtgccttggcagtgacctt

SEQ ID NO: 746714 - DNA, 20 bp, Artificial
  CRISPR gRNA sequence
ccttggcagtgacctttggc

SEQ ID NO: 746715 - DNA, 20 bp, Artificial
  CRISPR gRNA sequence
cttggcagtgacctttggcc

SEQ ID NO: 746716 - DNA, 20 bp, Artificial
  CRISPR gRNA sequence
ttggcagtgacctttggcca

SEQ ID NO: 746717 - DNA, 20 bp, Artificial
  CRISPR gRNA sequence
cagtgacctttggccagggc

SEQ ID NO: 746718 - DNA, 20 bp, Artificial
  CRISPR gRNA sequence
ccagggcaagtgcctcatga

SEQ ID NO: 746719 - DNA, 20 bp, Artificial
  CRISPR gRNA sequence
cagggcaagtgcctcatgac

SEQ ID NO: 746720 - DNA, 20 bp, Artificial
  CRISPR gRNA sequence
aagtgcctcatgacaggtac

SEQ ID NO: 746721 - DNA, 20 bp, Artificial
  CRISPR gRNA sequence
agtgcctcatgacaggtact

SEQ ID NO: 746722 - DNA, 20 bp, Artificial
  CRISPR gRNA sequence
atgacaggtactgggtgccc

SEQ ID NO: 746723 - DNA, 20 bp, Artificial
  CRISPR gRNA sequence
tgacaggtactgggtgcccc

SEQ ID NO: 746724 - DNA, 20 bp, Artificial
  CRISPR gRNA sequence
caggtactgggtgccccagg

SEQ ID NO: 746725 - DNA, 20 bp, Artificial
  CRISPR gRNA sequence
actgggtgccccaggcagct

SEQ ID NO: 746726 - DNA, 20 bp, Artificial
  CRISPR gRNA sequence
ctaagtgccgccctgcccac

SEQ ID NO: 746727 - DNA, 20 bp, Artificial
  CRISPR gRNA sequence
ccctgcccaccagcccccta

SEQ ID NO: 746728 - DNA, 20 bp, Artificial
  CRISPR gRNA sequence
cccaccagccccctatggct

SEQ ID NO: 746729 - DNA, 20 bp, Artificial
  CRISPR gRNA sequence
ccaccagccccctatggctt

SEQ ID NO: 746730 - DNA, 20 bp, Artificial
  CRISPR gRNA sequence
ccagccccctatggcttggg

SEQ ID NO: 746731 - DNA, 20 bp, Artificial
  CRISPR gRNA sequence
cagccccctatggcttggga

SEQ ID NO: 746732 - DNA, 20 bp, Artificial
  CRISPR gRNA sequence
cccctatggcttgggaaggc

SEQ ID NO: 746733 - DNA, 20 bp, Artificial
  CRISPR gRNA sequence
ccctatggcttgggaaggct

SEQ ID NO: 746734 - DNA, 20 bp, Artificial
  CRISPR gRNA sequence
cctatggcttgggaaggctg

SEQ ID NO: 746735 - DNA, 20 bp, Artificial
  CRISPR gRNA sequence
ctatggcttgggaaggctgg

SEQ ID NO: 746736 - DNA, 20 bp, Artificial
  CRISPR gRNA sequence
gggaaggctgggggtcctct

SEQ ID NO: 746737 - DNA, 20 bp, Artificial
  CRISPR gRNA sequence
ggctgggggtcctcttggcc

SEQ ID NO: 746738 - DNA, 20 bp, Artificial
  CRISPR gRNA sequence
ggcctagaattaaactactt

SEQ ID NO: 746739 - DNA, 20 bp, Artificial
  CRISPR gRNA sequence
ttctgtgtttctatgttctt

SEQ ID NO: 746740 - DNA, 20 bp, Artificial
  CRISPR gRNA sequence
tcttcagatgttctctgttg

SEQ ID NO: 746741 - DNA, 20 bp, Artificial
  CRISPR gRNA sequence
cttcagatgttctctgttgc

SEQ ID NO: 746742 - DNA, 20 bp, Artificial
  CRISPR gRNA sequence
ttcagatgttctctgttgca

SEQ ID NO: 746743 - DNA, 20 bp, Artificial
  CRISPR gRNA sequence
tcagatgttctctgttgcag

SEQ ID NO: 746744 - DNA, 20 bp, Artificial
  CRISPR gRNA sequence
agatgttctctgttgcaggg

SEQ ID NO: 746745 - DNA, 20 bp, Artificial
  CRISPR gRNA sequence
gatgttctctgttgcagggg

SEQ ID NO: 746746 - DNA, 20 bp, Artificial
  CRISPR gRNA sequence
atgttctctgttgcagggga

SEQ ID NO: 746747 - DNA, 20 bp, Artificial
  CRISPR gRNA sequence
gttctctgttgcaggggagg

SEQ ID NO: 746748 - DNA, 20 bp, Artificial
  CRISPR gRNA sequence
ttctctgttgcaggggaggg

SEQ ID NO: 746749 - DNA, 20 bp, Artificial
  CRISPR gRNA sequence
ctctgttgcaggggagggag

SEQ ID NO: 746750 - DNA, 20 bp, Artificial
  CRISPR gRNA sequence
tctgttgcaggggagggagg

SEQ ID NO: 746751 - DNA, 20 bp, Artificial
  CRISPR gRNA sequence
gttgcaggggagggaggagg

SEQ ID NO: 746752 - DNA, 20 bp, Artificial
  CRISPR gRNA sequence
tgcaggggagggaggaggaa

SEQ ID NO: 746753 - DNA, 20 bp, Artificial
  CRISPR gRNA sequence
gcaggggagggaggaggaag

SEQ ID NO: 746754 - DNA, 20 bp, Artificial
  CRISPR gRNA sequence
ggagggaggaggaagaggtt

SEQ ID NO: 746755 - DNA, 20 bp, Artificial
  CRISPR gRNA sequence
gagggaggaggaagaggttc

SEQ ID NO: 746756 - DNA, 20 bp, Artificial
  CRISPR gRNA sequence
ggaggaggaagaggttcagg

SEQ ID NO: 746757 - DNA, 20 bp, Artificial
  CRISPR gRNA sequence
gaggaggaagaggttcagga

SEQ ID NO: 746758 - DNA, 20 bp, Artificial
  CRISPR gRNA sequence
aggaggaagaggttcaggaa

SEQ ID NO: 746759 - DNA, 20 bp, Artificial
  CRISPR gRNA sequence
ggaggaagaggttcaggaag

SEQ ID NO: 746760 - DNA, 20 bp, Artificial
  CRISPR gRNA sequence
aagaggttcaggaaggggaa

SEQ ID NO: 746761 - DNA, 20 bp, Artificial
  CRISPR gRNA sequence
ggaacagaactacctttcct

SEQ ID NO: 746762 - DNA, 20 bp, Artificial
  CRISPR gRNA sequence
ttcctgagttcccactgtgc

SEQ ID NO: 746763 - DNA, 20 bp, Artificial
  CRISPR gRNA sequence
tcctgagttcccactgtgct

SEQ ID NO: 746764 - DNA, 20 bp, Artificial
  CRISPR gRNA sequence
gttcccactgtgctgggcac

SEQ ID NO: 746765 - DNA, 20 bp, Artificial
  CRISPR gRNA sequence
actgtgctgggcactggact

SEQ ID NO: 746766 - DNA, 20 bp, Artificial
  CRISPR gRNA sequence
gcactggactaagtcttttt

SEQ ID NO: 746767 - DNA, 20 bp, Artificial
  CRISPR gRNA sequence
ctttttaagtattattatct

SEQ ID NO: 746768 - DNA, 20 bp, Artificial
  CRISPR gRNA sequence
tttttaagtattattatctc

SEQ ID NO: 746769 - DNA, 20 bp, Artificial
  CRISPR gRNA sequence
ttttaagtattattatctca

SEQ ID NO: 746770 - DNA, 20 bp, Artificial
  CRISPR gRNA sequence
tgtgtatattttctgaaaca

SEQ ID NO: 746771 - DNA, 20 bp, Artificial
  CRISPR gRNA sequence
cacggtttcactctgttacc

SEQ ID NO: 746772 - DNA, 20 bp, Artificial
  CRISPR gRNA sequence
acggtttcactctgttaccc

SEQ ID NO: 746773 - DNA, 20 bp, Artificial
  CRISPR gRNA sequence
tttcactctgttacccaggc

SEQ ID NO: 746774 - DNA, 20 bp, Artificial
  CRISPR gRNA sequence
tcactctgttacccaggctg

SEQ ID NO: 746775 - DNA, 20 bp, Artificial
  CRISPR gRNA sequence
ctgttacccaggctggagtg

SEQ ID NO: 746776 - DNA, 20 bp, Artificial
  CRISPR gRNA sequence
ttacccaggctggagtgcag

SEQ ID NO: 746777 - DNA, 20 bp, Artificial
  CRISPR gRNA sequence
tggagtgcagtggcgcgatc

SEQ ID NO: 746778 - DNA, 20 bp, Artificial
  CRISPR gRNA sequence
ggagtgcagtggcgcgatct

SEQ ID NO: 746779 - DNA, 20 bp, Artificial
  CRISPR gRNA sequence
tcactgcaacctccgcctcc

SEQ ID NO: 746780 - DNA, 20 bp, Artificial
  CRISPR gRNA sequence
aacctccgcctcccggattc

SEQ ID NO: 746781 - DNA, 20 bp, Artificial
  CRISPR gRNA sequence
ttcaagcgattcttctgcct

SEQ ID NO: 746782 - DNA, 20 bp, Artificial
  CRISPR gRNA sequence
ttcttctgcctcagcctccc

SEQ ID NO: 746783 - DNA, 20 bp, Artificial
  CRISPR gRNA sequence
ttctgcctcagcctcccgag

SEQ ID NO: 746784 - DNA, 20 bp, Artificial
  CRISPR gRNA sequence
gcctcagcctcccgagtagc

SEQ ID NO: 746785 - DNA, 20 bp, Artificial
  CRISPR gRNA sequence
cctcagcctcccgagtagct

SEQ ID NO: 746786 - DNA, 20 bp, Artificial
  CRISPR gRNA sequence
gcctcccgagtagctaggat

SEQ ID NO: 746787 - DNA, 20 bp, Artificial
  CRISPR gRNA sequence
gagtagctaggatgagatta

SEQ ID NO: 746788 - DNA, 20 bp, Artificial
  CRISPR gRNA sequence
agtagctaggatgagattac

SEQ ID NO: 746789 - DNA, 20 bp, Artificial
  CRISPR gRNA sequence
caggcgtgcaccacaatgcc

SEQ ID NO: 746790 - DNA, 20 bp, Artificial
  CRISPR gRNA sequence
ctggctaatttttgtatttt

SEQ ID NO: 746791 - DNA, 20 bp, Artificial
  CRISPR gRNA sequence
gctaatttttgtatttttag

SEQ ID NO: 746792 - DNA, 20 bp, Artificial
  CRISPR gRNA sequence
taatttttgtatttttagtg

SEQ ID NO: 746793 - DNA, 20 bp, Artificial
  CRISPR gRNA sequence
ttttgtatttttagtggagc

SEQ ID NO: 746794 - DNA, 20 bp, Artificial
  CRISPR gRNA sequence
tttgtatttttagtggagct

SEQ ID NO: 746795 - DNA, 20 bp, Artificial
  CRISPR gRNA sequence
ttgtatttttagtggagctg

SEQ ID NO: 746796 - DNA, 20 bp, Artificial
  CRISPR gRNA sequence
gagctggggtttcaccatgt

SEQ ID NO: 746797 - DNA, 20 bp, Artificial
  CRISPR gRNA sequence
tggggtttcaccatgttggc

SEQ ID NO: 746798 - DNA, 20 bp, Artificial
  CRISPR gRNA sequence
ggggtttcaccatgttggcc

SEQ ID NO: 746799 - DNA, 20 bp, Artificial
  CRISPR gRNA sequence
tttcaccatgttggccaggc

SEQ ID NO: 746800 - DNA, 20 bp, Artificial
  CRISPR gRNA sequence
gacaaatgatctaactgcct

SEQ ID NO: 746801 - DNA, 20 bp, Artificial
  CRISPR gRNA sequence
ctaactgcctcggcctccca

SEQ ID NO: 746802 - DNA, 20 bp, Artificial
  CRISPR gRNA sequence
gcctcggcctcccaaagtgc

SEQ ID NO: 746803 - DNA, 20 bp, Artificial
  CRISPR gRNA sequence
cctcggcctcccaaagtgct

SEQ ID NO: 746804 - DNA, 20 bp, Artificial
  CRISPR gRNA sequence
ctcccaaagtgctgggatta

SEQ ID NO: 746805 - DNA, 20 bp, Artificial
  CRISPR gRNA sequence
tcccaaagtgctgggattac

SEQ ID NO: 746806 - DNA, 20 bp, Artificial
  CRISPR gRNA sequence
agtgctgggattacaggtgt

SEQ ID NO: 746807 - DNA, 20 bp, Artificial
  CRISPR gRNA sequence
caggtgtgagtcaccacgcc

SEQ ID NO: 746808 - DNA, 20 bp, Artificial
  CRISPR gRNA sequence
tgagtcaccacgcctggcct

SEQ ID NO: 746809 - DNA, 20 bp, Artificial
  CRISPR gRNA sequence
gagtcaccacgcctggcctc

SEQ ID NO: 746810 - DNA, 20 bp, Artificial
  CRISPR gRNA sequence
caggaatttttttttttttt

SEQ ID NO: 746811 - DNA, 20 bp, Artificial
  CRISPR gRNA sequence
aattttttttttttttgaga

SEQ ID NO: 746812 - DNA, 20 bp, Artificial
  CRISPR gRNA sequence
aagactctctctctgtcact

SEQ ID NO: 746813 - DNA, 20 bp, Artificial
  CRISPR gRNA sequence
agactctctctctgtcactc

SEQ ID NO: 746814 - DNA, 20 bp, Artificial
  CRISPR gRNA sequence
tctctctctgtcactcaggc

SEQ ID NO: 746815 - DNA, 20 bp, Artificial
  CRISPR gRNA sequence
ctgtcactcaggctggaatg

SEQ ID NO: 746816 - DNA, 20 bp, Artificial
  CRISPR gRNA sequence
tcactcaggctggaatgcag

SEQ ID NO: 746817 - DNA, 20 bp, Artificial
  CRISPR gRNA sequence
ggaatgcagtggtgcaatca

SEQ ID NO: 746818 - DNA, 20 bp, Artificial
  CRISPR gRNA sequence
ggtgcaatcacagctcactg

SEQ ID NO: 746819 - DNA, 20 bp, Artificial
  CRISPR gRNA sequence
tcactgaagcctcaaacttc

SEQ ID NO: 746820 - DNA, 20 bp, Artificial
  CRISPR gRNA sequence
agcctcaaacttccagatgc

SEQ ID NO: 746821 - DNA, 20 bp, Artificial
  CRISPR gRNA sequence
tcttcctgcttcattctccc

SEQ ID NO: 746822 - DNA, 20 bp, Artificial
  CRISPR gRNA sequence
tcctgcttcattctcccaag

SEQ ID NO: 746823 - DNA, 20 bp, Artificial
  CRISPR gRNA sequence
gcttcattctcccaagtagc

SEQ ID NO: 746824 - DNA, 20 bp, Artificial
  CRISPR gRNA sequence
cttcattctcccaagtagct

SEQ ID NO: 746825 - DNA, 20 bp, Artificial
  CRISPR gRNA sequence
ctcccaagtagctgggacta

SEQ ID NO: 746826 - DNA, 20 bp, Artificial
  CRISPR gRNA sequence
tcccaagtagctgggactac

SEQ ID NO: 746827 - DNA, 20 bp, Artificial
  CRISPR gRNA sequence
caggcacgcatcaccatgtc

SEQ ID NO: 746828 - DNA, 20 bp, Artificial
  CRISPR gRNA sequence
gaatttttaaaaattatttt

SEQ ID NO: 746829 - DNA, 20 bp, Artificial
  CRISPR gRNA sequence
aatttttaaaaattattttt

SEQ ID NO: 746830 - DNA, 20 bp, Artificial
  CRISPR gRNA sequence
atttttaaaaattatttttg

SEQ ID NO: 746831 - DNA, 20 bp, Artificial
  CRISPR gRNA sequence
ttaaaaattatttttggggt

SEQ ID NO: 746832 - DNA, 20 bp, Artificial
  CRISPR gRNA sequence
taaaaattatttttggggtt

SEQ ID NO: 746833 - DNA, 20 bp, Artificial
  CRISPR gRNA sequence
attatttttggggttaggtg

SEQ ID NO: 746834 - DNA, 20 bp, Artificial
  CRISPR gRNA sequence
atttttggggttaggtgcgg

SEQ ID NO: 746835 - DNA, 20 bp, Artificial
  CRISPR gRNA sequence
gtggctcacgcctgtaatcc

SEQ ID NO: 746836 - DNA, 20 bp, Artificial
  CRISPR gRNA sequence
cgcctgtaatcccagcactt

SEQ ID NO: 746837 - DNA, 20 bp, Artificial
  CRISPR gRNA sequence
gcctgtaatcccagcacttt

SEQ ID NO: 746838 - DNA, 20 bp, Artificial
  CRISPR gRNA sequence
ctgtaatcccagcactttag

SEQ ID NO: 746839 - DNA, 20 bp, Artificial
  CRISPR gRNA sequence
tgtaatcccagcactttagg

SEQ ID NO: 746840 - DNA, 20 bp, Artificial
  CRISPR gRNA sequence
tcccagcactttaggaggtc

SEQ ID NO: 746841 - DNA, 20 bp, Artificial
  CRISPR gRNA sequence
cccagcactttaggaggtca

SEQ ID NO: 746842 - DNA, 20 bp, Artificial
  CRISPR gRNA sequence
agcactttaggaggtcaagg

SEQ ID NO: 746843 - DNA, 20 bp, Artificial
  CRISPR gRNA sequence
gcactttaggaggtcaaggc

SEQ ID NO: 746844 - DNA, 20 bp, Artificial
  CRISPR gRNA sequence
ctttaggaggtcaaggcagg

SEQ ID NO: 746845 - DNA, 20 bp, Artificial
  CRISPR gRNA sequence
tcaaggcaggcagatcgctt

SEQ ID NO: 746846 - DNA, 20 bp, Artificial
  CRISPR gRNA sequence
caaggcaggcagatcgcttg

SEQ ID NO: 746847 - DNA, 20 bp, Artificial
  CRISPR gRNA sequence
gcaggcagatcgcttgaggc

SEQ ID NO: 746848 - DNA, 20 bp, Artificial
  CRISPR gRNA sequence
caggcagatcgcttgaggcc

SEQ ID NO: 746849 - DNA, 20 bp, Artificial
  CRISPR gRNA sequence
ggcagatcgcttgaggccag

SEQ ID NO: 746850 - DNA, 20 bp, Artificial
  CRISPR gRNA sequence
tcgcttgaggccaggagttc

SEQ ID NO: 746851 - DNA, 20 bp, Artificial
  CRISPR gRNA sequence
tgaggccaggagttcgagac

SEQ ID NO: 746852 - DNA, 20 bp, Artificial
  CRISPR gRNA sequence
ccaggagttcgagaccagcc

SEQ ID NO: 746853 - DNA, 20 bp, Artificial
  CRISPR gRNA sequence
ttcgagaccagcctggccaa

SEQ ID NO: 746854 - DNA, 20 bp, Artificial
  CRISPR gRNA sequence
tcgagaccagcctggccaac

SEQ ID NO: 746855 - DNA, 20 bp, Artificial
  CRISPR gRNA sequence
cgagaccagcctggccaaca

SEQ ID NO: 746856 - DNA, 20 bp, Artificial
  CRISPR gRNA sequence
tctactaaaaacacaaaaat

SEQ ID NO: 746857 - DNA, 20 bp, Artificial
  CRISPR gRNA sequence
ctaaaaacacaaaaattagc

SEQ ID NO: 746858 - DNA, 20 bp, Artificial
  CRISPR gRNA sequence
taaaaacacaaaaattagcc

SEQ ID NO: 746859 - DNA, 20 bp, Artificial
  CRISPR gRNA sequence
acacaaaaattagccaggca

SEQ ID NO: 746860 - DNA, 20 bp, Artificial
  CRISPR gRNA sequence
caaaaattagccaggcatgg

SEQ ID NO: 746861 - DNA, 20 bp, Artificial
  CRISPR gRNA sequence
ggcatggtggtgcacgcctg

SEQ ID NO: 746862 - DNA, 20 bp, Artificial
  CRISPR gRNA sequence
gtggtgcacgcctgtagtcc

SEQ ID NO: 746863 - DNA, 20 bp, Artificial
  CRISPR gRNA sequence
gcctgtagtcccagctactc

SEQ ID NO: 746864 - DNA, 20 bp, Artificial
  CRISPR gRNA sequence
ctgtagtcccagctactcaa

SEQ ID NO: 746865 - DNA, 20 bp, Artificial
  CRISPR gRNA sequence
tgtagtcccagctactcaag

SEQ ID NO: 746866 - DNA, 20 bp, Artificial
  CRISPR gRNA sequence
tcccagctactcaagaggct

SEQ ID NO: 746867 - DNA, 20 bp, Artificial
  CRISPR gRNA sequence
cccagctactcaagaggctg

SEQ ID NO: 746868 - DNA, 20 bp, Artificial
  CRISPR gRNA sequence
gctactcaagaggctgaggc

SEQ ID NO: 746869 - DNA, 20 bp, Artificial
  CRISPR gRNA sequence
tactcaagaggctgaggcaa

SEQ ID NO: 746870 - DNA, 20 bp, Artificial
  CRISPR gRNA sequence
gcaagagaatcgcttgaacc

SEQ ID NO: 746871 - DNA, 20 bp, Artificial
  CRISPR gRNA sequence
caagagaatcgcttgaaccc

SEQ ID NO: 746872 - DNA, 20 bp, Artificial
  CRISPR gRNA sequence
agagaatcgcttgaacccgg

SEQ ID NO: 746873 - DNA, 20 bp, Artificial
  CRISPR gRNA sequence
aatcgcttgaacccgggagt

SEQ ID NO: 746874 - DNA, 20 bp, Artificial
  CRISPR gRNA sequence
tcgcttgaacccgggagtca

SEQ ID NO: 746875 - DNA, 20 bp, Artificial
  CRISPR gRNA sequence
cgcttgaacccgggagtcag

SEQ ID NO: 746876 - DNA, 20 bp, Artificial
  CRISPR gRNA sequence
aacccgggagtcagaggtta

SEQ ID NO: 746877 - DNA, 20 bp, Artificial
  CRISPR gRNA sequence
cgggagtcagaggttacagt

SEQ ID NO: 746878 - DNA, 20 bp, Artificial
  CRISPR gRNA sequence
gtcagaggttacagtgagcc

SEQ ID NO: 746879 - DNA, 20 bp, Artificial
  CRISPR gRNA sequence
gagatcgcgccactgcactc

SEQ ID NO: 746880 - DNA, 20 bp, Artificial
  CRISPR gRNA sequence
actgcactccagcctgctga

SEQ ID NO: 746881 - DNA, 20 bp, Artificial
  CRISPR gRNA sequence
tgcactccagcctgctgata

SEQ ID NO: 746882 - DNA, 20 bp, Artificial
  CRISPR gRNA sequence
ctccagcctgctgatagagc

SEQ ID NO: 746883 - DNA, 20 bp, Artificial
  CRISPR gRNA sequence
aaaacaacccaaaatttgcc

SEQ ID NO: 746884 - DNA, 20 bp, Artificial
  CRISPR gRNA sequence
aacccaaaatttgcctggca

SEQ ID NO: 746885 - DNA, 20 bp, Artificial
  CRISPR gRNA sequence
ccaaaatttgcctggcatgg

SEQ ID NO: 746886 - DNA, 20 bp, Artificial
  CRISPR gRNA sequence
aaatttgcctggcatggtgg

SEQ ID NO: 746887 - DNA, 20 bp, Artificial
  CRISPR gRNA sequence
aatttgcctggcatggtggc

SEQ ID NO: 746888 - DNA, 20 bp, Artificial
  CRISPR gRNA sequence
gtggcaggcatctgtaatcc

SEQ ID NO: 746889 - DNA, 20 bp, Artificial
  CRISPR gRNA sequence
catctgtaatcccagctact

SEQ ID NO: 746890 - DNA, 20 bp, Artificial
  CRISPR gRNA sequence
atctgtaatcccagctactc

SEQ ID NO: 746891 - DNA, 20 bp, Artificial
  CRISPR gRNA sequence
ctgtaatcccagctactcgg

SEQ ID NO: 746892 - DNA, 20 bp, Artificial
  CRISPR gRNA sequence
tgtaatcccagctactcggg

SEQ ID NO: 746893 - DNA, 20 bp, Artificial
  CRISPR gRNA sequence
tcccagctactcgggaggct

SEQ ID NO: 746894 - DNA, 20 bp, Artificial
  CRISPR gRNA sequence
tactcgggaggctgagacat

SEQ ID NO: 746895 - DNA, 20 bp, Artificial
  CRISPR gRNA sequence
ctcgggaggctgagacatga

SEQ ID NO: 746896 - DNA, 20 bp, Artificial
  CRISPR gRNA sequence
acatgagagctgcttgaacc

SEQ ID NO: 746897 - DNA, 20 bp, Artificial
  CRISPR gRNA sequence
catgagagctgcttgaacct

SEQ ID NO: 746898 - DNA, 20 bp, Artificial
  CRISPR gRNA sequence
tgagagctgcttgaacctgg

SEQ ID NO: 746899 - DNA, 20 bp, Artificial
  CRISPR gRNA sequence
gagagctgcttgaacctggg

SEQ ID NO: 746900 - DNA, 20 bp, Artificial
  CRISPR gRNA sequence
agctgcttgaacctgggagg

SEQ ID NO: 746901 - DNA, 20 bp, Artificial
  CRISPR gRNA sequence
tgcttgaacctgggaggcag

SEQ ID NO: 746902 - DNA, 20 bp, Artificial
  CRISPR gRNA sequence
aacctgggaggcagaagttg

SEQ ID NO: 746903 - DNA, 20 bp, Artificial
  CRISPR gRNA sequence
tgggaggcagaagttgcagt

SEQ ID NO: 746904 - DNA, 20 bp, Artificial
  CRISPR gRNA sequence
ggcagaagttgcagtgagcc

SEQ ID NO: 746905 - DNA, 20 bp, Artificial
  CRISPR gRNA sequence
gagatcacaccactgcactc

SEQ ID NO: 746906 - DNA, 20 bp, Artificial
  CRISPR gRNA sequence
cacaccactgcactccagcc

SEQ ID NO: 746907 - DNA, 20 bp, Artificial
  CRISPR gRNA sequence
acaccactgcactccagcct

SEQ ID NO: 746908 - DNA, 20 bp, Artificial
  CRISPR gRNA sequence
ctgcactccagcctgggtga

SEQ ID NO: 746909 - DNA, 20 bp, Artificial
  CRISPR gRNA sequence
gcactccagcctgggtgaca

SEQ ID NO: 746910 - DNA, 20 bp, Artificial
  CRISPR gRNA sequence
tccagcctgggtgacagagc

SEQ ID NO: 746911 - DNA, 20 bp, Artificial
  CRISPR gRNA sequence
aaaatcaaaaaaatcacttt

SEQ ID NO: 746912 - DNA, 20 bp, Artificial
  CRISPR gRNA sequence
atcaaaaaaatcacttttgg

SEQ ID NO: 746913 - DNA, 20 bp, Artificial
  CRISPR gRNA sequence
caaaaaaatcacttttggta

SEQ ID NO: 746914 - DNA, 20 bp, Artificial
  CRISPR gRNA sequence
tgcactctcgctatgttgcc

SEQ ID NO: 746915 - DNA, 20 bp, Artificial
  CRISPR gRNA sequence
gcactctcgctatgttgccc

SEQ ID NO: 746916 - DNA, 20 bp, Artificial
  CRISPR gRNA sequence
tctcgctatgttgcccaggc

SEQ ID NO: 746917 - DNA, 20 bp, Artificial
  CRISPR gRNA sequence
ccaggctggtcttgaactcc

SEQ ID NO: 746918 - DNA, 20 bp, Artificial
  CRISPR gRNA sequence
caggctggtcttgaactcct

SEQ ID NO: 746919 - DNA, 20 bp, Artificial
  CRISPR gRNA sequence
tcttcccaccttgacctcca

SEQ ID NO: 746920 - DNA, 20 bp, Artificial
  CRISPR gRNA sequence
caccttgacctccaaagtgc

SEQ ID NO: 746921 - DNA, 20 bp, Artificial
  CRISPR gRNA sequence
accttgacctccaaagtgct

SEQ ID NO: 746922 - DNA, 20 bp, Artificial
  CRISPR gRNA sequence
cctccaaagtgctgggatta

SEQ ID NO: 746923 - DNA, 20 bp, Artificial
  CRISPR gRNA sequence
ctccaaagtgctgggattac

SEQ ID NO: 746924 - DNA, 20 bp, Artificial
  CRISPR gRNA sequence
agtgctgggattacaggtgt

SEQ ID NO: 746925 - DNA, 20 bp, Artificial
  CRISPR gRNA sequence
caggtgtgagccaccatgcc

SEQ ID NO: 746926 - DNA, 20 bp, Artificial
  CRISPR gRNA sequence
tgagccaccatgcctagcct

SEQ ID NO: 746927 - DNA, 20 bp, Artificial
  CRISPR gRNA sequence
gagccaccatgcctagcctc

SEQ ID NO: 746928 - DNA, 20 bp, Artificial
  CRISPR gRNA sequence
agccaccatgcctagcctca

SEQ ID NO: 746929 - DNA, 20 bp, Artificial
  CRISPR gRNA sequence
tagcctcagggaattcttat

SEQ ID NO: 746930 - DNA, 20 bp, Artificial
  CRISPR gRNA sequence
attcttataagaactctatg

SEQ ID NO: 746931 - DNA, 20 bp, Artificial
  CRISPR gRNA sequence
cttataagaactctatgaag

SEQ ID NO: 746932 - DNA, 20 bp, Artificial
  CRISPR gRNA sequence
ttataagaactctatgaagt

SEQ ID NO: 746933 - DNA, 20 bp, Artificial
  CRISPR gRNA sequence
caccatcttctctgtatcca

SEQ ID NO: 746934 - DNA, 20 bp, Artificial
  CRISPR gRNA sequence
atcttctctgtatccatgga

SEQ ID NO: 746935 - DNA, 20 bp, Artificial
  CRISPR gRNA sequence
cttctctgtatccatggaaa

SEQ ID NO: 746936 - DNA, 20 bp, Artificial
  CRISPR gRNA sequence
tctctgtatccatggaaaga

SEQ ID NO: 746937 - DNA, 20 bp, Artificial
  CRISPR gRNA sequence
ctctgtatccatggaaagag

SEQ ID NO: 746938 - DNA, 20 bp, Artificial
  CRISPR gRNA sequence
tatccatggaaagagaggcc

SEQ ID NO: 746939 - DNA, 20 bp, Artificial
  CRISPR gRNA sequence
tccatggaaagagaggccta

SEQ ID NO: 746940 - DNA, 20 bp, Artificial
  CRISPR gRNA sequence
agatgtatgctaacttgccc

SEQ ID NO: 746941 - DNA, 20 bp, Artificial
  CRISPR gRNA sequence
ctaacttgcccaagctcaca

SEQ ID NO: 746942 - DNA, 20 bp, Artificial
  CRISPR gRNA sequence
ttgcccaagctcacatagcc

SEQ ID NO: 746943 - DNA, 20 bp, Artificial
  CRISPR gRNA sequence
tgcccaagctcacatagccc

SEQ ID NO: 746944 - DNA, 20 bp, Artificial
  CRISPR gRNA sequence
gcccaagctcacatagccca

SEQ ID NO: 746945 - DNA, 20 bp, Artificial
  CRISPR gRNA sequence
caagctcacatagcccaggg

SEQ ID NO: 746946 - DNA, 20 bp, Artificial
  CRISPR gRNA sequence
tcacatagcccagggtagca

SEQ ID NO: 746947 - DNA, 20 bp, Artificial
  CRISPR gRNA sequence
atagcccagggtagcatagc

SEQ ID NO: 746948 - DNA, 20 bp, Artificial
  CRISPR gRNA sequence
tagcccagggtagcatagct

SEQ ID NO: 746949 - DNA, 20 bp, Artificial
  CRISPR gRNA sequence
agggtagcatagctgggatc

SEQ ID NO: 746950 - DNA, 20 bp, Artificial
  CRISPR gRNA sequence
gcatagctgggatctggctg

SEQ ID NO: 746951 - DNA, 20 bp, Artificial
  CRISPR gRNA sequence
catagctgggatctggctgc

SEQ ID NO: 746952 - DNA, 20 bp, Artificial
  CRISPR gRNA sequence
gatctggctgcaggcctgct

SEQ ID NO: 746953 - DNA, 20 bp, Artificial
  CRISPR gRNA sequence
ctgcatactcaccttcttcc

SEQ ID NO: 746954 - DNA, 20 bp, Artificial
  CRISPR gRNA sequence
tactcaccttcttcccagct

SEQ ID NO: 746955 - DNA, 20 bp, Artificial
  CRISPR gRNA sequence
actcaccttcttcccagctt

SEQ ID NO: 746956 - DNA, 20 bp, Artificial
  CRISPR gRNA sequence
ctcaccttcttcccagcttg

SEQ ID NO: 746957 - DNA, 20 bp, Artificial
  CRISPR gRNA sequence
accttcttcccagcttgggg

SEQ ID NO: 746958 - DNA, 20 bp, Artificial
  CRISPR gRNA sequence
cttcccagcttggggcagtg

SEQ ID NO: 746959 - DNA, 20 bp, Artificial
  CRISPR gRNA sequence
cccagcttggggcagtgcag

SEQ ID NO: 746960 - DNA, 20 bp, Artificial
  CRISPR gRNA sequence
ccagcttggggcagtgcagt

SEQ ID NO: 746961 - DNA, 20 bp, Artificial
  CRISPR gRNA sequence
gcttggggcagtgcagtggg

SEQ ID NO: 746962 - DNA, 20 bp, Artificial
  CRISPR gRNA sequence
tggggcagtgcagtgggtag

SEQ ID NO: 746963 - DNA, 20 bp, Artificial
  CRISPR gRNA sequence
gcagtgcagtgggtagcagt

SEQ ID NO: 746964 - DNA, 20 bp, Artificial
  CRISPR gRNA sequence
gtgggtagcagttagccccc

SEQ ID NO: 746965 - DNA, 20 bp, Artificial
  CRISPR gRNA sequence
gttagccccccggtgcttgc

SEQ ID NO: 746966 - DNA, 20 bp, Artificial
  CRISPR gRNA sequence
tagccccccggtgcttgcca

SEQ ID NO: 746967 - DNA, 20 bp, Artificial
  CRISPR gRNA sequence
gccccccggtgcttgccaga

SEQ ID NO: 746968 - DNA, 20 bp, Artificial
  CRISPR gRNA sequence
ccccccggtgcttgccagag

SEQ ID NO: 746969 - DNA, 20 bp, Artificial
  CRISPR gRNA sequence
cttgccagagaggtgcccta

SEQ ID NO: 746970 - DNA, 20 bp, Artificial
  CRISPR gRNA sequence
ttgccagagaggtgccctac

SEQ ID NO: 746971 - DNA, 20 bp, Artificial
  CRISPR gRNA sequence
tgccagagaggtgccctaca

SEQ ID NO: 746972 - DNA, 20 bp, Artificial
  CRISPR gRNA sequence
agagaggtgccctacagggt

SEQ ID NO: 746973 - DNA, 20 bp, Artificial
  CRISPR gRNA sequence
agaggtgccctacagggtaa

SEQ ID NO: 746974 - DNA, 20 bp, Artificial
  CRISPR gRNA sequence
gaggtgccctacagggtaag

SEQ ID NO: 746975 - DNA, 20 bp, Artificial
  CRISPR gRNA sequence
aggtgccctacagggtaaga

SEQ ID NO: 746976 - DNA, 20 bp, Artificial
  CRISPR gRNA sequence
gggtaagagggcactgccct

SEQ ID NO: 746977 - DNA, 20 bp, Artificial
  CRISPR gRNA sequence
ggtaagagggcactgcccta

SEQ ID NO: 746978 - DNA, 20 bp, Artificial
  CRISPR gRNA sequence
gtaagagggcactgccctaa

SEQ ID NO: 746979 - DNA, 20 bp, Artificial
  CRISPR gRNA sequence
ggcactgccctaagggtgcc

SEQ ID NO: 746980 - DNA, 20 bp, Artificial
  CRISPR gRNA sequence
ccctaagggtgcctggcgct

SEQ ID NO: 746981 - DNA, 20 bp, Artificial
  CRISPR gRNA sequence
ctaagggtgcctggcgctga

SEQ ID NO: 746982 - DNA, 20 bp, Artificial
  CRISPR gRNA sequence
taagggtgcctggcgctgag

SEQ ID NO: 746983 - DNA, 20 bp, Artificial
  CRISPR gRNA sequence
ggtgcctggcgctgagaggt

SEQ ID NO: 746984 - DNA, 20 bp, Artificial
  CRISPR gRNA sequence
gtgcctggcgctgagaggtt

SEQ ID NO: 746985 - DNA, 20 bp, Artificial
  CRISPR gRNA sequence
ctggcgctgagaggttgggt

SEQ ID NO: 746986 - DNA, 20 bp, Artificial
  CRISPR gRNA sequence
agaggttgggtgagaatacc

SEQ ID NO: 746987 - DNA, 20 bp, Artificial
  CRISPR gRNA sequence
ggttgggtgagaatacccag

SEQ ID NO: 746988 - DNA, 20 bp, Artificial
  CRISPR gRNA sequence
ggtgagaatacccagcagct

SEQ ID NO: 746989 - DNA, 20 bp, Artificial
  CRISPR gRNA sequence
tgagaatacccagcagcttg

SEQ ID NO: 746990 - DNA, 20 bp, Artificial
  CRISPR gRNA sequence
gcagcttggagacaaaatgc

SEQ ID NO: 746991 - DNA, 20 bp, Artificial
  CRISPR gRNA sequence
cagcttggagacaaaatgca

SEQ ID NO: 746992 - DNA, 20 bp, Artificial
  CRISPR gRNA sequence
agcttggagacaaaatgcaa

SEQ ID NO: 746993 - DNA, 20 bp, Artificial
  CRISPR gRNA sequence
caagggcacctccctcttct

SEQ ID NO: 746994 - DNA, 20 bp, Artificial
  CRISPR gRNA sequence
gggcacctccctcttctgag

SEQ ID NO: 746995 - DNA, 20 bp, Artificial
  CRISPR gRNA sequence
gcacctccctcttctgagaa

SEQ ID NO: 746996 - DNA, 20 bp, Artificial
  CRISPR gRNA sequence
cacctccctcttctgagaag

SEQ ID NO: 746997 - DNA, 20 bp, Artificial
  CRISPR gRNA sequence
cctcttctgagaagaggtct

SEQ ID NO: 746998 - DNA, 20 bp, Artificial
  CRISPR gRNA sequence
cctctataccctgtatgtgt

SEQ ID NO: 746999 - DNA, 20 bp, Artificial
  CRISPR gRNA sequence
ccctgtatgtgtcagacatc

SEQ ID NO: 747000 - DNA, 20 bp, Artificial
  CRISPR gRNA sequence
tgtatgtgtcagacatccag

SEQ ID NO: 747001 - DNA, 20 bp, Artificial
  CRISPR gRNA sequence
gtatgtgtcagacatccagt

SEQ ID NO: 747002 - DNA, 20 bp, Artificial
  CRISPR gRNA sequence
tatgtgtcagacatccagtg

SEQ ID NO: 747003 - DNA, 20 bp, Artificial
  CRISPR gRNA sequence
gtcagacatccagtggggac

SEQ ID NO: 747004 - DNA, 20 bp, Artificial
  CRISPR gRNA sequence
cagtggggaccagcccctgc

SEQ ID NO: 747005 - DNA, 20 bp, Artificial
  CRISPR gRNA sequence
agtggggaccagcccctgct

SEQ ID NO: 747006 - DNA, 20 bp, Artificial
  CRISPR gRNA sequence
gaccagcccctgctaggccc

SEQ ID NO: 747007 - DNA, 20 bp, Artificial
  CRISPR gRNA sequence
ccagcccctgctaggccctg

SEQ ID NO: 747008 - DNA, 20 bp, Artificial
  CRISPR gRNA sequence
tgctaggccctggagataca

SEQ ID NO: 747009 - DNA, 20 bp, Artificial
  CRISPR gRNA sequence
gctaggccctggagatacaa

SEQ ID NO: 747010 - DNA, 20 bp, Artificial
  CRISPR gRNA sequence
cctggagatacaaaggcatc

SEQ ID NO: 747011 - DNA, 20 bp, Artificial
  CRISPR gRNA sequence
ctggagatacaaaggcatcc

SEQ ID NO: 747012 - DNA, 20 bp, Artificial
  CRISPR gRNA sequence
ggagatacaaaggcatccag

SEQ ID NO: 747013 - DNA, 20 bp, Artificial
  CRISPR gRNA sequence
gagatacaaaggcatccagg

SEQ ID NO: 747014 - DNA, 20 bp, Artificial
  CRISPR gRNA sequence
gcatccaggaggacatgcac

SEQ ID NO: 747015 - DNA, 20 bp, Artificial
  CRISPR gRNA sequence
catccaggaggacatgcacg

SEQ ID NO: 747016 - DNA, 20 bp, Artificial
  CRISPR gRNA sequence
gaggacatgcacgaggacct

SEQ ID NO: 747017 - DNA, 20 bp, Artificial
  CRISPR gRNA sequence
acatgcacgaggacctaagc

SEQ ID NO: 747018 - DNA, 20 bp, Artificial
  CRISPR gRNA sequence
cacgaggacctaagccggaa

SEQ ID NO: 747019 - DNA, 20 bp, Artificial
  CRISPR gRNA sequence
acgaggacctaagccggaat

SEQ ID NO: 747020 - DNA, 20 bp, Artificial
  CRISPR gRNA sequence
cgaggacctaagccggaatg

SEQ ID NO: 747021 - DNA, 20 bp, Artificial
  CRISPR gRNA sequence
acctaagccggaatggggat

SEQ ID NO: 747022 - DNA, 20 bp, Artificial
  CRISPR gRNA sequence
aatggggatcagctaaacca

SEQ ID NO: 747023 - DNA, 20 bp, Artificial
  CRISPR gRNA sequence
acccaacaaaacccaactca

SEQ ID NO: 747024 - DNA, 20 bp, Artificial
  CRISPR gRNA sequence
cccaacaaaacccaactcaa

SEQ ID NO: 747025 - DNA, 20 bp, Artificial
  CRISPR gRNA sequence
aaaacccaactcaaaggcta

SEQ ID NO: 747026 - DNA, 20 bp, Artificial
  CRISPR gRNA sequence
ggctacagtgactttttact

SEQ ID NO: 747027 - DNA, 20 bp, Artificial
  CRISPR gRNA sequence
ccttttttcaaaccaacaaa

SEQ ID NO: 747028 - DNA, 20 bp, Artificial
  CRISPR gRNA sequence
cttttttcaaaccaacaaac

SEQ ID NO: 747029 - DNA, 20 bp, Artificial
  CRISPR gRNA sequence
ttcaaaccaacaaacaggcc

SEQ ID NO: 747030 - DNA, 20 bp, Artificial
  CRISPR gRNA sequence
caaaccaacaaacaggccaa

SEQ ID NO: 747031 - DNA, 20 bp, Artificial
  CRISPR gRNA sequence
aaacaggccaagagcaaaat

SEQ ID NO: 747032 - DNA, 20 bp, Artificial
  CRISPR gRNA sequence
caaaattagaacatgcattt

SEQ ID NO: 747033 - DNA, 20 bp, Artificial
  CRISPR gRNA sequence
attagaacatgcattttggt

SEQ ID NO: 747034 - DNA, 20 bp, Artificial
  CRISPR gRNA sequence
tagaacatgcattttggtca

SEQ ID NO: 747035 - DNA, 20 bp, Artificial
  CRISPR gRNA sequence
cattttggtcagagccatgt

SEQ ID NO: 747036 - DNA, 20 bp, Artificial
  CRISPR gRNA sequence
ttggtcagagccatgttggt

SEQ ID NO: 747037 - DNA, 20 bp, Artificial
  CRISPR gRNA sequence
tggtcagagccatgttggtc

SEQ ID NO: 747038 - DNA, 20 bp, Artificial
  CRISPR gRNA sequence
cagagccatgttggtcaggc

SEQ ID NO: 747039 - DNA, 20 bp, Artificial
  CRISPR gRNA sequence
tcaggctggtctcgaactcc

SEQ ID NO: 747040 - DNA, 20 bp, Artificial
  CRISPR gRNA sequence
caggctggtctcgaactcct

SEQ ID NO: 747041 - DNA, 20 bp, Artificial
  CRISPR gRNA sequence
ggtctcgaactcctgggctc

SEQ ID NO: 747042 - DNA, 20 bp, Artificial
  CRISPR gRNA sequence
ctcaagtgatctacccgcct

SEQ ID NO: 747043 - DNA, 20 bp, Artificial
  CRISPR gRNA sequence
ctacccgccttggctcccca

SEQ ID NO: 747044 - DNA, 20 bp, Artificial
  CRISPR gRNA sequence
gccttggctccccaaagtgc

SEQ ID NO: 747045 - DNA, 20 bp, Artificial
  CRISPR gRNA sequence
ccttggctccccaaagtgct

SEQ ID NO: 747046 - DNA, 20 bp, Artificial
  CRISPR gRNA sequence
tccccaaagtgctgggatta

SEQ ID NO: 747047 - DNA, 20 bp, Artificial
  CRISPR gRNA sequence
ccccaaagtgctgggattac

SEQ ID NO: 747048 - DNA, 20 bp, Artificial
  CRISPR gRNA sequence
agtgctgggattacaggatt

SEQ ID NO: 747049 - DNA, 20 bp, Artificial
  CRISPR gRNA sequence
caggattgagccactatgcc

SEQ ID NO: 747050 - DNA, 20 bp, Artificial
  CRISPR gRNA sequence
tgagccactatgcccagccc

SEQ ID NO: 747051 - DNA, 20 bp, Artificial
  CRISPR gRNA sequence
actatgcccagccccagtgc

SEQ ID NO: 747052 - DNA, 20 bp, Artificial
  CRISPR gRNA sequence
cagcctcttaatgttatcct

SEQ ID NO: 747053 - DNA, 20 bp, Artificial
  CRISPR gRNA sequence
agcctcttaatgttatcctt

SEQ ID NO: 747054 - DNA, 20 bp, Artificial
  CRISPR gRNA sequence
ctcttaatgttatccttggg

SEQ ID NO: 747055 - DNA, 20 bp, Artificial
  CRISPR gRNA sequence
taatgttatccttgggaagt

SEQ ID NO: 747056 - DNA, 20 bp, Artificial
  CRISPR gRNA sequence
atgttatccttgggaagtaa

SEQ ID NO: 747057 - DNA, 20 bp, Artificial
  CRISPR gRNA sequence
atccttgggaagtaagagtg

SEQ ID NO: 747058 - DNA, 20 bp, Artificial
  CRISPR gRNA sequence
ttgactatgaaataacatga

SEQ ID NO: 747059 - DNA, 20 bp, Artificial
  CRISPR gRNA sequence
atgaaataacatgaaagtac

SEQ ID NO: 747060 - DNA, 20 bp, Artificial
  CRISPR gRNA sequence
atgaaagtacaagttaacct

SEQ ID NO: 747061 - DNA, 20 bp, Artificial
  CRISPR gRNA sequence
tgaaagtacaagttaacctg

SEQ ID NO: 747062 - DNA, 20 bp, Artificial
  CRISPR gRNA sequence
aagtacaagttaacctgagg

SEQ ID NO: 747063 - DNA, 20 bp, Artificial
  CRISPR gRNA sequence
agtacaagttaacctgaggt

SEQ ID NO: 747064 - DNA, 20 bp, Artificial
  CRISPR gRNA sequence
gtacaagttaacctgaggta

SEQ ID NO: 747065 - DNA, 20 bp, Artificial
  CRISPR gRNA sequence
tacaagttaacctgaggtag

SEQ ID NO: 747066 - DNA, 20 bp, Artificial
  CRISPR gRNA sequence
ttaacctgaggtaggggaat

SEQ ID NO: 747067 - DNA, 20 bp, Artificial
  CRISPR gRNA sequence
ctgaggtaggggaatgagac

SEQ ID NO: 747068 - DNA, 20 bp, Artificial
  CRISPR gRNA sequence
gaggtaggggaatgagacta

SEQ ID NO: 747069 - DNA, 20 bp, Artificial
  CRISPR gRNA sequence
gtaggggaatgagactagag

SEQ ID NO: 747070 - DNA, 20 bp, Artificial
  CRISPR gRNA sequence
gggaatgagactagagaagt

SEQ ID NO: 747071 - DNA, 20 bp, Artificial
  CRISPR gRNA sequence
gactagagaagttggtgccc

SEQ ID NO: 747072 - DNA, 20 bp, Artificial
  CRISPR gRNA sequence
actagagaagttggtgccca

SEQ ID NO: 747073 - DNA, 20 bp, Artificial
  CRISPR gRNA sequence
tagagaagttggtgcccaag

SEQ ID NO: 747074 - DNA, 20 bp, Artificial
  CRISPR gRNA sequence
caaggagctcctgcattgct

SEQ ID NO: 747075 - DNA, 20 bp, Artificial
  CRISPR gRNA sequence
aaggagctcctgcattgctg

SEQ ID NO: 747076 - DNA, 20 bp, Artificial
  CRISPR gRNA sequence
aggagctcctgcattgctga

SEQ ID NO: 747077 - DNA, 20 bp, Artificial
  CRISPR gRNA sequence
ggagctcctgcattgctgag

SEQ ID NO: 747078 - DNA, 20 bp, Artificial
  CRISPR gRNA sequence
cctgcattgctgaggggctg

SEQ ID NO: 747079 - DNA, 20 bp, Artificial
  CRISPR gRNA sequence
gctgaggggctgtggtttct

SEQ ID NO: 747080 - DNA, 20 bp, Artificial
  CRISPR gRNA sequence
aggggctgtggtttctcagt

SEQ ID NO: 747081 - DNA, 20 bp, Artificial
  CRISPR gRNA sequence
ctgtggtttctcagtgagct

SEQ ID NO: 747082 - DNA, 20 bp, Artificial
  CRISPR gRNA sequence
gtggtttctcagtgagctca

SEQ ID NO: 747083 - DNA, 20 bp, Artificial
  CRISPR gRNA sequence
gtttctcagtgagctcagag

SEQ ID NO: 747084 - DNA, 20 bp, Artificial
  CRISPR gRNA sequence
tttctcagtgagctcagaga

SEQ ID NO: 747085 - DNA, 20 bp, Artificial
  CRISPR gRNA sequence
ttctcagtgagctcagagaa

SEQ ID NO: 747086 - DNA, 20 bp, Artificial
  CRISPR gRNA sequence
tctcagtgagctcagagaag

SEQ ID NO: 747087 - DNA, 20 bp, Artificial
  CRISPR gRNA sequence
gtgagctcagagaaggggtc

SEQ ID NO: 747088 - DNA, 20 bp, Artificial
  CRISPR gRNA sequence
tgagctcagagaaggggtct

SEQ ID NO: 747089 - DNA, 20 bp, Artificial
  CRISPR gRNA sequence
gctcagagaaggggtctagg

SEQ ID NO: 747090 - DNA, 20 bp, Artificial
  CRISPR gRNA sequence
ttgaacttcttcccaccccc

SEQ ID NO: 747091 - DNA, 20 bp, Artificial
  CRISPR gRNA sequence
cttcttcccaccccccagcg

SEQ ID NO: 747092 - DNA, 20 bp, Artificial
  CRISPR gRNA sequence
cttcccaccccccagcgcag

SEQ ID NO: 747093 - DNA, 20 bp, Artificial
  CRISPR gRNA sequence
atgtgctgtctgctttcacc

SEQ ID NO: 747094 - DNA, 20 bp, Artificial
  CRISPR gRNA sequence
ctttcacccagcttcctccc

SEQ ID NO: 747095 - DNA, 20 bp, Artificial
  CRISPR gRNA sequence
tttcacccagcttcctccct

SEQ ID NO: 747096 - DNA, 20 bp, Artificial
  CRISPR gRNA sequence
cagcttcctccctgggaaac

SEQ ID NO: 747097 - DNA, 20 bp, Artificial
  CRISPR gRNA sequence
agcttcctccctgggaaacc

SEQ ID NO: 747098 - DNA, 20 bp, Artificial
  CRISPR gRNA sequence
ttcctccctgggaaaccagg

SEQ ID NO: 747099 - DNA, 20 bp, Artificial
  CRISPR gRNA sequence
aaaccaggcagcccaaccct

SEQ ID NO: 747100 - DNA, 20 bp, Artificial
  CRISPR gRNA sequence
ccaggcagcccaaccctcag

SEQ ID NO: 747101 - DNA, 20 bp, Artificial
  CRISPR gRNA sequence
ccctcctccatatatccccg

SEQ ID NO: 747102 - DNA, 20 bp, Artificial
  CRISPR gRNA sequence
cctcctccatatatccccgt

SEQ ID NO: 747103 - DNA, 20 bp, Artificial
  CRISPR gRNA sequence
catatatccccgtgggctac

SEQ ID NO: 747104 - DNA, 20 bp, Artificial
  CRISPR gRNA sequence
atatatccccgtgggctacc

SEQ ID NO: 747105 - DNA, 20 bp, Artificial
  CRISPR gRNA sequence
tatccccgtgggctaccagg

SEQ ID NO: 747106 - DNA, 20 bp, Artificial
  CRISPR gRNA sequence
atccccgtgggctaccaggc

SEQ ID NO: 747107 - DNA, 20 bp, Artificial
  CRISPR gRNA sequence
gtgggctaccaggcaggccc

SEQ ID NO: 747108 - DNA, 20 bp, Artificial
  CRISPR gRNA sequence
taccaggcaggccctggaca

SEQ ID NO: 747109 - DNA, 20 bp, Artificial
  CRISPR gRNA sequence
accaggcaggccctggacaa

SEQ ID NO: 747110 - DNA, 20 bp, Artificial
  CRISPR gRNA sequence
gccctggacaaaggccgcct

SEQ ID NO: 747111 - DNA, 20 bp, Artificial
  CRISPR gRNA sequence
ctggacaaaggccgcctgag

SEQ ID NO: 747112 - DNA, 20 bp, Artificial
  CRISPR gRNA sequence
tggacaaaggccgcctgagc

SEQ ID NO: 747113 - DNA, 20 bp, Artificial
  CRISPR gRNA sequence
caaaggccgcctgagcaggc

SEQ ID NO: 747114 - DNA, 20 bp, Artificial
  CRISPR gRNA sequence
aaaggccgcctgagcaggcc

SEQ ID NO: 747115 - DNA, 20 bp, Artificial
  CRISPR gRNA sequence
cccatcccaccctgctgtgt

SEQ ID NO: 747116 - DNA, 20 bp, Artificial
  CRISPR gRNA sequence
ccatcccaccctgctgtgtc

SEQ ID NO: 747117 - DNA, 20 bp, Artificial
  CRISPR gRNA sequence
catcccaccctgctgtgtca

SEQ ID NO: 747118 - DNA, 20 bp, Artificial
  CRISPR gRNA sequence
caccctgctgtgtcagggcc

SEQ ID NO: 747119 - DNA, 20 bp, Artificial
  CRISPR gRNA sequence
tcagggcctggcacactcct

SEQ ID NO: 747120 - DNA, 20 bp, Artificial
  CRISPR gRNA sequence
gcctggcacactccttagtg

SEQ ID NO: 747121 - DNA, 20 bp, Artificial
  CRISPR gRNA sequence
cacactccttagtgcggtgt

SEQ ID NO: 747122 - DNA, 20 bp, Artificial
  CRISPR gRNA sequence
actccttagtgcggtgtcgg

SEQ ID NO: 747123 - DNA, 20 bp, Artificial
  CRISPR gRNA sequence
gtgtcggcagctacctctgc

SEQ ID NO: 747124 - DNA, 20 bp, Artificial
  CRISPR gRNA sequence
ccagcgcctgatcaccttcc

SEQ ID NO: 747125 - DNA, 20 bp, Artificial
  CRISPR gRNA sequence
cagcgcctgatcaccttccc

SEQ ID NO: 747126 - DNA, 20 bp, Artificial
  CRISPR gRNA sequence
cctgatcaccttcccaggat

SEQ ID NO: 747127 - DNA, 20 bp, Artificial
  CRISPR gRNA sequence
tcaccttcccaggataagcc

SEQ ID NO: 747128 - DNA, 20 bp, Artificial
  CRISPR gRNA sequence
tcccaggataagcctggctc

SEQ ID NO: 747129 - DNA, 20 bp, Artificial
  CRISPR gRNA sequence
aggataagcctggctctgga

SEQ ID NO: 747130 - DNA, 20 bp, Artificial
  CRISPR gRNA sequence
taagcctggctctggatggt

SEQ ID NO: 747131 - DNA, 20 bp, Artificial
  CRISPR gRNA sequence
cctggctctggatggtgagt

SEQ ID NO: 747132 - DNA, 20 bp, Artificial
  CRISPR gRNA sequence
gtatgcctgccttcccctgt

SEQ ID NO: 747133 - DNA, 20 bp, Artificial
  CRISPR gRNA sequence
ctgccttcccctgtgagtgc

SEQ ID NO: 747134 - DNA, 20 bp, Artificial
  CRISPR gRNA sequence
ttcccctgtgagtgccagcc

SEQ ID NO: 747135 - DNA, 20 bp, Artificial
  CRISPR gRNA sequence
tcccctgtgagtgccagccc

SEQ ID NO: 747136 - DNA, 20 bp, Artificial
  CRISPR gRNA sequence
gtgagtgccagcccaggcac

SEQ ID NO: 747137 - DNA, 20 bp, Artificial
  CRISPR gRNA sequence
gcccaggcactggccacgct

SEQ ID NO: 747138 - DNA, 20 bp, Artificial
  CRISPR gRNA sequence
cccaggcactggccacgctt

SEQ ID NO: 747139 - DNA, 20 bp, Artificial
  CRISPR gRNA sequence
ccaggcactggccacgcttg

SEQ ID NO: 747140 - DNA, 20 bp, Artificial
  CRISPR gRNA sequence
caggcactggccacgcttgg

SEQ ID NO: 747141 - DNA, 20 bp, Artificial
  CRISPR gRNA sequence
gcactggccacgcttggggg

SEQ ID NO: 747142 - DNA, 20 bp, Artificial
  CRISPR gRNA sequence
cactggccacgcttggggga

SEQ ID NO: 747143 - DNA, 20 bp, Artificial
  CRISPR gRNA sequence
actggccacgcttgggggaa

SEQ ID NO: 747144 - DNA, 20 bp, Artificial
  CRISPR gRNA sequence
ctggccacgcttgggggaag

SEQ ID NO: 747145 - DNA, 20 bp, Artificial
  CRISPR gRNA sequence
gccacgcttgggggaagggg

SEQ ID NO: 747146 - DNA, 20 bp, Artificial
  CRISPR gRNA sequence
ccacgcttgggggaaggggt

SEQ ID NO: 747147 - DNA, 20 bp, Artificial
  CRISPR gRNA sequence
cacgcttgggggaaggggtg

SEQ ID NO: 747148 - DNA, 20 bp, Artificial
  CRISPR gRNA sequence
ggggaaggggtggggaactg

SEQ ID NO: 747149 - DNA, 20 bp, Artificial
  CRISPR gRNA sequence
aaggggtggggaactgtggc

SEQ ID NO: 747150 - DNA, 20 bp, Artificial
  CRISPR gRNA sequence
aggggtggggaactgtggcg

SEQ ID NO: 747151 - DNA, 20 bp, Artificial
  CRISPR gRNA sequence
tggggaactgtggcgaggct

SEQ ID NO: 747152 - DNA, 20 bp, Artificial
  CRISPR gRNA sequence
tgtggcgaggctgagctctg

SEQ ID NO: 747153 - DNA, 20 bp, Artificial
  CRISPR gRNA sequence
tggcgaggctgagctctgca

SEQ ID NO: 747154 - DNA, 20 bp, Artificial
  CRISPR gRNA sequence
gagctctgcagagatgccta

SEQ ID NO: 747155 - DNA, 20 bp, Artificial
  CRISPR gRNA sequence
tgcagagatgcctacggctt

SEQ ID NO: 747156 - DNA, 20 bp, Artificial
  CRISPR gRNA sequence
gagatgcctacggcttcaga

SEQ ID NO: 747157 - DNA, 20 bp, Artificial
  CRISPR gRNA sequence
atgcctacggcttcagaaag

SEQ ID NO: 747158 - DNA, 20 bp, Artificial
  CRISPR gRNA sequence
ctacggcttcagaaagcagc

SEQ ID NO: 747159 - DNA, 20 bp, Artificial
  CRISPR gRNA sequence
tcagaaagcagctggatcca

SEQ ID NO: 747160 - DNA, 20 bp, Artificial
  CRISPR gRNA sequence
acctctgcgcccctctgccc

SEQ ID NO: 747161 - DNA, 20 bp, Artificial
  CRISPR gRNA sequence
cctctgccccagcctcaact

SEQ ID NO: 747162 - DNA, 20 bp, Artificial
  CRISPR gRNA sequence
gccccagcctcaactcagcc

SEQ ID NO: 747163 - DNA, 20 bp, Artificial
  CRISPR gRNA sequence
ctcaactcagcccagatcgt

SEQ ID NO: 747164 - DNA, 20 bp, Artificial
  CRISPR gRNA sequence
tcaactcagcccagatcgta

SEQ ID NO: 747165 - DNA, 20 bp, Artificial
  CRISPR gRNA sequence
actcagcccagatcgtaagg

SEQ ID NO: 747166 - DNA, 20 bp, Artificial
  CRISPR gRNA sequence
cccagatcgtaaggaagcct

SEQ ID NO: 747167 - DNA, 20 bp, Artificial
  CRISPR gRNA sequence
ccagatcgtaaggaagcctc

SEQ ID NO: 747168 - DNA, 20 bp, Artificial
  CRISPR gRNA sequence
aaggaagcctcaggctctca

SEQ ID NO: 747169 - DNA, 20 bp, Artificial
  CRISPR gRNA sequence
caggctctcaaagtgaaatt

SEQ ID NO: 747170 - DNA, 20 bp, Artificial
  CRISPR gRNA sequence
gaaattaagtcctgatctga

SEQ ID NO: 747171 - DNA, 20 bp, Artificial
  CRISPR gRNA sequence
aattaagtcctgatctgata

SEQ ID NO: 747172 - DNA, 20 bp, Artificial
  CRISPR gRNA sequence
attaagtcctgatctgatag

SEQ ID NO: 747173 - DNA, 20 bp, Artificial
  CRISPR gRNA sequence
ttaagtcctgatctgataga

SEQ ID NO: 747174 - DNA, 20 bp, Artificial
  CRISPR gRNA sequence
gatctgatagagggtccaca

SEQ ID NO: 747175 - DNA, 20 bp, Artificial
  CRISPR gRNA sequence
atctgatagagggtccacat

SEQ ID NO: 747176 - DNA, 20 bp, Artificial
  CRISPR gRNA sequence
tctgatagagggtccacata

SEQ ID NO: 747177 - DNA, 20 bp, Artificial
  CRISPR gRNA sequence
ctgatagagggtccacatag

SEQ ID NO: 747178 - DNA, 20 bp, Artificial
  CRISPR gRNA sequence
acataggggaaatctctacc

SEQ ID NO: 747179 - DNA, 20 bp, Artificial
  CRISPR gRNA sequence
cataggggaaatctctacct

SEQ ID NO: 747180 - DNA, 20 bp, Artificial
  CRISPR gRNA sequence
ataggggaaatctctacctg

SEQ ID NO: 747181 - DNA, 20 bp, Artificial
  CRISPR gRNA sequence
gggaaatctctacctgggga

SEQ ID NO: 747182 - DNA, 20 bp, Artificial
  CRISPR gRNA sequence
aaatctctacctggggatag

SEQ ID NO: 747183 - DNA, 20 bp, Artificial
  CRISPR gRNA sequence
ctctacctggggatagaagt

SEQ ID NO: 747184 - DNA, 20 bp, Artificial
  CRISPR gRNA sequence
tctacctggggatagaagtt

SEQ ID NO: 747185 - DNA, 20 bp, Artificial
  CRISPR gRNA sequence
acctggggatagaagttagg

SEQ ID NO: 747186 - DNA, 20 bp, Artificial
  CRISPR gRNA sequence
cctggggatagaagttaggc

SEQ ID NO: 747187 - DNA, 20 bp, Artificial
  CRISPR gRNA sequence
ctggggatagaagttaggca

SEQ ID NO: 747188 - DNA, 20 bp, Artificial
  CRISPR gRNA sequence
agaagttaggcagggatatc

SEQ ID NO: 747189 - DNA, 20 bp, Artificial
  CRISPR gRNA sequence
ttaggcagggatatctggcc

SEQ ID NO: 747190 - DNA, 20 bp, Artificial
  CRISPR gRNA sequence
ctggccaagctcaccctcca

SEQ ID NO: 747191 - DNA, 20 bp, Artificial
  CRISPR gRNA sequence
tggccaagctcaccctccaa

SEQ ID NO: 747192 - DNA, 20 bp, Artificial
  CRISPR gRNA sequence
ccaagctcaccctccaaagg

SEQ ID NO: 747193 - DNA, 20 bp, Artificial
  CRISPR gRNA sequence
gctcaccctccaaaggcaga

SEQ ID NO: 747194 - DNA, 20 bp, Artificial
  CRISPR gRNA sequence
ctcaccctccaaaggcagat

SEQ ID NO: 747195 - DNA, 20 bp, Artificial
  CRISPR gRNA sequence
tcaccctccaaaggcagata

SEQ ID NO: 747196 - DNA, 20 bp, Artificial
  CRISPR gRNA sequence
ctccaaaggcagatagggaa

SEQ ID NO: 747197 - DNA, 20 bp, Artificial
  CRISPR gRNA sequence
tccaaaggcagatagggaac

SEQ ID NO: 747198 - DNA, 20 bp, Artificial
  CRISPR gRNA sequence
gatagggaacaggtatcaat

SEQ ID NO: 747199 - DNA, 20 bp, Artificial
  CRISPR gRNA sequence
aacaggtatcaatgagcacc

SEQ ID NO: 747200 - DNA, 20 bp, Artificial
  CRISPR gRNA sequence
gtatcaatgagcacctggca

SEQ ID NO: 747201 - DNA, 20 bp, Artificial
  CRISPR gRNA sequence
gctcacaaaatgttgcttac

SEQ ID NO: 747202 - DNA, 20 bp, Artificial
  CRISPR gRNA sequence
aatgttgcttactagccgtc

SEQ ID NO: 747203 - DNA, 20 bp, Artificial
  CRISPR gRNA sequence
tgttgcttactagccgtcca

SEQ ID NO: 747204 - DNA, 20 bp, Artificial
  CRISPR gRNA sequence
gttgcttactagccgtccag

SEQ ID NO: 747205 - DNA, 20 bp, Artificial
  CRISPR gRNA sequence
tgcttactagccgtccagag

SEQ ID NO: 747206 - DNA, 20 bp, Artificial
  CRISPR gRNA sequence
aggagacctgctttgatcac

SEQ ID NO: 747207 - DNA, 20 bp, Artificial
  CRISPR gRNA sequence
agacctgctttgatcactag

SEQ ID NO: 747208 - DNA, 20 bp, Artificial
  CRISPR gRNA sequence
acctgctttgatcactagaa

SEQ ID NO: 747209 - DNA, 20 bp, Artificial
  CRISPR gRNA sequence
ctgctttgatcactagaaga

SEQ ID NO: 747210 - DNA, 20 bp, Artificial
  CRISPR gRNA sequence
agaagagagtgctttgcaac

SEQ ID NO: 747211 - DNA, 20 bp, Artificial
  CRISPR gRNA sequence
tctcaaatattgcccacaat

SEQ ID NO: 747212 - DNA, 20 bp, Artificial
  CRISPR gRNA sequence
ctcaaatattgcccacaata

SEQ ID NO: 747213 - DNA, 20 bp, Artificial
  CRISPR gRNA sequence
cccacaataaggtcctttga

SEQ ID NO: 747214 - DNA, 20 bp, Artificial
  CRISPR gRNA sequence
ccacaataaggtcctttgat

SEQ ID NO: 747215 - DNA, 20 bp, Artificial
  CRISPR gRNA sequence
cacaataaggtcctttgatg

SEQ ID NO: 747216 - DNA, 20 bp, Artificial
  CRISPR gRNA sequence
acaataaggtcctttgatgg

SEQ ID NO: 747217 - DNA, 20 bp, Artificial
  CRISPR gRNA sequence
gatgggggttttgaaatact

SEQ ID NO: 747218 - DNA, 20 bp, Artificial
  CRISPR gRNA sequence
atgggggttttgaaatactg

SEQ ID NO: 747219 - DNA, 20 bp, Artificial
  CRISPR gRNA sequence
ttttgaaatactgaggtgtc

SEQ ID NO: 747220 - DNA, 20 bp, Artificial
  CRISPR gRNA sequence
tttgaaatactgaggtgtct

SEQ ID NO: 747221 - DNA, 20 bp, Artificial
  CRISPR gRNA sequence
atactgaggtgtctgggtta

SEQ ID NO: 747222 - DNA, 20 bp, Artificial
  CRISPR gRNA sequence
caatattccacgtcaaaatg

SEQ ID NO: 747223 - DNA, 20 bp, Artificial
  CRISPR gRNA sequence
cgtcaaaatgcagccttgct

SEQ ID NO: 747224 - DNA, 20 bp, Artificial
  CRISPR gRNA sequence
tgcagccttgctaagatctg

SEQ ID NO: 747225 - DNA, 20 bp, Artificial
  CRISPR gRNA sequence
gcagccttgctaagatctgc

SEQ ID NO: 747226 - DNA, 20 bp, Artificial
  CRISPR gRNA sequence
cagccttgctaagatctgca

SEQ ID NO: 747227 - DNA, 20 bp, Artificial
  CRISPR gRNA sequence
gcagggaacctgctgtaatg

SEQ ID NO: 747228 - DNA, 20 bp, Artificial
  CRISPR gRNA sequence
agggaacctgctgtaatgtg

SEQ ID NO: 747229 - DNA, 20 bp, Artificial
  CRISPR gRNA sequence
gaacctgctgtaatgtggag

SEQ ID NO: 747230 - DNA, 20 bp, Artificial
  CRISPR gRNA sequence
agcggaacttgctttgtaat

SEQ ID NO: 747231 - DNA, 20 bp, Artificial
  CRISPR gRNA sequence
aacttgctttgtaattagca

SEQ ID NO: 747232 - DNA, 20 bp, Artificial
  CRISPR gRNA sequence
catagcaactgttcctgtac

SEQ ID NO: 747233 - DNA, 20 bp, Artificial
  CRISPR gRNA sequence
agcaactgttcctgtaccag

SEQ ID NO: 747234 - DNA, 20 bp, Artificial
  CRISPR gRNA sequence
gcaactgttcctgtaccagt

SEQ ID NO: 747235 - DNA, 20 bp, Artificial
  CRISPR gRNA sequence
tgtaccagtgggtacttcta

SEQ ID NO: 747236 - DNA, 20 bp, Artificial
  CRISPR gRNA sequence
acttctaaagtgactgaaaa

SEQ ID NO: 747237 - DNA, 20 bp, Artificial
  CRISPR gRNA sequence
aaacagtttgttctcatttg

SEQ ID NO: 747238 - DNA, 20 bp, Artificial
  CRISPR gRNA sequence
agtatgaacaaacctcctga

SEQ ID NO: 747239 - DNA, 20 bp, Artificial
  CRISPR gRNA sequence
tgaaagcttgtttacgctgt

SEQ ID NO: 747240 - DNA, 20 bp, Artificial
  CRISPR gRNA sequence
ttgtttacgctgtcggattg

SEQ ID NO: 747241 - DNA, 20 bp, Artificial
  CRISPR gRNA sequence
gtttacgctgtcggattgta

SEQ ID NO: 747242 - DNA, 20 bp, Artificial
  CRISPR gRNA sequence
attgtagagcaaaacaaaaa

SEQ ID NO: 747243 - DNA, 20 bp, Artificial
  CRISPR gRNA sequence
agcctttattcccaaacaaa

SEQ ID NO: 747244 - DNA, 20 bp, Artificial
  CRISPR gRNA sequence
ctttattcccaaacaaatag

SEQ ID NO: 747245 - DNA, 20 bp, Artificial
  CRISPR gRNA sequence
attcccaaacaaatagcgga

SEQ ID NO: 747246 - DNA, 20 bp, Artificial
  CRISPR gRNA sequence
ttcccaaacaaatagcggaa

SEQ ID NO: 747247 - DNA, 20 bp, Artificial
  CRISPR gRNA sequence
aatagcggaaaggcaacatt

SEQ ID NO: 747248 - DNA, 20 bp, Artificial
  CRISPR gRNA sequence
gaaaggcaacatttagacca

SEQ ID NO: 747249 - DNA, 20 bp, Artificial
  CRISPR gRNA sequence
gaccacagccatttacctct

SEQ ID NO: 747250 - DNA, 20 bp, Artificial
  CRISPR gRNA sequence
ccacagccatttacctctca

SEQ ID NO: 747251 - DNA, 20 bp, Artificial
  CRISPR gRNA sequence
atttacctctcagagctctt

SEQ ID NO: 747252 - DNA, 20 bp, Artificial
  CRISPR gRNA sequence
tttacctctcagagctcttt

SEQ ID NO: 747253 - DNA, 20 bp, Artificial
  CRISPR gRNA sequence
ttacctctcagagctctttg

SEQ ID NO: 747254 - DNA, 20 bp, Artificial
  CRISPR gRNA sequence
tctcagagctctttggggcg

SEQ ID NO: 747255 - DNA, 20 bp, Artificial
  CRISPR gRNA sequence
ggcgaagttgacactgtgac

SEQ ID NO: 747256 - DNA, 20 bp, Artificial
  CRISPR gRNA sequence
gcgaagttgacactgtgaca

SEQ ID NO: 747257 - DNA, 20 bp, Artificial
  CRISPR gRNA sequence
gacactgtgacaaggtatcc

SEQ ID NO: 747258 - DNA, 20 bp, Artificial
  CRISPR gRNA sequence
aggtatcccagcccatcttt

SEQ ID NO: 747259 - DNA, 20 bp, Artificial
  CRISPR gRNA sequence
cccagcccatcttttggccc

SEQ ID NO: 747260 - DNA, 20 bp, Artificial
  CRISPR gRNA sequence
ccagcccatcttttggccct

SEQ ID NO: 747261 - DNA, 20 bp, Artificial
  CRISPR gRNA sequence
cccatcttttggccctggga

SEQ ID NO: 747262 - DNA, 20 bp, Artificial
  CRISPR gRNA sequence
ccatcttttggccctgggaa

SEQ ID NO: 747263 - DNA, 20 bp, Artificial
  CRISPR gRNA sequence
gccctgggaaaggctaaaat

SEQ ID NO: 747264 - DNA, 20 bp, Artificial
  CRISPR gRNA sequence
ccctgggaaaggctaaaatt

SEQ ID NO: 747265 - DNA, 20 bp, Artificial
  CRISPR gRNA sequence
tgggaaaggctaaaattggg

SEQ ID NO: 747266 - DNA, 20 bp, Artificial
  CRISPR gRNA sequence
gggaaaggctaaaattggga

SEQ ID NO: 747267 - DNA, 20 bp, Artificial
  CRISPR gRNA sequence
ggaaggaaatgcgtttatgt

SEQ ID NO: 747268 - DNA, 20 bp, Artificial
  CRISPR gRNA sequence
aaatgcgtttatgttggttg

SEQ ID NO: 747269 - DNA, 20 bp, Artificial
  CRISPR gRNA sequence
tttatgttggttgtggttct

SEQ ID NO: 747270 - DNA, 20 bp, Artificial
  CRISPR gRNA sequence
ttatgttggttgtggttctg

SEQ ID NO: 747271 - DNA, 20 bp, Artificial
  CRISPR gRNA sequence
tatgttggttgtggttctga

SEQ ID NO: 747272 - DNA, 20 bp, Artificial
  CRISPR gRNA sequence
tctgagggcacgtctgttcc

SEQ ID NO: 747273 - DNA, 20 bp, Artificial
  CRISPR gRNA sequence
tgttcccagctaaactcctg

SEQ ID NO: 747274 - DNA, 20 bp, Artificial
  CRISPR gRNA sequence
cccagctaaactcctgcagt

SEQ ID NO: 747275 - DNA, 20 bp, Artificial
  CRISPR gRNA sequence
agctaaactcctgcagtcag

SEQ ID NO: 747276 - DNA, 20 bp, Artificial
  CRISPR gRNA sequence
atcaaacctcctcatgctgt

SEQ ID NO: 747277 - DNA, 20 bp, Artificial
  CRISPR gRNA sequence
tcaaacctcctcatgctgtt

SEQ ID NO: 747278 - DNA, 20 bp, Artificial
  CRISPR gRNA sequence
acctcctcatgctgttggga

SEQ ID NO: 747279 - DNA, 20 bp, Artificial
  CRISPR gRNA sequence
ctcatgctgttgggacagcg

SEQ ID NO: 747280 - DNA, 20 bp, Artificial
  CRISPR gRNA sequence
aagcttcgtgtacacctttt

SEQ ID NO: 747281 - DNA, 20 bp, Artificial
  CRISPR gRNA sequence
gcttcgtgtacacctttttg

SEQ ID NO: 747282 - DNA, 20 bp, Artificial
  CRISPR gRNA sequence
cttcgtgtacacctttttgg

SEQ ID NO: 747283 - DNA, 20 bp, Artificial
  CRISPR gRNA sequence
ttcgtgtacacctttttgga

SEQ ID NO: 747284 - DNA, 20 bp, Artificial
  CRISPR gRNA sequence
cacctttttggagggcaatt

SEQ ID NO: 747285 - DNA, 20 bp, Artificial
  CRISPR gRNA sequence
tttggagggcaatttagcaa

SEQ ID NO: 747286 - DNA, 20 bp, Artificial
  CRISPR gRNA sequence
gcaatttagcaatagcctaa

SEQ ID NO: 747287 - DNA, 20 bp, Artificial
  CRISPR gRNA sequence
aagaaaatgcacatactctt

SEQ ID NO: 747288 - DNA, 20 bp, Artificial
  CRISPR gRNA sequence
aatgcacatactctttggct

SEQ ID NO: 747289 - DNA, 20 bp, Artificial
  CRISPR gRNA sequence
tggctcagcactttgaccgc

SEQ ID NO: 747290 - DNA, 20 bp, Artificial
  CRISPR gRNA sequence
ggctcagcactttgaccgct

SEQ ID NO: 747291 - DNA, 20 bp, Artificial
  CRISPR gRNA sequence
tgaccgctaggaatttacta

SEQ ID NO: 747292 - DNA, 20 bp, Artificial
  CRISPR gRNA sequence
ttactacagatttccttgct

SEQ ID NO: 747293 - DNA, 20 bp, Artificial
  CRISPR gRNA sequence
tacagatttccttgctgagt

SEQ ID NO: 747294 - DNA, 20 bp, Artificial
  CRISPR gRNA sequence
gatttccttgctgagtgagc

SEQ ID NO: 747295 - DNA, 20 bp, Artificial
  CRISPR gRNA sequence
atttccttgctgagtgagcc

SEQ ID NO: 747296 - DNA, 20 bp, Artificial
  CRISPR gRNA sequence
gtgagccaggctgcgtgcac

SEQ ID NO: 747297 - DNA, 20 bp, Artificial
  CRISPR gRNA sequence
caagttcattgctacattat

SEQ ID NO: 747298 - DNA, 20 bp, Artificial
  CRISPR gRNA sequence
attattagttatgctgaaaa

SEQ ID NO: 747299 - DNA, 20 bp, Artificial
  CRISPR gRNA sequence
ggaaacaacatgtctaccaa

SEQ ID NO: 747300 - DNA, 20 bp, Artificial
  CRISPR gRNA sequence
gaaacaacatgtctaccaac

SEQ ID NO: 747301 - DNA, 20 bp, Artificial
  CRISPR gRNA sequence
aaacaacatgtctaccaaca

SEQ ID NO: 747302 - DNA, 20 bp, Artificial
  CRISPR gRNA sequence
aacaacatgtctaccaacag

SEQ ID NO: 747303 - DNA, 20 bp, Artificial
  CRISPR gRNA sequence
ggggactgcttcaataaatt

SEQ ID NO: 747304 - DNA, 20 bp, Artificial
  CRISPR gRNA sequence
gactgcttcaataaatttag

SEQ ID NO: 747305 - DNA, 20 bp, Artificial
  CRISPR gRNA sequence
actgcttcaataaatttagt

SEQ ID NO: 747306 - DNA, 20 bp, Artificial
  CRISPR gRNA sequence
tgcttcaataaatttagtgg

SEQ ID NO: 747307 - DNA, 20 bp, Artificial
  CRISPR gRNA sequence
gagccatgtgataaaactct

SEQ ID NO: 747308 - DNA, 20 bp, Artificial
  CRISPR gRNA sequence
ccatgtgataaaactctaag

SEQ ID NO: 747309 - DNA, 20 bp, Artificial
  CRISPR gRNA sequence
gataaaactctaagcagaat

SEQ ID NO: 747310 - DNA, 20 bp, Artificial
  CRISPR gRNA sequence
ataaaactctaagcagaatg

SEQ ID NO: 747311 - DNA, 20 bp, Artificial
  CRISPR gRNA sequence
aaactctaagcagaatgagg

SEQ ID NO: 747312 - DNA, 20 bp, Artificial
  CRISPR gRNA sequence
aactctaagcagaatgaggc

SEQ ID NO: 747313 - DNA, 20 bp, Artificial
  CRISPR gRNA sequence
actctaagcagaatgaggca

SEQ ID NO: 747314 - DNA, 20 bp, Artificial
  CRISPR gRNA sequence
ctctaagcagaatgaggcag

SEQ ID NO: 747315 - DNA, 20 bp, Artificial
  CRISPR gRNA sequence
ctaagcagaatgaggcaggg

SEQ ID NO: 747316 - DNA, 20 bp, Artificial
  CRISPR gRNA sequence
gcagaatgaggcaggggaga

SEQ ID NO: 747317 - DNA, 20 bp, Artificial
  CRISPR gRNA sequence
agaatgaggcaggggagaca

SEQ ID NO: 747318 - DNA, 20 bp, Artificial
  CRISPR gRNA sequence
aatgaggcaggggagacaga

SEQ ID NO: 747319 - DNA, 20 bp, Artificial
  CRISPR gRNA sequence
ggggagacagagagatgtcc

SEQ ID NO: 747320 - DNA, 20 bp, Artificial
  CRISPR gRNA sequence
agagatgtccaagctgtgct

SEQ ID NO: 747321 - DNA, 20 bp, Artificial
  CRISPR gRNA sequence
gatgtccaagctgtgctcag

SEQ ID NO: 747322 - DNA, 20 bp, Artificial
  CRISPR gRNA sequence
atgtccaagctgtgctcagt

SEQ ID NO: 747323 - DNA, 20 bp, Artificial
  CRISPR gRNA sequence
caagctgtgctcagtgggaa

SEQ ID NO: 747324 - DNA, 20 bp, Artificial
  CRISPR gRNA sequence
tgctgcgtctgctgtatttg

SEQ ID NO: 747325 - DNA, 20 bp, Artificial
  CRISPR gRNA sequence
gctgcgtctgctgtatttgc

SEQ ID NO: 747326 - DNA, 20 bp, Artificial
  CRISPR gRNA sequence
ctgcgtctgctgtatttgca

SEQ ID NO: 747327 - DNA, 20 bp, Artificial
  CRISPR gRNA sequence
gtatttgcagggaatataac

SEQ ID NO: 747328 - DNA, 20 bp, Artificial
  CRISPR gRNA sequence
tatttgcagggaatataact

SEQ ID NO: 747329 - DNA, 20 bp, Artificial
  CRISPR gRNA sequence
taggaccataacacaaaaac

SEQ ID NO: 747330 - DNA, 20 bp, Artificial
  CRISPR gRNA sequence
ataacacaaaaaccggcaca

SEQ ID NO: 747331 - DNA, 20 bp, Artificial
  CRISPR gRNA sequence
taacacaaaaaccggcacac

SEQ ID NO: 747332 - DNA, 20 bp, Artificial
  CRISPR gRNA sequence
aacacaaaaaccggcacaca

SEQ ID NO: 747333 - DNA, 20 bp, Artificial
  CRISPR gRNA sequence
gcacacagggatgatctctt

SEQ ID NO: 747334 - DNA, 20 bp, Artificial
  CRISPR gRNA sequence
acacagggatgatctcttca

SEQ ID NO: 747335 - DNA, 20 bp, Artificial
  CRISPR gRNA sequence
cacagggatgatctcttcag

SEQ ID NO: 747336 - DNA, 20 bp, Artificial
  CRISPR gRNA sequence
acagggatgatctcttcaga

SEQ ID NO: 747337 - DNA, 20 bp, Artificial
  CRISPR gRNA sequence
cagggatgatctcttcagag

SEQ ID NO: 747338 - DNA, 20 bp, Artificial
  CRISPR gRNA sequence
agggatgatctcttcagagg

SEQ ID NO: 747339 - DNA, 20 bp, Artificial
  CRISPR gRNA sequence
gatctcttcagagggggtct

SEQ ID NO: 747340 - DNA, 20 bp, Artificial
  CRISPR gRNA sequence
ttcagagggggtcttggtac

SEQ ID NO: 747341 - DNA, 20 bp, Artificial
  CRISPR gRNA sequence
tcagagggggtcttggtaca

SEQ ID NO: 747342 - DNA, 20 bp, Artificial
  CRISPR gRNA sequence
cagagggggtcttggtacaa

SEQ ID NO: 747343 - DNA, 20 bp, Artificial
  CRISPR gRNA sequence
agagggggtcttggtacaag

SEQ ID NO: 747344 - DNA, 20 bp, Artificial
  CRISPR gRNA sequence
agggggtcttggtacaaggg

SEQ ID NO: 747345 - DNA, 20 bp, Artificial
  CRISPR gRNA sequence
gggggtcttggtacaagggg

SEQ ID NO: 747346 - DNA, 20 bp, Artificial
  CRISPR gRNA sequence
gggtcttggtacaaggggag

SEQ ID NO: 747347 - DNA, 20 bp, Artificial
  CRISPR gRNA sequence
ggtcttggtacaaggggagg

SEQ ID NO: 747348 - DNA, 20 bp, Artificial
  CRISPR gRNA sequence
tcttggtacaaggggaggag

SEQ ID NO: 747349 - DNA, 20 bp, Artificial
  CRISPR gRNA sequence
ttttaaacttgtactttttt

SEQ ID NO: 747350 - DNA, 20 bp, Artificial
  CRISPR gRNA sequence
taaacttgtactttttttgg

SEQ ID NO: 747351 - DNA, 20 bp, Artificial
  CRISPR gRNA sequence
actttttttggtagtttaat

SEQ ID NO: 747352 - DNA, 20 bp, Artificial
  CRISPR gRNA sequence
aaaattgaaaaacattgtac

SEQ ID NO: 747353 - DNA, 20 bp, Artificial
  CRISPR gRNA sequence
aaattgaaaaacattgtaca

SEQ ID NO: 747354 - DNA, 20 bp, Artificial
  CRISPR gRNA sequence
tacaaggattcacgtttttc

SEQ ID NO: 747355 - DNA, 20 bp, Artificial
  CRISPR gRNA sequence
cgtttttctagttctcaccc

SEQ ID NO: 747356 - DNA, 20 bp, Artificial
  CRISPR gRNA sequence
gtttttctagttctcacccc

SEQ ID NO: 747357 - DNA, 20 bp, Artificial
  CRISPR gRNA sequence
tgtttctcctgtgacttgtg

SEQ ID NO: 747358 - DNA, 20 bp, Artificial
  CRISPR gRNA sequence
tctcctgtgacttgtgtggt

SEQ ID NO: 747359 - DNA, 20 bp, Artificial
  CRISPR gRNA sequence
gtgacttgtgtggtgagatc

SEQ ID NO: 747360 - DNA, 20 bp, Artificial
  CRISPR gRNA sequence
tgacttgtgtggtgagatca

SEQ ID NO: 747361 - DNA, 20 bp, Artificial
  CRISPR gRNA sequence
gacttgtgtggtgagatcaa

SEQ ID NO: 747362 - DNA, 20 bp, Artificial
  CRISPR gRNA sequence
acttgtgtggtgagatcaag

SEQ ID NO: 747363 - DNA, 20 bp, Artificial
  CRISPR gRNA sequence
gtggtgagatcaaggggttc

SEQ ID NO: 747364 - DNA, 20 bp, Artificial
  CRISPR gRNA sequence
ggtgagatcaaggggttcta

SEQ ID NO: 747365 - DNA, 20 bp, Artificial
  CRISPR gRNA sequence
gtgagatcaaggggttctag

SEQ ID NO: 747366 - DNA, 20 bp, Artificial
  CRISPR gRNA sequence
gggttctagaggccccatcc

SEQ ID NO: 747367 - DNA, 20 bp, Artificial
  CRISPR gRNA sequence
gttctagaggccccatccca

SEQ ID NO: 747368 - DNA, 20 bp, Artificial
  CRISPR gRNA sequence
agaggccccatcccagagct

SEQ ID NO: 747369 - DNA, 20 bp, Artificial
  CRISPR gRNA sequence
gaggccccatcccagagcta

SEQ ID NO: 747370 - DNA, 20 bp, Artificial
  CRISPR gRNA sequence
ggccccatcccagagctaag

SEQ ID NO: 747371 - DNA, 20 bp, Artificial
  CRISPR gRNA sequence
tcccagagctaaggagtctc

SEQ ID NO: 747372 - DNA, 20 bp, Artificial
  CRISPR gRNA sequence
cccagagctaaggagtctct

SEQ ID NO: 747373 - DNA, 20 bp, Artificial
  CRISPR gRNA sequence
agctaaggagtctctgggat

SEQ ID NO: 747374 - DNA, 20 bp, Artificial
  CRISPR gRNA sequence
aaggagtctctgggatgagt

SEQ ID NO: 747375 - DNA, 20 bp, Artificial
  CRISPR gRNA sequence
aggagtctctgggatgagtt

SEQ ID NO: 747376 - DNA, 20 bp, Artificial
  CRISPR gRNA sequence
ggagtctctgggatgagttg

SEQ ID NO: 747377 - DNA, 20 bp, Artificial
  CRISPR gRNA sequence
tttgccatttcaaccatttt

SEQ ID NO: 747378 - DNA, 20 bp, Artificial
  CRISPR gRNA sequence
tttcaaccattttaagccta

SEQ ID NO: 747379 - DNA, 20 bp, Artificial
  CRISPR gRNA sequence
accattttaagcctacagtt

SEQ ID NO: 747380 - DNA, 20 bp, Artificial
  CRISPR gRNA sequence
attttaagcctacagtttgg

SEQ ID NO: 747381 - DNA, 20 bp, Artificial
  CRISPR gRNA sequence
ttttcaaaactttcatcact

SEQ ID NO: 747382 - DNA, 20 bp, Artificial
  CRISPR gRNA sequence
tttcaaaactttcatcactt

SEQ ID NO: 747383 - DNA, 20 bp, Artificial
  CRISPR gRNA sequence
cttaggcttcttttgacctt

SEQ ID NO: 747384 - DNA, 20 bp, Artificial
  CRISPR gRNA sequence
tcttttgaccttgagctctg

SEQ ID NO: 747385 - DNA, 20 bp, Artificial
  CRISPR gRNA sequence
tgaccttgagctctgtggca

SEQ ID NO: 747386 - DNA, 20 bp, Artificial
  CRISPR gRNA sequence
gaccttgagctctgtggcat

SEQ ID NO: 747387 - DNA, 20 bp, Artificial
  CRISPR gRNA sequence
accttgagctctgtggcatg

SEQ ID NO: 747388 - DNA, 20 bp, Artificial
  CRISPR gRNA sequence
tctgtggcatggggtctgcg

SEQ ID NO: 747389 - DNA, 20 bp, Artificial
  CRISPR gRNA sequence
ctgtggcatggggtctgcga

SEQ ID NO: 747390 - DNA, 20 bp, Artificial
  CRISPR gRNA sequence
aaggccctgctctccctttt

SEQ ID NO: 747391 - DNA, 20 bp, Artificial
  CRISPR gRNA sequence
ggccctgctctcccttttca

SEQ ID NO: 747392 - DNA, 20 bp, Artificial
  CRISPR gRNA sequence
ccttttcagagaacaacctg

SEQ ID NO: 747393 - DNA, 20 bp, Artificial
  CRISPR gRNA sequence
tcagagaacaacctgtagcc

SEQ ID NO: 747394 - DNA, 20 bp, Artificial
  CRISPR gRNA sequence
cagagaacaacctgtagcca

SEQ ID NO: 747395 - DNA, 20 bp, Artificial
  CRISPR gRNA sequence
agagaacaacctgtagccaa

SEQ ID NO: 747396 - DNA, 20 bp, Artificial
  CRISPR gRNA sequence
acctgtagccaagggtgttc

SEQ ID NO: 747397 - DNA, 20 bp, Artificial
  CRISPR gRNA sequence
ggtgttccagctgtaccttg

SEQ ID NO: 747398 - DNA, 20 bp, Artificial
  CRISPR gRNA sequence
gtgttccagctgtaccttgt

SEQ ID NO: 747399 - DNA, 20 bp, Artificial
  CRISPR gRNA sequence
tccagctgtaccttgtgggc

SEQ ID NO: 747400 - DNA, 20 bp, Artificial
  CRISPR gRNA sequence
ccagctgtaccttgtgggct

SEQ ID NO: 747401 - DNA, 20 bp, Artificial
  CRISPR gRNA sequence
tgtaccttgtgggctgggat

SEQ ID NO: 747402 - DNA, 20 bp, Artificial
  CRISPR gRNA sequence
gtaccttgtgggctgggatg

SEQ ID NO: 747403 - DNA, 20 bp, Artificial
  CRISPR gRNA sequence
actctgttccctctcttgcc

SEQ ID NO: 747404 - DNA, 20 bp, Artificial
  CRISPR gRNA sequence
tctgttccctctcttgcctg

SEQ ID NO: 747405 - DNA, 20 bp, Artificial
  CRISPR gRNA sequence
tctcttgcctggagctgcct

SEQ ID NO: 747406 - DNA, 20 bp, Artificial
  CRISPR gRNA sequence
gcctggagctgcctgagctg

SEQ ID NO: 747407 - DNA, 20 bp, Artificial
  CRISPR gRNA sequence
cctggagctgcctgagctgt

SEQ ID NO: 747408 - DNA, 20 bp, Artificial
  CRISPR gRNA sequence
gctgcctgagctgtaggtga

SEQ ID NO: 747409 - DNA, 20 bp, Artificial
  CRISPR gRNA sequence
ctgcctgagctgtaggtgac

SEQ ID NO: 747410 - DNA, 20 bp, Artificial
  CRISPR gRNA sequence
aggtgacaggtcttgtttct

SEQ ID NO: 747411 - DNA, 20 bp, Artificial
  CRISPR gRNA sequence
ggtcttgtttctgagtgctc

SEQ ID NO: 747412 - DNA, 20 bp, Artificial
  CRISPR gRNA sequence
gtcttgtttctgagtgctcc

SEQ ID NO: 747413 - DNA, 20 bp, Artificial
  CRISPR gRNA sequence
tcttgtttctgagtgctcca

SEQ ID NO: 747414 - DNA, 20 bp, Artificial
  CRISPR gRNA sequence
cttgtttctgagtgctccag

SEQ ID NO: 747415 - DNA, 20 bp, Artificial
  CRISPR gRNA sequence
ttctgagtgctccaggggca

SEQ ID NO: 747416 - DNA, 20 bp, Artificial
  CRISPR gRNA sequence
tctgagtgctccaggggcat

SEQ ID NO: 747417 - DNA, 20 bp, Artificial
  CRISPR gRNA sequence
ctgagtgctccaggggcata

SEQ ID NO: 747418 - DNA, 20 bp, Artificial
  CRISPR gRNA sequence
agtgctccaggggcataggg

SEQ ID NO: 747419 - DNA, 20 bp, Artificial
  CRISPR gRNA sequence
gctccaggggcatagggcgg

SEQ ID NO: 747420 - DNA, 20 bp, Artificial
  CRISPR gRNA sequence
ctccaggggcatagggcggc

SEQ ID NO: 747421 - DNA, 20 bp, Artificial
  CRISPR gRNA sequence
ggggcatagggcggcaggca

SEQ ID NO: 747422 - DNA, 20 bp, Artificial
  CRISPR gRNA sequence
gggcatagggcggcaggcac

SEQ ID NO: 747423 - DNA, 20 bp, Artificial
  CRISPR gRNA sequence
ggcatagggcggcaggcaca

SEQ ID NO: 747424 - DNA, 20 bp, Artificial
  CRISPR gRNA sequence
aggcacagggctctctttga

SEQ ID NO: 747425 - DNA, 20 bp, Artificial
  CRISPR gRNA sequence
ggcacagggctctctttgaa

SEQ ID NO: 747426 - DNA, 20 bp, Artificial
  CRISPR gRNA sequence
cacagggctctctttgaaag

SEQ ID NO: 747427 - DNA, 20 bp, Artificial
  CRISPR gRNA sequence
ccttatcttccatgcctctg

SEQ ID NO: 747428 - DNA, 20 bp, Artificial
  CRISPR gRNA sequence
cttatcttccatgcctctgt

SEQ ID NO: 747429 - DNA, 20 bp, Artificial
  CRISPR gRNA sequence
tccatgcctctgtaggttgc

SEQ ID NO: 747430 - DNA, 20 bp, Artificial
  CRISPR gRNA sequence
ccatgcctctgtaggttgct

SEQ ID NO: 747431 - DNA, 20 bp, Artificial
  CRISPR gRNA sequence
catgcctctgtaggttgctg

SEQ ID NO: 747432 - DNA, 20 bp, Artificial
  CRISPR gRNA sequence
atgcctctgtaggttgctgg

SEQ ID NO: 747433 - DNA, 20 bp, Artificial
  CRISPR gRNA sequence
tctgtaggttgctgggggtc

SEQ ID NO: 747434 - DNA, 20 bp, Artificial
  CRISPR gRNA sequence
ggttgctgggggtctagctg

SEQ ID NO: 747435 - DNA, 20 bp, Artificial
  CRISPR gRNA sequence
gttgctgggggtctagctgt

SEQ ID NO: 747436 - DNA, 20 bp, Artificial
  CRISPR gRNA sequence
ggggtctagctgtgggactc

SEQ ID NO: 747437 - DNA, 20 bp, Artificial
  CRISPR gRNA sequence
gggtctagctgtgggactct

SEQ ID NO: 747438 - DNA, 20 bp, Artificial
  CRISPR gRNA sequence
ggtctagctgtgggactctg

SEQ ID NO: 747439 - DNA, 20 bp, Artificial
  CRISPR gRNA sequence
tagctgtgggactctgggga

SEQ ID NO: 747440 - DNA, 20 bp, Artificial
  CRISPR gRNA sequence
agctgtgggactctggggaa

SEQ ID NO: 747441 - DNA, 20 bp, Artificial
  CRISPR gRNA sequence
tgtgggactctggggaaagg

SEQ ID NO: 747442 - DNA, 20 bp, Artificial
  CRISPR gRNA sequence
gtgggactctggggaaaggc

SEQ ID NO: 747443 - DNA, 20 bp, Artificial
  CRISPR gRNA sequence
aaggcgggtctcctgcttcc

SEQ ID NO: 747444 - DNA, 20 bp, Artificial
  CRISPR gRNA sequence
cttcctggccttccctctct

SEQ ID NO: 747445 - DNA, 20 bp, Artificial
  CRISPR gRNA sequence
ggccttccctctctgagcct

SEQ ID NO: 747446 - DNA, 20 bp, Artificial
  CRISPR gRNA sequence
tctgagcctcagtttatgct

SEQ ID NO: 747447 - DNA, 20 bp, Artificial
  CRISPR gRNA sequence
ctgagcctcagtttatgctc

SEQ ID NO: 747448 - DNA, 20 bp, Artificial
  CRISPR gRNA sequence
gagcctcagtttatgctcag

SEQ ID NO: 747449 - DNA, 20 bp, Artificial
  CRISPR gRNA sequence
agcctcagtttatgctcagg

SEQ ID NO: 747450 - DNA, 20 bp, Artificial
  CRISPR gRNA sequence
cctcagtttatgctcaggag

SEQ ID NO: 747451 - DNA, 20 bp, Artificial
  CRISPR gRNA sequence
tttatgctcaggaggagcaa

SEQ ID NO: 747452 - DNA, 20 bp, Artificial
  CRISPR gRNA sequence
ttatgctcaggaggagcaat

SEQ ID NO: 747453 - DNA, 20 bp, Artificial
  CRISPR gRNA sequence
ctcaggaggagcaatgggaa

SEQ ID NO: 747454 - DNA, 20 bp, Artificial
  CRISPR gRNA sequence
tcaggaggagcaatgggaat

SEQ ID NO: 747455 - DNA, 20 bp, Artificial
  CRISPR gRNA sequence
caggaggagcaatgggaatg

SEQ ID NO: 747456 - DNA, 20 bp, Artificial
  CRISPR gRNA sequence
atgggaatggggcttcacct

SEQ ID NO: 747457 - DNA, 20 bp, Artificial
  CRISPR gRNA sequence
tggctacctctctgcccttt

SEQ ID NO: 747458 - DNA, 20 bp, Artificial
  CRISPR gRNA sequence
ctctgccctttcagacatca

SEQ ID NO: 747459 - DNA, 20 bp, Artificial
  CRISPR gRNA sequence
cctttcagacatcacggctg

SEQ ID NO: 747460 - DNA, 20 bp, Artificial
  CRISPR gRNA sequence
agacatcacggctgcagccc

SEQ ID NO: 747461 - DNA, 20 bp, Artificial
  CRISPR gRNA sequence
cacggctgcagccctggcta

SEQ ID NO: 747462 - DNA, 20 bp, Artificial
  CRISPR gRNA sequence
acggctgcagccctggctac

SEQ ID NO: 747463 - DNA, 20 bp, Artificial
  CRISPR gRNA sequence
ggctacgggtgcctgcatcg

SEQ ID NO: 747464 - DNA, 20 bp, Artificial
  CRISPR gRNA sequence
gctacgggtgcctgcatcgt

SEQ ID NO: 747465 - DNA, 20 bp, Artificial
  CRISPR gRNA sequence
cctccccctcatcctgctcc

SEQ ID NO: 747466 - DNA, 20 bp, Artificial
  CRISPR gRNA sequence
tcatcctgctcctggtctac

SEQ ID NO: 747467 - DNA, 20 bp, Artificial
  CRISPR gRNA sequence
ctgctcctggtctacaagca

SEQ ID NO: 747468 - DNA, 20 bp, Artificial
  CRISPR gRNA sequence
tgctcctggtctacaagcaa

SEQ ID NO: 747469 - DNA, 20 bp, Artificial
  CRISPR gRNA sequence
tcctggtctacaagcaaagg

SEQ ID NO: 747470 - DNA, 20 bp, Artificial
  CRISPR gRNA sequence
cctggtctacaagcaaaggc

SEQ ID NO: 747471 - DNA, 20 bp, Artificial
  CRISPR gRNA sequence
ggtctacaagcaaaggcagg

SEQ ID NO: 747472 - DNA, 20 bp, Artificial
  CRISPR gRNA sequence
aggcagcctccaaccgccgt

SEQ ID NO: 747473 - DNA, 20 bp, Artificial
  CRISPR gRNA sequence
cgtgagtattcctccctgcc

SEQ ID NO: 747474 - DNA, 20 bp, Artificial
  CRISPR gRNA sequence
gtgagtattcctccctgcct

SEQ ID NO: 747475 - DNA, 20 bp, Artificial
  CRISPR gRNA sequence
tgagtattcctccctgcctg

SEQ ID NO: 747476 - DNA, 20 bp, Artificial
  CRISPR gRNA sequence
gtattcctccctgcctgggg

SEQ ID NO: 747477 - DNA, 20 bp, Artificial
  CRISPR gRNA sequence
tattcctccctgcctggggt

SEQ ID NO: 747478 - DNA, 20 bp, Artificial
  CRISPR gRNA sequence
tcctccctgcctggggtggg

SEQ ID NO: 747479 - DNA, 20 bp, Artificial
  CRISPR gRNA sequence
ccctgcctggggtgggtgga

SEQ ID NO: 747480 - DNA, 20 bp, Artificial
  CRISPR gRNA sequence
ctggggtgggtggacggtgc

SEQ ID NO: 747481 - DNA, 20 bp, Artificial
  CRISPR gRNA sequence
acggtgcgagtgacctgctc

SEQ ID NO: 747482 - DNA, 20 bp, Artificial
  CRISPR gRNA sequence
gagtgacctgctccagcccc

SEQ ID NO: 747483 - DNA, 20 bp, Artificial
  CRISPR gRNA sequence
acctgctccagcccccagtt

SEQ ID NO: 747484 - DNA, 20 bp, Artificial
  CRISPR gRNA sequence
ccagcccccagttcagcccc

SEQ ID NO: 747485 - DNA, 20 bp, Artificial
  CRISPR gRNA sequence
cagcccccagttcagcccct

SEQ ID NO: 747486 - DNA, 20 bp, Artificial
  CRISPR gRNA sequence
ttcagcccctgggattcgca

SEQ ID NO: 747487 - DNA, 20 bp, Artificial
  CRISPR gRNA sequence
tcagcccctgggattcgcaa

SEQ ID NO: 747488 - DNA, 20 bp, Artificial
  CRISPR gRNA sequence
ggattcgcaaaggcacgatg

SEQ ID NO: 747489 - DNA, 20 bp, Artificial
  CRISPR gRNA sequence
gattcgcaaaggcacgatgc

SEQ ID NO: 747490 - DNA, 20 bp, Artificial
  CRISPR gRNA sequence
ggcacaattccttttcattt

SEQ ID NO: 747491 - DNA, 20 bp, Artificial
  CRISPR gRNA sequence
cacaattccttttcatttga

SEQ ID NO: 747492 - DNA, 20 bp, Artificial
  CRISPR gRNA sequence
attccttttcatttgagagt

SEQ ID NO: 747493 - DNA, 20 bp, Artificial
  CRISPR gRNA sequence
ttccttttcatttgagagtt

SEQ ID NO: 747494 - DNA, 20 bp, Artificial
  CRISPR gRNA sequence
ccttttcatttgagagttgg

SEQ ID NO: 747495 - DNA, 20 bp, Artificial
  CRISPR gRNA sequence
tttcatttgagagttgggag

SEQ ID NO: 747496 - DNA, 20 bp, Artificial
  CRISPR gRNA sequence
ggagcagctgcacttcccgc

SEQ ID NO: 747497 - DNA, 20 bp, Artificial
  CRISPR gRNA sequence
gagcagctgcacttcccgcc

SEQ ID NO: 747498 - DNA, 20 bp, Artificial
  CRISPR gRNA sequence
gcagctgcacttcccgccag

SEQ ID NO: 747499 - DNA, 20 bp, Artificial
  CRISPR gRNA sequence
ctgcacttcccgccaggagc

SEQ ID NO: 747500 - DNA, 20 bp, Artificial
  CRISPR gRNA sequence
tgcacttcccgccaggagct

SEQ ID NO: 747501 - DNA, 20 bp, Artificial
  CRISPR gRNA sequence
ccgccaggagctgggcgaaa

SEQ ID NO: 747502 - DNA, 20 bp, Artificial
  CRISPR gRNA sequence
aggagctgggcgaaatggcc

SEQ ID NO: 747503 - DNA, 20 bp, Artificial
  CRISPR gRNA sequence
gagctgggcgaaatggccga

SEQ ID NO: 747504 - DNA, 20 bp, Artificial
  CRISPR gRNA sequence
tgggcgaaatggccgagaga

SEQ ID NO: 747505 - DNA, 20 bp, Artificial
  CRISPR gRNA sequence
gggcgaaatggccgagagaa

SEQ ID NO: 747506 - DNA, 20 bp, Artificial
  CRISPR gRNA sequence
gcgaaatggccgagagaaag

SEQ ID NO: 747507 - DNA, 20 bp, Artificial
  CRISPR gRNA sequence
cgaaatggccgagagaaagg

SEQ ID NO: 747508 - DNA, 20 bp, Artificial
  CRISPR gRNA sequence
gaaaggaggcatgccatttc

SEQ ID NO: 747509 - DNA, 20 bp, Artificial
  CRISPR gRNA sequence
aaaggaggcatgccatttcc

SEQ ID NO: 747510 - DNA, 20 bp, Artificial
  CRISPR gRNA sequence
aaggaggcatgccatttccg

SEQ ID NO: 747511 - DNA, 20 bp, Artificial
  CRISPR gRNA sequence
aggaggcatgccatttccgg

SEQ ID NO: 747512 - DNA, 20 bp, Artificial
  CRISPR gRNA sequence
gcatgccatttccgggggcc

SEQ ID NO: 747513 - DNA, 20 bp, Artificial
  CRISPR gRNA sequence
tccgggggccaagtgcccac

SEQ ID NO: 747514 - DNA, 20 bp, Artificial
  CRISPR gRNA sequence
caagtgcccaccagcccctt

SEQ ID NO: 747515 - DNA, 20 bp, Artificial
  CRISPR gRNA sequence
ccaccagcccctttggctcc

SEQ ID NO: 747516 - DNA, 20 bp, Artificial
  CRISPR gRNA sequence
caccagcccctttggctccc

SEQ ID NO: 747517 - DNA, 20 bp, Artificial
  CRISPR gRNA sequence
cagcccctttggctcccagg

SEQ ID NO: 747518 - DNA, 20 bp, Artificial
  CRISPR gRNA sequence
ctttggctcccaggcagtgc

SEQ ID NO: 747519 - DNA, 20 bp, Artificial
  CRISPR gRNA sequence
gctcccaggcagtgctggct

SEQ ID NO: 747520 - DNA, 20 bp, Artificial
  CRISPR gRNA sequence
tctgaatgaatgatcatatg

SEQ ID NO: 747521 - DNA, 20 bp, Artificial
  CRISPR gRNA sequence
gaatgaatgatcatatgcag

SEQ ID NO: 747522 - DNA, 20 bp, Artificial
  CRISPR gRNA sequence
atgatcatatgcagtagctc

SEQ ID NO: 747523 - DNA, 20 bp, Artificial
  CRISPR gRNA sequence
tagctcaagttgctttataa

SEQ ID NO: 747524 - DNA, 20 bp, Artificial
  CRISPR gRNA sequence
tcaagttgctttataaaagc

SEQ ID NO: 747525 - DNA, 20 bp, Artificial
  CRISPR gRNA sequence
aaaagcaagttgctgccact

SEQ ID NO: 747526 - DNA, 20 bp, Artificial
  CRISPR gRNA sequence
aagcaagttgctgccactca

SEQ ID NO: 747527 - DNA, 20 bp, Artificial
  CRISPR gRNA sequence
tgctgccactcagagatcct

SEQ ID NO: 747528 - DNA, 20 bp, Artificial
  CRISPR gRNA sequence
gctgccactcagagatcctt

SEQ ID NO: 747529 - DNA, 20 bp, Artificial
  CRISPR gRNA sequence
ctgccactcagagatccttg

SEQ ID NO: 747530 - DNA, 20 bp, Artificial
  CRISPR gRNA sequence
tgccactcagagatccttgg

SEQ ID NO: 747531 - DNA, 20 bp, Artificial
  CRISPR gRNA sequence
gatccttgggggacctgttt

SEQ ID NO: 747532 - DNA, 20 bp, Artificial
  CRISPR gRNA sequence
atccttgggggacctgttta

SEQ ID NO: 747533 - DNA, 20 bp, Artificial
  CRISPR gRNA sequence
tgggggacctgtttaaggta

SEQ ID NO: 747534 - DNA, 20 bp, Artificial
  CRISPR gRNA sequence
gggggacctgtttaaggtat

SEQ ID NO: 747535 - DNA, 20 bp, Artificial
  CRISPR gRNA sequence
gggcgtgcttgttttgtaat

SEQ ID NO: 747536 - DNA, 20 bp, Artificial
  CRISPR gRNA sequence
cgtgcttgttttgtaattag

SEQ ID NO: 747537 - DNA, 20 bp, Artificial
  CRISPR gRNA sequence
ttgtaattagtagcaattgt

SEQ ID NO: 747538 - DNA, 20 bp, Artificial
  CRISPR gRNA sequence
tgtaattagtagcaattgtt

SEQ ID NO: 747539 - DNA, 20 bp, Artificial
  CRISPR gRNA sequence
ttgggacaaaaaatgatctt

SEQ ID NO: 747540 - DNA, 20 bp, Artificial
  CRISPR gRNA sequence
aaaaatgatctttggaatat

SEQ ID NO: 747541 - DNA, 20 bp, Artificial
  CRISPR gRNA sequence
aatgatctttggaatatcag

SEQ ID NO: 747542 - DNA, 20 bp, Artificial
  CRISPR gRNA sequence
gatctttggaatatcagaag

SEQ ID NO: 747543 - DNA, 20 bp, Artificial
  CRISPR gRNA sequence
ctttggaatatcagaagtgg

SEQ ID NO: 747544 - DNA, 20 bp, Artificial
  CRISPR gRNA sequence
tttggaatatcagaagtgga

SEQ ID NO: 747545 - DNA, 20 bp, Artificial
  CRISPR gRNA sequence
ttggaatatcagaagtggaa

SEQ ID NO: 747546 - DNA, 20 bp, Artificial
  CRISPR gRNA sequence
tggaatatcagaagtggaag

SEQ ID NO: 747547 - DNA, 20 bp, Artificial
  CRISPR gRNA sequence
cagaagtggaaggggtctta

SEQ ID NO: 747548 - DNA, 20 bp, Artificial
  CRISPR gRNA sequence
aaggggtcttacagacaact

SEQ ID NO: 747549 - DNA, 20 bp, Artificial
  CRISPR gRNA sequence
agctcaaccctttctttttc

SEQ ID NO: 747550 - DNA, 20 bp, Artificial
  CRISPR gRNA sequence
aaccctttctttttccagat

SEQ ID NO: 747551 - DNA, 20 bp, Artificial
  CRISPR gRNA sequence
cctttctttttccagatgag

SEQ ID NO: 747552 - DNA, 20 bp, Artificial
  CRISPR gRNA sequence
ctttctttttccagatgaga

SEQ ID NO: 747553 - DNA, 20 bp, Artificial
  CRISPR gRNA sequence
tttttccagatgagaaggct

SEQ ID NO: 747554 - DNA, 20 bp, Artificial
  CRISPR gRNA sequence
ccagatgagaaggctaagat

SEQ ID NO: 747555 - DNA, 20 bp, Artificial
  CRISPR gRNA sequence
gatgagaaggctaagatcag

SEQ ID NO: 747556 - DNA, 20 bp, Artificial
  CRISPR gRNA sequence
atgagaaggctaagatcagt

SEQ ID NO: 747557 - DNA, 20 bp, Artificial
  CRISPR gRNA sequence
tgagaaggctaagatcagtg

SEQ ID NO: 747558 - DNA, 20 bp, Artificial
  CRISPR gRNA sequence
tgactgaatgttacgtaact

SEQ ID NO: 747559 - DNA, 20 bp, Artificial
  CRISPR gRNA sequence
tgaatgttacgtaacttagt

SEQ ID NO: 747560 - DNA, 20 bp, Artificial
  CRISPR gRNA sequence
atgttacgtaacttagtaag

SEQ ID NO: 747561 - DNA, 20 bp, Artificial
  CRISPR gRNA sequence
ttacgtaacttagtaagtgg

SEQ ID NO: 747562 - DNA, 20 bp, Artificial
  CRISPR gRNA sequence
acgtaacttagtaagtggca

SEQ ID NO: 747563 - DNA, 20 bp, Artificial
  CRISPR gRNA sequence
aacttagtaagtggcagagc

SEQ ID NO: 747564 - DNA, 20 bp, Artificial
  CRISPR gRNA sequence
acttagtaagtggcagagct

SEQ ID NO: 747565 - DNA, 20 bp, Artificial
  CRISPR gRNA sequence
gcagagctaggactcaatct

SEQ ID NO: 747566 - DNA, 20 bp, Artificial
  CRISPR gRNA sequence
agagctaggactcaatctca

SEQ ID NO: 747567 - DNA, 20 bp, Artificial
  CRISPR gRNA sequence
ctttcaacgcatgctctttc

SEQ ID NO: 747568 - DNA, 20 bp, Artificial
  CRISPR gRNA sequence
tttcaacgcatgctctttcc

SEQ ID NO: 747569 - DNA, 20 bp, Artificial
  CRISPR gRNA sequence
ttcaacgcatgctctttcca

SEQ ID NO: 747570 - DNA, 20 bp, Artificial
  CRISPR gRNA sequence
cgcatgctctttccagggaa

SEQ ID NO: 747571 - DNA, 20 bp, Artificial
  CRISPR gRNA sequence
atgctctttccagggaatag

SEQ ID NO: 747572 - DNA, 20 bp, Artificial
  CRISPR gRNA sequence
tctcacttactcctcattgc

SEQ ID NO: 747573 - DNA, 20 bp, Artificial
  CRISPR gRNA sequence
ttactcctcattgcaagtcc

SEQ ID NO: 747574 - DNA, 20 bp, Artificial
  CRISPR gRNA sequence
tcattgcaagtccaagaatt

SEQ ID NO: 747575 - DNA, 20 bp, Artificial
  CRISPR gRNA sequence
cattgtccccattttactga

SEQ ID NO: 747576 - DNA, 20 bp, Artificial
  CRISPR gRNA sequence
attgtccccattttactgat

SEQ ID NO: 747577 - DNA, 20 bp, Artificial
  CRISPR gRNA sequence
ccattttactgatgggcaaa

SEQ ID NO: 747578 - DNA, 20 bp, Artificial
  CRISPR gRNA sequence
attttactgatgggcaaacg

SEQ ID NO: 747579 - DNA, 20 bp, Artificial
  CRISPR gRNA sequence
ttttactgatgggcaaacgg

SEQ ID NO: 747580 - DNA, 20 bp, Artificial
  CRISPR gRNA sequence
ctgatgggcaaacggaggca

SEQ ID NO: 747581 - DNA, 20 bp, Artificial
  CRISPR gRNA sequence
gatgggcaaacggaggcaca

SEQ ID NO: 747582 - DNA, 20 bp, Artificial
  CRISPR gRNA sequence
atgggcaaacggaggcacag

SEQ ID NO: 747583 - DNA, 20 bp, Artificial
  CRISPR gRNA sequence
tgggcaaacggaggcacaga

SEQ ID NO: 747584 - DNA, 20 bp, Artificial
  CRISPR gRNA sequence
gggcaaacggaggcacagag

SEQ ID NO: 747585 - DNA, 20 bp, Artificial
  CRISPR gRNA sequence
aacggaggcacagaggggtt

SEQ ID NO: 747586 - DNA, 20 bp, Artificial
  CRISPR gRNA sequence
aggggttaagtaacttgcct

SEQ ID NO: 747587 - DNA, 20 bp, Artificial
  CRISPR gRNA sequence
ggggttaagtaacttgccta

SEQ ID NO: 747588 - DNA, 20 bp, Artificial
  CRISPR gRNA sequence
aacttgcctaaggaaccaca

SEQ ID NO: 747589 - DNA, 20 bp, Artificial
  CRISPR gRNA sequence
taaggaaccacacagcaaat

SEQ ID NO: 747590 - DNA, 20 bp, Artificial
  CRISPR gRNA sequence
ggaaccacacagcaaataag

SEQ ID NO: 747591 - DNA, 20 bp, Artificial
  CRISPR gRNA sequence
accacacagcaaataagtgg

SEQ ID NO: 747592 - DNA, 20 bp, Artificial
  CRISPR gRNA sequence
ccacacagcaaataagtggt

SEQ ID NO: 747593 - DNA, 20 bp, Artificial
  CRISPR gRNA sequence
cacacagcaaataagtggtg

SEQ ID NO: 747594 - DNA, 20 bp, Artificial
  CRISPR gRNA sequence
cagcaaataagtggtggggc

SEQ ID NO: 747595 - DNA, 20 bp, Artificial
  CRISPR gRNA sequence
agcaaataagtggtggggct

SEQ ID NO: 747596 - DNA, 20 bp, Artificial
  CRISPR gRNA sequence
aagtggtggggctgggcttt

SEQ ID NO: 747597 - DNA, 20 bp, Artificial
  CRISPR gRNA sequence
tggggctgggctttaagtca

SEQ ID NO: 747598 - DNA, 20 bp, Artificial
  CRISPR gRNA sequence
ggggctgggctttaagtcat

SEQ ID NO: 747599 - DNA, 20 bp, Artificial
  CRISPR gRNA sequence
acatctttcacctcccaccc

SEQ ID NO: 747600 - DNA, 20 bp, Artificial
  CRISPR gRNA sequence
ctttcacctcccaccctggc

SEQ ID NO: 747601 - DNA, 20 bp, Artificial
  CRISPR gRNA sequence
tttcacctcccaccctggcc

SEQ ID NO: 747602 - DNA, 20 bp, Artificial
  CRISPR gRNA sequence
ctcccaccctggccaggtga

SEQ ID NO: 747603 - DNA, 20 bp, Artificial
  CRISPR gRNA sequence
aggtgacagtgccccttgcc

SEQ ID NO: 747604 - DNA, 20 bp, Artificial
  CRISPR gRNA sequence
tagttcctgaccctgccctt

SEQ ID NO: 747605 - DNA, 20 bp, Artificial
  CRISPR gRNA sequence
ctgaccctgcccttgagtct

SEQ ID NO: 747606 - DNA, 20 bp, Artificial
  CRISPR gRNA sequence
ccctgcccttgagtcttggt

SEQ ID NO: 747607 - DNA, 20 bp, Artificial
  CRISPR gRNA sequence
ccttgagtcttggttagtct

SEQ ID NO: 747608 - DNA, 20 bp, Artificial
  CRISPR gRNA sequence
ttggttagtctgagtcctcc

SEQ ID NO: 747609 - DNA, 20 bp, Artificial
  CRISPR gRNA sequence
gttagtctgagtcctccaag

SEQ ID NO: 747610 - DNA, 20 bp, Artificial
  CRISPR gRNA sequence
ttagtctgagtcctccaaga

SEQ ID NO: 747611 - DNA, 20 bp, Artificial
  CRISPR gRNA sequence
tagtctgagtcctccaagaa

SEQ ID NO: 747612 - DNA, 20 bp, Artificial
  CRISPR gRNA sequence
agtctgagtcctccaagaag

SEQ ID NO: 747613 - DNA, 20 bp, Artificial
  CRISPR gRNA sequence
tgagtcctccaagaaggggc

SEQ ID NO: 747614 - DNA, 20 bp, Artificial
  CRISPR gRNA sequence
gagtcctccaagaaggggct

SEQ ID NO: 747615 - DNA, 20 bp, Artificial
  CRISPR gRNA sequence
agtcctccaagaaggggcta

SEQ ID NO: 747616 - DNA, 20 bp, Artificial
  CRISPR gRNA sequence
tcctccaagaaggggctagg

SEQ ID NO: 747617 - DNA, 20 bp, Artificial
  CRISPR gRNA sequence
ttacccttgcctcccctccc

SEQ ID NO: 747618 - DNA, 20 bp, Artificial
  CRISPR gRNA sequence
ctggcctcttcccgtctgcc

SEQ ID NO: 747619 - DNA, 20 bp, Artificial
  CRISPR gRNA sequence
tcttcccgtctgcctggcta

SEQ ID NO: 747620 - DNA, 20 bp, Artificial
  CRISPR gRNA sequence
ttcccgtctgcctggctaca

SEQ ID NO: 747621 - DNA, 20 bp, Artificial
  CRISPR gRNA sequence
tcccgtctgcctggctacag

SEQ ID NO: 747622 - DNA, 20 bp, Artificial
  CRISPR gRNA sequence
gcctggctacagaggtaact

SEQ ID NO: 747623 - DNA, 20 bp, Artificial
  CRISPR gRNA sequence
ggctacagaggtaactgaga

SEQ ID NO: 747624 - DNA, 20 bp, Artificial
  CRISPR gRNA sequence
gctacagaggtaactgagaa

SEQ ID NO: 747625 - DNA, 20 bp, Artificial
  CRISPR gRNA sequence
taactgagaaaggattgctc

SEQ ID NO: 747626 - DNA, 20 bp, Artificial
  CRISPR gRNA sequence
agaaaggattgctctggtgc

SEQ ID NO: 747627 - DNA, 20 bp, Artificial
  CRISPR gRNA sequence
gaaaggattgctctggtgcc

SEQ ID NO: 747628 - DNA, 20 bp, Artificial
  CRISPR gRNA sequence
aggattgctctggtgccagg

SEQ ID NO: 747629 - DNA, 20 bp, Artificial
  CRISPR gRNA sequence
ctctggtgccaggtggcttt

SEQ ID NO: 747630 - DNA, 20 bp, Artificial
  CRISPR gRNA sequence
ggctcgcaacttatttcctg

SEQ ID NO: 747631 - DNA, 20 bp, Artificial
  CRISPR gRNA sequence
cgcaacttatttcctgtggc

SEQ ID NO: 747632 - DNA, 20 bp, Artificial
  CRISPR gRNA sequence
tccctccctcccctcattcc

SEQ ID NO: 747633 - DNA, 20 bp, Artificial
  CRISPR gRNA sequence
ccctccctcccctcattccc

SEQ ID NO: 747634 - DNA, 20 bp, Artificial
  CRISPR gRNA sequence
cctccctcccctcattcccg

SEQ ID NO: 747635 - DNA, 20 bp, Artificial
  CRISPR gRNA sequence
ctccctcccctcattcccgg

SEQ ID NO: 747636 - DNA, 20 bp, Artificial
  CRISPR gRNA sequence
ttcccgggggcccccacgtg

SEQ ID NO: 747637 - DNA, 20 bp, Artificial
  CRISPR gRNA sequence
ggcccccacgtgaagcccca

SEQ ID NO: 747638 - DNA, 20 bp, Artificial
  CRISPR gRNA sequence
ccccacgtgaagccccatag

SEQ ID NO: 747639 - DNA, 20 bp, Artificial
  CRISPR gRNA sequence
cccacgtgaagccccatagt

SEQ ID NO: 747640 - DNA, 20 bp, Artificial
  CRISPR gRNA sequence
aagccccatagtgggtcact

SEQ ID NO: 747641 - DNA, 20 bp, Artificial
  CRISPR gRNA sequence
agccccatagtgggtcactc

SEQ ID NO: 747642 - DNA, 20 bp, Artificial
  CRISPR gRNA sequence
gccccatagtgggtcactcg

SEQ ID NO: 747643 - DNA, 20 bp, Artificial
  CRISPR gRNA sequence
ccccatagtgggtcactcgg

SEQ ID NO: 747644 - DNA, 20 bp, Artificial
  CRISPR gRNA sequence
agtgggtcactcgggggctg

SEQ ID NO: 747645 - DNA, 20 bp, Artificial
  CRISPR gRNA sequence
ggccacctcacccttgcttt

SEQ ID NO: 747646 - DNA, 20 bp, Artificial
  CRISPR gRNA sequence
gaactcccctattcctctcc

SEQ ID NO: 747647 - DNA, 20 bp, Artificial
  CRISPR gRNA sequence
aacacaccacaacctacctg

SEQ ID NO: 747648 - DNA, 20 bp, Artificial
  CRISPR gRNA sequence
acacaccacaacctacctgc

SEQ ID NO: 747649 - DNA, 20 bp, Artificial
  CRISPR gRNA sequence
cctacctgcaggaataccca

SEQ ID NO: 747650 - DNA, 20 bp, Artificial
  CRISPR gRNA sequence
cctgcaggaatacccatggc

SEQ ID NO: 747651 - DNA, 20 bp, Artificial
  CRISPR gRNA sequence
ctgcaggaatacccatggct

SEQ ID NO: 747652 - DNA, 20 bp, Artificial
  CRISPR gRNA sequence
tgcaggaatacccatggctg

SEQ ID NO: 747653 - DNA, 20 bp, Artificial
  CRISPR gRNA sequence
gcaggaatacccatggctgg

SEQ ID NO: 747654 - DNA, 20 bp, Artificial
  CRISPR gRNA sequence
ggaatacccatggctggggg

SEQ ID NO: 747655 - DNA, 20 bp, Artificial
  CRISPR gRNA sequence
gaatacccatggctgggggt

SEQ ID NO: 747656 - DNA, 20 bp, Artificial
  CRISPR gRNA sequence
tacccatggctgggggtggg

SEQ ID NO: 747657 - DNA, 20 bp, Artificial
  CRISPR gRNA sequence
acccatggctgggggtgggt

SEQ ID NO: 747658 - DNA, 20 bp, Artificial
  CRISPR gRNA sequence
cccatggctgggggtgggtg

SEQ ID NO: 747659 - DNA, 20 bp, Artificial
  CRISPR gRNA sequence
ccatggctgggggtgggtgg

SEQ ID NO: 747660 - DNA, 20 bp, Artificial
  CRISPR gRNA sequence
tggctgggggtgggtggggg

SEQ ID NO: 747661 - DNA, 20 bp, Artificial
  CRISPR gRNA sequence
ggctgggggtgggtgggggc

SEQ ID NO: 747662 - DNA, 20 bp, Artificial
  CRISPR gRNA sequence
ggggtgggtgggggcaggta

SEQ ID NO: 747663 - DNA, 20 bp, Artificial
  CRISPR gRNA sequence
gggtgggtgggggcaggtaa

SEQ ID NO: 747664 - DNA, 20 bp, Artificial
  CRISPR gRNA sequence
ggtgggtgggggcaggtaaa

SEQ ID NO: 747665 - DNA, 20 bp, Artificial
  CRISPR gRNA sequence
gtgggggcaggtaaagggct

SEQ ID NO: 747666 - DNA, 20 bp, Artificial
  CRISPR gRNA sequence
ggcaggtaaagggcttggaa

SEQ ID NO: 747667 - DNA, 20 bp, Artificial
  CRISPR gRNA sequence
aggtaaagggcttggaacag

SEQ ID NO: 747668 - DNA, 20 bp, Artificial
  CRISPR gRNA sequence
gtaaagggcttggaacagaa

SEQ ID NO: 747669 - DNA, 20 bp, Artificial
  CRISPR gRNA sequence
ttggaacagaagagcaacgc

SEQ ID NO: 747670 - DNA, 20 bp, Artificial
  CRISPR gRNA sequence
tggaacagaagagcaacgct

SEQ ID NO: 747671 - DNA, 20 bp, Artificial
  CRISPR gRNA sequence
aacagaagagcaacgctggg

SEQ ID NO: 747672 - DNA, 20 bp, Artificial
  CRISPR gRNA sequence
agaagagcaacgctgggcag

SEQ ID NO: 747673 - DNA, 20 bp, Artificial
  CRISPR gRNA sequence
gaagagcaacgctgggcagc

SEQ ID NO: 747674 - DNA, 20 bp, Artificial
  CRISPR gRNA sequence
aagagcaacgctgggcagca

SEQ ID NO: 747675 - DNA, 20 bp, Artificial
  CRISPR gRNA sequence
agcaacgctgggcagcaggg

SEQ ID NO: 747676 - DNA, 20 bp, Artificial
  CRISPR gRNA sequence
gcaacgctgggcagcagggc

SEQ ID NO: 747677 - DNA, 20 bp, Artificial
  CRISPR gRNA sequence
caacgctgggcagcagggca

SEQ ID NO: 747678 - DNA, 20 bp, Artificial
  CRISPR gRNA sequence
aacgctgggcagcagggcag

SEQ ID NO: 747679 - DNA, 20 bp, Artificial
  CRISPR gRNA sequence
acgctgggcagcagggcagg

SEQ ID NO: 747680 - DNA, 20 bp, Artificial
  CRISPR gRNA sequence
gctgggcagcagggcagggg

SEQ ID NO: 747681 - DNA, 20 bp, Artificial
  CRISPR gRNA sequence
gggcagcagggcagggggag

SEQ ID NO: 747682 - DNA, 20 bp, Artificial
  CRISPR gRNA sequence
ggcagcagggcagggggagc

SEQ ID NO: 747683 - DNA, 20 bp, Artificial
  CRISPR gRNA sequence
aggtgttgctgtgccctccc

SEQ ID NO: 747684 - DNA, 20 bp, Artificial
  CRISPR gRNA sequence
tgttgctgtgccctccctgg

SEQ ID NO: 747685 - DNA, 20 bp, Artificial
  CRISPR gRNA sequence
tgctgtgccctccctggtgg

SEQ ID NO: 747686 - DNA, 20 bp, Artificial
  CRISPR gRNA sequence
gctgtgccctccctggtgga

SEQ ID NO: 747687 - DNA, 20 bp, Artificial
  CRISPR gRNA sequence
tgccctccctggtggaaggc

SEQ ID NO: 747688 - DNA, 20 bp, Artificial
  CRISPR gRNA sequence
tccctggtggaaggctggcc

SEQ ID NO: 747689 - DNA, 20 bp, Artificial
  CRISPR gRNA sequence
cctggtggaaggctggccca

SEQ ID NO: 747690 - DNA, 20 bp, Artificial
  CRISPR gRNA sequence
tggtggaaggctggcccaga

SEQ ID NO: 747691 - DNA, 20 bp, Artificial
  CRISPR gRNA sequence
gctggcccagagagcctgct

SEQ ID NO: 747692 - DNA, 20 bp, Artificial
  CRISPR gRNA sequence
ctggcccagagagcctgctc

SEQ ID NO: 747693 - DNA, 20 bp, Artificial
  CRISPR gRNA sequence
cagagagcctgctcaggaat

SEQ ID NO: 747694 - DNA, 20 bp, Artificial
  CRISPR gRNA sequence
agagagcctgctcaggaatg

SEQ ID NO: 747695 - DNA, 20 bp, Artificial
  CRISPR gRNA sequence
gctcaggaatgaggcactct

SEQ ID NO: 747696 - DNA, 20 bp, Artificial
  CRISPR gRNA sequence
ctcaggaatgaggcactctc

SEQ ID NO: 747697 - DNA, 20 bp, Artificial
  CRISPR gRNA sequence
tgaggcactctcaggaaaaa

SEQ ID NO: 747698 - DNA, 20 bp, Artificial
  CRISPR gRNA sequence
cactctcaggaaaaaaagaa

SEQ ID NO: 747699 - DNA, 20 bp, Artificial
  CRISPR gRNA sequence
actctcaggaaaaaaagaaa

SEQ ID NO: 747700 - DNA, 20 bp, Artificial
  CRISPR gRNA sequence
tcaggaaaaaaagaaaagga

SEQ ID NO: 747701 - DNA, 20 bp, Artificial
  CRISPR gRNA sequence
caggaaaaaaagaaaaggaa

SEQ ID NO: 747702 - DNA, 20 bp, Artificial
  CRISPR gRNA sequence
aggaaaaaaagaaaaggaaa

SEQ ID NO: 747703 - DNA, 20 bp, Artificial
  CRISPR gRNA sequence
aaaaaagaaaaggaaagggc

SEQ ID NO: 747704 - DNA, 20 bp, Artificial
  CRISPR gRNA sequence
aaaaagaaaaggaaagggct

SEQ ID NO: 747705 - DNA, 20 bp, Artificial
  CRISPR gRNA sequence
aaagaaaaggaaagggctgg

SEQ ID NO: 747706 - DNA, 20 bp, Artificial
  CRISPR gRNA sequence
aggaaagggctgggagcctt

SEQ ID NO: 747707 - DNA, 20 bp, Artificial
  CRISPR gRNA sequence
ggaaagggctgggagccttg

SEQ ID NO: 747708 - DNA, 20 bp, Artificial
  CRISPR gRNA sequence
agggctgggagccttgagga

SEQ ID NO: 747709 - DNA, 20 bp, Artificial
  CRISPR gRNA sequence
gctgggagccttgaggacgg

SEQ ID NO: 747710 - DNA, 20 bp, Artificial
  CRISPR gRNA sequence
ccttgaggacggcagtttgc

SEQ ID NO: 747711 - DNA, 20 bp, Artificial
  CRISPR gRNA sequence
ttgaggacggcagtttgctg

SEQ ID NO: 747712 - DNA, 20 bp, Artificial
  CRISPR gRNA sequence
gaggacggcagtttgctgga

SEQ ID NO: 747713 - DNA, 20 bp, Artificial
  CRISPR gRNA sequence
aggacggcagtttgctggag

SEQ ID NO: 747714 - DNA, 20 bp, Artificial
  CRISPR gRNA sequence
cagtttgctggagaggccaa

SEQ ID NO: 747715 - DNA, 20 bp, Artificial
  CRISPR gRNA sequence
agtttgctggagaggccaac

SEQ ID NO: 747716 - DNA, 20 bp, Artificial
  CRISPR gRNA sequence
gctggagaggccaacaggtg

SEQ ID NO: 747717 - DNA, 20 bp, Artificial
  CRISPR gRNA sequence
tgtggatttccatcctgctt

SEQ ID NO: 747718 - DNA, 20 bp, Artificial
  CRISPR gRNA sequence
tttccatcctgctttggact

SEQ ID NO: 747719 - DNA, 20 bp, Artificial
  CRISPR gRNA sequence
tcctgctttggactgagcct

SEQ ID NO: 747720 - DNA, 20 bp, Artificial
  CRISPR gRNA sequence
ggactgagcctcagtttccc

SEQ ID NO: 747721 - DNA, 20 bp, Artificial
  CRISPR gRNA sequence
cagtttccccagctctaaaa

SEQ ID NO: 747722 - DNA, 20 bp, Artificial
  CRISPR gRNA sequence
agtttccccagctctaaaat

SEQ ID NO: 747723 - DNA, 20 bp, Artificial
  CRISPR gRNA sequence
gaccaacaaccctcacccca

SEQ ID NO: 747724 - DNA, 20 bp, Artificial
  CRISPR gRNA sequence
accaacaaccctcaccccaa

SEQ ID NO: 747725 - DNA, 20 bp, Artificial
  CRISPR gRNA sequence
ccaacaaccctcaccccaaa

SEQ ID NO: 747726 - DNA, 20 bp, Artificial
  CRISPR gRNA sequence
acaaccctcaccccaaaggg

SEQ ID NO: 747727 - DNA, 20 bp, Artificial
  CRISPR gRNA sequence
cctcaccccaaagggtggca

SEQ ID NO: 747728 - DNA, 20 bp, Artificial
  CRISPR gRNA sequence
tcaccccaaagggtggcaca

SEQ ID NO: 747729 - DNA, 20 bp, Artificial
  CRISPR gRNA sequence
caccccaaagggtggcacag

SEQ ID NO: 747730 - DNA, 20 bp, Artificial
  CRISPR gRNA sequence
caaagggtggcacagaggat

SEQ ID NO: 747731 - DNA, 20 bp, Artificial
  CRISPR gRNA sequence
ggtggcacagaggatgagat

SEQ ID NO: 747732 - DNA, 20 bp, Artificial
  CRISPR gRNA sequence
gtggcacagaggatgagatg

SEQ ID NO: 747733 - DNA, 20 bp, Artificial
  CRISPR gRNA sequence
tggcacagaggatgagatga

SEQ ID NO: 747734 - DNA, 20 bp, Artificial
  CRISPR gRNA sequence
tacccgtgtgcacctgcacg

SEQ ID NO: 747735 - DNA, 20 bp, Artificial
  CRISPR gRNA sequence
ctgcacgaagcctgacccat

SEQ ID NO: 747736 - DNA, 20 bp, Artificial
  CRISPR gRNA sequence
acgaagcctgacccatgagt

SEQ ID NO: 747737 - DNA, 20 bp, Artificial
  CRISPR gRNA sequence
ctgacccatgagtcggctgt

SEQ ID NO: 747738 - DNA, 20 bp, Artificial
  CRISPR gRNA sequence
catgagtcggctgtaagcaa

SEQ ID NO: 747739 - DNA, 20 bp, Artificial
  CRISPR gRNA sequence
tcggctgtaagcaatagcca

SEQ ID NO: 747740 - DNA, 20 bp, Artificial
  CRISPR gRNA sequence
agcaatagccatggtttgaa

SEQ ID NO: 747741 - DNA, 20 bp, Artificial
  CRISPR gRNA sequence
gccatggtttgaatagattt

SEQ ID NO: 747742 - DNA, 20 bp, Artificial
  CRISPR gRNA sequence
ccatggtttgaatagatttc

SEQ ID NO: 747743 - DNA, 20 bp, Artificial
  CRISPR gRNA sequence
gaatagatttcaggaacttt

SEQ ID NO: 747744 - DNA, 20 bp, Artificial
  CRISPR gRNA sequence
aatagatttcaggaactttt

SEQ ID NO: 747745 - DNA, 20 bp, Artificial
  CRISPR gRNA sequence
atctgtttccccatcgtaat

SEQ ID NO: 747746 - DNA, 20 bp, Artificial
  CRISPR gRNA sequence
tgtttccccatcgtaatcag

SEQ ID NO: 747747 - DNA, 20 bp, Artificial
  CRISPR gRNA sequence
gcagtaaatctccttaaaac

SEQ ID NO: 747748 - DNA, 20 bp, Artificial
  CRISPR gRNA sequence
gtaaatctccttaaaacgag

SEQ ID NO: 747749 - DNA, 20 bp, Artificial
  CRISPR gRNA sequence
cttaaaacgagaagcatctg

SEQ ID NO: 747750 - DNA, 20 bp, Artificial
  CRISPR gRNA sequence
ttaaaacgagaagcatctgt

SEQ ID NO: 747751 - DNA, 20 bp, Artificial
  CRISPR gRNA sequence
aaaacgagaagcatctgtgg

SEQ ID NO: 747752 - DNA, 20 bp, Artificial
  CRISPR gRNA sequence
aaacgagaagcatctgtggg

SEQ ID NO: 747753 - DNA, 20 bp, Artificial
  CRISPR gRNA sequence
gaagcatctgtgggaggaca

SEQ ID NO: 747754 - DNA, 20 bp, Artificial
  CRISPR gRNA sequence
aagcatctgtgggaggacat

SEQ ID NO: 747755 - DNA, 20 bp, Artificial
  CRISPR gRNA sequence
agcatctgtgggaggacatg

SEQ ID NO: 747756 - DNA, 20 bp, Artificial
  CRISPR gRNA sequence
ggacatggggtgctgcatga

SEQ ID NO: 747757 - DNA, 20 bp, Artificial
  CRISPR gRNA sequence
acatggggtgctgcatgaaa

SEQ ID NO: 747758 - DNA, 20 bp, Artificial
  CRISPR gRNA sequence
catggggtgctgcatgaaag

SEQ ID NO: 747759 - DNA, 20 bp, Artificial
  CRISPR gRNA sequence
atggggtgctgcatgaaaga

SEQ ID NO: 747760 - DNA, 20 bp, Artificial
  CRISPR gRNA sequence
gggtgctgcatgaaagaggg

SEQ ID NO: 747761 - DNA, 20 bp, Artificial
  CRISPR gRNA sequence
gctgcatgaaagagggaagt

SEQ ID NO: 747762 - DNA, 20 bp, Artificial
  CRISPR gRNA sequence
ctgcatgaaagagggaagtt

SEQ ID NO: 747763 - DNA, 20 bp, Artificial
  CRISPR gRNA sequence
tgcatgaaagagggaagttg

SEQ ID NO: 747764 - DNA, 20 bp, Artificial
  CRISPR gRNA sequence
ttggggtcactgcatctaat

SEQ ID NO: 747765 - DNA, 20 bp, Artificial
  CRISPR gRNA sequence
gggtcactgcatctaattgg

SEQ ID NO: 747766 - DNA, 20 bp, Artificial
  CRISPR gRNA sequence
cactgcatctaattggtggc

SEQ ID NO: 747767 - DNA, 20 bp, Artificial
  CRISPR gRNA sequence
catctaattggtggccagtt

SEQ ID NO: 747768 - DNA, 20 bp, Artificial
  CRISPR gRNA sequence
atctaattggtggccagttt

SEQ ID NO: 747769 - DNA, 20 bp, Artificial
  CRISPR gRNA sequence
tctaattggtggccagtttg

SEQ ID NO: 747770 - DNA, 20 bp, Artificial
  CRISPR gRNA sequence
ctaattggtggccagtttgg

SEQ ID NO: 747771 - DNA, 20 bp, Artificial
  CRISPR gRNA sequence
taattggtggccagtttggg

SEQ ID NO: 747772 - DNA, 20 bp, Artificial
  CRISPR gRNA sequence
ttggtggccagtttgggggg

SEQ ID NO: 747773 - DNA, 20 bp, Artificial
  CRISPR gRNA sequence
tggtggccagtttggggggt

SEQ ID NO: 747774 - DNA, 20 bp, Artificial
  CRISPR gRNA sequence
ggtggccagtttggggggtg

SEQ ID NO: 747775 - DNA, 20 bp, Artificial
  CRISPR gRNA sequence
tttggggggtggggtgtccc

SEQ ID NO: 747776 - DNA, 20 bp, Artificial
  CRISPR gRNA sequence
ttggggggtggggtgtccca

SEQ ID NO: 747777 - DNA, 20 bp, Artificial
  CRISPR gRNA sequence
gggtggggtgtcccaaggct

SEQ ID NO: 747778 - DNA, 20 bp, Artificial
  CRISPR gRNA sequence
ggtggggtgtcccaaggctg

SEQ ID NO: 747779 - DNA, 20 bp, Artificial
  CRISPR gRNA sequence
gggtgtcccaaggctgaggc

SEQ ID NO: 747780 - DNA, 20 bp, Artificial
  CRISPR gRNA sequence
tgtcccaaggctgaggcaag

SEQ ID NO: 747781 - DNA, 20 bp, Artificial
  CRISPR gRNA sequence
cccaaggctgaggcaagcgg

SEQ ID NO: 747782 - DNA, 20 bp, Artificial
  CRISPR gRNA sequence
tgaggcaagcggcagcaact

SEQ ID NO: 747783 - DNA, 20 bp, Artificial
  CRISPR gRNA sequence
caagcggcagcaacttggat

SEQ ID NO: 747784 - DNA, 20 bp, Artificial
  CRISPR gRNA sequence
gcggcagcaacttggatgag

SEQ ID NO: 747785 - DNA, 20 bp, Artificial
  CRISPR gRNA sequence
gcagcaacttggatgagaag

SEQ ID NO: 747786 - DNA, 20 bp, Artificial
  CRISPR gRNA sequence
caacttggatgagaagcaga

SEQ ID NO: 747787 - DNA, 20 bp, Artificial
  CRISPR gRNA sequence
ttggatgagaagcagaaagt

SEQ ID NO: 747788 - DNA, 20 bp, Artificial
  CRISPR gRNA sequence
tgagaagcagaaagtgagtg

SEQ ID NO: 747789 - DNA, 20 bp, Artificial
  CRISPR gRNA sequence
gaagcagaaagtgagtgaag

SEQ ID NO: 747790 - DNA, 20 bp, Artificial
  CRISPR gRNA sequence
cagaaagtgagtgaagtggc

SEQ ID NO: 747791 - DNA, 20 bp, Artificial
  CRISPR gRNA sequence
agaaagtgagtgaagtggct

SEQ ID NO: 747792 - DNA, 20 bp, Artificial
  CRISPR gRNA sequence
aagtgagtgaagtggctggg

SEQ ID NO: 747793 - DNA, 20 bp, Artificial
  CRISPR gRNA sequence
tgaagtggctgggaagtgat

SEQ ID NO: 747794 - DNA, 20 bp, Artificial
  CRISPR gRNA sequence
gaagtggctgggaagtgatc

SEQ ID NO: 747795 - DNA, 20 bp, Artificial
  CRISPR gRNA sequence
aagtggctgggaagtgatcg

SEQ ID NO: 747796 - DNA, 20 bp, Artificial
  CRISPR gRNA sequence
atcggggacttgcaccttgt

SEQ ID NO: 747797 - DNA, 20 bp, Artificial
  CRISPR gRNA sequence
tcggggacttgcaccttgta

SEQ ID NO: 747798 - DNA, 20 bp, Artificial
  CRISPR gRNA sequence
gcaccttgtaaggtttccct

SEQ ID NO: 747799 - DNA, 20 bp, Artificial
  CRISPR gRNA sequence
accttgtaaggtttccctga

SEQ ID NO: 747800 - DNA, 20 bp, Artificial
  CRISPR gRNA sequence
tttccctgagagatgtcccc

SEQ ID NO: 747801 - DNA, 20 bp, Artificial
  CRISPR gRNA sequence
cccctagaatgccaccctat

SEQ ID NO: 747802 - DNA, 20 bp, Artificial
  CRISPR gRNA sequence
ccctagaatgccaccctatt

SEQ ID NO: 747803 - DNA, 20 bp, Artificial
  CRISPR gRNA sequence
tgccaccctattaggcaatg

SEQ ID NO: 747804 - DNA, 20 bp, Artificial
  CRISPR gRNA sequence
gccaccctattaggcaatgt

SEQ ID NO: 747805 - DNA, 20 bp, Artificial
  CRISPR gRNA sequence
ccaccctattaggcaatgta

SEQ ID NO: 747806 - DNA, 20 bp, Artificial
  CRISPR gRNA sequence
caccctattaggcaatgtag

SEQ ID NO: 747807 - DNA, 20 bp, Artificial
  CRISPR gRNA sequence
ctattaggcaatgtagggga

SEQ ID NO: 747808 - DNA, 20 bp, Artificial
  CRISPR gRNA sequence
tattaggcaatgtaggggat

SEQ ID NO: 747809 - DNA, 20 bp, Artificial
  CRISPR gRNA sequence
aggcaatgtaggggatagga

SEQ ID NO: 747810 - DNA, 20 bp, Artificial
  CRISPR gRNA sequence
gcaatgtaggggataggaca

SEQ ID NO: 747811 - DNA, 20 bp, Artificial
  CRISPR gRNA sequence
aatgtaggggataggacaga

SEQ ID NO: 747812 - DNA, 20 bp, Artificial
  CRISPR gRNA sequence
atgtaggggataggacagag

SEQ ID NO: 747813 - DNA, 20 bp, Artificial
  CRISPR gRNA sequence
ggggataggacagagaggac

SEQ ID NO: 747814 - DNA, 20 bp, Artificial
  CRISPR gRNA sequence
gggataggacagagaggacc

SEQ ID NO: 747815 - DNA, 20 bp, Artificial
  CRISPR gRNA sequence
gataggacagagaggaccag

SEQ ID NO: 747816 - DNA, 20 bp, Artificial
  CRISPR gRNA sequence
aggaccaggagccctctaat

SEQ ID NO: 747817 - DNA, 20 bp, Artificial
  CRISPR gRNA sequence
ggaccaggagccctctaatt

SEQ ID NO: 747818 - DNA, 20 bp, Artificial
  CRISPR gRNA sequence
tgaccttaaacactcccacc

SEQ ID NO: 747819 - DNA, 20 bp, Artificial
  CRISPR gRNA sequence
cttaaacactcccacccagt

SEQ ID NO: 747820 - DNA, 20 bp, Artificial
  CRISPR gRNA sequence
cactcccacccagtaagtca

SEQ ID NO: 747821 - DNA, 20 bp, Artificial
  CRISPR gRNA sequence
cacccagtaagtcatggcta

SEQ ID NO: 747822 - DNA, 20 bp, Artificial
  CRISPR gRNA sequence
agtaagtcatggctaaagac

SEQ ID NO: 747823 - DNA, 20 bp, Artificial
  CRISPR gRNA sequence
catggctaaagaccagaacc

SEQ ID NO: 747824 - DNA, 20 bp, Artificial
  CRISPR gRNA sequence
aacctggcaaatgttcaaac

SEQ ID NO: 747825 - DNA, 20 bp, Artificial
  CRISPR gRNA sequence
cctggcaaatgttcaaacaa

SEQ ID NO: 747826 - DNA, 20 bp, Artificial
  CRISPR gRNA sequence
aatgttcaaacaagagacac

SEQ ID NO: 747827 - DNA, 20 bp, Artificial
  CRISPR gRNA sequence
ttcaaacaagagacaccagt

SEQ ID NO: 747828 - DNA, 20 bp, Artificial
  CRISPR gRNA sequence
agacaccagttagcaaattc

SEQ ID NO: 747829 - DNA, 20 bp, Artificial
  CRISPR gRNA sequence
acaccagttagcaaattcaa

SEQ ID NO: 747830 - DNA, 20 bp, Artificial
  CRISPR gRNA sequence
tgctcgatacttaaatcctg

SEQ ID NO: 747831 - DNA, 20 bp, Artificial
  CRISPR gRNA sequence
gctcgatacttaaatcctga

SEQ ID NO: 747832 - DNA, 20 bp, Artificial
  CRISPR gRNA sequence
ctgaaggtctgacactgtgt

SEQ ID NO: 747833 - DNA, 20 bp, Artificial
  CRISPR gRNA sequence
ggtctgacactgtgtaagtc

SEQ ID NO: 747834 - DNA, 20 bp, Artificial
  CRISPR gRNA sequence
acactgtgtaagtcaagcca

SEQ ID NO: 747835 - DNA, 20 bp, Artificial
  CRISPR gRNA sequence
cactgtgtaagtcaagccat

SEQ ID NO: 747836 - DNA, 20 bp, Artificial
  CRISPR gRNA sequence
ctgtgtaagtcaagccatag

SEQ ID NO: 747837 - DNA, 20 bp, Artificial
  CRISPR gRNA sequence
gtaagtcaagccataggaga

SEQ ID NO: 747838 - DNA, 20 bp, Artificial
  CRISPR gRNA sequence
caagccataggagaaagcgc

SEQ ID NO: 747839 - DNA, 20 bp, Artificial
  CRISPR gRNA sequence
gagaaagcgctggctgcctt

SEQ ID NO: 747840 - DNA, 20 bp, Artificial
  CRISPR gRNA sequence
ggctgcctttggtctcctga

SEQ ID NO: 747841 - DNA, 20 bp, Artificial
  CRISPR gRNA sequence
tgcctttggtctcctgatgg

SEQ ID NO: 747842 - DNA, 20 bp, Artificial
  CRISPR gRNA sequence
tttggtctcctgatggcaga

SEQ ID NO: 747843 - DNA, 20 bp, Artificial
  CRISPR gRNA sequence
agatagcgttcttacactcc

SEQ ID NO: 747844 - DNA, 20 bp, Artificial
  CRISPR gRNA sequence
tcttacactcctggaaaatg

SEQ ID NO: 747845 - DNA, 20 bp, Artificial
  CRISPR gRNA sequence
acactcctggaaaatgcaga

SEQ ID NO: 747846 - DNA, 20 bp, Artificial
  CRISPR gRNA sequence
actcctggaaaatgcagata

SEQ ID NO: 747847 - DNA, 20 bp, Artificial
  CRISPR gRNA sequence
gcagatagagtttcatttat

SEQ ID NO: 747848 - DNA, 20 bp, Artificial
  CRISPR gRNA sequence
tcatttatcagtcgtcaaaa

SEQ ID NO: 747849 - DNA, 20 bp, Artificial
  CRISPR gRNA sequence
catttatcagtcgtcaaaat

SEQ ID NO: 747850 - DNA, 20 bp, Artificial
  CRISPR gRNA sequence
tcgtcaaaatgggcccctca

SEQ ID NO: 747851 - DNA, 20 bp, Artificial
  CRISPR gRNA sequence
gtcaaaatgggcccctcatg

SEQ ID NO: 747852 - DNA, 20 bp, Artificial
  CRISPR gRNA sequence
tcaaaatgggcccctcatgg

SEQ ID NO: 747853 - DNA, 20 bp, Artificial
  CRISPR gRNA sequence
ctcatggaggccccatctgc

SEQ ID NO: 747854 - DNA, 20 bp, Artificial
  CRISPR gRNA sequence
tggaggccccatctgctgga

SEQ ID NO: 747855 - DNA, 20 bp, Artificial
  CRISPR gRNA sequence
ccatctgctggacagacacg

SEQ ID NO: 747856 - DNA, 20 bp, Artificial
  CRISPR gRNA sequence
cagacacgcagatcgcttgc

SEQ ID NO: 747857 - DNA, 20 bp, Artificial
  CRISPR gRNA sequence
cacgcagatcgcttgctgga

SEQ ID NO: 747858 - DNA, 20 bp, Artificial
  CRISPR gRNA sequence
ctggacagcacccatgtgaa

SEQ ID NO: 747859 - DNA, 20 bp, Artificial
  CRISPR gRNA sequence
agcacccatgtgaaaagaaa

SEQ ID NO: 747860 - DNA, 20 bp, Artificial
  CRISPR gRNA sequence
cacccatgtgaaaagaaatg

SEQ ID NO: 747861 - DNA, 20 bp, Artificial
  CRISPR gRNA sequence
atgtgaaaagaaatggagtc

SEQ ID NO: 747862 - DNA, 20 bp, Artificial
  CRISPR gRNA sequence
gtgaaaagaaatggagtccg

SEQ ID NO: 747863 - DNA, 20 bp, Artificial
  CRISPR gRNA sequence
aaatggagtccggagctgtg

SEQ ID NO: 747864 - DNA, 20 bp, Artificial
  CRISPR gRNA sequence
aatggagtccggagctgtgc

SEQ ID NO: 747865 - DNA, 20 bp, Artificial
  CRISPR gRNA sequence
atggagtccggagctgtgca

SEQ ID NO: 747866 - DNA, 20 bp, Artificial
  CRISPR gRNA sequence
ggagctgtgcagggccctcc

SEQ ID NO: 747867 - DNA, 20 bp, Artificial
  CRISPR gRNA sequence
gagctgtgcagggccctcct

SEQ ID NO: 747868 - DNA, 20 bp, Artificial
  CRISPR gRNA sequence
gggctcgctcctgttccctg

SEQ ID NO: 747869 - DNA, 20 bp, Artificial
  CRISPR gRNA sequence
ggctcgctcctgttccctgc

SEQ ID NO: 747870 - DNA, 20 bp, Artificial
  CRISPR gRNA sequence
gctcgctcctgttccctgca

SEQ ID NO: 747871 - DNA, 20 bp, Artificial
  CRISPR gRNA sequence
gttccctgcagggcatctgc

SEQ ID NO: 747872 - DNA, 20 bp, Artificial
  CRISPR gRNA sequence
ccctgcagggcatctgccag

SEQ ID NO: 747873 - DNA, 20 bp, Artificial
  CRISPR gRNA sequence
cctgcagggcatctgccagc

SEQ ID NO: 747874 - DNA, 20 bp, Artificial
  CRISPR gRNA sequence
ctgcagggcatctgccagca

SEQ ID NO: 747875 - DNA, 20 bp, Artificial
  CRISPR gRNA sequence
tgcagggcatctgccagcag

SEQ ID NO: 747876 - DNA, 20 bp, Artificial
  CRISPR gRNA sequence
agggcatctgccagcagggg

SEQ ID NO: 747877 - DNA, 20 bp, Artificial
  CRISPR gRNA sequence
gggcatctgccagcaggggc

SEQ ID NO: 747878 - DNA, 20 bp, Artificial
  CRISPR gRNA sequence
ggcatctgccagcaggggca

SEQ ID NO: 747879 - DNA, 20 bp, Artificial
  CRISPR gRNA sequence
gcaggggcagggatgttgta

SEQ ID NO: 747880 - DNA, 20 bp, Artificial
  CRISPR gRNA sequence
caggggcagggatgttgtat

SEQ ID NO: 747881 - DNA, 20 bp, Artificial
  CRISPR gRNA sequence
aggggcagggatgttgtatg

SEQ ID NO: 747882 - DNA, 20 bp, Artificial
  CRISPR gRNA sequence
ggcagggatgttgtatgggg

SEQ ID NO: 747883 - DNA, 20 bp, Artificial
  CRISPR gRNA sequence
gaagccttcccttccatgac

SEQ ID NO: 747884 - DNA, 20 bp, Artificial
  CRISPR gRNA sequence
cttctctgtctgtctgtccc

SEQ ID NO: 747885 - DNA, 20 bp, Artificial
  CRISPR gRNA sequence
ttctctgtctgtctgtccct

SEQ ID NO: 747886 - DNA, 20 bp, Artificial
  CRISPR gRNA sequence
tctgtctgtccctaggtgcc

SEQ ID NO: 747887 - DNA, 20 bp, Artificial
  CRISPR gRNA sequence
ctgtctgtccctaggtgccc

SEQ ID NO: 747888 - DNA, 20 bp, Artificial
  CRISPR gRNA sequence
gtctgtccctaggtgcccag

SEQ ID NO: 747889 - DNA, 20 bp, Artificial
  CRISPR gRNA sequence
gtccctaggtgcccaggagc

SEQ ID NO: 747890 - DNA, 20 bp, Artificial
  CRISPR gRNA sequence
taggtgcccaggagctggtg

SEQ ID NO: 747891 - DNA, 20 bp, Artificial
  CRISPR gRNA sequence
tgcccaggagctggtgcgga

SEQ ID NO: 747892 - DNA, 20 bp, Artificial
  CRISPR gRNA sequence
caggagctggtgcggatgga

SEQ ID NO: 747893 - DNA, 20 bp, Artificial
  CRISPR gRNA sequence
aggagctggtgcggatggac

SEQ ID NO: 747894 - DNA, 20 bp, Artificial
  CRISPR gRNA sequence
gctggtgcggatggacaggt

SEQ ID NO: 747895 - DNA, 20 bp, Artificial
  CRISPR gRNA sequence
ctggtgcggatggacaggta

SEQ ID NO: 747896 - DNA, 20 bp, Artificial
  CRISPR gRNA sequence
ggatggacaggtaaggccca

SEQ ID NO: 747897 - DNA, 20 bp, Artificial
  CRISPR gRNA sequence
atggacaggtaaggcccatg

SEQ ID NO: 747898 - DNA, 20 bp, Artificial
  CRISPR gRNA sequence
aggcccatggagaccttctt

SEQ ID NO: 747899 - DNA, 20 bp, Artificial
  CRISPR gRNA sequence
accttcttgagaaaacttcc

SEQ ID NO: 747900 - DNA, 20 bp, Artificial
  CRISPR gRNA sequence
ccttcttgagaaaacttcct

SEQ ID NO: 747901 - DNA, 20 bp, Artificial
  CRISPR gRNA sequence
cttgagaaaacttcctgggc

SEQ ID NO: 747902 - DNA, 20 bp, Artificial
  CRISPR gRNA sequence
aacttcctgggccggctatc

SEQ ID NO: 747903 - DNA, 20 bp, Artificial
  CRISPR gRNA sequence
acttcctgggccggctatcc

SEQ ID NO: 747904 - DNA, 20 bp, Artificial
  CRISPR gRNA sequence
tcctgggccggctatccagg

SEQ ID NO: 747905 - DNA, 20 bp, Artificial
  CRISPR gRNA sequence
ctgggccggctatccaggaa

SEQ ID NO: 747906 - DNA, 20 bp, Artificial
  CRISPR gRNA sequence
caggaagagatacttctgtg

SEQ ID NO: 747907 - DNA, 20 bp, Artificial
  CRISPR gRNA sequence
gaagagatacttctgtgcag

SEQ ID NO: 747908 - DNA, 20 bp, Artificial
  CRISPR gRNA sequence
aagagatacttctgtgcagt

SEQ ID NO: 747909 - DNA, 20 bp, Artificial
  CRISPR gRNA sequence
agagatacttctgtgcagta

SEQ ID NO: 747910 - DNA, 20 bp, Artificial
  CRISPR gRNA sequence
gagatacttctgtgcagtag

SEQ ID NO: 747911 - DNA, 20 bp, Artificial
  CRISPR gRNA sequence
tgtgcagtaggggccctgtt

SEQ ID NO: 747912 - DNA, 20 bp, Artificial
  CRISPR gRNA sequence
aggggccctgtttagctgcc

SEQ ID NO: 747913 - DNA, 20 bp, Artificial
  CRISPR gRNA sequence
gggccctgtttagctgccta

SEQ ID NO: 747914 - DNA, 20 bp, Artificial
  CRISPR gRNA sequence
ccctgtttagctgcctagag

SEQ ID NO: 747915 - DNA, 20 bp, Artificial
  CRISPR gRNA sequence
gtttagctgcctagagcagc

SEQ ID NO: 747916 - DNA, 20 bp, Artificial
  CRISPR gRNA sequence
agctgcctagagcagctggt

SEQ ID NO: 747917 - DNA, 20 bp, Artificial
  CRISPR gRNA sequence
tgcctagagcagctggtcag

SEQ ID NO: 747918 - DNA, 20 bp, Artificial
  CRISPR gRNA sequence
cctagagcagctggtcagaa

SEQ ID NO: 747919 - DNA, 20 bp, Artificial
  CRISPR gRNA sequence
gcctctgccatctgctgctg

SEQ ID NO: 747920 - DNA, 20 bp, Artificial
  CRISPR gRNA sequence
ctgaagcctgcacatctgtg

SEQ ID NO: 747921 - DNA, 20 bp, Artificial
  CRISPR gRNA sequence
gcctgcacatctgtgcagat

SEQ ID NO: 747922 - DNA, 20 bp, Artificial
  CRISPR gRNA sequence
gttctcctgccaccccgact

SEQ ID NO: 747923 - DNA, 20 bp, Artificial
  CRISPR gRNA sequence
ctcctgccaccccgactcag

SEQ ID NO: 747924 - DNA, 20 bp, Artificial
  CRISPR gRNA sequence
tcctgccaccccgactcagc

SEQ ID NO: 747925 - DNA, 20 bp, Artificial
  CRISPR gRNA sequence
ccaccccgactcagcaggct

SEQ ID NO: 747926 - DNA, 20 bp, Artificial
  CRISPR gRNA sequence
ggctgagctctgattctgct

SEQ ID NO: 747927 - DNA, 20 bp, Artificial
  CRISPR gRNA sequence
atgtgtcatgcacccacctt

SEQ ID NO: 747928 - DNA, 20 bp, Artificial
  CRISPR gRNA sequence
tgtgtcatgcacccaccttc

SEQ ID NO: 747929 - DNA, 20 bp, Artificial
  CRISPR gRNA sequence
atgcacccaccttcgggtct

SEQ ID NO: 747930 - DNA, 20 bp, Artificial
  CRISPR gRNA sequence
cacccaccttcgggtctcag

SEQ ID NO: 747931 - DNA, 20 bp, Artificial
  CRISPR gRNA sequence
caccttcgggtctcagtggt

SEQ ID NO: 747932 - DNA, 20 bp, Artificial
  CRISPR gRNA sequence
tcgggtctcagtggtcagcc

SEQ ID NO: 747933 - DNA, 20 bp, Artificial
  CRISPR gRNA sequence
cgggtctcagtggtcagcct

SEQ ID NO: 747934 - DNA, 20 bp, Artificial
  CRISPR gRNA sequence
tctcagtggtcagcctgggc

SEQ ID NO: 747935 - DNA, 20 bp, Artificial
  CRISPR gRNA sequence
ctcagtggtcagcctgggcc

SEQ ID NO: 747936 - DNA, 20 bp, Artificial
  CRISPR gRNA sequence
gtggtcagcctgggccagga

SEQ ID NO: 747937 - DNA, 20 bp, Artificial
  CRISPR gRNA sequence
tggtcagcctgggccaggat

SEQ ID NO: 747938 - DNA, 20 bp, Artificial
  CRISPR gRNA sequence
ggtcagcctgggccaggatg

SEQ ID NO: 747939 - DNA, 20 bp, Artificial
  CRISPR gRNA sequence
agcctgggccaggatgggga

SEQ ID NO: 747940 - DNA, 20 bp, Artificial
  CRISPR gRNA sequence
gcctgggccaggatggggac

SEQ ID NO: 747941 - DNA, 20 bp, Artificial
  CRISPR gRNA sequence
cctgggccaggatggggaca

SEQ ID NO: 747942 - DNA, 20 bp, Artificial
  CRISPR gRNA sequence
tgggccaggatggggacagg

SEQ ID NO: 747943 - DNA, 20 bp, Artificial
  CRISPR gRNA sequence
gggccaggatggggacaggg

SEQ ID NO: 747944 - DNA, 20 bp, Artificial
  CRISPR gRNA sequence
ccaggatggggacagggagg

SEQ ID NO: 747945 - DNA, 20 bp, Artificial
  CRISPR gRNA sequence
gacagggaggaagcactgtc

SEQ ID NO: 747946 - DNA, 20 bp, Artificial
  CRISPR gRNA sequence
acagggaggaagcactgtct

SEQ ID NO: 747947 - DNA, 20 bp, Artificial
  CRISPR gRNA sequence
cagggaggaagcactgtctg

SEQ ID NO: 747948 - DNA, 20 bp, Artificial
  CRISPR gRNA sequence
ggaggaagcactgtctgggg

SEQ ID NO: 747949 - DNA, 20 bp, Artificial
  CRISPR gRNA sequence
gaagcactgtctggggcaga

SEQ ID NO: 747950 - DNA, 20 bp, Artificial
  CRISPR gRNA sequence
cactgtctggggcagacagt

SEQ ID NO: 747951 - DNA, 20 bp, Artificial
  CRISPR gRNA sequence
ggcagacagtgagacatgca

SEQ ID NO: 747952 - DNA, 20 bp, Artificial
  CRISPR gRNA sequence
gcagacagtgagacatgcaa

SEQ ID NO: 747953 - DNA, 20 bp, Artificial
  CRISPR gRNA sequence
agacagtgagacatgcaaag

SEQ ID NO: 747954 - DNA, 20 bp, Artificial
  CRISPR gRNA sequence
gacagtgagacatgcaaagg

SEQ ID NO: 747955 - DNA, 20 bp, Artificial
  CRISPR gRNA sequence
gtgagacatgcaaaggaggc

SEQ ID NO: 747956 - DNA, 20 bp, Artificial
  CRISPR gRNA sequence
agacatgcaaaggaggccag

SEQ ID NO: 747957 - DNA, 20 bp, Artificial
  CRISPR gRNA sequence
gacatgcaaaggaggccagc

SEQ ID NO: 747958 - DNA, 20 bp, Artificial
  CRISPR gRNA sequence
gcaaaggaggccagcgggcc

SEQ ID NO: 747959 - DNA, 20 bp, Artificial
  CRISPR gRNA sequence
gaggccagcgggcccagccc

SEQ ID NO: 747960 - DNA, 20 bp, Artificial
  CRISPR gRNA sequence
agcgggcccagccccagcca

SEQ ID NO: 747961 - DNA, 20 bp, Artificial
  CRISPR gRNA sequence
cagccccagccacagccctt

SEQ ID NO: 747962 - DNA, 20 bp, Artificial
  CRISPR gRNA sequence
tgagctgtgcctcctgcccg

SEQ ID NO: 747963 - DNA, 20 bp, Artificial
  CRISPR gRNA sequence
agctgtgcctcctgcccgca

SEQ ID NO: 747964 - DNA, 20 bp, Artificial
  CRISPR gRNA sequence
tcctgcccgcagagaactcc

SEQ ID NO: 747965 - DNA, 20 bp, Artificial
  CRISPR gRNA sequence
cctgcccgcagagaactcca

SEQ ID NO: 747966 - DNA, 20 bp, Artificial
  CRISPR gRNA sequence
tgcccgcagagaactccaag

SEQ ID NO: 747967 - DNA, 20 bp, Artificial
  CRISPR gRNA sequence
cgcagagaactccaaggaga

SEQ ID NO: 747968 - DNA, 20 bp, Artificial
  CRISPR gRNA sequence
aactccaaggagaaagctgt

SEQ ID NO: 747969 - DNA, 20 bp, Artificial
  CRISPR gRNA sequence
actccaaggagaaagctgtt

SEQ ID NO: 747970 - DNA, 20 bp, Artificial
  CRISPR gRNA sequence
agaaagctgttaggccgctg

SEQ ID NO: 747971 - DNA, 20 bp, Artificial
  CRISPR gRNA sequence
gaaagctgttaggccgctgc

SEQ ID NO: 747972 - DNA, 20 bp, Artificial
  CRISPR gRNA sequence
gttaggccgctgcaggccac

SEQ ID NO: 747973 - DNA, 20 bp, Artificial
  CRISPR gRNA sequence
ttaggccgctgcaggccaca

SEQ ID NO: 747974 - DNA, 20 bp, Artificial
  CRISPR gRNA sequence
taggccgctgcaggccacaa

SEQ ID NO: 747975 - DNA, 20 bp, Artificial
  CRISPR gRNA sequence
gccgctgcaggccacaaggg

SEQ ID NO: 747976 - DNA, 20 bp, Artificial
  CRISPR gRNA sequence
cgctgcaggccacaagggca

SEQ ID NO: 747977 - DNA, 20 bp, Artificial
  CRISPR gRNA sequence
gctgcaggccacaagggcag

SEQ ID NO: 747978 - DNA, 20 bp, Artificial
  CRISPR gRNA sequence
aggccacaagggcagaggct

SEQ ID NO: 747979 - DNA, 20 bp, Artificial
  CRISPR gRNA sequence
ggccacaagggcagaggctg

SEQ ID NO: 747980 - DNA, 20 bp, Artificial
  CRISPR gRNA sequence
gccacaagggcagaggctga

SEQ ID NO: 747981 - DNA, 20 bp, Artificial
  CRISPR gRNA sequence
ccacaagggcagaggctgag

SEQ ID NO: 747982 - DNA, 20 bp, Artificial
  CRISPR gRNA sequence
gggcagaggctgaggggtcc

SEQ ID NO: 747983 - DNA, 20 bp, Artificial
  CRISPR gRNA sequence
gcagaggctgaggggtccca

SEQ ID NO: 747984 - DNA, 20 bp, Artificial
  CRISPR gRNA sequence
gaggctgaggggtcccagag

SEQ ID NO: 747985 - DNA, 20 bp, Artificial
  CRISPR gRNA sequence
tgaggggtcccagagtggtg

SEQ ID NO: 747986 - DNA, 20 bp, Artificial
  CRISPR gRNA sequence
ggggtcccagagtggtgcag

SEQ ID NO: 747987 - DNA, 20 bp, Artificial
  CRISPR gRNA sequence
gggtcccagagtggtgcagt

SEQ ID NO: 747988 - DNA, 20 bp, Artificial
  CRISPR gRNA sequence
cccagagtggtgcagtgggc

SEQ ID NO: 747989 - DNA, 20 bp, Artificial
  CRISPR gRNA sequence
ccagagtggtgcagtgggct

SEQ ID NO: 747990 - DNA, 20 bp, Artificial
  CRISPR gRNA sequence
gtggtgcagtgggctgggtc

SEQ ID NO: 747991 - DNA, 20 bp, Artificial
  CRISPR gRNA sequence
tggtgcagtgggctgggtct

SEQ ID NO: 747992 - DNA, 20 bp, Artificial
  CRISPR gRNA sequence
ggtgcagtgggctgggtcta

SEQ ID NO: 747993 - DNA, 20 bp, Artificial
  CRISPR gRNA sequence
gtgcagtgggctgggtctag

SEQ ID NO: 747994 - DNA, 20 bp, Artificial
  CRISPR gRNA sequence
cagtgggctgggtctagggg

SEQ ID NO: 747995 - DNA, 20 bp, Artificial
  CRISPR gRNA sequence
gtgggctgggtctaggggca

SEQ ID NO: 747996 - DNA, 20 bp, Artificial
  CRISPR gRNA sequence
tgggctgggtctaggggcag

SEQ ID NO: 747997 - DNA, 20 bp, Artificial
  CRISPR gRNA sequence
gggctgggtctaggggcaga

SEQ ID NO: 747998 - DNA, 20 bp, Artificial
  CRISPR gRNA sequence
ggctgggtctaggggcagag

SEQ ID NO: 747999 - DNA, 20 bp, Artificial
  CRISPR gRNA sequence
gggtctaggggcagagggga

SEQ ID NO: 748000 - DNA, 20 bp, Artificial
  CRISPR gRNA sequence
ggtctaggggcagaggggat

SEQ ID NO: 748001 - DNA, 20 bp, Artificial
  CRISPR gRNA sequence
gtctaggggcagaggggatg

SEQ ID NO: 748002 - DNA, 20 bp, Artificial
  CRISPR gRNA sequence
aggggatggggactgtgtat

SEQ ID NO: 748003 - DNA, 20 bp, Artificial
  CRISPR gRNA sequence
gactgtgtattggtgtgctc

SEQ ID NO: 748004 - DNA, 20 bp, Artificial
  CRISPR gRNA sequence
actgtgtattggtgtgctct

SEQ ID NO: 748005 - DNA, 20 bp, Artificial
  CRISPR gRNA sequence
gtgtattggtgtgctctggg

SEQ ID NO: 748006 - DNA, 20 bp, Artificial
  CRISPR gRNA sequence
tgtattggtgtgctctgggc

SEQ ID NO: 748007 - DNA, 20 bp, Artificial
  CRISPR gRNA sequence
attggtgtgctctgggcagg

SEQ ID NO: 748008 - DNA, 20 bp, Artificial
  CRISPR gRNA sequence
ctgggcaggaagctgccatg

SEQ ID NO: 748009 - DNA, 20 bp, Artificial
  CRISPR gRNA sequence
caggaagctgccatgcagcc

SEQ ID NO: 748010 - DNA, 20 bp, Artificial
  CRISPR gRNA sequence
agctgccatgcagcctggcc

SEQ ID NO: 748011 - DNA, 20 bp, Artificial
  CRISPR gRNA sequence
ctgccatgcagcctggcctg

SEQ ID NO: 748012 - DNA, 20 bp, Artificial
  CRISPR gRNA sequence
tgccatgcagcctggcctgg

SEQ ID NO: 748013 - DNA, 20 bp, Artificial
  CRISPR gRNA sequence
gccatgcagcctggcctgga

SEQ ID NO: 748014 - DNA, 20 bp, Artificial
  CRISPR gRNA sequence
cctggcctggagggtgtgtt

SEQ ID NO: 748015 - DNA, 20 bp, Artificial
  CRISPR gRNA sequence
ctggcctggagggtgtgttc

SEQ ID NO: 748016 - DNA, 20 bp, Artificial
  CRISPR gRNA sequence
tggcctggagggtgtgttca

SEQ ID NO: 748017 - DNA, 20 bp, Artificial
  CRISPR gRNA sequence
agggtgtgttcagggaaccc

SEQ ID NO: 748018 - DNA, 20 bp, Artificial
  CRISPR gRNA sequence
gggaacccaagttcctgccc

SEQ ID NO: 748019 - DNA, 20 bp, Artificial
  CRISPR gRNA sequence
tacctgcaacaccaaacaca

SEQ ID NO: 748020 - DNA, 20 bp, Artificial
  CRISPR gRNA sequence
caccaaacacaaagctcctc

SEQ ID NO: 748021 - DNA, 20 bp, Artificial
  CRISPR gRNA sequence
accaaacacaaagctcctct

SEQ ID NO: 748022 - DNA, 20 bp, Artificial
  CRISPR gRNA sequence
aagctcctctaggtgtttga

SEQ ID NO: 748023 - DNA, 20 bp, Artificial
  CRISPR gRNA sequence
agctcctctaggtgtttgaa

SEQ ID NO: 748024 - DNA, 20 bp, Artificial
  CRISPR gRNA sequence
gctcctctaggtgtttgaaa

SEQ ID NO: 748025 - DNA, 20 bp, Artificial
  CRISPR gRNA sequence
gtttgaaagggatgatcttc

SEQ ID NO: 748026 - DNA, 20 bp, Artificial
  CRISPR gRNA sequence
gaaagggatgatcttcaaga

SEQ ID NO: 748027 - DNA, 20 bp, Artificial
  CRISPR gRNA sequence
aaagggatgatcttcaagac

SEQ ID NO: 748028 - DNA, 20 bp, Artificial
  CRISPR gRNA sequence
atgatcttcaagacaggttg

SEQ ID NO: 748029 - DNA, 20 bp, Artificial
  CRISPR gRNA sequence
tgatcttcaagacaggttga

SEQ ID NO: 748030 - DNA, 20 bp, Artificial
  CRISPR gRNA sequence
tcttcaagacaggttgaagg

SEQ ID NO: 748031 - DNA, 20 bp, Artificial
  CRISPR gRNA sequence
agtcctgcttgcaactcatc

SEQ ID NO: 748032 - DNA, 20 bp, Artificial
  CRISPR gRNA sequence
ttgcaactcatctagaatct

SEQ ID NO: 748033 - DNA, 20 bp, Artificial
  CRISPR gRNA sequence
gcaactcatctagaatctaa

SEQ ID NO: 748034 - DNA, 20 bp, Artificial
  CRISPR gRNA sequence
catctagaatctaagagttg

SEQ ID NO: 748035 - DNA, 20 bp, Artificial
  CRISPR gRNA sequence
atctagaatctaagagttgc

SEQ ID NO: 748036 - DNA, 20 bp, Artificial
  CRISPR gRNA sequence
tctagaatctaagagttgca

SEQ ID NO: 748037 - DNA, 20 bp, Artificial
  CRISPR gRNA sequence
ctagaatctaagagttgcag

SEQ ID NO: 748038 - DNA, 20 bp, Artificial
  CRISPR gRNA sequence
ctaagagttgcaggggtctt

SEQ ID NO: 748039 - DNA, 20 bp, Artificial
  CRISPR gRNA sequence
agagttgcaggggtcttcag

SEQ ID NO: 748040 - DNA, 20 bp, Artificial
  CRISPR gRNA sequence
gaagttatcccactcccaac

SEQ ID NO: 748041 - DNA, 20 bp, Artificial
  CRISPR gRNA sequence
aagttatcccactcccaact

SEQ ID NO: 748042 - DNA, 20 bp, Artificial
  CRISPR gRNA sequence
ttatcccactcccaactggg

SEQ ID NO: 748043 - DNA, 20 bp, Artificial
  CRISPR gRNA sequence
atcccactcccaactgggaa

SEQ ID NO: 748044 - DNA, 20 bp, Artificial
  CRISPR gRNA sequence
ccactcccaactgggaagag

SEQ ID NO: 748045 - DNA, 20 bp, Artificial
  CRISPR gRNA sequence
actcccaactgggaagagaa

SEQ ID NO: 748046 - DNA, 20 bp, Artificial
  CRISPR gRNA sequence
gagaagagaacccctcccct

SEQ ID NO: 748047 - DNA, 20 bp, Artificial
  CRISPR gRNA sequence
agaacccctcccctcagctc

SEQ ID NO: 748048 - DNA, 20 bp, Artificial
  CRISPR gRNA sequence
cccctcccctcagctcaaga

SEQ ID NO: 748049 - DNA, 20 bp, Artificial
  CRISPR gRNA sequence
ccctcccctcagctcaagac

SEQ ID NO: 748050 - DNA, 20 bp, Artificial
  CRISPR gRNA sequence
cctcagctcaagacaggctt

SEQ ID NO: 748051 - DNA, 20 bp, Artificial
  CRISPR gRNA sequence
ctcagctcaagacaggcttt

SEQ ID NO: 748052 - DNA, 20 bp, Artificial
  CRISPR gRNA sequence
tcagctcaagacaggctttg

SEQ ID NO: 748053 - DNA, 20 bp, Artificial
  CRISPR gRNA sequence
gccatcaactctattgacca

SEQ ID NO: 748054 - DNA, 20 bp, Artificial
  CRISPR gRNA sequence
catcaactctattgaccaaa

SEQ ID NO: 748055 - DNA, 20 bp, Artificial
  CRISPR gRNA sequence
aaacttgtccccaaattcct

SEQ ID NO: 748056 - DNA, 20 bp, Artificial
  CRISPR gRNA sequence
aacttgtccccaaattcctg

SEQ ID NO: 748057 - DNA, 20 bp, Artificial
  CRISPR gRNA sequence
tccccaaattcctgaggctg

SEQ ID NO: 748058 - DNA, 20 bp, Artificial
  CRISPR gRNA sequence
aattcctgaggctgaagttc

SEQ ID NO: 748059 - DNA, 20 bp, Artificial
  CRISPR gRNA sequence
tcctgaggctgaagttctag

SEQ ID NO: 748060 - DNA, 20 bp, Artificial
  CRISPR gRNA sequence
ctagaagtgtctgtgatttt

SEQ ID NO: 748061 - DNA, 20 bp, Artificial
  CRISPR gRNA sequence
gtctgtgatttttggcttcc

SEQ ID NO: 748062 - DNA, 20 bp, Artificial
  CRISPR gRNA sequence
tttggcttcctggctgtgcc

SEQ ID NO: 748063 - DNA, 20 bp, Artificial
  CRISPR gRNA sequence
ttggcttcctggctgtgccc

SEQ ID NO: 748064 - DNA, 20 bp, Artificial
  CRISPR gRNA sequence
tggcttcctggctgtgcccg

SEQ ID NO: 748065 - DNA, 20 bp, Artificial
  CRISPR gRNA sequence
ctggctgtgcccggggttga

SEQ ID NO: 748066 - DNA, 20 bp, Artificial
  CRISPR gRNA sequence
ctgtgcccggggttgatggt

SEQ ID NO: 748067 - DNA, 20 bp, Artificial
  CRISPR gRNA sequence
cggggttgatggtcagacca

SEQ ID NO: 748068 - DNA, 20 bp, Artificial
  CRISPR gRNA sequence
ggggttgatggtcagaccac

SEQ ID NO: 748069 - DNA, 20 bp, Artificial
  CRISPR gRNA sequence
gggttgatggtcagaccaca

SEQ ID NO: 748070 - DNA, 20 bp, Artificial
  CRISPR gRNA sequence
gttgatggtcagaccacagg

SEQ ID NO: 748071 - DNA, 20 bp, Artificial
  CRISPR gRNA sequence
ttgatggtcagaccacaggg

SEQ ID NO: 748072 - DNA, 20 bp, Artificial
  CRISPR gRNA sequence
gatggtcagaccacagggag

SEQ ID NO: 748073 - DNA, 20 bp, Artificial
  CRISPR gRNA sequence
gtcagaccacagggaggagc

SEQ ID NO: 748074 - DNA, 20 bp, Artificial
  CRISPR gRNA sequence
tcagaccacagggaggagct

SEQ ID NO: 748075 - DNA, 20 bp, Artificial
  CRISPR gRNA sequence
cagaccacagggaggagctg

SEQ ID NO: 748076 - DNA, 20 bp, Artificial
  CRISPR gRNA sequence
ggaggagctggggtctgttc

SEQ ID NO: 748077 - DNA, 20 bp, Artificial
  CRISPR gRNA sequence
ggagctggggtctgttctgg

SEQ ID NO: 748078 - DNA, 20 bp, Artificial
  CRISPR gRNA sequence
gagctggggtctgttctggt

SEQ ID NO: 748079 - DNA, 20 bp, Artificial
  CRISPR gRNA sequence
ctggtgggccctgatgccct

SEQ ID NO: 748080 - DNA, 20 bp, Artificial
  CRISPR gRNA sequence
gggccctgatgccctcagct

SEQ ID NO: 748081 - DNA, 20 bp, Artificial
  CRISPR gRNA sequence
ggccctgatgccctcagctc

SEQ ID NO: 748082 - DNA, 20 bp, Artificial
  CRISPR gRNA sequence
ctgatgccctcagctcagga

SEQ ID NO: 748083 - DNA, 20 bp, Artificial
  CRISPR gRNA sequence
tgatgccctcagctcaggac

SEQ ID NO: 748084 - DNA, 20 bp, Artificial
  CRISPR gRNA sequence
tgccctcagctcaggacagg

SEQ ID NO: 748085 - DNA, 20 bp, Artificial
  CRISPR gRNA sequence
gccctcagctcaggacaggt

SEQ ID NO: 748086 - DNA, 20 bp, Artificial
  CRISPR gRNA sequence
ctcagctcaggacaggtggg

SEQ ID NO: 748087 - DNA, 20 bp, Artificial
  CRISPR gRNA sequence
tcagctcaggacaggtgggc

SEQ ID NO: 748088 - DNA, 20 bp, Artificial
  CRISPR gRNA sequence
tcaggacaggtgggcaggtg

SEQ ID NO: 748089 - DNA, 20 bp, Artificial
  CRISPR gRNA sequence
aggtgggcaggtgcagccca

SEQ ID NO: 748090 - DNA, 20 bp, Artificial
  CRISPR gRNA sequence
agcccatggcctttgctctg

SEQ ID NO: 748091 - DNA, 20 bp, Artificial
  CRISPR gRNA sequence
gcccatggcctttgctctgt

SEQ ID NO: 748092 - DNA, 20 bp, Artificial
  CRISPR gRNA sequence
tggcctttgctctgtgggcc

SEQ ID NO: 748093 - DNA, 20 bp, Artificial
  CRISPR gRNA sequence
ctggctcctgccttcttgct

SEQ ID NO: 748094 - DNA, 20 bp, Artificial
  CRISPR gRNA sequence
ggctcctgccttcttgcttg

SEQ ID NO: 748095 - DNA, 20 bp, Artificial
  CRISPR gRNA sequence
tcttgcttggagatgctgct

SEQ ID NO: 748096 - DNA, 20 bp, Artificial
  CRISPR gRNA sequence
cttgcttggagatgctgctg

SEQ ID NO: 748097 - DNA, 20 bp, Artificial
  CRISPR gRNA sequence
ttggagatgctgctgaggct

SEQ ID NO: 748098 - DNA, 20 bp, Artificial
  CRISPR gRNA sequence
tggagatgctgctgaggctt

SEQ ID NO: 748099 - DNA, 20 bp, Artificial
  CRISPR gRNA sequence
ggagatgctgctgaggcttg

SEQ ID NO: 748100 - DNA, 20 bp, Artificial
  CRISPR gRNA sequence
atgctgctgaggcttgggga

SEQ ID NO: 748101 - DNA, 20 bp, Artificial
  CRISPR gRNA sequence
tgctgctgaggcttggggat

SEQ ID NO: 748102 - DNA, 20 bp, Artificial
  CRISPR gRNA sequence
gctgctgaggcttggggatg

SEQ ID NO: 748103 - DNA, 20 bp, Artificial
  CRISPR gRNA sequence
gaggcttggggatggggatg

SEQ ID NO: 748104 - DNA, 20 bp, Artificial
  CRISPR gRNA sequence
aggcttggggatggggatgt

SEQ ID NO: 748105 - DNA, 20 bp, Artificial
  CRISPR gRNA sequence
ttggggatggggatgtaggt

SEQ ID NO: 748106 - DNA, 20 bp, Artificial
  CRISPR gRNA sequence
ggggatggggatgtaggtga

SEQ ID NO: 748107 - DNA, 20 bp, Artificial
  CRISPR gRNA sequence
atggggatgtaggtgagaga

SEQ ID NO: 748108 - DNA, 20 bp, Artificial
  CRISPR gRNA sequence
tggggatgtaggtgagagaa

SEQ ID NO: 748109 - DNA, 20 bp, Artificial
  CRISPR gRNA sequence
ggggatgtaggtgagagaaa

SEQ ID NO: 748110 - DNA, 20 bp, Artificial
  CRISPR gRNA sequence
ggatgtaggtgagagaaagg

SEQ ID NO: 748111 - DNA, 20 bp, Artificial
  CRISPR gRNA sequence
gatgtaggtgagagaaaggg

SEQ ID NO: 748112 - DNA, 20 bp, Artificial
  CRISPR gRNA sequence
tgtaggtgagagaaagggag

SEQ ID NO: 748113 - DNA, 20 bp, Artificial
  CRISPR gRNA sequence
taggtgagagaaagggagga

SEQ ID NO: 748114 - DNA, 20 bp, Artificial
  CRISPR gRNA sequence
gaaagggaggagagaaaaac

SEQ ID NO: 748115 - DNA, 20 bp, Artificial
  CRISPR gRNA sequence
aaagggaggagagaaaaact

SEQ ID NO: 748116 - DNA, 20 bp, Artificial
  CRISPR gRNA sequence
aagggaggagagaaaaactg

SEQ ID NO: 748117 - DNA, 20 bp, Artificial
  CRISPR gRNA sequence
agggaggagagaaaaactgg

SEQ ID NO: 748118 - DNA, 20 bp, Artificial
  CRISPR gRNA sequence
gaggagagaaaaactggggg

SEQ ID NO: 748119 - DNA, 20 bp, Artificial
  CRISPR gRNA sequence
aggagagaaaaactgggggc

SEQ ID NO: 748120 - DNA, 20 bp, Artificial
  CRISPR gRNA sequence
ggagagaaaaactgggggca

SEQ ID NO: 748121 - DNA, 20 bp, Artificial
  CRISPR gRNA sequence
agagaaaaactgggggcagg

SEQ ID NO: 748122 - DNA, 20 bp, Artificial
  CRISPR gRNA sequence
gagaaaaactgggggcaggg

SEQ ID NO: 748123 - DNA, 20 bp, Artificial
  CRISPR gRNA sequence
agaaaaactgggggcaggga

SEQ ID NO: 748124 - DNA, 20 bp, Artificial
  CRISPR gRNA sequence
aaaactgggggcagggaggg

SEQ ID NO: 748125 - DNA, 20 bp, Artificial
  CRISPR gRNA sequence
aactgggggcagggagggca

SEQ ID NO: 748126 - DNA, 20 bp, Artificial
  CRISPR gRNA sequence
ggagggcagagttcacgctc

SEQ ID NO: 748127 - DNA, 20 bp, Artificial
  CRISPR gRNA sequence
ggcagagttcacgctccgga

SEQ ID NO: 748128 - DNA, 20 bp, Artificial
  CRISPR gRNA sequence
agttcacgctccggacagca

SEQ ID NO: 748129 - DNA, 20 bp, Artificial
  CRISPR gRNA sequence
gcacagatgaccttccattc

SEQ ID NO: 748130 - DNA, 20 bp, Artificial
  CRISPR gRNA sequence
gaccttccattctggttctg

SEQ ID NO: 748131 - DNA, 20 bp, Artificial
  CRISPR gRNA sequence
cttccattctggttctgtgg

SEQ ID NO: 748132 - DNA, 20 bp, Artificial
  CRISPR gRNA sequence
gttctgtggcagcaacattc

SEQ ID NO: 748133 - DNA, 20 bp, Artificial
  CRISPR gRNA sequence
ttctgtggcagcaacattca

SEQ ID NO: 748134 - DNA, 20 bp, Artificial
  CRISPR gRNA sequence
tctgtggcagcaacattcaa

SEQ ID NO: 748135 - DNA, 20 bp, Artificial
  CRISPR gRNA sequence
attcaagggattgaaaaccc

SEQ ID NO: 748136 - DNA, 20 bp, Artificial
  CRISPR gRNA sequence
gattgaaaaccccggctttg

SEQ ID NO: 748137 - DNA, 20 bp, Artificial
  CRISPR gRNA sequence
ttgaagcctcaccacctgcc

SEQ ID NO: 748138 - DNA, 20 bp, Artificial
  CRISPR gRNA sequence
tgaagcctcaccacctgccc

SEQ ID NO: 748139 - DNA, 20 bp, Artificial
  CRISPR gRNA sequence
gaagcctcaccacctgccca

SEQ ID NO: 748140 - DNA, 20 bp, Artificial
  CRISPR gRNA sequence
aagcctcaccacctgcccag

SEQ ID NO: 748141 - DNA, 20 bp, Artificial
  CRISPR gRNA sequence
cacctgcccaggggataccc

SEQ ID NO: 748142 - DNA, 20 bp, Artificial
  CRISPR gRNA sequence
acctgcccaggggatacccg

SEQ ID NO: 748143 - DNA, 20 bp, Artificial
  CRISPR gRNA sequence
ccaggggatacccgaggcca

SEQ ID NO: 748144 - DNA, 20 bp, Artificial
  CRISPR gRNA sequence
gggatacccgaggccaaagt

SEQ ID NO: 748145 - DNA, 20 bp, Artificial
  CRISPR gRNA sequence
ggatacccgaggccaaagtc

SEQ ID NO: 748146 - DNA, 20 bp, Artificial
  CRISPR gRNA sequence
caggcaccccctgtcctatg

SEQ ID NO: 748147 - DNA, 20 bp, Artificial
  CRISPR gRNA sequence
accccctgtcctatgtggcc

SEQ ID NO: 748148 - DNA, 20 bp, Artificial
  CRISPR gRNA sequence
ccctgtcctatgtggcccag

SEQ ID NO: 748149 - DNA, 20 bp, Artificial
  CRISPR gRNA sequence
tgtcctatgtggcccagcgg

SEQ ID NO: 748150 - DNA, 20 bp, Artificial
  CRISPR gRNA sequence
tggcccagcggcagccttct

SEQ ID NO: 748151 - DNA, 20 bp, Artificial
  CRISPR gRNA sequence
cagcggcagccttctgagtc

SEQ ID NO: 748152 - DNA, 20 bp, Artificial
  CRISPR gRNA sequence
agcggcagccttctgagtct

SEQ ID NO: 748153 - DNA, 20 bp, Artificial
  CRISPR gRNA sequence
ggcagccttctgagtctggg

SEQ ID NO: 748154 - DNA, 20 bp, Artificial
  CRISPR gRNA sequence
gtctgggcggcatctgcttt

SEQ ID NO: 748155 - DNA, 20 bp, Artificial
  CRISPR gRNA sequence
ctgggcggcatctgctttcg

SEQ ID NO: 748156 - DNA, 20 bp, Artificial
  CRISPR gRNA sequence
cggcatctgctttcggagcc

SEQ ID NO: 748157 - DNA, 20 bp, Artificial
  CRISPR gRNA sequence
cagcacccccctgtctcctc

SEQ ID NO: 748158 - DNA, 20 bp, Artificial
  CRISPR gRNA sequence
agcacccccctgtctcctcc

SEQ ID NO: 748159 - DNA, 20 bp, Artificial
  CRISPR gRNA sequence
cccctgtctcctccaggccc

SEQ ID NO: 748160 - DNA, 20 bp, Artificial
  CRISPR gRNA sequence
cctgtctcctccaggccccg

SEQ ID NO: 748161 - DNA, 20 bp, Artificial
  CRISPR gRNA sequence
agacgtcttcttcccatccc

SEQ ID NO: 748162 - DNA, 20 bp, Artificial
  CRISPR gRNA sequence
gacgtcttcttcccatccct

SEQ ID NO: 748163 - DNA, 20 bp, Artificial
  CRISPR gRNA sequence
tcttcttcccatccctgggt

SEQ ID NO: 748164 - DNA, 20 bp, Artificial
  CRISPR gRNA sequence
taagtgtttcctgaccttca

SEQ ID NO: 748165 - DNA, 20 bp, Artificial
  CRISPR gRNA sequence
ttcacagcacgatgacctgt

SEQ ID NO: 748166 - DNA, 20 bp, Artificial
  CRISPR gRNA sequence
tcacagcacgatgacctgta

SEQ ID NO: 748167 - DNA, 20 bp, Artificial
  CRISPR gRNA sequence
cctgtaaggtcatgacctca

SEQ ID NO: 748168 - DNA, 20 bp, Artificial
  CRISPR gRNA sequence
ggtcatgacctcatggcctg

SEQ ID NO: 748169 - DNA, 20 bp, Artificial
  CRISPR gRNA sequence
gtcatgacctcatggcctgc

SEQ ID NO: 748170 - DNA, 20 bp, Artificial
  CRISPR gRNA sequence
tcatgacctcatggcctgca

SEQ ID NO: 748171 - DNA, 20 bp, Artificial
  CRISPR gRNA sequence
cctcatggcctgcagggcat

SEQ ID NO: 748172 - DNA, 20 bp, Artificial
  CRISPR gRNA sequence
ctcactccctgccctccctg

SEQ ID NO: 748173 - DNA, 20 bp, Artificial
  CRISPR gRNA sequence
cactccctgccctccctgaa

SEQ ID NO: 748174 - DNA, 20 bp, Artificial
  CRISPR gRNA sequence
gccctccctgaagagttcca

SEQ ID NO: 748175 - DNA, 20 bp, Artificial
  CRISPR gRNA sequence
tgaagagttccacggcctca

SEQ ID NO: 748176 - DNA, 20 bp, Artificial
  CRISPR gRNA sequence
gaagagttccacggcctcac

SEQ ID NO: 748177 - DNA, 20 bp, Artificial
  CRISPR gRNA sequence
aagagttccacggcctcacg

SEQ ID NO: 748178 - DNA, 20 bp, Artificial
  CRISPR gRNA sequence
agttccacggcctcacgggg

SEQ ID NO: 748179 - DNA, 20 bp, Artificial
  CRISPR gRNA sequence
gttccacggcctcacggggt

SEQ ID NO: 748180 - DNA, 20 bp, Artificial
  CRISPR gRNA sequence
ttccacggcctcacggggtg

SEQ ID NO: 748181 - DNA, 20 bp, Artificial
  CRISPR gRNA sequence
cggcctcacggggtggggtt

SEQ ID NO: 748182 - DNA, 20 bp, Artificial
  CRISPR gRNA sequence
ggcctcacggggtggggttg

SEQ ID NO: 748183 - DNA, 20 bp, Artificial
  CRISPR gRNA sequence
gcctcacggggtggggttga

SEQ ID NO: 748184 - DNA, 20 bp, Artificial
  CRISPR gRNA sequence
cacggggtggggttgagggt

SEQ ID NO: 748185 - DNA, 20 bp, Artificial
  CRISPR gRNA sequence
acggggtggggttgagggtg

SEQ ID NO: 748186 - DNA, 20 bp, Artificial
  CRISPR gRNA sequence
cggggtggggttgagggtga

SEQ ID NO: 748187 - DNA, 20 bp, Artificial
  CRISPR gRNA sequence
gtggggttgagggtgaggga

SEQ ID NO: 748188 - DNA, 20 bp, Artificial
  CRISPR gRNA sequence
ggggttgagggtgagggaca

SEQ ID NO: 748189 - DNA, 20 bp, Artificial
  CRISPR gRNA sequence
gggttgagggtgagggacag

SEQ ID NO: 748190 - DNA, 20 bp, Artificial
  CRISPR gRNA sequence
ggttgagggtgagggacaga

SEQ ID NO: 748191 - DNA, 20 bp, Artificial
  CRISPR gRNA sequence
gttgagggtgagggacagag

SEQ ID NO: 748192 - DNA, 20 bp, Artificial
  CRISPR gRNA sequence
ggcccccattcacctccctg

SEQ ID NO: 748193 - DNA, 20 bp, Artificial
  CRISPR gRNA sequence
cccccattcacctccctgaa

SEQ ID NO: 748194 - DNA, 20 bp, Artificial
  CRISPR gRNA sequence
cacctccctgaagagttcca

SEQ ID NO: 748195 - DNA, 20 bp, Artificial
  CRISPR gRNA sequence
tgaagagttccacggcctca

SEQ ID NO: 748196 - DNA, 20 bp, Artificial
  CRISPR gRNA sequence
gaagagttccacggcctcac

SEQ ID NO: 748197 - DNA, 20 bp, Artificial
  CRISPR gRNA sequence
aagagttccacggcctcacg

SEQ ID NO: 748198 - DNA, 20 bp, Artificial
  CRISPR gRNA sequence
agttccacggcctcacgggg

SEQ ID NO: 748199 - DNA, 20 bp, Artificial
  CRISPR gRNA sequence
gttccacggcctcacggggt

SEQ ID NO: 748200 - DNA, 20 bp, Artificial
  CRISPR gRNA sequence
ttccacggcctcacggggtg

SEQ ID NO: 748201 - DNA, 20 bp, Artificial
  CRISPR gRNA sequence
cggcctcacggggtggggtt

SEQ ID NO: 748202 - DNA, 20 bp, Artificial
  CRISPR gRNA sequence
ggcctcacggggtggggttg

SEQ ID NO: 748203 - DNA, 20 bp, Artificial
  CRISPR gRNA sequence
gcctcacggggtggggttga

SEQ ID NO: 748204 - DNA, 20 bp, Artificial
  CRISPR gRNA sequence
cacggggtggggttgagggt

SEQ ID NO: 748205 - DNA, 20 bp, Artificial
  CRISPR gRNA sequence
acggggtggggttgagggtg

SEQ ID NO: 748206 - DNA, 20 bp, Artificial
  CRISPR gRNA sequence
cggggtggggttgagggtga

SEQ ID NO: 748207 - DNA, 20 bp, Artificial
  CRISPR gRNA sequence
gtggggttgagggtgaggga

SEQ ID NO: 748208 - DNA, 20 bp, Artificial
  CRISPR gRNA sequence
ggggttgagggtgagggaca

SEQ ID NO: 748209 - DNA, 20 bp, Artificial
  CRISPR gRNA sequence
gggttgagggtgagggacag

SEQ ID NO: 748210 - DNA, 20 bp, Artificial
  CRISPR gRNA sequence
ggttgagggtgagggacaga

SEQ ID NO: 748211 - DNA, 20 bp, Artificial
  CRISPR gRNA sequence
gttgagggtgagggacagag

SEQ ID NO: 748212 - DNA, 20 bp, Artificial
  CRISPR gRNA sequence
ggcccccattcacctccctg

SEQ ID NO: 748213 - DNA, 20 bp, Artificial
  CRISPR gRNA sequence
cccccattcacctccctgaa

SEQ ID NO: 748214 - DNA, 20 bp, Artificial
  CRISPR gRNA sequence
cacctccctgaagagttcca

SEQ ID NO: 748215 - DNA, 20 bp, Artificial
  CRISPR gRNA sequence
tgaagagttccacggcctca

SEQ ID NO: 748216 - DNA, 20 bp, Artificial
  CRISPR gRNA sequence
gaagagttccacggcctcac

SEQ ID NO: 748217 - DNA, 20 bp, Artificial
  CRISPR gRNA sequence
aagagttccacggcctcacg

SEQ ID NO: 748218 - DNA, 20 bp, Artificial
  CRISPR gRNA sequence
agttccacggcctcacgggg

SEQ ID NO: 748219 - DNA, 20 bp, Artificial
  CRISPR gRNA sequence
gttccacggcctcacggggt

SEQ ID NO: 748220 - DNA, 20 bp, Artificial
  CRISPR gRNA sequence
ttccacggcctcacggggtg

SEQ ID NO: 748221 - DNA, 20 bp, Artificial
  CRISPR gRNA sequence
cggcctcacggggtggggtt

SEQ ID NO: 748222 - DNA, 20 bp, Artificial
  CRISPR gRNA sequence
ggcctcacggggtggggttg

SEQ ID NO: 748223 - DNA, 20 bp, Artificial
  CRISPR gRNA sequence
gcctcacggggtggggttga

SEQ ID NO: 748224 - DNA, 20 bp, Artificial
  CRISPR gRNA sequence
cacggggtggggttgagggt

SEQ ID NO: 748225 - DNA, 20 bp, Artificial
  CRISPR gRNA sequence
acggggtggggttgagggtg

SEQ ID NO: 748226 - DNA, 20 bp, Artificial
  CRISPR gRNA sequence
cggggtggggttgagggtga

SEQ ID NO: 748227 - DNA, 20 bp, Artificial
  CRISPR gRNA sequence
gtggggttgagggtgaggga

SEQ ID NO: 748228 - DNA, 20 bp, Artificial
  CRISPR gRNA sequence
ggggttgagggtgagggaca

SEQ ID NO: 748229 - DNA, 20 bp, Artificial
  CRISPR gRNA sequence
gggttgagggtgagggacag

SEQ ID NO: 748230 - DNA, 20 bp, Artificial
  CRISPR gRNA sequence
ggttgagggtgagggacaga

SEQ ID NO: 748231 - DNA, 20 bp, Artificial
  CRISPR gRNA sequence
gttgagggtgagggacagag

SEQ ID NO: 748232 - DNA, 20 bp, Artificial
  CRISPR gRNA sequence
ggcccccattcacctccctg

SEQ ID NO: 748233 - DNA, 20 bp, Artificial
  CRISPR gRNA sequence
cccccattcacctccctgaa

SEQ ID NO: 748234 - DNA, 20 bp, Artificial
  CRISPR gRNA sequence
cacctccctgaagagttcca

SEQ ID NO: 748235 - DNA, 20 bp, Artificial
  CRISPR gRNA sequence
tgaagagttccacggcctca

SEQ ID NO: 748236 - DNA, 20 bp, Artificial
  CRISPR gRNA sequence
gaagagttccacggcctcac

SEQ ID NO: 748237 - DNA, 20 bp, Artificial
  CRISPR gRNA sequence
aagagttccacggcctcacg

SEQ ID NO: 748238 - DNA, 20 bp, Artificial
  CRISPR gRNA sequence
agttccacggcctcacgggg

SEQ ID NO: 748239 - DNA, 20 bp, Artificial
  CRISPR gRNA sequence
gttccacggcctcacggggt

SEQ ID NO: 748240 - DNA, 20 bp, Artificial
  CRISPR gRNA sequence
ttccacggcctcacggggtg

SEQ ID NO: 748241 - DNA, 20 bp, Artificial
  CRISPR gRNA sequence
cggcctcacggggtggggtt

SEQ ID NO: 748242 - DNA, 20 bp, Artificial
  CRISPR gRNA sequence
ggcctcacggggtggggttg

SEQ ID NO: 748243 - DNA, 20 bp, Artificial
  CRISPR gRNA sequence
gcctcacggggtggggttga

SEQ ID NO: 748244 - DNA, 20 bp, Artificial
  CRISPR gRNA sequence
cacggggtggggttgagggt

SEQ ID NO: 748245 - DNA, 20 bp, Artificial
  CRISPR gRNA sequence
acggggtggggttgagggtg

SEQ ID NO: 748246 - DNA, 20 bp, Artificial
  CRISPR gRNA sequence
cggggtggggttgagggtga

SEQ ID NO: 748247 - DNA, 20 bp, Artificial
  CRISPR gRNA sequence
ggggtggggttgagggtgag

SEQ ID NO: 748248 - DNA, 20 bp, Artificial
  CRISPR gRNA sequence
gtggggttgagggtgagggg

SEQ ID NO: 748249 - DNA, 20 bp, Artificial
  CRISPR gRNA sequence
ggggttgagggtgaggggca

SEQ ID NO: 748250 - DNA, 20 bp, Artificial
  CRISPR gRNA sequence
gggttgagggtgaggggcag

SEQ ID NO: 748251 - DNA, 20 bp, Artificial
  CRISPR gRNA sequence
ggttgagggtgaggggcaga

SEQ ID NO: 748252 - DNA, 20 bp, Artificial
  CRISPR gRNA sequence
gttgagggtgaggggcagag

SEQ ID NO: 748253 - DNA, 20 bp, Artificial
  CRISPR gRNA sequence
ctttgcttctccttttcttg

SEQ ID NO: 748254 - DNA, 20 bp, Artificial
  CRISPR gRNA sequence
tccctgactctccaaacttt

SEQ ID NO: 748255 - DNA, 20 bp, Artificial
  CRISPR gRNA sequence
ccctgactctccaaactttg

SEQ ID NO: 748256 - DNA, 20 bp, Artificial
  CRISPR gRNA sequence
ctccaaactttgaggtcatc

SEQ ID NO: 748257 - DNA, 20 bp, Artificial
  CRISPR gRNA sequence
aactttgaggtcatctagcc

SEQ ID NO: 748258 - DNA, 20 bp, Artificial
  CRISPR gRNA sequence
ttgaggtcatctagcccagc

SEQ ID NO: 748259 - DNA, 20 bp, Artificial
  CRISPR gRNA sequence
tgaggtcatctagcccagct

SEQ ID NO: 748260 - DNA, 20 bp, Artificial
  CRISPR gRNA sequence
gaggtcatctagcccagctg

SEQ ID NO: 748261 - DNA, 20 bp, Artificial
  CRISPR gRNA sequence
aggtcatctagcccagctgg

SEQ ID NO: 748262 - DNA, 20 bp, Artificial
  CRISPR gRNA sequence
catctagcccagctggggga

SEQ ID NO: 748263 - DNA, 20 bp, Artificial
  CRISPR gRNA sequence
ctagcccagctgggggacag

SEQ ID NO: 748264 - DNA, 20 bp, Artificial
  CRISPR gRNA sequence
tagcccagctgggggacagt

SEQ ID NO: 748265 - DNA, 20 bp, Artificial
  CRISPR gRNA sequence
tgggggacagtgggctgttg

SEQ ID NO: 748266 - DNA, 20 bp, Artificial
  CRISPR gRNA sequence
ggacagtgggctgttgtggc

SEQ ID NO: 748267 - DNA, 20 bp, Artificial
  CRISPR gRNA sequence
gacagtgggctgttgtggct

SEQ ID NO: 748268 - DNA, 20 bp, Artificial
  CRISPR gRNA sequence
tgggctgttgtggctgggtc

SEQ ID NO: 748269 - DNA, 20 bp, Artificial
  CRISPR gRNA sequence
gggctgttgtggctgggtct

SEQ ID NO: 748270 - DNA, 20 bp, Artificial
  CRISPR gRNA sequence
ggctgttgtggctgggtctg

SEQ ID NO: 748271 - DNA, 20 bp, Artificial
  CRISPR gRNA sequence
tgttgtggctgggtctgggg

SEQ ID NO: 748272 - DNA, 20 bp, Artificial
  CRISPR gRNA sequence
gttgtggctgggtctggggc

SEQ ID NO: 748273 - DNA, 20 bp, Artificial
  CRISPR gRNA sequence
ggtctggggcaggtgcattt

SEQ ID NO: 748274 - DNA, 20 bp, Artificial
  CRISPR gRNA sequence
tggggcaggtgcatttgagc

SEQ ID NO: 748275 - DNA, 20 bp, Artificial
  CRISPR gRNA sequence
ggggcaggtgcatttgagcc

SEQ ID NO: 748276 - DNA, 20 bp, Artificial
  CRISPR gRNA sequence
gggcaggtgcatttgagcca

SEQ ID NO: 748277 - DNA, 20 bp, Artificial
  CRISPR gRNA sequence
aggtgcatttgagccagggc

SEQ ID NO: 748278 - DNA, 20 bp, Artificial
  CRISPR gRNA sequence
tgagccagggctggctctgt

SEQ ID NO: 748279 - DNA, 20 bp, Artificial
  CRISPR gRNA sequence
gccagggctggctctgtgag

SEQ ID NO: 748280 - DNA, 20 bp, Artificial
  CRISPR gRNA sequence
ggctctgtgagtggcctcct

SEQ ID NO: 748281 - DNA, 20 bp, Artificial
  CRISPR gRNA sequence
gtgagtggcctccttggcct

SEQ ID NO: 748282 - DNA, 20 bp, Artificial
  CRISPR gRNA sequence
ggcctccttggcctcggccc

SEQ ID NO: 748283 - DNA, 20 bp, Artificial
  CRISPR gRNA sequence
tggttccctccctcctgctc

SEQ ID NO: 748284 - DNA, 20 bp, Artificial
  CRISPR gRNA sequence
ggttccctccctcctgctct

SEQ ID NO: 748285 - DNA, 20 bp, Artificial
  CRISPR gRNA sequence
cctccctcctgctctgggct

SEQ ID NO: 748286 - DNA, 20 bp, Artificial
  CRISPR gRNA sequence
gctcagatactgtgacatcc

SEQ ID NO: 748287 - DNA, 20 bp, Artificial
  CRISPR gRNA sequence
cagatactgtgacatcccag

SEQ ID NO: 748288 - DNA, 20 bp, Artificial
  CRISPR gRNA sequence
actgtgacatcccagaagcc

SEQ ID NO: 748289 - DNA, 20 bp, Artificial
  CRISPR gRNA sequence
gcccagcccctcaacccctc

SEQ ID NO: 748290 - DNA, 20 bp, Artificial
  CRISPR gRNA sequence
caacccctctggatgctaca

SEQ ID NO: 748291 - DNA, 20 bp, Artificial
  CRISPR gRNA sequence
aacccctctggatgctacat

SEQ ID NO: 748292 - DNA, 20 bp, Artificial
  CRISPR gRNA sequence
acccctctggatgctacatg

SEQ ID NO: 748293 - DNA, 20 bp, Artificial
  CRISPR gRNA sequence
tggatgctacatggggatgc

SEQ ID NO: 748294 - DNA, 20 bp, Artificial
  CRISPR gRNA sequence
tgctacatggggatgctgga

SEQ ID NO: 748295 - DNA, 20 bp, Artificial
  CRISPR gRNA sequence
catggggatgctggacggct

SEQ ID NO: 748296 - DNA, 20 bp, Artificial
  CRISPR gRNA sequence
gacggctcagcccctgttcc

SEQ ID NO: 748297 - DNA, 20 bp, Artificial
  CRISPR gRNA sequence
acggctcagcccctgttcca

SEQ ID NO: 748298 - DNA, 20 bp, Artificial
  CRISPR gRNA sequence
agcccctgttccaaggattt

SEQ ID NO: 748299 - DNA, 20 bp, Artificial
  CRISPR gRNA sequence
gcccctgttccaaggatttt

SEQ ID NO: 748300 - DNA, 20 bp, Artificial
  CRISPR gRNA sequence
cccctgttccaaggattttg

SEQ ID NO: 748301 - DNA, 20 bp, Artificial
  CRISPR gRNA sequence
tccaaggattttggggtgct

SEQ ID NO: 748302 - DNA, 20 bp, Artificial
  CRISPR gRNA sequence
ggggtgctgagattctcccc

SEQ ID NO: 748303 - DNA, 20 bp, Artificial
  CRISPR gRNA sequence
ggtgctgagattctccccta

SEQ ID NO: 748304 - DNA, 20 bp, Artificial
  CRISPR gRNA sequence
cctagagacctgaaattcac

SEQ ID NO: 748305 - DNA, 20 bp, Artificial
  CRISPR gRNA sequence
gacctgaaattcaccagcta

SEQ ID NO: 748306 - DNA, 20 bp, Artificial
  CRISPR gRNA sequence
tgccaaatgacttacatctt

SEQ ID NO: 748307 - DNA, 20 bp, Artificial
  CRISPR gRNA sequence
caaatgacttacatcttaag

SEQ ID NO: 748308 - DNA, 20 bp, Artificial
  CRISPR gRNA sequence
acttacatcttaagaagtct

SEQ ID NO: 748309 - DNA, 20 bp, Artificial
  CRISPR gRNA sequence
ttaagaagtctcagaacgtc

SEQ ID NO: 748310 - DNA, 20 bp, Artificial
  CRISPR gRNA sequence
tctcagaacgtccagccctt

SEQ ID NO: 748311 - DNA, 20 bp, Artificial
  CRISPR gRNA sequence
cagaacgtccagcccttcag

SEQ ID NO: 748312 - DNA, 20 bp, Artificial
  CRISPR gRNA sequence
ccttcagcagctctcgttct

SEQ ID NO: 748313 - DNA, 20 bp, Artificial
  CRISPR gRNA sequence
cagctctcgttctgagacat

SEQ ID NO: 748314 - DNA, 20 bp, Artificial
  CRISPR gRNA sequence
tcgttctgagacatgagcct

SEQ ID NO: 748315 - DNA, 20 bp, Artificial
  CRISPR gRNA sequence
cgttctgagacatgagcctt

SEQ ID NO: 748316 - DNA, 20 bp, Artificial
  CRISPR gRNA sequence
gagacatgagccttgggatg

SEQ ID NO: 748317 - DNA, 20 bp, Artificial
  CRISPR gRNA sequence
acatgagccttgggatgtgg

SEQ ID NO: 748318 - DNA, 20 bp, Artificial
  CRISPR gRNA sequence
gccttgggatgtggcagcat

SEQ ID NO: 748319 - DNA, 20 bp, Artificial
  CRISPR gRNA sequence
ttgggatgtggcagcatcag

SEQ ID NO: 748320 - DNA, 20 bp, Artificial
  CRISPR gRNA sequence
tgggatgtggcagcatcagt

SEQ ID NO: 748321 - DNA, 20 bp, Artificial
  CRISPR gRNA sequence
tgtggcagcatcagtgggac

SEQ ID NO: 748322 - DNA, 20 bp, Artificial
  CRISPR gRNA sequence
gcagcatcagtgggacaaga

SEQ ID NO: 748323 - DNA, 20 bp, Artificial
  CRISPR gRNA sequence
cagtgggacaagatggacac

SEQ ID NO: 748324 - DNA, 20 bp, Artificial
  CRISPR gRNA sequence
agtgggacaagatggacact

SEQ ID NO: 748325 - DNA, 20 bp, Artificial
  CRISPR gRNA sequence
tggacactgggccaccctcc

SEQ ID NO: 748326 - DNA, 20 bp, Artificial
  CRISPR gRNA sequence
ggacactgggccaccctccc

SEQ ID NO: 748327 - DNA, 20 bp, Artificial
  CRISPR gRNA sequence
tgggccaccctcccaggcac

SEQ ID NO: 748328 - DNA, 20 bp, Artificial
  CRISPR gRNA sequence
accctcccaggcaccagaca

SEQ ID NO: 748329 - DNA, 20 bp, Artificial
  CRISPR gRNA sequence
ccctcccaggcaccagacac

SEQ ID NO: 748330 - DNA, 20 bp, Artificial
  CRISPR gRNA sequence
cctcccaggcaccagacaca

SEQ ID NO: 748331 - DNA, 20 bp, Artificial
  CRISPR gRNA sequence
caggcaccagacacagggca

SEQ ID NO: 748332 - DNA, 20 bp, Artificial
  CRISPR gRNA sequence
gcaccagacacagggcacgg

SEQ ID NO: 748333 - DNA, 20 bp, Artificial
  CRISPR gRNA sequence
accagacacagggcacggtg

SEQ ID NO: 748334 - DNA, 20 bp, Artificial
  CRISPR gRNA sequence
cagacacagggcacggtgga

SEQ ID NO: 748335 - DNA, 20 bp, Artificial
  CRISPR gRNA sequence
gtggagagacttctcccccg

SEQ ID NO: 748336 - DNA, 20 bp, Artificial
  CRISPR gRNA sequence
cttctcccccgtggccgcct

SEQ ID NO: 748337 - DNA, 20 bp, Artificial
  CRISPR gRNA sequence
ttggctcccccgttttgccc

SEQ ID NO: 748338 - DNA, 20 bp, Artificial
  CRISPR gRNA sequence
tggctcccccgttttgcccg

SEQ ID NO: 748339 - DNA, 20 bp, Artificial
  CRISPR gRNA sequence
gcccgaggctgctcttctgt

SEQ ID NO: 748340 - DNA, 20 bp, Artificial
  CRISPR gRNA sequence
cagacttcctctttgtacca

SEQ ID NO: 748341 - DNA, 20 bp, Artificial
  CRISPR gRNA sequence
acttcctctttgtaccacag

SEQ ID NO: 748342 - DNA, 20 bp, Artificial
  CRISPR gRNA sequence
tctttgtaccacagtggctc

SEQ ID NO: 748343 - DNA, 20 bp, Artificial
  CRISPR gRNA sequence
ctttgtaccacagtggctct

SEQ ID NO: 748344 - DNA, 20 bp, Artificial
  CRISPR gRNA sequence
tttgtaccacagtggctctg

SEQ ID NO: 748345 - DNA, 20 bp, Artificial
  CRISPR gRNA sequence
taccacagtggctctggggc

SEQ ID NO: 748346 - DNA, 20 bp, Artificial
  CRISPR gRNA sequence
accacagtggctctggggcc

SEQ ID NO: 748347 - DNA, 20 bp, Artificial
  CRISPR gRNA sequence
ggccaggcctgcctgcccac

SEQ ID NO: 748348 - DNA, 20 bp, Artificial
  CRISPR gRNA sequence
ctggccatcgccaccttccc

SEQ ID NO: 748349 - DNA, 20 bp, Artificial
  CRISPR gRNA sequence
cttccccagctgcctcctac

SEQ ID NO: 748350 - DNA, 20 bp, Artificial
  CRISPR gRNA sequence
ccccagctgcctcctaccag

SEQ ID NO: 748351 - DNA, 20 bp, Artificial
  CRISPR gRNA sequence
tcctaccagcagtttctctg

SEQ ID NO: 748352 - DNA, 20 bp, Artificial
  CRISPR gRNA sequence
tttctctgaagatctgtcaa

SEQ ID NO: 748353 - DNA, 20 bp, Artificial
  CRISPR gRNA sequence
ttctctgaagatctgtcaac

SEQ ID NO: 748354 - DNA, 20 bp, Artificial
  CRISPR gRNA sequence
tgaagatctgtcaacaggtt

SEQ ID NO: 748355 - DNA, 20 bp, Artificial
  CRISPR gRNA sequence
gtcaacaggttaagtcaatc

SEQ ID NO: 748356 - DNA, 20 bp, Artificial
  CRISPR gRNA sequence
tcaacaggttaagtcaatct

SEQ ID NO: 748357 - DNA, 20 bp, Artificial
  CRISPR gRNA sequence
caacaggttaagtcaatctg

SEQ ID NO: 748358 - DNA, 20 bp, Artificial
  CRISPR gRNA sequence
ggcttccactgcctgcattc

SEQ ID NO: 748359 - DNA, 20 bp, Artificial
  CRISPR gRNA sequence
actgcctgcattccagtccc

SEQ ID NO: 748360 - DNA, 20 bp, Artificial
  CRISPR gRNA sequence
tgcctgcattccagtcccca

SEQ ID NO: 748361 - DNA, 20 bp, Artificial
  CRISPR gRNA sequence
gcattccagtccccagagct

SEQ ID NO: 748362 - DNA, 20 bp, Artificial
  CRISPR gRNA sequence
ttccagtccccagagcttgg

SEQ ID NO: 748363 - DNA, 20 bp, Artificial
  CRISPR gRNA sequence
agagcttggtggtcccgaaa

SEQ ID NO: 748364 - DNA, 20 bp, Artificial
  CRISPR gRNA sequence
gagcttggtggtcccgaaac

SEQ ID NO: 748365 - DNA, 20 bp, Artificial
  CRISPR gRNA sequence
cttggtggtcccgaaacggg

SEQ ID NO: 748366 - DNA, 20 bp, Artificial
  CRISPR gRNA sequence
ccgaaacgggaagtacatat

SEQ ID NO: 748367 - DNA, 20 bp, Artificial
  CRISPR gRNA sequence
cgaaacgggaagtacatatt

SEQ ID NO: 748368 - DNA, 20 bp, Artificial
  CRISPR gRNA sequence
gaaacgggaagtacatattg

SEQ ID NO: 748369 - DNA, 20 bp, Artificial
  CRISPR gRNA sequence
gggaagtacatattggggca

SEQ ID NO: 748370 - DNA, 20 bp, Artificial
  CRISPR gRNA sequence
aagtacatattggggcatgg

SEQ ID NO: 748371 - DNA, 20 bp, Artificial
  CRISPR gRNA sequence
tggggcatggtggcctccgt

SEQ ID NO: 748372 - DNA, 20 bp, Artificial
  CRISPR gRNA sequence
tggtggcctccgtgagcaaa

SEQ ID NO: 748373 - DNA, 20 bp, Artificial
  CRISPR gRNA sequence
tccgtgagcaaatggtgtct

SEQ ID NO: 748374 - DNA, 20 bp, Artificial
  CRISPR gRNA sequence
ccgtgagcaaatggtgtctt

SEQ ID NO: 748375 - DNA, 20 bp, Artificial
  CRISPR gRNA sequence
aatggtgtcttgggcaatct

SEQ ID NO: 748376 - DNA, 20 bp, Artificial
  CRISPR gRNA sequence
atggtgtcttgggcaatctg

SEQ ID NO: 748377 - DNA, 20 bp, Artificial
  CRISPR gRNA sequence
tgtcttgggcaatctgaggc

SEQ ID NO: 748378 - DNA, 20 bp, Artificial
  CRISPR gRNA sequence
gtcttgggcaatctgaggcc

SEQ ID NO: 748379 - DNA, 20 bp, Artificial
  CRISPR gRNA sequence
tgggcaatctgaggccagga

SEQ ID NO: 748380 - DNA, 20 bp, Artificial
  CRISPR gRNA sequence
acagatgttgccccacccac

SEQ ID NO: 748381 - DNA, 20 bp, Artificial
  CRISPR gRNA sequence
agatgttgccccacccactg

SEQ ID NO: 748382 - DNA, 20 bp, Artificial
  CRISPR gRNA sequence
gttgccccacccactggaga

SEQ ID NO: 748383 - DNA, 20 bp, Artificial
  CRISPR gRNA sequence
cacccactggagatggtgct

SEQ ID NO: 748384 - DNA, 20 bp, Artificial
  CRISPR gRNA sequence
acccactggagatggtgctg

SEQ ID NO: 748385 - DNA, 20 bp, Artificial
  CRISPR gRNA sequence
cccactggagatggtgctga

SEQ ID NO: 748386 - DNA, 20 bp, Artificial
  CRISPR gRNA sequence
cactggagatggtgctgagg

SEQ ID NO: 748387 - DNA, 20 bp, Artificial
  CRISPR gRNA sequence
actggagatggtgctgaggg

SEQ ID NO: 748388 - DNA, 20 bp, Artificial
  CRISPR gRNA sequence
ggagatggtgctgagggagg

SEQ ID NO: 748389 - DNA, 20 bp, Artificial
  CRISPR gRNA sequence
gagatggtgctgagggaggt

SEQ ID NO: 748390 - DNA, 20 bp, Artificial
  CRISPR gRNA sequence
atggtgctgagggaggtggg

SEQ ID NO: 748391 - DNA, 20 bp, Artificial
  CRISPR gRNA sequence
tggtgctgagggaggtgggt

SEQ ID NO: 748392 - DNA, 20 bp, Artificial
  CRISPR gRNA sequence
ggtgctgagggaggtgggtg

SEQ ID NO: 748393 - DNA, 20 bp, Artificial
  CRISPR gRNA sequence
gggaggtgggtggggccttc

SEQ ID NO: 748394 - DNA, 20 bp, Artificial
  CRISPR gRNA sequence
ggaggtgggtggggccttct

SEQ ID NO: 748395 - DNA, 20 bp, Artificial
  CRISPR gRNA sequence
ggtgggtggggccttctggg

SEQ ID NO: 748396 - DNA, 20 bp, Artificial
  CRISPR gRNA sequence
gtgggtggggccttctggga

SEQ ID NO: 748397 - DNA, 20 bp, Artificial
  CRISPR gRNA sequence
gtggggccttctgggaaggt

SEQ ID NO: 748398 - DNA, 20 bp, Artificial
  CRISPR gRNA sequence
gggccttctgggaaggtgag

SEQ ID NO: 748399 - DNA, 20 bp, Artificial
  CRISPR gRNA sequence
gccttctgggaaggtgagtg

SEQ ID NO: 748400 - DNA, 20 bp, Artificial
  CRISPR gRNA sequence
cttctgggaaggtgagtgga

SEQ ID NO: 748401 - DNA, 20 bp, Artificial
  CRISPR gRNA sequence
ttctgggaaggtgagtggag

SEQ ID NO: 748402 - DNA, 20 bp, Artificial
  CRISPR gRNA sequence
tctgggaaggtgagtggaga

SEQ ID NO: 748403 - DNA, 20 bp, Artificial
  CRISPR gRNA sequence
ctgggaaggtgagtggagag

SEQ ID NO: 748404 - DNA, 20 bp, Artificial
  CRISPR gRNA sequence
catcccctactcccactgct

SEQ ID NO: 748405 - DNA, 20 bp, Artificial
  CRISPR gRNA sequence
cctactcccactgctcagcg

SEQ ID NO: 748406 - DNA, 20 bp, Artificial
  CRISPR gRNA sequence
ctactcccactgctcagcgc

SEQ ID NO: 748407 - DNA, 20 bp, Artificial
  CRISPR gRNA sequence
tgctcagcgcgggccattgc

SEQ ID NO: 748408 - DNA, 20 bp, Artificial
  CRISPR gRNA sequence
gctcagcgcgggccattgca

SEQ ID NO: 748409 - DNA, 20 bp, Artificial
  CRISPR gRNA sequence
ctcagcgcgggccattgcaa

SEQ ID NO: 748410 - DNA, 20 bp, Artificial
  CRISPR gRNA sequence
acacaatgtcttgtccaccc

SEQ ID NO: 748411 - DNA, 20 bp, Artificial
  CRISPR gRNA sequence
cacaatgtcttgtccaccct

SEQ ID NO: 748412 - DNA, 20 bp, Artificial
  CRISPR gRNA sequence
gtccaccctgggacacttct

SEQ ID NO: 748413 - DNA, 20 bp, Artificial
  CRISPR gRNA sequence
ctgggacacttctgagtatg

SEQ ID NO: 748414 - DNA, 20 bp, Artificial
  CRISPR gRNA sequence
ggacacttctgagtatgaag

SEQ ID NO: 748415 - DNA, 20 bp, Artificial
  CRISPR gRNA sequence
gacacttctgagtatgaagc

SEQ ID NO: 748416 - DNA, 20 bp, Artificial
  CRISPR gRNA sequence
ggatgctattaaaaactaca

SEQ ID NO: 748417 - DNA, 20 bp, Artificial
  CRISPR gRNA sequence
gatgctattaaaaactacat

SEQ ID NO: 748418 - DNA, 20 bp, Artificial
  CRISPR gRNA sequence
atgctattaaaaactacatg

SEQ ID NO: 748419 - DNA, 20 bp, Artificial
  CRISPR gRNA sequence
ttaaaaactacatggggaaa

SEQ ID NO: 748420 - DNA, 20 bp, Artificial
  CRISPR gRNA sequence
taaaaactacatggggaaac

SEQ ID NO: 748421 - DNA, 20 bp, Artificial
  CRISPR gRNA sequence
ggggaaacaggtgcaaaccc

SEQ ID NO: 748422 - DNA, 20 bp, Artificial
  CRISPR gRNA sequence
ggaaacaggtgcaaaccctg

SEQ ID NO: 748423 - DNA, 20 bp, Artificial
  CRISPR gRNA sequence
acaggtgcaaaccctggaga

SEQ ID NO: 748424 - DNA, 20 bp, Artificial
  CRISPR gRNA sequence
aaaccctggagatggattgt

SEQ ID NO: 748425 - DNA, 20 bp, Artificial
  CRISPR gRNA sequence
accctggagatggattgtaa

SEQ ID NO: 748426 - DNA, 20 bp, Artificial
  CRISPR gRNA sequence
tggagatggattgtaagagc

SEQ ID NO: 748427 - DNA, 20 bp, Artificial
  CRISPR gRNA sequence
accttccactccatacaatc

SEQ ID NO: 748428 - DNA, 20 bp, Artificial
  CRISPR gRNA sequence
ccttccactccatacaatct

SEQ ID NO: 748429 - DNA, 20 bp, Artificial
  CRISPR gRNA sequence
cactccatacaatctgggcc

SEQ ID NO: 748430 - DNA, 20 bp, Artificial
  CRISPR gRNA sequence
tccatacaatctgggcctgg

SEQ ID NO: 748431 - DNA, 20 bp, Artificial
  CRISPR gRNA sequence
catacaatctgggcctggtg

SEQ ID NO: 748432 - DNA, 20 bp, Artificial
  CRISPR gRNA sequence
gcctggtggagtcttcgctt

SEQ ID NO: 748433 - DNA, 20 bp, Artificial
  CRISPR gRNA sequence
ctggtggagtcttcgcttca

SEQ ID NO: 748434 - DNA, 20 bp, Artificial
  CRISPR gRNA sequence
gtcttcgcttcagagccatt

SEQ ID NO: 748435 - DNA, 20 bp, Artificial
  CRISPR gRNA sequence
tcgcttcagagccattcggc

SEQ ID NO: 748436 - DNA, 20 bp, Artificial
  CRISPR gRNA sequence
cgcttcagagccattcggcc

SEQ ID NO: 748437 - DNA, 20 bp, Artificial
  CRISPR gRNA sequence
cagagccattcggccaggtg

SEQ ID NO: 748438 - DNA, 20 bp, Artificial
  CRISPR gRNA sequence
agagccattcggccaggtgc

SEQ ID NO: 748439 - DNA, 20 bp, Artificial
  CRISPR gRNA sequence
atgttcccatctcctgcttg

SEQ ID NO: 748440 - DNA, 20 bp, Artificial
  CRISPR gRNA sequence
tgttcccatctcctgcttgt

SEQ ID NO: 748441 - DNA, 20 bp, Artificial
  CRISPR gRNA sequence
tcctgcttgtgggcatgccc

SEQ ID NO: 748442 - DNA, 20 bp, Artificial
  CRISPR gRNA sequence
tggctttgtttttatacaca

SEQ ID NO: 748443 - DNA, 20 bp, Artificial
  CRISPR gRNA sequence
ggctttgtttttatacacat

SEQ ID NO: 748444 - DNA, 20 bp, Artificial
  CRISPR gRNA sequence
ttgtttttatacacataggc

SEQ ID NO: 748445 - DNA, 20 bp, Artificial
  CRISPR gRNA sequence
tgtttttatacacataggca

SEQ ID NO: 748446 - DNA, 20 bp, Artificial
  CRISPR gRNA sequence
tttatacacataggcaaggt

SEQ ID NO: 748447 - DNA, 20 bp, Artificial
  CRISPR gRNA sequence
taggcaaggtgagtcctctg

SEQ ID NO: 748448 - DNA, 20 bp, Artificial
  CRISPR gRNA sequence
cctctgtggaattgtgattg

SEQ ID NO: 748449 - DNA, 20 bp, Artificial
  CRISPR gRNA sequence
ctctgtggaattgtgattga

SEQ ID NO: 748450 - DNA, 20 bp, Artificial
  CRISPR gRNA sequence
attgtgattgaaggatttta

SEQ ID NO: 748451 - DNA, 20 bp, Artificial
  CRISPR gRNA sequence
gtgattgaaggattttaaag

SEQ ID NO: 748452 - DNA, 20 bp, Artificial
  CRISPR gRNA sequence
tgattgaaggattttaaagc

SEQ ID NO: 748453 - DNA, 20 bp, Artificial
  CRISPR gRNA sequence
gattgaaggattttaaagca

SEQ ID NO: 748454 - DNA, 20 bp, Artificial
  CRISPR gRNA sequence
attgaaggattttaaagcag

SEQ ID NO: 748455 - DNA, 20 bp, Artificial
  CRISPR gRNA sequence
tgaaggattttaaagcaggg

SEQ ID NO: 748456 - DNA, 20 bp, Artificial
  CRISPR gRNA sequence
gaaggattttaaagcagggg

SEQ ID NO: 748457 - DNA, 20 bp, Artificial
  CRISPR gRNA sequence
aggattttaaagcaggggag

SEQ ID NO: 748458 - DNA, 20 bp, Artificial
  CRISPR gRNA sequence
gattttaaagcaggggagga

SEQ ID NO: 748459 - DNA, 20 bp, Artificial
  CRISPR gRNA sequence
tttaaagcaggggaggagag

SEQ ID NO: 748460 - DNA, 20 bp, Artificial
  CRISPR gRNA sequence
ttaaagcaggggaggagagt

SEQ ID NO: 748461 - DNA, 20 bp, Artificial
  CRISPR gRNA sequence
taaagcaggggaggagagta

SEQ ID NO: 748462 - DNA, 20 bp, Artificial
  CRISPR gRNA sequence
aaagcaggggaggagagtag

SEQ ID NO: 748463 - DNA, 20 bp, Artificial
  CRISPR gRNA sequence
aagcaggggaggagagtagg

SEQ ID NO: 748464 - DNA, 20 bp, Artificial
  CRISPR gRNA sequence
gggggcatctctgtacactc

SEQ ID NO: 748465 - DNA, 20 bp, Artificial
  CRISPR gRNA sequence
ggggcatctctgtacactct

SEQ ID NO: 748466 - DNA, 20 bp, Artificial
  CRISPR gRNA sequence
gggcatctctgtacactctg

SEQ ID NO: 748467 - DNA, 20 bp, Artificial
  CRISPR gRNA sequence
ggcatctctgtacactctgg

SEQ ID NO: 748468 - DNA, 20 bp, Artificial
  CRISPR gRNA sequence
tgtacactctgggggtaaaa

SEQ ID NO: 748469 - DNA, 20 bp, Artificial
  CRISPR gRNA sequence
gtacactctgggggtaaaac

SEQ ID NO: 748470 - DNA, 20 bp, Artificial
  CRISPR gRNA sequence
tacactctgggggtaaaaca

SEQ ID NO: 748471 - DNA, 20 bp, Artificial
  CRISPR gRNA sequence
actctgggggtaaaacaggg

SEQ ID NO: 748472 - DNA, 20 bp, Artificial
  CRISPR gRNA sequence
ctctgggggtaaaacaggga

SEQ ID NO: 748473 - DNA, 20 bp, Artificial
  CRISPR gRNA sequence
tgggggtaaaacagggaagg

SEQ ID NO: 748474 - DNA, 20 bp, Artificial
  CRISPR gRNA sequence
aaacagggaaggcagtgcct

SEQ ID NO: 748475 - DNA, 20 bp, Artificial
  CRISPR gRNA sequence
gggaaggcagtgcctgagca

SEQ ID NO: 748476 - DNA, 20 bp, Artificial
  CRISPR gRNA sequence
ggaaggcagtgcctgagcat

SEQ ID NO: 748477 - DNA, 20 bp, Artificial
  CRISPR gRNA sequence
gaaggcagtgcctgagcatg

SEQ ID NO: 748478 - DNA, 20 bp, Artificial
  CRISPR gRNA sequence
gcagtgcctgagcatgggga

SEQ ID NO: 748479 - DNA, 20 bp, Artificial
  CRISPR gRNA sequence
cagtgcctgagcatggggac

SEQ ID NO: 748480 - DNA, 20 bp, Artificial
  CRISPR gRNA sequence
gcctgagcatggggacaggt

SEQ ID NO: 748481 - DNA, 20 bp, Artificial
  CRISPR gRNA sequence
cctgagcatggggacaggtg

SEQ ID NO: 748482 - DNA, 20 bp, Artificial
  CRISPR gRNA sequence
gagcatggggacaggtgagg

SEQ ID NO: 748483 - DNA, 20 bp, Artificial
  CRISPR gRNA sequence
agcatggggacaggtgaggt

SEQ ID NO: 748484 - DNA, 20 bp, Artificial
  CRISPR gRNA sequence
gcatggggacaggtgaggtg

SEQ ID NO: 748485 - DNA, 20 bp, Artificial
  CRISPR gRNA sequence
ggggacaggtgaggtggggc

SEQ ID NO: 748486 - DNA, 20 bp, Artificial
  CRISPR gRNA sequence
gggacaggtgaggtggggct

SEQ ID NO: 748487 - DNA, 20 bp, Artificial
  CRISPR gRNA sequence
acaggtgaggtggggctggg

SEQ ID NO: 748488 - DNA, 20 bp, Artificial
  CRISPR gRNA sequence
ggggctgggcagaccccctg

SEQ ID NO: 748489 - DNA, 20 bp, Artificial
  CRISPR gRNA sequence
ggcagaccccctgtagcgtt

SEQ ID NO: 748490 - DNA, 20 bp, Artificial
  CRISPR gRNA sequence
agaccccctgtagcgtttag

SEQ ID NO: 748491 - DNA, 20 bp, Artificial
  CRISPR gRNA sequence
gaccccctgtagcgtttagc

SEQ ID NO: 748492 - DNA, 20 bp, Artificial
  CRISPR gRNA sequence
ccctgtagcgtttagcagga

SEQ ID NO: 748493 - DNA, 20 bp, Artificial
  CRISPR gRNA sequence
cctgtagcgtttagcaggat

SEQ ID NO: 748494 - DNA, 20 bp, Artificial
  CRISPR gRNA sequence
ctgtagcgtttagcaggatg

SEQ ID NO: 748495 - DNA, 20 bp, Artificial
  CRISPR gRNA sequence
tgtagcgtttagcaggatgg

SEQ ID NO: 748496 - DNA, 20 bp, Artificial
  CRISPR gRNA sequence
gtttagcaggatgggggccc

SEQ ID NO: 748497 - DNA, 20 bp, Artificial
  CRISPR gRNA sequence
tttagcaggatgggggcccc

SEQ ID NO: 748498 - DNA, 20 bp, Artificial
  CRISPR gRNA sequence
gatgggggccccaggtactg

SEQ ID NO: 748499 - DNA, 20 bp, Artificial
  CRISPR gRNA sequence
tgggggccccaggtactgtg

SEQ ID NO: 748500 - DNA, 20 bp, Artificial
  CRISPR gRNA sequence
ggggccccaggtactgtgga

SEQ ID NO: 748501 - DNA, 20 bp, Artificial
  CRISPR gRNA sequence
cccaggtactgtggagagca

SEQ ID NO: 748502 - DNA, 20 bp, Artificial
  CRISPR gRNA sequence
gtactgtggagagcatagtc

SEQ ID NO: 748503 - DNA, 20 bp, Artificial
  CRISPR gRNA sequence
gtggagagcatagtccagcc

SEQ ID NO: 748504 - DNA, 20 bp, Artificial
  CRISPR gRNA sequence
tggagagcatagtccagcct

SEQ ID NO: 748505 - DNA, 20 bp, Artificial
  CRISPR gRNA sequence
cagcctgggcatttgtctcc

SEQ ID NO: 748506 - DNA, 20 bp, Artificial
  CRISPR gRNA sequence
cctgggcatttgtctcctag

SEQ ID NO: 748507 - DNA, 20 bp, Artificial
  CRISPR gRNA sequence
tgtctcctagcagcctacac

SEQ ID NO: 748508 - DNA, 20 bp, Artificial
  CRISPR gRNA sequence
cagcctacactggctctgct

SEQ ID NO: 748509 - DNA, 20 bp, Artificial
  CRISPR gRNA sequence
ctacactggctctgctgagc

SEQ ID NO: 748510 - DNA, 20 bp, Artificial
  CRISPR gRNA sequence
tacactggctctgctgagct

SEQ ID NO: 748511 - DNA, 20 bp, Artificial
  CRISPR gRNA sequence
tggctctgctgagctgggcc

SEQ ID NO: 748512 - DNA, 20 bp, Artificial
  CRISPR gRNA sequence
ggctctgctgagctgggcct

SEQ ID NO: 748513 - DNA, 20 bp, Artificial
  CRISPR gRNA sequence
gagctgggcctgggtgctga

SEQ ID NO: 748514 - DNA, 20 bp, Artificial
  CRISPR gRNA sequence
tgggcctgggtgctgaaagc

SEQ ID NO: 748515 - DNA, 20 bp, Artificial
  CRISPR gRNA sequence
gggcctgggtgctgaaagcc

SEQ ID NO: 748516 - DNA, 20 bp, Artificial
  CRISPR gRNA sequence
gggtgctgaaagccaggatt

SEQ ID NO: 748517 - DNA, 20 bp, Artificial
  CRISPR gRNA sequence
ggtgctgaaagccaggattt

SEQ ID NO: 748518 - DNA, 20 bp, Artificial
  CRISPR gRNA sequence
gtgctgaaagccaggatttg

SEQ ID NO: 748519 - DNA, 20 bp, Artificial
  CRISPR gRNA sequence
tgaaagccaggatttggggc

SEQ ID NO: 748520 - DNA, 20 bp, Artificial
  CRISPR gRNA sequence
gaaagccaggatttggggct

SEQ ID NO: 748521 - DNA, 20 bp, Artificial
  CRISPR gRNA sequence
agccaggatttggggctagg

SEQ ID NO: 748522 - DNA, 20 bp, Artificial
  CRISPR gRNA sequence
gccaggatttggggctaggc

SEQ ID NO: 748523 - DNA, 20 bp, Artificial
  CRISPR gRNA sequence
aggatttggggctaggcggg

SEQ ID NO: 748524 - DNA, 20 bp, Artificial
  CRISPR gRNA sequence
aagatgttcgcccaattgct

SEQ ID NO: 748525 - DNA, 20 bp, Artificial
  CRISPR gRNA sequence
agatgttcgcccaattgctt

SEQ ID NO: 748526 - DNA, 20 bp, Artificial
  CRISPR gRNA sequence
gatgttcgcccaattgcttg

SEQ ID NO: 748527 - DNA, 20 bp, Artificial
  CRISPR gRNA sequence
atgttcgcccaattgcttgg

SEQ ID NO: 748528 - DNA, 20 bp, Artificial
  CRISPR gRNA sequence
tgttcgcccaattgcttggg

SEQ ID NO: 748529 - DNA, 20 bp, Artificial
  CRISPR gRNA sequence
cgcccaattgcttggggggt

SEQ ID NO: 748530 - DNA, 20 bp, Artificial
  CRISPR gRNA sequence
gcccaattgcttggggggtt

SEQ ID NO: 748531 - DNA, 20 bp, Artificial
  CRISPR gRNA sequence
cccaattgcttggggggttg

SEQ ID NO: 748532 - DNA, 20 bp, Artificial
  CRISPR gRNA sequence
ccaattgcttggggggttgg

SEQ ID NO: 748533 - DNA, 20 bp, Artificial
  CRISPR gRNA sequence
caattgcttggggggttggg

SEQ ID NO: 748534 - DNA, 20 bp, Artificial
  CRISPR gRNA sequence
tgcttggggggttgggggga

SEQ ID NO: 748535 - DNA, 20 bp, Artificial
  CRISPR gRNA sequence
ggggggttggggggatggaa

SEQ ID NO: 748536 - DNA, 20 bp, Artificial
  CRISPR gRNA sequence
gggggttggggggatggaaa

SEQ ID NO: 748537 - DNA, 20 bp, Artificial
  CRISPR gRNA sequence
ggggttggggggatggaaaa

SEQ ID NO: 748538 - DNA, 20 bp, Artificial
  CRISPR gRNA sequence
gggttggggggatggaaaag

SEQ ID NO: 748539 - DNA, 20 bp, Artificial
  CRISPR gRNA sequence
gttggggggatggaaaaggg

SEQ ID NO: 748540 - DNA, 20 bp, Artificial
  CRISPR gRNA sequence
atggaaaaggggagcacctc

SEQ ID NO: 748541 - DNA, 20 bp, Artificial
  CRISPR gRNA sequence
tggaaaaggggagcacctct

SEQ ID NO: 748542 - DNA, 20 bp, Artificial
  CRISPR gRNA sequence
gggagcacctctaggctgcc

SEQ ID NO: 748543 - DNA, 20 bp, Artificial
  CRISPR gRNA sequence
agcacctctaggctgcctgg

SEQ ID NO: 748544 - DNA, 20 bp, Artificial
  CRISPR gRNA sequence
acctctaggctgcctggcag

SEQ ID NO: 748545 - DNA, 20 bp, Artificial
  CRISPR gRNA sequence
ctaggctgcctggcagcagt

SEQ ID NO: 748546 - DNA, 20 bp, Artificial
  CRISPR gRNA sequence
tgcctggcagcagtgagccc

SEQ ID NO: 748547 - DNA, 20 bp, Artificial
  CRISPR gRNA sequence
gcctggcagcagtgagccct

SEQ ID NO: 748548 - DNA, 20 bp, Artificial
  CRISPR gRNA sequence
agcagtgagccctgggcctg

SEQ ID NO: 748549 - DNA, 20 bp, Artificial
  CRISPR gRNA sequence
gagccctgggcctgtggcta

SEQ ID NO: 748550 - DNA, 20 bp, Artificial
  CRISPR gRNA sequence
cctgggcctgtggctacagc

SEQ ID NO: 748551 - DNA, 20 bp, Artificial
  CRISPR gRNA sequence
ctgggcctgtggctacagcc

SEQ ID NO: 748552 - DNA, 20 bp, Artificial
  CRISPR gRNA sequence
tgggcctgtggctacagcca

SEQ ID NO: 748553 - DNA, 20 bp, Artificial
  CRISPR gRNA sequence
tacagccagggaaccccacc

SEQ ID NO: 748554 - DNA, 20 bp, Artificial
  CRISPR gRNA sequence
gggaaccccacctggacaca

SEQ ID NO: 748555 - DNA, 20 bp, Artificial
  CRISPR gRNA sequence
ggacacatggccctgcttct

SEQ ID NO: 748556 - DNA, 20 bp, Artificial
  CRISPR gRNA sequence
ggccctgcttctaagccccc

SEQ ID NO: 748557 - DNA, 20 bp, Artificial
  CRISPR gRNA sequence
ctgcttctaagccccccagt

SEQ ID NO: 748558 - DNA, 20 bp, Artificial
  CRISPR gRNA sequence
tgcttctaagccccccagtt

SEQ ID NO: 748559 - DNA, 20 bp, Artificial
  CRISPR gRNA sequence
aagccccccagttaggccca

SEQ ID NO: 748560 - DNA, 20 bp, Artificial
  CRISPR gRNA sequence
agccccccagttaggcccaa

SEQ ID NO: 748561 - DNA, 20 bp, Artificial
  CRISPR gRNA sequence
cccagttaggcccaaaggaa

SEQ ID NO: 748562 - DNA, 20 bp, Artificial
  CRISPR gRNA sequence
gcccaaaggaatggtccact

SEQ ID NO: 748563 - DNA, 20 bp, Artificial
  CRISPR gRNA sequence
cccaaaggaatggtccactg

SEQ ID NO: 748564 - DNA, 20 bp, Artificial
  CRISPR gRNA sequence
ccaaaggaatggtccactga

SEQ ID NO: 748565 - DNA, 20 bp, Artificial
  CRISPR gRNA sequence
tgagggcctcctgctctgcc

SEQ ID NO: 748566 - DNA, 20 bp, Artificial
  CRISPR gRNA sequence
gagggcctcctgctctgcct

SEQ ID NO: 748567 - DNA, 20 bp, Artificial
  CRISPR gRNA sequence
gcctcctgctctgcctgggc

SEQ ID NO: 748568 - DNA, 20 bp, Artificial
  CRISPR gRNA sequence
cctcctgctctgcctgggct

SEQ ID NO: 748569 - DNA, 20 bp, Artificial
  CRISPR gRNA sequence
ctgctctgcctgggctgggc

SEQ ID NO: 748570 - DNA, 20 bp, Artificial
  CRISPR gRNA sequence
tgctctgcctgggctgggcc

SEQ ID NO: 748571 - DNA, 20 bp, Artificial
  CRISPR gRNA sequence
gctctgcctgggctgggcca

SEQ ID NO: 748572 - DNA, 20 bp, Artificial
  CRISPR gRNA sequence
ctctgcctgggctgggccag

SEQ ID NO: 748573 - DNA, 20 bp, Artificial
  CRISPR gRNA sequence
tgggctgggccaggggcttt

SEQ ID NO: 748574 - DNA, 20 bp, Artificial
  CRISPR gRNA sequence
gggctgggccaggggctttg

SEQ ID NO: 748575 - DNA, 20 bp, Artificial
  CRISPR gRNA sequence
gctgggccaggggctttgag

SEQ ID NO: 748576 - DNA, 20 bp, Artificial
  CRISPR gRNA sequence
tgggccaggggctttgagga

SEQ ID NO: 748577 - DNA, 20 bp, Artificial
  CRISPR gRNA sequence
gggccaggggctttgaggag

SEQ ID NO: 748578 - DNA, 20 bp, Artificial
  CRISPR gRNA sequence
ggccaggggctttgaggaga

SEQ ID NO: 748579 - DNA, 20 bp, Artificial
  CRISPR gRNA sequence
ctttgaggagagggtaaaca

SEQ ID NO: 748580 - DNA, 20 bp, Artificial
  CRISPR gRNA sequence
tttgaggagagggtaaacat

SEQ ID NO: 748581 - DNA, 20 bp, Artificial
  CRISPR gRNA sequence
ggagagggtaaacataggcc

SEQ ID NO: 748582 - DNA, 20 bp, Artificial
  CRISPR gRNA sequence
agagggtaaacataggcccg

SEQ ID NO: 748583 - DNA, 20 bp, Artificial
  CRISPR gRNA sequence
ggtaaacataggcccggaga

SEQ ID NO: 748584 - DNA, 20 bp, Artificial
  CRISPR gRNA sequence
gtaaacataggcccggagat

SEQ ID NO: 748585 - DNA, 20 bp, Artificial
  CRISPR gRNA sequence
taaacataggcccggagatg

SEQ ID NO: 748586 - DNA, 20 bp, Artificial
  CRISPR gRNA sequence
ggagatggggctgacacctc

SEQ ID NO: 748587 - DNA, 20 bp, Artificial
  CRISPR gRNA sequence
gatggggctgacacctcgag

SEQ ID NO: 748588 - DNA, 20 bp, Artificial
  CRISPR gRNA sequence
gggctgacacctcgagtggc

SEQ ID NO: 748589 - DNA, 20 bp, Artificial
  CRISPR gRNA sequence
gccagaatatgcccaaaccc

SEQ ID NO: 748590 - DNA, 20 bp, Artificial
  CRISPR gRNA sequence
cccggcttctcccttgtccc

SEQ ID NO: 748591 - DNA, 20 bp, Artificial
  CRISPR gRNA sequence
ccggcttctcccttgtccct

SEQ ID NO: 748592 - DNA, 20 bp, Artificial
  CRISPR gRNA sequence
gcttctcccttgtccctagg

SEQ ID NO: 748593 - DNA, 20 bp, Artificial
  CRISPR gRNA sequence
ttctcccttgtccctaggca

SEQ ID NO: 748594 - DNA, 20 bp, Artificial
  CRISPR gRNA sequence
tctcccttgtccctaggcag

SEQ ID NO: 748595 - DNA, 20 bp, Artificial
  CRISPR gRNA sequence
ctcccttgtccctaggcaga

SEQ ID NO: 748596 - DNA, 20 bp, Artificial
  CRISPR gRNA sequence
tcccttgtccctaggcagag

SEQ ID NO: 748597 - DNA, 20 bp, Artificial
  CRISPR gRNA sequence
cccttgtccctaggcagagg

SEQ ID NO: 748598 - DNA, 20 bp, Artificial
  CRISPR gRNA sequence
ccttgtccctaggcagaggg

SEQ ID NO: 748599 - DNA, 20 bp, Artificial
  CRISPR gRNA sequence
gtcccttcttttgttccctc

SEQ ID NO: 748600 - DNA, 20 bp, Artificial
  CRISPR gRNA sequence
gtcaccacaatgcttgatgc

SEQ ID NO: 748601 - DNA, 20 bp, Artificial
  CRISPR gRNA sequence
atgcttgatgccagctgcca

SEQ ID NO: 748602 - DNA, 20 bp, Artificial
  CRISPR gRNA sequence
tgcttgatgccagctgccat

SEQ ID NO: 748603 - DNA, 20 bp, Artificial
  CRISPR gRNA sequence
ttgatgccagctgccatagg

SEQ ID NO: 748604 - DNA, 20 bp, Artificial
  CRISPR gRNA sequence
gatgccagctgccataggaa

SEQ ID NO: 748605 - DNA, 20 bp, Artificial
  CRISPR gRNA sequence
atgccagctgccataggaag

SEQ ID NO: 748606 - DNA, 20 bp, Artificial
  CRISPR gRNA sequence
tgccagctgccataggaaga

SEQ ID NO: 748607 - DNA, 20 bp, Artificial
  CRISPR gRNA sequence
ctgccataggaagagggtgc

SEQ ID NO: 748608 - DNA, 20 bp, Artificial
  CRISPR gRNA sequence
cataggaagagggtgctggc

SEQ ID NO: 748609 - DNA, 20 bp, Artificial
  CRISPR gRNA sequence
aagagggtgctggctggcca

SEQ ID NO: 748610 - DNA, 20 bp, Artificial
  CRISPR gRNA sequence
agggtgctggctggccatgg

SEQ ID NO: 748611 - DNA, 20 bp, Artificial
  CRISPR gRNA sequence
gtggcacacacctgtcctcc

SEQ ID NO: 748612 - DNA, 20 bp, Artificial
  CRISPR gRNA sequence
cctgtcctcccagcactttg

SEQ ID NO: 748613 - DNA, 20 bp, Artificial
  CRISPR gRNA sequence
ctgtcctcccagcactttgc

SEQ ID NO: 748614 - DNA, 20 bp, Artificial
  CRISPR gRNA sequence
tgtcctcccagcactttgca

SEQ ID NO: 748615 - DNA, 20 bp, Artificial
  CRISPR gRNA sequence
tcccagcactttgcagggct

SEQ ID NO: 748616 - DNA, 20 bp, Artificial
  CRISPR gRNA sequence
cccagcactttgcagggctg

SEQ ID NO: 748617 - DNA, 20 bp, Artificial
  CRISPR gRNA sequence
agcactttgcagggctgagg

SEQ ID NO: 748618 - DNA, 20 bp, Artificial
  CRISPR gRNA sequence
actttgcagggctgaggtgg

SEQ ID NO: 748619 - DNA, 20 bp, Artificial
  CRISPR gRNA sequence
ctttgcagggctgaggtgga

SEQ ID NO: 748620 - DNA, 20 bp, Artificial
  CRISPR gRNA sequence
ctgaggtggaaggaccgctt

SEQ ID NO: 748621 - DNA, 20 bp, Artificial
  CRISPR gRNA sequence
gtggaaggaccgcttaagcc

SEQ ID NO: 748622 - DNA, 20 bp, Artificial
  CRISPR gRNA sequence
tggaaggaccgcttaagccc

SEQ ID NO: 748623 - DNA, 20 bp, Artificial
  CRISPR gRNA sequence
ccgcttaagcccaggtgttc

SEQ ID NO: 748624 - DNA, 20 bp, Artificial
  CRISPR gRNA sequence
cgcttaagcccaggtgttca

SEQ ID NO: 748625 - DNA, 20 bp, Artificial
  CRISPR gRNA sequence
caggtgttcaaggctgctgt

SEQ ID NO: 748626 - DNA, 20 bp, Artificial
  CRISPR gRNA sequence
ggctgctgtgagctgtgttc

SEQ ID NO: 748627 - DNA, 20 bp, Artificial
  CRISPR gRNA sequence
gtgttcgagccactacactc

SEQ ID NO: 748628 - DNA, 20 bp, Artificial
  CRISPR gRNA sequence
cgagccactacactccagcc

SEQ ID NO: 748629 - DNA, 20 bp, Artificial
  CRISPR gRNA sequence
gagccactacactccagcct

SEQ ID NO: 748630 - DNA, 20 bp, Artificial
  CRISPR gRNA sequence
agccactacactccagcctg

SEQ ID NO: 748631 - DNA, 20 bp, Artificial
  CRISPR gRNA sequence
actacactccagcctgggga

SEQ ID NO: 748632 - DNA, 20 bp, Artificial
  CRISPR gRNA sequence
tacactccagcctggggacg

SEQ ID NO: 748633 - DNA, 20 bp, Artificial
  CRISPR gRNA sequence
gcctcaaaacaaattttaaa

SEQ ID NO: 748634 - DNA, 20 bp, Artificial
  CRISPR gRNA sequence
caaaacaaattttaaaaaga

SEQ ID NO: 748635 - DNA, 20 bp, Artificial
  CRISPR gRNA sequence
acaaattttaaaaagaaaga

SEQ ID NO: 748636 - DNA, 20 bp, Artificial
  CRISPR gRNA sequence
aattttaaaaagaaagaaag

SEQ ID NO: 748637 - DNA, 20 bp, Artificial
  CRISPR gRNA sequence
attttaaaaagaaagaaaga

SEQ ID NO: 748638 - DNA, 20 bp, Artificial
  CRISPR gRNA sequence
taaaaagaaagaaagaagga

SEQ ID NO: 748639 - DNA, 20 bp, Artificial
  CRISPR gRNA sequence
aaaagaaagaaagaaggaaa

SEQ ID NO: 748640 - DNA, 20 bp, Artificial
  CRISPR gRNA sequence
aaagaaagaaagaaggaaag

SEQ ID NO: 748641 - DNA, 20 bp, Artificial
  CRISPR gRNA sequence
aagaaagaaagaaggaaaga

SEQ ID NO: 748642 - DNA, 20 bp, Artificial
  CRISPR gRNA sequence
ggtatgtttttcacaattca

SEQ ID NO: 748643 - DNA, 20 bp, Artificial
  CRISPR gRNA sequence
gtatgtttttcacaattcat

SEQ ID NO: 748644 - DNA, 20 bp, Artificial
  CRISPR gRNA sequence
tatgtttttcacaattcatg

SEQ ID NO: 748645 - DNA, 20 bp, Artificial
  CRISPR gRNA sequence
atgtttttcacaattcatgg

SEQ ID NO: 748646 - DNA, 20 bp, Artificial
  CRISPR gRNA sequence
acaattcatgggggcctgca

SEQ ID NO: 748647 - DNA, 20 bp, Artificial
  CRISPR gRNA sequence
attcatgggggcctgcatgg

SEQ ID NO: 748648 - DNA, 20 bp, Artificial
  CRISPR gRNA sequence
ttcatgggggcctgcatggc

SEQ ID NO: 748649 - DNA, 20 bp, Artificial
  CRISPR gRNA sequence
catgggggcctgcatggcag

SEQ ID NO: 748650 - DNA, 20 bp, Artificial
  CRISPR gRNA sequence
gggggcctgcatggcaggag

SEQ ID NO: 748651 - DNA, 20 bp, Artificial
  CRISPR gRNA sequence
ggggcctgcatggcaggagt

SEQ ID NO: 748652 - DNA, 20 bp, Artificial
  CRISPR gRNA sequence
gggcctgcatggcaggagtg

SEQ ID NO: 748653 - DNA, 20 bp, Artificial
  CRISPR gRNA sequence
ctgcatggcaggagtgggga

SEQ ID NO: 748654 - DNA, 20 bp, Artificial
  CRISPR gRNA sequence
tgcatggcaggagtggggac

SEQ ID NO: 748655 - DNA, 20 bp, Artificial
  CRISPR gRNA sequence
gacaggacacctgctgttcc

SEQ ID NO: 748656 - DNA, 20 bp, Artificial
  CRISPR gRNA sequence
caggacacctgctgttcctg

SEQ ID NO: 748657 - DNA, 20 bp, Artificial
  CRISPR gRNA sequence
acctgctgttcctggagtcg

SEQ ID NO: 748658 - DNA, 20 bp, Artificial
  CRISPR gRNA sequence
cctgctgttcctggagtcga

SEQ ID NO: 748659 - DNA, 20 bp, Artificial
  CRISPR gRNA sequence
tgttcctggagtcgaaggac

SEQ ID NO: 748660 - DNA, 20 bp, Artificial
  CRISPR gRNA sequence
ggagtcgaaggacaagccca

SEQ ID NO: 748661 - DNA, 20 bp, Artificial
  CRISPR gRNA sequence
cgaaggacaagcccacagcc

SEQ ID NO: 748662 - DNA, 20 bp, Artificial
  CRISPR gRNA sequence
caagcccacagcccagattc

SEQ ID NO: 748663 - DNA, 20 bp, Artificial
  CRISPR gRNA sequence
agattccggttctcccaact

SEQ ID NO: 748664 - DNA, 20 bp, Artificial
  CRISPR gRNA sequence
gattccggttctcccaactc

SEQ ID NO: 748665 - DNA, 20 bp, Artificial
  CRISPR gRNA sequence
tccggttctcccaactcagg

SEQ ID NO: 748666 - DNA, 20 bp, Artificial
  CRISPR gRNA sequence
cggttctcccaactcaggaa

SEQ ID NO: 748667 - DNA, 20 bp, Artificial
  CRISPR gRNA sequence
gaagagcatgccctgccctc

SEQ ID NO: 748668 - DNA, 20 bp, Artificial
  CRISPR gRNA sequence
aagagcatgccctgccctct

SEQ ID NO: 748669 - DNA, 20 bp, Artificial
  CRISPR gRNA sequence
agagcatgccctgccctctg

SEQ ID NO: 748670 - DNA, 20 bp, Artificial
  CRISPR gRNA sequence
agcatgccctgccctctggg

SEQ ID NO: 748671 - DNA, 20 bp, Artificial
  CRISPR gRNA sequence
gcatgccctgccctctgggg

SEQ ID NO: 748672 - DNA, 20 bp, Artificial
  CRISPR gRNA sequence
gccctgccctctggggaggc

SEQ ID NO: 748673 - DNA, 20 bp, Artificial
  CRISPR gRNA sequence
gccctctggggaggctggcc

SEQ ID NO: 748674 - DNA, 20 bp, Artificial
  CRISPR gRNA sequence
tggggaggctggcctggccc

SEQ ID NO: 748675 - DNA, 20 bp, Artificial
  CRISPR gRNA sequence
gctggcctggccccagccct

SEQ ID NO: 748676 - DNA, 20 bp, Artificial
  CRISPR gRNA sequence
agccctcagctgctgacctt

SEQ ID NO: 748677 - DNA, 20 bp, Artificial
  CRISPR gRNA sequence
gccctcagctgctgaccttg

SEQ ID NO: 748678 - DNA, 20 bp, Artificial
  CRISPR gRNA sequence
ctcagctgctgaccttgagg

SEQ ID NO: 748679 - DNA, 20 bp, Artificial
  CRISPR gRNA sequence
cagctgctgaccttgaggca

SEQ ID NO: 748680 - DNA, 20 bp, Artificial
  CRISPR gRNA sequence
ttgaggcagagacaacttct

SEQ ID NO: 748681 - DNA, 20 bp, Artificial
  CRISPR gRNA sequence
agagacaacttctaagaatt

SEQ ID NO: 748682 - DNA, 20 bp, Artificial
  CRISPR gRNA sequence
acttctaagaatttggctgc

SEQ ID NO: 748683 - DNA, 20 bp, Artificial
  CRISPR gRNA sequence
agaatttggctgccagaccc

SEQ ID NO: 748684 - DNA, 20 bp, Artificial
  CRISPR gRNA sequence
gaatttggctgccagacccc

SEQ ID NO: 748685 - DNA, 20 bp, Artificial
  CRISPR gRNA sequence
tggctgccagaccccaggcc

SEQ ID NO: 748686 - DNA, 20 bp, Artificial
  CRISPR gRNA sequence
caggcctggctgctgctgtg

SEQ ID NO: 748687 - DNA, 20 bp, Artificial
  CRISPR gRNA sequence
ggcctggctgctgctgtgtg

SEQ ID NO: 748688 - DNA, 20 bp, Artificial
  CRISPR gRNA sequence
cctggctgctgctgtgtgga

SEQ ID NO: 748689 - DNA, 20 bp, Artificial
  CRISPR gRNA sequence
ctggctgctgctgtgtggag

SEQ ID NO: 748690 - DNA, 20 bp, Artificial
  CRISPR gRNA sequence
tggctgctgctgtgtggaga

SEQ ID NO: 748691 - DNA, 20 bp, Artificial
  CRISPR gRNA sequence
gctgctgctgtgtggagagg

SEQ ID NO: 748692 - DNA, 20 bp, Artificial
  CRISPR gRNA sequence
ctgctgctgtgtggagaggg

SEQ ID NO: 748693 - DNA, 20 bp, Artificial
  CRISPR gRNA sequence
ctgctgtgtggagagggagg

SEQ ID NO: 748694 - DNA, 20 bp, Artificial
  CRISPR gRNA sequence
gtggagagggaggcggcccg

SEQ ID NO: 748695 - DNA, 20 bp, Artificial
  CRISPR gRNA sequence
gagagggaggcggcccgcag

SEQ ID NO: 748696 - DNA, 20 bp, Artificial
  CRISPR gRNA sequence
ggaggcggcccgcagcagaa

SEQ ID NO: 748697 - DNA, 20 bp, Artificial
  CRISPR gRNA sequence
cagccaccgcacttcctcct

SEQ ID NO: 748698 - DNA, 20 bp, Artificial
  CRISPR gRNA sequence
acttcctcctcagcttcctc

SEQ ID NO: 748699 - DNA, 20 bp, Artificial
  CRISPR gRNA sequence
ctcctcagcttcctctggtg

SEQ ID NO: 748700 - DNA, 20 bp, Artificial
  CRISPR gRNA sequence
cggccctgccctctcttctc

SEQ ID NO: 748701 - DNA, 20 bp, Artificial
  CRISPR gRNA sequence
cttttacaactgaacgcatc

SEQ ID NO: 748702 - DNA, 20 bp, Artificial
  CRISPR gRNA sequence
ttttacaactgaacgcatct

SEQ ID NO: 748703 - DNA, 20 bp, Artificial
  CRISPR gRNA sequence
ctgaacgcatctgggcttcg

SEQ ID NO: 748704 - DNA, 20 bp, Artificial
  CRISPR gRNA sequence
gcttcgtggtttcctgtttt

SEQ ID NO: 748705 - DNA, 20 bp, Artificial
  CRISPR gRNA sequence
ttttcagcgaaatttactct

SEQ ID NO: 748706 - DNA, 20 bp, Artificial
  CRISPR gRNA sequence
cgaaatttactctgagctcc

SEQ ID NO: 748707 - DNA, 20 bp, Artificial
  CRISPR gRNA sequence
cccagttccatcttcatcca

SEQ ID NO: 748708 - DNA, 20 bp, Artificial
  CRISPR gRNA sequence
tccatcttcatccatggcca

SEQ ID NO: 748709 - DNA, 20 bp, Artificial
  CRISPR gRNA sequence
ccatcttcatccatggccac

SEQ ID NO: 748710 - DNA, 20 bp, Artificial
  CRISPR gRNA sequence
aggccctgcctacaacgcac

SEQ ID NO: 748711 - DNA, 20 bp, Artificial
  CRISPR gRNA sequence
ggccctgcctacaacgcact

SEQ ID NO: 748712 - DNA, 20 bp, Artificial
  CRISPR gRNA sequence
gccctgcctacaacgcacta

SEQ ID NO: 748713 - DNA, 20 bp, Artificial
  CRISPR gRNA sequence
acgtccctccctgctgctgc

SEQ ID NO: 748714 - DNA, 20 bp, Artificial
  CRISPR gRNA sequence
cgtccctccctgctgctgct

SEQ ID NO: 748715 - DNA, 20 bp, Artificial
  CRISPR gRNA sequence
gtccctccctgctgctgctg

SEQ ID NO: 748716 - DNA, 20 bp, Artificial
  CRISPR gRNA sequence
ccctccctgctgctgctggg

SEQ ID NO: 748717 - DNA, 20 bp, Artificial
  CRISPR gRNA sequence
cctccctgctgctgctgggg

SEQ ID NO: 748718 - DNA, 20 bp, Artificial
  CRISPR gRNA sequence
ctccctgctgctgctgggga

SEQ ID NO: 748719 - DNA, 20 bp, Artificial
  CRISPR gRNA sequence
tccctgctgctgctggggag

SEQ ID NO: 748720 - DNA, 20 bp, Artificial
  CRISPR gRNA sequence
ctgctgctgctggggagggg

SEQ ID NO: 748721 - DNA, 20 bp, Artificial
  CRISPR gRNA sequence
tgctgctgctggggaggggc

SEQ ID NO: 748722 - DNA, 20 bp, Artificial
  CRISPR gRNA sequence
gctggggaggggcaggctgc

SEQ ID NO: 748723 - DNA, 20 bp, Artificial
  CRISPR gRNA sequence
tggggaggggcaggctgctg

SEQ ID NO: 748724 - DNA, 20 bp, Artificial
  CRISPR gRNA sequence
ggctgctggagccgccctct

SEQ ID NO: 748725 - DNA, 20 bp, Artificial
  CRISPR gRNA sequence
gagccgccctctgagttgcc

SEQ ID NO: 748726 - DNA, 20 bp, Artificial
  CRISPR gRNA sequence
agccgccctctgagttgccc

SEQ ID NO: 748727 - DNA, 20 bp, Artificial
  CRISPR gRNA sequence
gccctctgagttgcccggga

SEQ ID NO: 748728 - DNA, 20 bp, Artificial
  CRISPR gRNA sequence
ctctgagttgcccgggatgg

SEQ ID NO: 748729 - DNA, 20 bp, Artificial
  CRISPR gRNA sequence
gatggtagtgcctctgatgc

SEQ ID NO: 748730 - DNA, 20 bp, Artificial
  CRISPR gRNA sequence
agtgcctctgatgccagccc

SEQ ID NO: 748731 - DNA, 20 bp, Artificial
  CRISPR gRNA sequence
gcctctgatgccagccctgg

SEQ ID NO: 748732 - DNA, 20 bp, Artificial
  CRISPR gRNA sequence
gatgccagccctggtggctg

SEQ ID NO: 748733 - DNA, 20 bp, Artificial
  CRISPR gRNA sequence
atgccagccctggtggctgt

SEQ ID NO: 748734 - DNA, 20 bp, Artificial
  CRISPR gRNA sequence
cagccctggtggctgtgggc

SEQ ID NO: 748735 - DNA, 20 bp, Artificial
  CRISPR gRNA sequence
agccctggtggctgtgggct

SEQ ID NO: 748736 - DNA, 20 bp, Artificial
  CRISPR gRNA sequence
gccctggtggctgtgggctg

SEQ ID NO: 748737 - DNA, 20 bp, Artificial
  CRISPR gRNA sequence
tggctgtgggctggggtgca

SEQ ID NO: 748738 - DNA, 20 bp, Artificial
  CRISPR gRNA sequence
ggctgtgggctggggtgcat

SEQ ID NO: 748739 - DNA, 20 bp, Artificial
  CRISPR gRNA sequence
ctgtgggctggggtgcatgg

SEQ ID NO: 748740 - DNA, 20 bp, Artificial
  CRISPR gRNA sequence
gtgggctggggtgcatggga

SEQ ID NO: 748741 - DNA, 20 bp, Artificial
  CRISPR gRNA sequence
gctggggtgcatgggagagc

SEQ ID NO: 748742 - DNA, 20 bp, Artificial
  CRISPR gRNA sequence
ctggggtgcatgggagagct

SEQ ID NO: 748743 - DNA, 20 bp, Artificial
  CRISPR gRNA sequence
tgcatgggagagctgggtgc

SEQ ID NO: 748744 - DNA, 20 bp, Artificial
  CRISPR gRNA sequence
gagagctgggtgcgagaaca

SEQ ID NO: 748745 - DNA, 20 bp, Artificial
  CRISPR gRNA sequence
gtgcgagaacatggcgcctc

SEQ ID NO: 748746 - DNA, 20 bp, Artificial
  CRISPR gRNA sequence
tgcgagaacatggcgcctcc

SEQ ID NO: 748747 - DNA, 20 bp, Artificial
  CRISPR gRNA sequence
gcgagaacatggcgcctcca

SEQ ID NO: 748748 - DNA, 20 bp, Artificial
  CRISPR gRNA sequence
cgagaacatggcgcctccag

SEQ ID NO: 748749 - DNA, 20 bp, Artificial
  CRISPR gRNA sequence
gagaacatggcgcctccagg

SEQ ID NO: 748750 - DNA, 20 bp, Artificial
  CRISPR gRNA sequence
aacatggcgcctccaggggg

SEQ ID NO: 748751 - DNA, 20 bp, Artificial
  CRISPR gRNA sequence
acatggcgcctccagggggc

SEQ ID NO: 748752 - DNA, 20 bp, Artificial
  CRISPR gRNA sequence
atggcgcctccagggggcgg

SEQ ID NO: 748753 - DNA, 20 bp, Artificial
  CRISPR gRNA sequence
tggcgcctccagggggcggg

SEQ ID NO: 748754 - DNA, 20 bp, Artificial
  CRISPR gRNA sequence
gcgcctccagggggcgggag

SEQ ID NO: 748755 - DNA, 20 bp, Artificial
  CRISPR gRNA sequence
ccagggggcgggaggagcac

SEQ ID NO: 748756 - DNA, 20 bp, Artificial
  CRISPR gRNA sequence
cagggggcgggaggagcact

SEQ ID NO: 748757 - DNA, 20 bp, Artificial
  CRISPR gRNA sequence
agggggcgggaggagcacta

SEQ ID NO: 748758 - DNA, 20 bp, Artificial
  CRISPR gRNA sequence
gggggcgggaggagcactag

SEQ ID NO: 748759 - DNA, 20 bp, Artificial
  CRISPR gRNA sequence
gcgggaggagcactaggggc

SEQ ID NO: 748760 - DNA, 20 bp, Artificial
  CRISPR gRNA sequence
cgggaggagcactaggggct

SEQ ID NO: 748761 - DNA, 20 bp, Artificial
  CRISPR gRNA sequence
gggaggagcactaggggctg

SEQ ID NO: 748762 - DNA, 20 bp, Artificial
  CRISPR gRNA sequence
aggagcactaggggctgggg

SEQ ID NO: 748763 - DNA, 20 bp, Artificial
  CRISPR gRNA sequence
ggagcactaggggctggggc

SEQ ID NO: 748764 - DNA, 20 bp, Artificial
  CRISPR gRNA sequence
agcactaggggctggggcag

SEQ ID NO: 748765 - DNA, 20 bp, Artificial
  CRISPR gRNA sequence
gcactaggggctggggcagg

SEQ ID NO: 748766 - DNA, 20 bp, Artificial
  CRISPR gRNA sequence
gggctggggcaggaggctcc

SEQ ID NO: 748767 - DNA, 20 bp, Artificial
  CRISPR gRNA sequence
gctggggcaggaggctcctg

SEQ ID NO: 748768 - DNA, 20 bp, Artificial
  CRISPR gRNA sequence
gcaggaggctcctggagcgc

SEQ ID NO: 748769 - DNA, 20 bp, Artificial
  CRISPR gRNA sequence
ctcctggagcgctggattcg

SEQ ID NO: 748770 - DNA, 20 bp, Artificial
  CRISPR gRNA sequence
ggagcgctggattcgtggca

SEQ ID NO: 748771 - DNA, 20 bp, Artificial
  CRISPR gRNA sequence
ctggattcgtggcacagtct

SEQ ID NO: 748772 - DNA, 20 bp, Artificial
  CRISPR gRNA sequence
tggattcgtggcacagtctg

SEQ ID NO: 748773 - DNA, 20 bp, Artificial
  CRISPR gRNA sequence
gtggcacagtctgaggccct

SEQ ID NO: 748774 - DNA, 20 bp, Artificial
  CRISPR gRNA sequence
ggcacagtctgaggccctga

SEQ ID NO: 748775 - DNA, 20 bp, Artificial
  CRISPR gRNA sequence
gcacagtctgaggccctgag

SEQ ID NO: 748776 - DNA, 20 bp, Artificial
  CRISPR gRNA sequence
cacagtctgaggccctgaga

SEQ ID NO: 748777 - DNA, 20 bp, Artificial
  CRISPR gRNA sequence
agagggaaatccatgctttt

SEQ ID NO: 748778 - DNA, 20 bp, Artificial
  CRISPR gRNA sequence
tttaagaactaattcattgt

SEQ ID NO: 748779 - DNA, 20 bp, Artificial
  CRISPR gRNA sequence
ttaagaactaattcattgtt

SEQ ID NO: 748780 - DNA, 20 bp, Artificial
  CRISPR gRNA sequence
aagaactaattcattgttag

SEQ ID NO: 748781 - DNA, 20 bp, Artificial
  CRISPR gRNA sequence
ttcattgttaggagatcaat

SEQ ID NO: 748782 - DNA, 20 bp, Artificial
  CRISPR gRNA sequence
tcattgttaggagatcaatc

SEQ ID NO: 748783 - DNA, 20 bp, Artificial
  CRISPR gRNA sequence
ttaggagatcaatcaggaat

SEQ ID NO: 748784 - DNA, 20 bp, Artificial
  CRISPR gRNA sequence
taggagatcaatcaggaatt

SEQ ID NO: 748785 - DNA, 20 bp, Artificial
  CRISPR gRNA sequence
aggagatcaatcaggaatta

SEQ ID NO: 748786 - DNA, 20 bp, Artificial
  CRISPR gRNA sequence
ggagatcaatcaggaattag

SEQ ID NO: 748787 - DNA, 20 bp, Artificial
  CRISPR gRNA sequence
tacctatctcctgacattca

SEQ ID NO: 748788 - DNA, 20 bp, Artificial
  CRISPR gRNA sequence
tcctgacattcacagtttaa

SEQ ID NO: 748789 - DNA, 20 bp, Artificial
  CRISPR gRNA sequence
ctgacattcacagtttaata

SEQ ID NO: 748790 - DNA, 20 bp, Artificial
  CRISPR gRNA sequence
ttcctgcctttattccctcc

SEQ ID NO: 748791 - DNA, 20 bp, Artificial
  CRISPR gRNA sequence
tcctgcctttattccctccc

SEQ ID NO: 748792 - DNA, 20 bp, Artificial
  CRISPR gRNA sequence
cctgcctttattccctccca

SEQ ID NO: 748793 - DNA, 20 bp, Artificial
  CRISPR gRNA sequence
tgcctttattccctcccagg

SEQ ID NO: 748794 - DNA, 20 bp, Artificial
  CRISPR gRNA sequence
cctttattccctcccaggga

SEQ ID NO: 748795 - DNA, 20 bp, Artificial
  CRISPR gRNA sequence
ctttattccctcccagggag

SEQ ID NO: 748796 - DNA, 20 bp, Artificial
  CRISPR gRNA sequence
tccctcccagggagaggctg

SEQ ID NO: 748797 - DNA, 20 bp, Artificial
  CRISPR gRNA sequence
ccctcccagggagaggctga

SEQ ID NO: 748798 - DNA, 20 bp, Artificial
  CRISPR gRNA sequence
ccagggagaggctgaaggaa

SEQ ID NO: 748799 - DNA, 20 bp, Artificial
  CRISPR gRNA sequence
ggctgaaggaatggaattga

SEQ ID NO: 748800 - DNA, 20 bp, Artificial
  CRISPR gRNA sequence
atggaattgaaagcaccatt

SEQ ID NO: 748801 - DNA, 20 bp, Artificial
  CRISPR gRNA sequence
ggaattgaaagcaccatttg

SEQ ID NO: 748802 - DNA, 20 bp, Artificial
  CRISPR gRNA sequence
gaattgaaagcaccatttgg

SEQ ID NO: 748803 - DNA, 20 bp, Artificial
  CRISPR gRNA sequence
aattgaaagcaccatttgga

SEQ ID NO: 748804 - DNA, 20 bp, Artificial
  CRISPR gRNA sequence
tttggagggttttgctgaca

SEQ ID NO: 748805 - DNA, 20 bp, Artificial
  CRISPR gRNA sequence
ggagggttttgctgacacag

SEQ ID NO: 748806 - DNA, 20 bp, Artificial
  CRISPR gRNA sequence
gagggttttgctgacacagc

SEQ ID NO: 748807 - DNA, 20 bp, Artificial
  CRISPR gRNA sequence
agggttttgctgacacagcg

SEQ ID NO: 748808 - DNA, 20 bp, Artificial
  CRISPR gRNA sequence
ctgacacagcggggactgct

SEQ ID NO: 748809 - DNA, 20 bp, Artificial
  CRISPR gRNA sequence
cactccctaaaaacacacca

SEQ ID NO: 748810 - DNA, 20 bp, Artificial
  CRISPR gRNA sequence
ctccctaaaaacacaccatg

SEQ ID NO: 748811 - DNA, 20 bp, Artificial
  CRISPR gRNA sequence
tccctaaaaacacaccatgg

SEQ ID NO: 748812 - DNA, 20 bp, Artificial
  CRISPR gRNA sequence
aaacacaccatggaggccac

SEQ ID NO: 748813 - DNA, 20 bp, Artificial
  CRISPR gRNA sequence
tggaggccactggtgactgc

SEQ ID NO: 748814 - DNA, 20 bp, Artificial
  CRISPR gRNA sequence
aggccactggtgactgctgg

SEQ ID NO: 748815 - DNA, 20 bp, Artificial
  CRISPR gRNA sequence
ggccactggtgactgctggt

SEQ ID NO: 748816 - DNA, 20 bp, Artificial
  CRISPR gRNA sequence
cactggtgactgctggtggg

SEQ ID NO: 748817 - DNA, 20 bp, Artificial
  CRISPR gRNA sequence
actggtgactgctggtgggc

SEQ ID NO: 748818 - DNA, 20 bp, Artificial
  CRISPR gRNA sequence
gtgactgctggtgggcaggc

SEQ ID NO: 748819 - DNA, 20 bp, Artificial
  CRISPR gRNA sequence
gtgggcaggctggccctgcc

SEQ ID NO: 748820 - DNA, 20 bp, Artificial
  CRISPR gRNA sequence
tgggcaggctggccctgcct

SEQ ID NO: 748821 - DNA, 20 bp, Artificial
  CRISPR gRNA sequence
gggcaggctggccctgcctg

SEQ ID NO: 748822 - DNA, 20 bp, Artificial
  CRISPR gRNA sequence
ggcaggctggccctgcctgg

SEQ ID NO: 748823 - DNA, 20 bp, Artificial
  CRISPR gRNA sequence
caggctggccctgcctgggg

SEQ ID NO: 748824 - DNA, 20 bp, Artificial
  CRISPR gRNA sequence
gccctgcctgggggagtccg

SEQ ID NO: 748825 - DNA, 20 bp, Artificial
  CRISPR gRNA sequence
cctgggggagtccgtggcga

SEQ ID NO: 748826 - DNA, 20 bp, Artificial
  CRISPR gRNA sequence
ctgggggagtccgtggcgat

SEQ ID NO: 748827 - DNA, 20 bp, Artificial
  CRISPR gRNA sequence
gagtccgtggcgatgggcgc

SEQ ID NO: 748828 - DNA, 20 bp, Artificial
  CRISPR gRNA sequence
agtccgtggcgatgggcgct

SEQ ID NO: 748829 - DNA, 20 bp, Artificial
  CRISPR gRNA sequence
gtccgtggcgatgggcgctg

SEQ ID NO: 748830 - DNA, 20 bp, Artificial
  CRISPR gRNA sequence
cgtggcgatgggcgctgggg

SEQ ID NO: 748831 - DNA, 20 bp, Artificial
  CRISPR gRNA sequence
tggcgatgggcgctggggtg

SEQ ID NO: 748832 - DNA, 20 bp, Artificial
  CRISPR gRNA sequence
ggcgatgggcgctggggtgg

SEQ ID NO: 748833 - DNA, 20 bp, Artificial
  CRISPR gRNA sequence
tgggcgctggggtggaggtg

SEQ ID NO: 748834 - DNA, 20 bp, Artificial
  CRISPR gRNA sequence
gggcgctggggtggaggtgc

SEQ ID NO: 748835 - DNA, 20 bp, Artificial
  CRISPR gRNA sequence
gcgctggggtggaggtgcag

SEQ ID NO: 748836 - DNA, 20 bp, Artificial
  CRISPR gRNA sequence
gggtggaggtgcaggagccc

SEQ ID NO: 748837 - DNA, 20 bp, Artificial
  CRISPR gRNA sequence
ggtggaggtgcaggagcccc

SEQ ID NO: 748838 - DNA, 20 bp, Artificial
  CRISPR gRNA sequence
ccccaggacctgcttttcaa

SEQ ID NO: 748839 - DNA, 20 bp, Artificial
  CRISPR gRNA sequence
tcaaaagacttctgcctgac

SEQ ID NO: 748840 - DNA, 20 bp, Artificial
  CRISPR gRNA sequence
aaaagacttctgcctgacca

SEQ ID NO: 748841 - DNA, 20 bp, Artificial
  CRISPR gRNA sequence
accagagctcccactacatg

SEQ ID NO: 748842 - DNA, 20 bp, Artificial
  CRISPR gRNA sequence
agagctcccactacatgcag

SEQ ID NO: 748843 - DNA, 20 bp, Artificial
  CRISPR gRNA sequence
tcccactacatgcagtggcc

SEQ ID NO: 748844 - DNA, 20 bp, Artificial
  CRISPR gRNA sequence
cccactacatgcagtggccc

SEQ ID NO: 748845 - DNA, 20 bp, Artificial
  CRISPR gRNA sequence
ccactacatgcagtggccca

SEQ ID NO: 748846 - DNA, 20 bp, Artificial
  CRISPR gRNA sequence
ctacatgcagtggcccaggg

SEQ ID NO: 748847 - DNA, 20 bp, Artificial
  CRISPR gRNA sequence
acatgcagtggcccagggca

SEQ ID NO: 748848 - DNA, 20 bp, Artificial
  CRISPR gRNA sequence
catgcagtggcccagggcag

SEQ ID NO: 748849 - DNA, 20 bp, Artificial
  CRISPR gRNA sequence
atgcagtggcccagggcaga

SEQ ID NO: 748850 - DNA, 20 bp, Artificial
  CRISPR gRNA sequence
tgcagtggcccagggcagag

SEQ ID NO: 748851 - DNA, 20 bp, Artificial
  CRISPR gRNA sequence
agggcagaggggctgataca

SEQ ID NO: 748852 - DNA, 20 bp, Artificial
  CRISPR gRNA sequence
ggctgatacatggccttttt

SEQ ID NO: 748853 - DNA, 20 bp, Artificial
  CRISPR gRNA sequence
gctgatacatggcctttttc

SEQ ID NO: 748854 - DNA, 20 bp, Artificial
  CRISPR gRNA sequence
ctgatacatggcctttttca

SEQ ID NO: 748855 - DNA, 20 bp, Artificial
  CRISPR gRNA sequence
tgatacatggcctttttcag

SEQ ID NO: 748856 - DNA, 20 bp, Artificial
  CRISPR gRNA sequence
gatacatggcctttttcagg

SEQ ID NO: 748857 - DNA, 20 bp, Artificial
  CRISPR gRNA sequence
ttttcagggggtgctcctcg

SEQ ID NO: 748858 - DNA, 20 bp, Artificial
  CRISPR gRNA sequence
tttcagggggtgctcctcgc

SEQ ID NO: 748859 - DNA, 20 bp, Artificial
  CRISPR gRNA sequence
ttcagggggtgctcctcgcg

SEQ ID NO: 748860 - DNA, 20 bp, Artificial
  CRISPR gRNA sequence
agggggtgctcctcgcgggg

SEQ ID NO: 748861 - DNA, 20 bp, Artificial
  CRISPR gRNA sequence
tgctcctcgcggggtggact

SEQ ID NO: 748862 - DNA, 20 bp, Artificial
  CRISPR gRNA sequence
gctcctcgcggggtggactt

SEQ ID NO: 748863 - DNA, 20 bp, Artificial
  CRISPR gRNA sequence
tcctcgcggggtggacttgg

SEQ ID NO: 748864 - DNA, 20 bp, Artificial
  CRISPR gRNA sequence
ggggtggacttgggagtgtg

SEQ ID NO: 748865 - DNA, 20 bp, Artificial
  CRISPR gRNA sequence
gtggacttgggagtgtgcag

SEQ ID NO: 748866 - DNA, 20 bp, Artificial
  CRISPR gRNA sequence
tggacttgggagtgtgcagt

SEQ ID NO: 748867 - DNA, 20 bp, Artificial
  CRISPR gRNA sequence
cttgggagtgtgcagtggga

SEQ ID NO: 748868 - DNA, 20 bp, Artificial
  CRISPR gRNA sequence
ttgggagtgtgcagtgggac

SEQ ID NO: 748869 - DNA, 20 bp, Artificial
  CRISPR gRNA sequence
tgggagtgtgcagtgggaca

SEQ ID NO: 748870 - DNA, 20 bp, Artificial
  CRISPR gRNA sequence
gggagtgtgcagtgggacag

SEQ ID NO: 748871 - DNA, 20 bp, Artificial
  CRISPR gRNA sequence
ggagtgtgcagtgggacagg

SEQ ID NO: 748872 - DNA, 20 bp, Artificial
  CRISPR gRNA sequence
tgcagtgggacagggggctg

SEQ ID NO: 748873 - DNA, 20 bp, Artificial
  CRISPR gRNA sequence
gcagtgggacagggggctgc

SEQ ID NO: 748874 - DNA, 20 bp, Artificial
  CRISPR gRNA sequence
cagtgggacagggggctgca

SEQ ID NO: 748875 - DNA, 20 bp, Artificial
  CRISPR gRNA sequence
agtgggacagggggctgcag

SEQ ID NO: 748876 - DNA, 20 bp, Artificial
  CRISPR gRNA sequence
gcaggggtcctgccaccacc

SEQ ID NO: 748877 - DNA, 20 bp, Artificial
  CRISPR gRNA sequence
gccaccaccgagcaccaact

SEQ ID NO: 748878 - DNA, 20 bp, Artificial
  CRISPR gRNA sequence
ccgagcaccaacttggcccc

SEQ ID NO: 748879 - DNA, 20 bp, Artificial
  CRISPR gRNA sequence
cgagcaccaacttggcccct

SEQ ID NO: 748880 - DNA, 20 bp, Artificial
  CRISPR gRNA sequence
gagcaccaacttggcccctg

SEQ ID NO: 748881 - DNA, 20 bp, Artificial
  CRISPR gRNA sequence
tggggtcctgcctcatgaat

SEQ ID NO: 748882 - DNA, 20 bp, Artificial
  CRISPR gRNA sequence
ggggtcctgcctcatgaatg

SEQ ID NO: 748883 - DNA, 20 bp, Artificial
  CRISPR gRNA sequence
ctcatgaatgaggccttccc

SEQ ID NO: 748884 - DNA, 20 bp, Artificial
  CRISPR gRNA sequence
tcatgaatgaggccttcccc

SEQ ID NO: 748885 - DNA, 20 bp, Artificial
  CRISPR gRNA sequence
catgaatgaggccttcccca

SEQ ID NO: 748886 - DNA, 20 bp, Artificial
  CRISPR gRNA sequence
aatgaggccttccccagggc

SEQ ID NO: 748887 - DNA, 20 bp, Artificial
  CRISPR gRNA sequence
cagggctggcctgactgtgc

SEQ ID NO: 748888 - DNA, 20 bp, Artificial
  CRISPR gRNA sequence
agggctggcctgactgtgct

SEQ ID NO: 748889 - DNA, 20 bp, Artificial
  CRISPR gRNA sequence
gggctggcctgactgtgctg

SEQ ID NO: 748890 - DNA, 20 bp, Artificial
  CRISPR gRNA sequence
ggctggcctgactgtgctgg

SEQ ID NO: 748891 - DNA, 20 bp, Artificial
  CRISPR gRNA sequence
ggcctgactgtgctgggggc

SEQ ID NO: 748892 - DNA, 20 bp, Artificial
  CRISPR gRNA sequence
gcctgactgtgctgggggct

SEQ ID NO: 748893 - DNA, 20 bp, Artificial
  CRISPR gRNA sequence
gggctgggttaacgttttct

SEQ ID NO: 748894 - DNA, 20 bp, Artificial
  CRISPR gRNA sequence
ggctgggttaacgttttctc

SEQ ID NO: 748895 - DNA, 20 bp, Artificial
  CRISPR gRNA sequence
gctgggttaacgttttctca

SEQ ID NO: 748896 - DNA, 20 bp, Artificial
  CRISPR gRNA sequence
cagggaaccacaatgcacga

SEQ ID NO: 748897 - DNA, 20 bp, Artificial
  CRISPR gRNA sequence
gggaaccacaatgcacgaaa

SEQ ID NO: 748898 - DNA, 20 bp, Artificial
  CRISPR gRNA sequence
ggaaccacaatgcacgaaag

SEQ ID NO: 748899 - DNA, 20 bp, Artificial
  CRISPR gRNA sequence
acaatgcacgaaagaggaac

SEQ ID NO: 748900 - DNA, 20 bp, Artificial
  CRISPR gRNA sequence
caatgcacgaaagaggaact

SEQ ID NO: 748901 - DNA, 20 bp, Artificial
  CRISPR gRNA sequence
aatgcacgaaagaggaactg

SEQ ID NO: 748902 - DNA, 20 bp, Artificial
  CRISPR gRNA sequence
gaggaactggggttgctaac

SEQ ID NO: 748903 - DNA, 20 bp, Artificial
  CRISPR gRNA sequence
aggaactggggttgctaacc

SEQ ID NO: 748904 - DNA, 20 bp, Artificial
  CRISPR gRNA sequence
ggggttgctaaccaggatgc

SEQ ID NO: 748905 - DNA, 20 bp, Artificial
  CRISPR gRNA sequence
gggttgctaaccaggatgct

SEQ ID NO: 748906 - DNA, 20 bp, Artificial
  CRISPR gRNA sequence
taaccaggatgctgggaaca

SEQ ID NO: 748907 - DNA, 20 bp, Artificial
  CRISPR gRNA sequence
aaccaggatgctgggaacaa

SEQ ID NO: 748908 - DNA, 20 bp, Artificial
  CRISPR gRNA sequence
ctgggaacaaaggcctcttg

SEQ ID NO: 748909 - DNA, 20 bp, Artificial
  CRISPR gRNA sequence
aacaaaggcctcttgaagcc

SEQ ID NO: 748910 - DNA, 20 bp, Artificial
  CRISPR gRNA sequence
ggcctcttgaagcccagcca

SEQ ID NO: 748911 - DNA, 20 bp, Artificial
  CRISPR gRNA sequence
cttgaagcccagccacagcc

SEQ ID NO: 748912 - DNA, 20 bp, Artificial
  CRISPR gRNA sequence
agcccagccacagcccagct

SEQ ID NO: 748913 - DNA, 20 bp, Artificial
  CRISPR gRNA sequence
gccacagcccagctgagcat

SEQ ID NO: 748914 - DNA, 20 bp, Artificial
  CRISPR gRNA sequence
ccacagcccagctgagcatg

SEQ ID NO: 748915 - DNA, 20 bp, Artificial
  CRISPR gRNA sequence
gcccagctgagcatgaggcc

SEQ ID NO: 748916 - DNA, 20 bp, Artificial
  CRISPR gRNA sequence
tgagcatgaggcccagccca

SEQ ID NO: 748917 - DNA, 20 bp, Artificial
  CRISPR gRNA sequence
catgaggcccagcccataga

SEQ ID NO: 748918 - DNA, 20 bp, Artificial
  CRISPR gRNA sequence
ggcccagcccatagacggca

SEQ ID NO: 748919 - DNA, 20 bp, Artificial
  CRISPR gRNA sequence
gcccagcccatagacggcac

SEQ ID NO: 748920 - DNA, 20 bp, Artificial
  CRISPR gRNA sequence
catagacggcacaggccacc

SEQ ID NO: 748921 - DNA, 20 bp, Artificial
  CRISPR gRNA sequence
aggccacctggcccattccc

SEQ ID NO: 748922 - DNA, 20 bp, Artificial
  CRISPR gRNA sequence
ggccacctggcccattccct

SEQ ID NO: 748923 - DNA, 20 bp, Artificial
  CRISPR gRNA sequence
tgctgcttctcttcacccca

SEQ ID NO: 748924 - DNA, 20 bp, Artificial
  CRISPR gRNA sequence
ctgcttctcttcaccccatg

SEQ ID NO: 748925 - DNA, 20 bp, Artificial
  CRISPR gRNA sequence
tgcttctcttcaccccatgg

SEQ ID NO: 748926 - DNA, 20 bp, Artificial
  CRISPR gRNA sequence
ctatgtcaccctaactatcc

SEQ ID NO: 748927 - DNA, 20 bp, Artificial
  CRISPR gRNA sequence
taactatcctggaatgtgtt

SEQ ID NO: 748928 - DNA, 20 bp, Artificial
  CRISPR gRNA sequence
actatcctggaatgtgttga

SEQ ID NO: 748929 - DNA, 20 bp, Artificial
  CRISPR gRNA sequence
ctatcctggaatgtgttgag

SEQ ID NO: 748930 - DNA, 20 bp, Artificial
  CRISPR gRNA sequence
tatcctggaatgtgttgaga

SEQ ID NO: 748931 - DNA, 20 bp, Artificial
  CRISPR gRNA sequence
gggattctgaatgatcaata

SEQ ID NO: 748932 - DNA, 20 bp, Artificial
  CRISPR gRNA sequence
tctgaatgatcaatatagct

SEQ ID NO: 748933 - DNA, 20 bp, Artificial
  CRISPR gRNA sequence
aatgatcaatatagcttggt

SEQ ID NO: 748934 - DNA, 20 bp, Artificial
  CRISPR gRNA sequence
atcaatatagcttggtgaga

SEQ ID NO: 748935 - DNA, 20 bp, Artificial
  CRISPR gRNA sequence
tagcttggtgagacagtgcc

SEQ ID NO: 748936 - DNA, 20 bp, Artificial
  CRISPR gRNA sequence
ttggtgagacagtgccgaga

SEQ ID NO: 748937 - DNA, 20 bp, Artificial
  CRISPR gRNA sequence
tgagacagtgccgagataga

SEQ ID NO: 748938 - DNA, 20 bp, Artificial
  CRISPR gRNA sequence
atagatagccatgtctgcct

SEQ ID NO: 748939 - DNA, 20 bp, Artificial
  CRISPR gRNA sequence
tagatagccatgtctgcctt

SEQ ID NO: 748940 - DNA, 20 bp, Artificial
  CRISPR gRNA sequence
agccatgtctgccttgggca

SEQ ID NO: 748941 - DNA, 20 bp, Artificial
  CRISPR gRNA sequence
gccatgtctgccttgggcac

SEQ ID NO: 748942 - DNA, 20 bp, Artificial
  CRISPR gRNA sequence
catgtctgccttgggcacgg

SEQ ID NO: 748943 - DNA, 20 bp, Artificial
  CRISPR gRNA sequence
tgtctgccttgggcacggga

SEQ ID NO: 748944 - DNA, 20 bp, Artificial
  CRISPR gRNA sequence
gtctgccttgggcacgggag

SEQ ID NO: 748945 - DNA, 20 bp, Artificial
  CRISPR gRNA sequence
tctgccttgggcacgggaga

SEQ ID NO: 748946 - DNA, 20 bp, Artificial
  CRISPR gRNA sequence
gccttgggcacgggagaggg

SEQ ID NO: 748947 - DNA, 20 bp, Artificial
  CRISPR gRNA sequence
ttgggcacgggagagggaag

SEQ ID NO: 748948 - DNA, 20 bp, Artificial
  CRISPR gRNA sequence
ggcacgggagagggaagtgg

SEQ ID NO: 748949 - DNA, 20 bp, Artificial
  CRISPR gRNA sequence
gcagcatgcatgctgtttct

SEQ ID NO: 748950 - DNA, 20 bp, Artificial
  CRISPR gRNA sequence
tgtttcttggccttttctgt

SEQ ID NO: 748951 - DNA, 20 bp, Artificial
  CRISPR gRNA sequence
gccttttctgttagaatact

SEQ ID NO: 748952 - DNA, 20 bp, Artificial
  CRISPR gRNA sequence
acccccttccctgaaaatcc

SEQ ID NO: 748953 - DNA, 20 bp, Artificial
  CRISPR gRNA sequence
cccccttccctgaaaatcct

SEQ ID NO: 748954 - DNA, 20 bp, Artificial
  CRISPR gRNA sequence
cccttccctgaaaatcctgg

SEQ ID NO: 748955 - DNA, 20 bp, Artificial
  CRISPR gRNA sequence
ccttccctgaaaatcctggg

SEQ ID NO: 748956 - DNA, 20 bp, Artificial
  CRISPR gRNA sequence
tttattgctgccatttaaca

SEQ ID NO: 748957 - DNA, 20 bp, Artificial
  CRISPR gRNA sequence
tattgctgccatttaacaca

SEQ ID NO: 748958 - DNA, 20 bp, Artificial
  CRISPR gRNA sequence
attgctgccatttaacacag

SEQ ID NO: 748959 - DNA, 20 bp, Artificial
  CRISPR gRNA sequence
ttgctgccatttaacacaga

SEQ ID NO: 748960 - DNA, 20 bp, Artificial
  CRISPR gRNA sequence
ccatttaacacagagggcaa

SEQ ID NO: 748961 - DNA, 20 bp, Artificial
  CRISPR gRNA sequence
atttaacacagagggcaata

SEQ ID NO: 748962 - DNA, 20 bp, Artificial
  CRISPR gRNA sequence
tttaacacagagggcaatag

SEQ ID NO: 748963 - DNA, 20 bp, Artificial
  CRISPR gRNA sequence
gagggcaatagaggttctga

SEQ ID NO: 748964 - DNA, 20 bp, Artificial
  CRISPR gRNA sequence
agggcaatagaggttctgaa

SEQ ID NO: 748965 - DNA, 20 bp, Artificial
  CRISPR gRNA sequence
ggtctgtgtcttgtcaaaac

SEQ ID NO: 748966 - DNA, 20 bp, Artificial
  CRISPR gRNA sequence
gtcttgtcaaaacaagtaaa

SEQ ID NO: 748967 - DNA, 20 bp, Artificial
  CRISPR gRNA sequence
ttgtcaaaacaagtaaacgg

SEQ ID NO: 748968 - DNA, 20 bp, Artificial
  CRISPR gRNA sequence
gtggaactacgactaaaccc

SEQ ID NO: 748969 - DNA, 20 bp, Artificial
  CRISPR gRNA sequence
tggaactacgactaaaccct

SEQ ID NO: 748970 - DNA, 20 bp, Artificial
  CRISPR gRNA sequence
cctgcttcctcctcactgaa

SEQ ID NO: 748971 - DNA, 20 bp, Artificial
  CRISPR gRNA sequence
ttcctcctcactgaatggat

SEQ ID NO: 748972 - DNA, 20 bp, Artificial
  CRISPR gRNA sequence
cactgaatggattggtatta

SEQ ID NO: 748973 - DNA, 20 bp, Artificial
  CRISPR gRNA sequence
actgaatggattggtattat

SEQ ID NO: 748974 - DNA, 20 bp, Artificial
  CRISPR gRNA sequence
aatggattggtattatgggc

SEQ ID NO: 748975 - DNA, 20 bp, Artificial
  CRISPR gRNA sequence
atggattggtattatgggcc

SEQ ID NO: 748976 - DNA, 20 bp, Artificial
  CRISPR gRNA sequence
tggattggtattatgggcca

SEQ ID NO: 748977 - DNA, 20 bp, Artificial
  CRISPR gRNA sequence
tggtattatgggccagggcc

SEQ ID NO: 748978 - DNA, 20 bp, Artificial
  CRISPR gRNA sequence
ttatgggccagggcctggct

SEQ ID NO: 748979 - DNA, 20 bp, Artificial
  CRISPR gRNA sequence
gcctggcttggccttcacct

SEQ ID NO: 748980 - DNA, 20 bp, Artificial
  CRISPR gRNA sequence
gccttcaccttggacttgct

SEQ ID NO: 748981 - DNA, 20 bp, Artificial
  CRISPR gRNA sequence
cttcaccttggacttgctta

SEQ ID NO: 748982 - DNA, 20 bp, Artificial
  CRISPR gRNA sequence
gacttgcttagagcacatac

SEQ ID NO: 748983 - DNA, 20 bp, Artificial
  CRISPR gRNA sequence
acttgcttagagcacataca

SEQ ID NO: 748984 - DNA, 20 bp, Artificial
  CRISPR gRNA sequence
cttgcttagagcacatacaa

SEQ ID NO: 748985 - DNA, 20 bp, Artificial
  CRISPR gRNA sequence
tgaggaggaagcaggagacc

SEQ ID NO: 748986 - DNA, 20 bp, Artificial
  CRISPR gRNA sequence
atggcagcaataaaacctcc

SEQ ID NO: 748987 - DNA, 20 bp, Artificial
  CRISPR gRNA sequence
ctcccaggattttcagggaa

SEQ ID NO: 748988 - DNA, 20 bp, Artificial
  CRISPR gRNA sequence
caggattttcagggaagggg

SEQ ID NO: 748989 - DNA, 20 bp, Artificial
  CRISPR gRNA sequence
accaagctatattgatcatt

SEQ ID NO: 748990 - DNA, 20 bp, Artificial
  CRISPR gRNA sequence
gaatccctctcaacacattc

SEQ ID NO: 748991 - DNA, 20 bp, Artificial
  CRISPR gRNA sequence
tcaacacattccaggatagt

SEQ ID NO: 748992 - DNA, 20 bp, Artificial
  CRISPR gRNA sequence
ttagggtgacatagcctcca

SEQ ID NO: 748993 - DNA, 20 bp, Artificial
  CRISPR gRNA sequence
agaagcagcaatgcaaagca

SEQ ID NO: 748994 - DNA, 20 bp, Artificial
  CRISPR gRNA sequence
tgcaaagcagggaatgccca

SEQ ID NO: 748995 - DNA, 20 bp, Artificial
  CRISPR gRNA sequence
gcctccatggtgtgttttta

SEQ ID NO: 748996 - DNA, 20 bp, Artificial
  CRISPR gRNA sequence
ccttcagcctctccctggga

SEQ ID NO: 748997 - DNA, 20 bp, Artificial
  CRISPR gRNA sequence
caggaagtctctattaaact

SEQ ID NO: 748998 - DNA, 20 bp, Artificial
  CRISPR gRNA sequence
tcctgattgatctcctaaca

SEQ ID NO: 748999 - DNA, 20 bp, Artificial
  CRISPR gRNA sequence
atgaattagttcttaaaagc

SEQ ID NO: 749000 - DNA, 20 bp, Artificial
  CRISPR gRNA sequence
tcagggcctcagactgtgcc

SEQ ID NO: 749001 - DNA, 20 bp, Artificial
  CRISPR gRNA sequence
tgtaggcagggcctgtggcc

SEQ ID NO: 749002 - DNA, 20 bp, Artificial
  CRISPR gRNA sequence
tgaagatggaactgggagct

SEQ ID NO: 749003 - DNA, 20 bp, Artificial
  CRISPR gRNA sequence
ccagatgcgttcagttgtaa

SEQ ID NO: 749004 - DNA, 20 bp, Artificial
  CRISPR gRNA sequence
cacacagcagcagccaggcc

SEQ ID NO: 749005 - DNA, 20 bp, Artificial
  CRISPR gRNA sequence
gagggcagggcatgctcttc

SEQ ID NO: 749006 - DNA, 20 bp, Artificial
  CRISPR gRNA sequence
tcttcctgagttgggagaac

SEQ ID NO: 749007 - DNA, 20 bp, Artificial
  CRISPR gRNA sequence
ctcctgccatgcaggccccc

SEQ ID NO: 749008 - DNA, 20 bp, Artificial
  CRISPR gRNA sequence
gttttgctccgtccccaggc

SEQ ID NO: 749009 - DNA, 20 bp, Artificial
  CRISPR gRNA sequence
cctagggacaagggagaagc

SEQ ID NO: 749010 - DNA, 20 bp, Artificial
  CRISPR gRNA sequence
agcagggccatgtgtccagg

SEQ ID NO: 749011 - DNA, 20 bp, Artificial
  CRISPR gRNA sequence
ccatcctgctaaacgctaca

SEQ ID NO: 749012 - DNA, 20 bp, Artificial
  CRISPR gRNA sequence
tgccttccctgttttacccc

SEQ ID NO: 749013 - DNA, 20 bp, Artificial
  CRISPR gRNA sequence
ggaacatcacccgcacctgg

SEQ ID NO: 749014 - DNA, 20 bp, Artificial
  CRISPR gRNA sequence
tccaccaggcccagattgta

SEQ ID NO: 749015 - DNA, 20 bp, Artificial
  CRISPR gRNA sequence
gattgtatggagtggaaggt

SEQ ID NO: 749016 - DNA, 20 bp, Artificial
  CRISPR gRNA sequence
tgggggtgggggaggagcag

SEQ ID NO: 749017 - DNA, 20 bp, Artificial
  CRISPR gRNA sequence
tggctcttacaatccatctc

SEQ ID NO: 749018 - DNA, 20 bp, Artificial
  CRISPR gRNA sequence
cttcatactcagaagtgtcc

SEQ ID NO: 749019 - DNA, 20 bp, Artificial
  CRISPR gRNA sequence
aatggcccgcgctgagcagt

SEQ ID NO: 749020 - DNA, 20 bp, Artificial
  CRISPR gRNA sequence
cgcgctgagcagtgggagta

SEQ ID NO: 749021 - DNA, 20 bp, Artificial
  CRISPR gRNA sequence
ctccctcagcaccatctcca

SEQ ID NO: 749022 - DNA, 20 bp, Artificial
  CRISPR gRNA sequence
gaccaccaagctctggggac

SEQ ID NO: 749023 - DNA, 20 bp, Artificial
  CRISPR gRNA sequence
gccctgtgtctggtgcctgg

SEQ ID NO: 749024 - DNA, 20 bp, Artificial
  CRISPR gRNA sequence
tcatttggcatctgtagctg

SEQ ID NO: 749025 - DNA, 20 bp, Artificial
  CRISPR gRNA sequence
tgaatttcaggtctctaggg

SEQ ID NO: 749026 - DNA, 20 bp, Artificial
  CRISPR gRNA sequence
catccccatgtagcatccag

SEQ ID NO: 749027 - DNA, 20 bp, Artificial
  CRISPR gRNA sequence
gggttgaggggctgggcttc

SEQ ID NO: 749028 - DNA, 20 bp, Artificial
  CRISPR gRNA sequence
ctagatgacctcaaagtttg

SEQ ID NO: 749029 - DNA, 20 bp, Artificial
  CRISPR gRNA sequence
aaagtttggagagtcaggga

SEQ ID NO: 749030 - DNA, 20 bp, Artificial
  CRISPR gRNA sequence
ccgtggaactcttcagggag

SEQ ID NO: 749031 - DNA, 20 bp, Artificial
  CRISPR gRNA sequence
ccgtggaactcttcagggag

SEQ ID NO: 749032 - DNA, 20 bp, Artificial
  CRISPR gRNA sequence
ccgtggaactcttcagggag

SEQ ID NO: 749033 - DNA, 20 bp, Artificial
  CRISPR gRNA sequence
ggaactcttcagggagggca

SEQ ID NO: 749034 - DNA, 20 bp, Artificial
  CRISPR gRNA sequence
aggtcaggaaacacttaccc

SEQ ID NO: 749035 - DNA, 20 bp, Artificial
  CRISPR gRNA sequence
ccggggcctggaggagacag

SEQ ID NO: 749036 - DNA, 20 bp, Artificial
  CRISPR gRNA sequence
ccgctgggccacataggaca

SEQ ID NO: 749037 - DNA, 20 bp, Artificial
  CRISPR gRNA sequence
gggggtgcctgactttggcc

SEQ ID NO: 749038 - DNA, 20 bp, Artificial
  CRISPR gRNA sequence
aggtggtgaggcttcaaagc

SEQ ID NO: 749039 - DNA, 20 bp, Artificial
  CRISPR gRNA sequence
aagccggggttttcaatccc

SEQ ID NO: 749040 - DNA, 20 bp, Artificial
  CRISPR gRNA sequence
gaatgttgctgccacagaac

SEQ ID NO: 749041 - DNA, 20 bp, Artificial
  CRISPR gRNA sequence
acttctagaacttcagcctc

SEQ ID NO: 749042 - DNA, 20 bp, Artificial
  CRISPR gRNA sequence
acaagtttctctttggtcaa

SEQ ID NO: 749043 - DNA, 20 bp, Artificial
  CRISPR gRNA sequence
gtcaatagagttgatggcat

SEQ ID NO: 749044 - DNA, 20 bp, Artificial
  CRISPR gRNA sequence
gcctgtcttgagctgagggg

SEQ ID NO: 749045 - DNA, 20 bp, Artificial
  CRISPR gRNA sequence
gttctcttctcttcccagtt

SEQ ID NO: 749046 - DNA, 20 bp, Artificial
  CRISPR gRNA sequence
cttctcttcccagttgggag

SEQ ID NO: 749047 - DNA, 20 bp, Artificial
  CRISPR gRNA sequence
ctgcaactcttagattctag

SEQ ID NO: 749048 - DNA, 20 bp, Artificial
  CRISPR gRNA sequence
gcaggtaccggggcaggaac

SEQ ID NO: 749049 - DNA, 20 bp, Artificial
  CRISPR gRNA sequence
cggcctaacagctttctcct

SEQ ID NO: 749050 - DNA, 20 bp, Artificial
  CRISPR gRNA sequence
ctgaccactgagacccgaag

SEQ ID NO: 749051 - DNA, 20 bp, Artificial
  CRISPR gRNA sequence
gggtgcatgacacatctgag

SEQ ID NO: 749052 - DNA, 20 bp, Artificial
  CRISPR gRNA sequence
cagaatcagagctcagcctg

SEQ ID NO: 749053 - DNA, 20 bp, Artificial
  CRISPR gRNA sequence
cagagctcagcctgctgagt

SEQ ID NO: 749054 - DNA, 20 bp, Artificial
  CRISPR gRNA sequence
ctgcacagaagtatctcttc

SEQ ID NO: 749055 - DNA, 20 bp, Artificial
  CRISPR gRNA sequence
cggactccatttcttttcac

SEQ ID NO: 749056 - DNA, 20 bp, Artificial
  CRISPR gRNA sequence
aaactctatctgcattttcc

SEQ ID NO: 749057 - DNA, 20 bp, Artificial
  CRISPR gRNA sequence
cttacacagtgtcagacctt

SEQ ID NO: 749058 - DNA, 20 bp, Artificial
  CRISPR gRNA sequence
tatcgagcaaaggtcaactc

SEQ ID NO: 749059 - DNA, 20 bp, Artificial
  CRISPR gRNA sequence
tggtctttagccatgactta

SEQ ID NO: 749060 - DNA, 20 bp, Artificial
  CRISPR gRNA sequence
ttagccatgacttactgggt

SEQ ID NO: 749061 - DNA, 20 bp, Artificial
  CRISPR gRNA sequence
ctatcccctacattgcctaa

SEQ ID NO: 749062 - DNA, 20 bp, Artificial
  CRISPR gRNA sequence
ctattgcttacagccgactc

SEQ ID NO: 749063 - DNA, 20 bp, Artificial
  CRISPR gRNA sequence
caggcttcgtgcaggtgcac

SEQ ID NO: 749064 - DNA, 20 bp, Artificial
  CRISPR gRNA sequence
tcatcctctgtgccaccctt

SEQ ID NO: 749065 - DNA, 20 bp, Artificial
  CRISPR gRNA sequence
tctgtgccaccctttggggt

SEQ ID NO: 749066 - DNA, 20 bp, Artificial
  CRISPR gRNA sequence
aactgaggctcagtccaaag

SEQ ID NO: 749067 - DNA, 20 bp, Artificial
  CRISPR gRNA sequence
tttccttttctttttttcct

SEQ ID NO: 749068 - DNA, 20 bp, Artificial
  CRISPR gRNA sequence
gcccccacccacccccagcc

SEQ ID NO: 749069 - DNA, 20 bp, Artificial
  CRISPR gRNA sequence
gttgtggtgtgttctaggag

SEQ ID NO: 749070 - DNA, 20 bp, Artificial
  CRISPR gRNA sequence
gtgttctaggagaggaatag

SEQ ID NO: 749071 - DNA, 20 bp, Artificial
  CRISPR gRNA sequence
aataggggagttctgaaagc

SEQ ID NO: 749072 - DNA, 20 bp, Artificial
  CRISPR gRNA sequence
gggtgaggtggccacagccc

SEQ ID NO: 749073 - DNA, 20 bp, Artificial
  CRISPR gRNA sequence
ggcttcacgtgggggccccc

SEQ ID NO: 749074 - DNA, 20 bp, Artificial
  CRISPR gRNA sequence
ccccgggaatgaggggaggg

SEQ ID NO: 749075 - DNA, 20 bp, Artificial
  CRISPR gRNA sequence
agaggccagggaggggaggc

SEQ ID NO: 749076 - DNA, 20 bp, Artificial
  CRISPR gRNA sequence
gactaaccaagactcaaggg

SEQ ID NO: 749077 - DNA, 20 bp, Artificial
  CRISPR gRNA sequence
aaggggcactgtcacctggc

SEQ ID NO: 749078 - DNA, 20 bp, Artificial
  CRISPR gRNA sequence
aaattcttggacttgcaatg

SEQ ID NO: 749079 - DNA, 20 bp, Artificial
  CRISPR gRNA sequence
atgcgttgaaagctctgaga

SEQ ID NO: 749080 - DNA, 20 bp, Artificial
  CRISPR gRNA sequence
ccttctcatctggaaaaaga

SEQ ID NO: 749081 - DNA, 20 bp, Artificial
  CRISPR gRNA sequence
ataccttaaacaggtccccc

SEQ ID NO: 749082 - DNA, 20 bp, Artificial
  CRISPR gRNA sequence
aacaggtcccccaaggatct

SEQ ID NO: 749083 - DNA, 20 bp, Artificial
  CRISPR gRNA sequence
attcattcagaagacatgta

SEQ ID NO: 749084 - DNA, 20 bp, Artificial
  CRISPR gRNA sequence
ctcccaactctcaaatgaaa

SEQ ID NO: 749085 - DNA, 20 bp, Artificial
  CRISPR gRNA sequence
tgtgcctgcatcgtgccttt

SEQ ID NO: 749086 - DNA, 20 bp, Artificial
  CRISPR gRNA sequence
tccacccaccccaggcaggg

SEQ ID NO: 749087 - DNA, 20 bp, Artificial
  CRISPR gRNA sequence
ctttgcttgtagaccaggag

SEQ ID NO: 749088 - DNA, 20 bp, Artificial
  CRISPR gRNA sequence
agcaggatgagggggaggca

SEQ ID NO: 749089 - DNA, 20 bp, Artificial
  CRISPR gRNA sequence
gcaggagacccgcctttccc

SEQ ID NO: 749090 - DNA, 20 bp, Artificial
  CRISPR gRNA sequence
gctccaggcaagagagggaa

SEQ ID NO: 749091 - DNA, 20 bp, Artificial
  CRISPR gRNA sequence
agtggtgacggttgcacatt

SEQ ID NO: 749092 - DNA, 20 bp, Artificial
  CRISPR gRNA sequence
tcccagagactccttagctc

SEQ ID NO: 749093 - DNA, 20 bp, Artificial
  CRISPR gRNA sequence
caagtcacaggagaaacacc

SEQ ID NO: 749094 - DNA, 20 bp, Artificial
  CRISPR gRNA sequence
ggggtgagaactagaaaaac

SEQ ID NO: 749095 - DNA, 20 bp, Artificial
  CRISPR gRNA sequence
agtacaagtttaaaaaatat

SEQ ID NO: 749096 - DNA, 20 bp, Artificial
  CRISPR gRNA sequence
ctcccctgcctcattctgct

SEQ ID NO: 749097 - DNA, 20 bp, Artificial
  CRISPR gRNA sequence
gcggtcaaagtgctgagcca

SEQ ID NO: 749098 - DNA, 20 bp, Artificial
  CRISPR gRNA sequence
tcagggcatctgctgactgc

SEQ ID NO: 749099 - DNA, 20 bp, Artificial
  CRISPR gRNA sequence
cccagggccaaaagatgggc

SEQ ID NO: 749100 - DNA, 20 bp, Artificial
  CRISPR gRNA sequence
tgcctttccgctatttgttt

SEQ ID NO: 749101 - DNA, 20 bp, Artificial
  CRISPR gRNA sequence
agcaaggctgcattttgacg

SEQ ID NO: 749102 - DNA, 20 bp, Artificial
  CRISPR gRNA sequence
ctgttccctatctgcctttg

SEQ ID NO: 749103 - DNA, 20 bp, Artificial
  CRISPR gRNA sequence
aggcttccttacgatctggg

SEQ ID NO: 749104 - DNA, 20 bp, Artificial
  CRISPR gRNA sequence
agaggtttggggacaagtct

SEQ ID NO: 749105 - DNA, 20 bp, Artificial
  CRISPR gRNA sequence
tagctgccgacaccgcacta

SEQ ID NO: 749106 - DNA, 20 bp, Artificial
  CRISPR gRNA sequence
tgtgccaggccctgacacag

SEQ ID NO: 749107 - DNA, 20 bp, Artificial
  CRISPR gRNA sequence
caggccctgacacagcaggg

SEQ ID NO: 749108 - DNA, 20 bp, Artificial
  CRISPR gRNA sequence
gggcctgcctggtagcccac

SEQ ID NO: 749109 - DNA, 20 bp, Artificial
  CRISPR gRNA sequence
ccacggggatatatggagga

SEQ ID NO: 749110 - DNA, 20 bp, Artificial
  CRISPR gRNA sequence
gaggagggagttcggctgct

SEQ ID NO: 749111 - DNA, 20 bp, Artificial
  CRISPR gRNA sequence
ctggtttcccagggaggaag

SEQ ID NO: 749112 - DNA, 20 bp, Artificial
  CRISPR gRNA sequence
cagcacattctgctgcgctg

SEQ ID NO: 749113 - DNA, 20 bp, Artificial
  CRISPR gRNA sequence
aagctacactcttacttccc

SEQ ID NO: 749114 - DNA, 20 bp, Artificial
  CRISPR gRNA sequence
cagcactttggggagccaag

SEQ ID NO: 749115 - DNA, 20 bp, Artificial
  CRISPR gRNA sequence
cgggtagatcacttgagccc

SEQ ID NO: 749116 - DNA, 20 bp, Artificial
  CRISPR gRNA sequence
cctgtttgttggtttgaaaa

SEQ ID NO: 749117 - DNA, 20 bp, Artificial
  CRISPR gRNA sequence
ttggtttgaaaaaagggtag

SEQ ID NO: 749118 - DNA, 20 bp, Artificial
  CRISPR gRNA sequence
gtaaaaagtcactgtagcct

SEQ ID NO: 749119 - DNA, 20 bp, Artificial
  CRISPR gRNA sequence
aagtcactgtagcctttgag

SEQ ID NO: 749120 - DNA, 20 bp, Artificial
  CRISPR gRNA sequence
agcctttgagttgggttttg

SEQ ID NO: 749121 - DNA, 20 bp, Artificial
  CRISPR gRNA sequence
aggtcctcgtgcatgtcctc

SEQ ID NO: 749122 - DNA, 20 bp, Artificial
  CRISPR gRNA sequence
ctagcaggggctggtcccca

SEQ ID NO: 749123 - DNA, 20 bp, Artificial
  CRISPR gRNA sequence
cactggatgtctgacacata

SEQ ID NO: 749124 - DNA, 20 bp, Artificial
  CRISPR gRNA sequence
ctgacacatacagggtatag

SEQ ID NO: 749125 - DNA, 20 bp, Artificial
  CRISPR gRNA sequence
tgcattttgtctccaagctg

SEQ ID NO: 749126 - DNA, 20 bp, Artificial
  CRISPR gRNA sequence
tgccccaagctgggaagaag

SEQ ID NO: 749127 - DNA, 20 bp, Artificial
  CRISPR gRNA sequence
atctctaggcctctctttcc

SEQ ID NO: 749128 - DNA, 20 bp, Artificial
  CRISPR gRNA sequence
agatggtgatgcctacttca

SEQ ID NO: 749129 - DNA, 20 bp, Artificial
  CRISPR gRNA sequence
ctacttcatagagttcttat

SEQ ID NO: 749130 - DNA, 20 bp, Artificial
  CRISPR gRNA sequence
tgggaagatcaattgagccc

SEQ ID NO: 749131 - DNA, 20 bp, Artificial
  CRISPR gRNA sequence
accagcctgggcaacatagc

SEQ ID NO: 749132 - DNA, 20 bp, Artificial
  CRISPR gRNA sequence
atttttttgattttttggga

SEQ ID NO: 749133 - DNA, 20 bp, Artificial
  CRISPR gRNA sequence
tctcgctctgtcacccaggc

SEQ ID NO: 749134 - DNA, 20 bp, Artificial
  CRISPR gRNA sequence
agctctcatgtctcagcctc

SEQ ID NO: 749135 - DNA, 20 bp, Artificial
  CRISPR gRNA sequence
gtctcagcctcccgagtagc

SEQ ID NO: 749136 - DNA, 20 bp, Artificial
  CRISPR gRNA sequence
gccaccatgccaggcaaatt

SEQ ID NO: 749137 - DNA, 20 bp, Artificial
  CRISPR gRNA sequence
gggttgttttttttttgaga

SEQ ID NO: 749138 - DNA, 20 bp, Artificial
  CRISPR gRNA sequence
gtcttgctctatcagcaggc

SEQ ID NO: 749139 - DNA, 20 bp, Artificial
  CRISPR gRNA sequence
ctcactgtaacctctgactc

SEQ ID NO: 749140 - DNA, 20 bp, Artificial
  CRISPR gRNA sequence
gattctcttgcctcagcctc

SEQ ID NO: 749141 - DNA, 20 bp, Artificial
  CRISPR gRNA sequence
ttttgtgtttttagtagaga

SEQ ID NO: 749142 - DNA, 20 bp, Artificial
  CRISPR gRNA sequence
gccttgacctcctaaagtgc

SEQ ID NO: 749143 - DNA, 20 bp, Artificial
  CRISPR gRNA sequence
ctgtagtcccagctacttgg

SEQ ID NO: 749144 - DNA, 20 bp, Artificial
  CRISPR gRNA sequence
ttgcaccactgcattccagc

SEQ ID NO: 749145 - DNA, 20 bp, Artificial
  CRISPR gRNA sequence
tccagcctgagtgacagaga

SEQ ID NO: 749146 - DNA, 20 bp, Artificial
  CRISPR gRNA sequence
tactcgggaggctgaggcag

SEQ ID NO: 749147 - DNA, 20 bp, Artificial
  CRISPR gRNA sequence
ggctgaggcagaagaatcgc

SEQ ID NO: 749148 - DNA, 20 bp, Artificial
  CRISPR gRNA sequence
tcgcgccactgcactccagc

SEQ ID NO: 749149 - DNA, 20 bp, Artificial
  CRISPR gRNA sequence
ctgcactccagcctgggtaa

SEQ ID NO: 749150 - DNA, 20 bp, Artificial
  CRISPR gRNA sequence
gccaaggcacagccactcca

SEQ ID NO: 749151 - DNA, 20 bp, Artificial
  CRISPR gRNA sequence
gactccagagcagatggaag

SEQ ID NO: 749152 - DNA, 20 bp, Artificial
  CRISPR gRNA sequence
tggaaggagagtgggcttct

SEQ ID NO: 749153 - DNA, 20 bp, Artificial
  CRISPR gRNA sequence
tgcaccaaggaggaagcaga

SEQ ID NO: 749154 - DNA, 20 bp, Artificial
  CRISPR gRNA sequence
gcagaaaaggaggaggaccg

SEQ ID NO: 749155 - DNA, 20 bp, Artificial
  CRISPR gRNA sequence
accggggggttctgagggct

SEQ ID NO: 749156 - DNA, 20 bp, Artificial
  CRISPR gRNA sequence
agggcttggggtgatgaggc

SEQ ID NO: 749157 - DNA, 20 bp, Artificial
  CRISPR gRNA sequence
gatgaggccagagttccaaa

SEQ ID NO: 749158 - DNA, 20 bp, Artificial
  CRISPR gRNA sequence
gccagagttccaaacagggt

SEQ ID NO: 749159 - DNA, 20 bp, Artificial
  CRISPR gRNA sequence
ttccaaacagggtctgggtg

SEQ ID NO: 749160 - DNA, 20 bp, Artificial
  CRISPR gRNA sequence
tactttcactatcctgggag

SEQ ID NO: 749161 - DNA, 20 bp, Artificial
  CRISPR gRNA sequence
ttcactatcctgggaggagg

SEQ ID NO: 749162 - DNA, 20 bp, Artificial
  CRISPR gRNA sequence
aggatgggtacaccacacag

SEQ ID NO: 749163 - DNA, 20 bp, Artificial
  CRISPR gRNA sequence
acaaacagaagggccattag

SEQ ID NO: 749164 - DNA, 20 bp, Artificial
  CRISPR gRNA sequence
catgccactcccaggggcat

SEQ ID NO: 749165 - DNA, 20 bp, Artificial
  CRISPR gRNA sequence
aacagccattcagccatcca

SEQ ID NO: 749166 - DNA, 20 bp, Artificial
  CRISPR gRNA sequence
catctcacccacacactccc

SEQ ID NO: 749167 - DNA, 20 bp, Artificial
  CRISPR gRNA sequence
actctgcccagcacagtgtc

SEQ ID NO: 749168 - DNA, 20 bp, Artificial
  CRISPR gRNA sequence
acacgccaggctgtcacgtg

SEQ ID NO: 749169 - DNA, 20 bp, Artificial
  CRISPR gRNA sequence
ggcaccatggaccctgtgct

SEQ ID NO: 749170 - DNA, 20 bp, Artificial
  CRISPR gRNA sequence
cagtagaggccgctatccag

SEQ ID NO: 749171 - DNA, 20 bp, Artificial
  CRISPR gRNA sequence
aggtcctggaacgtgaggtt

SEQ ID NO: 749172 - DNA, 20 bp, Artificial
  CRISPR gRNA sequence
gggcccaagagcctgcaggt

SEQ ID NO: 749173 - DNA, 20 bp, Artificial
  CRISPR gRNA sequence
cccctcgggacagacataca

SEQ ID NO: 749174 - DNA, 20 bp, Artificial
  CRISPR gRNA sequence
ccatcctaggctgttgtagg

SEQ ID NO: 749175 - DNA, 20 bp, Artificial
  CRISPR gRNA sequence
tcacagaagcttccccaact

SEQ ID NO: 749176 - DNA, 20 bp, Artificial
  CRISPR gRNA sequence
ttccccaactaggggtgctc

SEQ ID NO: 749177 - DNA, 20 bp, Artificial
  CRISPR gRNA sequence
cttggagggcagtgatgcag

SEQ ID NO: 749178 - DNA, 20 bp, Artificial
  CRISPR gRNA sequence
gggtgtgtccctcttcccag

SEQ ID NO: 749179 - DNA, 20 bp, Artificial
  CRISPR gRNA sequence
tagagtatatgcaaaacctg

SEQ ID NO: 749180 - DNA, 20 bp, Artificial
  CRISPR gRNA sequence
tgctgcatctcacctgcatg

SEQ ID NO: 749181 - DNA, 20 bp, Artificial
  CRISPR gRNA sequence
cagggacttcctgaaggagg

SEQ ID NO: 749182 - DNA, 20 bp, Artificial
  CRISPR gRNA sequence
ctttggacttggtgcataga

SEQ ID NO: 749183 - DNA, 20 bp, Artificial
  CRISPR gRNA sequence
ataggatttcagccagtaga

SEQ ID NO: 749184 - DNA, 20 bp, Artificial
  CRISPR gRNA sequence
gtgtctgagggaccgggaca

SEQ ID NO: 749185 - DNA, 20 bp, Artificial
  CRISPR gRNA sequence
cccaatcctccagcatttaa

SEQ ID NO: 749186 - DNA, 20 bp, Artificial
  CRISPR gRNA sequence
aaaccatgagcttttgaaaa

SEQ ID NO: 749187 - DNA, 20 bp, Artificial
  CRISPR gRNA sequence
gagcttttgaaaacagaata

SEQ ID NO: 749188 - DNA, 20 bp, Artificial
  CRISPR gRNA sequence
gaaaactattggctacaatg

SEQ ID NO: 749189 - DNA, 20 bp, Artificial
  CRISPR gRNA sequence
atgccctctgcagacatctg

SEQ ID NO: 749190 - DNA, 20 bp, Artificial
  CRISPR gRNA sequence
ttatttatttgtttttgaga

SEQ ID NO: 749191 - DNA, 20 bp, Artificial
  CRISPR gRNA sequence
gccttggcctctcaaagtct

SEQ ID NO: 749192 - DNA, 20 bp, Artificial
  CRISPR gRNA sequence
aaatggcatgtcaggctgtt

SEQ ID NO: 749193 - DNA, 20 bp, Artificial
  CRISPR gRNA sequence
gggtctagcagagagggaag

SEQ ID NO: 749194 - DNA, 20 bp, Artificial
  CRISPR gRNA sequence
aggagggttagaactatgta

SEQ ID NO: 749195 - DNA, 20 bp, Artificial
  CRISPR gRNA sequence
aaatgaaaacatctccctgg

SEQ ID NO: 749196 - DNA, 20 bp, Artificial
  CRISPR gRNA sequence
aagtgttctgtaagtgccat

SEQ ID NO: 749197 - DNA, 20 bp, Artificial
  CRISPR gRNA sequence
caagtcaagaagtgcctcct

SEQ ID NO: 749198 - DNA, 20 bp, Artificial
  CRISPR gRNA sequence
cctaggagtgagaagcacag

SEQ ID NO: 749199 - DNA, 20 bp, Artificial
  CRISPR gRNA sequence
aaagtctttcctgctaaggt

SEQ ID NO: 749200 - DNA, 20 bp, Artificial
  CRISPR gRNA sequence
tggggcgcttgtgtttaaag

SEQ ID NO: 749201 - DNA, 20 bp, Artificial
  CRISPR gRNA sequence
gccccaaacggcatgtctgc

SEQ ID NO: 749202 - DNA, 20 bp, Artificial
  CRISPR gRNA sequence
aaacggcatgtctgcaagag

SEQ ID NO: 749203 - DNA, 20 bp, Artificial
  CRISPR gRNA sequence
gtctgggagccccagatttt

SEQ ID NO: 749204 - DNA, 20 bp, Artificial
  CRISPR gRNA sequence
cagatttttggagtcattgt

SEQ ID NO: 749205 - DNA, 20 bp, Artificial
  CRISPR gRNA sequence
actgaagttccaaagttcca

SEQ ID NO: 749206 - DNA, 20 bp, Artificial
  CRISPR gRNA sequence
atgggggacttcaggtaacg

SEQ ID NO: 749207 - DNA, 20 bp, Artificial
  CRISPR gRNA sequence
catgtgttgtgcactacgct

SEQ ID NO: 749208 - DNA, 20 bp, Artificial
  CRISPR gRNA sequence
cagcaagcaagtgctagagc

SEQ ID NO: 749209 - DNA, 20 bp, Artificial
  CRISPR gRNA sequence
cagccttcacacatatttca

SEQ ID NO: 749210 - DNA, 20 bp, Artificial
  CRISPR gRNA sequence
gatggcaacatttaaaaacc

SEQ ID NO: 749211 - DNA, 20 bp, Artificial
  CRISPR gRNA sequence
gcaccggcactccagttcgc

SEQ ID NO: 749212 - DNA, 20 bp, Artificial
  CRISPR gRNA sequence
tttcttggtcctgtggacat

SEQ ID NO: 749213 - DNA, 20 bp, Artificial
  CRISPR gRNA sequence
tgtggacatttgagtttgtg

SEQ ID NO: 749214 - DNA, 20 bp, Artificial
  CRISPR gRNA sequence
gacatttgagtttgtgatga

SEQ ID NO: 749215 - DNA, 20 bp, Artificial
  CRISPR gRNA sequence
aagagaggagatgatccacc

SEQ ID NO: 749216 - DNA, 20 bp, Artificial
  CRISPR gRNA sequence
cctggacttccccttcacac

SEQ ID NO: 749217 - DNA, 20 bp, Artificial
  CRISPR gRNA sequence
acttccccttcacacctgag

SEQ ID NO: 749218 - DNA, 20 bp, Artificial
  CRISPR gRNA sequence
ccccttcacacctgagtggg

SEQ ID NO: 749219 - DNA, 20 bp, Artificial
  CRISPR gRNA sequence
agccaccccagggctgggag

SEQ ID NO: 749220 - DNA, 20 bp, Artificial
  CRISPR gRNA sequence
cacggggctgcaggccagag

SEQ ID NO: 749221 - DNA, 20 bp, Artificial
  CRISPR gRNA sequence
ggagggtatggcagggcagg

SEQ ID NO: 749222 - DNA, 20 bp, Artificial
  CRISPR gRNA sequence
gcaagatgcgcaaagctgag

SEQ ID NO: 749223 - DNA, 20 bp, Artificial
  CRISPR gRNA sequence
atgcgcaaagctgagctggg

SEQ ID NO: 749224 - DNA, 20 bp, Artificial
  CRISPR gRNA sequence
gggctagcgtggttgttggc

SEQ ID NO: 749225 - DNA, 20 bp, Artificial
  CRISPR gRNA sequence
ggcaccaggctgggagccct

SEQ ID NO: 749226 - DNA, 20 bp, Artificial
  CRISPR gRNA sequence
agccctcagggtctaagcaa

SEQ ID NO: 749227 - DNA, 20 bp, Artificial
  CRISPR gRNA sequence
agcaatggggttaatgaccc

SEQ ID NO: 749228 - DNA, 20 bp, Artificial
  CRISPR gRNA sequence
agcacccgcagcagtaggga

SEQ ID NO: 749229 - DNA, 20 bp, Artificial
  CRISPR gRNA sequence
caacttccttgagatgcacg

SEQ ID NO: 749230 - DNA, 20 bp, Artificial
  CRISPR gRNA sequence
ttccttgagatgcacggcgg

SEQ ID NO: 749231 - DNA, 20 bp, Artificial
  CRISPR gRNA sequence
tgggtgcatcagagagaaag

SEQ ID NO: 749232 - DNA, 20 bp, Artificial
  CRISPR gRNA sequence
cagagagaaagcagagttca

SEQ ID NO: 749233 - DNA, 20 bp, Artificial
  CRISPR gRNA sequence
acccatcccacaggtcccaa

SEQ ID NO: 749234 - DNA, 20 bp, Artificial
  CRISPR gRNA sequence
cttttagaaaaaagctgtct

SEQ ID NO: 749235 - DNA, 20 bp, Artificial
  CRISPR gRNA sequence
ttcaagtttggggagcaggg

SEQ ID NO: 749236 - DNA, 20 bp, Artificial
  CRISPR gRNA sequence
agcaagagggccagacagga

SEQ ID NO: 749237 - DNA, 20 bp, Artificial
  CRISPR gRNA sequence
ccagagggacaggacaaacc

SEQ ID NO: 749238 - DNA, 20 bp, Artificial
  CRISPR gRNA sequence
aggacaaaccaagggtccac

SEQ ID NO: 749239 - DNA, 20 bp, Artificial
  CRISPR gRNA sequence
aaattacaattctttggcga

SEQ ID NO: 749240 - DNA, 20 bp, Artificial
  CRISPR gRNA sequence
gagcagatccttttggacac

SEQ ID NO: 749241 - DNA, 20 bp, Artificial
  CRISPR gRNA sequence
attgtcggagaccgggaaaa

SEQ ID NO: 749242 - DNA, 20 bp, Artificial
  CRISPR gRNA sequence
gggaggaaagcccctggctc

SEQ ID NO: 749243 - DNA, 20 bp, Artificial
  CRISPR gRNA sequence
gaggcagggccacctagagg

SEQ ID NO: 749244 - DNA, 20 bp, Artificial
  CRISPR gRNA sequence
tgccgtgaacctgggaaagc

SEQ ID NO: 749245 - DNA, 20 bp, Artificial
  CRISPR gRNA sequence
cctgggaaagcctgagtctc

SEQ ID NO: 749246 - DNA, 20 bp, Artificial
  CRISPR gRNA sequence
ctcaggagtaaaactctcgc

SEQ ID NO: 749247 - DNA, 20 bp, Artificial
  CRISPR gRNA sequence
gttctcataacacccccaac

SEQ ID NO: 749248 - DNA, 20 bp, Artificial
  CRISPR gRNA sequence
ggcccaggcagggaggctgt

SEQ ID NO: 749249 - DNA, 20 bp, Artificial
  CRISPR gRNA sequence
gcagggaggctgtggggatg

SEQ ID NO: 749250 - DNA, 20 bp, Artificial
  CRISPR gRNA sequence
agctcttgttggcatcttct

SEQ ID NO: 749251 - DNA, 20 bp, Artificial
  CRISPR gRNA sequence
ctctctccacccagcaggcc

SEQ ID NO: 749252 - DNA, 20 bp, Artificial
  CRISPR gRNA sequence
gcaggccccgggtgacccct

SEQ ID NO: 749253 - DNA, 20 bp, Artificial
  CRISPR gRNA sequence
gtgacccctgtgagtgtgca

SEQ ID NO: 749254 - DNA, 20 bp, Artificial
  CRISPR gRNA sequence
cccctgtgagtgtgcacggg

SEQ ID NO: 749255 - DNA, 20 bp, Artificial
  CRISPR gRNA sequence
tgtgcacgggatgggtgtgt

SEQ ID NO: 749256 - DNA, 20 bp, Artificial
  CRISPR gRNA sequence
gtctcacaggacatcccaaa

SEQ ID NO: 749257 - DNA, 20 bp, Artificial
  CRISPR gRNA sequence
ccccgccaggccccatcccc

SEQ ID NO: 749258 - DNA, 20 bp, Artificial
  CRISPR gRNA sequence
atgcagagggaaacagaggc

SEQ ID NO: 749259 - DNA, 20 bp, Artificial
  CRISPR gRNA sequence
ctggccagaggtcccggccc

SEQ ID NO: 749260 - DNA, 20 bp, Artificial
  CRISPR gRNA sequence
cccggcccgtggatgcttct

SEQ ID NO: 749261 - DNA, 20 bp, Artificial
  CRISPR gRNA sequence
ctatgctgtgaagacgtcct

SEQ ID NO: 749262 - DNA, 20 bp, Artificial
  CRISPR gRNA sequence
gttgttgttgttgtttgaga

SEQ ID NO: 749263 - DNA, 20 bp, Artificial
  CRISPR gRNA sequence
tctcgctctgttgcccaggc

SEQ ID NO: 749264 - DNA, 20 bp, Artificial
  CRISPR gRNA sequence
aactctcctgcctcagcctc

SEQ ID NO: 749265 - DNA, 20 bp, Artificial
  CRISPR gRNA sequence
ttttgtatttttagtagaga

SEQ ID NO: 749266 - DNA, 20 bp, Artificial
  CRISPR gRNA sequence
gcctcgtcctccccaagtgc

SEQ ID NO: 749267 - DNA, 20 bp, Artificial
  CRISPR gRNA sequence
tccccaagtgctgggattac

SEQ ID NO: 749268 - DNA, 20 bp, Artificial
  CRISPR gRNA sequence
gttggttttctttagtgagc

SEQ ID NO: 749269 - DNA, 20 bp, Artificial
  CRISPR gRNA sequence
gtcttgctcttcactcaggc

SEQ ID NO: 749270 - DNA, 20 bp, Artificial
  CRISPR gRNA sequence
ttttaaatttttcatagtga

SEQ ID NO: 749271 - DNA, 20 bp, Artificial
  CRISPR gRNA sequence
acctcagcctcccaaagtgc

SEQ ID NO: 749272 - DNA, 20 bp, Artificial
  CRISPR gRNA sequence
caactaataagtgatggtgt

SEQ ID NO: 749273 - DNA, 20 bp, Artificial
  CRISPR gRNA sequence
tgccatctgactactctcta

SEQ ID NO: 749274 - DNA, 20 bp, Artificial
  CRISPR gRNA sequence
tggttttacattaaataaca

SEQ ID NO: 749275 - DNA, 20 bp, Artificial
  CRISPR gRNA sequence
cccaggctaaagtttccaac

SEQ ID NO: 749276 - DNA, 20 bp, Artificial
  CRISPR gRNA sequence
agatctacatactcaaataa

SEQ ID NO: 749277 - DNA, 20 bp, Artificial
  CRISPR gRNA sequence
ctacatactcaaataaaaga

SEQ ID NO: 749278 - DNA, 20 bp, Artificial
  CRISPR gRNA sequence
aagctagggaaacaccatca

SEQ ID NO: 749279 - DNA, 20 bp, Artificial
  CRISPR gRNA sequence
catggaattaaccttcagag

SEQ ID NO: 749280 - DNA, 20 bp, Artificial
  CRISPR gRNA sequence
tgtgtgtttgtgttcccatg

SEQ ID NO: 749281 - DNA, 20 bp, Artificial
  CRISPR gRNA sequence
tgatgagtgaacagcagagg

SEQ ID NO: 749282 - DNA, 20 bp, Artificial
  CRISPR gRNA sequence
atcctacgcagaaaggctaa

SEQ ID NO: 749283 - DNA, 20 bp, Artificial
  CRISPR gRNA sequence
gtagcagagcaacctcatta

SEQ ID NO: 749284 - DNA, 20 bp, Artificial
  CRISPR gRNA sequence
tttggtgatggccagccaaa

SEQ ID NO: 749285 - DNA, 20 bp, Artificial
  CRISPR gRNA sequence
ggccagccaaagtgaatgga

SEQ ID NO: 749286 - DNA, 20 bp, Artificial
  CRISPR gRNA sequence
ccttcatactccaggctttg

SEQ ID NO: 749287 - DNA, 20 bp, Artificial
  CRISPR gRNA sequence
tacacagtattcacgaggag

SEQ ID NO: 749288 - DNA, 20 bp, Artificial
  CRISPR gRNA sequence
ggggaacttgctcagggaga

SEQ ID NO: 749289 - DNA, 20 bp, Artificial
  CRISPR gRNA sequence
agagcagtaaatggccatct

SEQ ID NO: 749290 - DNA, 20 bp, Artificial
  CRISPR gRNA sequence
cttgggatttaagcctaggt

SEQ ID NO: 749291 - DNA, 20 bp, Artificial
  CRISPR gRNA sequence
ctgagtgactcacaaagccc

SEQ ID NO: 749292 - DNA, 20 bp, Artificial
  CRISPR gRNA sequence
cctgggagaccagactgacc

SEQ ID NO: 749293 - DNA, 20 bp, Artificial
  CRISPR gRNA sequence
gtggggctcgctcactgcca

SEQ ID NO: 749294 - DNA, 20 bp, Artificial
  CRISPR gRNA sequence
actgccaacgggttctcctt

SEQ ID NO: 749295 - DNA, 20 bp, Artificial
  CRISPR gRNA sequence
taacaccccatacactgtgt

SEQ ID NO: 749296 - DNA, 20 bp, Artificial
  CRISPR gRNA sequence
cagcggaacctttgccctgc

SEQ ID NO: 749297 - DNA, 20 bp, Artificial
  CRISPR gRNA sequence
actcccagtattgctggccc

SEQ ID NO: 749298 - DNA, 20 bp, Artificial
  CRISPR gRNA sequence
gcccttgggtgtccctggca

SEQ ID NO: 749299 - DNA, 20 bp, Artificial
  CRISPR gRNA sequence
tactccagagcctctgggca

SEQ ID NO: 749300 - DNA, 20 bp, Artificial
  CRISPR gRNA sequence
gagcctctgggcagtgggtt

SEQ ID NO: 749301 - DNA, 20 bp, Artificial
  CRISPR gRNA sequence
tgcgtcagaggcttgcagca

SEQ ID NO: 749302 - DNA, 20 bp, Artificial
  CRISPR gRNA sequence
gtttgctatgaaggagaaga

SEQ ID NO: 749303 - DNA, 20 bp, Artificial
  CRISPR gRNA sequence
atgtgctagtcccagaggtt

SEQ ID NO: 749304 - DNA, 20 bp, Artificial
  CRISPR gRNA sequence
agtcccagaggttgggagtc

SEQ ID NO: 749305 - DNA, 20 bp, Artificial
  CRISPR gRNA sequence
gggcaaggacagtaactgcc

SEQ ID NO: 749306 - DNA, 20 bp, Artificial
  CRISPR gRNA sequence
cagtaactgcctcgggtcct

SEQ ID NO: 749307 - DNA, 20 bp, Artificial
  CRISPR gRNA sequence
tctgctacccttgagatctg

SEQ ID NO: 749308 - DNA, 20 bp, Artificial
  CRISPR gRNA sequence
acctctccacccatctcacc

SEQ ID NO: 749309 - DNA, 20 bp, Artificial
  CRISPR gRNA sequence
ccctgagtcaggcccaggaa

SEQ ID NO: 749310 - DNA, 20 bp, Artificial
  CRISPR gRNA sequence
cctcagtgcacactgtccta

SEQ ID NO: 749311 - DNA, 20 bp, Artificial
  CRISPR gRNA sequence
gtgcacactgtcctagggag

SEQ ID NO: 749312 - DNA, 20 bp, Artificial
  CRISPR gRNA sequence
acactgtcctagggagttgg

SEQ ID NO: 749313 - DNA, 20 bp, Artificial
  CRISPR gRNA sequence
agtgtgtccatgtcacagtt

SEQ ID NO: 749314 - DNA, 20 bp, Artificial
  CRISPR gRNA sequence
cctttagtataccatgttgt

SEQ ID NO: 749315 - DNA, 20 bp, Artificial
  CRISPR gRNA sequence
tttgagtagccaagacctct

SEQ ID NO: 749316 - DNA, 20 bp, Artificial
  CRISPR gRNA sequence
ctcttggggcctctctgcta

SEQ ID NO: 749317 - DNA, 20 bp, Artificial
  CRISPR gRNA sequence
gctactgggtgctctgcaag

SEQ ID NO: 749318 - DNA, 20 bp, Artificial
  CRISPR gRNA sequence
gcaagctgggtccctgtgcc

SEQ ID NO: 749319 - DNA, 20 bp, Artificial
  CRISPR gRNA sequence
gaagtgggcaagaaagcagg

SEQ ID NO: 749320 - DNA, 20 bp, Artificial
  CRISPR gRNA sequence
ggcaggtggcccatgacagg

SEQ ID NO: 749321 - DNA, 20 bp, Artificial
  CRISPR gRNA sequence
cttctattccatcctgccca

SEQ ID NO: 749322 - DNA, 20 bp, Artificial
  CRISPR gRNA sequence
cacctccctcctgcctccct

SEQ ID NO: 749323 - DNA, 20 bp, Artificial
  CRISPR gRNA sequence
aagaactaggcaaccaggcc

SEQ ID NO: 749324 - DNA, 20 bp, Artificial
  CRISPR gRNA sequence
gggagcccctgtgttggggc

SEQ ID NO: 749325 - DNA, 20 bp, Artificial
  CRISPR gRNA sequence
aggggctcatagctgagctg

SEQ ID NO: 749326 - DNA, 20 bp, Artificial
  CRISPR gRNA sequence
ccagtactccacactggtcc

SEQ ID NO: 749327 - DNA, 20 bp, Artificial
  CRISPR gRNA sequence
tccctgagtggcagccttgc

SEQ ID NO: 749328 - DNA, 20 bp, Artificial
  CRISPR gRNA sequence
ggcagccttgctaggatggc

SEQ ID NO: 749329 - DNA, 20 bp, Artificial
  CRISPR gRNA sequence
ttcctgggccatcagaccct

SEQ ID NO: 749330 - DNA, 20 bp, Artificial
  CRISPR gRNA sequence
gtgcccaccaaggctcagcc

SEQ ID NO: 749331 - DNA, 20 bp, Artificial
  CRISPR gRNA sequence
ttgcagaagctacctgtgcc

SEQ ID NO: 749332 - DNA, 20 bp, Artificial
  CRISPR gRNA sequence
gttgccactgcaccctgcct

SEQ ID NO: 749333 - DNA, 20 bp, Artificial
  CRISPR gRNA sequence
gtcccagcagcctctgggcg

SEQ ID NO: 749334 - DNA, 20 bp, Artificial
  CRISPR gRNA sequence
agcagcctctgggcggtggg

SEQ ID NO: 749335 - DNA, 20 bp, Artificial
  CRISPR gRNA sequence
cctctgggcggtgggtggag

SEQ ID NO: 749336 - DNA, 20 bp, Artificial
  CRISPR gRNA sequence
ccaggaagagagcgaagagc

SEQ ID NO: 749337 - DNA, 20 bp, Artificial
  CRISPR gRNA sequence
cgcggggaagcctcccgcga

SEQ ID NO: 749338 - DNA, 20 bp, Artificial
  CRISPR gRNA sequence
cctcccgcgactgagtgcga

SEQ ID NO: 749339 - DNA, 20 bp, Artificial
  CRISPR gRNA sequence
gcttcccggaggccggcccc

SEQ ID NO: 749340 - DNA, 20 bp, Artificial
  CRISPR gRNA sequence
gggggcgctgcgcgaagggg

SEQ ID NO: 749341 - DNA, 20 bp, Artificial
  CRISPR gRNA sequence
ggaggccggcagctggcgct

SEQ ID NO: 749342 - DNA, 20 bp, Artificial
  CRISPR gRNA sequence
gctgggagaagacagcagac

SEQ ID NO: 749343 - DNA, 20 bp, Artificial
  CRISPR gRNA sequence
gcagactggagtgggaactg

SEQ ID NO: 749344 - DNA, 20 bp, Artificial
  CRISPR gRNA sequence
aggctgctgggacccctagg

SEQ ID NO: 749345 - DNA, 20 bp, Artificial
  CRISPR gRNA sequence
tctgcaaagaaggagaggca

SEQ ID NO: 749346 - DNA, 20 bp, Artificial
  CRISPR gRNA sequence
ggggcggtcagtgtgttctg

SEQ ID NO: 749347 - DNA, 20 bp, Artificial
  CRISPR gRNA sequence
ggcactgggcactggtcacg

SEQ ID NO: 749348 - DNA, 20 bp, Artificial
  CRISPR gRNA sequence
gcccacctggtccctattct

SEQ ID NO: 749349 - DNA, 20 bp, Artificial
  CRISPR gRNA sequence
ttctaagggtctgatggccc

SEQ ID NO: 749350 - DNA, 20 bp, Artificial
  CRISPR gRNA sequence
ctgccactcagggaccagtg

SEQ ID NO: 749351 - DNA, 20 bp, Artificial
  CRISPR gRNA sequence
gaccagtgtggagtactggg

SEQ ID NO: 749352 - DNA, 20 bp, Artificial
  CRISPR gRNA sequence
agctcagctatgagcccctt

SEQ ID NO: 749353 - DNA, 20 bp, Artificial
  CRISPR gRNA sequence
tatgagccccttctgggtcc

SEQ ID NO: 749354 - DNA, 20 bp, Artificial
  CRISPR gRNA sequence
cctgcccagagctgaagagg

SEQ ID NO: 749355 - DNA, 20 bp, Artificial
  CRISPR gRNA sequence
agggagggcccagggaaagt

SEQ ID NO: 749356 - DNA, 20 bp, Artificial
  CRISPR gRNA sequence
tggcacagggacccagtggg

SEQ ID NO: 749357 - DNA, 20 bp, Artificial
  CRISPR gRNA sequence
cagggacccagtgggcagga

SEQ ID NO: 749358 - DNA, 20 bp, Artificial
  CRISPR gRNA sequence
ggcaggatggaatagaagga

SEQ ID NO: 749359 - DNA, 20 bp, Artificial
  CRISPR gRNA sequence
ggaatagaaggagagggtga

SEQ ID NO: 749360 - DNA, 20 bp, Artificial
  CRISPR gRNA sequence
ctggaagataccttagcaac

SEQ ID NO: 749361 - DNA, 20 bp, Artificial
  CRISPR gRNA sequence
gacacagctgccctaagccc

SEQ ID NO: 749362 - DNA, 20 bp, Artificial
  CRISPR gRNA sequence
cagctgccctaagccccagg

SEQ ID NO: 749363 - DNA, 20 bp, Artificial
  CRISPR gRNA sequence
gtgacagtcagagggaggag

SEQ ID NO: 749364 - DNA, 20 bp, Artificial
  CRISPR gRNA sequence
gggaggaggagaatgggagg

SEQ ID NO: 749365 - DNA, 20 bp, Artificial
  CRISPR gRNA sequence
catggcttccagaaggaaca

SEQ ID NO: 749366 - DNA, 20 bp, Artificial
  CRISPR gRNA sequence
tcaaacaacatggtatacta

SEQ ID NO: 749367 - DNA, 20 bp, Artificial
  CRISPR gRNA sequence
ctgaaaggagccagaagcat

SEQ ID NO: 749368 - DNA, 20 bp, Artificial
  CRISPR gRNA sequence
tttgaattgctctgggacct

SEQ ID NO: 749369 - DNA, 20 bp, Artificial
  CRISPR gRNA sequence
ctggttgcaggcatggtcag

SEQ ID NO: 749370 - DNA, 20 bp, Artificial
  CRISPR gRNA sequence
atcaccagcctgccgaggtg

SEQ ID NO: 749371 - DNA, 20 bp, Artificial
  CRISPR gRNA sequence
tgccgaggtgctgggttgcc

SEQ ID NO: 749372 - DNA, 20 bp, Artificial
  CRISPR gRNA sequence
ttatgccagggaaagtgaga

SEQ ID NO: 749373 - DNA, 20 bp, Artificial
  CRISPR gRNA sequence
ccagcctgttctccagctct

SEQ ID NO: 749374 - DNA, 20 bp, Artificial
  CRISPR gRNA sequence
ggggttgggccagcactgag

SEQ ID NO: 749375 - DNA, 20 bp, Artificial
  CRISPR gRNA sequence
cactgaggagaatggtagtg

SEQ ID NO: 749376 - DNA, 20 bp, Artificial
  CRISPR gRNA sequence
cccctttcctgggcctgact

SEQ ID NO: 749377 - DNA, 20 bp, Artificial
  CRISPR gRNA sequence
tgggcctgactcagggtgag

SEQ ID NO: 749378 - DNA, 20 bp, Artificial
  CRISPR gRNA sequence
accaggacccagcagatctc

SEQ ID NO: 749379 - DNA, 20 bp, Artificial
  CRISPR gRNA sequence
aaccaggctgcagggccttg

SEQ ID NO: 749380 - DNA, 20 bp, Artificial
  CRISPR gRNA sequence
aacccactgcccagaggctc

SEQ ID NO: 749381 - DNA, 20 bp, Artificial
  CRISPR gRNA sequence
tgaggccagtccctggcatg

SEQ ID NO: 749382 - DNA, 20 bp, Artificial
  CRISPR gRNA sequence
acccaagggccagcaatact

SEQ ID NO: 749383 - DNA, 20 bp, Artificial
  CRISPR gRNA sequence
aagcagggcaaaggttccgc

SEQ ID NO: 749384 - DNA, 20 bp, Artificial
  CRISPR gRNA sequence
ggggtctgaccttcctggga

SEQ ID NO: 749385 - DNA, 20 bp, Artificial
  CRISPR gRNA sequence
tgggagagggtggtccaggc

SEQ ID NO: 749386 - DNA, 20 bp, Artificial
  CRISPR gRNA sequence
gtgtgctgctgagacgctaa

SEQ ID NO: 749387 - DNA, 20 bp, Artificial
  CRISPR gRNA sequence
ccctatccgcacacagtgta

SEQ ID NO: 749388 - DNA, 20 bp, Artificial
  CRISPR gRNA sequence
tgagcagatgaaaggaagaa

SEQ ID NO: 749389 - DNA, 20 bp, Artificial
  CRISPR gRNA sequence
gctttagccaaccaatgacc

SEQ ID NO: 749390 - DNA, 20 bp, Artificial
  CRISPR gRNA sequence
gtcagtctggtctcccaggg

SEQ ID NO: 749391 - DNA, 20 bp, Artificial
  CRISPR gRNA sequence
ctcccaggggagggtgggcc

SEQ ID NO: 749392 - DNA, 20 bp, Artificial
  CRISPR gRNA sequence
ttgcttaactcttgggcttt

SEQ ID NO: 749393 - DNA, 20 bp, Artificial
  CRISPR gRNA sequence
aacacagcacccggctcctc

SEQ ID NO: 749394 - DNA, 20 bp, Artificial
  CRISPR gRNA sequence
ttgctctctacagggcctaa

SEQ ID NO: 749395 - DNA, 20 bp, Artificial
  CRISPR gRNA sequence
ggactagattctccaaagcc

SEQ ID NO: 749396 - DNA, 20 bp, Artificial
  CRISPR gRNA sequence
tctccaaagcctggagtatg

SEQ ID NO: 749397 - DNA, 20 bp, Artificial
  CRISPR gRNA sequence
acttgaaggcaagcctggcc

SEQ ID NO: 749398 - DNA, 20 bp, Artificial
  CRISPR gRNA sequence
ccctgggtttgcttatcttg

SEQ ID NO: 749399 - DNA, 20 bp, Artificial
  CRISPR gRNA sequence
attcctttagcctttctgcg

SEQ ID NO: 749400 - DNA, 20 bp, Artificial
  CRISPR gRNA sequence
tcttatttcccatggggacc

SEQ ID NO: 749401 - DNA, 20 bp, Artificial
  CRISPR gRNA sequence
ttgtctgtgcaatggacagg

SEQ ID NO: 749402 - DNA, 20 bp, Artificial
  CRISPR gRNA sequence
aaatctactcattcttttat

SEQ ID NO: 749403 - DNA, 20 bp, Artificial
  CRISPR gRNA sequence
acgtaacaggaaaaccatat

SEQ ID NO: 749404 - DNA, 20 bp, Artificial
  CRISPR gRNA sequence
aggaaaaccatataagggta

SEQ ID NO: 749405 - DNA, 20 bp, Artificial
  CRISPR gRNA sequence
aactttagcctgggaaggct

SEQ ID NO: 749406 - DNA, 20 bp, Artificial
  CRISPR gRNA sequence
aggactgaaataattgtaaa

SEQ ID NO: 749407 - DNA, 20 bp, Artificial
  CRISPR gRNA sequence
ccagctacctctattctcta

SEQ ID NO: 749408 - DNA, 20 bp, Artificial
  CRISPR gRNA sequence
gacctccagaggctgactac

SEQ ID NO: 749409 - DNA, 20 bp, Artificial
  CRISPR gRNA sequence
tgatactagtacctacctca

SEQ ID NO: 749410 - DNA, 20 bp, Artificial
  CRISPR gRNA sequence
gtacctacctcatagggtgg

SEQ ID NO: 749411 - DNA, 20 bp, Artificial
  CRISPR gRNA sequence
ctaatctatgtaaaagtgtt

SEQ ID NO: 749412 - DNA, 20 bp, Artificial
  CRISPR gRNA sequence
actttgggaggctgaggtgg

SEQ ID NO: 749413 - DNA, 20 bp, Artificial
  CRISPR gRNA sequence
tgggaggatctcttgaagcc

SEQ ID NO: 749414 - DNA, 20 bp, Artificial
  CRISPR gRNA sequence
tgtagtcctagttgggaggc

SEQ ID NO: 749415 - DNA, 20 bp, Artificial
  CRISPR gRNA sequence
tagttgggaggcaggggtgg

SEQ ID NO: 749416 - DNA, 20 bp, Artificial
  CRISPR gRNA sequence
tgggaggataacttgagccc

SEQ ID NO: 749417 - DNA, 20 bp, Artificial
  CRISPR gRNA sequence
cattgtcactgcattccagc

SEQ ID NO: 749418 - DNA, 20 bp, Artificial
  CRISPR gRNA sequence
cagcacttggggaggacgag

SEQ ID NO: 749419 - DNA, 20 bp, Artificial
  CRISPR gRNA sequence
acttggggaggacgaggcgg

SEQ ID NO: 749420 - DNA, 20 bp, Artificial
  CRISPR gRNA sequence
cgggtggatcacatgaggtc

SEQ ID NO: 749421 - DNA, 20 bp, Artificial
  CRISPR gRNA sequence
aaaattagccaggcgtggtg

SEQ ID NO: 749422 - DNA, 20 bp, Artificial
  CRISPR gRNA sequence
tactcgggaggctgaggcag

SEQ ID NO: 749423 - DNA, 20 bp, Artificial
  CRISPR gRNA sequence
caaccaaacaaacaagcact

SEQ ID NO: 749424 - DNA, 20 bp, Artificial
  CRISPR gRNA sequence
acttagaatgatgcctggca

SEQ ID NO: 749425 - DNA, 20 bp, Artificial
  CRISPR gRNA sequence
tcttcacagcatagaagcgt

SEQ ID NO: 749426 - DNA, 20 bp, Artificial
  CRISPR gRNA sequence
tcctcctccaaaagggcctg

SEQ ID NO: 749427 - DNA, 20 bp, Artificial
  CRISPR gRNA sequence
aagggcctggggagtctggg

SEQ ID NO: 749428 - DNA, 20 bp, Artificial
  CRISPR gRNA sequence
gctagcctccagctccagcc

SEQ ID NO: 749429 - DNA, 20 bp, Artificial
  CRISPR gRNA sequence
cccagcccccttggtctgat

SEQ ID NO: 749430 - DNA, 20 bp, Artificial
  CRISPR gRNA sequence
ccagcctgtggaccatcctg

SEQ ID NO: 749431 - DNA, 20 bp, Artificial
  CRISPR gRNA sequence
gaaccaggtcccattctctt

SEQ ID NO: 749432 - DNA, 20 bp, Artificial
  CRISPR gRNA sequence
gacaacctctagcagctggt

SEQ ID NO: 749433 - DNA, 20 bp, Artificial
  CRISPR gRNA sequence
gctggtcagagttcagctgt

SEQ ID NO: 749434 - DNA, 20 bp, Artificial
  CRISPR gRNA sequence
ctaggcccgactaaccaagc

SEQ ID NO: 749435 - DNA, 20 bp, Artificial
  CRISPR gRNA sequence
cccatcccgtgcacactcac

SEQ ID NO: 749436 - DNA, 20 bp, Artificial
  CRISPR gRNA sequence
caggggtcacccggggcctg

SEQ ID NO: 749437 - DNA, 20 bp, Artificial
  CRISPR gRNA sequence
gtactgggacagaaacatct

SEQ ID NO: 749438 - DNA, 20 bp, Artificial
  CRISPR gRNA sequence
aggaccttggtaaatatttg

SEQ ID NO: 749439 - DNA, 20 bp, Artificial
  CRISPR gRNA sequence
ggtaaatatttgtggaatga

SEQ ID NO: 749440 - DNA, 20 bp, Artificial
  CRISPR gRNA sequence
gaaagaatgatgttttcagc

SEQ ID NO: 749441 - DNA, 20 bp, Artificial
  CRISPR gRNA sequence
gcttgggtctgaggcagagc

SEQ ID NO: 749442 - DNA, 20 bp, Artificial
  CRISPR gRNA sequence
tcattttttctaaatagctg

SEQ ID NO: 749443 - DNA, 20 bp, Artificial
  CRISPR gRNA sequence
tcagccccgcctgcccactg

SEQ ID NO: 749444 - DNA, 20 bp, Artificial
  CRISPR gRNA sequence
cactggagggttctggagag

SEQ ID NO: 749445 - DNA, 20 bp, Artificial
  CRISPR gRNA sequence
agtgctggcctgtccaaggt

SEQ ID NO: 749446 - DNA, 20 bp, Artificial
  CRISPR gRNA sequence
gccttgggcaagtcacttct

SEQ ID NO: 749447 - DNA, 20 bp, Artificial
  CRISPR gRNA sequence
tgtttcctcatctttaaaat

SEQ ID NO: 749448 - DNA, 20 bp, Artificial
  CRISPR gRNA sequence
gggatgataccacccatgtt

SEQ ID NO: 749449 - DNA, 20 bp, Artificial
  CRISPR gRNA sequence
cagctcttccctcctgccca

SEQ ID NO: 749450 - DNA, 20 bp, Artificial
  CRISPR gRNA sequence
gaagaaacggaggctcagag

SEQ ID NO: 749451 - DNA, 20 bp, Artificial
  CRISPR gRNA sequence
aacggaggctcagagaaggg

SEQ ID NO: 749452 - DNA, 20 bp, Artificial
  CRISPR gRNA sequence
caggacgttgcaatccaagc

SEQ ID NO: 749453 - DNA, 20 bp, Artificial
  CRISPR gRNA sequence
tccttacctggtggcaggtg

SEQ ID NO: 749454 - DNA, 20 bp, Artificial
  CRISPR gRNA sequence
gcgggtggcgggcggggggc

SEQ ID NO: 749455 - DNA, 20 bp, Artificial
  CRISPR gRNA sequence
cacatgctcaggcccaggcc

SEQ ID NO: 749456 - DNA, 20 bp, Artificial
  CRISPR gRNA sequence
acaatgacccaggtgtccaa

SEQ ID NO: 749457 - DNA, 20 bp, Artificial
  CRISPR gRNA sequence
taagcaacatcctctcgcca

SEQ ID NO: 749458 - DNA, 20 bp, Artificial
  CRISPR gRNA sequence
cacaggcatgtgcacagatg

SEQ ID NO: 749459 - DNA, 20 bp, Artificial
  CRISPR gRNA sequence
ctctcccccatgccatgcct

SEQ ID NO: 749460 - DNA, 20 bp, Artificial
  CRISPR gRNA sequence
gctgtgggccttgtcccagc

SEQ ID NO: 749461 - DNA, 20 bp, Artificial
  CRISPR gRNA sequence
ggagtctcagacacagtaaa

SEQ ID NO: 749462 - DNA, 20 bp, Artificial
  CRISPR gRNA sequence
tcctcccctgctccccaaac

SEQ ID NO: 749463 - DNA, 20 bp, Artificial
  CRISPR gRNA sequence
aacaactcctttgggacctg

SEQ ID NO: 749464 - DNA, 20 bp, Artificial
  CRISPR gRNA sequence
actcctttgggacctgtggg

SEQ ID NO: 749465 - DNA, 20 bp, Artificial
  CRISPR gRNA sequence
ggatgggtggccagtgtgtg

SEQ ID NO: 749466 - DNA, 20 bp, Artificial
  CRISPR gRNA sequence
gtgaggggtggggaggtgtg

SEQ ID NO: 749467 - DNA, 20 bp, Artificial
  CRISPR gRNA sequence
aacatcccttccctactgct

SEQ ID NO: 749468 - DNA, 20 bp, Artificial
  CRISPR gRNA sequence
tccctactgctgcgggtgct

SEQ ID NO: 749469 - DNA, 20 bp, Artificial
  CRISPR gRNA sequence
gggtgctatgggtacaatcc

SEQ ID NO: 749470 - DNA, 20 bp, Artificial
  CRISPR gRNA sequence
taccgtagctgaagctggag

SEQ ID NO: 749471 - DNA, 20 bp, Artificial
  CRISPR gRNA sequence
ctgaattcagctcccagccc

SEQ ID NO: 749472 - DNA, 20 bp, Artificial
  CRISPR gRNA sequence
tcccagccctggggtggctc

SEQ ID NO: 749473 - DNA, 20 bp, Artificial
  CRISPR gRNA sequence
ggcaggttttgtttcttcct

SEQ ID NO: 749474 - DNA, 20 bp, Artificial
  CRISPR gRNA sequence
ttttccactgagcctgctgc

SEQ ID NO: 749475 - DNA, 20 bp, Artificial
  CRISPR gRNA sequence
ctgctgcaggggtaagggca

SEQ ID NO: 749476 - DNA, 20 bp, Artificial
  CRISPR gRNA sequence
agggcagtgggttagcagag

SEQ ID NO: 749477 - DNA, 20 bp, Artificial
  CRISPR gRNA sequence
ccaggctttccctggggacc

SEQ ID NO: 749478 - DNA, 20 bp, Artificial
  CRISPR gRNA sequence
gctttccctggggaccctgg

SEQ ID NO: 749479 - DNA, 20 bp, Artificial
  CRISPR gRNA sequence
tgggtggatcatctcctctc

SEQ ID NO: 749480 - DNA, 20 bp, Artificial
  CRISPR gRNA sequence
tcatctcctctcttgagtct

SEQ ID NO: 749481 - DNA, 20 bp, Artificial
  CRISPR gRNA sequence
tgggtcagatttgtagcata

SEQ ID NO: 749482 - DNA, 20 bp, Artificial
  CRISPR gRNA sequence
agcataatgggtttgggcag

SEQ ID NO: 749483 - DNA, 20 bp, Artificial
  CRISPR gRNA sequence
ggaccaagaaaccacggtga

SEQ ID NO: 749484 - DNA, 20 bp, Artificial
  CRISPR gRNA sequence
agagagtgaagcaggccagg

SEQ ID NO: 749485 - DNA, 20 bp, Artificial
  CRISPR gRNA sequence
caggccaggtggaattatta

SEQ ID NO: 749486 - DNA, 20 bp, Artificial
  CRISPR gRNA sequence
acggacggactctggcgaac

SEQ ID NO: 749487 - DNA, 20 bp, Artificial
  CRISPR gRNA sequence
ttctaaggagagctggaagt

SEQ ID NO: 749488 - DNA, 20 bp, Artificial
  CRISPR gRNA sequence
aagaaaattaaaaagatttt

SEQ ID NO: 749489 - DNA, 20 bp, Artificial
  CRISPR gRNA sequence
caatgaaatatgtgtgaagg

SEQ ID NO: 749490 - DNA, 20 bp, Artificial
  CRISPR gRNA sequence
tcagtatagtgtctatgtgt

SEQ ID NO: 749491 - DNA, 20 bp, Artificial
  CRISPR gRNA sequence
tgcttgctgtgtgatcatca

SEQ ID NO: 749492 - DNA, 20 bp, Artificial
  CRISPR gRNA sequence
agtttcttcatcagtgcaat

SEQ ID NO: 749493 - DNA, 20 bp, Artificial
  CRISPR gRNA sequence
agtccaaccactttcccttt

SEQ ID NO: 749494 - DNA, 20 bp, Artificial
  CRISPR gRNA sequence
tcctttaaacacaagcgccc

SEQ ID NO: 749495 - DNA, 20 bp, Artificial
  CRISPR gRNA sequence
taaacacaagcgccccagga

SEQ ID NO: 749496 - DNA, 20 bp, Artificial
  CRISPR gRNA sequence
aggaggcacttcttgacttg

SEQ ID NO: 749497 - DNA, 20 bp, Artificial
  CRISPR gRNA sequence
ggcacttcttgacttgctga

SEQ ID NO: 749498 - DNA, 20 bp, Artificial
  CRISPR gRNA sequence
gcacttacagaacacttcat

SEQ ID NO: 749499 - DNA, 20 bp, Artificial
  CRISPR gRNA sequence
catttctgggaaaaacatct

SEQ ID NO: 749500 - DNA, 20 bp, Artificial
  CRISPR gRNA sequence
gggaaaaacatctgtgagtg

SEQ ID NO: 749501 - DNA, 20 bp, Artificial
  CRISPR gRNA sequence
caaggctttcagctcttcca

SEQ ID NO: 749502 - DNA, 20 bp, Artificial
  CRISPR gRNA sequence
gtgggtcccagcctgccgcc

SEQ ID NO: 749503 - DNA, 20 bp, Artificial
  CRISPR gRNA sequence
cagggaaggggcatctgaag

SEQ ID NO: 749504 - DNA, 20 bp, Artificial
  CRISPR gRNA sequence
cccctggctggggcaatgaa

SEQ ID NO: 749505 - DNA, 20 bp, Artificial
  CRISPR gRNA sequence
aatgaaaaggatgtatcagt

SEQ ID NO: 749506 - DNA, 20 bp, Artificial
  CRISPR gRNA sequence
aataccactggccgggcgta

SEQ ID NO: 749507 - DNA, 20 bp, Artificial
  CRISPR gRNA sequence
actttgagaggccaaggcag

SEQ ID NO: 749508 - DNA, 20 bp, Artificial
  CRISPR gRNA sequence
caggagaattgcttgaagcc

SEQ ID NO: 749509 - DNA, 20 bp, Artificial
  CRISPR gRNA sequence
tttcaaaagctcatggtttt

SEQ ID NO: 749510 - DNA, 20 bp, Artificial
  CRISPR gRNA sequence
gtcaacccaattaaatgctg

SEQ ID NO: 749511 - DNA, 20 bp, Artificial
  CRISPR gRNA sequence
ccaattaaatgctggaggat

SEQ ID NO: 749512 - DNA, 20 bp, Artificial
  CRISPR gRNA sequence
ggataaggcaaagtggacca

SEQ ID NO: 749513 - DNA, 20 bp, Artificial
  CRISPR gRNA sequence
gtttggctggaaggacgtgc

SEQ ID NO: 749514 - DNA, 20 bp, Artificial
  CRISPR gRNA sequence
ctgtcccggtccctcagaca

SEQ ID NO: 749515 - DNA, 20 bp, Artificial
  CRISPR gRNA sequence
aagtgccctgagggctggca

SEQ ID NO: 749516 - DNA, 20 bp, Artificial
  CRISPR gRNA sequence
gcattggattgcctttgcca

SEQ ID NO: 749517 - DNA, 20 bp, Artificial
  CRISPR gRNA sequence
tgccatggggttctgctgtc

SEQ ID NO: 749518 - DNA, 20 bp, Artificial
  CRISPR gRNA sequence
ctctcttagtgctccctggc

SEQ ID NO: 749519 - DNA, 20 bp, Artificial
  CRISPR gRNA sequence
gggaaggcatgttcagtcct

SEQ ID NO: 749520 - DNA, 20 bp, Artificial
  CRISPR gRNA sequence
tgactccccctacaacagcc

SEQ ID NO: 749521 - DNA, 20 bp, Artificial
  CRISPR gRNA sequence
ccccctacaacagcctagga

SEQ ID NO: 749522 - DNA, 20 bp, Artificial
  CRISPR gRNA sequence
tacaacagcctaggatggag

SEQ ID NO: 749523 - DNA, 20 bp, Artificial
  CRISPR gRNA sequence
gctaaggttcttccccgctc

SEQ ID NO: 749524 - DNA, 20 bp, Artificial
  CRISPR gRNA sequence
ttccccgctctggggttgcc

SEQ ID NO: 749525 - DNA, 20 bp, Artificial
  CRISPR gRNA sequence
tggggttgccaggagtagca

SEQ ID NO: 749526 - DNA, 20 bp, Artificial
  CRISPR gRNA sequence
cctggctcagcgccacgggc

SEQ ID NO: 749527 - DNA, 20 bp, Artificial
  CRISPR gRNA sequence
ccatgcgcaacctgaccctg

SEQ ID NO: 749528 - DNA, 20 bp, Artificial
  CRISPR gRNA sequence
aggcaccaccactcggagca

SEQ ID NO: 749529 - DNA, 20 bp, Artificial
  CRISPR gRNA sequence
attcatgacactgtgctggg

SEQ ID NO: 749530 - DNA, 20 bp, Artificial
  CRISPR gRNA sequence
tgggcagagtgtgaggctgc

SEQ ID NO: 749531 - DNA, 20 bp, Artificial
  CRISPR gRNA sequence
tgggtaacactggcactcca

SEQ ID NO: 749532 - DNA, 20 bp, Artificial
  CRISPR gRNA sequence
actggcactccagggagtgt

SEQ ID NO: 749533 - DNA, 20 bp, Artificial
  CRISPR gRNA sequence
cagggagtgtgtgggtgaga

SEQ ID NO: 749534 - DNA, 20 bp, Artificial
  CRISPR gRNA sequence
gtgggtgagatggggtggtc

SEQ ID NO: 749535 - DNA, 20 bp, Artificial
  CRISPR gRNA sequence
atggggtggtcaagggtgtg

SEQ ID NO: 749536 - DNA, 20 bp, Artificial
  CRISPR gRNA sequence
tggtcaagggtgtgtggagt

SEQ ID NO: 749537 - DNA, 20 bp, Artificial
  CRISPR gRNA sequence
agtgtgggtttgtagttagc

SEQ ID NO: 749538 - DNA, 20 bp, Artificial
  CRISPR gRNA sequence
tagctggagtgatggagagg

SEQ ID NO: 749539 - DNA, 20 bp, Artificial
  CRISPR gRNA sequence
aggctgtaggtacctgggct

SEQ ID NO: 749540 - DNA, 20 bp, Artificial
  CRISPR gRNA sequence
atgatgacatcatggctgct

SEQ ID NO: 749541 - DNA, 20 bp, Artificial
  CRISPR gRNA sequence
gtgccctggggcatgactca

SEQ ID NO: 749542 - DNA, 20 bp, Artificial
  CRISPR gRNA sequence
gggcatgactcagtggatgg

SEQ ID NO: 749543 - DNA, 20 bp, Artificial
  CRISPR gRNA sequence
ggatggctgaatggctgttg

SEQ ID NO: 749544 - DNA, 20 bp, Artificial
  CRISPR gRNA sequence
gtgtgtctgtctgttcaggt

SEQ ID NO: 749545 - DNA, 20 bp, Artificial
  CRISPR gRNA sequence
agagtgcaagggcccatggt

SEQ ID NO: 749546 - DNA, 20 bp, Artificial
  CRISPR gRNA sequence
ggatagaggtgtgggcacca

SEQ ID NO: 749547 - DNA, 20 bp, Artificial
  CRISPR gRNA sequence
gcgggtattcacatgcccct

SEQ ID NO: 749548 - DNA, 20 bp, Artificial
  CRISPR gRNA sequence
gggagtggcatgaaaatggg

SEQ ID NO: 749549 - DNA, 20 bp, Artificial
  CRISPR gRNA sequence
tgggcagggtgagaacatgc

SEQ ID NO: 749550 - DNA, 20 bp, Artificial
  CRISPR gRNA sequence
gagaacatgccagggtgtgt

SEQ ID NO: 749551 - DNA, 20 bp, Artificial
  CRISPR gRNA sequence
ctgccactgggccaacactg

SEQ ID NO: 749552 - DNA, 20 bp, Artificial
  CRISPR gRNA sequence
tggtgtacccatcctcctcc

SEQ ID NO: 749553 - DNA, 20 bp, Artificial
  CRISPR gRNA sequence
ggaccaacctcttgcccctt

SEQ ID NO: 749554 - DNA, 20 bp, Artificial
  CRISPR gRNA sequence
cactctccttccatctgctc

SEQ ID NO: 749555 - DNA, 20 bp, Artificial
  CRISPR gRNA sequence
ctctgctcctcttgactctc

SEQ ID NO: 749556 - DNA, 20 bp, Artificial
  CRISPR gRNA sequence
caagtgcctcatgacaggta

SEQ ID NO: 749557 - DNA, 20 bp, Artificial
  CRISPR gRNA sequence
ccctatggcttgggaaggct

SEQ ID NO: 749558 - DNA, 20 bp, Artificial
  CRISPR gRNA sequence
ggctgggggtcctcttggcc

SEQ ID NO: 749559 - DNA, 20 bp, Artificial
  CRISPR gRNA sequence
ggggaacagaactacctttc

SEQ ID NO: 749560 - DNA, 20 bp, Artificial
  CRISPR gRNA sequence
tttttaagtattattatctc

SEQ ID NO: 749561 - DNA, 20 bp, Artificial
  CRISPR gRNA sequence
tttcactctgttacccaggc

SEQ ID NO: 749562 - DNA, 20 bp, Artificial
  CRISPR gRNA sequence
ctcactgcaacctccgcctc

SEQ ID NO: 749563 - DNA, 20 bp, Artificial
  CRISPR gRNA sequence
gattcttctgcctcagcctc

SEQ ID NO: 749564 - DNA, 20 bp, Artificial
  CRISPR gRNA sequence
gcctcagcctcccgagtagc

SEQ ID NO: 749565 - DNA, 20 bp, Artificial
  CRISPR gRNA sequence
ttttgtatttttagtggagc

SEQ ID NO: 749566 - DNA, 20 bp, Artificial
  CRISPR gRNA sequence
gcctcggcctcccaaagtgc

SEQ ID NO: 749567 - DNA, 20 bp, Artificial
  CRISPR gRNA sequence
aaagtgctgggattacaggt

SEQ ID NO: 749568 - DNA, 20 bp, Artificial
  CRISPR gRNA sequence
gagtcaccacgcctggcctc

SEQ ID NO: 749569 - DNA, 20 bp, Artificial
  CRISPR gRNA sequence
tctctctctgtcactcaggc

SEQ ID NO: 749570 - DNA, 20 bp, Artificial
  CRISPR gRNA sequence
ggcacgcatcaccatgtctg

SEQ ID NO: 749571 - DNA, 20 bp, Artificial
  CRISPR gRNA sequence
gaatttttaaaaattatttt

SEQ ID NO: 749572 - DNA, 20 bp, Artificial
  CRISPR gRNA sequence
caggcagatcgcttgaggcc

SEQ ID NO: 749573 - DNA, 20 bp, Artificial
  CRISPR gRNA sequence
ttcgagaccagcctggccaa

SEQ ID NO: 749574 - DNA, 20 bp, Artificial
  CRISPR gRNA sequence
tactcaagaggctgaggcaa

SEQ ID NO: 749575 - DNA, 20 bp, Artificial
  CRISPR gRNA sequence
caagagaatcgcttgaaccc

SEQ ID NO: 749576 - DNA, 20 bp, Artificial
  CRISPR gRNA sequence
tcacaccactgcactccagc

SEQ ID NO: 749577 - DNA, 20 bp, Artificial
  CRISPR gRNA sequence
caccttgacctccaaagtgc

SEQ ID NO: 749578 - DNA, 20 bp, Artificial
  CRISPR gRNA sequence
agccaccatgcctagcctca

SEQ ID NO: 749579 - DNA, 20 bp, Artificial
  CRISPR gRNA sequence
ttgcccaagctcacatagcc

SEQ ID NO: 749580 - DNA, 20 bp, Artificial
  CRISPR gRNA sequence
atagcccagggtagcatagc

SEQ ID NO: 749581 - DNA, 20 bp, Artificial
  CRISPR gRNA sequence
tcccagcttggggcagtgca

SEQ ID NO: 749582 - DNA, 20 bp, Artificial
  CRISPR gRNA sequence
cttgccagagaggtgcccta

SEQ ID NO: 749583 - DNA, 20 bp, Artificial
  CRISPR gRNA sequence
gggtaagagggcactgccct

SEQ ID NO: 749584 - DNA, 20 bp, Artificial
  CRISPR gRNA sequence
gggtgcctggcgctgagagg

SEQ ID NO: 749585 - DNA, 20 bp, Artificial
  CRISPR gRNA sequence
ctggcgctgagaggttgggt

SEQ ID NO: 749586 - DNA, 20 bp, Artificial
  CRISPR gRNA sequence
acatgcacgaggacctaagc

SEQ ID NO: 749587 - DNA, 20 bp, Artificial
  CRISPR gRNA sequence
acgaggacctaagccggaat

SEQ ID NO: 749588 - DNA, 20 bp, Artificial
  CRISPR gRNA sequence
gccttggctccccaaagtgc

SEQ ID NO: 749589 - DNA, 20 bp, Artificial
  CRISPR gRNA sequence
tccccaaagtgctgggatta

SEQ ID NO: 749590 - DNA, 20 bp, Artificial
  CRISPR gRNA sequence
taatgttatccttgggaagt

SEQ ID NO: 749591 - DNA, 20 bp, Artificial
  CRISPR gRNA sequence
tacaagttaacctgaggtag

SEQ ID NO: 749592 - DNA, 20 bp, Artificial
  CRISPR gRNA sequence
tttctcagtgagctcagaga

SEQ ID NO: 749593 - DNA, 20 bp, Artificial
  CRISPR gRNA sequence
cttcccaccccccagcgcag

SEQ ID NO: 749594 - DNA, 20 bp, Artificial
  CRISPR gRNA sequence
ccagcgcctgatcaccttcc

SEQ ID NO: 749595 - DNA, 20 bp, Artificial
  CRISPR gRNA sequence
ttcccaggataagcctggct

SEQ ID NO: 749596 - DNA, 20 bp, Artificial
  CRISPR gRNA sequence
gataagcctggctctggatg

SEQ ID NO: 749597 - DNA, 20 bp, Artificial
  CRISPR gRNA sequence
agcctggctctggatggtga

SEQ ID NO: 749598 - DNA, 20 bp, Artificial
  CRISPR gRNA sequence
gagtatgcctgccttcccct

SEQ ID NO: 749599 - DNA, 20 bp, Artificial
  CRISPR gRNA sequence
cactggccacgcttggggga

SEQ ID NO: 749600 - DNA, 20 bp, Artificial
  CRISPR gRNA sequence
cctacggcttcagaaagcag

SEQ ID NO: 749601 - DNA, 20 bp, Artificial
  CRISPR gRNA sequence
aattaagtcctgatctgata

SEQ ID NO: 749602 - DNA, 20 bp, Artificial
  CRISPR gRNA sequence
cataggggaaatctctacct

SEQ ID NO: 749603 - DNA, 20 bp, Artificial
  CRISPR gRNA sequence
cctggggatagaagttaggc

SEQ ID NO: 749604 - DNA, 20 bp, Artificial
  CRISPR gRNA sequence
acctgctttgatcactagaa

SEQ ID NO: 749605 - DNA, 20 bp, Artificial
  CRISPR gRNA sequence
ccacaataaggtcctttgat

SEQ ID NO: 749606 - DNA, 20 bp, Artificial
  CRISPR gRNA sequence
gttttgaaatactgaggtgt

SEQ ID NO: 749607 - DNA, 20 bp, Artificial
  CRISPR gRNA sequence
atactgaggtgtctgggtta

SEQ ID NO: 749608 - DNA, 20 bp, Artificial
  CRISPR gRNA sequence
tagcaactgttcctgtacca

SEQ ID NO: 749609 - DNA, 20 bp, Artificial
  CRISPR gRNA sequence
ctgaaagcttgtttacgctg

SEQ ID NO: 749610 - DNA, 20 bp, Artificial
  CRISPR gRNA sequence
ggctcagcactttgaccgct

SEQ ID NO: 749611 - DNA, 20 bp, Artificial
  CRISPR gRNA sequence
atttactacagatttccttg

SEQ ID NO: 749612 - DNA, 20 bp, Artificial
  CRISPR gRNA sequence
ccatgtgataaaactctaag

SEQ ID NO: 749613 - DNA, 20 bp, Artificial
  CRISPR gRNA sequence
ctgcgtctgctgtatttgca

SEQ ID NO: 749614 - DNA, 20 bp, Artificial
  CRISPR gRNA sequence
taacacaaaaaccggcacac

SEQ ID NO: 749615 - DNA, 20 bp, Artificial
  CRISPR gRNA sequence
acagggatgatctcttcaga

SEQ ID NO: 749616 - DNA, 20 bp, Artificial
  CRISPR gRNA sequence
gtacaaggggaggaggagat

SEQ ID NO: 749617 - DNA, 20 bp, Artificial
  CRISPR gRNA sequence
aaaattgaaaaacattgtac

SEQ ID NO: 749618 - DNA, 20 bp, Artificial
  CRISPR gRNA sequence
acgtttttctagttctcacc

SEQ ID NO: 749619 - DNA, 20 bp, Artificial
  CRISPR gRNA sequence
tgacttgtgtggtgagatca

SEQ ID NO: 749620 - DNA, 20 bp, Artificial
  CRISPR gRNA sequence
gaggccccatcccagagcta

SEQ ID NO: 749621 - DNA, 20 bp, Artificial
  CRISPR gRNA sequence
tcccagagctaaggagtctc

SEQ ID NO: 749622 - DNA, 20 bp, Artificial
  CRISPR gRNA sequence
agagctaaggagtctctggg

SEQ ID NO: 749623 - DNA, 20 bp, Artificial
  CRISPR gRNA sequence
tgaccttgagctctgtggca

SEQ ID NO: 749624 - DNA, 20 bp, Artificial
  CRISPR gRNA sequence
tcagagaacaacctgtagcc

SEQ ID NO: 749625 - DNA, 20 bp, Artificial
  CRISPR gRNA sequence
tccagctgtaccttgtgggc

SEQ ID NO: 749626 - DNA, 20 bp, Artificial
  CRISPR gRNA sequence
gtaggtgacaggtcttgttt

SEQ ID NO: 749627 - DNA, 20 bp, Artificial
  CRISPR gRNA sequence
ccatgcctctgtaggttgct

SEQ ID NO: 749628 - DNA, 20 bp, Artificial
  CRISPR gRNA sequence
ctgtgggactctggggaaag

SEQ ID NO: 749629 - DNA, 20 bp, Artificial
  CRISPR gRNA sequence
ttatgctcaggaggagcaat

SEQ ID NO: 749630 - DNA, 20 bp, Artificial
  CRISPR gRNA sequence
tcacggctgcagccctggct

SEQ ID NO: 749631 - DNA, 20 bp, Artificial
  CRISPR gRNA sequence
gctacgggtgcctgcatcgt

SEQ ID NO: 749632 - DNA, 20 bp, Artificial
  CRISPR gRNA sequence
gcaggcagcctccaaccgcc

SEQ ID NO: 749633 - DNA, 20 bp, Artificial
  CRISPR gRNA sequence
cgtgagtattcctccctgcc

SEQ ID NO: 749634 - DNA, 20 bp, Artificial
  CRISPR gRNA sequence
agtattcctccctgcctggg

SEQ ID NO: 749635 - DNA, 20 bp, Artificial
  CRISPR gRNA sequence
gcctggggtgggtggacggt

SEQ ID NO: 749636 - DNA, 20 bp, Artificial
  CRISPR gRNA sequence
ccagcccccagttcagcccc

SEQ ID NO: 749637 - DNA, 20 bp, Artificial
  CRISPR gRNA sequence
ggcacaattccttttcattt

SEQ ID NO: 749638 - DNA, 20 bp, Artificial
  CRISPR gRNA sequence
cggcactcaatacatgtctt

SEQ ID NO: 749639 - DNA, 20 bp, Artificial
  CRISPR gRNA sequence
actcaatacatgtcttctga

SEQ ID NO: 749640 - DNA, 20 bp, Artificial
  CRISPR gRNA sequence
ttgggacaaaaaatgatctt

SEQ ID NO: 749641 - DNA, 20 bp, Artificial
  CRISPR gRNA sequence
tttggaatatcagaagtgga

SEQ ID NO: 749642 - DNA, 20 bp, Artificial
  CRISPR gRNA sequence
gatgagaaggctaagatcag

SEQ ID NO: 749643 - DNA, 20 bp, Artificial
  CRISPR gRNA sequence
cagtggggttacataactga

SEQ ID NO: 749644 - DNA, 20 bp, Artificial
  CRISPR gRNA sequence
ttcaacgcatgctctttcca

SEQ ID NO: 749645 - DNA, 20 bp, Artificial
  CRISPR gRNA sequence
ttactcctcattgcaagtcc

SEQ ID NO: 749646 - DNA, 20 bp, Artificial
  CRISPR gRNA sequence
atgggcaaacggaggcacag

SEQ ID NO: 749647 - DNA, 20 bp, Artificial
  CRISPR gRNA sequence
cctagttcctgaccctgccc

SEQ ID NO: 749648 - DNA, 20 bp, Artificial
  CRISPR gRNA sequence
gcccttgagtcttggttagt

SEQ ID NO: 749649 - DNA, 20 bp, Artificial
  CRISPR gRNA sequence
agtcctccaagaaggggcta

SEQ ID NO: 749650 - DNA, 20 bp, Artificial
  CRISPR gRNA sequence
ggctacagaggtaactgaga

SEQ ID NO: 749651 - DNA, 20 bp, Artificial
  CRISPR gRNA sequence
cccccacgtgaagccccata

SEQ ID NO: 749652 - DNA, 20 bp, Artificial
  CRISPR gRNA sequence
acacaccacaacctacctgc

SEQ ID NO: 749653 - DNA, 20 bp, Artificial
  CRISPR gRNA sequence
ctgcaggaatacccatggct

SEQ ID NO: 749654 - DNA, 20 bp, Artificial
  CRISPR gRNA sequence
aggaatacccatggctgggg

SEQ ID NO: 749655 - DNA, 20 bp, Artificial
  CRISPR gRNA sequence
ctggcccagagagcctgctc

SEQ ID NO: 749656 - DNA, 20 bp, Artificial
  CRISPR gRNA sequence
tgctggagaggccaacaggt

SEQ ID NO: 749657 - DNA, 20 bp, Artificial
  CRISPR gRNA sequence
gaccaacaaccctcacccca

SEQ ID NO: 749658 - DNA, 20 bp, Artificial
  CRISPR gRNA sequence
tcaccccaaagggtggcaca

SEQ ID NO: 749659 - DNA, 20 bp, Artificial
  CRISPR gRNA sequence
tggcacagaggatgagatga

SEQ ID NO: 749660 - DNA, 20 bp, Artificial
  CRISPR gRNA sequence
acctgcacgaagcctgaccc

SEQ ID NO: 749661 - DNA, 20 bp, Artificial
  CRISPR gRNA sequence
ctgtaagcaatagccatggt

SEQ ID NO: 749662 - DNA, 20 bp, Artificial
  CRISPR gRNA sequence
tgaatagatttcaggaactt

SEQ ID NO: 749663 - DNA, 20 bp, Artificial
  CRISPR gRNA sequence
gaagcatctgtgggaggaca

SEQ ID NO: 749664 - DNA, 20 bp, Artificial
  CRISPR gRNA sequence
gctgcatgaaagagggaagt

SEQ ID NO: 749665 - DNA, 20 bp, Artificial
  CRISPR gRNA sequence
tctaattggtggccagtttg

SEQ ID NO: 749666 - DNA, 20 bp, Artificial
  CRISPR gRNA sequence
ttggtggccagtttgggggg

SEQ ID NO: 749667 - DNA, 20 bp, Artificial
  CRISPR gRNA sequence
ctgaggcaagcggcagcaac

SEQ ID NO: 749668 - DNA, 20 bp, Artificial
  CRISPR gRNA sequence
acttggatgagaagcagaaa

SEQ ID NO: 749669 - DNA, 20 bp, Artificial
  CRISPR gRNA sequence
tttccctgagagatgtcccc

SEQ ID NO: 749670 - DNA, 20 bp, Artificial
  CRISPR gRNA sequence
ccaccctattaggcaatgta

SEQ ID NO: 749671 - DNA, 20 bp, Artificial
  CRISPR gRNA sequence
agacaccagttagcaaattc

SEQ ID NO: 749672 - DNA, 20 bp, Artificial
  CRISPR gRNA sequence
acactcctggaaaatgcaga

SEQ ID NO: 749673 - DNA, 20 bp, Artificial
  CRISPR gRNA sequence
agcacccatgtgaaaagaaa

SEQ ID NO: 749674 - DNA, 20 bp, Artificial
  CRISPR gRNA sequence
gggcatctgccagcaggggc

SEQ ID NO: 749675 - DNA, 20 bp, Artificial
  CRISPR gRNA sequence
ctaggtgcccaggagctggt

SEQ ID NO: 749676 - DNA, 20 bp, Artificial
  CRISPR gRNA sequence
gatgtgtcatgcacccacct

SEQ ID NO: 749677 - DNA, 20 bp, Artificial
  CRISPR gRNA sequence
tctcagtggtcagcctgggc

SEQ ID NO: 749678 - DNA, 20 bp, Artificial
  CRISPR gRNA sequence
ggccacaagggcagaggctg

SEQ ID NO: 749679 - DNA, 20 bp, Artificial
  CRISPR gRNA sequence
gggcagaggctgaggggtcc

SEQ ID NO: 749680 - DNA, 20 bp, Artificial
  CRISPR gRNA sequence
tcccagagtggtgcagtggg

SEQ ID NO: 749681 - DNA, 20 bp, Artificial
  CRISPR gRNA sequence
gggctgggtctaggggcaga

SEQ ID NO: 749682 - DNA, 20 bp, Artificial
  CRISPR gRNA sequence
ctgccatgcagcctggcctg

SEQ ID NO: 749683 - DNA, 20 bp, Artificial
  CRISPR gRNA sequence
agctcctctaggtgtttgaa

SEQ ID NO: 749684 - DNA, 20 bp, Artificial
  CRISPR gRNA sequence
agtcctgcttgcaactcatc

SEQ ID NO: 749685 - DNA, 20 bp, Artificial
  CRISPR gRNA sequence
ttgcaactcatctagaatct

SEQ ID NO: 749686 - DNA, 20 bp, Artificial
  CRISPR gRNA sequence
atctagaatctaagagttgc

SEQ ID NO: 749687 - DNA, 20 bp, Artificial
  CRISPR gRNA sequence
ctcagctcaagacaggcttt

SEQ ID NO: 749688 - DNA, 20 bp, Artificial
  CRISPR gRNA sequence
tttggcttcctggctgtgcc

SEQ ID NO: 749689 - DNA, 20 bp, Artificial
  CRISPR gRNA sequence
gtcagaccacagggaggagc

SEQ ID NO: 749690 - DNA, 20 bp, Artificial
  CRISPR gRNA sequence
tggagatgctgctgaggctt

SEQ ID NO: 749691 - DNA, 20 bp, Artificial
  CRISPR gRNA sequence
tgctgctgaggcttggggat

SEQ ID NO: 749692 - DNA, 20 bp, Artificial
  CRISPR gRNA sequence
aaaactgggggcagggaggg

SEQ ID NO: 749693 - DNA, 20 bp, Artificial
  CRISPR gRNA sequence
ttctgtggcagcaacattca

SEQ ID NO: 749694 - DNA, 20 bp, Artificial
  CRISPR gRNA sequence
gaagcctcaccacctgccca

SEQ ID NO: 749695 - DNA, 20 bp, Artificial
  CRISPR gRNA sequence
tgtggcccagcggcagcctt

SEQ ID NO: 749696 - DNA, 20 bp, Artificial
  CRISPR gRNA sequence
gagacgtcttcttcccatcc

SEQ ID NO: 749697 - DNA, 20 bp, Artificial
  CRISPR gRNA sequence
ctcactccctgccctccctg

SEQ ID NO: 749698 - DNA, 20 bp, Artificial
  CRISPR gRNA sequence
tgaagagttccacggcctca

SEQ ID NO: 749699 - DNA, 20 bp, Artificial
  CRISPR gRNA sequence
agttccacggcctcacgggg

SEQ ID NO: 749700 - DNA, 20 bp, Artificial
  CRISPR gRNA sequence
cggcctcacggggtggggtt

SEQ ID NO: 749701 - DNA, 20 bp, Artificial
  CRISPR gRNA sequence
ggcccccattcacctccctg

SEQ ID NO: 749702 - DNA, 20 bp, Artificial
  CRISPR gRNA sequence
tgaagagttccacggcctca

SEQ ID NO: 749703 - DNA, 20 bp, Artificial
  CRISPR gRNA sequence
agttccacggcctcacgggg

SEQ ID NO: 749704 - DNA, 20 bp, Artificial
  CRISPR gRNA sequence
cggcctcacggggtggggtt

SEQ ID NO: 749705 - DNA, 20 bp, Artificial
  CRISPR gRNA sequence
ggcccccattcacctccctg

SEQ ID NO: 749706 - DNA, 20 bp, Artificial
  CRISPR gRNA sequence
tgaagagttccacggcctca

SEQ ID NO: 749707 - DNA, 20 bp, Artificial
  CRISPR gRNA sequence
agttccacggcctcacgggg

SEQ ID NO: 749708 - DNA, 20 bp, Artificial
  CRISPR gRNA sequence
cggcctcacggggtggggtt

SEQ ID NO: 749709 - DNA, 20 bp, Artificial
  CRISPR gRNA sequence
ggcccccattcacctccctg

SEQ ID NO: 749710 - DNA, 20 bp, Artificial
  CRISPR gRNA sequence
tgaagagttccacggcctca

SEQ ID NO: 749711 - DNA, 20 bp, Artificial
  CRISPR gRNA sequence
agttccacggcctcacgggg

SEQ ID NO: 749712 - DNA, 20 bp, Artificial
  CRISPR gRNA sequence
cggcctcacggggtggggtt

SEQ ID NO: 749713 - DNA, 20 bp, Artificial
  CRISPR gRNA sequence
gggacagtgggctgttgtgg

SEQ ID NO: 749714 - DNA, 20 bp, Artificial
  CRISPR gRNA sequence
tttgagccagggctggctct

SEQ ID NO: 749715 - DNA, 20 bp, Artificial
  CRISPR gRNA sequence
agcccagcccctcaacccct

SEQ ID NO: 749716 - DNA, 20 bp, Artificial
  CRISPR gRNA sequence
aacccctctggatgctacat

SEQ ID NO: 749717 - DNA, 20 bp, Artificial
  CRISPR gRNA sequence
gacggctcagcccctgttcc

SEQ ID NO: 749718 - DNA, 20 bp, Artificial
  CRISPR gRNA sequence
agcccctgttccaaggattt

SEQ ID NO: 749719 - DNA, 20 bp, Artificial
  CRISPR gRNA sequence
tcgttctgagacatgagcct

SEQ ID NO: 749720 - DNA, 20 bp, Artificial
  CRISPR gRNA sequence
tggagatggtgctgagggag

SEQ ID NO: 749721 - DNA, 20 bp, Artificial
  CRISPR gRNA sequence
gggtggggccttctgggaag

SEQ ID NO: 749722 - DNA, 20 bp, Artificial
  CRISPR gRNA sequence
tgctcagcgcgggccattgc

SEQ ID NO: 749723 - DNA, 20 bp, Artificial
  CRISPR gRNA sequence
ttgtccaccctgggacactt

SEQ ID NO: 749724 - DNA, 20 bp, Artificial
  CRISPR gRNA sequence
ggacacttctgagtatgaag

SEQ ID NO: 749725 - DNA, 20 bp, Artificial
  CRISPR gRNA sequence
aacaggtgcaaaccctggag

SEQ ID NO: 749726 - DNA, 20 bp, Artificial
  CRISPR gRNA sequence
tccatacaatctgggcctgg

SEQ ID NO: 749727 - DNA, 20 bp, Artificial
  CRISPR gRNA sequence
tcagagccattcggccaggt

SEQ ID NO: 749728 - DNA, 20 bp, Artificial
  CRISPR gRNA sequence
tttttatacacataggcaag

SEQ ID NO: 749729 - DNA, 20 bp, Artificial
  CRISPR gRNA sequence
taggcaaggtgagtcctctg

SEQ ID NO: 749730 - DNA, 20 bp, Artificial
  CRISPR gRNA sequence
cctctgtggaattgtgattg

SEQ ID NO: 749731 - DNA, 20 bp, Artificial
  CRISPR gRNA sequence
aggattttaaagcaggggag

SEQ ID NO: 749732 - DNA, 20 bp, Artificial
  CRISPR gRNA sequence
ggggcatctctgtacactct

SEQ ID NO: 749733 - DNA, 20 bp, Artificial
  CRISPR gRNA sequence
agaccccctgtagcgtttag

SEQ ID NO: 749734 - DNA, 20 bp, Artificial
  CRISPR gRNA sequence
ctggctctgctgagctgggc

SEQ ID NO: 749735 - DNA, 20 bp, Artificial
  CRISPR gRNA sequence
tgggcctgggtgctgaaagc

SEQ ID NO: 749736 - DNA, 20 bp, Artificial
  CRISPR gRNA sequence
gatgttcgcccaattgcttg

SEQ ID NO: 749737 - DNA, 20 bp, Artificial
  CRISPR gRNA sequence
ccaattgcttggggggttgg

SEQ ID NO: 749738 - DNA, 20 bp, Artificial
  CRISPR gRNA sequence
agccccccagttaggcccaa

SEQ ID NO: 749739 - DNA, 20 bp, Artificial
  CRISPR gRNA sequence
tgggccaggggctttgagga

SEQ ID NO: 749740 - DNA, 20 bp, Artificial
  CRISPR gRNA sequence
ccggagatggggctgacacc

SEQ ID NO: 749741 - DNA, 20 bp, Artificial
  CRISPR gRNA sequence
gggctgacacctcgagtggc

SEQ ID NO: 749742 - DNA, 20 bp, Artificial
  CRISPR gRNA sequence
tcccttgtccctaggcagag

SEQ ID NO: 749743 - DNA, 20 bp, Artificial
  CRISPR gRNA sequence
gatgccagctgccataggaa

SEQ ID NO: 749744 - DNA, 20 bp, Artificial
  CRISPR gRNA sequence
aaaagaaagaaagaaggaaa

SEQ ID NO: 749745 - DNA, 20 bp, Artificial
  CRISPR gRNA sequence
ttcatgggggcctgcatggc

SEQ ID NO: 749746 - DNA, 20 bp, Artificial
  CRISPR gRNA sequence
gacaggacacctgctgttcc

SEQ ID NO: 749747 - DNA, 20 bp, Artificial
  CRISPR gRNA sequence
ttgaggcagagacaacttct

SEQ ID NO: 749748 - DNA, 20 bp, Artificial
  CRISPR gRNA sequence
caggctgctggagccgccct

SEQ ID NO: 749749 - DNA, 20 bp, Artificial
  CRISPR gRNA sequence
gagccgccctctgagttgcc

SEQ ID NO: 749750 - DNA, 20 bp, Artificial
  CRISPR gRNA sequence
cagccctggtggctgtgggc

SEQ ID NO: 749751 - DNA, 20 bp, Artificial
  CRISPR gRNA sequence
ggctggggtgcatgggagag

SEQ ID NO: 749752 - DNA, 20 bp, Artificial
  CRISPR gRNA sequence
ggcaggaggctcctggagcg

SEQ ID NO: 749753 - DNA, 20 bp, Artificial
  CRISPR gRNA sequence
tcattgttaggagatcaatc

SEQ ID NO: 749754 - DNA, 20 bp, Artificial
  CRISPR gRNA sequence
ccctcccagggagaggctga

SEQ ID NO: 749755 - DNA, 20 bp, Artificial
  CRISPR gRNA sequence
ccagggagaggctgaaggaa

SEQ ID NO: 749756 - DNA, 20 bp, Artificial
  CRISPR gRNA sequence
ggaattgaaagcaccatttg

SEQ ID NO: 749757 - DNA, 20 bp, Artificial
  CRISPR gRNA sequence
ggcaggctggccctgcctgg

SEQ ID NO: 749758 - DNA, 20 bp, Artificial
  CRISPR gRNA sequence
gagtccgtggcgatgggcgc

SEQ ID NO: 749759 - DNA, 20 bp, Artificial
  CRISPR gRNA sequence
ctgatacatggcctttttca

SEQ ID NO: 749760 - DNA, 20 bp, Artificial
  CRISPR gRNA sequence
ttttcagggggtgctcctcg

SEQ ID NO: 749761 - DNA, 20 bp, Artificial
  CRISPR gRNA sequence
gctcctcgcggggtggactt

SEQ ID NO: 749762 - DNA, 20 bp, Artificial
  CRISPR gRNA sequence
gcagtgggacagggggctgc

SEQ ID NO: 749763 - DNA, 20 bp, Artificial
  CRISPR gRNA sequence
ccgagcaccaacttggcccc

SEQ ID NO: 749764 - DNA, 20 bp, Artificial
  CRISPR gRNA sequence
ggcccctggggtcctgcctc

SEQ ID NO: 749765 - DNA, 20 bp, Artificial
  CRISPR gRNA sequence
tggcctgactgtgctggggg

SEQ ID NO: 749766 - DNA, 20 bp, Artificial
  CRISPR gRNA sequence
acaatgcacgaaagaggaac

SEQ ID NO: 749767 - DNA, 20 bp, Artificial
  CRISPR gRNA sequence
gaggaactggggttgctaac

SEQ ID NO: 749768 - DNA, 20 bp, Artificial
  CRISPR gRNA sequence
ctatgtcaccctaactatcc

SEQ ID NO: 749769 - DNA, 20 bp, Artificial
  CRISPR gRNA sequence
ctatcctggaatgtgttgag

SEQ ID NO: 749770 - DNA, 20 bp, Artificial
  CRISPR gRNA sequence
ggaatgtgttgagagggatt

SEQ ID NO: 749771 - DNA, 20 bp, Artificial
  CRISPR gRNA sequence
tgtttcttggccttttctgt

SEQ ID NO: 749772 - DNA, 20 bp, Artificial
  CRISPR gRNA sequence
ggtggaactacgactaaacc

SEQ ID NO: 749773 - DNA, 20 bp, Artificial
  CRISPR gRNA sequence
ggtctcctgcttcctcctca

SEQ ID NO: 749774 - DNA, 20 bp, Artificial
  CRISPR gRNA sequence
tcctgcttcctcctcactga

SEQ ID NO: 749775 - DNA, 20 bp, Artificial
  CRISPR gRNA sequence
tgaggaggaagcaggagacc

SEQ ID NO: 749776 - DNA, 20 bp, Artificial
  CRISPR gRNA sequence
ccagggtttagtcgtagttc

SEQ ID NO: 749777 - DNA, 20 bp, Artificial
  CRISPR gRNA sequence
tagtcgtagttccaccgttt

SEQ ID NO: 749778 - DNA, 20 bp, Artificial
  CRISPR gRNA sequence
aatggcagcaataaaacctc

SEQ ID NO: 749779 - DNA, 20 bp, Artificial
  CRISPR gRNA sequence
catgctcagctgggctgtgg

SEQ ID NO: 749780 - DNA, 20 bp, Artificial
  CRISPR gRNA sequence
agtcaccagtggcctccatg

SEQ ID NO: 749781 - DNA, 20 bp, Artificial
  CRISPR gRNA sequence
tgtcagcaaaaccctccaaa

SEQ ID NO: 749782 - DNA, 20 bp, Artificial
  CRISPR gRNA sequence
taggtaagatggcccctaat

SEQ ID NO: 749783 - DNA, 20 bp, Artificial
  CRISPR gRNA sequence
aatgaattagttcttaaaag

SEQ ID NO: 749784 - DNA, 20 bp, Artificial
  CRISPR gRNA sequence
ggagaaccggaatctgggct

SEQ ID NO: 749785 - DNA, 20 bp, Artificial
  CRISPR gRNA sequence
cttctttctttctttttaaa

SEQ ID NO: 749786 - DNA, 20 bp, Artificial
  CRISPR gRNA sequence
ttttaaaatttgttttgagg

SEQ ID NO: 749787 - DNA, 20 bp, Artificial
  CRISPR gRNA sequence
ctcacagcagccttgaacac

SEQ ID NO: 749788 - DNA, 20 bp, Artificial
  CRISPR gRNA sequence
cctagggacaagggagaagc

SEQ ID NO: 749789 - DNA, 20 bp, Artificial
  CRISPR gRNA sequence
tgtcagccccatctccgggc

SEQ ID NO: 749790 - DNA, 20 bp, Artificial
  CRISPR gRNA sequence
cattcctttgggcctaactg

SEQ ID NO: 749791 - DNA, 20 bp, Artificial
  CRISPR gRNA sequence
cttcccgcctagccccaaat

SEQ ID NO: 749792 - DNA, 20 bp, Artificial
  CRISPR gRNA sequence
ccatgctcaggcactgcctt

SEQ ID NO: 749793 - DNA, 20 bp, Artificial
  CRISPR gRNA sequence
agatgccccctactctcctc

SEQ ID NO: 749794 - DNA, 20 bp, Artificial
  CRISPR gRNA sequence
gaagcgaagactccaccagg

SEQ ID NO: 749795 - DNA, 20 bp, Artificial
  CRISPR gRNA sequence
gtgggggaggagcagcagag

SEQ ID NO: 749796 - DNA, 20 bp, Artificial
  CRISPR gRNA sequence
tggctcttacaatccatctc

SEQ ID NO: 749797 - DNA, 20 bp, Artificial
  CRISPR gRNA sequence
aatccatctccagggtttgc

SEQ ID NO: 749798 - DNA, 20 bp, Artificial
  CRISPR gRNA sequence
ggtttgcacctgtttcccca

SEQ ID NO: 749799 - DNA, 20 bp, Artificial
  CRISPR gRNA sequence
ccatgtagtttttaatagca

SEQ ID NO: 749800 - DNA, 20 bp, Artificial
  CRISPR gRNA sequence
ggggcaacatctgtcctggc

SEQ ID NO: 749801 - DNA, 20 bp, Artificial
  CRISPR gRNA sequence
accatgccccaatatgtact

SEQ ID NO: 749802 - DNA, 20 bp, Artificial
  CRISPR gRNA sequence
ggaatgcaggcagtggaagc

SEQ ID NO: 749803 - DNA, 20 bp, Artificial
  CRISPR gRNA sequence
catccagaggggttgagggg

SEQ ID NO: 749804 - DNA, 20 bp, Artificial
  CRISPR gRNA sequence
ccagctgggctagatgacct

SEQ ID NO: 749805 - DNA, 20 bp, Artificial
  CRISPR gRNA sequence
ggtatcccctgggcaggtgg

SEQ ID NO: 749806 - DNA, 20 bp, Artificial
  CRISPR gRNA sequence
aggtggtgaggcttcaaagc

SEQ ID NO: 749807 - DNA, 20 bp, Artificial
  CRISPR gRNA sequence
tgaactctgccctccctgcc

SEQ ID NO: 749808 - DNA, 20 bp, Artificial
  CRISPR gRNA sequence
tcagcctcaggaatttgggg

SEQ ID NO: 749809 - DNA, 20 bp, Artificial
  CRISPR gRNA sequence
ttctgaagacccctgcaact

SEQ ID NO: 749810 - DNA, 20 bp, Artificial
  CRISPR gRNA sequence
catccctttcaaacacctag

SEQ ID NO: 749811 - DNA, 20 bp, Artificial
  CRISPR gRNA sequence
ttcaaacacctagaggagct

SEQ ID NO: 749812 - DNA, 20 bp, Artificial
  CRISPR gRNA sequence
ccctccaggccaggctgcat

SEQ ID NO: 749813 - DNA, 20 bp, Artificial
  CRISPR gRNA sequence
cttgtggcctgcagcggcct

SEQ ID NO: 749814 - DNA, 20 bp, Artificial
  CRISPR gRNA sequence
gtctcactgtctgccccaga

SEQ ID NO: 749815 - DNA, 20 bp, Artificial
  CRISPR gRNA sequence
cagccaatctgcacagatgt

SEQ ID NO: 749816 - DNA, 20 bp, Artificial
  CRISPR gRNA sequence
cttcctggatagccggccca

SEQ ID NO: 749817 - DNA, 20 bp, Artificial
  CRISPR gRNA sequence
gagaagctggtcatggaagg

SEQ ID NO: 749818 - DNA, 20 bp, Artificial
  CRISPR gRNA sequence
atcaggagaccaaaggcagc

SEQ ID NO: 749819 - DNA, 20 bp, Artificial
  CRISPR gRNA sequence
aggcagccagcgctttctcc

SEQ ID NO: 749820 - DNA, 20 bp, Artificial
  CRISPR gRNA sequence
acttacacagtgtcagacct

SEQ ID NO: 749821 - DNA, 20 bp, Artificial
  CRISPR gRNA sequence
tgaatttgctaactggtgtc

SEQ ID NO: 749822 - DNA, 20 bp, Artificial
  CRISPR gRNA sequence
agccatgacttactgggtgg

SEQ ID NO: 749823 - DNA, 20 bp, Artificial
  CRISPR gRNA sequence
tcccagccacttcactcact

SEQ ID NO: 749824 - DNA, 20 bp, Artificial
  CRISPR gRNA sequence
ctgcttctcatccaagttgc

SEQ ID NO: 749825 - DNA, 20 bp, Artificial
  CRISPR gRNA sequence
agcaccccatgtcctcccac

SEQ ID NO: 749826 - DNA, 20 bp, Artificial
  CRISPR gRNA sequence
catgtcctcccacagatgct

SEQ ID NO: 749827 - DNA, 20 bp, Artificial
  CRISPR gRNA sequence
cacagatgcttctcgtttta

SEQ ID NO: 749828 - DNA, 20 bp, Artificial
  CRISPR gRNA sequence
ctcgttttaaggagatttac

SEQ ID NO: 749829 - DNA, 20 bp, Artificial
  CRISPR gRNA sequence
aaatctattcaaaccatggc

SEQ ID NO: 749830 - DNA, 20 bp, Artificial
  CRISPR gRNA sequence
gcttacagccgactcatggg

SEQ ID NO: 749831 - DNA, 20 bp, Artificial
  CRISPR gRNA sequence
agcccccgagtgacccacta

SEQ ID NO: 749832 - DNA, 20 bp, Artificial
  CRISPR gRNA sequence
tggccagggtgggaggtgaa

SEQ ID NO: 749833 - DNA, 20 bp, Artificial
  CRISPR gRNA sequence
gttacttaacccctctgtgc

SEQ ID NO: 749834 - DNA, 20 bp, Artificial
  CRISPR gRNA sequence
aagagcatgcgttgaaagct

SEQ ID NO: 749835 - DNA, 20 bp, Artificial
  CRISPR gRNA sequence
aggatctctgagtggcagca

SEQ ID NO: 749836 - DNA, 20 bp, Artificial
  CRISPR gRNA sequence
ggcggttggaggctgcctgc

SEQ ID NO: 749837 - DNA, 20 bp, Artificial
  CRISPR gRNA sequence
gagcaggatgagggggaggc

SEQ ID NO: 749838 - DNA, 20 bp, Artificial
  CRISPR gRNA sequence
tcaaaagaagcctaagtgat

SEQ ID NO: 749839 - DNA, 20 bp, Artificial
  CRISPR gRNA sequence
gtaattaatgccaccaaact

SEQ ID NO: 749840 - DNA, 20 bp, Artificial
  CRISPR gRNA sequence
aatggcaaattttacattat

SEQ ID NO: 749841 - DNA, 20 bp, Artificial
  CRISPR gRNA sequence
gaaaaacgtgaatccttgta

SEQ ID NO: 749842 - DNA, 20 bp, Artificial
  CRISPR gRNA sequence
attaaactaccaaaaaaagt

SEQ ID NO: 749843 - DNA, 20 bp, Artificial
  CRISPR gRNA sequence
tgaagagatcatccctgtgt

SEQ ID NO: 749844 - DNA, 20 bp, Artificial
  CRISPR gRNA sequence
gcagacgcagcatcatatga

SEQ ID NO: 749845 - DNA, 20 bp, Artificial
  CRISPR gRNA sequence
acaatgcttttcccactgag

SEQ ID NO: 749846 - DNA, 20 bp, Artificial
  CRISPR gRNA sequence
tctctgtctcccctgcctca

SEQ ID NO: 749847 - DNA, 20 bp, Artificial
  CRISPR gRNA sequence
ctcccctgcctcattctgct

SEQ ID NO: 749848 - DNA, 20 bp, Artificial
  CRISPR gRNA sequence
cagtcccctgttggtagaca

SEQ ID NO: 749849 - DNA, 20 bp, Artificial
  CRISPR gRNA sequence
gccctccaaaaaggtgtaca

SEQ ID NO: 749850 - DNA, 20 bp, Artificial
  CRISPR gRNA sequence
tcgctgtcccaacagcatga

SEQ ID NO: 749851 - DNA, 20 bp, Artificial
  CRISPR gRNA sequence
tgtcccaacagcatgaggag

SEQ ID NO: 749852 - DNA, 20 bp, Artificial
  CRISPR gRNA sequence
tcagggcatctgctgactgc

SEQ ID NO: 749853 - DNA, 20 bp, Artificial
  CRISPR gRNA sequence
ctaaatgttgcctttccgct

SEQ ID NO: 749854 - DNA, 20 bp, Artificial
  CRISPR gRNA sequence
gctatttgtttgggaataaa

SEQ ID NO: 749855 - DNA, 20 bp, Artificial
  CRISPR gRNA sequence
tgtttgggaataaaggctgt

SEQ ID NO: 749856 - DNA, 20 bp, Artificial
  CRISPR gRNA sequence
tctacaatccgacagcgtaa

SEQ ID NO: 749857 - DNA, 20 bp, Artificial
  CRISPR gRNA sequence
acagcgtaaacaagctttca

SEQ ID NO: 749858 - DNA, 20 bp, Artificial
  CRISPR gRNA sequence
tcatactgcaaatgagaaca

SEQ ID NO: 749859 - DNA, 20 bp, Artificial
  CRISPR gRNA sequence
cggctagtaagcaacatttt

SEQ ID NO: 749860 - DNA, 20 bp, Artificial
  CRISPR gRNA sequence
tccctatctgcctttggagg

SEQ ID NO: 749861 - DNA, 20 bp, Artificial
  CRISPR gRNA sequence
gcctaacttctatccccagg

SEQ ID NO: 749862 - DNA, 20 bp, Artificial
  CRISPR gRNA sequence
ttaatttcactttgagagcc

SEQ ID NO: 749863 - DNA, 20 bp, Artificial
  CRISPR gRNA sequence
aggctggggcagaggggcgc

SEQ ID NO: 749864 - DNA, 20 bp, Artificial
  CRISPR gRNA sequence
ggggacaagtctgtggatcc

SEQ ID NO: 749865 - DNA, 20 bp, Artificial
  CRISPR gRNA sequence
tactcactcaccatccagag

SEQ ID NO: 749866 - DNA, 20 bp, Artificial
  CRISPR gRNA sequence
ggctgctgagggttgggctg

SEQ ID NO: 749867 - DNA, 20 bp, Artificial
  CRISPR gRNA sequence
atgttctaattttgctcttg

SEQ ID NO: 749868 - DNA, 20 bp, Artificial
  CRISPR gRNA sequence
attttgctcttggcctgttt

SEQ ID NO: 749869 - DNA, 20 bp, Artificial
  CRISPR gRNA sequence
aagtcactgtagcctttgag

SEQ ID NO: 749870 - DNA, 20 bp, Artificial
  CRISPR gRNA sequence
gagttgggttttgttgggtc

SEQ ID NO: 749871 - DNA, 20 bp, Artificial
  CRISPR gRNA sequence
gtggtttagctgatccccat

SEQ ID NO: 749872 - DNA, 20 bp, Artificial
  CRISPR gRNA sequence
gctatgctaccctgggctat

SEQ ID NO: 749873 - DNA, 20 bp, Artificial
  CRISPR gRNA sequence
cgagagtgcatctctaccaa

SEQ ID NO: 749874 - DNA, 20 bp, Artificial
  CRISPR gRNA sequence
atctctaccaaaagtgattt

SEQ ID NO: 749875 - DNA, 20 bp, Artificial
  CRISPR gRNA sequence
tgtctcagcctcccgagtag

SEQ ID NO: 749876 - DNA, 20 bp, Artificial
  CRISPR gRNA sequence
accatgccaggcaaattttg

SEQ ID NO: 749877 - DNA, 20 bp, Artificial
  CRISPR gRNA sequence
aacctctgactcccgggttc

SEQ ID NO: 749878 - DNA, 20 bp, Artificial
  CRISPR gRNA sequence
ccaccatgcctggctaattt

SEQ ID NO: 749879 - DNA, 20 bp, Artificial
  CRISPR gRNA sequence
ttttgtgtttttagtagaga

SEQ ID NO: 749880 - DNA, 20 bp, Artificial
  CRISPR gRNA sequence
tgccttgacctcctaaagtg

SEQ ID NO: 749881 - DNA, 20 bp, Artificial
  CRISPR gRNA sequence
caggaagatcacttgcatct

SEQ ID NO: 749882 - DNA, 20 bp, Artificial
  CRISPR gRNA sequence
atcacttgcatctggaagtt

SEQ ID NO: 749883 - DNA, 20 bp, Artificial
  CRISPR gRNA sequence
aagtttgaggcttcagtgag

SEQ ID NO: 749884 - DNA, 20 bp, Artificial
  CRISPR gRNA sequence
aggcagttagatcatttgtc

SEQ ID NO: 749885 - DNA, 20 bp, Artificial
  CRISPR gRNA sequence
tcgggaggctgaggcagaag

SEQ ID NO: 749886 - DNA, 20 bp, Artificial
  CRISPR gRNA sequence
gcctgggtaacagagtgaaa

SEQ ID NO: 749887 - DNA, 20 bp, Artificial
  CRISPR gRNA sequence
cacagaacacagaaatctga

SEQ ID NO: 749888 - DNA, 20 bp, Artificial
  CRISPR gRNA sequence
ccagagcagatggaaggaga

SEQ ID NO: 749889 - DNA, 20 bp, Artificial
  CRISPR gRNA sequence
atggaaggagagtgggcttc

SEQ ID NO: 749890 - DNA, 20 bp, Artificial
  CRISPR gRNA sequence
gaggaggaccggggggttct

SEQ ID NO: 749891 - DNA, 20 bp, Artificial
  CRISPR gRNA sequence
tgtcaggcccaggaggccag

SEQ ID NO: 749892 - DNA, 20 bp, Artificial
  CRISPR gRNA sequence
gctgttgtagggggagtcac

SEQ ID NO: 749893 - DNA, 20 bp, Artificial
  CRISPR gRNA sequence
ggcaggttggggagcaggaa

SEQ ID NO: 749894 - DNA, 20 bp, Artificial
  CRISPR gRNA sequence
tctttggacttggtgcatag

SEQ ID NO: 749895 - DNA, 20 bp, Artificial
  CRISPR gRNA sequence
aaacttagaaaactgtctag

SEQ ID NO: 749896 - DNA, 20 bp, Artificial
  CRISPR gRNA sequence
tagaaaactgtctagttctg

SEQ ID NO: 749897 - DNA, 20 bp, Artificial
  CRISPR gRNA sequence
ttgggttgaccctcaaaacc

SEQ ID NO: 749898 - DNA, 20 bp, Artificial
  CRISPR gRNA sequence
aacagaatattggatagagg

SEQ ID NO: 749899 - DNA, 20 bp, Artificial
  CRISPR gRNA sequence
ttctatctaactgtatgagc

SEQ ID NO: 749900 - DNA, 20 bp, Artificial
  CRISPR gRNA sequence
ggtgttatttttatttattt

SEQ ID NO: 749901 - DNA, 20 bp, Artificial
  CRISPR gRNA sequence
gcccaggctgaccttgaact

SEQ ID NO: 749902 - DNA, 20 bp, Artificial
  CRISPR gRNA sequence
tgccttggcctctcaaagtc

SEQ ID NO: 749903 - DNA, 20 bp, Artificial
  CRISPR gRNA sequence
ccaggagggaggcagcctgg

SEQ ID NO: 749904 - DNA, 20 bp, Artificial
  CRISPR gRNA sequence
agccccgactcctcactcac

SEQ ID NO: 749905 - DNA, 20 bp, Artificial
  CRISPR gRNA sequence
gtaagtgccatgcgagtagt

SEQ ID NO: 749906 - DNA, 20 bp, Artificial
  CRISPR gRNA sequence
aagcacagtgggatggagaa

SEQ ID NO: 749907 - DNA, 20 bp, Artificial
  CRISPR gRNA sequence
caacttgtgatccgatcctg

SEQ ID NO: 749908 - DNA, 20 bp, Artificial
  CRISPR gRNA sequence
gtgatccgatcctggggcgc

SEQ ID NO: 749909 - DNA, 20 bp, Artificial
  CRISPR gRNA sequence
aaacggcatgtctgcaagag

SEQ ID NO: 749910 - DNA, 20 bp, Artificial
  CRISPR gRNA sequence
agagagccaagtctgggagc

SEQ ID NO: 749911 - DNA, 20 bp, Artificial
  CRISPR gRNA sequence
ggagtcattgtcagggtgag

SEQ ID NO: 749912 - DNA, 20 bp, Artificial
  CRISPR gRNA sequence
catgtgttgtgcactacgct

SEQ ID NO: 749913 - DNA, 20 bp, Artificial
  CRISPR gRNA sequence
tatctaacaatgccataagg

SEQ ID NO: 749914 - DNA, 20 bp, Artificial
  CRISPR gRNA sequence
aaatcagaagataatgctaa

SEQ ID NO: 749915 - DNA, 20 bp, Artificial
  CRISPR gRNA sequence
actgtcagctggggctcagt

SEQ ID NO: 749916 - DNA, 20 bp, Artificial
  CRISPR gRNA sequence
ctccctaataattccacctg

SEQ ID NO: 749917 - DNA, 20 bp, Artificial
  CRISPR gRNA sequence
ggcctgcttcactctctcac

SEQ ID NO: 749918 - DNA, 20 bp, Artificial
  CRISPR gRNA sequence
tttcttggtcctgtggacat

SEQ ID NO: 749919 - DNA, 20 bp, Artificial
  CRISPR gRNA sequence
ttgagtttgtgatgaatgag

SEQ ID NO: 749920 - DNA, 20 bp, Artificial
  CRISPR gRNA sequence
tcagtggaaaaggagcccca

SEQ ID NO: 749921 - DNA, 20 bp, Artificial
  CRISPR gRNA sequence
ccaggaagcttggctgtgcc

SEQ ID NO: 749922 - DNA, 20 bp, Artificial
  CRISPR gRNA sequence
caggtcccaccagcacctct

SEQ ID NO: 749923 - DNA, 20 bp, Artificial
  CRISPR gRNA sequence
ggctgggagctgaattcagc

SEQ ID NO: 749924 - DNA, 20 bp, Artificial
  CRISPR gRNA sequence
aagcaatggggttaatgacc

SEQ ID NO: 749925 - DNA, 20 bp, Artificial
  CRISPR gRNA sequence
ccttttagaaaaaagctgtc

SEQ ID NO: 749926 - DNA, 20 bp, Artificial
  CRISPR gRNA sequence
gaaaaaagctgtcttaggat

SEQ ID NO: 749927 - DNA, 20 bp, Artificial
  CRISPR gRNA sequence
ttggggagcaggggaggatg

SEQ ID NO: 749928 - DNA, 20 bp, Artificial
  CRISPR gRNA sequence
aggacaaaccaagggtccac

SEQ ID NO: 749929 - DNA, 20 bp, Artificial
  CRISPR gRNA sequence
acaattctttggcgagagga

SEQ ID NO: 749930 - DNA, 20 bp, Artificial
  CRISPR gRNA sequence
ctgagtctcaggagtaaaac

SEQ ID NO: 749931 - DNA, 20 bp, Artificial
  CRISPR gRNA sequence
tctcaggagtaaaactctcg

SEQ ID NO: 749932 - DNA, 20 bp, Artificial
  CRISPR gRNA sequence
gatcccacccttctctgagc

SEQ ID NO: 749933 - DNA, 20 bp, Artificial
  CRISPR gRNA sequence
cacagtgctgtgtgactgag

SEQ ID NO: 749934 - DNA, 20 bp, Artificial
  CRISPR gRNA sequence
acttgggcctggacctgtgc

SEQ ID NO: 749935 - DNA, 20 bp, Artificial
  CRISPR gRNA sequence
tttctagctgtggcaccctc

SEQ ID NO: 749936 - DNA, 20 bp, Artificial
  CRISPR gRNA sequence
tgttggcatcttctcagaat

SEQ ID NO: 749937 - DNA, 20 bp, Artificial
  CRISPR gRNA sequence
tgtatttttcatgacagggc

SEQ ID NO: 749938 - DNA, 20 bp, Artificial
  CRISPR gRNA sequence
ctagcctttggaggtgggac

SEQ ID NO: 749939 - DNA, 20 bp, Artificial
  CRISPR gRNA sequence
tgaagccagcaagtctgccc

SEQ ID NO: 749940 - DNA, 20 bp, Artificial
  CRISPR gRNA sequence
gaggacaaagggcatctcag

SEQ ID NO: 749941 - DNA, 20 bp, Artificial
  CRISPR gRNA sequence
ggccagaggtcccggcccgt

SEQ ID NO: 749942 - DNA, 20 bp, Artificial
  CRISPR gRNA sequence
ccggctccagccagccaccc

SEQ ID NO: 749943 - DNA, 20 bp, Artificial
  CRISPR gRNA sequence
tctgtgccaggcatcattct

SEQ ID NO: 749944 - DNA, 20 bp, Artificial
  CRISPR gRNA sequence
tgccaggcatcattctaagt

SEQ ID NO: 749945 - DNA, 20 bp, Artificial
  CRISPR gRNA sequence
aggcatcattctaagtgctt

SEQ ID NO: 749946 - DNA, 20 bp, Artificial
  CRISPR gRNA sequence
tctaagtgcttgtttgtttg

SEQ ID NO: 749947 - DNA, 20 bp, Artificial
  CRISPR gRNA sequence
gttgctgttgttgttgttgt

SEQ ID NO: 749948 - DNA, 20 bp, Artificial
  CRISPR gRNA sequence
ttttgtatttttagtagaga

SEQ ID NO: 749949 - DNA, 20 bp, Artificial
  CRISPR gRNA sequence
cgcctcgtcctccccaagtg

SEQ ID NO: 749950 - DNA, 20 bp, Artificial
  CRISPR gRNA sequence
aggagtgagccactgtgcct

SEQ ID NO: 749951 - DNA, 20 bp, Artificial
  CRISPR gRNA sequence
ccactgtgcctggccgtttg

SEQ ID NO: 749952 - DNA, 20 bp, Artificial
  CRISPR gRNA sequence
tatgttgtccaggctggtcc

SEQ ID NO: 749953 - DNA, 20 bp, Artificial
  CRISPR gRNA sequence
tggtcccctggcttgaaact

SEQ ID NO: 749954 - DNA, 20 bp, Artificial
  CRISPR gRNA sequence
cacctcagcctcccaaagtg

SEQ ID NO: 749955 - DNA, 20 bp, Artificial
  CRISPR gRNA sequence
cctcattctaaacactttta

SEQ ID NO: 749956 - DNA, 20 bp, Artificial
  CRISPR gRNA sequence
ttctaaacacttttacatag

SEQ ID NO: 749957 - DNA, 20 bp, Artificial
  CRISPR gRNA sequence
gatgagaaaacggaagcaca

SEQ ID NO: 749958 - DNA, 20 bp, Artificial
  CRISPR gRNA sequence
aatgtcatgaccaatgaaag

SEQ ID NO: 749959 - DNA, 20 bp, Artificial
  CRISPR gRNA sequence
ttgcctggccacgtctacca

SEQ ID NO: 749960 - DNA, 20 bp, Artificial
  CRISPR gRNA sequence
gtctaccacatagttttact

SEQ ID NO: 749961 - DNA, 20 bp, Artificial
  CRISPR gRNA sequence
tccctttacaattatttcag

SEQ ID NO: 749962 - DNA, 20 bp, Artificial
  CRISPR gRNA sequence
gattacatcaaagagaaagt

SEQ ID NO: 749963 - DNA, 20 bp, Artificial
  CRISPR gRNA sequence
aattttttgcaagggaaagc

SEQ ID NO: 749964 - DNA, 20 bp, Artificial
  CRISPR gRNA sequence
gactccgagccttcccaggc

SEQ ID NO: 749965 - DNA, 20 bp, Artificial
  CRISPR gRNA sequence
actagaattcaataccctta

SEQ ID NO: 749966 - DNA, 20 bp, Artificial
  CRISPR gRNA sequence
gttttcctgttacgttcttt

SEQ ID NO: 749967 - DNA, 20 bp, Artificial
  CRISPR gRNA sequence
ttctatttatgacaagtgat

SEQ ID NO: 749968 - DNA, 20 bp, Artificial
  CRISPR gRNA sequence
ttccactaatgacagcgata

SEQ ID NO: 749969 - DNA, 20 bp, Artificial
  CRISPR gRNA sequence
catactcaaataaaagaatg

SEQ ID NO: 749970 - DNA, 20 bp, Artificial
  CRISPR gRNA sequence
tgcacagacaaaggggaagt

SEQ ID NO: 749971 - DNA, 20 bp, Artificial
  CRISPR gRNA sequence
tgatgagtgaacagcagagg

SEQ ID NO: 749972 - DNA, 20 bp, Artificial
  CRISPR gRNA sequence
tacgcagaaaggctaaagga

SEQ ID NO: 749973 - DNA, 20 bp, Artificial
  CRISPR gRNA sequence
cagaaaggctaaaggaatgg

SEQ ID NO: 749974 - DNA, 20 bp, Artificial
  CRISPR gRNA sequence
aggctaaaggaatgggcttg

SEQ ID NO: 749975 - DNA, 20 bp, Artificial
  CRISPR gRNA sequence
agtagcagagcaacctcatt

SEQ ID NO: 749976 - DNA, 20 bp, Artificial
  CRISPR gRNA sequence
caagataagcaaacccaggg

SEQ ID NO: 749977 - DNA, 20 bp, Artificial
  CRISPR gRNA sequence
gcccatgcacccttcatact

SEQ ID NO: 749978 - DNA, 20 bp, Artificial
  CRISPR gRNA sequence
attaggccctgtagagagca

SEQ ID NO: 749979 - DNA, 20 bp, Artificial
  CRISPR gRNA sequence
cagagcagtaaatggccatc

SEQ ID NO: 749980 - DNA, 20 bp, Artificial
  CRISPR gRNA sequence
gaagccctggcatgcatgtc

SEQ ID NO: 749981 - DNA, 20 bp, Artificial
  CRISPR gRNA sequence
gttggctaaagcctggggcc

SEQ ID NO: 749982 - DNA, 20 bp, Artificial
  CRISPR gRNA sequence
agaccccagcggaacctttg

SEQ ID NO: 749983 - DNA, 20 bp, Artificial
  CRISPR gRNA sequence
agagcctctgggcagtgggt

SEQ ID NO: 749984 - DNA, 20 bp, Artificial
  CRISPR gRNA sequence
gagctgaccattgctgcgtc

SEQ ID NO: 749985 - DNA, 20 bp, Artificial
  CRISPR gRNA sequence
tactcaacaaggccctgcag

SEQ ID NO: 749986 - DNA, 20 bp, Artificial
  CRISPR gRNA sequence
gcccaggaaaggggtatctt

SEQ ID NO: 749987 - DNA, 20 bp, Artificial
  CRISPR gRNA sequence
aggggtatctttggtgtttc

SEQ ID NO: 749988 - DNA, 20 bp, Artificial
  CRISPR gRNA sequence
tatctcactttccctggcat

SEQ ID NO: 749989 - DNA, 20 bp, Artificial
  CRISPR gRNA sequence
ctgaggtcccagagcaattc

SEQ ID NO: 749990 - DNA, 20 bp, Artificial
  CRISPR gRNA sequence
gatgaccctttagtatacca

SEQ ID NO: 749991 - DNA, 20 bp, Artificial
  CRISPR gRNA sequence
cctgtgccctggatctctag

SEQ ID NO: 749992 - DNA, 20 bp, Artificial
  CRISPR gRNA sequence
tggcccatgacaggtgggat

SEQ ID NO: 749993 - DNA, 20 bp, Artificial
  CRISPR gRNA sequence
accttgagaagcatccaccc

SEQ ID NO: 749994 - DNA, 20 bp, Artificial
  CRISPR gRNA sequence
ctttccctgggccctcccta

SEQ ID NO: 749995 - DNA, 20 bp, Artificial
  CRISPR gRNA sequence
tggactttggaaggggaaaa

SEQ ID NO: 749996 - DNA, 20 bp, Artificial
  CRISPR gRNA sequence
ggaaaatggtgcttccctgt

SEQ ID NO: 749997 - DNA, 20 bp, Artificial
  CRISPR gRNA sequence
gtgcttccctgtgtgggctt

SEQ ID NO: 749998 - DNA, 20 bp, Artificial
  CRISPR gRNA sequence
gtgcccaccaaggctcagcc

SEQ ID NO: 749999 - DNA, 20 bp, Artificial
  CRISPR gRNA sequence
actccagtctgctgtcttct

SEQ ID NO: 750000 - DNA, 20 bp, Artificial
  CRISPR gRNA sequence
ctctccgagggccgcgtggg

SEQ ID NO: 750001 - DNA, 20 bp, Artificial
  CRISPR gRNA sequence
ctcgctcgcactcagtcgcg

SEQ ID NO: 750002 - DNA, 20 bp, Artificial
  CRISPR gRNA sequence
cccagagaacccagggcaca

SEQ ID NO: 750003 - DNA, 20 bp, Artificial
  CRISPR gRNA sequence
agtgtgttctggtggatatc

SEQ ID NO: 750004 - DNA, 20 bp, Artificial
  CRISPR gRNA sequence
tggcccaggaataagtggtc

SEQ ID NO: 750005 - DNA, 20 bp, Artificial
  CRISPR gRNA sequence
aattacggcatctctctggc

SEQ ID NO: 750006 - DNA, 20 bp, Artificial
  CRISPR gRNA sequence
agggaggcaggagggaggtg

SEQ ID NO: 750007 - DNA, 20 bp, Artificial
  CRISPR gRNA sequence
gctgccctaagccccagggt

SEQ ID NO: 750008 - DNA, 20 bp, Artificial
  CRISPR gRNA sequence
ggccatggctcatggcaggg

SEQ ID NO: 750009 - DNA, 20 bp, Artificial
  CRISPR gRNA sequence
tggtggccctgtgagaccct

SEQ ID NO: 750010 - DNA, 20 bp, Artificial
  CRISPR gRNA sequence
agagatccagggcacaggga

SEQ ID NO: 750011 - DNA, 20 bp, Artificial
  CRISPR gRNA sequence
gctcaggacgccttccccta

SEQ ID NO: 750012 - DNA, 20 bp, Artificial
  CRISPR gRNA sequence
ttcctgggcccagcacaggg

SEQ ID NO: 750013 - DNA, 20 bp, Artificial
  CRISPR gRNA sequence
gggagatgatttaggctggc

SEQ ID NO: 750014 - DNA, 20 bp, Artificial
  CRISPR gRNA sequence
atttgaattgctctgggacc

SEQ ID NO: 750015 - DNA, 20 bp, Artificial
  CRISPR gRNA sequence
tcagcaggatctgtaagttg

SEQ ID NO: 750016 - DNA, 20 bp, Artificial
  CRISPR gRNA sequence
tgctgagctgtactagttgt

SEQ ID NO: 750017 - DNA, 20 bp, Artificial
  CRISPR gRNA sequence
cacataccaaacttgaggcc

SEQ ID NO: 750018 - DNA, 20 bp, Artificial
  CRISPR gRNA sequence
ggtgggccagggatcagcac

SEQ ID NO: 750019 - DNA, 20 bp, Artificial
  CRISPR gRNA sequence
aaagccagggacatgcatgc

SEQ ID NO: 750020 - DNA, 20 bp, Artificial
  CRISPR gRNA sequence
gccagggcttccgtacagcc

SEQ ID NO: 750021 - DNA, 20 bp, Artificial
  CRISPR gRNA sequence
tacagccccttgcttaactc

SEQ ID NO: 750022 - DNA, 20 bp, Artificial
  CRISPR gRNA sequence
gctttgtgagtcactcagac

SEQ ID NO: 750023 - DNA, 20 bp, Artificial
  CRISPR gRNA sequence
tgtgtaatattatggtattt

SEQ ID NO: 750024 - DNA, 20 bp, Artificial
  CRISPR gRNA sequence
gcttctgcaggccacatgcc

SEQ ID NO: 750025 - DNA, 20 bp, Artificial
  CRISPR gRNA sequence
tgccattggctttctatcta

SEQ ID NO: 750026 - DNA, 20 bp, Artificial
  CRISPR gRNA sequence
cagggcctgggaaggcattg

SEQ ID NO: 750027 - DNA, 20 bp, Artificial
  CRISPR gRNA sequence
cattggtgagcttcactggg

SEQ ID NO: 750028 - DNA, 20 bp, Artificial
  CRISPR gRNA sequence
acttgaaggcaagcctggcc

SEQ ID NO: 750029 - DNA, 20 bp, Artificial
  CRISPR gRNA sequence
gaaggcaagcctggccctgg

SEQ ID NO: 750030 - DNA, 20 bp, Artificial
  CRISPR gRNA sequence
tctgaaggttaattccatga

SEQ ID NO: 750031 - DNA, 20 bp, Artificial
  CRISPR gRNA sequence
taattccatgatggtgtttc

SEQ ID NO: 750032 - DNA, 20 bp, Artificial
  CRISPR gRNA sequence
gtgtttccctagcttcagtc

SEQ ID NO: 750033 - DNA, 20 bp, Artificial
  CRISPR gRNA sequence
aaggctcggagtctgaaaac

SEQ ID NO: 750034 - DNA, 20 bp, Artificial
  CRISPR gRNA sequence
aaataaaatttaaaaagaaa

SEQ ID NO: 750035 - DNA, 20 bp, Artificial
  CRISPR gRNA sequence
aaaaagaaaaggagattagc

SEQ ID NO: 750036 - DNA, 20 bp, Artificial
  CRISPR gRNA sequence
aagggaataacctcttctat

SEQ ID NO: 750037 - DNA, 20 bp, Artificial
  CRISPR gRNA sequence
ggtagacgtggccaggcaag

SEQ ID NO: 750038 - DNA, 20 bp, Artificial
  CRISPR gRNA sequence
tgggcaagatactaatctct

SEQ ID NO: 750039 - DNA, 20 bp, Artificial
  CRISPR gRNA sequence
agatactaatctctctgtgc

SEQ ID NO: 750040 - DNA, 20 bp, Artificial
  CRISPR gRNA sequence
agtacctacctcatagggtg

SEQ ID NO: 750041 - DNA, 20 bp, Artificial
  CRISPR gRNA sequence
acataaactaatctatgtaa

SEQ ID NO: 750042 - DNA, 20 bp, Artificial
  CRISPR gRNA sequence
tgggaggatctcttgaagcc

SEQ ID NO: 750043 - DNA, 20 bp, Artificial
  CRISPR gRNA sequence
tcgggaggctgaggcaggag

SEQ ID NO: 750044 - DNA, 20 bp, Artificial
  CRISPR gRNA sequence
gaggcggaggttgcagtgag

SEQ ID NO: 750045 - DNA, 20 bp, Artificial
  CRISPR gRNA sequence
agctccagccccggatgcac

SEQ ID NO: 750046 - DNA, 20 bp, Artificial
  CRISPR gRNA sequence
ctttcccaaggtgctggaag

SEQ ID NO: 750047 - DNA, 20 bp, Artificial
  CRISPR gRNA sequence
tgccgcttccttcaatagag

SEQ ID NO: 750048 - DNA, 20 bp, Artificial
  CRISPR gRNA sequence
gaaagccccagggcagactt

SEQ ID NO: 750049 - DNA, 20 bp, Artificial
  CRISPR gRNA sequence
ggccctgagcctatgccttg

SEQ ID NO: 750050 - DNA, 20 bp, Artificial
  CRISPR gRNA sequence
cttagccttggcagccccag

SEQ ID NO: 750051 - DNA, 20 bp, Artificial
  CRISPR gRNA sequence
cagtcctgattgatccatgc

SEQ ID NO: 750052 - DNA, 20 bp, Artificial
  CRISPR gRNA sequence
agccacagcaggcaattaat

SEQ ID NO: 750053 - DNA, 20 bp, Artificial
  CRISPR gRNA sequence
ctagcagctggtcagagttc

SEQ ID NO: 750054 - DNA, 20 bp, Artificial
  CRISPR gRNA sequence
tcagagttcagctgtttggg

SEQ ID NO: 750055 - DNA, 20 bp, Artificial
  CRISPR gRNA sequence
ggcttcctaggcccgactaa

SEQ ID NO: 750056 - DNA, 20 bp, Artificial
  CRISPR gRNA sequence
atatttgtggaatgaaagaa

SEQ ID NO: 750057 - DNA, 20 bp, Artificial
  CRISPR gRNA sequence
tggaatgaaagaatgatgtt

SEQ ID NO: 750058 - DNA, 20 bp, Artificial
  CRISPR gRNA sequence
tgggcaagtcacttctctga

SEQ ID NO: 750059 - DNA, 20 bp, Artificial
  CRISPR gRNA sequence
acagctcttccctcctgccc

SEQ ID NO: 750060 - DNA, 20 bp, Artificial
  CRISPR gRNA sequence
caggacgttgcaatccaagc

SEQ ID NO: 750061 - DNA, 20 bp, Artificial
  CRISPR gRNA sequence
gagagttttactcctgagac

SEQ ID NO: 750062 - DNA, 20 bp, Artificial
  CRISPR gRNA sequence
ccgggtcattttcctgtccc

SEQ ID NO: 750063 - DNA, 20 bp, Artificial
  CRISPR gRNA sequence
cttttggccaccctggagcc

SEQ ID NO: 750064 - DNA, 20 bp, Artificial
  CRISPR gRNA sequence
ttgtaattttagccgggctg

SEQ ID NO: 750065 - DNA, 20 bp, Artificial
  CRISPR gRNA sequence
agtctcagacacagtaaatg

SEQ ID NO: 750066 - DNA, 20 bp, Artificial
  CRISPR gRNA sequence
aggacaaacccctgtggacc

SEQ ID NO: 750067 - DNA, 20 bp, Artificial
  CRISPR gRNA sequence
cccttggtttgtcctgtccc

SEQ ID NO: 750068 - DNA, 20 bp, Artificial
  CRISPR gRNA sequence
gaccctctcctgtctggccc

SEQ ID NO: 750069 - DNA, 20 bp, Artificial
  CRISPR gRNA sequence
tccccaaacttgaatcctaa

SEQ ID NO: 750070 - DNA, 20 bp, Artificial
  CRISPR gRNA sequence
tgtgaggggtggggaggtgt

SEQ ID NO: 750071 - DNA, 20 bp, Artificial
  CRISPR gRNA sequence
cctctcccgtactccctgaa

SEQ ID NO: 750072 - DNA, 20 bp, Artificial
  CRISPR gRNA sequence
aatcctggggtcattaaccc

SEQ ID NO: 750073 - DNA, 20 bp, Artificial
  CRISPR gRNA sequence
gggcccccaaccccacccag

SEQ ID NO: 750074 - DNA, 20 bp, Artificial
  CRISPR gRNA sequence
acccagctcagctttgcgca

SEQ ID NO: 750075 - DNA, 20 bp, Artificial
  CRISPR gRNA sequence
cagcacagggcccccttggg

SEQ ID NO: 750076 - DNA, 20 bp, Artificial
  CRISPR gRNA sequence
cagggcccccttggggcagg

SEQ ID NO: 750077 - DNA, 20 bp, Artificial
  CRISPR gRNA sequence
tttccctaggtcctcctcac

SEQ ID NO: 750078 - DNA, 20 bp, Artificial
  CRISPR gRNA sequence
cttctgtttcccggcagagc

SEQ ID NO: 750079 - DNA, 20 bp, Artificial
  CRISPR gRNA sequence
ggacaaaaccaggggcacag

SEQ ID NO: 750080 - DNA, 20 bp, Artificial
  CRISPR gRNA sequence
gttggctagtccctgcactg

SEQ ID NO: 750081 - DNA, 20 bp, Artificial
  CRISPR gRNA sequence
ctcctctcttgagtctgtgg

SEQ ID NO: 750082 - DNA, 20 bp, Artificial
  CRISPR gRNA sequence
tgggtcagatttgtagcata

SEQ ID NO: 750083 - DNA, 20 bp, Artificial
  CRISPR gRNA sequence
gacagttgccctgtgggaaa

SEQ ID NO: 750084 - DNA, 20 bp, Artificial
  CRISPR gRNA sequence
aaagctggtttagcattatc

SEQ ID NO: 750085 - DNA, 20 bp, Artificial
  CRISPR gRNA sequence
cagaattttcatgtcaaatt

SEQ ID NO: 750086 - DNA, 20 bp, Artificial
  CRISPR gRNA sequence
ttgccatctcaagaaaatta

SEQ ID NO: 750087 - DNA, 20 bp, Artificial
  CRISPR gRNA sequence
ctggatgtggcctgtgggct

SEQ ID NO: 750088 - DNA, 20 bp, Artificial
  CRISPR gRNA sequence
tcagtatagtgtctatgtgt

SEQ ID NO: 750089 - DNA, 20 bp, Artificial
  CRISPR gRNA sequence
agtttaattctagctctagc

SEQ ID NO: 750090 - DNA, 20 bp, Artificial
  CRISPR gRNA sequence
gttacgtaagttctctgtgc

SEQ ID NO: 750091 - DNA, 20 bp, Artificial
  CRISPR gRNA sequence
tacctgaagtcccccatgct

SEQ ID NO: 750092 - DNA, 20 bp, Artificial
  CRISPR gRNA sequence
cactttccctttctgggtct

SEQ ID NO: 750093 - DNA, 20 bp, Artificial
  CRISPR gRNA sequence
aaactccactcttgcagaca

SEQ ID NO: 750094 - DNA, 20 bp, Artificial
  CRISPR gRNA sequence
actcttgcagacatgccgtt

SEQ ID NO: 750095 - DNA, 20 bp, Artificial
  CRISPR gRNA sequence
ttagcaggaaagactttaaa

SEQ ID NO: 750096 - DNA, 20 bp, Artificial
  CRISPR gRNA sequence
aagctggcttctccatccca

SEQ ID NO: 750097 - DNA, 20 bp, Artificial
  CRISPR gRNA sequence
ttgcctcaactctgccaggg

SEQ ID NO: 750098 - DNA, 20 bp, Artificial
  CRISPR gRNA sequence
ctgcctccctcctggctggg

SEQ ID NO: 750099 - DNA, 20 bp, Artificial
  CRISPR gRNA sequence
tggggcaatgaaaaggatgt

SEQ ID NO: 750100 - DNA, 20 bp, Artificial
  CRISPR gRNA sequence
caatgaaaaggatgtatcag

SEQ ID NO: 750101 - DNA, 20 bp, Artificial
  CRISPR gRNA sequence
ttgagaggccaaggcaggag

SEQ ID NO: 750102 - DNA, 20 bp, Artificial
  CRISPR gRNA sequence
tgcaaccctgcattgtagcc

SEQ ID NO: 750103 - DNA, 20 bp, Artificial
  CRISPR gRNA sequence
aacgcggcctctatccaata

SEQ ID NO: 750104 - DNA, 20 bp, Artificial
  CRISPR gRNA sequence
atattctgttttcaaaagct

SEQ ID NO: 750105 - DNA, 20 bp, Artificial
  CRISPR gRNA sequence
ggtcaacccaattaaatgct

SEQ ID NO: 750106 - DNA, 20 bp, Artificial
  CRISPR gRNA sequence
taaggcaaagtggaccaggg

SEQ ID NO: 750107 - DNA, 20 bp, Artificial
  CRISPR gRNA sequence
gtggaccagggaattgcttc

SEQ ID NO: 750108 - DNA, 20 bp, Artificial
  CRISPR gRNA sequence
aaaaaaaccaaacagaacta

SEQ ID NO: 750109 - DNA, 20 bp, Artificial
  CRISPR gRNA sequence
aaacagaactagacagtttt

SEQ ID NO: 750110 - DNA, 20 bp, Artificial
  CRISPR gRNA sequence
ctgtcccggtccctcagaca

SEQ ID NO: 750111 - DNA, 20 bp, Artificial
  CRISPR gRNA sequence
gtccctgactgtccccagaa

SEQ ID NO: 750112 - DNA, 20 bp, Artificial
  CRISPR gRNA sequence
caagtgccctgagggctggc

SEQ ID NO: 750113 - DNA, 20 bp, Artificial
  CRISPR gRNA sequence
cccaacctgcctcccaccca

SEQ ID NO: 750114 - DNA, 20 bp, Artificial
  CRISPR gRNA sequence
ccaggagcacccctagttgg

SEQ ID NO: 750115 - DNA, 20 bp, Artificial
  CRISPR gRNA sequence
tacaacagcctaggatggag

SEQ ID NO: 750116 - DNA, 20 bp, Artificial
  CRISPR gRNA sequence
tggtcaagggtgtgtggagt

SEQ ID NO: 750117 - DNA, 20 bp, Artificial
  CRISPR gRNA sequence
gtgggtataggcatcagtgg

SEQ ID NO: 750118 - DNA, 20 bp, Artificial
  CRISPR gRNA sequence
tgacacccacctaatggccc

SEQ ID NO: 750119 - DNA, 20 bp, Artificial
  CRISPR gRNA sequence
cctcttgccccttttgggtt

SEQ ID NO: 750120 - DNA, 20 bp, Artificial
  CRISPR gRNA sequence
gtcctcatcctgcacccaga

SEQ ID NO: 750121 - DNA, 20 bp, Artificial
  CRISPR gRNA sequence
tttctgctgctgcacatccc

SEQ ID NO: 750122 - DNA, 20 bp, Artificial
  CRISPR gRNA sequence
cgccctgcccaccagccccc

SEQ ID NO: 750123 - DNA, 20 bp, Artificial
  CRISPR gRNA sequence
ttggcctagaattaaactac

SEQ ID NO: 750124 - DNA, 20 bp, Artificial
  CRISPR gRNA sequence
ctacttcagatttctgtgtt

SEQ ID NO: 750125 - DNA, 20 bp, Artificial
  CRISPR gRNA sequence
tgtgtgtatattttctgaaa

SEQ ID NO: 750126 - DNA, 20 bp, Artificial
  CRISPR gRNA sequence
gctcactgcaacctccgcct

SEQ ID NO: 750127 - DNA, 20 bp, Artificial
  CRISPR gRNA sequence
aacctccgcctcccggattc

SEQ ID NO: 750128 - DNA, 20 bp, Artificial
  CRISPR gRNA sequence
cagcctcccgagtagctagg

SEQ ID NO: 750129 - DNA, 20 bp, Artificial
  CRISPR gRNA sequence
ttttgtatttttagtggagc

SEQ ID NO: 750130 - DNA, 20 bp, Artificial
  CRISPR gRNA sequence
tgcctcggcctcccaaagtg

SEQ ID NO: 750131 - DNA, 20 bp, Artificial
  CRISPR gRNA sequence
cttccagatgcaagtgatct

SEQ ID NO: 750132 - DNA, 20 bp, Artificial
  CRISPR gRNA sequence
ttaggaggtcaaggcaggca

SEQ ID NO: 750133 - DNA, 20 bp, Artificial
  CRISPR gRNA sequence
tcaagaggctgaggcaagag

SEQ ID NO: 750134 - DNA, 20 bp, Artificial
  CRISPR gRNA sequence
tcgggaggctgagacatgag

SEQ ID NO: 750135 - DNA, 20 bp, Artificial
  CRISPR gRNA sequence
ccaccttgacctccaaagtg

SEQ ID NO: 750136 - DNA, 20 bp, Artificial
  CRISPR gRNA sequence
tagctgggatctggctgcag

SEQ ID NO: 750137 - DNA, 20 bp, Artificial
  CRISPR gRNA sequence
ctctgcatactcaccttctt

SEQ ID NO: 750138 - DNA, 20 bp, Artificial
  CRISPR gRNA sequence
gtgggtagcagttagccccc

SEQ ID NO: 750139 - DNA, 20 bp, Artificial
  CRISPR gRNA sequence
gaggttgggtgagaataccc

SEQ ID NO: 750140 - DNA, 20 bp, Artificial
  CRISPR gRNA sequence
tccctcttctgagaagaggt

SEQ ID NO: 750141 - DNA, 20 bp, Artificial
  CRISPR gRNA sequence
cgccttggctccccaaagtg

SEQ ID NO: 750142 - DNA, 20 bp, Artificial
  CRISPR gRNA sequence
ctccccaaagtgctgggatt

SEQ ID NO: 750143 - DNA, 20 bp, Artificial
  CRISPR gRNA sequence
ttatccttgggaagtaagag

SEQ ID NO: 750144 - DNA, 20 bp, Artificial
  CRISPR gRNA sequence
ctcctgcattgctgaggggc

SEQ ID NO: 750145 - DNA, 20 bp, Artificial
  CRISPR gRNA sequence
ccagcgcagcagaatgtgct

SEQ ID NO: 750146 - DNA, 20 bp, Artificial
  CRISPR gRNA sequence
gaatgtgctgtctgctttca

SEQ ID NO: 750147 - DNA, 20 bp, Artificial
  CRISPR gRNA sequence
agtgccagcccaggcactgg

SEQ ID NO: 750148 - DNA, 20 bp, Artificial
  CRISPR gRNA sequence
ctgagctctgcagagatgcc

SEQ ID NO: 750149 - DNA, 20 bp, Artificial
  CRISPR gRNA sequence
acctggcaaagctcacaaaa

SEQ ID NO: 750150 - DNA, 20 bp, Artificial
  CRISPR gRNA sequence
ttactagccgtccagaggag

SEQ ID NO: 750151 - DNA, 20 bp, Artificial
  CRISPR gRNA sequence
ctgctttgatcactagaaga

SEQ ID NO: 750152 - DNA, 20 bp, Artificial
  CRISPR gRNA sequence
ctagaagagagtgctttgca

SEQ ID NO: 750153 - DNA, 20 bp, Artificial
  CRISPR gRNA sequence
ccacaataaggtcctttgat

SEQ ID NO: 750154 - DNA, 20 bp, Artificial
  CRISPR gRNA sequence
ctgctgtaatgtggagcgga

SEQ ID NO: 750155 - DNA, 20 bp, Artificial
  CRISPR gRNA sequence
gtacttctaaagtgactgaa

SEQ ID NO: 750156 - DNA, 20 bp, Artificial
  CRISPR gRNA sequence
gcagtatgaacaaacctcct

SEQ ID NO: 750157 - DNA, 20 bp, Artificial
  CRISPR gRNA sequence
tatgaacaaacctcctgaaa

SEQ ID NO: 750158 - DNA, 20 bp, Artificial
  CRISPR gRNA sequence
cctgaaagcttgtttacgct

SEQ ID NO: 750159 - DNA, 20 bp, Artificial
  CRISPR gRNA sequence
aggctaaaattgggaaggaa

SEQ ID NO: 750160 - DNA, 20 bp, Artificial
  CRISPR gRNA sequence
tcctcatgctgttgggacag

SEQ ID NO: 750161 - DNA, 20 bp, Artificial
  CRISPR gRNA sequence
tttgaccgctaggaatttac

SEQ ID NO: 750162 - DNA, 20 bp, Artificial
  CRISPR gRNA sequence
caacatgtctaccaacaggg

SEQ ID NO: 750163 - DNA, 20 bp, Artificial
  CRISPR gRNA sequence
ggtcttggtacaaggggagg

SEQ ID NO: 750164 - DNA, 20 bp, Artificial
  CRISPR gRNA sequence
tttaaacttgtacttttttt

SEQ ID NO: 750165 - DNA, 20 bp, Artificial
  CRISPR gRNA sequence
gtactttttttggtagttta

SEQ ID NO: 750166 - DNA, 20 bp, Artificial
  CRISPR gRNA sequence
taaaattgaaaaacattgta

SEQ ID NO: 750167 - DNA, 20 bp, Artificial
  CRISPR gRNA sequence
gaaaaacattgtacaaggat

SEQ ID NO: 750168 - DNA, 20 bp, Artificial
  CRISPR gRNA sequence
gtttttctagttctcacccc

SEQ ID NO: 750169 - DNA, 20 bp, Artificial
  CRISPR gRNA sequence
aaggagtctctgggatgagt

SEQ ID NO: 750170 - DNA, 20 bp, Artificial
  CRISPR gRNA sequence
catttcaaccattttaagcc

SEQ ID NO: 750171 - DNA, 20 bp, Artificial
  CRISPR gRNA sequence
attttcaaaactttcatcac

SEQ ID NO: 750172 - DNA, 20 bp, Artificial
  CRISPR gRNA sequence
cctgagctgtaggtgacagg

SEQ ID NO: 750173 - DNA, 20 bp, Artificial
  CRISPR gRNA sequence
actctggggaaaggcgggtc

SEQ ID NO: 750174 - DNA, 20 bp, Artificial
  CRISPR gRNA sequence
ctggccttccctctctgagc

SEQ ID NO: 750175 - DNA, 20 bp, Artificial
  CRISPR gRNA sequence
ctcaggaggagcaatgggaa

SEQ ID NO: 750176 - DNA, 20 bp, Artificial
  CRISPR gRNA sequence
tccagcccccagttcagccc

SEQ ID NO: 750177 - DNA, 20 bp, Artificial
  CRISPR gRNA sequence
tgatcatatgcagtagctca

SEQ ID NO: 750178 - DNA, 20 bp, Artificial
  CRISPR gRNA sequence
cactcagagatccttggggg

SEQ ID NO: 750179 - DNA, 20 bp, Artificial
  CRISPR gRNA sequence
gggacctgtttaaggtatgg

SEQ ID NO: 750180 - DNA, 20 bp, Artificial
  CRISPR gRNA sequence
cctgtttaaggtatgggcgt

SEQ ID NO: 750181 - DNA, 20 bp, Artificial
  CRISPR gRNA sequence
gcagagctaggactcaatct

SEQ ID NO: 750182 - DNA, 20 bp, Artificial
  CRISPR gRNA sequence
acagcaaataagtggtgggg

SEQ ID NO: 750183 - DNA, 20 bp, Artificial
  CRISPR gRNA sequence
agtcctccaagaaggggcta

SEQ ID NO: 750184 - DNA, 20 bp, Artificial
  CRISPR gRNA sequence
tggctacagaggtaactgag

SEQ ID NO: 750185 - DNA, 20 bp, Artificial
  CRISPR gRNA sequence
aaaggattgctctggtgcca

SEQ ID NO: 750186 - DNA, 20 bp, Artificial
  CRISPR gRNA sequence
gggggctgtggccacctcac

SEQ ID NO: 750187 - DNA, 20 bp, Artificial
  CRISPR gRNA sequence
ggggtgggtgggggcaggta

SEQ ID NO: 750188 - DNA, 20 bp, Artificial
  CRISPR gRNA sequence
gggctgggagccttgaggac

SEQ ID NO: 750189 - DNA, 20 bp, Artificial
  CRISPR gRNA sequence
ttgctggagaggccaacagg

SEQ ID NO: 750190 - DNA, 20 bp, Artificial
  CRISPR gRNA sequence
ccaacaggtgtggatttcca

SEQ ID NO: 750191 - DNA, 20 bp, Artificial
  CRISPR gRNA sequence
catcctgctttggactgagc

SEQ ID NO: 750192 - DNA, 20 bp, Artificial
  CRISPR gRNA sequence
agtcggctgtaagcaatagc

SEQ ID NO: 750193 - DNA, 20 bp, Artificial
  CRISPR gRNA sequence
taagcaatagccatggtttg

SEQ ID NO: 750194 - DNA, 20 bp, Artificial
  CRISPR gRNA sequence
ggaacttttgggtaacttcc

SEQ ID NO: 750195 - DNA, 20 bp, Artificial
  CRISPR gRNA sequence
tgttgtgcccctcccccacc

SEQ ID NO: 750196 - DNA, 20 bp, Artificial
  CRISPR gRNA sequence
gtcactgcatctaattggtg

SEQ ID NO: 750197 - DNA, 20 bp, Artificial
  CRISPR gRNA sequence
gatcggggacttgcaccttg

SEQ ID NO: 750198 - DNA, 20 bp, Artificial
  CRISPR gRNA sequence
acactcctggaaaatgcaga

SEQ ID NO: 750199 - DNA, 20 bp, Artificial
  CRISPR gRNA sequence
atctgctggacagacacgca

SEQ ID NO: 750200 - DNA, 20 bp, Artificial
  CRISPR gRNA sequence
gggaagccttcccttccatg

SEQ ID NO: 750201 - DNA, 20 bp, Artificial
  CRISPR gRNA sequence
atacttctgtgcagtagggg

SEQ ID NO: 750202 - DNA, 20 bp, Artificial
  CRISPR gRNA sequence
tgctgaagcctgcacatctg

SEQ ID NO: 750203 - DNA, 20 bp, Artificial
  CRISPR gRNA sequence
ccccgactcagcaggctgag

SEQ ID NO: 750204 - DNA, 20 bp, Artificial
  CRISPR gRNA sequence
accaaacacaaagctcctct

SEQ ID NO: 750205 - DNA, 20 bp, Artificial
  CRISPR gRNA sequence
tcaagacaggttgaaggaag

SEQ ID NO: 750206 - DNA, 20 bp, Artificial
  CRISPR gRNA sequence
acccctcccctcagctcaag

SEQ ID NO: 750207 - DNA, 20 bp, Artificial
  CRISPR gRNA sequence
ggctgaagttctagaagtgt

SEQ ID NO: 750208 - DNA, 20 bp, Artificial
  CRISPR gRNA sequence
ttctagaagtgtctgtgatt

SEQ ID NO: 750209 - DNA, 20 bp, Artificial
  CRISPR gRNA sequence
tgtgggcctggctcctgcct

SEQ ID NO: 750210 - DNA, 20 bp, Artificial
  CRISPR gRNA sequence
ttcttgcttggagatgctgc

SEQ ID NO: 750211 - DNA, 20 bp, Artificial
  CRISPR gRNA sequence
gttctgtggcagcaacattc

SEQ ID NO: 750212 - DNA, 20 bp, Artificial
  CRISPR gRNA sequence
acattcaagggattgaaaac

SEQ ID NO: 750213 - DNA, 20 bp, Artificial
  CRISPR gRNA sequence
gccttctgagtctgggcggc

SEQ ID NO: 750214 - DNA, 20 bp, Artificial
  CRISPR gRNA sequence
tcttcttcccatccctgggt

SEQ ID NO: 750215 - DNA, 20 bp, Artificial
  CRISPR gRNA sequence
gggcagaggggccccgttca

SEQ ID NO: 750216 - DNA, 20 bp, Artificial
  CRISPR gRNA sequence
ggacggctcagcccctgttc

SEQ ID NO: 750217 - DNA, 20 bp, Artificial
  CRISPR gRNA sequence
gttccaaggattttggggtg

SEQ ID NO: 750218 - DNA, 20 bp, Artificial
  CRISPR gRNA sequence
ccccgtggccgccttggctc

SEQ ID NO: 750219 - DNA, 20 bp, Artificial
  CRISPR gRNA sequence
ttccccagctgcctcctacc

SEQ ID NO: 750220 - DNA, 20 bp, Artificial
  CRISPR gRNA sequence
gtcaacaggttaagtcaatc

SEQ ID NO: 750221 - DNA, 20 bp, Artificial
  CRISPR gRNA sequence
actgcctgcattccagtccc

SEQ ID NO: 750222 - DNA, 20 bp, Artificial
  CRISPR gRNA sequence
aaacaggtgcaaaccctgga

SEQ ID NO: 750223 - DNA, 20 bp, Artificial
  CRISPR gRNA sequence
cctggagatggattgtaaga

SEQ ID NO: 750224 - DNA, 20 bp, Artificial
  CRISPR gRNA sequence
caatctgggcctggtggagt

SEQ ID NO: 750225 - DNA, 20 bp, Artificial
  CRISPR gRNA sequence
gtgcgggtgatgttcccatc

SEQ ID NO: 750226 - DNA, 20 bp, Artificial
  CRISPR gRNA sequence
tctcctgcttgtgggcatgc

SEQ ID NO: 750227 - DNA, 20 bp, Artificial
  CRISPR gRNA sequence
tgcttgtgggcatgccctgg

SEQ ID NO: 750228 - DNA, 20 bp, Artificial
  CRISPR gRNA sequence
aaggtgagtcctctgtggaa

SEQ ID NO: 750229 - DNA, 20 bp, Artificial
  CRISPR gRNA sequence
tcctctgtggaattgtgatt

SEQ ID NO: 750230 - DNA, 20 bp, Artificial
  CRISPR gRNA sequence
ggggctgggcagaccccctg

SEQ ID NO: 750231 - DNA, 20 bp, Artificial
  CRISPR gRNA sequence
ctgggcctgggtgctgaaag

SEQ ID NO: 750232 - DNA, 20 bp, Artificial
  CRISPR gRNA sequence
aggcgggaagatgttcgccc

SEQ ID NO: 750233 - DNA, 20 bp, Artificial
  CRISPR gRNA sequence
aaccccacctggacacatgg

SEQ ID NO: 750234 - DNA, 20 bp, Artificial
  CRISPR gRNA sequence
tgctctgcctgggctgggcc

SEQ ID NO: 750235 - DNA, 20 bp, Artificial
  CRISPR gRNA sequence
tggccagaatatgcccaaac

SEQ ID NO: 750236 - DNA, 20 bp, Artificial
  CRISPR gRNA sequence
tttgttccctctggtcacca

SEQ ID NO: 750237 - DNA, 20 bp, Artificial
  CRISPR gRNA sequence
ttgcagggctgaggtggaag

SEQ ID NO: 750238 - DNA, 20 bp, Artificial
  CRISPR gRNA sequence
gaaagaaagaaggaaagagg

SEQ ID NO: 750239 - DNA, 20 bp, Artificial
  CRISPR gRNA sequence
gtcgaaggacaagcccacag

SEQ ID NO: 750240 - DNA, 20 bp, Artificial
  CRISPR gRNA sequence
aacagccaccgcacttcctc

SEQ ID NO: 750241 - DNA, 20 bp, Artificial
  CRISPR gRNA sequence
ccttttacaactgaacgcat

SEQ ID NO: 750242 - DNA, 20 bp, Artificial
  CRISPR gRNA sequence
aactgaacgcatctgggctt

SEQ ID NO: 750243 - DNA, 20 bp, Artificial
  CRISPR gRNA sequence
cgcatctgggcttcgtggtt

SEQ ID NO: 750244 - DNA, 20 bp, Artificial
  CRISPR gRNA sequence
gggcaggaggctcctggagc

SEQ ID NO: 750245 - DNA, 20 bp, Artificial
  CRISPR gRNA sequence
tgaggccctgagagggaaat

SEQ ID NO: 750246 - DNA, 20 bp, Artificial
  CRISPR gRNA sequence
cttacctatctcctgacatt

SEQ ID NO: 750247 - DNA, 20 bp, Artificial
  CRISPR gRNA sequence
ggaattgaaagcaccatttg

SEQ ID NO: 750248 - DNA, 20 bp, Artificial
  CRISPR gRNA sequence
ggaggtgcaggagccccagg

SEQ ID NO: 750249 - DNA, 20 bp, Artificial
  CRISPR gRNA sequence
gactgtgctgggggctgggt

SEQ ID NO: 750250 - DNA, 20 bp, Artificial
  CRISPR gRNA sequence
tggcccattccctgggcatt

SEQ ID NO: 750251 - DNA, 20 bp, Artificial
  CRISPR gRNA sequence
gggcattccctgctttgcat

SEQ ID NO: 750252 - DNA, 20 bp, Artificial
  CRISPR gRNA sequence
actatcctggaatgtgttga

SEQ ID NO: 750253 - DNA, 20 bp, Artificial
  CRISPR gRNA sequence
gagggattctgaatgatcaa

SEQ ID NO: 750254 - DNA, 20 bp, Artificial
  CRISPR gRNA sequence
gagggaagtggcagcatgca

SEQ ID NO: 750255 - DNA, 20 bp, Artificial
  CRISPR gRNA sequence
gccttttctgttagaatact

SEQ ID NO: 750256 - DNA, 20 bp, Artificial
  CRISPR gRNA sequence
acactttcacatgtgttgta

SEQ ID NO: 750257 - DNA, 20 bp, Artificial
  CRISPR gRNA sequence
ccccttccctgaaaatcctg

SEQ ID NO: 750258 - DNA, 20 bp, Artificial
  CRISPR gRNA sequence
ctacgactaaaccctgggtc

SEQ ID NO: 750259 - DNA, 20 bp, Artificial
  CRISPR gRNA sequence
ctcctgcttcctcctcactg

SEQ ID NO: 750260 - DNA, 20 bp, Artificial
  CRISPR gRNA sequence
attggtattatgggccaggg

SEQ ID NO: 750261 - DNA, 20 bp, Artificial
  CRISPR gRNA sequence
tggcttggccttcaccttgg

SEQ ID NO: 750262 - DNA, 20 bp, Artificial
  CRISPR gRNA sequence
ggaaagcaccaagtattcta

SEQ ID NO: 750263 - DNA, 20 bp, Artificial
  CRISPR gRNA sequence
agtattctaacagaaaaggc

SEQ ID NO: 750264 - DNA, 20 bp, Artificial
  CRISPR gRNA sequence
caccaagctatattgatcat

SEQ ID NO: 750265 - DNA, 20 bp, Artificial
  CRISPR gRNA sequence
tttcgtgcattgtggttccc

SEQ ID NO: 750266 - DNA, 20 bp, Artificial
  CRISPR gRNA sequence
taacctgttgacagatcttc

SEQ ID NO: 750267 - DNA, 20 bp, Artificial
  CRISPR gRNA sequence
gtgaatttcaggtctctagg

SEQ ID NO: 750268 - DNA, 20 bp, Artificial
  CRISPR gRNA sequence
agagtcagggacagggtctg

SEQ ID NO: 750269 - DNA, 20 bp, Artificial
  CRISPR gRNA sequence
tgaatgttgctgccacagaa

SEQ ID NO: 750270 - DNA, 20 bp, Artificial
  CRISPR gRNA sequence
tgggtgcatgacacatctga

SEQ ID NO: 750271 - DNA, 20 bp, Artificial
  CRISPR gRNA sequence
cttagccttctcatctggaa

SEQ ID NO: 750272 - DNA, 20 bp, Artificial
  CRISPR gRNA sequence
gccctatgcccctggagcac

SEQ ID NO: 750273 - DNA, 20 bp, Artificial
  CRISPR gRNA sequence
atctcaccacacaagtcaca

SEQ ID NO: 750274 - DNA, 20 bp, Artificial
  CRISPR gRNA sequence
agaaacacccggggtgagaa

SEQ ID NO: 750275 - DNA, 20 bp, Artificial
  CRISPR gRNA sequence
gaccccttctctgagctcac

SEQ ID NO: 750276 - DNA, 20 bp, Artificial
  CRISPR gRNA sequence
cctacttcatagagttctta

SEQ ID NO: 750277 - DNA, 20 bp, Artificial
  CRISPR gRNA sequence
cctgtagtcccagctacttg

SEQ ID NO: 750278 - DNA, 20 bp, Artificial
  CRISPR gRNA sequence
ctactcgggaggctgaggca

SEQ ID NO: 750279 - DNA, 20 bp, Artificial
  CRISPR gRNA sequence
taacagagtgaaaccgtgtt

SEQ ID NO: 750280 - DNA, 20 bp, Artificial
  CRISPR gRNA sequence
acagagaacatctgaagaac

SEQ ID NO: 750281 - DNA, 20 bp, Artificial
  CRISPR gRNA sequence
agaacatagaaacacagaac

SEQ ID NO: 750282 - DNA, 20 bp, Artificial
  CRISPR gRNA sequence
agcagaagggatgtgcagca

SEQ ID NO: 750283 - DNA, 20 bp, Artificial
  CRISPR gRNA sequence
ctgggtgcaggatgaggaca

SEQ ID NO: 750284 - DNA, 20 bp, Artificial
  CRISPR gRNA sequence
catagataggatttcagcca

SEQ ID NO: 750285 - DNA, 20 bp, Artificial
  CRISPR gRNA sequence
gcacgtccttccagccaaac

SEQ ID NO: 750286 - DNA, 20 bp, Artificial
  CRISPR gRNA sequence
aaaaccatgagcttttgaaa

SEQ ID NO: 750287 - DNA, 20 bp, Artificial
  CRISPR gRNA sequence
cagtttcctcctctgtgcag

SEQ ID NO: 750288 - DNA, 20 bp, Artificial
  CRISPR gRNA sequence
aaggagggttagaactatgt

SEQ ID NO: 750289 - DNA, 20 bp, Artificial
  CRISPR gRNA sequence
ctcactcacagatgtttttc

SEQ ID NO: 750290 - DNA, 20 bp, Artificial
  CRISPR gRNA sequence
gatacaggtctccttttcag

SEQ ID NO: 750291 - DNA, 20 bp, Artificial
  CRISPR gRNA sequence
tcaggcagaaacacagagac

SEQ ID NO: 750292 - DNA, 20 bp, Artificial
  CRISPR gRNA sequence
tttattcccattgcactgat

SEQ ID NO: 750293 - DNA, 20 bp, Artificial
  CRISPR gRNA sequence
acagcaagcaagtgctagag

SEQ ID NO: 750294 - DNA, 20 bp, Artificial
  CRISPR gRNA sequence
tatactgatgaaaaaaaagg

SEQ ID NO: 750295 - DNA, 20 bp, Artificial
  CRISPR gRNA sequence
attctgacttccagctctcc

SEQ ID NO: 750296 - DNA, 20 bp, Artificial
  CRISPR gRNA sequence
gctctcccacgtactcccag

SEQ ID NO: 750297 - DNA, 20 bp, Artificial
  CRISPR gRNA sequence
acggcgggtgggtgcatcag

SEQ ID NO: 750298 - DNA, 20 bp, Artificial
  CRISPR gRNA sequence
ccaaaggagttgttcccctt

SEQ ID NO: 750299 - DNA, 20 bp, Artificial
  CRISPR gRNA sequence
tcctggggagggagggaagg

SEQ ID NO: 750300 - DNA, 20 bp, Artificial
  CRISPR gRNA sequence
atgcctcatccttcagctat

SEQ ID NO: 750301 - DNA, 20 bp, Artificial
  CRISPR gRNA sequence
gagctcttgttggcatcttc

SEQ ID NO: 750302 - DNA, 20 bp, Artificial
  CRISPR gRNA sequence
ggtctcacaggacatcccaa

SEQ ID NO: 750303 - DNA, 20 bp, Artificial
  CRISPR gRNA sequence
aggactggggctgccaaggc

SEQ ID NO: 750304 - DNA, 20 bp, Artificial
  CRISPR gRNA sequence
tatcatctccattttacaga

SEQ ID NO: 750305 - DNA, 20 bp, Artificial
  CRISPR gRNA sequence
gtgccatctgactactctct

SEQ ID NO: 750306 - DNA, 20 bp, Artificial
  CRISPR gRNA sequence
ttcagtcctgattacatcaa

SEQ ID NO: 750307 - DNA, 20 bp, Artificial
  CRISPR gRNA sequence
tcccaggctaaagtttccaa

SEQ ID NO: 750308 - DNA, 20 bp, Artificial
  CRISPR gRNA sequence
aagatctacatactcaaata

SEQ ID NO: 750309 - DNA, 20 bp, Artificial
  CRISPR gRNA sequence
ataaaagaatgagtagattt

SEQ ID NO: 750310 - DNA, 20 bp, Artificial
  CRISPR gRNA sequence
catgggaaataagatcctac

SEQ ID NO: 750311 - DNA, 20 bp, Artificial
  CRISPR gRNA sequence
cctcattattggattactga

SEQ ID NO: 750312 - DNA, 20 bp, Artificial
  CRISPR gRNA sequence
gaatgtaaaaagatcagatg

SEQ ID NO: 750313 - DNA, 20 bp, Artificial
  CRISPR gRNA sequence
cccttcatactccaggcttt

SEQ ID NO: 750314 - DNA, 20 bp, Artificial
  CRISPR gRNA sequence
gtagagagcaagcagcttag

SEQ ID NO: 750315 - DNA, 20 bp, Artificial
  CRISPR gRNA sequence
ggcatgtggcctgcagaagc

SEQ ID NO: 750316 - DNA, 20 bp, Artificial
  CRISPR gRNA sequence
tagtgtgtccatgtcacagt

SEQ ID NO: 750317 - DNA, 20 bp, Artificial
  CRISPR gRNA sequence
ggtccctgtgccctggatct

SEQ ID NO: 750318 - DNA, 20 bp, Artificial
  CRISPR gRNA sequence
aagtgagggcaggaagtggg

SEQ ID NO: 750319 - DNA, 20 bp, Artificial
  CRISPR gRNA sequence
attcctgggccatcagaccc

SEQ ID NO: 750320 - DNA, 20 bp, Artificial
  CRISPR gRNA sequence
agagccctgagactagaggg

SEQ ID NO: 750321 - DNA, 20 bp, Artificial
  CRISPR gRNA sequence
ggtgacagtcagagggagga

SEQ ID NO: 750322 - DNA, 20 bp, Artificial
  CRISPR gRNA sequence
tctgttcagcagccccaatt

SEQ ID NO: 750323 - DNA, 20 bp, Artificial
  CRISPR gRNA sequence
tggggttgggccagcactga

SEQ ID NO: 750324 - DNA, 20 bp, Artificial
  CRISPR gRNA sequence
taggcctgagcagatgaaag

SEQ ID NO: 750325 - DNA, 20 bp, Artificial
  CRISPR gRNA sequence
taaaataaaataaaatttaa

SEQ ID NO: 750326 - DNA, 20 bp, Artificial
  CRISPR gRNA sequence
actaatctatgtaaaagtgt

SEQ ID NO: 750327 - DNA, 20 bp, Artificial
  CRISPR gRNA sequence
gagcaagaccctagctcact

SEQ ID NO: 750328 - DNA, 20 bp, Artificial
  CRISPR gRNA sequence
ccaaccaaacaaacaagcac

SEQ ID NO: 750329 - DNA, 20 bp, Artificial
  CRISPR gRNA sequence
atgccctttgtcctcactgg

SEQ ID NO: 750330 - DNA, 20 bp, Artificial
  CRISPR gRNA sequence
ctcctttcccttgtactggg

SEQ ID NO: 750331 - DNA, 20 bp, Artificial
  CRISPR gRNA sequence
aacatctgagggtgccacag

SEQ ID NO: 750332 - DNA, 20 bp, Artificial
  CRISPR gRNA sequence
tggtaaatatttgtggaatg

SEQ ID NO: 750333 - DNA, 20 bp, Artificial
  CRISPR gRNA sequence
ggcagccctcaggttaagat

SEQ ID NO: 750334 - DNA, 20 bp, Artificial
  CRISPR gRNA sequence
ataagcaacatcctctcgcc

SEQ ID NO: 750335 - DNA, 20 bp, Artificial
  CRISPR gRNA sequence
ggaggtgatgtcaggcaaag

SEQ ID NO: 750336 - DNA, 20 bp, Artificial
  CRISPR gRNA sequence
aactcaaatgtccacaggac

SEQ ID NO: 750337 - DNA, 20 bp, Artificial
  CRISPR gRNA sequence
tttctaaggagagctggaag

SEQ ID NO: 750338 - DNA, 20 bp, Artificial
  CRISPR gRNA sequence
gtttttaaatgttgccatct

SEQ ID NO: 750339 - DNA, 20 bp, Artificial
  CRISPR gRNA sequence
gactttgagaggccaaggca

SEQ ID NO: 750340 - DNA, 20 bp, Artificial
  CRISPR gRNA sequence
actgaggctcatacagttag

SEQ ID NO: 750341 - DNA, 20 bp, Artificial
  CRISPR gRNA sequence
tggatggctgaatggctgtt

SEQ ID NO: 750342 - DNA, 20 bp, Artificial
  CRISPR gRNA sequence
aggctgggggtcctcttggc

SEQ ID NO: 750343 - DNA, 20 bp, Artificial
  CRISPR gRNA sequence
tcaggaattttttttttttt

SEQ ID NO: 750344 - DNA, 20 bp, Artificial
  CRISPR gRNA sequence
ctactcaagaggctgaggca

SEQ ID NO: 750345 - DNA, 20 bp, Artificial
  CRISPR gRNA sequence
cctggcgctgagaggttggg

SEQ ID NO: 750346 - DNA, 20 bp, Artificial
  CRISPR gRNA sequence
tcttcccaccccccagcgca

SEQ ID NO: 750347 - DNA, 20 bp, Artificial
  CRISPR gRNA sequence
ctgcagagatgcctacggct

SEQ ID NO: 750348 - DNA, 20 bp, Artificial
  CRISPR gRNA sequence
aatactgaggtgtctgggtt

SEQ ID NO: 750349 - DNA, 20 bp, Artificial
  CRISPR gRNA sequence
ggcaatttagcaatagccta

SEQ ID NO: 750350 - DNA, 20 bp, Artificial
  CRISPR gRNA sequence
gccatgtgataaaactctaa

SEQ ID NO: 750351 - DNA, 20 bp, Artificial
  CRISPR gRNA sequence
ggagctgggcgaaatggccg

SEQ ID NO: 750352 - DNA, 20 bp, Artificial
  CRISPR gRNA sequence
cttactcctcattgcaagtc

SEQ ID NO: 750353 - DNA, 20 bp, Artificial
  CRISPR gRNA sequence
tgcctggctacagaggtaac

SEQ ID NO: 750354 - DNA, 20 bp, Artificial
  CRISPR gRNA sequence
atgaggcactctcaggaaaa

SEQ ID NO: 750355 - DNA, 20 bp, Artificial
  CRISPR gRNA sequence
ggcagcaacttggatgagaa

SEQ ID NO: 750356 - DNA, 20 bp, Artificial
  CRISPR gRNA sequence
gtttccctgagagatgtccc

SEQ ID NO: 750357 - DNA, 20 bp, Artificial
  CRISPR gRNA sequence
actgtgtaagtcaagccata

SEQ ID NO: 750358 - DNA, 20 bp, Artificial
  CRISPR gRNA sequence
gctggacagcacccatgtga

SEQ ID NO: 750359 - DNA, 20 bp, Artificial
  CRISPR gRNA sequence
aaggcccatggagaccttct

SEQ ID NO: 750360 - DNA, 20 bp, Artificial
  CRISPR gRNA sequence
ctgcccgcagagaactccaa

SEQ ID NO: 750361 - DNA, 20 bp, Artificial
  CRISPR gRNA sequence
aagtcctgcttgcaactcat

SEQ ID NO: 750362 - DNA, 20 bp, Artificial
  CRISPR gRNA sequence
ccatcaactctattgaccaa

SEQ ID NO: 750363 - DNA, 20 bp, Artificial
  CRISPR gRNA sequence
tggggatggggatgtaggtg

SEQ ID NO: 750364 - DNA, 20 bp, Artificial
  CRISPR gRNA sequence
gtaggtgagagaaagggagg

SEQ ID NO: 750365 - DNA, 20 bp, Artificial
  CRISPR gRNA sequence
ggggctgacacctcgagtgg

SEQ ID NO: 750366 - DNA, 20 bp, Artificial
  CRISPR gRNA sequence
tgcctcaaaacaaattttaa

SEQ ID NO: 750367 - DNA, 20 bp, Artificial
  CRISPR gRNA sequence
tcaaaacaaattttaaaaag

SEQ ID NO: 750368 - DNA, 20 bp, Artificial
  CRISPR gRNA sequence
cttgaggcagagacaacttc

SEQ ID NO: 750369 - DNA, 20 bp, Artificial
  CRISPR gRNA sequence
ctgtttcttggccttttctg

SEQ ID NO: 750370 - DNA, 20 bp, Artificial
  CRISPR gRNA sequence
tctgtgttaaatggcagcaa

SEQ ID NO: 750371 - DNA, 20 bp, Artificial
  CRISPR gRNA sequence
cgtgcattgtggttccctga

SEQ ID NO: 750372 - DNA, 20 bp, Artificial
  CRISPR gRNA sequence
agcagtccccgctgtgtcag

SEQ ID NO: 750373 - DNA, 20 bp, Artificial
  CRISPR gRNA sequence
agctcagagtaaatttcgct

SEQ ID NO: 750374 - DNA, 20 bp, Artificial
  CRISPR gRNA sequence
gcaggcccccatgaattgtg

SEQ ID NO: 750375 - DNA, 20 bp, Artificial
  CRISPR gRNA sequence
ctcaccttgcctatgtgtat

SEQ ID NO: 750376 - DNA, 20 bp, Artificial
  CRISPR gRNA sequence
gacagaagagcagcctcggg

SEQ ID NO: 750377 - DNA, 20 bp, Artificial
  CRISPR gRNA sequence
agggaggggaggcaagggta

SEQ ID NO: 750378 - DNA, 20 bp, Artificial
  CRISPR gRNA sequence
ccaacaattgctactaatta

SEQ ID NO: 750379 - DNA, 20 bp, Artificial
  CRISPR gRNA sequence
acacccggggtgagaactag

SEQ ID NO: 750380 - DNA, 20 bp, Artificial
  CRISPR gRNA sequence
acccagacacctcagtattt

SEQ ID NO: 750381 - DNA, 20 bp, Artificial
  CRISPR gRNA sequence
ggtgcaggatgaggacagaa

SEQ ID NO: 750382 - DNA, 20 bp, Artificial
  CRISPR gRNA sequence
tcttcccagtagagtatatg

SEQ ID NO: 750383 - DNA, 20 bp, Artificial
  CRISPR gRNA sequence
gcaagatagtgtgaaaatgg

SEQ ID NO: 750384 - DNA, 20 bp, Artificial
  CRISPR gRNA sequence
cgtccttccagccaaactta

SEQ ID NO: 750385 - DNA, 20 bp, Artificial
  CRISPR gRNA sequence
catttaattgggttgaccct

SEQ ID NO: 750386 - DNA, 20 bp, Artificial
  CRISPR gRNA sequence
cctcaaaaccatgagctttt

SEQ ID NO: 750387 - DNA, 20 bp, Artificial
  CRISPR gRNA sequence
tttcctcctctgtgcagtga

SEQ ID NO: 750388 - DNA, 20 bp, Artificial
  CRISPR gRNA sequence
cagatgtttttcccagaaat

SEQ ID NO: 750389 - DNA, 20 bp, Artificial
  CRISPR gRNA sequence
ttcttgagatggcaacattt

SEQ ID NO: 750390 - DNA, 20 bp, Artificial
  CRISPR gRNA sequence
gagtggggtgggtgtagctg

SEQ ID NO: 750391 - DNA, 20 bp, Artificial
  CRISPR gRNA sequence
cacgtactcccaggaagaaa

SEQ ID NO: 750392 - DNA, 20 bp, Artificial
  CRISPR gRNA sequence
tggggagggagggaaggcca

SEQ ID NO: 750393 - DNA, 20 bp, Artificial
  CRISPR gRNA sequence
gaaagcctgagtctcaggag

SEQ ID NO: 750394 - DNA, 20 bp, Artificial
  CRISPR gRNA sequence
ctctgcctcagacccaagct

SEQ ID NO: 750395 - DNA, 20 bp, Artificial
  CRISPR gRNA sequence
catctccattttacagatga

SEQ ID NO: 750396 - DNA, 20 bp, Artificial
  CRISPR gRNA sequence
gtttgatgctaatatgtctc

SEQ ID NO: 750397 - DNA, 20 bp, Artificial
  CRISPR gRNA sequence
atcacttgtcataaatagaa

SEQ ID NO: 750398 - DNA, 20 bp, Artificial
  CRISPR gRNA sequence
accataaaagaacgtaacag

SEQ ID NO: 750399 - DNA, 20 bp, Artificial
  CRISPR gRNA sequence
cctgggaaggctcggagtct

SEQ ID NO: 750400 - DNA, 20 bp, Artificial
  CRISPR gRNA sequence
tgattcaatgttatttaatg

SEQ ID NO: 750401 - DNA, 20 bp, Artificial
  CRISPR gRNA sequence
atttaatgtaaaaccaaaag

SEQ ID NO: 750402 - DNA, 20 bp, Artificial
  CRISPR gRNA sequence
caagaccctagctcactaaa

SEQ ID NO: 750403 - DNA, 20 bp, Artificial
  CRISPR gRNA sequence
tggagagaggtgaaggtcac

SEQ ID NO: 750404 - DNA, 20 bp, Artificial
  CRISPR gRNA sequence
cctgtctggccctcttgctt

SEQ ID NO: 750405 - DNA, 20 bp, Artificial
  CRISPR gRNA sequence
gaagtccaggccagcacgga

SEQ ID NO: 750406 - DNA, 20 bp, Artificial
  CRISPR gRNA sequence
ttcatcagtgcaatgggaat

SEQ ID NO: 750407 - DNA, 20 bp, Artificial
  CRISPR gRNA sequence
cccagacttggctctctgcc

SEQ ID NO: 750408 - DNA, 20 bp, Artificial
  CRISPR gRNA sequence
gagatgttttcatttctggg

SEQ ID NO: 750409 - DNA, 20 bp, Artificial
  CRISPR gRNA sequence
acagagggagactccgtctc

SEQ ID NO: 750410 - DNA, 20 bp, Artificial
  CRISPR gRNA sequence
tgcttcatttgcttggtgaa

SEQ ID NO: 750411 - DNA, 20 bp, Artificial
  CRISPR gRNA sequence
ggtgaaaccccatctctact

SEQ ID NO: 750412 - DNA, 20 bp, Artificial
  CRISPR gRNA sequence
gcaagactccatctcaaaaa

SEQ ID NO: 750413 - DNA, 20 bp, Artificial
  CRISPR gRNA sequence
cagctaaaccacggacccaa

SEQ ID NO: 750414 - DNA, 20 bp, Artificial
  CRISPR gRNA sequence
tgggtacttctaaagtgact

SEQ ID NO: 750415 - DNA, 20 bp, Artificial
  CRISPR gRNA sequence
tacgctgtcggattgtagag

SEQ ID NO: 750416 - DNA, 20 bp, Artificial
  CRISPR gRNA sequence
gtcggattgtagagcaaaac

SEQ ID NO: 750417 - DNA, 20 bp, Artificial
  CRISPR gRNA sequence
atttagtgggagccatgtga

SEQ ID NO: 750418 - DNA, 20 bp, Artificial
  CRISPR gRNA sequence
tataactaggaccataacac

SEQ ID NO: 750419 - DNA, 20 bp, Artificial
  CRISPR gRNA sequence
gtttaataagtttaaaattg

SEQ ID NO: 750420 - DNA, 20 bp, Artificial
  CRISPR gRNA sequence
gggctttttatctattatga

SEQ ID NO: 750421 - DNA, 20 bp, Artificial
  CRISPR gRNA sequence
ccgtcaccactgtctatttt

SEQ ID NO: 750422 - DNA, 20 bp, Artificial
  CRISPR gRNA sequence
taatcagcagtaaatctcct

SEQ ID NO: 750423 - DNA, 20 bp, Artificial
  CRISPR gRNA sequence
gcccatggagaccttcttga

SEQ ID NO: 750424 - DNA, 20 bp, Artificial
  CRISPR gRNA sequence
gtgagagaaagggaggagag

SEQ ID NO: 750425 - DNA, 20 bp, Artificial
  CRISPR gRNA sequence
gcagcaacattcaagggatt

SEQ ID NO: 750426 - DNA, 20 bp, Artificial
  CRISPR gRNA sequence
gtatgaagcgggatgctatt

SEQ ID NO: 750427 - DNA, 20 bp, Artificial
  CRISPR gRNA sequence
atctctgtacactctggggg

SEQ ID NO: 750428 - DNA, 20 bp, Artificial
  CRISPR gRNA sequence
actccagcctggggacggag

SEQ ID NO: 750429 - DNA, 20 bp, Artificial
  CRISPR gRNA sequence
gacggagcaaaactttgcct

SEQ ID NO: 750430 - DNA, 20 bp, Artificial
  CRISPR gRNA sequence
gggactgctcagcactccct

SEQ ID NO: 750431 - DNA, 20 bp, Artificial
  CRISPR gRNA sequence
ctgaaaggtctgtgtcttgt

SEQ ID NO: 750432 - DNA, 20 bp, Artificial
  CRISPR gRNA sequence
gtatgtgctctaagcaagtc

SEQ ID NO: 750433 - DNA, 20 bp, Artificial
  CRISPR gRNA sequence
tatgtgctctaagcaagtcc

SEQ ID NO: 750434 - DNA, 20 bp, Artificial
  CRISPR gRNA sequence
taagcaagtccaaggtgaag

SEQ ID NO: 750435 - DNA, 20 bp, Artificial
  CRISPR gRNA sequence
agcaagtccaaggtgaaggc

SEQ ID NO: 750436 - DNA, 20 bp, Artificial
  CRISPR gRNA sequence
gcccataataccaatccatt

SEQ ID NO: 750437 - DNA, 20 bp, Artificial
  CRISPR gRNA sequence
agtgaggaggaagcaggaga

SEQ ID NO: 750438 - DNA, 20 bp, Artificial
  CRISPR gRNA sequence
agtcgtagttccaccgttta

SEQ ID NO: 750439 - DNA, 20 bp, Artificial
  CRISPR gRNA sequence
gtcgtagttccaccgtttac

SEQ ID NO: 750440 - DNA, 20 bp, Artificial
  CRISPR gRNA sequence
caccgtttacttgttttgac

SEQ ID NO: 750441 - DNA, 20 bp, Artificial
  CRISPR gRNA sequence
acttgttttgacaagacaca

SEQ ID NO: 750442 - DNA, 20 bp, Artificial
  CRISPR gRNA sequence
cttgttttgacaagacacag

SEQ ID NO: 750443 - DNA, 20 bp, Artificial
  CRISPR gRNA sequence
gttttgacaagacacagacc

SEQ ID NO: 750444 - DNA, 20 bp, Artificial
  CRISPR gRNA sequence
ttttgacaagacacagacct

SEQ ID NO: 750445 - DNA, 20 bp, Artificial
  CRISPR gRNA sequence
tgacaagacacagacctttc

SEQ ID NO: 750446 - DNA, 20 bp, Artificial
  CRISPR gRNA sequence
gacaagacacagacctttca

SEQ ID NO: 750447 - DNA, 20 bp, Artificial
  CRISPR gRNA sequence
acaagacacagacctttcag

SEQ ID NO: 750448 - DNA, 20 bp, Artificial
  CRISPR gRNA sequence
tcagaacctctattgccctc

SEQ ID NO: 750449 - DNA, 20 bp, Artificial
  CRISPR gRNA sequence
cagaacctctattgccctct

SEQ ID NO: 750450 - DNA, 20 bp, Artificial
  CRISPR gRNA sequence
agaacctctattgccctctg

SEQ ID NO: 750451 - DNA, 20 bp, Artificial
  CRISPR gRNA sequence
tattgccctctgtgttaaat

SEQ ID NO: 750452 - DNA, 20 bp, Artificial
  CRISPR gRNA sequence
ttgccctctgtgttaaatgg

SEQ ID NO: 750453 - DNA, 20 bp, Artificial
  CRISPR gRNA sequence
ccctctgtgttaaatggcag

SEQ ID NO: 750454 - DNA, 20 bp, Artificial
  CRISPR gRNA sequence
tgtgttaaatggcagcaata

SEQ ID NO: 750455 - DNA, 20 bp, Artificial
  CRISPR gRNA sequence
tgttaaatggcagcaataaa

SEQ ID NO: 750456 - DNA, 20 bp, Artificial
  CRISPR gRNA sequence
aatggcagcaataaaacctc

SEQ ID NO: 750457 - DNA, 20 bp, Artificial
  CRISPR gRNA sequence
ccaggattttcagggaaggg

SEQ ID NO: 750458 - DNA, 20 bp, Artificial
  CRISPR gRNA sequence
tcagggaagggggtggatca

SEQ ID NO: 750459 - DNA, 20 bp, Artificial
  CRISPR gRNA sequence
cagggaagggggtggatcaa

SEQ ID NO: 750460 - DNA, 20 bp, Artificial
  CRISPR gRNA sequence
agggaagggggtggatcaaa

SEQ ID NO: 750461 - DNA, 20 bp, Artificial
  CRISPR gRNA sequence
caacacatgtgaaagtgtgt

SEQ ID NO: 750462 - DNA, 20 bp, Artificial
  CRISPR gRNA sequence
gaaagcaccaagtattctaa

SEQ ID NO: 750463 - DNA, 20 bp, Artificial
  CRISPR gRNA sequence
taacagaaaaggccaagaaa

SEQ ID NO: 750464 - DNA, 20 bp, Artificial
  CRISPR gRNA sequence
acagaaaaggccaagaaaca

SEQ ID NO: 750465 - DNA, 20 bp, Artificial
  CRISPR gRNA sequence
ccacttccctctcccgtgcc

SEQ ID NO: 750466 - DNA, 20 bp, Artificial
  CRISPR gRNA sequence
ccctctcccgtgcccaaggc

SEQ ID NO: 750467 - DNA, 20 bp, Artificial
  CRISPR gRNA sequence
cctctcccgtgcccaaggca

SEQ ID NO: 750468 - DNA, 20 bp, Artificial
  CRISPR gRNA sequence
tcccgtgcccaaggcagaca

SEQ ID NO: 750469 - DNA, 20 bp, Artificial
  CRISPR gRNA sequence
ccgtgcccaaggcagacatg

SEQ ID NO: 750470 - DNA, 20 bp, Artificial
  CRISPR gRNA sequence
tctatctcggcactgtctca

SEQ ID NO: 750471 - DNA, 20 bp, Artificial
  CRISPR gRNA sequence
tctcggcactgtctcaccaa

SEQ ID NO: 750472 - DNA, 20 bp, Artificial
  CRISPR gRNA sequence
ggcactgtctcaccaagcta

SEQ ID NO: 750473 - DNA, 20 bp, Artificial
  CRISPR gRNA sequence
tctcaccaagctatattgat

SEQ ID NO: 750474 - DNA, 20 bp, Artificial
  CRISPR gRNA sequence
accaagctatattgatcatt

SEQ ID NO: 750475 - DNA, 20 bp, Artificial
  CRISPR gRNA sequence
tattgatcattcagaatccc

SEQ ID NO: 750476 - DNA, 20 bp, Artificial
  CRISPR gRNA sequence
atcattcagaatccctctca

SEQ ID NO: 750477 - DNA, 20 bp, Artificial
  CRISPR gRNA sequence
agaatccctctcaacacatt

SEQ ID NO: 750478 - DNA, 20 bp, Artificial
  CRISPR gRNA sequence
tcaacacattccaggatagt

SEQ ID NO: 750479 - DNA, 20 bp, Artificial
  CRISPR gRNA sequence
aacacattccaggatagtta

SEQ ID NO: 750480 - DNA, 20 bp, Artificial
  CRISPR gRNA sequence
caggatagttagggtgacat

SEQ ID NO: 750481 - DNA, 20 bp, Artificial
  CRISPR gRNA sequence
gggtgacatagcctccatgg

SEQ ID NO: 750482 - DNA, 20 bp, Artificial
  CRISPR gRNA sequence
catggggtgaagagaagcag

SEQ ID NO: 750483 - DNA, 20 bp, Artificial
  CRISPR gRNA sequence
tgccgtctatgggctgggcc

SEQ ID NO: 750484 - DNA, 20 bp, Artificial
  CRISPR gRNA sequence
tgggctgggcctcatgctca

SEQ ID NO: 750485 - DNA, 20 bp, Artificial
  CRISPR gRNA sequence
ggcctcatgctcagctgggc

SEQ ID NO: 750486 - DNA, 20 bp, Artificial
  CRISPR gRNA sequence
atgctcagctgggctgtggc

SEQ ID NO: 750487 - DNA, 20 bp, Artificial
  CRISPR gRNA sequence
agctgggctgtggctgggct

SEQ ID NO: 750488 - DNA, 20 bp, Artificial
  CRISPR gRNA sequence
ggctgtggctgggcttcaag

SEQ ID NO: 750489 - DNA, 20 bp, Artificial
  CRISPR gRNA sequence
tggctgggcttcaagaggcc

SEQ ID NO: 750490 - DNA, 20 bp, Artificial
  CRISPR gRNA sequence
ggcttcaagaggcctttgtt

SEQ ID NO: 750491 - DNA, 20 bp, Artificial
  CRISPR gRNA sequence
caagaggcctttgttcccag

SEQ ID NO: 750492 - DNA, 20 bp, Artificial
  CRISPR gRNA sequence
aagaggcctttgttcccagc

SEQ ID NO: 750493 - DNA, 20 bp, Artificial
  CRISPR gRNA sequence
tgttcccagcatcctggtta

SEQ ID NO: 750494 - DNA, 20 bp, Artificial
  CRISPR gRNA sequence
gttcccagcatcctggttag

SEQ ID NO: 750495 - DNA, 20 bp, Artificial
  CRISPR gRNA sequence
ttcccagcatcctggttagc

SEQ ID NO: 750496 - DNA, 20 bp, Artificial
  CRISPR gRNA sequence
ccagcatcctggttagcaac

SEQ ID NO: 750497 - DNA, 20 bp, Artificial
  CRISPR gRNA sequence
gttagcaaccccagttcctc

SEQ ID NO: 750498 - DNA, 20 bp, Artificial
  CRISPR gRNA sequence
gcaaccccagttcctctttc

SEQ ID NO: 750499 - DNA, 20 bp, Artificial
  CRISPR gRNA sequence
ctctttcgtgcattgtggtt

SEQ ID NO: 750500 - DNA, 20 bp, Artificial
  CRISPR gRNA sequence
tttcgtgcattgtggttccc

SEQ ID NO: 750501 - DNA, 20 bp, Artificial
  CRISPR gRNA sequence
tcgtgcattgtggttccctg

SEQ ID NO: 750502 - DNA, 20 bp, Artificial
  CRISPR gRNA sequence
cgtgcattgtggttccctga

SEQ ID NO: 750503 - DNA, 20 bp, Artificial
  CRISPR gRNA sequence
gtgcattgtggttccctgag

SEQ ID NO: 750504 - DNA, 20 bp, Artificial
  CRISPR gRNA sequence
tggttccctgagaaaacgtt

SEQ ID NO: 750505 - DNA, 20 bp, Artificial
  CRISPR gRNA sequence
cctgagaaaacgttaaccca

SEQ ID NO: 750506 - DNA, 20 bp, Artificial
  CRISPR gRNA sequence
agaaaacgttaacccagccc

SEQ ID NO: 750507 - DNA, 20 bp, Artificial
  CRISPR gRNA sequence
acccagcccccagcacagtc

SEQ ID NO: 750508 - DNA, 20 bp, Artificial
  CRISPR gRNA sequence
gggaaggcctcattcatgag

SEQ ID NO: 750509 - DNA, 20 bp, Artificial
  CRISPR gRNA sequence
attcatgaggcaggacccca

SEQ ID NO: 750510 - DNA, 20 bp, Artificial
  CRISPR gRNA sequence
atgaggcaggaccccagggg

SEQ ID NO: 750511 - DNA, 20 bp, Artificial
  CRISPR gRNA sequence
gtgctcggtggtggcaggac

SEQ ID NO: 750512 - DNA, 20 bp, Artificial
  CRISPR gRNA sequence
ggtggtggcaggacccctgc

SEQ ID NO: 750513 - DNA, 20 bp, Artificial
  CRISPR gRNA sequence
cagccccctgtcccactgca

SEQ ID NO: 750514 - DNA, 20 bp, Artificial
  CRISPR gRNA sequence
tcccactgcacactcccaag

SEQ ID NO: 750515 - DNA, 20 bp, Artificial
  CRISPR gRNA sequence
cacactcccaagtccacccc

SEQ ID NO: 750516 - DNA, 20 bp, Artificial
  CRISPR gRNA sequence
ccaagtccaccccgcgagga

SEQ ID NO: 750517 - DNA, 20 bp, Artificial
  CRISPR gRNA sequence
aaaaaggccatgtatcagcc

SEQ ID NO: 750518 - DNA, 20 bp, Artificial
  CRISPR gRNA sequence
tgccctgggccactgcatgt

SEQ ID NO: 750519 - DNA, 20 bp, Artificial
  CRISPR gRNA sequence
ccctgggccactgcatgtag

SEQ ID NO: 750520 - DNA, 20 bp, Artificial
  CRISPR gRNA sequence
ggccactgcatgtagtggga

SEQ ID NO: 750521 - DNA, 20 bp, Artificial
  CRISPR gRNA sequence
catgtagtgggagctctggt

SEQ ID NO: 750522 - DNA, 20 bp, Artificial
  CRISPR gRNA sequence
tggtcaggcagaagtctttt

SEQ ID NO: 750523 - DNA, 20 bp, Artificial
  CRISPR gRNA sequence
gtcaggcagaagtcttttga

SEQ ID NO: 750524 - DNA, 20 bp, Artificial
  CRISPR gRNA sequence
ttgaaaagcaggtcctgggg

SEQ ID NO: 750525 - DNA, 20 bp, Artificial
  CRISPR gRNA sequence
tgaaaagcaggtcctggggc

SEQ ID NO: 750526 - DNA, 20 bp, Artificial
  CRISPR gRNA sequence
gaaaagcaggtcctggggct

SEQ ID NO: 750527 - DNA, 20 bp, Artificial
  CRISPR gRNA sequence
aaaagcaggtcctggggctc

SEQ ID NO: 750528 - DNA, 20 bp, Artificial
  CRISPR gRNA sequence
gggctcctgcacctccaccc

SEQ ID NO: 750529 - DNA, 20 bp, Artificial
  CRISPR gRNA sequence
ctgcacctccaccccagcgc

SEQ ID NO: 750530 - DNA, 20 bp, Artificial
  CRISPR gRNA sequence
cacctccaccccagcgccca

SEQ ID NO: 750531 - DNA, 20 bp, Artificial
  CRISPR gRNA sequence
caccccagcgcccatcgcca

SEQ ID NO: 750532 - DNA, 20 bp, Artificial
  CRISPR gRNA sequence
ccccaggcagggccagcctg

SEQ ID NO: 750533 - DNA, 20 bp, Artificial
  CRISPR gRNA sequence
cccaccagcagtcaccagtg

SEQ ID NO: 750534 - DNA, 20 bp, Artificial
  CRISPR gRNA sequence
catggtgtgtttttagggag

SEQ ID NO: 750535 - DNA, 20 bp, Artificial
  CRISPR gRNA sequence
ttagggagtgctgagcagtc

SEQ ID NO: 750536 - DNA, 20 bp, Artificial
  CRISPR gRNA sequence
tagggagtgctgagcagtcc

SEQ ID NO: 750537 - DNA, 20 bp, Artificial
  CRISPR gRNA sequence
agggagtgctgagcagtccc

SEQ ID NO: 750538 - DNA, 20 bp, Artificial
  CRISPR gRNA sequence
gggagtgctgagcagtcccc

SEQ ID NO: 750539 - DNA, 20 bp, Artificial
  CRISPR gRNA sequence
agcagtccccgctgtgtcag

SEQ ID NO: 750540 - DNA, 20 bp, Artificial
  CRISPR gRNA sequence
tgtcagcaaaaccctccaaa

SEQ ID NO: 750541 - DNA, 20 bp, Artificial
  CRISPR gRNA sequence
caaatggtgctttcaattcc

SEQ ID NO: 750542 - DNA, 20 bp, Artificial
  CRISPR gRNA sequence
tcaattccattccttcagcc

SEQ ID NO: 750543 - DNA, 20 bp, Artificial
  CRISPR gRNA sequence
caattccattccttcagcct

SEQ ID NO: 750544 - DNA, 20 bp, Artificial
  CRISPR gRNA sequence
aattccattccttcagcctc

SEQ ID NO: 750545 - DNA, 20 bp, Artificial
  CRISPR gRNA sequence
cattccttcagcctctccct

SEQ ID NO: 750546 - DNA, 20 bp, Artificial
  CRISPR gRNA sequence
cttcagcctctccctgggag

SEQ ID NO: 750547 - DNA, 20 bp, Artificial
  CRISPR gRNA sequence
cagcctctccctgggaggga

SEQ ID NO: 750548 - DNA, 20 bp, Artificial
  CRISPR gRNA sequence
agcctctccctgggagggaa

SEQ ID NO: 750549 - DNA, 20 bp, Artificial
  CRISPR gRNA sequence
tccctgggagggaataaagg

SEQ ID NO: 750550 - DNA, 20 bp, Artificial
  CRISPR gRNA sequence
cctgggagggaataaaggca

SEQ ID NO: 750551 - DNA, 20 bp, Artificial
  CRISPR gRNA sequence
ggagggaataaaggcaggaa

SEQ ID NO: 750552 - DNA, 20 bp, Artificial
  CRISPR gRNA sequence
tattaaactgtgaatgtcag

SEQ ID NO: 750553 - DNA, 20 bp, Artificial
  CRISPR gRNA sequence
ttaaactgtgaatgtcagga

SEQ ID NO: 750554 - DNA, 20 bp, Artificial
  CRISPR gRNA sequence
aactgtgaatgtcaggagat

SEQ ID NO: 750555 - DNA, 20 bp, Artificial
  CRISPR gRNA sequence
tgaatgtcaggagataggta

SEQ ID NO: 750556 - DNA, 20 bp, Artificial
  CRISPR gRNA sequence
attcctgattgatctcctaa

SEQ ID NO: 750557 - DNA, 20 bp, Artificial
  CRISPR gRNA sequence
ctgattgatctcctaacaat

SEQ ID NO: 750558 - DNA, 20 bp, Artificial
  CRISPR gRNA sequence
attgatctcctaacaatgaa

SEQ ID NO: 750559 - DNA, 20 bp, Artificial
  CRISPR gRNA sequence
atctcctaacaatgaattag

SEQ ID NO: 750560 - DNA, 20 bp, Artificial
  CRISPR gRNA sequence
ctaacaatgaattagttctt

SEQ ID NO: 750561 - DNA, 20 bp, Artificial
  CRISPR gRNA sequence
acaatgaattagttcttaaa

SEQ ID NO: 750562 - DNA, 20 bp, Artificial
  CRISPR gRNA sequence
gttcttaaaagcatggattt

SEQ ID NO: 750563 - DNA, 20 bp, Artificial
  CRISPR gRNA sequence
ttaaaagcatggatttccct

SEQ ID NO: 750564 - DNA, 20 bp, Artificial
  CRISPR gRNA sequence
aaaagcatggatttccctct

SEQ ID NO: 750565 - DNA, 20 bp, Artificial
  CRISPR gRNA sequence
aaagcatggatttccctctc

SEQ ID NO: 750566 - DNA, 20 bp, Artificial
  CRISPR gRNA sequence
ccctctcagggcctcagact

SEQ ID NO: 750567 - DNA, 20 bp, Artificial
  CRISPR gRNA sequence
cctctcagggcctcagactg

SEQ ID NO: 750568 - DNA, 20 bp, Artificial
  CRISPR gRNA sequence
tcagggcctcagactgtgcc

SEQ ID NO: 750569 - DNA, 20 bp, Artificial
  CRISPR gRNA sequence
agggcctcagactgtgccac

SEQ ID NO: 750570 - DNA, 20 bp, Artificial
  CRISPR gRNA sequence
agactgtgccacgaatccag

SEQ ID NO: 750571 - DNA, 20 bp, Artificial
  CRISPR gRNA sequence
tgccacgaatccagcgctcc

SEQ ID NO: 750572 - DNA, 20 bp, Artificial
  CRISPR gRNA sequence
caggagcctcctgccccagc

SEQ ID NO: 750573 - DNA, 20 bp, Artificial
  CRISPR gRNA sequence
ctgccccagcccctagtgct

SEQ ID NO: 750574 - DNA, 20 bp, Artificial
  CRISPR gRNA sequence
ccccagcccctagtgctcct

SEQ ID NO: 750575 - DNA, 20 bp, Artificial
  CRISPR gRNA sequence
gtgctcctcccgccccctgg

SEQ ID NO: 750576 - DNA, 20 bp, Artificial
  CRISPR gRNA sequence
ctcccgccccctggaggcgc

SEQ ID NO: 750577 - DNA, 20 bp, Artificial
  CRISPR gRNA sequence
ccgccccctggaggcgccat

SEQ ID NO: 750578 - DNA, 20 bp, Artificial
  CRISPR gRNA sequence
gaggcgccatgttctcgcac

SEQ ID NO: 750579 - DNA, 20 bp, Artificial
  CRISPR gRNA sequence
tcgcacccagctctcccatg

SEQ ID NO: 750580 - DNA, 20 bp, Artificial
  CRISPR gRNA sequence
gcacccagctctcccatgca

SEQ ID NO: 750581 - DNA, 20 bp, Artificial
  CRISPR gRNA sequence
tcccatgcaccccagcccac

SEQ ID NO: 750582 - DNA, 20 bp, Artificial
  CRISPR gRNA sequence
ccatgcaccccagcccacag

SEQ ID NO: 750583 - DNA, 20 bp, Artificial
  CRISPR gRNA sequence
gcatcagaggcactaccatc

SEQ ID NO: 750584 - DNA, 20 bp, Artificial
  CRISPR gRNA sequence
ccatcccgggcaactcagag

SEQ ID NO: 750585 - DNA, 20 bp, Artificial
  CRISPR gRNA sequence
agagggcggctccagcagcc

SEQ ID NO: 750586 - DNA, 20 bp, Artificial
  CRISPR gRNA sequence
cagcagcctgcccctcccca

SEQ ID NO: 750587 - DNA, 20 bp, Artificial
  CRISPR gRNA sequence
cccctccccagcagcagcag

SEQ ID NO: 750588 - DNA, 20 bp, Artificial
  CRISPR gRNA sequence
cccagcagcagcagggaggg

SEQ ID NO: 750589 - DNA, 20 bp, Artificial
  CRISPR gRNA sequence
gtgcgttgtaggcagggcct

SEQ ID NO: 750590 - DNA, 20 bp, Artificial
  CRISPR gRNA sequence
taggcagggcctgtggccat

SEQ ID NO: 750591 - DNA, 20 bp, Artificial
  CRISPR gRNA sequence
tggccatggatgaagatgga

SEQ ID NO: 750592 - DNA, 20 bp, Artificial
  CRISPR gRNA sequence
ggagctcagagtaaatttcg

SEQ ID NO: 750593 - DNA, 20 bp, Artificial
  CRISPR gRNA sequence
agagtaaatttcgctgaaaa

SEQ ID NO: 750594 - DNA, 20 bp, Artificial
  CRISPR gRNA sequence
cgctgaaaacaggaaaccac

SEQ ID NO: 750595 - DNA, 20 bp, Artificial
  CRISPR gRNA sequence
gctgaaaacaggaaaccacg

SEQ ID NO: 750596 - DNA, 20 bp, Artificial
  CRISPR gRNA sequence
aaaacaggaaaccacgaagc

SEQ ID NO: 750597 - DNA, 20 bp, Artificial
  CRISPR gRNA sequence
agttgtaaaagggtccagag

SEQ ID NO: 750598 - DNA, 20 bp, Artificial
  CRISPR gRNA sequence
taaaagggtccagagaagag

SEQ ID NO: 750599 - DNA, 20 bp, Artificial
  CRISPR gRNA sequence
aggaggaagtgcggtggctg

SEQ ID NO: 750600 - DNA, 20 bp, Artificial
  CRISPR gRNA sequence
ttctgctgcgggccgcctcc

SEQ ID NO: 750601 - DNA, 20 bp, Artificial
  CRISPR gRNA sequence
tgctgcgggccgcctccctc

SEQ ID NO: 750602 - DNA, 20 bp, Artificial
  CRISPR gRNA sequence
ctgcgggccgcctccctctc

SEQ ID NO: 750603 - DNA, 20 bp, Artificial
  CRISPR gRNA sequence
cgggccgcctccctctccac

SEQ ID NO: 750604 - DNA, 20 bp, Artificial
  CRISPR gRNA sequence
cctctccacacagcagcagc

SEQ ID NO: 750605 - DNA, 20 bp, Artificial
  CRISPR gRNA sequence
tccacacagcagcagccagg

SEQ ID NO: 750606 - DNA, 20 bp, Artificial
  CRISPR gRNA sequence
cacacagcagcagccaggcc

SEQ ID NO: 750607 - DNA, 20 bp, Artificial
  CRISPR gRNA sequence
gggtctggcagccaaattct

SEQ ID NO: 750608 - DNA, 20 bp, Artificial
  CRISPR gRNA sequence
gcagccaaattcttagaagt

SEQ ID NO: 750609 - DNA, 20 bp, Artificial
  CRISPR gRNA sequence
ttagaagttgtctctgcctc

SEQ ID NO: 750610 - DNA, 20 bp, Artificial
  CRISPR gRNA sequence
agaagttgtctctgcctcaa

SEQ ID NO: 750611 - DNA, 20 bp, Artificial
  CRISPR gRNA sequence
gaagttgtctctgcctcaag

SEQ ID NO: 750612 - DNA, 20 bp, Artificial
  CRISPR gRNA sequence
tctctgcctcaaggtcagca

SEQ ID NO: 750613 - DNA, 20 bp, Artificial
  CRISPR gRNA sequence
tgcctcaaggtcagcagctg

SEQ ID NO: 750614 - DNA, 20 bp, Artificial
  CRISPR gRNA sequence
cctcaaggtcagcagctgag

SEQ ID NO: 750615 - DNA, 20 bp, Artificial
  CRISPR gRNA sequence
aaggtcagcagctgagggct

SEQ ID NO: 750616 - DNA, 20 bp, Artificial
  CRISPR gRNA sequence
agggctggggccaggccagc

SEQ ID NO: 750617 - DNA, 20 bp, Artificial
  CRISPR gRNA sequence
gggccaggccagcctcccca

SEQ ID NO: 750618 - DNA, 20 bp, Artificial
  CRISPR gRNA sequence
cccagagggcagggcatgct

SEQ ID NO: 750619 - DNA, 20 bp, Artificial
  CRISPR gRNA sequence
ttcctgagttgggagaaccg

SEQ ID NO: 750620 - DNA, 20 bp, Artificial
  CRISPR gRNA sequence
cctgagttgggagaaccgga

SEQ ID NO: 750621 - DNA, 20 bp, Artificial
  CRISPR gRNA sequence
ctgagttgggagaaccggaa

SEQ ID NO: 750622 - DNA, 20 bp, Artificial
  CRISPR gRNA sequence
agttgggagaaccggaatct

SEQ ID NO: 750623 - DNA, 20 bp, Artificial
  CRISPR gRNA sequence
ggagaaccggaatctgggct

SEQ ID NO: 750624 - DNA, 20 bp, Artificial
  CRISPR gRNA sequence
ggctgtgggcttgtccttcg

SEQ ID NO: 750625 - DNA, 20 bp, Artificial
  CRISPR gRNA sequence
tgggcttgtccttcgactcc

SEQ ID NO: 750626 - DNA, 20 bp, Artificial
  CRISPR gRNA sequence
gtccttcgactccaggaaca

SEQ ID NO: 750627 - DNA, 20 bp, Artificial
  CRISPR gRNA sequence
tccttcgactccaggaacag

SEQ ID NO: 750628 - DNA, 20 bp, Artificial
  CRISPR gRNA sequence
cgactccaggaacagcaggt

SEQ ID NO: 750629 - DNA, 20 bp, Artificial
  CRISPR gRNA sequence
gactccaggaacagcaggtg

SEQ ID NO: 750630 - DNA, 20 bp, Artificial
  CRISPR gRNA sequence
caggaacagcaggtgtcctg

SEQ ID NO: 750631 - DNA, 20 bp, Artificial
  CRISPR gRNA sequence
tccccactcctgccatgcag

SEQ ID NO: 750632 - DNA, 20 bp, Artificial
  CRISPR gRNA sequence
ctgccatgcaggcccccatg

SEQ ID NO: 750633 - DNA, 20 bp, Artificial
  CRISPR gRNA sequence
ccatgcaggcccccatgaat

SEQ ID NO: 750634 - DNA, 20 bp, Artificial
  CRISPR gRNA sequence
tgaaaaacataccctctttc

SEQ ID NO: 750635 - DNA, 20 bp, Artificial
  CRISPR gRNA sequence
tttccttctttctttctttt

SEQ ID NO: 750636 - DNA, 20 bp, Artificial
  CRISPR gRNA sequence
tccttctttctttcttttta

SEQ ID NO: 750637 - DNA, 20 bp, Artificial
  CRISPR gRNA sequence
ccttctttctttctttttaa

SEQ ID NO: 750638 - DNA, 20 bp, Artificial
  CRISPR gRNA sequence
cttctttctttctttttaaa

SEQ ID NO: 750639 - DNA, 20 bp, Artificial
  CRISPR gRNA sequence
ctttctttctttttaaaatt

SEQ ID NO: 750640 - DNA, 20 bp, Artificial
  CRISPR gRNA sequence
tttctttctttttaaaattt

SEQ ID NO: 750641 - DNA, 20 bp, Artificial
  CRISPR gRNA sequence
tctttctttttaaaatttgt

SEQ ID NO: 750642 - DNA, 20 bp, Artificial
  CRISPR gRNA sequence
ctttctttttaaaatttgtt

SEQ ID NO: 750643 - DNA, 20 bp, Artificial
  CRISPR gRNA sequence
tttctttttaaaatttgttt

SEQ ID NO: 750644 - DNA, 20 bp, Artificial
  CRISPR gRNA sequence
tctttttaaaatttgttttg

SEQ ID NO: 750645 - DNA, 20 bp, Artificial
  CRISPR gRNA sequence
ctttttaaaatttgttttga

SEQ ID NO: 750646 - DNA, 20 bp, Artificial
  CRISPR gRNA sequence
tttttaaaatttgttttgag

SEQ ID NO: 750647 - DNA, 20 bp, Artificial
  CRISPR gRNA sequence
tttaaaatttgttttgaggc

SEQ ID NO: 750648 - DNA, 20 bp, Artificial
  CRISPR gRNA sequence
ttaaaatttgttttgaggca

SEQ ID NO: 750649 - DNA, 20 bp, Artificial
  CRISPR gRNA sequence
taaaatttgttttgaggcaa

SEQ ID NO: 750650 - DNA, 20 bp, Artificial
  CRISPR gRNA sequence
aaaatttgttttgaggcaaa

SEQ ID NO: 750651 - DNA, 20 bp, Artificial
  CRISPR gRNA sequence
aaatttgttttgaggcaaag

SEQ ID NO: 750652 - DNA, 20 bp, Artificial
  CRISPR gRNA sequence
gttttgaggcaaagttttgc

SEQ ID NO: 750653 - DNA, 20 bp, Artificial
  CRISPR gRNA sequence
ttttgaggcaaagttttgct

SEQ ID NO: 750654 - DNA, 20 bp, Artificial
  CRISPR gRNA sequence
tgaggcaaagttttgctccg

SEQ ID NO: 750655 - DNA, 20 bp, Artificial
  CRISPR gRNA sequence
gaggcaaagttttgctccgt

SEQ ID NO: 750656 - DNA, 20 bp, Artificial
  CRISPR gRNA sequence
aggcaaagttttgctccgtc

SEQ ID NO: 750657 - DNA, 20 bp, Artificial
  CRISPR gRNA sequence
tgctccgtccccaggctgga

SEQ ID NO: 750658 - DNA, 20 bp, Artificial
  CRISPR gRNA sequence
gctccgtccccaggctggag

SEQ ID NO: 750659 - DNA, 20 bp, Artificial
  CRISPR gRNA sequence
ctccgtccccaggctggagt

SEQ ID NO: 750660 - DNA, 20 bp, Artificial
  CRISPR gRNA sequence
cgtccccaggctggagtgta

SEQ ID NO: 750661 - DNA, 20 bp, Artificial
  CRISPR gRNA sequence
gagtgtagtggctcgaacac

SEQ ID NO: 750662 - DNA, 20 bp, Artificial
  CRISPR gRNA sequence
gaacacagctcacagcagcc

SEQ ID NO: 750663 - DNA, 20 bp, Artificial
  CRISPR gRNA sequence
acagcagccttgaacacctg

SEQ ID NO: 750664 - DNA, 20 bp, Artificial
  CRISPR gRNA sequence
gaacacctgggcttaagcgg

SEQ ID NO: 750665 - DNA, 20 bp, Artificial
  CRISPR gRNA sequence
aacacctgggcttaagcggt

SEQ ID NO: 750666 - DNA, 20 bp, Artificial
  CRISPR gRNA sequence
ggcttaagcggtccttccac

SEQ ID NO: 750667 - DNA, 20 bp, Artificial
  CRISPR gRNA sequence
aagcggtccttccacctcag

SEQ ID NO: 750668 - DNA, 20 bp, Artificial
  CRISPR gRNA sequence
agcggtccttccacctcagc

SEQ ID NO: 750669 - DNA, 20 bp, Artificial
  CRISPR gRNA sequence
ccacctcagccctgcaaagt

SEQ ID NO: 750670 - DNA, 20 bp, Artificial
  CRISPR gRNA sequence
cacctcagccctgcaaagtg

SEQ ID NO: 750671 - DNA, 20 bp, Artificial
  CRISPR gRNA sequence
agccctgcaaagtgctggga

SEQ ID NO: 750672 - DNA, 20 bp, Artificial
  CRISPR gRNA sequence
caaagtgctgggaggacagg

SEQ ID NO: 750673 - DNA, 20 bp, Artificial
  CRISPR gRNA sequence
ggaggacaggtgtgtgccac

SEQ ID NO: 750674 - DNA, 20 bp, Artificial
  CRISPR gRNA sequence
ttcctatggcagctggcatc

SEQ ID NO: 750675 - DNA, 20 bp, Artificial
  CRISPR gRNA sequence
cctatggcagctggcatcaa

SEQ ID NO: 750676 - DNA, 20 bp, Artificial
  CRISPR gRNA sequence
ctatggcagctggcatcaag

SEQ ID NO: 750677 - DNA, 20 bp, Artificial
  CRISPR gRNA sequence
tggcagctggcatcaagcat

SEQ ID NO: 750678 - DNA, 20 bp, Artificial
  CRISPR gRNA sequence
gcatcaagcattgtggtgac

SEQ ID NO: 750679 - DNA, 20 bp, Artificial
  CRISPR gRNA sequence
tggtgaccagagggaacaaa

SEQ ID NO: 750680 - DNA, 20 bp, Artificial
  CRISPR gRNA sequence
tgcctagggacaagggagaa

SEQ ID NO: 750681 - DNA, 20 bp, Artificial
  CRISPR gRNA sequence
cctagggacaagggagaagc

SEQ ID NO: 750682 - DNA, 20 bp, Artificial
  CRISPR gRNA sequence
gggacaagggagaagccggg

SEQ ID NO: 750683 - DNA, 20 bp, Artificial
  CRISPR gRNA sequence
gggcatattctggccactcg

SEQ ID NO: 750684 - DNA, 20 bp, Artificial
  CRISPR gRNA sequence
ggcatattctggccactcga

SEQ ID NO: 750685 - DNA, 20 bp, Artificial
  CRISPR gRNA sequence
tggccactcgaggtgtcagc

SEQ ID NO: 750686 - DNA, 20 bp, Artificial
  CRISPR gRNA sequence
gccactcgaggtgtcagccc

SEQ ID NO: 750687 - DNA, 20 bp, Artificial
  CRISPR gRNA sequence
gaggtgtcagccccatctcc

SEQ ID NO: 750688 - DNA, 20 bp, Artificial
  CRISPR gRNA sequence
cgggcctatgtttaccctct

SEQ ID NO: 750689 - DNA, 20 bp, Artificial
  CRISPR gRNA sequence
tgtttaccctctcctcaaag

SEQ ID NO: 750690 - DNA, 20 bp, Artificial
  CRISPR gRNA sequence
accctctcctcaaagcccct

SEQ ID NO: 750691 - DNA, 20 bp, Artificial
  CRISPR gRNA sequence
ccctctcctcaaagcccctg

SEQ ID NO: 750692 - DNA, 20 bp, Artificial
  CRISPR gRNA sequence
tcctcaaagcccctggccca

SEQ ID NO: 750693 - DNA, 20 bp, Artificial
  CRISPR gRNA sequence
ctcaaagcccctggcccagc

SEQ ID NO: 750694 - DNA, 20 bp, Artificial
  CRISPR gRNA sequence
aaagcccctggcccagccca

SEQ ID NO: 750695 - DNA, 20 bp, Artificial
  CRISPR gRNA sequence
gcccagcccaggcagagcag

SEQ ID NO: 750696 - DNA, 20 bp, Artificial
  CRISPR gRNA sequence
agtggaccattcctttgggc

SEQ ID NO: 750697 - DNA, 20 bp, Artificial
  CRISPR gRNA sequence
ctttgggcctaactgggggg

SEQ ID NO: 750698 - DNA, 20 bp, Artificial
  CRISPR gRNA sequence
tgggcctaactggggggctt

SEQ ID NO: 750699 - DNA, 20 bp, Artificial
  CRISPR gRNA sequence
gggcctaactggggggctta

SEQ ID NO: 750700 - DNA, 20 bp, Artificial
  CRISPR gRNA sequence
ggcctaactggggggcttag

SEQ ID NO: 750701 - DNA, 20 bp, Artificial
  CRISPR gRNA sequence
actggggggcttagaagcag

SEQ ID NO: 750702 - DNA, 20 bp, Artificial
  CRISPR gRNA sequence
gggggcttagaagcagggcc

SEQ ID NO: 750703 - DNA, 20 bp, Artificial
  CRISPR gRNA sequence
agaagcagggccatgtgtcc

SEQ ID NO: 750704 - DNA, 20 bp, Artificial
  CRISPR gRNA sequence
gaagcagggccatgtgtcca

SEQ ID NO: 750705 - DNA, 20 bp, Artificial
  CRISPR gRNA sequence
cctggctgtagccacaggcc

SEQ ID NO: 750706 - DNA, 20 bp, Artificial
  CRISPR gRNA sequence
gctgtagccacaggcccagg

SEQ ID NO: 750707 - DNA, 20 bp, Artificial
  CRISPR gRNA sequence
tagccacaggcccagggctc

SEQ ID NO: 750708 - DNA, 20 bp, Artificial
  CRISPR gRNA sequence
actgctgccaggcagcctag

SEQ ID NO: 750709 - DNA, 20 bp, Artificial
  CRISPR gRNA sequence
ctgccaggcagcctagaggt

SEQ ID NO: 750710 - DNA, 20 bp, Artificial
  CRISPR gRNA sequence
ccaggcagcctagaggtgct

SEQ ID NO: 750711 - DNA, 20 bp, Artificial
  CRISPR gRNA sequence
gaggtgctccccttttccat

SEQ ID NO: 750712 - DNA, 20 bp, Artificial
  CRISPR gRNA sequence
cccttttccatccccccaac

SEQ ID NO: 750713 - DNA, 20 bp, Artificial
  CRISPR gRNA sequence
ttccatccccccaacccccc

SEQ ID NO: 750714 - DNA, 20 bp, Artificial
  CRISPR gRNA sequence
tccatccccccaacccccca

SEQ ID NO: 750715 - DNA, 20 bp, Artificial
  CRISPR gRNA sequence
ccatccccccaaccccccaa

SEQ ID NO: 750716 - DNA, 20 bp, Artificial
  CRISPR gRNA sequence
catccccccaaccccccaag

SEQ ID NO: 750717 - DNA, 20 bp, Artificial
  CRISPR gRNA sequence
ggcgaacatcttcccgccta

SEQ ID NO: 750718 - DNA, 20 bp, Artificial
  CRISPR gRNA sequence
cccgcctagccccaaatcct

SEQ ID NO: 750719 - DNA, 20 bp, Artificial
  CRISPR gRNA sequence
ccgcctagccccaaatcctg

SEQ ID NO: 750720 - DNA, 20 bp, Artificial
  CRISPR gRNA sequence
gccccaaatcctggctttca

SEQ ID NO: 750721 - DNA, 20 bp, Artificial
  CRISPR gRNA sequence
gctttcagcacccaggccca

SEQ ID NO: 750722 - DNA, 20 bp, Artificial
  CRISPR gRNA sequence
tcagcacccaggcccagctc

SEQ ID NO: 750723 - DNA, 20 bp, Artificial
  CRISPR gRNA sequence
cagcacccaggcccagctca

SEQ ID NO: 750724 - DNA, 20 bp, Artificial
  CRISPR gRNA sequence
agcacccaggcccagctcag

SEQ ID NO: 750725 - DNA, 20 bp, Artificial
  CRISPR gRNA sequence
agcagagccagtgtaggctg

SEQ ID NO: 750726 - DNA, 20 bp, Artificial
  CRISPR gRNA sequence
ctaggagacaaatgcccagg

SEQ ID NO: 750727 - DNA, 20 bp, Artificial
  CRISPR gRNA sequence
ggagacaaatgcccaggctg

SEQ ID NO: 750728 - DNA, 20 bp, Artificial
  CRISPR gRNA sequence
gactatgctctccacagtac

SEQ ID NO: 750729 - DNA, 20 bp, Artificial
  CRISPR gRNA sequence
tgctctccacagtacctggg

SEQ ID NO: 750730 - DNA, 20 bp, Artificial
  CRISPR gRNA sequence
tccacagtacctggggcccc

SEQ ID NO: 750731 - DNA, 20 bp, Artificial
  CRISPR gRNA sequence
cacagtacctggggccccca

SEQ ID NO: 750732 - DNA, 20 bp, Artificial
  CRISPR gRNA sequence
gggcccccatcctgctaaac

SEQ ID NO: 750733 - DNA, 20 bp, Artificial
  CRISPR gRNA sequence
ctaaacgctacagggggtct

SEQ ID NO: 750734 - DNA, 20 bp, Artificial
  CRISPR gRNA sequence
aacgctacagggggtctgcc

SEQ ID NO: 750735 - DNA, 20 bp, Artificial
  CRISPR gRNA sequence
cagggggtctgcccagcccc

SEQ ID NO: 750736 - DNA, 20 bp, Artificial
  CRISPR gRNA sequence
cccagccccacctcacctgt

SEQ ID NO: 750737 - DNA, 20 bp, Artificial
  CRISPR gRNA sequence
acctgtccccatgctcaggc

SEQ ID NO: 750738 - DNA, 20 bp, Artificial
  CRISPR gRNA sequence
tccccatgctcaggcactgc

SEQ ID NO: 750739 - DNA, 20 bp, Artificial
  CRISPR gRNA sequence
aggcactgccttccctgttt

SEQ ID NO: 750740 - DNA, 20 bp, Artificial
  CRISPR gRNA sequence
ccttccctgttttaccccca

SEQ ID NO: 750741 - DNA, 20 bp, Artificial
  CRISPR gRNA sequence
ccctgttttacccccagagt

SEQ ID NO: 750742 - DNA, 20 bp, Artificial
  CRISPR gRNA sequence
cctgttttacccccagagtg

SEQ ID NO: 750743 - DNA, 20 bp, Artificial
  CRISPR gRNA sequence
ttttacccccagagtgtaca

SEQ ID NO: 750744 - DNA, 20 bp, Artificial
  CRISPR gRNA sequence
tacccccagagtgtacagag

SEQ ID NO: 750745 - DNA, 20 bp, Artificial
  CRISPR gRNA sequence
acccccagagtgtacagaga

SEQ ID NO: 750746 - DNA, 20 bp, Artificial
  CRISPR gRNA sequence
cccccagagtgtacagagat

SEQ ID NO: 750747 - DNA, 20 bp, Artificial
  CRISPR gRNA sequence
ctctcctcccctgctttaaa

SEQ ID NO: 750748 - DNA, 20 bp, Artificial
  CRISPR gRNA sequence
tcctcccctgctttaaaatc

SEQ ID NO: 750749 - DNA, 20 bp, Artificial
  CRISPR gRNA sequence
ctcccctgctttaaaatcct

SEQ ID NO: 750750 - DNA, 20 bp, Artificial
  CRISPR gRNA sequence
ccctgctttaaaatccttca

SEQ ID NO: 750751 - DNA, 20 bp, Artificial
  CRISPR gRNA sequence
ctttaaaatccttcaatcac

SEQ ID NO: 750752 - DNA, 20 bp, Artificial
  CRISPR gRNA sequence
taaaatccttcaatcacaat

SEQ ID NO: 750753 - DNA, 20 bp, Artificial
  CRISPR gRNA sequence
aaaatccttcaatcacaatt

SEQ ID NO: 750754 - DNA, 20 bp, Artificial
  CRISPR gRNA sequence
aaatccttcaatcacaattc

SEQ ID NO: 750755 - DNA, 20 bp, Artificial
  CRISPR gRNA sequence
caatcacaattccacagagg

SEQ ID NO: 750756 - DNA, 20 bp, Artificial
  CRISPR gRNA sequence
aatcacaattccacagagga

SEQ ID NO: 750757 - DNA, 20 bp, Artificial
  CRISPR gRNA sequence
cacagaggactcaccttgcc

SEQ ID NO: 750758 - DNA, 20 bp, Artificial
  CRISPR gRNA sequence
accttgcctatgtgtataaa

SEQ ID NO: 750759 - DNA, 20 bp, Artificial
  CRISPR gRNA sequence
gcctatgtgtataaaaacaa

SEQ ID NO: 750760 - DNA, 20 bp, Artificial
  CRISPR gRNA sequence
cctatgtgtataaaaacaaa

SEQ ID NO: 750761 - DNA, 20 bp, Artificial
  CRISPR gRNA sequence
tgtgtataaaaacaaagcca

SEQ ID NO: 750762 - DNA, 20 bp, Artificial
  CRISPR gRNA sequence
gccgaatggctctgaagcga

SEQ ID NO: 750763 - DNA, 20 bp, Artificial
  CRISPR gRNA sequence
tgaagcgaagactccaccag

SEQ ID NO: 750764 - DNA, 20 bp, Artificial
  CRISPR gRNA sequence
aagcgaagactccaccaggc

SEQ ID NO: 750765 - DNA, 20 bp, Artificial
  CRISPR gRNA sequence
caccaggcccagattgtatg

SEQ ID NO: 750766 - DNA, 20 bp, Artificial
  CRISPR gRNA sequence
tatggagtggaaggtggggg

SEQ ID NO: 750767 - DNA, 20 bp, Artificial
  CRISPR gRNA sequence
aaactggctcttacaatcca

SEQ ID NO: 750768 - DNA, 20 bp, Artificial
  CRISPR gRNA sequence
aactggctcttacaatccat

SEQ ID NO: 750769 - DNA, 20 bp, Artificial
  CRISPR gRNA sequence
gctcttacaatccatctcca

SEQ ID NO: 750770 - DNA, 20 bp, Artificial
  CRISPR gRNA sequence
ttacaatccatctccagggt

SEQ ID NO: 750771 - DNA, 20 bp, Artificial
  CRISPR gRNA sequence
acaatccatctccagggttt

SEQ ID NO: 750772 - DNA, 20 bp, Artificial
  CRISPR gRNA sequence
caatccatctccagggtttg

SEQ ID NO: 750773 - DNA, 20 bp, Artificial
  CRISPR gRNA sequence
cagggtttgcacctgtttcc

SEQ ID NO: 750774 - DNA, 20 bp, Artificial
  CRISPR gRNA sequence
gcacctgtttccccatgtag

SEQ ID NO: 750775 - DNA, 20 bp, Artificial
  CRISPR gRNA sequence
cacctgtttccccatgtagt

SEQ ID NO: 750776 - DNA, 20 bp, Artificial
  CRISPR gRNA sequence
tttccccatgtagtttttaa

SEQ ID NO: 750777 - DNA, 20 bp, Artificial
  CRISPR gRNA sequence
ccccatgtagtttttaatag

SEQ ID NO: 750778 - DNA, 20 bp, Artificial
  CRISPR gRNA sequence
cccatgtagtttttaatagc

SEQ ID NO: 750779 - DNA, 20 bp, Artificial
  CRISPR gRNA sequence
ttaatagcatcccgcttcat

SEQ ID NO: 750780 - DNA, 20 bp, Artificial
  CRISPR gRNA sequence
taatagcatcccgcttcata

SEQ ID NO: 750781 - DNA, 20 bp, Artificial
  CRISPR gRNA sequence
aatagcatcccgcttcatac

SEQ ID NO: 750782 - DNA, 20 bp, Artificial
  CRISPR gRNA sequence
atagcatcccgcttcatact

SEQ ID NO: 750783 - DNA, 20 bp, Artificial
  CRISPR gRNA sequence
catactcagaagtgtcccag

SEQ ID NO: 750784 - DNA, 20 bp, Artificial
  CRISPR gRNA sequence
atactcagaagtgtcccagg

SEQ ID NO: 750785 - DNA, 20 bp, Artificial
  CRISPR gRNA sequence
agaagtgtcccagggtggac

SEQ ID NO: 750786 - DNA, 20 bp, Artificial
  CRISPR gRNA sequence
tgtggcacccttgcaatggc

SEQ ID NO: 750787 - DNA, 20 bp, Artificial
  CRISPR gRNA sequence
gcaatggcccgcgctgagca

SEQ ID NO: 750788 - DNA, 20 bp, Artificial
  CRISPR gRNA sequence
caatggcccgcgctgagcag

SEQ ID NO: 750789 - DNA, 20 bp, Artificial
  CRISPR gRNA sequence
agcagtgggagtaggggatg

SEQ ID NO: 750790 - DNA, 20 bp, Artificial
  CRISPR gRNA sequence
tccactcaccttcccagaag

SEQ ID NO: 750791 - DNA, 20 bp, Artificial
  CRISPR gRNA sequence
cactcaccttcccagaaggc

SEQ ID NO: 750792 - DNA, 20 bp, Artificial
  CRISPR gRNA sequence
accttcccagaaggccccac

SEQ ID NO: 750793 - DNA, 20 bp, Artificial
  CRISPR gRNA sequence
cccagaaggccccacccacc

SEQ ID NO: 750794 - DNA, 20 bp, Artificial
  CRISPR gRNA sequence
ccagaaggccccacccacct

SEQ ID NO: 750795 - DNA, 20 bp, Artificial
  CRISPR gRNA sequence
cctcagcaccatctccagtg

SEQ ID NO: 750796 - DNA, 20 bp, Artificial
  CRISPR gRNA sequence
agcaccatctccagtgggtg

SEQ ID NO: 750797 - DNA, 20 bp, Artificial
  CRISPR gRNA sequence
cagtgggtggggcaacatct

SEQ ID NO: 750798 - DNA, 20 bp, Artificial
  CRISPR gRNA sequence
tcctggcctcagattgccca

SEQ ID NO: 750799 - DNA, 20 bp, Artificial
  CRISPR gRNA sequence
gcctcagattgcccaagaca

SEQ ID NO: 750800 - DNA, 20 bp, Artificial
  CRISPR gRNA sequence
agattgcccaagacaccatt

SEQ ID NO: 750801 - DNA, 20 bp, Artificial
  CRISPR gRNA sequence
cccaagacaccatttgctca

SEQ ID NO: 750802 - DNA, 20 bp, Artificial
  CRISPR gRNA sequence
gctcacggaggccaccatgc

SEQ ID NO: 750803 - DNA, 20 bp, Artificial
  CRISPR gRNA sequence
ctcacggaggccaccatgcc

SEQ ID NO: 750804 - DNA, 20 bp, Artificial
  CRISPR gRNA sequence
acggaggccaccatgcccca

SEQ ID NO: 750805 - DNA, 20 bp, Artificial
  CRISPR gRNA sequence
cccgtttcgggaccaccaag

SEQ ID NO: 750806 - DNA, 20 bp, Artificial
  CRISPR gRNA sequence
ccgtttcgggaccaccaagc

SEQ ID NO: 750807 - DNA, 20 bp, Artificial
  CRISPR gRNA sequence
cgggaccaccaagctctggg

SEQ ID NO: 750808 - DNA, 20 bp, Artificial
  CRISPR gRNA sequence
gggaccaccaagctctgggg

SEQ ID NO: 750809 - DNA, 20 bp, Artificial
  CRISPR gRNA sequence
tggggactggaatgcaggca

SEQ ID NO: 750810 - DNA, 20 bp, Artificial
  CRISPR gRNA sequence
gggactggaatgcaggcagt

SEQ ID NO: 750811 - DNA, 20 bp, Artificial
  CRISPR gRNA sequence
gaatgcaggcagtggaagcc

SEQ ID NO: 750812 - DNA, 20 bp, Artificial
  CRISPR gRNA sequence
acttaacctgttgacagatc

SEQ ID NO: 750813 - DNA, 20 bp, Artificial
  CRISPR gRNA sequence
aacctgttgacagatcttca

SEQ ID NO: 750814 - DNA, 20 bp, Artificial
  CRISPR gRNA sequence
acctgttgacagatcttcag

SEQ ID NO: 750815 - DNA, 20 bp, Artificial
  CRISPR gRNA sequence
ttgacagatcttcagagaaa

SEQ ID NO: 750816 - DNA, 20 bp, Artificial
  CRISPR gRNA sequence
acagatcttcagagaaactg

SEQ ID NO: 750817 - DNA, 20 bp, Artificial
  CRISPR gRNA sequence
cagagaaactgctggtagga

SEQ ID NO: 750818 - DNA, 20 bp, Artificial
  CRISPR gRNA sequence
agagaaactgctggtaggag

SEQ ID NO: 750819 - DNA, 20 bp, Artificial
  CRISPR gRNA sequence
ctggtaggaggcagctgggg

SEQ ID NO: 750820 - DNA, 20 bp, Artificial
  CRISPR gRNA sequence
gtaggaggcagctggggaag

SEQ ID NO: 750821 - DNA, 20 bp, Artificial
  CRISPR gRNA sequence
gggaaggtggcgatggccag

SEQ ID NO: 750822 - DNA, 20 bp, Artificial
  CRISPR gRNA sequence
gccccagagccactgtggta

SEQ ID NO: 750823 - DNA, 20 bp, Artificial
  CRISPR gRNA sequence
tggtacaaagaggaagtctg

SEQ ID NO: 750824 - DNA, 20 bp, Artificial
  CRISPR gRNA sequence
acagaagagcagcctcgggc

SEQ ID NO: 750825 - DNA, 20 bp, Artificial
  CRISPR gRNA sequence
gggcaaaacgggggagccaa

SEQ ID NO: 750826 - DNA, 20 bp, Artificial
  CRISPR gRNA sequence
tccaccgtgccctgtgtctg

SEQ ID NO: 750827 - DNA, 20 bp, Artificial
  CRISPR gRNA sequence
caccgtgccctgtgtctggt

SEQ ID NO: 750828 - DNA, 20 bp, Artificial
  CRISPR gRNA sequence
tgtctggtgcctgggagggt

SEQ ID NO: 750829 - DNA, 20 bp, Artificial
  CRISPR gRNA sequence
gtgcctgggagggtggccca

SEQ ID NO: 750830 - DNA, 20 bp, Artificial
  CRISPR gRNA sequence
ggagggtggcccagtgtcca

SEQ ID NO: 750831 - DNA, 20 bp, Artificial
  CRISPR gRNA sequence
gtcccactgatgctgccaca

SEQ ID NO: 750832 - DNA, 20 bp, Artificial
  CRISPR gRNA sequence
tcccactgatgctgccacat

SEQ ID NO: 750833 - DNA, 20 bp, Artificial
  CRISPR gRNA sequence
atgctgccacatcccaaggc

SEQ ID NO: 750834 - DNA, 20 bp, Artificial
  CRISPR gRNA sequence
ccacatcccaaggctcatgt

SEQ ID NO: 750835 - DNA, 20 bp, Artificial
  CRISPR gRNA sequence
atgtctcagaacgagagctg

SEQ ID NO: 750836 - DNA, 20 bp, Artificial
  CRISPR gRNA sequence
agaacgagagctgctgaagg

SEQ ID NO: 750837 - DNA, 20 bp, Artificial
  CRISPR gRNA sequence
ctgaagggctggacgttctg

SEQ ID NO: 750838 - DNA, 20 bp, Artificial
  CRISPR gRNA sequence
aagggctggacgttctgaga

SEQ ID NO: 750839 - DNA, 20 bp, Artificial
  CRISPR gRNA sequence
gacgttctgagacttcttaa

SEQ ID NO: 750840 - DNA, 20 bp, Artificial
  CRISPR gRNA sequence
tgagacttcttaagatgtaa

SEQ ID NO: 750841 - DNA, 20 bp, Artificial
  CRISPR gRNA sequence
agacttcttaagatgtaagt

SEQ ID NO: 750842 - DNA, 20 bp, Artificial
  CRISPR gRNA sequence
cttaagatgtaagtcatttg

SEQ ID NO: 750843 - DNA, 20 bp, Artificial
  CRISPR gRNA sequence
ttaagatgtaagtcatttgg

SEQ ID NO: 750844 - DNA, 20 bp, Artificial
  CRISPR gRNA sequence
aagatgtaagtcatttggca

SEQ ID NO: 750845 - DNA, 20 bp, Artificial
  CRISPR gRNA sequence
agatgtaagtcatttggcat

SEQ ID NO: 750846 - DNA, 20 bp, Artificial
  CRISPR gRNA sequence
ggcatctgtagctggtgaat

SEQ ID NO: 750847 - DNA, 20 bp, Artificial
  CRISPR gRNA sequence
gcatctgtagctggtgaatt

SEQ ID NO: 750848 - DNA, 20 bp, Artificial
  CRISPR gRNA sequence
tagctggtgaatttcaggtc

SEQ ID NO: 750849 - DNA, 20 bp, Artificial
  CRISPR gRNA sequence
gtgaatttcaggtctctagg

SEQ ID NO: 750850 - DNA, 20 bp, Artificial
  CRISPR gRNA sequence
caggtctctaggggagaatc

SEQ ID NO: 750851 - DNA, 20 bp, Artificial
  CRISPR gRNA sequence
aggtctctaggggagaatct

SEQ ID NO: 750852 - DNA, 20 bp, Artificial
  CRISPR gRNA sequence
taggggagaatctcagcacc

SEQ ID NO: 750853 - DNA, 20 bp, Artificial
  CRISPR gRNA sequence
ggggagaatctcagcacccc

SEQ ID NO: 750854 - DNA, 20 bp, Artificial
  CRISPR gRNA sequence
agcaccccaaaatccttgga

SEQ ID NO: 750855 - DNA, 20 bp, Artificial
  CRISPR gRNA sequence
ggaacaggggctgagccgtc

SEQ ID NO: 750856 - DNA, 20 bp, Artificial
  CRISPR gRNA sequence
gaacaggggctgagccgtcc

SEQ ID NO: 750857 - DNA, 20 bp, Artificial
  CRISPR gRNA sequence
agccgtccagcatccccatg

SEQ ID NO: 750858 - DNA, 20 bp, Artificial
  CRISPR gRNA sequence
aggggctgggcttctgggat

SEQ ID NO: 750859 - DNA, 20 bp, Artificial
  CRISPR gRNA sequence
ggcttctgggatgtcacagt

SEQ ID NO: 750860 - DNA, 20 bp, Artificial
  CRISPR gRNA sequence
ctgggatgtcacagtatctg

SEQ ID NO: 750861 - DNA, 20 bp, Artificial
  CRISPR gRNA sequence
tgggatgtcacagtatctga

SEQ ID NO: 750862 - DNA, 20 bp, Artificial
  CRISPR gRNA sequence
ggatgtcacagtatctgagc

SEQ ID NO: 750863 - DNA, 20 bp, Artificial
  CRISPR gRNA sequence
agcccagagcaggagggagg

SEQ ID NO: 750864 - DNA, 20 bp, Artificial
  CRISPR gRNA sequence
acagagccagccctggctca

SEQ ID NO: 750865 - DNA, 20 bp, Artificial
  CRISPR gRNA sequence
gctcaaatgcacctgcccca

SEQ ID NO: 750866 - DNA, 20 bp, Artificial
  CRISPR gRNA sequence
aaatgcacctgccccagacc

SEQ ID NO: 750867 - DNA, 20 bp, Artificial
  CRISPR gRNA sequence
ccccagacccagccacaaca

SEQ ID NO: 750868 - DNA, 20 bp, Artificial
  CRISPR gRNA sequence
tcccccagctgggctagatg

SEQ ID NO: 750869 - DNA, 20 bp, Artificial
  CRISPR gRNA sequence
ggctagatgacctcaaagtt

SEQ ID NO: 750870 - DNA, 20 bp, Artificial
  CRISPR gRNA sequence
gatgacctcaaagtttggag

SEQ ID NO: 750871 - DNA, 20 bp, Artificial
  CRISPR gRNA sequence
aaagtttggagagtcaggga

SEQ ID NO: 750872 - DNA, 20 bp, Artificial
  CRISPR gRNA sequence
ggagagtcagggacagggtc

SEQ ID NO: 750873 - DNA, 20 bp, Artificial
  CRISPR gRNA sequence
gagagtcagggacagggtct

SEQ ID NO: 750874 - DNA, 20 bp, Artificial
  CRISPR gRNA sequence
caagaaaaggagaagcaaag

SEQ ID NO: 750875 - DNA, 20 bp, Artificial
  CRISPR gRNA sequence
tgcccctcaccctcaacccc

SEQ ID NO: 750876 - DNA, 20 bp, Artificial
  CRISPR gRNA sequence
cccctcaccctcaaccccac

SEQ ID NO: 750877 - DNA, 20 bp, Artificial
  CRISPR gRNA sequence
accctcaaccccaccccgtg

SEQ ID NO: 750878 - DNA, 20 bp, Artificial
  CRISPR gRNA sequence
aaccccaccccgtgaggccg

SEQ ID NO: 750879 - DNA, 20 bp, Artificial
  CRISPR gRNA sequence
ttcagggaggtgaatggggg

SEQ ID NO: 750880 - DNA, 20 bp, Artificial
  CRISPR gRNA sequence
cagggaggtgaatgggggcc

SEQ ID NO: 750881 - DNA, 20 bp, Artificial
  CRISPR gRNA sequence
agggaggtgaatgggggccc

SEQ ID NO: 750882 - DNA, 20 bp, Artificial
  CRISPR gRNA sequence
tgtccctcaccctcaacccc

SEQ ID NO: 750883 - DNA, 20 bp, Artificial
  CRISPR gRNA sequence
tccctcaccctcaaccccac

SEQ ID NO: 750884 - DNA, 20 bp, Artificial
  CRISPR gRNA sequence
accctcaaccccaccccgtg

SEQ ID NO: 750885 - DNA, 20 bp, Artificial
  CRISPR gRNA sequence
aaccccaccccgtgaggccg

SEQ ID NO: 750886 - DNA, 20 bp, Artificial
  CRISPR gRNA sequence
ttcagggaggtgaatggggg

SEQ ID NO: 750887 - DNA, 20 bp, Artificial
  CRISPR gRNA sequence
cagggaggtgaatgggggcc

SEQ ID NO: 750888 - DNA, 20 bp, Artificial
  CRISPR gRNA sequence
agggaggtgaatgggggccc

SEQ ID NO: 750889 - DNA, 20 bp, Artificial
  CRISPR gRNA sequence
tgtccctcaccctcaacccc

SEQ ID NO: 750890 - DNA, 20 bp, Artificial
  CRISPR gRNA sequence
tccctcaccctcaaccccac

SEQ ID NO: 750891 - DNA, 20 bp, Artificial
  CRISPR gRNA sequence
accctcaaccccaccccgtg

SEQ ID NO: 750892 - DNA, 20 bp, Artificial
  CRISPR gRNA sequence
aaccccaccccgtgaggccg

SEQ ID NO: 750893 - DNA, 20 bp, Artificial
  CRISPR gRNA sequence
ttcagggaggtgaatggggg

SEQ ID NO: 750894 - DNA, 20 bp, Artificial
  CRISPR gRNA sequence
cagggaggtgaatgggggcc

SEQ ID NO: 750895 - DNA, 20 bp, Artificial
  CRISPR gRNA sequence
agggaggtgaatgggggccc

SEQ ID NO: 750896 - DNA, 20 bp, Artificial
  CRISPR gRNA sequence
tgtccctcaccctcaacccc

SEQ ID NO: 750897 - DNA, 20 bp, Artificial
  CRISPR gRNA sequence
tccctcaccctcaaccccac

SEQ ID NO: 750898 - DNA, 20 bp, Artificial
  CRISPR gRNA sequence
accctcaaccccaccccgtg

SEQ ID NO: 750899 - DNA, 20 bp, Artificial
  CRISPR gRNA sequence
aaccccaccccgtgaggccg

SEQ ID NO: 750900 - DNA, 20 bp, Artificial
  CRISPR gRNA sequence
ttcagggagggcagggagtg

SEQ ID NO: 750901 - DNA, 20 bp, Artificial
  CRISPR gRNA sequence
cagggagggcagggagtgag

SEQ ID NO: 750902 - DNA, 20 bp, Artificial
  CRISPR gRNA sequence
agggagggcagggagtgagg

SEQ ID NO: 750903 - DNA, 20 bp, Artificial
  CRISPR gRNA sequence
caggccatgaggtcatgacc

SEQ ID NO: 750904 - DNA, 20 bp, Artificial
  CRISPR gRNA sequence
acaggtcatcgtgctgtgaa

SEQ ID NO: 750905 - DNA, 20 bp, Artificial
  CRISPR gRNA sequence
caggtcatcgtgctgtgaag

SEQ ID NO: 750906 - DNA, 20 bp, Artificial
  CRISPR gRNA sequence
tgaaggtcaggaaacactta

SEQ ID NO: 750907 - DNA, 20 bp, Artificial
  CRISPR gRNA sequence
acccagggatgggaagaaga

SEQ ID NO: 750908 - DNA, 20 bp, Artificial
  CRISPR gRNA sequence
cccagggatgggaagaagac

SEQ ID NO: 750909 - DNA, 20 bp, Artificial
  CRISPR gRNA sequence
cggggcctggaggagacagg

SEQ ID NO: 750910 - DNA, 20 bp, Artificial
  CRISPR gRNA sequence
gaggagacaggggggtgctg

SEQ ID NO: 750911 - DNA, 20 bp, Artificial
  CRISPR gRNA sequence
ggctccgaaagcagatgccg

SEQ ID NO: 750912 - DNA, 20 bp, Artificial
  CRISPR gRNA sequence
cgaaagcagatgccgcccag

SEQ ID NO: 750913 - DNA, 20 bp, Artificial
  CRISPR gRNA sequence
agaaggctgccgctgggcca

SEQ ID NO: 750914 - DNA, 20 bp, Artificial
  CRISPR gRNA sequence
ccgctgggccacataggaca

SEQ ID NO: 750915 - DNA, 20 bp, Artificial
  CRISPR gRNA sequence
ggccacataggacagggggt

SEQ ID NO: 750916 - DNA, 20 bp, Artificial
  CRISPR gRNA sequence
actttggcctcgggtatccc

SEQ ID NO: 750917 - DNA, 20 bp, Artificial
  CRISPR gRNA sequence
tggcctcgggtatcccctgg

SEQ ID NO: 750918 - DNA, 20 bp, Artificial
  CRISPR gRNA sequence
ggcctcgggtatcccctggg

SEQ ID NO: 750919 - DNA, 20 bp, Artificial
  CRISPR gRNA sequence
gcctcgggtatcccctgggc

SEQ ID NO: 750920 - DNA, 20 bp, Artificial
  CRISPR gRNA sequence
gggtatcccctgggcaggtg

SEQ ID NO: 750921 - DNA, 20 bp, Artificial
  CRISPR gRNA sequence
ggcaggtggtgaggcttcaa

SEQ ID NO: 750922 - DNA, 20 bp, Artificial
  CRISPR gRNA sequence
caaagccggggttttcaatc

SEQ ID NO: 750923 - DNA, 20 bp, Artificial
  CRISPR gRNA sequence
aaagccggggttttcaatcc

SEQ ID NO: 750924 - DNA, 20 bp, Artificial
  CRISPR gRNA sequence
tcaatcccttgaatgttgct

SEQ ID NO: 750925 - DNA, 20 bp, Artificial
  CRISPR gRNA sequence
caatcccttgaatgttgctg

SEQ ID NO: 750926 - DNA, 20 bp, Artificial
  CRISPR gRNA sequence
aatcccttgaatgttgctgc

SEQ ID NO: 750927 - DNA, 20 bp, Artificial
  CRISPR gRNA sequence
gaatgttgctgccacagaac

SEQ ID NO: 750928 - DNA, 20 bp, Artificial
  CRISPR gRNA sequence
aatgttgctgccacagaacc

SEQ ID NO: 750929 - DNA, 20 bp, Artificial
  CRISPR gRNA sequence
ctgccacagaaccagaatgg

SEQ ID NO: 750930 - DNA, 20 bp, Artificial
  CRISPR gRNA sequence
ccacagaaccagaatggaag

SEQ ID NO: 750931 - DNA, 20 bp, Artificial
  CRISPR gRNA sequence
tgctgtccggagcgtgaact

SEQ ID NO: 750932 - DNA, 20 bp, Artificial
  CRISPR gRNA sequence
tccggagcgtgaactctgcc

SEQ ID NO: 750933 - DNA, 20 bp, Artificial
  CRISPR gRNA sequence
tgccctccctgcccccagtt

SEQ ID NO: 750934 - DNA, 20 bp, Artificial
  CRISPR gRNA sequence
ccctccctgcccccagtttt

SEQ ID NO: 750935 - DNA, 20 bp, Artificial
  CRISPR gRNA sequence
cctgcccccagtttttctct

SEQ ID NO: 750936 - DNA, 20 bp, Artificial
  CRISPR gRNA sequence
cccccagtttttctctcctc

SEQ ID NO: 750937 - DNA, 20 bp, Artificial
  CRISPR gRNA sequence
ttctctcctccctttctctc

SEQ ID NO: 750938 - DNA, 20 bp, Artificial
  CRISPR gRNA sequence
tctctcctccctttctctca

SEQ ID NO: 750939 - DNA, 20 bp, Artificial
  CRISPR gRNA sequence
ctctcctccctttctctcac

SEQ ID NO: 750940 - DNA, 20 bp, Artificial
  CRISPR gRNA sequence
tctcctccctttctctcacc

SEQ ID NO: 750941 - DNA, 20 bp, Artificial
  CRISPR gRNA sequence
tcctccctttctctcaccta

SEQ ID NO: 750942 - DNA, 20 bp, Artificial
  CRISPR gRNA sequence
ctccctttctctcacctaca

SEQ ID NO: 750943 - DNA, 20 bp, Artificial
  CRISPR gRNA sequence
cctttctctcacctacatcc

SEQ ID NO: 750944 - DNA, 20 bp, Artificial
  CRISPR gRNA sequence
tctctcacctacatccccat

SEQ ID NO: 750945 - DNA, 20 bp, Artificial
  CRISPR gRNA sequence
ctctcacctacatccccatc

SEQ ID NO: 750946 - DNA, 20 bp, Artificial
  CRISPR gRNA sequence
tctcacctacatccccatcc

SEQ ID NO: 750947 - DNA, 20 bp, Artificial
  CRISPR gRNA sequence
tcacctacatccccatcccc

SEQ ID NO: 750948 - DNA, 20 bp, Artificial
  CRISPR gRNA sequence
acctacatccccatccccaa

SEQ ID NO: 750949 - DNA, 20 bp, Artificial
  CRISPR gRNA sequence
catccccatccccaagcctc

SEQ ID NO: 750950 - DNA, 20 bp, Artificial
  CRISPR gRNA sequence
agcagcatctccaagcaaga

SEQ ID NO: 750951 - DNA, 20 bp, Artificial
  CRISPR gRNA sequence
caagcaagaaggcaggagcc

SEQ ID NO: 750952 - DNA, 20 bp, Artificial
  CRISPR gRNA sequence
cacctgcccacctgtcctga

SEQ ID NO: 750953 - DNA, 20 bp, Artificial
  CRISPR gRNA sequence
cccacctgtcctgagctgag

SEQ ID NO: 750954 - DNA, 20 bp, Artificial
  CRISPR gRNA sequence
tcctgagctgagggcatcag

SEQ ID NO: 750955 - DNA, 20 bp, Artificial
  CRISPR gRNA sequence
agctgagggcatcagggccc

SEQ ID NO: 750956 - DNA, 20 bp, Artificial
  CRISPR gRNA sequence
agggcatcagggcccaccag

SEQ ID NO: 750957 - DNA, 20 bp, Artificial
  CRISPR gRNA sequence
ctccctgtggtctgaccatc

SEQ ID NO: 750958 - DNA, 20 bp, Artificial
  CRISPR gRNA sequence
cctgtggtctgaccatcaac

SEQ ID NO: 750959 - DNA, 20 bp, Artificial
  CRISPR gRNA sequence
tggtctgaccatcaaccccg

SEQ ID NO: 750960 - DNA, 20 bp, Artificial
  CRISPR gRNA sequence
accatcaaccccgggcacag

SEQ ID NO: 750961 - DNA, 20 bp, Artificial
  CRISPR gRNA sequence
ctagaacttcagcctcagga

SEQ ID NO: 750962 - DNA, 20 bp, Artificial
  CRISPR gRNA sequence
tagaacttcagcctcaggaa

SEQ ID NO: 750963 - DNA, 20 bp, Artificial
  CRISPR gRNA sequence
gaacttcagcctcaggaatt

SEQ ID NO: 750964 - DNA, 20 bp, Artificial
  CRISPR gRNA sequence
cagcctcaggaatttgggga

SEQ ID NO: 750965 - DNA, 20 bp, Artificial
  CRISPR gRNA sequence
agcctcaggaatttggggac

SEQ ID NO: 750966 - DNA, 20 bp, Artificial
  CRISPR gRNA sequence
aggaatttggggacaagttt

SEQ ID NO: 750967 - DNA, 20 bp, Artificial
  CRISPR gRNA sequence
ggggacaagtttctctttgg

SEQ ID NO: 750968 - DNA, 20 bp, Artificial
  CRISPR gRNA sequence
gggacaagtttctctttggt

SEQ ID NO: 750969 - DNA, 20 bp, Artificial
  CRISPR gRNA sequence
ctctttggtcaatagagttg

SEQ ID NO: 750970 - DNA, 20 bp, Artificial
  CRISPR gRNA sequence
tctttggtcaatagagttga

SEQ ID NO: 750971 - DNA, 20 bp, Artificial
  CRISPR gRNA sequence
tttggtcaatagagttgatg

SEQ ID NO: 750972 - DNA, 20 bp, Artificial
  CRISPR gRNA sequence
tggtcaatagagttgatggc

SEQ ID NO: 750973 - DNA, 20 bp, Artificial
  CRISPR gRNA sequence
ggtcaatagagttgatggca

SEQ ID NO: 750974 - DNA, 20 bp, Artificial
  CRISPR gRNA sequence
gtcaatagagttgatggcat

SEQ ID NO: 750975 - DNA, 20 bp, Artificial
  CRISPR gRNA sequence
atggcattaggatcgaacat

SEQ ID NO: 750976 - DNA, 20 bp, Artificial
  CRISPR gRNA sequence
ggatcgaacatccccaaagc

SEQ ID NO: 750977 - DNA, 20 bp, Artificial
  CRISPR gRNA sequence
tcttgagctgaggggagggg

SEQ ID NO: 750978 - DNA, 20 bp, Artificial
  CRISPR gRNA sequence
gagctgaggggaggggttct

SEQ ID NO: 750979 - DNA, 20 bp, Artificial
  CRISPR gRNA sequence
agctgaggggaggggttctc

SEQ ID NO: 750980 - DNA, 20 bp, Artificial
  CRISPR gRNA sequence
aggggaggggttctcttctc

SEQ ID NO: 750981 - DNA, 20 bp, Artificial
  CRISPR gRNA sequence
tcttctcttcccagttggga

SEQ ID NO: 750982 - DNA, 20 bp, Artificial
  CRISPR gRNA sequence
ttctcttcccagttgggagt

SEQ ID NO: 750983 - DNA, 20 bp, Artificial
  CRISPR gRNA sequence
ctcttcccagttgggagtgg

SEQ ID NO: 750984 - DNA, 20 bp, Artificial
  CRISPR gRNA sequence
tcttcccagttgggagtggg

SEQ ID NO: 750985 - DNA, 20 bp, Artificial
  CRISPR gRNA sequence
ttcccagttgggagtgggat

SEQ ID NO: 750986 - DNA, 20 bp, Artificial
  CRISPR gRNA sequence
cccagttgggagtgggataa

SEQ ID NO: 750987 - DNA, 20 bp, Artificial
  CRISPR gRNA sequence
ccagttgggagtgggataac

SEQ ID NO: 750988 - DNA, 20 bp, Artificial
  CRISPR gRNA sequence
ggagtgggataacttctgaa

SEQ ID NO: 750989 - DNA, 20 bp, Artificial
  CRISPR gRNA sequence
ctgaagacccctgcaactct

SEQ ID NO: 750990 - DNA, 20 bp, Artificial
  CRISPR gRNA sequence
tgaagacccctgcaactctt

SEQ ID NO: 750991 - DNA, 20 bp, Artificial
  CRISPR gRNA sequence
aagacccctgcaactcttag

SEQ ID NO: 750992 - DNA, 20 bp, Artificial
  CRISPR gRNA sequence
caactcttagattctagatg

SEQ ID NO: 750993 - DNA, 20 bp, Artificial
  CRISPR gRNA sequence
ttagattctagatgagttgc

SEQ ID NO: 750994 - DNA, 20 bp, Artificial
  CRISPR gRNA sequence
agattctagatgagttgcaa

SEQ ID NO: 750995 - DNA, 20 bp, Artificial
  CRISPR gRNA sequence
gattctagatgagttgcaag

SEQ ID NO: 750996 - DNA, 20 bp, Artificial
  CRISPR gRNA sequence
tagatgagttgcaagcagga

SEQ ID NO: 750997 - DNA, 20 bp, Artificial
  CRISPR gRNA sequence
gatgagttgcaagcaggact

SEQ ID NO: 750998 - DNA, 20 bp, Artificial
  CRISPR gRNA sequence
caagcaggacttccttcaac

SEQ ID NO: 750999 - DNA, 20 bp, Artificial
  CRISPR gRNA sequence
ccttcaacctgtcttgaaga

SEQ ID NO: 751000 - DNA, 20 bp, Artificial
  CRISPR gRNA sequence
cttcaacctgtcttgaagat

SEQ ID NO: 751001 - DNA, 20 bp, Artificial
  CRISPR gRNA sequence
caacctgtcttgaagatcat

SEQ ID NO: 751002 - DNA, 20 bp, Artificial
  CRISPR gRNA sequence
aacctgtcttgaagatcatc

SEQ ID NO: 751003 - DNA, 20 bp, Artificial
  CRISPR gRNA sequence
tcttgaagatcatccctttc

SEQ ID NO: 751004 - DNA, 20 bp, Artificial
  CRISPR gRNA sequence
gaagatcatccctttcaaac

SEQ ID NO: 751005 - DNA, 20 bp, Artificial
  CRISPR gRNA sequence
aagatcatccctttcaaaca

SEQ ID NO: 751006 - DNA, 20 bp, Artificial
  CRISPR gRNA sequence
tcaaacacctagaggagctt

SEQ ID NO: 751007 - DNA, 20 bp, Artificial
  CRISPR gRNA sequence
caaacacctagaggagcttt

SEQ ID NO: 751008 - DNA, 20 bp, Artificial
  CRISPR gRNA sequence
aaacacctagaggagctttg

SEQ ID NO: 751009 - DNA, 20 bp, Artificial
  CRISPR gRNA sequence
gaggagctttgtgtttggtg

SEQ ID NO: 751010 - DNA, 20 bp, Artificial
  CRISPR gRNA sequence
tgtgtttggtgttgcaggta

SEQ ID NO: 751011 - DNA, 20 bp, Artificial
  CRISPR gRNA sequence
gtgtttggtgttgcaggtac

SEQ ID NO: 751012 - DNA, 20 bp, Artificial
  CRISPR gRNA sequence
tgtttggtgttgcaggtacc

SEQ ID NO: 751013 - DNA, 20 bp, Artificial
  CRISPR gRNA sequence
ggtgttgcaggtaccggggc

SEQ ID NO: 751014 - DNA, 20 bp, Artificial
  CRISPR gRNA sequence
gtgttgcaggtaccggggca

SEQ ID NO: 751015 - DNA, 20 bp, Artificial
  CRISPR gRNA sequence
caggtaccggggcaggaact

SEQ ID NO: 751016 - DNA, 20 bp, Artificial
  CRISPR gRNA sequence
gggttccctgaacacaccct

SEQ ID NO: 751017 - DNA, 20 bp, Artificial
  CRISPR gRNA sequence
ggttccctgaacacaccctc

SEQ ID NO: 751018 - DNA, 20 bp, Artificial
  CRISPR gRNA sequence
cctgaacacaccctccaggc

SEQ ID NO: 751019 - DNA, 20 bp, Artificial
  CRISPR gRNA sequence
aacacaccctccaggccagg

SEQ ID NO: 751020 - DNA, 20 bp, Artificial
  CRISPR gRNA sequence
caggccaggctgcatggcag

SEQ ID NO: 751021 - DNA, 20 bp, Artificial
  CRISPR gRNA sequence
catggcagcttcctgcccag

SEQ ID NO: 751022 - DNA, 20 bp, Artificial
  CRISPR gRNA sequence
cctgcccagagcacaccaat

SEQ ID NO: 751023 - DNA, 20 bp, Artificial
  CRISPR gRNA sequence
ctgcccagagcacaccaata

SEQ ID NO: 751024 - DNA, 20 bp, Artificial
  CRISPR gRNA sequence
cccagagcacaccaatacac

SEQ ID NO: 751025 - DNA, 20 bp, Artificial
  CRISPR gRNA sequence
tgcccctagacccagcccac

SEQ ID NO: 751026 - DNA, 20 bp, Artificial
  CRISPR gRNA sequence
cccctagacccagcccactg

SEQ ID NO: 751027 - DNA, 20 bp, Artificial
  CRISPR gRNA sequence
gacccagcccactgcaccac

SEQ ID NO: 751028 - DNA, 20 bp, Artificial
  CRISPR gRNA sequence
caccactctgggacccctca

SEQ ID NO: 751029 - DNA, 20 bp, Artificial
  CRISPR gRNA sequence
tgggacccctcagcctctgc

SEQ ID NO: 751030 - DNA, 20 bp, Artificial
  CRISPR gRNA sequence
ggacccctcagcctctgccc

SEQ ID NO: 751031 - DNA, 20 bp, Artificial
  CRISPR gRNA sequence
agcctctgcccttgtggcct

SEQ ID NO: 751032 - DNA, 20 bp, Artificial
  CRISPR gRNA sequence
tgcccttgtggcctgcagcg

SEQ ID NO: 751033 - DNA, 20 bp, Artificial
  CRISPR gRNA sequence
cccttgtggcctgcagcggc

SEQ ID NO: 751034 - DNA, 20 bp, Artificial
  CRISPR gRNA sequence
gtggcctgcagcggcctaac

SEQ ID NO: 751035 - DNA, 20 bp, Artificial
  CRISPR gRNA sequence
tggcctgcagcggcctaaca

SEQ ID NO: 751036 - DNA, 20 bp, Artificial
  CRISPR gRNA sequence
cagcggcctaacagctttct

SEQ ID NO: 751037 - DNA, 20 bp, Artificial
  CRISPR gRNA sequence
acagctttctccttggagtt

SEQ ID NO: 751038 - DNA, 20 bp, Artificial
  CRISPR gRNA sequence
tctccttggagttctctgcg

SEQ ID NO: 751039 - DNA, 20 bp, Artificial
  CRISPR gRNA sequence
ctccttggagttctctgcgg

SEQ ID NO: 751040 - DNA, 20 bp, Artificial
  CRISPR gRNA sequence
tccttggagttctctgcggg

SEQ ID NO: 751041 - DNA, 20 bp, Artificial
  CRISPR gRNA sequence
cttggagttctctgcgggca

SEQ ID NO: 751042 - DNA, 20 bp, Artificial
  CRISPR gRNA sequence
ggagttctctgcgggcagga

SEQ ID NO: 751043 - DNA, 20 bp, Artificial
  CRISPR gRNA sequence
gagttctctgcgggcaggag

SEQ ID NO: 751044 - DNA, 20 bp, Artificial
  CRISPR gRNA sequence
tctgcgggcaggaggcacag

SEQ ID NO: 751045 - DNA, 20 bp, Artificial
  CRISPR gRNA sequence
tgcgggcaggaggcacagct

SEQ ID NO: 751046 - DNA, 20 bp, Artificial
  CRISPR gRNA sequence
cgggcaggaggcacagctca

SEQ ID NO: 751047 - DNA, 20 bp, Artificial
  CRISPR gRNA sequence
aagggctgtggctggggctg

SEQ ID NO: 751048 - DNA, 20 bp, Artificial
  CRISPR gRNA sequence
tggctggggctgggcccgct

SEQ ID NO: 751049 - DNA, 20 bp, Artificial
  CRISPR gRNA sequence
gggctgggcccgctggcctc

SEQ ID NO: 751050 - DNA, 20 bp, Artificial
  CRISPR gRNA sequence
ggcccgctggcctcctttgc

SEQ ID NO: 751051 - DNA, 20 bp, Artificial
  CRISPR gRNA sequence
gcctcctttgcatgtctcac

SEQ ID NO: 751052 - DNA, 20 bp, Artificial
  CRISPR gRNA sequence
ctttgcatgtctcactgtct

SEQ ID NO: 751053 - DNA, 20 bp, Artificial
  CRISPR gRNA sequence
tgcatgtctcactgtctgcc

SEQ ID NO: 751054 - DNA, 20 bp, Artificial
  CRISPR gRNA sequence
gcatgtctcactgtctgccc

SEQ ID NO: 751055 - DNA, 20 bp, Artificial
  CRISPR gRNA sequence
catgtctcactgtctgcccc

SEQ ID NO: 751056 - DNA, 20 bp, Artificial
  CRISPR gRNA sequence
actgtctgccccagacagtg

SEQ ID NO: 751057 - DNA, 20 bp, Artificial
  CRISPR gRNA sequence
tctgccccagacagtgcttc

SEQ ID NO: 751058 - DNA, 20 bp, Artificial
  CRISPR gRNA sequence
ccccagacagtgcttcctcc

SEQ ID NO: 751059 - DNA, 20 bp, Artificial
  CRISPR gRNA sequence
cctccctgtccccatcctgg

SEQ ID NO: 751060 - DNA, 20 bp, Artificial
  CRISPR gRNA sequence
ctccctgtccccatcctggc

SEQ ID NO: 751061 - DNA, 20 bp, Artificial
  CRISPR gRNA sequence
cctgtccccatcctggccca

SEQ ID NO: 751062 - DNA, 20 bp, Artificial
  CRISPR gRNA sequence
tccccatcctggcccaggct

SEQ ID NO: 751063 - DNA, 20 bp, Artificial
  CRISPR gRNA sequence
gcccaggctgaccactgaga

SEQ ID NO: 751064 - DNA, 20 bp, Artificial
  CRISPR gRNA sequence
accactgagacccgaaggtg

SEQ ID NO: 751065 - DNA, 20 bp, Artificial
  CRISPR gRNA sequence
agacccgaaggtgggtgcat

SEQ ID NO: 751066 - DNA, 20 bp, Artificial
  CRISPR gRNA sequence
agcagaatcagagctcagcc

SEQ ID NO: 751067 - DNA, 20 bp, Artificial
  CRISPR gRNA sequence
agcctgctgagtcggggtgg

SEQ ID NO: 751068 - DNA, 20 bp, Artificial
  CRISPR gRNA sequence
ctgagtcggggtggcaggag

SEQ ID NO: 751069 - DNA, 20 bp, Artificial
  CRISPR gRNA sequence
agtcggggtggcaggagaac

SEQ ID NO: 751070 - DNA, 20 bp, Artificial
  CRISPR gRNA sequence
cacagatgtgcaggcttcag

SEQ ID NO: 751071 - DNA, 20 bp, Artificial
  CRISPR gRNA sequence
cagcagcagatggcagaggc

SEQ ID NO: 751072 - DNA, 20 bp, Artificial
  CRISPR gRNA sequence
agcagcagatggcagaggct

SEQ ID NO: 751073 - DNA, 20 bp, Artificial
  CRISPR gRNA sequence
ttctgaccagctgctctagg

SEQ ID NO: 751074 - DNA, 20 bp, Artificial
  CRISPR gRNA sequence
ctgaccagctgctctaggca

SEQ ID NO: 751075 - DNA, 20 bp, Artificial
  CRISPR gRNA sequence
tgaccagctgctctaggcag

SEQ ID NO: 751076 - DNA, 20 bp, Artificial
  CRISPR gRNA sequence
accagctgctctaggcagct

SEQ ID NO: 751077 - DNA, 20 bp, Artificial
  CRISPR gRNA sequence
ctctaggcagctaaacaggg

SEQ ID NO: 751078 - DNA, 20 bp, Artificial
  CRISPR gRNA sequence
taggcagctaaacagggccc

SEQ ID NO: 751079 - DNA, 20 bp, Artificial
  CRISPR gRNA sequence
ggcagctaaacagggcccct

SEQ ID NO: 751080 - DNA, 20 bp, Artificial
  CRISPR gRNA sequence
aacagggcccctactgcaca

SEQ ID NO: 751081 - DNA, 20 bp, Artificial
  CRISPR gRNA sequence
ctgcacagaagtatctcttc

SEQ ID NO: 751082 - DNA, 20 bp, Artificial
  CRISPR gRNA sequence
cacagaagtatctcttcctg

SEQ ID NO: 751083 - DNA, 20 bp, Artificial
  CRISPR gRNA sequence
ttcctggatagccggcccag

SEQ ID NO: 751084 - DNA, 20 bp, Artificial
  CRISPR gRNA sequence
cctggatagccggcccagga

SEQ ID NO: 751085 - DNA, 20 bp, Artificial
  CRISPR gRNA sequence
ctggatagccggcccaggaa

SEQ ID NO: 751086 - DNA, 20 bp, Artificial
  CRISPR gRNA sequence
gatagccggcccaggaagtt

SEQ ID NO: 751087 - DNA, 20 bp, Artificial
  CRISPR gRNA sequence
tctcaagaaggtctccatgg

SEQ ID NO: 751088 - DNA, 20 bp, Artificial
  CRISPR gRNA sequence
ctcaagaaggtctccatggg

SEQ ID NO: 751089 - DNA, 20 bp, Artificial
  CRISPR gRNA sequence
tcaagaaggtctccatgggc

SEQ ID NO: 751090 - DNA, 20 bp, Artificial
  CRISPR gRNA sequence
aagaaggtctccatgggcct

SEQ ID NO: 751091 - DNA, 20 bp, Artificial
  CRISPR gRNA sequence
catgggccttacctgtccat

SEQ ID NO: 751092 - DNA, 20 bp, Artificial
  CRISPR gRNA sequence
acctgtccatccgcaccagc

SEQ ID NO: 751093 - DNA, 20 bp, Artificial
  CRISPR gRNA sequence
cctgtccatccgcaccagct

SEQ ID NO: 751094 - DNA, 20 bp, Artificial
  CRISPR gRNA sequence
tccatccgcaccagctcctg

SEQ ID NO: 751095 - DNA, 20 bp, Artificial
  CRISPR gRNA sequence
ctgggcacctagggacagac

SEQ ID NO: 751096 - DNA, 20 bp, Artificial
  CRISPR gRNA sequence
ggcacctagggacagacaga

SEQ ID NO: 751097 - DNA, 20 bp, Artificial
  CRISPR gRNA sequence
gggacagacagacagagaag

SEQ ID NO: 751098 - DNA, 20 bp, Artificial
  CRISPR gRNA sequence
gtcatggaagggaaggcttc

SEQ ID NO: 751099 - DNA, 20 bp, Artificial
  CRISPR gRNA sequence
ccccatacaacatccctgcc

SEQ ID NO: 751100 - DNA, 20 bp, Artificial
  CRISPR gRNA sequence
cccatacaacatccctgccc

SEQ ID NO: 751101 - DNA, 20 bp, Artificial
  CRISPR gRNA sequence
cccctgctggcagatgccct

SEQ ID NO: 751102 - DNA, 20 bp, Artificial
  CRISPR gRNA sequence
ctggcagatgccctgcaggg

SEQ ID NO: 751103 - DNA, 20 bp, Artificial
  CRISPR gRNA sequence
gcagatgccctgcagggaac

SEQ ID NO: 751104 - DNA, 20 bp, Artificial
  CRISPR gRNA sequence
cagggaacaggagcgagccc

SEQ ID NO: 751105 - DNA, 20 bp, Artificial
  CRISPR gRNA sequence
cacagctccggactccattt

SEQ ID NO: 751106 - DNA, 20 bp, Artificial
  CRISPR gRNA sequence
cggactccatttcttttcac

SEQ ID NO: 751107 - DNA, 20 bp, Artificial
  CRISPR gRNA sequence
catttcttttcacatgggtg

SEQ ID NO: 751108 - DNA, 20 bp, Artificial
  CRISPR gRNA sequence
cttttcacatgggtgctgtc

SEQ ID NO: 751109 - DNA, 20 bp, Artificial
  CRISPR gRNA sequence
ttttcacatgggtgctgtcc

SEQ ID NO: 751110 - DNA, 20 bp, Artificial
  CRISPR gRNA sequence
ttcacatgggtgctgtccag

SEQ ID NO: 751111 - DNA, 20 bp, Artificial
  CRISPR gRNA sequence
tcacatgggtgctgtccagc

SEQ ID NO: 751112 - DNA, 20 bp, Artificial
  CRISPR gRNA sequence
cacatgggtgctgtccagca

SEQ ID NO: 751113 - DNA, 20 bp, Artificial
  CRISPR gRNA sequence
acatgggtgctgtccagcaa

SEQ ID NO: 751114 - DNA, 20 bp, Artificial
  CRISPR gRNA sequence
tccagcaagcgatctgcgtg

SEQ ID NO: 751115 - DNA, 20 bp, Artificial
  CRISPR gRNA sequence
cgtgtctgtccagcagatgg

SEQ ID NO: 751116 - DNA, 20 bp, Artificial
  CRISPR gRNA sequence
tccagcagatggggcctcca

SEQ ID NO: 751117 - DNA, 20 bp, Artificial
  CRISPR gRNA sequence
catgaggggcccattttgac

SEQ ID NO: 751118 - DNA, 20 bp, Artificial
  CRISPR gRNA sequence
tgacgactgataaatgaaac

SEQ ID NO: 751119 - DNA, 20 bp, Artificial
  CRISPR gRNA sequence
gacgactgataaatgaaact

SEQ ID NO: 751120 - DNA, 20 bp, Artificial
  CRISPR gRNA sequence
acgactgataaatgaaactc

SEQ ID NO: 751121 - DNA, 20 bp, Artificial
  CRISPR gRNA sequence
ataaatgaaactctatctgc

SEQ ID NO: 751122 - DNA, 20 bp, Artificial
  CRISPR gRNA sequence
tatctgcattttccaggagt

SEQ ID NO: 751123 - DNA, 20 bp, Artificial
  CRISPR gRNA sequence
tctgcattttccaggagtgt

SEQ ID NO: 751124 - DNA, 20 bp, Artificial
  CRISPR gRNA sequence
cattttccaggagtgtaaga

SEQ ID NO: 751125 - DNA, 20 bp, Artificial
  CRISPR gRNA sequence
tccaggagtgtaagaacgct

SEQ ID NO: 751126 - DNA, 20 bp, Artificial
  CRISPR gRNA sequence
ccaggagtgtaagaacgcta

SEQ ID NO: 751127 - DNA, 20 bp, Artificial
  CRISPR gRNA sequence
caggagtgtaagaacgctat

SEQ ID NO: 751128 - DNA, 20 bp, Artificial
  CRISPR gRNA sequence
tctgccatcaggagaccaaa

SEQ ID NO: 751129 - DNA, 20 bp, Artificial
  CRISPR gRNA sequence
ccatcaggagaccaaaggca

SEQ ID NO: 751130 - DNA, 20 bp, Artificial
  CRISPR gRNA sequence
tctcctatggcttgacttac

SEQ ID NO: 751131 - DNA, 20 bp, Artificial
  CRISPR gRNA sequence
ctcctatggcttgacttaca

SEQ ID NO: 751132 - DNA, 20 bp, Artificial
  CRISPR gRNA sequence
tcctatggcttgacttacac

SEQ ID NO: 751133 - DNA, 20 bp, Artificial
  CRISPR gRNA sequence
ctatggcttgacttacacag

SEQ ID NO: 751134 - DNA, 20 bp, Artificial
  CRISPR gRNA sequence
tggcttgacttacacagtgt

SEQ ID NO: 751135 - DNA, 20 bp, Artificial
  CRISPR gRNA sequence
gacttacacagtgtcagacc

SEQ ID NO: 751136 - DNA, 20 bp, Artificial
  CRISPR gRNA sequence
acttacacagtgtcagacct

SEQ ID NO: 751137 - DNA, 20 bp, Artificial
  CRISPR gRNA sequence
acacagtgtcagaccttcag

SEQ ID NO: 751138 - DNA, 20 bp, Artificial
  CRISPR gRNA sequence
cacagtgtcagaccttcagg

SEQ ID NO: 751139 - DNA, 20 bp, Artificial
  CRISPR gRNA sequence
caggatttaagtatcgagca

SEQ ID NO: 751140 - DNA, 20 bp, Artificial
  CRISPR gRNA sequence
aggatttaagtatcgagcaa

SEQ ID NO: 751141 - DNA, 20 bp, Artificial
  CRISPR gRNA sequence
aagtatcgagcaaaggtcaa

SEQ ID NO: 751142 - DNA, 20 bp, Artificial
  CRISPR gRNA sequence
agtatcgagcaaaggtcaac

SEQ ID NO: 751143 - DNA, 20 bp, Artificial
  CRISPR gRNA sequence
ttgaatttgctaactggtgt

SEQ ID NO: 751144 - DNA, 20 bp, Artificial
  CRISPR gRNA sequence
gaatttgctaactggtgtct

SEQ ID NO: 751145 - DNA, 20 bp, Artificial
  CRISPR gRNA sequence
aatttgctaactggtgtctc

SEQ ID NO: 751146 - DNA, 20 bp, Artificial
  CRISPR gRNA sequence
gctaactggtgtctcttgtt

SEQ ID NO: 751147 - DNA, 20 bp, Artificial
  CRISPR gRNA sequence
ctaactggtgtctcttgttt

SEQ ID NO: 751148 - DNA, 20 bp, Artificial
  CRISPR gRNA sequence
actggtgtctcttgtttgaa

SEQ ID NO: 751149 - DNA, 20 bp, Artificial
  CRISPR gRNA sequence
gtgtctcttgtttgaacatt

SEQ ID NO: 751150 - DNA, 20 bp, Artificial
  CRISPR gRNA sequence
ttgtttgaacatttgccagg

SEQ ID NO: 751151 - DNA, 20 bp, Artificial
  CRISPR gRNA sequence
gtttgaacatttgccaggtt

SEQ ID NO: 751152 - DNA, 20 bp, Artificial
  CRISPR gRNA sequence
tttgaacatttgccaggttc

SEQ ID NO: 751153 - DNA, 20 bp, Artificial
  CRISPR gRNA sequence
gaacatttgccaggttctgg

SEQ ID NO: 751154 - DNA, 20 bp, Artificial
  CRISPR gRNA sequence
aacatttgccaggttctggt

SEQ ID NO: 751155 - DNA, 20 bp, Artificial
  CRISPR gRNA sequence
gccaggttctggtctttagc

SEQ ID NO: 751156 - DNA, 20 bp, Artificial
  CRISPR gRNA sequence
ccaggttctggtctttagcc

SEQ ID NO: 751157 - DNA, 20 bp, Artificial
  CRISPR gRNA sequence
tggtctttagccatgactta

SEQ ID NO: 751158 - DNA, 20 bp, Artificial
  CRISPR gRNA sequence
gtctttagccatgacttact

SEQ ID NO: 751159 - DNA, 20 bp, Artificial
  CRISPR gRNA sequence
tagccatgacttactgggtg

SEQ ID NO: 751160 - DNA, 20 bp, Artificial
  CRISPR gRNA sequence
agccatgacttactgggtgg

SEQ ID NO: 751161 - DNA, 20 bp, Artificial
  CRISPR gRNA sequence
gccatgacttactgggtggg

SEQ ID NO: 751162 - DNA, 20 bp, Artificial
  CRISPR gRNA sequence
actgggtgggagtgtttaag

SEQ ID NO: 751163 - DNA, 20 bp, Artificial
  CRISPR gRNA sequence
ctgggtgggagtgtttaagg

SEQ ID NO: 751164 - DNA, 20 bp, Artificial
  CRISPR gRNA sequence
ggtgggagtgtttaaggtca

SEQ ID NO: 751165 - DNA, 20 bp, Artificial
  CRISPR gRNA sequence
aaggtcagttcctaattaga

SEQ ID NO: 751166 - DNA, 20 bp, Artificial
  CRISPR gRNA sequence
aggtcagttcctaattagag

SEQ ID NO: 751167 - DNA, 20 bp, Artificial
  CRISPR gRNA sequence
ctaattagagggctcctggt

SEQ ID NO: 751168 - DNA, 20 bp, Artificial
  CRISPR gRNA sequence
attagagggctcctggtcct

SEQ ID NO: 751169 - DNA, 20 bp, Artificial
  CRISPR gRNA sequence
gagggctcctggtcctctct

SEQ ID NO: 751170 - DNA, 20 bp, Artificial
  CRISPR gRNA sequence
ctggtcctctctgtcctatc

SEQ ID NO: 751171 - DNA, 20 bp, Artificial
  CRISPR gRNA sequence
gtcctctctgtcctatcccc

SEQ ID NO: 751172 - DNA, 20 bp, Artificial
  CRISPR gRNA sequence
tctgtcctatcccctacatt

SEQ ID NO: 751173 - DNA, 20 bp, Artificial
  CRISPR gRNA sequence
tgtcctatcccctacattgc

SEQ ID NO: 751174 - DNA, 20 bp, Artificial
  CRISPR gRNA sequence
tcctatcccctacattgcct

SEQ ID NO: 751175 - DNA, 20 bp, Artificial
  CRISPR gRNA sequence
tcccctacattgcctaatag

SEQ ID NO: 751176 - DNA, 20 bp, Artificial
  CRISPR gRNA sequence
cattgcctaatagggtggca

SEQ ID NO: 751177 - DNA, 20 bp, Artificial
  CRISPR gRNA sequence
cctaatagggtggcattcta

SEQ ID NO: 751178 - DNA, 20 bp, Artificial
  CRISPR gRNA sequence
atagggtggcattctagggg

SEQ ID NO: 751179 - DNA, 20 bp, Artificial
  CRISPR gRNA sequence
taggggacatctctcaggga

SEQ ID NO: 751180 - DNA, 20 bp, Artificial
  CRISPR gRNA sequence
ggggacatctctcagggaaa

SEQ ID NO: 751181 - DNA, 20 bp, Artificial
  CRISPR gRNA sequence
tcagggaaaccttacaaggt

SEQ ID NO: 751182 - DNA, 20 bp, Artificial
  CRISPR gRNA sequence
agggaaaccttacaaggtgc

SEQ ID NO: 751183 - DNA, 20 bp, Artificial
  CRISPR gRNA sequence
acaaggtgcaagtccccgat

SEQ ID NO: 751184 - DNA, 20 bp, Artificial
  CRISPR gRNA sequence
caaggtgcaagtccccgatc

SEQ ID NO: 751185 - DNA, 20 bp, Artificial
  CRISPR gRNA sequence
cccagccacttcactcactt

SEQ ID NO: 751186 - DNA, 20 bp, Artificial
  CRISPR gRNA sequence
ccagccacttcactcacttt

SEQ ID NO: 751187 - DNA, 20 bp, Artificial
  CRISPR gRNA sequence
cactcactttctgcttctca

SEQ ID NO: 751188 - DNA, 20 bp, Artificial
  CRISPR gRNA sequence
actcactttctgcttctcat

SEQ ID NO: 751189 - DNA, 20 bp, Artificial
  CRISPR gRNA sequence
actttctgcttctcatccaa

SEQ ID NO: 751190 - DNA, 20 bp, Artificial
  CRISPR gRNA sequence
tctgcttctcatccaagttg

SEQ ID NO: 751191 - DNA, 20 bp, Artificial
  CRISPR gRNA sequence
ctgcttctcatccaagttgc

SEQ ID NO: 751192 - DNA, 20 bp, Artificial
  CRISPR gRNA sequence
tgcttctcatccaagttgct

SEQ ID NO: 751193 - DNA, 20 bp, Artificial
  CRISPR gRNA sequence
cttctcatccaagttgctgc

SEQ ID NO: 751194 - DNA, 20 bp, Artificial
  CRISPR gRNA sequence
ctcatccaagttgctgccgc

SEQ ID NO: 751195 - DNA, 20 bp, Artificial
  CRISPR gRNA sequence
tcatccaagttgctgccgct

SEQ ID NO: 751196 - DNA, 20 bp, Artificial
  CRISPR gRNA sequence
atccaagttgctgccgcttg

SEQ ID NO: 751197 - DNA, 20 bp, Artificial
  CRISPR gRNA sequence
ctgccgcttgcctcagcctt

SEQ ID NO: 751198 - DNA, 20 bp, Artificial
  CRISPR gRNA sequence
ccgcttgcctcagccttggg

SEQ ID NO: 751199 - DNA, 20 bp, Artificial
  CRISPR gRNA sequence
gcctcagccttgggacaccc

SEQ ID NO: 751200 - DNA, 20 bp, Artificial
  CRISPR gRNA sequence
cctcagccttgggacacccc

SEQ ID NO: 751201 - DNA, 20 bp, Artificial
  CRISPR gRNA sequence
agccttgggacaccccaccc

SEQ ID NO: 751202 - DNA, 20 bp, Artificial
  CRISPR gRNA sequence
gggacaccccaccccccaaa

SEQ ID NO: 751203 - DNA, 20 bp, Artificial
  CRISPR gRNA sequence
ggacaccccaccccccaaac

SEQ ID NO: 751204 - DNA, 20 bp, Artificial
  CRISPR gRNA sequence
gccaccaattagatgcagtg

SEQ ID NO: 751205 - DNA, 20 bp, Artificial
  CRISPR gRNA sequence
gatgcagtgaccccaacttc

SEQ ID NO: 751206 - DNA, 20 bp, Artificial
  CRISPR gRNA sequence
ccctctttcatgcagcaccc

SEQ ID NO: 751207 - DNA, 20 bp, Artificial
  CRISPR gRNA sequence
cctctttcatgcagcacccc

SEQ ID NO: 751208 - DNA, 20 bp, Artificial
  CRISPR gRNA sequence
tttcatgcagcaccccatgt

SEQ ID NO: 751209 - DNA, 20 bp, Artificial
  CRISPR gRNA sequence
tcatgcagcaccccatgtcc

SEQ ID NO: 751210 - DNA, 20 bp, Artificial
  CRISPR gRNA sequence
catgcagcaccccatgtcct

SEQ ID NO: 751211 - DNA, 20 bp, Artificial
  CRISPR gRNA sequence
atgcagcaccccatgtcctc

SEQ ID NO: 751212 - DNA, 20 bp, Artificial
  CRISPR gRNA sequence
ccacagatgcttctcgtttt

SEQ ID NO: 751213 - DNA, 20 bp, Artificial
  CRISPR gRNA sequence
ctcgttttaaggagatttac

SEQ ID NO: 751214 - DNA, 20 bp, Artificial
  CRISPR gRNA sequence
tcgttttaaggagatttact

SEQ ID NO: 751215 - DNA, 20 bp, Artificial
  CRISPR gRNA sequence
gttttaaggagatttactgc

SEQ ID NO: 751216 - DNA, 20 bp, Artificial
  CRISPR gRNA sequence
taaggagatttactgctgat

SEQ ID NO: 751217 - DNA, 20 bp, Artificial
  CRISPR gRNA sequence
aaggagatttactgctgatt

SEQ ID NO: 751218 - DNA, 20 bp, Artificial
  CRISPR gRNA sequence
aggagatttactgctgatta

SEQ ID NO: 751219 - DNA, 20 bp, Artificial
  CRISPR gRNA sequence
actgctgattacgatgggga

SEQ ID NO: 751220 - DNA, 20 bp, Artificial
  CRISPR gRNA sequence
ctgctgattacgatggggaa

SEQ ID NO: 751221 - DNA, 20 bp, Artificial
  CRISPR gRNA sequence
ctgattacgatggggaaaca

SEQ ID NO: 751222 - DNA, 20 bp, Artificial
  CRISPR gRNA sequence
attacgatggggaaacagat

SEQ ID NO: 751223 - DNA, 20 bp, Artificial
  CRISPR gRNA sequence
cgatggggaaacagatggtg

SEQ ID NO: 751224 - DNA, 20 bp, Artificial
  CRISPR gRNA sequence
cccaaaagttcctgaaatct

SEQ ID NO: 751225 - DNA, 20 bp, Artificial
  CRISPR gRNA sequence
ctgaaatctattcaaaccat

SEQ ID NO: 751226 - DNA, 20 bp, Artificial
  CRISPR gRNA sequence
aaatctattcaaaccatggc

SEQ ID NO: 751227 - DNA, 20 bp, Artificial
  CRISPR gRNA sequence
ttcaaaccatggctattgct

SEQ ID NO: 751228 - DNA, 20 bp, Artificial
  CRISPR gRNA sequence
aaaccatggctattgcttac

SEQ ID NO: 751229 - DNA, 20 bp, Artificial
  CRISPR gRNA sequence
ttgcttacagccgactcatg

SEQ ID NO: 751230 - DNA, 20 bp, Artificial
  CRISPR gRNA sequence
cttacagccgactcatgggt

SEQ ID NO: 751231 - DNA, 20 bp, Artificial
  CRISPR gRNA sequence
acagccgactcatgggtcag

SEQ ID NO: 751232 - DNA, 20 bp, Artificial
  CRISPR gRNA sequence
cagccgactcatgggtcagg

SEQ ID NO: 751233 - DNA, 20 bp, Artificial
  CRISPR gRNA sequence
atgggtcaggcttcgtgcag

SEQ ID NO: 751234 - DNA, 20 bp, Artificial
  CRISPR gRNA sequence
cgtgcaggtgcacacgggta

SEQ ID NO: 751235 - DNA, 20 bp, Artificial
  CRISPR gRNA sequence
gtgcaggtgcacacgggtat

SEQ ID NO: 751236 - DNA, 20 bp, Artificial
  CRISPR gRNA sequence
cctcatctcatcctctgtgc

SEQ ID NO: 751237 - DNA, 20 bp, Artificial
  CRISPR gRNA sequence
atctcatcctctgtgccacc

SEQ ID NO: 751238 - DNA, 20 bp, Artificial
  CRISPR gRNA sequence
atcctctgtgccaccctttg

SEQ ID NO: 751239 - DNA, 20 bp, Artificial
  CRISPR gRNA sequence
tgtgccaccctttggggtga

SEQ ID NO: 751240 - DNA, 20 bp, Artificial
  CRISPR gRNA sequence
tgccaccctttggggtgagg

SEQ ID NO: 751241 - DNA, 20 bp, Artificial
  CRISPR gRNA sequence
tggggtgagggttgttggtc

SEQ ID NO: 751242 - DNA, 20 bp, Artificial
  CRISPR gRNA sequence
ggggtgagggttgttggtcc

SEQ ID NO: 751243 - DNA, 20 bp, Artificial
  CRISPR gRNA sequence
gggtgagggttgttggtccc

SEQ ID NO: 751244 - DNA, 20 bp, Artificial
  CRISPR gRNA sequence
ttggtcccattttagagctg

SEQ ID NO: 751245 - DNA, 20 bp, Artificial
  CRISPR gRNA sequence
gtcccattttagagctgggg

SEQ ID NO: 751246 - DNA, 20 bp, Artificial
  CRISPR gRNA sequence
tagagctggggaaactgagg

SEQ ID NO: 751247 - DNA, 20 bp, Artificial
  CRISPR gRNA sequence
agagctggggaaactgaggc

SEQ ID NO: 751248 - DNA, 20 bp, Artificial
  CRISPR gRNA sequence
gagctggggaaactgaggct

SEQ ID NO: 751249 - DNA, 20 bp, Artificial
  CRISPR gRNA sequence
gggaaactgaggctcagtcc

SEQ ID NO: 751250 - DNA, 20 bp, Artificial
  CRISPR gRNA sequence
aggctcagtccaaagcagga

SEQ ID NO: 751251 - DNA, 20 bp, Artificial
  CRISPR gRNA sequence
agtccaaagcaggatggaaa

SEQ ID NO: 751252 - DNA, 20 bp, Artificial
  CRISPR gRNA sequence
ttggcctctccagcaaactg

SEQ ID NO: 751253 - DNA, 20 bp, Artificial
  CRISPR gRNA sequence
gcctctccagcaaactgccg

SEQ ID NO: 751254 - DNA, 20 bp, Artificial
  CRISPR gRNA sequence
tccagcaaactgccgtcctc

SEQ ID NO: 751255 - DNA, 20 bp, Artificial
  CRISPR gRNA sequence
cagcaaactgccgtcctcaa

SEQ ID NO: 751256 - DNA, 20 bp, Artificial
  CRISPR gRNA sequence
ccgtcctcaaggctcccagc

SEQ ID NO: 751257 - DNA, 20 bp, Artificial
  CRISPR gRNA sequence
aaggctcccagccctttcct

SEQ ID NO: 751258 - DNA, 20 bp, Artificial
  CRISPR gRNA sequence
ccagccctttccttttcttt

SEQ ID NO: 751259 - DNA, 20 bp, Artificial
  CRISPR gRNA sequence
tccttttctttttttcctga

SEQ ID NO: 751260 - DNA, 20 bp, Artificial
  CRISPR gRNA sequence
ccttttctttttttcctgag

SEQ ID NO: 751261 - DNA, 20 bp, Artificial
  CRISPR gRNA sequence
cttttctttttttcctgaga

SEQ ID NO: 751262 - DNA, 20 bp, Artificial
  CRISPR gRNA sequence
ttctttttttcctgagagtg

SEQ ID NO: 751263 - DNA, 20 bp, Artificial
  CRISPR gRNA sequence
tctttttttcctgagagtgc

SEQ ID NO: 751264 - DNA, 20 bp, Artificial
  CRISPR gRNA sequence
ctttttttcctgagagtgcc

SEQ ID NO: 751265 - DNA, 20 bp, Artificial
  CRISPR gRNA sequence
tttttttcctgagagtgcct

SEQ ID NO: 751266 - DNA, 20 bp, Artificial
  CRISPR gRNA sequence
tttttcctgagagtgcctca

SEQ ID NO: 751267 - DNA, 20 bp, Artificial
  CRISPR gRNA sequence
ttttcctgagagtgcctcat

SEQ ID NO: 751268 - DNA, 20 bp, Artificial
  CRISPR gRNA sequence
tttcctgagagtgcctcatt

SEQ ID NO: 751269 - DNA, 20 bp, Artificial
  CRISPR gRNA sequence
ttcctgagagtgcctcattc

SEQ ID NO: 751270 - DNA, 20 bp, Artificial
  CRISPR gRNA sequence
tcctgagagtgcctcattcc

SEQ ID NO: 751271 - DNA, 20 bp, Artificial
  CRISPR gRNA sequence
cctgagagtgcctcattcct

SEQ ID NO: 751272 - DNA, 20 bp, Artificial
  CRISPR gRNA sequence
ctgagagtgcctcattcctg

SEQ ID NO: 751273 - DNA, 20 bp, Artificial
  CRISPR gRNA sequence
agagtgcctcattcctgagc

SEQ ID NO: 751274 - DNA, 20 bp, Artificial
  CRISPR gRNA sequence
attcctgagcaggctctctg

SEQ ID NO: 751275 - DNA, 20 bp, Artificial
  CRISPR gRNA sequence
ctgagcaggctctctgggcc

SEQ ID NO: 751276 - DNA, 20 bp, Artificial
  CRISPR gRNA sequence
agcaggctctctgggccagc

SEQ ID NO: 751277 - DNA, 20 bp, Artificial
  CRISPR gRNA sequence
tctgggccagccttccacca

SEQ ID NO: 751278 - DNA, 20 bp, Artificial
  CRISPR gRNA sequence
tgggccagccttccaccagg

SEQ ID NO: 751279 - DNA, 20 bp, Artificial
  CRISPR gRNA sequence
ggccagccttccaccaggga

SEQ ID NO: 751280 - DNA, 20 bp, Artificial
  CRISPR gRNA sequence
ccaccagggagggcacagca

SEQ ID NO: 751281 - DNA, 20 bp, Artificial
  CRISPR gRNA sequence
caccagggagggcacagcaa

SEQ ID NO: 751282 - DNA, 20 bp, Artificial
  CRISPR gRNA sequence
ctccccctgccctgctgccc

SEQ ID NO: 751283 - DNA, 20 bp, Artificial
  CRISPR gRNA sequence
cccctgccctgctgcccagc

SEQ ID NO: 751284 - DNA, 20 bp, Artificial
  CRISPR gRNA sequence
ccctgctgcccagcgttgct

SEQ ID NO: 751285 - DNA, 20 bp, Artificial
  CRISPR gRNA sequence
ctgcccagcgttgctcttct

SEQ ID NO: 751286 - DNA, 20 bp, Artificial
  CRISPR gRNA sequence
cccagcgttgctcttctgtt

SEQ ID NO: 751287 - DNA, 20 bp, Artificial
  CRISPR gRNA sequence
ctcttctgttccaagccctt

SEQ ID NO: 751288 - DNA, 20 bp, Artificial
  CRISPR gRNA sequence
ttctgttccaagccctttac

SEQ ID NO: 751289 - DNA, 20 bp, Artificial
  CRISPR gRNA sequence
ctgttccaagccctttacct

SEQ ID NO: 751290 - DNA, 20 bp, Artificial
  CRISPR gRNA sequence
tgttccaagccctttacctg

SEQ ID NO: 751291 - DNA, 20 bp, Artificial
  CRISPR gRNA sequence
ttccaagccctttacctgcc

SEQ ID NO: 751292 - DNA, 20 bp, Artificial
  CRISPR gRNA sequence
caagccctttacctgccccc

SEQ ID NO: 751293 - DNA, 20 bp, Artificial
  CRISPR gRNA sequence
tacctgcccccacccacccc

SEQ ID NO: 751294 - DNA, 20 bp, Artificial
  CRISPR gRNA sequence
acctgcccccacccaccccc

SEQ ID NO: 751295 - DNA, 20 bp, Artificial
  CRISPR gRNA sequence
cctgcccccacccaccccca

SEQ ID NO: 751296 - DNA, 20 bp, Artificial
  CRISPR gRNA sequence
cccccacccacccccagcca

SEQ ID NO: 751297 - DNA, 20 bp, Artificial
  CRISPR gRNA sequence
ctgcaggtaggttgtggtgt

SEQ ID NO: 751298 - DNA, 20 bp, Artificial
  CRISPR gRNA sequence
caggtaggttgtggtgtgtt

SEQ ID NO: 751299 - DNA, 20 bp, Artificial
  CRISPR gRNA sequence
tggtgtgttctaggagagga

SEQ ID NO: 751300 - DNA, 20 bp, Artificial
  CRISPR gRNA sequence
taggagaggaataggggagt

SEQ ID NO: 751301 - DNA, 20 bp, Artificial
  CRISPR gRNA sequence
ggagaggaataggggagttc

SEQ ID NO: 751302 - DNA, 20 bp, Artificial
  CRISPR gRNA sequence
tgaaagcaagggtgaggtgg

SEQ ID NO: 751303 - DNA, 20 bp, Artificial
  CRISPR gRNA sequence
aaagcaagggtgaggtggcc

SEQ ID NO: 751304 - DNA, 20 bp, Artificial
  CRISPR gRNA sequence
tggggcttcacgtgggggcc

SEQ ID NO: 751305 - DNA, 20 bp, Artificial
  CRISPR gRNA sequence
cacgtgggggcccccgggaa

SEQ ID NO: 751306 - DNA, 20 bp, Artificial
  CRISPR gRNA sequence
acgtgggggcccccgggaat

SEQ ID NO: 751307 - DNA, 20 bp, Artificial
  CRISPR gRNA sequence
ttaagggccggccacaggaa

SEQ ID NO: 751308 - DNA, 20 bp, Artificial
  CRISPR gRNA sequence
agggccggccacaggaaata

SEQ ID NO: 751309 - DNA, 20 bp, Artificial
  CRISPR gRNA sequence
cgagccaaaagccacctggc

SEQ ID NO: 751310 - DNA, 20 bp, Artificial
  CRISPR gRNA sequence
gcaccagagcaatcctttct

SEQ ID NO: 751311 - DNA, 20 bp, Artificial
  CRISPR gRNA sequence
tctcagttacctctgtagcc

SEQ ID NO: 751312 - DNA, 20 bp, Artificial
  CRISPR gRNA sequence
ctcagttacctctgtagcca

SEQ ID NO: 751313 - DNA, 20 bp, Artificial
  CRISPR gRNA sequence
tcagttacctctgtagccag

SEQ ID NO: 751314 - DNA, 20 bp, Artificial
  CRISPR gRNA sequence
agttacctctgtagccaggc

SEQ ID NO: 751315 - DNA, 20 bp, Artificial
  CRISPR gRNA sequence
cctctgtagccaggcagacg

SEQ ID NO: 751316 - DNA, 20 bp, Artificial
  CRISPR gRNA sequence
tgtagccaggcagacgggaa

SEQ ID NO: 751317 - DNA, 20 bp, Artificial
  CRISPR gRNA sequence
tagccaggcagacgggaaga

SEQ ID NO: 751318 - DNA, 20 bp, Artificial
  CRISPR gRNA sequence
cctagccccttcttggagga

SEQ ID NO: 751319 - DNA, 20 bp, Artificial
  CRISPR gRNA sequence
gccccttcttggaggactca

SEQ ID NO: 751320 - DNA, 20 bp, Artificial
  CRISPR gRNA sequence
cttggaggactcagactaac

SEQ ID NO: 751321 - DNA, 20 bp, Artificial
  CRISPR gRNA sequence
ttggaggactcagactaacc

SEQ ID NO: 751322 - DNA, 20 bp, Artificial
  CRISPR gRNA sequence
ggaggactcagactaaccaa

SEQ ID NO: 751323 - DNA, 20 bp, Artificial
  CRISPR gRNA sequence
gaggactcagactaaccaag

SEQ ID NO: 751324 - DNA, 20 bp, Artificial
  CRISPR gRNA sequence
agactaaccaagactcaagg

SEQ ID NO: 751325 - DNA, 20 bp, Artificial
  CRISPR gRNA sequence
accaagactcaagggcaggg

SEQ ID NO: 751326 - DNA, 20 bp, Artificial
  CRISPR gRNA sequence
aagggcagggtcaggaacta

SEQ ID NO: 751327 - DNA, 20 bp, Artificial
  CRISPR gRNA sequence
ggcaaggggcactgtcacct

SEQ ID NO: 751328 - DNA, 20 bp, Artificial
  CRISPR gRNA sequence
tcacctggccagggtgggag

SEQ ID NO: 751329 - DNA, 20 bp, Artificial
  CRISPR gRNA sequence
gccagggtgggaggtgaaag

SEQ ID NO: 751330 - DNA, 20 bp, Artificial
  CRISPR gRNA sequence
gtgcccatgacttaaagccc

SEQ ID NO: 751331 - DNA, 20 bp, Artificial
  CRISPR gRNA sequence
tgcccatgacttaaagccca

SEQ ID NO: 751332 - DNA, 20 bp, Artificial
  CRISPR gRNA sequence
aaagcccagccccaccactt

SEQ ID NO: 751333 - DNA, 20 bp, Artificial
  CRISPR gRNA sequence
aagcccagccccaccactta

SEQ ID NO: 751334 - DNA, 20 bp, Artificial
  CRISPR gRNA sequence
atttgctgtgtggttcctta

SEQ ID NO: 751335 - DNA, 20 bp, Artificial
  CRISPR gRNA sequence
tttgctgtgtggttccttag

SEQ ID NO: 751336 - DNA, 20 bp, Artificial
  CRISPR gRNA sequence
gctgtgtggttccttaggca

SEQ ID NO: 751337 - DNA, 20 bp, Artificial
  CRISPR gRNA sequence
ctgtgtggttccttaggcaa

SEQ ID NO: 751338 - DNA, 20 bp, Artificial
  CRISPR gRNA sequence
tgtggttccttaggcaagtt

SEQ ID NO: 751339 - DNA, 20 bp, Artificial
  CRISPR gRNA sequence
cttaggcaagttacttaacc

SEQ ID NO: 751340 - DNA, 20 bp, Artificial
  CRISPR gRNA sequence
aggcaagttacttaacccct

SEQ ID NO: 751341 - DNA, 20 bp, Artificial
  CRISPR gRNA sequence
ggcaagttacttaacccctc

SEQ ID NO: 751342 - DNA, 20 bp, Artificial
  CRISPR gRNA sequence
cttaacccctctgtgcctcc

SEQ ID NO: 751343 - DNA, 20 bp, Artificial
  CRISPR gRNA sequence
aacccctctgtgcctccgtt

SEQ ID NO: 751344 - DNA, 20 bp, Artificial
  CRISPR gRNA sequence
acccctctgtgcctccgttt

SEQ ID NO: 751345 - DNA, 20 bp, Artificial
  CRISPR gRNA sequence
tgtgcctccgtttgcccatc

SEQ ID NO: 751346 - DNA, 20 bp, Artificial
  CRISPR gRNA sequence
tgcctccgtttgcccatcag

SEQ ID NO: 751347 - DNA, 20 bp, Artificial
  CRISPR gRNA sequence
cgtttgcccatcagtaaaat

SEQ ID NO: 751348 - DNA, 20 bp, Artificial
  CRISPR gRNA sequence
gcccatcagtaaaatgggga

SEQ ID NO: 751349 - DNA, 20 bp, Artificial
  CRISPR gRNA sequence
cccatcagtaaaatggggac

SEQ ID NO: 751350 - DNA, 20 bp, Artificial
  CRISPR gRNA sequence
ttggacttgcaatgaggagt

SEQ ID NO: 751351 - DNA, 20 bp, Artificial
  CRISPR gRNA sequence
ggacttgcaatgaggagtaa

SEQ ID NO: 751352 - DNA, 20 bp, Artificial
  CRISPR gRNA sequence
gacttgcaatgaggagtaag

SEQ ID NO: 751353 - DNA, 20 bp, Artificial
  CRISPR gRNA sequence
gcaatgaggagtaagtgaga

SEQ ID NO: 751354 - DNA, 20 bp, Artificial
  CRISPR gRNA sequence
caatgaggagtaagtgagag

SEQ ID NO: 751355 - DNA, 20 bp, Artificial
  CRISPR gRNA sequence
ttattatatggtggacttct

SEQ ID NO: 751356 - DNA, 20 bp, Artificial
  CRISPR gRNA sequence
tattatatggtggacttcta

SEQ ID NO: 751357 - DNA, 20 bp, Artificial
  CRISPR gRNA sequence
attatatggtggacttctat

SEQ ID NO: 751358 - DNA, 20 bp, Artificial
  CRISPR gRNA sequence
ttatatggtggacttctatt

SEQ ID NO: 751359 - DNA, 20 bp, Artificial
  CRISPR gRNA sequence
tatggtggacttctattccc

SEQ ID NO: 751360 - DNA, 20 bp, Artificial
  CRISPR gRNA sequence
ctattccctggaaagagcat

SEQ ID NO: 751361 - DNA, 20 bp, Artificial
  CRISPR gRNA sequence
tattccctggaaagagcatg

SEQ ID NO: 751362 - DNA, 20 bp, Artificial
  CRISPR gRNA sequence
ttccctggaaagagcatgcg

SEQ ID NO: 751363 - DNA, 20 bp, Artificial
  CRISPR gRNA sequence
cctggaaagagcatgcgttg

SEQ ID NO: 751364 - DNA, 20 bp, Artificial
  CRISPR gRNA sequence
gaaagagcatgcgttgaaag

SEQ ID NO: 751365 - DNA, 20 bp, Artificial
  CRISPR gRNA sequence
aaagctctgagattgagtcc

SEQ ID NO: 751366 - DNA, 20 bp, Artificial
  CRISPR gRNA sequence
tgagattgagtcctagctct

SEQ ID NO: 751367 - DNA, 20 bp, Artificial
  CRISPR gRNA sequence
agattgagtcctagctctgc

SEQ ID NO: 751368 - DNA, 20 bp, Artificial
  CRISPR gRNA sequence
agtcctagctctgccactta

SEQ ID NO: 751369 - DNA, 20 bp, Artificial
  CRISPR gRNA sequence
gctctgccacttactaagtt

SEQ ID NO: 751370 - DNA, 20 bp, Artificial
  CRISPR gRNA sequence
tgccacttactaagttacgt

SEQ ID NO: 751371 - DNA, 20 bp, Artificial
  CRISPR gRNA sequence
ccacttactaagttacgtaa

SEQ ID NO: 751372 - DNA, 20 bp, Artificial
  CRISPR gRNA sequence
actaagttacgtaacattca

SEQ ID NO: 751373 - DNA, 20 bp, Artificial
  CRISPR gRNA sequence
ctaagttacgtaacattcag

SEQ ID NO: 751374 - DNA, 20 bp, Artificial
  CRISPR gRNA sequence
agttacgtaacattcagtca

SEQ ID NO: 751375 - DNA, 20 bp, Artificial
  CRISPR gRNA sequence
cgtaacattcagtcagttat

SEQ ID NO: 751376 - DNA, 20 bp, Artificial
  CRISPR gRNA sequence
agtcagttatgtaaccccac

SEQ ID NO: 751377 - DNA, 20 bp, Artificial
  CRISPR gRNA sequence
tgtaaccccactgatcttag

SEQ ID NO: 751378 - DNA, 20 bp, Artificial
  CRISPR gRNA sequence
atcttagccttctcatctgg

SEQ ID NO: 751379 - DNA, 20 bp, Artificial
  CRISPR gRNA sequence
agccttctcatctggaaaaa

SEQ ID NO: 751380 - DNA, 20 bp, Artificial
  CRISPR gRNA sequence
gccttctcatctggaaaaag

SEQ ID NO: 751381 - DNA, 20 bp, Artificial
  CRISPR gRNA sequence
ctcatctggaaaaagaaagg

SEQ ID NO: 751382 - DNA, 20 bp, Artificial
  CRISPR gRNA sequence
tcatctggaaaaagaaaggg

SEQ ID NO: 751383 - DNA, 20 bp, Artificial
  CRISPR gRNA sequence
atctggaaaaagaaagggtt

SEQ ID NO: 751384 - DNA, 20 bp, Artificial
  CRISPR gRNA sequence
gaaaaagaaagggttgagct

SEQ ID NO: 751385 - DNA, 20 bp, Artificial
  CRISPR gRNA sequence
agctaagttgtctgtaagac

SEQ ID NO: 751386 - DNA, 20 bp, Artificial
  CRISPR gRNA sequence
agttgtctgtaagacccctt

SEQ ID NO: 751387 - DNA, 20 bp, Artificial
  CRISPR gRNA sequence
tctgtaagaccccttccact

SEQ ID NO: 751388 - DNA, 20 bp, Artificial
  CRISPR gRNA sequence
taagaccccttccacttctg

SEQ ID NO: 751389 - DNA, 20 bp, Artificial
  CRISPR gRNA sequence
ccacttctgatattccaaag

SEQ ID NO: 751390 - DNA, 20 bp, Artificial
  CRISPR gRNA sequence
cacttctgatattccaaaga

SEQ ID NO: 751391 - DNA, 20 bp, Artificial
  CRISPR gRNA sequence
ctgatattccaaagatcatt

SEQ ID NO: 751392 - DNA, 20 bp, Artificial
  CRISPR gRNA sequence
tgatattccaaagatcattt

SEQ ID NO: 751393 - DNA, 20 bp, Artificial
  CRISPR gRNA sequence
atattccaaagatcattttt

SEQ ID NO: 751394 - DNA, 20 bp, Artificial
  CRISPR gRNA sequence
caaagatcattttttgtccc

SEQ ID NO: 751395 - DNA, 20 bp, Artificial
  CRISPR gRNA sequence
tttgtcccaacaattgctac

SEQ ID NO: 751396 - DNA, 20 bp, Artificial
  CRISPR gRNA sequence
ttgtcccaacaattgctact

SEQ ID NO: 751397 - DNA, 20 bp, Artificial
  CRISPR gRNA sequence
tgtcccaacaattgctacta

SEQ ID NO: 751398 - DNA, 20 bp, Artificial
  CRISPR gRNA sequence
gtcccaacaattgctactaa

SEQ ID NO: 751399 - DNA, 20 bp, Artificial
  CRISPR gRNA sequence
tcccaacaattgctactaat

SEQ ID NO: 751400 - DNA, 20 bp, Artificial
  CRISPR gRNA sequence
ctactaattacaaaacaagc

SEQ ID NO: 751401 - DNA, 20 bp, Artificial
  CRISPR gRNA sequence
ctaattacaaaacaagcacg

SEQ ID NO: 751402 - DNA, 20 bp, Artificial
  CRISPR gRNA sequence
attacaaaacaagcacgccc

SEQ ID NO: 751403 - DNA, 20 bp, Artificial
  CRISPR gRNA sequence
caaaacaagcacgcccatac

SEQ ID NO: 751404 - DNA, 20 bp, Artificial
  CRISPR gRNA sequence
aaacaggtcccccaaggatc

SEQ ID NO: 751405 - DNA, 20 bp, Artificial
  CRISPR gRNA sequence
aacaggtcccccaaggatct

SEQ ID NO: 751406 - DNA, 20 bp, Artificial
  CRISPR gRNA sequence
tgagtggcagcaacttgctt

SEQ ID NO: 751407 - DNA, 20 bp, Artificial
  CRISPR gRNA sequence
agtggcagcaacttgctttt

SEQ ID NO: 751408 - DNA, 20 bp, Artificial
  CRISPR gRNA sequence
gcttttataaagcaacttga

SEQ ID NO: 751409 - DNA, 20 bp, Artificial
  CRISPR gRNA sequence
cttttataaagcaacttgag

SEQ ID NO: 751410 - DNA, 20 bp, Artificial
  CRISPR gRNA sequence
ttataaagcaacttgagcta

SEQ ID NO: 751411 - DNA, 20 bp, Artificial
  CRISPR gRNA sequence
tataaagcaacttgagctac

SEQ ID NO: 751412 - DNA, 20 bp, Artificial
  CRISPR gRNA sequence
ataaagcaacttgagctact

SEQ ID NO: 751413 - DNA, 20 bp, Artificial
  CRISPR gRNA sequence
taaagcaacttgagctactg

SEQ ID NO: 751414 - DNA, 20 bp, Artificial
  CRISPR gRNA sequence
gagctactgcatatgatcat

SEQ ID NO: 751415 - DNA, 20 bp, Artificial
  CRISPR gRNA sequence
agctactgcatatgatcatt

SEQ ID NO: 751416 - DNA, 20 bp, Artificial
  CRISPR gRNA sequence
ctgcatatgatcattcattc

SEQ ID NO: 751417 - DNA, 20 bp, Artificial
  CRISPR gRNA sequence
catatgatcattcattcaga

SEQ ID NO: 751418 - DNA, 20 bp, Artificial
  CRISPR gRNA sequence
attcagaagacatgtattga

SEQ ID NO: 751419 - DNA, 20 bp, Artificial
  CRISPR gRNA sequence
agaagacatgtattgagtgc

SEQ ID NO: 751420 - DNA, 20 bp, Artificial
  CRISPR gRNA sequence
agtgccgagccagcactgcc

SEQ ID NO: 751421 - DNA, 20 bp, Artificial
  CRISPR gRNA sequence
cctgggagccaaaggggctg

SEQ ID NO: 751422 - DNA, 20 bp, Artificial
  CRISPR gRNA sequence
ggagccaaaggggctggtgg

SEQ ID NO: 751423 - DNA, 20 bp, Artificial
  CRISPR gRNA sequence
gtgggcacttggcccccgga

SEQ ID NO: 751424 - DNA, 20 bp, Artificial
  CRISPR gRNA sequence
ggcccccggaaatggcatgc

SEQ ID NO: 751425 - DNA, 20 bp, Artificial
  CRISPR gRNA sequence
gcccccggaaatggcatgcc

SEQ ID NO: 751426 - DNA, 20 bp, Artificial
  CRISPR gRNA sequence
ctttctctcggccatttcgc

SEQ ID NO: 751427 - DNA, 20 bp, Artificial
  CRISPR gRNA sequence
tctctcggccatttcgccca

SEQ ID NO: 751428 - DNA, 20 bp, Artificial
  CRISPR gRNA sequence
ctctcggccatttcgcccag

SEQ ID NO: 751429 - DNA, 20 bp, Artificial
  CRISPR gRNA sequence
tctcggccatttcgcccagc

SEQ ID NO: 751430 - DNA, 20 bp, Artificial
  CRISPR gRNA sequence
tcggccatttcgcccagctc

SEQ ID NO: 751431 - DNA, 20 bp, Artificial
  CRISPR gRNA sequence
ggccatttcgcccagctcct

SEQ ID NO: 751432 - DNA, 20 bp, Artificial
  CRISPR gRNA sequence
cgcccagctcctggcgggaa

SEQ ID NO: 751433 - DNA, 20 bp, Artificial
  CRISPR gRNA sequence
gcccagctcctggcgggaag

SEQ ID NO: 751434 - DNA, 20 bp, Artificial
  CRISPR gRNA sequence
ctggcgggaagtgcagctgc

SEQ ID NO: 751435 - DNA, 20 bp, Artificial
  CRISPR gRNA sequence
gcgggaagtgcagctgctcc

SEQ ID NO: 751436 - DNA, 20 bp, Artificial
  CRISPR gRNA sequence
ctcccaactctcaaatgaaa

SEQ ID NO: 751437 - DNA, 20 bp, Artificial
  CRISPR gRNA sequence
ccaactctcaaatgaaaagg

SEQ ID NO: 751438 - DNA, 20 bp, Artificial
  CRISPR gRNA sequence
tcaaatgaaaaggaattgtg

SEQ ID NO: 751439 - DNA, 20 bp, Artificial
  CRISPR gRNA sequence
aaatgaaaaggaattgtgcc

SEQ ID NO: 751440 - DNA, 20 bp, Artificial
  CRISPR gRNA sequence
tgcctgcatcgtgcctttgc

SEQ ID NO: 751441 - DNA, 20 bp, Artificial
  CRISPR gRNA sequence
catcgtgcctttgcgaatcc

SEQ ID NO: 751442 - DNA, 20 bp, Artificial
  CRISPR gRNA sequence
tgcgaatcccaggggctgaa

SEQ ID NO: 751443 - DNA, 20 bp, Artificial
  CRISPR gRNA sequence
gcgaatcccaggggctgaac

SEQ ID NO: 751444 - DNA, 20 bp, Artificial
  CRISPR gRNA sequence
cgaatcccaggggctgaact

SEQ ID NO: 751445 - DNA, 20 bp, Artificial
  CRISPR gRNA sequence
aactgggggctggagcaggt

SEQ ID NO: 751446 - DNA, 20 bp, Artificial
  CRISPR gRNA sequence
ggggctggagcaggtcactc

SEQ ID NO: 751447 - DNA, 20 bp, Artificial
  CRISPR gRNA sequence
gagcaggtcactcgcaccgt

SEQ ID NO: 751448 - DNA, 20 bp, Artificial
  CRISPR gRNA sequence
gcaccgtccacccaccccag

SEQ ID NO: 751449 - DNA, 20 bp, Artificial
  CRISPR gRNA sequence
acggcggttggaggctgcct

SEQ ID NO: 751450 - DNA, 20 bp, Artificial
  CRISPR gRNA sequence
gaggctgcctgcctttgctt

SEQ ID NO: 751451 - DNA, 20 bp, Artificial
  CRISPR gRNA sequence
cctgcctttgcttgtagacc

SEQ ID NO: 751452 - DNA, 20 bp, Artificial
  CRISPR gRNA sequence
cctttgcttgtagaccagga

SEQ ID NO: 751453 - DNA, 20 bp, Artificial
  CRISPR gRNA sequence
tgcttgtagaccaggagcag

SEQ ID NO: 751454 - DNA, 20 bp, Artificial
  CRISPR gRNA sequence
gcttgtagaccaggagcagg

SEQ ID NO: 751455 - DNA, 20 bp, Artificial
  CRISPR gRNA sequence
cttgtagaccaggagcagga

SEQ ID NO: 751456 - DNA, 20 bp, Artificial
  CRISPR gRNA sequence
gtagaccaggagcaggatga

SEQ ID NO: 751457 - DNA, 20 bp, Artificial
  CRISPR gRNA sequence
tagaccaggagcaggatgag

SEQ ID NO: 751458 - DNA, 20 bp, Artificial
  CRISPR gRNA sequence
ctacgatgcaggcacccgta

SEQ ID NO: 751459 - DNA, 20 bp, Artificial
  CRISPR gRNA sequence
cgatgcaggcacccgtagcc

SEQ ID NO: 751460 - DNA, 20 bp, Artificial
  CRISPR gRNA sequence
cagccgtgatgtctgaaagg

SEQ ID NO: 751461 - DNA, 20 bp, Artificial
  CRISPR gRNA sequence
aaagggcagagaggtagcca

SEQ ID NO: 751462 - DNA, 20 bp, Artificial
  CRISPR gRNA sequence
ccattgctcctcctgagcat

SEQ ID NO: 751463 - DNA, 20 bp, Artificial
  CRISPR gRNA sequence
ctcctcctgagcataaactg

SEQ ID NO: 751464 - DNA, 20 bp, Artificial
  CRISPR gRNA sequence
ctcctgagcataaactgagg

SEQ ID NO: 751465 - DNA, 20 bp, Artificial
  CRISPR gRNA sequence
ctgagcataaactgaggctc

SEQ ID NO: 751466 - DNA, 20 bp, Artificial
  CRISPR gRNA sequence
agcataaactgaggctcaga

SEQ ID NO: 751467 - DNA, 20 bp, Artificial
  CRISPR gRNA sequence
aggctcagagagggaaggcc

SEQ ID NO: 751468 - DNA, 20 bp, Artificial
  CRISPR gRNA sequence
agagagggaaggccaggaag

SEQ ID NO: 751469 - DNA, 20 bp, Artificial
  CRISPR gRNA sequence
tccccagagtcccacagcta

SEQ ID NO: 751470 - DNA, 20 bp, Artificial
  CRISPR gRNA sequence
ccccagagtcccacagctag

SEQ ID NO: 751471 - DNA, 20 bp, Artificial
  CRISPR gRNA sequence
cccagagtcccacagctaga

SEQ ID NO: 751472 - DNA, 20 bp, Artificial
  CRISPR gRNA sequence
gacccccagcaacctacaga

SEQ ID NO: 751473 - DNA, 20 bp, Artificial
  CRISPR gRNA sequence
cagaggcatggaagataagg

SEQ ID NO: 751474 - DNA, 20 bp, Artificial
  CRISPR gRNA sequence
tcctttcaaagagagccctg

SEQ ID NO: 751475 - DNA, 20 bp, Artificial
  CRISPR gRNA sequence
ctttcaaagagagccctgtg

SEQ ID NO: 751476 - DNA, 20 bp, Artificial
  CRISPR gRNA sequence
tcaaagagagccctgtgcct

SEQ ID NO: 751477 - DNA, 20 bp, Artificial
  CRISPR gRNA sequence
caaagagagccctgtgcctg

SEQ ID NO: 751478 - DNA, 20 bp, Artificial
  CRISPR gRNA sequence
aaagagagccctgtgcctgc

SEQ ID NO: 751479 - DNA, 20 bp, Artificial
  CRISPR gRNA sequence
tgcctgccgccctatgcccc

SEQ ID NO: 751480 - DNA, 20 bp, Artificial
  CRISPR gRNA sequence
ccgccctatgcccctggagc

SEQ ID NO: 751481 - DNA, 20 bp, Artificial
  CRISPR gRNA sequence
tgcccctggagcactcagaa

SEQ ID NO: 751482 - DNA, 20 bp, Artificial
  CRISPR gRNA sequence
gagcactcagaaacaagacc

SEQ ID NO: 751483 - DNA, 20 bp, Artificial
  CRISPR gRNA sequence
agaaacaagacctgtcacct

SEQ ID NO: 751484 - DNA, 20 bp, Artificial
  CRISPR gRNA sequence
tcacctacagctcaggcagc

SEQ ID NO: 751485 - DNA, 20 bp, Artificial
  CRISPR gRNA sequence
cagctcaggcagctccaggc

SEQ ID NO: 751486 - DNA, 20 bp, Artificial
  CRISPR gRNA sequence
aggcagctccaggcaagaga

SEQ ID NO: 751487 - DNA, 20 bp, Artificial
  CRISPR gRNA sequence
caggcaagagagggaacaga

SEQ ID NO: 751488 - DNA, 20 bp, Artificial
  CRISPR gRNA sequence
atcccagcccacaaggtaca

SEQ ID NO: 751489 - DNA, 20 bp, Artificial
  CRISPR gRNA sequence
gaacacccttggctacaggt

SEQ ID NO: 751490 - DNA, 20 bp, Artificial
  CRISPR gRNA sequence
ggctacaggttgttctctga

SEQ ID NO: 751491 - DNA, 20 bp, Artificial
  CRISPR gRNA sequence
gctacaggttgttctctgaa

SEQ ID NO: 751492 - DNA, 20 bp, Artificial
  CRISPR gRNA sequence
caggttgttctctgaaaagg

SEQ ID NO: 751493 - DNA, 20 bp, Artificial
  CRISPR gRNA sequence
ttctctgaaaagggagagca

SEQ ID NO: 751494 - DNA, 20 bp, Artificial
  CRISPR gRNA sequence
tctgaaaagggagagcaggg

SEQ ID NO: 751495 - DNA, 20 bp, Artificial
  CRISPR gRNA sequence
tgaaaagggagagcagggcc

SEQ ID NO: 751496 - DNA, 20 bp, Artificial
  CRISPR gRNA sequence
aaaagggagagcagggcctt

SEQ ID NO: 751497 - DNA, 20 bp, Artificial
  CRISPR gRNA sequence
cgcagaccccatgccacaga

SEQ ID NO: 751498 - DNA, 20 bp, Artificial
  CRISPR gRNA sequence
gcagaccccatgccacagag

SEQ ID NO: 751499 - DNA, 20 bp, Artificial
  CRISPR gRNA sequence
aaggtcaaaagaagcctaag

SEQ ID NO: 751500 - DNA, 20 bp, Artificial
  CRISPR gRNA sequence
agtgatgaaagttttgaaaa

SEQ ID NO: 751501 - DNA, 20 bp, Artificial
  CRISPR gRNA sequence
tgaaaatagacagtggtgac

SEQ ID NO: 751502 - DNA, 20 bp, Artificial
  CRISPR gRNA sequence
gaaaatagacagtggtgacg

SEQ ID NO: 751503 - DNA, 20 bp, Artificial
  CRISPR gRNA sequence
aaaatagacagtggtgacgg

SEQ ID NO: 751504 - DNA, 20 bp, Artificial
  CRISPR gRNA sequence
cacattgtgaatgtaattaa

SEQ ID NO: 751505 - DNA, 20 bp, Artificial
  CRISPR gRNA sequence
tgaatgtaattaatgccacc

SEQ ID NO: 751506 - DNA, 20 bp, Artificial
  CRISPR gRNA sequence
atgccaccaaactgtaggct

SEQ ID NO: 751507 - DNA, 20 bp, Artificial
  CRISPR gRNA sequence
taggcttaaaatggttgaaa

SEQ ID NO: 751508 - DNA, 20 bp, Artificial
  CRISPR gRNA sequence
aaaatggttgaaatggcaaa

SEQ ID NO: 751509 - DNA, 20 bp, Artificial
  CRISPR gRNA sequence
aaatggttgaaatggcaaat

SEQ ID NO: 751510 - DNA, 20 bp, Artificial
  CRISPR gRNA sequence
aaatggcaaattttacatta

SEQ ID NO: 751511 - DNA, 20 bp, Artificial
  CRISPR gRNA sequence
tacattatatatgttttatc

SEQ ID NO: 751512 - DNA, 20 bp, Artificial
  CRISPR gRNA sequence
acattatatatgttttatca

SEQ ID NO: 751513 - DNA, 20 bp, Artificial
  CRISPR gRNA sequence
cattatatatgttttatcat

SEQ ID NO: 751514 - DNA, 20 bp, Artificial
  CRISPR gRNA sequence
tatatgttttatcataatag

SEQ ID NO: 751515 - DNA, 20 bp, Artificial
  CRISPR gRNA sequence
tatcataatagataaaaagc

SEQ ID NO: 751516 - DNA, 20 bp, Artificial
  CRISPR gRNA sequence
atcataatagataaaaagcc

SEQ ID NO: 751517 - DNA, 20 bp, Artificial
  CRISPR gRNA sequence
tcataatagataaaaagccc

SEQ ID NO: 751518 - DNA, 20 bp, Artificial
  CRISPR gRNA sequence
atcccagagactccttagct

SEQ ID NO: 751519 - DNA, 20 bp, Artificial
  CRISPR gRNA sequence
cttagctctgggatggggcc

SEQ ID NO: 751520 - DNA, 20 bp, Artificial
  CRISPR gRNA sequence
agctctgggatggggcctct

SEQ ID NO: 751521 - DNA, 20 bp, Artificial
  CRISPR gRNA sequence
gctctgggatggggcctcta

SEQ ID NO: 751522 - DNA, 20 bp, Artificial
  CRISPR gRNA sequence
tgggatggggcctctagaac

SEQ ID NO: 751523 - DNA, 20 bp, Artificial
  CRISPR gRNA sequence
ggatggggcctctagaaccc

SEQ ID NO: 751524 - DNA, 20 bp, Artificial
  CRISPR gRNA sequence
tagaaccccttgatctcacc

SEQ ID NO: 751525 - DNA, 20 bp, Artificial
  CRISPR gRNA sequence
gaaccccttgatctcaccac

SEQ ID NO: 751526 - DNA, 20 bp, Artificial
  CRISPR gRNA sequence
gatctcaccacacaagtcac

SEQ ID NO: 751527 - DNA, 20 bp, Artificial
  CRISPR gRNA sequence
atctcaccacacaagtcaca

SEQ ID NO: 751528 - DNA, 20 bp, Artificial
  CRISPR gRNA sequence
accacacaagtcacaggaga

SEQ ID NO: 751529 - DNA, 20 bp, Artificial
  CRISPR gRNA sequence
gaaaaacgtgaatccttgta

SEQ ID NO: 751530 - DNA, 20 bp, Artificial
  CRISPR gRNA sequence
gtacaatgtttttcaatttt

SEQ ID NO: 751531 - DNA, 20 bp, Artificial
  CRISPR gRNA sequence
tacaatgtttttcaatttta

SEQ ID NO: 751532 - DNA, 20 bp, Artificial
  CRISPR gRNA sequence
ttcaattttaaacttattaa

SEQ ID NO: 751533 - DNA, 20 bp, Artificial
  CRISPR gRNA sequence
tcaattttaaacttattaaa

SEQ ID NO: 751534 - DNA, 20 bp, Artificial
  CRISPR gRNA sequence
caattttaaacttattaaac

SEQ ID NO: 751535 - DNA, 20 bp, Artificial
  CRISPR gRNA sequence
aattttaaacttattaaact

SEQ ID NO: 751536 - DNA, 20 bp, Artificial
  CRISPR gRNA sequence
taaacttattaaactaccaa

SEQ ID NO: 751537 - DNA, 20 bp, Artificial
  CRISPR gRNA sequence
aaacttattaaactaccaaa

SEQ ID NO: 751538 - DNA, 20 bp, Artificial
  CRISPR gRNA sequence
aacttattaaactaccaaaa

SEQ ID NO: 751539 - DNA, 20 bp, Artificial
  CRISPR gRNA sequence
attaaactaccaaaaaaagt

SEQ ID NO: 751540 - DNA, 20 bp, Artificial
  CRISPR gRNA sequence
ttaaactaccaaaaaaagta

SEQ ID NO: 751541 - DNA, 20 bp, Artificial
  CRISPR gRNA sequence
aactaccaaaaaaagtacaa

SEQ ID NO: 751542 - DNA, 20 bp, Artificial
  CRISPR gRNA sequence
ccaaaaaaagtacaagttta

SEQ ID NO: 751543 - DNA, 20 bp, Artificial
  CRISPR gRNA sequence
aaaaaatattcgaatctcct

SEQ ID NO: 751544 - DNA, 20 bp, Artificial
  CRISPR gRNA sequence
aaaaatattcgaatctcctc

SEQ ID NO: 751545 - DNA, 20 bp, Artificial
  CRISPR gRNA sequence
gaatctcctcctccccttgt

SEQ ID NO: 751546 - DNA, 20 bp, Artificial
  CRISPR gRNA sequence
ctcctccccttgtaccaaga

SEQ ID NO: 751547 - DNA, 20 bp, Artificial
  CRISPR gRNA sequence
ctccccttgtaccaagaccc

SEQ ID NO: 751548 - DNA, 20 bp, Artificial
  CRISPR gRNA sequence
cccttgtaccaagaccccct

SEQ ID NO: 751549 - DNA, 20 bp, Artificial
  CRISPR gRNA sequence
gtaccaagaccccctctgaa

SEQ ID NO: 751550 - DNA, 20 bp, Artificial
  CRISPR gRNA sequence
taccaagaccccctctgaag

SEQ ID NO: 751551 - DNA, 20 bp, Artificial
  CRISPR gRNA sequence
tgaagagatcatccctgtgt

SEQ ID NO: 751552 - DNA, 20 bp, Artificial
  CRISPR gRNA sequence
aagagatcatccctgtgtgc

SEQ ID NO: 751553 - DNA, 20 bp, Artificial
  CRISPR gRNA sequence
tgtgccggtttttgtgttat

SEQ ID NO: 751554 - DNA, 20 bp, Artificial
  CRISPR gRNA sequence
ttgtgttatggtcctagtta

SEQ ID NO: 751555 - DNA, 20 bp, Artificial
  CRISPR gRNA sequence
tgtgttatggtcctagttat

SEQ ID NO: 751556 - DNA, 20 bp, Artificial
  CRISPR gRNA sequence
gtgttatggtcctagttata

SEQ ID NO: 751557 - DNA, 20 bp, Artificial
  CRISPR gRNA sequence
tgttatggtcctagttatat

SEQ ID NO: 751558 - DNA, 20 bp, Artificial
  CRISPR gRNA sequence
tggtcctagttatattccct

SEQ ID NO: 751559 - DNA, 20 bp, Artificial
  CRISPR gRNA sequence
gttatattccctgcaaatac

SEQ ID NO: 751560 - DNA, 20 bp, Artificial
  CRISPR gRNA sequence
tattccctgcaaatacagca

SEQ ID NO: 751561 - DNA, 20 bp, Artificial
  CRISPR gRNA sequence
cctgcaaatacagcagacgc

SEQ ID NO: 751562 - DNA, 20 bp, Artificial
  CRISPR gRNA sequence
caaatacagcagacgcagca

SEQ ID NO: 751563 - DNA, 20 bp, Artificial
  CRISPR gRNA sequence
ttcccactgagcacagcttg

SEQ ID NO: 751564 - DNA, 20 bp, Artificial
  CRISPR gRNA sequence
tcccactgagcacagcttgg

SEQ ID NO: 751565 - DNA, 20 bp, Artificial
  CRISPR gRNA sequence
cccactgagcacagcttgga

SEQ ID NO: 751566 - DNA, 20 bp, Artificial
  CRISPR gRNA sequence
ccactgagcacagcttggac

SEQ ID NO: 751567 - DNA, 20 bp, Artificial
  CRISPR gRNA sequence
agcacagcttggacatctct

SEQ ID NO: 751568 - DNA, 20 bp, Artificial
  CRISPR gRNA sequence
ggacatctctctgtctcccc

SEQ ID NO: 751569 - DNA, 20 bp, Artificial
  CRISPR gRNA sequence
gacatctctctgtctcccct

SEQ ID NO: 751570 - DNA, 20 bp, Artificial
  CRISPR gRNA sequence
tctgtctcccctgcctcatt

SEQ ID NO: 751571 - DNA, 20 bp, Artificial
  CRISPR gRNA sequence
tgtctcccctgcctcattct

SEQ ID NO: 751572 - DNA, 20 bp, Artificial
  CRISPR gRNA sequence
tctcccctgcctcattctgc

SEQ ID NO: 751573 - DNA, 20 bp, Artificial
  CRISPR gRNA sequence
ccctgcctcattctgcttag

SEQ ID NO: 751574 - DNA, 20 bp, Artificial
  CRISPR gRNA sequence
cctcattctgcttagagttt

SEQ ID NO: 751575 - DNA, 20 bp, Artificial
  CRISPR gRNA sequence
attctgcttagagttttatc

SEQ ID NO: 751576 - DNA, 20 bp, Artificial
  CRISPR gRNA sequence
tgcttagagttttatcacat

SEQ ID NO: 751577 - DNA, 20 bp, Artificial
  CRISPR gRNA sequence
cttagagttttatcacatgg

SEQ ID NO: 751578 - DNA, 20 bp, Artificial
  CRISPR gRNA sequence
agagttttatcacatggctc

SEQ ID NO: 751579 - DNA, 20 bp, Artificial
  CRISPR gRNA sequence
gagttttatcacatggctcc

SEQ ID NO: 751580 - DNA, 20 bp, Artificial
  CRISPR gRNA sequence
tatcacatggctcccactaa

SEQ ID NO: 751581 - DNA, 20 bp, Artificial
  CRISPR gRNA sequence
atcacatggctcccactaaa

SEQ ID NO: 751582 - DNA, 20 bp, Artificial
  CRISPR gRNA sequence
tcacatggctcccactaaat

SEQ ID NO: 751583 - DNA, 20 bp, Artificial
  CRISPR gRNA sequence
ccactaaatttattgaagca

SEQ ID NO: 751584 - DNA, 20 bp, Artificial
  CRISPR gRNA sequence
aatttattgaagcagtcccc

SEQ ID NO: 751585 - DNA, 20 bp, Artificial
  CRISPR gRNA sequence
attgaagcagtcccctgttg

SEQ ID NO: 751586 - DNA, 20 bp, Artificial
  CRISPR gRNA sequence
ttgaagcagtcccctgttgg

SEQ ID NO: 751587 - DNA, 20 bp, Artificial
  CRISPR gRNA sequence
aagcagtcccctgttggtag

SEQ ID NO: 751588 - DNA, 20 bp, Artificial
  CRISPR gRNA sequence
ttggtagacatgttgtttcc

SEQ ID NO: 751589 - DNA, 20 bp, Artificial
  CRISPR gRNA sequence
gtagacatgttgtttccatt

SEQ ID NO: 751590 - DNA, 20 bp, Artificial
  CRISPR gRNA sequence
tttccattttcagcataact

SEQ ID NO: 751591 - DNA, 20 bp, Artificial
  CRISPR gRNA sequence
ccattttcagcataactaat

SEQ ID NO: 751592 - DNA, 20 bp, Artificial
  CRISPR gRNA sequence
cattttcagcataactaata

SEQ ID NO: 751593 - DNA, 20 bp, Artificial
  CRISPR gRNA sequence
tcagcataactaataatgta

SEQ ID NO: 751594 - DNA, 20 bp, Artificial
  CRISPR gRNA sequence
cagcataactaataatgtag

SEQ ID NO: 751595 - DNA, 20 bp, Artificial
  CRISPR gRNA sequence
agcataactaataatgtagc

SEQ ID NO: 751596 - DNA, 20 bp, Artificial
  CRISPR gRNA sequence
ataatgtagcaatgaacttg

SEQ ID NO: 751597 - DNA, 20 bp, Artificial
  CRISPR gRNA sequence
gtgcacgcagcctggctcac

SEQ ID NO: 751598 - DNA, 20 bp, Artificial
  CRISPR gRNA sequence
tgcacgcagcctggctcact

SEQ ID NO: 751599 - DNA, 20 bp, Artificial
  CRISPR gRNA sequence
gctcactcagcaaggaaatc

SEQ ID NO: 751600 - DNA, 20 bp, Artificial
  CRISPR gRNA sequence
actcagcaaggaaatctgta

SEQ ID NO: 751601 - DNA, 20 bp, Artificial
  CRISPR gRNA sequence
agcaaggaaatctgtagtaa

SEQ ID NO: 751602 - DNA, 20 bp, Artificial
  CRISPR gRNA sequence
tagtaaattcctagcggtca

SEQ ID NO: 751603 - DNA, 20 bp, Artificial
  CRISPR gRNA sequence
ctagcggtcaaagtgctgag

SEQ ID NO: 751604 - DNA, 20 bp, Artificial
  CRISPR gRNA sequence
gcggtcaaagtgctgagcca

SEQ ID NO: 751605 - DNA, 20 bp, Artificial
  CRISPR gRNA sequence
agccaaagagtatgtgcatt

SEQ ID NO: 751606 - DNA, 20 bp, Artificial
  CRISPR gRNA sequence
tcttttaggctattgctaaa

SEQ ID NO: 751607 - DNA, 20 bp, Artificial
  CRISPR gRNA sequence
cttttaggctattgctaaat

SEQ ID NO: 751608 - DNA, 20 bp, Artificial
  CRISPR gRNA sequence
ttttaggctattgctaaatt

SEQ ID NO: 751609 - DNA, 20 bp, Artificial
  CRISPR gRNA sequence
ttaggctattgctaaattgc

SEQ ID NO: 751610 - DNA, 20 bp, Artificial
  CRISPR gRNA sequence
taggctattgctaaattgcc

SEQ ID NO: 751611 - DNA, 20 bp, Artificial
  CRISPR gRNA sequence
aggctattgctaaattgccc

SEQ ID NO: 751612 - DNA, 20 bp, Artificial
  CRISPR gRNA sequence
ggctattgctaaattgccct

SEQ ID NO: 751613 - DNA, 20 bp, Artificial
  CRISPR gRNA sequence
ttgctaaattgccctccaaa

SEQ ID NO: 751614 - DNA, 20 bp, Artificial
  CRISPR gRNA sequence
ctaaattgccctccaaaaag

SEQ ID NO: 751615 - DNA, 20 bp, Artificial
  CRISPR gRNA sequence
aattgccctccaaaaaggtg

SEQ ID NO: 751616 - DNA, 20 bp, Artificial
  CRISPR gRNA sequence
ccctccaaaaaggtgtacac

SEQ ID NO: 751617 - DNA, 20 bp, Artificial
  CRISPR gRNA sequence
caaaaaggtgtacacgaagc

SEQ ID NO: 751618 - DNA, 20 bp, Artificial
  CRISPR gRNA sequence
cgctgtcccaacagcatgag

SEQ ID NO: 751619 - DNA, 20 bp, Artificial
  CRISPR gRNA sequence
gctgtcccaacagcatgagg

SEQ ID NO: 751620 - DNA, 20 bp, Artificial
  CRISPR gRNA sequence
tcccaacagcatgaggaggt

SEQ ID NO: 751621 - DNA, 20 bp, Artificial
  CRISPR gRNA sequence
gatttatttcagggcatctg

SEQ ID NO: 751622 - DNA, 20 bp, Artificial
  CRISPR gRNA sequence
atttatttcagggcatctgc

SEQ ID NO: 751623 - DNA, 20 bp, Artificial
  CRISPR gRNA sequence
atttcagggcatctgctgac

SEQ ID NO: 751624 - DNA, 20 bp, Artificial
  CRISPR gRNA sequence
tttcagggcatctgctgact

SEQ ID NO: 751625 - DNA, 20 bp, Artificial
  CRISPR gRNA sequence
cagggcatctgctgactgca

SEQ ID NO: 751626 - DNA, 20 bp, Artificial
  CRISPR gRNA sequence
agggcatctgctgactgcag

SEQ ID NO: 751627 - DNA, 20 bp, Artificial
  CRISPR gRNA sequence
ctgactgcaggagtttagct

SEQ ID NO: 751628 - DNA, 20 bp, Artificial
  CRISPR gRNA sequence
actgcaggagtttagctggg

SEQ ID NO: 751629 - DNA, 20 bp, Artificial
  CRISPR gRNA sequence
caggagtttagctgggaaca

SEQ ID NO: 751630 - DNA, 20 bp, Artificial
  CRISPR gRNA sequence
agctgggaacagacgtgccc

SEQ ID NO: 751631 - DNA, 20 bp, Artificial
  CRISPR gRNA sequence
gctgggaacagacgtgccct

SEQ ID NO: 751632 - DNA, 20 bp, Artificial
  CRISPR gRNA sequence
ggaacagacgtgccctcaga

SEQ ID NO: 751633 - DNA, 20 bp, Artificial
  CRISPR gRNA sequence
agaaccacaaccaacataaa

SEQ ID NO: 751634 - DNA, 20 bp, Artificial
  CRISPR gRNA sequence
ccttcccaattttagccttt

SEQ ID NO: 751635 - DNA, 20 bp, Artificial
  CRISPR gRNA sequence
cttcccaattttagcctttc

SEQ ID NO: 751636 - DNA, 20 bp, Artificial
  CRISPR gRNA sequence
cccaattttagcctttccca

SEQ ID NO: 751637 - DNA, 20 bp, Artificial
  CRISPR gRNA sequence
ccaattttagcctttcccag

SEQ ID NO: 751638 - DNA, 20 bp, Artificial
  CRISPR gRNA sequence
tagcctttcccagggccaaa

SEQ ID NO: 751639 - DNA, 20 bp, Artificial
  CRISPR gRNA sequence
agcctttcccagggccaaaa

SEQ ID NO: 751640 - DNA, 20 bp, Artificial
  CRISPR gRNA sequence
gcctttcccagggccaaaag

SEQ ID NO: 751641 - DNA, 20 bp, Artificial
  CRISPR gRNA sequence
tcccagggccaaaagatggg

SEQ ID NO: 751642 - DNA, 20 bp, Artificial
  CRISPR gRNA sequence
cccagggccaaaagatgggc

SEQ ID NO: 751643 - DNA, 20 bp, Artificial
  CRISPR gRNA sequence
ccagggccaaaagatgggct

SEQ ID NO: 751644 - DNA, 20 bp, Artificial
  CRISPR gRNA sequence
ggataccttgtcacagtgtc

SEQ ID NO: 751645 - DNA, 20 bp, Artificial
  CRISPR gRNA sequence
gtcacagtgtcaacttcgcc

SEQ ID NO: 751646 - DNA, 20 bp, Artificial
  CRISPR gRNA sequence
tcacagtgtcaacttcgccc

SEQ ID NO: 751647 - DNA, 20 bp, Artificial
  CRISPR gRNA sequence
cgccccaaagagctctgaga

SEQ ID NO: 751648 - DNA, 20 bp, Artificial
  CRISPR gRNA sequence
gccccaaagagctctgagag

SEQ ID NO: 751649 - DNA, 20 bp, Artificial
  CRISPR gRNA sequence
tgagaggtaaatggctgtgg

SEQ ID NO: 751650 - DNA, 20 bp, Artificial
  CRISPR gRNA sequence
agaggtaaatggctgtggtc

SEQ ID NO: 751651 - DNA, 20 bp, Artificial
  CRISPR gRNA sequence
tggtctaaatgttgcctttc

SEQ ID NO: 751652 - DNA, 20 bp, Artificial
  CRISPR gRNA sequence
aatgttgcctttccgctatt

SEQ ID NO: 751653 - DNA, 20 bp, Artificial
  CRISPR gRNA sequence
cctttccgctatttgtttgg

SEQ ID NO: 751654 - DNA, 20 bp, Artificial
  CRISPR gRNA sequence
tccgctatttgtttgggaat

SEQ ID NO: 751655 - DNA, 20 bp, Artificial
  CRISPR gRNA sequence
ccgctatttgtttgggaata

SEQ ID NO: 751656 - DNA, 20 bp, Artificial
  CRISPR gRNA sequence
cgctatttgtttgggaataa

SEQ ID NO: 751657 - DNA, 20 bp, Artificial
  CRISPR gRNA sequence
tttgtttgggaataaaggct

SEQ ID NO: 751658 - DNA, 20 bp, Artificial
  CRISPR gRNA sequence
gtttgggaataaaggctgtt

SEQ ID NO: 751659 - DNA, 20 bp, Artificial
  CRISPR gRNA sequence
tttgggaataaaggctgttt

SEQ ID NO: 751660 - DNA, 20 bp, Artificial
  CRISPR gRNA sequence
gggaataaaggctgtttttg

SEQ ID NO: 751661 - DNA, 20 bp, Artificial
  CRISPR gRNA sequence
ggaataaaggctgtttttgt

SEQ ID NO: 751662 - DNA, 20 bp, Artificial
  CRISPR gRNA sequence
tttttgttttgctctacaat

SEQ ID NO: 751663 - DNA, 20 bp, Artificial
  CRISPR gRNA sequence
ttgttttgctctacaatccg

SEQ ID NO: 751664 - DNA, 20 bp, Artificial
  CRISPR gRNA sequence
tgttttgctctacaatccga

SEQ ID NO: 751665 - DNA, 20 bp, Artificial
  CRISPR gRNA sequence
gttttgctctacaatccgac

SEQ ID NO: 751666 - DNA, 20 bp, Artificial
  CRISPR gRNA sequence
ttttgctctacaatccgaca

SEQ ID NO: 751667 - DNA, 20 bp, Artificial
  CRISPR gRNA sequence
tgctctacaatccgacagcg

SEQ ID NO: 751668 - DNA, 20 bp, Artificial
  CRISPR gRNA sequence
gctctacaatccgacagcgt

SEQ ID NO: 751669 - DNA, 20 bp, Artificial
  CRISPR gRNA sequence
ctctacaatccgacagcgta

SEQ ID NO: 751670 - DNA, 20 bp, Artificial
  CRISPR gRNA sequence
tacaatccgacagcgtaaac

SEQ ID NO: 751671 - DNA, 20 bp, Artificial
  CRISPR gRNA sequence
caatccgacagcgtaaacaa

SEQ ID NO: 751672 - DNA, 20 bp, Artificial
  CRISPR gRNA sequence
tcaggaggtttgttcatact

SEQ ID NO: 751673 - DNA, 20 bp, Artificial
  CRISPR gRNA sequence
caggaggtttgttcatactg

SEQ ID NO: 751674 - DNA, 20 bp, Artificial
  CRISPR gRNA sequence
aggaggtttgttcatactgc

SEQ ID NO: 751675 - DNA, 20 bp, Artificial
  CRISPR gRNA sequence
gttcatactgcaaatgagaa

SEQ ID NO: 751676 - DNA, 20 bp, Artificial
  CRISPR gRNA sequence
ttcatactgcaaatgagaac

SEQ ID NO: 751677 - DNA, 20 bp, Artificial
  CRISPR gRNA sequence
atactgcaaatgagaacaaa

SEQ ID NO: 751678 - DNA, 20 bp, Artificial
  CRISPR gRNA sequence
caaatgagaacaaactgttt

SEQ ID NO: 751679 - DNA, 20 bp, Artificial
  CRISPR gRNA sequence
ttttcagtcactttagaagt

SEQ ID NO: 751680 - DNA, 20 bp, Artificial
  CRISPR gRNA sequence
tcagtcactttagaagtacc

SEQ ID NO: 751681 - DNA, 20 bp, Artificial
  CRISPR gRNA sequence
cagtcactttagaagtaccc

SEQ ID NO: 751682 - DNA, 20 bp, Artificial
  CRISPR gRNA sequence
agtcactttagaagtaccca

SEQ ID NO: 751683 - DNA, 20 bp, Artificial
  CRISPR gRNA sequence
tagaagtacccactggtaca

SEQ ID NO: 751684 - DNA, 20 bp, Artificial
  CRISPR gRNA sequence
agaagtacccactggtacag

SEQ ID NO: 751685 - DNA, 20 bp, Artificial
  CRISPR gRNA sequence
gaagtacccactggtacagg

SEQ ID NO: 751686 - DNA, 20 bp, Artificial
  CRISPR gRNA sequence
gtacaggaacagttgctatg

SEQ ID NO: 751687 - DNA, 20 bp, Artificial
  CRISPR gRNA sequence
ctatgctaattacaaagcaa

SEQ ID NO: 751688 - DNA, 20 bp, Artificial
  CRISPR gRNA sequence
tgctaattacaaagcaagtt

SEQ ID NO: 751689 - DNA, 20 bp, Artificial
  CRISPR gRNA sequence
attacaaagcaagttccgct

SEQ ID NO: 751690 - DNA, 20 bp, Artificial
  CRISPR gRNA sequence
caaagcaagttccgctccac

SEQ ID NO: 751691 - DNA, 20 bp, Artificial
  CRISPR gRNA sequence
cgctccacattacagcaggt

SEQ ID NO: 751692 - DNA, 20 bp, Artificial
  CRISPR gRNA sequence
cacattacagcaggttccct

SEQ ID NO: 751693 - DNA, 20 bp, Artificial
  CRISPR gRNA sequence
cagcaggttccctgcagatc

SEQ ID NO: 751694 - DNA, 20 bp, Artificial
  CRISPR gRNA sequence
cctgcagatcttagcaaggc

SEQ ID NO: 751695 - DNA, 20 bp, Artificial
  CRISPR gRNA sequence
cagatcttagcaaggctgca

SEQ ID NO: 751696 - DNA, 20 bp, Artificial
  CRISPR gRNA sequence
agcaaggctgcattttgacg

SEQ ID NO: 751697 - DNA, 20 bp, Artificial
  CRISPR gRNA sequence
gcaaggctgcattttgacgt

SEQ ID NO: 751698 - DNA, 20 bp, Artificial
  CRISPR gRNA sequence
cattttgacgtggaatattg

SEQ ID NO: 751699 - DNA, 20 bp, Artificial
  CRISPR gRNA sequence
tgacgtggaatattgaaagt

SEQ ID NO: 751700 - DNA, 20 bp, Artificial
  CRISPR gRNA sequence
gacgtggaatattgaaagta

SEQ ID NO: 751701 - DNA, 20 bp, Artificial
  CRISPR gRNA sequence
acgtggaatattgaaagtaa

SEQ ID NO: 751702 - DNA, 20 bp, Artificial
  CRISPR gRNA sequence
aaagtaaagacattctataa

SEQ ID NO: 751703 - DNA, 20 bp, Artificial
  CRISPR gRNA sequence
tataacccagacacctcagt

SEQ ID NO: 751704 - DNA, 20 bp, Artificial
  CRISPR gRNA sequence
taacccagacacctcagtat

SEQ ID NO: 751705 - DNA, 20 bp, Artificial
  CRISPR gRNA sequence
agtatttcaaaacccccatc

SEQ ID NO: 751706 - DNA, 20 bp, Artificial
  CRISPR gRNA sequence
caaaacccccatcaaaggac

SEQ ID NO: 751707 - DNA, 20 bp, Artificial
  CRISPR gRNA sequence
aaaacccccatcaaaggacc

SEQ ID NO: 751708 - DNA, 20 bp, Artificial
  CRISPR gRNA sequence
attgtgggcaatatttgaga

SEQ ID NO: 751709 - DNA, 20 bp, Artificial
  CRISPR gRNA sequence
ttgtgggcaatatttgagaa

SEQ ID NO: 751710 - DNA, 20 bp, Artificial
  CRISPR gRNA sequence
tgggcaatatttgagaagcc

SEQ ID NO: 751711 - DNA, 20 bp, Artificial
  CRISPR gRNA sequence
gagaagccagttgcaaagca

SEQ ID NO: 751712 - DNA, 20 bp, Artificial
  CRISPR gRNA sequence
agaagccagttgcaaagcac

SEQ ID NO: 751713 - DNA, 20 bp, Artificial
  CRISPR gRNA sequence
caaagcactctcttctagtg

SEQ ID NO: 751714 - DNA, 20 bp, Artificial
  CRISPR gRNA sequence
tcttctagtgatcaaagcag

SEQ ID NO: 751715 - DNA, 20 bp, Artificial
  CRISPR gRNA sequence
ttctagtgatcaaagcaggt

SEQ ID NO: 751716 - DNA, 20 bp, Artificial
  CRISPR gRNA sequence
ctagtgatcaaagcaggtct

SEQ ID NO: 751717 - DNA, 20 bp, Artificial
  CRISPR gRNA sequence
tagtgatcaaagcaggtctc

SEQ ID NO: 751718 - DNA, 20 bp, Artificial
  CRISPR gRNA sequence
gtgatcaaagcaggtctcct

SEQ ID NO: 751719 - DNA, 20 bp, Artificial
  CRISPR gRNA sequence
ctctggacggctagtaagca

SEQ ID NO: 751720 - DNA, 20 bp, Artificial
  CRISPR gRNA sequence
tggacggctagtaagcaaca

SEQ ID NO: 751721 - DNA, 20 bp, Artificial
  CRISPR gRNA sequence
gacggctagtaagcaacatt

SEQ ID NO: 751722 - DNA, 20 bp, Artificial
  CRISPR gRNA sequence
gtaagcaacattttgtgagc

SEQ ID NO: 751723 - DNA, 20 bp, Artificial
  CRISPR gRNA sequence
tgtgagctttgccaggtgct

SEQ ID NO: 751724 - DNA, 20 bp, Artificial
  CRISPR gRNA sequence
gtgagctttgccaggtgctc

SEQ ID NO: 751725 - DNA, 20 bp, Artificial
  CRISPR gRNA sequence
tgagctttgccaggtgctca

SEQ ID NO: 751726 - DNA, 20 bp, Artificial
  CRISPR gRNA sequence
tgccaggtgctcattgatac

SEQ ID NO: 751727 - DNA, 20 bp, Artificial
  CRISPR gRNA sequence
gccaggtgctcattgatacc

SEQ ID NO: 751728 - DNA, 20 bp, Artificial
  CRISPR gRNA sequence
ccaggtgctcattgatacct

SEQ ID NO: 751729 - DNA, 20 bp, Artificial
  CRISPR gRNA sequence
attgatacctgttccctatc

SEQ ID NO: 751730 - DNA, 20 bp, Artificial
  CRISPR gRNA sequence
atacctgttccctatctgcc

SEQ ID NO: 751731 - DNA, 20 bp, Artificial
  CRISPR gRNA sequence
ttccctatctgcctttggag

SEQ ID NO: 751732 - DNA, 20 bp, Artificial
  CRISPR gRNA sequence
cctatctgcctttggagggt

SEQ ID NO: 751733 - DNA, 20 bp, Artificial
  CRISPR gRNA sequence
tctgcctttggagggtgagc

SEQ ID NO: 751734 - DNA, 20 bp, Artificial
  CRISPR gRNA sequence
cctttggagggtgagcttgg

SEQ ID NO: 751735 - DNA, 20 bp, Artificial
  CRISPR gRNA sequence
tggagggtgagcttggccag

SEQ ID NO: 751736 - DNA, 20 bp, Artificial
  CRISPR gRNA sequence
ggagggtgagcttggccaga

SEQ ID NO: 751737 - DNA, 20 bp, Artificial
  CRISPR gRNA sequence
gagggtgagcttggccagat

SEQ ID NO: 751738 - DNA, 20 bp, Artificial
  CRISPR gRNA sequence
ggccagatatccctgcctaa

SEQ ID NO: 751739 - DNA, 20 bp, Artificial
  CRISPR gRNA sequence
gccagatatccctgcctaac

SEQ ID NO: 751740 - DNA, 20 bp, Artificial
  CRISPR gRNA sequence
cctaacttctatccccaggt

SEQ ID NO: 751741 - DNA, 20 bp, Artificial
  CRISPR gRNA sequence
acttctatccccaggtagag

SEQ ID NO: 751742 - DNA, 20 bp, Artificial
  CRISPR gRNA sequence
ctatccccaggtagagattt

SEQ ID NO: 751743 - DNA, 20 bp, Artificial
  CRISPR gRNA sequence
tatccccaggtagagatttc

SEQ ID NO: 751744 - DNA, 20 bp, Artificial
  CRISPR gRNA sequence
tccccaggtagagatttccc

SEQ ID NO: 751745 - DNA, 20 bp, Artificial
  CRISPR gRNA sequence
cccctatgtggaccctctat

SEQ ID NO: 751746 - DNA, 20 bp, Artificial
  CRISPR gRNA sequence
ccctatgtggaccctctatc

SEQ ID NO: 751747 - DNA, 20 bp, Artificial
  CRISPR gRNA sequence
tgtggaccctctatcagatc

SEQ ID NO: 751748 - DNA, 20 bp, Artificial
  CRISPR gRNA sequence
tatcagatcaggacttaatt

SEQ ID NO: 751749 - DNA, 20 bp, Artificial
  CRISPR gRNA sequence
tcagatcaggacttaatttc

SEQ ID NO: 751750 - DNA, 20 bp, Artificial
  CRISPR gRNA sequence
aatttcactttgagagcctg

SEQ ID NO: 751751 - DNA, 20 bp, Artificial
  CRISPR gRNA sequence
atttcactttgagagcctga

SEQ ID NO: 751752 - DNA, 20 bp, Artificial
  CRISPR gRNA sequence
cactttgagagcctgaggct

SEQ ID NO: 751753 - DNA, 20 bp, Artificial
  CRISPR gRNA sequence
actttgagagcctgaggctt

SEQ ID NO: 751754 - DNA, 20 bp, Artificial
  CRISPR gRNA sequence
tgagagcctgaggcttcctt

SEQ ID NO: 751755 - DNA, 20 bp, Artificial
  CRISPR gRNA sequence
gagagcctgaggcttcctta

SEQ ID NO: 751756 - DNA, 20 bp, Artificial
  CRISPR gRNA sequence
agagcctgaggcttccttac

SEQ ID NO: 751757 - DNA, 20 bp, Artificial
  CRISPR gRNA sequence
aggcttccttacgatctggg

SEQ ID NO: 751758 - DNA, 20 bp, Artificial
  CRISPR gRNA sequence
ccttacgatctgggctgagt

SEQ ID NO: 751759 - DNA, 20 bp, Artificial
  CRISPR gRNA sequence
cttacgatctgggctgagtt

SEQ ID NO: 751760 - DNA, 20 bp, Artificial
  CRISPR gRNA sequence
acgatctgggctgagttgag

SEQ ID NO: 751761 - DNA, 20 bp, Artificial
  CRISPR gRNA sequence
cgatctgggctgagttgagg

SEQ ID NO: 751762 - DNA, 20 bp, Artificial
  CRISPR gRNA sequence
ggctgagttgaggctggggc

SEQ ID NO: 751763 - DNA, 20 bp, Artificial
  CRISPR gRNA sequence
agttgaggctggggcagagg

SEQ ID NO: 751764 - DNA, 20 bp, Artificial
  CRISPR gRNA sequence
aggctggggcagaggggcgc

SEQ ID NO: 751765 - DNA, 20 bp, Artificial
  CRISPR gRNA sequence
gggcagaggggcgcagaggt

SEQ ID NO: 751766 - DNA, 20 bp, Artificial
  CRISPR gRNA sequence
ggggacaagtctgtggatcc

SEQ ID NO: 751767 - DNA, 20 bp, Artificial
  CRISPR gRNA sequence
gggacaagtctgtggatcca

SEQ ID NO: 751768 - DNA, 20 bp, Artificial
  CRISPR gRNA sequence
tggatccagctgctttctga

SEQ ID NO: 751769 - DNA, 20 bp, Artificial
  CRISPR gRNA sequence
ctttctgaagccgtaggcat

SEQ ID NO: 751770 - DNA, 20 bp, Artificial
  CRISPR gRNA sequence
tctgaagccgtaggcatctc

SEQ ID NO: 751771 - DNA, 20 bp, Artificial
  CRISPR gRNA sequence
ctgaagccgtaggcatctct

SEQ ID NO: 751772 - DNA, 20 bp, Artificial
  CRISPR gRNA sequence
tgaagccgtaggcatctctg

SEQ ID NO: 751773 - DNA, 20 bp, Artificial
  CRISPR gRNA sequence
aagccgtaggcatctctgca

SEQ ID NO: 751774 - DNA, 20 bp, Artificial
  CRISPR gRNA sequence
tgcagagctcagcctcgcca

SEQ ID NO: 751775 - DNA, 20 bp, Artificial
  CRISPR gRNA sequence
cagagctcagcctcgccaca

SEQ ID NO: 751776 - DNA, 20 bp, Artificial
  CRISPR gRNA sequence
agcctcgccacagttcccca

SEQ ID NO: 751777 - DNA, 20 bp, Artificial
  CRISPR gRNA sequence
gccacagttccccacccctt

SEQ ID NO: 751778 - DNA, 20 bp, Artificial
  CRISPR gRNA sequence
cccaccccttcccccaagcg

SEQ ID NO: 751779 - DNA, 20 bp, Artificial
  CRISPR gRNA sequence
cccccaagcgtggccagtgc

SEQ ID NO: 751780 - DNA, 20 bp, Artificial
  CRISPR gRNA sequence
ccccaagcgtggccagtgcc

SEQ ID NO: 751781 - DNA, 20 bp, Artificial
  CRISPR gRNA sequence
ggctggcactcacaggggaa

SEQ ID NO: 751782 - DNA, 20 bp, Artificial
  CRISPR gRNA sequence
gcactcacaggggaaggcag

SEQ ID NO: 751783 - DNA, 20 bp, Artificial
  CRISPR gRNA sequence
acaggggaaggcaggcatac

SEQ ID NO: 751784 - DNA, 20 bp, Artificial
  CRISPR gRNA sequence
actcaccatccagagccagg

SEQ ID NO: 751785 - DNA, 20 bp, Artificial
  CRISPR gRNA sequence
accatccagagccaggctta

SEQ ID NO: 751786 - DNA, 20 bp, Artificial
  CRISPR gRNA sequence
atcctgggaaggtgatcagg

SEQ ID NO: 751787 - DNA, 20 bp, Artificial
  CRISPR gRNA sequence
tcctgggaaggtgatcaggc

SEQ ID NO: 751788 - DNA, 20 bp, Artificial
  CRISPR gRNA sequence
ggaaggtgatcaggcgctgg

SEQ ID NO: 751789 - DNA, 20 bp, Artificial
  CRISPR gRNA sequence
gcagaggtagctgccgacac

SEQ ID NO: 751790 - DNA, 20 bp, Artificial
  CRISPR gRNA sequence
ccgacaccgcactaaggagt

SEQ ID NO: 751791 - DNA, 20 bp, Artificial
  CRISPR gRNA sequence
aggagtgtgccaggccctga

SEQ ID NO: 751792 - DNA, 20 bp, Artificial
  CRISPR gRNA sequence
acacagcagggtgggatggg

SEQ ID NO: 751793 - DNA, 20 bp, Artificial
  CRISPR gRNA sequence
gcctgctcaggcggcctttg

SEQ ID NO: 751794 - DNA, 20 bp, Artificial
  CRISPR gRNA sequence
ctcaggcggcctttgtccag

SEQ ID NO: 751795 - DNA, 20 bp, Artificial
  CRISPR gRNA sequence
aggcggcctttgtccagggc

SEQ ID NO: 751796 - DNA, 20 bp, Artificial
  CRISPR gRNA sequence
tgtccagggcctgcctggta

SEQ ID NO: 751797 - DNA, 20 bp, Artificial
  CRISPR gRNA sequence
gtccagggcctgcctggtag

SEQ ID NO: 751798 - DNA, 20 bp, Artificial
  CRISPR gRNA sequence
tccagggcctgcctggtagc

SEQ ID NO: 751799 - DNA, 20 bp, Artificial
  CRISPR gRNA sequence
cctggtagcccacggggata

SEQ ID NO: 751800 - DNA, 20 bp, Artificial
  CRISPR gRNA sequence
gtagcccacggggatatatg

SEQ ID NO: 751801 - DNA, 20 bp, Artificial
  CRISPR gRNA sequence
ggctgctgagggttgggctg

SEQ ID NO: 751802 - DNA, 20 bp, Artificial
  CRISPR gRNA sequence
ctgagggttgggctgcctgg

SEQ ID NO: 751803 - DNA, 20 bp, Artificial
  CRISPR gRNA sequence
agggttgggctgcctggttt

SEQ ID NO: 751804 - DNA, 20 bp, Artificial
  CRISPR gRNA sequence
ggctgcctggtttcccaggg

SEQ ID NO: 751805 - DNA, 20 bp, Artificial
  CRISPR gRNA sequence
cctggtttcccagggaggaa

SEQ ID NO: 751806 - DNA, 20 bp, Artificial
  CRISPR gRNA sequence
gtttcccagggaggaagctg

SEQ ID NO: 751807 - DNA, 20 bp, Artificial
  CRISPR gRNA sequence
cccagggaggaagctgggtg

SEQ ID NO: 751808 - DNA, 20 bp, Artificial
  CRISPR gRNA sequence
ccagggaggaagctgggtga

SEQ ID NO: 751809 - DNA, 20 bp, Artificial
  CRISPR gRNA sequence
ggtgaaagcagacagcacat

SEQ ID NO: 751810 - DNA, 20 bp, Artificial
  CRISPR gRNA sequence
tgctgcgctggggggtggga

SEQ ID NO: 751811 - DNA, 20 bp, Artificial
  CRISPR gRNA sequence
ctgcgctggggggtgggaag

SEQ ID NO: 751812 - DNA, 20 bp, Artificial
  CRISPR gRNA sequence
cgctggggggtgggaagaag

SEQ ID NO: 751813 - DNA, 20 bp, Artificial
  CRISPR gRNA sequence
gggggtgggaagaagttcaa

SEQ ID NO: 751814 - DNA, 20 bp, Artificial
  CRISPR gRNA sequence
aaagggagatgagctgccta

SEQ ID NO: 751815 - DNA, 20 bp, Artificial
  CRISPR gRNA sequence
cctagaccccttctctgagc

SEQ ID NO: 751816 - DNA, 20 bp, Artificial
  CRISPR gRNA sequence
gaccccttctctgagctcac

SEQ ID NO: 751817 - DNA, 20 bp, Artificial
  CRISPR gRNA sequence
ctctgagctcactgagaaac

SEQ ID NO: 751818 - DNA, 20 bp, Artificial
  CRISPR gRNA sequence
tctgagctcactgagaaacc

SEQ ID NO: 751819 - DNA, 20 bp, Artificial
  CRISPR gRNA sequence
tgagctcactgagaaaccac

SEQ ID NO: 751820 - DNA, 20 bp, Artificial
  CRISPR gRNA sequence
agctcactgagaaaccacag

SEQ ID NO: 751821 - DNA, 20 bp, Artificial
  CRISPR gRNA sequence
actgagaaaccacagcccct

SEQ ID NO: 751822 - DNA, 20 bp, Artificial
  CRISPR gRNA sequence
agaaaccacagcccctcagc

SEQ ID NO: 751823 - DNA, 20 bp, Artificial
  CRISPR gRNA sequence
agcaatgcaggagctccttg

SEQ ID NO: 751824 - DNA, 20 bp, Artificial
  CRISPR gRNA sequence
cttgggcaccaacttctcta

SEQ ID NO: 751825 - DNA, 20 bp, Artificial
  CRISPR gRNA sequence
gggcaccaacttctctagtc

SEQ ID NO: 751826 - DNA, 20 bp, Artificial
  CRISPR gRNA sequence
ggcaccaacttctctagtct

SEQ ID NO: 751827 - DNA, 20 bp, Artificial
  CRISPR gRNA sequence
ctctagtctcattcccctac

SEQ ID NO: 751828 - DNA, 20 bp, Artificial
  CRISPR gRNA sequence
tctagtctcattcccctacc

SEQ ID NO: 751829 - DNA, 20 bp, Artificial
  CRISPR gRNA sequence
tagtctcattcccctacctc

SEQ ID NO: 751830 - DNA, 20 bp, Artificial
  CRISPR gRNA sequence
gtctcattcccctacctcag

SEQ ID NO: 751831 - DNA, 20 bp, Artificial
  CRISPR gRNA sequence
attcccctacctcaggttaa

SEQ ID NO: 751832 - DNA, 20 bp, Artificial
  CRISPR gRNA sequence
ccctacctcaggttaacttg

SEQ ID NO: 751833 - DNA, 20 bp, Artificial
  CRISPR gRNA sequence
cctcaggttaacttgtactt

SEQ ID NO: 751834 - DNA, 20 bp, Artificial
  CRISPR gRNA sequence
aggttaacttgtactttcat

SEQ ID NO: 751835 - DNA, 20 bp, Artificial
  CRISPR gRNA sequence
acttgtactttcatgttatt

SEQ ID NO: 751836 - DNA, 20 bp, Artificial
  CRISPR gRNA sequence
gtactttcatgttatttcat

SEQ ID NO: 751837 - DNA, 20 bp, Artificial
  CRISPR gRNA sequence
tactttcatgttatttcata

SEQ ID NO: 751838 - DNA, 20 bp, Artificial
  CRISPR gRNA sequence
tcatgttatttcatagtcaa

SEQ ID NO: 751839 - DNA, 20 bp, Artificial
  CRISPR gRNA sequence
catgttatttcatagtcaag

SEQ ID NO: 751840 - DNA, 20 bp, Artificial
  CRISPR gRNA sequence
atgttatttcatagtcaagc

SEQ ID NO: 751841 - DNA, 20 bp, Artificial
  CRISPR gRNA sequence
tttcatagtcaagctacact

SEQ ID NO: 751842 - DNA, 20 bp, Artificial
  CRISPR gRNA sequence
catagtcaagctacactctt

SEQ ID NO: 751843 - DNA, 20 bp, Artificial
  CRISPR gRNA sequence
atagtcaagctacactctta

SEQ ID NO: 751844 - DNA, 20 bp, Artificial
  CRISPR gRNA sequence
cactcttacttcccaaggat

SEQ ID NO: 751845 - DNA, 20 bp, Artificial
  CRISPR gRNA sequence
ttacttcccaaggataacat

SEQ ID NO: 751846 - DNA, 20 bp, Artificial
  CRISPR gRNA sequence
acttcccaaggataacatta

SEQ ID NO: 751847 - DNA, 20 bp, Artificial
  CRISPR gRNA sequence
cttcccaaggataacattaa

SEQ ID NO: 751848 - DNA, 20 bp, Artificial
  CRISPR gRNA sequence
cccaaggataacattaagag

SEQ ID NO: 751849 - DNA, 20 bp, Artificial
  CRISPR gRNA sequence
ccaaggataacattaagagg

SEQ ID NO: 751850 - DNA, 20 bp, Artificial
  CRISPR gRNA sequence
agaggctggcactggggctg

SEQ ID NO: 751851 - DNA, 20 bp, Artificial
  CRISPR gRNA sequence
gcactggggctgggcatagt

SEQ ID NO: 751852 - DNA, 20 bp, Artificial
  CRISPR gRNA sequence
gggctgggcatagtggctca

SEQ ID NO: 751853 - DNA, 20 bp, Artificial
  CRISPR gRNA sequence
ggcatagtggctcaatcctg

SEQ ID NO: 751854 - DNA, 20 bp, Artificial
  CRISPR gRNA sequence
aatcctgtaatcccagcact

SEQ ID NO: 751855 - DNA, 20 bp, Artificial
  CRISPR gRNA sequence
taatcccagcactttgggga

SEQ ID NO: 751856 - DNA, 20 bp, Artificial
  CRISPR gRNA sequence
tggggagccaaggcgggtag

SEQ ID NO: 751857 - DNA, 20 bp, Artificial
  CRISPR gRNA sequence
ggggagccaaggcgggtaga

SEQ ID NO: 751858 - DNA, 20 bp, Artificial
  CRISPR gRNA sequence
gggagccaaggcgggtagat

SEQ ID NO: 751859 - DNA, 20 bp, Artificial
  CRISPR gRNA sequence
gagcccaggagttcgagacc

SEQ ID NO: 751860 - DNA, 20 bp, Artificial
  CRISPR gRNA sequence
agcccaggagttcgagacca

SEQ ID NO: 751861 - DNA, 20 bp, Artificial
  CRISPR gRNA sequence
gagaccagcctgaccaacat

SEQ ID NO: 751862 - DNA, 20 bp, Artificial
  CRISPR gRNA sequence
accaacatggctctgaccaa

SEQ ID NO: 751863 - DNA, 20 bp, Artificial
  CRISPR gRNA sequence
tgaccaaaatgcatgttcta

SEQ ID NO: 751864 - DNA, 20 bp, Artificial
  CRISPR gRNA sequence
accaaaatgcatgttctaat

SEQ ID NO: 751865 - DNA, 20 bp, Artificial
  CRISPR gRNA sequence
taattttgctcttggcctgt

SEQ ID NO: 751866 - DNA, 20 bp, Artificial
  CRISPR gRNA sequence
attttgctcttggcctgttt

SEQ ID NO: 751867 - DNA, 20 bp, Artificial
  CRISPR gRNA sequence
tgctcttggcctgtttgttg

SEQ ID NO: 751868 - DNA, 20 bp, Artificial
  CRISPR gRNA sequence
gctcttggcctgtttgttgg

SEQ ID NO: 751869 - DNA, 20 bp, Artificial
  CRISPR gRNA sequence
ctcttggcctgtttgttggt

SEQ ID NO: 751870 - DNA, 20 bp, Artificial
  CRISPR gRNA sequence
ttggcctgtttgttggtttg

SEQ ID NO: 751871 - DNA, 20 bp, Artificial
  CRISPR gRNA sequence
ggcctgtttgttggtttgaa

SEQ ID NO: 751872 - DNA, 20 bp, Artificial
  CRISPR gRNA sequence
gcctgtttgttggtttgaaa

SEQ ID NO: 751873 - DNA, 20 bp, Artificial
  CRISPR gRNA sequence
tttgttggtttgaaaaaagg

SEQ ID NO: 751874 - DNA, 20 bp, Artificial
  CRISPR gRNA sequence
gttggtttgaaaaaagggta

SEQ ID NO: 751875 - DNA, 20 bp, Artificial
  CRISPR gRNA sequence
ttggtttgaaaaaagggtag

SEQ ID NO: 751876 - DNA, 20 bp, Artificial
  CRISPR gRNA sequence
gtttgaaaaaagggtagctg

SEQ ID NO: 751877 - DNA, 20 bp, Artificial
  CRISPR gRNA sequence
gaaaaaagggtagctgagta

SEQ ID NO: 751878 - DNA, 20 bp, Artificial
  CRISPR gRNA sequence
aaaaaagggtagctgagtaa

SEQ ID NO: 751879 - DNA, 20 bp, Artificial
  CRISPR gRNA sequence
agtaaaaagtcactgtagcc

SEQ ID NO: 751880 - DNA, 20 bp, Artificial
  CRISPR gRNA sequence
tagcctttgagttgggtttt

SEQ ID NO: 751881 - DNA, 20 bp, Artificial
  CRISPR gRNA sequence
tgagttgggttttgttgggt

SEQ ID NO: 751882 - DNA, 20 bp, Artificial
  CRISPR gRNA sequence
gagttgggttttgttgggtc

SEQ ID NO: 751883 - DNA, 20 bp, Artificial
  CRISPR gRNA sequence
agttgggttttgttgggtcc

SEQ ID NO: 751884 - DNA, 20 bp, Artificial
  CRISPR gRNA sequence
ggttttgttgggtccgtggt

SEQ ID NO: 751885 - DNA, 20 bp, Artificial
  CRISPR gRNA sequence
tgttgggtccgtggtttagc

SEQ ID NO: 751886 - DNA, 20 bp, Artificial
  CRISPR gRNA sequence
gttgggtccgtggtttagct

SEQ ID NO: 751887 - DNA, 20 bp, Artificial
  CRISPR gRNA sequence
ttgggtccgtggtttagctg

SEQ ID NO: 751888 - DNA, 20 bp, Artificial
  CRISPR gRNA sequence
ggtccgtggtttagctgatc

SEQ ID NO: 751889 - DNA, 20 bp, Artificial
  CRISPR gRNA sequence
agctgatccccattccggct

SEQ ID NO: 751890 - DNA, 20 bp, Artificial
  CRISPR gRNA sequence
gctgatccccattccggctt

SEQ ID NO: 751891 - DNA, 20 bp, Artificial
  CRISPR gRNA sequence
atccccattccggcttaggt

SEQ ID NO: 751892 - DNA, 20 bp, Artificial
  CRISPR gRNA sequence
cggcttaggtcctcgtgcat

SEQ ID NO: 751893 - DNA, 20 bp, Artificial
  CRISPR gRNA sequence
aggtcctcgtgcatgtcctc

SEQ ID NO: 751894 - DNA, 20 bp, Artificial
  CRISPR gRNA sequence
ggtcctcgtgcatgtcctcc

SEQ ID NO: 751895 - DNA, 20 bp, Artificial
  CRISPR gRNA sequence
gtgcatgtcctcctggatgc

SEQ ID NO: 751896 - DNA, 20 bp, Artificial
  CRISPR gRNA sequence
ctggatgcctttgtatctcc

SEQ ID NO: 751897 - DNA, 20 bp, Artificial
  CRISPR gRNA sequence
gatgcctttgtatctccagg

SEQ ID NO: 751898 - DNA, 20 bp, Artificial
  CRISPR gRNA sequence
tgtatctccagggcctagca

SEQ ID NO: 751899 - DNA, 20 bp, Artificial
  CRISPR gRNA sequence
gtatctccagggcctagcag

SEQ ID NO: 751900 - DNA, 20 bp, Artificial
  CRISPR gRNA sequence
tatctccagggcctagcagg

SEQ ID NO: 751901 - DNA, 20 bp, Artificial
  CRISPR gRNA sequence
cagggcctagcaggggctgg

SEQ ID NO: 751902 - DNA, 20 bp, Artificial
  CRISPR gRNA sequence
gcaggggctggtccccactg

SEQ ID NO: 751903 - DNA, 20 bp, Artificial
  CRISPR gRNA sequence
gtccccactggatgtctgac

SEQ ID NO: 751904 - DNA, 20 bp, Artificial
  CRISPR gRNA sequence
gatgtctgacacatacaggg

SEQ ID NO: 751905 - DNA, 20 bp, Artificial
  CRISPR gRNA sequence
acacatacagggtatagagg

SEQ ID NO: 751906 - DNA, 20 bp, Artificial
  CRISPR gRNA sequence
ttctcagaagagggaggtgc

SEQ ID NO: 751907 - DNA, 20 bp, Artificial
  CRISPR gRNA sequence
ctcagaagagggaggtgccc

SEQ ID NO: 751908 - DNA, 20 bp, Artificial
  CRISPR gRNA sequence
tcagaagagggaggtgccct

SEQ ID NO: 751909 - DNA, 20 bp, Artificial
  CRISPR gRNA sequence
agaagagggaggtgcccttg

SEQ ID NO: 751910 - DNA, 20 bp, Artificial
  CRISPR gRNA sequence
gcattttgtctccaagctgc

SEQ ID NO: 751911 - DNA, 20 bp, Artificial
  CRISPR gRNA sequence
cattttgtctccaagctgct

SEQ ID NO: 751912 - DNA, 20 bp, Artificial
  CRISPR gRNA sequence
tgtctccaagctgctgggta

SEQ ID NO: 751913 - DNA, 20 bp, Artificial
  CRISPR gRNA sequence
gtctccaagctgctgggtat

SEQ ID NO: 751914 - DNA, 20 bp, Artificial
  CRISPR gRNA sequence
tctccaagctgctgggtatt

SEQ ID NO: 751915 - DNA, 20 bp, Artificial
  CRISPR gRNA sequence
caagctgctgggtattctca

SEQ ID NO: 751916 - DNA, 20 bp, Artificial
  CRISPR gRNA sequence
ctgggtattctcacccaacc

SEQ ID NO: 751917 - DNA, 20 bp, Artificial
  CRISPR gRNA sequence
ggtattctcacccaacctct

SEQ ID NO: 751918 - DNA, 20 bp, Artificial
  CRISPR gRNA sequence
tcacccaacctctcagcgcc

SEQ ID NO: 751919 - DNA, 20 bp, Artificial
  CRISPR gRNA sequence
acccaacctctcagcgccag

SEQ ID NO: 751920 - DNA, 20 bp, Artificial
  CRISPR gRNA sequence
tcagcgccaggcacccttag

SEQ ID NO: 751921 - DNA, 20 bp, Artificial
  CRISPR gRNA sequence
agcgccaggcacccttaggg

SEQ ID NO: 751922 - DNA, 20 bp, Artificial
  CRISPR gRNA sequence
agggcagtgccctcttaccc

SEQ ID NO: 751923 - DNA, 20 bp, Artificial
  CRISPR gRNA sequence
gggcagtgccctcttaccct

SEQ ID NO: 751924 - DNA, 20 bp, Artificial
  CRISPR gRNA sequence
ttaccctgtagggcacctct

SEQ ID NO: 751925 - DNA, 20 bp, Artificial
  CRISPR gRNA sequence
accctgtagggcacctctct

SEQ ID NO: 751926 - DNA, 20 bp, Artificial
  CRISPR gRNA sequence
ccctgtagggcacctctctg

SEQ ID NO: 751927 - DNA, 20 bp, Artificial
  CRISPR gRNA sequence
tagggcacctctctggcaag

SEQ ID NO: 751928 - DNA, 20 bp, Artificial
  CRISPR gRNA sequence
tctggcaagcaccggggggc

SEQ ID NO: 751929 - DNA, 20 bp, Artificial
  CRISPR gRNA sequence
tggcaagcaccggggggcta

SEQ ID NO: 751930 - DNA, 20 bp, Artificial
  CRISPR gRNA sequence
gcaagcaccggggggctaac

SEQ ID NO: 751931 - DNA, 20 bp, Artificial
  CRISPR gRNA sequence
actgctacccactgcactgc

SEQ ID NO: 751932 - DNA, 20 bp, Artificial
  CRISPR gRNA sequence
ctacccactgcactgcccca

SEQ ID NO: 751933 - DNA, 20 bp, Artificial
  CRISPR gRNA sequence
cccactgcactgccccaagc

SEQ ID NO: 751934 - DNA, 20 bp, Artificial
  CRISPR gRNA sequence
cactgccccaagctgggaag

SEQ ID NO: 751935 - DNA, 20 bp, Artificial
  CRISPR gRNA sequence
ccccaagctgggaagaaggt

SEQ ID NO: 751936 - DNA, 20 bp, Artificial
  CRISPR gRNA sequence
ggaagaaggtgagtatgcag

SEQ ID NO: 751937 - DNA, 20 bp, Artificial
  CRISPR gRNA sequence
agcaggcctgcagccagatc

SEQ ID NO: 751938 - DNA, 20 bp, Artificial
  CRISPR gRNA sequence
cagccagatcccagctatgc

SEQ ID NO: 751939 - DNA, 20 bp, Artificial
  CRISPR gRNA sequence
tgctaccctgggctatgtga

SEQ ID NO: 751940 - DNA, 20 bp, Artificial
  CRISPR gRNA sequence
ccctgggctatgtgagcttg

SEQ ID NO: 751941 - DNA, 20 bp, Artificial
  CRISPR gRNA sequence
ggctatgtgagcttgggcaa

SEQ ID NO: 751942 - DNA, 20 bp, Artificial
  CRISPR gRNA sequence
tgtgagcttgggcaagttag

SEQ ID NO: 751943 - DNA, 20 bp, Artificial
  CRISPR gRNA sequence
gggcaagttagcatacatct

SEQ ID NO: 751944 - DNA, 20 bp, Artificial
  CRISPR gRNA sequence
ggcaagttagcatacatctc

SEQ ID NO: 751945 - DNA, 20 bp, Artificial
  CRISPR gRNA sequence
gcatacatctctaggcctct

SEQ ID NO: 751946 - DNA, 20 bp, Artificial
  CRISPR gRNA sequence
taggcctctctttccatgga

SEQ ID NO: 751947 - DNA, 20 bp, Artificial
  CRISPR gRNA sequence
ggcctctctttccatggata

SEQ ID NO: 751948 - DNA, 20 bp, Artificial
  CRISPR gRNA sequence
tctttccatggatacagaga

SEQ ID NO: 751949 - DNA, 20 bp, Artificial
  CRISPR gRNA sequence
tttccatggatacagagaag

SEQ ID NO: 751950 - DNA, 20 bp, Artificial
  CRISPR gRNA sequence
tccatggatacagagaagat

SEQ ID NO: 751951 - DNA, 20 bp, Artificial
  CRISPR gRNA sequence
ccatggatacagagaagatg

SEQ ID NO: 751952 - DNA, 20 bp, Artificial
  CRISPR gRNA sequence
catggatacagagaagatgg

SEQ ID NO: 751953 - DNA, 20 bp, Artificial
  CRISPR gRNA sequence
cttcatagagttcttataag

SEQ ID NO: 751954 - DNA, 20 bp, Artificial
  CRISPR gRNA sequence
catagagttcttataagaat

SEQ ID NO: 751955 - DNA, 20 bp, Artificial
  CRISPR gRNA sequence
atagagttcttataagaatt

SEQ ID NO: 751956 - DNA, 20 bp, Artificial
  CRISPR gRNA sequence
ttataagaattccctgaggc

SEQ ID NO: 751957 - DNA, 20 bp, Artificial
  CRISPR gRNA sequence
ataagaattccctgaggcta

SEQ ID NO: 751958 - DNA, 20 bp, Artificial
  CRISPR gRNA sequence
taagaattccctgaggctag

SEQ ID NO: 751959 - DNA, 20 bp, Artificial
  CRISPR gRNA sequence
cctgaggctaggcatggtgg

SEQ ID NO: 751960 - DNA, 20 bp, Artificial
  CRISPR gRNA sequence
aggctaggcatggtggctca

SEQ ID NO: 751961 - DNA, 20 bp, Artificial
  CRISPR gRNA sequence
ggcatggtggctcacacctg

SEQ ID NO: 751962 - DNA, 20 bp, Artificial
  CRISPR gRNA sequence
acacctgtaatcccagcact

SEQ ID NO: 751963 - DNA, 20 bp, Artificial
  CRISPR gRNA sequence
taatcccagcactttggagg

SEQ ID NO: 751964 - DNA, 20 bp, Artificial
  CRISPR gRNA sequence
tggaggtcaaggtgggaaga

SEQ ID NO: 751965 - DNA, 20 bp, Artificial
  CRISPR gRNA sequence
ggaggtcaaggtgggaagat

SEQ ID NO: 751966 - DNA, 20 bp, Artificial
  CRISPR gRNA sequence
gaggtcaaggtgggaagatc

SEQ ID NO: 751967 - DNA, 20 bp, Artificial
  CRISPR gRNA sequence
agcccaggagttcaagacca

SEQ ID NO: 751968 - DNA, 20 bp, Artificial
  CRISPR gRNA sequence
aagaccagcctgggcaacat

SEQ ID NO: 751969 - DNA, 20 bp, Artificial
  CRISPR gRNA sequence
ggcaacatagcgagagtgca

SEQ ID NO: 751970 - DNA, 20 bp, Artificial
  CRISPR gRNA sequence
taccaaaagtgatttttttg

SEQ ID NO: 751971 - DNA, 20 bp, Artificial
  CRISPR gRNA sequence
ccaaaagtgatttttttgat

SEQ ID NO: 751972 - DNA, 20 bp, Artificial
  CRISPR gRNA sequence
ttttgattttttgggacaga

SEQ ID NO: 751973 - DNA, 20 bp, Artificial
  CRISPR gRNA sequence
tttgattttttgggacagag

SEQ ID NO: 751974 - DNA, 20 bp, Artificial
  CRISPR gRNA sequence
ttgattttttgggacagagt

SEQ ID NO: 751975 - DNA, 20 bp, Artificial
  CRISPR gRNA sequence
tgattttttgggacagagtc

SEQ ID NO: 751976 - DNA, 20 bp, Artificial
  CRISPR gRNA sequence
gattttttgggacagagtct

SEQ ID NO: 751977 - DNA, 20 bp, Artificial
  CRISPR gRNA sequence
attttttgggacagagtctc

SEQ ID NO: 751978 - DNA, 20 bp, Artificial
  CRISPR gRNA sequence
tttgggacagagtctcgctc

SEQ ID NO: 751979 - DNA, 20 bp, Artificial
  CRISPR gRNA sequence
ttgggacagagtctcgctct

SEQ ID NO: 751980 - DNA, 20 bp, Artificial
  CRISPR gRNA sequence
tgggacagagtctcgctctg

SEQ ID NO: 751981 - DNA, 20 bp, Artificial
  CRISPR gRNA sequence
gggacagagtctcgctctgt

SEQ ID NO: 751982 - DNA, 20 bp, Artificial
  CRISPR gRNA sequence
ggacagagtctcgctctgtc

SEQ ID NO: 751983 - DNA, 20 bp, Artificial
  CRISPR gRNA sequence
gctctgtcacccaggctgga

SEQ ID NO: 751984 - DNA, 20 bp, Artificial
  CRISPR gRNA sequence
tgtcacccaggctggagtgc

SEQ ID NO: 751985 - DNA, 20 bp, Artificial
  CRISPR gRNA sequence
tcacccaggctggagtgcag

SEQ ID NO: 751986 - DNA, 20 bp, Artificial
  CRISPR gRNA sequence
gagtgcagtggtgtgatctc

SEQ ID NO: 751987 - DNA, 20 bp, Artificial
  CRISPR gRNA sequence
ggctcactgcaacttctgcc

SEQ ID NO: 751988 - DNA, 20 bp, Artificial
  CRISPR gRNA sequence
actgcaacttctgcctccca

SEQ ID NO: 751989 - DNA, 20 bp, Artificial
  CRISPR gRNA sequence
caacttctgcctcccaggtt

SEQ ID NO: 751990 - DNA, 20 bp, Artificial
  CRISPR gRNA sequence
ctgcctcccaggttcaagca

SEQ ID NO: 751991 - DNA, 20 bp, Artificial
  CRISPR gRNA sequence
tgcctcccaggttcaagcag

SEQ ID NO: 751992 - DNA, 20 bp, Artificial
  CRISPR gRNA sequence
cctcccaggttcaagcagct

SEQ ID NO: 751993 - DNA, 20 bp, Artificial
  CRISPR gRNA sequence
ccaggttcaagcagctctca

SEQ ID NO: 751994 - DNA, 20 bp, Artificial
  CRISPR gRNA sequence
aagcagctctcatgtctcag

SEQ ID NO: 751995 - DNA, 20 bp, Artificial
  CRISPR gRNA sequence
tcatgtctcagcctcccgag

SEQ ID NO: 751996 - DNA, 20 bp, Artificial
  CRISPR gRNA sequence
atgtctcagcctcccgagta

SEQ ID NO: 751997 - DNA, 20 bp, Artificial
  CRISPR gRNA sequence
agcctcccgagtagctggga

SEQ ID NO: 751998 - DNA, 20 bp, Artificial
  CRISPR gRNA sequence
ccgagtagctgggattacag

SEQ ID NO: 751999 - DNA, 20 bp, Artificial
  CRISPR gRNA sequence
ggattacagatgcctgccac

SEQ ID NO: 752000 - DNA, 20 bp, Artificial
  CRISPR gRNA sequence
cagatgcctgccaccatgcc

SEQ ID NO: 752001 - DNA, 20 bp, Artificial
  CRISPR gRNA sequence
ccaccatgccaggcaaattt

SEQ ID NO: 752002 - DNA, 20 bp, Artificial
  CRISPR gRNA sequence
tgggttgttttttttttgag

SEQ ID NO: 752003 - DNA, 20 bp, Artificial
  CRISPR gRNA sequence
gggttgttttttttttgaga

SEQ ID NO: 752004 - DNA, 20 bp, Artificial
  CRISPR gRNA sequence
ggttgttttttttttgagat

SEQ ID NO: 752005 - DNA, 20 bp, Artificial
  CRISPR gRNA sequence
ttttttttttgagatggagt

SEQ ID NO: 752006 - DNA, 20 bp, Artificial
  CRISPR gRNA sequence
tttttttgagatggagtctt

SEQ ID NO: 752007 - DNA, 20 bp, Artificial
  CRISPR gRNA sequence
ttttttgagatggagtcttg

SEQ ID NO: 752008 - DNA, 20 bp, Artificial
  CRISPR gRNA sequence
tttttgagatggagtcttgc

SEQ ID NO: 752009 - DNA, 20 bp, Artificial
  CRISPR gRNA sequence
ttttgagatggagtcttgct

SEQ ID NO: 752010 - DNA, 20 bp, Artificial
  CRISPR gRNA sequence
tttgagatggagtcttgctc

SEQ ID NO: 752011 - DNA, 20 bp, Artificial
  CRISPR gRNA sequence
ttgagatggagtcttgctct

SEQ ID NO: 752012 - DNA, 20 bp, Artificial
  CRISPR gRNA sequence
tgagatggagtcttgctcta

SEQ ID NO: 752013 - DNA, 20 bp, Artificial
  CRISPR gRNA sequence
gagatggagtcttgctctat

SEQ ID NO: 752014 - DNA, 20 bp, Artificial
  CRISPR gRNA sequence
agatggagtcttgctctatc

SEQ ID NO: 752015 - DNA, 20 bp, Artificial
  CRISPR gRNA sequence
gctctatcagcaggctggag

SEQ ID NO: 752016 - DNA, 20 bp, Artificial
  CRISPR gRNA sequence
ctctatcagcaggctggagt

SEQ ID NO: 752017 - DNA, 20 bp, Artificial
  CRISPR gRNA sequence
tatcagcaggctggagtgca

SEQ ID NO: 752018 - DNA, 20 bp, Artificial
  CRISPR gRNA sequence
tcagcaggctggagtgcagt

SEQ ID NO: 752019 - DNA, 20 bp, Artificial
  CRISPR gRNA sequence
gagtgcagtggcgcgatctc

SEQ ID NO: 752020 - DNA, 20 bp, Artificial
  CRISPR gRNA sequence
ggctcactgtaacctctgac

SEQ ID NO: 752021 - DNA, 20 bp, Artificial
  CRISPR gRNA sequence
actgtaacctctgactcccg

SEQ ID NO: 752022 - DNA, 20 bp, Artificial
  CRISPR gRNA sequence
taacctctgactcccgggtt

SEQ ID NO: 752023 - DNA, 20 bp, Artificial
  CRISPR gRNA sequence
tgactcccgggttcaagcga

SEQ ID NO: 752024 - DNA, 20 bp, Artificial
  CRISPR gRNA sequence
actcccgggttcaagcgatt

SEQ ID NO: 752025 - DNA, 20 bp, Artificial
  CRISPR gRNA sequence
ccgggttcaagcgattctct

SEQ ID NO: 752026 - DNA, 20 bp, Artificial
  CRISPR gRNA sequence
aagcgattctcttgcctcag

SEQ ID NO: 752027 - DNA, 20 bp, Artificial
  CRISPR gRNA sequence
tcttgcctcagcctcttgag

SEQ ID NO: 752028 - DNA, 20 bp, Artificial
  CRISPR gRNA sequence
ttgcctcagcctcttgagta

SEQ ID NO: 752029 - DNA, 20 bp, Artificial
  CRISPR gRNA sequence
gcctcagcctcttgagtagc

SEQ ID NO: 752030 - DNA, 20 bp, Artificial
  CRISPR gRNA sequence
cctcagcctcttgagtagct

SEQ ID NO: 752031 - DNA, 20 bp, Artificial
  CRISPR gRNA sequence
agcctcttgagtagctggga

SEQ ID NO: 752032 - DNA, 20 bp, Artificial
  CRISPR gRNA sequence
ttgagtagctgggactacag

SEQ ID NO: 752033 - DNA, 20 bp, Artificial
  CRISPR gRNA sequence
gagtagctgggactacaggc

SEQ ID NO: 752034 - DNA, 20 bp, Artificial
  CRISPR gRNA sequence
agtagctgggactacaggcg

SEQ ID NO: 752035 - DNA, 20 bp, Artificial
  CRISPR gRNA sequence
ggactacaggcgtgcaccac

SEQ ID NO: 752036 - DNA, 20 bp, Artificial
  CRISPR gRNA sequence
caggcgtgcaccaccatgcc

SEQ ID NO: 752037 - DNA, 20 bp, Artificial
  CRISPR gRNA sequence
gctaatttttgtgtttttag

SEQ ID NO: 752038 - DNA, 20 bp, Artificial
  CRISPR gRNA sequence
atttttgtgtttttagtaga

SEQ ID NO: 752039 - DNA, 20 bp, Artificial
  CRISPR gRNA sequence
ttgtgtttttagtagagatg

SEQ ID NO: 752040 - DNA, 20 bp, Artificial
  CRISPR gRNA sequence
tgtgtttttagtagagatgg

SEQ ID NO: 752041 - DNA, 20 bp, Artificial
  CRISPR gRNA sequence
gtgtttttagtagagatggg

SEQ ID NO: 752042 - DNA, 20 bp, Artificial
  CRISPR gRNA sequence
tgtttttagtagagatgggg

SEQ ID NO: 752043 - DNA, 20 bp, Artificial
  CRISPR gRNA sequence
ttagtagagatggggtttca

SEQ ID NO: 752044 - DNA, 20 bp, Artificial
  CRISPR gRNA sequence
tagtagagatggggtttcac

SEQ ID NO: 752045 - DNA, 20 bp, Artificial
  CRISPR gRNA sequence
agtagagatggggtttcacc

SEQ ID NO: 752046 - DNA, 20 bp, Artificial
  CRISPR gRNA sequence
gtagagatggggtttcaccc

SEQ ID NO: 752047 - DNA, 20 bp, Artificial
  CRISPR gRNA sequence
caccctgttggccaggctgg

SEQ ID NO: 752048 - DNA, 20 bp, Artificial
  CRISPR gRNA sequence
accctgttggccaggctggt

SEQ ID NO: 752049 - DNA, 20 bp, Artificial
  CRISPR gRNA sequence
ttggccaggctggtctcgaa

SEQ ID NO: 752050 - DNA, 20 bp, Artificial
  CRISPR gRNA sequence
gccaggctggtctcgaactc

SEQ ID NO: 752051 - DNA, 20 bp, Artificial
  CRISPR gRNA sequence
gtctcgaactcctggcctca

SEQ ID NO: 752052 - DNA, 20 bp, Artificial
  CRISPR gRNA sequence
gaactcctggcctcaagcga

SEQ ID NO: 752053 - DNA, 20 bp, Artificial
  CRISPR gRNA sequence
ctggcctcaagcgatctgcc

SEQ ID NO: 752054 - DNA, 20 bp, Artificial
  CRISPR gRNA sequence
gcctcaagcgatctgcctgc

SEQ ID NO: 752055 - DNA, 20 bp, Artificial
  CRISPR gRNA sequence
aagcgatctgcctgccttga

SEQ ID NO: 752056 - DNA, 20 bp, Artificial
  CRISPR gRNA sequence
cctgccttgacctcctaaag

SEQ ID NO: 752057 - DNA, 20 bp, Artificial
  CRISPR gRNA sequence
ccttgacctcctaaagtgct

SEQ ID NO: 752058 - DNA, 20 bp, Artificial
  CRISPR gRNA sequence
gacctcctaaagtgctggga

SEQ ID NO: 752059 - DNA, 20 bp, Artificial
  CRISPR gRNA sequence
acctcctaaagtgctgggat

SEQ ID NO: 752060 - DNA, 20 bp, Artificial
  CRISPR gRNA sequence
ctaaagtgctgggattacag

SEQ ID NO: 752061 - DNA, 20 bp, Artificial
  CRISPR gRNA sequence
aagtgctgggattacaggcg

SEQ ID NO: 752062 - DNA, 20 bp, Artificial
  CRISPR gRNA sequence
ggattacaggcgtgagccac

SEQ ID NO: 752063 - DNA, 20 bp, Artificial
  CRISPR gRNA sequence
caggcgtgagccaccgcacc

SEQ ID NO: 752064 - DNA, 20 bp, Artificial
  CRISPR gRNA sequence
accccaaaaataatttttaa

SEQ ID NO: 752065 - DNA, 20 bp, Artificial
  CRISPR gRNA sequence
ttaaaaattcaccagacatg

SEQ ID NO: 752066 - DNA, 20 bp, Artificial
  CRISPR gRNA sequence
taaaaattcaccagacatgg

SEQ ID NO: 752067 - DNA, 20 bp, Artificial
  CRISPR gRNA sequence
aaaaattcaccagacatggt

SEQ ID NO: 752068 - DNA, 20 bp, Artificial
  CRISPR gRNA sequence
aaaattcaccagacatggtg

SEQ ID NO: 752069 - DNA, 20 bp, Artificial
  CRISPR gRNA sequence
accagacatggtgatgcgtg

SEQ ID NO: 752070 - DNA, 20 bp, Artificial
  CRISPR gRNA sequence
tagtcccagctacttgggag

SEQ ID NO: 752071 - DNA, 20 bp, Artificial
  CRISPR gRNA sequence
cttgggagaatgaagcagga

SEQ ID NO: 752072 - DNA, 20 bp, Artificial
  CRISPR gRNA sequence
gggagaatgaagcaggaaga

SEQ ID NO: 752073 - DNA, 20 bp, Artificial
  CRISPR gRNA sequence
ggagaatgaagcaggaagat

SEQ ID NO: 752074 - DNA, 20 bp, Artificial
  CRISPR gRNA sequence
gcatctggaagtttgaggct

SEQ ID NO: 752075 - DNA, 20 bp, Artificial
  CRISPR gRNA sequence
catctggaagtttgaggctt

SEQ ID NO: 752076 - DNA, 20 bp, Artificial
  CRISPR gRNA sequence
gaagtttgaggcttcagtga

SEQ ID NO: 752077 - DNA, 20 bp, Artificial
  CRISPR gRNA sequence
gaggcttcagtgagctgtga

SEQ ID NO: 752078 - DNA, 20 bp, Artificial
  CRISPR gRNA sequence
aggcttcagtgagctgtgat

SEQ ID NO: 752079 - DNA, 20 bp, Artificial
  CRISPR gRNA sequence
cagtgagctgtgattgcacc

SEQ ID NO: 752080 - DNA, 20 bp, Artificial
  CRISPR gRNA sequence
agtgagctgtgattgcacca

SEQ ID NO: 752081 - DNA, 20 bp, Artificial
  CRISPR gRNA sequence
tgattgcaccactgcattcc

SEQ ID NO: 752082 - DNA, 20 bp, Artificial
  CRISPR gRNA sequence
caccactgcattccagcctg

SEQ ID NO: 752083 - DNA, 20 bp, Artificial
  CRISPR gRNA sequence
cattccagcctgagtgacag

SEQ ID NO: 752084 - DNA, 20 bp, Artificial
  CRISPR gRNA sequence
cagcctgagtgacagagaga

SEQ ID NO: 752085 - DNA, 20 bp, Artificial
  CRISPR gRNA sequence
agtgacagagagagagtctt

SEQ ID NO: 752086 - DNA, 20 bp, Artificial
  CRISPR gRNA sequence
tctcaaaaaaaaaaaaaatt

SEQ ID NO: 752087 - DNA, 20 bp, Artificial
  CRISPR gRNA sequence
ctcaaaaaaaaaaaaaattc

SEQ ID NO: 752088 - DNA, 20 bp, Artificial
  CRISPR gRNA sequence
tcaaaaaaaaaaaaaattcc

SEQ ID NO: 752089 - DNA, 20 bp, Artificial
  CRISPR gRNA sequence
aaaaaaaaaaaaaattcctg

SEQ ID NO: 752090 - DNA, 20 bp, Artificial
  CRISPR gRNA sequence
ctgaggccaggcgtggtgac

SEQ ID NO: 752091 - DNA, 20 bp, Artificial
  CRISPR gRNA sequence
aggccaggcgtggtgactca

SEQ ID NO: 752092 - DNA, 20 bp, Artificial
  CRISPR gRNA sequence
acacctgtaatcccagcact

SEQ ID NO: 752093 - DNA, 20 bp, Artificial
  CRISPR gRNA sequence
taatcccagcactttgggag

SEQ ID NO: 752094 - DNA, 20 bp, Artificial
  CRISPR gRNA sequence
tgggaggccgaggcagttag

SEQ ID NO: 752095 - DNA, 20 bp, Artificial
  CRISPR gRNA sequence
gggaggccgaggcagttaga

SEQ ID NO: 752096 - DNA, 20 bp, Artificial
  CRISPR gRNA sequence
ggaggccgaggcagttagat

SEQ ID NO: 752097 - DNA, 20 bp, Artificial
  CRISPR gRNA sequence
gatcatttgtcagtagtttg

SEQ ID NO: 752098 - DNA, 20 bp, Artificial
  CRISPR gRNA sequence
gtcagtagtttgagaccagc

SEQ ID NO: 752099 - DNA, 20 bp, Artificial
  CRISPR gRNA sequence
tcagtagtttgagaccagcc

SEQ ID NO: 752100 - DNA, 20 bp, Artificial
  CRISPR gRNA sequence
gagaccagcctggccaacat

SEQ ID NO: 752101 - DNA, 20 bp, Artificial
  CRISPR gRNA sequence
agaccagcctggccaacatg

SEQ ID NO: 752102 - DNA, 20 bp, Artificial
  CRISPR gRNA sequence
gccaacatggtgaaacccca

SEQ ID NO: 752103 - DNA, 20 bp, Artificial
  CRISPR gRNA sequence
cactaaaaatacaaaaatta

SEQ ID NO: 752104 - DNA, 20 bp, Artificial
  CRISPR gRNA sequence
aaaatacaaaaattagccag

SEQ ID NO: 752105 - DNA, 20 bp, Artificial
  CRISPR gRNA sequence
gccaggcattgtggtgcacg

SEQ ID NO: 752106 - DNA, 20 bp, Artificial
  CRISPR gRNA sequence
tggtgcacgcctgtaatctc

SEQ ID NO: 752107 - DNA, 20 bp, Artificial
  CRISPR gRNA sequence
taatctcatcctagctactc

SEQ ID NO: 752108 - DNA, 20 bp, Artificial
  CRISPR gRNA sequence
atcctagctactcgggaggc

SEQ ID NO: 752109 - DNA, 20 bp, Artificial
  CRISPR gRNA sequence
gctactcgggaggctgaggc

SEQ ID NO: 752110 - DNA, 20 bp, Artificial
  CRISPR gRNA sequence
ctcgggaggctgaggcagaa

SEQ ID NO: 752111 - DNA, 20 bp, Artificial
  CRISPR gRNA sequence
gggaggctgaggcagaagaa

SEQ ID NO: 752112 - DNA, 20 bp, Artificial
  CRISPR gRNA sequence
aggcagaagaatcgcttgaa

SEQ ID NO: 752113 - DNA, 20 bp, Artificial
  CRISPR gRNA sequence
gaatccgggaggcggaggtt

SEQ ID NO: 752114 - DNA, 20 bp, Artificial
  CRISPR gRNA sequence
aatccgggaggcggaggttg

SEQ ID NO: 752115 - DNA, 20 bp, Artificial
  CRISPR gRNA sequence
cagtgagcccagatcgcgcc

SEQ ID NO: 752116 - DNA, 20 bp, Artificial
  CRISPR gRNA sequence
cactccagcctgggtaacag

SEQ ID NO: 752117 - DNA, 20 bp, Artificial
  CRISPR gRNA sequence
cagcctgggtaacagagtga

SEQ ID NO: 752118 - DNA, 20 bp, Artificial
  CRISPR gRNA sequence
ggtaacagagtgaaaccgtg

SEQ ID NO: 752119 - DNA, 20 bp, Artificial
  CRISPR gRNA sequence
cagaaaatatacacacacac

SEQ ID NO: 752120 - DNA, 20 bp, Artificial
  CRISPR gRNA sequence
agaaaatatacacacacaca

SEQ ID NO: 752121 - DNA, 20 bp, Artificial
  CRISPR gRNA sequence
agataataatacttaaaaag

SEQ ID NO: 752122 - DNA, 20 bp, Artificial
  CRISPR gRNA sequence
aaaaagacttagtccagtgc

SEQ ID NO: 752123 - DNA, 20 bp, Artificial
  CRISPR gRNA sequence
aaaagacttagtccagtgcc

SEQ ID NO: 752124 - DNA, 20 bp, Artificial
  CRISPR gRNA sequence
agtccagtgcccagcacagt

SEQ ID NO: 752125 - DNA, 20 bp, Artificial
  CRISPR gRNA sequence
gtccagtgcccagcacagtg

SEQ ID NO: 752126 - DNA, 20 bp, Artificial
  CRISPR gRNA sequence
aggaaaggtagttctgttcc

SEQ ID NO: 752127 - DNA, 20 bp, Artificial
  CRISPR gRNA sequence
tgttccccttcctgaacctc

SEQ ID NO: 752128 - DNA, 20 bp, Artificial
  CRISPR gRNA sequence
ttccccttcctgaacctctt

SEQ ID NO: 752129 - DNA, 20 bp, Artificial
  CRISPR gRNA sequence
cccttcctgaacctcttcct

SEQ ID NO: 752130 - DNA, 20 bp, Artificial
  CRISPR gRNA sequence
cctgaacctcttcctcctcc

SEQ ID NO: 752131 - DNA, 20 bp, Artificial
  CRISPR gRNA sequence
ctgaacctcttcctcctccc

SEQ ID NO: 752132 - DNA, 20 bp, Artificial
  CRISPR gRNA sequence
aacctcttcctcctccctcc

SEQ ID NO: 752133 - DNA, 20 bp, Artificial
  CRISPR gRNA sequence
ttcctcctccctcccctgca

SEQ ID NO: 752134 - DNA, 20 bp, Artificial
  CRISPR gRNA sequence
cctcctccctcccctgcaac

SEQ ID NO: 752135 - DNA, 20 bp, Artificial
  CRISPR gRNA sequence
ctcctccctcccctgcaaca

SEQ ID NO: 752136 - DNA, 20 bp, Artificial
  CRISPR gRNA sequence
ctccctcccctgcaacagag

SEQ ID NO: 752137 - DNA, 20 bp, Artificial
  CRISPR gRNA sequence
cctcccctgcaacagagaac

SEQ ID NO: 752138 - DNA, 20 bp, Artificial
  CRISPR gRNA sequence
ccctgcaacagagaacatct

SEQ ID NO: 752139 - DNA, 20 bp, Artificial
  CRISPR gRNA sequence
caacagagaacatctgaaga

SEQ ID NO: 752140 - DNA, 20 bp, Artificial
  CRISPR gRNA sequence
aagaacatagaaacacagaa

SEQ ID NO: 752141 - DNA, 20 bp, Artificial
  CRISPR gRNA sequence
aagtagtttaattctaggcc

SEQ ID NO: 752142 - DNA, 20 bp, Artificial
  CRISPR gRNA sequence
aattctaggccaagaggacc

SEQ ID NO: 752143 - DNA, 20 bp, Artificial
  CRISPR gRNA sequence
attctaggccaagaggaccc

SEQ ID NO: 752144 - DNA, 20 bp, Artificial
  CRISPR gRNA sequence
taggccaagaggacccccag

SEQ ID NO: 752145 - DNA, 20 bp, Artificial
  CRISPR gRNA sequence
ggccaagaggacccccagcc

SEQ ID NO: 752146 - DNA, 20 bp, Artificial
  CRISPR gRNA sequence
cccaagccatagggggctgg

SEQ ID NO: 752147 - DNA, 20 bp, Artificial
  CRISPR gRNA sequence
ccaagccatagggggctggt

SEQ ID NO: 752148 - DNA, 20 bp, Artificial
  CRISPR gRNA sequence
gtgggcagggcggcacttag

SEQ ID NO: 752149 - DNA, 20 bp, Artificial
  CRISPR gRNA sequence
agctgcctggggcacccagt

SEQ ID NO: 752150 - DNA, 20 bp, Artificial
  CRISPR gRNA sequence
gctgcctggggcacccagta

SEQ ID NO: 752151 - DNA, 20 bp, Artificial
  CRISPR gRNA sequence
cctggggcacccagtacctg

SEQ ID NO: 752152 - DNA, 20 bp, Artificial
  CRISPR gRNA sequence
gggcacccagtacctgtcat

SEQ ID NO: 752153 - DNA, 20 bp, Artificial
  CRISPR gRNA sequence
tcatgaggcacttgccctgg

SEQ ID NO: 752154 - DNA, 20 bp, Artificial
  CRISPR gRNA sequence
gccctggccaaaggtcactg

SEQ ID NO: 752155 - DNA, 20 bp, Artificial
  CRISPR gRNA sequence
ccctggccaaaggtcactgc

SEQ ID NO: 752156 - DNA, 20 bp, Artificial
  CRISPR gRNA sequence
gccaaaggtcactgccaagg

SEQ ID NO: 752157 - DNA, 20 bp, Artificial
  CRISPR gRNA sequence
ccaaggcacagccactccag

SEQ ID NO: 752158 - DNA, 20 bp, Artificial
  CRISPR gRNA sequence
cagagagtcaagaggagcag

SEQ ID NO: 752159 - DNA, 20 bp, Artificial
  CRISPR gRNA sequence
cagagcagatggaaggagag

SEQ ID NO: 752160 - DNA, 20 bp, Artificial
  CRISPR gRNA sequence
ctggggattgcaccaaggag

SEQ ID NO: 752161 - DNA, 20 bp, Artificial
  CRISPR gRNA sequence
tggggattgcaccaaggagg

SEQ ID NO: 752162 - DNA, 20 bp, Artificial
  CRISPR gRNA sequence
gggattgcaccaaggaggaa

SEQ ID NO: 752163 - DNA, 20 bp, Artificial
  CRISPR gRNA sequence
caccaaggaggaagcagaag

SEQ ID NO: 752164 - DNA, 20 bp, Artificial
  CRISPR gRNA sequence
tgagggcttggggtgatgag

SEQ ID NO: 752165 - DNA, 20 bp, Artificial
  CRISPR gRNA sequence
agggcttggggtgatgaggc

SEQ ID NO: 752166 - DNA, 20 bp, Artificial
  CRISPR gRNA sequence
ggggtgatgaggccagagtt

SEQ ID NO: 752167 - DNA, 20 bp, Artificial
  CRISPR gRNA sequence
gggtgatgaggccagagttc

SEQ ID NO: 752168 - DNA, 20 bp, Artificial
  CRISPR gRNA sequence
caaacagggtctgggtgcag

SEQ ID NO: 752169 - DNA, 20 bp, Artificial
  CRISPR gRNA sequence
ggtgcaggatgaggacagaa

SEQ ID NO: 752170 - DNA, 20 bp, Artificial
  CRISPR gRNA sequence
gtcccttactttcactatcc

SEQ ID NO: 752171 - DNA, 20 bp, Artificial
  CRISPR gRNA sequence
actttcactatcctgggagg

SEQ ID NO: 752172 - DNA, 20 bp, Artificial
  CRISPR gRNA sequence
ctttcactatcctgggagga

SEQ ID NO: 752173 - DNA, 20 bp, Artificial
  CRISPR gRNA sequence
tcactatcctgggaggagga

SEQ ID NO: 752174 - DNA, 20 bp, Artificial
  CRISPR gRNA sequence
cactatcctgggaggaggat

SEQ ID NO: 752175 - DNA, 20 bp, Artificial
  CRISPR gRNA sequence
actatcctgggaggaggatg

SEQ ID NO: 752176 - DNA, 20 bp, Artificial
  CRISPR gRNA sequence
tcctgggaggaggatgggta

SEQ ID NO: 752177 - DNA, 20 bp, Artificial
  CRISPR gRNA sequence
ggaggaggatgggtacacca

SEQ ID NO: 752178 - DNA, 20 bp, Artificial
  CRISPR gRNA sequence
gatggtgcatctttgcctgt

SEQ ID NO: 752179 - DNA, 20 bp, Artificial
  CRISPR gRNA sequence
tgcctgtgggaacaaacaga

SEQ ID NO: 752180 - DNA, 20 bp, Artificial
  CRISPR gRNA sequence
gcctgtgggaacaaacagaa

SEQ ID NO: 752181 - DNA, 20 bp, Artificial
  CRISPR gRNA sequence
cctgtgggaacaaacagaag

SEQ ID NO: 752182 - DNA, 20 bp, Artificial
  CRISPR gRNA sequence
tgggaacaaacagaagggcc

SEQ ID NO: 752183 - DNA, 20 bp, Artificial
  CRISPR gRNA sequence
ggtgggtgtcaggcccagga

SEQ ID NO: 752184 - DNA, 20 bp, Artificial
  CRISPR gRNA sequence
gtccaggccagtgtccccct

SEQ ID NO: 752185 - DNA, 20 bp, Artificial
  CRISPR gRNA sequence
tccaggccagtgtccccctc

SEQ ID NO: 752186 - DNA, 20 bp, Artificial
  CRISPR gRNA sequence
ctgccccaggttctcacgct

SEQ ID NO: 752187 - DNA, 20 bp, Artificial
  CRISPR gRNA sequence
ccccaggttctcacgctagt

SEQ ID NO: 752188 - DNA, 20 bp, Artificial
  CRISPR gRNA sequence
tcacgctagtgcctactcgg

SEQ ID NO: 752189 - DNA, 20 bp, Artificial
  CRISPR gRNA sequence
acgctagtgcctactcggca

SEQ ID NO: 752190 - DNA, 20 bp, Artificial
  CRISPR gRNA sequence
gtgcctactcggcagtgttg

SEQ ID NO: 752191 - DNA, 20 bp, Artificial
  CRISPR gRNA sequence
ctcggcagtgttggcccagt

SEQ ID NO: 752192 - DNA, 20 bp, Artificial
  CRISPR gRNA sequence
ggcagtgttggcccagtggc

SEQ ID NO: 752193 - DNA, 20 bp, Artificial
  CRISPR gRNA sequence
gcccagtggcagcctgcaca

SEQ ID NO: 752194 - DNA, 20 bp, Artificial
  CRISPR gRNA sequence
cacacgtgtgcacccacaca

SEQ ID NO: 752195 - DNA, 20 bp, Artificial
  CRISPR gRNA sequence
gcatgttctcaccctgccca

SEQ ID NO: 752196 - DNA, 20 bp, Artificial
  CRISPR gRNA sequence
tcaccctgcccattttcatg

SEQ ID NO: 752197 - DNA, 20 bp, Artificial
  CRISPR gRNA sequence
accctgcccattttcatgcc

SEQ ID NO: 752198 - DNA, 20 bp, Artificial
  CRISPR gRNA sequence
cccattttcatgccactccc

SEQ ID NO: 752199 - DNA, 20 bp, Artificial
  CRISPR gRNA sequence
tcatgccactcccaggggca

SEQ ID NO: 752200 - DNA, 20 bp, Artificial
  CRISPR gRNA sequence
catgccactcccaggggcat

SEQ ID NO: 752201 - DNA, 20 bp, Artificial
  CRISPR gRNA sequence
atgccactcccaggggcatg

SEQ ID NO: 752202 - DNA, 20 bp, Artificial
  CRISPR gRNA sequence
ccaggggcatgtgaataccc

SEQ ID NO: 752203 - DNA, 20 bp, Artificial
  CRISPR gRNA sequence
gtgcccacacctctatccga

SEQ ID NO: 752204 - DNA, 20 bp, Artificial
  CRISPR gRNA sequence
tatccgaaccatgggccctt

SEQ ID NO: 752205 - DNA, 20 bp, Artificial
  CRISPR gRNA sequence
tccgaaccatgggcccttgc

SEQ ID NO: 752206 - DNA, 20 bp, Artificial
  CRISPR gRNA sequence
gcactctcacctgaacagac

SEQ ID NO: 752207 - DNA, 20 bp, Artificial
  CRISPR gRNA sequence
cactctcacctgaacagaca

SEQ ID NO: 752208 - DNA, 20 bp, Artificial
  CRISPR gRNA sequence
tcacctgaacagacagacac

SEQ ID NO: 752209 - DNA, 20 bp, Artificial
  CRISPR gRNA sequence
acctgaacagacagacacac

SEQ ID NO: 752210 - DNA, 20 bp, Artificial
  CRISPR gRNA sequence
aacagacagacacacacacg

SEQ ID NO: 752211 - DNA, 20 bp, Artificial
  CRISPR gRNA sequence
tccaacagccattcagccat

SEQ ID NO: 752212 - DNA, 20 bp, Artificial
  CRISPR gRNA sequence
caacagccattcagccatcc

SEQ ID NO: 752213 - DNA, 20 bp, Artificial
  CRISPR gRNA sequence
agccatccactgagtcatgc

SEQ ID NO: 752214 - DNA, 20 bp, Artificial
  CRISPR gRNA sequence
agtcatgccccagggcacca

SEQ ID NO: 752215 - DNA, 20 bp, Artificial
  CRISPR gRNA sequence
atgcctatacccacagcagc

SEQ ID NO: 752216 - DNA, 20 bp, Artificial
  CRISPR gRNA sequence
tacccacagcagccatgatg

SEQ ID NO: 752217 - DNA, 20 bp, Artificial
  CRISPR gRNA sequence
ccagcccaggtacctacagc

SEQ ID NO: 752218 - DNA, 20 bp, Artificial
  CRISPR gRNA sequence
cagcctcacacattaaaaag

SEQ ID NO: 752219 - DNA, 20 bp, Artificial
  CRISPR gRNA sequence
acacattaaaaagtctcact

SEQ ID NO: 752220 - DNA, 20 bp, Artificial
  CRISPR gRNA sequence
aaaagtctcactgtcacaaa

SEQ ID NO: 752221 - DNA, 20 bp, Artificial
  CRISPR gRNA sequence
actgtcacaaatggagccag

SEQ ID NO: 752222 - DNA, 20 bp, Artificial
  CRISPR gRNA sequence
tcacaaatggagccaggtac

SEQ ID NO: 752223 - DNA, 20 bp, Artificial
  CRISPR gRNA sequence
cctctccatcactccagcta

SEQ ID NO: 752224 - DNA, 20 bp, Artificial
  CRISPR gRNA sequence
tccatcactccagctaacta

SEQ ID NO: 752225 - DNA, 20 bp, Artificial
  CRISPR gRNA sequence
catcactccagctaactaca

SEQ ID NO: 752226 - DNA, 20 bp, Artificial
  CRISPR gRNA sequence
cagctaactacaaacccaca

SEQ ID NO: 752227 - DNA, 20 bp, Artificial
  CRISPR gRNA sequence
actacaaacccacactccac

SEQ ID NO: 752228 - DNA, 20 bp, Artificial
  CRISPR gRNA sequence
caaacccacactccacacac

SEQ ID NO: 752229 - DNA, 20 bp, Artificial
  CRISPR gRNA sequence
cacacacccttgaccacccc

SEQ ID NO: 752230 - DNA, 20 bp, Artificial
  CRISPR gRNA sequence
gaccaccccatctcacccac

SEQ ID NO: 752231 - DNA, 20 bp, Artificial
  CRISPR gRNA sequence
accaccccatctcacccaca

SEQ ID NO: 752232 - DNA, 20 bp, Artificial
  CRISPR gRNA sequence
acccacacactccctggagt

SEQ ID NO: 752233 - DNA, 20 bp, Artificial
  CRISPR gRNA sequence
cctggagtgccagtgttacc

SEQ ID NO: 752234 - DNA, 20 bp, Artificial
  CRISPR gRNA sequence
gagtgccagtgttacccatg

SEQ ID NO: 752235 - DNA, 20 bp, Artificial
  CRISPR gRNA sequence
cccatgcagcctcacactct

SEQ ID NO: 752236 - DNA, 20 bp, Artificial
  CRISPR gRNA sequence
acactctgcccagcacagtg

SEQ ID NO: 752237 - DNA, 20 bp, Artificial
  CRISPR gRNA sequence
tgcccagcacagtgtcatga

SEQ ID NO: 752238 - DNA, 20 bp, Artificial
  CRISPR gRNA sequence
cccagcacagtgtcatgaat

SEQ ID NO: 752239 - DNA, 20 bp, Artificial
  CRISPR gRNA sequence
cacacacgccaggctgtcac

SEQ ID NO: 752240 - DNA, 20 bp, Artificial
  CRISPR gRNA sequence
tcacgtgcaggatgccctca

SEQ ID NO: 752241 - DNA, 20 bp, Artificial
  CRISPR gRNA sequence
acctgtctgcacctgcagct

SEQ ID NO: 752242 - DNA, 20 bp, Artificial
  CRISPR gRNA sequence
tctgcacctgcagctccatg

SEQ ID NO: 752243 - DNA, 20 bp, Artificial
  CRISPR gRNA sequence
cacctgcagctccatggcac

SEQ ID NO: 752244 - DNA, 20 bp, Artificial
  CRISPR gRNA sequence
cagctccatggcaccatgga

SEQ ID NO: 752245 - DNA, 20 bp, Artificial
  CRISPR gRNA sequence
catggcaccatggaccctgt

SEQ ID NO: 752246 - DNA, 20 bp, Artificial
  CRISPR gRNA sequence
tgctccgagtggtggtgcct

SEQ ID NO: 752247 - DNA, 20 bp, Artificial
  CRISPR gRNA sequence
cgagtggtggtgcctgatct

SEQ ID NO: 752248 - DNA, 20 bp, Artificial
  CRISPR gRNA sequence
atctccaccaccaggcagca

SEQ ID NO: 752249 - DNA, 20 bp, Artificial
  CRISPR gRNA sequence
caccaccaggcagcagtaga

SEQ ID NO: 752250 - DNA, 20 bp, Artificial
  CRISPR gRNA sequence
tccagcagggtcaggttgcg

SEQ ID NO: 752251 - DNA, 20 bp, Artificial
  CRISPR gRNA sequence
cgcatggtgatggagaagtt

SEQ ID NO: 752252 - DNA, 20 bp, Artificial
  CRISPR gRNA sequence
ccatggtggtcggaggccga

SEQ ID NO: 752253 - DNA, 20 bp, Artificial
  CRISPR gRNA sequence
cagcccgtggcgctgagcca

SEQ ID NO: 752254 - DNA, 20 bp, Artificial
  CRISPR gRNA sequence
agccaggtcgtggctggtgt

SEQ ID NO: 752255 - DNA, 20 bp, Artificial
  CRISPR gRNA sequence
gtgttggcagcctggtggcc

SEQ ID NO: 752256 - DNA, 20 bp, Artificial
  CRISPR gRNA sequence
gcagcctggtggcctccatg

SEQ ID NO: 752257 - DNA, 20 bp, Artificial
  CRISPR gRNA sequence
gtggcctccatggtgcaggt

SEQ ID NO: 752258 - DNA, 20 bp, Artificial
  CRISPR gRNA sequence
catggtgcaggtgaaggtcc

SEQ ID NO: 752259 - DNA, 20 bp, Artificial
  CRISPR gRNA sequence
gaacgtgaggttgcggatgg

SEQ ID NO: 752260 - DNA, 20 bp, Artificial
  CRISPR gRNA sequence
cggatgggccggcgctctga

SEQ ID NO: 752261 - DNA, 20 bp, Artificial
  CRISPR gRNA sequence
tgagcaggtctgcacctcgc

SEQ ID NO: 752262 - DNA, 20 bp, Artificial
  CRISPR gRNA sequence
agcaggtctgcacctcgccc

SEQ ID NO: 752263 - DNA, 20 bp, Artificial
  CRISPR gRNA sequence
cacctcgcccctcgagctgc

SEQ ID NO: 752264 - DNA, 20 bp, Artificial
  CRISPR gRNA sequence
gcccctcgagctgcggtacc

SEQ ID NO: 752265 - DNA, 20 bp, Artificial
  CRISPR gRNA sequence
gagctgcggtaccacgtctt

SEQ ID NO: 752266 - DNA, 20 bp, Artificial
  CRISPR gRNA sequence
cggtaccacgtcttgtagaa

SEQ ID NO: 752267 - DNA, 20 bp, Artificial
  CRISPR gRNA sequence
gtagaaggtcacatcgtgcc

SEQ ID NO: 752268 - DNA, 20 bp, Artificial
  CRISPR gRNA sequence
tagaaggtcacatcgtgccc

SEQ ID NO: 752269 - DNA, 20 bp, Artificial
  CRISPR gRNA sequence
tgtccacagggcccaagagc

SEQ ID NO: 752270 - DNA, 20 bp, Artificial
  CRISPR gRNA sequence
gtccacagggcccaagagcc

SEQ ID NO: 752271 - DNA, 20 bp, Artificial
  CRISPR gRNA sequence
tccacagggcccaagagcct

SEQ ID NO: 752272 - DNA, 20 bp, Artificial
  CRISPR gRNA sequence
caggtgagggtgacgttctg

SEQ ID NO: 752273 - DNA, 20 bp, Artificial
  CRISPR gRNA sequence
tgcccctcgggacagacata

SEQ ID NO: 752274 - DNA, 20 bp, Artificial
  CRISPR gRNA sequence
cccctcgggacagacataca

SEQ ID NO: 752275 - DNA, 20 bp, Artificial
  CRISPR gRNA sequence
gggacagacatacagggaat

SEQ ID NO: 752276 - DNA, 20 bp, Artificial
  CRISPR gRNA sequence
gaaggctgccaccggacctg

SEQ ID NO: 752277 - DNA, 20 bp, Artificial
  CRISPR gRNA sequence
aaggctgccaccggacctgc

SEQ ID NO: 752278 - DNA, 20 bp, Artificial
  CRISPR gRNA sequence
ccaccggacctgctcagaga

SEQ ID NO: 752279 - DNA, 20 bp, Artificial
  CRISPR gRNA sequence
ctcagagagaggagagccct

SEQ ID NO: 752280 - DNA, 20 bp, Artificial
  CRISPR gRNA sequence
agagagaggagagccctgtc

SEQ ID NO: 752281 - DNA, 20 bp, Artificial
  CRISPR gRNA sequence
tcacctgactgatccagtgc

SEQ ID NO: 752282 - DNA, 20 bp, Artificial
  CRISPR gRNA sequence
actgatccagtgctactcct

SEQ ID NO: 752283 - DNA, 20 bp, Artificial
  CRISPR gRNA sequence
atccagtgctactcctggca

SEQ ID NO: 752284 - DNA, 20 bp, Artificial
  CRISPR gRNA sequence
ctcctggcaaccccagagcg

SEQ ID NO: 752285 - DNA, 20 bp, Artificial
  CRISPR gRNA sequence
ctggcaaccccagagcgggg

SEQ ID NO: 752286 - DNA, 20 bp, Artificial
  CRISPR gRNA sequence
gcaaccccagagcggggaag

SEQ ID NO: 752287 - DNA, 20 bp, Artificial
  CRISPR gRNA sequence
agcctctgctacttcccagc

SEQ ID NO: 752288 - DNA, 20 bp, Artificial
  CRISPR gRNA sequence
gcctctgctacttcccagcc

SEQ ID NO: 752289 - DNA, 20 bp, Artificial
  CRISPR gRNA sequence
tgctacttcccagccacagg

SEQ ID NO: 752290 - DNA, 20 bp, Artificial
  CRISPR gRNA sequence
ctacttcccagccacaggcc

SEQ ID NO: 752291 - DNA, 20 bp, Artificial
  CRISPR gRNA sequence
cttcccagccacaggccagg

SEQ ID NO: 752292 - DNA, 20 bp, Artificial
  CRISPR gRNA sequence
cccagccacaggccaggggc

SEQ ID NO: 752293 - DNA, 20 bp, Artificial
  CRISPR gRNA sequence
ccagccacaggccaggggca

SEQ ID NO: 752294 - DNA, 20 bp, Artificial
  CRISPR gRNA sequence
acctccctaagactgccttc

SEQ ID NO: 752295 - DNA, 20 bp, Artificial
  CRISPR gRNA sequence
cctaagactgccttctgcat

SEQ ID NO: 752296 - DNA, 20 bp, Artificial
  CRISPR gRNA sequence
agactgccttctgcatttgt

SEQ ID NO: 752297 - DNA, 20 bp, Artificial
  CRISPR gRNA sequence
ccttctgcatttgttcacaa

SEQ ID NO: 752298 - DNA, 20 bp, Artificial
  CRISPR gRNA sequence
ctgcatttgttcacaaaccc

SEQ ID NO: 752299 - DNA, 20 bp, Artificial
  CRISPR gRNA sequence
tgcatttgttcacaaacccc

SEQ ID NO: 752300 - DNA, 20 bp, Artificial
  CRISPR gRNA sequence
catttgttcacaaaccccac

SEQ ID NO: 752301 - DNA, 20 bp, Artificial
  CRISPR gRNA sequence
gttcacaaaccccactccat

SEQ ID NO: 752302 - DNA, 20 bp, Artificial
  CRISPR gRNA sequence
ttcacaaaccccactccatc

SEQ ID NO: 752303 - DNA, 20 bp, Artificial
  CRISPR gRNA sequence
acaaaccccactccatccta

SEQ ID NO: 752304 - DNA, 20 bp, Artificial
  CRISPR gRNA sequence
catcctaggctgttgtaggg

SEQ ID NO: 752305 - DNA, 20 bp, Artificial
  CRISPR gRNA sequence
ggctgttgtagggggagtca

SEQ ID NO: 752306 - DNA, 20 bp, Artificial
  CRISPR gRNA sequence
ttgtagggggagtcacagaa

SEQ ID NO: 752307 - DNA, 20 bp, Artificial
  CRISPR gRNA sequence
tagggggagtcacagaagct

SEQ ID NO: 752308 - DNA, 20 bp, Artificial
  CRISPR gRNA sequence
ccccaactaggggtgctcct

SEQ ID NO: 752309 - DNA, 20 bp, Artificial
  CRISPR gRNA sequence
cccaactaggggtgctcctg

SEQ ID NO: 752310 - DNA, 20 bp, Artificial
  CRISPR gRNA sequence
ggggtgctcctggatgctgg

SEQ ID NO: 752311 - DNA, 20 bp, Artificial
  CRISPR gRNA sequence
ctggatgctggacagggcag

SEQ ID NO: 752312 - DNA, 20 bp, Artificial
  CRISPR gRNA sequence
gatgctggacagggcaggga

SEQ ID NO: 752313 - DNA, 20 bp, Artificial
  CRISPR gRNA sequence
gacagggcagggagagactt

SEQ ID NO: 752314 - DNA, 20 bp, Artificial
  CRISPR gRNA sequence
ggagggcagtgatgcagtcg

SEQ ID NO: 752315 - DNA, 20 bp, Artificial
  CRISPR gRNA sequence
gagggcagtgatgcagtcgg

SEQ ID NO: 752316 - DNA, 20 bp, Artificial
  CRISPR gRNA sequence
ttcccagtagagtatatgca

SEQ ID NO: 752317 - DNA, 20 bp, Artificial
  CRISPR gRNA sequence
cccagtagagtatatgcaaa

SEQ ID NO: 752318 - DNA, 20 bp, Artificial
  CRISPR gRNA sequence
ccagtagagtatatgcaaaa

SEQ ID NO: 752319 - DNA, 20 bp, Artificial
  CRISPR gRNA sequence
ttgggtgggaggcaggttgg

SEQ ID NO: 752320 - DNA, 20 bp, Artificial
  CRISPR gRNA sequence
ggtgggaggcaggttgggga

SEQ ID NO: 752321 - DNA, 20 bp, Artificial
  CRISPR gRNA sequence
gggagcaggaaggctgtttc

SEQ ID NO: 752322 - DNA, 20 bp, Artificial
  CRISPR gRNA sequence
tttcgaacagcagctccttg

SEQ ID NO: 752323 - DNA, 20 bp, Artificial
  CRISPR gRNA sequence
cgaacagcagctccttgtcc

SEQ ID NO: 752324 - DNA, 20 bp, Artificial
  CRISPR gRNA sequence
gaacagcagctccttgtcct

SEQ ID NO: 752325 - DNA, 20 bp, Artificial
  CRISPR gRNA sequence
cttgtccttggccgctctgt

SEQ ID NO: 752326 - DNA, 20 bp, Artificial
  CRISPR gRNA sequence
gtccttggccgctctgtagg

SEQ ID NO: 752327 - DNA, 20 bp, Artificial
  CRISPR gRNA sequence
tccttggccgctctgtaggg

SEQ ID NO: 752328 - DNA, 20 bp, Artificial
  CRISPR gRNA sequence
ggccgctctgtaggggccat

SEQ ID NO: 752329 - DNA, 20 bp, Artificial
  CRISPR gRNA sequence
gccgctctgtaggggccatc

SEQ ID NO: 752330 - DNA, 20 bp, Artificial
  CRISPR gRNA sequence
tgtaggggccatcaacacct

SEQ ID NO: 752331 - DNA, 20 bp, Artificial
  CRISPR gRNA sequence
taggggccatcaacacctct

SEQ ID NO: 752332 - DNA, 20 bp, Artificial
  CRISPR gRNA sequence
tgccccttcctactcctagg

SEQ ID NO: 752333 - DNA, 20 bp, Artificial
  CRISPR gRNA sequence
ccccttcctactcctaggac

SEQ ID NO: 752334 - DNA, 20 bp, Artificial
  CRISPR gRNA sequence
cctactcctaggactgaaca

SEQ ID NO: 752335 - DNA, 20 bp, Artificial
  CRISPR gRNA sequence
ctactcctaggactgaacat

SEQ ID NO: 752336 - DNA, 20 bp, Artificial
  CRISPR gRNA sequence
ctcctaggactgaacatgcc

SEQ ID NO: 752337 - DNA, 20 bp, Artificial
  CRISPR gRNA sequence
ctaggactgaacatgccttc

SEQ ID NO: 752338 - DNA, 20 bp, Artificial
  CRISPR gRNA sequence
ggactgaacatgccttccca

SEQ ID NO: 752339 - DNA, 20 bp, Artificial
  CRISPR gRNA sequence
aacatgccttcccatccttg

SEQ ID NO: 752340 - DNA, 20 bp, Artificial
  CRISPR gRNA sequence
cccatccttgccagggagca

SEQ ID NO: 752341 - DNA, 20 bp, Artificial
  CRISPR gRNA sequence
ccatccttgccagggagcac

SEQ ID NO: 752342 - DNA, 20 bp, Artificial
  CRISPR gRNA sequence
gccagggagcactaagagag

SEQ ID NO: 752343 - DNA, 20 bp, Artificial
  CRISPR gRNA sequence
ccagggagcactaagagagc

SEQ ID NO: 752344 - DNA, 20 bp, Artificial
  CRISPR gRNA sequence
agagagcacctgcgtgtgca

SEQ ID NO: 752345 - DNA, 20 bp, Artificial
  CRISPR gRNA sequence
cgtgtgcaaggcctgggcca

SEQ ID NO: 752346 - DNA, 20 bp, Artificial
  CRISPR gRNA sequence
ggccaggtgctgcatctcac

SEQ ID NO: 752347 - DNA, 20 bp, Artificial
  CRISPR gRNA sequence
catctcacctgcatgctgaa

SEQ ID NO: 752348 - DNA, 20 bp, Artificial
  CRISPR gRNA sequence
acctgcatgctgaatgcatg

SEQ ID NO: 752349 - DNA, 20 bp, Artificial
  CRISPR gRNA sequence
catgctgaatgcatggcctc

SEQ ID NO: 752350 - DNA, 20 bp, Artificial
  CRISPR gRNA sequence
aatgcatggcctccccttga

SEQ ID NO: 752351 - DNA, 20 bp, Artificial
  CRISPR gRNA sequence
cccttgagcagacgaggcct

SEQ ID NO: 752352 - DNA, 20 bp, Artificial
  CRISPR gRNA sequence
gagcagacgaggcctgcatt

SEQ ID NO: 752353 - DNA, 20 bp, Artificial
  CRISPR gRNA sequence
agcagacgaggcctgcattc

SEQ ID NO: 752354 - DNA, 20 bp, Artificial
  CRISPR gRNA sequence
cattcccgacagcagaaccc

SEQ ID NO: 752355 - DNA, 20 bp, Artificial
  CRISPR gRNA sequence
ccgacagcagaaccccatgg

SEQ ID NO: 752356 - DNA, 20 bp, Artificial
  CRISPR gRNA sequence
agggcacttggaggagggag

SEQ ID NO: 752357 - DNA, 20 bp, Artificial
  CRISPR gRNA sequence
ggaggagggaggaaacagcc

SEQ ID NO: 752358 - DNA, 20 bp, Artificial
  CRISPR gRNA sequence
gaggagggaggaaacagcct

SEQ ID NO: 752359 - DNA, 20 bp, Artificial
  CRISPR gRNA sequence
ctggggacagtcagggactt

SEQ ID NO: 752360 - DNA, 20 bp, Artificial
  CRISPR gRNA sequence
tggggacagtcagggacttc

SEQ ID NO: 752361 - DNA, 20 bp, Artificial
  CRISPR gRNA sequence
gggacagtcagggacttcct

SEQ ID NO: 752362 - DNA, 20 bp, Artificial
  CRISPR gRNA sequence
cctgaaggagggagagtctt

SEQ ID NO: 752363 - DNA, 20 bp, Artificial
  CRISPR gRNA sequence
ctgaaggagggagagtcttt

SEQ ID NO: 752364 - DNA, 20 bp, Artificial
  CRISPR gRNA sequence
aaggagggagagtctttgga

SEQ ID NO: 752365 - DNA, 20 bp, Artificial
  CRISPR gRNA sequence
tggacttggtgcatagatag

SEQ ID NO: 752366 - DNA, 20 bp, Artificial
  CRISPR gRNA sequence
ggacttggtgcatagatagg

SEQ ID NO: 752367 - DNA, 20 bp, Artificial
  CRISPR gRNA sequence
gacttggtgcatagatagga

SEQ ID NO: 752368 - DNA, 20 bp, Artificial
  CRISPR gRNA sequence
ggtgcatagataggatttca

SEQ ID NO: 752369 - DNA, 20 bp, Artificial
  CRISPR gRNA sequence
gtgcatagataggatttcag

SEQ ID NO: 752370 - DNA, 20 bp, Artificial
  CRISPR gRNA sequence
cagccagtagaaagggtgtc

SEQ ID NO: 752371 - DNA, 20 bp, Artificial
  CRISPR gRNA sequence
agccagtagaaagggtgtcc

SEQ ID NO: 752372 - DNA, 20 bp, Artificial
  CRISPR gRNA sequence
ggcaagatagtgtgaaaatg

SEQ ID NO: 752373 - DNA, 20 bp, Artificial
  CRISPR gRNA sequence
agggaccgggacagagagta

SEQ ID NO: 752374 - DNA, 20 bp, Artificial
  CRISPR gRNA sequence
atccatgcacgtccttccag

SEQ ID NO: 752375 - DNA, 20 bp, Artificial
  CRISPR gRNA sequence
ccagccaaacttagaaaact

SEQ ID NO: 752376 - DNA, 20 bp, Artificial
  CRISPR gRNA sequence
cagccaaacttagaaaactg

SEQ ID NO: 752377 - DNA, 20 bp, Artificial
  CRISPR gRNA sequence
agaaaactgtctagttctgt

SEQ ID NO: 752378 - DNA, 20 bp, Artificial
  CRISPR gRNA sequence
gaaaactgtctagttctgtt

SEQ ID NO: 752379 - DNA, 20 bp, Artificial
  CRISPR gRNA sequence
tctagttctgtttggttttt

SEQ ID NO: 752380 - DNA, 20 bp, Artificial
  CRISPR gRNA sequence
gttctgtttggtttttttca

SEQ ID NO: 752381 - DNA, 20 bp, Artificial
  CRISPR gRNA sequence
tgtttggtttttttcaccaa

SEQ ID NO: 752382 - DNA, 20 bp, Artificial
  CRISPR gRNA sequence
tttggtttttttcaccaagc

SEQ ID NO: 752383 - DNA, 20 bp, Artificial
  CRISPR gRNA sequence
ggtttttttcaccaagcaaa

SEQ ID NO: 752384 - DNA, 20 bp, Artificial
  CRISPR gRNA sequence
gtttttttcaccaagcaaat

SEQ ID NO: 752385 - DNA, 20 bp, Artificial
  CRISPR gRNA sequence
ttttcaccaagcaaatgaag

SEQ ID NO: 752386 - DNA, 20 bp, Artificial
  CRISPR gRNA sequence
tttcaccaagcaaatgaagc

SEQ ID NO: 752387 - DNA, 20 bp, Artificial
  CRISPR gRNA sequence
ttcaccaagcaaatgaagca

SEQ ID NO: 752388 - DNA, 20 bp, Artificial
  CRISPR gRNA sequence
tcaccaagcaaatgaagcaa

SEQ ID NO: 752389 - DNA, 20 bp, Artificial
  CRISPR gRNA sequence
caccaagcaaatgaagcaat

SEQ ID NO: 752390 - DNA, 20 bp, Artificial
  CRISPR gRNA sequence
accaagcaaatgaagcaatt

SEQ ID NO: 752391 - DNA, 20 bp, Artificial
  CRISPR gRNA sequence
cctggtccactttgccttat

SEQ ID NO: 752392 - DNA, 20 bp, Artificial
  CRISPR gRNA sequence
gtccactttgccttatccca

SEQ ID NO: 752393 - DNA, 20 bp, Artificial
  CRISPR gRNA sequence
tgccttatcccaatcctcca

SEQ ID NO: 752394 - DNA, 20 bp, Artificial
  CRISPR gRNA sequence
gccttatcccaatcctccag

SEQ ID NO: 752395 - DNA, 20 bp, Artificial
  CRISPR gRNA sequence
ccttatcccaatcctccagc

SEQ ID NO: 752396 - DNA, 20 bp, Artificial
  CRISPR gRNA sequence
atcccaatcctccagcattt

SEQ ID NO: 752397 - DNA, 20 bp, Artificial
  CRISPR gRNA sequence
tcccaatcctccagcattta

SEQ ID NO: 752398 - DNA, 20 bp, Artificial
  CRISPR gRNA sequence
cagcatttaattgggttgac

SEQ ID NO: 752399 - DNA, 20 bp, Artificial
  CRISPR gRNA sequence
aattgggttgaccctcaaaa

SEQ ID NO: 752400 - DNA, 20 bp, Artificial
  CRISPR gRNA sequence
attgggttgaccctcaaaac

SEQ ID NO: 752401 - DNA, 20 bp, Artificial
  CRISPR gRNA sequence
ggttgaccctcaaaaccatg

SEQ ID NO: 752402 - DNA, 20 bp, Artificial
  CRISPR gRNA sequence
accctcaaaaccatgagctt

SEQ ID NO: 752403 - DNA, 20 bp, Artificial
  CRISPR gRNA sequence
aaaaccatgagcttttgaaa

SEQ ID NO: 752404 - DNA, 20 bp, Artificial
  CRISPR gRNA sequence
ttgaaaacagaatattggat

SEQ ID NO: 752405 - DNA, 20 bp, Artificial
  CRISPR gRNA sequence
tgaaaacagaatattggata

SEQ ID NO: 752406 - DNA, 20 bp, Artificial
  CRISPR gRNA sequence
gaaaacagaatattggatag

SEQ ID NO: 752407 - DNA, 20 bp, Artificial
  CRISPR gRNA sequence
aaaacagaatattggataga

SEQ ID NO: 752408 - DNA, 20 bp, Artificial
  CRISPR gRNA sequence
gatagaggccgcgtttctat

SEQ ID NO: 752409 - DNA, 20 bp, Artificial
  CRISPR gRNA sequence
ctatctaactgtatgagcct

SEQ ID NO: 752410 - DNA, 20 bp, Artificial
  CRISPR gRNA sequence
tatctaactgtatgagcctc

SEQ ID NO: 752411 - DNA, 20 bp, Artificial
  CRISPR gRNA sequence
tctaactgtatgagcctcag

SEQ ID NO: 752412 - DNA, 20 bp, Artificial
  CRISPR gRNA sequence
actgtatgagcctcagtttc

SEQ ID NO: 752413 - DNA, 20 bp, Artificial
  CRISPR gRNA sequence
tatgagcctcagtttcctcc

SEQ ID NO: 752414 - DNA, 20 bp, Artificial
  CRISPR gRNA sequence
agtttcctcctctgtgcagt

SEQ ID NO: 752415 - DNA, 20 bp, Artificial
  CRISPR gRNA sequence
cctcctctgtgcagtgagaa

SEQ ID NO: 752416 - DNA, 20 bp, Artificial
  CRISPR gRNA sequence
ctcctctgtgcagtgagaaa

SEQ ID NO: 752417 - DNA, 20 bp, Artificial
  CRISPR gRNA sequence
ctctgtgcagtgagaaaact

SEQ ID NO: 752418 - DNA, 20 bp, Artificial
  CRISPR gRNA sequence
tgtgcagtgagaaaactatt

SEQ ID NO: 752419 - DNA, 20 bp, Artificial
  CRISPR gRNA sequence
tgcagtgagaaaactattgg

SEQ ID NO: 752420 - DNA, 20 bp, Artificial
  CRISPR gRNA sequence
ttggctacaatgcagggttg

SEQ ID NO: 752421 - DNA, 20 bp, Artificial
  CRISPR gRNA sequence
gctacaatgcagggttgcaa

SEQ ID NO: 752422 - DNA, 20 bp, Artificial
  CRISPR gRNA sequence
caatgcagggttgcaaaagg

SEQ ID NO: 752423 - DNA, 20 bp, Artificial
  CRISPR gRNA sequence
caaaaggactagatgaggga

SEQ ID NO: 752424 - DNA, 20 bp, Artificial
  CRISPR gRNA sequence
gatgagggaaagatgagaac

SEQ ID NO: 752425 - DNA, 20 bp, Artificial
  CRISPR gRNA sequence
taatgccctctgcagacatc

SEQ ID NO: 752426 - DNA, 20 bp, Artificial
  CRISPR gRNA sequence
atgccctctgcagacatctg

SEQ ID NO: 752427 - DNA, 20 bp, Artificial
  CRISPR gRNA sequence
tgcagacatctgagggatag

SEQ ID NO: 752428 - DNA, 20 bp, Artificial
  CRISPR gRNA sequence
cagacatctgagggatagct

SEQ ID NO: 752429 - DNA, 20 bp, Artificial
  CRISPR gRNA sequence
agggatagctataattatta

SEQ ID NO: 752430 - DNA, 20 bp, Artificial
  CRISPR gRNA sequence
taattattatgcgttggtgt

SEQ ID NO: 752431 - DNA, 20 bp, Artificial
  CRISPR gRNA sequence
ttatgcgttggtgttatttt

SEQ ID NO: 752432 - DNA, 20 bp, Artificial
  CRISPR gRNA sequence
tgcgttggtgttatttttat

SEQ ID NO: 752433 - DNA, 20 bp, Artificial
  CRISPR gRNA sequence
gtgttatttttatttattta

SEQ ID NO: 752434 - DNA, 20 bp, Artificial
  CRISPR gRNA sequence
tttttatttatttatttgtt

SEQ ID NO: 752435 - DNA, 20 bp, Artificial
  CRISPR gRNA sequence
ttatttatttatttgttttt

SEQ ID NO: 752436 - DNA, 20 bp, Artificial
  CRISPR gRNA sequence
tatttatttatttgtttttg

SEQ ID NO: 752437 - DNA, 20 bp, Artificial
  CRISPR gRNA sequence
atttatttatttgtttttga

SEQ ID NO: 752438 - DNA, 20 bp, Artificial
  CRISPR gRNA sequence
tttatttatttgtttttgag

SEQ ID NO: 752439 - DNA, 20 bp, Artificial
  CRISPR gRNA sequence
atttatttgtttttgagacg

SEQ ID NO: 752440 - DNA, 20 bp, Artificial
  CRISPR gRNA sequence
tttatttgtttttgagacgg

SEQ ID NO: 752441 - DNA, 20 bp, Artificial
  CRISPR gRNA sequence
atttgtttttgagacggagt

SEQ ID NO: 752442 - DNA, 20 bp, Artificial
  CRISPR gRNA sequence
tttgtttttgagacggagtc

SEQ ID NO: 752443 - DNA, 20 bp, Artificial
  CRISPR gRNA sequence
gtttttgagacggagtctcc

SEQ ID NO: 752444 - DNA, 20 bp, Artificial
  CRISPR gRNA sequence
tttttgagacggagtctccc

SEQ ID NO: 752445 - DNA, 20 bp, Artificial
  CRISPR gRNA sequence
ttgagacggagtctccctct

SEQ ID NO: 752446 - DNA, 20 bp, Artificial
  CRISPR gRNA sequence
tgagacggagtctccctctg

SEQ ID NO: 752447 - DNA, 20 bp, Artificial
  CRISPR gRNA sequence
gagacggagtctccctctgt

SEQ ID NO: 752448 - DNA, 20 bp, Artificial
  CRISPR gRNA sequence
agacggagtctccctctgtt

SEQ ID NO: 752449 - DNA, 20 bp, Artificial
  CRISPR gRNA sequence
cctctgttgcccaggctgac

SEQ ID NO: 752450 - DNA, 20 bp, Artificial
  CRISPR gRNA sequence
tgttgcccaggctgaccttg

SEQ ID NO: 752451 - DNA, 20 bp, Artificial
  CRISPR gRNA sequence
ttgcccaggctgaccttgaa

SEQ ID NO: 752452 - DNA, 20 bp, Artificial
  CRISPR gRNA sequence
cccaggctgaccttgaactc

SEQ ID NO: 752453 - DNA, 20 bp, Artificial
  CRISPR gRNA sequence
accttgaactcctggcttca

SEQ ID NO: 752454 - DNA, 20 bp, Artificial
  CRISPR gRNA sequence
gaactcctggcttcaagcaa

SEQ ID NO: 752455 - DNA, 20 bp, Artificial
  CRISPR gRNA sequence
aactcctggcttcaagcaat

SEQ ID NO: 752456 - DNA, 20 bp, Artificial
  CRISPR gRNA sequence
ctggcttcaagcaattctcc

SEQ ID NO: 752457 - DNA, 20 bp, Artificial
  CRISPR gRNA sequence
gcttcaagcaattctcctgc

SEQ ID NO: 752458 - DNA, 20 bp, Artificial
  CRISPR gRNA sequence
caagcaattctcctgccttg

SEQ ID NO: 752459 - DNA, 20 bp, Artificial
  CRISPR gRNA sequence
aagcaattctcctgccttgg

SEQ ID NO: 752460 - DNA, 20 bp, Artificial
  CRISPR gRNA sequence
tcctgccttggcctctcaaa

SEQ ID NO: 752461 - DNA, 20 bp, Artificial
  CRISPR gRNA sequence
ctgccttggcctctcaaagt

SEQ ID NO: 752462 - DNA, 20 bp, Artificial
  CRISPR gRNA sequence
ccttggcctctcaaagtctt

SEQ ID NO: 752463 - DNA, 20 bp, Artificial
  CRISPR gRNA sequence
ggcctctcaaagtcttggga

SEQ ID NO: 752464 - DNA, 20 bp, Artificial
  CRISPR gRNA sequence
gcctctcaaagtcttgggat

SEQ ID NO: 752465 - DNA, 20 bp, Artificial
  CRISPR gRNA sequence
tcaaagtcttgggattacaa

SEQ ID NO: 752466 - DNA, 20 bp, Artificial
  CRISPR gRNA sequence
aaagtcttgggattacaagt

SEQ ID NO: 752467 - DNA, 20 bp, Artificial
  CRISPR gRNA sequence
gggattacaagtgtgaccca

SEQ ID NO: 752468 - DNA, 20 bp, Artificial
  CRISPR gRNA sequence
ggattacaagtgtgacccac

SEQ ID NO: 752469 - DNA, 20 bp, Artificial
  CRISPR gRNA sequence
caagtgtgacccactacgcc

SEQ ID NO: 752470 - DNA, 20 bp, Artificial
  CRISPR gRNA sequence
cgcccggccagtggtatttt

SEQ ID NO: 752471 - DNA, 20 bp, Artificial
  CRISPR gRNA sequence
ttattttaaatggcatgtca

SEQ ID NO: 752472 - DNA, 20 bp, Artificial
  CRISPR gRNA sequence
tattttaaatggcatgtcag

SEQ ID NO: 752473 - DNA, 20 bp, Artificial
  CRISPR gRNA sequence
attttaaatggcatgtcagg

SEQ ID NO: 752474 - DNA, 20 bp, Artificial
  CRISPR gRNA sequence
ttttaaatggcatgtcaggc

SEQ ID NO: 752475 - DNA, 20 bp, Artificial
  CRISPR gRNA sequence
taaatggcatgtcaggctgt

SEQ ID NO: 752476 - DNA, 20 bp, Artificial
  CRISPR gRNA sequence
aaatggcatgtcaggctgtt

SEQ ID NO: 752477 - DNA, 20 bp, Artificial
  CRISPR gRNA sequence
aatggcatgtcaggctgttg

SEQ ID NO: 752478 - DNA, 20 bp, Artificial
  CRISPR gRNA sequence
ttgtgggtctagcagagagg

SEQ ID NO: 752479 - DNA, 20 bp, Artificial
  CRISPR gRNA sequence
tgggtctagcagagagggaa

SEQ ID NO: 752480 - DNA, 20 bp, Artificial
  CRISPR gRNA sequence
gcagagagggaaggagggtt

SEQ ID NO: 752481 - DNA, 20 bp, Artificial
  CRISPR gRNA sequence
gaactatgtacagaatccaa

SEQ ID NO: 752482 - DNA, 20 bp, Artificial
  CRISPR gRNA sequence
tgtacagaatccaaactgat

SEQ ID NO: 752483 - DNA, 20 bp, Artificial
  CRISPR gRNA sequence
atacatccttttcattgccc

SEQ ID NO: 752484 - DNA, 20 bp, Artificial
  CRISPR gRNA sequence
ttcattgccccagccagggg

SEQ ID NO: 752485 - DNA, 20 bp, Artificial
  CRISPR gRNA sequence
tcattgccccagccaggggc

SEQ ID NO: 752486 - DNA, 20 bp, Artificial
  CRISPR gRNA sequence
cattgccccagccaggggca

SEQ ID NO: 752487 - DNA, 20 bp, Artificial
  CRISPR gRNA sequence
attgccccagccaggggcat

SEQ ID NO: 752488 - DNA, 20 bp, Artificial
  CRISPR gRNA sequence
ccccagccaggggcattgcc

SEQ ID NO: 752489 - DNA, 20 bp, Artificial
  CRISPR gRNA sequence
cccagaaccaatataatgcc

SEQ ID NO: 752490 - DNA, 20 bp, Artificial
  CRISPR gRNA sequence
cttcagatgccccttccctg

SEQ ID NO: 752491 - DNA, 20 bp, Artificial
  CRISPR gRNA sequence
cagatgccccttccctgccc

SEQ ID NO: 752492 - DNA, 20 bp, Artificial
  CRISPR gRNA sequence
agatgccccttccctgccct

SEQ ID NO: 752493 - DNA, 20 bp, Artificial
  CRISPR gRNA sequence
ccctgcccttagagcccagg

SEQ ID NO: 752494 - DNA, 20 bp, Artificial
  CRISPR gRNA sequence
cctgcccttagagcccagga

SEQ ID NO: 752495 - DNA, 20 bp, Artificial
  CRISPR gRNA sequence
cccttagagcccaggaccct

SEQ ID NO: 752496 - DNA, 20 bp, Artificial
  CRISPR gRNA sequence
agagcccaggaccctcggcg

SEQ ID NO: 752497 - DNA, 20 bp, Artificial
  CRISPR gRNA sequence
gagcccaggaccctcggcgg

SEQ ID NO: 752498 - DNA, 20 bp, Artificial
  CRISPR gRNA sequence
ggcggcaggctgggacccac

SEQ ID NO: 752499 - DNA, 20 bp, Artificial
  CRISPR gRNA sequence
ggacccactggaagagctga

SEQ ID NO: 752500 - DNA, 20 bp, Artificial
  CRISPR gRNA sequence
gaagagctgaaagccttgcc

SEQ ID NO: 752501 - DNA, 20 bp, Artificial
  CRISPR gRNA sequence
aaagccttgcccagccagga

SEQ ID NO: 752502 - DNA, 20 bp, Artificial
  CRISPR gRNA sequence
gcccagccaggagggaggca

SEQ ID NO: 752503 - DNA, 20 bp, Artificial
  CRISPR gRNA sequence
cccagccaggagggaggcag

SEQ ID NO: 752504 - DNA, 20 bp, Artificial
  CRISPR gRNA sequence
gtggggcttctggagctggc

SEQ ID NO: 752505 - DNA, 20 bp, Artificial
  CRISPR gRNA sequence
ctggagctggccagcctgta

SEQ ID NO: 752506 - DNA, 20 bp, Artificial
  CRISPR gRNA sequence
tggagctggccagcctgtac

SEQ ID NO: 752507 - DNA, 20 bp, Artificial
  CRISPR gRNA sequence
gagctggccagcctgtactg

SEQ ID NO: 752508 - DNA, 20 bp, Artificial
  CRISPR gRNA sequence
gccagcctgtactggaccag

SEQ ID NO: 752509 - DNA, 20 bp, Artificial
  CRISPR gRNA sequence
tactggaccagtagctgtga

SEQ ID NO: 752510 - DNA, 20 bp, Artificial
  CRISPR gRNA sequence
gaccagtagctgtgagccac

SEQ ID NO: 752511 - DNA, 20 bp, Artificial
  CRISPR gRNA sequence
tgagccacttagacgctgag

SEQ ID NO: 752512 - DNA, 20 bp, Artificial
  CRISPR gRNA sequence
agacgctgagccccgactcc

SEQ ID NO: 752513 - DNA, 20 bp, Artificial
  CRISPR gRNA sequence
gacgctgagccccgactcct

SEQ ID NO: 752514 - DNA, 20 bp, Artificial
  CRISPR gRNA sequence
agccccgactcctcactcac

SEQ ID NO: 752515 - DNA, 20 bp, Artificial
  CRISPR gRNA sequence
ctcactcacagatgtttttc

SEQ ID NO: 752516 - DNA, 20 bp, Artificial
  CRISPR gRNA sequence
actcacagatgtttttccca

SEQ ID NO: 752517 - DNA, 20 bp, Artificial
  CRISPR gRNA sequence
acagatgtttttcccagaaa

SEQ ID NO: 752518 - DNA, 20 bp, Artificial
  CRISPR gRNA sequence
ttcccagaaatgaaaacatc

SEQ ID NO: 752519 - DNA, 20 bp, Artificial
  CRISPR gRNA sequence
tcccagaaatgaaaacatct

SEQ ID NO: 752520 - DNA, 20 bp, Artificial
  CRISPR gRNA sequence
cccagaaatgaaaacatctc

SEQ ID NO: 752521 - DNA, 20 bp, Artificial
  CRISPR gRNA sequence
ccagaaatgaaaacatctcc

SEQ ID NO: 752522 - DNA, 20 bp, Artificial
  CRISPR gRNA sequence
cctggcagagttgaggcaac

SEQ ID NO: 752523 - DNA, 20 bp, Artificial
  CRISPR gRNA sequence
gcagagttgaggcaacggtt

SEQ ID NO: 752524 - DNA, 20 bp, Artificial
  CRISPR gRNA sequence
aggcaacggttagtaataat

SEQ ID NO: 752525 - DNA, 20 bp, Artificial
  CRISPR gRNA sequence
gtaataattcacatgaagtg

SEQ ID NO: 752526 - DNA, 20 bp, Artificial
  CRISPR gRNA sequence
acatgaagtgttctgtaagt

SEQ ID NO: 752527 - DNA, 20 bp, Artificial
  CRISPR gRNA sequence
tgtaagtgccatgcgagtag

SEQ ID NO: 752528 - DNA, 20 bp, Artificial
  CRISPR gRNA sequence
taagtgccatgcgagtagtc

SEQ ID NO: 752529 - DNA, 20 bp, Artificial
  CRISPR gRNA sequence
ggtacttgggagctagacag

SEQ ID NO: 752530 - DNA, 20 bp, Artificial
  CRISPR gRNA sequence
gtacttgggagctagacagg

SEQ ID NO: 752531 - DNA, 20 bp, Artificial
  CRISPR gRNA sequence
gggagctagacaggtctcta

SEQ ID NO: 752532 - DNA, 20 bp, Artificial
  CRISPR gRNA sequence
ggagctagacaggtctctaa

SEQ ID NO: 752533 - DNA, 20 bp, Artificial
  CRISPR gRNA sequence
gacaggtctctaattcattc

SEQ ID NO: 752534 - DNA, 20 bp, Artificial
  CRISPR gRNA sequence
taattcattcagcaagtcaa

SEQ ID NO: 752535 - DNA, 20 bp, Artificial
  CRISPR gRNA sequence
attcattcagcaagtcaaga

SEQ ID NO: 752536 - DNA, 20 bp, Artificial
  CRISPR gRNA sequence
attcagcaagtcaagaagtg

SEQ ID NO: 752537 - DNA, 20 bp, Artificial
  CRISPR gRNA sequence
agcaagtcaagaagtgcctc

SEQ ID NO: 752538 - DNA, 20 bp, Artificial
  CRISPR gRNA sequence
ctaggagtgagaagcacagt

SEQ ID NO: 752539 - DNA, 20 bp, Artificial
  CRISPR gRNA sequence
ggagtgagaagcacagtggg

SEQ ID NO: 752540 - DNA, 20 bp, Artificial
  CRISPR gRNA sequence
taaagtctttcctgctaagg

SEQ ID NO: 752541 - DNA, 20 bp, Artificial
  CRISPR gRNA sequence
aaagtctttcctgctaaggt

SEQ ID NO: 752542 - DNA, 20 bp, Artificial
  CRISPR gRNA sequence
aagtctttcctgctaaggtg

SEQ ID NO: 752543 - DNA, 20 bp, Artificial
  CRISPR gRNA sequence
tcctgctaaggtgtgaatga

SEQ ID NO: 752544 - DNA, 20 bp, Artificial
  CRISPR gRNA sequence
cctgctaaggtgtgaatgac

SEQ ID NO: 752545 - DNA, 20 bp, Artificial
  CRISPR gRNA sequence
ctgctaaggtgtgaatgact

SEQ ID NO: 752546 - DNA, 20 bp, Artificial
  CRISPR gRNA sequence
ctaaggtgtgaatgactgat

SEQ ID NO: 752547 - DNA, 20 bp, Artificial
  CRISPR gRNA sequence
aggtgtgaatgactgataac

SEQ ID NO: 752548 - DNA, 20 bp, Artificial
  CRISPR gRNA sequence
ataacaacttgtgatccgat

SEQ ID NO: 752549 - DNA, 20 bp, Artificial
  CRISPR gRNA sequence
gtgatccgatcctggggcgc

SEQ ID NO: 752550 - DNA, 20 bp, Artificial
  CRISPR gRNA sequence
tgatccgatcctggggcgct

SEQ ID NO: 752551 - DNA, 20 bp, Artificial
  CRISPR gRNA sequence
gggcgcttgtgtttaaagga

SEQ ID NO: 752552 - DNA, 20 bp, Artificial
  CRISPR gRNA sequence
gtgtttaaaggagagtctcc

SEQ ID NO: 752553 - DNA, 20 bp, Artificial
  CRISPR gRNA sequence
tgtttaaaggagagtctcca

SEQ ID NO: 752554 - DNA, 20 bp, Artificial
  CRISPR gRNA sequence
aaaggagagtctccaaaggc

SEQ ID NO: 752555 - DNA, 20 bp, Artificial
  CRISPR gRNA sequence
aaggagagtctccaaaggca

SEQ ID NO: 752556 - DNA, 20 bp, Artificial
  CRISPR gRNA sequence
caaaggcaccaaagccccaa

SEQ ID NO: 752557 - DNA, 20 bp, Artificial
  CRISPR gRNA sequence
caagagtggagttttaggca

SEQ ID NO: 752558 - DNA, 20 bp, Artificial
  CRISPR gRNA sequence
taggcagagagccaagtctg

SEQ ID NO: 752559 - DNA, 20 bp, Artificial
  CRISPR gRNA sequence
aggcagagagccaagtctgg

SEQ ID NO: 752560 - DNA, 20 bp, Artificial
  CRISPR gRNA sequence
ggcagagagccaagtctggg

SEQ ID NO: 752561 - DNA, 20 bp, Artificial
  CRISPR gRNA sequence
ggagccccagatttttggag

SEQ ID NO: 752562 - DNA, 20 bp, Artificial
  CRISPR gRNA sequence
ttggagtcattgtcagggtg

SEQ ID NO: 752563 - DNA, 20 bp, Artificial
  CRISPR gRNA sequence
tggagtcattgtcagggtga

SEQ ID NO: 752564 - DNA, 20 bp, Artificial
  CRISPR gRNA sequence
ggagtcattgtcagggtgag

SEQ ID NO: 752565 - DNA, 20 bp, Artificial
  CRISPR gRNA sequence
gagtcattgtcagggtgagc

SEQ ID NO: 752566 - DNA, 20 bp, Artificial
  CRISPR gRNA sequence
tcagggtgagcagagatttc

SEQ ID NO: 752567 - DNA, 20 bp, Artificial
  CRISPR gRNA sequence
cagaacttctttggcaagat

SEQ ID NO: 752568 - DNA, 20 bp, Artificial
  CRISPR gRNA sequence
agaacttctttggcaagata

SEQ ID NO: 752569 - DNA, 20 bp, Artificial
  CRISPR gRNA sequence
ctttggcaagatacaggtct

SEQ ID NO: 752570 - DNA, 20 bp, Artificial
  CRISPR gRNA sequence
tttggcaagatacaggtctc

SEQ ID NO: 752571 - DNA, 20 bp, Artificial
  CRISPR gRNA sequence
tggcaagatacaggtctcct

SEQ ID NO: 752572 - DNA, 20 bp, Artificial
  CRISPR gRNA sequence
ggcaagatacaggtctcctt

SEQ ID NO: 752573 - DNA, 20 bp, Artificial
  CRISPR gRNA sequence
gcaagatacaggtctccttt

SEQ ID NO: 752574 - DNA, 20 bp, Artificial
  CRISPR gRNA sequence
cttttcaggcagaaacacag

SEQ ID NO: 752575 - DNA, 20 bp, Artificial
  CRISPR gRNA sequence
ttcaggcagaaacacagaga

SEQ ID NO: 752576 - DNA, 20 bp, Artificial
  CRISPR gRNA sequence
tcaggcagaaacacagagac

SEQ ID NO: 752577 - DNA, 20 bp, Artificial
  CRISPR gRNA sequence
caggcagaaacacagagacc

SEQ ID NO: 752578 - DNA, 20 bp, Artificial
  CRISPR gRNA sequence
aggcagaaacacagagaccc

SEQ ID NO: 752579 - DNA, 20 bp, Artificial
  CRISPR gRNA sequence
gactgaagttccaaagttcc

SEQ ID NO: 752580 - DNA, 20 bp, Artificial
  CRISPR gRNA sequence
aagttccaaagttccagagg

SEQ ID NO: 752581 - DNA, 20 bp, Artificial
  CRISPR gRNA sequence
caaagttccagagggtatga

SEQ ID NO: 752582 - DNA, 20 bp, Artificial
  CRISPR gRNA sequence
cagagggtatgatctcaaag

SEQ ID NO: 752583 - DNA, 20 bp, Artificial
  CRISPR gRNA sequence
aaagcctggagcatggggga

SEQ ID NO: 752584 - DNA, 20 bp, Artificial
  CRISPR gRNA sequence
gagcatgggggacttcaggt

SEQ ID NO: 752585 - DNA, 20 bp, Artificial
  CRISPR gRNA sequence
caggtaacgcaggatctagg

SEQ ID NO: 752586 - DNA, 20 bp, Artificial
  CRISPR gRNA sequence
aggtaacgcaggatctaggc

SEQ ID NO: 752587 - DNA, 20 bp, Artificial
  CRISPR gRNA sequence
ggcagaaccgtaataagaag

SEQ ID NO: 752588 - DNA, 20 bp, Artificial
  CRISPR gRNA sequence
tgcactacgctaagggtttc

SEQ ID NO: 752589 - DNA, 20 bp, Artificial
  CRISPR gRNA sequence
cgctaagggtttcatgggca

SEQ ID NO: 752590 - DNA, 20 bp, Artificial
  CRISPR gRNA sequence
agggtttcatgggcatatct

SEQ ID NO: 752591 - DNA, 20 bp, Artificial
  CRISPR gRNA sequence
catgggcatatctaacaatg

SEQ ID NO: 752592 - DNA, 20 bp, Artificial
  CRISPR gRNA sequence
atgggcatatctaacaatgc

SEQ ID NO: 752593 - DNA, 20 bp, Artificial
  CRISPR gRNA sequence
acaatgccataaggtattgt

SEQ ID NO: 752594 - DNA, 20 bp, Artificial
  CRISPR gRNA sequence
tttttattcccattgcactg

SEQ ID NO: 752595 - DNA, 20 bp, Artificial
  CRISPR gRNA sequence
ttattcccattgcactgatg

SEQ ID NO: 752596 - DNA, 20 bp, Artificial
  CRISPR gRNA sequence
tattcccattgcactgatga

SEQ ID NO: 752597 - DNA, 20 bp, Artificial
  CRISPR gRNA sequence
attcccattgcactgatgaa

SEQ ID NO: 752598 - DNA, 20 bp, Artificial
  CRISPR gRNA sequence
ttcccattgcactgatgaag

SEQ ID NO: 752599 - DNA, 20 bp, Artificial
  CRISPR gRNA sequence
ccattgcactgatgaagaaa

SEQ ID NO: 752600 - DNA, 20 bp, Artificial
  CRISPR gRNA sequence
cactgatgaagaaactaagg

SEQ ID NO: 752601 - DNA, 20 bp, Artificial
  CRISPR gRNA sequence
atgaagaaactaaggcacag

SEQ ID NO: 752602 - DNA, 20 bp, Artificial
  CRISPR gRNA sequence
aggcacagagaacttacgta

SEQ ID NO: 752603 - DNA, 20 bp, Artificial
  CRISPR gRNA sequence
acgtaactcactgatgatca

SEQ ID NO: 752604 - DNA, 20 bp, Artificial
  CRISPR gRNA sequence
cgtaactcactgatgatcac

SEQ ID NO: 752605 - DNA, 20 bp, Artificial
  CRISPR gRNA sequence
actgatgatcacacagcaag

SEQ ID NO: 752606 - DNA, 20 bp, Artificial
  CRISPR gRNA sequence
atgatcacacagcaagcaag

SEQ ID NO: 752607 - DNA, 20 bp, Artificial
  CRISPR gRNA sequence
gagctagaattaaactcaga

SEQ ID NO: 752608 - DNA, 20 bp, Artificial
  CRISPR gRNA sequence
gaattaaactcagacacata

SEQ ID NO: 752609 - DNA, 20 bp, Artificial
  CRISPR gRNA sequence
aactcagacacatagacact

SEQ ID NO: 752610 - DNA, 20 bp, Artificial
  CRISPR gRNA sequence
agacacatagacactatact

SEQ ID NO: 752611 - DNA, 20 bp, Artificial
  CRISPR gRNA sequence
tactgatgaaaaaaaaggcc

SEQ ID NO: 752612 - DNA, 20 bp, Artificial
  CRISPR gRNA sequence
atgaaaaaaaaggccagaaa

SEQ ID NO: 752613 - DNA, 20 bp, Artificial
  CRISPR gRNA sequence
ggagcccacaggccacatcc

SEQ ID NO: 752614 - DNA, 20 bp, Artificial
  CRISPR gRNA sequence
cacacatatttcattggatc

SEQ ID NO: 752615 - DNA, 20 bp, Artificial
  CRISPR gRNA sequence
acacatatttcattggatcc

SEQ ID NO: 752616 - DNA, 20 bp, Artificial
  CRISPR gRNA sequence
cattggatcctcaaaatctt

SEQ ID NO: 752617 - DNA, 20 bp, Artificial
  CRISPR gRNA sequence
attggatcctcaaaatcttt

SEQ ID NO: 752618 - DNA, 20 bp, Artificial
  CRISPR gRNA sequence
gatcctcaaaatctttttaa

SEQ ID NO: 752619 - DNA, 20 bp, Artificial
  CRISPR gRNA sequence
aaaatctttttaattttctt

SEQ ID NO: 752620 - DNA, 20 bp, Artificial
  CRISPR gRNA sequence
tttaattttcttgagatggc

SEQ ID NO: 752621 - DNA, 20 bp, Artificial
  CRISPR gRNA sequence
ttaattttcttgagatggca

SEQ ID NO: 752622 - DNA, 20 bp, Artificial
  CRISPR gRNA sequence
taattttcttgagatggcaa

SEQ ID NO: 752623 - DNA, 20 bp, Artificial
  CRISPR gRNA sequence
aattttcttgagatggcaac

SEQ ID NO: 752624 - DNA, 20 bp, Artificial
  CRISPR gRNA sequence
attttcttgagatggcaaca

SEQ ID NO: 752625 - DNA, 20 bp, Artificial
  CRISPR gRNA sequence
tcttgagatggcaacattta

SEQ ID NO: 752626 - DNA, 20 bp, Artificial
  CRISPR gRNA sequence
cttgagatggcaacatttaa

SEQ ID NO: 752627 - DNA, 20 bp, Artificial
  CRISPR gRNA sequence
ttgagatggcaacatttaaa

SEQ ID NO: 752628 - DNA, 20 bp, Artificial
  CRISPR gRNA sequence
gagatggcaacatttaaaaa

SEQ ID NO: 752629 - DNA, 20 bp, Artificial
  CRISPR gRNA sequence
agatggcaacatttaaaaac

SEQ ID NO: 752630 - DNA, 20 bp, Artificial
  CRISPR gRNA sequence
aaaaaccaggaatttgacat

SEQ ID NO: 752631 - DNA, 20 bp, Artificial
  CRISPR gRNA sequence
aaaaccaggaatttgacatg

SEQ ID NO: 752632 - DNA, 20 bp, Artificial
  CRISPR gRNA sequence
gacatgaaaattctgacttc

SEQ ID NO: 752633 - DNA, 20 bp, Artificial
  CRISPR gRNA sequence
acatgaaaattctgacttcc

SEQ ID NO: 752634 - DNA, 20 bp, Artificial
  CRISPR gRNA sequence
tgacttccagctctccttag

SEQ ID NO: 752635 - DNA, 20 bp, Artificial
  CRISPR gRNA sequence
acttccagctctccttagaa

SEQ ID NO: 752636 - DNA, 20 bp, Artificial
  CRISPR gRNA sequence
ccagctctccttagaaaatc

SEQ ID NO: 752637 - DNA, 20 bp, Artificial
  CRISPR gRNA sequence
cagctctccttagaaaatca

SEQ ID NO: 752638 - DNA, 20 bp, Artificial
  CRISPR gRNA sequence
tccttagaaaatcagaagat

SEQ ID NO: 752639 - DNA, 20 bp, Artificial
  CRISPR gRNA sequence
cttagaaaatcagaagataa

SEQ ID NO: 752640 - DNA, 20 bp, Artificial
  CRISPR gRNA sequence
agaaaatcagaagataatgc

SEQ ID NO: 752641 - DNA, 20 bp, Artificial
  CRISPR gRNA sequence
gaaaatcagaagataatgct

SEQ ID NO: 752642 - DNA, 20 bp, Artificial
  CRISPR gRNA sequence
aaccagctttcccacagggc

SEQ ID NO: 752643 - DNA, 20 bp, Artificial
  CRISPR gRNA sequence
tcccacagggcaactgtcag

SEQ ID NO: 752644 - DNA, 20 bp, Artificial
  CRISPR gRNA sequence
cccacagggcaactgtcagc

SEQ ID NO: 752645 - DNA, 20 bp, Artificial
  CRISPR gRNA sequence
ccacagggcaactgtcagct

SEQ ID NO: 752646 - DNA, 20 bp, Artificial
  CRISPR gRNA sequence
tcagctggggctcagtagca

SEQ ID NO: 752647 - DNA, 20 bp, Artificial
  CRISPR gRNA sequence
gggctcagtagcagcttttg

SEQ ID NO: 752648 - DNA, 20 bp, Artificial
  CRISPR gRNA sequence
agtagcagcttttggggggc

SEQ ID NO: 752649 - DNA, 20 bp, Artificial
  CRISPR gRNA sequence
ttggggggcaccggcactcc

SEQ ID NO: 752650 - DNA, 20 bp, Artificial
  CRISPR gRNA sequence
tggggggcaccggcactcca

SEQ ID NO: 752651 - DNA, 20 bp, Artificial
  CRISPR gRNA sequence
ggggggcaccggcactccag

SEQ ID NO: 752652 - DNA, 20 bp, Artificial
  CRISPR gRNA sequence
gggggcaccggcactccagt

SEQ ID NO: 752653 - DNA, 20 bp, Artificial
  CRISPR gRNA sequence
cagttcgccagagtccgtcc

SEQ ID NO: 752654 - DNA, 20 bp, Artificial
  CRISPR gRNA sequence
gccagagtccgtccgtacta

SEQ ID NO: 752655 - DNA, 20 bp, Artificial
  CRISPR gRNA sequence
ctccctaataattccacctg

SEQ ID NO: 752656 - DNA, 20 bp, Artificial
  CRISPR gRNA sequence
cctaataattccacctggcc

SEQ ID NO: 752657 - DNA, 20 bp, Artificial
  CRISPR gRNA sequence
ataattccacctggcctgct

SEQ ID NO: 752658 - DNA, 20 bp, Artificial
  CRISPR gRNA sequence
cacctggcctgcttcactct

SEQ ID NO: 752659 - DNA, 20 bp, Artificial
  CRISPR gRNA sequence
gcctgcttcactctctcacc

SEQ ID NO: 752660 - DNA, 20 bp, Artificial
  CRISPR gRNA sequence
cttcactctctcaccgtggt

SEQ ID NO: 752661 - DNA, 20 bp, Artificial
  CRISPR gRNA sequence
cactctctcaccgtggtttc

SEQ ID NO: 752662 - DNA, 20 bp, Artificial
  CRISPR gRNA sequence
actctctcaccgtggtttct

SEQ ID NO: 752663 - DNA, 20 bp, Artificial
  CRISPR gRNA sequence
tctcaccgtggtttcttggt

SEQ ID NO: 752664 - DNA, 20 bp, Artificial
  CRISPR gRNA sequence
tcaccgtggtttcttggtcc

SEQ ID NO: 752665 - DNA, 20 bp, Artificial
  CRISPR gRNA sequence
accgtggtttcttggtcctg

SEQ ID NO: 752666 - DNA, 20 bp, Artificial
  CRISPR gRNA sequence
cttggtcctgtggacatttg

SEQ ID NO: 752667 - DNA, 20 bp, Artificial
  CRISPR gRNA sequence
ttggtcctgtggacatttga

SEQ ID NO: 752668 - DNA, 20 bp, Artificial
  CRISPR gRNA sequence
ggtcctgtggacatttgagt

SEQ ID NO: 752669 - DNA, 20 bp, Artificial
  CRISPR gRNA sequence
gtcctgtggacatttgagtt

SEQ ID NO: 752670 - DNA, 20 bp, Artificial
  CRISPR gRNA sequence
tggacatttgagtttgtgat

SEQ ID NO: 752671 - DNA, 20 bp, Artificial
  CRISPR gRNA sequence
gagtttgtgatgaatgagtg

SEQ ID NO: 752672 - DNA, 20 bp, Artificial
  CRISPR gRNA sequence
agtttgtgatgaatgagtgt

SEQ ID NO: 752673 - DNA, 20 bp, Artificial
  CRISPR gRNA sequence
gtgatgaatgagtgtggctt

SEQ ID NO: 752674 - DNA, 20 bp, Artificial
  CRISPR gRNA sequence
tgatgaatgagtgtggcttc

SEQ ID NO: 752675 - DNA, 20 bp, Artificial
  CRISPR gRNA sequence
cttgggctagctggcatggg

SEQ ID NO: 752676 - DNA, 20 bp, Artificial
  CRISPR gRNA sequence
ttgggctagctggcatggga

SEQ ID NO: 752677 - DNA, 20 bp, Artificial
  CRISPR gRNA sequence
gggctagctggcatgggact

SEQ ID NO: 752678 - DNA, 20 bp, Artificial
  CRISPR gRNA sequence
ggctagctggcatgggactc

SEQ ID NO: 752679 - DNA, 20 bp, Artificial
  CRISPR gRNA sequence
gctggcatgggactctactg

SEQ ID NO: 752680 - DNA, 20 bp, Artificial
  CRISPR gRNA sequence
gcatgggactctactgccca

SEQ ID NO: 752681 - DNA, 20 bp, Artificial
  CRISPR gRNA sequence
tactgcccaaacccattatg

SEQ ID NO: 752682 - DNA, 20 bp, Artificial
  CRISPR gRNA sequence
ctgcccaaacccattatgct

SEQ ID NO: 752683 - DNA, 20 bp, Artificial
  CRISPR gRNA sequence
cccaaacccattatgctaca

SEQ ID NO: 752684 - DNA, 20 bp, Artificial
  CRISPR gRNA sequence
tgctacaaatctgacccaca

SEQ ID NO: 752685 - DNA, 20 bp, Artificial
  CRISPR gRNA sequence
caaatctgacccacagactc

SEQ ID NO: 752686 - DNA, 20 bp, Artificial
  CRISPR gRNA sequence
acccacagactcaagagagg

SEQ ID NO: 752687 - DNA, 20 bp, Artificial
  CRISPR gRNA sequence
aagagaggagatgatccacc

SEQ ID NO: 752688 - DNA, 20 bp, Artificial
  CRISPR gRNA sequence
gcagtgcagggactagccaa

SEQ ID NO: 752689 - DNA, 20 bp, Artificial
  CRISPR gRNA sequence
gccaactctcctctgctaac

SEQ ID NO: 752690 - DNA, 20 bp, Artificial
  CRISPR gRNA sequence
tcctctgctaacccactgcc

SEQ ID NO: 752691 - DNA, 20 bp, Artificial
  CRISPR gRNA sequence
ctctgctaacccactgccct

SEQ ID NO: 752692 - DNA, 20 bp, Artificial
  CRISPR gRNA sequence
tgctaacccactgcccttac

SEQ ID NO: 752693 - DNA, 20 bp, Artificial
  CRISPR gRNA sequence
ctaacccactgcccttaccc

SEQ ID NO: 752694 - DNA, 20 bp, Artificial
  CRISPR gRNA sequence
acccactgcccttacccctg

SEQ ID NO: 752695 - DNA, 20 bp, Artificial
  CRISPR gRNA sequence
cccttacccctgcagcaggc

SEQ ID NO: 752696 - DNA, 20 bp, Artificial
  CRISPR gRNA sequence
acccctgcagcaggctcagt

SEQ ID NO: 752697 - DNA, 20 bp, Artificial
  CRISPR gRNA sequence
cccctgcagcaggctcagtg

SEQ ID NO: 752698 - DNA, 20 bp, Artificial
  CRISPR gRNA sequence
cagcaggctcagtggaaaag

SEQ ID NO: 752699 - DNA, 20 bp, Artificial
  CRISPR gRNA sequence
agtggaaaaggagccccagg

SEQ ID NO: 752700 - DNA, 20 bp, Artificial
  CRISPR gRNA sequence
ggctgtgcccctggttttgt

SEQ ID NO: 752701 - DNA, 20 bp, Artificial
  CRISPR gRNA sequence
gctgtgcccctggttttgtc

SEQ ID NO: 752702 - DNA, 20 bp, Artificial
  CRISPR gRNA sequence
tgcccctggttttgtccgtg

SEQ ID NO: 752703 - DNA, 20 bp, Artificial
  CRISPR gRNA sequence
gttttgtccgtgctggcctg

SEQ ID NO: 752704 - DNA, 20 bp, Artificial
  CRISPR gRNA sequence
tgtccgtgctggcctggact

SEQ ID NO: 752705 - DNA, 20 bp, Artificial
  CRISPR gRNA sequence
gtccgtgctggcctggactt

SEQ ID NO: 752706 - DNA, 20 bp, Artificial
  CRISPR gRNA sequence
tccgtgctggcctggacttc

SEQ ID NO: 752707 - DNA, 20 bp, Artificial
  CRISPR gRNA sequence
gcctggacttccccttcaca

SEQ ID NO: 752708 - DNA, 20 bp, Artificial
  CRISPR gRNA sequence
gacttccccttcacacctga

SEQ ID NO: 752709 - DNA, 20 bp, Artificial
  CRISPR gRNA sequence
ccccttcacacctgagtggg

SEQ ID NO: 752710 - DNA, 20 bp, Artificial
  CRISPR gRNA sequence
cccttcacacctgagtgggg

SEQ ID NO: 752711 - DNA, 20 bp, Artificial
  CRISPR gRNA sequence
cacacctgagtggggtgggt

SEQ ID NO: 752712 - DNA, 20 bp, Artificial
  CRISPR gRNA sequence
acacctgagtggggtgggtg

SEQ ID NO: 752713 - DNA, 20 bp, Artificial
  CRISPR gRNA sequence
agtggggtgggtgtagctgc

SEQ ID NO: 752714 - DNA, 20 bp, Artificial
  CRISPR gRNA sequence
caaaactatggctctgccgg

SEQ ID NO: 752715 - DNA, 20 bp, Artificial
  CRISPR gRNA sequence
tggctctgccgggaaacaga

SEQ ID NO: 752716 - DNA, 20 bp, Artificial
  CRISPR gRNA sequence
tgccgggaaacagaagtgag

SEQ ID NO: 752717 - DNA, 20 bp, Artificial
  CRISPR gRNA sequence
ccgggaaacagaagtgagga

SEQ ID NO: 752718 - DNA, 20 bp, Artificial
  CRISPR gRNA sequence
gggaaagggctctcccacgt

SEQ ID NO: 752719 - DNA, 20 bp, Artificial
  CRISPR gRNA sequence
tcccacgtactcccaggaag

SEQ ID NO: 752720 - DNA, 20 bp, Artificial
  CRISPR gRNA sequence
ccacgtactcccaggaagaa

SEQ ID NO: 752721 - DNA, 20 bp, Artificial
  CRISPR gRNA sequence
ccaggaagaaacaaaacctg

SEQ ID NO: 752722 - DNA, 20 bp, Artificial
  CRISPR gRNA sequence
ccccaagggggccctgtgct

SEQ ID NO: 752723 - DNA, 20 bp, Artificial
  CRISPR gRNA sequence
tgctgcccccttccccagca

SEQ ID NO: 752724 - DNA, 20 bp, Artificial
  CRISPR gRNA sequence
cccccttccccagcaggcca

SEQ ID NO: 752725 - DNA, 20 bp, Artificial
  CRISPR gRNA sequence
ccccagcaggccatgtggca

SEQ ID NO: 752726 - DNA, 20 bp, Artificial
  CRISPR gRNA sequence
cccagcaggccatgtggcag

SEQ ID NO: 752727 - DNA, 20 bp, Artificial
  CRISPR gRNA sequence
tcccagcttctgcccctttc

SEQ ID NO: 752728 - DNA, 20 bp, Artificial
  CRISPR gRNA sequence
ccagcttctgcccctttctc

SEQ ID NO: 752729 - DNA, 20 bp, Artificial
  CRISPR gRNA sequence
ctgcccctttctccctttgc

SEQ ID NO: 752730 - DNA, 20 bp, Artificial
  CRISPR gRNA sequence
tgcccctttctccctttgcc

SEQ ID NO: 752731 - DNA, 20 bp, Artificial
  CRISPR gRNA sequence
cccctttctccctttgcctg

SEQ ID NO: 752732 - DNA, 20 bp, Artificial
  CRISPR gRNA sequence
tctccctttgcctgacatca

SEQ ID NO: 752733 - DNA, 20 bp, Artificial
  CRISPR gRNA sequence
ctccctttgcctgacatcac

SEQ ID NO: 752734 - DNA, 20 bp, Artificial
  CRISPR gRNA sequence
tccctttgcctgacatcacc

SEQ ID NO: 752735 - DNA, 20 bp, Artificial
  CRISPR gRNA sequence
cctttgcctgacatcacctc

SEQ ID NO: 752736 - DNA, 20 bp, Artificial
  CRISPR gRNA sequence
tgcctgacatcacctcctac

SEQ ID NO: 752737 - DNA, 20 bp, Artificial
  CRISPR gRNA sequence
gcctgacatcacctcctacc

SEQ ID NO: 752738 - DNA, 20 bp, Artificial
  CRISPR gRNA sequence
cctgacatcacctcctaccc

SEQ ID NO: 752739 - DNA, 20 bp, Artificial
  CRISPR gRNA sequence
acatcacctcctaccccaga

SEQ ID NO: 752740 - DNA, 20 bp, Artificial
  CRISPR gRNA sequence
ctaccccagagccaccccag

SEQ ID NO: 752741 - DNA, 20 bp, Artificial
  CRISPR gRNA sequence
ccccagagccaccccagggc

SEQ ID NO: 752742 - DNA, 20 bp, Artificial
  CRISPR gRNA sequence
ggagctgaattcagctccag

SEQ ID NO: 752743 - DNA, 20 bp, Artificial
  CRISPR gRNA sequence
aattcagctccagcttcagc

SEQ ID NO: 752744 - DNA, 20 bp, Artificial
  CRISPR gRNA sequence
agctccagcttcagctacgg

SEQ ID NO: 752745 - DNA, 20 bp, Artificial
  CRISPR gRNA sequence
cagcttcagctacggtagta

SEQ ID NO: 752746 - DNA, 20 bp, Artificial
  CRISPR gRNA sequence
cagctacggtagtatttacc

SEQ ID NO: 752747 - DNA, 20 bp, Artificial
  CRISPR gRNA sequence
agctacggtagtatttacca

SEQ ID NO: 752748 - DNA, 20 bp, Artificial
  CRISPR gRNA sequence
cggtagtatttaccaccagc

SEQ ID NO: 752749 - DNA, 20 bp, Artificial
  CRISPR gRNA sequence
accaccagcacacatacctt

SEQ ID NO: 752750 - DNA, 20 bp, Artificial
  CRISPR gRNA sequence
ccaccagcacacataccttg

SEQ ID NO: 752751 - DNA, 20 bp, Artificial
  CRISPR gRNA sequence
gggggctggccaaagggctg

SEQ ID NO: 752752 - DNA, 20 bp, Artificial
  CRISPR gRNA sequence
ggggctggccaaagggctgg

SEQ ID NO: 752753 - DNA, 20 bp, Artificial
  CRISPR gRNA sequence
gccaaagggctggctcagca

SEQ ID NO: 752754 - DNA, 20 bp, Artificial
  CRISPR gRNA sequence
gctcagcagacacggggctg

SEQ ID NO: 752755 - DNA, 20 bp, Artificial
  CRISPR gRNA sequence
agcagacacggggctgcagg

SEQ ID NO: 752756 - DNA, 20 bp, Artificial
  CRISPR gRNA sequence
caggccagaggagggtatgg

SEQ ID NO: 752757 - DNA, 20 bp, Artificial
  CRISPR gRNA sequence
gcagccaaagcaagatgcgc

SEQ ID NO: 752758 - DNA, 20 bp, Artificial
  CRISPR gRNA sequence
agctgggtggggttgggggc

SEQ ID NO: 752759 - DNA, 20 bp, Artificial
  CRISPR gRNA sequence
ggtggggttgggggccctca

SEQ ID NO: 752760 - DNA, 20 bp, Artificial
  CRISPR gRNA sequence
ggggccctcaagtggacaga

SEQ ID NO: 752761 - DNA, 20 bp, Artificial
  CRISPR gRNA sequence
aagtggacagaggtgtggac

SEQ ID NO: 752762 - DNA, 20 bp, Artificial
  CRISPR gRNA sequence
gcgtggttgttggcctgagt

SEQ ID NO: 752763 - DNA, 20 bp, Artificial
  CRISPR gRNA sequence
ttggcctgagtgtccctgtg

SEQ ID NO: 752764 - DNA, 20 bp, Artificial
  CRISPR gRNA sequence
gcctgagtgtccctgtgaac

SEQ ID NO: 752765 - DNA, 20 bp, Artificial
  CRISPR gRNA sequence
agtgtccctgtgaacaaggt

SEQ ID NO: 752766 - DNA, 20 bp, Artificial
  CRISPR gRNA sequence
tgaacaaggtggggcagggc

SEQ ID NO: 752767 - DNA, 20 bp, Artificial
  CRISPR gRNA sequence
ggagccctcagggtctaagc

SEQ ID NO: 752768 - DNA, 20 bp, Artificial
  CRISPR gRNA sequence
agggtctaagcaatggggtt

SEQ ID NO: 752769 - DNA, 20 bp, Artificial
  CRISPR gRNA sequence
agcaatggggttaatgaccc

SEQ ID NO: 752770 - DNA, 20 bp, Artificial
  CRISPR gRNA sequence
atgaccccaggattgtaccc

SEQ ID NO: 752771 - DNA, 20 bp, Artificial
  CRISPR gRNA sequence
tacccatagcacccgcagca

SEQ ID NO: 752772 - DNA, 20 bp, Artificial
  CRISPR gRNA sequence
tcccctggaggcaacttcct

SEQ ID NO: 752773 - DNA, 20 bp, Artificial
  CRISPR gRNA sequence
ccctggaggcaacttccttg

SEQ ID NO: 752774 - DNA, 20 bp, Artificial
  CRISPR gRNA sequence
gaggcaacttccttgagatg

SEQ ID NO: 752775 - DNA, 20 bp, Artificial
  CRISPR gRNA sequence
ccttgagatgcacggcgggt

SEQ ID NO: 752776 - DNA, 20 bp, Artificial
  CRISPR gRNA sequence
cttgagatgcacggcgggtg

SEQ ID NO: 752777 - DNA, 20 bp, Artificial
  CRISPR gRNA sequence
gagatgcacggcgggtgggt

SEQ ID NO: 752778 - DNA, 20 bp, Artificial
  CRISPR gRNA sequence
agatgcacggcgggtgggtg

SEQ ID NO: 752779 - DNA, 20 bp, Artificial
  CRISPR gRNA sequence
agggagtacgggagaggggg

SEQ ID NO: 752780 - DNA, 20 bp, Artificial
  CRISPR gRNA sequence
ctcaatcccccacacctccc

SEQ ID NO: 752781 - DNA, 20 bp, Artificial
  CRISPR gRNA sequence
aatcccccacacctccccac

SEQ ID NO: 752782 - DNA, 20 bp, Artificial
  CRISPR gRNA sequence
cccacccctcacacactggc

SEQ ID NO: 752783 - DNA, 20 bp, Artificial
  CRISPR gRNA sequence
acacactggccacccatccc

SEQ ID NO: 752784 - DNA, 20 bp, Artificial
  CRISPR gRNA sequence
gccacccatcccacaggtcc

SEQ ID NO: 752785 - DNA, 20 bp, Artificial
  CRISPR gRNA sequence
ttccccttttagaaaaaagc

SEQ ID NO: 752786 - DNA, 20 bp, Artificial
  CRISPR gRNA sequence
cccttttagaaaaaagctgt

SEQ ID NO: 752787 - DNA, 20 bp, Artificial
  CRISPR gRNA sequence
ttagaaaaaagctgtcttag

SEQ ID NO: 752788 - DNA, 20 bp, Artificial
  CRISPR gRNA sequence
tagaaaaaagctgtcttagg

SEQ ID NO: 752789 - DNA, 20 bp, Artificial
  CRISPR gRNA sequence
agaaaaaagctgtcttagga

SEQ ID NO: 752790 - DNA, 20 bp, Artificial
  CRISPR gRNA sequence
gaaaaaagctgtcttaggat

SEQ ID NO: 752791 - DNA, 20 bp, Artificial
  CRISPR gRNA sequence
tcttaggattcaagtttggg

SEQ ID NO: 752792 - DNA, 20 bp, Artificial
  CRISPR gRNA sequence
aggattcaagtttggggagc

SEQ ID NO: 752793 - DNA, 20 bp, Artificial
  CRISPR gRNA sequence
ggattcaagtttggggagca

SEQ ID NO: 752794 - DNA, 20 bp, Artificial
  CRISPR gRNA sequence
aagtttggggagcaggggag

SEQ ID NO: 752795 - DNA, 20 bp, Artificial
  CRISPR gRNA sequence
ggggagcaggggaggatgtt

SEQ ID NO: 752796 - DNA, 20 bp, Artificial
  CRISPR gRNA sequence
gggagcaggggaggatgttc

SEQ ID NO: 752797 - DNA, 20 bp, Artificial
  CRISPR gRNA sequence
agttttcaagcaagagggcc

SEQ ID NO: 752798 - DNA, 20 bp, Artificial
  CRISPR gRNA sequence
tcaagcaagagggccagaca

SEQ ID NO: 752799 - DNA, 20 bp, Artificial
  CRISPR gRNA sequence
caagcaagagggccagacag

SEQ ID NO: 752800 - DNA, 20 bp, Artificial
  CRISPR gRNA sequence
aagcaagagggccagacagg

SEQ ID NO: 752801 - DNA, 20 bp, Artificial
  CRISPR gRNA sequence
gtcctggggagggagggaag

SEQ ID NO: 752802 - DNA, 20 bp, Artificial
  CRISPR gRNA sequence
tcctggggagggagggaagg

SEQ ID NO: 752803 - DNA, 20 bp, Artificial
  CRISPR gRNA sequence
gggagggagggaaggccaga

SEQ ID NO: 752804 - DNA, 20 bp, Artificial
  CRISPR gRNA sequence
actgtgtctgagactccagc

SEQ ID NO: 752805 - DNA, 20 bp, Artificial
  CRISPR gRNA sequence
ctgtgtctgagactccagct

SEQ ID NO: 752806 - DNA, 20 bp, Artificial
  CRISPR gRNA sequence
tgtctgagactccagctggg

SEQ ID NO: 752807 - DNA, 20 bp, Artificial
  CRISPR gRNA sequence
agactccagctgggacaagg

SEQ ID NO: 752808 - DNA, 20 bp, Artificial
  CRISPR gRNA sequence
cagctgggacaaggcccaca

SEQ ID NO: 752809 - DNA, 20 bp, Artificial
  CRISPR gRNA sequence
ggacaaggcccacagcagcc

SEQ ID NO: 752810 - DNA, 20 bp, Artificial
  CRISPR gRNA sequence
tcgttaggaggacactcgaa

SEQ ID NO: 752811 - DNA, 20 bp, Artificial
  CRISPR gRNA sequence
ggaggacactcgaaggcatg

SEQ ID NO: 752812 - DNA, 20 bp, Artificial
  CRISPR gRNA sequence
gaaggcatggcatgggggag

SEQ ID NO: 752813 - DNA, 20 bp, Artificial
  CRISPR gRNA sequence
cacgtgccccgcggactcca

SEQ ID NO: 752814 - DNA, 20 bp, Artificial
  CRISPR gRNA sequence
cacatctgtgcacatgcctg

SEQ ID NO: 752815 - DNA, 20 bp, Artificial
  CRISPR gRNA sequence
tgcacatgcctgtgtgttgt

SEQ ID NO: 752816 - DNA, 20 bp, Artificial
  CRISPR gRNA sequence
tgtgttgtcagggaagctgt

SEQ ID NO: 752817 - DNA, 20 bp, Artificial
  CRISPR gRNA sequence
tcagggaagctgtgcagccc

SEQ ID NO: 752818 - DNA, 20 bp, Artificial
  CRISPR gRNA sequence
tgcagcccggctaaaattac

SEQ ID NO: 752819 - DNA, 20 bp, Artificial
  CRISPR gRNA sequence
aaattacaattctttggcga

SEQ ID NO: 752820 - DNA, 20 bp, Artificial
  CRISPR gRNA sequence
caattctttggcgagaggat

SEQ ID NO: 752821 - DNA, 20 bp, Artificial
  CRISPR gRNA sequence
tttggcgagaggatgttgct

SEQ ID NO: 752822 - DNA, 20 bp, Artificial
  CRISPR gRNA sequence
tggcgagaggatgttgctta

SEQ ID NO: 752823 - DNA, 20 bp, Artificial
  CRISPR gRNA sequence
ggcgagaggatgttgcttat

SEQ ID NO: 752824 - DNA, 20 bp, Artificial
  CRISPR gRNA sequence
gcgagaggatgttgcttatt

SEQ ID NO: 752825 - DNA, 20 bp, Artificial
  CRISPR gRNA sequence
cttattgtcaggagcagatc

SEQ ID NO: 752826 - DNA, 20 bp, Artificial
  CRISPR gRNA sequence
attgtcaggagcagatcctt

SEQ ID NO: 752827 - DNA, 20 bp, Artificial
  CRISPR gRNA sequence
ttgtcaggagcagatccttt

SEQ ID NO: 752828 - DNA, 20 bp, Artificial
  CRISPR gRNA sequence
tcaggagcagatccttttgg

SEQ ID NO: 752829 - DNA, 20 bp, Artificial
  CRISPR gRNA sequence
ttggacacctgggtcattgt

SEQ ID NO: 752830 - DNA, 20 bp, Artificial
  CRISPR gRNA sequence
tggacacctgggtcattgtc

SEQ ID NO: 752831 - DNA, 20 bp, Artificial
  CRISPR gRNA sequence
ggacacctgggtcattgtcg

SEQ ID NO: 752832 - DNA, 20 bp, Artificial
  CRISPR gRNA sequence
gacacctgggtcattgtcgg

SEQ ID NO: 752833 - DNA, 20 bp, Artificial
  CRISPR gRNA sequence
ggtcattgtcggagaccggg

SEQ ID NO: 752834 - DNA, 20 bp, Artificial
  CRISPR gRNA sequence
tcggagaccgggaaaagtgg

SEQ ID NO: 752835 - DNA, 20 bp, Artificial
  CRISPR gRNA sequence
gctccagggtggccaaaagc

SEQ ID NO: 752836 - DNA, 20 bp, Artificial
  CRISPR gRNA sequence
cagggtggccaaaagcatgt

SEQ ID NO: 752837 - DNA, 20 bp, Artificial
  CRISPR gRNA sequence
ggcctgagcatgtgccaggc

SEQ ID NO: 752838 - DNA, 20 bp, Artificial
  CRISPR gRNA sequence
agcatgtgccaggcgggaac

SEQ ID NO: 752839 - DNA, 20 bp, Artificial
  CRISPR gRNA sequence
ccgtgctgctgtcaagaccc

SEQ ID NO: 752840 - DNA, 20 bp, Artificial
  CRISPR gRNA sequence
ctgtcaagacccaggccccc

SEQ ID NO: 752841 - DNA, 20 bp, Artificial
  CRISPR gRNA sequence
tcaagacccaggccccccgc

SEQ ID NO: 752842 - DNA, 20 bp, Artificial
  CRISPR gRNA sequence
ccaccaggtaaggaggcagg

SEQ ID NO: 752843 - DNA, 20 bp, Artificial
  CRISPR gRNA sequence
gaggaagagtgccgtgaacc

SEQ ID NO: 752844 - DNA, 20 bp, Artificial
  CRISPR gRNA sequence
ggaaagcctgagtctcagga

SEQ ID NO: 752845 - DNA, 20 bp, Artificial
  CRISPR gRNA sequence
agtctcaggagtaaaactct

SEQ ID NO: 752846 - DNA, 20 bp, Artificial
  CRISPR gRNA sequence
aggagtaaaactctcgcttg

SEQ ID NO: 752847 - DNA, 20 bp, Artificial
  CRISPR gRNA sequence
tcgcttggattgcaacgtcc

SEQ ID NO: 752848 - DNA, 20 bp, Artificial
  CRISPR gRNA sequence
gcttggattgcaacgtcctg

SEQ ID NO: 752849 - DNA, 20 bp, Artificial
  CRISPR gRNA sequence
ggattgcaacgtcctggggc

SEQ ID NO: 752850 - DNA, 20 bp, Artificial
  CRISPR gRNA sequence
gattgcaacgtcctggggcc

SEQ ID NO: 752851 - DNA, 20 bp, Artificial
  CRISPR gRNA sequence
caacgtcctggggcctcagt

SEQ ID NO: 752852 - DNA, 20 bp, Artificial
  CRISPR gRNA sequence
gggcctcagtgtccacttag

SEQ ID NO: 752853 - DNA, 20 bp, Artificial
  CRISPR gRNA sequence
agtgtccacttagttgtgcc

SEQ ID NO: 752854 - DNA, 20 bp, Artificial
  CRISPR gRNA sequence
agttgtgccctcattgtgtg

SEQ ID NO: 752855 - DNA, 20 bp, Artificial
  CRISPR gRNA sequence
gttgtgccctcattgtgtgc

SEQ ID NO: 752856 - DNA, 20 bp, Artificial
  CRISPR gRNA sequence
tgccctcattgtgtgccctt

SEQ ID NO: 752857 - DNA, 20 bp, Artificial
  CRISPR gRNA sequence
attgtgtgcccttgggcaga

SEQ ID NO: 752858 - DNA, 20 bp, Artificial
  CRISPR gRNA sequence
tgtgcccttgggcagatccc

SEQ ID NO: 752859 - DNA, 20 bp, Artificial
  CRISPR gRNA sequence
gggcagatcccacccttctc

SEQ ID NO: 752860 - DNA, 20 bp, Artificial
  CRISPR gRNA sequence
ggcagatcccacccttctct

SEQ ID NO: 752861 - DNA, 20 bp, Artificial
  CRISPR gRNA sequence
ctctgagcctccgtttcttc

SEQ ID NO: 752862 - DNA, 20 bp, Artificial
  CRISPR gRNA sequence
tctgagcctccgtttcttca

SEQ ID NO: 752863 - DNA, 20 bp, Artificial
  CRISPR gRNA sequence
tgagcctccgtttcttcatc

SEQ ID NO: 752864 - DNA, 20 bp, Artificial
  CRISPR gRNA sequence
agcctccgtttcttcatctt

SEQ ID NO: 752865 - DNA, 20 bp, Artificial
  CRISPR gRNA sequence
cgtttcttcatcttaacctg

SEQ ID NO: 752866 - DNA, 20 bp, Artificial
  CRISPR gRNA sequence
cttcatcttaacctgagggc

SEQ ID NO: 752867 - DNA, 20 bp, Artificial
  CRISPR gRNA sequence
ttcatcttaacctgagggct

SEQ ID NO: 752868 - DNA, 20 bp, Artificial
  CRISPR gRNA sequence
catcttaacctgagggctgc

SEQ ID NO: 752869 - DNA, 20 bp, Artificial
  CRISPR gRNA sequence
atcttaacctgagggctgcc

SEQ ID NO: 752870 - DNA, 20 bp, Artificial
  CRISPR gRNA sequence
aacctgagggctgccagctc

SEQ ID NO: 752871 - DNA, 20 bp, Artificial
  CRISPR gRNA sequence
acctgagggctgccagctct

SEQ ID NO: 752872 - DNA, 20 bp, Artificial
  CRISPR gRNA sequence
agggctgccagctctaaaat

SEQ ID NO: 752873 - DNA, 20 bp, Artificial
  CRISPR gRNA sequence
ccagctctaaaatcctgtgg

SEQ ID NO: 752874 - DNA, 20 bp, Artificial
  CRISPR gRNA sequence
taaaatcctgtgggcaggag

SEQ ID NO: 752875 - DNA, 20 bp, Artificial
  CRISPR gRNA sequence
aaatcctgtgggcaggaggg

SEQ ID NO: 752876 - DNA, 20 bp, Artificial
  CRISPR gRNA sequence
tgggcaggagggaagagctg

SEQ ID NO: 752877 - DNA, 20 bp, Artificial
  CRISPR gRNA sequence
tcttatgaccatgtattatg

SEQ ID NO: 752878 - DNA, 20 bp, Artificial
  CRISPR gRNA sequence
atgaccatgtattatgtgct

SEQ ID NO: 752879 - DNA, 20 bp, Artificial
  CRISPR gRNA sequence
tgaccatgtattatgtgcta

SEQ ID NO: 752880 - DNA, 20 bp, Artificial
  CRISPR gRNA sequence
tgtgctaggctcttgctgag

SEQ ID NO: 752881 - DNA, 20 bp, Artificial
  CRISPR gRNA sequence
ggctcttgctgagcatctta

SEQ ID NO: 752882 - DNA, 20 bp, Artificial
  CRISPR gRNA sequence
ttgctgagcatcttatacct

SEQ ID NO: 752883 - DNA, 20 bp, Artificial
  CRISPR gRNA sequence
gctgagcatcttatacctgt

SEQ ID NO: 752884 - DNA, 20 bp, Artificial
  CRISPR gRNA sequence
ctgagcatcttatacctgtc

SEQ ID NO: 752885 - DNA, 20 bp, Artificial
  CRISPR gRNA sequence
agcatcttatacctgtcaca

SEQ ID NO: 752886 - DNA, 20 bp, Artificial
  CRISPR gRNA sequence
atacctgtcacatttagttc

SEQ ID NO: 752887 - DNA, 20 bp, Artificial
  CRISPR gRNA sequence
tacctgtcacatttagttct

SEQ ID NO: 752888 - DNA, 20 bp, Artificial
  CRISPR gRNA sequence
tcacatttagttctcataac

SEQ ID NO: 752889 - DNA, 20 bp, Artificial
  CRISPR gRNA sequence
agttctcataacacccccaa

SEQ ID NO: 752890 - DNA, 20 bp, Artificial
  CRISPR gRNA sequence
gttctcataacacccccaac

SEQ ID NO: 752891 - DNA, 20 bp, Artificial
  CRISPR gRNA sequence
tcataacacccccaacatgg

SEQ ID NO: 752892 - DNA, 20 bp, Artificial
  CRISPR gRNA sequence
ataacacccccaacatgggt

SEQ ID NO: 752893 - DNA, 20 bp, Artificial
  CRISPR gRNA sequence
ttttaaagatgaggaaacag

SEQ ID NO: 752894 - DNA, 20 bp, Artificial
  CRISPR gRNA sequence
taaagatgaggaaacagact

SEQ ID NO: 752895 - DNA, 20 bp, Artificial
  CRISPR gRNA sequence
aaagatgaggaaacagactc

SEQ ID NO: 752896 - DNA, 20 bp, Artificial
  CRISPR gRNA sequence
aagatgaggaaacagactca

SEQ ID NO: 752897 - DNA, 20 bp, Artificial
  CRISPR gRNA sequence
agagaagtgacttgcccaag

SEQ ID NO: 752898 - DNA, 20 bp, Artificial
  CRISPR gRNA sequence
gcccaaggccacacagtgct

SEQ ID NO: 752899 - DNA, 20 bp, Artificial
  CRISPR gRNA sequence
cccaaggccacacagtgctg

SEQ ID NO: 752900 - DNA, 20 bp, Artificial
  CRISPR gRNA sequence
tgtgactgagctgagattca

SEQ ID NO: 752901 - DNA, 20 bp, Artificial
  CRISPR gRNA sequence
agctgagattcacaccttgg

SEQ ID NO: 752902 - DNA, 20 bp, Artificial
  CRISPR gRNA sequence
agattcacaccttggacagg

SEQ ID NO: 752903 - DNA, 20 bp, Artificial
  CRISPR gRNA sequence
acaccttggacaggccagca

SEQ ID NO: 752904 - DNA, 20 bp, Artificial
  CRISPR gRNA sequence
ggacaggccagcactgcaga

SEQ ID NO: 752905 - DNA, 20 bp, Artificial
  CRISPR gRNA sequence
gacaggccagcactgcagac

SEQ ID NO: 752906 - DNA, 20 bp, Artificial
  CRISPR gRNA sequence
cagacaggaagagccaccca

SEQ ID NO: 752907 - DNA, 20 bp, Artificial
  CRISPR gRNA sequence
tccagaaccctccagtgggc

SEQ ID NO: 752908 - DNA, 20 bp, Artificial
  CRISPR gRNA sequence
cagaaccctccagtgggcag

SEQ ID NO: 752909 - DNA, 20 bp, Artificial
  CRISPR gRNA sequence
cagtgggcaggcggggctga

SEQ ID NO: 752910 - DNA, 20 bp, Artificial
  CRISPR gRNA sequence
atgcctcatccttcagctat

SEQ ID NO: 752911 - DNA, 20 bp, Artificial
  CRISPR gRNA sequence
atccttcagctatttagaaa

SEQ ID NO: 752912 - DNA, 20 bp, Artificial
  CRISPR gRNA sequence
cagctatttagaaaaaatga

SEQ ID NO: 752913 - DNA, 20 bp, Artificial
  CRISPR gRNA sequence
agctatttagaaaaaatgaa

SEQ ID NO: 752914 - DNA, 20 bp, Artificial
  CRISPR gRNA sequence
tttagaaaaaatgaactgac

SEQ ID NO: 752915 - DNA, 20 bp, Artificial
  CRISPR gRNA sequence
agaaaaaatgaactgaccgt

SEQ ID NO: 752916 - DNA, 20 bp, Artificial
  CRISPR gRNA sequence
gaaaaaatgaactgaccgtg

SEQ ID NO: 752917 - DNA, 20 bp, Artificial
  CRISPR gRNA sequence
accgtgcattgacctccacg

SEQ ID NO: 752918 - DNA, 20 bp, Artificial
  CRISPR gRNA sequence
acctccacgccctccgtgca

SEQ ID NO: 752919 - DNA, 20 bp, Artificial
  CRISPR gRNA sequence
cacgccctccgtgcaacatt

SEQ ID NO: 752920 - DNA, 20 bp, Artificial
  CRISPR gRNA sequence
cgtgcaacattcctgctctg

SEQ ID NO: 752921 - DNA, 20 bp, Artificial
  CRISPR gRNA sequence
ctgctctgcctcagacccaa

SEQ ID NO: 752922 - DNA, 20 bp, Artificial
  CRISPR gRNA sequence
ctctgcctcagacccaagct

SEQ ID NO: 752923 - DNA, 20 bp, Artificial
  CRISPR gRNA sequence
tgcctcagacccaagctgaa

SEQ ID NO: 752924 - DNA, 20 bp, Artificial
  CRISPR gRNA sequence
cctcagacccaagctgaaaa

SEQ ID NO: 752925 - DNA, 20 bp, Artificial
  CRISPR gRNA sequence
agacccaagctgaaaacatc

SEQ ID NO: 752926 - DNA, 20 bp, Artificial
  CRISPR gRNA sequence
aaaacatcattctttcattc

SEQ ID NO: 752927 - DNA, 20 bp, Artificial
  CRISPR gRNA sequence
tttcattccacaaatattta

SEQ ID NO: 752928 - DNA, 20 bp, Artificial
  CRISPR gRNA sequence
tcattccacaaatatttacc

SEQ ID NO: 752929 - DNA, 20 bp, Artificial
  CRISPR gRNA sequence
cattccacaaatatttacca

SEQ ID NO: 752930 - DNA, 20 bp, Artificial
  CRISPR gRNA sequence
attccacaaatatttaccaa

SEQ ID NO: 752931 - DNA, 20 bp, Artificial
  CRISPR gRNA sequence
cacaaatatttaccaaggtc

SEQ ID NO: 752932 - DNA, 20 bp, Artificial
  CRISPR gRNA sequence
accaaggtcctaacatgggc

SEQ ID NO: 752933 - DNA, 20 bp, Artificial
  CRISPR gRNA sequence
ccaaggtcctaacatgggcc

SEQ ID NO: 752934 - DNA, 20 bp, Artificial
  CRISPR gRNA sequence
acatgggccaggcccaggca

SEQ ID NO: 752935 - DNA, 20 bp, Artificial
  CRISPR gRNA sequence
tggggatgcagagttccatc

SEQ ID NO: 752936 - DNA, 20 bp, Artificial
  CRISPR gRNA sequence
catcaggggcatctgctcag

SEQ ID NO: 752937 - DNA, 20 bp, Artificial
  CRISPR gRNA sequence
ctcagaacttgggcctggac

SEQ ID NO: 752938 - DNA, 20 bp, Artificial
  CRISPR gRNA sequence
agaacttgggcctggacctg

SEQ ID NO: 752939 - DNA, 20 bp, Artificial
  CRISPR gRNA sequence
gggcctggacctgtgcctga

SEQ ID NO: 752940 - DNA, 20 bp, Artificial
  CRISPR gRNA sequence
ggcctggacctgtgcctgag

SEQ ID NO: 752941 - DNA, 20 bp, Artificial
  CRISPR gRNA sequence
gacctgtgcctgagatttct

SEQ ID NO: 752942 - DNA, 20 bp, Artificial
  CRISPR gRNA sequence
tgcctgagatttctagctgt

SEQ ID NO: 752943 - DNA, 20 bp, Artificial
  CRISPR gRNA sequence
agatttctagctgtggcacc

SEQ ID NO: 752944 - DNA, 20 bp, Artificial
  CRISPR gRNA sequence
ctagctgtggcaccctcaga

SEQ ID NO: 752945 - DNA, 20 bp, Artificial
  CRISPR gRNA sequence
tagctgtggcaccctcagat

SEQ ID NO: 752946 - DNA, 20 bp, Artificial
  CRISPR gRNA sequence
gctgtggcaccctcagatgt

SEQ ID NO: 752947 - DNA, 20 bp, Artificial
  CRISPR gRNA sequence
tggcaccctcagatgtttct

SEQ ID NO: 752948 - DNA, 20 bp, Artificial
  CRISPR gRNA sequence
agatgtttctgtcccagtac

SEQ ID NO: 752949 - DNA, 20 bp, Artificial
  CRISPR gRNA sequence
ctgtcccagtacaagggaaa

SEQ ID NO: 752950 - DNA, 20 bp, Artificial
  CRISPR gRNA sequence
tgtcccagtacaagggaaag

SEQ ID NO: 752951 - DNA, 20 bp, Artificial
  CRISPR gRNA sequence
tcccagtacaagggaaagga

SEQ ID NO: 752952 - DNA, 20 bp, Artificial
  CRISPR gRNA sequence
ttgttggcatcttctcagaa

SEQ ID NO: 752953 - DNA, 20 bp, Artificial
  CRISPR gRNA sequence
gttggcatcttctcagaatg

SEQ ID NO: 752954 - DNA, 20 bp, Artificial
  CRISPR gRNA sequence
ttggcatcttctcagaatgc

SEQ ID NO: 752955 - DNA, 20 bp, Artificial
  CRISPR gRNA sequence
gcatcttctcagaatgccag

SEQ ID NO: 752956 - DNA, 20 bp, Artificial
  CRISPR gRNA sequence
ctcagaatgccagtttttgt

SEQ ID NO: 752957 - DNA, 20 bp, Artificial
  CRISPR gRNA sequence
tcagaatgccagtttttgtg

SEQ ID NO: 752958 - DNA, 20 bp, Artificial
  CRISPR gRNA sequence
agaatgccagtttttgtgac

SEQ ID NO: 752959 - DNA, 20 bp, Artificial
  CRISPR gRNA sequence
ttgtgaccttcacctctctc

SEQ ID NO: 752960 - DNA, 20 bp, Artificial
  CRISPR gRNA sequence
tgtgaccttcacctctctcc

SEQ ID NO: 752961 - DNA, 20 bp, Artificial
  CRISPR gRNA sequence
gtgaccttcacctctctcca

SEQ ID NO: 752962 - DNA, 20 bp, Artificial
  CRISPR gRNA sequence
tgaccttcacctctctccac

SEQ ID NO: 752963 - DNA, 20 bp, Artificial
  CRISPR gRNA sequence
cacctctctccacccagcag

SEQ ID NO: 752964 - DNA, 20 bp, Artificial
  CRISPR gRNA sequence
acctctctccacccagcagg

SEQ ID NO: 752965 - DNA, 20 bp, Artificial
  CRISPR gRNA sequence
tctccacccagcaggccccg

SEQ ID NO: 752966 - DNA, 20 bp, Artificial
  CRISPR gRNA sequence
tccacccagcaggccccggg

SEQ ID NO: 752967 - DNA, 20 bp, Artificial
  CRISPR gRNA sequence
cacccagcaggccccgggtg

SEQ ID NO: 752968 - DNA, 20 bp, Artificial
  CRISPR gRNA sequence
tgagtgtgcacgggatgggt

SEQ ID NO: 752969 - DNA, 20 bp, Artificial
  CRISPR gRNA sequence
tgtatttttcatgacagggc

SEQ ID NO: 752970 - DNA, 20 bp, Artificial
  CRISPR gRNA sequence
ttcatgacagggcgtgagct

SEQ ID NO: 752971 - DNA, 20 bp, Artificial
  CRISPR gRNA sequence
tcatgacagggcgtgagctt

SEQ ID NO: 752972 - DNA, 20 bp, Artificial
  CRISPR gRNA sequence
catgacagggcgtgagctta

SEQ ID NO: 752973 - DNA, 20 bp, Artificial
  CRISPR gRNA sequence
atgacagggcgtgagcttag

SEQ ID NO: 752974 - DNA, 20 bp, Artificial
  CRISPR gRNA sequence
agcccacagtcgccaaggca

SEQ ID NO: 752975 - DNA, 20 bp, Artificial
  CRISPR gRNA sequence
gcccacagtcgccaaggcaa

SEQ ID NO: 752976 - DNA, 20 bp, Artificial
  CRISPR gRNA sequence
gcctttggaggtgggaccca

SEQ ID NO: 752977 - DNA, 20 bp, Artificial
  CRISPR gRNA sequence
tggaggtgggacccaagctt

SEQ ID NO: 752978 - DNA, 20 bp, Artificial
  CRISPR gRNA sequence
ggaggtgggacccaagcttg

SEQ ID NO: 752979 - DNA, 20 bp, Artificial
  CRISPR gRNA sequence
gaggtgggacccaagcttgg

SEQ ID NO: 752980 - DNA, 20 bp, Artificial
  CRISPR gRNA sequence
ggttagtcgggcctaggaag

SEQ ID NO: 752981 - DNA, 20 bp, Artificial
  CRISPR gRNA sequence
gttagtcgggcctaggaagc

SEQ ID NO: 752982 - DNA, 20 bp, Artificial
  CRISPR gRNA sequence
gtcgggcctaggaagcccca

SEQ ID NO: 752983 - DNA, 20 bp, Artificial
  CRISPR gRNA sequence
ggaagccccacccaaacagc

SEQ ID NO: 752984 - DNA, 20 bp, Artificial
  CRISPR gRNA sequence
aactctgaccagctgctaga

SEQ ID NO: 752985 - DNA, 20 bp, Artificial
  CRISPR gRNA sequence
tgaccagctgctagaggttg

SEQ ID NO: 752986 - DNA, 20 bp, Artificial
  CRISPR gRNA sequence
accagctgctagaggttgtc

SEQ ID NO: 752987 - DNA, 20 bp, Artificial
  CRISPR gRNA sequence
ctagaggttgtcaagtaaac

SEQ ID NO: 752988 - DNA, 20 bp, Artificial
  CRISPR gRNA sequence
gaggttgtcaagtaaacagt

SEQ ID NO: 752989 - DNA, 20 bp, Artificial
  CRISPR gRNA sequence
tcaagtaaacagttattaat

SEQ ID NO: 752990 - DNA, 20 bp, Artificial
  CRISPR gRNA sequence
ttaattgcctgctgtggctg

SEQ ID NO: 752991 - DNA, 20 bp, Artificial
  CRISPR gRNA sequence
attgcctgctgtggctggcc

SEQ ID NO: 752992 - DNA, 20 bp, Artificial
  CRISPR gRNA sequence
cctgctgtggctggccctgc

SEQ ID NO: 752993 - DNA, 20 bp, Artificial
  CRISPR gRNA sequence
ctgtggctggccctgcacta

SEQ ID NO: 752994 - DNA, 20 bp, Artificial
  CRISPR gRNA sequence
tggctggccctgcactagat

SEQ ID NO: 752995 - DNA, 20 bp, Artificial
  CRISPR gRNA sequence
gccctgcactagatgcaaaa

SEQ ID NO: 752996 - DNA, 20 bp, Artificial
  CRISPR gRNA sequence
cactagatgcaaaaggtccc

SEQ ID NO: 752997 - DNA, 20 bp, Artificial
  CRISPR gRNA sequence
gatgcaaaaggtcccgtcct

SEQ ID NO: 752998 - DNA, 20 bp, Artificial
  CRISPR gRNA sequence
ggtctcacaggacatcccaa

SEQ ID NO: 752999 - DNA, 20 bp, Artificial
  CRISPR gRNA sequence
gtctcacaggacatcccaaa

SEQ ID NO: 753000 - DNA, 20 bp, Artificial
  CRISPR gRNA sequence
acaggacatcccaaagagaa

SEQ ID NO: 753001 - DNA, 20 bp, Artificial
  CRISPR gRNA sequence
gttccagctccccgccaggc

SEQ ID NO: 753002 - DNA, 20 bp, Artificial
  CRISPR gRNA sequence
cagctccccgccaggcccca

SEQ ID NO: 753003 - DNA, 20 bp, Artificial
  CRISPR gRNA sequence
cccgccaggccccatccccc

SEQ ID NO: 753004 - DNA, 20 bp, Artificial
  CRISPR gRNA sequence
gggctggggctgtaggaaaa

SEQ ID NO: 753005 - DNA, 20 bp, Artificial
  CRISPR gRNA sequence
gggctgtaggaaaagactat

SEQ ID NO: 753006 - DNA, 20 bp, Artificial
  CRISPR gRNA sequence
taggaaaagactatgttctg

SEQ ID NO: 753007 - DNA, 20 bp, Artificial
  CRISPR gRNA sequence
tgttctgtctttatcaagat

SEQ ID NO: 753008 - DNA, 20 bp, Artificial
  CRISPR gRNA sequence
tgtctttatcaagatgcaga

SEQ ID NO: 753009 - DNA, 20 bp, Artificial
  CRISPR gRNA sequence
tctttatcaagatgcagagg

SEQ ID NO: 753010 - DNA, 20 bp, Artificial
  CRISPR gRNA sequence
tatcaagatgcagagggaaa

SEQ ID NO: 753011 - DNA, 20 bp, Artificial
  CRISPR gRNA sequence
atcaagatgcagagggaaac

SEQ ID NO: 753012 - DNA, 20 bp, Artificial
  CRISPR gRNA sequence
tcaagatgcagagggaaaca

SEQ ID NO: 753013 - DNA, 20 bp, Artificial
  CRISPR gRNA sequence
gggctgccaaggctaagaaa

SEQ ID NO: 753014 - DNA, 20 bp, Artificial
  CRISPR gRNA sequence
ccaaggctaagaaaggaagc

SEQ ID NO: 753015 - DNA, 20 bp, Artificial
  CRISPR gRNA sequence
agaaaggaagcgtcacaagg

SEQ ID NO: 753016 - DNA, 20 bp, Artificial
  CRISPR gRNA sequence
agggcctgaagccagcaagt

SEQ ID NO: 753017 - DNA, 20 bp, Artificial
  CRISPR gRNA sequence
aagccagcaagtctgccctg

SEQ ID NO: 753018 - DNA, 20 bp, Artificial
  CRISPR gRNA sequence
ccctggggctttctggccag

SEQ ID NO: 753019 - DNA, 20 bp, Artificial
  CRISPR gRNA sequence
gggctttctggccagtgagg

SEQ ID NO: 753020 - DNA, 20 bp, Artificial
  CRISPR gRNA sequence
tctggccagtgaggacaaag

SEQ ID NO: 753021 - DNA, 20 bp, Artificial
  CRISPR gRNA sequence
ctggccagtgaggacaaagg

SEQ ID NO: 753022 - DNA, 20 bp, Artificial
  CRISPR gRNA sequence
tggccagtgaggacaaaggg

SEQ ID NO: 753023 - DNA, 20 bp, Artificial
  CRISPR gRNA sequence
gccagtgaggacaaagggca

SEQ ID NO: 753024 - DNA, 20 bp, Artificial
  CRISPR gRNA sequence
agatgtgtttattgatacct

SEQ ID NO: 753025 - DNA, 20 bp, Artificial
  CRISPR gRNA sequence
attgatacctgcccccgcag

SEQ ID NO: 753026 - DNA, 20 bp, Artificial
  CRISPR gRNA sequence
ttgatacctgcccccgcagg

SEQ ID NO: 753027 - DNA, 20 bp, Artificial
  CRISPR gRNA sequence
atacctgcccccgcaggaag

SEQ ID NO: 753028 - DNA, 20 bp, Artificial
  CRISPR gRNA sequence
cccccgcaggaagtgtccat

SEQ ID NO: 753029 - DNA, 20 bp, Artificial
  CRISPR gRNA sequence
acatcagaccaagggggctg

SEQ ID NO: 753030 - DNA, 20 bp, Artificial
  CRISPR gRNA sequence
ggaaggggaagccaggctct

SEQ ID NO: 753031 - DNA, 20 bp, Artificial
  CRISPR gRNA sequence
tattgaaggaagcggcactt

SEQ ID NO: 753032 - DNA, 20 bp, Artificial
  CRISPR gRNA sequence
ttgaaggaagcggcacttcc

SEQ ID NO: 753033 - DNA, 20 bp, Artificial
  CRISPR gRNA sequence
aaggaagcggcacttccagc

SEQ ID NO: 753034 - DNA, 20 bp, Artificial
  CRISPR gRNA sequence
ccagcaccttgggaaagcct

SEQ ID NO: 753035 - DNA, 20 bp, Artificial
  CRISPR gRNA sequence
cagcaccttgggaaagcctc

SEQ ID NO: 753036 - DNA, 20 bp, Artificial
  CRISPR gRNA sequence
gggaaagcctccgtgcatcc

SEQ ID NO: 753037 - DNA, 20 bp, Artificial
  CRISPR gRNA sequence
ggaaagcctccgtgcatccg

SEQ ID NO: 753038 - DNA, 20 bp, Artificial
  CRISPR gRNA sequence
cgtgcatccggggctggagc

SEQ ID NO: 753039 - DNA, 20 bp, Artificial
  CRISPR gRNA sequence
gagctggaggctagcatgcc

SEQ ID NO: 753040 - DNA, 20 bp, Artificial
  CRISPR gRNA sequence
gaggctagcatgcctcccca

SEQ ID NO: 753041 - DNA, 20 bp, Artificial
  CRISPR gRNA sequence
gcatgcctccccagggaggg

SEQ ID NO: 753042 - DNA, 20 bp, Artificial
  CRISPR gRNA sequence
cccagggagggcctaggcag

SEQ ID NO: 753043 - DNA, 20 bp, Artificial
  CRISPR gRNA sequence
ggcagctggccagaggtccc

SEQ ID NO: 753044 - DNA, 20 bp, Artificial
  CRISPR gRNA sequence
gccagaggtcccggcccgtg

SEQ ID NO: 753045 - DNA, 20 bp, Artificial
  CRISPR gRNA sequence
ctgtggatgaacccctccca

SEQ ID NO: 753046 - DNA, 20 bp, Artificial
  CRISPR gRNA sequence
tgtggatgaacccctcccag

SEQ ID NO: 753047 - DNA, 20 bp, Artificial
  CRISPR gRNA sequence
tggatgaacccctcccagac

SEQ ID NO: 753048 - DNA, 20 bp, Artificial
  CRISPR gRNA sequence
ccagactccccaggcccttt

SEQ ID NO: 753049 - DNA, 20 bp, Artificial
  CRISPR gRNA sequence
cccaggcccttttggaggag

SEQ ID NO: 753050 - DNA, 20 bp, Artificial
  CRISPR gRNA sequence
ttggaggaggactgtgtgca

SEQ ID NO: 753051 - DNA, 20 bp, Artificial
  CRISPR gRNA sequence
tggaggaggactgtgtgcag

SEQ ID NO: 753052 - DNA, 20 bp, Artificial
  CRISPR gRNA sequence
ggaggaggactgtgtgcagc

SEQ ID NO: 753053 - DNA, 20 bp, Artificial
  CRISPR gRNA sequence
gaggaggactgtgtgcagct

SEQ ID NO: 753054 - DNA, 20 bp, Artificial
  CRISPR gRNA sequence
tgtgcagctcaggctcccgg

SEQ ID NO: 753055 - DNA, 20 bp, Artificial
  CRISPR gRNA sequence
aggctcccggctccagccag

SEQ ID NO: 753056 - DNA, 20 bp, Artificial
  CRISPR gRNA sequence
ccggctccagccagccaccc

SEQ ID NO: 753057 - DNA, 20 bp, Artificial
  CRISPR gRNA sequence
cagccagccaccctcacgct

SEQ ID NO: 753058 - DNA, 20 bp, Artificial
  CRISPR gRNA sequence
acgcttctatgctgtgaaga

SEQ ID NO: 753059 - DNA, 20 bp, Artificial
  CRISPR gRNA sequence
ctatgctgtgaagacgtcct

SEQ ID NO: 753060 - DNA, 20 bp, Artificial
  CRISPR gRNA sequence
tatgctgtgaagacgtcctc

SEQ ID NO: 753061 - DNA, 20 bp, Artificial
  CRISPR gRNA sequence
tgctgtgaagacgtcctcag

SEQ ID NO: 753062 - DNA, 20 bp, Artificial
  CRISPR gRNA sequence
tgaagacgtcctcagggtcc

SEQ ID NO: 753063 - DNA, 20 bp, Artificial
  CRISPR gRNA sequence
agggtccagctcaagtcttt

SEQ ID NO: 753064 - DNA, 20 bp, Artificial
  CRISPR gRNA sequence
aagtctttttgccccctact

SEQ ID NO: 753065 - DNA, 20 bp, Artificial
  CRISPR gRNA sequence
tttgccccctactactctgt

SEQ ID NO: 753066 - DNA, 20 bp, Artificial
  CRISPR gRNA sequence
ttgccccctactactctgtg

SEQ ID NO: 753067 - DNA, 20 bp, Artificial
  CRISPR gRNA sequence
tgccccctactactctgtgc

SEQ ID NO: 753068 - DNA, 20 bp, Artificial
  CRISPR gRNA sequence
gccccctactactctgtgcc

SEQ ID NO: 753069 - DNA, 20 bp, Artificial
  CRISPR gRNA sequence
ccccctactactctgtgcca

SEQ ID NO: 753070 - DNA, 20 bp, Artificial
  CRISPR gRNA sequence
ctactctgtgccaggcatca

SEQ ID NO: 753071 - DNA, 20 bp, Artificial
  CRISPR gRNA sequence
ctctgtgccaggcatcattc

SEQ ID NO: 753072 - DNA, 20 bp, Artificial
  CRISPR gRNA sequence
tgtgccaggcatcattctaa

SEQ ID NO: 753073 - DNA, 20 bp, Artificial
  CRISPR gRNA sequence
tgccaggcatcattctaagt

SEQ ID NO: 753074 - DNA, 20 bp, Artificial
  CRISPR gRNA sequence
taagtgcttgtttgtttggt

SEQ ID NO: 753075 - DNA, 20 bp, Artificial
  CRISPR gRNA sequence
agtgcttgtttgtttggttg

SEQ ID NO: 753076 - DNA, 20 bp, Artificial
  CRISPR gRNA sequence
gtttgtttggttggctttgt

SEQ ID NO: 753077 - DNA, 20 bp, Artificial
  CRISPR gRNA sequence
tttgtttggttggctttgtt

SEQ ID NO: 753078 - DNA, 20 bp, Artificial
  CRISPR gRNA sequence
gtttggttggctttgttgct

SEQ ID NO: 753079 - DNA, 20 bp, Artificial
  CRISPR gRNA sequence
tttggttggctttgttgctg

SEQ ID NO: 753080 - DNA, 20 bp, Artificial
  CRISPR gRNA sequence
ggttggctttgttgctgttg

SEQ ID NO: 753081 - DNA, 20 bp, Artificial
  CRISPR gRNA sequence
gttggctttgttgctgttgt

SEQ ID NO: 753082 - DNA, 20 bp, Artificial
  CRISPR gRNA sequence
gctttgttgctgttgttgtt

SEQ ID NO: 753083 - DNA, 20 bp, Artificial
  CRISPR gRNA sequence
tgttgctgttgttgttgttg

SEQ ID NO: 753084 - DNA, 20 bp, Artificial
  CRISPR gRNA sequence
gttgctgttgttgttgttgt

SEQ ID NO: 753085 - DNA, 20 bp, Artificial
  CRISPR gRNA sequence
ttgctgttgttgttgttgtt

SEQ ID NO: 753086 - DNA, 20 bp, Artificial
  CRISPR gRNA sequence
ctgttgttgttgttgttgtt

SEQ ID NO: 753087 - DNA, 20 bp, Artificial
  CRISPR gRNA sequence
ttgttgttgttgttgttgtt

SEQ ID NO: 753088 - DNA, 20 bp, Artificial
  CRISPR gRNA sequence
ttgttgttgttgttgtttga

SEQ ID NO: 753089 - DNA, 20 bp, Artificial
  CRISPR gRNA sequence
ttgttgttgttgtttgagat

SEQ ID NO: 753090 - DNA, 20 bp, Artificial
  CRISPR gRNA sequence
ttgttgttgtttgagatgga

SEQ ID NO: 753091 - DNA, 20 bp, Artificial
  CRISPR gRNA sequence
ttgttgtttgagatggagtc

SEQ ID NO: 753092 - DNA, 20 bp, Artificial
  CRISPR gRNA sequence
ttgtttgagatggagtctcg

SEQ ID NO: 753093 - DNA, 20 bp, Artificial
  CRISPR gRNA sequence
tttgagatggagtctcgctc

SEQ ID NO: 753094 - DNA, 20 bp, Artificial
  CRISPR gRNA sequence
gagatggagtctcgctctgt

SEQ ID NO: 753095 - DNA, 20 bp, Artificial
  CRISPR gRNA sequence
agatggagtctcgctctgtt

SEQ ID NO: 753096 - DNA, 20 bp, Artificial
  CRISPR gRNA sequence
gctctgttgcccaggctgga

SEQ ID NO: 753097 - DNA, 20 bp, Artificial
  CRISPR gRNA sequence
tgttgcccaggctggagttc

SEQ ID NO: 753098 - DNA, 20 bp, Artificial
  CRISPR gRNA sequence
ttgcccaggctggagttcag

SEQ ID NO: 753099 - DNA, 20 bp, Artificial
  CRISPR gRNA sequence
cccaggctggagttcagtgg

SEQ ID NO: 753100 - DNA, 20 bp, Artificial
  CRISPR gRNA sequence
gagttcagtggtgcaatctc

SEQ ID NO: 753101 - DNA, 20 bp, Artificial
  CRISPR gRNA sequence
agtggtgcaatctcagctca

SEQ ID NO: 753102 - DNA, 20 bp, Artificial
  CRISPR gRNA sequence
agctcactgcaacctccgcc

SEQ ID NO: 753103 - DNA, 20 bp, Artificial
  CRISPR gRNA sequence
actgcaacctccgcctccca

SEQ ID NO: 753104 - DNA, 20 bp, Artificial
  CRISPR gRNA sequence
caacctccgcctcccaggtt

SEQ ID NO: 753105 - DNA, 20 bp, Artificial
  CRISPR gRNA sequence
cgcctcccaggttgaagcaa

SEQ ID NO: 753106 - DNA, 20 bp, Artificial
  CRISPR gRNA sequence
ccaggttgaagcaactctcc

SEQ ID NO: 753107 - DNA, 20 bp, Artificial
  CRISPR gRNA sequence
aagcaactctcctgcctcag

SEQ ID NO: 753108 - DNA, 20 bp, Artificial
  CRISPR gRNA sequence
tcctgcctcagcctcccgag

SEQ ID NO: 753109 - DNA, 20 bp, Artificial
  CRISPR gRNA sequence
ctgcctcagcctcccgagta

SEQ ID NO: 753110 - DNA, 20 bp, Artificial
  CRISPR gRNA sequence
cctcagcctcccgagtagct

SEQ ID NO: 753111 - DNA, 20 bp, Artificial
  CRISPR gRNA sequence
agcctcccgagtagctggga

SEQ ID NO: 753112 - DNA, 20 bp, Artificial
  CRISPR gRNA sequence
ccgagtagctgggactacag

SEQ ID NO: 753113 - DNA, 20 bp, Artificial
  CRISPR gRNA sequence
ggactacaggcacccgccac

SEQ ID NO: 753114 - DNA, 20 bp, Artificial
  CRISPR gRNA sequence
caggcacccgccaccacgcc

SEQ ID NO: 753115 - DNA, 20 bp, Artificial
  CRISPR gRNA sequence
gctaatttttgtatttttag

SEQ ID NO: 753116 - DNA, 20 bp, Artificial
  CRISPR gRNA sequence
atttttgtatttttagtaga

SEQ ID NO: 753117 - DNA, 20 bp, Artificial
  CRISPR gRNA sequence
ttgtatttttagtagagacg

SEQ ID NO: 753118 - DNA, 20 bp, Artificial
  CRISPR gRNA sequence
tgtatttttagtagagacgg

SEQ ID NO: 753119 - DNA, 20 bp, Artificial
  CRISPR gRNA sequence
gtatttttagtagagacggg

SEQ ID NO: 753120 - DNA, 20 bp, Artificial
  CRISPR gRNA sequence
tatttttagtagagacgggg

SEQ ID NO: 753121 - DNA, 20 bp, Artificial
  CRISPR gRNA sequence
ttagtagagacggggtttca

SEQ ID NO: 753122 - DNA, 20 bp, Artificial
  CRISPR gRNA sequence
tagtagagacggggtttcac

SEQ ID NO: 753123 - DNA, 20 bp, Artificial
  CRISPR gRNA sequence
agtagagacggggtttcacc

SEQ ID NO: 753124 - DNA, 20 bp, Artificial
  CRISPR gRNA sequence
gtagagacggggtttcacca

SEQ ID NO: 753125 - DNA, 20 bp, Artificial
  CRISPR gRNA sequence
caccacgttggccaggctgg

SEQ ID NO: 753126 - DNA, 20 bp, Artificial
  CRISPR gRNA sequence
accacgttggccaggctggt

SEQ ID NO: 753127 - DNA, 20 bp, Artificial
  CRISPR gRNA sequence
gccaggctggtcttgaactc

SEQ ID NO: 753128 - DNA, 20 bp, Artificial
  CRISPR gRNA sequence
gtcttgaactcctgacctca

SEQ ID NO: 753129 - DNA, 20 bp, Artificial
  CRISPR gRNA sequence
gaactcctgacctcatgtga

SEQ ID NO: 753130 - DNA, 20 bp, Artificial
  CRISPR gRNA sequence
aactcctgacctcatgtgat

SEQ ID NO: 753131 - DNA, 20 bp, Artificial
  CRISPR gRNA sequence
ctgacctcatgtgatccacc

SEQ ID NO: 753132 - DNA, 20 bp, Artificial
  CRISPR gRNA sequence
acctcatgtgatccacccgc

SEQ ID NO: 753133 - DNA, 20 bp, Artificial
  CRISPR gRNA sequence
atgtgatccacccgcctcgt

SEQ ID NO: 753134 - DNA, 20 bp, Artificial
  CRISPR gRNA sequence
gtcctccccaagtgctggga

SEQ ID NO: 753135 - DNA, 20 bp, Artificial
  CRISPR gRNA sequence
cccaagtgctgggattacag

SEQ ID NO: 753136 - DNA, 20 bp, Artificial
  CRISPR gRNA sequence
ggattacaggagtgagccac

SEQ ID NO: 753137 - DNA, 20 bp, Artificial
  CRISPR gRNA sequence
caggagtgagccactgtgcc

SEQ ID NO: 753138 - DNA, 20 bp, Artificial
  CRISPR gRNA sequence
tgcctggccgtttggttggt

SEQ ID NO: 753139 - DNA, 20 bp, Artificial
  CRISPR gRNA sequence
gccgtttggttggttttctt

SEQ ID NO: 753140 - DNA, 20 bp, Artificial
  CRISPR gRNA sequence
ggttggttttctttagtgag

SEQ ID NO: 753141 - DNA, 20 bp, Artificial
  CRISPR gRNA sequence
gttggttttctttagtgagc

SEQ ID NO: 753142 - DNA, 20 bp, Artificial
  CRISPR gRNA sequence
gttttctttagtgagctagg

SEQ ID NO: 753143 - DNA, 20 bp, Artificial
  CRISPR gRNA sequence
tctttagtgagctagggtct

SEQ ID NO: 753144 - DNA, 20 bp, Artificial
  CRISPR gRNA sequence
ctttagtgagctagggtctt

SEQ ID NO: 753145 - DNA, 20 bp, Artificial
  CRISPR gRNA sequence
tttagtgagctagggtcttg

SEQ ID NO: 753146 - DNA, 20 bp, Artificial
  CRISPR gRNA sequence
tagtgagctagggtcttgct

SEQ ID NO: 753147 - DNA, 20 bp, Artificial
  CRISPR gRNA sequence
agtgagctagggtcttgctc

SEQ ID NO: 753148 - DNA, 20 bp, Artificial
  CRISPR gRNA sequence
gtgagctagggtcttgctct

SEQ ID NO: 753149 - DNA, 20 bp, Artificial
  CRISPR gRNA sequence
gggtcttgctcttcactcag

SEQ ID NO: 753150 - DNA, 20 bp, Artificial
  CRISPR gRNA sequence
gctcttcactcaggctggaa

SEQ ID NO: 753151 - DNA, 20 bp, Artificial
  CRISPR gRNA sequence
ctcttcactcaggctggaat

SEQ ID NO: 753152 - DNA, 20 bp, Artificial
  CRISPR gRNA sequence
ttcactcaggctggaatgca

SEQ ID NO: 753153 - DNA, 20 bp, Artificial
  CRISPR gRNA sequence
cactcaggctggaatgcagt

SEQ ID NO: 753154 - DNA, 20 bp, Artificial
  CRISPR gRNA sequence
actcaggctggaatgcagtg

SEQ ID NO: 753155 - DNA, 20 bp, Artificial
  CRISPR gRNA sequence
aggctggaatgcagtgacaa

SEQ ID NO: 753156 - DNA, 20 bp, Artificial
  CRISPR gRNA sequence
gaatgcagtgacaatgagat

SEQ ID NO: 753157 - DNA, 20 bp, Artificial
  CRISPR gRNA sequence
taacctcgaactcatgggct

SEQ ID NO: 753158 - DNA, 20 bp, Artificial
  CRISPR gRNA sequence
gaactcatgggctcaagtta

SEQ ID NO: 753159 - DNA, 20 bp, Artificial
  CRISPR gRNA sequence
atgggctcaagttatcctcc

SEQ ID NO: 753160 - DNA, 20 bp, Artificial
  CRISPR gRNA sequence
aagttatcctcccacccctg

SEQ ID NO: 753161 - DNA, 20 bp, Artificial
  CRISPR gRNA sequence
tcctcccacccctgcctccc

SEQ ID NO: 753162 - DNA, 20 bp, Artificial
  CRISPR gRNA sequence
ccacccctgcctcccaacta

SEQ ID NO: 753163 - DNA, 20 bp, Artificial
  CRISPR gRNA sequence
cctcccaactaggactacag

SEQ ID NO: 753164 - DNA, 20 bp, Artificial
  CRISPR gRNA sequence
ccaactaggactacagacac

SEQ ID NO: 753165 - DNA, 20 bp, Artificial
  CRISPR gRNA sequence
ggactacagacacatgccac

SEQ ID NO: 753166 - DNA, 20 bp, Artificial
  CRISPR gRNA sequence
cagacacatgccactatgcc

SEQ ID NO: 753167 - DNA, 20 bp, Artificial
  CRISPR gRNA sequence
tgcccagctaatttttaaat

SEQ ID NO: 753168 - DNA, 20 bp, Artificial
  CRISPR gRNA sequence
atttttaaatttttcatagt

SEQ ID NO: 753169 - DNA, 20 bp, Artificial
  CRISPR gRNA sequence
ttaaatttttcatagtgatg

SEQ ID NO: 753170 - DNA, 20 bp, Artificial
  CRISPR gRNA sequence
taaatttttcatagtgatgg

SEQ ID NO: 753171 - DNA, 20 bp, Artificial
  CRISPR gRNA sequence
aaatttttcatagtgatggg

SEQ ID NO: 753172 - DNA, 20 bp, Artificial
  CRISPR gRNA sequence
aatttttcatagtgatgggg

SEQ ID NO: 753173 - DNA, 20 bp, Artificial
  CRISPR gRNA sequence
ttcatagtgatggggtctcg

SEQ ID NO: 753174 - DNA, 20 bp, Artificial
  CRISPR gRNA sequence
tcatagtgatggggtctcgt

SEQ ID NO: 753175 - DNA, 20 bp, Artificial
  CRISPR gRNA sequence
catagtgatggggtctcgtt

SEQ ID NO: 753176 - DNA, 20 bp, Artificial
  CRISPR gRNA sequence
atagtgatggggtctcgtta

SEQ ID NO: 753177 - DNA, 20 bp, Artificial
  CRISPR gRNA sequence
gttatgttgtccaggctggt

SEQ ID NO: 753178 - DNA, 20 bp, Artificial
  CRISPR gRNA sequence
tgttgtccaggctggtcccc

SEQ ID NO: 753179 - DNA, 20 bp, Artificial
  CRISPR gRNA sequence
tccaggctggtcccctggct

SEQ ID NO: 753180 - DNA, 20 bp, Artificial
  CRISPR gRNA sequence
gtcccctggcttgaaactcc

SEQ ID NO: 753181 - DNA, 20 bp, Artificial
  CRISPR gRNA sequence
gcttgaaactcctggcttca

SEQ ID NO: 753182 - DNA, 20 bp, Artificial
  CRISPR gRNA sequence
gaaactcctggcttcaagag

SEQ ID NO: 753183 - DNA, 20 bp, Artificial
  CRISPR gRNA sequence
aaactcctggcttcaagaga

SEQ ID NO: 753184 - DNA, 20 bp, Artificial
  CRISPR gRNA sequence
ctggcttcaagagatcctcc

SEQ ID NO: 753185 - DNA, 20 bp, Artificial
  CRISPR gRNA sequence
gcttcaagagatcctcccac

SEQ ID NO: 753186 - DNA, 20 bp, Artificial
  CRISPR gRNA sequence
caagagatcctcccacctca

SEQ ID NO: 753187 - DNA, 20 bp, Artificial
  CRISPR gRNA sequence
aagagatcctcccacctcag

SEQ ID NO: 753188 - DNA, 20 bp, Artificial
  CRISPR gRNA sequence
ccacctcagcctcccaaagt

SEQ ID NO: 753189 - DNA, 20 bp, Artificial
  CRISPR gRNA sequence
agcctcccaaagtgctggga

SEQ ID NO: 753190 - DNA, 20 bp, Artificial
  CRISPR gRNA sequence
ccaaagtgctgggattacag

SEQ ID NO: 753191 - DNA, 20 bp, Artificial
  CRISPR gRNA sequence
ggattacaggcatgagccac

SEQ ID NO: 753192 - DNA, 20 bp, Artificial
  CRISPR gRNA sequence
caggcatgagccactgtgct

SEQ ID NO: 753193 - DNA, 20 bp, Artificial
  CRISPR gRNA sequence
tgctcggcctcattctaaac

SEQ ID NO: 753194 - DNA, 20 bp, Artificial
  CRISPR gRNA sequence
ggcctcattctaaacacttt

SEQ ID NO: 753195 - DNA, 20 bp, Artificial
  CRISPR gRNA sequence
attctaaacacttttacata

SEQ ID NO: 753196 - DNA, 20 bp, Artificial
  CRISPR gRNA sequence
taaacacttttacatagatt

SEQ ID NO: 753197 - DNA, 20 bp, Artificial
  CRISPR gRNA sequence
aacacttttacatagattag

SEQ ID NO: 753198 - DNA, 20 bp, Artificial
  CRISPR gRNA sequence
ttacatagattagtttatgt

SEQ ID NO: 753199 - DNA, 20 bp, Artificial
  CRISPR gRNA sequence
tacatagattagtttatgta

SEQ ID NO: 753200 - DNA, 20 bp, Artificial
  CRISPR gRNA sequence
acatagattagtttatgtaa

SEQ ID NO: 753201 - DNA, 20 bp, Artificial
  CRISPR gRNA sequence
catagattagtttatgtaat

SEQ ID NO: 753202 - DNA, 20 bp, Artificial
  CRISPR gRNA sequence
gtttatgtaatccttccacc

SEQ ID NO: 753203 - DNA, 20 bp, Artificial
  CRISPR gRNA sequence
atgtaatccttccaccctat

SEQ ID NO: 753204 - DNA, 20 bp, Artificial
  CRISPR gRNA sequence
tgtaatccttccaccctatg

SEQ ID NO: 753205 - DNA, 20 bp, Artificial
  CRISPR gRNA sequence
ccaccctatgaggtaggtac

SEQ ID NO: 753206 - DNA, 20 bp, Artificial
  CRISPR gRNA sequence
caccctatgaggtaggtact

SEQ ID NO: 753207 - DNA, 20 bp, Artificial
  CRISPR gRNA sequence
tgaggtaggtactagtatca

SEQ ID NO: 753208 - DNA, 20 bp, Artificial
  CRISPR gRNA sequence
gtatcatctccattttacag

SEQ ID NO: 753209 - DNA, 20 bp, Artificial
  CRISPR gRNA sequence
cattttacagatgagaaaac

SEQ ID NO: 753210 - DNA, 20 bp, Artificial
  CRISPR gRNA sequence
tacagatgagaaaacggaag

SEQ ID NO: 753211 - DNA, 20 bp, Artificial
  CRISPR gRNA sequence
acagatgagaaaacggaagc

SEQ ID NO: 753212 - DNA, 20 bp, Artificial
  CRISPR gRNA sequence
cagatgagaaaacggaagca

SEQ ID NO: 753213 - DNA, 20 bp, Artificial
  CRISPR gRNA sequence
gtatcttgcccacagcctca

SEQ ID NO: 753214 - DNA, 20 bp, Artificial
  CRISPR gRNA sequence
gcccacagcctcacaactaa

SEQ ID NO: 753215 - DNA, 20 bp, Artificial
  CRISPR gRNA sequence
cccacagcctcacaactaat

SEQ ID NO: 753216 - DNA, 20 bp, Artificial
  CRISPR gRNA sequence
acaactaataagtgatggtg

SEQ ID NO: 753217 - DNA, 20 bp, Artificial
  CRISPR gRNA sequence
ataagtgatggtgtcaggat

SEQ ID NO: 753218 - DNA, 20 bp, Artificial
  CRISPR gRNA sequence
aacccaggtagtcagcctct

SEQ ID NO: 753219 - DNA, 20 bp, Artificial
  CRISPR gRNA sequence
tggaggtctggtgccatctg

SEQ ID NO: 753220 - DNA, 20 bp, Artificial
  CRISPR gRNA sequence
gaggtctggtgccatctgac

SEQ ID NO: 753221 - DNA, 20 bp, Artificial
  CRISPR gRNA sequence
gtgccatctgactactctct

SEQ ID NO: 753222 - DNA, 20 bp, Artificial
  CRISPR gRNA sequence
actactctctagagaataga

SEQ ID NO: 753223 - DNA, 20 bp, Artificial
  CRISPR gRNA sequence
ctctctagagaatagaggta

SEQ ID NO: 753224 - DNA, 20 bp, Artificial
  CRISPR gRNA sequence
tctagagaatagaggtagct

SEQ ID NO: 753225 - DNA, 20 bp, Artificial
  CRISPR gRNA sequence
tagagaatagaggtagctgg

SEQ ID NO: 753226 - DNA, 20 bp, Artificial
  CRISPR gRNA sequence
gagaatagaggtagctgggg

SEQ ID NO: 753227 - DNA, 20 bp, Artificial
  CRISPR gRNA sequence
gggactgactggaggcccca

SEQ ID NO: 753228 - DNA, 20 bp, Artificial
  CRISPR gRNA sequence
actggaggccccacctcctt

SEQ ID NO: 753229 - DNA, 20 bp, Artificial
  CRISPR gRNA sequence
gaggccccacctccttcttg

SEQ ID NO: 753230 - DNA, 20 bp, Artificial
  CRISPR gRNA sequence
cttcttgaagacggacaaat

SEQ ID NO: 753231 - DNA, 20 bp, Artificial
  CRISPR gRNA sequence
cttgaagacggacaaatgtc

SEQ ID NO: 753232 - DNA, 20 bp, Artificial
  CRISPR gRNA sequence
ttgaagacggacaaatgtca

SEQ ID NO: 753233 - DNA, 20 bp, Artificial
  CRISPR gRNA sequence
gaagacggacaaatgtcatg

SEQ ID NO: 753234 - DNA, 20 bp, Artificial
  CRISPR gRNA sequence
aagacggacaaatgtcatga

SEQ ID NO: 753235 - DNA, 20 bp, Artificial
  CRISPR gRNA sequence
gcctggccacgtctaccaca

SEQ ID NO: 753236 - DNA, 20 bp, Artificial
  CRISPR gRNA sequence
cctggccacgtctaccacat

SEQ ID NO: 753237 - DNA, 20 bp, Artificial
  CRISPR gRNA sequence
gccacgtctaccacatagtt

SEQ ID NO: 753238 - DNA, 20 bp, Artificial
  CRISPR gRNA sequence
ccacatagttttacttttgg

SEQ ID NO: 753239 - DNA, 20 bp, Artificial
  CRISPR gRNA sequence
tacttttggttttacattaa

SEQ ID NO: 753240 - DNA, 20 bp, Artificial
  CRISPR gRNA sequence
acttttggttttacattaaa

SEQ ID NO: 753241 - DNA, 20 bp, Artificial
  CRISPR gRNA sequence
cttttggttttacattaaat

SEQ ID NO: 753242 - DNA, 20 bp, Artificial
  CRISPR gRNA sequence
ttggttttacattaaataac

SEQ ID NO: 753243 - DNA, 20 bp, Artificial
  CRISPR gRNA sequence
tggttttacattaaataaca

SEQ ID NO: 753244 - DNA, 20 bp, Artificial
  CRISPR gRNA sequence
ggttttacattaaataacat

SEQ ID NO: 753245 - DNA, 20 bp, Artificial
  CRISPR gRNA sequence
gttttacattaaataacatt

SEQ ID NO: 753246 - DNA, 20 bp, Artificial
  CRISPR gRNA sequence
tacattaaataacattgaat

SEQ ID NO: 753247 - DNA, 20 bp, Artificial
  CRISPR gRNA sequence
acattaaataacattgaatc

SEQ ID NO: 753248 - DNA, 20 bp, Artificial
  CRISPR gRNA sequence
cattaaataacattgaatca

SEQ ID NO: 753249 - DNA, 20 bp, Artificial
  CRISPR gRNA sequence
aataacattgaatcatatat

SEQ ID NO: 753250 - DNA, 20 bp, Artificial
  CRISPR gRNA sequence
aatcatatatagaagaggtt

SEQ ID NO: 753251 - DNA, 20 bp, Artificial
  CRISPR gRNA sequence
ttccctttacaattatttca

SEQ ID NO: 753252 - DNA, 20 bp, Artificial
  CRISPR gRNA sequence
cctttacaattatttcagtc

SEQ ID NO: 753253 - DNA, 20 bp, Artificial
  CRISPR gRNA sequence
tacaattatttcagtcctga

SEQ ID NO: 753254 - DNA, 20 bp, Artificial
  CRISPR gRNA sequence
acaattatttcagtcctgat

SEQ ID NO: 753255 - DNA, 20 bp, Artificial
  CRISPR gRNA sequence
caattatttcagtcctgatt

SEQ ID NO: 753256 - DNA, 20 bp, Artificial
  CRISPR gRNA sequence
tttcagtcctgattacatca

SEQ ID NO: 753257 - DNA, 20 bp, Artificial
  CRISPR gRNA sequence
cagtcctgattacatcaaag

SEQ ID NO: 753258 - DNA, 20 bp, Artificial
  CRISPR gRNA sequence
agtcctgattacatcaaaga

SEQ ID NO: 753259 - DNA, 20 bp, Artificial
  CRISPR gRNA sequence
attacatcaaagagaaagtc

SEQ ID NO: 753260 - DNA, 20 bp, Artificial
  CRISPR gRNA sequence
catcaaagagaaagtctcag

SEQ ID NO: 753261 - DNA, 20 bp, Artificial
  CRISPR gRNA sequence
agtttgatgctaatatgtct

SEQ ID NO: 753262 - DNA, 20 bp, Artificial
  CRISPR gRNA sequence
gatgctaatatgtctctaaa

SEQ ID NO: 753263 - DNA, 20 bp, Artificial
  CRISPR gRNA sequence
atgctaatatgtctctaaaa

SEQ ID NO: 753264 - DNA, 20 bp, Artificial
  CRISPR gRNA sequence
atatgtctctaaaacatttg

SEQ ID NO: 753265 - DNA, 20 bp, Artificial
  CRISPR gRNA sequence
taaaacatttgctaatctcc

SEQ ID NO: 753266 - DNA, 20 bp, Artificial
  CRISPR gRNA sequence
aaacatttgctaatctcctt

SEQ ID NO: 753267 - DNA, 20 bp, Artificial
  CRISPR gRNA sequence
gctaatctccttttcttttt

SEQ ID NO: 753268 - DNA, 20 bp, Artificial
  CRISPR gRNA sequence
ctaatctccttttcttttta

SEQ ID NO: 753269 - DNA, 20 bp, Artificial
  CRISPR gRNA sequence
atctccttttctttttaaat

SEQ ID NO: 753270 - DNA, 20 bp, Artificial
  CRISPR gRNA sequence
cttttctttttaaattttat

SEQ ID NO: 753271 - DNA, 20 bp, Artificial
  CRISPR gRNA sequence
ttctttttaaattttatttt

SEQ ID NO: 753272 - DNA, 20 bp, Artificial
  CRISPR gRNA sequence
tctttttaaattttatttta

SEQ ID NO: 753273 - DNA, 20 bp, Artificial
  CRISPR gRNA sequence
ctttttaaattttattttat

SEQ ID NO: 753274 - DNA, 20 bp, Artificial
  CRISPR gRNA sequence
tttttaaattttattttatt

SEQ ID NO: 753275 - DNA, 20 bp, Artificial
  CRISPR gRNA sequence
tttaaattttattttatttt

SEQ ID NO: 753276 - DNA, 20 bp, Artificial
  CRISPR gRNA sequence
ttaaattttattttatttta

SEQ ID NO: 753277 - DNA, 20 bp, Artificial
  CRISPR gRNA sequence
taaattttattttattttaa

SEQ ID NO: 753278 - DNA, 20 bp, Artificial
  CRISPR gRNA sequence
aaattttattttattttaat

SEQ ID NO: 753279 - DNA, 20 bp, Artificial
  CRISPR gRNA sequence
aattttattttattttaatt

SEQ ID NO: 753280 - DNA, 20 bp, Artificial
  CRISPR gRNA sequence
tattttattttaattttttg

SEQ ID NO: 753281 - DNA, 20 bp, Artificial
  CRISPR gRNA sequence
attttattttaattttttgc

SEQ ID NO: 753282 - DNA, 20 bp, Artificial
  CRISPR gRNA sequence
ttttattttaattttttgca

SEQ ID NO: 753283 - DNA, 20 bp, Artificial
  CRISPR gRNA sequence
tattttaattttttgcaagg

SEQ ID NO: 753284 - DNA, 20 bp, Artificial
  CRISPR gRNA sequence
attttaattttttgcaaggg

SEQ ID NO: 753285 - DNA, 20 bp, Artificial
  CRISPR gRNA sequence
ttttaattttttgcaaggga

SEQ ID NO: 753286 - DNA, 20 bp, Artificial
  CRISPR gRNA sequence
taattttttgcaagggaaag

SEQ ID NO: 753287 - DNA, 20 bp, Artificial
  CRISPR gRNA sequence
aattttttgcaagggaaagc

SEQ ID NO: 753288 - DNA, 20 bp, Artificial
  CRISPR gRNA sequence
attttttgcaagggaaagca

SEQ ID NO: 753289 - DNA, 20 bp, Artificial
  CRISPR gRNA sequence
tttgcaagggaaagcagcag

SEQ ID NO: 753290 - DNA, 20 bp, Artificial
  CRISPR gRNA sequence
ttgcaagggaaagcagcagt

SEQ ID NO: 753291 - DNA, 20 bp, Artificial
  CRISPR gRNA sequence
tgcaagggaaagcagcagtt

SEQ ID NO: 753292 - DNA, 20 bp, Artificial
  CRISPR gRNA sequence
gcaagggaaagcagcagttt

SEQ ID NO: 753293 - DNA, 20 bp, Artificial
  CRISPR gRNA sequence
caagggaaagcagcagtttt

SEQ ID NO: 753294 - DNA, 20 bp, Artificial
  CRISPR gRNA sequence
tcagactccgagccttccca

SEQ ID NO: 753295 - DNA, 20 bp, Artificial
  CRISPR gRNA sequence
cagactccgagccttcccag

SEQ ID NO: 753296 - DNA, 20 bp, Artificial
  CRISPR gRNA sequence
agactccgagccttcccagg

SEQ ID NO: 753297 - DNA, 20 bp, Artificial
  CRISPR gRNA sequence
cgagccttcccaggctaaag

SEQ ID NO: 753298 - DNA, 20 bp, Artificial
  CRISPR gRNA sequence
cccaggctaaagtttccaac

SEQ ID NO: 753299 - DNA, 20 bp, Artificial
  CRISPR gRNA sequence
ccaggctaaagtttccaact

SEQ ID NO: 753300 - DNA, 20 bp, Artificial
  CRISPR gRNA sequence
aagtttccaactagaattca

SEQ ID NO: 753301 - DNA, 20 bp, Artificial
  CRISPR gRNA sequence
ccaactagaattcaataccc

SEQ ID NO: 753302 - DNA, 20 bp, Artificial
  CRISPR gRNA sequence
caactagaattcaataccct

SEQ ID NO: 753303 - DNA, 20 bp, Artificial
  CRISPR gRNA sequence
gaattcaatacccttatatg

SEQ ID NO: 753304 - DNA, 20 bp, Artificial
  CRISPR gRNA sequence
aatacccttatatggttttc

SEQ ID NO: 753305 - DNA, 20 bp, Artificial
  CRISPR gRNA sequence
atatggttttcctgttacgt

SEQ ID NO: 753306 - DNA, 20 bp, Artificial
  CRISPR gRNA sequence
tatggttttcctgttacgtt

SEQ ID NO: 753307 - DNA, 20 bp, Artificial
  CRISPR gRNA sequence
tcctgttacgttcttttatg

SEQ ID NO: 753308 - DNA, 20 bp, Artificial
  CRISPR gRNA sequence
cctgttacgttcttttatgg

SEQ ID NO: 753309 - DNA, 20 bp, Artificial
  CRISPR gRNA sequence
ctgttacgttcttttatggt

SEQ ID NO: 753310 - DNA, 20 bp, Artificial
  CRISPR gRNA sequence
ttacgttcttttatggtttt

SEQ ID NO: 753311 - DNA, 20 bp, Artificial
  CRISPR gRNA sequence
cgttcttttatggttttgtt

SEQ ID NO: 753312 - DNA, 20 bp, Artificial
  CRISPR gRNA sequence
ttttatggttttgttctatt

SEQ ID NO: 753313 - DNA, 20 bp, Artificial
  CRISPR gRNA sequence
ttatggttttgttctattta

SEQ ID NO: 753314 - DNA, 20 bp, Artificial
  CRISPR gRNA sequence
tatggttttgttctatttat

SEQ ID NO: 753315 - DNA, 20 bp, Artificial
  CRISPR gRNA sequence
atggttttgttctatttatg

SEQ ID NO: 753316 - DNA, 20 bp, Artificial
  CRISPR gRNA sequence
tggttttgttctatttatga

SEQ ID NO: 753317 - DNA, 20 bp, Artificial
  CRISPR gRNA sequence
tgttctatttatgacaagtg

SEQ ID NO: 753318 - DNA, 20 bp, Artificial
  CRISPR gRNA sequence
gttctatttatgacaagtga

SEQ ID NO: 753319 - DNA, 20 bp, Artificial
  CRISPR gRNA sequence
ttctatttatgacaagtgat

SEQ ID NO: 753320 - DNA, 20 bp, Artificial
  CRISPR gRNA sequence
tatttatgacaagtgatact

SEQ ID NO: 753321 - DNA, 20 bp, Artificial
  CRISPR gRNA sequence
tttatgacaagtgatactgg

SEQ ID NO: 753322 - DNA, 20 bp, Artificial
  CRISPR gRNA sequence
atgacaagtgatactggctt

SEQ ID NO: 753323 - DNA, 20 bp, Artificial
  CRISPR gRNA sequence
tgacaagtgatactggcttt

SEQ ID NO: 753324 - DNA, 20 bp, Artificial
  CRISPR gRNA sequence
gctttccactaatgacagcg

SEQ ID NO: 753325 - DNA, 20 bp, Artificial
  CRISPR gRNA sequence
tccactaatgacagcgataa

SEQ ID NO: 753326 - DNA, 20 bp, Artificial
  CRISPR gRNA sequence
ccactaatgacagcgataaa

SEQ ID NO: 753327 - DNA, 20 bp, Artificial
  CRISPR gRNA sequence
cactaatgacagcgataaaa

SEQ ID NO: 753328 - DNA, 20 bp, Artificial
  CRISPR gRNA sequence
atgacagcgataaaaagttt

SEQ ID NO: 753329 - DNA, 20 bp, Artificial
  CRISPR gRNA sequence
ccttttaaagatctacatac

SEQ ID NO: 753330 - DNA, 20 bp, Artificial
  CRISPR gRNA sequence
cttttaaagatctacatact

SEQ ID NO: 753331 - DNA, 20 bp, Artificial
  CRISPR gRNA sequence
ttaaagatctacatactcaa

SEQ ID NO: 753332 - DNA, 20 bp, Artificial
  CRISPR gRNA sequence
taaagatctacatactcaaa

SEQ ID NO: 753333 - DNA, 20 bp, Artificial
  CRISPR gRNA sequence
aaagatctacatactcaaat

SEQ ID NO: 753334 - DNA, 20 bp, Artificial
  CRISPR gRNA sequence
aagatctacatactcaaata

SEQ ID NO: 753335 - DNA, 20 bp, Artificial
  CRISPR gRNA sequence
catactcaaataaaagaatg

SEQ ID NO: 753336 - DNA, 20 bp, Artificial
  CRISPR gRNA sequence
aaataaaagaatgagtagat

SEQ ID NO: 753337 - DNA, 20 bp, Artificial
  CRISPR gRNA sequence
aaagaaaaaaataagtaaat

SEQ ID NO: 753338 - DNA, 20 bp, Artificial
  CRISPR gRNA sequence
aagaaaaaaataagtaaata

SEQ ID NO: 753339 - DNA, 20 bp, Artificial
  CRISPR gRNA sequence
tgaaaggcagacactgcaga

SEQ ID NO: 753340 - DNA, 20 bp, Artificial
  CRISPR gRNA sequence
cagagatcacaaaggtgata

SEQ ID NO: 753341 - DNA, 20 bp, Artificial
  CRISPR gRNA sequence
aagctagggaaacaccatca

SEQ ID NO: 753342 - DNA, 20 bp, Artificial
  CRISPR gRNA sequence
gggaaacaccatcatggaat

SEQ ID NO: 753343 - DNA, 20 bp, Artificial
  CRISPR gRNA sequence
accttcagaggagggtggtc

SEQ ID NO: 753344 - DNA, 20 bp, Artificial
  CRISPR gRNA sequence
cagaggagggtggtcagcct

SEQ ID NO: 753345 - DNA, 20 bp, Artificial
  CRISPR gRNA sequence
agaggagggtggtcagcctc

SEQ ID NO: 753346 - DNA, 20 bp, Artificial
  CRISPR gRNA sequence
actgagaccacgtcacccaa

SEQ ID NO: 753347 - DNA, 20 bp, Artificial
  CRISPR gRNA sequence
agaccacgtcacccaacctg

SEQ ID NO: 753348 - DNA, 20 bp, Artificial
  CRISPR gRNA sequence
tccattgcacagacaaaggg

SEQ ID NO: 753349 - DNA, 20 bp, Artificial
  CRISPR gRNA sequence
cacagacaaaggggaagtgt

SEQ ID NO: 753350 - DNA, 20 bp, Artificial
  CRISPR gRNA sequence
gtgttcccatgatgagtgaa

SEQ ID NO: 753351 - DNA, 20 bp, Artificial
  CRISPR gRNA sequence
tgttcccatgatgagtgaac

SEQ ID NO: 753352 - DNA, 20 bp, Artificial
  CRISPR gRNA sequence
ccatgatgagtgaacagcag

SEQ ID NO: 753353 - DNA, 20 bp, Artificial
  CRISPR gRNA sequence
gaccccaggtccccatggga

SEQ ID NO: 753354 - DNA, 20 bp, Artificial
  CRISPR gRNA sequence
accccaggtccccatgggaa

SEQ ID NO: 753355 - DNA, 20 bp, Artificial
  CRISPR gRNA sequence
cgcagaaaggctaaaggaat

SEQ ID NO: 753356 - DNA, 20 bp, Artificial
  CRISPR gRNA sequence
aaggaatgggcttgcttggc

SEQ ID NO: 753357 - DNA, 20 bp, Artificial
  CRISPR gRNA sequence
gcttggcttggtaagtagca

SEQ ID NO: 753358 - DNA, 20 bp, Artificial
  CRISPR gRNA sequence
cttggcttggtaagtagcag

SEQ ID NO: 753359 - DNA, 20 bp, Artificial
  CRISPR gRNA sequence
ggcttggtaagtagcagagc

SEQ ID NO: 753360 - DNA, 20 bp, Artificial
  CRISPR gRNA sequence
gcttggtaagtagcagagca

SEQ ID NO: 753361 - DNA, 20 bp, Artificial
  CRISPR gRNA sequence
ggtaagtagcagagcaacct

SEQ ID NO: 753362 - DNA, 20 bp, Artificial
  CRISPR gRNA sequence
gtaagtagcagagcaacctc

SEQ ID NO: 753363 - DNA, 20 bp, Artificial
  CRISPR gRNA sequence
attattggattactgatgag

SEQ ID NO: 753364 - DNA, 20 bp, Artificial
  CRISPR gRNA sequence
ttggattactgatgagaaag

SEQ ID NO: 753365 - DNA, 20 bp, Artificial
  CRISPR gRNA sequence
gattactgatgagaaagatg

SEQ ID NO: 753366 - DNA, 20 bp, Artificial
  CRISPR gRNA sequence
ctgatgagaaagatggtggc

SEQ ID NO: 753367 - DNA, 20 bp, Artificial
  CRISPR gRNA sequence
atgagaaagatggtggccac

SEQ ID NO: 753368 - DNA, 20 bp, Artificial
  CRISPR gRNA sequence
tctttgtctttggtgatggc

SEQ ID NO: 753369 - DNA, 20 bp, Artificial
  CRISPR gRNA sequence
tgtctttggtgatggccagc

SEQ ID NO: 753370 - DNA, 20 bp, Artificial
  CRISPR gRNA sequence
gtctttggtgatggccagcc

SEQ ID NO: 753371 - DNA, 20 bp, Artificial
  CRISPR gRNA sequence
tctttggtgatggccagcca

SEQ ID NO: 753372 - DNA, 20 bp, Artificial
  CRISPR gRNA sequence
tggtgatggccagccaaagt

SEQ ID NO: 753373 - DNA, 20 bp, Artificial
  CRISPR gRNA sequence
ggtgatggccagccaaagtg

SEQ ID NO: 753374 - DNA, 20 bp, Artificial
  CRISPR gRNA sequence
gtgatggccagccaaagtga

SEQ ID NO: 753375 - DNA, 20 bp, Artificial
  CRISPR gRNA sequence
gccttcaagttgcaatgtcc

SEQ ID NO: 753376 - DNA, 20 bp, Artificial
  CRISPR gRNA sequence
ccttcaagttgcaatgtccc

SEQ ID NO: 753377 - DNA, 20 bp, Artificial
  CRISPR gRNA sequence
caagttgcaatgtccccatc

SEQ ID NO: 753378 - DNA, 20 bp, Artificial
  CRISPR gRNA sequence
aagttgcaatgtccccatct

SEQ ID NO: 753379 - DNA, 20 bp, Artificial
  CRISPR gRNA sequence
caatgtccccatctcctgac

SEQ ID NO: 753380 - DNA, 20 bp, Artificial
  CRISPR gRNA sequence
ctgacaactttaagaagaga

SEQ ID NO: 753381 - DNA, 20 bp, Artificial
  CRISPR gRNA sequence
acaactttaagaagagaacc

SEQ ID NO: 753382 - DNA, 20 bp, Artificial
  CRISPR gRNA sequence
taagaagagaacctgtaggc

SEQ ID NO: 753383 - DNA, 20 bp, Artificial
  CRISPR gRNA sequence
aagaagagaacctgtaggca

SEQ ID NO: 753384 - DNA, 20 bp, Artificial
  CRISPR gRNA sequence
agaagagaacctgtaggcac

SEQ ID NO: 753385 - DNA, 20 bp, Artificial
  CRISPR gRNA sequence
taggcacctccatgggcatt

SEQ ID NO: 753386 - DNA, 20 bp, Artificial
  CRISPR gRNA sequence
catgggcatttcagactgtg

SEQ ID NO: 753387 - DNA, 20 bp, Artificial
  CRISPR gRNA sequence
cagactgtgagggcctacag

SEQ ID NO: 753388 - DNA, 20 bp, Artificial
  CRISPR gRNA sequence
agactgtgagggcctacagg

SEQ ID NO: 753389 - DNA, 20 bp, Artificial
  CRISPR gRNA sequence
tgagggcctacaggggctca

SEQ ID NO: 753390 - DNA, 20 bp, Artificial
  CRISPR gRNA sequence
caggggctcacaggtagctg

SEQ ID NO: 753391 - DNA, 20 bp, Artificial
  CRISPR gRNA sequence
acaggtagctggacgcagcc

SEQ ID NO: 753392 - DNA, 20 bp, Artificial
  CRISPR gRNA sequence
gacgcagcccatgcaccctt

SEQ ID NO: 753393 - DNA, 20 bp, Artificial
  CRISPR gRNA sequence
catactccaggctttggaga

SEQ ID NO: 753394 - DNA, 20 bp, Artificial
  CRISPR gRNA sequence
atactccaggctttggagaa

SEQ ID NO: 753395 - DNA, 20 bp, Artificial
  CRISPR gRNA sequence
caggctttggagaatctagt

SEQ ID NO: 753396 - DNA, 20 bp, Artificial
  CRISPR gRNA sequence
tggagaatctagtcccagtg

SEQ ID NO: 753397 - DNA, 20 bp, Artificial
  CRISPR gRNA sequence
ggagaatctagtcccagtga

SEQ ID NO: 753398 - DNA, 20 bp, Artificial
  CRISPR gRNA sequence
gagaatctagtcccagtgaa

SEQ ID NO: 753399 - DNA, 20 bp, Artificial
  CRISPR gRNA sequence
gtcccagtgaagctcaccaa

SEQ ID NO: 753400 - DNA, 20 bp, Artificial
  CRISPR gRNA sequence
accaatgccttcccaggccc

SEQ ID NO: 753401 - DNA, 20 bp, Artificial
  CRISPR gRNA sequence
cccaggccctgggcactcca

SEQ ID NO: 753402 - DNA, 20 bp, Artificial
  CRISPR gRNA sequence
ccaggccctgggcactccat

SEQ ID NO: 753403 - DNA, 20 bp, Artificial
  CRISPR gRNA sequence
ggcactccattaggccctgt

SEQ ID NO: 753404 - DNA, 20 bp, Artificial
  CRISPR gRNA sequence
cattaggccctgtagagagc

SEQ ID NO: 753405 - DNA, 20 bp, Artificial
  CRISPR gRNA sequence
ggccctgtagagagcaagca

SEQ ID NO: 753406 - DNA, 20 bp, Artificial
  CRISPR gRNA sequence
tagagagcaagcagcttaga

SEQ ID NO: 753407 - DNA, 20 bp, Artificial
  CRISPR gRNA sequence
agatagaaagccaatggcat

SEQ ID NO: 753408 - DNA, 20 bp, Artificial
  CRISPR gRNA sequence
gatagaaagccaatggcatg

SEQ ID NO: 753409 - DNA, 20 bp, Artificial
  CRISPR gRNA sequence
cagaagccaagaaataccat

SEQ ID NO: 753410 - DNA, 20 bp, Artificial
  CRISPR gRNA sequence
cacagtattcacgaggagcc

SEQ ID NO: 753411 - DNA, 20 bp, Artificial
  CRISPR gRNA sequence
acgaggagccgggtgctgtg

SEQ ID NO: 753412 - DNA, 20 bp, Artificial
  CRISPR gRNA sequence
tgttaagtgttcgttcattg

SEQ ID NO: 753413 - DNA, 20 bp, Artificial
  CRISPR gRNA sequence
agtgttcgttcattggctct

SEQ ID NO: 753414 - DNA, 20 bp, Artificial
  CRISPR gRNA sequence
gttcattggctcttcacagt

SEQ ID NO: 753415 - DNA, 20 bp, Artificial
  CRISPR gRNA sequence
attggctcttcacagttgcc

SEQ ID NO: 753416 - DNA, 20 bp, Artificial
  CRISPR gRNA sequence
gctcttcacagttgccctcc

SEQ ID NO: 753417 - DNA, 20 bp, Artificial
  CRISPR gRNA sequence
ttcacagttgccctccaagg

SEQ ID NO: 753418 - DNA, 20 bp, Artificial
  CRISPR gRNA sequence
cacagttgccctccaaggga

SEQ ID NO: 753419 - DNA, 20 bp, Artificial
  CRISPR gRNA sequence
acagttgccctccaagggag

SEQ ID NO: 753420 - DNA, 20 bp, Artificial
  CRISPR gRNA sequence
ccctccaagggaggtggtat

SEQ ID NO: 753421 - DNA, 20 bp, Artificial
  CRISPR gRNA sequence
caagggaggtggtatcatct

SEQ ID NO: 753422 - DNA, 20 bp, Artificial
  CRISPR gRNA sequence
cccactttagagggagggga

SEQ ID NO: 753423 - DNA, 20 bp, Artificial
  CRISPR gRNA sequence
ccactttagagggaggggaa

SEQ ID NO: 753424 - DNA, 20 bp, Artificial
  CRISPR gRNA sequence
tagagggaggggaacttgct

SEQ ID NO: 753425 - DNA, 20 bp, Artificial
  CRISPR gRNA sequence
agagggaggggaacttgctc

SEQ ID NO: 753426 - DNA, 20 bp, Artificial
  CRISPR gRNA sequence
gagggaggggaacttgctca

SEQ ID NO: 753427 - DNA, 20 bp, Artificial
  CRISPR gRNA sequence
gctcagggagactgaataac

SEQ ID NO: 753428 - DNA, 20 bp, Artificial
  CRISPR gRNA sequence
ctcagggagactgaataact

SEQ ID NO: 753429 - DNA, 20 bp, Artificial
  CRISPR gRNA sequence
agggagactgaataacttgt

SEQ ID NO: 753430 - DNA, 20 bp, Artificial
  CRISPR gRNA sequence
aataacttgtccaatatcac

SEQ ID NO: 753431 - DNA, 20 bp, Artificial
  CRISPR gRNA sequence
gtccaatatcacagagcagt

SEQ ID NO: 753432 - DNA, 20 bp, Artificial
  CRISPR gRNA sequence
tccaatatcacagagcagta

SEQ ID NO: 753433 - DNA, 20 bp, Artificial
  CRISPR gRNA sequence
gggatttaagcctaggtctg

SEQ ID NO: 753434 - DNA, 20 bp, Artificial
  CRISPR gRNA sequence
ggatttaagcctaggtctga

SEQ ID NO: 753435 - DNA, 20 bp, Artificial
  CRISPR gRNA sequence
aagcctaggtctgagtgact

SEQ ID NO: 753436 - DNA, 20 bp, Artificial
  CRISPR gRNA sequence
agcctaggtctgagtgactc

SEQ ID NO: 753437 - DNA, 20 bp, Artificial
  CRISPR gRNA sequence
ggtctgagtgactcacaaag

SEQ ID NO: 753438 - DNA, 20 bp, Artificial
  CRISPR gRNA sequence
agtgactcacaaagcccaag

SEQ ID NO: 753439 - DNA, 20 bp, Artificial
  CRISPR gRNA sequence
acaaagcccaagagttaagc

SEQ ID NO: 753440 - DNA, 20 bp, Artificial
  CRISPR gRNA sequence
agcaaggggctgtacggaag

SEQ ID NO: 753441 - DNA, 20 bp, Artificial
  CRISPR gRNA sequence
tacggaagccctggcatgca

SEQ ID NO: 753442 - DNA, 20 bp, Artificial
  CRISPR gRNA sequence
gcatgcatgtccctggcttt

SEQ ID NO: 753443 - DNA, 20 bp, Artificial
  CRISPR gRNA sequence
gctttgccatatacaggcat

SEQ ID NO: 753444 - DNA, 20 bp, Artificial
  CRISPR gRNA sequence
tgccatatacaggcatgctg

SEQ ID NO: 753445 - DNA, 20 bp, Artificial
  CRISPR gRNA sequence
gccatatacaggcatgctgg

SEQ ID NO: 753446 - DNA, 20 bp, Artificial
  CRISPR gRNA sequence
ccatatacaggcatgctggg

SEQ ID NO: 753447 - DNA, 20 bp, Artificial
  CRISPR gRNA sequence
ggactgcagctaagggcatc

SEQ ID NO: 753448 - DNA, 20 bp, Artificial
  CRISPR gRNA sequence
cagctaagggcatctgtggg

SEQ ID NO: 753449 - DNA, 20 bp, Artificial
  CRISPR gRNA sequence
agggcatctgtggggccact

SEQ ID NO: 753450 - DNA, 20 bp, Artificial
  CRISPR gRNA sequence
tggggccactggaagccaca

SEQ ID NO: 753451 - DNA, 20 bp, Artificial
  CRISPR gRNA sequence
gaagccacagtgctgatccc

SEQ ID NO: 753452 - DNA, 20 bp, Artificial
  CRISPR gRNA sequence
atccctggcccaccctcccc

SEQ ID NO: 753453 - DNA, 20 bp, Artificial
  CRISPR gRNA sequence
gcccaccctcccctgggaga

SEQ ID NO: 753454 - DNA, 20 bp, Artificial
  CRISPR gRNA sequence
ccctgggagaccagactgac

SEQ ID NO: 753455 - DNA, 20 bp, Artificial
  CRISPR gRNA sequence
ggagaccagactgaccctgg

SEQ ID NO: 753456 - DNA, 20 bp, Artificial
  CRISPR gRNA sequence
accctgggtcattggttggc

SEQ ID NO: 753457 - DNA, 20 bp, Artificial
  CRISPR gRNA sequence
ggtcattggttggctaaagc

SEQ ID NO: 753458 - DNA, 20 bp, Artificial
  CRISPR gRNA sequence
gttggctaaagcctggggcc

SEQ ID NO: 753459 - DNA, 20 bp, Artificial
  CRISPR gRNA sequence
gctaaagcctggggcctcaa

SEQ ID NO: 753460 - DNA, 20 bp, Artificial
  CRISPR gRNA sequence
aagcctggggcctcaagttt

SEQ ID NO: 753461 - DNA, 20 bp, Artificial
  CRISPR gRNA sequence
gggcctcaagtttggtatgt

SEQ ID NO: 753462 - DNA, 20 bp, Artificial
  CRISPR gRNA sequence
aagtttggtatgtggggctc

SEQ ID NO: 753463 - DNA, 20 bp, Artificial
  CRISPR gRNA sequence
ggtatgtggggctcgctcac

SEQ ID NO: 753464 - DNA, 20 bp, Artificial
  CRISPR gRNA sequence
gtatgtggggctcgctcact

SEQ ID NO: 753465 - DNA, 20 bp, Artificial
  CRISPR gRNA sequence
gctcactgccaacgggttct

SEQ ID NO: 753466 - DNA, 20 bp, Artificial
  CRISPR gRNA sequence
actgccaacgggttctcctt

SEQ ID NO: 753467 - DNA, 20 bp, Artificial
  CRISPR gRNA sequence
ccaacgggttctccttgagg

SEQ ID NO: 753468 - DNA, 20 bp, Artificial
  CRISPR gRNA sequence
tccttgaggatccctttctt

SEQ ID NO: 753469 - DNA, 20 bp, Artificial
  CRISPR gRNA sequence
cttgaggatccctttcttcc

SEQ ID NO: 753470 - DNA, 20 bp, Artificial
  CRISPR gRNA sequence
gaggatccctttcttccttt

SEQ ID NO: 753471 - DNA, 20 bp, Artificial
  CRISPR gRNA sequence
aggatccctttcttcctttc

SEQ ID NO: 753472 - DNA, 20 bp, Artificial
  CRISPR gRNA sequence
tcttcctttcatctgctcag

SEQ ID NO: 753473 - DNA, 20 bp, Artificial
  CRISPR gRNA sequence
cttcctttcatctgctcagg

SEQ ID NO: 753474 - DNA, 20 bp, Artificial
  CRISPR gRNA sequence
ttcctttcatctgctcaggc

SEQ ID NO: 753475 - DNA, 20 bp, Artificial
  CRISPR gRNA sequence
cctttcatctgctcaggcct

SEQ ID NO: 753476 - DNA, 20 bp, Artificial
  CRISPR gRNA sequence
ctttcatctgctcaggccta

SEQ ID NO: 753477 - DNA, 20 bp, Artificial
  CRISPR gRNA sequence
tcatctgctcaggcctaaca

SEQ ID NO: 753478 - DNA, 20 bp, Artificial
  CRISPR gRNA sequence
catctgctcaggcctaacac

SEQ ID NO: 753479 - DNA, 20 bp, Artificial
  CRISPR gRNA sequence
atctgctcaggcctaacacc

SEQ ID NO: 753480 - DNA, 20 bp, Artificial
  CRISPR gRNA sequence
ctcaggcctaacaccccata

SEQ ID NO: 753481 - DNA, 20 bp, Artificial
  CRISPR gRNA sequence
aggcctaacaccccatacac

SEQ ID NO: 753482 - DNA, 20 bp, Artificial
  CRISPR gRNA sequence
acaccccatacactgtgtgc

SEQ ID NO: 753483 - DNA, 20 bp, Artificial
  CRISPR gRNA sequence
tgtgcggatagggaggtgac

SEQ ID NO: 753484 - DNA, 20 bp, Artificial
  CRISPR gRNA sequence
tagcgtctcagcagcacact

SEQ ID NO: 753485 - DNA, 20 bp, Artificial
  CRISPR gRNA sequence
agcgtctcagcagcacactc

SEQ ID NO: 753486 - DNA, 20 bp, Artificial
  CRISPR gRNA sequence
gcgtctcagcagcacactcc

SEQ ID NO: 753487 - DNA, 20 bp, Artificial
  CRISPR gRNA sequence
agcagcacactcctgcctgg

SEQ ID NO: 753488 - DNA, 20 bp, Artificial
  CRISPR gRNA sequence
ctgcctggaccaccctctcc

SEQ ID NO: 753489 - DNA, 20 bp, Artificial
  CRISPR gRNA sequence
cctggaccaccctctcccag

SEQ ID NO: 753490 - DNA, 20 bp, Artificial
  CRISPR gRNA sequence
gaccaccctctcccaggaag

SEQ ID NO: 753491 - DNA, 20 bp, Artificial
  CRISPR gRNA sequence
tcccaggaaggtcagacccc

SEQ ID NO: 753492 - DNA, 20 bp, Artificial
  CRISPR gRNA sequence
ccaggaaggtcagaccccag

SEQ ID NO: 753493 - DNA, 20 bp, Artificial
  CRISPR gRNA sequence
tgccctgcttgggtggaagc

SEQ ID NO: 753494 - DNA, 20 bp, Artificial
  CRISPR gRNA sequence
gccctgcttgggtggaagca

SEQ ID NO: 753495 - DNA, 20 bp, Artificial
  CRISPR gRNA sequence
ccctgcttgggtggaagcat

SEQ ID NO: 753496 - DNA, 20 bp, Artificial
  CRISPR gRNA sequence
cttgggtggaagcatgaaca

SEQ ID NO: 753497 - DNA, 20 bp, Artificial
  CRISPR gRNA sequence
gggtggaagcatgaacaact

SEQ ID NO: 753498 - DNA, 20 bp, Artificial
  CRISPR gRNA sequence
ggtggaagcatgaacaacta

SEQ ID NO: 753499 - DNA, 20 bp, Artificial
  CRISPR gRNA sequence
gtacagctcagcaagggact

SEQ ID NO: 753500 - DNA, 20 bp, Artificial
  CRISPR gRNA sequence
agcaagggactcccagtatt

SEQ ID NO: 753501 - DNA, 20 bp, Artificial
  CRISPR gRNA sequence
ccagtattgctggcccttgg

SEQ ID NO: 753502 - DNA, 20 bp, Artificial
  CRISPR gRNA sequence
ctggcccttgggtgtccctg

SEQ ID NO: 753503 - DNA, 20 bp, Artificial
  CRISPR gRNA sequence
gcccttgggtgtccctggca

SEQ ID NO: 753504 - DNA, 20 bp, Artificial
  CRISPR gRNA sequence
gggtgtccctggcattgggt

SEQ ID NO: 753505 - DNA, 20 bp, Artificial
  CRISPR gRNA sequence
ggtgtccctggcattgggta

SEQ ID NO: 753506 - DNA, 20 bp, Artificial
  CRISPR gRNA sequence
gcattgggtagatgacccct

SEQ ID NO: 753507 - DNA, 20 bp, Artificial
  CRISPR gRNA sequence
ggtagatgacccctcatgcc

SEQ ID NO: 753508 - DNA, 20 bp, Artificial
  CRISPR gRNA sequence
atgccagggactggcctcaa

SEQ ID NO: 753509 - DNA, 20 bp, Artificial
  CRISPR gRNA sequence
gcctcaaggctgttcctctc

SEQ ID NO: 753510 - DNA, 20 bp, Artificial
  CRISPR gRNA sequence
aaggctgttcctctctactc

SEQ ID NO: 753511 - DNA, 20 bp, Artificial
  CRISPR gRNA sequence
ttcctctctactccagagcc

SEQ ID NO: 753512 - DNA, 20 bp, Artificial
  CRISPR gRNA sequence
ctctctactccagagcctct

SEQ ID NO: 753513 - DNA, 20 bp, Artificial
  CRISPR gRNA sequence
tctactccagagcctctggg

SEQ ID NO: 753514 - DNA, 20 bp, Artificial
  CRISPR gRNA sequence
tactccagagcctctgggca

SEQ ID NO: 753515 - DNA, 20 bp, Artificial
  CRISPR gRNA sequence
ctccagagcctctgggcagt

SEQ ID NO: 753516 - DNA, 20 bp, Artificial
  CRISPR gRNA sequence
cagagcctctgggcagtggg

SEQ ID NO: 753517 - DNA, 20 bp, Artificial
  CRISPR gRNA sequence
tgggcagtgggttgtggatt

SEQ ID NO: 753518 - DNA, 20 bp, Artificial
  CRISPR gRNA sequence
ggcagtgggttgtggatttc

SEQ ID NO: 753519 - DNA, 20 bp, Artificial
  CRISPR gRNA sequence
tggatttcctaagagctgac

SEQ ID NO: 753520 - DNA, 20 bp, Artificial
  CRISPR gRNA sequence
cctaagagctgaccattgct

SEQ ID NO: 753521 - DNA, 20 bp, Artificial
  CRISPR gRNA sequence
ctaagagctgaccattgctg

SEQ ID NO: 753522 - DNA, 20 bp, Artificial
  CRISPR gRNA sequence
agagctgaccattgctgcgt

SEQ ID NO: 753523 - DNA, 20 bp, Artificial
  CRISPR gRNA sequence
accattgctgcgtcagaggc

SEQ ID NO: 753524 - DNA, 20 bp, Artificial
  CRISPR gRNA sequence
ctgcgtcagaggcttgcagc

SEQ ID NO: 753525 - DNA, 20 bp, Artificial
  CRISPR gRNA sequence
cgtcagaggcttgcagcact

SEQ ID NO: 753526 - DNA, 20 bp, Artificial
  CRISPR gRNA sequence
gcagcactgggttactcaac

SEQ ID NO: 753527 - DNA, 20 bp, Artificial
  CRISPR gRNA sequence
cagcactgggttactcaaca

SEQ ID NO: 753528 - DNA, 20 bp, Artificial
  CRISPR gRNA sequence
ggttactcaacaaggccctg

SEQ ID NO: 753529 - DNA, 20 bp, Artificial
  CRISPR gRNA sequence
ctcaacaaggccctgcagcc

SEQ ID NO: 753530 - DNA, 20 bp, Artificial
  CRISPR gRNA sequence
aacaaggccctgcagcctgg

SEQ ID NO: 753531 - DNA, 20 bp, Artificial
  CRISPR gRNA sequence
cagcctggtttgctatgaag

SEQ ID NO: 753532 - DNA, 20 bp, Artificial
  CRISPR gRNA sequence
gtttgctatgaaggagaaga

SEQ ID NO: 753533 - DNA, 20 bp, Artificial
  CRISPR gRNA sequence
gctatgaaggagaagatggg

SEQ ID NO: 753534 - DNA, 20 bp, Artificial
  CRISPR gRNA sequence
ctatgaaggagaagatgggg

SEQ ID NO: 753535 - DNA, 20 bp, Artificial
  CRISPR gRNA sequence
tgaaggagaagatggggtct

SEQ ID NO: 753536 - DNA, 20 bp, Artificial
  CRISPR gRNA sequence
tcgtccctagccccagtgca

SEQ ID NO: 753537 - DNA, 20 bp, Artificial
  CRISPR gRNA sequence
gtccctagccccagtgcact

SEQ ID NO: 753538 - DNA, 20 bp, Artificial
  CRISPR gRNA sequence
gccccagtgcacttaaatgt

SEQ ID NO: 753539 - DNA, 20 bp, Artificial
  CRISPR gRNA sequence
aaatgtgctagtcccagagg

SEQ ID NO: 753540 - DNA, 20 bp, Artificial
  CRISPR gRNA sequence
aatgtgctagtcccagaggt

SEQ ID NO: 753541 - DNA, 20 bp, Artificial
  CRISPR gRNA sequence
gtcccagaggttgggagtcc

SEQ ID NO: 753542 - DNA, 20 bp, Artificial
  CRISPR gRNA sequence
ggagtcctgagtcagcctgt

SEQ ID NO: 753543 - DNA, 20 bp, Artificial
  CRISPR gRNA sequence
agtcagcctgtgaggacagg

SEQ ID NO: 753544 - DNA, 20 bp, Artificial
  CRISPR gRNA sequence
tgaggacagggcaaggacag

SEQ ID NO: 753545 - DNA, 20 bp, Artificial
  CRISPR gRNA sequence
cctcgggtcctgggaatgtc

SEQ ID NO: 753546 - DNA, 20 bp, Artificial
  CRISPR gRNA sequence
gggtcctgggaatgtctgtg

SEQ ID NO: 753547 - DNA, 20 bp, Artificial
  CRISPR gRNA sequence
ggaatgtctgtggggaagaa

SEQ ID NO: 753548 - DNA, 20 bp, Artificial
  CRISPR gRNA sequence
tggggaagaagaggctctgc

SEQ ID NO: 753549 - DNA, 20 bp, Artificial
  CRISPR gRNA sequence
tgctacccttgagatctgct

SEQ ID NO: 753550 - DNA, 20 bp, Artificial
  CRISPR gRNA sequence
ctacccttgagatctgctgg

SEQ ID NO: 753551 - DNA, 20 bp, Artificial
  CRISPR gRNA sequence
cccttgagatctgctgggtc

SEQ ID NO: 753552 - DNA, 20 bp, Artificial
  CRISPR gRNA sequence
gagatctgctgggtcctggt

SEQ ID NO: 753553 - DNA, 20 bp, Artificial
  CRISPR gRNA sequence
agatctgctgggtcctggtc

SEQ ID NO: 753554 - DNA, 20 bp, Artificial
  CRISPR gRNA sequence
ctgggtcctggtccctaagt

SEQ ID NO: 753555 - DNA, 20 bp, Artificial
  CRISPR gRNA sequence
ggtcctggtccctaagtgta

SEQ ID NO: 753556 - DNA, 20 bp, Artificial
  CRISPR gRNA sequence
gtccctaagtgtacctctcc

SEQ ID NO: 753557 - DNA, 20 bp, Artificial
  CRISPR gRNA sequence
agtgtacctctccacccatc

SEQ ID NO: 753558 - DNA, 20 bp, Artificial
  CRISPR gRNA sequence
tccacccatctcaccctgag

SEQ ID NO: 753559 - DNA, 20 bp, Artificial
  CRISPR gRNA sequence
cacccatctcaccctgagtc

SEQ ID NO: 753560 - DNA, 20 bp, Artificial
  CRISPR gRNA sequence
accctgagtcaggcccagga

SEQ ID NO: 753561 - DNA, 20 bp, Artificial
  CRISPR gRNA sequence
agtcaggcccaggaaagggg

SEQ ID NO: 753562 - DNA, 20 bp, Artificial
  CRISPR gRNA sequence
tggtgtttcctgggcttctg

SEQ ID NO: 753563 - DNA, 20 bp, Artificial
  CRISPR gRNA sequence
ggtgtttcctgggcttctga

SEQ ID NO: 753564 - DNA, 20 bp, Artificial
  CRISPR gRNA sequence
gtgtttcctgggcttctgaa

SEQ ID NO: 753565 - DNA, 20 bp, Artificial
  CRISPR gRNA sequence
cctgggcttctgaacaccac

SEQ ID NO: 753566 - DNA, 20 bp, Artificial
  CRISPR gRNA sequence
ctgggcttctgaacaccaca

SEQ ID NO: 753567 - DNA, 20 bp, Artificial
  CRISPR gRNA sequence
ggcttctgaacaccacattc

SEQ ID NO: 753568 - DNA, 20 bp, Artificial
  CRISPR gRNA sequence
ctgaacaccacattcatcac

SEQ ID NO: 753569 - DNA, 20 bp, Artificial
  CRISPR gRNA sequence
tgaacaccacattcatcact

SEQ ID NO: 753570 - DNA, 20 bp, Artificial
  CRISPR gRNA sequence
aacaccacattcatcactac

SEQ ID NO: 753571 - DNA, 20 bp, Artificial
  CRISPR gRNA sequence
atcactaccattctcctcag

SEQ ID NO: 753572 - DNA, 20 bp, Artificial
  CRISPR gRNA sequence
ccattctcctcagtgctggc

SEQ ID NO: 753573 - DNA, 20 bp, Artificial
  CRISPR gRNA sequence
tcctcagtgctggcccaacc

SEQ ID NO: 753574 - DNA, 20 bp, Artificial
  CRISPR gRNA sequence
ctcagtgctggcccaacccc

SEQ ID NO: 753575 - DNA, 20 bp, Artificial
  CRISPR gRNA sequence
agtgctggcccaaccccaag

SEQ ID NO: 753576 - DNA, 20 bp, Artificial
  CRISPR gRNA sequence
gcccaaccccaagagctgga

SEQ ID NO: 753577 - DNA, 20 bp, Artificial
  CRISPR gRNA sequence
gagaacaggctggccccggc

SEQ ID NO: 753578 - DNA, 20 bp, Artificial
  CRISPR gRNA sequence
gccccggccactctatctca

SEQ ID NO: 753579 - DNA, 20 bp, Artificial
  CRISPR gRNA sequence
tatctcactttccctggcat

SEQ ID NO: 753580 - DNA, 20 bp, Artificial
  CRISPR gRNA sequence
tctcactttccctggcataa

SEQ ID NO: 753581 - DNA, 20 bp, Artificial
  CRISPR gRNA sequence
actttccctggcataaaggc

SEQ ID NO: 753582 - DNA, 20 bp, Artificial
  CRISPR gRNA sequence
tccctggcataaaggctttg

SEQ ID NO: 753583 - DNA, 20 bp, Artificial
  CRISPR gRNA sequence
ccctggcataaaggctttga

SEQ ID NO: 753584 - DNA, 20 bp, Artificial
  CRISPR gRNA sequence
cctggcataaaggctttgac

SEQ ID NO: 753585 - DNA, 20 bp, Artificial
  CRISPR gRNA sequence
gcataaaggctttgaccttg

SEQ ID NO: 753586 - DNA, 20 bp, Artificial
  CRISPR gRNA sequence
tgaccttgggcaacataccc

SEQ ID NO: 753587 - DNA, 20 bp, Artificial
  CRISPR gRNA sequence
gaccttgggcaacataccca

SEQ ID NO: 753588 - DNA, 20 bp, Artificial
  CRISPR gRNA sequence
accttgggcaacatacccag

SEQ ID NO: 753589 - DNA, 20 bp, Artificial
  CRISPR gRNA sequence
gggcaacatacccagggcaa

SEQ ID NO: 753590 - DNA, 20 bp, Artificial
  CRISPR gRNA sequence
ggcaacatacccagggcaac

SEQ ID NO: 753591 - DNA, 20 bp, Artificial
  CRISPR gRNA sequence
ggcaggctggtgatcaatct

SEQ ID NO: 753592 - DNA, 20 bp, Artificial
  CRISPR gRNA sequence
gtgatcaatcttctcaactt

SEQ ID NO: 753593 - DNA, 20 bp, Artificial
  CRISPR gRNA sequence
ctcaacttacagatcctgct

SEQ ID NO: 753594 - DNA, 20 bp, Artificial
  CRISPR gRNA sequence
tcaacttacagatcctgctg

SEQ ID NO: 753595 - DNA, 20 bp, Artificial
  CRISPR gRNA sequence
aacttacagatcctgctgac

SEQ ID NO: 753596 - DNA, 20 bp, Artificial
  CRISPR gRNA sequence
acagatcctgctgaccatgc

SEQ ID NO: 753597 - DNA, 20 bp, Artificial
  CRISPR gRNA sequence
cagatcctgctgaccatgcc

SEQ ID NO: 753598 - DNA, 20 bp, Artificial
  CRISPR gRNA sequence
ctgaccatgcctgcaaccag

SEQ ID NO: 753599 - DNA, 20 bp, Artificial
  CRISPR gRNA sequence
accatgcctgcaaccaggcc

SEQ ID NO: 753600 - DNA, 20 bp, Artificial
  CRISPR gRNA sequence
caaccaggcctcccatctgc

SEQ ID NO: 753601 - DNA, 20 bp, Artificial
  CRISPR gRNA sequence
ccatctgctatctccctcag

SEQ ID NO: 753602 - DNA, 20 bp, Artificial
  CRISPR gRNA sequence
ctatctccctcagtgcacac

SEQ ID NO: 753603 - DNA, 20 bp, Artificial
  CRISPR gRNA sequence
tctccctcagtgcacactgt

SEQ ID NO: 753604 - DNA, 20 bp, Artificial
  CRISPR gRNA sequence
cctcagtgcacactgtccta

SEQ ID NO: 753605 - DNA, 20 bp, Artificial
  CRISPR gRNA sequence
agtgcacactgtcctaggga

SEQ ID NO: 753606 - DNA, 20 bp, Artificial
  CRISPR gRNA sequence
tcctagggagttgggtgaat

SEQ ID NO: 753607 - DNA, 20 bp, Artificial
  CRISPR gRNA sequence
gggagttgggtgaatatcta

SEQ ID NO: 753608 - DNA, 20 bp, Artificial
  CRISPR gRNA sequence
ggtgaatatctattatagtg

SEQ ID NO: 753609 - DNA, 20 bp, Artificial
  CRISPR gRNA sequence
ttatagtgtgtccatgtcac

SEQ ID NO: 753610 - DNA, 20 bp, Artificial
  CRISPR gRNA sequence
tagtgtgtccatgtcacagt

SEQ ID NO: 753611 - DNA, 20 bp, Artificial
  CRISPR gRNA sequence
agaatcctgaggtcccagag

SEQ ID NO: 753612 - DNA, 20 bp, Artificial
  CRISPR gRNA sequence
aggtcccagagcaattcaaa

SEQ ID NO: 753613 - DNA, 20 bp, Artificial
  CRISPR gRNA sequence
aaatgcttctggctcctttc

SEQ ID NO: 753614 - DNA, 20 bp, Artificial
  CRISPR gRNA sequence
ctggctcctttcagtggaaa

SEQ ID NO: 753615 - DNA, 20 bp, Artificial
  CRISPR gRNA sequence
tggctcctttcagtggaaag

SEQ ID NO: 753616 - DNA, 20 bp, Artificial
  CRISPR gRNA sequence
gctcctttcagtggaaagct

SEQ ID NO: 753617 - DNA, 20 bp, Artificial
  CRISPR gRNA sequence
ctttcagtggaaagctgcag

SEQ ID NO: 753618 - DNA, 20 bp, Artificial
  CRISPR gRNA sequence
tcagtggaaagctgcagcca

SEQ ID NO: 753619 - DNA, 20 bp, Artificial
  CRISPR gRNA sequence
cagtggaaagctgcagccag

SEQ ID NO: 753620 - DNA, 20 bp, Artificial
  CRISPR gRNA sequence
agtggaaagctgcagccagc

SEQ ID NO: 753621 - DNA, 20 bp, Artificial
  CRISPR gRNA sequence
cagccagcctaaatcatctc

SEQ ID NO: 753622 - DNA, 20 bp, Artificial
  CRISPR gRNA sequence
aatcatctccctgtgctggg

SEQ ID NO: 753623 - DNA, 20 bp, Artificial
  CRISPR gRNA sequence
cctgtgctgggcccaggaag

SEQ ID NO: 753624 - DNA, 20 bp, Artificial
  CRISPR gRNA sequence
tgctgggcccaggaagagat

SEQ ID NO: 753625 - DNA, 20 bp, Artificial
  CRISPR gRNA sequence
ggcccaggaagagatgaccc

SEQ ID NO: 753626 - DNA, 20 bp, Artificial
  CRISPR gRNA sequence
tagtataccatgttgtttga

SEQ ID NO: 753627 - DNA, 20 bp, Artificial
  CRISPR gRNA sequence
agtataccatgttgtttgag

SEQ ID NO: 753628 - DNA, 20 bp, Artificial
  CRISPR gRNA sequence
gtataccatgttgtttgagt

SEQ ID NO: 753629 - DNA, 20 bp, Artificial
  CRISPR gRNA sequence
tttgagtagccaagacctct

SEQ ID NO: 753630 - DNA, 20 bp, Artificial
  CRISPR gRNA sequence
gagtagccaagacctctggg

SEQ ID NO: 753631 - DNA, 20 bp, Artificial
  CRISPR gRNA sequence
agtagccaagacctctggga

SEQ ID NO: 753632 - DNA, 20 bp, Artificial
  CRISPR gRNA sequence
tgggagtaaaggcccctggc

SEQ ID NO: 753633 - DNA, 20 bp, Artificial
  CRISPR gRNA sequence
ggagtaaaggcccctggcca

SEQ ID NO: 753634 - DNA, 20 bp, Artificial
  CRISPR gRNA sequence
gccatataagcaatataggg

SEQ ID NO: 753635 - DNA, 20 bp, Artificial
  CRISPR gRNA sequence
agctcctcttggggcctctc

SEQ ID NO: 753636 - DNA, 20 bp, Artificial
  CRISPR gRNA sequence
ctcttggggcctctctgcta

SEQ ID NO: 753637 - DNA, 20 bp, Artificial
  CRISPR gRNA sequence
ttggggcctctctgctactg

SEQ ID NO: 753638 - DNA, 20 bp, Artificial
  CRISPR gRNA sequence
ggggcctctctgctactggg

SEQ ID NO: 753639 - DNA, 20 bp, Artificial
  CRISPR gRNA sequence
gggcctctctgctactgggt

SEQ ID NO: 753640 - DNA, 20 bp, Artificial
  CRISPR gRNA sequence
tctgctactgggtgctctgc

SEQ ID NO: 753641 - DNA, 20 bp, Artificial
  CRISPR gRNA sequence
tgctactgggtgctctgcaa

SEQ ID NO: 753642 - DNA, 20 bp, Artificial
  CRISPR gRNA sequence
ctactgggtgctctgcaagc

SEQ ID NO: 753643 - DNA, 20 bp, Artificial
  CRISPR gRNA sequence
ctgggtgctctgcaagctgg

SEQ ID NO: 753644 - DNA, 20 bp, Artificial
  CRISPR gRNA sequence
ggtgctctgcaagctgggtc

SEQ ID NO: 753645 - DNA, 20 bp, Artificial
  CRISPR gRNA sequence
tgcaagctgggtccctgtgc

SEQ ID NO: 753646 - DNA, 20 bp, Artificial
  CRISPR gRNA sequence
caagctgggtccctgtgccc

SEQ ID NO: 753647 - DNA, 20 bp, Artificial
  CRISPR gRNA sequence
ggtccctgtgccctggatct

SEQ ID NO: 753648 - DNA, 20 bp, Artificial
  CRISPR gRNA sequence
tgccctggatctctagaaat

SEQ ID NO: 753649 - DNA, 20 bp, Artificial
  CRISPR gRNA sequence
gatctctagaaatgtttctc

SEQ ID NO: 753650 - DNA, 20 bp, Artificial
  CRISPR gRNA sequence
tagaaatgtttctcaaattg

SEQ ID NO: 753651 - DNA, 20 bp, Artificial
  CRISPR gRNA sequence
gaaatgtttctcaaattggg

SEQ ID NO: 753652 - DNA, 20 bp, Artificial
  CRISPR gRNA sequence
ctcaaattggggctgctgaa

SEQ ID NO: 753653 - DNA, 20 bp, Artificial
  CRISPR gRNA sequence
tcaaattggggctgctgaac

SEQ ID NO: 753654 - DNA, 20 bp, Artificial
  CRISPR gRNA sequence
aaattggggctgctgaacag

SEQ ID NO: 753655 - DNA, 20 bp, Artificial
  CRISPR gRNA sequence
gggctgctgaacagagggca

SEQ ID NO: 753656 - DNA, 20 bp, Artificial
  CRISPR gRNA sequence
ctgaacagagggcagcccag

SEQ ID NO: 753657 - DNA, 20 bp, Artificial
  CRISPR gRNA sequence
aacagagggcagcccagcca

SEQ ID NO: 753658 - DNA, 20 bp, Artificial
  CRISPR gRNA sequence
acagggccaccagggagggc

SEQ ID NO: 753659 - DNA, 20 bp, Artificial
  CRISPR gRNA sequence
gcttgcctgcctgccaccat

SEQ ID NO: 753660 - DNA, 20 bp, Artificial
  CRISPR gRNA sequence
gcctgcctgccaccatcctc

SEQ ID NO: 753661 - DNA, 20 bp, Artificial
  CRISPR gRNA sequence
cctgcctgccaccatcctct

SEQ ID NO: 753662 - DNA, 20 bp, Artificial
  CRISPR gRNA sequence
cctgccaccatcctctgttc

SEQ ID NO: 753663 - DNA, 20 bp, Artificial
  CRISPR gRNA sequence
ccaccatcctctgttccttc

SEQ ID NO: 753664 - DNA, 20 bp, Artificial
  CRISPR gRNA sequence
tgttccttctggaagccatg

SEQ ID NO: 753665 - DNA, 20 bp, Artificial
  CRISPR gRNA sequence
ttccttctggaagccatgcc

SEQ ID NO: 753666 - DNA, 20 bp, Artificial
  CRISPR gRNA sequence
cttctggaagccatgccctg

SEQ ID NO: 753667 - DNA, 20 bp, Artificial
  CRISPR gRNA sequence
ctggaagccatgccctgcca

SEQ ID NO: 753668 - DNA, 20 bp, Artificial
  CRISPR gRNA sequence
tggaagccatgccctgccat

SEQ ID NO: 753669 - DNA, 20 bp, Artificial
  CRISPR gRNA sequence
gaagccatgccctgccatga

SEQ ID NO: 753670 - DNA, 20 bp, Artificial
  CRISPR gRNA sequence
ccatgagccatggccttggt

SEQ ID NO: 753671 - DNA, 20 bp, Artificial
  CRISPR gRNA sequence
ggtgctgagactgtccattc

SEQ ID NO: 753672 - DNA, 20 bp, Artificial
  CRISPR gRNA sequence
gtgctgagactgtccattcc

SEQ ID NO: 753673 - DNA, 20 bp, Artificial
  CRISPR gRNA sequence
agactgtccattccacctcc

SEQ ID NO: 753674 - DNA, 20 bp, Artificial
  CRISPR gRNA sequence
tccattccacctcccattct

SEQ ID NO: 753675 - DNA, 20 bp, Artificial
  CRISPR gRNA sequence
cacctcccattctcctcctc

SEQ ID NO: 753676 - DNA, 20 bp, Artificial
  CRISPR gRNA sequence
ccattctcctcctccctctg

SEQ ID NO: 753677 - DNA, 20 bp, Artificial
  CRISPR gRNA sequence
tcctcctccctctgactgtc

SEQ ID NO: 753678 - DNA, 20 bp, Artificial
  CRISPR gRNA sequence
ctcctccctctgactgtcac

SEQ ID NO: 753679 - DNA, 20 bp, Artificial
  CRISPR gRNA sequence
ctccctctgactgtcacctt

SEQ ID NO: 753680 - DNA, 20 bp, Artificial
  CRISPR gRNA sequence
cctctgactgtcaccttgag

SEQ ID NO: 753681 - DNA, 20 bp, Artificial
  CRISPR gRNA sequence
tgactgtcaccttgagaagc

SEQ ID NO: 753682 - DNA, 20 bp, Artificial
  CRISPR gRNA sequence
actgtcaccttgagaagcat

SEQ ID NO: 753683 - DNA, 20 bp, Artificial
  CRISPR gRNA sequence
tcaccttgagaagcatccac

SEQ ID NO: 753684 - DNA, 20 bp, Artificial
  CRISPR gRNA sequence
gagaagcatccaccctgggg

SEQ ID NO: 753685 - DNA, 20 bp, Artificial
  CRISPR gRNA sequence
agaagcatccaccctggggc

SEQ ID NO: 753686 - DNA, 20 bp, Artificial
  CRISPR gRNA sequence
gggcttagggcagctgtgtc

SEQ ID NO: 753687 - DNA, 20 bp, Artificial
  CRISPR gRNA sequence
agggcagctgtgtctgtgac

SEQ ID NO: 753688 - DNA, 20 bp, Artificial
  CRISPR gRNA sequence
gggcagctgtgtctgtgaca

SEQ ID NO: 753689 - DNA, 20 bp, Artificial
  CRISPR gRNA sequence
tgtctgtgacatgtggagcc

SEQ ID NO: 753690 - DNA, 20 bp, Artificial
  CRISPR gRNA sequence
tgacatgtggagccctcctc

SEQ ID NO: 753691 - DNA, 20 bp, Artificial
  CRISPR gRNA sequence
ctcctcctcagaggcccagg

SEQ ID NO: 753692 - DNA, 20 bp, Artificial
  CRISPR gRNA sequence
ctcctcagaggcccaggcca

SEQ ID NO: 753693 - DNA, 20 bp, Artificial
  CRISPR gRNA sequence
ctcagaggcccaggccagcc

SEQ ID NO: 753694 - DNA, 20 bp, Artificial
  CRISPR gRNA sequence
agaggcccaggccagcctcc

SEQ ID NO: 753695 - DNA, 20 bp, Artificial
  CRISPR gRNA sequence
caagtgctgagatagccagc

SEQ ID NO: 753696 - DNA, 20 bp, Artificial
  CRISPR gRNA sequence
agatagccagctgcctgtgg

SEQ ID NO: 753697 - DNA, 20 bp, Artificial
  CRISPR gRNA sequence
cctgtgggcacccaggttgc

SEQ ID NO: 753698 - DNA, 20 bp, Artificial
  CRISPR gRNA sequence
tgggcacccaggttgctaag

SEQ ID NO: 753699 - DNA, 20 bp, Artificial
  CRISPR gRNA sequence
ctaaggtatcttccaggttc

SEQ ID NO: 753700 - DNA, 20 bp, Artificial
  CRISPR gRNA sequence
aggtatcttccaggttcagc

SEQ ID NO: 753701 - DNA, 20 bp, Artificial
  CRISPR gRNA sequence
ccaggttcagcctcctcctc

SEQ ID NO: 753702 - DNA, 20 bp, Artificial
  CRISPR gRNA sequence
caggttcagcctcctcctct

SEQ ID NO: 753703 - DNA, 20 bp, Artificial
  CRISPR gRNA sequence
agcctcctcctctccctctt

SEQ ID NO: 753704 - DNA, 20 bp, Artificial
  CRISPR gRNA sequence
ctcctctccctcttatccta

SEQ ID NO: 753705 - DNA, 20 bp, Artificial
  CRISPR gRNA sequence
ctctccctcttatcctatca

SEQ ID NO: 753706 - DNA, 20 bp, Artificial
  CRISPR gRNA sequence
tccctcttatcctatcaccc

SEQ ID NO: 753707 - DNA, 20 bp, Artificial
  CRISPR gRNA sequence
cctcttatcctatcaccctc

SEQ ID NO: 753708 - DNA, 20 bp, Artificial
  CRISPR gRNA sequence
ttatcctatcaccctctcct

SEQ ID NO: 753709 - DNA, 20 bp, Artificial
  CRISPR gRNA sequence
atcctatcaccctctccttc

SEQ ID NO: 753710 - DNA, 20 bp, Artificial
  CRISPR gRNA sequence
tcctatcaccctctccttct

SEQ ID NO: 753711 - DNA, 20 bp, Artificial
  CRISPR gRNA sequence
tcaccctctccttctattcc

SEQ ID NO: 753712 - DNA, 20 bp, Artificial
  CRISPR gRNA sequence
tccttctattccatcctgcc

SEQ ID NO: 753713 - DNA, 20 bp, Artificial
  CRISPR gRNA sequence
cttctattccatcctgccca

SEQ ID NO: 753714 - DNA, 20 bp, Artificial
  CRISPR gRNA sequence
ctattccatcctgcccactg

SEQ ID NO: 753715 - DNA, 20 bp, Artificial
  CRISPR gRNA sequence
tattccatcctgcccactgg

SEQ ID NO: 753716 - DNA, 20 bp, Artificial
  CRISPR gRNA sequence
ttccatcctgcccactgggt

SEQ ID NO: 753717 - DNA, 20 bp, Artificial
  CRISPR gRNA sequence
catcctgcccactgggtccc

SEQ ID NO: 753718 - DNA, 20 bp, Artificial
  CRISPR gRNA sequence
cccactgggtccctgtgcca

SEQ ID NO: 753719 - DNA, 20 bp, Artificial
  CRISPR gRNA sequence
ggtccctgtgccaagccctc

SEQ ID NO: 753720 - DNA, 20 bp, Artificial
  CRISPR gRNA sequence
tgccaagccctccacctccc

SEQ ID NO: 753721 - DNA, 20 bp, Artificial
  CRISPR gRNA sequence
cacctccctcctgcctccct

SEQ ID NO: 753722 - DNA, 20 bp, Artificial
  CRISPR gRNA sequence
cctcctgcctccctccgagt

SEQ ID NO: 753723 - DNA, 20 bp, Artificial
  CRISPR gRNA sequence
ctgcctccctccgagtccct

SEQ ID NO: 753724 - DNA, 20 bp, Artificial
  CRISPR gRNA sequence
cctccctccgagtccctgca

SEQ ID NO: 753725 - DNA, 20 bp, Artificial
  CRISPR gRNA sequence
cctccgagtccctgcatgac

SEQ ID NO: 753726 - DNA, 20 bp, Artificial
  CRISPR gRNA sequence
cgagtccctgcatgactcat

SEQ ID NO: 753727 - DNA, 20 bp, Artificial
  CRISPR gRNA sequence
catgactcatactttccctg

SEQ ID NO: 753728 - DNA, 20 bp, Artificial
  CRISPR gRNA sequence
atactttccctgggccctcc

SEQ ID NO: 753729 - DNA, 20 bp, Artificial
  CRISPR gRNA sequence
tccctgggccctccctataa

SEQ ID NO: 753730 - DNA, 20 bp, Artificial
  CRISPR gRNA sequence
ccctgggccctccctataaa

SEQ ID NO: 753731 - DNA, 20 bp, Artificial
  CRISPR gRNA sequence
cctgggccctccctataaag

SEQ ID NO: 753732 - DNA, 20 bp, Artificial
  CRISPR gRNA sequence
ggccctccctataaagtttg

SEQ ID NO: 753733 - DNA, 20 bp, Artificial
  CRISPR gRNA sequence
cctataaagtttggttccac

SEQ ID NO: 753734 - DNA, 20 bp, Artificial
  CRISPR gRNA sequence
taaagtttggttccacaggc

SEQ ID NO: 753735 - DNA, 20 bp, Artificial
  CRISPR gRNA sequence
ggttccacaggctctttgaa

SEQ ID NO: 753736 - DNA, 20 bp, Artificial
  CRISPR gRNA sequence
gttccacaggctctttgaag

SEQ ID NO: 753737 - DNA, 20 bp, Artificial
  CRISPR gRNA sequence
cacaggctctttgaagagat

SEQ ID NO: 753738 - DNA, 20 bp, Artificial
  CRISPR gRNA sequence
tttgaagagatccagcctct

SEQ ID NO: 753739 - DNA, 20 bp, Artificial
  CRISPR gRNA sequence
tgaagagatccagcctcttc

SEQ ID NO: 753740 - DNA, 20 bp, Artificial
  CRISPR gRNA sequence
gaagagatccagcctcttca

SEQ ID NO: 753741 - DNA, 20 bp, Artificial
  CRISPR gRNA sequence
aagagatccagcctcttcag

SEQ ID NO: 753742 - DNA, 20 bp, Artificial
  CRISPR gRNA sequence
ttcagctctgggcaggcaag

SEQ ID NO: 753743 - DNA, 20 bp, Artificial
  CRISPR gRNA sequence
cagctctgggcaggcaagaa

SEQ ID NO: 753744 - DNA, 20 bp, Artificial
  CRISPR gRNA sequence
agctctgggcaggcaagaac

SEQ ID NO: 753745 - DNA, 20 bp, Artificial
  CRISPR gRNA sequence
tgggcaggcaagaactaggc

SEQ ID NO: 753746 - DNA, 20 bp, Artificial
  CRISPR gRNA sequence
ggcaggcaagaactaggcaa

SEQ ID NO: 753747 - DNA, 20 bp, Artificial
  CRISPR gRNA sequence
ggcaaccaggccatgggtac

SEQ ID NO: 753748 - DNA, 20 bp, Artificial
  CRISPR gRNA sequence
tgcccccagcccgggagccc

SEQ ID NO: 753749 - DNA, 20 bp, Artificial
  CRISPR gRNA sequence
cccccagcccgggagcccct

SEQ ID NO: 753750 - DNA, 20 bp, Artificial
  CRISPR gRNA sequence
tgttggggccaggatactat

SEQ ID NO: 753751 - DNA, 20 bp, Artificial
  CRISPR gRNA sequence
gggccaggatactatctgaa

SEQ ID NO: 753752 - DNA, 20 bp, Artificial
  CRISPR gRNA sequence
tctgaacatgctgacagtct

SEQ ID NO: 753753 - DNA, 20 bp, Artificial
  CRISPR gRNA sequence
aacatgctgacagtctggac

SEQ ID NO: 753754 - DNA, 20 bp, Artificial
  CRISPR gRNA sequence
acagtctggactttggaagg

SEQ ID NO: 753755 - DNA, 20 bp, Artificial
  CRISPR gRNA sequence
gactttggaaggggaaaatg

SEQ ID NO: 753756 - DNA, 20 bp, Artificial
  CRISPR gRNA sequence
tggaaggggaaaatggtgct

SEQ ID NO: 753757 - DNA, 20 bp, Artificial
  CRISPR gRNA sequence
ggaaggggaaaatggtgctt

SEQ ID NO: 753758 - DNA, 20 bp, Artificial
  CRISPR gRNA sequence
gaaggggaaaatggtgcttc

SEQ ID NO: 753759 - DNA, 20 bp, Artificial
  CRISPR gRNA sequence
ccctgtgtgggcttctgtgt

SEQ ID NO: 753760 - DNA, 20 bp, Artificial
  CRISPR gRNA sequence
cctgtgtgggcttctgtgtt

SEQ ID NO: 753761 - DNA, 20 bp, Artificial
  CRISPR gRNA sequence
tgtgggcttctgtgtttgag

SEQ ID NO: 753762 - DNA, 20 bp, Artificial
  CRISPR gRNA sequence
ctgtgtttgagctgaggaaa

SEQ ID NO: 753763 - DNA, 20 bp, Artificial
  CRISPR gRNA sequence
tgtgtttgagctgaggaaac

SEQ ID NO: 753764 - DNA, 20 bp, Artificial
  CRISPR gRNA sequence
tgtttgagctgaggaaactg

SEQ ID NO: 753765 - DNA, 20 bp, Artificial
  CRISPR gRNA sequence
gagctgaggaaactgaggcc

SEQ ID NO: 753766 - DNA, 20 bp, Artificial
  CRISPR gRNA sequence
agctgaggaaactgaggcca

SEQ ID NO: 753767 - DNA, 20 bp, Artificial
  CRISPR gRNA sequence
aggaaactgaggccagagag

SEQ ID NO: 753768 - DNA, 20 bp, Artificial
  CRISPR gRNA sequence
aggccagagagatgccgtaa

SEQ ID NO: 753769 - DNA, 20 bp, Artificial
  CRISPR gRNA sequence
atccagggacccagaagggg

SEQ ID NO: 753770 - DNA, 20 bp, Artificial
  CRISPR gRNA sequence
tccagggacccagaaggggc

SEQ ID NO: 753771 - DNA, 20 bp, Artificial
  CRISPR gRNA sequence
atagctgagctgaagagtgt

SEQ ID NO: 753772 - DNA, 20 bp, Artificial
  CRISPR gRNA sequence
agctgaagagtgtcccacat

SEQ ID NO: 753773 - DNA, 20 bp, Artificial
  CRISPR gRNA sequence
aagagtgtcccacatcctcc

SEQ ID NO: 753774 - DNA, 20 bp, Artificial
  CRISPR gRNA sequence
cccagtactccacactggtc

SEQ ID NO: 753775 - DNA, 20 bp, Artificial
  CRISPR gRNA sequence
cacactggtccctgagtggc

SEQ ID NO: 753776 - DNA, 20 bp, Artificial
  CRISPR gRNA sequence
gtccctgagtggcagccttg

SEQ ID NO: 753777 - DNA, 20 bp, Artificial
  CRISPR gRNA sequence
agtggcagccttgctaggat

SEQ ID NO: 753778 - DNA, 20 bp, Artificial
  CRISPR gRNA sequence
gctaggatggcaggaatcag

SEQ ID NO: 753779 - DNA, 20 bp, Artificial
  CRISPR gRNA sequence
ctaggatggcaggaatcagc

SEQ ID NO: 753780 - DNA, 20 bp, Artificial
  CRISPR gRNA sequence
ggatggcaggaatcagctga

SEQ ID NO: 753781 - DNA, 20 bp, Artificial
  CRISPR gRNA sequence
accacttattcctgggccat

SEQ ID NO: 753782 - DNA, 20 bp, Artificial
  CRISPR gRNA sequence
attcctgggccatcagaccc

SEQ ID NO: 753783 - DNA, 20 bp, Artificial
  CRISPR gRNA sequence
ttcctgggccatcagaccct

SEQ ID NO: 753784 - DNA, 20 bp, Artificial
  CRISPR gRNA sequence
ctgggccatcagacccttag

SEQ ID NO: 753785 - DNA, 20 bp, Artificial
  CRISPR gRNA sequence
ggccatcagacccttagaat

SEQ ID NO: 753786 - DNA, 20 bp, Artificial
  CRISPR gRNA sequence
agaatagggaccaggtgggc

SEQ ID NO: 753787 - DNA, 20 bp, Artificial
  CRISPR gRNA sequence
gaatagggaccaggtgggca

SEQ ID NO: 753788 - DNA, 20 bp, Artificial
  CRISPR gRNA sequence
cctctgtgtctgaaagtgga

SEQ ID NO: 753789 - DNA, 20 bp, Artificial
  CRISPR gRNA sequence
tgtgtctgaaagtggaccca

SEQ ID NO: 753790 - DNA, 20 bp, Artificial
  CRISPR gRNA sequence
tgtctgaaagtggacccacc

SEQ ID NO: 753791 - DNA, 20 bp, Artificial
  CRISPR gRNA sequence
aaagtggacccaccgtgacc

SEQ ID NO: 753792 - DNA, 20 bp, Artificial
  CRISPR gRNA sequence
agccaggggtttcaccaggg

SEQ ID NO: 753793 - DNA, 20 bp, Artificial
  CRISPR gRNA sequence
caccagggcatggggcactg

SEQ ID NO: 753794 - DNA, 20 bp, Artificial
  CRISPR gRNA sequence
accagggcatggggcactgg

SEQ ID NO: 753795 - DNA, 20 bp, Artificial
  CRISPR gRNA sequence
gctgagcataccacgccctc

SEQ ID NO: 753796 - DNA, 20 bp, Artificial
  CRISPR gRNA sequence
agcataccacgccctctgtg

SEQ ID NO: 753797 - DNA, 20 bp, Artificial
  CRISPR gRNA sequence
tgtgtcctctgcaacactag

SEQ ID NO: 753798 - DNA, 20 bp, Artificial
  CRISPR gRNA sequence
tgtcctctgcaacactagag

SEQ ID NO: 753799 - DNA, 20 bp, Artificial
  CRISPR gRNA sequence
tgcaacactagagccctgag

SEQ ID NO: 753800 - DNA, 20 bp, Artificial
  CRISPR gRNA sequence
caacactagagccctgagac

SEQ ID NO: 753801 - DNA, 20 bp, Artificial
  CRISPR gRNA sequence
gagccctgagactagagggg

SEQ ID NO: 753802 - DNA, 20 bp, Artificial
  CRISPR gRNA sequence
agactagaggggcagaaaga

SEQ ID NO: 753803 - DNA, 20 bp, Artificial
  CRISPR gRNA sequence
gaggggcagaaagatgccag

SEQ ID NO: 753804 - DNA, 20 bp, Artificial
  CRISPR gRNA sequence
tcaaaagccagtgatatcca

SEQ ID NO: 753805 - DNA, 20 bp, Artificial
  CRISPR gRNA sequence
accgcccccaccctgtgcct

SEQ ID NO: 753806 - DNA, 20 bp, Artificial
  CRISPR gRNA sequence
tgcctctccttctttgcaga

SEQ ID NO: 753807 - DNA, 20 bp, Artificial
  CRISPR gRNA sequence
tccttctttgcagaagctac

SEQ ID NO: 753808 - DNA, 20 bp, Artificial
  CRISPR gRNA sequence
cttctttgcagaagctacct

SEQ ID NO: 753809 - DNA, 20 bp, Artificial
  CRISPR gRNA sequence
ctttgcagaagctacctgtg

SEQ ID NO: 753810 - DNA, 20 bp, Artificial
  CRISPR gRNA sequence
tttgcagaagctacctgtgc

SEQ ID NO: 753811 - DNA, 20 bp, Artificial
  CRISPR gRNA sequence
tgcagaagctacctgtgccc

SEQ ID NO: 753812 - DNA, 20 bp, Artificial
  CRISPR gRNA sequence
gcagaagctacctgtgccct

SEQ ID NO: 753813 - DNA, 20 bp, Artificial
  CRISPR gRNA sequence
cagaagctacctgtgccctg

SEQ ID NO: 753814 - DNA, 20 bp, Artificial
  CRISPR gRNA sequence
cctgtgccctgggttctctg

SEQ ID NO: 753815 - DNA, 20 bp, Artificial
  CRISPR gRNA sequence
tgccctgggttctctgggca

SEQ ID NO: 753816 - DNA, 20 bp, Artificial
  CRISPR gRNA sequence
ggttctctgggcagggaagg

SEQ ID NO: 753817 - DNA, 20 bp, Artificial
  CRISPR gRNA sequence
tctgggcagggaagggctgg

SEQ ID NO: 753818 - DNA, 20 bp, Artificial
  CRISPR gRNA sequence
tgggcagggaagggctggac

SEQ ID NO: 753819 - DNA, 20 bp, Artificial
  CRISPR gRNA sequence
ggcagggaagggctggacag

SEQ ID NO: 753820 - DNA, 20 bp, Artificial
  CRISPR gRNA sequence
gacaggcagccctcagggga

SEQ ID NO: 753821 - DNA, 20 bp, Artificial
  CRISPR gRNA sequence
aggggacagccctgcctgcc

SEQ ID NO: 753822 - DNA, 20 bp, Artificial
  CRISPR gRNA sequence
cctgccacttgggcagctgt

SEQ ID NO: 753823 - DNA, 20 bp, Artificial
  CRISPR gRNA sequence
ccacttgggcagctgtcaga

SEQ ID NO: 753824 - DNA, 20 bp, Artificial
  CRISPR gRNA sequence
gggcagctgtcagagcatgc

SEQ ID NO: 753825 - DNA, 20 bp, Artificial
  CRISPR gRNA sequence
ggcagctgtcagagcatgca

SEQ ID NO: 753826 - DNA, 20 bp, Artificial
  CRISPR gRNA sequence
tcagagcatgcagatgtgcc

SEQ ID NO: 753827 - DNA, 20 bp, Artificial
  CRISPR gRNA sequence
gctggggcacttggcacagt

SEQ ID NO: 753828 - DNA, 20 bp, Artificial
  CRISPR gRNA sequence
gggcacttggcacagttgcc

SEQ ID NO: 753829 - DNA, 20 bp, Artificial
  CRISPR gRNA sequence
ggcacagttgccactgcacc

SEQ ID NO: 753830 - DNA, 20 bp, Artificial
  CRISPR gRNA sequence
gcacagttgccactgcaccc

SEQ ID NO: 753831 - DNA, 20 bp, Artificial
  CRISPR gRNA sequence
ccactgcaccctgcctaggg

SEQ ID NO: 753832 - DNA, 20 bp, Artificial
  CRISPR gRNA sequence
caccctgcctaggggtccca

SEQ ID NO: 753833 - DNA, 20 bp, Artificial
  CRISPR gRNA sequence
cctaggggtcccagcagcct

SEQ ID NO: 753834 - DNA, 20 bp, Artificial
  CRISPR gRNA sequence
ggggtcccagcagcctctgg

SEQ ID NO: 753835 - DNA, 20 bp, Artificial
  CRISPR gRNA sequence
tgggcggtgggtggagtggg

SEQ ID NO: 753836 - DNA, 20 bp, Artificial
  CRISPR gRNA sequence
ggcggtgggtggagtggggt

SEQ ID NO: 753837 - DNA, 20 bp, Artificial
  CRISPR gRNA sequence
agagggcccccaggacgccc

SEQ ID NO: 753838 - DNA, 20 bp, Artificial
  CRISPR gRNA sequence
ccactccagtctgctgtctt

SEQ ID NO: 753839 - DNA, 20 bp, Artificial
  CRISPR gRNA sequence
cagtctgctgtcttctccca

SEQ ID NO: 753840 - DNA, 20 bp, Artificial
  CRISPR gRNA sequence
ctgtcttctcccagcttttt

SEQ ID NO: 753841 - DNA, 20 bp, Artificial
  CRISPR gRNA sequence
tcttctcccagctttttccc

SEQ ID NO: 753842 - DNA, 20 bp, Artificial
  CRISPR gRNA sequence
ctcccagctttttcccagcg

SEQ ID NO: 753843 - DNA, 20 bp, Artificial
  CRISPR gRNA sequence
tcccagctttttcccagcgc

SEQ ID NO: 753844 - DNA, 20 bp, Artificial
  CRISPR gRNA sequence
ccagctttttcccagcgccc

SEQ ID NO: 753845 - DNA, 20 bp, Artificial
  CRISPR gRNA sequence
tttcccagcgccccgcctcc

SEQ ID NO: 753846 - DNA, 20 bp, Artificial
  CRISPR gRNA sequence
ttcccagcgccccgcctccc

SEQ ID NO: 753847 - DNA, 20 bp, Artificial
  CRISPR gRNA sequence
tcccagcgccccgcctcccc

SEQ ID NO: 753848 - DNA, 20 bp, Artificial
  CRISPR gRNA sequence
cccagcgccccgcctccccc

SEQ ID NO: 753849 - DNA, 20 bp, Artificial
  CRISPR gRNA sequence
ccagcgccccgcctcccccg

SEQ ID NO: 753850 - DNA, 20 bp, Artificial
  CRISPR gRNA sequence
ccccgaccttacctagggac

SEQ ID NO: 753851 - DNA, 20 bp, Artificial
  CRISPR gRNA sequence
acctagggacgcagccagga

SEQ ID NO: 753852 - DNA, 20 bp, Artificial
  CRISPR gRNA sequence
cctagggacgcagccaggaa

SEQ ID NO: 753853 - DNA, 20 bp, Artificial
  CRISPR gRNA sequence
gggacgcagccaggaagaga

SEQ ID NO: 753854 - DNA, 20 bp, Artificial
  CRISPR gRNA sequence
ccggcctccagggccgtggg

SEQ ID NO: 753855 - DNA, 20 bp, Artificial
  CRISPR gRNA sequence
cagggccgtggggacgccca

SEQ ID NO: 753856 - DNA, 20 bp, Artificial
  CRISPR gRNA sequence
ctggtgccggggagcgggcg

SEQ ID NO: 753857 - DNA, 20 bp, Artificial
  CRISPR gRNA sequence
tggtgccggggagcgggcgg

SEQ ID NO: 753858 - DNA, 20 bp, Artificial
  CRISPR gRNA sequence
gtgccggggagcgggcggga

SEQ ID NO: 753859 - DNA, 20 bp, Artificial
  CRISPR gRNA sequence
ccgcgactgagtgcgagcga

SEQ ID NO: 753860 - DNA, 20 bp, Artificial
  CRISPR gRNA sequence
agtgcgagcgagtgagcgct

SEQ ID NO: 753861 - DNA, 20 bp, Artificial
  CRISPR gRNA sequence
cgggcggccccagcgccgtg

SEQ ID NO: 753862 - DNA, 20 bp, Artificial
  CRISPR gRNA sequence
caggcacccgcccccttcgc

SEQ ID NO: 753863 - DNA, 20 bp, Artificial
  CRISPR gRNA sequence
cgcgcagcgcccccgggggg

SEQ ID NO: 753864 - DNA, 20 bp, Artificial
  CRISPR gRNA sequence
gcgcagcgcccccggggggc

SEQ ID NO: 753865 - DNA, 20 bp, Artificial
  CRISPR gRNA sequence
cctctccgagggccgcgtgg

SEQ ID NO: 753866 - DNA, 20 bp, Artificial
  CRISPR gRNA sequence
tccgagggccgcgtgggagg

SEQ ID NO: 753867 - DNA, 20 bp, Artificial
  CRISPR gRNA sequence
cgagggccgcgtgggagggg

SEQ ID NO: 753868 - DNA, 20 bp, Artificial
  CRISPR gRNA sequence
cccggaggccggccccgtgg

SEQ ID NO: 753869 - DNA, 20 bp, Artificial
  CRISPR gRNA sequence
ccggaggccggccccgtggg

SEQ ID NO: 753870 - DNA, 20 bp, Artificial
  CRISPR gRNA sequence
gctccccacccacggggccg

SEQ ID NO: 753871 - DNA, 20 bp, Artificial
  CRISPR gRNA sequence
cccacccacggggccggcct

SEQ ID NO: 753872 - DNA, 20 bp, Artificial
  CRISPR gRNA sequence
cgggaagcccctcccacgcg

SEQ ID NO: 753873 - DNA, 20 bp, Artificial
  CRISPR gRNA sequence
ccacgcggccctcggagagg

SEQ ID NO: 753874 - DNA, 20 bp, Artificial
  CRISPR gRNA sequence
ggagaggcagttcccccaca

SEQ ID NO: 753875 - DNA, 20 bp, Artificial
  CRISPR gRNA sequence
ccccacacggccccccgggg

SEQ ID NO: 753876 - DNA, 20 bp, Artificial
  CRISPR gRNA sequence
cgcgaagggggcgggtgcct

SEQ ID NO: 753877 - DNA, 20 bp, Artificial
  CRISPR gRNA sequence
gagcacggcgctggggccgc

SEQ ID NO: 753878 - DNA, 20 bp, Artificial
  CRISPR gRNA sequence
gggccgcccgcagcgctcac

SEQ ID NO: 753879 - DNA, 20 bp, Artificial
  CRISPR gRNA sequence
actcgctcgcactcagtcgc

SEQ ID NO: 753880 - DNA, 20 bp, Artificial
  CRISPR gRNA sequence
gctcgcactcagtcgcggga

SEQ ID NO: 753881 - DNA, 20 bp, Artificial
  CRISPR gRNA sequence
gcactcagtcgcgggaggct

SEQ ID NO: 753882 - DNA, 20 bp, Artificial
  CRISPR gRNA sequence
agtcgcgggaggcttccccg

SEQ ID NO: 753883 - DNA, 20 bp, Artificial
  CRISPR gRNA sequence
ccccgcgccggccgcgtccc

SEQ ID NO: 753884 - DNA, 20 bp, Artificial
  CRISPR gRNA sequence
cccgcgccggccgcgtcccg

SEQ ID NO: 753885 - DNA, 20 bp, Artificial
  CRISPR gRNA sequence
cccggcaccagaagttcctc

SEQ ID NO: 753886 - DNA, 20 bp, Artificial
  CRISPR gRNA sequence
ctctgcgcgtccgacggcga

SEQ ID NO: 753887 - DNA, 20 bp, Artificial
  CRISPR gRNA sequence
tgcgcgtccgacggcgacat

SEQ ID NO: 753888 - DNA, 20 bp, Artificial
  CRISPR gRNA sequence
cgcgtccgacggcgacatgg

SEQ ID NO: 753889 - DNA, 20 bp, Artificial
  CRISPR gRNA sequence
gaggccggcagctggcgctg

SEQ ID NO: 753890 - DNA, 20 bp, Artificial
  CRISPR gRNA sequence
gcgctggggatccctgctct

SEQ ID NO: 753891 - DNA, 20 bp, Artificial
  CRISPR gRNA sequence
gggatccctgctcttcgctc

SEQ ID NO: 753892 - DNA, 20 bp, Artificial
  CRISPR gRNA sequence
ctcttcgctctcttcctggc

SEQ ID NO: 753893 - DNA, 20 bp, Artificial
  CRISPR gRNA sequence
ttcgctctcttcctggctgc

SEQ ID NO: 753894 - DNA, 20 bp, Artificial
  CRISPR gRNA sequence
cgctctcttcctggctgcgt

SEQ ID NO: 753895 - DNA, 20 bp, Artificial
  CRISPR gRNA sequence
gctctcttcctggctgcgtc

SEQ ID NO: 753896 - DNA, 20 bp, Artificial
  CRISPR gRNA sequence
tcttcctggctgcgtcccta

SEQ ID NO: 753897 - DNA, 20 bp, Artificial
  CRISPR gRNA sequence
ttcctggctgcgtccctagg

SEQ ID NO: 753898 - DNA, 20 bp, Artificial
  CRISPR gRNA sequence
cctggctgcgtccctaggta

SEQ ID NO: 753899 - DNA, 20 bp, Artificial
  CRISPR gRNA sequence
ctggctgcgtccctaggtaa

SEQ ID NO: 753900 - DNA, 20 bp, Artificial
  CRISPR gRNA sequence
gctgcgtccctaggtaaggt

SEQ ID NO: 753901 - DNA, 20 bp, Artificial
  CRISPR gRNA sequence
cgtccctaggtaaggtcggg

SEQ ID NO: 753902 - DNA, 20 bp, Artificial
  CRISPR gRNA sequence
ggtaaggtcgggggaggcgg

SEQ ID NO: 753903 - DNA, 20 bp, Artificial
  CRISPR gRNA sequence
ggaaaaagctgggagaagac

SEQ ID NO: 753904 - DNA, 20 bp, Artificial
  CRISPR gRNA sequence
ggagaagacagcagactgga

SEQ ID NO: 753905 - DNA, 20 bp, Artificial
  CRISPR gRNA sequence
gagtgggaactgtgggatgg

SEQ ID NO: 753906 - DNA, 20 bp, Artificial
  CRISPR gRNA sequence
tgggatgggggcgtcctggg

SEQ ID NO: 753907 - DNA, 20 bp, Artificial
  CRISPR gRNA sequence
ggggccctctcagcctgtgt

SEQ ID NO: 753908 - DNA, 20 bp, Artificial
  CRISPR gRNA sequence
tcagcctgtgtgaccgtgca

SEQ ID NO: 753909 - DNA, 20 bp, Artificial
  CRISPR gRNA sequence
agcctgtgtgaccgtgcacc

SEQ ID NO: 753910 - DNA, 20 bp, Artificial
  CRISPR gRNA sequence
tgtgaccgtgcaccccactc

SEQ ID NO: 753911 - DNA, 20 bp, Artificial
  CRISPR gRNA sequence
cacccaccgcccagaggctg

SEQ ID NO: 753912 - DNA, 20 bp, Artificial
  CRISPR gRNA sequence
ctgggacccctaggcagggt

SEQ ID NO: 753913 - DNA, 20 bp, Artificial
  CRISPR gRNA sequence
ggacccctaggcagggtgca

SEQ ID NO: 753914 - DNA, 20 bp, Artificial
  CRISPR gRNA sequence
ggcagggtgcagtggcaact

SEQ ID NO: 753915 - DNA, 20 bp, Artificial
  CRISPR gRNA sequence
tgccaagtgccccagctagg

SEQ ID NO: 753916 - DNA, 20 bp, Artificial
  CRISPR gRNA sequence
ggcatcgggcacatctgcat

SEQ ID NO: 753917 - DNA, 20 bp, Artificial
  CRISPR gRNA sequence
catgctctgacagctgccca

SEQ ID NO: 753918 - DNA, 20 bp, Artificial
  CRISPR gRNA sequence
tgacagctgcccaagtggca

SEQ ID NO: 753919 - DNA, 20 bp, Artificial
  CRISPR gRNA sequence
acagctgcccaagtggcagg

SEQ ID NO: 753920 - DNA, 20 bp, Artificial
  CRISPR gRNA sequence
cccaagtggcaggcagggct

SEQ ID NO: 753921 - DNA, 20 bp, Artificial
  CRISPR gRNA sequence
tcccctgagggctgcctgtc

SEQ ID NO: 753922 - DNA, 20 bp, Artificial
  CRISPR gRNA sequence
agggctgcctgtccagccct

SEQ ID NO: 753923 - DNA, 20 bp, Artificial
  CRISPR gRNA sequence
cctgtccagcccttccctgc

SEQ ID NO: 753924 - DNA, 20 bp, Artificial
  CRISPR gRNA sequence
tccagcccttccctgcccag

SEQ ID NO: 753925 - DNA, 20 bp, Artificial
  CRISPR gRNA sequence
ccctgcccagagaacccagg

SEQ ID NO: 753926 - DNA, 20 bp, Artificial
  CRISPR gRNA sequence
cctgcccagagaacccaggg

SEQ ID NO: 753927 - DNA, 20 bp, Artificial
  CRISPR gRNA sequence
cccagagaacccagggcaca

SEQ ID NO: 753928 - DNA, 20 bp, Artificial
  CRISPR gRNA sequence
ctgcaaagaaggagaggcac

SEQ ID NO: 753929 - DNA, 20 bp, Artificial
  CRISPR gRNA sequence
tgcaaagaaggagaggcaca

SEQ ID NO: 753930 - DNA, 20 bp, Artificial
  CRISPR gRNA sequence
caaagaaggagaggcacagg

SEQ ID NO: 753931 - DNA, 20 bp, Artificial
  CRISPR gRNA sequence
tggtggatatcactggcttt

SEQ ID NO: 753932 - DNA, 20 bp, Artificial
  CRISPR gRNA sequence
gtggatatcactggcttttg

SEQ ID NO: 753933 - DNA, 20 bp, Artificial
  CRISPR gRNA sequence
gcttttgacagctggcatct

SEQ ID NO: 753934 - DNA, 20 bp, Artificial
  CRISPR gRNA sequence
ttgacagctggcatctttct

SEQ ID NO: 753935 - DNA, 20 bp, Artificial
  CRISPR gRNA sequence
tgacagctggcatctttctg

SEQ ID NO: 753936 - DNA, 20 bp, Artificial
  CRISPR gRNA sequence
gacagctggcatctttctgc

SEQ ID NO: 753937 - DNA, 20 bp, Artificial
  CRISPR gRNA sequence
acagctggcatctttctgcc

SEQ ID NO: 753938 - DNA, 20 bp, Artificial
  CRISPR gRNA sequence
gcatctttctgcccctctag

SEQ ID NO: 753939 - DNA, 20 bp, Artificial
  CRISPR gRNA sequence
tctgcccctctagtctcagg

SEQ ID NO: 753940 - DNA, 20 bp, Artificial
  CRISPR gRNA sequence
ctgcccctctagtctcaggg

SEQ ID NO: 753941 - DNA, 20 bp, Artificial
  CRISPR gRNA sequence
tgcccctctagtctcagggc

SEQ ID NO: 753942 - DNA, 20 bp, Artificial
  CRISPR gRNA sequence
cccctctagtctcagggctc

SEQ ID NO: 753943 - DNA, 20 bp, Artificial
  CRISPR gRNA sequence
tagtctcagggctctagtgt

SEQ ID NO: 753944 - DNA, 20 bp, Artificial
  CRISPR gRNA sequence
gtctcagggctctagtgttg

SEQ ID NO: 753945 - DNA, 20 bp, Artificial
  CRISPR gRNA sequence
agggctctagtgttgcagag

SEQ ID NO: 753946 - DNA, 20 bp, Artificial
  CRISPR gRNA sequence
tagtgttgcagaggacacag

SEQ ID NO: 753947 - DNA, 20 bp, Artificial
  CRISPR gRNA sequence
gtgttgcagaggacacagag

SEQ ID NO: 753948 - DNA, 20 bp, Artificial
  CRISPR gRNA sequence
cagaggacacagagggcgtg

SEQ ID NO: 753949 - DNA, 20 bp, Artificial
  CRISPR gRNA sequence
agccagtgccccatgccctg

SEQ ID NO: 753950 - DNA, 20 bp, Artificial
  CRISPR gRNA sequence
gtgaaacccctggctgagcc

SEQ ID NO: 753951 - DNA, 20 bp, Artificial
  CRISPR gRNA sequence
gctgagccttggtgggcact

SEQ ID NO: 753952 - DNA, 20 bp, Artificial
  CRISPR gRNA sequence
agccttggtgggcactgggc

SEQ ID NO: 753953 - DNA, 20 bp, Artificial
  CRISPR gRNA sequence
ggtgggcactgggcactggt

SEQ ID NO: 753954 - DNA, 20 bp, Artificial
  CRISPR gRNA sequence
gtgggcactgggcactggtc

SEQ ID NO: 753955 - DNA, 20 bp, Artificial
  CRISPR gRNA sequence
ggcactggtcacggtgggtc

SEQ ID NO: 753956 - DNA, 20 bp, Artificial
  CRISPR gRNA sequence
gtcacggtgggtccactttc

SEQ ID NO: 753957 - DNA, 20 bp, Artificial
  CRISPR gRNA sequence
tcagacacagaggcagcact

SEQ ID NO: 753958 - DNA, 20 bp, Artificial
  CRISPR gRNA sequence
cagacacagaggcagcactg

SEQ ID NO: 753959 - DNA, 20 bp, Artificial
  CRISPR gRNA sequence
agacacagaggcagcactgc

SEQ ID NO: 753960 - DNA, 20 bp, Artificial
  CRISPR gRNA sequence
cccacctggtccctattcta

SEQ ID NO: 753961 - DNA, 20 bp, Artificial
  CRISPR gRNA sequence
gtccctattctaagggtctg

SEQ ID NO: 753962 - DNA, 20 bp, Artificial
  CRISPR gRNA sequence
ttctaagggtctgatggccc

SEQ ID NO: 753963 - DNA, 20 bp, Artificial
  CRISPR gRNA sequence
taagggtctgatggcccagg

SEQ ID NO: 753964 - DNA, 20 bp, Artificial
  CRISPR gRNA sequence
agggtctgatggcccaggaa

SEQ ID NO: 753965 - DNA, 20 bp, Artificial
  CRISPR gRNA sequence
atggcccaggaataagtggt

SEQ ID NO: 753966 - DNA, 20 bp, Artificial
  CRISPR gRNA sequence
attcctgccatcctagcaag

SEQ ID NO: 753967 - DNA, 20 bp, Artificial
  CRISPR gRNA sequence
ctgccatcctagcaaggctg

SEQ ID NO: 753968 - DNA, 20 bp, Artificial
  CRISPR gRNA sequence
ccatcctagcaaggctgcca

SEQ ID NO: 753969 - DNA, 20 bp, Artificial
  CRISPR gRNA sequence
gcaaggctgccactcaggga

SEQ ID NO: 753970 - DNA, 20 bp, Artificial
  CRISPR gRNA sequence
ccactcagggaccagtgtgg

SEQ ID NO: 753971 - DNA, 20 bp, Artificial
  CRISPR gRNA sequence
agggaccagtgtggagtact

SEQ ID NO: 753972 - DNA, 20 bp, Artificial
  CRISPR gRNA sequence
gggaggatgtgggacactct

SEQ ID NO: 753973 - DNA, 20 bp, Artificial
  CRISPR gRNA sequence
ttcagctcagctatgagccc

SEQ ID NO: 753974 - DNA, 20 bp, Artificial
  CRISPR gRNA sequence
cagctcagctatgagcccct

SEQ ID NO: 753975 - DNA, 20 bp, Artificial
  CRISPR gRNA sequence
agctcagctatgagcccctt

SEQ ID NO: 753976 - DNA, 20 bp, Artificial
  CRISPR gRNA sequence
agctatgagccccttctggg

SEQ ID NO: 753977 - DNA, 20 bp, Artificial
  CRISPR gRNA sequence
tgagccccttctgggtccct

SEQ ID NO: 753978 - DNA, 20 bp, Artificial
  CRISPR gRNA sequence
ctgggtccctggataaatta

SEQ ID NO: 753979 - DNA, 20 bp, Artificial
  CRISPR gRNA sequence
tgggtccctggataaattac

SEQ ID NO: 753980 - DNA, 20 bp, Artificial
  CRISPR gRNA sequence
ggtccctggataaattacgg

SEQ ID NO: 753981 - DNA, 20 bp, Artificial
  CRISPR gRNA sequence
gataaattacggcatctctc

SEQ ID NO: 753982 - DNA, 20 bp, Artificial
  CRISPR gRNA sequence
cggcatctctctggcctcag

SEQ ID NO: 753983 - DNA, 20 bp, Artificial
  CRISPR gRNA sequence
tctggcctcagtttcctcag

SEQ ID NO: 753984 - DNA, 20 bp, Artificial
  CRISPR gRNA sequence
tggcctcagtttcctcagct

SEQ ID NO: 753985 - DNA, 20 bp, Artificial
  CRISPR gRNA sequence
gcctcagtttcctcagctca

SEQ ID NO: 753986 - DNA, 20 bp, Artificial
  CRISPR gRNA sequence
agtttcctcagctcaaacac

SEQ ID NO: 753987 - DNA, 20 bp, Artificial
  CRISPR gRNA sequence
cctcagctcaaacacagaag

SEQ ID NO: 753988 - DNA, 20 bp, Artificial
  CRISPR gRNA sequence
ctcagctcaaacacagaagc

SEQ ID NO: 753989 - DNA, 20 bp, Artificial
  CRISPR gRNA sequence
agctcaaacacagaagccca

SEQ ID NO: 753990 - DNA, 20 bp, Artificial
  CRISPR gRNA sequence
aaacacagaagcccacacag

SEQ ID NO: 753991 - DNA, 20 bp, Artificial
  CRISPR gRNA sequence
tccccttccaaagtccagac

SEQ ID NO: 753992 - DNA, 20 bp, Artificial
  CRISPR gRNA sequence
ccccttccaaagtccagact

SEQ ID NO: 753993 - DNA, 20 bp, Artificial
  CRISPR gRNA sequence
cccttccaaagtccagactg

SEQ ID NO: 753994 - DNA, 20 bp, Artificial
  CRISPR gRNA sequence
ccaaagtccagactgtcagc

SEQ ID NO: 753995 - DNA, 20 bp, Artificial
  CRISPR gRNA sequence
caaagtccagactgtcagca

SEQ ID NO: 753996 - DNA, 20 bp, Artificial
  CRISPR gRNA sequence
tcagcatgttcagatagtat

SEQ ID NO: 753997 - DNA, 20 bp, Artificial
  CRISPR gRNA sequence
agatagtatcctggccccaa

SEQ ID NO: 753998 - DNA, 20 bp, Artificial
  CRISPR gRNA sequence
gccccaacacaggggctccc

SEQ ID NO: 753999 - DNA, 20 bp, Artificial
  CRISPR gRNA sequence
ccgggctgggggcagaggcc

SEQ ID NO: 754000 - DNA, 20 bp, Artificial
  CRISPR gRNA sequence
ggggcagaggccctggtacc

SEQ ID NO: 754001 - DNA, 20 bp, Artificial
  CRISPR gRNA sequence
gtacccatggcctggttgcc

SEQ ID NO: 754002 - DNA, 20 bp, Artificial
  CRISPR gRNA sequence
gttgcctagttcttgcctgc

SEQ ID NO: 754003 - DNA, 20 bp, Artificial
  CRISPR gRNA sequence
cctagttcttgcctgcccag

SEQ ID NO: 754004 - DNA, 20 bp, Artificial
  CRISPR gRNA sequence
gttcttgcctgcccagagct

SEQ ID NO: 754005 - DNA, 20 bp, Artificial
  CRISPR gRNA sequence
ttgcctgcccagagctgaag

SEQ ID NO: 754006 - DNA, 20 bp, Artificial
  CRISPR gRNA sequence
gcctgcccagagctgaagag

SEQ ID NO: 754007 - DNA, 20 bp, Artificial
  CRISPR gRNA sequence
cctgcccagagctgaagagg

SEQ ID NO: 754008 - DNA, 20 bp, Artificial
  CRISPR gRNA sequence
cccagagctgaagaggctgg

SEQ ID NO: 754009 - DNA, 20 bp, Artificial
  CRISPR gRNA sequence
aagaggctggatctcttcaa

SEQ ID NO: 754010 - DNA, 20 bp, Artificial
  CRISPR gRNA sequence
gatctcttcaaagagcctgt

SEQ ID NO: 754011 - DNA, 20 bp, Artificial
  CRISPR gRNA sequence
ttcaaagagcctgtggaacc

SEQ ID NO: 754012 - DNA, 20 bp, Artificial
  CRISPR gRNA sequence
caaagagcctgtggaaccaa

SEQ ID NO: 754013 - DNA, 20 bp, Artificial
  CRISPR gRNA sequence
aaagagcctgtggaaccaaa

SEQ ID NO: 754014 - DNA, 20 bp, Artificial
  CRISPR gRNA sequence
tggaaccaaactttataggg

SEQ ID NO: 754015 - DNA, 20 bp, Artificial
  CRISPR gRNA sequence
tatagggagggcccagggaa

SEQ ID NO: 754016 - DNA, 20 bp, Artificial
  CRISPR gRNA sequence
atagggagggcccagggaaa

SEQ ID NO: 754017 - DNA, 20 bp, Artificial
  CRISPR gRNA sequence
tagggagggcccagggaaag

SEQ ID NO: 754018 - DNA, 20 bp, Artificial
  CRISPR gRNA sequence
ggagggaggcaggagggagg

SEQ ID NO: 754019 - DNA, 20 bp, Artificial
  CRISPR gRNA sequence
ggcacagggacccagtgggc

SEQ ID NO: 754020 - DNA, 20 bp, Artificial
  CRISPR gRNA sequence
gcacagggacccagtgggca

SEQ ID NO: 754021 - DNA, 20 bp, Artificial
  CRISPR gRNA sequence
aacctggaagataccttagc

SEQ ID NO: 754022 - DNA, 20 bp, Artificial
  CRISPR gRNA sequence
gaagataccttagcaacctg

SEQ ID NO: 754023 - DNA, 20 bp, Artificial
  CRISPR gRNA sequence
agcaacctgggtgcccacag

SEQ ID NO: 754024 - DNA, 20 bp, Artificial
  CRISPR gRNA sequence
gcaacctgggtgcccacagg

SEQ ID NO: 754025 - DNA, 20 bp, Artificial
  CRISPR gRNA sequence
ggtgcccacaggcagctggc

SEQ ID NO: 754026 - DNA, 20 bp, Artificial
  CRISPR gRNA sequence
gctatctcagcacttggagg

SEQ ID NO: 754027 - DNA, 20 bp, Artificial
  CRISPR gRNA sequence
tctcagcacttggaggctgg

SEQ ID NO: 754028 - DNA, 20 bp, Artificial
  CRISPR gRNA sequence
agcacttggaggctggcctg

SEQ ID NO: 754029 - DNA, 20 bp, Artificial
  CRISPR gRNA sequence
ggaggctggcctgggcctct

SEQ ID NO: 754030 - DNA, 20 bp, Artificial
  CRISPR gRNA sequence
gaggctggcctgggcctctg

SEQ ID NO: 754031 - DNA, 20 bp, Artificial
  CRISPR gRNA sequence
gcctgggcctctgaggagga

SEQ ID NO: 754032 - DNA, 20 bp, Artificial
  CRISPR gRNA sequence
ggcctctgaggaggaggagg

SEQ ID NO: 754033 - DNA, 20 bp, Artificial
  CRISPR gRNA sequence
tgaggaggaggagggctcca

SEQ ID NO: 754034 - DNA, 20 bp, Artificial
  CRISPR gRNA sequence
aggaggaggagggctccaca

SEQ ID NO: 754035 - DNA, 20 bp, Artificial
  CRISPR gRNA sequence
cacatgtcacagacacagct

SEQ ID NO: 754036 - DNA, 20 bp, Artificial
  CRISPR gRNA sequence
ccctaagccccagggtggat

SEQ ID NO: 754037 - DNA, 20 bp, Artificial
  CRISPR gRNA sequence
agccccagggtggatgcttc

SEQ ID NO: 754038 - DNA, 20 bp, Artificial
  CRISPR gRNA sequence
ctcaaggtgacagtcagagg

SEQ ID NO: 754039 - DNA, 20 bp, Artificial
  CRISPR gRNA sequence
tcaaggtgacagtcagaggg

SEQ ID NO: 754040 - DNA, 20 bp, Artificial
  CRISPR gRNA sequence
aaggtgacagtcagagggag

SEQ ID NO: 754041 - DNA, 20 bp, Artificial
  CRISPR gRNA sequence
agcaccaaggccatggctca

SEQ ID NO: 754042 - DNA, 20 bp, Artificial
  CRISPR gRNA sequence
atggcagggcatggcttcca

SEQ ID NO: 754043 - DNA, 20 bp, Artificial
  CRISPR gRNA sequence
ccagaaggaacagaggatgg

SEQ ID NO: 754044 - DNA, 20 bp, Artificial
  CRISPR gRNA sequence
cagaaggaacagaggatggt

SEQ ID NO: 754045 - DNA, 20 bp, Artificial
  CRISPR gRNA sequence
tcatgggccacctgccctgc

SEQ ID NO: 754046 - DNA, 20 bp, Artificial
  CRISPR gRNA sequence
ccctgcactgccctccctgg

SEQ ID NO: 754047 - DNA, 20 bp, Artificial
  CRISPR gRNA sequence
cactgccctccctggtggcc

SEQ ID NO: 754048 - DNA, 20 bp, Artificial
  CRISPR gRNA sequence
ccctccctggtggccctgtg

SEQ ID NO: 754049 - DNA, 20 bp, Artificial
  CRISPR gRNA sequence
cctggtggccctgtgagacc

SEQ ID NO: 754050 - DNA, 20 bp, Artificial
  CRISPR gRNA sequence
gtggccctgtgagacccttc

SEQ ID NO: 754051 - DNA, 20 bp, Artificial
  CRISPR gRNA sequence
tgagacccttcctgctttct

SEQ ID NO: 754052 - DNA, 20 bp, Artificial
  CRISPR gRNA sequence
cctgctttcttgcccacttc

SEQ ID NO: 754053 - DNA, 20 bp, Artificial
  CRISPR gRNA sequence
ctgctttcttgcccacttcc

SEQ ID NO: 754054 - DNA, 20 bp, Artificial
  CRISPR gRNA sequence
ctttcttgcccacttcctgc

SEQ ID NO: 754055 - DNA, 20 bp, Artificial
  CRISPR gRNA sequence
tcttgcccacttcctgccct

SEQ ID NO: 754056 - DNA, 20 bp, Artificial
  CRISPR gRNA sequence
cttgcccacttcctgccctc

SEQ ID NO: 754057 - DNA, 20 bp, Artificial
  CRISPR gRNA sequence
ttgcccacttcctgccctca

SEQ ID NO: 754058 - DNA, 20 bp, Artificial
  CRISPR gRNA sequence
gcccacttcctgccctcact

SEQ ID NO: 754059 - DNA, 20 bp, Artificial
  CRISPR gRNA sequence
cccacttcctgccctcactt

SEQ ID NO: 754060 - DNA, 20 bp, Artificial
  CRISPR gRNA sequence
cctgccctcacttggctggg

SEQ ID NO: 754061 - DNA, 20 bp, Artificial
  CRISPR gRNA sequence
ctgccctcacttggctgggc

SEQ ID NO: 754062 - DNA, 20 bp, Artificial
  CRISPR gRNA sequence
ccctcacttggctgggctgc

SEQ ID NO: 754063 - DNA, 20 bp, Artificial
  CRISPR gRNA sequence
acttggctgggctgccctct

SEQ ID NO: 754064 - DNA, 20 bp, Artificial
  CRISPR gRNA sequence
ggctgggctgccctctgttc

SEQ ID NO: 754065 - DNA, 20 bp, Artificial
  CRISPR gRNA sequence
gctgggctgccctctgttca

SEQ ID NO: 754066 - DNA, 20 bp, Artificial
  CRISPR gRNA sequence
ggctgccctctgttcagcag

SEQ ID NO: 754067 - DNA, 20 bp, Artificial
  CRISPR gRNA sequence
ccctctgttcagcagcccca

SEQ ID NO: 754068 - DNA, 20 bp, Artificial
  CRISPR gRNA sequence
tgttcagcagccccaatttg

SEQ ID NO: 754069 - DNA, 20 bp, Artificial
  CRISPR gRNA sequence
ttcagcagccccaatttgag

SEQ ID NO: 754070 - DNA, 20 bp, Artificial
  CRISPR gRNA sequence
agcagccccaatttgagaaa

SEQ ID NO: 754071 - DNA, 20 bp, Artificial
  CRISPR gRNA sequence
gagaaacatttctagagatc

SEQ ID NO: 754072 - DNA, 20 bp, Artificial
  CRISPR gRNA sequence
agaaacatttctagagatcc

SEQ ID NO: 754073 - DNA, 20 bp, Artificial
  CRISPR gRNA sequence
ctagagatccagggcacagg

SEQ ID NO: 754074 - DNA, 20 bp, Artificial
  CRISPR gRNA sequence
tagagatccagggcacaggg

SEQ ID NO: 754075 - DNA, 20 bp, Artificial
  CRISPR gRNA sequence
gagatccagggcacagggac

SEQ ID NO: 754076 - DNA, 20 bp, Artificial
  CRISPR gRNA sequence
gcagagcacccagtagcaga

SEQ ID NO: 754077 - DNA, 20 bp, Artificial
  CRISPR gRNA sequence
cagagcacccagtagcagag

SEQ ID NO: 754078 - DNA, 20 bp, Artificial
  CRISPR gRNA sequence
aggacgccttcccctatatt

SEQ ID NO: 754079 - DNA, 20 bp, Artificial
  CRISPR gRNA sequence
cccctatattgcttatatgg

SEQ ID NO: 754080 - DNA, 20 bp, Artificial
  CRISPR gRNA sequence
ccctatattgcttatatggc

SEQ ID NO: 754081 - DNA, 20 bp, Artificial
  CRISPR gRNA sequence
tattgcttatatggccaggg

SEQ ID NO: 754082 - DNA, 20 bp, Artificial
  CRISPR gRNA sequence
cttatatggccaggggcctt

SEQ ID NO: 754083 - DNA, 20 bp, Artificial
  CRISPR gRNA sequence
atatggccaggggcctttac

SEQ ID NO: 754084 - DNA, 20 bp, Artificial
  CRISPR gRNA sequence
tatggccaggggcctttact

SEQ ID NO: 754085 - DNA, 20 bp, Artificial
  CRISPR gRNA sequence
tactcccagaggtcttggct

SEQ ID NO: 754086 - DNA, 20 bp, Artificial
  CRISPR gRNA sequence
actcccagaggtcttggcta

SEQ ID NO: 754087 - DNA, 20 bp, Artificial
  CRISPR gRNA sequence
ctcccagaggtcttggctac

SEQ ID NO: 754088 - DNA, 20 bp, Artificial
  CRISPR gRNA sequence
ccagaggtcttggctactca

SEQ ID NO: 754089 - DNA, 20 bp, Artificial
  CRISPR gRNA sequence
ggctactcaaacaacatggt

SEQ ID NO: 754090 - DNA, 20 bp, Artificial
  CRISPR gRNA sequence
gctactcaaacaacatggta

SEQ ID NO: 754091 - DNA, 20 bp, Artificial
  CRISPR gRNA sequence
ctcaaacaacatggtatact

SEQ ID NO: 754092 - DNA, 20 bp, Artificial
  CRISPR gRNA sequence
aaacaacatggtatactaaa

SEQ ID NO: 754093 - DNA, 20 bp, Artificial
  CRISPR gRNA sequence
aagggtcatctcttcctggg

SEQ ID NO: 754094 - DNA, 20 bp, Artificial
  CRISPR gRNA sequence
ttcctgggcccagcacaggg

SEQ ID NO: 754095 - DNA, 20 bp, Artificial
  CRISPR gRNA sequence
cctgggcccagcacagggag

SEQ ID NO: 754096 - DNA, 20 bp, Artificial
  CRISPR gRNA sequence
ctgggcccagcacagggaga

SEQ ID NO: 754097 - DNA, 20 bp, Artificial
  CRISPR gRNA sequence
ggcccagcacagggagatga

SEQ ID NO: 754098 - DNA, 20 bp, Artificial
  CRISPR gRNA sequence
aggctggctgcagctttcca

SEQ ID NO: 754099 - DNA, 20 bp, Artificial
  CRISPR gRNA sequence
ggctggctgcagctttccac

SEQ ID NO: 754100 - DNA, 20 bp, Artificial
  CRISPR gRNA sequence
gctgcagctttccactgaaa

SEQ ID NO: 754101 - DNA, 20 bp, Artificial
  CRISPR gRNA sequence
cagctttccactgaaaggag

SEQ ID NO: 754102 - DNA, 20 bp, Artificial
  CRISPR gRNA sequence
tccactgaaaggagccagaa

SEQ ID NO: 754103 - DNA, 20 bp, Artificial
  CRISPR gRNA sequence
ccactgaaaggagccagaag

SEQ ID NO: 754104 - DNA, 20 bp, Artificial
  CRISPR gRNA sequence
cactgaaaggagccagaagc

SEQ ID NO: 754105 - DNA, 20 bp, Artificial
  CRISPR gRNA sequence
aaaggagccagaagcatttg

SEQ ID NO: 754106 - DNA, 20 bp, Artificial
  CRISPR gRNA sequence
gaattgctctgggacctcag

SEQ ID NO: 754107 - DNA, 20 bp, Artificial
  CRISPR gRNA sequence
aattgctctgggacctcagg

SEQ ID NO: 754108 - DNA, 20 bp, Artificial
  CRISPR gRNA sequence
ctctgggacctcaggattct

SEQ ID NO: 754109 - DNA, 20 bp, Artificial
  CRISPR gRNA sequence
tgggacctcaggattctgaa

SEQ ID NO: 754110 - DNA, 20 bp, Artificial
  CRISPR gRNA sequence
ggacctcaggattctgaact

SEQ ID NO: 754111 - DNA, 20 bp, Artificial
  CRISPR gRNA sequence
aggattctgaactgtgacat

SEQ ID NO: 754112 - DNA, 20 bp, Artificial
  CRISPR gRNA sequence
tgaactgtgacatggacaca

SEQ ID NO: 754113 - DNA, 20 bp, Artificial
  CRISPR gRNA sequence
aactgtgacatggacacact

SEQ ID NO: 754114 - DNA, 20 bp, Artificial
  CRISPR gRNA sequence
tgacatggacacactataat

SEQ ID NO: 754115 - DNA, 20 bp, Artificial
  CRISPR gRNA sequence
taatagatattcacccaact

SEQ ID NO: 754116 - DNA, 20 bp, Artificial
  CRISPR gRNA sequence
acccaactccctaggacagt

SEQ ID NO: 754117 - DNA, 20 bp, Artificial
  CRISPR gRNA sequence
cctaggacagtgtgcactga

SEQ ID NO: 754118 - DNA, 20 bp, Artificial
  CRISPR gRNA sequence
ggacagtgtgcactgaggga

SEQ ID NO: 754119 - DNA, 20 bp, Artificial
  CRISPR gRNA sequence
agggagatagcagatgggag

SEQ ID NO: 754120 - DNA, 20 bp, Artificial
  CRISPR gRNA sequence
gttgcaggcatggtcagcag

SEQ ID NO: 754121 - DNA, 20 bp, Artificial
  CRISPR gRNA sequence
caggcatggtcagcaggatc

SEQ ID NO: 754122 - DNA, 20 bp, Artificial
  CRISPR gRNA sequence
taagttgagaagattgatca

SEQ ID NO: 754123 - DNA, 20 bp, Artificial
  CRISPR gRNA sequence
agaagattgatcaccagcct

SEQ ID NO: 754124 - DNA, 20 bp, Artificial
  CRISPR gRNA sequence
atcaccagcctgccgaggtg

SEQ ID NO: 754125 - DNA, 20 bp, Artificial
  CRISPR gRNA sequence
ccgaggtgctgggttgccct

SEQ ID NO: 754126 - DNA, 20 bp, Artificial
  CRISPR gRNA sequence
ggttgccctgggtatgttgc

SEQ ID NO: 754127 - DNA, 20 bp, Artificial
  CRISPR gRNA sequence
ccctgggtatgttgcccaag

SEQ ID NO: 754128 - DNA, 20 bp, Artificial
  CRISPR gRNA sequence
ggtatgttgcccaaggtcaa

SEQ ID NO: 754129 - DNA, 20 bp, Artificial
  CRISPR gRNA sequence
cccaaggtcaaagcctttat

SEQ ID NO: 754130 - DNA, 20 bp, Artificial
  CRISPR gRNA sequence
tatgccagggaaagtgagat

SEQ ID NO: 754131 - DNA, 20 bp, Artificial
  CRISPR gRNA sequence
atgccagggaaagtgagata

SEQ ID NO: 754132 - DNA, 20 bp, Artificial
  CRISPR gRNA sequence
tgccagggaaagtgagatag

SEQ ID NO: 754133 - DNA, 20 bp, Artificial
  CRISPR gRNA sequence
ttctccagctcttggggttg

SEQ ID NO: 754134 - DNA, 20 bp, Artificial
  CRISPR gRNA sequence
tccagctcttggggttgggc

SEQ ID NO: 754135 - DNA, 20 bp, Artificial
  CRISPR gRNA sequence
cagctcttggggttgggcca

SEQ ID NO: 754136 - DNA, 20 bp, Artificial
  CRISPR gRNA sequence
ttggggttgggccagcactg

SEQ ID NO: 754137 - DNA, 20 bp, Artificial
  CRISPR gRNA sequence
ggggttgggccagcactgag

SEQ ID NO: 754138 - DNA, 20 bp, Artificial
  CRISPR gRNA sequence
gggttgggccagcactgagg

SEQ ID NO: 754139 - DNA, 20 bp, Artificial
  CRISPR gRNA sequence
ggccagcactgaggagaatg

SEQ ID NO: 754140 - DNA, 20 bp, Artificial
  CRISPR gRNA sequence
aggagaatggtagtgatgaa

SEQ ID NO: 754141 - DNA, 20 bp, Artificial
  CRISPR gRNA sequence
agaagcccaggaaacaccaa

SEQ ID NO: 754142 - DNA, 20 bp, Artificial
  CRISPR gRNA sequence
tcctgggcctgactcagggt

SEQ ID NO: 754143 - DNA, 20 bp, Artificial
  CRISPR gRNA sequence
cctgggcctgactcagggtg

SEQ ID NO: 754144 - DNA, 20 bp, Artificial
  CRISPR gRNA sequence
ctgggcctgactcagggtga

SEQ ID NO: 754145 - DNA, 20 bp, Artificial
  CRISPR gRNA sequence
ggcctgactcagggtgagat

SEQ ID NO: 754146 - DNA, 20 bp, Artificial
  CRISPR gRNA sequence
actcagggtgagatgggtgg

SEQ ID NO: 754147 - DNA, 20 bp, Artificial
  CRISPR gRNA sequence
agggtgagatgggtggagag

SEQ ID NO: 754148 - DNA, 20 bp, Artificial
  CRISPR gRNA sequence
agggaccaggacccagcaga

SEQ ID NO: 754149 - DNA, 20 bp, Artificial
  CRISPR gRNA sequence
gggaccaggacccagcagat

SEQ ID NO: 754150 - DNA, 20 bp, Artificial
  CRISPR gRNA sequence
aagggtagcagagcctcttc

SEQ ID NO: 754151 - DNA, 20 bp, Artificial
  CRISPR gRNA sequence
ttcttccccacagacattcc

SEQ ID NO: 754152 - DNA, 20 bp, Artificial
  CRISPR gRNA sequence
cttccccacagacattccca

SEQ ID NO: 754153 - DNA, 20 bp, Artificial
  CRISPR gRNA sequence
ttccccacagacattcccag

SEQ ID NO: 754154 - DNA, 20 bp, Artificial
  CRISPR gRNA sequence
ccccacagacattcccagga

SEQ ID NO: 754155 - DNA, 20 bp, Artificial
  CRISPR gRNA sequence
cccacagacattcccaggac

SEQ ID NO: 754156 - DNA, 20 bp, Artificial
  CRISPR gRNA sequence
ccaggacccgaggcagttac

SEQ ID NO: 754157 - DNA, 20 bp, Artificial
  CRISPR gRNA sequence
ctgtccttgccctgtcctca

SEQ ID NO: 754158 - DNA, 20 bp, Artificial
  CRISPR gRNA sequence
tccttgccctgtcctcacag

SEQ ID NO: 754159 - DNA, 20 bp, Artificial
  CRISPR gRNA sequence
gccctgtcctcacaggctga

SEQ ID NO: 754160 - DNA, 20 bp, Artificial
  CRISPR gRNA sequence
ccctgtcctcacaggctgac

SEQ ID NO: 754161 - DNA, 20 bp, Artificial
  CRISPR gRNA sequence
tcctcacaggctgactcagg

SEQ ID NO: 754162 - DNA, 20 bp, Artificial
  CRISPR gRNA sequence
acaggctgactcaggactcc

SEQ ID NO: 754163 - DNA, 20 bp, Artificial
  CRISPR gRNA sequence
actcaggactcccaacctct

SEQ ID NO: 754164 - DNA, 20 bp, Artificial
  CRISPR gRNA sequence
aggactcccaacctctggga

SEQ ID NO: 754165 - DNA, 20 bp, Artificial
  CRISPR gRNA sequence
ccaacctctgggactagcac

SEQ ID NO: 754166 - DNA, 20 bp, Artificial
  CRISPR gRNA sequence
tgggactagcacatttaagt

SEQ ID NO: 754167 - DNA, 20 bp, Artificial
  CRISPR gRNA sequence
ggactagcacatttaagtgc

SEQ ID NO: 754168 - DNA, 20 bp, Artificial
  CRISPR gRNA sequence
gcacatttaagtgcactggg

SEQ ID NO: 754169 - DNA, 20 bp, Artificial
  CRISPR gRNA sequence
aagtgcactggggctaggga

SEQ ID NO: 754170 - DNA, 20 bp, Artificial
  CRISPR gRNA sequence
agtgcactggggctagggac

SEQ ID NO: 754171 - DNA, 20 bp, Artificial
  CRISPR gRNA sequence
gggctagggacgagagaccc

SEQ ID NO: 754172 - DNA, 20 bp, Artificial
  CRISPR gRNA sequence
gggacgagagaccccatctt

SEQ ID NO: 754173 - DNA, 20 bp, Artificial
  CRISPR gRNA sequence
ctccttcatagcaaaccagg

SEQ ID NO: 754174 - DNA, 20 bp, Artificial
  CRISPR gRNA sequence
tccttcatagcaaaccaggc

SEQ ID NO: 754175 - DNA, 20 bp, Artificial
  CRISPR gRNA sequence
cttcatagcaaaccaggctg

SEQ ID NO: 754176 - DNA, 20 bp, Artificial
  CRISPR gRNA sequence
catagcaaaccaggctgcag

SEQ ID NO: 754177 - DNA, 20 bp, Artificial
  CRISPR gRNA sequence
atagcaaaccaggctgcagg

SEQ ID NO: 754178 - DNA, 20 bp, Artificial
  CRISPR gRNA sequence
cagggccttgttgagtaacc

SEQ ID NO: 754179 - DNA, 20 bp, Artificial
  CRISPR gRNA sequence
gttgagtaacccagtgctgc

SEQ ID NO: 754180 - DNA, 20 bp, Artificial
  CRISPR gRNA sequence
ttgagtaacccagtgctgca

SEQ ID NO: 754181 - DNA, 20 bp, Artificial
  CRISPR gRNA sequence
agtaacccagtgctgcaagc

SEQ ID NO: 754182 - DNA, 20 bp, Artificial
  CRISPR gRNA sequence
caagcctctgacgcagcaat

SEQ ID NO: 754183 - DNA, 20 bp, Artificial
  CRISPR gRNA sequence
tgacgcagcaatggtcagct

SEQ ID NO: 754184 - DNA, 20 bp, Artificial
  CRISPR gRNA sequence
acgcagcaatggtcagctct

SEQ ID NO: 754185 - DNA, 20 bp, Artificial
  CRISPR gRNA sequence
ttaggaaatccacaacccac

SEQ ID NO: 754186 - DNA, 20 bp, Artificial
  CRISPR gRNA sequence
aggaaatccacaacccactg

SEQ ID NO: 754187 - DNA, 20 bp, Artificial
  CRISPR gRNA sequence
ggaaatccacaacccactgc

SEQ ID NO: 754188 - DNA, 20 bp, Artificial
  CRISPR gRNA sequence
cccagaggctctggagtaga

SEQ ID NO: 754189 - DNA, 20 bp, Artificial
  CRISPR gRNA sequence
tggagtagagaggaacagcc

SEQ ID NO: 754190 - DNA, 20 bp, Artificial
  CRISPR gRNA sequence
gagtagagaggaacagcctt

SEQ ID NO: 754191 - DNA, 20 bp, Artificial
  CRISPR gRNA sequence
gaggccagtccctggcatga

SEQ ID NO: 754192 - DNA, 20 bp, Artificial
  CRISPR gRNA sequence
aggccagtccctggcatgag

SEQ ID NO: 754193 - DNA, 20 bp, Artificial
  CRISPR gRNA sequence
gcatgaggggtcatctaccc

SEQ ID NO: 754194 - DNA, 20 bp, Artificial
  CRISPR gRNA sequence
cccaatgccagggacaccca

SEQ ID NO: 754195 - DNA, 20 bp, Artificial
  CRISPR gRNA sequence
ggagtcccttgctgagctgt

SEQ ID NO: 754196 - DNA, 20 bp, Artificial
  CRISPR gRNA sequence
gctgagctgtactagttgtt

SEQ ID NO: 754197 - DNA, 20 bp, Artificial
  CRISPR gRNA sequence
ctgagctgtactagttgttc

SEQ ID NO: 754198 - DNA, 20 bp, Artificial
  CRISPR gRNA sequence
agctgtactagttgttcatg

SEQ ID NO: 754199 - DNA, 20 bp, Artificial
  CRISPR gRNA sequence
tactagttgttcatgcttcc

SEQ ID NO: 754200 - DNA, 20 bp, Artificial
  CRISPR gRNA sequence
gttgttcatgcttccaccca

SEQ ID NO: 754201 - DNA, 20 bp, Artificial
  CRISPR gRNA sequence
ttcatgcttccacccaagca

SEQ ID NO: 754202 - DNA, 20 bp, Artificial
  CRISPR gRNA sequence
atgcttccacccaagcaggg

SEQ ID NO: 754203 - DNA, 20 bp, Artificial
  CRISPR gRNA sequence
ccacccaagcagggcaaagg

SEQ ID NO: 754204 - DNA, 20 bp, Artificial
  CRISPR gRNA sequence
cacccaagcagggcaaaggt

SEQ ID NO: 754205 - DNA, 20 bp, Artificial
  CRISPR gRNA sequence
cgctggggtctgaccttcct

SEQ ID NO: 754206 - DNA, 20 bp, Artificial
  CRISPR gRNA sequence
gggtctgaccttcctgggag

SEQ ID NO: 754207 - DNA, 20 bp, Artificial
  CRISPR gRNA sequence
accttcctgggagagggtgg

SEQ ID NO: 754208 - DNA, 20 bp, Artificial
  CRISPR gRNA sequence
cctgggagagggtggtccag

SEQ ID NO: 754209 - DNA, 20 bp, Artificial
  CRISPR gRNA sequence
ctgggagagggtggtccagg

SEQ ID NO: 754210 - DNA, 20 bp, Artificial
  CRISPR gRNA sequence
ggagagggtggtccaggcag

SEQ ID NO: 754211 - DNA, 20 bp, Artificial
  CRISPR gRNA sequence
ctgagacgctaaaggggtca

SEQ ID NO: 754212 - DNA, 20 bp, Artificial
  CRISPR gRNA sequence
agacgctaaaggggtcacct

SEQ ID NO: 754213 - DNA, 20 bp, Artificial
  CRISPR gRNA sequence
aaggggtcacctccctatcc

SEQ ID NO: 754214 - DNA, 20 bp, Artificial
  CRISPR gRNA sequence
cctatccgcacacagtgtat

SEQ ID NO: 754215 - DNA, 20 bp, Artificial
  CRISPR gRNA sequence
tccgcacacagtgtatgggg

SEQ ID NO: 754216 - DNA, 20 bp, Artificial
  CRISPR gRNA sequence
ggcctgagcagatgaaagga

SEQ ID NO: 754217 - DNA, 20 bp, Artificial
  CRISPR gRNA sequence
agcagatgaaaggaagaaag

SEQ ID NO: 754218 - DNA, 20 bp, Artificial
  CRISPR gRNA sequence
aaggagaacccgttggcagt

SEQ ID NO: 754219 - DNA, 20 bp, Artificial
  CRISPR gRNA sequence
gcagtgagcgagccccacat

SEQ ID NO: 754220 - DNA, 20 bp, Artificial
  CRISPR gRNA sequence
gaggccccaggctttagcca

SEQ ID NO: 754221 - DNA, 20 bp, Artificial
  CRISPR gRNA sequence
aggccccaggctttagccaa

SEQ ID NO: 754222 - DNA, 20 bp, Artificial
  CRISPR gRNA sequence
tagccaaccaatgacccagg

SEQ ID NO: 754223 - DNA, 20 bp, Artificial
  CRISPR gRNA sequence
agccaaccaatgacccaggg

SEQ ID NO: 754224 - DNA, 20 bp, Artificial
  CRISPR gRNA sequence
gccaaccaatgacccagggt

SEQ ID NO: 754225 - DNA, 20 bp, Artificial
  CRISPR gRNA sequence
gtctcccaggggagggtggg

SEQ ID NO: 754226 - DNA, 20 bp, Artificial
  CRISPR gRNA sequence
ccaggggagggtgggccagg

SEQ ID NO: 754227 - DNA, 20 bp, Artificial
  CRISPR gRNA sequence
tggcttccagtggccccaca

SEQ ID NO: 754228 - DNA, 20 bp, Artificial
  CRISPR gRNA sequence
ccagtggccccacagatgcc

SEQ ID NO: 754229 - DNA, 20 bp, Artificial
  CRISPR gRNA sequence
cagtggccccacagatgccc

SEQ ID NO: 754230 - DNA, 20 bp, Artificial
  CRISPR gRNA sequence
agctgcagtcccagcatgcc

SEQ ID NO: 754231 - DNA, 20 bp, Artificial
  CRISPR gRNA sequence
gctgcagtcccagcatgcct

SEQ ID NO: 754232 - DNA, 20 bp, Artificial
  CRISPR gRNA sequence
cagtcccagcatgcctgtat

SEQ ID NO: 754233 - DNA, 20 bp, Artificial
  CRISPR gRNA sequence
tatatggcaaagccagggac

SEQ ID NO: 754234 - DNA, 20 bp, Artificial
  CRISPR gRNA sequence
ccgtacagccccttgcttaa

SEQ ID NO: 754235 - DNA, 20 bp, Artificial
  CRISPR gRNA sequence
cgtacagccccttgcttaac

SEQ ID NO: 754236 - DNA, 20 bp, Artificial
  CRISPR gRNA sequence
gcttaactcttgggctttgt

SEQ ID NO: 754237 - DNA, 20 bp, Artificial
  CRISPR gRNA sequence
cttaactcttgggctttgtg

SEQ ID NO: 754238 - DNA, 20 bp, Artificial
  CRISPR gRNA sequence
aactcttgggctttgtgagt

SEQ ID NO: 754239 - DNA, 20 bp, Artificial
  CRISPR gRNA sequence
actcttgggctttgtgagtc

SEQ ID NO: 754240 - DNA, 20 bp, Artificial
  CRISPR gRNA sequence
ttgggctttgtgagtcactc

SEQ ID NO: 754241 - DNA, 20 bp, Artificial
  CRISPR gRNA sequence
gggctttgtgagtcactcag

SEQ ID NO: 754242 - DNA, 20 bp, Artificial
  CRISPR gRNA sequence
ggctttgtgagtcactcaga

SEQ ID NO: 754243 - DNA, 20 bp, Artificial
  CRISPR gRNA sequence
tgtgagtcactcagacctag

SEQ ID NO: 754244 - DNA, 20 bp, Artificial
  CRISPR gRNA sequence
gtgagtcactcagacctagg

SEQ ID NO: 754245 - DNA, 20 bp, Artificial
  CRISPR gRNA sequence
tgagtcactcagacctaggc

SEQ ID NO: 754246 - DNA, 20 bp, Artificial
  CRISPR gRNA sequence
agacctaggcttaaatccca

SEQ ID NO: 754247 - DNA, 20 bp, Artificial
  CRISPR gRNA sequence
ggcttaaatcccaagatggc

SEQ ID NO: 754248 - DNA, 20 bp, Artificial
  CRISPR gRNA sequence
aaatcccaagatggccattt

SEQ ID NO: 754249 - DNA, 20 bp, Artificial
  CRISPR gRNA sequence
aatcccaagatggccattta

SEQ ID NO: 754250 - DNA, 20 bp, Artificial
  CRISPR gRNA sequence
actgctctgtgatattggac

SEQ ID NO: 754251 - DNA, 20 bp, Artificial
  CRISPR gRNA sequence
ctgctctgtgatattggaca

SEQ ID NO: 754252 - DNA, 20 bp, Artificial
  CRISPR gRNA sequence
ctctgtgatattggacaagt

SEQ ID NO: 754253 - DNA, 20 bp, Artificial
  CRISPR gRNA sequence
tgtgatattggacaagttat

SEQ ID NO: 754254 - DNA, 20 bp, Artificial
  CRISPR gRNA sequence
tgatattggacaagttattc

SEQ ID NO: 754255 - DNA, 20 bp, Artificial
  CRISPR gRNA sequence
gacaagttattcagtctccc

SEQ ID NO: 754256 - DNA, 20 bp, Artificial
  CRISPR gRNA sequence
ttcagtctccctgagcaagt

SEQ ID NO: 754257 - DNA, 20 bp, Artificial
  CRISPR gRNA sequence
agtctccctgagcaagttcc

SEQ ID NO: 754258 - DNA, 20 bp, Artificial
  CRISPR gRNA sequence
cctgagcaagttcccctccc

SEQ ID NO: 754259 - DNA, 20 bp, Artificial
  CRISPR gRNA sequence
agcaagttcccctccctcta

SEQ ID NO: 754260 - DNA, 20 bp, Artificial
  CRISPR gRNA sequence
ccctccctctaaagtgggaa

SEQ ID NO: 754261 - DNA, 20 bp, Artificial
  CRISPR gRNA sequence
cctctaaagtgggaagatga

SEQ ID NO: 754262 - DNA, 20 bp, Artificial
  CRISPR gRNA sequence
taaagtgggaagatgatacc

SEQ ID NO: 754263 - DNA, 20 bp, Artificial
  CRISPR gRNA sequence
aagtgggaagatgataccac

SEQ ID NO: 754264 - DNA, 20 bp, Artificial
  CRISPR gRNA sequence
ccttggagggcaactgtgaa

SEQ ID NO: 754265 - DNA, 20 bp, Artificial
  CRISPR gRNA sequence
ggagggcaactgtgaagagc

SEQ ID NO: 754266 - DNA, 20 bp, Artificial
  CRISPR gRNA sequence
gagggcaactgtgaagagcc

SEQ ID NO: 754267 - DNA, 20 bp, Artificial
  CRISPR gRNA sequence
tgaagagccaatgaacgaac

SEQ ID NO: 754268 - DNA, 20 bp, Artificial
  CRISPR gRNA sequence
aacacagcacccggctcctc

SEQ ID NO: 754269 - DNA, 20 bp, Artificial
  CRISPR gRNA sequence
acacagcacccggctcctcg

SEQ ID NO: 754270 - DNA, 20 bp, Artificial
  CRISPR gRNA sequence
ctcgtgaatactgtgtaata

SEQ ID NO: 754271 - DNA, 20 bp, Artificial
  CRISPR gRNA sequence
gtgaatactgtgtaatatta

SEQ ID NO: 754272 - DNA, 20 bp, Artificial
  CRISPR gRNA sequence
tgtaatattatggtatttct

SEQ ID NO: 754273 - DNA, 20 bp, Artificial
  CRISPR gRNA sequence
tggtatttcttggcttctgc

SEQ ID NO: 754274 - DNA, 20 bp, Artificial
  CRISPR gRNA sequence
cttggcttctgcaggccaca

SEQ ID NO: 754275 - DNA, 20 bp, Artificial
  CRISPR gRNA sequence
ttggcttctgcaggccacat

SEQ ID NO: 754276 - DNA, 20 bp, Artificial
  CRISPR gRNA sequence
ggcttctgcaggccacatgc

SEQ ID NO: 754277 - DNA, 20 bp, Artificial
  CRISPR gRNA sequence
gcttctgcaggccacatgcc

SEQ ID NO: 754278 - DNA, 20 bp, Artificial
  CRISPR gRNA sequence
ctgcaggccacatgccattg

SEQ ID NO: 754279 - DNA, 20 bp, Artificial
  CRISPR gRNA sequence
tgcaggccacatgccattgg

SEQ ID NO: 754280 - DNA, 20 bp, Artificial
  CRISPR gRNA sequence
caggccacatgccattggct

SEQ ID NO: 754281 - DNA, 20 bp, Artificial
  CRISPR gRNA sequence
gctttctatctaagctgctt

SEQ ID NO: 754282 - DNA, 20 bp, Artificial
  CRISPR gRNA sequence
tctatctaagctgcttgctc

SEQ ID NO: 754283 - DNA, 20 bp, Artificial
  CRISPR gRNA sequence
ctatctaagctgcttgctct

SEQ ID NO: 754284 - DNA, 20 bp, Artificial
  CRISPR gRNA sequence
tatctaagctgcttgctctc

SEQ ID NO: 754285 - DNA, 20 bp, Artificial
  CRISPR gRNA sequence
tctaagctgcttgctctcta

SEQ ID NO: 754286 - DNA, 20 bp, Artificial
  CRISPR gRNA sequence
agctgcttgctctctacagg

SEQ ID NO: 754287 - DNA, 20 bp, Artificial
  CRISPR gRNA sequence
cttgctctctacagggccta

SEQ ID NO: 754288 - DNA, 20 bp, Artificial
  CRISPR gRNA sequence
gctctctacagggcctaatg

SEQ ID NO: 754289 - DNA, 20 bp, Artificial
  CRISPR gRNA sequence
ctctctacagggcctaatgg

SEQ ID NO: 754290 - DNA, 20 bp, Artificial
  CRISPR gRNA sequence
tctacagggcctaatggagt

SEQ ID NO: 754291 - DNA, 20 bp, Artificial
  CRISPR gRNA sequence
tacagggcctaatggagtgc

SEQ ID NO: 754292 - DNA, 20 bp, Artificial
  CRISPR gRNA sequence
cagggcctaatggagtgccc

SEQ ID NO: 754293 - DNA, 20 bp, Artificial
  CRISPR gRNA sequence
atggagtgcccagggcctgg

SEQ ID NO: 754294 - DNA, 20 bp, Artificial
  CRISPR gRNA sequence
ggaaggcattggtgagcttc

SEQ ID NO: 754295 - DNA, 20 bp, Artificial
  CRISPR gRNA sequence
gtgagcttcactgggactag

SEQ ID NO: 754296 - DNA, 20 bp, Artificial
  CRISPR gRNA sequence
cactgggactagattctcca

SEQ ID NO: 754297 - DNA, 20 bp, Artificial
  CRISPR gRNA sequence
actgggactagattctccaa

SEQ ID NO: 754298 - DNA, 20 bp, Artificial
  CRISPR gRNA sequence
ggactagattctccaaagcc

SEQ ID NO: 754299 - DNA, 20 bp, Artificial
  CRISPR gRNA sequence
gattctccaaagcctggagt

SEQ ID NO: 754300 - DNA, 20 bp, Artificial
  CRISPR gRNA sequence
tccaaagcctggagtatgaa

SEQ ID NO: 754301 - DNA, 20 bp, Artificial
  CRISPR gRNA sequence
caaagcctggagtatgaagg

SEQ ID NO: 754302 - DNA, 20 bp, Artificial
  CRISPR gRNA sequence
gagtatgaagggtgcatggg

SEQ ID NO: 754303 - DNA, 20 bp, Artificial
  CRISPR gRNA sequence
cgtccagctacctgtgagcc

SEQ ID NO: 754304 - DNA, 20 bp, Artificial
  CRISPR gRNA sequence
cctgtgagcccctgtaggcc

SEQ ID NO: 754305 - DNA, 20 bp, Artificial
  CRISPR gRNA sequence
tgagcccctgtaggccctca

SEQ ID NO: 754306 - DNA, 20 bp, Artificial
  CRISPR gRNA sequence
taggccctcacagtctgaaa

SEQ ID NO: 754307 - DNA, 20 bp, Artificial
  CRISPR gRNA sequence
acagtctgaaatgcccatgg

SEQ ID NO: 754308 - DNA, 20 bp, Artificial
  CRISPR gRNA sequence
aaatgcccatggaggtgcct

SEQ ID NO: 754309 - DNA, 20 bp, Artificial
  CRISPR gRNA sequence
caggttctcttcttaaagtt

SEQ ID NO: 754310 - DNA, 20 bp, Artificial
  CRISPR gRNA sequence
tcttcttaaagttgtcagga

SEQ ID NO: 754311 - DNA, 20 bp, Artificial
  CRISPR gRNA sequence
ttcttaaagttgtcaggaga

SEQ ID NO: 754312 - DNA, 20 bp, Artificial
  CRISPR gRNA sequence
cttaaagttgtcaggagatg

SEQ ID NO: 754313 - DNA, 20 bp, Artificial
  CRISPR gRNA sequence
ttaaagttgtcaggagatgg

SEQ ID NO: 754314 - DNA, 20 bp, Artificial
  CRISPR gRNA sequence
aaagttgtcaggagatgggg

SEQ ID NO: 754315 - DNA, 20 bp, Artificial
  CRISPR gRNA sequence
aagttgtcaggagatgggga

SEQ ID NO: 754316 - DNA, 20 bp, Artificial
  CRISPR gRNA sequence
tcaggagatggggacattgc

SEQ ID NO: 754317 - DNA, 20 bp, Artificial
  CRISPR gRNA sequence
caacttgaaggcaagcctgg

SEQ ID NO: 754318 - DNA, 20 bp, Artificial
  CRISPR gRNA sequence
gaaggcaagcctggccctgg

SEQ ID NO: 754319 - DNA, 20 bp, Artificial
  CRISPR gRNA sequence
aaggcaagcctggccctggg

SEQ ID NO: 754320 - DNA, 20 bp, Artificial
  CRISPR gRNA sequence
gccctgggtttgcttatctt

SEQ ID NO: 754321 - DNA, 20 bp, Artificial
  CRISPR gRNA sequence
ggtttgcttatcttggtgga

SEQ ID NO: 754322 - DNA, 20 bp, Artificial
  CRISPR gRNA sequence
gcttatcttggtggatcttt

SEQ ID NO: 754323 - DNA, 20 bp, Artificial
  CRISPR gRNA sequence
cttatcttggtggatctttc

SEQ ID NO: 754324 - DNA, 20 bp, Artificial
  CRISPR gRNA sequence
atcttggtggatctttctta

SEQ ID NO: 754325 - DNA, 20 bp, Artificial
  CRISPR gRNA sequence
tcttggtggatctttcttac

SEQ ID NO: 754326 - DNA, 20 bp, Artificial
  CRISPR gRNA sequence
ggtggatctttcttacatct

SEQ ID NO: 754327 - DNA, 20 bp, Artificial
  CRISPR gRNA sequence
gtggatctttcttacatctg

SEQ ID NO: 754328 - DNA, 20 bp, Artificial
  CRISPR gRNA sequence
tcttacatctgatcttttta

SEQ ID NO: 754329 - DNA, 20 bp, Artificial
  CRISPR gRNA sequence
cttacatctgatctttttac

SEQ ID NO: 754330 - DNA, 20 bp, Artificial
  CRISPR gRNA sequence
ttacatctgatctttttaca

SEQ ID NO: 754331 - DNA, 20 bp, Artificial
  CRISPR gRNA sequence
acatctgatctttttacatt

SEQ ID NO: 754332 - DNA, 20 bp, Artificial
  CRISPR gRNA sequence
catctgatctttttacattc

SEQ ID NO: 754333 - DNA, 20 bp, Artificial
  CRISPR gRNA sequence
atctttttacattcggtcca

SEQ ID NO: 754334 - DNA, 20 bp, Artificial
  CRISPR gRNA sequence
tttacattcggtccattcac

SEQ ID NO: 754335 - DNA, 20 bp, Artificial
  CRISPR gRNA sequence
ttacattcggtccattcact

SEQ ID NO: 754336 - DNA, 20 bp, Artificial
  CRISPR gRNA sequence
tacattcggtccattcactt

SEQ ID NO: 754337 - DNA, 20 bp, Artificial
  CRISPR gRNA sequence
acattcggtccattcacttt

SEQ ID NO: 754338 - DNA, 20 bp, Artificial
  CRISPR gRNA sequence
cattcggtccattcactttg

SEQ ID NO: 754339 - DNA, 20 bp, Artificial
  CRISPR gRNA sequence
ggtccattcactttggctgg

SEQ ID NO: 754340 - DNA, 20 bp, Artificial
  CRISPR gRNA sequence
actttggctggccatcacca

SEQ ID NO: 754341 - DNA, 20 bp, Artificial
  CRISPR gRNA sequence
tggctggccatcaccaaaga

SEQ ID NO: 754342 - DNA, 20 bp, Artificial
  CRISPR gRNA sequence
ggctggccatcaccaaagac

SEQ ID NO: 754343 - DNA, 20 bp, Artificial
  CRISPR gRNA sequence
gctggccatcaccaaagaca

SEQ ID NO: 754344 - DNA, 20 bp, Artificial
  CRISPR gRNA sequence
gccatcaccaaagacaaaga

SEQ ID NO: 754345 - DNA, 20 bp, Artificial
  CRISPR gRNA sequence
tctcatcagtaatccaataa

SEQ ID NO: 754346 - DNA, 20 bp, Artificial
  CRISPR gRNA sequence
ctcatcagtaatccaataat

SEQ ID NO: 754347 - DNA, 20 bp, Artificial
  CRISPR gRNA sequence
tcatcagtaatccaataatg

SEQ ID NO: 754348 - DNA, 20 bp, Artificial
  CRISPR gRNA sequence
atcagtaatccaataatgag

SEQ ID NO: 754349 - DNA, 20 bp, Artificial
  CRISPR gRNA sequence
ctctgctacttaccaagcca

SEQ ID NO: 754350 - DNA, 20 bp, Artificial
  CRISPR gRNA sequence
tgctacttaccaagccaagc

SEQ ID NO: 754351 - DNA, 20 bp, Artificial
  CRISPR gRNA sequence
ctacttaccaagccaagcaa

SEQ ID NO: 754352 - DNA, 20 bp, Artificial
  CRISPR gRNA sequence
cttaccaagccaagcaagcc

SEQ ID NO: 754353 - DNA, 20 bp, Artificial
  CRISPR gRNA sequence
accaagccaagcaagcccat

SEQ ID NO: 754354 - DNA, 20 bp, Artificial
  CRISPR gRNA sequence
ccaagccaagcaagcccatt

SEQ ID NO: 754355 - DNA, 20 bp, Artificial
  CRISPR gRNA sequence
ctttagcctttctgcgtagg

SEQ ID NO: 754356 - DNA, 20 bp, Artificial
  CRISPR gRNA sequence
tagcctttctgcgtaggatc

SEQ ID NO: 754357 - DNA, 20 bp, Artificial
  CRISPR gRNA sequence
agcctttctgcgtaggatct

SEQ ID NO: 754358 - DNA, 20 bp, Artificial
  CRISPR gRNA sequence
gcctttctgcgtaggatctt

SEQ ID NO: 754359 - DNA, 20 bp, Artificial
  CRISPR gRNA sequence
tctgcgtaggatcttatttc

SEQ ID NO: 754360 - DNA, 20 bp, Artificial
  CRISPR gRNA sequence
ctgcgtaggatcttatttcc

SEQ ID NO: 754361 - DNA, 20 bp, Artificial
  CRISPR gRNA sequence
tgcgtaggatcttatttccc

SEQ ID NO: 754362 - DNA, 20 bp, Artificial
  CRISPR gRNA sequence
cgtaggatcttatttcccat

SEQ ID NO: 754363 - DNA, 20 bp, Artificial
  CRISPR gRNA sequence
atttcccatggggacctggg

SEQ ID NO: 754364 - DNA, 20 bp, Artificial
  CRISPR gRNA sequence
tttcccatggggacctgggg

SEQ ID NO: 754365 - DNA, 20 bp, Artificial
  CRISPR gRNA sequence
cccatggggacctggggtca

SEQ ID NO: 754366 - DNA, 20 bp, Artificial
  CRISPR gRNA sequence
ccatggggacctggggtcaa

SEQ ID NO: 754367 - DNA, 20 bp, Artificial
  CRISPR gRNA sequence
gggtcaaaccctgcctctgc

SEQ ID NO: 754368 - DNA, 20 bp, Artificial
  CRISPR gRNA sequence
cctctgctgttcactcatca

SEQ ID NO: 754369 - DNA, 20 bp, Artificial
  CRISPR gRNA sequence
tgctgttcactcatcatggg

SEQ ID NO: 754370 - DNA, 20 bp, Artificial
  CRISPR gRNA sequence
ctgttcactcatcatgggaa

SEQ ID NO: 754371 - DNA, 20 bp, Artificial
  CRISPR gRNA sequence
ttcactcatcatgggaacac

SEQ ID NO: 754372 - DNA, 20 bp, Artificial
  CRISPR gRNA sequence
actcatcatgggaacacaaa

SEQ ID NO: 754373 - DNA, 20 bp, Artificial
  CRISPR gRNA sequence
atcatgggaacacaaacaca

SEQ ID NO: 754374 - DNA, 20 bp, Artificial
  CRISPR gRNA sequence
cccctttgtctgtgcaatgg

SEQ ID NO: 754375 - DNA, 20 bp, Artificial
  CRISPR gRNA sequence
ccctttgtctgtgcaatgga

SEQ ID NO: 754376 - DNA, 20 bp, Artificial
  CRISPR gRNA sequence
tgtctgtgcaatggacaggt

SEQ ID NO: 754377 - DNA, 20 bp, Artificial
  CRISPR gRNA sequence
gtctgtgcaatggacaggtt

SEQ ID NO: 754378 - DNA, 20 bp, Artificial
  CRISPR gRNA sequence
tctgtgcaatggacaggttg

SEQ ID NO: 754379 - DNA, 20 bp, Artificial
  CRISPR gRNA sequence
tgcaatggacaggttgggtg

SEQ ID NO: 754380 - DNA, 20 bp, Artificial
  CRISPR gRNA sequence
ggtgacgtggtctcagtgag

SEQ ID NO: 754381 - DNA, 20 bp, Artificial
  CRISPR gRNA sequence
agtgaggctgaccaccctcc

SEQ ID NO: 754382 - DNA, 20 bp, Artificial
  CRISPR gRNA sequence
accaccctcctctgaaggtt

SEQ ID NO: 754383 - DNA, 20 bp, Artificial
  CRISPR gRNA sequence
ctctgaaggttaattccatg

SEQ ID NO: 754384 - DNA, 20 bp, Artificial
  CRISPR gRNA sequence
tgaaggttaattccatgatg

SEQ ID NO: 754385 - DNA, 20 bp, Artificial
  CRISPR gRNA sequence
aaggttaattccatgatggt

SEQ ID NO: 754386 - DNA, 20 bp, Artificial
  CRISPR gRNA sequence
attccatgatggtgtttccc

SEQ ID NO: 754387 - DNA, 20 bp, Artificial
  CRISPR gRNA sequence
catgatggtgtttccctagc

SEQ ID NO: 754388 - DNA, 20 bp, Artificial
  CRISPR gRNA sequence
ccctagcttcagtcatttgc

SEQ ID NO: 754389 - DNA, 20 bp, Artificial
  CRISPR gRNA sequence
cctagcttcagtcatttgct

SEQ ID NO: 754390 - DNA, 20 bp, Artificial
  CRISPR gRNA sequence
gcttcagtcatttgcttatc

SEQ ID NO: 754391 - DNA, 20 bp, Artificial
  CRISPR gRNA sequence
cagtcatttgcttatcacct

SEQ ID NO: 754392 - DNA, 20 bp, Artificial
  CRISPR gRNA sequence
agtcatttgcttatcacctt

SEQ ID NO: 754393 - DNA, 20 bp, Artificial
  CRISPR gRNA sequence
gcttatcacctttgtgatct

SEQ ID NO: 754394 - DNA, 20 bp, Artificial
  CRISPR gRNA sequence
cttatcacctttgtgatctc

SEQ ID NO: 754395 - DNA, 20 bp, Artificial
  CRISPR gRNA sequence
atcacctttgtgatctctgc

SEQ ID NO: 754396 - DNA, 20 bp, Artificial
  CRISPR gRNA sequence
tcacctttgtgatctctgca

SEQ ID NO: 754397 - DNA, 20 bp, Artificial
  CRISPR gRNA sequence
tgtgatctctgcagtgtctg

SEQ ID NO: 754398 - DNA, 20 bp, Artificial
  CRISPR gRNA sequence
gtgatctctgcagtgtctgc

SEQ ID NO: 754399 - DNA, 20 bp, Artificial
  CRISPR gRNA sequence
tgatctctgcagtgtctgcc

SEQ ID NO: 754400 - DNA, 20 bp, Artificial
  CRISPR gRNA sequence
tgcagtgtctgcctttcata

SEQ ID NO: 754401 - DNA, 20 bp, Artificial
  CRISPR gRNA sequence
cagtgtctgcctttcataat

SEQ ID NO: 754402 - DNA, 20 bp, Artificial
  CRISPR gRNA sequence
cctttcataatatttactta

SEQ ID NO: 754403 - DNA, 20 bp, Artificial
  CRISPR gRNA sequence
tcataatatttacttatttt

SEQ ID NO: 754404 - DNA, 20 bp, Artificial
  CRISPR gRNA sequence
cataatatttacttattttt

SEQ ID NO: 754405 - DNA, 20 bp, Artificial
  CRISPR gRNA sequence
ataatatttacttatttttt

SEQ ID NO: 754406 - DNA, 20 bp, Artificial
  CRISPR gRNA sequence
acttatttttttctttaaat

SEQ ID NO: 754407 - DNA, 20 bp, Artificial
  CRISPR gRNA sequence
cttatttttttctttaaatc

SEQ ID NO: 754408 - DNA, 20 bp, Artificial
  CRISPR gRNA sequence
atttttttctttaaatctac

SEQ ID NO: 754409 - DNA, 20 bp, Artificial
  CRISPR gRNA sequence
tttttttctttaaatctact

SEQ ID NO: 754410 - DNA, 20 bp, Artificial
  CRISPR gRNA sequence
ttttctttaaatctactcat

SEQ ID NO: 754411 - DNA, 20 bp, Artificial
  CRISPR gRNA sequence
tttctttaaatctactcatt

SEQ ID NO: 754412 - DNA, 20 bp, Artificial
  CRISPR gRNA sequence
ttctttaaatctactcattc

SEQ ID NO: 754413 - DNA, 20 bp, Artificial
  CRISPR gRNA sequence
tctttaaatctactcattct

SEQ ID NO: 754414 - DNA, 20 bp, Artificial
  CRISPR gRNA sequence
ctttaaatctactcattctt

SEQ ID NO: 754415 - DNA, 20 bp, Artificial
  CRISPR gRNA sequence
tttaaatctactcattcttt

SEQ ID NO: 754416 - DNA, 20 bp, Artificial
  CRISPR gRNA sequence
taaatctactcattctttta

SEQ ID NO: 754417 - DNA, 20 bp, Artificial
  CRISPR gRNA sequence
aaatctactcattcttttat

SEQ ID NO: 754418 - DNA, 20 bp, Artificial
  CRISPR gRNA sequence
aatctactcattcttttatt

SEQ ID NO: 754419 - DNA, 20 bp, Artificial
  CRISPR gRNA sequence
ctcattcttttatttgagta

SEQ ID NO: 754420 - DNA, 20 bp, Artificial
  CRISPR gRNA sequence
attcttttatttgagtatgt

SEQ ID NO: 754421 - DNA, 20 bp, Artificial
  CRISPR gRNA sequence
ttttatttgagtatgtagat

SEQ ID NO: 754422 - DNA, 20 bp, Artificial
  CRISPR gRNA sequence
ttatttgagtatgtagatct

SEQ ID NO: 754423 - DNA, 20 bp, Artificial
  CRISPR gRNA sequence
tatttgagtatgtagatctt

SEQ ID NO: 754424 - DNA, 20 bp, Artificial
  CRISPR gRNA sequence
atttgagtatgtagatcttt

SEQ ID NO: 754425 - DNA, 20 bp, Artificial
  CRISPR gRNA sequence
tttgagtatgtagatcttta

SEQ ID NO: 754426 - DNA, 20 bp, Artificial
  CRISPR gRNA sequence
gagtatgtagatctttaaaa

SEQ ID NO: 754427 - DNA, 20 bp, Artificial
  CRISPR gRNA sequence
agtatgtagatctttaaaag

SEQ ID NO: 754428 - DNA, 20 bp, Artificial
  CRISPR gRNA sequence
taaaaggaaactttttatcg

SEQ ID NO: 754429 - DNA, 20 bp, Artificial
  CRISPR gRNA sequence
aaaaggaaactttttatcgc

SEQ ID NO: 754430 - DNA, 20 bp, Artificial
  CRISPR gRNA sequence
aaaggaaactttttatcgct

SEQ ID NO: 754431 - DNA, 20 bp, Artificial
  CRISPR gRNA sequence
tttatcgctgtcattagtgg

SEQ ID NO: 754432 - DNA, 20 bp, Artificial
  CRISPR gRNA sequence
ttatcgctgtcattagtgga

SEQ ID NO: 754433 - DNA, 20 bp, Artificial
  CRISPR gRNA sequence
tatcgctgtcattagtggaa

SEQ ID NO: 754434 - DNA, 20 bp, Artificial
  CRISPR gRNA sequence
atcgctgtcattagtggaaa

SEQ ID NO: 754435 - DNA, 20 bp, Artificial
  CRISPR gRNA sequence
tcgctgtcattagtggaaag

SEQ ID NO: 754436 - DNA, 20 bp, Artificial
  CRISPR gRNA sequence
tcattagtggaaagccagta

SEQ ID NO: 754437 - DNA, 20 bp, Artificial
  CRISPR gRNA sequence
gtggaaagccagtatcactt

SEQ ID NO: 754438 - DNA, 20 bp, Artificial
  CRISPR gRNA sequence
gtcataaatagaacaaaacc

SEQ ID NO: 754439 - DNA, 20 bp, Artificial
  CRISPR gRNA sequence
tcataaatagaacaaaacca

SEQ ID NO: 754440 - DNA, 20 bp, Artificial
  CRISPR gRNA sequence
aattctagttggaaacttta

SEQ ID NO: 754441 - DNA, 20 bp, Artificial
  CRISPR gRNA sequence
tagttggaaactttagcctg

SEQ ID NO: 754442 - DNA, 20 bp, Artificial
  CRISPR gRNA sequence
gttggaaactttagcctggg

SEQ ID NO: 754443 - DNA, 20 bp, Artificial
  CRISPR gRNA sequence
gaaactttagcctgggaagg

SEQ ID NO: 754444 - DNA, 20 bp, Artificial
  CRISPR gRNA sequence
tagcctgggaaggctcggag

SEQ ID NO: 754445 - DNA, 20 bp, Artificial
  CRISPR gRNA sequence
agcctgggaaggctcggagt

SEQ ID NO: 754446 - DNA, 20 bp, Artificial
  CRISPR gRNA sequence
gcctgggaaggctcggagtc

SEQ ID NO: 754447 - DNA, 20 bp, Artificial
  CRISPR gRNA sequence
ggaaggctcggagtctgaaa

SEQ ID NO: 754448 - DNA, 20 bp, Artificial
  CRISPR gRNA sequence
ggagtctgaaaactgctgct

SEQ ID NO: 754449 - DNA, 20 bp, Artificial
  CRISPR gRNA sequence
aaaactgctgctttcccttg

SEQ ID NO: 754450 - DNA, 20 bp, Artificial
  CRISPR gRNA sequence
ctgctttcccttgcaaaaaa

SEQ ID NO: 754451 - DNA, 20 bp, Artificial
  CRISPR gRNA sequence
ctttcccttgcaaaaaatta

SEQ ID NO: 754452 - DNA, 20 bp, Artificial
  CRISPR gRNA sequence
tcccttgcaaaaaattaaaa

SEQ ID NO: 754453 - DNA, 20 bp, Artificial
  CRISPR gRNA sequence
cccttgcaaaaaattaaaat

SEQ ID NO: 754454 - DNA, 20 bp, Artificial
  CRISPR gRNA sequence
ccttgcaaaaaattaaaata

SEQ ID NO: 754455 - DNA, 20 bp, Artificial
  CRISPR gRNA sequence
gcaaaaaattaaaataaaat

SEQ ID NO: 754456 - DNA, 20 bp, Artificial
  CRISPR gRNA sequence
caaaaaattaaaataaaata

SEQ ID NO: 754457 - DNA, 20 bp, Artificial
  CRISPR gRNA sequence
aaataaaataaaatttaaaa

SEQ ID NO: 754458 - DNA, 20 bp, Artificial
  CRISPR gRNA sequence
aaaaagaaaaggagattagc

SEQ ID NO: 754459 - DNA, 20 bp, Artificial
  CRISPR gRNA sequence
aaaagaaaaggagattagca

SEQ ID NO: 754460 - DNA, 20 bp, Artificial
  CRISPR gRNA sequence
gcaaatgttttagagacata

SEQ ID NO: 754461 - DNA, 20 bp, Artificial
  CRISPR gRNA sequence
tagagacatattagcatcaa

SEQ ID NO: 754462 - DNA, 20 bp, Artificial
  CRISPR gRNA sequence
agagacatattagcatcaaa

SEQ ID NO: 754463 - DNA, 20 bp, Artificial
  CRISPR gRNA sequence
gagacatattagcatcaaac

SEQ ID NO: 754464 - DNA, 20 bp, Artificial
  CRISPR gRNA sequence
gcatcaaactgagactttct

SEQ ID NO: 754465 - DNA, 20 bp, Artificial
  CRISPR gRNA sequence
agactttctctttgatgtaa

SEQ ID NO: 754466 - DNA, 20 bp, Artificial
  CRISPR gRNA sequence
tctctttgatgtaatcagga

SEQ ID NO: 754467 - DNA, 20 bp, Artificial
  CRISPR gRNA sequence
ctctttgatgtaatcaggac

SEQ ID NO: 754468 - DNA, 20 bp, Artificial
  CRISPR gRNA sequence
tctttgatgtaatcaggact

SEQ ID NO: 754469 - DNA, 20 bp, Artificial
  CRISPR gRNA sequence
tttgatgtaatcaggactga

SEQ ID NO: 754470 - DNA, 20 bp, Artificial
  CRISPR gRNA sequence
tgatgtaatcaggactgaaa

SEQ ID NO: 754471 - DNA, 20 bp, Artificial
  CRISPR gRNA sequence
gatgtaatcaggactgaaat

SEQ ID NO: 754472 - DNA, 20 bp, Artificial
  CRISPR gRNA sequence
atgtaatcaggactgaaata

SEQ ID NO: 754473 - DNA, 20 bp, Artificial
  CRISPR gRNA sequence
aaataattgtaaagggaata

SEQ ID NO: 754474 - DNA, 20 bp, Artificial
  CRISPR gRNA sequence
taaagggaataacctcttct

SEQ ID NO: 754475 - DNA, 20 bp, Artificial
  CRISPR gRNA sequence
ttctatatatgattcaatgt

SEQ ID NO: 754476 - DNA, 20 bp, Artificial
  CRISPR gRNA sequence
ctatatatgattcaatgtta

SEQ ID NO: 754477 - DNA, 20 bp, Artificial
  CRISPR gRNA sequence
tatatatgattcaatgttat

SEQ ID NO: 754478 - DNA, 20 bp, Artificial
  CRISPR gRNA sequence
tatatgattcaatgttattt

SEQ ID NO: 754479 - DNA, 20 bp, Artificial
  CRISPR gRNA sequence
aatgttatttaatgtaaaac

SEQ ID NO: 754480 - DNA, 20 bp, Artificial
  CRISPR gRNA sequence
tttaatgtaaaaccaaaagt

SEQ ID NO: 754481 - DNA, 20 bp, Artificial
  CRISPR gRNA sequence
aatgtaaaaccaaaagtaaa

SEQ ID NO: 754482 - DNA, 20 bp, Artificial
  CRISPR gRNA sequence
atgtaaaaccaaaagtaaaa

SEQ ID NO: 754483 - DNA, 20 bp, Artificial
  CRISPR gRNA sequence
tgtggtagacgtggccaggc

SEQ ID NO: 754484 - DNA, 20 bp, Artificial
  CRISPR gRNA sequence
ggctttcattggtcatgaca

SEQ ID NO: 754485 - DNA, 20 bp, Artificial
  CRISPR gRNA sequence
tcattggtcatgacatttgt

SEQ ID NO: 754486 - DNA, 20 bp, Artificial
  CRISPR gRNA sequence
cattggtcatgacatttgtc

SEQ ID NO: 754487 - DNA, 20 bp, Artificial
  CRISPR gRNA sequence
attggtcatgacatttgtcc

SEQ ID NO: 754488 - DNA, 20 bp, Artificial
  CRISPR gRNA sequence
gtcatgacatttgtccgtct

SEQ ID NO: 754489 - DNA, 20 bp, Artificial
  CRISPR gRNA sequence
gtccgtcttcaagaaggagg

SEQ ID NO: 754490 - DNA, 20 bp, Artificial
  CRISPR gRNA sequence
tccgtcttcaagaaggaggt

SEQ ID NO: 754491 - DNA, 20 bp, Artificial
  CRISPR gRNA sequence
caagaaggaggtggggcctc

SEQ ID NO: 754492 - DNA, 20 bp, Artificial
  CRISPR gRNA sequence
aagaaggaggtggggcctcc

SEQ ID NO: 754493 - DNA, 20 bp, Artificial
  CRISPR gRNA sequence
cagtcagtccccagctacct

SEQ ID NO: 754494 - DNA, 20 bp, Artificial
  CRISPR gRNA sequence
cctctattctctagagagta

SEQ ID NO: 754495 - DNA, 20 bp, Artificial
  CRISPR gRNA sequence
tattctctagagagtagtca

SEQ ID NO: 754496 - DNA, 20 bp, Artificial
  CRISPR gRNA sequence
ttctctagagagtagtcaga

SEQ ID NO: 754497 - DNA, 20 bp, Artificial
  CRISPR gRNA sequence
tctagagagtagtcagatgg

SEQ ID NO: 754498 - DNA, 20 bp, Artificial
  CRISPR gRNA sequence
tagagagtagtcagatggca

SEQ ID NO: 754499 - DNA, 20 bp, Artificial
  CRISPR gRNA sequence
gagagtagtcagatggcacc

SEQ ID NO: 754500 - DNA, 20 bp, Artificial
  CRISPR gRNA sequence
cagaggctgactacctgggt

SEQ ID NO: 754501 - DNA, 20 bp, Artificial
  CRISPR gRNA sequence
actacctgggttcagatcct

SEQ ID NO: 754502 - DNA, 20 bp, Artificial
  CRISPR gRNA sequence
cctgggttcagatcctgaca

SEQ ID NO: 754503 - DNA, 20 bp, Artificial
  CRISPR gRNA sequence
ggttcagatcctgacaccat

SEQ ID NO: 754504 - DNA, 20 bp, Artificial
  CRISPR gRNA sequence
agatcctgacaccatcactt

SEQ ID NO: 754505 - DNA, 20 bp, Artificial
  CRISPR gRNA sequence
acaccatcacttattagttg

SEQ ID NO: 754506 - DNA, 20 bp, Artificial
  CRISPR gRNA sequence
attagttgtgaggctgtggg

SEQ ID NO: 754507 - DNA, 20 bp, Artificial
  CRISPR gRNA sequence
ttagttgtgaggctgtgggc

SEQ ID NO: 754508 - DNA, 20 bp, Artificial
  CRISPR gRNA sequence
gttgtgaggctgtgggcaag

SEQ ID NO: 754509 - DNA, 20 bp, Artificial
  CRISPR gRNA sequence
tgaggctgtgggcaagatac

SEQ ID NO: 754510 - DNA, 20 bp, Artificial
  CRISPR gRNA sequence
tgggcaagatactaatctct

SEQ ID NO: 754511 - DNA, 20 bp, Artificial
  CRISPR gRNA sequence
atctctctgtgcttccgttt

SEQ ID NO: 754512 - DNA, 20 bp, Artificial
  CRISPR gRNA sequence
tctgtgcttccgttttctca

SEQ ID NO: 754513 - DNA, 20 bp, Artificial
  CRISPR gRNA sequence
tgtgcttccgttttctcatc

SEQ ID NO: 754514 - DNA, 20 bp, Artificial
  CRISPR gRNA sequence
tgcttccgttttctcatctg

SEQ ID NO: 754515 - DNA, 20 bp, Artificial
  CRISPR gRNA sequence
ccgttttctcatctgtaaaa

SEQ ID NO: 754516 - DNA, 20 bp, Artificial
  CRISPR gRNA sequence
cgttttctcatctgtaaaat

SEQ ID NO: 754517 - DNA, 20 bp, Artificial
  CRISPR gRNA sequence
tctcatctgtaaaatggaga

SEQ ID NO: 754518 - DNA, 20 bp, Artificial
  CRISPR gRNA sequence
ctcatctgtaaaatggagat

SEQ ID NO: 754519 - DNA, 20 bp, Artificial
  CRISPR gRNA sequence
tcatctgtaaaatggagatg

SEQ ID NO: 754520 - DNA, 20 bp, Artificial
  CRISPR gRNA sequence
atctgtaaaatggagatgat

SEQ ID NO: 754521 - DNA, 20 bp, Artificial
  CRISPR gRNA sequence
taaaatggagatgatactag

SEQ ID NO: 754522 - DNA, 20 bp, Artificial
  CRISPR gRNA sequence
gtacctacctcatagggtgg

SEQ ID NO: 754523 - DNA, 20 bp, Artificial
  CRISPR gRNA sequence
cctcatagggtggaaggatt

SEQ ID NO: 754524 - DNA, 20 bp, Artificial
  CRISPR gRNA sequence
atagggtggaaggattacat

SEQ ID NO: 754525 - DNA, 20 bp, Artificial
  CRISPR gRNA sequence
cataaactaatctatgtaaa

SEQ ID NO: 754526 - DNA, 20 bp, Artificial
  CRISPR gRNA sequence
atctatgtaaaagtgtttag

SEQ ID NO: 754527 - DNA, 20 bp, Artificial
  CRISPR gRNA sequence
tgtaaaagtgtttagaatga

SEQ ID NO: 754528 - DNA, 20 bp, Artificial
  CRISPR gRNA sequence
agaatgaggccgagcacagt

SEQ ID NO: 754529 - DNA, 20 bp, Artificial
  CRISPR gRNA sequence
gaatgaggccgagcacagtg

SEQ ID NO: 754530 - DNA, 20 bp, Artificial
  CRISPR gRNA sequence
atgcctgtaatcccagcact

SEQ ID NO: 754531 - DNA, 20 bp, Artificial
  CRISPR gRNA sequence
taatcccagcactttgggag

SEQ ID NO: 754532 - DNA, 20 bp, Artificial
  CRISPR gRNA sequence
tgggaggctgaggtgggagg

SEQ ID NO: 754533 - DNA, 20 bp, Artificial
  CRISPR gRNA sequence
gggaggctgaggtgggagga

SEQ ID NO: 754534 - DNA, 20 bp, Artificial
  CRISPR gRNA sequence
ggaggctgaggtgggaggat

SEQ ID NO: 754535 - DNA, 20 bp, Artificial
  CRISPR gRNA sequence
aggtgggaggatctcttgaa

SEQ ID NO: 754536 - DNA, 20 bp, Artificial
  CRISPR gRNA sequence
ttgaagccaggagtttcaag

SEQ ID NO: 754537 - DNA, 20 bp, Artificial
  CRISPR gRNA sequence
gaagccaggagtttcaagcc

SEQ ID NO: 754538 - DNA, 20 bp, Artificial
  CRISPR gRNA sequence
aagccaggagtttcaagcca

SEQ ID NO: 754539 - DNA, 20 bp, Artificial
  CRISPR gRNA sequence
caagccaggggaccagcctg

SEQ ID NO: 754540 - DNA, 20 bp, Artificial
  CRISPR gRNA sequence
aagccaggggaccagcctgg

SEQ ID NO: 754541 - DNA, 20 bp, Artificial
  CRISPR gRNA sequence
gacaacataacgagacccca

SEQ ID NO: 754542 - DNA, 20 bp, Artificial
  CRISPR gRNA sequence
tgaaaaatttaaaaattagc

SEQ ID NO: 754543 - DNA, 20 bp, Artificial
  CRISPR gRNA sequence
aaaaattagctgggcatagt

SEQ ID NO: 754544 - DNA, 20 bp, Artificial
  CRISPR gRNA sequence
aaaattagctgggcatagtg

SEQ ID NO: 754545 - DNA, 20 bp, Artificial
  CRISPR gRNA sequence
gctgggcatagtggcatgtg

SEQ ID NO: 754546 - DNA, 20 bp, Artificial
  CRISPR gRNA sequence
ggcatagtggcatgtgtctg

SEQ ID NO: 754547 - DNA, 20 bp, Artificial
  CRISPR gRNA sequence
tagtcctagttgggaggcag

SEQ ID NO: 754548 - DNA, 20 bp, Artificial
  CRISPR gRNA sequence
gttgggaggcaggggtggga

SEQ ID NO: 754549 - DNA, 20 bp, Artificial
  CRISPR gRNA sequence
ggaggcaggggtgggaggat

SEQ ID NO: 754550 - DNA, 20 bp, Artificial
  CRISPR gRNA sequence
gagcccatgagttcgaggtt

SEQ ID NO: 754551 - DNA, 20 bp, Artificial
  CRISPR gRNA sequence
agcccatgagttcgaggtta

SEQ ID NO: 754552 - DNA, 20 bp, Artificial
  CRISPR gRNA sequence
gaggttacagtgggctatga

SEQ ID NO: 754553 - DNA, 20 bp, Artificial
  CRISPR gRNA sequence
cagtgggctatgatctcatt

SEQ ID NO: 754554 - DNA, 20 bp, Artificial
  CRISPR gRNA sequence
tgatctcattgtcactgcat

SEQ ID NO: 754555 - DNA, 20 bp, Artificial
  CRISPR gRNA sequence
attgtcactgcattccagcc

SEQ ID NO: 754556 - DNA, 20 bp, Artificial
  CRISPR gRNA sequence
tcactgcattccagcctgag

SEQ ID NO: 754557 - DNA, 20 bp, Artificial
  CRISPR gRNA sequence
cattccagcctgagtgaaga

SEQ ID NO: 754558 - DNA, 20 bp, Artificial
  CRISPR gRNA sequence
cagcctgagtgaagagcaag

SEQ ID NO: 754559 - DNA, 20 bp, Artificial
  CRISPR gRNA sequence
agtgaagagcaagaccctag

SEQ ID NO: 754560 - DNA, 20 bp, Artificial
  CRISPR gRNA sequence
gctcactaaagaaaaccaac

SEQ ID NO: 754561 - DNA, 20 bp, Artificial
  CRISPR gRNA sequence
actaaagaaaaccaaccaaa

SEQ ID NO: 754562 - DNA, 20 bp, Artificial
  CRISPR gRNA sequence
aagaaaaccaaccaaacggc

SEQ ID NO: 754563 - DNA, 20 bp, Artificial
  CRISPR gRNA sequence
actcctgtaatcccagcact

SEQ ID NO: 754564 - DNA, 20 bp, Artificial
  CRISPR gRNA sequence
ctgtaatcccagcacttggg

SEQ ID NO: 754565 - DNA, 20 bp, Artificial
  CRISPR gRNA sequence
taatcccagcacttggggag

SEQ ID NO: 754566 - DNA, 20 bp, Artificial
  CRISPR gRNA sequence
ggggaggacgaggcgggtgg

SEQ ID NO: 754567 - DNA, 20 bp, Artificial
  CRISPR gRNA sequence
gggaggacgaggcgggtgga

SEQ ID NO: 754568 - DNA, 20 bp, Artificial
  CRISPR gRNA sequence
aagaccagcctggccaacgt

SEQ ID NO: 754569 - DNA, 20 bp, Artificial
  CRISPR gRNA sequence
gccaacgtggtgaaaccccg

SEQ ID NO: 754570 - DNA, 20 bp, Artificial
  CRISPR gRNA sequence
tactaaaaatacaaaaatta

SEQ ID NO: 754571 - DNA, 20 bp, Artificial
  CRISPR gRNA sequence
ctaaaaatacaaaaattagc

SEQ ID NO: 754572 - DNA, 20 bp, Artificial
  CRISPR gRNA sequence
aaaatacaaaaattagccag

SEQ ID NO: 754573 - DNA, 20 bp, Artificial
  CRISPR gRNA sequence
gccaggcgtggtggcgggtg

SEQ ID NO: 754574 - DNA, 20 bp, Artificial
  CRISPR gRNA sequence
tagtcccagctactcgggag

SEQ ID NO: 754575 - DNA, 20 bp, Artificial
  CRISPR gRNA sequence
ctcgggaggctgaggcagga

SEQ ID NO: 754576 - DNA, 20 bp, Artificial
  CRISPR gRNA sequence
gggaggctgaggcaggagag

SEQ ID NO: 754577 - DNA, 20 bp, Artificial
  CRISPR gRNA sequence
aggcaggagagttgcttcaa

SEQ ID NO: 754578 - DNA, 20 bp, Artificial
  CRISPR gRNA sequence
cttcaacctgggaggcggag

SEQ ID NO: 754579 - DNA, 20 bp, Artificial
  CRISPR gRNA sequence
caacctgggaggcggaggtt

SEQ ID NO: 754580 - DNA, 20 bp, Artificial
  CRISPR gRNA sequence
aacctgggaggcggaggttg

SEQ ID NO: 754581 - DNA, 20 bp, Artificial
  CRISPR gRNA sequence
ggaggcggaggttgcagtga

SEQ ID NO: 754582 - DNA, 20 bp, Artificial
  CRISPR gRNA sequence
cagtgagctgagattgcacc

SEQ ID NO: 754583 - DNA, 20 bp, Artificial
  CRISPR gRNA sequence
agattgcaccactgaactcc

SEQ ID NO: 754584 - DNA, 20 bp, Artificial
  CRISPR gRNA sequence
caccactgaactccagcctg

SEQ ID NO: 754585 - DNA, 20 bp, Artificial
  CRISPR gRNA sequence
aactccagcctgggcaacag

SEQ ID NO: 754586 - DNA, 20 bp, Artificial
  CRISPR gRNA sequence
cagcctgggcaacagagcga

SEQ ID NO: 754587 - DNA, 20 bp, Artificial
  CRISPR gRNA sequence
ggcaacagagcgagactcca

SEQ ID NO: 754588 - DNA, 20 bp, Artificial
  CRISPR gRNA sequence
catctcaaacaacaacaaca

SEQ ID NO: 754589 - DNA, 20 bp, Artificial
  CRISPR gRNA sequence
aaacaacaacaacaacaaca

SEQ ID NO: 754590 - DNA, 20 bp, Artificial
  CRISPR gRNA sequence
agaatgatgcctggcacaga

SEQ ID NO: 754591 - DNA, 20 bp, Artificial
  CRISPR gRNA sequence
gaatgatgcctggcacagag

SEQ ID NO: 754592 - DNA, 20 bp, Artificial
  CRISPR gRNA sequence
gcacagagtagtagggggca

SEQ ID NO: 754593 - DNA, 20 bp, Artificial
  CRISPR gRNA sequence
gagctggaccctgaggacgt

SEQ ID NO: 754594 - DNA, 20 bp, Artificial
  CRISPR gRNA sequence
agctggaccctgaggacgtc

SEQ ID NO: 754595 - DNA, 20 bp, Artificial
  CRISPR gRNA sequence
gaccctgaggacgtcttcac

SEQ ID NO: 754596 - DNA, 20 bp, Artificial
  CRISPR gRNA sequence
aggacgtcttcacagcatag

SEQ ID NO: 754597 - DNA, 20 bp, Artificial
  CRISPR gRNA sequence
cacagcatagaagcgtgagg

SEQ ID NO: 754598 - DNA, 20 bp, Artificial
  CRISPR gRNA sequence
acagcatagaagcgtgaggg

SEQ ID NO: 754599 - DNA, 20 bp, Artificial
  CRISPR gRNA sequence
gctggagccgggagcctgag

SEQ ID NO: 754600 - DNA, 20 bp, Artificial
  CRISPR gRNA sequence
gagccgggagcctgagctgc

SEQ ID NO: 754601 - DNA, 20 bp, Artificial
  CRISPR gRNA sequence
agctgcacacagtcctcctc

SEQ ID NO: 754602 - DNA, 20 bp, Artificial
  CRISPR gRNA sequence
cacacagtcctcctccaaaa

SEQ ID NO: 754603 - DNA, 20 bp, Artificial
  CRISPR gRNA sequence
ctccaaaagggcctggggag

SEQ ID NO: 754604 - DNA, 20 bp, Artificial
  CRISPR gRNA sequence
caaaagggcctggggagtct

SEQ ID NO: 754605 - DNA, 20 bp, Artificial
  CRISPR gRNA sequence
gggagtctgggaggggttca

SEQ ID NO: 754606 - DNA, 20 bp, Artificial
  CRISPR gRNA sequence
ggaggggttcatccacagaa

SEQ ID NO: 754607 - DNA, 20 bp, Artificial
  CRISPR gRNA sequence
atccacagaagcatccacgg

SEQ ID NO: 754608 - DNA, 20 bp, Artificial
  CRISPR gRNA sequence
tggccagctgcctaggccct

SEQ ID NO: 754609 - DNA, 20 bp, Artificial
  CRISPR gRNA sequence
gccagctgcctaggccctcc

SEQ ID NO: 754610 - DNA, 20 bp, Artificial
  CRISPR gRNA sequence
cctaggccctccctggggag

SEQ ID NO: 754611 - DNA, 20 bp, Artificial
  CRISPR gRNA sequence
ggccctccctggggaggcat

SEQ ID NO: 754612 - DNA, 20 bp, Artificial
  CRISPR gRNA sequence
cctggggaggcatgctagcc

SEQ ID NO: 754613 - DNA, 20 bp, Artificial
  CRISPR gRNA sequence
gggaggcatgctagcctcca

SEQ ID NO: 754614 - DNA, 20 bp, Artificial
  CRISPR gRNA sequence
gcctccagctccagccccgg

SEQ ID NO: 754615 - DNA, 20 bp, Artificial
  CRISPR gRNA sequence
cagctccagccccggatgca

SEQ ID NO: 754616 - DNA, 20 bp, Artificial
  CRISPR gRNA sequence
cagccccggatgcacggagg

SEQ ID NO: 754617 - DNA, 20 bp, Artificial
  CRISPR gRNA sequence
tcccaaggtgctggaagtgc

SEQ ID NO: 754618 - DNA, 20 bp, Artificial
  CRISPR gRNA sequence
cccaaggtgctggaagtgcc

SEQ ID NO: 754619 - DNA, 20 bp, Artificial
  CRISPR gRNA sequence
ccaaggtgctggaagtgccg

SEQ ID NO: 754620 - DNA, 20 bp, Artificial
  CRISPR gRNA sequence
gaagtgccgcttccttcaat

SEQ ID NO: 754621 - DNA, 20 bp, Artificial
  CRISPR gRNA sequence
ccttcaatagagcctggctt

SEQ ID NO: 754622 - DNA, 20 bp, Artificial
  CRISPR gRNA sequence
cttcaatagagcctggcttc

SEQ ID NO: 754623 - DNA, 20 bp, Artificial
  CRISPR gRNA sequence
caatagagcctggcttcccc

SEQ ID NO: 754624 - DNA, 20 bp, Artificial
  CRISPR gRNA sequence
aatagagcctggcttcccct

SEQ ID NO: 754625 - DNA, 20 bp, Artificial
  CRISPR gRNA sequence
gcttccccttcccagccccc

SEQ ID NO: 754626 - DNA, 20 bp, Artificial
  CRISPR gRNA sequence
ccccttcccagcccccttgg

SEQ ID NO: 754627 - DNA, 20 bp, Artificial
  CRISPR gRNA sequence
cccttcccagcccccttggt

SEQ ID NO: 754628 - DNA, 20 bp, Artificial
  CRISPR gRNA sequence
cccagcccccttggtctgat

SEQ ID NO: 754629 - DNA, 20 bp, Artificial
  CRISPR gRNA sequence
ccagcccccttggtctgatg

SEQ ID NO: 754630 - DNA, 20 bp, Artificial
  CRISPR gRNA sequence
ggtctgatgtgaatggacac

SEQ ID NO: 754631 - DNA, 20 bp, Artificial
  CRISPR gRNA sequence
gtctgatgtgaatggacact

SEQ ID NO: 754632 - DNA, 20 bp, Artificial
  CRISPR gRNA sequence
atgtgaatggacacttcctg

SEQ ID NO: 754633 - DNA, 20 bp, Artificial
  CRISPR gRNA sequence
cctgcgggggcaggtatcaa

SEQ ID NO: 754634 - DNA, 20 bp, Artificial
  CRISPR gRNA sequence
ctgcgggggcaggtatcaat

SEQ ID NO: 754635 - DNA, 20 bp, Artificial
  CRISPR gRNA sequence
cgggggcaggtatcaataaa

SEQ ID NO: 754636 - DNA, 20 bp, Artificial
  CRISPR gRNA sequence
agatgccctttgtcctcact

SEQ ID NO: 754637 - DNA, 20 bp, Artificial
  CRISPR gRNA sequence
tgtcctcactggccagaaag

SEQ ID NO: 754638 - DNA, 20 bp, Artificial
  CRISPR gRNA sequence
gtcctcactggccagaaagc

SEQ ID NO: 754639 - DNA, 20 bp, Artificial
  CRISPR gRNA sequence
tcctcactggccagaaagcc

SEQ ID NO: 754640 - DNA, 20 bp, Artificial
  CRISPR gRNA sequence
actggccagaaagccccagg

SEQ ID NO: 754641 - DNA, 20 bp, Artificial
  CRISPR gRNA sequence
gccagaaagccccagggcag

SEQ ID NO: 754642 - DNA, 20 bp, Artificial
  CRISPR gRNA sequence
gctggcttcaggccctgagc

SEQ ID NO: 754643 - DNA, 20 bp, Artificial
  CRISPR gRNA sequence
ctggcttcaggccctgagcc

SEQ ID NO: 754644 - DNA, 20 bp, Artificial
  CRISPR gRNA sequence
gcttcaggccctgagcctat

SEQ ID NO: 754645 - DNA, 20 bp, Artificial
  CRISPR gRNA sequence
caggccctgagcctatgcct

SEQ ID NO: 754646 - DNA, 20 bp, Artificial
  CRISPR gRNA sequence
aggccctgagcctatgcctt

SEQ ID NO: 754647 - DNA, 20 bp, Artificial
  CRISPR gRNA sequence
agcctatgccttgtgacgct

SEQ ID NO: 754648 - DNA, 20 bp, Artificial
  CRISPR gRNA sequence
tgccttgtgacgcttccttt

SEQ ID NO: 754649 - DNA, 20 bp, Artificial
  CRISPR gRNA sequence
gtgacgcttcctttcttagc

SEQ ID NO: 754650 - DNA, 20 bp, Artificial
  CRISPR gRNA sequence
tgacgcttcctttcttagcc

SEQ ID NO: 754651 - DNA, 20 bp, Artificial
  CRISPR gRNA sequence
cctttcttagccttggcagc

SEQ ID NO: 754652 - DNA, 20 bp, Artificial
  CRISPR gRNA sequence
ctttcttagccttggcagcc

SEQ ID NO: 754653 - DNA, 20 bp, Artificial
  CRISPR gRNA sequence
tcttagccttggcagcccca

SEQ ID NO: 754654 - DNA, 20 bp, Artificial
  CRISPR gRNA sequence
cttagccttggcagccccag

SEQ ID NO: 754655 - DNA, 20 bp, Artificial
  CRISPR gRNA sequence
ttagccttggcagccccagt

SEQ ID NO: 754656 - DNA, 20 bp, Artificial
  CRISPR gRNA sequence
agccttggcagccccagtcc

SEQ ID NO: 754657 - DNA, 20 bp, Artificial
  CRISPR gRNA sequence
gccttggcagccccagtcct

SEQ ID NO: 754658 - DNA, 20 bp, Artificial
  CRISPR gRNA sequence
ggcagccccagtcctgattg

SEQ ID NO: 754659 - DNA, 20 bp, Artificial
  CRISPR gRNA sequence
gcagccccagtcctgattga

SEQ ID NO: 754660 - DNA, 20 bp, Artificial
  CRISPR gRNA sequence
attgatccatgcctctgttt

SEQ ID NO: 754661 - DNA, 20 bp, Artificial
  CRISPR gRNA sequence
atccatgcctctgtttccct

SEQ ID NO: 754662 - DNA, 20 bp, Artificial
  CRISPR gRNA sequence
tgtttccctctgcatcttga

SEQ ID NO: 754663 - DNA, 20 bp, Artificial
  CRISPR gRNA sequence
tttccctctgcatcttgata

SEQ ID NO: 754664 - DNA, 20 bp, Artificial
  CRISPR gRNA sequence
ccctctgcatcttgataaag

SEQ ID NO: 754665 - DNA, 20 bp, Artificial
  CRISPR gRNA sequence
cctctgcatcttgataaaga

SEQ ID NO: 754666 - DNA, 20 bp, Artificial
  CRISPR gRNA sequence
tgcatcttgataaagacaga

SEQ ID NO: 754667 - DNA, 20 bp, Artificial
  CRISPR gRNA sequence
catcttgataaagacagaac

SEQ ID NO: 754668 - DNA, 20 bp, Artificial
  CRISPR gRNA sequence
gataaagacagaacatagtc

SEQ ID NO: 754669 - DNA, 20 bp, Artificial
  CRISPR gRNA sequence
ataaagacagaacatagtct

SEQ ID NO: 754670 - DNA, 20 bp, Artificial
  CRISPR gRNA sequence
ttcctacagccccagcccca

SEQ ID NO: 754671 - DNA, 20 bp, Artificial
  CRISPR gRNA sequence
tcctacagccccagccccag

SEQ ID NO: 754672 - DNA, 20 bp, Artificial
  CRISPR gRNA sequence
cctacagccccagccccagc

SEQ ID NO: 754673 - DNA, 20 bp, Artificial
  CRISPR gRNA sequence
ctacagccccagccccagcc

SEQ ID NO: 754674 - DNA, 20 bp, Artificial
  CRISPR gRNA sequence
cagccccagccccagcctgt

SEQ ID NO: 754675 - DNA, 20 bp, Artificial
  CRISPR gRNA sequence
tggaccatcctgggggatgg

SEQ ID NO: 754676 - DNA, 20 bp, Artificial
  CRISPR gRNA sequence
ggggatggggcctggcgggg

SEQ ID NO: 754677 - DNA, 20 bp, Artificial
  CRISPR gRNA sequence
gcggggagctggaaccaggt

SEQ ID NO: 754678 - DNA, 20 bp, Artificial
  CRISPR gRNA sequence
gaaccaggtcccattctctt

SEQ ID NO: 754679 - DNA, 20 bp, Artificial
  CRISPR gRNA sequence
tctttgggatgtcctgtgag

SEQ ID NO: 754680 - DNA, 20 bp, Artificial
  CRISPR gRNA sequence
tttgggatgtcctgtgagac

SEQ ID NO: 754681 - DNA, 20 bp, Artificial
  CRISPR gRNA sequence
tgggatgtcctgtgagacca

SEQ ID NO: 754682 - DNA, 20 bp, Artificial
  CRISPR gRNA sequence
gggatgtcctgtgagaccaa

SEQ ID NO: 754683 - DNA, 20 bp, Artificial
  CRISPR gRNA sequence
ggatgtcctgtgagaccaag

SEQ ID NO: 754684 - DNA, 20 bp, Artificial
  CRISPR gRNA sequence
tgagaccaaggacgggacct

SEQ ID NO: 754685 - DNA, 20 bp, Artificial
  CRISPR gRNA sequence
ttgcatctagtgcagggcca

SEQ ID NO: 754686 - DNA, 20 bp, Artificial
  CRISPR gRNA sequence
tgcatctagtgcagggccag

SEQ ID NO: 754687 - DNA, 20 bp, Artificial
  CRISPR gRNA sequence
gcatctagtgcagggccagc

SEQ ID NO: 754688 - DNA, 20 bp, Artificial
  CRISPR gRNA sequence
catctagtgcagggccagcc

SEQ ID NO: 754689 - DNA, 20 bp, Artificial
  CRISPR gRNA sequence
gtgcagggccagccacagca

SEQ ID NO: 754690 - DNA, 20 bp, Artificial
  CRISPR gRNA sequence
ataactgtttacttgacaac

SEQ ID NO: 754691 - DNA, 20 bp, Artificial
  CRISPR gRNA sequence
tttacttgacaacctctagc

SEQ ID NO: 754692 - DNA, 20 bp, Artificial
  CRISPR gRNA sequence
acttgacaacctctagcagc

SEQ ID NO: 754693 - DNA, 20 bp, Artificial
  CRISPR gRNA sequence
cttgacaacctctagcagct

SEQ ID NO: 754694 - DNA, 20 bp, Artificial
  CRISPR gRNA sequence
gacaacctctagcagctggt

SEQ ID NO: 754695 - DNA, 20 bp, Artificial
  CRISPR gRNA sequence
acaacctctagcagctggtc

SEQ ID NO: 754696 - DNA, 20 bp, Artificial
  CRISPR gRNA sequence
tagcagctggtcagagttca

SEQ ID NO: 754697 - DNA, 20 bp, Artificial
  CRISPR gRNA sequence
gcagctggtcagagttcagc

SEQ ID NO: 754698 - DNA, 20 bp, Artificial
  CRISPR gRNA sequence
gtcagagttcagctgtttgg

SEQ ID NO: 754699 - DNA, 20 bp, Artificial
  CRISPR gRNA sequence
agctgtttgggtggggcttc

SEQ ID NO: 754700 - DNA, 20 bp, Artificial
  CRISPR gRNA sequence
tttgggtggggcttcctagg

SEQ ID NO: 754701 - DNA, 20 bp, Artificial
  CRISPR gRNA sequence
gggtggggcttcctaggccc

SEQ ID NO: 754702 - DNA, 20 bp, Artificial
  CRISPR gRNA sequence
ggtggggcttcctaggcccg

SEQ ID NO: 754703 - DNA, 20 bp, Artificial
  CRISPR gRNA sequence
cctaggcccgactaaccaag

SEQ ID NO: 754704 - DNA, 20 bp, Artificial
  CRISPR gRNA sequence
ctaggcccgactaaccaagc

SEQ ID NO: 754705 - DNA, 20 bp, Artificial
  CRISPR gRNA sequence
ggcccgactaaccaagcttg

SEQ ID NO: 754706 - DNA, 20 bp, Artificial
  CRISPR gRNA sequence
accaagcttgggtcccacct

SEQ ID NO: 754707 - DNA, 20 bp, Artificial
  CRISPR gRNA sequence
gggtcccacctccaaaggct

SEQ ID NO: 754708 - DNA, 20 bp, Artificial
  CRISPR gRNA sequence
ggtcccacctccaaaggcta

SEQ ID NO: 754709 - DNA, 20 bp, Artificial
  CRISPR gRNA sequence
caaaggctagggcgttgcct

SEQ ID NO: 754710 - DNA, 20 bp, Artificial
  CRISPR gRNA sequence
gggcgttgccttggcgactg

SEQ ID NO: 754711 - DNA, 20 bp, Artificial
  CRISPR gRNA sequence
ccttggcgactgtgggctaa

SEQ ID NO: 754712 - DNA, 20 bp, Artificial
  CRISPR gRNA sequence
ggcgactgtgggctaagctc

SEQ ID NO: 754713 - DNA, 20 bp, Artificial
  CRISPR gRNA sequence
gcgactgtgggctaagctca

SEQ ID NO: 754714 - DNA, 20 bp, Artificial
  CRISPR gRNA sequence
tgggctaagctcacgccctg

SEQ ID NO: 754715 - DNA, 20 bp, Artificial
  CRISPR gRNA sequence
agctcacgccctgtcatgaa

SEQ ID NO: 754716 - DNA, 20 bp, Artificial
  CRISPR gRNA sequence
acgccctgtcatgaaaaata

SEQ ID NO: 754717 - DNA, 20 bp, Artificial
  CRISPR gRNA sequence
tcatgaaaaatacacaggcc

SEQ ID NO: 754718 - DNA, 20 bp, Artificial
  CRISPR gRNA sequence
tccacacccacacacaccca

SEQ ID NO: 754719 - DNA, 20 bp, Artificial
  CRISPR gRNA sequence
acaggggtcacccggggcct

SEQ ID NO: 754720 - DNA, 20 bp, Artificial
  CRISPR gRNA sequence
ctgggtggagagaggtgaag

SEQ ID NO: 754721 - DNA, 20 bp, Artificial
  CRISPR gRNA sequence
ggtggagagaggtgaaggtc

SEQ ID NO: 754722 - DNA, 20 bp, Artificial
  CRISPR gRNA sequence
gcattctgagaagatgccaa

SEQ ID NO: 754723 - DNA, 20 bp, Artificial
  CRISPR gRNA sequence
tgagaagatgccaacaagag

SEQ ID NO: 754724 - DNA, 20 bp, Artificial
  CRISPR gRNA sequence
agaagatgccaacaagagct

SEQ ID NO: 754725 - DNA, 20 bp, Artificial
  CRISPR gRNA sequence
ctttcccttgtactgggaca

SEQ ID NO: 754726 - DNA, 20 bp, Artificial
  CRISPR gRNA sequence
tcccttgtactgggacagaa

SEQ ID NO: 754727 - DNA, 20 bp, Artificial
  CRISPR gRNA sequence
cccttgtactgggacagaaa

SEQ ID NO: 754728 - DNA, 20 bp, Artificial
  CRISPR gRNA sequence
ccttgtactgggacagaaac

SEQ ID NO: 754729 - DNA, 20 bp, Artificial
  CRISPR gRNA sequence
gtactgggacagaaacatct

SEQ ID NO: 754730 - DNA, 20 bp, Artificial
  CRISPR gRNA sequence
tactgggacagaaacatctg

SEQ ID NO: 754731 - DNA, 20 bp, Artificial
  CRISPR gRNA sequence
ggacagaaacatctgagggt

SEQ ID NO: 754732 - DNA, 20 bp, Artificial
  CRISPR gRNA sequence
agggtgccacagctagaaat

SEQ ID NO: 754733 - DNA, 20 bp, Artificial
  CRISPR gRNA sequence
gaaatctcaggcacaggtcc

SEQ ID NO: 754734 - DNA, 20 bp, Artificial
  CRISPR gRNA sequence
aggcacaggtccaggcccaa

SEQ ID NO: 754735 - DNA, 20 bp, Artificial
  CRISPR gRNA sequence
tgagcagatgcccctgatgg

SEQ ID NO: 754736 - DNA, 20 bp, Artificial
  CRISPR gRNA sequence
agcagatgcccctgatggaa

SEQ ID NO: 754737 - DNA, 20 bp, Artificial
  CRISPR gRNA sequence
atggaactctgcatccccac

SEQ ID NO: 754738 - DNA, 20 bp, Artificial
  CRISPR gRNA sequence
tgcatccccacagcctccct

SEQ ID NO: 754739 - DNA, 20 bp, Artificial
  CRISPR gRNA sequence
catccccacagcctccctgc

SEQ ID NO: 754740 - DNA, 20 bp, Artificial
  CRISPR gRNA sequence
cctgcctgggcctggcccat

SEQ ID NO: 754741 - DNA, 20 bp, Artificial
  CRISPR gRNA sequence
cctgggcctggcccatgtta

SEQ ID NO: 754742 - DNA, 20 bp, Artificial
  CRISPR gRNA sequence
ggcctggcccatgttaggac

SEQ ID NO: 754743 - DNA, 20 bp, Artificial
  CRISPR gRNA sequence
gcccatgttaggaccttggt

SEQ ID NO: 754744 - DNA, 20 bp, Artificial
  CRISPR gRNA sequence
ggaccttggtaaatatttgt

SEQ ID NO: 754745 - DNA, 20 bp, Artificial
  CRISPR gRNA sequence
ggtaaatatttgtggaatga

SEQ ID NO: 754746 - DNA, 20 bp, Artificial
  CRISPR gRNA sequence
gtaaatatttgtggaatgaa

SEQ ID NO: 754747 - DNA, 20 bp, Artificial
  CRISPR gRNA sequence
gtggaatgaaagaatgatgt

SEQ ID NO: 754748 - DNA, 20 bp, Artificial
  CRISPR gRNA sequence
tggaatgaaagaatgatgtt

SEQ ID NO: 754749 - DNA, 20 bp, Artificial
  CRISPR gRNA sequence
tcagcttgggtctgaggcag

SEQ ID NO: 754750 - DNA, 20 bp, Artificial
  CRISPR gRNA sequence
cagcttgggtctgaggcaga

SEQ ID NO: 754751 - DNA, 20 bp, Artificial
  CRISPR gRNA sequence
agcttgggtctgaggcagag

SEQ ID NO: 754752 - DNA, 20 bp, Artificial
  CRISPR gRNA sequence
gggtctgaggcagagcagga

SEQ ID NO: 754753 - DNA, 20 bp, Artificial
  CRISPR gRNA sequence
ggtctgaggcagagcaggaa

SEQ ID NO: 754754 - DNA, 20 bp, Artificial
  CRISPR gRNA sequence
aggcagagcaggaatgttgc

SEQ ID NO: 754755 - DNA, 20 bp, Artificial
  CRISPR gRNA sequence
cacggagggcgtggaggtca

SEQ ID NO: 754756 - DNA, 20 bp, Artificial
  CRISPR gRNA sequence
attttttctaaatagctgaa

SEQ ID NO: 754757 - DNA, 20 bp, Artificial
  CRISPR gRNA sequence
tttctaaatagctgaaggat

SEQ ID NO: 754758 - DNA, 20 bp, Artificial
  CRISPR gRNA sequence
ttctaaatagctgaaggatg

SEQ ID NO: 754759 - DNA, 20 bp, Artificial
  CRISPR gRNA sequence
tctaaatagctgaaggatga

SEQ ID NO: 754760 - DNA, 20 bp, Artificial
  CRISPR gRNA sequence
ctaaatagctgaaggatgag

SEQ ID NO: 754761 - DNA, 20 bp, Artificial
  CRISPR gRNA sequence
taaatagctgaaggatgagg

SEQ ID NO: 754762 - DNA, 20 bp, Artificial
  CRISPR gRNA sequence
aatagctgaaggatgaggca

SEQ ID NO: 754763 - DNA, 20 bp, Artificial
  CRISPR gRNA sequence
aaggatgaggcatcagcccc

SEQ ID NO: 754764 - DNA, 20 bp, Artificial
  CRISPR gRNA sequence
cccactggagggttctggag

SEQ ID NO: 754765 - DNA, 20 bp, Artificial
  CRISPR gRNA sequence
gagggttctggagaggtggg

SEQ ID NO: 754766 - DNA, 20 bp, Artificial
  CRISPR gRNA sequence
tggagaggtgggtggctctt

SEQ ID NO: 754767 - DNA, 20 bp, Artificial
  CRISPR gRNA sequence
gagaggtgggtggctcttcc

SEQ ID NO: 754768 - DNA, 20 bp, Artificial
  CRISPR gRNA sequence
ttcctgtctgcagtgctggc

SEQ ID NO: 754769 - DNA, 20 bp, Artificial
  CRISPR gRNA sequence
cctgtctgcagtgctggcct

SEQ ID NO: 754770 - DNA, 20 bp, Artificial
  CRISPR gRNA sequence
ctgtctgcagtgctggcctg

SEQ ID NO: 754771 - DNA, 20 bp, Artificial
  CRISPR gRNA sequence
tctgcagtgctggcctgtcc

SEQ ID NO: 754772 - DNA, 20 bp, Artificial
  CRISPR gRNA sequence
cagtgctggcctgtccaagg

SEQ ID NO: 754773 - DNA, 20 bp, Artificial
  CRISPR gRNA sequence
gcctgtccaaggtgtgaatc

SEQ ID NO: 754774 - DNA, 20 bp, Artificial
  CRISPR gRNA sequence
tccaaggtgtgaatctcagc

SEQ ID NO: 754775 - DNA, 20 bp, Artificial
  CRISPR gRNA sequence
agctcagtcacacagcactg

SEQ ID NO: 754776 - DNA, 20 bp, Artificial
  CRISPR gRNA sequence
agtcacacagcactgtgtgg

SEQ ID NO: 754777 - DNA, 20 bp, Artificial
  CRISPR gRNA sequence
tgtggccttgggcaagtcac

SEQ ID NO: 754778 - DNA, 20 bp, Artificial
  CRISPR gRNA sequence
gggcaagtcacttctctgag

SEQ ID NO: 754779 - DNA, 20 bp, Artificial
  CRISPR gRNA sequence
ggcaagtcacttctctgagt

SEQ ID NO: 754780 - DNA, 20 bp, Artificial
  CRISPR gRNA sequence
ctctgagtctgtttcctcat

SEQ ID NO: 754781 - DNA, 20 bp, Artificial
  CRISPR gRNA sequence
tctgagtctgtttcctcatc

SEQ ID NO: 754782 - DNA, 20 bp, Artificial
  CRISPR gRNA sequence
tgagtctgtttcctcatctt

SEQ ID NO: 754783 - DNA, 20 bp, Artificial
  CRISPR gRNA sequence
agtctgtttcctcatcttta

SEQ ID NO: 754784 - DNA, 20 bp, Artificial
  CRISPR gRNA sequence
tttcctcatctttaaaatag

SEQ ID NO: 754785 - DNA, 20 bp, Artificial
  CRISPR gRNA sequence
cctcatctttaaaataggga

SEQ ID NO: 754786 - DNA, 20 bp, Artificial
  CRISPR gRNA sequence
ctcatctttaaaatagggat

SEQ ID NO: 754787 - DNA, 20 bp, Artificial
  CRISPR gRNA sequence
atctttaaaatagggatgat

SEQ ID NO: 754788 - DNA, 20 bp, Artificial
  CRISPR gRNA sequence
taaaatagggatgataccac

SEQ ID NO: 754789 - DNA, 20 bp, Artificial
  CRISPR gRNA sequence
aaaatagggatgataccacc

SEQ ID NO: 754790 - DNA, 20 bp, Artificial
  CRISPR gRNA sequence
aaatagggatgataccaccc

SEQ ID NO: 754791 - DNA, 20 bp, Artificial
  CRISPR gRNA sequence
ggggtgttatgagaactaaa

SEQ ID NO: 754792 - DNA, 20 bp, Artificial
  CRISPR gRNA sequence
tgagaactaaatgtgacagg

SEQ ID NO: 754793 - DNA, 20 bp, Artificial
  CRISPR gRNA sequence
aatgtgacaggtataagatg

SEQ ID NO: 754794 - DNA, 20 bp, Artificial
  CRISPR gRNA sequence
agcaagagcctagcacataa

SEQ ID NO: 754795 - DNA, 20 bp, Artificial
  CRISPR gRNA sequence
gcacataatacatggtcata

SEQ ID NO: 754796 - DNA, 20 bp, Artificial
  CRISPR gRNA sequence
ttccctcctgcccacaggat

SEQ ID NO: 754797 - DNA, 20 bp, Artificial
  CRISPR gRNA sequence
ccctcctgcccacaggattt

SEQ ID NO: 754798 - DNA, 20 bp, Artificial
  CRISPR gRNA sequence
cctcctgcccacaggatttt

SEQ ID NO: 754799 - DNA, 20 bp, Artificial
  CRISPR gRNA sequence
ctgcccacaggattttagag

SEQ ID NO: 754800 - DNA, 20 bp, Artificial
  CRISPR gRNA sequence
cccacaggattttagagctg

SEQ ID NO: 754801 - DNA, 20 bp, Artificial
  CRISPR gRNA sequence
tagagctggcagccctcagg

SEQ ID NO: 754802 - DNA, 20 bp, Artificial
  CRISPR gRNA sequence
agagctggcagccctcaggt

SEQ ID NO: 754803 - DNA, 20 bp, Artificial
  CRISPR gRNA sequence
gagctggcagccctcaggtt

SEQ ID NO: 754804 - DNA, 20 bp, Artificial
  CRISPR gRNA sequence
gcagccctcaggttaagatg

SEQ ID NO: 754805 - DNA, 20 bp, Artificial
  CRISPR gRNA sequence
aggttaagatgaagaaacgg

SEQ ID NO: 754806 - DNA, 20 bp, Artificial
  CRISPR gRNA sequence
agatgaagaaacggaggctc

SEQ ID NO: 754807 - DNA, 20 bp, Artificial
  CRISPR gRNA sequence
agagaagggtgggatctgcc

SEQ ID NO: 754808 - DNA, 20 bp, Artificial
  CRISPR gRNA sequence
cccaagggcacacaatgagg

SEQ ID NO: 754809 - DNA, 20 bp, Artificial
  CRISPR gRNA sequence
agtggacactgaggccccag

SEQ ID NO: 754810 - DNA, 20 bp, Artificial
  CRISPR gRNA sequence
aggccccaggacgttgcaat

SEQ ID NO: 754811 - DNA, 20 bp, Artificial
  CRISPR gRNA sequence
caatccaagcgagagtttta

SEQ ID NO: 754812 - DNA, 20 bp, Artificial
  CRISPR gRNA sequence
tactcctgagactcaggctt

SEQ ID NO: 754813 - DNA, 20 bp, Artificial
  CRISPR gRNA sequence
actcctgagactcaggcttt

SEQ ID NO: 754814 - DNA, 20 bp, Artificial
  CRISPR gRNA sequence
ctcctgagactcaggctttc

SEQ ID NO: 754815 - DNA, 20 bp, Artificial
  CRISPR gRNA sequence
ctgagactcaggctttccca

SEQ ID NO: 754816 - DNA, 20 bp, Artificial
  CRISPR gRNA sequence
agactcaggctttcccaggt

SEQ ID NO: 754817 - DNA, 20 bp, Artificial
  CRISPR gRNA sequence
aggctttcccaggttcacgg

SEQ ID NO: 754818 - DNA, 20 bp, Artificial
  CRISPR gRNA sequence
tcccaggttcacggcactct

SEQ ID NO: 754819 - DNA, 20 bp, Artificial
  CRISPR gRNA sequence
cccaggttcacggcactctt

SEQ ID NO: 754820 - DNA, 20 bp, Artificial
  CRISPR gRNA sequence
ccaggttcacggcactcttc

SEQ ID NO: 754821 - DNA, 20 bp, Artificial
  CRISPR gRNA sequence
acggcactcttcctctaggt

SEQ ID NO: 754822 - DNA, 20 bp, Artificial
  CRISPR gRNA sequence
ttcctctaggtggccctgcc

SEQ ID NO: 754823 - DNA, 20 bp, Artificial
  CRISPR gRNA sequence
cctctaggtggccctgcctc

SEQ ID NO: 754824 - DNA, 20 bp, Artificial
  CRISPR gRNA sequence
ctctaggtggccctgcctcc

SEQ ID NO: 754825 - DNA, 20 bp, Artificial
  CRISPR gRNA sequence
taggtggccctgcctcctta

SEQ ID NO: 754826 - DNA, 20 bp, Artificial
  CRISPR gRNA sequence
ggtggccctgcctccttacc

SEQ ID NO: 754827 - DNA, 20 bp, Artificial
  CRISPR gRNA sequence
cctccttacctggtggcagg

SEQ ID NO: 754828 - DNA, 20 bp, Artificial
  CRISPR gRNA sequence
cttacctggtggcaggtggc

SEQ ID NO: 754829 - DNA, 20 bp, Artificial
  CRISPR gRNA sequence
acctggtggcaggtggcggg

SEQ ID NO: 754830 - DNA, 20 bp, Artificial
  CRISPR gRNA sequence
cctggtggcaggtggcgggt

SEQ ID NO: 754831 - DNA, 20 bp, Artificial
  CRISPR gRNA sequence
gtggcaggtggcgggtggcg

SEQ ID NO: 754832 - DNA, 20 bp, Artificial
  CRISPR gRNA sequence
ggtcttgacagcagcacggc

SEQ ID NO: 754833 - DNA, 20 bp, Artificial
  CRISPR gRNA sequence
gacagcagcacggcaactgg

SEQ ID NO: 754834 - DNA, 20 bp, Artificial
  CRISPR gRNA sequence
acagcagcacggcaactgga

SEQ ID NO: 754835 - DNA, 20 bp, Artificial
  CRISPR gRNA sequence
gacggttcccgcctggcaca

SEQ ID NO: 754836 - DNA, 20 bp, Artificial
  CRISPR gRNA sequence
ccgcctggcacatgctcagg

SEQ ID NO: 754837 - DNA, 20 bp, Artificial
  CRISPR gRNA sequence
gcacatgctcaggcccaggc

SEQ ID NO: 754838 - DNA, 20 bp, Artificial
  CRISPR gRNA sequence
aggcccaggccccgggtcat

SEQ ID NO: 754839 - DNA, 20 bp, Artificial
  CRISPR gRNA sequence
tcctgtcccacatgcttttg

SEQ ID NO: 754840 - DNA, 20 bp, Artificial
  CRISPR gRNA sequence
cctgtcccacatgcttttgg

SEQ ID NO: 754841 - DNA, 20 bp, Artificial
  CRISPR gRNA sequence
ctgtcccacatgcttttggc

SEQ ID NO: 754842 - DNA, 20 bp, Artificial
  CRISPR gRNA sequence
tcccacatgcttttggccac

SEQ ID NO: 754843 - DNA, 20 bp, Artificial
  CRISPR gRNA sequence
ttggccaccctggagccagg

SEQ ID NO: 754844 - DNA, 20 bp, Artificial
  CRISPR gRNA sequence
tggccaccctggagccaggg

SEQ ID NO: 754845 - DNA, 20 bp, Artificial
  CRISPR gRNA sequence
ggccaccctggagccagggg

SEQ ID NO: 754846 - DNA, 20 bp, Artificial
  CRISPR gRNA sequence
gccaccctggagccaggggc

SEQ ID NO: 754847 - DNA, 20 bp, Artificial
  CRISPR gRNA sequence
gagccaggggctttcctccc

SEQ ID NO: 754848 - DNA, 20 bp, Artificial
  CRISPR gRNA sequence
tcctccccacccacttttcc

SEQ ID NO: 754849 - DNA, 20 bp, Artificial
  CRISPR gRNA sequence
cctccccacccacttttccc

SEQ ID NO: 754850 - DNA, 20 bp, Artificial
  CRISPR gRNA sequence
ctccccacccacttttcccg

SEQ ID NO: 754851 - DNA, 20 bp, Artificial
  CRISPR gRNA sequence
cccacccacttttcccggtc

SEQ ID NO: 754852 - DNA, 20 bp, Artificial
  CRISPR gRNA sequence
ttcccggtctccgacaatga

SEQ ID NO: 754853 - DNA, 20 bp, Artificial
  CRISPR gRNA sequence
tcccggtctccgacaatgac

SEQ ID NO: 754854 - DNA, 20 bp, Artificial
  CRISPR gRNA sequence
cccggtctccgacaatgacc

SEQ ID NO: 754855 - DNA, 20 bp, Artificial
  CRISPR gRNA sequence
ccggtctccgacaatgaccc

SEQ ID NO: 754856 - DNA, 20 bp, Artificial
  CRISPR gRNA sequence
cgacaatgacccaggtgtcc

SEQ ID NO: 754857 - DNA, 20 bp, Artificial
  CRISPR gRNA sequence
ctcctgacaataagcaacat

SEQ ID NO: 754858 - DNA, 20 bp, Artificial
  CRISPR gRNA sequence
ctgacaataagcaacatcct

SEQ ID NO: 754859 - DNA, 20 bp, Artificial
  CRISPR gRNA sequence
acaataagcaacatcctctc

SEQ ID NO: 754860 - DNA, 20 bp, Artificial
  CRISPR gRNA sequence
tcgccaaagaattgtaattt

SEQ ID NO: 754861 - DNA, 20 bp, Artificial
  CRISPR gRNA sequence
gccaaagaattgtaatttta

SEQ ID NO: 754862 - DNA, 20 bp, Artificial
  CRISPR gRNA sequence
taattttagccgggctgcac

SEQ ID NO: 754863 - DNA, 20 bp, Artificial
  CRISPR gRNA sequence
tagccgggctgcacagcttc

SEQ ID NO: 754864 - DNA, 20 bp, Artificial
  CRISPR gRNA sequence
agccgggctgcacagcttcc

SEQ ID NO: 754865 - DNA, 20 bp, Artificial
  CRISPR gRNA sequence
gccgggctgcacagcttccc

SEQ ID NO: 754866 - DNA, 20 bp, Artificial
  CRISPR gRNA sequence
cacagcttccctgacaacac

SEQ ID NO: 754867 - DNA, 20 bp, Artificial
  CRISPR gRNA sequence
ccctgacaacacacaggcat

SEQ ID NO: 754868 - DNA, 20 bp, Artificial
  CRISPR gRNA sequence
cctgacaacacacaggcatg

SEQ ID NO: 754869 - DNA, 20 bp, Artificial
  CRISPR gRNA sequence
acaacacacaggcatgtgca

SEQ ID NO: 754870 - DNA, 20 bp, Artificial
  CRISPR gRNA sequence
tgcgtgctgtgcgctgcccc

SEQ ID NO: 754871 - DNA, 20 bp, Artificial
  CRISPR gRNA sequence
cgtgctgtgcgctgcccctc

SEQ ID NO: 754872 - DNA, 20 bp, Artificial
  CRISPR gRNA sequence
tgcgctgcccctctccccca

SEQ ID NO: 754873 - DNA, 20 bp, Artificial
  CRISPR gRNA sequence
cccctctcccccatgccatg

SEQ ID NO: 754874 - DNA, 20 bp, Artificial
  CRISPR gRNA sequence
tcccccatgccatgccttcg

SEQ ID NO: 754875 - DNA, 20 bp, Artificial
  CRISPR gRNA sequence
ccccatgccatgccttcgag

SEQ ID NO: 754876 - DNA, 20 bp, Artificial
  CRISPR gRNA sequence
cgagtgtcctcctaacgaca

SEQ ID NO: 754877 - DNA, 20 bp, Artificial
  CRISPR gRNA sequence
gagtgtcctcctaacgacag

SEQ ID NO: 754878 - DNA, 20 bp, Artificial
  CRISPR gRNA sequence
ctaacgacaggctgctgtgg

SEQ ID NO: 754879 - DNA, 20 bp, Artificial
  CRISPR gRNA sequence
acgacaggctgctgtgggcc

SEQ ID NO: 754880 - DNA, 20 bp, Artificial
  CRISPR gRNA sequence
ctgtgggccttgtcccagct

SEQ ID NO: 754881 - DNA, 20 bp, Artificial
  CRISPR gRNA sequence
tgggccttgtcccagctgga

SEQ ID NO: 754882 - DNA, 20 bp, Artificial
  CRISPR gRNA sequence
gtcccagctggagtctcaga

SEQ ID NO: 754883 - DNA, 20 bp, Artificial
  CRISPR gRNA sequence
tcccagctggagtctcagac

SEQ ID NO: 754884 - DNA, 20 bp, Artificial
  CRISPR gRNA sequence
gagtctcagacacagtaaat

SEQ ID NO: 754885 - DNA, 20 bp, Artificial
  CRISPR gRNA sequence
agacacagtaaatggggtgt

SEQ ID NO: 754886 - DNA, 20 bp, Artificial
  CRISPR gRNA sequence
tctggccttccctccctccc

SEQ ID NO: 754887 - DNA, 20 bp, Artificial
  CRISPR gRNA sequence
ctggccttccctccctcccc

SEQ ID NO: 754888 - DNA, 20 bp, Artificial
  CRISPR gRNA sequence
tggccttccctccctcccca

SEQ ID NO: 754889 - DNA, 20 bp, Artificial
  CRISPR gRNA sequence
gccttccctccctccccagg

SEQ ID NO: 754890 - DNA, 20 bp, Artificial
  CRISPR gRNA sequence
ccctccctccccaggacaaa

SEQ ID NO: 754891 - DNA, 20 bp, Artificial
  CRISPR gRNA sequence
cctccctccccaggacaaac

SEQ ID NO: 754892 - DNA, 20 bp, Artificial
  CRISPR gRNA sequence
cctccccaggacaaacccct

SEQ ID NO: 754893 - DNA, 20 bp, Artificial
  CRISPR gRNA sequence
cccaggacaaacccctgtgg

SEQ ID NO: 754894 - DNA, 20 bp, Artificial
  CRISPR gRNA sequence
tggacccttggtttgtcctg

SEQ ID NO: 754895 - DNA, 20 bp, Artificial
  CRISPR gRNA sequence
ggtttgtcctgtccctctgg

SEQ ID NO: 754896 - DNA, 20 bp, Artificial
  CRISPR gRNA sequence
gtttgtcctgtccctctggc

SEQ ID NO: 754897 - DNA, 20 bp, Artificial
  CRISPR gRNA sequence
gtcctgtccctctggcttgt

SEQ ID NO: 754898 - DNA, 20 bp, Artificial
  CRISPR gRNA sequence
tcctgtccctctggcttgtc

SEQ ID NO: 754899 - DNA, 20 bp, Artificial
  CRISPR gRNA sequence
tccctctggcttgtcctgga

SEQ ID NO: 754900 - DNA, 20 bp, Artificial
  CRISPR gRNA sequence
tggcttgtcctggaccctct

SEQ ID NO: 754901 - DNA, 20 bp, Artificial
  CRISPR gRNA sequence
gcttgtcctggaccctctcc

SEQ ID NO: 754902 - DNA, 20 bp, Artificial
  CRISPR gRNA sequence
gtcctggaccctctcctgtc

SEQ ID NO: 754903 - DNA, 20 bp, Artificial
  CRISPR gRNA sequence
tcctggaccctctcctgtct

SEQ ID NO: 754904 - DNA, 20 bp, Artificial
  CRISPR gRNA sequence
gaccctctcctgtctggccc

SEQ ID NO: 754905 - DNA, 20 bp, Artificial
  CRISPR gRNA sequence
tcctgtctggccctcttgct

SEQ ID NO: 754906 - DNA, 20 bp, Artificial
  CRISPR gRNA sequence
ctgtctggccctcttgcttg

SEQ ID NO: 754907 - DNA, 20 bp, Artificial
  CRISPR gRNA sequence
tctggccctcttgcttgaaa

SEQ ID NO: 754908 - DNA, 20 bp, Artificial
  CRISPR gRNA sequence
gccctcttgcttgaaaactg

SEQ ID NO: 754909 - DNA, 20 bp, Artificial
  CRISPR gRNA sequence
ttgcttgaaaactgaacatc

SEQ ID NO: 754910 - DNA, 20 bp, Artificial
  CRISPR gRNA sequence
gcttgaaaactgaacatcct

SEQ ID NO: 754911 - DNA, 20 bp, Artificial
  CRISPR gRNA sequence
cttgaaaactgaacatcctc

SEQ ID NO: 754912 - DNA, 20 bp, Artificial
  CRISPR gRNA sequence
gaaaactgaacatcctcccc

SEQ ID NO: 754913 - DNA, 20 bp, Artificial
  CRISPR gRNA sequence
aaaactgaacatcctcccct

SEQ ID NO: 754914 - DNA, 20 bp, Artificial
  CRISPR gRNA sequence
aacatcctcccctgctcccc

SEQ ID NO: 754915 - DNA, 20 bp, Artificial
  CRISPR gRNA sequence
ccctgctccccaaacttgaa

SEQ ID NO: 754916 - DNA, 20 bp, Artificial
  CRISPR gRNA sequence
ctccccaaacttgaatccta

SEQ ID NO: 754917 - DNA, 20 bp, Artificial
  CRISPR gRNA sequence
cccaaacttgaatcctaaga

SEQ ID NO: 754918 - DNA, 20 bp, Artificial
  CRISPR gRNA sequence
gaatcctaagacagcttttt

SEQ ID NO: 754919 - DNA, 20 bp, Artificial
  CRISPR gRNA sequence
aatcctaagacagctttttt

SEQ ID NO: 754920 - DNA, 20 bp, Artificial
  CRISPR gRNA sequence
agacagcttttttctaaaag

SEQ ID NO: 754921 - DNA, 20 bp, Artificial
  CRISPR gRNA sequence
ttttctaaaaggggaacaac

SEQ ID NO: 754922 - DNA, 20 bp, Artificial
  CRISPR gRNA sequence
tttctaaaaggggaacaact

SEQ ID NO: 754923 - DNA, 20 bp, Artificial
  CRISPR gRNA sequence
ttctaaaaggggaacaactc

SEQ ID NO: 754924 - DNA, 20 bp, Artificial
  CRISPR gRNA sequence
tctaaaaggggaacaactcc

SEQ ID NO: 754925 - DNA, 20 bp, Artificial
  CRISPR gRNA sequence
ctaaaaggggaacaactcct

SEQ ID NO: 754926 - DNA, 20 bp, Artificial
  CRISPR gRNA sequence
taaaaggggaacaactcctt

SEQ ID NO: 754927 - DNA, 20 bp, Artificial
  CRISPR gRNA sequence
aaaggggaacaactcctttg

SEQ ID NO: 754928 - DNA, 20 bp, Artificial
  CRISPR gRNA sequence
ctttgggacctgtgggatgg

SEQ ID NO: 754929 - DNA, 20 bp, Artificial
  CRISPR gRNA sequence
tgggacctgtgggatgggtg

SEQ ID NO: 754930 - DNA, 20 bp, Artificial
  CRISPR gRNA sequence
gggacctgtgggatgggtgg

SEQ ID NO: 754931 - DNA, 20 bp, Artificial
  CRISPR gRNA sequence
ggacctgtgggatgggtggc

SEQ ID NO: 754932 - DNA, 20 bp, Artificial
  CRISPR gRNA sequence
tgggatgggtggccagtgtg

SEQ ID NO: 754933 - DNA, 20 bp, Artificial
  CRISPR gRNA sequence
agcaatgccccctctcccgt

SEQ ID NO: 754934 - DNA, 20 bp, Artificial
  CRISPR gRNA sequence
tcccgtactccctgaactct

SEQ ID NO: 754935 - DNA, 20 bp, Artificial
  CRISPR gRNA sequence
ccgtactccctgaactctgc

SEQ ID NO: 754936 - DNA, 20 bp, Artificial
  CRISPR gRNA sequence
cctgaactctgctttctctc

SEQ ID NO: 754937 - DNA, 20 bp, Artificial
  CRISPR gRNA sequence
aactctgctttctctctgat

SEQ ID NO: 754938 - DNA, 20 bp, Artificial
  CRISPR gRNA sequence
tgctttctctctgatgcacc

SEQ ID NO: 754939 - DNA, 20 bp, Artificial
  CRISPR gRNA sequence
ctttctctctgatgcaccca

SEQ ID NO: 754940 - DNA, 20 bp, Artificial
  CRISPR gRNA sequence
tctctctgatgcacccaccc

SEQ ID NO: 754941 - DNA, 20 bp, Artificial
  CRISPR gRNA sequence
ctctctgatgcacccacccg

SEQ ID NO: 754942 - DNA, 20 bp, Artificial
  CRISPR gRNA sequence
tctctgatgcacccacccgc

SEQ ID NO: 754943 - DNA, 20 bp, Artificial
  CRISPR gRNA sequence
tctgatgcacccacccgccg

SEQ ID NO: 754944 - DNA, 20 bp, Artificial
  CRISPR gRNA sequence
tgatgcacccacccgccgtg

SEQ ID NO: 754945 - DNA, 20 bp, Artificial
  CRISPR gRNA sequence
atgcacccacccgccgtgca

SEQ ID NO: 754946 - DNA, 20 bp, Artificial
  CRISPR gRNA sequence
aaggaagttgcctccagggg

SEQ ID NO: 754947 - DNA, 20 bp, Artificial
  CRISPR gRNA sequence
cctccaggggagaacatccc

SEQ ID NO: 754948 - DNA, 20 bp, Artificial
  CRISPR gRNA sequence
caggggagaacatcccttcc

SEQ ID NO: 754949 - DNA, 20 bp, Artificial
  CRISPR gRNA sequence
ccctactgctgcgggtgcta

SEQ ID NO: 754950 - DNA, 20 bp, Artificial
  CRISPR gRNA sequence
cctactgctgcgggtgctat

SEQ ID NO: 754951 - DNA, 20 bp, Artificial
  CRISPR gRNA sequence
ctgctgcgggtgctatgggt

SEQ ID NO: 754952 - DNA, 20 bp, Artificial
  CRISPR gRNA sequence
ctgcgggtgctatgggtaca

SEQ ID NO: 754953 - DNA, 20 bp, Artificial
  CRISPR gRNA sequence
cgggtgctatgggtacaatc

SEQ ID NO: 754954 - DNA, 20 bp, Artificial
  CRISPR gRNA sequence
tgggtacaatcctggggtca

SEQ ID NO: 754955 - DNA, 20 bp, Artificial
  CRISPR gRNA sequence
gggtcattaaccccattgct

SEQ ID NO: 754956 - DNA, 20 bp, Artificial
  CRISPR gRNA sequence
accccattgcttagaccctg

SEQ ID NO: 754957 - DNA, 20 bp, Artificial
  CRISPR gRNA sequence
cttagaccctgagggctccc

SEQ ID NO: 754958 - DNA, 20 bp, Artificial
  CRISPR gRNA sequence
agaccctgagggctcccagc

SEQ ID NO: 754959 - DNA, 20 bp, Artificial
  CRISPR gRNA sequence
gaccctgagggctcccagcc

SEQ ID NO: 754960 - DNA, 20 bp, Artificial
  CRISPR gRNA sequence
agggctcccagcctggtgcc

SEQ ID NO: 754961 - DNA, 20 bp, Artificial
  CRISPR gRNA sequence
ccagcctggtgccctgcccc

SEQ ID NO: 754962 - DNA, 20 bp, Artificial
  CRISPR gRNA sequence
gtgccctgccccaccttgtt

SEQ ID NO: 754963 - DNA, 20 bp, Artificial
  CRISPR gRNA sequence
ccccaccttgttcacaggga

SEQ ID NO: 754964 - DNA, 20 bp, Artificial
  CRISPR gRNA sequence
gttcacagggacactcaggc

SEQ ID NO: 754965 - DNA, 20 bp, Artificial
  CRISPR gRNA sequence
ttcacagggacactcaggcc

SEQ ID NO: 754966 - DNA, 20 bp, Artificial
  CRISPR gRNA sequence
acagggacactcaggccaac

SEQ ID NO: 754967 - DNA, 20 bp, Artificial
  CRISPR gRNA sequence
aggccaacaaccacgctagc

SEQ ID NO: 754968 - DNA, 20 bp, Artificial
  CRISPR gRNA sequence
gccccacttgtccacacctc

SEQ ID NO: 754969 - DNA, 20 bp, Artificial
  CRISPR gRNA sequence
gtccacacctctgtccactt

SEQ ID NO: 754970 - DNA, 20 bp, Artificial
  CRISPR gRNA sequence
tccacacctctgtccacttg

SEQ ID NO: 754971 - DNA, 20 bp, Artificial
  CRISPR gRNA sequence
tgtccacttgagggccccca

SEQ ID NO: 754972 - DNA, 20 bp, Artificial
  CRISPR gRNA sequence
tccacttgagggcccccaac

SEQ ID NO: 754973 - DNA, 20 bp, Artificial
  CRISPR gRNA sequence
gagggcccccaaccccaccc

SEQ ID NO: 754974 - DNA, 20 bp, Artificial
  CRISPR gRNA sequence
agggcccccaaccccaccca

SEQ ID NO: 754975 - DNA, 20 bp, Artificial
  CRISPR gRNA sequence
agctttgcgcatcttgcttt

SEQ ID NO: 754976 - DNA, 20 bp, Artificial
  CRISPR gRNA sequence
tgcgcatcttgctttggctg

SEQ ID NO: 754977 - DNA, 20 bp, Artificial
  CRISPR gRNA sequence
gcgcatcttgctttggctgc

SEQ ID NO: 754978 - DNA, 20 bp, Artificial
  CRISPR gRNA sequence
cgcatcttgctttggctgcc

SEQ ID NO: 754979 - DNA, 20 bp, Artificial
  CRISPR gRNA sequence
gctttggctgccagctctac

SEQ ID NO: 754980 - DNA, 20 bp, Artificial
  CRISPR gRNA sequence
ctttggctgccagctctact

SEQ ID NO: 754981 - DNA, 20 bp, Artificial
  CRISPR gRNA sequence
tggctgccagctctactctg

SEQ ID NO: 754982 - DNA, 20 bp, Artificial
  CRISPR gRNA sequence
ggctgccagctctactctgc

SEQ ID NO: 754983 - DNA, 20 bp, Artificial
  CRISPR gRNA sequence
gctgccagctctactctgcc

SEQ ID NO: 754984 - DNA, 20 bp, Artificial
  CRISPR gRNA sequence
ccagctctactctgcctgcc

SEQ ID NO: 754985 - DNA, 20 bp, Artificial
  CRISPR gRNA sequence
tactctgcctgccctgccat

SEQ ID NO: 754986 - DNA, 20 bp, Artificial
  CRISPR gRNA sequence
ctctgcctgccctgccatac

SEQ ID NO: 754987 - DNA, 20 bp, Artificial
  CRISPR gRNA sequence
tgcctgccctgccataccct

SEQ ID NO: 754988 - DNA, 20 bp, Artificial
  CRISPR gRNA sequence
cctgccctgccataccctcc

SEQ ID NO: 754989 - DNA, 20 bp, Artificial
  CRISPR gRNA sequence
ccctgccataccctcctctg

SEQ ID NO: 754990 - DNA, 20 bp, Artificial
  CRISPR gRNA sequence
ccataccctcctctggcctg

SEQ ID NO: 754991 - DNA, 20 bp, Artificial
  CRISPR gRNA sequence
ctctggcctgcagccccgtg

SEQ ID NO: 754992 - DNA, 20 bp, Artificial
  CRISPR gRNA sequence
tggcctgcagccccgtgtct

SEQ ID NO: 754993 - DNA, 20 bp, Artificial
  CRISPR gRNA sequence
gcctgcagccccgtgtctgc

SEQ ID NO: 754994 - DNA, 20 bp, Artificial
  CRISPR gRNA sequence
cagccccgtgtctgctgagc

SEQ ID NO: 754995 - DNA, 20 bp, Artificial
  CRISPR gRNA sequence
ctgagccagccctttggcca

SEQ ID NO: 754996 - DNA, 20 bp, Artificial
  CRISPR gRNA sequence
agccagccctttggccagcc

SEQ ID NO: 754997 - DNA, 20 bp, Artificial
  CRISPR gRNA sequence
tggccagcccccaaggtatg

SEQ ID NO: 754998 - DNA, 20 bp, Artificial
  CRISPR gRNA sequence
ggccagcccccaaggtatgt

SEQ ID NO: 754999 - DNA, 20 bp, Artificial
  CRISPR gRNA sequence
gccagcccccaaggtatgtg

SEQ ID NO: 755000 - DNA, 20 bp, Artificial
  CRISPR gRNA sequence
gtggtaaatactaccgtagc

SEQ ID NO: 755001 - DNA, 20 bp, Artificial
  CRISPR gRNA sequence
ccgtagctgaagctggagct

SEQ ID NO: 755002 - DNA, 20 bp, Artificial
  CRISPR gRNA sequence
aagctggagctgaattcagc

SEQ ID NO: 755003 - DNA, 20 bp, Artificial
  CRISPR gRNA sequence
gagctgaattcagctcccag

SEQ ID NO: 755004 - DNA, 20 bp, Artificial
  CRISPR gRNA sequence
aattcagctcccagccctgg

SEQ ID NO: 755005 - DNA, 20 bp, Artificial
  CRISPR gRNA sequence
agctcccagccctggggtgg

SEQ ID NO: 755006 - DNA, 20 bp, Artificial
  CRISPR gRNA sequence
ccagccctggggtggctctg

SEQ ID NO: 755007 - DNA, 20 bp, Artificial
  CRISPR gRNA sequence
gggtggctctggggtaggag

SEQ ID NO: 755008 - DNA, 20 bp, Artificial
  CRISPR gRNA sequence
tggggtaggaggtgatgtca

SEQ ID NO: 755009 - DNA, 20 bp, Artificial
  CRISPR gRNA sequence
gggtaggaggtgatgtcagg

SEQ ID NO: 755010 - DNA, 20 bp, Artificial
  CRISPR gRNA sequence
ggagaggtgctggtgggacc

SEQ ID NO: 755011 - DNA, 20 bp, Artificial
  CRISPR gRNA sequence
gtgggacctgccacatggcc

SEQ ID NO: 755012 - DNA, 20 bp, Artificial
  CRISPR gRNA sequence
ccacatggcctgctggggaa

SEQ ID NO: 755013 - DNA, 20 bp, Artificial
  CRISPR gRNA sequence
ctggggaagggggcagcaca

SEQ ID NO: 755014 - DNA, 20 bp, Artificial
  CRISPR gRNA sequence
gggaagggggcagcacaggg

SEQ ID NO: 755015 - DNA, 20 bp, Artificial
  CRISPR gRNA sequence
ggggcaggttttgtttcttc

SEQ ID NO: 755016 - DNA, 20 bp, Artificial
  CRISPR gRNA sequence
gggcaggttttgtttcttcc

SEQ ID NO: 755017 - DNA, 20 bp, Artificial
  CRISPR gRNA sequence
tgtttcttcctgggagtacg

SEQ ID NO: 755018 - DNA, 20 bp, Artificial
  CRISPR gRNA sequence
gtttcttcctgggagtacgt

SEQ ID NO: 755019 - DNA, 20 bp, Artificial
  CRISPR gRNA sequence
tttcttcctgggagtacgtg

SEQ ID NO: 755020 - DNA, 20 bp, Artificial
  CRISPR gRNA sequence
cttcctgggagtacgtggga

SEQ ID NO: 755021 - DNA, 20 bp, Artificial
  CRISPR gRNA sequence
ttcctgggagtacgtgggag

SEQ ID NO: 755022 - DNA, 20 bp, Artificial
  CRISPR gRNA sequence
cctgggagtacgtgggagag

SEQ ID NO: 755023 - DNA, 20 bp, Artificial
  CRISPR gRNA sequence
ctgggagtacgtgggagagc

SEQ ID NO: 755024 - DNA, 20 bp, Artificial
  CRISPR gRNA sequence
ggagtacgtgggagagccct

SEQ ID NO: 755025 - DNA, 20 bp, Artificial
  CRISPR gRNA sequence
tccctaggtcctcctcactt

SEQ ID NO: 755026 - DNA, 20 bp, Artificial
  CRISPR gRNA sequence
ccctaggtcctcctcacttc

SEQ ID NO: 755027 - DNA, 20 bp, Artificial
  CRISPR gRNA sequence
cctaggtcctcctcacttct

SEQ ID NO: 755028 - DNA, 20 bp, Artificial
  CRISPR gRNA sequence
ggtcctcctcacttctgttt

SEQ ID NO: 755029 - DNA, 20 bp, Artificial
  CRISPR gRNA sequence
ctcacttctgtttcccggca

SEQ ID NO: 755030 - DNA, 20 bp, Artificial
  CRISPR gRNA sequence
acttctgtttcccggcagag

SEQ ID NO: 755031 - DNA, 20 bp, Artificial
  CRISPR gRNA sequence
ctgtttcccggcagagccat

SEQ ID NO: 755032 - DNA, 20 bp, Artificial
  CRISPR gRNA sequence
tgtttcccggcagagccata

SEQ ID NO: 755033 - DNA, 20 bp, Artificial
  CRISPR gRNA sequence
tttcccggcagagccatagt

SEQ ID NO: 755034 - DNA, 20 bp, Artificial
  CRISPR gRNA sequence
cccggcagagccatagtttt

SEQ ID NO: 755035 - DNA, 20 bp, Artificial
  CRISPR gRNA sequence
ccggcagagccatagttttg

SEQ ID NO: 755036 - DNA, 20 bp, Artificial
  CRISPR gRNA sequence
tgcagctacacccaccccac

SEQ ID NO: 755037 - DNA, 20 bp, Artificial
  CRISPR gRNA sequence
gcagctacacccaccccact

SEQ ID NO: 755038 - DNA, 20 bp, Artificial
  CRISPR gRNA sequence
cagctacacccaccccactc

SEQ ID NO: 755039 - DNA, 20 bp, Artificial
  CRISPR gRNA sequence
cacccaccccactcaggtgt

SEQ ID NO: 755040 - DNA, 20 bp, Artificial
  CRISPR gRNA sequence
aggtgtgaaggggaagtcca

SEQ ID NO: 755041 - DNA, 20 bp, Artificial
  CRISPR gRNA sequence
cctggggctccttttccact

SEQ ID NO: 755042 - DNA, 20 bp, Artificial
  CRISPR gRNA sequence
ctggggctccttttccactg

SEQ ID NO: 755043 - DNA, 20 bp, Artificial
  CRISPR gRNA sequence
gggctccttttccactgagc

SEQ ID NO: 755044 - DNA, 20 bp, Artificial
  CRISPR gRNA sequence
cttttccactgagcctgctg

SEQ ID NO: 755045 - DNA, 20 bp, Artificial
  CRISPR gRNA sequence
ttccactgagcctgctgcag

SEQ ID NO: 755046 - DNA, 20 bp, Artificial
  CRISPR gRNA sequence
tccactgagcctgctgcagg

SEQ ID NO: 755047 - DNA, 20 bp, Artificial
  CRISPR gRNA sequence
ccactgagcctgctgcaggg

SEQ ID NO: 755048 - DNA, 20 bp, Artificial
  CRISPR gRNA sequence
cactgagcctgctgcagggg

SEQ ID NO: 755049 - DNA, 20 bp, Artificial
  CRISPR gRNA sequence
agcctgctgcaggggtaagg

SEQ ID NO: 755050 - DNA, 20 bp, Artificial
  CRISPR gRNA sequence
ctgcaggggtaagggcagtg

SEQ ID NO: 755051 - DNA, 20 bp, Artificial
  CRISPR gRNA sequence
caggggtaagggcagtgggt

SEQ ID NO: 755052 - DNA, 20 bp, Artificial
  CRISPR gRNA sequence
gcagaggagagttggctagt

SEQ ID NO: 755053 - DNA, 20 bp, Artificial
  CRISPR gRNA sequence
gctagtccctgcactgccag

SEQ ID NO: 755054 - DNA, 20 bp, Artificial
  CRISPR gRNA sequence
gtccctgcactgccaggctt

SEQ ID NO: 755055 - DNA, 20 bp, Artificial
  CRISPR gRNA sequence
cactgccaggctttccctgg

SEQ ID NO: 755056 - DNA, 20 bp, Artificial
  CRISPR gRNA sequence
ccaggctttccctggggacc

SEQ ID NO: 755057 - DNA, 20 bp, Artificial
  CRISPR gRNA sequence
tccctggggaccctgggtgg

SEQ ID NO: 755058 - DNA, 20 bp, Artificial
  CRISPR gRNA sequence
ccctggggaccctgggtgga

SEQ ID NO: 755059 - DNA, 20 bp, Artificial
  CRISPR gRNA sequence
cctggggaccctgggtggat

SEQ ID NO: 755060 - DNA, 20 bp, Artificial
  CRISPR gRNA sequence
gggaccctgggtggatcatc

SEQ ID NO: 755061 - DNA, 20 bp, Artificial
  CRISPR gRNA sequence
ggtggatcatctcctctctt

SEQ ID NO: 755062 - DNA, 20 bp, Artificial
  CRISPR gRNA sequence
ctctcttgagtctgtgggtc

SEQ ID NO: 755063 - DNA, 20 bp, Artificial
  CRISPR gRNA sequence
tcttgagtctgtgggtcaga

SEQ ID NO: 755064 - DNA, 20 bp, Artificial
  CRISPR gRNA sequence
ttgagtctgtgggtcagatt

SEQ ID NO: 755065 - DNA, 20 bp, Artificial
  CRISPR gRNA sequence
gagtctgtgggtcagatttg

SEQ ID NO: 755066 - DNA, 20 bp, Artificial
  CRISPR gRNA sequence
agtctgtgggtcagatttgt

SEQ ID NO: 755067 - DNA, 20 bp, Artificial
  CRISPR gRNA sequence
tgggtcagatttgtagcata

SEQ ID NO: 755068 - DNA, 20 bp, Artificial
  CRISPR gRNA sequence
gtagcataatgggtttgggc

SEQ ID NO: 755069 - DNA, 20 bp, Artificial
  CRISPR gRNA sequence
tagcataatgggtttgggca

SEQ ID NO: 755070 - DNA, 20 bp, Artificial
  CRISPR gRNA sequence
gggcagtagagtcccatgcc

SEQ ID NO: 755071 - DNA, 20 bp, Artificial
  CRISPR gRNA sequence
ggcagtagagtcccatgcca

SEQ ID NO: 755072 - DNA, 20 bp, Artificial
  CRISPR gRNA sequence
gcccaagaagccacactcat

SEQ ID NO: 755073 - DNA, 20 bp, Artificial
  CRISPR gRNA sequence
attcatcacaaactcaaatg

SEQ ID NO: 755074 - DNA, 20 bp, Artificial
  CRISPR gRNA sequence
atcacaaactcaaatgtcca

SEQ ID NO: 755075 - DNA, 20 bp, Artificial
  CRISPR gRNA sequence
aaatgtccacaggaccaaga

SEQ ID NO: 755076 - DNA, 20 bp, Artificial
  CRISPR gRNA sequence
ttagggagtagtacggacgg

SEQ ID NO: 755077 - DNA, 20 bp, Artificial
  CRISPR gRNA sequence
gggagtagtacggacggact

SEQ ID NO: 755078 - DNA, 20 bp, Artificial
  CRISPR gRNA sequence
tggcgaactggagtgccggt

SEQ ID NO: 755079 - DNA, 20 bp, Artificial
  CRISPR gRNA sequence
gcgaactggagtgccggtgc

SEQ ID NO: 755080 - DNA, 20 bp, Artificial
  CRISPR gRNA sequence
gagtgccggtgccccccaaa

SEQ ID NO: 755081 - DNA, 20 bp, Artificial
  CRISPR gRNA sequence
ctactgagccccagctgaca

SEQ ID NO: 755082 - DNA, 20 bp, Artificial
  CRISPR gRNA sequence
ctgagccccagctgacagtt

SEQ ID NO: 755083 - DNA, 20 bp, Artificial
  CRISPR gRNA sequence
agccccagctgacagttgcc

SEQ ID NO: 755084 - DNA, 20 bp, Artificial
  CRISPR gRNA sequence
acagttgccctgtgggaaag

SEQ ID NO: 755085 - DNA, 20 bp, Artificial
  CRISPR gRNA sequence
ccctgtgggaaagctggttt

SEQ ID NO: 755086 - DNA, 20 bp, Artificial
  CRISPR gRNA sequence
tgggaaagctggtttagcat

SEQ ID NO: 755087 - DNA, 20 bp, Artificial
  CRISPR gRNA sequence
gtttagcattatcttctgat

SEQ ID NO: 755088 - DNA, 20 bp, Artificial
  CRISPR gRNA sequence
agcattatcttctgattttc

SEQ ID NO: 755089 - DNA, 20 bp, Artificial
  CRISPR gRNA sequence
gcattatcttctgattttct

SEQ ID NO: 755090 - DNA, 20 bp, Artificial
  CRISPR gRNA sequence
tcttctgattttctaaggag

SEQ ID NO: 755091 - DNA, 20 bp, Artificial
  CRISPR gRNA sequence
ctgattttctaaggagagct

SEQ ID NO: 755092 - DNA, 20 bp, Artificial
  CRISPR gRNA sequence
tgattttctaaggagagctg

SEQ ID NO: 755093 - DNA, 20 bp, Artificial
  CRISPR gRNA sequence
attttctaaggagagctgga

SEQ ID NO: 755094 - DNA, 20 bp, Artificial
  CRISPR gRNA sequence
tctaaggagagctggaagtc

SEQ ID NO: 755095 - DNA, 20 bp, Artificial
  CRISPR gRNA sequence
ctaaggagagctggaagtca

SEQ ID NO: 755096 - DNA, 20 bp, Artificial
  CRISPR gRNA sequence
taaggagagctggaagtcag

SEQ ID NO: 755097 - DNA, 20 bp, Artificial
  CRISPR gRNA sequence
aggagagctggaagtcagaa

SEQ ID NO: 755098 - DNA, 20 bp, Artificial
  CRISPR gRNA sequence
gaagtcagaattttcatgtc

SEQ ID NO: 755099 - DNA, 20 bp, Artificial
  CRISPR gRNA sequence
tcatgtcaaattcctggttt

SEQ ID NO: 755100 - DNA, 20 bp, Artificial
  CRISPR gRNA sequence
catgtcaaattcctggtttt

SEQ ID NO: 755101 - DNA, 20 bp, Artificial
  CRISPR gRNA sequence
atgtcaaattcctggttttt

SEQ ID NO: 755102 - DNA, 20 bp, Artificial
  CRISPR gRNA sequence
ctggtttttaaatgttgcca

SEQ ID NO: 755103 - DNA, 20 bp, Artificial
  CRISPR gRNA sequence
gtttttaaatgttgccatct

SEQ ID NO: 755104 - DNA, 20 bp, Artificial
  CRISPR gRNA sequence
ttaaatgttgccatctcaag

SEQ ID NO: 755105 - DNA, 20 bp, Artificial
  CRISPR gRNA sequence
taaatgttgccatctcaaga

SEQ ID NO: 755106 - DNA, 20 bp, Artificial
  CRISPR gRNA sequence
aaatgttgccatctcaagaa

SEQ ID NO: 755107 - DNA, 20 bp, Artificial
  CRISPR gRNA sequence
aatgttgccatctcaagaaa

SEQ ID NO: 755108 - DNA, 20 bp, Artificial
  CRISPR gRNA sequence
ccatctcaagaaaattaaaa

SEQ ID NO: 755109 - DNA, 20 bp, Artificial
  CRISPR gRNA sequence
aagaaaattaaaaagatttt

SEQ ID NO: 755110 - DNA, 20 bp, Artificial
  CRISPR gRNA sequence
aaaagattttgaggatccaa

SEQ ID NO: 755111 - DNA, 20 bp, Artificial
  CRISPR gRNA sequence
tgaggatccaatgaaatatg

SEQ ID NO: 755112 - DNA, 20 bp, Artificial
  CRISPR gRNA sequence
gaggatccaatgaaatatgt

SEQ ID NO: 755113 - DNA, 20 bp, Artificial
  CRISPR gRNA sequence
aggatccaatgaaatatgtg

SEQ ID NO: 755114 - DNA, 20 bp, Artificial
  CRISPR gRNA sequence
gatgtggcctgtgggctccc

SEQ ID NO: 755115 - DNA, 20 bp, Artificial
  CRISPR gRNA sequence
tgggctcccagtttctggcc

SEQ ID NO: 755116 - DNA, 20 bp, Artificial
  CRISPR gRNA sequence
ccagtttctggccttttttt

SEQ ID NO: 755117 - DNA, 20 bp, Artificial
  CRISPR gRNA sequence
ctggccttttttttcatcag

SEQ ID NO: 755118 - DNA, 20 bp, Artificial
  CRISPR gRNA sequence
tggccttttttttcatcagt

SEQ ID NO: 755119 - DNA, 20 bp, Artificial
  CRISPR gRNA sequence
gccttttttttcatcagtat

SEQ ID NO: 755120 - DNA, 20 bp, Artificial
  CRISPR gRNA sequence
ttttttcatcagtatagtgt

SEQ ID NO: 755121 - DNA, 20 bp, Artificial
  CRISPR gRNA sequence
tttttcatcagtatagtgtc

SEQ ID NO: 755122 - DNA, 20 bp, Artificial
  CRISPR gRNA sequence
ttttcatcagtatagtgtct

SEQ ID NO: 755123 - DNA, 20 bp, Artificial
  CRISPR gRNA sequence
tttcatcagtatagtgtcta

SEQ ID NO: 755124 - DNA, 20 bp, Artificial
  CRISPR gRNA sequence
ttcatcagtatagtgtctat

SEQ ID NO: 755125 - DNA, 20 bp, Artificial
  CRISPR gRNA sequence
tcatcagtatagtgtctatg

SEQ ID NO: 755126 - DNA, 20 bp, Artificial
  CRISPR gRNA sequence
catcagtatagtgtctatgt

SEQ ID NO: 755127 - DNA, 20 bp, Artificial
  CRISPR gRNA sequence
atcagtatagtgtctatgtg

SEQ ID NO: 755128 - DNA, 20 bp, Artificial
  CRISPR gRNA sequence
tgtgtctgagtttaattcta

SEQ ID NO: 755129 - DNA, 20 bp, Artificial
  CRISPR gRNA sequence
agtttaattctagctctagc

SEQ ID NO: 755130 - DNA, 20 bp, Artificial
  CRISPR gRNA sequence
aattctagctctagcacttg

SEQ ID NO: 755131 - DNA, 20 bp, Artificial
  CRISPR gRNA sequence
attctagctctagcacttgc

SEQ ID NO: 755132 - DNA, 20 bp, Artificial
  CRISPR gRNA sequence
tagctctagcacttgcttgc

SEQ ID NO: 755133 - DNA, 20 bp, Artificial
  CRISPR gRNA sequence
gctctagcacttgcttgctg

SEQ ID NO: 755134 - DNA, 20 bp, Artificial
  CRISPR gRNA sequence
tagcacttgcttgctgtgtg

SEQ ID NO: 755135 - DNA, 20 bp, Artificial
  CRISPR gRNA sequence
gcacttgcttgctgtgtgat

SEQ ID NO: 755136 - DNA, 20 bp, Artificial
  CRISPR gRNA sequence
gcttgctgtgtgatcatcag

SEQ ID NO: 755137 - DNA, 20 bp, Artificial
  CRISPR gRNA sequence
cttgctgtgtgatcatcagt

SEQ ID NO: 755138 - DNA, 20 bp, Artificial
  CRISPR gRNA sequence
gctgtgtgatcatcagtgag

SEQ ID NO: 755139 - DNA, 20 bp, Artificial
  CRISPR gRNA sequence
ctgtgtgatcatcagtgagt

SEQ ID NO: 755140 - DNA, 20 bp, Artificial
  CRISPR gRNA sequence
tgtgatcatcagtgagttac

SEQ ID NO: 755141 - DNA, 20 bp, Artificial
  CRISPR gRNA sequence
cgtaagttctctgtgcctta

SEQ ID NO: 755142 - DNA, 20 bp, Artificial
  CRISPR gRNA sequence
tctgtgccttagtttcttca

SEQ ID NO: 755143 - DNA, 20 bp, Artificial
  CRISPR gRNA sequence
tgtgccttagtttcttcatc

SEQ ID NO: 755144 - DNA, 20 bp, Artificial
  CRISPR gRNA sequence
tgccttagtttcttcatcag

SEQ ID NO: 755145 - DNA, 20 bp, Artificial
  CRISPR gRNA sequence
agtttcttcatcagtgcaat

SEQ ID NO: 755146 - DNA, 20 bp, Artificial
  CRISPR gRNA sequence
gtttcttcatcagtgcaatg

SEQ ID NO: 755147 - DNA, 20 bp, Artificial
  CRISPR gRNA sequence
cttcatcagtgcaatgggaa

SEQ ID NO: 755148 - DNA, 20 bp, Artificial
  CRISPR gRNA sequence
ttcatcagtgcaatgggaat

SEQ ID NO: 755149 - DNA, 20 bp, Artificial
  CRISPR gRNA sequence
catcagtgcaatgggaataa

SEQ ID NO: 755150 - DNA, 20 bp, Artificial
  CRISPR gRNA sequence
atcagtgcaatgggaataaa

SEQ ID NO: 755151 - DNA, 20 bp, Artificial
  CRISPR gRNA sequence
atggcattgttagatatgcc

SEQ ID NO: 755152 - DNA, 20 bp, Artificial
  CRISPR gRNA sequence
tggcattgttagatatgccc

SEQ ID NO: 755153 - DNA, 20 bp, Artificial
  CRISPR gRNA sequence
ttagatatgcccatgaaacc

SEQ ID NO: 755154 - DNA, 20 bp, Artificial
  CRISPR gRNA sequence
gatatgcccatgaaaccctt

SEQ ID NO: 755155 - DNA, 20 bp, Artificial
  CRISPR gRNA sequence
agcgtagtgcacaacacatg

SEQ ID NO: 755156 - DNA, 20 bp, Artificial
  CRISPR gRNA sequence
gcgtagtgcacaacacatgc

SEQ ID NO: 755157 - DNA, 20 bp, Artificial
  CRISPR gRNA sequence
tgtcttcttattacggttct

SEQ ID NO: 755158 - DNA, 20 bp, Artificial
  CRISPR gRNA sequence
cttattacggttctgcctag

SEQ ID NO: 755159 - DNA, 20 bp, Artificial
  CRISPR gRNA sequence
ttattacggttctgcctaga

SEQ ID NO: 755160 - DNA, 20 bp, Artificial
  CRISPR gRNA sequence
attacggttctgcctagatc

SEQ ID NO: 755161 - DNA, 20 bp, Artificial
  CRISPR gRNA sequence
ttacggttctgcctagatcc

SEQ ID NO: 755162 - DNA, 20 bp, Artificial
  CRISPR gRNA sequence
cggttctgcctagatcctgc

SEQ ID NO: 755163 - DNA, 20 bp, Artificial
  CRISPR gRNA sequence
tgcctagatcctgcgttacc

SEQ ID NO: 755164 - DNA, 20 bp, Artificial
  CRISPR gRNA sequence
cctagatcctgcgttacctg

SEQ ID NO: 755165 - DNA, 20 bp, Artificial
  CRISPR gRNA sequence
gatcctgcgttacctgaagt

SEQ ID NO: 755166 - DNA, 20 bp, Artificial
  CRISPR gRNA sequence
cgttacctgaagtcccccat

SEQ ID NO: 755167 - DNA, 20 bp, Artificial
  CRISPR gRNA sequence
cctgaagtcccccatgctcc

SEQ ID NO: 755168 - DNA, 20 bp, Artificial
  CRISPR gRNA sequence
aagtcccccatgctccaggc

SEQ ID NO: 755169 - DNA, 20 bp, Artificial
  CRISPR gRNA sequence
caggctttgagatcataccc

SEQ ID NO: 755170 - DNA, 20 bp, Artificial
  CRISPR gRNA sequence
tgagatcataccctctggaa

SEQ ID NO: 755171 - DNA, 20 bp, Artificial
  CRISPR gRNA sequence
gagatcataccctctggaac

SEQ ID NO: 755172 - DNA, 20 bp, Artificial
  CRISPR gRNA sequence
agatcataccctctggaact

SEQ ID NO: 755173 - DNA, 20 bp, Artificial
  CRISPR gRNA sequence
tggaactttggaacttcagt

SEQ ID NO: 755174 - DNA, 20 bp, Artificial
  CRISPR gRNA sequence
gaactttggaacttcagtcc

SEQ ID NO: 755175 - DNA, 20 bp, Artificial
  CRISPR gRNA sequence
tggaacttcagtccaaccac

SEQ ID NO: 755176 - DNA, 20 bp, Artificial
  CRISPR gRNA sequence
ggaacttcagtccaaccact

SEQ ID NO: 755177 - DNA, 20 bp, Artificial
  CRISPR gRNA sequence
gaacttcagtccaaccactt

SEQ ID NO: 755178 - DNA, 20 bp, Artificial
  CRISPR gRNA sequence
cagtccaaccactttccctt

SEQ ID NO: 755179 - DNA, 20 bp, Artificial
  CRISPR gRNA sequence
agtccaaccactttcccttt

SEQ ID NO: 755180 - DNA, 20 bp, Artificial
  CRISPR gRNA sequence
tccctttctgggtctctgtg

SEQ ID NO: 755181 - DNA, 20 bp, Artificial
  CRISPR gRNA sequence
ccctttctgggtctctgtgt

SEQ ID NO: 755182 - DNA, 20 bp, Artificial
  CRISPR gRNA sequence
cctttctgggtctctgtgtt

SEQ ID NO: 755183 - DNA, 20 bp, Artificial
  CRISPR gRNA sequence
tctgggtctctgtgtttctg

SEQ ID NO: 755184 - DNA, 20 bp, Artificial
  CRISPR gRNA sequence
ctgggtctctgtgtttctgc

SEQ ID NO: 755185 - DNA, 20 bp, Artificial
  CRISPR gRNA sequence
tgggtctctgtgtttctgcc

SEQ ID NO: 755186 - DNA, 20 bp, Artificial
  CRISPR gRNA sequence
ggtctctgtgtttctgcctg

SEQ ID NO: 755187 - DNA, 20 bp, Artificial
  CRISPR gRNA sequence
tgtgtttctgcctgaaaagg

SEQ ID NO: 755188 - DNA, 20 bp, Artificial
  CRISPR gRNA sequence
tgtttctgcctgaaaaggag

SEQ ID NO: 755189 - DNA, 20 bp, Artificial
  CRISPR gRNA sequence
ctgcctgaaaaggagacctg

SEQ ID NO: 755190 - DNA, 20 bp, Artificial
  CRISPR gRNA sequence
tgcctgaaaaggagacctgt

SEQ ID NO: 755191 - DNA, 20 bp, Artificial
  CRISPR gRNA sequence
cctgaaaaggagacctgtat

SEQ ID NO: 755192 - DNA, 20 bp, Artificial
  CRISPR gRNA sequence
aaaaggagacctgtatcttg

SEQ ID NO: 755193 - DNA, 20 bp, Artificial
  CRISPR gRNA sequence
tatcttgccaaagaagttct

SEQ ID NO: 755194 - DNA, 20 bp, Artificial
  CRISPR gRNA sequence
gccaaagaagttctgaaatc

SEQ ID NO: 755195 - DNA, 20 bp, Artificial
  CRISPR gRNA sequence
ccaaagaagttctgaaatct

SEQ ID NO: 755196 - DNA, 20 bp, Artificial
  CRISPR gRNA sequence
tgaaatctctgctcaccctg

SEQ ID NO: 755197 - DNA, 20 bp, Artificial
  CRISPR gRNA sequence
aaatctctgctcaccctgac

SEQ ID NO: 755198 - DNA, 20 bp, Artificial
  CRISPR gRNA sequence
tgctcaccctgacaatgact

SEQ ID NO: 755199 - DNA, 20 bp, Artificial
  CRISPR gRNA sequence
ctcaccctgacaatgactcc

SEQ ID NO: 755200 - DNA, 20 bp, Artificial
  CRISPR gRNA sequence
accctgacaatgactccaaa

SEQ ID NO: 755201 - DNA, 20 bp, Artificial
  CRISPR gRNA sequence
acaatgactccaaaaatctg

SEQ ID NO: 755202 - DNA, 20 bp, Artificial
  CRISPR gRNA sequence
caaaaatctggggctcccag

SEQ ID NO: 755203 - DNA, 20 bp, Artificial
  CRISPR gRNA sequence
gggctcccagacttggctct

SEQ ID NO: 755204 - DNA, 20 bp, Artificial
  CRISPR gRNA sequence
ccagacttggctctctgcct

SEQ ID NO: 755205 - DNA, 20 bp, Artificial
  CRISPR gRNA sequence
ggctctctgcctaaaactcc

SEQ ID NO: 755206 - DNA, 20 bp, Artificial
  CRISPR gRNA sequence
gctctctgcctaaaactcca

SEQ ID NO: 755207 - DNA, 20 bp, Artificial
  CRISPR gRNA sequence
tctgcctaaaactccactct

SEQ ID NO: 755208 - DNA, 20 bp, Artificial
  CRISPR gRNA sequence
tgcctaaaactccactcttg

SEQ ID NO: 755209 - DNA, 20 bp, Artificial
  CRISPR gRNA sequence
cctaaaactccactcttgca

SEQ ID NO: 755210 - DNA, 20 bp, Artificial
  CRISPR gRNA sequence
aaactccactcttgcagaca

SEQ ID NO: 755211 - DNA, 20 bp, Artificial
  CRISPR gRNA sequence
cactcttgcagacatgccgt

SEQ ID NO: 755212 - DNA, 20 bp, Artificial
  CRISPR gRNA sequence
ttgcagacatgccgtttggg

SEQ ID NO: 755213 - DNA, 20 bp, Artificial
  CRISPR gRNA sequence
gcagacatgccgtttggggc

SEQ ID NO: 755214 - DNA, 20 bp, Artificial
  CRISPR gRNA sequence
cagacatgccgtttggggct

SEQ ID NO: 755215 - DNA, 20 bp, Artificial
  CRISPR gRNA sequence
ggggctttggtgcctttgga

SEQ ID NO: 755216 - DNA, 20 bp, Artificial
  CRISPR gRNA sequence
gggctttggtgcctttggag

SEQ ID NO: 755217 - DNA, 20 bp, Artificial
  CRISPR gRNA sequence
tggtgcctttggagactctc

SEQ ID NO: 755218 - DNA, 20 bp, Artificial
  CRISPR gRNA sequence
ggtgcctttggagactctcc

SEQ ID NO: 755219 - DNA, 20 bp, Artificial
  CRISPR gRNA sequence
gtgcctttggagactctcct

SEQ ID NO: 755220 - DNA, 20 bp, Artificial
  CRISPR gRNA sequence
tggagactctcctttaaaca

SEQ ID NO: 755221 - DNA, 20 bp, Artificial
  CRISPR gRNA sequence
ggagactctcctttaaacac

SEQ ID NO: 755222 - DNA, 20 bp, Artificial
  CRISPR gRNA sequence
gagactctcctttaaacaca

SEQ ID NO: 755223 - DNA, 20 bp, Artificial
  CRISPR gRNA sequence
tcctttaaacacaagcgccc

SEQ ID NO: 755224 - DNA, 20 bp, Artificial
  CRISPR gRNA sequence
ctttaaacacaagcgcccca

SEQ ID NO: 755225 - DNA, 20 bp, Artificial
  CRISPR gRNA sequence
taaacacaagcgccccagga

SEQ ID NO: 755226 - DNA, 20 bp, Artificial
  CRISPR gRNA sequence
aaacacaagcgccccaggat

SEQ ID NO: 755227 - DNA, 20 bp, Artificial
  CRISPR gRNA sequence
aacacaagcgccccaggatc

SEQ ID NO: 755228 - DNA, 20 bp, Artificial
  CRISPR gRNA sequence
ttatcagtcattcacacctt

SEQ ID NO: 755229 - DNA, 20 bp, Artificial
  CRISPR gRNA sequence
tcagtcattcacaccttagc

SEQ ID NO: 755230 - DNA, 20 bp, Artificial
  CRISPR gRNA sequence
acaccttagcaggaaagact

SEQ ID NO: 755231 - DNA, 20 bp, Artificial
  CRISPR gRNA sequence
agcaggaaagactttaaagc

SEQ ID NO: 755232 - DNA, 20 bp, Artificial
  CRISPR gRNA sequence
gcaggaaagactttaaagct

SEQ ID NO: 755233 - DNA, 20 bp, Artificial
  CRISPR gRNA sequence
taaagctggcttctccatcc

SEQ ID NO: 755234 - DNA, 20 bp, Artificial
  CRISPR gRNA sequence
aaagctggcttctccatccc

SEQ ID NO: 755235 - DNA, 20 bp, Artificial
  CRISPR gRNA sequence
aagctggcttctccatccca

SEQ ID NO: 755236 - DNA, 20 bp, Artificial
  CRISPR gRNA sequence
gcttctccatcccactgtgc

SEQ ID NO: 755237 - DNA, 20 bp, Artificial
  CRISPR gRNA sequence
ctccatcccactgtgcttct

SEQ ID NO: 755238 - DNA, 20 bp, Artificial
  CRISPR gRNA sequence
tccatcccactgtgcttctc

SEQ ID NO: 755239 - DNA, 20 bp, Artificial
  CRISPR gRNA sequence
catcccactgtgcttctcac

SEQ ID NO: 755240 - DNA, 20 bp, Artificial
  CRISPR gRNA sequence
tgcttctcactcctaggagg

SEQ ID NO: 755241 - DNA, 20 bp, Artificial
  CRISPR gRNA sequence
ctcactcctaggaggcactt

SEQ ID NO: 755242 - DNA, 20 bp, Artificial
  CRISPR gRNA sequence
tcactcctaggaggcacttc

SEQ ID NO: 755243 - DNA, 20 bp, Artificial
  CRISPR gRNA sequence
actcctaggaggcacttctt

SEQ ID NO: 755244 - DNA, 20 bp, Artificial
  CRISPR gRNA sequence
ctaggaggcacttcttgact

SEQ ID NO: 755245 - DNA, 20 bp, Artificial
  CRISPR gRNA sequence
ggaggcacttcttgacttgc

SEQ ID NO: 755246 - DNA, 20 bp, Artificial
  CRISPR gRNA sequence
cttgacttgctgaatgaatt

SEQ ID NO: 755247 - DNA, 20 bp, Artificial
  CRISPR gRNA sequence
ttgacttgctgaatgaatta

SEQ ID NO: 755248 - DNA, 20 bp, Artificial
  CRISPR gRNA sequence
gacttgctgaatgaattaga

SEQ ID NO: 755249 - DNA, 20 bp, Artificial
  CRISPR gRNA sequence
acttgctgaatgaattagag

SEQ ID NO: 755250 - DNA, 20 bp, Artificial
  CRISPR gRNA sequence
gctgaatgaattagagacct

SEQ ID NO: 755251 - DNA, 20 bp, Artificial
  CRISPR gRNA sequence
ctgaatgaattagagacctg

SEQ ID NO: 755252 - DNA, 20 bp, Artificial
  CRISPR gRNA sequence
aatgaattagagacctgtct

SEQ ID NO: 755253 - DNA, 20 bp, Artificial
  CRISPR gRNA sequence
gagacctgtctagctcccaa

SEQ ID NO: 755254 - DNA, 20 bp, Artificial
  CRISPR gRNA sequence
tctagctcccaagtaccaag

SEQ ID NO: 755255 - DNA, 20 bp, Artificial
  CRISPR gRNA sequence
gctcccaagtaccaagcgcc

SEQ ID NO: 755256 - DNA, 20 bp, Artificial
  CRISPR gRNA sequence
ccaagtaccaagcgccgact

SEQ ID NO: 755257 - DNA, 20 bp, Artificial
  CRISPR gRNA sequence
ctcgcatggcacttacagaa

SEQ ID NO: 755258 - DNA, 20 bp, Artificial
  CRISPR gRNA sequence
gcatggcacttacagaacac

SEQ ID NO: 755259 - DNA, 20 bp, Artificial
  CRISPR gRNA sequence
acagaacacttcatgtgaat

SEQ ID NO: 755260 - DNA, 20 bp, Artificial
  CRISPR gRNA sequence
cagaacacttcatgtgaatt

SEQ ID NO: 755261 - DNA, 20 bp, Artificial
  CRISPR gRNA sequence
catgtgaattattactaacc

SEQ ID NO: 755262 - DNA, 20 bp, Artificial
  CRISPR gRNA sequence
atgtgaattattactaaccg

SEQ ID NO: 755263 - DNA, 20 bp, Artificial
  CRISPR gRNA sequence
ttactaaccgttgcctcaac

SEQ ID NO: 755264 - DNA, 20 bp, Artificial
  CRISPR gRNA sequence
ctaaccgttgcctcaactct

SEQ ID NO: 755265 - DNA, 20 bp, Artificial
  CRISPR gRNA sequence
accgttgcctcaactctgcc

SEQ ID NO: 755266 - DNA, 20 bp, Artificial
  CRISPR gRNA sequence
cctcaactctgccagggaga

SEQ ID NO: 755267 - DNA, 20 bp, Artificial
  CRISPR gRNA sequence
aactctgccagggagatgtt

SEQ ID NO: 755268 - DNA, 20 bp, Artificial
  CRISPR gRNA sequence
tgccagggagatgttttcat

SEQ ID NO: 755269 - DNA, 20 bp, Artificial
  CRISPR gRNA sequence
ccagggagatgttttcattt

SEQ ID NO: 755270 - DNA, 20 bp, Artificial
  CRISPR gRNA sequence
tcatttctgggaaaaacatc

SEQ ID NO: 755271 - DNA, 20 bp, Artificial
  CRISPR gRNA sequence
catttctgggaaaaacatct

SEQ ID NO: 755272 - DNA, 20 bp, Artificial
  CRISPR gRNA sequence
atttctgggaaaaacatctg

SEQ ID NO: 755273 - DNA, 20 bp, Artificial
  CRISPR gRNA sequence
ctgggaaaaacatctgtgag

SEQ ID NO: 755274 - DNA, 20 bp, Artificial
  CRISPR gRNA sequence
tgggaaaaacatctgtgagt

SEQ ID NO: 755275 - DNA, 20 bp, Artificial
  CRISPR gRNA sequence
ggaaaaacatctgtgagtga

SEQ ID NO: 755276 - DNA, 20 bp, Artificial
  CRISPR gRNA sequence
tgagtgaggagtcggggctc

SEQ ID NO: 755277 - DNA, 20 bp, Artificial
  CRISPR gRNA sequence
agcgtctaagtggctcacag

SEQ ID NO: 755278 - DNA, 20 bp, Artificial
  CRISPR gRNA sequence
agtggctcacagctactggt

SEQ ID NO: 755279 - DNA, 20 bp, Artificial
  CRISPR gRNA sequence
acagctactggtccagtaca

SEQ ID NO: 755280 - DNA, 20 bp, Artificial
  CRISPR gRNA sequence
ctggtccagtacaggctggc

SEQ ID NO: 755281 - DNA, 20 bp, Artificial
  CRISPR gRNA sequence
gtccagtacaggctggccag

SEQ ID NO: 755282 - DNA, 20 bp, Artificial
  CRISPR gRNA sequence
gccagctccagaagccccac

SEQ ID NO: 755283 - DNA, 20 bp, Artificial
  CRISPR gRNA sequence
cagaagccccaccaggctgc

SEQ ID NO: 755284 - DNA, 20 bp, Artificial
  CRISPR gRNA sequence
cctccctcctggctgggcaa

SEQ ID NO: 755285 - DNA, 20 bp, Artificial
  CRISPR gRNA sequence
cctcctggctgggcaaggct

SEQ ID NO: 755286 - DNA, 20 bp, Artificial
  CRISPR gRNA sequence
ctggctgggcaaggctttca

SEQ ID NO: 755287 - DNA, 20 bp, Artificial
  CRISPR gRNA sequence
gctgggcaaggctttcagct

SEQ ID NO: 755288 - DNA, 20 bp, Artificial
  CRISPR gRNA sequence
ggcaaggctttcagctcttc

SEQ ID NO: 755289 - DNA, 20 bp, Artificial
  CRISPR gRNA sequence
tcagctcttccagtgggtcc

SEQ ID NO: 755290 - DNA, 20 bp, Artificial
  CRISPR gRNA sequence
cagctcttccagtgggtccc

SEQ ID NO: 755291 - DNA, 20 bp, Artificial
  CRISPR gRNA sequence
agctcttccagtgggtccca

SEQ ID NO: 755292 - DNA, 20 bp, Artificial
  CRISPR gRNA sequence
ttccagtgggtcccagcctg

SEQ ID NO: 755293 - DNA, 20 bp, Artificial
  CRISPR gRNA sequence
ccagtgggtcccagcctgcc

SEQ ID NO: 755294 - DNA, 20 bp, Artificial
  CRISPR gRNA sequence
cagtgggtcccagcctgccg

SEQ ID NO: 755295 - DNA, 20 bp, Artificial
  CRISPR gRNA sequence
ccgccgagggtcctgggctc

SEQ ID NO: 755296 - DNA, 20 bp, Artificial
  CRISPR gRNA sequence
ggctctaagggcagggaagg

SEQ ID NO: 755297 - DNA, 20 bp, Artificial
  CRISPR gRNA sequence
taagggcagggaaggggcat

SEQ ID NO: 755298 - DNA, 20 bp, Artificial
  CRISPR gRNA sequence
agggcagggaaggggcatct

SEQ ID NO: 755299 - DNA, 20 bp, Artificial
  CRISPR gRNA sequence
aaggaggatgtggcattata

SEQ ID NO: 755300 - DNA, 20 bp, Artificial
  CRISPR gRNA sequence
tattggttctgggcaatgcc

SEQ ID NO: 755301 - DNA, 20 bp, Artificial
  CRISPR gRNA sequence
gttctgggcaatgcccctgg

SEQ ID NO: 755302 - DNA, 20 bp, Artificial
  CRISPR gRNA sequence
tgggcaatgcccctggctgg

SEQ ID NO: 755303 - DNA, 20 bp, Artificial
  CRISPR gRNA sequence
ggcaatgcccctggctgggg

SEQ ID NO: 755304 - DNA, 20 bp, Artificial
  CRISPR gRNA sequence
gctggggcaatgaaaaggat

SEQ ID NO: 755305 - DNA, 20 bp, Artificial
  CRISPR gRNA sequence
gggcaatgaaaaggatgtat

SEQ ID NO: 755306 - DNA, 20 bp, Artificial
  CRISPR gRNA sequence
ggattctgtacatagttcta

SEQ ID NO: 755307 - DNA, 20 bp, Artificial
  CRISPR gRNA sequence
gattctgtacatagttctaa

SEQ ID NO: 755308 - DNA, 20 bp, Artificial
  CRISPR gRNA sequence
tgtacatagttctaaccctc

SEQ ID NO: 755309 - DNA, 20 bp, Artificial
  CRISPR gRNA sequence
tacatagttctaaccctcct

SEQ ID NO: 755310 - DNA, 20 bp, Artificial
  CRISPR gRNA sequence
taaccctccttccctctctg

SEQ ID NO: 755311 - DNA, 20 bp, Artificial
  CRISPR gRNA sequence
accctccttccctctctgct

SEQ ID NO: 755312 - DNA, 20 bp, Artificial
  CRISPR gRNA sequence
cttccctctctgctagaccc

SEQ ID NO: 755313 - DNA, 20 bp, Artificial
  CRISPR gRNA sequence
ccctctctgctagacccaca

SEQ ID NO: 755314 - DNA, 20 bp, Artificial
  CRISPR gRNA sequence
cctctctgctagacccacaa

SEQ ID NO: 755315 - DNA, 20 bp, Artificial
  CRISPR gRNA sequence
tctgctagacccacaacagc

SEQ ID NO: 755316 - DNA, 20 bp, Artificial
  CRISPR gRNA sequence
tgctagacccacaacagcct

SEQ ID NO: 755317 - DNA, 20 bp, Artificial
  CRISPR gRNA sequence
ctagacccacaacagcctga

SEQ ID NO: 755318 - DNA, 20 bp, Artificial
  CRISPR gRNA sequence
gacccacaacagcctgacat

SEQ ID NO: 755319 - DNA, 20 bp, Artificial
  CRISPR gRNA sequence
acatgccatttaaaataaaa

SEQ ID NO: 755320 - DNA, 20 bp, Artificial
  CRISPR gRNA sequence
aaaataaaaataccactggc

SEQ ID NO: 755321 - DNA, 20 bp, Artificial
  CRISPR gRNA sequence
aaataaaaataccactggcc

SEQ ID NO: 755322 - DNA, 20 bp, Artificial
  CRISPR gRNA sequence
gccgggcgtagtgggtcaca

SEQ ID NO: 755323 - DNA, 20 bp, Artificial
  CRISPR gRNA sequence
gtaatcccaagactttgaga

SEQ ID NO: 755324 - DNA, 20 bp, Artificial
  CRISPR gRNA sequence
taatcccaagactttgagag

SEQ ID NO: 755325 - DNA, 20 bp, Artificial
  CRISPR gRNA sequence
tgagaggccaaggcaggaga

SEQ ID NO: 755326 - DNA, 20 bp, Artificial
  CRISPR gRNA sequence
gagaggccaaggcaggagaa

SEQ ID NO: 755327 - DNA, 20 bp, Artificial
  CRISPR gRNA sequence
agaggccaaggcaggagaat

SEQ ID NO: 755328 - DNA, 20 bp, Artificial
  CRISPR gRNA sequence
cttgaagccaggagttcaag

SEQ ID NO: 755329 - DNA, 20 bp, Artificial
  CRISPR gRNA sequence
gaagccaggagttcaaggtc

SEQ ID NO: 755330 - DNA, 20 bp, Artificial
  CRISPR gRNA sequence
aagccaggagttcaaggtca

SEQ ID NO: 755331 - DNA, 20 bp, Artificial
  CRISPR gRNA sequence
aaggtcagcctgggcaacag

SEQ ID NO: 755332 - DNA, 20 bp, Artificial
  CRISPR gRNA sequence
ggcaacagagggagactccg

SEQ ID NO: 755333 - DNA, 20 bp, Artificial
  CRISPR gRNA sequence
cgtctcaaaaacaaataaat

SEQ ID NO: 755334 - DNA, 20 bp, Artificial
  CRISPR gRNA sequence
aaaaacaaataaataaataa

SEQ ID NO: 755335 - DNA, 20 bp, Artificial
  CRISPR gRNA sequence
tagctatccctcagatgtct

SEQ ID NO: 755336 - DNA, 20 bp, Artificial
  CRISPR gRNA sequence
tccctcagatgtctgcagag

SEQ ID NO: 755337 - DNA, 20 bp, Artificial
  CRISPR gRNA sequence
agatgtctgcagagggcatt

SEQ ID NO: 755338 - DNA, 20 bp, Artificial
  CRISPR gRNA sequence
cagagggcattagagctcac

SEQ ID NO: 755339 - DNA, 20 bp, Artificial
  CRISPR gRNA sequence
gagctcacatcttgtgttct

SEQ ID NO: 755340 - DNA, 20 bp, Artificial
  CRISPR gRNA sequence
acatcttgtgttctcatctt

SEQ ID NO: 755341 - DNA, 20 bp, Artificial
  CRISPR gRNA sequence
gtgttctcatctttccctca

SEQ ID NO: 755342 - DNA, 20 bp, Artificial
  CRISPR gRNA sequence
tgttctcatctttccctcat

SEQ ID NO: 755343 - DNA, 20 bp, Artificial
  CRISPR gRNA sequence
tcatctttccctcatctagt

SEQ ID NO: 755344 - DNA, 20 bp, Artificial
  CRISPR gRNA sequence
atctttccctcatctagtcc

SEQ ID NO: 755345 - DNA, 20 bp, Artificial
  CRISPR gRNA sequence
tccctcatctagtccttttg

SEQ ID NO: 755346 - DNA, 20 bp, Artificial
  CRISPR gRNA sequence
ccctcatctagtccttttgc

SEQ ID NO: 755347 - DNA, 20 bp, Artificial
  CRISPR gRNA sequence
cctcatctagtccttttgca

SEQ ID NO: 755348 - DNA, 20 bp, Artificial
  CRISPR gRNA sequence
atctagtccttttgcaaccc

SEQ ID NO: 755349 - DNA, 20 bp, Artificial
  CRISPR gRNA sequence
gtccttttgcaaccctgcat

SEQ ID NO: 755350 - DNA, 20 bp, Artificial
  CRISPR gRNA sequence
ttgcaaccctgcattgtagc

SEQ ID NO: 755351 - DNA, 20 bp, Artificial
  CRISPR gRNA sequence
tgcaaccctgcattgtagcc

SEQ ID NO: 755352 - DNA, 20 bp, Artificial
  CRISPR gRNA sequence
gcaaccctgcattgtagcca

SEQ ID NO: 755353 - DNA, 20 bp, Artificial
  CRISPR gRNA sequence
caaccctgcattgtagccaa

SEQ ID NO: 755354 - DNA, 20 bp, Artificial
  CRISPR gRNA sequence
cattgtagccaatagttttc

SEQ ID NO: 755355 - DNA, 20 bp, Artificial
  CRISPR gRNA sequence
tagccaatagttttctcact

SEQ ID NO: 755356 - DNA, 20 bp, Artificial
  CRISPR gRNA sequence
tctcactgcacagaggagga

SEQ ID NO: 755357 - DNA, 20 bp, Artificial
  CRISPR gRNA sequence
ctcactgcacagaggaggaa

SEQ ID NO: 755358 - DNA, 20 bp, Artificial
  CRISPR gRNA sequence
tcactgcacagaggaggaaa

SEQ ID NO: 755359 - DNA, 20 bp, Artificial
  CRISPR gRNA sequence
actgcacagaggaggaaact

SEQ ID NO: 755360 - DNA, 20 bp, Artificial
  CRISPR gRNA sequence
cacagaggaggaaactgagg

SEQ ID NO: 755361 - DNA, 20 bp, Artificial
  CRISPR gRNA sequence
aggctcatacagttagatag

SEQ ID NO: 755362 - DNA, 20 bp, Artificial
  CRISPR gRNA sequence
atacagttagatagaaacgc

SEQ ID NO: 755363 - DNA, 20 bp, Artificial
  CRISPR gRNA sequence
gatagaaacgcggcctctat

SEQ ID NO: 755364 - DNA, 20 bp, Artificial
  CRISPR gRNA sequence
tatccaatattctgttttca

SEQ ID NO: 755365 - DNA, 20 bp, Artificial
  CRISPR gRNA sequence
tccaatattctgttttcaaa

SEQ ID NO: 755366 - DNA, 20 bp, Artificial
  CRISPR gRNA sequence
tgttttcaaaagctcatggt

SEQ ID NO: 755367 - DNA, 20 bp, Artificial
  CRISPR gRNA sequence
ttttcaaaagctcatggttt

SEQ ID NO: 755368 - DNA, 20 bp, Artificial
  CRISPR gRNA sequence
tcaaaagctcatggttttga

SEQ ID NO: 755369 - DNA, 20 bp, Artificial
  CRISPR gRNA sequence
caaaagctcatggttttgag

SEQ ID NO: 755370 - DNA, 20 bp, Artificial
  CRISPR gRNA sequence
aaaagctcatggttttgagg

SEQ ID NO: 755371 - DNA, 20 bp, Artificial
  CRISPR gRNA sequence
atggttttgagggtcaaccc

SEQ ID NO: 755372 - DNA, 20 bp, Artificial
  CRISPR gRNA sequence
tgagggtcaacccaattaaa

SEQ ID NO: 755373 - DNA, 20 bp, Artificial
  CRISPR gRNA sequence
gagggtcaacccaattaaat

SEQ ID NO: 755374 - DNA, 20 bp, Artificial
  CRISPR gRNA sequence
agggtcaacccaattaaatg

SEQ ID NO: 755375 - DNA, 20 bp, Artificial
  CRISPR gRNA sequence
aatgctggaggattgggata

SEQ ID NO: 755376 - DNA, 20 bp, Artificial
  CRISPR gRNA sequence
gaggattgggataaggcaaa

SEQ ID NO: 755377 - DNA, 20 bp, Artificial
  CRISPR gRNA sequence
ggataaggcaaagtggacca

SEQ ID NO: 755378 - DNA, 20 bp, Artificial
  CRISPR gRNA sequence
cttcatttgcttggtgaaaa

SEQ ID NO: 755379 - DNA, 20 bp, Artificial
  CRISPR gRNA sequence
catttgcttggtgaaaaaaa

SEQ ID NO: 755380 - DNA, 20 bp, Artificial
  CRISPR gRNA sequence
atttgcttggtgaaaaaaac

SEQ ID NO: 755381 - DNA, 20 bp, Artificial
  CRISPR gRNA sequence
gcttggtgaaaaaaaccaaa

SEQ ID NO: 755382 - DNA, 20 bp, Artificial
  CRISPR gRNA sequence
cttggtgaaaaaaaccaaac

SEQ ID NO: 755383 - DNA, 20 bp, Artificial
  CRISPR gRNA sequence
ggtgaaaaaaaccaaacaga

SEQ ID NO: 755384 - DNA, 20 bp, Artificial
  CRISPR gRNA sequence
gtgaaaaaaaccaaacagaa

SEQ ID NO: 755385 - DNA, 20 bp, Artificial
  CRISPR gRNA sequence
gacagttttctaagtttggc

SEQ ID NO: 755386 - DNA, 20 bp, Artificial
  CRISPR gRNA sequence
tctaagtttggctggaagga

SEQ ID NO: 755387 - DNA, 20 bp, Artificial
  CRISPR gRNA sequence
ctaagtttggctggaaggac

SEQ ID NO: 755388 - DNA, 20 bp, Artificial
  CRISPR gRNA sequence
taagtttggctggaaggacg

SEQ ID NO: 755389 - DNA, 20 bp, Artificial
  CRISPR gRNA sequence
agtttggctggaaggacgtg

SEQ ID NO: 755390 - DNA, 20 bp, Artificial
  CRISPR gRNA sequence
ggctggaaggacgtgcatgg

SEQ ID NO: 755391 - DNA, 20 bp, Artificial
  CRISPR gRNA sequence
gctggaaggacgtgcatgga

SEQ ID NO: 755392 - DNA, 20 bp, Artificial
  CRISPR gRNA sequence
gaaggacgtgcatggatgag

SEQ ID NO: 755393 - DNA, 20 bp, Artificial
  CRISPR gRNA sequence
tcatatactctctgtcccgg

SEQ ID NO: 755394 - DNA, 20 bp, Artificial
  CRISPR gRNA sequence
catatactctctgtcccggt

SEQ ID NO: 755395 - DNA, 20 bp, Artificial
  CRISPR gRNA sequence
atatactctctgtcccggtc

SEQ ID NO: 755396 - DNA, 20 bp, Artificial
  CRISPR gRNA sequence
tctgtcccggtccctcagac

SEQ ID NO: 755397 - DNA, 20 bp, Artificial
  CRISPR gRNA sequence
tgtcccggtccctcagacac

SEQ ID NO: 755398 - DNA, 20 bp, Artificial
  CRISPR gRNA sequence
tcccggtccctcagacactg

SEQ ID NO: 755399 - DNA, 20 bp, Artificial
  CRISPR gRNA sequence
agacactgggttttcccatt

SEQ ID NO: 755400 - DNA, 20 bp, Artificial
  CRISPR gRNA sequence
ggttttcccattttcacact

SEQ ID NO: 755401 - DNA, 20 bp, Artificial
  CRISPR gRNA sequence
tcccattttcacactatctt

SEQ ID NO: 755402 - DNA, 20 bp, Artificial
  CRISPR gRNA sequence
cccattttcacactatcttg

SEQ ID NO: 755403 - DNA, 20 bp, Artificial
  CRISPR gRNA sequence
ccattttcacactatcttgc

SEQ ID NO: 755404 - DNA, 20 bp, Artificial
  CRISPR gRNA sequence
tcacactatcttgcctagga

SEQ ID NO: 755405 - DNA, 20 bp, Artificial
  CRISPR gRNA sequence
cacactatcttgcctaggac

SEQ ID NO: 755406 - DNA, 20 bp, Artificial
  CRISPR gRNA sequence
acactatcttgcctaggaca

SEQ ID NO: 755407 - DNA, 20 bp, Artificial
  CRISPR gRNA sequence
tcttgcctaggacacccttt

SEQ ID NO: 755408 - DNA, 20 bp, Artificial
  CRISPR gRNA sequence
gcctaggacaccctttctac

SEQ ID NO: 755409 - DNA, 20 bp, Artificial
  CRISPR gRNA sequence
cctaggacaccctttctact

SEQ ID NO: 755410 - DNA, 20 bp, Artificial
  CRISPR gRNA sequence
ggacaccctttctactggct

SEQ ID NO: 755411 - DNA, 20 bp, Artificial
  CRISPR gRNA sequence
tctactggctgaaatcctat

SEQ ID NO: 755412 - DNA, 20 bp, Artificial
  CRISPR gRNA sequence
ctactggctgaaatcctatc

SEQ ID NO: 755413 - DNA, 20 bp, Artificial
  CRISPR gRNA sequence
tactggctgaaatcctatct

SEQ ID NO: 755414 - DNA, 20 bp, Artificial
  CRISPR gRNA sequence
ctggctgaaatcctatctat

SEQ ID NO: 755415 - DNA, 20 bp, Artificial
  CRISPR gRNA sequence
gctgaaatcctatctatgca

SEQ ID NO: 755416 - DNA, 20 bp, Artificial
  CRISPR gRNA sequence
aaatcctatctatgcaccaa

SEQ ID NO: 755417 - DNA, 20 bp, Artificial
  CRISPR gRNA sequence
tctatgcaccaagtccaaag

SEQ ID NO: 755418 - DNA, 20 bp, Artificial
  CRISPR gRNA sequence
tgcaccaagtccaaagactc

SEQ ID NO: 755419 - DNA, 20 bp, Artificial
  CRISPR gRNA sequence
tccctccttcaggaagtccc

SEQ ID NO: 755420 - DNA, 20 bp, Artificial
  CRISPR gRNA sequence
cctccttcaggaagtccctg

SEQ ID NO: 755421 - DNA, 20 bp, Artificial
  CRISPR gRNA sequence
cttcaggaagtccctgactg

SEQ ID NO: 755422 - DNA, 20 bp, Artificial
  CRISPR gRNA sequence
caggaagtccctgactgtcc

SEQ ID NO: 755423 - DNA, 20 bp, Artificial
  CRISPR gRNA sequence
aggaagtccctgactgtccc

SEQ ID NO: 755424 - DNA, 20 bp, Artificial
  CRISPR gRNA sequence
actgtccccagaaggctgtt

SEQ ID NO: 755425 - DNA, 20 bp, Artificial
  CRISPR gRNA sequence
tccccagaaggctgtttcct

SEQ ID NO: 755426 - DNA, 20 bp, Artificial
  CRISPR gRNA sequence
tttcctccctcctccaagtg

SEQ ID NO: 755427 - DNA, 20 bp, Artificial
  CRISPR gRNA sequence
cctccctcctccaagtgccc

SEQ ID NO: 755428 - DNA, 20 bp, Artificial
  CRISPR gRNA sequence
ctccctcctccaagtgccct

SEQ ID NO: 755429 - DNA, 20 bp, Artificial
  CRISPR gRNA sequence
cctcctccaagtgccctgag

SEQ ID NO: 755430 - DNA, 20 bp, Artificial
  CRISPR gRNA sequence
ctccaagtgccctgagggct

SEQ ID NO: 755431 - DNA, 20 bp, Artificial
  CRISPR gRNA sequence
caagtgccctgagggctggc

SEQ ID NO: 755432 - DNA, 20 bp, Artificial
  CRISPR gRNA sequence
agggctggcattggattgcc

SEQ ID NO: 755433 - DNA, 20 bp, Artificial
  CRISPR gRNA sequence
gcattggattgcctttgcca

SEQ ID NO: 755434 - DNA, 20 bp, Artificial
  CRISPR gRNA sequence
gattgcctttgccatggggt

SEQ ID NO: 755435 - DNA, 20 bp, Artificial
  CRISPR gRNA sequence
cctttgccatggggttctgc

SEQ ID NO: 755436 - DNA, 20 bp, Artificial
  CRISPR gRNA sequence
tgccatggggttctgctgtc

SEQ ID NO: 755437 - DNA, 20 bp, Artificial
  CRISPR gRNA sequence
gccatggggttctgctgtcg

SEQ ID NO: 755438 - DNA, 20 bp, Artificial
  CRISPR gRNA sequence
ccatggggttctgctgtcgg

SEQ ID NO: 755439 - DNA, 20 bp, Artificial
  CRISPR gRNA sequence
tgctgtcgggaatgcaggcc

SEQ ID NO: 755440 - DNA, 20 bp, Artificial
  CRISPR gRNA sequence
ctgtcgggaatgcaggcctc

SEQ ID NO: 755441 - DNA, 20 bp, Artificial
  CRISPR gRNA sequence
tcgggaatgcaggcctcgtc

SEQ ID NO: 755442 - DNA, 20 bp, Artificial
  CRISPR gRNA sequence
gtctgctcaaggggaggcca

SEQ ID NO: 755443 - DNA, 20 bp, Artificial
  CRISPR gRNA sequence
ctcaaggggaggccatgcat

SEQ ID NO: 755444 - DNA, 20 bp, Artificial
  CRISPR gRNA sequence
aaggggaggccatgcattca

SEQ ID NO: 755445 - DNA, 20 bp, Artificial
  CRISPR gRNA sequence
agcatgcaggtgagatgcag

SEQ ID NO: 755446 - DNA, 20 bp, Artificial
  CRISPR gRNA sequence
gcccaggccttgcacacgca

SEQ ID NO: 755447 - DNA, 20 bp, Artificial
  CRISPR gRNA sequence
gcacacgcaggtgctctctt

SEQ ID NO: 755448 - DNA, 20 bp, Artificial
  CRISPR gRNA sequence
cacacgcaggtgctctctta

SEQ ID NO: 755449 - DNA, 20 bp, Artificial
  CRISPR gRNA sequence
tcttagtgctccctggcaag

SEQ ID NO: 755450 - DNA, 20 bp, Artificial
  CRISPR gRNA sequence
ttagtgctccctggcaagga

SEQ ID NO: 755451 - DNA, 20 bp, Artificial
  CRISPR gRNA sequence
agtgctccctggcaaggatg

SEQ ID NO: 755452 - DNA, 20 bp, Artificial
  CRISPR gRNA sequence
gtgctccctggcaaggatgg

SEQ ID NO: 755453 - DNA, 20 bp, Artificial
  CRISPR gRNA sequence
cctggcaaggatgggaaggc

SEQ ID NO: 755454 - DNA, 20 bp, Artificial
  CRISPR gRNA sequence
gcaaggatgggaaggcatgt

SEQ ID NO: 755455 - DNA, 20 bp, Artificial
  CRISPR gRNA sequence
agtcctaggagtaggaaggg

SEQ ID NO: 755456 - DNA, 20 bp, Artificial
  CRISPR gRNA sequence
ggagtaggaaggggcagagg

SEQ ID NO: 755457 - DNA, 20 bp, Artificial
  CRISPR gRNA sequence
atggcccctacagagcggcc

SEQ ID NO: 755458 - DNA, 20 bp, Artificial
  CRISPR gRNA sequence
cagagcggccaaggacaagg

SEQ ID NO: 755459 - DNA, 20 bp, Artificial
  CRISPR gRNA sequence
ctgttcgaaacagccttcct

SEQ ID NO: 755460 - DNA, 20 bp, Artificial
  CRISPR gRNA sequence
ttcgaaacagccttcctgct

SEQ ID NO: 755461 - DNA, 20 bp, Artificial
  CRISPR gRNA sequence
gaaacagccttcctgctccc

SEQ ID NO: 755462 - DNA, 20 bp, Artificial
  CRISPR gRNA sequence
cctgctccccaacctgcctc

SEQ ID NO: 755463 - DNA, 20 bp, Artificial
  CRISPR gRNA sequence
ctgctccccaacctgcctcc

SEQ ID NO: 755464 - DNA, 20 bp, Artificial
  CRISPR gRNA sequence
ctccccaacctgcctcccac

SEQ ID NO: 755465 - DNA, 20 bp, Artificial
  CRISPR gRNA sequence
cccaacctgcctcccaccca

SEQ ID NO: 755466 - DNA, 20 bp, Artificial
  CRISPR gRNA sequence
cctcccacccaacaggtttt

SEQ ID NO: 755467 - DNA, 20 bp, Artificial
  CRISPR gRNA sequence
ccacccaacaggttttgcat

SEQ ID NO: 755468 - DNA, 20 bp, Artificial
  CRISPR gRNA sequence
tgcatatactctactgggaa

SEQ ID NO: 755469 - DNA, 20 bp, Artificial
  CRISPR gRNA sequence
gcatatactctactgggaag

SEQ ID NO: 755470 - DNA, 20 bp, Artificial
  CRISPR gRNA sequence
catatactctactgggaaga

SEQ ID NO: 755471 - DNA, 20 bp, Artificial
  CRISPR gRNA sequence
tactgggaagagggacacac

SEQ ID NO: 755472 - DNA, 20 bp, Artificial
  CRISPR gRNA sequence
ctgggaagagggacacaccc

SEQ ID NO: 755473 - DNA, 20 bp, Artificial
  CRISPR gRNA sequence
ggaagagggacacacccgac

SEQ ID NO: 755474 - DNA, 20 bp, Artificial
  CRISPR gRNA sequence
catcactgccctccaagtct

SEQ ID NO: 755475 - DNA, 20 bp, Artificial
  CRISPR gRNA sequence
ccctccaagtctctccctgc

SEQ ID NO: 755476 - DNA, 20 bp, Artificial
  CRISPR gRNA sequence
caagtctctccctgccctgt

SEQ ID NO: 755477 - DNA, 20 bp, Artificial
  CRISPR gRNA sequence
tccctgccctgtccagcatc

SEQ ID NO: 755478 - DNA, 20 bp, Artificial
  CRISPR gRNA sequence
cctgccctgtccagcatcca

SEQ ID NO: 755479 - DNA, 20 bp, Artificial
  CRISPR gRNA sequence
ccctgtccagcatccaggag

SEQ ID NO: 755480 - DNA, 20 bp, Artificial
  CRISPR gRNA sequence
tccagcatccaggagcaccc

SEQ ID NO: 755481 - DNA, 20 bp, Artificial
  CRISPR gRNA sequence
gttggggaagcttctgtgac

SEQ ID NO: 755482 - DNA, 20 bp, Artificial
  CRISPR gRNA sequence
gggaagcttctgtgactccc

SEQ ID NO: 755483 - DNA, 20 bp, Artificial
  CRISPR gRNA sequence
ctgtgactccccctacaaca

SEQ ID NO: 755484 - DNA, 20 bp, Artificial
  CRISPR gRNA sequence
tgtgactccccctacaacag

SEQ ID NO: 755485 - DNA, 20 bp, Artificial
  CRISPR gRNA sequence
tgactccccctacaacagcc

SEQ ID NO: 755486 - DNA, 20 bp, Artificial
  CRISPR gRNA sequence
cccctacaacagcctaggat

SEQ ID NO: 755487 - DNA, 20 bp, Artificial
  CRISPR gRNA sequence
caacagcctaggatggagtg

SEQ ID NO: 755488 - DNA, 20 bp, Artificial
  CRISPR gRNA sequence
ggatggagtggggtttgtga

SEQ ID NO: 755489 - DNA, 20 bp, Artificial
  CRISPR gRNA sequence
gtgaacaaatgcagaaggca

SEQ ID NO: 755490 - DNA, 20 bp, Artificial
  CRISPR gRNA sequence
tgaacaaatgcagaaggcag

SEQ ID NO: 755491 - DNA, 20 bp, Artificial
  CRISPR gRNA sequence
agggaggtcagctgacatgc

SEQ ID NO: 755492 - DNA, 20 bp, Artificial
  CRISPR gRNA sequence
gggaggtcagctgacatgcc

SEQ ID NO: 755493 - DNA, 20 bp, Artificial
  CRISPR gRNA sequence
acatgcccctggcctgtggc

SEQ ID NO: 755494 - DNA, 20 bp, Artificial
  CRISPR gRNA sequence
gcctgtggctgggaagtagc

SEQ ID NO: 755495 - DNA, 20 bp, Artificial
  CRISPR gRNA sequence
tggctgggaagtagcagagg

SEQ ID NO: 755496 - DNA, 20 bp, Artificial
  CRISPR gRNA sequence
ggaagtagcagaggctaagg

SEQ ID NO: 755497 - DNA, 20 bp, Artificial
  CRISPR gRNA sequence
aggttcttccccgctctggg

SEQ ID NO: 755498 - DNA, 20 bp, Artificial
  CRISPR gRNA sequence
ttccccgctctggggttgcc

SEQ ID NO: 755499 - DNA, 20 bp, Artificial
  CRISPR gRNA sequence
ccccgctctggggttgccag

SEQ ID NO: 755500 - DNA, 20 bp, Artificial
  CRISPR gRNA sequence
cccgctctggggttgccagg

SEQ ID NO: 755501 - DNA, 20 bp, Artificial
  CRISPR gRNA sequence
tggggttgccaggagtagca

SEQ ID NO: 755502 - DNA, 20 bp, Artificial
  CRISPR gRNA sequence
gggttgccaggagtagcact

SEQ ID NO: 755503 - DNA, 20 bp, Artificial
  CRISPR gRNA sequence
ccaggagtagcactggatca

SEQ ID NO: 755504 - DNA, 20 bp, Artificial
  CRISPR gRNA sequence
gatcagtcaggtgacagggc

SEQ ID NO: 755505 - DNA, 20 bp, Artificial
  CRISPR gRNA sequence
tcctctctctgagcaggtcc

SEQ ID NO: 755506 - DNA, 20 bp, Artificial
  CRISPR gRNA sequence
ctctctctgagcaggtccgg

SEQ ID NO: 755507 - DNA, 20 bp, Artificial
  CRISPR gRNA sequence
tctctgagcaggtccggtgg

SEQ ID NO: 755508 - DNA, 20 bp, Artificial
  CRISPR gRNA sequence
tctgagcaggtccggtggca

SEQ ID NO: 755509 - DNA, 20 bp, Artificial
  CRISPR gRNA sequence
tgagcaggtccggtggcagc

SEQ ID NO: 755510 - DNA, 20 bp, Artificial
  CRISPR gRNA sequence
agcaggtccggtggcagcct

SEQ ID NO: 755511 - DNA, 20 bp, Artificial
  CRISPR gRNA sequence
caaggtcgccacgccgtatt

SEQ ID NO: 755512 - DNA, 20 bp, Artificial
  CRISPR gRNA sequence
aaggtcgccacgccgtattc

SEQ ID NO: 755513 - DNA, 20 bp, Artificial
  CRISPR gRNA sequence
cctgtatgtctgtcccgagg

SEQ ID NO: 755514 - DNA, 20 bp, Artificial
  CRISPR gRNA sequence
tatgtctgtcccgaggggca

SEQ ID NO: 755515 - DNA, 20 bp, Artificial
  CRISPR gRNA sequence
tcccgaggggcagaacgtca

SEQ ID NO: 755516 - DNA, 20 bp, Artificial
  CRISPR gRNA sequence
acctgcaggctcttgggccc

SEQ ID NO: 755517 - DNA, 20 bp, Artificial
  CRISPR gRNA sequence
caggctcttgggccctgtgg

SEQ ID NO: 755518 - DNA, 20 bp, Artificial
  CRISPR gRNA sequence
ttgggccctgtggacaaagg

SEQ ID NO: 755519 - DNA, 20 bp, Artificial
  CRISPR gRNA sequence
gggccctgtggacaaagggc

SEQ ID NO: 755520 - DNA, 20 bp, Artificial
  CRISPR gRNA sequence
ggccctgtggacaaagggca

SEQ ID NO: 755521 - DNA, 20 bp, Artificial
  CRISPR gRNA sequence
tggacaaagggcacgatgtg

SEQ ID NO: 755522 - DNA, 20 bp, Artificial
  CRISPR gRNA sequence
ctacaagacgtggtaccgca

SEQ ID NO: 755523 - DNA, 20 bp, Artificial
  CRISPR gRNA sequence
tacaagacgtggtaccgcag

SEQ ID NO: 755524 - DNA, 20 bp, Artificial
  CRISPR gRNA sequence
caagacgtggtaccgcagct

SEQ ID NO: 755525 - DNA, 20 bp, Artificial
  CRISPR gRNA sequence
gaggggcgaggtgcagacct

SEQ ID NO: 755526 - DNA, 20 bp, Artificial
  CRISPR gRNA sequence
ctcagagcgccggcccatcc

SEQ ID NO: 755527 - DNA, 20 bp, Artificial
  CRISPR gRNA sequence
agagcgccggcccatccgca

SEQ ID NO: 755528 - DNA, 20 bp, Artificial
  CRISPR gRNA sequence
acgttccaggaccttcacct

SEQ ID NO: 755529 - DNA, 20 bp, Artificial
  CRISPR gRNA sequence
caggaccttcacctgcacca

SEQ ID NO: 755530 - DNA, 20 bp, Artificial
  CRISPR gRNA sequence
cacctgcaccatggaggcca

SEQ ID NO: 755531 - DNA, 20 bp, Artificial
  CRISPR gRNA sequence
acctgcaccatggaggccac

SEQ ID NO: 755532 - DNA, 20 bp, Artificial
  CRISPR gRNA sequence
caccatggaggccaccaggc

SEQ ID NO: 755533 - DNA, 20 bp, Artificial
  CRISPR gRNA sequence
ccaacaccagccacgacctg

SEQ ID NO: 755534 - DNA, 20 bp, Artificial
  CRISPR gRNA sequence
gctcagcgccacgggctgga

SEQ ID NO: 755535 - DNA, 20 bp, Artificial
  CRISPR gRNA sequence
agcgccacgggctggagtcg

SEQ ID NO: 755536 - DNA, 20 bp, Artificial
  CRISPR gRNA sequence
gagtcggcctccgaccacca

SEQ ID NO: 755537 - DNA, 20 bp, Artificial
  CRISPR gRNA sequence
cgaccaccatggcaacttct

SEQ ID NO: 755538 - DNA, 20 bp, Artificial
  CRISPR gRNA sequence
ctccatcaccatgcgcaacc

SEQ ID NO: 755539 - DNA, 20 bp, Artificial
  CRISPR gRNA sequence
tccatcaccatgcgcaacct

SEQ ID NO: 755540 - DNA, 20 bp, Artificial
  CRISPR gRNA sequence
catcaccatgcgcaacctga

SEQ ID NO: 755541 - DNA, 20 bp, Artificial
  CRISPR gRNA sequence
accctgctggatagcggcct

SEQ ID NO: 755542 - DNA, 20 bp, Artificial
  CRISPR gRNA sequence
ctggatagcggcctctactg

SEQ ID NO: 755543 - DNA, 20 bp, Artificial
  CRISPR gRNA sequence
gatagcggcctctactgctg

SEQ ID NO: 755544 - DNA, 20 bp, Artificial
  CRISPR gRNA sequence
tactgctgcctggtggtgga

SEQ ID NO: 755545 - DNA, 20 bp, Artificial
  CRISPR gRNA sequence
ctgctgcctggtggtggaga

SEQ ID NO: 755546 - DNA, 20 bp, Artificial
  CRISPR gRNA sequence
ctgcctggtggtggagatca

SEQ ID NO: 755547 - DNA, 20 bp, Artificial
  CRISPR gRNA sequence
cctggtggtggagatcaggc

SEQ ID NO: 755548 - DNA, 20 bp, Artificial
  CRISPR gRNA sequence
gtggtggagatcaggcacca

SEQ ID NO: 755549 - DNA, 20 bp, Artificial
  CRISPR gRNA sequence
ggagcacagggtccatggtg

SEQ ID NO: 755550 - DNA, 20 bp, Artificial
  CRISPR gRNA sequence
caggtgcagacaggtgaggg

SEQ ID NO: 755551 - DNA, 20 bp, Artificial
  CRISPR gRNA sequence
cacgtgacagcctggcgtgt

SEQ ID NO: 755552 - DNA, 20 bp, Artificial
  CRISPR gRNA sequence
gcgtgtgtggagggctgcct

SEQ ID NO: 755553 - DNA, 20 bp, Artificial
  CRISPR gRNA sequence
cctgtctgatggtgtgacca

SEQ ID NO: 755554 - DNA, 20 bp, Artificial
  CRISPR gRNA sequence
tctgatggtgtgaccattca

SEQ ID NO: 755555 - DNA, 20 bp, Artificial
  CRISPR gRNA sequence
atggtgtgaccattcatgac

SEQ ID NO: 755556 - DNA, 20 bp, Artificial
  CRISPR gRNA sequence
atgacactgtgctgggcaga

SEQ ID NO: 755557 - DNA, 20 bp, Artificial
  CRISPR gRNA sequence
tgctgggcagagtgtgaggc

SEQ ID NO: 755558 - DNA, 20 bp, Artificial
  CRISPR gRNA sequence
ggcagagtgtgaggctgcat

SEQ ID NO: 755559 - DNA, 20 bp, Artificial
  CRISPR gRNA sequence
catgggtaacactggcactc

SEQ ID NO: 755560 - DNA, 20 bp, Artificial
  CRISPR gRNA sequence
gcactccagggagtgtgtgg

SEQ ID NO: 755561 - DNA, 20 bp, Artificial
  CRISPR gRNA sequence
cagggagtgtgtgggtgaga

SEQ ID NO: 755562 - DNA, 20 bp, Artificial
  CRISPR gRNA sequence
gtagttagctggagtgatgg

SEQ ID NO: 755563 - DNA, 20 bp, Artificial
  CRISPR gRNA sequence
tagttagctggagtgatgga

SEQ ID NO: 755564 - DNA, 20 bp, Artificial
  CRISPR gRNA sequence
gctggagtgatggagaggga

SEQ ID NO: 755565 - DNA, 20 bp, Artificial
  CRISPR gRNA sequence
gagtgatggagagggagggt

SEQ ID NO: 755566 - DNA, 20 bp, Artificial
  CRISPR gRNA sequence
gctccatttgtgacagtgag

SEQ ID NO: 755567 - DNA, 20 bp, Artificial
  CRISPR gRNA sequence
catttgtgacagtgagactt

SEQ ID NO: 755568 - DNA, 20 bp, Artificial
  CRISPR gRNA sequence
gtgacagtgagactttttaa

SEQ ID NO: 755569 - DNA, 20 bp, Artificial
  CRISPR gRNA sequence
tgacagtgagactttttaat

SEQ ID NO: 755570 - DNA, 20 bp, Artificial
  CRISPR gRNA sequence
tttaatgtgtgaggctgtag

SEQ ID NO: 755571 - DNA, 20 bp, Artificial
  CRISPR gRNA sequence
ttaatgtgtgaggctgtagg

SEQ ID NO: 755572 - DNA, 20 bp, Artificial
  CRISPR gRNA sequence
taatgtgtgaggctgtaggt

SEQ ID NO: 755573 - DNA, 20 bp, Artificial
  CRISPR gRNA sequence
aatgtgtgaggctgtaggta

SEQ ID NO: 755574 - DNA, 20 bp, Artificial
  CRISPR gRNA sequence
atgtgtgaggctgtaggtac

SEQ ID NO: 755575 - DNA, 20 bp, Artificial
  CRISPR gRNA sequence
taggtacctgggctgggagt

SEQ ID NO: 755576 - DNA, 20 bp, Artificial
  CRISPR gRNA sequence
ggctgggagtgtgactgctc

SEQ ID NO: 755577 - DNA, 20 bp, Artificial
  CRISPR gRNA sequence
ggagtgtgactgctcatgat

SEQ ID NO: 755578 - DNA, 20 bp, Artificial
  CRISPR gRNA sequence
ctcatgatgacatcatggct

SEQ ID NO: 755579 - DNA, 20 bp, Artificial
  CRISPR gRNA sequence
atgatgacatcatggctgct

SEQ ID NO: 755580 - DNA, 20 bp, Artificial
  CRISPR gRNA sequence
ctgtgggtataggcatcagt

SEQ ID NO: 755581 - DNA, 20 bp, Artificial
  CRISPR gRNA sequence
tgggtataggcatcagtggg

SEQ ID NO: 755582 - DNA, 20 bp, Artificial
  CRISPR gRNA sequence
attggtgccctggggcatga

SEQ ID NO: 755583 - DNA, 20 bp, Artificial
  CRISPR gRNA sequence
gtgccctggggcatgactca

SEQ ID NO: 755584 - DNA, 20 bp, Artificial
  CRISPR gRNA sequence
gggcatgactcagtggatgg

SEQ ID NO: 755585 - DNA, 20 bp, Artificial
  CRISPR gRNA sequence
agtggatggctgaatggctg

SEQ ID NO: 755586 - DNA, 20 bp, Artificial
  CRISPR gRNA sequence
aatggctgttggagaatata

SEQ ID NO: 755587 - DNA, 20 bp, Artificial
  CRISPR gRNA sequence
ttggagaatatatgcgtgtg

SEQ ID NO: 755588 - DNA, 20 bp, Artificial
  CRISPR gRNA sequence
gagaatatatgcgtgtgtgt

SEQ ID NO: 755589 - DNA, 20 bp, Artificial
  CRISPR gRNA sequence
tctgttcaggtgagagtgca

SEQ ID NO: 755590 - DNA, 20 bp, Artificial
  CRISPR gRNA sequence
ttcaggtgagagtgcaaggg

SEQ ID NO: 755591 - DNA, 20 bp, Artificial
  CRISPR gRNA sequence
aggtgagagtgcaagggccc

SEQ ID NO: 755592 - DNA, 20 bp, Artificial
  CRISPR gRNA sequence
ggatagaggtgtgggcacca

SEQ ID NO: 755593 - DNA, 20 bp, Artificial
  CRISPR gRNA sequence
acatgcccctgggagtggca

SEQ ID NO: 755594 - DNA, 20 bp, Artificial
  CRISPR gRNA sequence
ggagtggcatgaaaatgggc

SEQ ID NO: 755595 - DNA, 20 bp, Artificial
  CRISPR gRNA sequence
ccactgggccaacactgccg

SEQ ID NO: 755596 - DNA, 20 bp, Artificial
  CRISPR gRNA sequence
ggccaacactgccgagtagg

SEQ ID NO: 755597 - DNA, 20 bp, Artificial
  CRISPR gRNA sequence
ccgagtaggcactagcgtga

SEQ ID NO: 755598 - DNA, 20 bp, Artificial
  CRISPR gRNA sequence
gcgtgagaacctggggcagg

SEQ ID NO: 755599 - DNA, 20 bp, Artificial
  CRISPR gRNA sequence
gggcaggagggggacactgg

SEQ ID NO: 755600 - DNA, 20 bp, Artificial
  CRISPR gRNA sequence
gcctggacaagcctccctgg

SEQ ID NO: 755601 - DNA, 20 bp, Artificial
  CRISPR gRNA sequence
gacaagcctccctggcctcc

SEQ ID NO: 755602 - DNA, 20 bp, Artificial
  CRISPR gRNA sequence
cctggcctcctgggcctgac

SEQ ID NO: 755603 - DNA, 20 bp, Artificial
  CRISPR gRNA sequence
gcctcctgggcctgacaccc

SEQ ID NO: 755604 - DNA, 20 bp, Artificial
  CRISPR gRNA sequence
ctgggcctgacacccaccta

SEQ ID NO: 755605 - DNA, 20 bp, Artificial
  CRISPR gRNA sequence
ggcctgacacccacctaatg

SEQ ID NO: 755606 - DNA, 20 bp, Artificial
  CRISPR gRNA sequence
acacccacctaatggccctt

SEQ ID NO: 755607 - DNA, 20 bp, Artificial
  CRISPR gRNA sequence
atggcccttctgtttgttcc

SEQ ID NO: 755608 - DNA, 20 bp, Artificial
  CRISPR gRNA sequence
ctgtttgttcccacaggcaa

SEQ ID NO: 755609 - DNA, 20 bp, Artificial
  CRISPR gRNA sequence
tgtttgttcccacaggcaaa

SEQ ID NO: 755610 - DNA, 20 bp, Artificial
  CRISPR gRNA sequence
tttgttcccacaggcaaaga

SEQ ID NO: 755611 - DNA, 20 bp, Artificial
  CRISPR gRNA sequence
gttcccacaggcaaagatgc

SEQ ID NO: 755612 - DNA, 20 bp, Artificial
  CRISPR gRNA sequence
ttcccacaggcaaagatgca

SEQ ID NO: 755613 - DNA, 20 bp, Artificial
  CRISPR gRNA sequence
ccacaggcaaagatgcacca

SEQ ID NO: 755614 - DNA, 20 bp, Artificial
  CRISPR gRNA sequence
tgtggtgtacccatcctcct

SEQ ID NO: 755615 - DNA, 20 bp, Artificial
  CRISPR gRNA sequence
ctcccaggatagtgaaagta

SEQ ID NO: 755616 - DNA, 20 bp, Artificial
  CRISPR gRNA sequence
ccaggatagtgaaagtaagg

SEQ ID NO: 755617 - DNA, 20 bp, Artificial
  CRISPR gRNA sequence
ttgccccttttgggttctct

SEQ ID NO: 755618 - DNA, 20 bp, Artificial
  CRISPR gRNA sequence
gccccttttgggttctctgt

SEQ ID NO: 755619 - DNA, 20 bp, Artificial
  CRISPR gRNA sequence
ccccttttgggttctctgtt

SEQ ID NO: 755620 - DNA, 20 bp, Artificial
  CRISPR gRNA sequence
ttgggttctctgttttcttc

SEQ ID NO: 755621 - DNA, 20 bp, Artificial
  CRISPR gRNA sequence
tgggttctctgttttcttct

SEQ ID NO: 755622 - DNA, 20 bp, Artificial
  CRISPR gRNA sequence
gggttctctgttttcttctg

SEQ ID NO: 755623 - DNA, 20 bp, Artificial
  CRISPR gRNA sequence
ggttctctgttttcttctgt

SEQ ID NO: 755624 - DNA, 20 bp, Artificial
  CRISPR gRNA sequence
tctgttttcttctgtcctca

SEQ ID NO: 755625 - DNA, 20 bp, Artificial
  CRISPR gRNA sequence
tgttttcttctgtcctcatc

SEQ ID NO: 755626 - DNA, 20 bp, Artificial
  CRISPR gRNA sequence
ttttcttctgtcctcatcct

SEQ ID NO: 755627 - DNA, 20 bp, Artificial
  CRISPR gRNA sequence
tcttctgtcctcatcctgca

SEQ ID NO: 755628 - DNA, 20 bp, Artificial
  CRISPR gRNA sequence
cttctgtcctcatcctgcac

SEQ ID NO: 755629 - DNA, 20 bp, Artificial
  CRISPR gRNA sequence
ttctgtcctcatcctgcacc

SEQ ID NO: 755630 - DNA, 20 bp, Artificial
  CRISPR gRNA sequence
ctgtcctcatcctgcaccca

SEQ ID NO: 755631 - DNA, 20 bp, Artificial
  CRISPR gRNA sequence
tgtcctcatcctgcacccag

SEQ ID NO: 755632 - DNA, 20 bp, Artificial
  CRISPR gRNA sequence
tcctcatcctgcacccagac

SEQ ID NO: 755633 - DNA, 20 bp, Artificial
  CRISPR gRNA sequence
atcctgcacccagaccctgt

SEQ ID NO: 755634 - DNA, 20 bp, Artificial
  CRISPR gRNA sequence
cacccagaccctgtttggaa

SEQ ID NO: 755635 - DNA, 20 bp, Artificial
  CRISPR gRNA sequence
tttggaactctggcctcatc

SEQ ID NO: 755636 - DNA, 20 bp, Artificial
  CRISPR gRNA sequence
ggaactctggcctcatcacc

SEQ ID NO: 755637 - DNA, 20 bp, Artificial
  CRISPR gRNA sequence
gaactctggcctcatcaccc

SEQ ID NO: 755638 - DNA, 20 bp, Artificial
  CRISPR gRNA sequence
tggcctcatcaccccaagcc

SEQ ID NO: 755639 - DNA, 20 bp, Artificial
  CRISPR gRNA sequence
gcctcatcaccccaagccct

SEQ ID NO: 755640 - DNA, 20 bp, Artificial
  CRISPR gRNA sequence
atcaccccaagccctcagaa

SEQ ID NO: 755641 - DNA, 20 bp, Artificial
  CRISPR gRNA sequence
agaaccccccggtcctcctc

SEQ ID NO: 755642 - DNA, 20 bp, Artificial
  CRISPR gRNA sequence
ctccttttctgctgctgcac

SEQ ID NO: 755643 - DNA, 20 bp, Artificial
  CRISPR gRNA sequence
cttttctgctgctgcacatc

SEQ ID NO: 755644 - DNA, 20 bp, Artificial
  CRISPR gRNA sequence
ttctgctgctgcacatccct

SEQ ID NO: 755645 - DNA, 20 bp, Artificial
  CRISPR gRNA sequence
tctgctgctgcacatccctt

SEQ ID NO: 755646 - DNA, 20 bp, Artificial
  CRISPR gRNA sequence
ctgctgctgcacatcccttc

SEQ ID NO: 755647 - DNA, 20 bp, Artificial
  CRISPR gRNA sequence
tgctgctgcacatcccttct

SEQ ID NO: 755648 - DNA, 20 bp, Artificial
  CRISPR gRNA sequence
ctgctgcacatcccttctgc

SEQ ID NO: 755649 - DNA, 20 bp, Artificial
  CRISPR gRNA sequence
ctgcacatcccttctgcttc

SEQ ID NO: 755650 - DNA, 20 bp, Artificial
  CRISPR gRNA sequence
cacatcccttctgcttcctc

SEQ ID NO: 755651 - DNA, 20 bp, Artificial
  CRISPR gRNA sequence
ctgcttcctccttggtgcaa

SEQ ID NO: 755652 - DNA, 20 bp, Artificial
  CRISPR gRNA sequence
tgcttcctccttggtgcaat

SEQ ID NO: 755653 - DNA, 20 bp, Artificial
  CRISPR gRNA sequence
cttcctccttggtgcaatcc

SEQ ID NO: 755654 - DNA, 20 bp, Artificial
  CRISPR gRNA sequence
cctccttggtgcaatcccca

SEQ ID NO: 755655 - DNA, 20 bp, Artificial
  CRISPR gRNA sequence
ctccttggtgcaatccccag

SEQ ID NO: 755656 - DNA, 20 bp, Artificial
  CRISPR gRNA sequence
cttggtgcaatccccagaag

SEQ ID NO: 755657 - DNA, 20 bp, Artificial
  CRISPR gRNA sequence
ggtgcaatccccagaagccc

SEQ ID NO: 755658 - DNA, 20 bp, Artificial
  CRISPR gRNA sequence
gtgcaatccccagaagccca

SEQ ID NO: 755659 - DNA, 20 bp, Artificial
  CRISPR gRNA sequence
tccttccatctgctctggag

SEQ ID NO: 755660 - DNA, 20 bp, Artificial
  CRISPR gRNA sequence
cttccatctgctctggagtc

SEQ ID NO: 755661 - DNA, 20 bp, Artificial
  CRISPR gRNA sequence
ccatctgctctggagtctct

SEQ ID NO: 755662 - DNA, 20 bp, Artificial
  CRISPR gRNA sequence
catctgctctggagtctctg

SEQ ID NO: 755663 - DNA, 20 bp, Artificial
  CRISPR gRNA sequence
ctctggagtctctgctcctc

SEQ ID NO: 755664 - DNA, 20 bp, Artificial
  CRISPR gRNA sequence
tggagtctctgctcctcttg

SEQ ID NO: 755665 - DNA, 20 bp, Artificial
  CRISPR gRNA sequence
gagtctctgctcctcttgac

SEQ ID NO: 755666 - DNA, 20 bp, Artificial
  CRISPR gRNA sequence
tgctcctcttgactctctgg

SEQ ID NO: 755667 - DNA, 20 bp, Artificial
  CRISPR gRNA sequence
ctcctcttgactctctggag

SEQ ID NO: 755668 - DNA, 20 bp, Artificial
  CRISPR gRNA sequence
ctcttgactctctggagtgg

SEQ ID NO: 755669 - DNA, 20 bp, Artificial
  CRISPR gRNA sequence
ttgactctctggagtggctg

SEQ ID NO: 755670 - DNA, 20 bp, Artificial
  CRISPR gRNA sequence
gactctctggagtggctgtg

SEQ ID NO: 755671 - DNA, 20 bp, Artificial
  CRISPR gRNA sequence
actctctggagtggctgtgc

SEQ ID NO: 755672 - DNA, 20 bp, Artificial
  CRISPR gRNA sequence
tctggagtggctgtgccttg

SEQ ID NO: 755673 - DNA, 20 bp, Artificial
  CRISPR gRNA sequence
tggagtggctgtgccttggc

SEQ ID NO: 755674 - DNA, 20 bp, Artificial
  CRISPR gRNA sequence
gagtggctgtgccttggcag

SEQ ID NO: 755675 - DNA, 20 bp, Artificial
  CRISPR gRNA sequence
tgccttggcagtgacctttg

SEQ ID NO: 755676 - DNA, 20 bp, Artificial
  CRISPR gRNA sequence
ggcagtgacctttggccagg

SEQ ID NO: 755677 - DNA, 20 bp, Artificial
  CRISPR gRNA sequence
gcagtgacctttggccaggg

SEQ ID NO: 755678 - DNA, 20 bp, Artificial
  CRISPR gRNA sequence
tggccagggcaagtgcctca

SEQ ID NO: 755679 - DNA, 20 bp, Artificial
  CRISPR gRNA sequence
ggccagggcaagtgcctcat

SEQ ID NO: 755680 - DNA, 20 bp, Artificial
  CRISPR gRNA sequence
gccagggcaagtgcctcatg

SEQ ID NO: 755681 - DNA, 20 bp, Artificial
  CRISPR gRNA sequence
atgacaggtactgggtgccc

SEQ ID NO: 755682 - DNA, 20 bp, Artificial
  CRISPR gRNA sequence
ggtgccccaggcagctaagt

SEQ ID NO: 755683 - DNA, 20 bp, Artificial
  CRISPR gRNA sequence
agtgccgccctgcccaccag

SEQ ID NO: 755684 - DNA, 20 bp, Artificial
  CRISPR gRNA sequence
cccaccagccccctatggct

SEQ ID NO: 755685 - DNA, 20 bp, Artificial
  CRISPR gRNA sequence
tggcttgggaaggctggggg

SEQ ID NO: 755686 - DNA, 20 bp, Artificial
  CRISPR gRNA sequence
gggaaggctgggggtcctct

SEQ ID NO: 755687 - DNA, 20 bp, Artificial
  CRISPR gRNA sequence
ggaaggctgggggtcctctt

SEQ ID NO: 755688 - DNA, 20 bp, Artificial
  CRISPR gRNA sequence
ggggtcctcttggcctagaa

SEQ ID NO: 755689 - DNA, 20 bp, Artificial
  CRISPR gRNA sequence
ttggcctagaattaaactac

SEQ ID NO: 755690 - DNA, 20 bp, Artificial
  CRISPR gRNA sequence
ggcctagaattaaactactt

SEQ ID NO: 755691 - DNA, 20 bp, Artificial
  CRISPR gRNA sequence
gcctagaattaaactacttc

SEQ ID NO: 755692 - DNA, 20 bp, Artificial
  CRISPR gRNA sequence
gaattaaactacttcagatt

SEQ ID NO: 755693 - DNA, 20 bp, Artificial
  CRISPR gRNA sequence
aactacttcagatttctgtg

SEQ ID NO: 755694 - DNA, 20 bp, Artificial
  CRISPR gRNA sequence
cttcagatttctgtgttctg

SEQ ID NO: 755695 - DNA, 20 bp, Artificial
  CRISPR gRNA sequence
cagatttctgtgttctgtgt

SEQ ID NO: 755696 - DNA, 20 bp, Artificial
  CRISPR gRNA sequence
agatttctgtgttctgtgtt

SEQ ID NO: 755697 - DNA, 20 bp, Artificial
  CRISPR gRNA sequence
ctgtgttctgtgtttctatg

SEQ ID NO: 755698 - DNA, 20 bp, Artificial
  CRISPR gRNA sequence
tgtgttctgtgtttctatgt

SEQ ID NO: 755699 - DNA, 20 bp, Artificial
  CRISPR gRNA sequence
tgttctgtgtttctatgttc

SEQ ID NO: 755700 - DNA, 20 bp, Artificial
  CRISPR gRNA sequence
tgtgtttctatgttcttcag

SEQ ID NO: 755701 - DNA, 20 bp, Artificial
  CRISPR gRNA sequence
tgtttctatgttcttcagat

SEQ ID NO: 755702 - DNA, 20 bp, Artificial
  CRISPR gRNA sequence
ctatgttcttcagatgttct

SEQ ID NO: 755703 - DNA, 20 bp, Artificial
  CRISPR gRNA sequence
tatgttcttcagatgttctc

SEQ ID NO: 755704 - DNA, 20 bp, Artificial
  CRISPR gRNA sequence
tgttcttcagatgttctctg

SEQ ID NO: 755705 - DNA, 20 bp, Artificial
  CRISPR gRNA sequence
ttcagatgttctctgttgca

SEQ ID NO: 755706 - DNA, 20 bp, Artificial
  CRISPR gRNA sequence
cagatgttctctgttgcagg

SEQ ID NO: 755707 - DNA, 20 bp, Artificial
  CRISPR gRNA sequence
agatgttctctgttgcaggg

SEQ ID NO: 755708 - DNA, 20 bp, Artificial
  CRISPR gRNA sequence
tctgttgcaggggagggagg

SEQ ID NO: 755709 - DNA, 20 bp, Artificial
  CRISPR gRNA sequence
tgttgcaggggagggaggag

SEQ ID NO: 755710 - DNA, 20 bp, Artificial
  CRISPR gRNA sequence
ttgcaggggagggaggagga

SEQ ID NO: 755711 - DNA, 20 bp, Artificial
  CRISPR gRNA sequence
caggggagggaggaggaaga

SEQ ID NO: 755712 - DNA, 20 bp, Artificial
  CRISPR gRNA sequence
aggaaggggaacagaactac

SEQ ID NO: 755713 - DNA, 20 bp, Artificial
  CRISPR gRNA sequence
cctttcctgagttcccactg

SEQ ID NO: 755714 - DNA, 20 bp, Artificial
  CRISPR gRNA sequence
tcctgagttcccactgtgct

SEQ ID NO: 755715 - DNA, 20 bp, Artificial
  CRISPR gRNA sequence
cctgagttcccactgtgctg

SEQ ID NO: 755716 - DNA, 20 bp, Artificial
  CRISPR gRNA sequence
ctgagttcccactgtgctgg

SEQ ID NO: 755717 - DNA, 20 bp, Artificial
  CRISPR gRNA sequence
agttcccactgtgctgggca

SEQ ID NO: 755718 - DNA, 20 bp, Artificial
  CRISPR gRNA sequence
ccactgtgctgggcactgga

SEQ ID NO: 755719 - DNA, 20 bp, Artificial
  CRISPR gRNA sequence
tgctgggcactggactaagt

SEQ ID NO: 755720 - DNA, 20 bp, Artificial
  CRISPR gRNA sequence
ggcactggactaagtctttt

SEQ ID NO: 755721 - DNA, 20 bp, Artificial
  CRISPR gRNA sequence
gactaagtctttttaagtat

SEQ ID NO: 755722 - DNA, 20 bp, Artificial
  CRISPR gRNA sequence
agtctttttaagtattatta

SEQ ID NO: 755723 - DNA, 20 bp, Artificial
  CRISPR gRNA sequence
tttaagtattattatctcag

SEQ ID NO: 755724 - DNA, 20 bp, Artificial
  CRISPR gRNA sequence
ttaagtattattatctcagg

SEQ ID NO: 755725 - DNA, 20 bp, Artificial
  CRISPR gRNA sequence
taagtattattatctcaggg

SEQ ID NO: 755726 - DNA, 20 bp, Artificial
  CRISPR gRNA sequence
aagtattattatctcaggga

SEQ ID NO: 755727 - DNA, 20 bp, Artificial
  CRISPR gRNA sequence
agtattattatctcagggat

SEQ ID NO: 755728 - DNA, 20 bp, Artificial
  CRISPR gRNA sequence
ttatctcagggatatatata

SEQ ID NO: 755729 - DNA, 20 bp, Artificial
  CRISPR gRNA sequence
tctcagggatatatatatat

SEQ ID NO: 755730 - DNA, 20 bp, Artificial
  CRISPR gRNA sequence
agggatatatatatatatat

SEQ ID NO: 755731 - DNA, 20 bp, Artificial
  CRISPR gRNA sequence
tctgaaacacggtttcactc

SEQ ID NO: 755732 - DNA, 20 bp, Artificial
  CRISPR gRNA sequence
ctgaaacacggtttcactct

SEQ ID NO: 755733 - DNA, 20 bp, Artificial
  CRISPR gRNA sequence
tgaaacacggtttcactctg

SEQ ID NO: 755734 - DNA, 20 bp, Artificial
  CRISPR gRNA sequence
aaacacggtttcactctgtt

SEQ ID NO: 755735 - DNA, 20 bp, Artificial
  CRISPR gRNA sequence
cactctgttacccaggctgg

SEQ ID NO: 755736 - DNA, 20 bp, Artificial
  CRISPR gRNA sequence
actctgttacccaggctgga

SEQ ID NO: 755737 - DNA, 20 bp, Artificial
  CRISPR gRNA sequence
tgttacccaggctggagtgc

SEQ ID NO: 755738 - DNA, 20 bp, Artificial
  CRISPR gRNA sequence
ttacccaggctggagtgcag

SEQ ID NO: 755739 - DNA, 20 bp, Artificial
  CRISPR gRNA sequence
cccaggctggagtgcagtgg

SEQ ID NO: 755740 - DNA, 20 bp, Artificial
  CRISPR gRNA sequence
gagtgcagtggcgcgatctg

SEQ ID NO: 755741 - DNA, 20 bp, Artificial
  CRISPR gRNA sequence
ggctcactgcaacctccgcc

SEQ ID NO: 755742 - DNA, 20 bp, Artificial
  CRISPR gRNA sequence
actgcaacctccgcctcccg

SEQ ID NO: 755743 - DNA, 20 bp, Artificial
  CRISPR gRNA sequence
caacctccgcctcccggatt

SEQ ID NO: 755744 - DNA, 20 bp, Artificial
  CRISPR gRNA sequence
cgcctcccggattcaagcga

SEQ ID NO: 755745 - DNA, 20 bp, Artificial
  CRISPR gRNA sequence
ccggattcaagcgattcttc

SEQ ID NO: 755746 - DNA, 20 bp, Artificial
  CRISPR gRNA sequence
aagcgattcttctgcctcag

SEQ ID NO: 755747 - DNA, 20 bp, Artificial
  CRISPR gRNA sequence
ttctgcctcagcctcccgag

SEQ ID NO: 755748 - DNA, 20 bp, Artificial
  CRISPR gRNA sequence
ctgcctcagcctcccgagta

SEQ ID NO: 755749 - DNA, 20 bp, Artificial
  CRISPR gRNA sequence
tgcctcagcctcccgagtag

SEQ ID NO: 755750 - DNA, 20 bp, Artificial
  CRISPR gRNA sequence
cctcagcctcccgagtagct

SEQ ID NO: 755751 - DNA, 20 bp, Artificial
  CRISPR gRNA sequence
agcctcccgagtagctagga

SEQ ID NO: 755752 - DNA, 20 bp, Artificial
  CRISPR gRNA sequence
ccgagtagctaggatgagat

SEQ ID NO: 755753 - DNA, 20 bp, Artificial
  CRISPR gRNA sequence
ggatgagattacaggcgtgc

SEQ ID NO: 755754 - DNA, 20 bp, Artificial
  CRISPR gRNA sequence
caggcgtgcaccacaatgcc

SEQ ID NO: 755755 - DNA, 20 bp, Artificial
  CRISPR gRNA sequence
gctaatttttgtatttttag

SEQ ID NO: 755756 - DNA, 20 bp, Artificial
  CRISPR gRNA sequence
atttttgtatttttagtgga

SEQ ID NO: 755757 - DNA, 20 bp, Artificial
  CRISPR gRNA sequence
ttgtatttttagtggagctg

SEQ ID NO: 755758 - DNA, 20 bp, Artificial
  CRISPR gRNA sequence
tgtatttttagtggagctgg

SEQ ID NO: 755759 - DNA, 20 bp, Artificial
  CRISPR gRNA sequence
gtatttttagtggagctggg

SEQ ID NO: 755760 - DNA, 20 bp, Artificial
  CRISPR gRNA sequence
tatttttagtggagctgggg

SEQ ID NO: 755761 - DNA, 20 bp, Artificial
  CRISPR gRNA sequence
ttagtggagctggggtttca

SEQ ID NO: 755762 - DNA, 20 bp, Artificial
  CRISPR gRNA sequence
tagtggagctggggtttcac

SEQ ID NO: 755763 - DNA, 20 bp, Artificial
  CRISPR gRNA sequence
agtggagctggggtttcacc

SEQ ID NO: 755764 - DNA, 20 bp, Artificial
  CRISPR gRNA sequence
gtggagctggggtttcacca

SEQ ID NO: 755765 - DNA, 20 bp, Artificial
  CRISPR gRNA sequence
gggtttcaccatgttggcca

SEQ ID NO: 755766 - DNA, 20 bp, Artificial
  CRISPR gRNA sequence
caccatgttggccaggctgg

SEQ ID NO: 755767 - DNA, 20 bp, Artificial
  CRISPR gRNA sequence
accatgttggccaggctggt

SEQ ID NO: 755768 - DNA, 20 bp, Artificial
  CRISPR gRNA sequence
gccaggctggtctcaaacta

SEQ ID NO: 755769 - DNA, 20 bp, Artificial
  CRISPR gRNA sequence
gtctcaaactactgacaaat

SEQ ID NO: 755770 - DNA, 20 bp, Artificial
  CRISPR gRNA sequence
aaactactgacaaatgatct

SEQ ID NO: 755771 - DNA, 20 bp, Artificial
  CRISPR gRNA sequence
ctgacaaatgatctaactgc

SEQ ID NO: 755772 - DNA, 20 bp, Artificial
  CRISPR gRNA sequence
acaaatgatctaactgcctc

SEQ ID NO: 755773 - DNA, 20 bp, Artificial
  CRISPR gRNA sequence
actgcctcggcctcccaaag

SEQ ID NO: 755774 - DNA, 20 bp, Artificial
  CRISPR gRNA sequence
cctcggcctcccaaagtgct

SEQ ID NO: 755775 - DNA, 20 bp, Artificial
  CRISPR gRNA sequence
ggcctcccaaagtgctggga

SEQ ID NO: 755776 - DNA, 20 bp, Artificial
  CRISPR gRNA sequence
ccaaagtgctgggattacag

SEQ ID NO: 755777 - DNA, 20 bp, Artificial
  CRISPR gRNA sequence
ggattacaggtgtgagtcac

SEQ ID NO: 755778 - DNA, 20 bp, Artificial
  CRISPR gRNA sequence
caggtgtgagtcaccacgcc

SEQ ID NO: 755779 - DNA, 20 bp, Artificial
  CRISPR gRNA sequence
gcctcaggaatttttttttt

SEQ ID NO: 755780 - DNA, 20 bp, Artificial
  CRISPR gRNA sequence
aggaattttttttttttttg

SEQ ID NO: 755781 - DNA, 20 bp, Artificial
  CRISPR gRNA sequence
tttttttttttgagaaagac

SEQ ID NO: 755782 - DNA, 20 bp, Artificial
  CRISPR gRNA sequence
ttttttttttgagaaagact

SEQ ID NO: 755783 - DNA, 20 bp, Artificial
  CRISPR gRNA sequence
tttttttttgagaaagactc

SEQ ID NO: 755784 - DNA, 20 bp, Artificial
  CRISPR gRNA sequence
ttttttttgagaaagactct

SEQ ID NO: 755785 - DNA, 20 bp, Artificial
  CRISPR gRNA sequence
tttttttgagaaagactctc

SEQ ID NO: 755786 - DNA, 20 bp, Artificial
  CRISPR gRNA sequence
ttttttgagaaagactctct

SEQ ID NO: 755787 - DNA, 20 bp, Artificial
  CRISPR gRNA sequence
tttttgagaaagactctctc

SEQ ID NO: 755788 - DNA, 20 bp, Artificial
  CRISPR gRNA sequence
ttttgagaaagactctctct

SEQ ID NO: 755789 - DNA, 20 bp, Artificial
  CRISPR gRNA sequence
tttgagaaagactctctctc

SEQ ID NO: 755790 - DNA, 20 bp, Artificial
  CRISPR gRNA sequence
ttgagaaagactctctctct

SEQ ID NO: 755791 - DNA, 20 bp, Artificial
  CRISPR gRNA sequence
tgagaaagactctctctctg

SEQ ID NO: 755792 - DNA, 20 bp, Artificial
  CRISPR gRNA sequence
gagaaagactctctctctgt

SEQ ID NO: 755793 - DNA, 20 bp, Artificial
  CRISPR gRNA sequence
agaaagactctctctctgtc

SEQ ID NO: 755794 - DNA, 20 bp, Artificial
  CRISPR gRNA sequence
tctctctgtcactcaggctg

SEQ ID NO: 755795 - DNA, 20 bp, Artificial
  CRISPR gRNA sequence
tctctgtcactcaggctgga

SEQ ID NO: 755796 - DNA, 20 bp, Artificial
  CRISPR gRNA sequence
tctgtcactcaggctggaat

SEQ ID NO: 755797 - DNA, 20 bp, Artificial
  CRISPR gRNA sequence
tgtcactcaggctggaatgc

SEQ ID NO: 755798 - DNA, 20 bp, Artificial
  CRISPR gRNA sequence
tcactcaggctggaatgcag

SEQ ID NO: 755799 - DNA, 20 bp, Artificial
  CRISPR gRNA sequence
aggctggaatgcagtggtgc

SEQ ID NO: 755800 - DNA, 20 bp, Artificial
  CRISPR gRNA sequence
gaatgcagtggtgcaatcac

SEQ ID NO: 755801 - DNA, 20 bp, Artificial
  CRISPR gRNA sequence
actgaagcctcaaacttcca

SEQ ID NO: 755802 - DNA, 20 bp, Artificial
  CRISPR gRNA sequence
aagcctcaaacttccagatg

SEQ ID NO: 755803 - DNA, 20 bp, Artificial
  CRISPR gRNA sequence
aaacttccagatgcaagtga

SEQ ID NO: 755804 - DNA, 20 bp, Artificial
  CRISPR gRNA sequence
ccagatgcaagtgatcttcc

SEQ ID NO: 755805 - DNA, 20 bp, Artificial
  CRISPR gRNA sequence
cagatgcaagtgatcttcct

SEQ ID NO: 755806 - DNA, 20 bp, Artificial
  CRISPR gRNA sequence
cctgcttcattctcccaagt

SEQ ID NO: 755807 - DNA, 20 bp, Artificial
  CRISPR gRNA sequence
ctgcttcattctcccaagta

SEQ ID NO: 755808 - DNA, 20 bp, Artificial
  CRISPR gRNA sequence
cttcattctcccaagtagct

SEQ ID NO: 755809 - DNA, 20 bp, Artificial
  CRISPR gRNA sequence
cattctcccaagtagctggg

SEQ ID NO: 755810 - DNA, 20 bp, Artificial
  CRISPR gRNA sequence
attctcccaagtagctggga

SEQ ID NO: 755811 - DNA, 20 bp, Artificial
  CRISPR gRNA sequence
tcccaagtagctgggactac

SEQ ID NO: 755812 - DNA, 20 bp, Artificial
  CRISPR gRNA sequence
ccaagtagctgggactacag

SEQ ID NO: 755813 - DNA, 20 bp, Artificial
  CRISPR gRNA sequence
ggactacaggcacgcatcac

SEQ ID NO: 755814 - DNA, 20 bp, Artificial
  CRISPR gRNA sequence
caggcacgcatcaccatgtc

SEQ ID NO: 755815 - DNA, 20 bp, Artificial
  CRISPR gRNA sequence
gtgaatttttaaaaattatt

SEQ ID NO: 755816 - DNA, 20 bp, Artificial
  CRISPR gRNA sequence
ttaaaaattatttttggggt

SEQ ID NO: 755817 - DNA, 20 bp, Artificial
  CRISPR gRNA sequence
taaaaattatttttggggtt

SEQ ID NO: 755818 - DNA, 20 bp, Artificial
  CRISPR gRNA sequence
aaaaattatttttggggtta

SEQ ID NO: 755819 - DNA, 20 bp, Artificial
  CRISPR gRNA sequence
aaaattatttttggggttag

SEQ ID NO: 755820 - DNA, 20 bp, Artificial
  CRISPR gRNA sequence
tttttggggttaggtgcggt

SEQ ID NO: 755821 - DNA, 20 bp, Artificial
  CRISPR gRNA sequence
ttggggttaggtgcggtggc

SEQ ID NO: 755822 - DNA, 20 bp, Artificial
  CRISPR gRNA sequence
tggggttaggtgcggtggct

SEQ ID NO: 755823 - DNA, 20 bp, Artificial
  CRISPR gRNA sequence
ggggttaggtgcggtggctc

SEQ ID NO: 755824 - DNA, 20 bp, Artificial
  CRISPR gRNA sequence
gggttaggtgcggtggctca

SEQ ID NO: 755825 - DNA, 20 bp, Artificial
  CRISPR gRNA sequence
ggtgcggtggctcacgcctg

SEQ ID NO: 755826 - DNA, 20 bp, Artificial
  CRISPR gRNA sequence
acgcctgtaatcccagcact

SEQ ID NO: 755827 - DNA, 20 bp, Artificial
  CRISPR gRNA sequence
taatcccagcactttaggag

SEQ ID NO: 755828 - DNA, 20 bp, Artificial
  CRISPR gRNA sequence
taggaggtcaaggcaggcag

SEQ ID NO: 755829 - DNA, 20 bp, Artificial
  CRISPR gRNA sequence
aggaggtcaaggcaggcaga

SEQ ID NO: 755830 - DNA, 20 bp, Artificial
  CRISPR gRNA sequence
ggaggtcaaggcaggcagat

SEQ ID NO: 755831 - DNA, 20 bp, Artificial
  CRISPR gRNA sequence
gaggccaggagttcgagacc

SEQ ID NO: 755832 - DNA, 20 bp, Artificial
  CRISPR gRNA sequence
aggccaggagttcgagacca

SEQ ID NO: 755833 - DNA, 20 bp, Artificial
  CRISPR gRNA sequence
gagaccagcctggccaacag

SEQ ID NO: 755834 - DNA, 20 bp, Artificial
  CRISPR gRNA sequence
gccaacagggtgaaacccca

SEQ ID NO: 755835 - DNA, 20 bp, Artificial
  CRISPR gRNA sequence
tactaaaaacacaaaaatta

SEQ ID NO: 755836 - DNA, 20 bp, Artificial
  CRISPR gRNA sequence
ctaaaaacacaaaaattagc

SEQ ID NO: 755837 - DNA, 20 bp, Artificial
  CRISPR gRNA sequence
aaaacacaaaaattagccag

SEQ ID NO: 755838 - DNA, 20 bp, Artificial
  CRISPR gRNA sequence
gccaggcatggtggtgcacg

SEQ ID NO: 755839 - DNA, 20 bp, Artificial
  CRISPR gRNA sequence
tagtcccagctactcaagag

SEQ ID NO: 755840 - DNA, 20 bp, Artificial
  CRISPR gRNA sequence
ctcaagaggctgaggcaaga

SEQ ID NO: 755841 - DNA, 20 bp, Artificial
  CRISPR gRNA sequence
aagaggctgaggcaagagaa

SEQ ID NO: 755842 - DNA, 20 bp, Artificial
  CRISPR gRNA sequence
aggcaagagaatcgcttgaa

SEQ ID NO: 755843 - DNA, 20 bp, Artificial
  CRISPR gRNA sequence
gaacccgggagtcagaggtt

SEQ ID NO: 755844 - DNA, 20 bp, Artificial
  CRISPR gRNA sequence
aacccgggagtcagaggtta

SEQ ID NO: 755845 - DNA, 20 bp, Artificial
  CRISPR gRNA sequence
cagtgagccgagatcgcgcc

SEQ ID NO: 755846 - DNA, 20 bp, Artificial
  CRISPR gRNA sequence
cactccagcctgctgataga

SEQ ID NO: 755847 - DNA, 20 bp, Artificial
  CRISPR gRNA sequence
cagcctgctgatagagcaag

SEQ ID NO: 755848 - DNA, 20 bp, Artificial
  CRISPR gRNA sequence
ctgatagagcaagactccat

SEQ ID NO: 755849 - DNA, 20 bp, Artificial
  CRISPR gRNA sequence
atagagcaagactccatctc

SEQ ID NO: 755850 - DNA, 20 bp, Artificial
  CRISPR gRNA sequence
catctcaaaaaaaaaacaac

SEQ ID NO: 755851 - DNA, 20 bp, Artificial
  CRISPR gRNA sequence
aaaaaaaaaacaacccaaaa

SEQ ID NO: 755852 - DNA, 20 bp, Artificial
  CRISPR gRNA sequence
gcctggcatggtggcaggca

SEQ ID NO: 755853 - DNA, 20 bp, Artificial
  CRISPR gRNA sequence
cctggcatggtggcaggcat

SEQ ID NO: 755854 - DNA, 20 bp, Artificial
  CRISPR gRNA sequence
gcatggtggcaggcatctgt

SEQ ID NO: 755855 - DNA, 20 bp, Artificial
  CRISPR gRNA sequence
taatcccagctactcgggag

SEQ ID NO: 755856 - DNA, 20 bp, Artificial
  CRISPR gRNA sequence
ctcgggaggctgagacatga

SEQ ID NO: 755857 - DNA, 20 bp, Artificial
  CRISPR gRNA sequence
gggaggctgagacatgagag

SEQ ID NO: 755858 - DNA, 20 bp, Artificial
  CRISPR gRNA sequence
agacatgagagctgcttgaa

SEQ ID NO: 755859 - DNA, 20 bp, Artificial
  CRISPR gRNA sequence
cttgaacctgggaggcagaa

SEQ ID NO: 755860 - DNA, 20 bp, Artificial
  CRISPR gRNA sequence
gaacctgggaggcagaagtt

SEQ ID NO: 755861 - DNA, 20 bp, Artificial
  CRISPR gRNA sequence
aacctgggaggcagaagttg

SEQ ID NO: 755862 - DNA, 20 bp, Artificial
  CRISPR gRNA sequence
ggaggcagaagttgcagtga

SEQ ID NO: 755863 - DNA, 20 bp, Artificial
  CRISPR gRNA sequence
cagtgagccgagatcacacc

SEQ ID NO: 755864 - DNA, 20 bp, Artificial
  CRISPR gRNA sequence
cactccagcctgggtgacag

SEQ ID NO: 755865 - DNA, 20 bp, Artificial
  CRISPR gRNA sequence
cagcctgggtgacagagcga

SEQ ID NO: 755866 - DNA, 20 bp, Artificial
  CRISPR gRNA sequence
ggtgacagagcgagactctg

SEQ ID NO: 755867 - DNA, 20 bp, Artificial
  CRISPR gRNA sequence
tgtcccaaaaaatcaaaaaa

SEQ ID NO: 755868 - DNA, 20 bp, Artificial
  CRISPR gRNA sequence
tcccaaaaaatcaaaaaaat

SEQ ID NO: 755869 - DNA, 20 bp, Artificial
  CRISPR gRNA sequence
ttggtagagatgcactctcg

SEQ ID NO: 755870 - DNA, 20 bp, Artificial
  CRISPR gRNA sequence
tggtagagatgcactctcgc

SEQ ID NO: 755871 - DNA, 20 bp, Artificial
  CRISPR gRNA sequence
ggtagagatgcactctcgct

SEQ ID NO: 755872 - DNA, 20 bp, Artificial
  CRISPR gRNA sequence
gtagagatgcactctcgcta

SEQ ID NO: 755873 - DNA, 20 bp, Artificial
  CRISPR gRNA sequence
tcgctatgttgcccaggctg

SEQ ID NO: 755874 - DNA, 20 bp, Artificial
  CRISPR gRNA sequence
gctatgttgcccaggctggt

SEQ ID NO: 755875 - DNA, 20 bp, Artificial
  CRISPR gRNA sequence
tgttgcccaggctggtcttg

SEQ ID NO: 755876 - DNA, 20 bp, Artificial
  CRISPR gRNA sequence
cccaggctggtcttgaactc

SEQ ID NO: 755877 - DNA, 20 bp, Artificial
  CRISPR gRNA sequence
gtcttgaactcctgggctca

SEQ ID NO: 755878 - DNA, 20 bp, Artificial
  CRISPR gRNA sequence
gaactcctgggctcaattga

SEQ ID NO: 755879 - DNA, 20 bp, Artificial
  CRISPR gRNA sequence
aactcctgggctcaattgat

SEQ ID NO: 755880 - DNA, 20 bp, Artificial
  CRISPR gRNA sequence
ctgggctcaattgatcttcc

SEQ ID NO: 755881 - DNA, 20 bp, Artificial
  CRISPR gRNA sequence
ggctcaattgatcttcccac

SEQ ID NO: 755882 - DNA, 20 bp, Artificial
  CRISPR gRNA sequence
aattgatcttcccaccttga

SEQ ID NO: 755883 - DNA, 20 bp, Artificial
  CRISPR gRNA sequence
atcttcccaccttgacctcc

SEQ ID NO: 755884 - DNA, 20 bp, Artificial
  CRISPR gRNA sequence
cccaccttgacctccaaagt

SEQ ID NO: 755885 - DNA, 20 bp, Artificial
  CRISPR gRNA sequence
ccaccttgacctccaaagtg

SEQ ID NO: 755886 - DNA, 20 bp, Artificial
  CRISPR gRNA sequence
gacctccaaagtgctgggat

SEQ ID NO: 755887 - DNA, 20 bp, Artificial
  CRISPR gRNA sequence
acctccaaagtgctgggatt

SEQ ID NO: 755888 - DNA, 20 bp, Artificial
  CRISPR gRNA sequence
caaagtgctgggattacagg

SEQ ID NO: 755889 - DNA, 20 bp, Artificial
  CRISPR gRNA sequence
ggattacaggtgtgagccac

SEQ ID NO: 755890 - DNA, 20 bp, Artificial
  CRISPR gRNA sequence
caggtgtgagccaccatgcc

SEQ ID NO: 755891 - DNA, 20 bp, Artificial
  CRISPR gRNA sequence
gcctcagggaattcttataa

SEQ ID NO: 755892 - DNA, 20 bp, Artificial
  CRISPR gRNA sequence
agggaattcttataagaact

SEQ ID NO: 755893 - DNA, 20 bp, Artificial
  CRISPR gRNA sequence
ttataagaactctatgaagt

SEQ ID NO: 755894 - DNA, 20 bp, Artificial
  CRISPR gRNA sequence
ataagaactctatgaagtag

SEQ ID NO: 755895 - DNA, 20 bp, Artificial
  CRISPR gRNA sequence
taagaactctatgaagtagg

SEQ ID NO: 755896 - DNA, 20 bp, Artificial
  CRISPR gRNA sequence
tatgaagtaggcatcaccat

SEQ ID NO: 755897 - DNA, 20 bp, Artificial
  CRISPR gRNA sequence
tgaagtaggcatcaccatct

SEQ ID NO: 755898 - DNA, 20 bp, Artificial
  CRISPR gRNA sequence
ctctgtatccatggaaagag

SEQ ID NO: 755899 - DNA, 20 bp, Artificial
  CRISPR gRNA sequence
tctgtatccatggaaagaga

SEQ ID NO: 755900 - DNA, 20 bp, Artificial
  CRISPR gRNA sequence
tgtatccatggaaagagagg

SEQ ID NO: 755901 - DNA, 20 bp, Artificial
  CRISPR gRNA sequence
tatccatggaaagagaggcc

SEQ ID NO: 755902 - DNA, 20 bp, Artificial
  CRISPR gRNA sequence
gagatgtatgctaacttgcc

SEQ ID NO: 755903 - DNA, 20 bp, Artificial
  CRISPR gRNA sequence
acttgcccaagctcacatag

SEQ ID NO: 755904 - DNA, 20 bp, Artificial
  CRISPR gRNA sequence
gcccaagctcacatagccca

SEQ ID NO: 755905 - DNA, 20 bp, Artificial
  CRISPR gRNA sequence
cccaagctcacatagcccag

SEQ ID NO: 755906 - DNA, 20 bp, Artificial
  CRISPR gRNA sequence
acatagcccagggtagcata

SEQ ID NO: 755907 - DNA, 20 bp, Artificial
  CRISPR gRNA sequence
ggatctggctgcaggcctgc

SEQ ID NO: 755908 - DNA, 20 bp, Artificial
  CRISPR gRNA sequence
gctgcaggcctgcttagctc

SEQ ID NO: 755909 - DNA, 20 bp, Artificial
  CRISPR gRNA sequence
caggcctgcttagctctgca

SEQ ID NO: 755910 - DNA, 20 bp, Artificial
  CRISPR gRNA sequence
cttagctctgcatactcacc

SEQ ID NO: 755911 - DNA, 20 bp, Artificial
  CRISPR gRNA sequence
agctctgcatactcaccttc

SEQ ID NO: 755912 - DNA, 20 bp, Artificial
  CRISPR gRNA sequence
gctctgcatactcaccttct

SEQ ID NO: 755913 - DNA, 20 bp, Artificial
  CRISPR gRNA sequence
tgcatactcaccttcttccc

SEQ ID NO: 755914 - DNA, 20 bp, Artificial
  CRISPR gRNA sequence
catactcaccttcttcccag

SEQ ID NO: 755915 - DNA, 20 bp, Artificial
  CRISPR gRNA sequence
accttcttcccagcttgggg

SEQ ID NO: 755916 - DNA, 20 bp, Artificial
  CRISPR gRNA sequence
cttcccagcttggggcagtg

SEQ ID NO: 755917 - DNA, 20 bp, Artificial
  CRISPR gRNA sequence
ttcccagcttggggcagtgc

SEQ ID NO: 755918 - DNA, 20 bp, Artificial
  CRISPR gRNA sequence
cccagcttggggcagtgcag

SEQ ID NO: 755919 - DNA, 20 bp, Artificial
  CRISPR gRNA sequence
ccagcttggggcagtgcagt

SEQ ID NO: 755920 - DNA, 20 bp, Artificial
  CRISPR gRNA sequence
ggggcagtgcagtgggtagc

SEQ ID NO: 755921 - DNA, 20 bp, Artificial
  CRISPR gRNA sequence
gggcagtgcagtgggtagca

SEQ ID NO: 755922 - DNA, 20 bp, Artificial
  CRISPR gRNA sequence
gccccccggtgcttgccaga

SEQ ID NO: 755923 - DNA, 20 bp, Artificial
  CRISPR gRNA sequence
gccagagaggtgccctacag

SEQ ID NO: 755924 - DNA, 20 bp, Artificial
  CRISPR gRNA sequence
ccagagaggtgccctacagg

SEQ ID NO: 755925 - DNA, 20 bp, Artificial
  CRISPR gRNA sequence
cagggtaagagggcactgcc

SEQ ID NO: 755926 - DNA, 20 bp, Artificial
  CRISPR gRNA sequence
ccctaagggtgcctggcgct

SEQ ID NO: 755927 - DNA, 20 bp, Artificial
  CRISPR gRNA sequence
agggtgcctggcgctgagag

SEQ ID NO: 755928 - DNA, 20 bp, Artificial
  CRISPR gRNA sequence
gcgctgagaggttgggtgag

SEQ ID NO: 755929 - DNA, 20 bp, Artificial
  CRISPR gRNA sequence
agaggttgggtgagaatacc

SEQ ID NO: 755930 - DNA, 20 bp, Artificial
  CRISPR gRNA sequence
ggtgagaatacccagcagct

SEQ ID NO: 755931 - DNA, 20 bp, Artificial
  CRISPR gRNA sequence
ggagacaaaatgcaagggca

SEQ ID NO: 755932 - DNA, 20 bp, Artificial
  CRISPR gRNA sequence
gagacaaaatgcaagggcac

SEQ ID NO: 755933 - DNA, 20 bp, Artificial
  CRISPR gRNA sequence
cctcttctgagaagaggtct

SEQ ID NO: 755934 - DNA, 20 bp, Artificial
  CRISPR gRNA sequence
ttctgagaagaggtcttggc

SEQ ID NO: 755935 - DNA, 20 bp, Artificial
  CRISPR gRNA sequence
ctgagaagaggtcttggctt

SEQ ID NO: 755936 - DNA, 20 bp, Artificial
  CRISPR gRNA sequence
tgagaagaggtcttggcttc

SEQ ID NO: 755937 - DNA, 20 bp, Artificial
  CRISPR gRNA sequence
agaagaggtcttggcttcca

SEQ ID NO: 755938 - DNA, 20 bp, Artificial
  CRISPR gRNA sequence
ggcttccacacccctctata

SEQ ID NO: 755939 - DNA, 20 bp, Artificial
  CRISPR gRNA sequence
gcttccacacccctctatac

SEQ ID NO: 755940 - DNA, 20 bp, Artificial
  CRISPR gRNA sequence
ccacacccctctataccctg

SEQ ID NO: 755941 - DNA, 20 bp, Artificial
  CRISPR gRNA sequence
cacacccctctataccctgt

SEQ ID NO: 755942 - DNA, 20 bp, Artificial
  CRISPR gRNA sequence
tataccctgtatgtgtcaga

SEQ ID NO: 755943 - DNA, 20 bp, Artificial
  CRISPR gRNA sequence
taccctgtatgtgtcagaca

SEQ ID NO: 755944 - DNA, 20 bp, Artificial
  CRISPR gRNA sequence
tatgtgtcagacatccagtg

SEQ ID NO: 755945 - DNA, 20 bp, Artificial
  CRISPR gRNA sequence
ctaggccctggagatacaaa

SEQ ID NO: 755946 - DNA, 20 bp, Artificial
  CRISPR gRNA sequence
ggccctggagatacaaaggc

SEQ ID NO: 755947 - DNA, 20 bp, Artificial
  CRISPR gRNA sequence
gagatacaaaggcatccagg

SEQ ID NO: 755948 - DNA, 20 bp, Artificial
  CRISPR gRNA sequence
agccggaatggggatcagct

SEQ ID NO: 755949 - DNA, 20 bp, Artificial
  CRISPR gRNA sequence
aaccacggacccaacaaaac

SEQ ID NO: 755950 - DNA, 20 bp, Artificial
  CRISPR gRNA sequence
aaaggctacagtgacttttt

SEQ ID NO: 755951 - DNA, 20 bp, Artificial
  CRISPR gRNA sequence
cagtgactttttactcagct

SEQ ID NO: 755952 - DNA, 20 bp, Artificial
  CRISPR gRNA sequence
tttactcagctacccttttt

SEQ ID NO: 755953 - DNA, 20 bp, Artificial
  CRISPR gRNA sequence
ttactcagctaccctttttt

SEQ ID NO: 755954 - DNA, 20 bp, Artificial
  CRISPR gRNA sequence
tactcagctacccttttttc

SEQ ID NO: 755955 - DNA, 20 bp, Artificial
  CRISPR gRNA sequence
actcagctacccttttttca

SEQ ID NO: 755956 - DNA, 20 bp, Artificial
  CRISPR gRNA sequence
ctcagctacccttttttcaa

SEQ ID NO: 755957 - DNA, 20 bp, Artificial
  CRISPR gRNA sequence
agctacccttttttcaaacc

SEQ ID NO: 755958 - DNA, 20 bp, Artificial
  CRISPR gRNA sequence
cccttttttcaaaccaacaa

SEQ ID NO: 755959 - DNA, 20 bp, Artificial
  CRISPR gRNA sequence
ttttcaaaccaacaaacagg

SEQ ID NO: 755960 - DNA, 20 bp, Artificial
  CRISPR gRNA sequence
tttcaaaccaacaaacaggc

SEQ ID NO: 755961 - DNA, 20 bp, Artificial
  CRISPR gRNA sequence
ttcaaaccaacaaacaggcc

SEQ ID NO: 755962 - DNA, 20 bp, Artificial
  CRISPR gRNA sequence
tcaaaccaacaaacaggcca

SEQ ID NO: 755963 - DNA, 20 bp, Artificial
  CRISPR gRNA sequence
caaaccaacaaacaggccaa

SEQ ID NO: 755964 - DNA, 20 bp, Artificial
  CRISPR gRNA sequence
aaaccaacaaacaggccaag

SEQ ID NO: 755965 - DNA, 20 bp, Artificial
  CRISPR gRNA sequence
gaacatgcattttggtcaga

SEQ ID NO: 755966 - DNA, 20 bp, Artificial
  CRISPR gRNA sequence
tggtcagagccatgttggtc

SEQ ID NO: 755967 - DNA, 20 bp, Artificial
  CRISPR gRNA sequence
ggtcagagccatgttggtca

SEQ ID NO: 755968 - DNA, 20 bp, Artificial
  CRISPR gRNA sequence
gtcagagccatgttggtcag

SEQ ID NO: 755969 - DNA, 20 bp, Artificial
  CRISPR gRNA sequence
gtcaggctggtctcgaactc

SEQ ID NO: 755970 - DNA, 20 bp, Artificial
  CRISPR gRNA sequence
gtctcgaactcctgggctca

SEQ ID NO: 755971 - DNA, 20 bp, Artificial
  CRISPR gRNA sequence
gaactcctgggctcaagtga

SEQ ID NO: 755972 - DNA, 20 bp, Artificial
  CRISPR gRNA sequence
ctgggctcaagtgatctacc

SEQ ID NO: 755973 - DNA, 20 bp, Artificial
  CRISPR gRNA sequence
ggctcaagtgatctacccgc

SEQ ID NO: 755974 - DNA, 20 bp, Artificial
  CRISPR gRNA sequence
aagtgatctacccgccttgg

SEQ ID NO: 755975 - DNA, 20 bp, Artificial
  CRISPR gRNA sequence
cccgccttggctccccaaag

SEQ ID NO: 755976 - DNA, 20 bp, Artificial
  CRISPR gRNA sequence
ggctccccaaagtgctggga

SEQ ID NO: 755977 - DNA, 20 bp, Artificial
  CRISPR gRNA sequence
gctccccaaagtgctgggat

SEQ ID NO: 755978 - DNA, 20 bp, Artificial
  CRISPR gRNA sequence
cccaaagtgctgggattaca

SEQ ID NO: 755979 - DNA, 20 bp, Artificial
  CRISPR gRNA sequence
ggattacaggattgagccac

SEQ ID NO: 755980 - DNA, 20 bp, Artificial
  CRISPR gRNA sequence
caggattgagccactatgcc

SEQ ID NO: 755981 - DNA, 20 bp, Artificial
  CRISPR gRNA sequence
agccactatgcccagcccca

SEQ ID NO: 755982 - DNA, 20 bp, Artificial
  CRISPR gRNA sequence
tgcccagccccagtgccagc

SEQ ID NO: 755983 - DNA, 20 bp, Artificial
  CRISPR gRNA sequence
ttaatgttatccttgggaag

SEQ ID NO: 755984 - DNA, 20 bp, Artificial
  CRISPR gRNA sequence
aatgttatccttgggaagta

SEQ ID NO: 755985 - DNA, 20 bp, Artificial
  CRISPR gRNA sequence
atgttatccttgggaagtaa

SEQ ID NO: 755986 - DNA, 20 bp, Artificial
  CRISPR gRNA sequence
tccttgggaagtaagagtgt

SEQ ID NO: 755987 - DNA, 20 bp, Artificial
  CRISPR gRNA sequence
gggaagtaagagtgtagctt

SEQ ID NO: 755988 - DNA, 20 bp, Artificial
  CRISPR gRNA sequence
ggaagtaagagtgtagcttg

SEQ ID NO: 755989 - DNA, 20 bp, Artificial
  CRISPR gRNA sequence
gactatgaaataacatgaaa

SEQ ID NO: 755990 - DNA, 20 bp, Artificial
  CRISPR gRNA sequence
actatgaaataacatgaaag

SEQ ID NO: 755991 - DNA, 20 bp, Artificial
  CRISPR gRNA sequence
tgaaataacatgaaagtaca

SEQ ID NO: 755992 - DNA, 20 bp, Artificial
  CRISPR gRNA sequence
acctgaggtaggggaatgag

SEQ ID NO: 755993 - DNA, 20 bp, Artificial
  CRISPR gRNA sequence
aggtaggggaatgagactag

SEQ ID NO: 755994 - DNA, 20 bp, Artificial
  CRISPR gRNA sequence
gagaagttggtgcccaagga

SEQ ID NO: 755995 - DNA, 20 bp, Artificial
  CRISPR gRNA sequence
gtgcccaaggagctcctgca

SEQ ID NO: 755996 - DNA, 20 bp, Artificial
  CRISPR gRNA sequence
ctgcattgctgaggggctgt

SEQ ID NO: 755997 - DNA, 20 bp, Artificial
  CRISPR gRNA sequence
cattgctgaggggctgtggt

SEQ ID NO: 755998 - DNA, 20 bp, Artificial
  CRISPR gRNA sequence
ctgaggggctgtggtttctc

SEQ ID NO: 755999 - DNA, 20 bp, Artificial
  CRISPR gRNA sequence
aggggctgtggtttctcagt

SEQ ID NO: 756000 - DNA, 20 bp, Artificial
  CRISPR gRNA sequence
tggtttctcagtgagctcag

SEQ ID NO: 756001 - DNA, 20 bp, Artificial
  CRISPR gRNA sequence
ctcagtgagctcagagaagg

SEQ ID NO: 756002 - DNA, 20 bp, Artificial
  CRISPR gRNA sequence
tcagtgagctcagagaaggg

SEQ ID NO: 756003 - DNA, 20 bp, Artificial
  CRISPR gRNA sequence
agtgagctcagagaaggggt

SEQ ID NO: 756004 - DNA, 20 bp, Artificial
  CRISPR gRNA sequence
agagaaggggtctaggcagc

SEQ ID NO: 756005 - DNA, 20 bp, Artificial
  CRISPR gRNA sequence
ggcagctcatctccctttga

SEQ ID NO: 756006 - DNA, 20 bp, Artificial
  CRISPR gRNA sequence
atctccctttgaacttcttc

SEQ ID NO: 756007 - DNA, 20 bp, Artificial
  CRISPR gRNA sequence
cctttgaacttcttcccacc

SEQ ID NO: 756008 - DNA, 20 bp, Artificial
  CRISPR gRNA sequence
tgaacttcttcccacccccc

SEQ ID NO: 756009 - DNA, 20 bp, Artificial
  CRISPR gRNA sequence
gaacttcttcccacccccca

SEQ ID NO: 756010 - DNA, 20 bp, Artificial
  CRISPR gRNA sequence
aacttcttcccaccccccag

SEQ ID NO: 756011 - DNA, 20 bp, Artificial
  CRISPR gRNA sequence
cttcccaccccccagcgcag

SEQ ID NO: 756012 - DNA, 20 bp, Artificial
  CRISPR gRNA sequence
ttcccaccccccagcgcagc

SEQ ID NO: 756013 - DNA, 20 bp, Artificial
  CRISPR gRNA sequence
cccaccccccagcgcagcag

SEQ ID NO: 756014 - DNA, 20 bp, Artificial
  CRISPR gRNA sequence
ccaccccccagcgcagcaga

SEQ ID NO: 756015 - DNA, 20 bp, Artificial
  CRISPR gRNA sequence
tctgctttcacccagcttcc

SEQ ID NO: 756016 - DNA, 20 bp, Artificial
  CRISPR gRNA sequence
ctttcacccagcttcctccc

SEQ ID NO: 756017 - DNA, 20 bp, Artificial
  CRISPR gRNA sequence
tcacccagcttcctccctgg

SEQ ID NO: 756018 - DNA, 20 bp, Artificial
  CRISPR gRNA sequence
cacccagcttcctccctggg

SEQ ID NO: 756019 - DNA, 20 bp, Artificial
  CRISPR gRNA sequence
acccagcttcctccctggga

SEQ ID NO: 756020 - DNA, 20 bp, Artificial
  CRISPR gRNA sequence
cctccctgggaaaccaggca

SEQ ID NO: 756021 - DNA, 20 bp, Artificial
  CRISPR gRNA sequence
ctccctgggaaaccaggcag

SEQ ID NO: 756022 - DNA, 20 bp, Artificial
  CRISPR gRNA sequence
cctgggaaaccaggcagccc

SEQ ID NO: 756023 - DNA, 20 bp, Artificial
  CRISPR gRNA sequence
ggaaaccaggcagcccaacc

SEQ ID NO: 756024 - DNA, 20 bp, Artificial
  CRISPR gRNA sequence
agcagccgaactccctcctc

SEQ ID NO: 756025 - DNA, 20 bp, Artificial
  CRISPR gRNA sequence
cctcctccatatatccccgt

SEQ ID NO: 756026 - DNA, 20 bp, Artificial
  CRISPR gRNA sequence
ctccatatatccccgtgggc

SEQ ID NO: 756027 - DNA, 20 bp, Artificial
  CRISPR gRNA sequence
catatatccccgtgggctac

SEQ ID NO: 756028 - DNA, 20 bp, Artificial
  CRISPR gRNA sequence
ccaggcaggccctggacaaa

SEQ ID NO: 756029 - DNA, 20 bp, Artificial
  CRISPR gRNA sequence
gacaaaggccgcctgagcag

SEQ ID NO: 756030 - DNA, 20 bp, Artificial
  CRISPR gRNA sequence
agcaggccaggcccctccca

SEQ ID NO: 756031 - DNA, 20 bp, Artificial
  CRISPR gRNA sequence
ccatcccaccctgctgtgtc

SEQ ID NO: 756032 - DNA, 20 bp, Artificial
  CRISPR gRNA sequence
ctgtgtcagggcctggcaca

SEQ ID NO: 756033 - DNA, 20 bp, Artificial
  CRISPR gRNA sequence
tgtcagggcctggcacactc

SEQ ID NO: 756034 - DNA, 20 bp, Artificial
  CRISPR gRNA sequence
gcacactccttagtgcggtg

SEQ ID NO: 756035 - DNA, 20 bp, Artificial
  CRISPR gRNA sequence
cttagtgcggtgtcggcagc

SEQ ID NO: 756036 - DNA, 20 bp, Artificial
  CRISPR gRNA sequence
agtgcggtgtcggcagctac

SEQ ID NO: 756037 - DNA, 20 bp, Artificial
  CRISPR gRNA sequence
gtgcggtgtcggcagctacc

SEQ ID NO: 756038 - DNA, 20 bp, Artificial
  CRISPR gRNA sequence
cctctgccagcgcctgatca

SEQ ID NO: 756039 - DNA, 20 bp, Artificial
  CRISPR gRNA sequence
tgccagcgcctgatcacctt

SEQ ID NO: 756040 - DNA, 20 bp, Artificial
  CRISPR gRNA sequence
ccagcgcctgatcaccttcc

SEQ ID NO: 756041 - DNA, 20 bp, Artificial
  CRISPR gRNA sequence
atcaccttcccaggataagc

SEQ ID NO: 756042 - DNA, 20 bp, Artificial
  CRISPR gRNA sequence
cccaggataagcctggctct

SEQ ID NO: 756043 - DNA, 20 bp, Artificial
  CRISPR gRNA sequence
ccaggataagcctggctctg

SEQ ID NO: 756044 - DNA, 20 bp, Artificial
  CRISPR gRNA sequence
gctctggatggtgagtgagt

SEQ ID NO: 756045 - DNA, 20 bp, Artificial
  CRISPR gRNA sequence
tggatggtgagtgagtatgc

SEQ ID NO: 756046 - DNA, 20 bp, Artificial
  CRISPR gRNA sequence
gatggtgagtgagtatgcct

SEQ ID NO: 756047 - DNA, 20 bp, Artificial
  CRISPR gRNA sequence
ccttcccctgtgagtgccag

SEQ ID NO: 756048 - DNA, 20 bp, Artificial
  CRISPR gRNA sequence
cccctgtgagtgccagccca

SEQ ID NO: 756049 - DNA, 20 bp, Artificial
  CRISPR gRNA sequence
ccctgtgagtgccagcccag

SEQ ID NO: 756050 - DNA, 20 bp, Artificial
  CRISPR gRNA sequence
tgagtgccagcccaggcact

SEQ ID NO: 756051 - DNA, 20 bp, Artificial
  CRISPR gRNA sequence
gccacgcttgggggaagggg

SEQ ID NO: 756052 - DNA, 20 bp, Artificial
  CRISPR gRNA sequence
gggggaaggggtggggaact

SEQ ID NO: 756053 - DNA, 20 bp, Artificial
  CRISPR gRNA sequence
ggggaaggggtggggaactg

SEQ ID NO: 756054 - DNA, 20 bp, Artificial
  CRISPR gRNA sequence
tggcgaggctgagctctgca

SEQ ID NO: 756055 - DNA, 20 bp, Artificial
  CRISPR gRNA sequence
agctctgcagagatgcctac

SEQ ID NO: 756056 - DNA, 20 bp, Artificial
  CRISPR gRNA sequence
tgcagagatgcctacggctt

SEQ ID NO: 756057 - DNA, 20 bp, Artificial
  CRISPR gRNA sequence
cagagatgcctacggcttca

SEQ ID NO: 756058 - DNA, 20 bp, Artificial
  CRISPR gRNA sequence
cggcttcagaaagcagctgg

SEQ ID NO: 756059 - DNA, 20 bp, Artificial
  CRISPR gRNA sequence
cagaaagcagctggatccac

SEQ ID NO: 756060 - DNA, 20 bp, Artificial
  CRISPR gRNA sequence
agaaagcagctggatccaca

SEQ ID NO: 756061 - DNA, 20 bp, Artificial
  CRISPR gRNA sequence
gatccacagacttgtcccca

SEQ ID NO: 756062 - DNA, 20 bp, Artificial
  CRISPR gRNA sequence
gtccccaaacctctgcgccc

SEQ ID NO: 756063 - DNA, 20 bp, Artificial
  CRISPR gRNA sequence
tccccaaacctctgcgcccc

SEQ ID NO: 756064 - DNA, 20 bp, Artificial
  CRISPR gRNA sequence
tgcgcccctctgccccagcc

SEQ ID NO: 756065 - DNA, 20 bp, Artificial
  CRISPR gRNA sequence
cgcccctctgccccagcctc

SEQ ID NO: 756066 - DNA, 20 bp, Artificial
  CRISPR gRNA sequence
tgccccagcctcaactcagc

SEQ ID NO: 756067 - DNA, 20 bp, Artificial
  CRISPR gRNA sequence
ccccagcctcaactcagccc

SEQ ID NO: 756068 - DNA, 20 bp, Artificial
  CRISPR gRNA sequence
aactcagcccagatcgtaag

SEQ ID NO: 756069 - DNA, 20 bp, Artificial
  CRISPR gRNA sequence
agcccagatcgtaaggaagc

SEQ ID NO: 756070 - DNA, 20 bp, Artificial
  CRISPR gRNA sequence
aggctctcaaagtgaaatta

SEQ ID NO: 756071 - DNA, 20 bp, Artificial
  CRISPR gRNA sequence
tcaaagtgaaattaagtcct

SEQ ID NO: 756072 - DNA, 20 bp, Artificial
  CRISPR gRNA sequence
aaagtgaaattaagtcctga

SEQ ID NO: 756073 - DNA, 20 bp, Artificial
  CRISPR gRNA sequence
agtcctgatctgatagaggg

SEQ ID NO: 756074 - DNA, 20 bp, Artificial
  CRISPR gRNA sequence
atctgatagagggtccacat

SEQ ID NO: 756075 - DNA, 20 bp, Artificial
  CRISPR gRNA sequence
atagagggtccacatagggg

SEQ ID NO: 756076 - DNA, 20 bp, Artificial
  CRISPR gRNA sequence
tacctggggatagaagttag

SEQ ID NO: 756077 - DNA, 20 bp, Artificial
  CRISPR gRNA sequence
cctggggatagaagttaggc

SEQ ID NO: 756078 - DNA, 20 bp, Artificial
  CRISPR gRNA sequence
gggatagaagttaggcaggg

SEQ ID NO: 756079 - DNA, 20 bp, Artificial
  CRISPR gRNA sequence
ggcagggatatctggccaag

SEQ ID NO: 756080 - DNA, 20 bp, Artificial
  CRISPR gRNA sequence
gccaagctcaccctccaaag

SEQ ID NO: 756081 - DNA, 20 bp, Artificial
  CRISPR gRNA sequence
accctccaaaggcagatagg

SEQ ID NO: 756082 - DNA, 20 bp, Artificial
  CRISPR gRNA sequence
caaaggcagatagggaacag

SEQ ID NO: 756083 - DNA, 20 bp, Artificial
  CRISPR gRNA sequence
gcaaagctcacaaaatgttg

SEQ ID NO: 756084 - DNA, 20 bp, Artificial
  CRISPR gRNA sequence
acaaaatgttgcttactagc

SEQ ID NO: 756085 - DNA, 20 bp, Artificial
  CRISPR gRNA sequence
cttactagccgtccagagga

SEQ ID NO: 756086 - DNA, 20 bp, Artificial
  CRISPR gRNA sequence
actagccgtccagaggagac

SEQ ID NO: 756087 - DNA, 20 bp, Artificial
  CRISPR gRNA sequence
ctagccgtccagaggagacc

SEQ ID NO: 756088 - DNA, 20 bp, Artificial
  CRISPR gRNA sequence
gccgtccagaggagacctgc

SEQ ID NO: 756089 - DNA, 20 bp, Artificial
  CRISPR gRNA sequence
ctttgatcactagaagagag

SEQ ID NO: 756090 - DNA, 20 bp, Artificial
  CRISPR gRNA sequence
tgatcactagaagagagtgc

SEQ ID NO: 756091 - DNA, 20 bp, Artificial
  CRISPR gRNA sequence
gatcactagaagagagtgct

SEQ ID NO: 756092 - DNA, 20 bp, Artificial
  CRISPR gRNA sequence
atcactagaagagagtgctt

SEQ ID NO: 756093 - DNA, 20 bp, Artificial
  CRISPR gRNA sequence
gaagagagtgctttgcaact

SEQ ID NO: 756094 - DNA, 20 bp, Artificial
  CRISPR gRNA sequence
tgcaactggcttctcaaata

SEQ ID NO: 756095 - DNA, 20 bp, Artificial
  CRISPR gRNA sequence
gcaactggcttctcaaatat

SEQ ID NO: 756096 - DNA, 20 bp, Artificial
  CRISPR gRNA sequence
caactggcttctcaaatatt

SEQ ID NO: 756097 - DNA, 20 bp, Artificial
  CRISPR gRNA sequence
gcttctcaaatattgcccac

SEQ ID NO: 756098 - DNA, 20 bp, Artificial
  CRISPR gRNA sequence
ctcaaatattgcccacaata

SEQ ID NO: 756099 - DNA, 20 bp, Artificial
  CRISPR gRNA sequence
tcaaatattgcccacaataa

SEQ ID NO: 756100 - DNA, 20 bp, Artificial
  CRISPR gRNA sequence
aaatattgcccacaataagg

SEQ ID NO: 756101 - DNA, 20 bp, Artificial
  CRISPR gRNA sequence
cccacaataaggtcctttga

SEQ ID NO: 756102 - DNA, 20 bp, Artificial
  CRISPR gRNA sequence
tgatgggggttttgaaatac

SEQ ID NO: 756103 - DNA, 20 bp, Artificial
  CRISPR gRNA sequence
gatgggggttttgaaatact

SEQ ID NO: 756104 - DNA, 20 bp, Artificial
  CRISPR gRNA sequence
atgggggttttgaaatactg

SEQ ID NO: 756105 - DNA, 20 bp, Artificial
  CRISPR gRNA sequence
tgaaatactgaggtgtctgg

SEQ ID NO: 756106 - DNA, 20 bp, Artificial
  CRISPR gRNA sequence
gaaatactgaggtgtctggg

SEQ ID NO: 756107 - DNA, 20 bp, Artificial
  CRISPR gRNA sequence
aaatactgaggtgtctgggt

SEQ ID NO: 756108 - DNA, 20 bp, Artificial
  CRISPR gRNA sequence
aggtgtctgggttatagaat

SEQ ID NO: 756109 - DNA, 20 bp, Artificial
  CRISPR gRNA sequence
ggttatagaatgtctttact

SEQ ID NO: 756110 - DNA, 20 bp, Artificial
  CRISPR gRNA sequence
tagaatgtctttactttcaa

SEQ ID NO: 756111 - DNA, 20 bp, Artificial
  CRISPR gRNA sequence
tactttcaatattccacgtc

SEQ ID NO: 756112 - DNA, 20 bp, Artificial
  CRISPR gRNA sequence
actttcaatattccacgtca

SEQ ID NO: 756113 - DNA, 20 bp, Artificial
  CRISPR gRNA sequence
ctttcaatattccacgtcaa

SEQ ID NO: 756114 - DNA, 20 bp, Artificial
  CRISPR gRNA sequence
tcaatattccacgtcaaaat

SEQ ID NO: 756115 - DNA, 20 bp, Artificial
  CRISPR gRNA sequence
caatattccacgtcaaaatg

SEQ ID NO: 756116 - DNA, 20 bp, Artificial
  CRISPR gRNA sequence
aatattccacgtcaaaatgc

SEQ ID NO: 756117 - DNA, 20 bp, Artificial
  CRISPR gRNA sequence
cacgtcaaaatgcagccttg

SEQ ID NO: 756118 - DNA, 20 bp, Artificial
  CRISPR gRNA sequence
gctaagatctgcagggaacc

SEQ ID NO: 756119 - DNA, 20 bp, Artificial
  CRISPR gRNA sequence
ctaagatctgcagggaacct

SEQ ID NO: 756120 - DNA, 20 bp, Artificial
  CRISPR gRNA sequence
agatctgcagggaacctgct

SEQ ID NO: 756121 - DNA, 20 bp, Artificial
  CRISPR gRNA sequence
cagggaacctgctgtaatgt

SEQ ID NO: 756122 - DNA, 20 bp, Artificial
  CRISPR gRNA sequence
ctgtaatgtggagcggaact

SEQ ID NO: 756123 - DNA, 20 bp, Artificial
  CRISPR gRNA sequence
taatgtggagcggaacttgc

SEQ ID NO: 756124 - DNA, 20 bp, Artificial
  CRISPR gRNA sequence
gctttgtaattagcatagca

SEQ ID NO: 756125 - DNA, 20 bp, Artificial
  CRISPR gRNA sequence
ctttgtaattagcatagcaa

SEQ ID NO: 756126 - DNA, 20 bp, Artificial
  CRISPR gRNA sequence
tgtaattagcatagcaactg

SEQ ID NO: 756127 - DNA, 20 bp, Artificial
  CRISPR gRNA sequence
gtaattagcatagcaactgt

SEQ ID NO: 756128 - DNA, 20 bp, Artificial
  CRISPR gRNA sequence
taattagcatagcaactgtt

SEQ ID NO: 756129 - DNA, 20 bp, Artificial
  CRISPR gRNA sequence
gcatagcaactgttcctgta

SEQ ID NO: 756130 - DNA, 20 bp, Artificial
  CRISPR gRNA sequence
ttcctgtaccagtgggtact

SEQ ID NO: 756131 - DNA, 20 bp, Artificial
  CRISPR gRNA sequence
ctgtaccagtgggtacttct

SEQ ID NO: 756132 - DNA, 20 bp, Artificial
  CRISPR gRNA sequence
taccagtgggtacttctaaa

SEQ ID NO: 756133 - DNA, 20 bp, Artificial
  CRISPR gRNA sequence
ctaaagtgactgaaaacagt

SEQ ID NO: 756134 - DNA, 20 bp, Artificial
  CRISPR gRNA sequence
taaagtgactgaaaacagtt

SEQ ID NO: 756135 - DNA, 20 bp, Artificial
  CRISPR gRNA sequence
aagtgactgaaaacagtttg

SEQ ID NO: 756136 - DNA, 20 bp, Artificial
  CRISPR gRNA sequence
aaaacagtttgttctcattt

SEQ ID NO: 756137 - DNA, 20 bp, Artificial
  CRISPR gRNA sequence
gttctcatttgcagtatgaa

SEQ ID NO: 756138 - DNA, 20 bp, Artificial
  CRISPR gRNA sequence
ttctcatttgcagtatgaac

SEQ ID NO: 756139 - DNA, 20 bp, Artificial
  CRISPR gRNA sequence
tcatttgcagtatgaacaaa

SEQ ID NO: 756140 - DNA, 20 bp, Artificial
  CRISPR gRNA sequence
atttgcagtatgaacaaacc

SEQ ID NO: 756141 - DNA, 20 bp, Artificial
  CRISPR gRNA sequence
gcagtatgaacaaacctcct

SEQ ID NO: 756142 - DNA, 20 bp, Artificial
  CRISPR gRNA sequence
cagtatgaacaaacctcctg

SEQ ID NO: 756143 - DNA, 20 bp, Artificial
  CRISPR gRNA sequence
ctgaaagcttgtttacgctg

SEQ ID NO: 756144 - DNA, 20 bp, Artificial
  CRISPR gRNA sequence
aaagcttgtttacgctgtcg

SEQ ID NO: 756145 - DNA, 20 bp, Artificial
  CRISPR gRNA sequence
gtttacgctgtcggattgta

SEQ ID NO: 756146 - DNA, 20 bp, Artificial
  CRISPR gRNA sequence
tttacgctgtcggattgtag

SEQ ID NO: 756147 - DNA, 20 bp, Artificial
  CRISPR gRNA sequence
acgctgtcggattgtagagc

SEQ ID NO: 756148 - DNA, 20 bp, Artificial
  CRISPR gRNA sequence
cgctgtcggattgtagagca

SEQ ID NO: 756149 - DNA, 20 bp, Artificial
  CRISPR gRNA sequence
tcggattgtagagcaaaaca

SEQ ID NO: 756150 - DNA, 20 bp, Artificial
  CRISPR gRNA sequence
tagagcaaaacaaaaacagc

SEQ ID NO: 756151 - DNA, 20 bp, Artificial
  CRISPR gRNA sequence
tattcccaaacaaatagcgg

SEQ ID NO: 756152 - DNA, 20 bp, Artificial
  CRISPR gRNA sequence
attcccaaacaaatagcgga

SEQ ID NO: 756153 - DNA, 20 bp, Artificial
  CRISPR gRNA sequence
ttcccaaacaaatagcggaa

SEQ ID NO: 756154 - DNA, 20 bp, Artificial
  CRISPR gRNA sequence
ccaaacaaatagcggaaagg

SEQ ID NO: 756155 - DNA, 20 bp, Artificial
  CRISPR gRNA sequence
agaccacagccatttacctc

SEQ ID NO: 756156 - DNA, 20 bp, Artificial
  CRISPR gRNA sequence
gaccacagccatttacctct

SEQ ID NO: 756157 - DNA, 20 bp, Artificial
  CRISPR gRNA sequence
acctctcagagctctttggg

SEQ ID NO: 756158 - DNA, 20 bp, Artificial
  CRISPR gRNA sequence
cctctcagagctctttgggg

SEQ ID NO: 756159 - DNA, 20 bp, Artificial
  CRISPR gRNA sequence
tcagagctctttggggcgaa

SEQ ID NO: 756160 - DNA, 20 bp, Artificial
  CRISPR gRNA sequence
agagctctttggggcgaagt

SEQ ID NO: 756161 - DNA, 20 bp, Artificial
  CRISPR gRNA sequence
tttggggcgaagttgacact

SEQ ID NO: 756162 - DNA, 20 bp, Artificial
  CRISPR gRNA sequence
tggggcgaagttgacactgt

SEQ ID NO: 756163 - DNA, 20 bp, Artificial
  CRISPR gRNA sequence
ggggcgaagttgacactgtg

SEQ ID NO: 756164 - DNA, 20 bp, Artificial
  CRISPR gRNA sequence
gggcgaagttgacactgtga

SEQ ID NO: 756165 - DNA, 20 bp, Artificial
  CRISPR gRNA sequence
acactgtgacaaggtatccc

SEQ ID NO: 756166 - DNA, 20 bp, Artificial
  CRISPR gRNA sequence
tgacaaggtatcccagccca

SEQ ID NO: 756167 - DNA, 20 bp, Artificial
  CRISPR gRNA sequence
ttggccctgggaaaggctaa

SEQ ID NO: 756168 - DNA, 20 bp, Artificial
  CRISPR gRNA sequence
tggccctgggaaaggctaaa

SEQ ID NO: 756169 - DNA, 20 bp, Artificial
  CRISPR gRNA sequence
ggccctgggaaaggctaaaa

SEQ ID NO: 756170 - DNA, 20 bp, Artificial
  CRISPR gRNA sequence
gccctgggaaaggctaaaat

SEQ ID NO: 756171 - DNA, 20 bp, Artificial
  CRISPR gRNA sequence
ggaaaggctaaaattgggaa

SEQ ID NO: 756172 - DNA, 20 bp, Artificial
  CRISPR gRNA sequence
aaattgggaaggaaatgcgt

SEQ ID NO: 756173 - DNA, 20 bp, Artificial
  CRISPR gRNA sequence
ggaaggaaatgcgtttatgt

SEQ ID NO: 756174 - DNA, 20 bp, Artificial
  CRISPR gRNA sequence
atgttggttgtggttctgag

SEQ ID NO: 756175 - DNA, 20 bp, Artificial
  CRISPR gRNA sequence
tgttggttgtggttctgagg

SEQ ID NO: 756176 - DNA, 20 bp, Artificial
  CRISPR gRNA sequence
gttgtggttctgagggcacg

SEQ ID NO: 756177 - DNA, 20 bp, Artificial
  CRISPR gRNA sequence
tggttctgagggcacgtctg

SEQ ID NO: 756178 - DNA, 20 bp, Artificial
  CRISPR gRNA sequence
tgagggcacgtctgttccca

SEQ ID NO: 756179 - DNA, 20 bp, Artificial
  CRISPR gRNA sequence
agggcacgtctgttcccagc

SEQ ID NO: 756180 - DNA, 20 bp, Artificial
  CRISPR gRNA sequence
ttcccagctaaactcctgca

SEQ ID NO: 756181 - DNA, 20 bp, Artificial
  CRISPR gRNA sequence
ccagctaaactcctgcagtc

SEQ ID NO: 756182 - DNA, 20 bp, Artificial
  CRISPR gRNA sequence
aactcctgcagtcagcagat

SEQ ID NO: 756183 - DNA, 20 bp, Artificial
  CRISPR gRNA sequence
ctgcagtcagcagatgccct

SEQ ID NO: 756184 - DNA, 20 bp, Artificial
  CRISPR gRNA sequence
cagtcagcagatgccctgaa

SEQ ID NO: 756185 - DNA, 20 bp, Artificial
  CRISPR gRNA sequence
aaataaatcaaacctcctca

SEQ ID NO: 756186 - DNA, 20 bp, Artificial
  CRISPR gRNA sequence
ctcatgctgttgggacagcg

SEQ ID NO: 756187 - DNA, 20 bp, Artificial
  CRISPR gRNA sequence
atgctgttgggacagcgaag

SEQ ID NO: 756188 - DNA, 20 bp, Artificial
  CRISPR gRNA sequence
ttgggacagcgaagcttcgt

SEQ ID NO: 756189 - DNA, 20 bp, Artificial
  CRISPR gRNA sequence
ggacagcgaagcttcgtgta

SEQ ID NO: 756190 - DNA, 20 bp, Artificial
  CRISPR gRNA sequence
cgtgtacacctttttggagg

SEQ ID NO: 756191 - DNA, 20 bp, Artificial
  CRISPR gRNA sequence
gtgtacacctttttggaggg

SEQ ID NO: 756192 - DNA, 20 bp, Artificial
  CRISPR gRNA sequence
tttggagggcaatttagcaa

SEQ ID NO: 756193 - DNA, 20 bp, Artificial
  CRISPR gRNA sequence
ttggagggcaatttagcaat

SEQ ID NO: 756194 - DNA, 20 bp, Artificial
  CRISPR gRNA sequence
tggagggcaatttagcaata

SEQ ID NO: 756195 - DNA, 20 bp, Artificial
  CRISPR gRNA sequence
ggagggcaatttagcaatag

SEQ ID NO: 756196 - DNA, 20 bp, Artificial
  CRISPR gRNA sequence
gagggcaatttagcaatagc

SEQ ID NO: 756197 - DNA, 20 bp, Artificial
  CRISPR gRNA sequence
agcaatagcctaaaagaaaa

SEQ ID NO: 756198 - DNA, 20 bp, Artificial
  CRISPR gRNA sequence
gcaatagcctaaaagaaaat

SEQ ID NO: 756199 - DNA, 20 bp, Artificial
  CRISPR gRNA sequence
aaagaaaatgcacatactct

SEQ ID NO: 756200 - DNA, 20 bp, Artificial
  CRISPR gRNA sequence
tttggctcagcactttgacc

SEQ ID NO: 756201 - DNA, 20 bp, Artificial
  CRISPR gRNA sequence
tggctcagcactttgaccgc

SEQ ID NO: 756202 - DNA, 20 bp, Artificial
  CRISPR gRNA sequence
ggctcagcactttgaccgct

SEQ ID NO: 756203 - DNA, 20 bp, Artificial
  CRISPR gRNA sequence
gctcagcactttgaccgcta

SEQ ID NO: 756204 - DNA, 20 bp, Artificial
  CRISPR gRNA sequence
agcactttgaccgctaggaa

SEQ ID NO: 756205 - DNA, 20 bp, Artificial
  CRISPR gRNA sequence
tgaccgctaggaatttacta

SEQ ID NO: 756206 - DNA, 20 bp, Artificial
  CRISPR gRNA sequence
gaccgctaggaatttactac

SEQ ID NO: 756207 - DNA, 20 bp, Artificial
  CRISPR gRNA sequence
accgctaggaatttactaca

SEQ ID NO: 756208 - DNA, 20 bp, Artificial
  CRISPR gRNA sequence
ggaatttactacagatttcc

SEQ ID NO: 756209 - DNA, 20 bp, Artificial
  CRISPR gRNA sequence
actacagatttccttgctga

SEQ ID NO: 756210 - DNA, 20 bp, Artificial
  CRISPR gRNA sequence
ctacagatttccttgctgag

SEQ ID NO: 756211 - DNA, 20 bp, Artificial
  CRISPR gRNA sequence
cagatttccttgctgagtga

SEQ ID NO: 756212 - DNA, 20 bp, Artificial
  CRISPR gRNA sequence
ccttgctgagtgagccaggc

SEQ ID NO: 756213 - DNA, 20 bp, Artificial
  CRISPR gRNA sequence
cttgctgagtgagccaggct

SEQ ID NO: 756214 - DNA, 20 bp, Artificial
  CRISPR gRNA sequence
gctgagtgagccaggctgcg

SEQ ID NO: 756215 - DNA, 20 bp, Artificial
  CRISPR gRNA sequence
ctgagtgagccaggctgcgt

SEQ ID NO: 756216 - DNA, 20 bp, Artificial
  CRISPR gRNA sequence
agtgagccaggctgcgtgca

SEQ ID NO: 756217 - DNA, 20 bp, Artificial
  CRISPR gRNA sequence
cgtgcacaagttcattgcta

SEQ ID NO: 756218 - DNA, 20 bp, Artificial
  CRISPR gRNA sequence
attgctacattattagttat

SEQ ID NO: 756219 - DNA, 20 bp, Artificial
  CRISPR gRNA sequence
ctacattattagttatgctg

SEQ ID NO: 756220 - DNA, 20 bp, Artificial
  CRISPR gRNA sequence
cattattagttatgctgaaa

SEQ ID NO: 756221 - DNA, 20 bp, Artificial
  CRISPR gRNA sequence
ttagttatgctgaaaatgga

SEQ ID NO: 756222 - DNA, 20 bp, Artificial
  CRISPR gRNA sequence
gttatgctgaaaatggaaac

SEQ ID NO: 756223 - DNA, 20 bp, Artificial
  CRISPR gRNA sequence
tgctgaaaatggaaacaaca

SEQ ID NO: 756224 - DNA, 20 bp, Artificial
  CRISPR gRNA sequence
aaaatggaaacaacatgtct

SEQ ID NO: 756225 - DNA, 20 bp, Artificial
  CRISPR gRNA sequence
ccaacaggggactgcttcaa

SEQ ID NO: 756226 - DNA, 20 bp, Artificial
  CRISPR gRNA sequence
cttcaataaatttagtggga

SEQ ID NO: 756227 - DNA, 20 bp, Artificial
  CRISPR gRNA sequence
caataaatttagtgggagcc

SEQ ID NO: 756228 - DNA, 20 bp, Artificial
  CRISPR gRNA sequence
aataaatttagtgggagcca

SEQ ID NO: 756229 - DNA, 20 bp, Artificial
  CRISPR gRNA sequence
agtgggagccatgtgataaa

SEQ ID NO: 756230 - DNA, 20 bp, Artificial
  CRISPR gRNA sequence
gtgggagccatgtgataaaa

SEQ ID NO: 756231 - DNA, 20 bp, Artificial
  CRISPR gRNA sequence
taagcagaatgaggcagggg

SEQ ID NO: 756232 - DNA, 20 bp, Artificial
  CRISPR gRNA sequence
agcagaatgaggcaggggag

SEQ ID NO: 756233 - DNA, 20 bp, Artificial
  CRISPR gRNA sequence
tgctcagtgggaaaagcatt

SEQ ID NO: 756234 - DNA, 20 bp, Artificial
  CRISPR gRNA sequence
agtgggaaaagcattgtcat

SEQ ID NO: 756235 - DNA, 20 bp, Artificial
  CRISPR gRNA sequence
tcatatgatgctgcgtctgc

SEQ ID NO: 756236 - DNA, 20 bp, Artificial
  CRISPR gRNA sequence
cgtctgctgtatttgcaggg

SEQ ID NO: 756237 - DNA, 20 bp, Artificial
  CRISPR gRNA sequence
ctgtatttgcagggaatata

SEQ ID NO: 756238 - DNA, 20 bp, Artificial
  CRISPR gRNA sequence
tatttgcagggaatataact

SEQ ID NO: 756239 - DNA, 20 bp, Artificial
  CRISPR gRNA sequence
gcagggaatataactaggac

SEQ ID NO: 756240 - DNA, 20 bp, Artificial
  CRISPR gRNA sequence
cagggaatataactaggacc

SEQ ID NO: 756241 - DNA, 20 bp, Artificial
  CRISPR gRNA sequence
ggaccataacacaaaaaccg

SEQ ID NO: 756242 - DNA, 20 bp, Artificial
  CRISPR gRNA sequence
ttcagagggggtcttggtac

SEQ ID NO: 756243 - DNA, 20 bp, Artificial
  CRISPR gRNA sequence
cagagggggtcttggtacaa

SEQ ID NO: 756244 - DNA, 20 bp, Artificial
  CRISPR gRNA sequence
agagggggtcttggtacaag

SEQ ID NO: 756245 - DNA, 20 bp, Artificial
  CRISPR gRNA sequence
ggtacaaggggaggaggaga

SEQ ID NO: 756246 - DNA, 20 bp, Artificial
  CRISPR gRNA sequence
gtacaaggggaggaggagat

SEQ ID NO: 756247 - DNA, 20 bp, Artificial
  CRISPR gRNA sequence
gaatattttttaaacttgta

SEQ ID NO: 756248 - DNA, 20 bp, Artificial
  CRISPR gRNA sequence
tttaaacttgtacttttttt

SEQ ID NO: 756249 - DNA, 20 bp, Artificial
  CRISPR gRNA sequence
ttaaacttgtactttttttg

SEQ ID NO: 756250 - DNA, 20 bp, Artificial
  CRISPR gRNA sequence
taaacttgtactttttttgg

SEQ ID NO: 756251 - DNA, 20 bp, Artificial
  CRISPR gRNA sequence
aaacttgtactttttttggt

SEQ ID NO: 756252 - DNA, 20 bp, Artificial
  CRISPR gRNA sequence
aacttgtactttttttggta

SEQ ID NO: 756253 - DNA, 20 bp, Artificial
  CRISPR gRNA sequence
gtactttttttggtagttta

SEQ ID NO: 756254 - DNA, 20 bp, Artificial
  CRISPR gRNA sequence
tactttttttggtagtttaa

SEQ ID NO: 756255 - DNA, 20 bp, Artificial
  CRISPR gRNA sequence
tttttggtagtttaataagt

SEQ ID NO: 756256 - DNA, 20 bp, Artificial
  CRISPR gRNA sequence
ttttggtagtttaataagtt

SEQ ID NO: 756257 - DNA, 20 bp, Artificial
  CRISPR gRNA sequence
tttggtagtttaataagttt

SEQ ID NO: 756258 - DNA, 20 bp, Artificial
  CRISPR gRNA sequence
ttggtagtttaataagttta

SEQ ID NO: 756259 - DNA, 20 bp, Artificial
  CRISPR gRNA sequence
tggtagtttaataagtttaa

SEQ ID NO: 756260 - DNA, 20 bp, Artificial
  CRISPR gRNA sequence
ggtagtttaataagtttaaa

SEQ ID NO: 756261 - DNA, 20 bp, Artificial
  CRISPR gRNA sequence
gtagtttaataagtttaaaa

SEQ ID NO: 756262 - DNA, 20 bp, Artificial
  CRISPR gRNA sequence
aataagtttaaaattgaaaa

SEQ ID NO: 756263 - DNA, 20 bp, Artificial
  CRISPR gRNA sequence
ataagtttaaaattgaaaaa

SEQ ID NO: 756264 - DNA, 20 bp, Artificial
  CRISPR gRNA sequence
aaaattgaaaaacattgtac

SEQ ID NO: 756265 - DNA, 20 bp, Artificial
  CRISPR gRNA sequence
aaattgaaaaacattgtaca

SEQ ID NO: 756266 - DNA, 20 bp, Artificial
  CRISPR gRNA sequence
aaaaacattgtacaaggatt

SEQ ID NO: 756267 - DNA, 20 bp, Artificial
  CRISPR gRNA sequence
tacaaggattcacgtttttc

SEQ ID NO: 756268 - DNA, 20 bp, Artificial
  CRISPR gRNA sequence
acgtttttctagttctcacc

SEQ ID NO: 756269 - DNA, 20 bp, Artificial
  CRISPR gRNA sequence
ttctagttctcaccccgggt

SEQ ID NO: 756270 - DNA, 20 bp, Artificial
  CRISPR gRNA sequence
tctagttctcaccccgggtg

SEQ ID NO: 756271 - DNA, 20 bp, Artificial
  CRISPR gRNA sequence
ctagttctcaccccgggtgt

SEQ ID NO: 756272 - DNA, 20 bp, Artificial
  CRISPR gRNA sequence
tagttctcaccccgggtgtt

SEQ ID NO: 756273 - DNA, 20 bp, Artificial
  CRISPR gRNA sequence
gttctcaccccgggtgtttc

SEQ ID NO: 756274 - DNA, 20 bp, Artificial
  CRISPR gRNA sequence
tcaccccgggtgtttctcct

SEQ ID NO: 756275 - DNA, 20 bp, Artificial
  CRISPR gRNA sequence
accccgggtgtttctcctgt

SEQ ID NO: 756276 - DNA, 20 bp, Artificial
  CRISPR gRNA sequence
ctcctgtgacttgtgtggtg

SEQ ID NO: 756277 - DNA, 20 bp, Artificial
  CRISPR gRNA sequence
tcctgtgacttgtgtggtga

SEQ ID NO: 756278 - DNA, 20 bp, Artificial
  CRISPR gRNA sequence
ctgtgacttgtgtggtgaga

SEQ ID NO: 756279 - DNA, 20 bp, Artificial
  CRISPR gRNA sequence
tgacttgtgtggtgagatca

SEQ ID NO: 756280 - DNA, 20 bp, Artificial
  CRISPR gRNA sequence
gtgtggtgagatcaaggggt

SEQ ID NO: 756281 - DNA, 20 bp, Artificial
  CRISPR gRNA sequence
tgtggtgagatcaaggggtt

SEQ ID NO: 756282 - DNA, 20 bp, Artificial
  CRISPR gRNA sequence
tagaggccccatcccagagc

SEQ ID NO: 756283 - DNA, 20 bp, Artificial
  CRISPR gRNA sequence
gaggccccatcccagagcta

SEQ ID NO: 756284 - DNA, 20 bp, Artificial
  CRISPR gRNA sequence
aggagtctctgggatgagtt

SEQ ID NO: 756285 - DNA, 20 bp, Artificial
  CRISPR gRNA sequence
tgggatgagttggggctttt

SEQ ID NO: 756286 - DNA, 20 bp, Artificial
  CRISPR gRNA sequence
ggatgagttggggcttttta

SEQ ID NO: 756287 - DNA, 20 bp, Artificial
  CRISPR gRNA sequence
gggctttttatctattatga

SEQ ID NO: 756288 - DNA, 20 bp, Artificial
  CRISPR gRNA sequence
tttatctattatgataaaac

SEQ ID NO: 756289 - DNA, 20 bp, Artificial
  CRISPR gRNA sequence
ttatctattatgataaaaca

SEQ ID NO: 756290 - DNA, 20 bp, Artificial
  CRISPR gRNA sequence
tatctattatgataaaacat

SEQ ID NO: 756291 - DNA, 20 bp, Artificial
  CRISPR gRNA sequence
atctattatgataaaacata

SEQ ID NO: 756292 - DNA, 20 bp, Artificial
  CRISPR gRNA sequence
tctattatgataaaacatat

SEQ ID NO: 756293 - DNA, 20 bp, Artificial
  CRISPR gRNA sequence
ttatgataaaacatatataa

SEQ ID NO: 756294 - DNA, 20 bp, Artificial
  CRISPR gRNA sequence
tgataaaacatatataatgt

SEQ ID NO: 756295 - DNA, 20 bp, Artificial
  CRISPR gRNA sequence
gccatttcaaccattttaag

SEQ ID NO: 756296 - DNA, 20 bp, Artificial
  CRISPR gRNA sequence
ccatttcaaccattttaagc

SEQ ID NO: 756297 - DNA, 20 bp, Artificial
  CRISPR gRNA sequence
caaccattttaagcctacag

SEQ ID NO: 756298 - DNA, 20 bp, Artificial
  CRISPR gRNA sequence
aaccattttaagcctacagt

SEQ ID NO: 756299 - DNA, 20 bp, Artificial
  CRISPR gRNA sequence
taagcctacagtttggtggc

SEQ ID NO: 756300 - DNA, 20 bp, Artificial
  CRISPR gRNA sequence
aagcctacagtttggtggca

SEQ ID NO: 756301 - DNA, 20 bp, Artificial
  CRISPR gRNA sequence
agcctacagtttggtggcat

SEQ ID NO: 756302 - DNA, 20 bp, Artificial
  CRISPR gRNA sequence
cagtttggtggcattaatta

SEQ ID NO: 756303 - DNA, 20 bp, Artificial
  CRISPR gRNA sequence
ggtggcattaattacattca

SEQ ID NO: 756304 - DNA, 20 bp, Artificial
  CRISPR gRNA sequence
gtggcattaattacattcac

SEQ ID NO: 756305 - DNA, 20 bp, Artificial
  CRISPR gRNA sequence
attacattcacaatgtgcaa

SEQ ID NO: 756306 - DNA, 20 bp, Artificial
  CRISPR gRNA sequence
cattcacaatgtgcaaccgt

SEQ ID NO: 756307 - DNA, 20 bp, Artificial
  CRISPR gRNA sequence
acaatgtgcaaccgtcacca

SEQ ID NO: 756308 - DNA, 20 bp, Artificial
  CRISPR gRNA sequence
tctattttcaaaactttcat

SEQ ID NO: 756309 - DNA, 20 bp, Artificial
  CRISPR gRNA sequence
ttttcaaaactttcatcact

SEQ ID NO: 756310 - DNA, 20 bp, Artificial
  CRISPR gRNA sequence
tcaaaactttcatcacttag

SEQ ID NO: 756311 - DNA, 20 bp, Artificial
  CRISPR gRNA sequence
caaaactttcatcacttagg

SEQ ID NO: 756312 - DNA, 20 bp, Artificial
  CRISPR gRNA sequence
aaaactttcatcacttaggc

SEQ ID NO: 756313 - DNA, 20 bp, Artificial
  CRISPR gRNA sequence
tcatcacttaggcttctttt

SEQ ID NO: 756314 - DNA, 20 bp, Artificial
  CRISPR gRNA sequence
catcacttaggcttcttttg

SEQ ID NO: 756315 - DNA, 20 bp, Artificial
  CRISPR gRNA sequence
atcacttaggcttcttttga

SEQ ID NO: 756316 - DNA, 20 bp, Artificial
  CRISPR gRNA sequence
aggcttcttttgaccttgag

SEQ ID NO: 756317 - DNA, 20 bp, Artificial
  CRISPR gRNA sequence
ggcttcttttgaccttgagc

SEQ ID NO: 756318 - DNA, 20 bp, Artificial
  CRISPR gRNA sequence
cttttgaccttgagctctgt

SEQ ID NO: 756319 - DNA, 20 bp, Artificial
  CRISPR gRNA sequence
ttttgaccttgagctctgtg

SEQ ID NO: 756320 - DNA, 20 bp, Artificial
  CRISPR gRNA sequence
ttgaccttgagctctgtggc

SEQ ID NO: 756321 - DNA, 20 bp, Artificial
  CRISPR gRNA sequence
tgaccttgagctctgtggca

SEQ ID NO: 756322 - DNA, 20 bp, Artificial
  CRISPR gRNA sequence
gaccttgagctctgtggcat

SEQ ID NO: 756323 - DNA, 20 bp, Artificial
  CRISPR gRNA sequence
accttgagctctgtggcatg

SEQ ID NO: 756324 - DNA, 20 bp, Artificial
  CRISPR gRNA sequence
gagctctgtggcatggggtc

SEQ ID NO: 756325 - DNA, 20 bp, Artificial
  CRISPR gRNA sequence
agctctgtggcatggggtct

SEQ ID NO: 756326 - DNA, 20 bp, Artificial
  CRISPR gRNA sequence
tgtggcatggggtctgcgaa

SEQ ID NO: 756327 - DNA, 20 bp, Artificial
  CRISPR gRNA sequence
tggcatggggtctgcgaagg

SEQ ID NO: 756328 - DNA, 20 bp, Artificial
  CRISPR gRNA sequence
cgaaggccctgctctccctt

SEQ ID NO: 756329 - DNA, 20 bp, Artificial
  CRISPR gRNA sequence
ctctcccttttcagagaaca

SEQ ID NO: 756330 - DNA, 20 bp, Artificial
  CRISPR gRNA sequence
tcccttttcagagaacaacc

SEQ ID NO: 756331 - DNA, 20 bp, Artificial
  CRISPR gRNA sequence
ccttttcagagaacaacctg

SEQ ID NO: 756332 - DNA, 20 bp, Artificial
  CRISPR gRNA sequence
ttcagagaacaacctgtagc

SEQ ID NO: 756333 - DNA, 20 bp, Artificial
  CRISPR gRNA sequence
tcagagaacaacctgtagcc

SEQ ID NO: 756334 - DNA, 20 bp, Artificial
  CRISPR gRNA sequence
cagagaacaacctgtagcca

SEQ ID NO: 756335 - DNA, 20 bp, Artificial
  CRISPR gRNA sequence
agagaacaacctgtagccaa

SEQ ID NO: 756336 - DNA, 20 bp, Artificial
  CRISPR gRNA sequence
tagccaagggtgttccagct

SEQ ID NO: 756337 - DNA, 20 bp, Artificial
  CRISPR gRNA sequence
cagctgtaccttgtgggctg

SEQ ID NO: 756338 - DNA, 20 bp, Artificial
  CRISPR gRNA sequence
taccttgtgggctgggatga

SEQ ID NO: 756339 - DNA, 20 bp, Artificial
  CRISPR gRNA sequence
gtgggctgggatgaggactc

SEQ ID NO: 756340 - DNA, 20 bp, Artificial
  CRISPR gRNA sequence
tgggctgggatgaggactct

SEQ ID NO: 756341 - DNA, 20 bp, Artificial
  CRISPR gRNA sequence
ggatgaggactctgttccct

SEQ ID NO: 756342 - DNA, 20 bp, Artificial
  CRISPR gRNA sequence
tgttccctctcttgcctgga

SEQ ID NO: 756343 - DNA, 20 bp, Artificial
  CRISPR gRNA sequence
ttccctctcttgcctggagc

SEQ ID NO: 756344 - DNA, 20 bp, Artificial
  CRISPR gRNA sequence
cctctcttgcctggagctgc

SEQ ID NO: 756345 - DNA, 20 bp, Artificial
  CRISPR gRNA sequence
tcttgcctggagctgcctga

SEQ ID NO: 756346 - DNA, 20 bp, Artificial
  CRISPR gRNA sequence
ttgcctggagctgcctgagc

SEQ ID NO: 756347 - DNA, 20 bp, Artificial
  CRISPR gRNA sequence
gcctggagctgcctgagctg

SEQ ID NO: 756348 - DNA, 20 bp, Artificial
  CRISPR gRNA sequence
cctggagctgcctgagctgt

SEQ ID NO: 756349 - DNA, 20 bp, Artificial
  CRISPR gRNA sequence
gagctgcctgagctgtaggt

SEQ ID NO: 756350 - DNA, 20 bp, Artificial
  CRISPR gRNA sequence
cctgagctgtaggtgacagg

SEQ ID NO: 756351 - DNA, 20 bp, Artificial
  CRISPR gRNA sequence
agctgtaggtgacaggtctt

SEQ ID NO: 756352 - DNA, 20 bp, Artificial
  CRISPR gRNA sequence
taggtgacaggtcttgtttc

SEQ ID NO: 756353 - DNA, 20 bp, Artificial
  CRISPR gRNA sequence
gtttctgagtgctccagggg

SEQ ID NO: 756354 - DNA, 20 bp, Artificial
  CRISPR gRNA sequence
tttctgagtgctccaggggc

SEQ ID NO: 756355 - DNA, 20 bp, Artificial
  CRISPR gRNA sequence
ctgagtgctccaggggcata

SEQ ID NO: 756356 - DNA, 20 bp, Artificial
  CRISPR gRNA sequence
tgagtgctccaggggcatag

SEQ ID NO: 756357 - DNA, 20 bp, Artificial
  CRISPR gRNA sequence
agtgctccaggggcataggg

SEQ ID NO: 756358 - DNA, 20 bp, Artificial
  CRISPR gRNA sequence
caggggcatagggcggcagg

SEQ ID NO: 756359 - DNA, 20 bp, Artificial
  CRISPR gRNA sequence
tctttgaaaggagaaccgcc

SEQ ID NO: 756360 - DNA, 20 bp, Artificial
  CRISPR gRNA sequence
tttgaaaggagaaccgcctt

SEQ ID NO: 756361 - DNA, 20 bp, Artificial
  CRISPR gRNA sequence
tgaaaggagaaccgccttat

SEQ ID NO: 756362 - DNA, 20 bp, Artificial
  CRISPR gRNA sequence
gaaaggagaaccgccttatc

SEQ ID NO: 756363 - DNA, 20 bp, Artificial
  CRISPR gRNA sequence
aaaggagaaccgccttatct

SEQ ID NO: 756364 - DNA, 20 bp, Artificial
  CRISPR gRNA sequence
atcttccatgcctctgtagg

SEQ ID NO: 756365 - DNA, 20 bp, Artificial
  CRISPR gRNA sequence
tcttccatgcctctgtaggt

SEQ ID NO: 756366 - DNA, 20 bp, Artificial
  CRISPR gRNA sequence
ccatgcctctgtaggttgct

SEQ ID NO: 756367 - DNA, 20 bp, Artificial
  CRISPR gRNA sequence
catgcctctgtaggttgctg

SEQ ID NO: 756368 - DNA, 20 bp, Artificial
  CRISPR gRNA sequence
tgtaggttgctgggggtcta

SEQ ID NO: 756369 - DNA, 20 bp, Artificial
  CRISPR gRNA sequence
taggttgctgggggtctagc

SEQ ID NO: 756370 - DNA, 20 bp, Artificial
  CRISPR gRNA sequence
ctgggggtctagctgtggga

SEQ ID NO: 756371 - DNA, 20 bp, Artificial
  CRISPR gRNA sequence
ggggtctagctgtgggactc

SEQ ID NO: 756372 - DNA, 20 bp, Artificial
  CRISPR gRNA sequence
gctgtgggactctggggaaa

SEQ ID NO: 756373 - DNA, 20 bp, Artificial
  CRISPR gRNA sequence
tgggactctggggaaaggcg

SEQ ID NO: 756374 - DNA, 20 bp, Artificial
  CRISPR gRNA sequence
tggggaaaggcgggtctcct

SEQ ID NO: 756375 - DNA, 20 bp, Artificial
  CRISPR gRNA sequence
gggaaaggcgggtctcctgc

SEQ ID NO: 756376 - DNA, 20 bp, Artificial
  CRISPR gRNA sequence
ctgcttcctggccttccctc

SEQ ID NO: 756377 - DNA, 20 bp, Artificial
  CRISPR gRNA sequence
cttcctggccttccctctct

SEQ ID NO: 756378 - DNA, 20 bp, Artificial
  CRISPR gRNA sequence
cctggccttccctctctgag

SEQ ID NO: 756379 - DNA, 20 bp, Artificial
  CRISPR gRNA sequence
ctggccttccctctctgagc

SEQ ID NO: 756380 - DNA, 20 bp, Artificial
  CRISPR gRNA sequence
gccttccctctctgagcctc

SEQ ID NO: 756381 - DNA, 20 bp, Artificial
  CRISPR gRNA sequence
ccctctctgagcctcagttt

SEQ ID NO: 756382 - DNA, 20 bp, Artificial
  CRISPR gRNA sequence
cctctctgagcctcagttta

SEQ ID NO: 756383 - DNA, 20 bp, Artificial
  CRISPR gRNA sequence
tctgagcctcagtttatgct

SEQ ID NO: 756384 - DNA, 20 bp, Artificial
  CRISPR gRNA sequence
tgagcctcagtttatgctca

SEQ ID NO: 756385 - DNA, 20 bp, Artificial
  CRISPR gRNA sequence
agcctcagtttatgctcagg

SEQ ID NO: 756386 - DNA, 20 bp, Artificial
  CRISPR gRNA sequence
agtttatgctcaggaggagc

SEQ ID NO: 756387 - DNA, 20 bp, Artificial
  CRISPR gRNA sequence
atgctcaggaggagcaatgg

SEQ ID NO: 756388 - DNA, 20 bp, Artificial
  CRISPR gRNA sequence
tgctcaggaggagcaatggg

SEQ ID NO: 756389 - DNA, 20 bp, Artificial
  CRISPR gRNA sequence
aggaggagcaatgggaatgg

SEQ ID NO: 756390 - DNA, 20 bp, Artificial
  CRISPR gRNA sequence
caccttggctacctctctgc

SEQ ID NO: 756391 - DNA, 20 bp, Artificial
  CRISPR gRNA sequence
accttggctacctctctgcc

SEQ ID NO: 756392 - DNA, 20 bp, Artificial
  CRISPR gRNA sequence
ggctacctctctgccctttc

SEQ ID NO: 756393 - DNA, 20 bp, Artificial
  CRISPR gRNA sequence
gctacctctctgccctttca

SEQ ID NO: 756394 - DNA, 20 bp, Artificial
  CRISPR gRNA sequence
cctctctgccctttcagaca

SEQ ID NO: 756395 - DNA, 20 bp, Artificial
  CRISPR gRNA sequence
tctgccctttcagacatcac

SEQ ID NO: 756396 - DNA, 20 bp, Artificial
  CRISPR gRNA sequence
tgccctttcagacatcacgg

SEQ ID NO: 756397 - DNA, 20 bp, Artificial
  CRISPR gRNA sequence
ccctttcagacatcacggct

SEQ ID NO: 756398 - DNA, 20 bp, Artificial
  CRISPR gRNA sequence
tcagacatcacggctgcagc

SEQ ID NO: 756399 - DNA, 20 bp, Artificial
  CRISPR gRNA sequence
cagacatcacggctgcagcc

SEQ ID NO: 756400 - DNA, 20 bp, Artificial
  CRISPR gRNA sequence
agacatcacggctgcagccc

SEQ ID NO: 756401 - DNA, 20 bp, Artificial
  CRISPR gRNA sequence
cagccctggctacgggtgcc

SEQ ID NO: 756402 - DNA, 20 bp, Artificial
  CRISPR gRNA sequence
gctacgggtgcctgcatcgt

SEQ ID NO: 756403 - DNA, 20 bp, Artificial
  CRISPR gRNA sequence
cgggtgcctgcatcgtagga

SEQ ID NO: 756404 - DNA, 20 bp, Artificial
  CRISPR gRNA sequence
catcgtaggaatcctctgcc

SEQ ID NO: 756405 - DNA, 20 bp, Artificial
  CRISPR gRNA sequence
tgcctccccctcatcctgct

SEQ ID NO: 756406 - DNA, 20 bp, Artificial
  CRISPR gRNA sequence
cctccccctcatcctgctcc

SEQ ID NO: 756407 - DNA, 20 bp, Artificial
  CRISPR gRNA sequence
cccctcatcctgctcctggt

SEQ ID NO: 756408 - DNA, 20 bp, Artificial
  CRISPR gRNA sequence
atcctgctcctggtctacaa

SEQ ID NO: 756409 - DNA, 20 bp, Artificial
  CRISPR gRNA sequence
ctcctggtctacaagcaaag

SEQ ID NO: 756410 - DNA, 20 bp, Artificial
  CRISPR gRNA sequence
ctggtctacaagcaaaggca

SEQ ID NO: 756411 - DNA, 20 bp, Artificial
  CRISPR gRNA sequence
gtctacaagcaaaggcaggc

SEQ ID NO: 756412 - DNA, 20 bp, Artificial
  CRISPR gRNA sequence
caagcaaaggcaggcagcct

SEQ ID NO: 756413 - DNA, 20 bp, Artificial
  CRISPR gRNA sequence
caaccgccgtgagtattcct

SEQ ID NO: 756414 - DNA, 20 bp, Artificial
  CRISPR gRNA sequence
ctccctgcctggggtgggtg

SEQ ID NO: 756415 - DNA, 20 bp, Artificial
  CRISPR gRNA sequence
cctgcctggggtgggtggac

SEQ ID NO: 756416 - DNA, 20 bp, Artificial
  CRISPR gRNA sequence
cctggggtgggtggacggtg

SEQ ID NO: 756417 - DNA, 20 bp, Artificial
  CRISPR gRNA sequence
gggtgggtggacggtgcgag

SEQ ID NO: 756418 - DNA, 20 bp, Artificial
  CRISPR gRNA sequence
ctccagcccccagttcagcc

SEQ ID NO: 756419 - DNA, 20 bp, Artificial
  CRISPR gRNA sequence
cagcccccagttcagcccct

SEQ ID NO: 756420 - DNA, 20 bp, Artificial
  CRISPR gRNA sequence
agcccctgggattcgcaaag

SEQ ID NO: 756421 - DNA, 20 bp, Artificial
  CRISPR gRNA sequence
ggattcgcaaaggcacgatg

SEQ ID NO: 756422 - DNA, 20 bp, Artificial
  CRISPR gRNA sequence
gcaaaggcacgatgcaggca

SEQ ID NO: 756423 - DNA, 20 bp, Artificial
  CRISPR gRNA sequence
cttttcatttgagagttggg

SEQ ID NO: 756424 - DNA, 20 bp, Artificial
  CRISPR gRNA sequence
ttcatttgagagttgggagc

SEQ ID NO: 756425 - DNA, 20 bp, Artificial
  CRISPR gRNA sequence
tcatttgagagttgggagca

SEQ ID NO: 756426 - DNA, 20 bp, Artificial
  CRISPR gRNA sequence
catttgagagttgggagcag

SEQ ID NO: 756427 - DNA, 20 bp, Artificial
  CRISPR gRNA sequence
atttgagagttgggagcagc

SEQ ID NO: 756428 - DNA, 20 bp, Artificial
  CRISPR gRNA sequence
gagagttgggagcagctgca

SEQ ID NO: 756429 - DNA, 20 bp, Artificial
  CRISPR gRNA sequence
agagttgggagcagctgcac

SEQ ID NO: 756430 - DNA, 20 bp, Artificial
  CRISPR gRNA sequence
ggagcagctgcacttcccgc

SEQ ID NO: 756431 - DNA, 20 bp, Artificial
  CRISPR gRNA sequence
cacttcccgccaggagctgg

SEQ ID NO: 756432 - DNA, 20 bp, Artificial
  CRISPR gRNA sequence
cccgccaggagctgggcgaa

SEQ ID NO: 756433 - DNA, 20 bp, Artificial
  CRISPR gRNA sequence
ccgccaggagctgggcgaaa

SEQ ID NO: 756434 - DNA, 20 bp, Artificial
  CRISPR gRNA sequence
ggcgaaatggccgagagaaa

SEQ ID NO: 756435 - DNA, 20 bp, Artificial
  CRISPR gRNA sequence
ccgggggccaagtgcccacc

SEQ ID NO: 756436 - DNA, 20 bp, Artificial
  CRISPR gRNA sequence
cgggggccaagtgcccacca

SEQ ID NO: 756437 - DNA, 20 bp, Artificial
  CRISPR gRNA sequence
tggctcccaggcagtgctgg

SEQ ID NO: 756438 - DNA, 20 bp, Artificial
  CRISPR gRNA sequence
ggctcccaggcagtgctggc

SEQ ID NO: 756439 - DNA, 20 bp, Artificial
  CRISPR gRNA sequence
gctcccaggcagtgctggct

SEQ ID NO: 756440 - DNA, 20 bp, Artificial
  CRISPR gRNA sequence
ccaggcagtgctggctcggc

SEQ ID NO: 756441 - DNA, 20 bp, Artificial
  CRISPR gRNA sequence
gctcggcactcaatacatgt

SEQ ID NO: 756442 - DNA, 20 bp, Artificial
  CRISPR gRNA sequence
ggcactcaatacatgtcttc

SEQ ID NO: 756443 - DNA, 20 bp, Artificial
  CRISPR gRNA sequence
aatacatgtcttctgaatga

SEQ ID NO: 756444 - DNA, 20 bp, Artificial
  CRISPR gRNA sequence
ctgaatgaatgatcatatgc

SEQ ID NO: 756445 - DNA, 20 bp, Artificial
  CRISPR gRNA sequence
tgaatgaatgatcatatgca

SEQ ID NO: 756446 - DNA, 20 bp, Artificial
  CRISPR gRNA sequence
aatgaatgatcatatgcagt

SEQ ID NO: 756447 - DNA, 20 bp, Artificial
  CRISPR gRNA sequence
aagttgctttataaaagcaa

SEQ ID NO: 756448 - DNA, 20 bp, Artificial
  CRISPR gRNA sequence
ctttataaaagcaagttgct

SEQ ID NO: 756449 - DNA, 20 bp, Artificial
  CRISPR gRNA sequence
tataaaagcaagttgctgcc

SEQ ID NO: 756450 - DNA, 20 bp, Artificial
  CRISPR gRNA sequence
ataaaagcaagttgctgcca

SEQ ID NO: 756451 - DNA, 20 bp, Artificial
  CRISPR gRNA sequence
taaaagcaagttgctgccac

SEQ ID NO: 756452 - DNA, 20 bp, Artificial
  CRISPR gRNA sequence
ctgccactcagagatccttg

SEQ ID NO: 756453 - DNA, 20 bp, Artificial
  CRISPR gRNA sequence
ccactcagagatccttgggg

SEQ ID NO: 756454 - DNA, 20 bp, Artificial
  CRISPR gRNA sequence
agagatccttgggggacctg

SEQ ID NO: 756455 - DNA, 20 bp, Artificial
  CRISPR gRNA sequence
gggggacctgtttaaggtat

SEQ ID NO: 756456 - DNA, 20 bp, Artificial
  CRISPR gRNA sequence
ggggacctgtttaaggtatg

SEQ ID NO: 756457 - DNA, 20 bp, Artificial
  CRISPR gRNA sequence
tttaaggtatgggcgtgctt

SEQ ID NO: 756458 - DNA, 20 bp, Artificial
  CRISPR gRNA sequence
aaggtatgggcgtgcttgtt

SEQ ID NO: 756459 - DNA, 20 bp, Artificial
  CRISPR gRNA sequence
aggtatgggcgtgcttgttt

SEQ ID NO: 756460 - DNA, 20 bp, Artificial
  CRISPR gRNA sequence
gttttgtaattagtagcaat

SEQ ID NO: 756461 - DNA, 20 bp, Artificial
  CRISPR gRNA sequence
ttttgtaattagtagcaatt

SEQ ID NO: 756462 - DNA, 20 bp, Artificial
  CRISPR gRNA sequence
tgtaattagtagcaattgtt

SEQ ID NO: 756463 - DNA, 20 bp, Artificial
  CRISPR gRNA sequence
gtaattagtagcaattgttg

SEQ ID NO: 756464 - DNA, 20 bp, Artificial
  CRISPR gRNA sequence
taattagtagcaattgttgg

SEQ ID NO: 756465 - DNA, 20 bp, Artificial
  CRISPR gRNA sequence
gtagcaattgttgggacaaa

SEQ ID NO: 756466 - DNA, 20 bp, Artificial
  CRISPR gRNA sequence
ttgggacaaaaaatgatctt

SEQ ID NO: 756467 - DNA, 20 bp, Artificial
  CRISPR gRNA sequence
ggacaaaaaatgatctttgg

SEQ ID NO: 756468 - DNA, 20 bp, Artificial
  CRISPR gRNA sequence
tggaatatcagaagtggaag

SEQ ID NO: 756469 - DNA, 20 bp, Artificial
  CRISPR gRNA sequence
ggaatatcagaagtggaagg

SEQ ID NO: 756470 - DNA, 20 bp, Artificial
  CRISPR gRNA sequence
gaatatcagaagtggaaggg

SEQ ID NO: 756471 - DNA, 20 bp, Artificial
  CRISPR gRNA sequence
acagacaacttagctcaacc

SEQ ID NO: 756472 - DNA, 20 bp, Artificial
  CRISPR gRNA sequence
cagacaacttagctcaaccc

SEQ ID NO: 756473 - DNA, 20 bp, Artificial
  CRISPR gRNA sequence
agctcaaccctttctttttc

SEQ ID NO: 756474 - DNA, 20 bp, Artificial
  CRISPR gRNA sequence
gctcaaccctttctttttcc

SEQ ID NO: 756475 - DNA, 20 bp, Artificial
  CRISPR gRNA sequence
aaccctttctttttccagat

SEQ ID NO: 756476 - DNA, 20 bp, Artificial
  CRISPR gRNA sequence
tctttttccagatgagaagg

SEQ ID NO: 756477 - DNA, 20 bp, Artificial
  CRISPR gRNA sequence
ctttttccagatgagaaggc

SEQ ID NO: 756478 - DNA, 20 bp, Artificial
  CRISPR gRNA sequence
tttttccagatgagaaggct

SEQ ID NO: 756479 - DNA, 20 bp, Artificial
  CRISPR gRNA sequence
tttccagatgagaaggctaa

SEQ ID NO: 756480 - DNA, 20 bp, Artificial
  CRISPR gRNA sequence
ttccagatgagaaggctaag

SEQ ID NO: 756481 - DNA, 20 bp, Artificial
  CRISPR gRNA sequence
tccagatgagaaggctaaga

SEQ ID NO: 756482 - DNA, 20 bp, Artificial
  CRISPR gRNA sequence
ccagatgagaaggctaagat

SEQ ID NO: 756483 - DNA, 20 bp, Artificial
  CRISPR gRNA sequence
cagatgagaaggctaagatc

SEQ ID NO: 756484 - DNA, 20 bp, Artificial
  CRISPR gRNA sequence
agatcagtggggttacataa

SEQ ID NO: 756485 - DNA, 20 bp, Artificial
  CRISPR gRNA sequence
cataactgactgaatgttac

SEQ ID NO: 756486 - DNA, 20 bp, Artificial
  CRISPR gRNA sequence
actgaatgttacgtaactta

SEQ ID NO: 756487 - DNA, 20 bp, Artificial
  CRISPR gRNA sequence
aatgttacgtaacttagtaa

SEQ ID NO: 756488 - DNA, 20 bp, Artificial
  CRISPR gRNA sequence
cgtaacttagtaagtggcag

SEQ ID NO: 756489 - DNA, 20 bp, Artificial
  CRISPR gRNA sequence
agtaagtggcagagctagga

SEQ ID NO: 756490 - DNA, 20 bp, Artificial
  CRISPR gRNA sequence
gtaagtggcagagctaggac

SEQ ID NO: 756491 - DNA, 20 bp, Artificial
  CRISPR gRNA sequence
ggactcaatctcagagcttt

SEQ ID NO: 756492 - DNA, 20 bp, Artificial
  CRISPR gRNA sequence
aatctcagagctttcaacgc

SEQ ID NO: 756493 - DNA, 20 bp, Artificial
  CRISPR gRNA sequence
agagctttcaacgcatgctc

SEQ ID NO: 756494 - DNA, 20 bp, Artificial
  CRISPR gRNA sequence
tcaacgcatgctctttccag

SEQ ID NO: 756495 - DNA, 20 bp, Artificial
  CRISPR gRNA sequence
caacgcatgctctttccagg

SEQ ID NO: 756496 - DNA, 20 bp, Artificial
  CRISPR gRNA sequence
aacgcatgctctttccaggg

SEQ ID NO: 756497 - DNA, 20 bp, Artificial
  CRISPR gRNA sequence
tttccagggaatagaagtcc

SEQ ID NO: 756498 - DNA, 20 bp, Artificial
  CRISPR gRNA sequence
tccagggaatagaagtccac

SEQ ID NO: 756499 - DNA, 20 bp, Artificial
  CRISPR gRNA sequence
ccagggaatagaagtccacc

SEQ ID NO: 756500 - DNA, 20 bp, Artificial
  CRISPR gRNA sequence
cagggaatagaagtccacca

SEQ ID NO: 756501 - DNA, 20 bp, Artificial
  CRISPR gRNA sequence
tcacttactcctcattgcaa

SEQ ID NO: 756502 - DNA, 20 bp, Artificial
  CRISPR gRNA sequence
acttactcctcattgcaagt

SEQ ID NO: 756503 - DNA, 20 bp, Artificial
  CRISPR gRNA sequence
actcctcattgcaagtccaa

SEQ ID NO: 756504 - DNA, 20 bp, Artificial
  CRISPR gRNA sequence
ctcctcattgcaagtccaag

SEQ ID NO: 756505 - DNA, 20 bp, Artificial
  CRISPR gRNA sequence
ctcattgcaagtccaagaat

SEQ ID NO: 756506 - DNA, 20 bp, Artificial
  CRISPR gRNA sequence
attgcaagtccaagaatttg

SEQ ID NO: 756507 - DNA, 20 bp, Artificial
  CRISPR gRNA sequence
caagtccaagaatttggtcc

SEQ ID NO: 756508 - DNA, 20 bp, Artificial
  CRISPR gRNA sequence
ggtcctaccattgtccccat

SEQ ID NO: 756509 - DNA, 20 bp, Artificial
  CRISPR gRNA sequence
gtcctaccattgtccccatt

SEQ ID NO: 756510 - DNA, 20 bp, Artificial
  CRISPR gRNA sequence
ccattgtccccattttactg

SEQ ID NO: 756511 - DNA, 20 bp, Artificial
  CRISPR gRNA sequence
tccccattttactgatgggc

SEQ ID NO: 756512 - DNA, 20 bp, Artificial
  CRISPR gRNA sequence
tactgatgggcaaacggagg

SEQ ID NO: 756513 - DNA, 20 bp, Artificial
  CRISPR gRNA sequence
actgatgggcaaacggaggc

SEQ ID NO: 756514 - DNA, 20 bp, Artificial
  CRISPR gRNA sequence
ctgatgggcaaacggaggca

SEQ ID NO: 756515 - DNA, 20 bp, Artificial
  CRISPR gRNA sequence
atgggcaaacggaggcacag

SEQ ID NO: 756516 - DNA, 20 bp, Artificial
  CRISPR gRNA sequence
agtaacttgcctaaggaacc

SEQ ID NO: 756517 - DNA, 20 bp, Artificial
  CRISPR gRNA sequence
gcctaaggaaccacacagca

SEQ ID NO: 756518 - DNA, 20 bp, Artificial
  CRISPR gRNA sequence
cctaaggaaccacacagcaa

SEQ ID NO: 756519 - DNA, 20 bp, Artificial
  CRISPR gRNA sequence
aggaaccacacagcaaataa

SEQ ID NO: 756520 - DNA, 20 bp, Artificial
  CRISPR gRNA sequence
ggctttaagtcatgggcaca

SEQ ID NO: 756521 - DNA, 20 bp, Artificial
  CRISPR gRNA sequence
taagtcatgggcacaaacat

SEQ ID NO: 756522 - DNA, 20 bp, Artificial
  CRISPR gRNA sequence
aagtcatgggcacaaacatc

SEQ ID NO: 756523 - DNA, 20 bp, Artificial
  CRISPR gRNA sequence
agtcatgggcacaaacatct

SEQ ID NO: 756524 - DNA, 20 bp, Artificial
  CRISPR gRNA sequence
tcacctcccaccctggccag

SEQ ID NO: 756525 - DNA, 20 bp, Artificial
  CRISPR gRNA sequence
cacctcccaccctggccagg

SEQ ID NO: 756526 - DNA, 20 bp, Artificial
  CRISPR gRNA sequence
acctcccaccctggccaggt

SEQ ID NO: 756527 - DNA, 20 bp, Artificial
  CRISPR gRNA sequence
ccaccctggccaggtgacag

SEQ ID NO: 756528 - DNA, 20 bp, Artificial
  CRISPR gRNA sequence
gccaggtgacagtgcccctt

SEQ ID NO: 756529 - DNA, 20 bp, Artificial
  CRISPR gRNA sequence
gcctagttcctgaccctgcc

SEQ ID NO: 756530 - DNA, 20 bp, Artificial
  CRISPR gRNA sequence
cctagttcctgaccctgccc

SEQ ID NO: 756531 - DNA, 20 bp, Artificial
  CRISPR gRNA sequence
gttcctgaccctgcccttga

SEQ ID NO: 756532 - DNA, 20 bp, Artificial
  CRISPR gRNA sequence
ctgaccctgcccttgagtct

SEQ ID NO: 756533 - DNA, 20 bp, Artificial
  CRISPR gRNA sequence
accctgcccttgagtcttgg

SEQ ID NO: 756534 - DNA, 20 bp, Artificial
  CRISPR gRNA sequence
cccttgagtcttggttagtc

SEQ ID NO: 756535 - DNA, 20 bp, Artificial
  CRISPR gRNA sequence
gagtcttggttagtctgagt

SEQ ID NO: 756536 - DNA, 20 bp, Artificial
  CRISPR gRNA sequence
agtcttggttagtctgagtc

SEQ ID NO: 756537 - DNA, 20 bp, Artificial
  CRISPR gRNA sequence
ggttagtctgagtcctccaa

SEQ ID NO: 756538 - DNA, 20 bp, Artificial
  CRISPR gRNA sequence
gttagtctgagtcctccaag

SEQ ID NO: 756539 - DNA, 20 bp, Artificial
  CRISPR gRNA sequence
gtctgagtcctccaagaagg

SEQ ID NO: 756540 - DNA, 20 bp, Artificial
  CRISPR gRNA sequence
agtcctccaagaaggggcta

SEQ ID NO: 756541 - DNA, 20 bp, Artificial
  CRISPR gRNA sequence
caagaaggggctagggagtt

SEQ ID NO: 756542 - DNA, 20 bp, Artificial
  CRISPR gRNA sequence
gggagttttttacccttgcc

SEQ ID NO: 756543 - DNA, 20 bp, Artificial
  CRISPR gRNA sequence
tttacccttgcctcccctcc

SEQ ID NO: 756544 - DNA, 20 bp, Artificial
  CRISPR gRNA sequence
ttacccttgcctcccctccc

SEQ ID NO: 756545 - DNA, 20 bp, Artificial
  CRISPR gRNA sequence
tacccttgcctcccctccct

SEQ ID NO: 756546 - DNA, 20 bp, Artificial
  CRISPR gRNA sequence
acccttgcctcccctccctg

SEQ ID NO: 756547 - DNA, 20 bp, Artificial
  CRISPR gRNA sequence
cccttgcctcccctccctgg

SEQ ID NO: 756548 - DNA, 20 bp, Artificial
  CRISPR gRNA sequence
gcctcccctccctggcctct

SEQ ID NO: 756549 - DNA, 20 bp, Artificial
  CRISPR gRNA sequence
cctcccctccctggcctctt

SEQ ID NO: 756550 - DNA, 20 bp, Artificial
  CRISPR gRNA sequence
ccctccctggcctcttcccg

SEQ ID NO: 756551 - DNA, 20 bp, Artificial
  CRISPR gRNA sequence
cctggcctcttcccgtctgc

SEQ ID NO: 756552 - DNA, 20 bp, Artificial
  CRISPR gRNA sequence
gcctcttcccgtctgcctgg

SEQ ID NO: 756553 - DNA, 20 bp, Artificial
  CRISPR gRNA sequence
ttcccgtctgcctggctaca

SEQ ID NO: 756554 - DNA, 20 bp, Artificial
  CRISPR gRNA sequence
cccgtctgcctggctacaga

SEQ ID NO: 756555 - DNA, 20 bp, Artificial
  CRISPR gRNA sequence
ccgtctgcctggctacagag

SEQ ID NO: 756556 - DNA, 20 bp, Artificial
  CRISPR gRNA sequence
cctggctacagaggtaactg

SEQ ID NO: 756557 - DNA, 20 bp, Artificial
  CRISPR gRNA sequence
gctacagaggtaactgagaa

SEQ ID NO: 756558 - DNA, 20 bp, Artificial
  CRISPR gRNA sequence
cagaggtaactgagaaagga

SEQ ID NO: 756559 - DNA, 20 bp, Artificial
  CRISPR gRNA sequence
agaaaggattgctctggtgc

SEQ ID NO: 756560 - DNA, 20 bp, Artificial
  CRISPR gRNA sequence
ctctggtgccaggtggcttt

SEQ ID NO: 756561 - DNA, 20 bp, Artificial
  CRISPR gRNA sequence
tggtgccaggtggcttttgg

SEQ ID NO: 756562 - DNA, 20 bp, Artificial
  CRISPR gRNA sequence
gtgccaggtggcttttggct

SEQ ID NO: 756563 - DNA, 20 bp, Artificial
  CRISPR gRNA sequence
ttggctcgcaacttatttcc

SEQ ID NO: 756564 - DNA, 20 bp, Artificial
  CRISPR gRNA sequence
tggctcgcaacttatttcct

SEQ ID NO: 756565 - DNA, 20 bp, Artificial
  CRISPR gRNA sequence
ggctcgcaacttatttcctg

SEQ ID NO: 756566 - DNA, 20 bp, Artificial
  CRISPR gRNA sequence
gctcgcaacttatttcctgt

SEQ ID NO: 756567 - DNA, 20 bp, Artificial
  CRISPR gRNA sequence
gcaacttatttcctgtggcc

SEQ ID NO: 756568 - DNA, 20 bp, Artificial
  CRISPR gRNA sequence
atttcctgtggccggccctt

SEQ ID NO: 756569 - DNA, 20 bp, Artificial
  CRISPR gRNA sequence
tttcctgtggccggccctta

SEQ ID NO: 756570 - DNA, 20 bp, Artificial
  CRISPR gRNA sequence
cctgtggccggcccttaaca

SEQ ID NO: 756571 - DNA, 20 bp, Artificial
  CRISPR gRNA sequence
ctgtggccggcccttaacaa

SEQ ID NO: 756572 - DNA, 20 bp, Artificial
  CRISPR gRNA sequence
tggccggcccttaacaactt

SEQ ID NO: 756573 - DNA, 20 bp, Artificial
  CRISPR gRNA sequence
aacaacttgtcatccctccc

SEQ ID NO: 756574 - DNA, 20 bp, Artificial
  CRISPR gRNA sequence
acaacttgtcatccctccct

SEQ ID NO: 756575 - DNA, 20 bp, Artificial
  CRISPR gRNA sequence
gtcatccctccctcccctca

SEQ ID NO: 756576 - DNA, 20 bp, Artificial
  CRISPR gRNA sequence
tcatccctccctcccctcat

SEQ ID NO: 756577 - DNA, 20 bp, Artificial
  CRISPR gRNA sequence
cctcccctcattcccggggg

SEQ ID NO: 756578 - DNA, 20 bp, Artificial
  CRISPR gRNA sequence
ccctcattcccgggggcccc

SEQ ID NO: 756579 - DNA, 20 bp, Artificial
  CRISPR gRNA sequence
attcccgggggcccccacgt

SEQ ID NO: 756580 - DNA, 20 bp, Artificial
  CRISPR gRNA sequence
ccgggggcccccacgtgaag

SEQ ID NO: 756581 - DNA, 20 bp, Artificial
  CRISPR gRNA sequence
gggggctgtggccacctcac

SEQ ID NO: 756582 - DNA, 20 bp, Artificial
  CRISPR gRNA sequence
tggccacctcacccttgctt

SEQ ID NO: 756583 - DNA, 20 bp, Artificial
  CRISPR gRNA sequence
acccttgctttcagaactcc

SEQ ID NO: 756584 - DNA, 20 bp, Artificial
  CRISPR gRNA sequence
gctttcagaactcccctatt

SEQ ID NO: 756585 - DNA, 20 bp, Artificial
  CRISPR gRNA sequence
ctttcagaactcccctattc

SEQ ID NO: 756586 - DNA, 20 bp, Artificial
  CRISPR gRNA sequence
tcagaactcccctattcctc

SEQ ID NO: 756587 - DNA, 20 bp, Artificial
  CRISPR gRNA sequence
cagaactcccctattcctct

SEQ ID NO: 756588 - DNA, 20 bp, Artificial
  CRISPR gRNA sequence
agaactcccctattcctctc

SEQ ID NO: 756589 - DNA, 20 bp, Artificial
  CRISPR gRNA sequence
ccctattcctctcctagaac

SEQ ID NO: 756590 - DNA, 20 bp, Artificial
  CRISPR gRNA sequence
ttcctctcctagaacacacc

SEQ ID NO: 756591 - DNA, 20 bp, Artificial
  CRISPR gRNA sequence
ctctcctagaacacaccaca

SEQ ID NO: 756592 - DNA, 20 bp, Artificial
  CRISPR gRNA sequence
tcctagaacacaccacaacc

SEQ ID NO: 756593 - DNA, 20 bp, Artificial
  CRISPR gRNA sequence
ctagaacacaccacaaccta

SEQ ID NO: 756594 - DNA, 20 bp, Artificial
  CRISPR gRNA sequence
gaacacaccacaacctacct

SEQ ID NO: 756595 - DNA, 20 bp, Artificial
  CRISPR gRNA sequence
cctgcaggaatacccatggc

SEQ ID NO: 756596 - DNA, 20 bp, Artificial
  CRISPR gRNA sequence
caggaatacccatggctggg

SEQ ID NO: 756597 - DNA, 20 bp, Artificial
  CRISPR gRNA sequence
ggggtgggtgggggcaggta

SEQ ID NO: 756598 - DNA, 20 bp, Artificial
  CRISPR gRNA sequence
ggaacagaagagcaacgctg

SEQ ID NO: 756599 - DNA, 20 bp, Artificial
  CRISPR gRNA sequence
gaacagaagagcaacgctgg

SEQ ID NO: 756600 - DNA, 20 bp, Artificial
  CRISPR gRNA sequence
ggcagcagggcagggggagc

SEQ ID NO: 756601 - DNA, 20 bp, Artificial
  CRISPR gRNA sequence
ctgtgccctccctggtggaa

SEQ ID NO: 756602 - DNA, 20 bp, Artificial
  CRISPR gRNA sequence
tgccctccctggtggaaggc

SEQ ID NO: 756603 - DNA, 20 bp, Artificial
  CRISPR gRNA sequence
cctggtggaaggctggccca

SEQ ID NO: 756604 - DNA, 20 bp, Artificial
  CRISPR gRNA sequence
gtggaaggctggcccagaga

SEQ ID NO: 756605 - DNA, 20 bp, Artificial
  CRISPR gRNA sequence
gcccagagagcctgctcagg

SEQ ID NO: 756606 - DNA, 20 bp, Artificial
  CRISPR gRNA sequence
ctcaggaatgaggcactctc

SEQ ID NO: 756607 - DNA, 20 bp, Artificial
  CRISPR gRNA sequence
aggaatgaggcactctcagg

SEQ ID NO: 756608 - DNA, 20 bp, Artificial
  CRISPR gRNA sequence
tcaggaaaaaaagaaaagga

SEQ ID NO: 756609 - DNA, 20 bp, Artificial
  CRISPR gRNA sequence
aggaaaaaaagaaaaggaaa

SEQ ID NO: 756610 - DNA, 20 bp, Artificial
  CRISPR gRNA sequence
ggagccttgaggacggcagt

SEQ ID NO: 756611 - DNA, 20 bp, Artificial
  CRISPR gRNA sequence
gaggacggcagtttgctgga

SEQ ID NO: 756612 - DNA, 20 bp, Artificial
  CRISPR gRNA sequence
aggacggcagtttgctggag

SEQ ID NO: 756613 - DNA, 20 bp, Artificial
  CRISPR gRNA sequence
gctggagaggccaacaggtg

SEQ ID NO: 756614 - DNA, 20 bp, Artificial
  CRISPR gRNA sequence
ctggagaggccaacaggtgt

SEQ ID NO: 756615 - DNA, 20 bp, Artificial
  CRISPR gRNA sequence
gagaggccaacaggtgtgga

SEQ ID NO: 756616 - DNA, 20 bp, Artificial
  CRISPR gRNA sequence
ccatcctgctttggactgag

SEQ ID NO: 756617 - DNA, 20 bp, Artificial
  CRISPR gRNA sequence
catcctgctttggactgagc

SEQ ID NO: 756618 - DNA, 20 bp, Artificial
  CRISPR gRNA sequence
ctttggactgagcctcagtt

SEQ ID NO: 756619 - DNA, 20 bp, Artificial
  CRISPR gRNA sequence
tggactgagcctcagtttcc

SEQ ID NO: 756620 - DNA, 20 bp, Artificial
  CRISPR gRNA sequence
ggactgagcctcagtttccc

SEQ ID NO: 756621 - DNA, 20 bp, Artificial
  CRISPR gRNA sequence
gactgagcctcagtttcccc

SEQ ID NO: 756622 - DNA, 20 bp, Artificial
  CRISPR gRNA sequence
agcctcagtttccccagctc

SEQ ID NO: 756623 - DNA, 20 bp, Artificial
  CRISPR gRNA sequence
agtttccccagctctaaaat

SEQ ID NO: 756624 - DNA, 20 bp, Artificial
  CRISPR gRNA sequence
ccccagctctaaaatgggac

SEQ ID NO: 756625 - DNA, 20 bp, Artificial
  CRISPR gRNA sequence
cccagctctaaaatgggacc

SEQ ID NO: 756626 - DNA, 20 bp, Artificial
  CRISPR gRNA sequence
taaaatgggaccaacaaccc

SEQ ID NO: 756627 - DNA, 20 bp, Artificial
  CRISPR gRNA sequence
aaatgggaccaacaaccctc

SEQ ID NO: 756628 - DNA, 20 bp, Artificial
  CRISPR gRNA sequence
accccaaagggtggcacaga

SEQ ID NO: 756629 - DNA, 20 bp, Artificial
  CRISPR gRNA sequence
cacgaagcctgacccatgag

SEQ ID NO: 756630 - DNA, 20 bp, Artificial
  CRISPR gRNA sequence
acccatgagtcggctgtaag

SEQ ID NO: 756631 - DNA, 20 bp, Artificial
  CRISPR gRNA sequence
taagcaatagccatggtttg

SEQ ID NO: 756632 - DNA, 20 bp, Artificial
  CRISPR gRNA sequence
gaatagatttcaggaacttt

SEQ ID NO: 756633 - DNA, 20 bp, Artificial
  CRISPR gRNA sequence
aatagatttcaggaactttt

SEQ ID NO: 756634 - DNA, 20 bp, Artificial
  CRISPR gRNA sequence
caggaacttttgggtaactt

SEQ ID NO: 756635 - DNA, 20 bp, Artificial
  CRISPR gRNA sequence
aggaacttttgggtaacttc

SEQ ID NO: 756636 - DNA, 20 bp, Artificial
  CRISPR gRNA sequence
ttgggtaacttccctgtgtt

SEQ ID NO: 756637 - DNA, 20 bp, Artificial
  CRISPR gRNA sequence
tgggtaacttccctgtgttt

SEQ ID NO: 756638 - DNA, 20 bp, Artificial
  CRISPR gRNA sequence
gggtaacttccctgtgtttg

SEQ ID NO: 756639 - DNA, 20 bp, Artificial
  CRISPR gRNA sequence
ggtaacttccctgtgtttgt

SEQ ID NO: 756640 - DNA, 20 bp, Artificial
  CRISPR gRNA sequence
ccctgtgtttgttctgttgt

SEQ ID NO: 756641 - DNA, 20 bp, Artificial
  CRISPR gRNA sequence
cctgtgtttgttctgttgtt

SEQ ID NO: 756642 - DNA, 20 bp, Artificial
  CRISPR gRNA sequence
tgtttgttctgttgttgtgc

SEQ ID NO: 756643 - DNA, 20 bp, Artificial
  CRISPR gRNA sequence
gttctgttgttgtgcccctc

SEQ ID NO: 756644 - DNA, 20 bp, Artificial
  CRISPR gRNA sequence
ttctgttgttgtgcccctcc

SEQ ID NO: 756645 - DNA, 20 bp, Artificial
  CRISPR gRNA sequence
tgttgttgtgcccctccccc

SEQ ID NO: 756646 - DNA, 20 bp, Artificial
  CRISPR gRNA sequence
ttgttgtgcccctcccccac

SEQ ID NO: 756647 - DNA, 20 bp, Artificial
  CRISPR gRNA sequence
ttgtgcccctcccccaccat

SEQ ID NO: 756648 - DNA, 20 bp, Artificial
  CRISPR gRNA sequence
tgcccctcccccaccatctg

SEQ ID NO: 756649 - DNA, 20 bp, Artificial
  CRISPR gRNA sequence
ccccaccatctgtttcccca

SEQ ID NO: 756650 - DNA, 20 bp, Artificial
  CRISPR gRNA sequence
tttccccatcgtaatcagca

SEQ ID NO: 756651 - DNA, 20 bp, Artificial
  CRISPR gRNA sequence
ccccatcgtaatcagcagta

SEQ ID NO: 756652 - DNA, 20 bp, Artificial
  CRISPR gRNA sequence
cccatcgtaatcagcagtaa

SEQ ID NO: 756653 - DNA, 20 bp, Artificial
  CRISPR gRNA sequence
cttaaaacgagaagcatctg

SEQ ID NO: 756654 - DNA, 20 bp, Artificial
  CRISPR gRNA sequence
aaaacgagaagcatctgtgg

SEQ ID NO: 756655 - DNA, 20 bp, Artificial
  CRISPR gRNA sequence
aaacgagaagcatctgtggg

SEQ ID NO: 756656 - DNA, 20 bp, Artificial
  CRISPR gRNA sequence
tgggaggacatggggtgctg

SEQ ID NO: 756657 - DNA, 20 bp, Artificial
  CRISPR gRNA sequence
catgaaagagggaagttggg

SEQ ID NO: 756658 - DNA, 20 bp, Artificial
  CRISPR gRNA sequence
gggtcactgcatctaattgg

SEQ ID NO: 756659 - DNA, 20 bp, Artificial
  CRISPR gRNA sequence
catctaattggtggccagtt

SEQ ID NO: 756660 - DNA, 20 bp, Artificial
  CRISPR gRNA sequence
attggtggccagtttggggg

SEQ ID NO: 756661 - DNA, 20 bp, Artificial
  CRISPR gRNA sequence
gtggccagtttggggggtgg

SEQ ID NO: 756662 - DNA, 20 bp, Artificial
  CRISPR gRNA sequence
ggggggtggggtgtcccaag

SEQ ID NO: 756663 - DNA, 20 bp, Artificial
  CRISPR gRNA sequence
gggggtggggtgtcccaagg

SEQ ID NO: 756664 - DNA, 20 bp, Artificial
  CRISPR gRNA sequence
aggcaagcggcagcaacttg

SEQ ID NO: 756665 - DNA, 20 bp, Artificial
  CRISPR gRNA sequence
ggatgagaagcagaaagtga

SEQ ID NO: 756666 - DNA, 20 bp, Artificial
  CRISPR gRNA sequence
gatgagaagcagaaagtgag

SEQ ID NO: 756667 - DNA, 20 bp, Artificial
  CRISPR gRNA sequence
ggaagtgatcggggacttgc

SEQ ID NO: 756668 - DNA, 20 bp, Artificial
  CRISPR gRNA sequence
gcaccttgtaaggtttccct

SEQ ID NO: 756669 - DNA, 20 bp, Artificial
  CRISPR gRNA sequence
caccttgtaaggtttccctg

SEQ ID NO: 756670 - DNA, 20 bp, Artificial
  CRISPR gRNA sequence
gtaaggtttccctgagagat

SEQ ID NO: 756671 - DNA, 20 bp, Artificial
  CRISPR gRNA sequence
taaggtttccctgagagatg

SEQ ID NO: 756672 - DNA, 20 bp, Artificial
  CRISPR gRNA sequence
ccctgagagatgtcccctag

SEQ ID NO: 756673 - DNA, 20 bp, Artificial
  CRISPR gRNA sequence
cctgagagatgtcccctaga

SEQ ID NO: 756674 - DNA, 20 bp, Artificial
  CRISPR gRNA sequence
agagatgtcccctagaatgc

SEQ ID NO: 756675 - DNA, 20 bp, Artificial
  CRISPR gRNA sequence
gaatgccaccctattaggca

SEQ ID NO: 756676 - DNA, 20 bp, Artificial
  CRISPR gRNA sequence
ttaggcaatgtaggggatag

SEQ ID NO: 756677 - DNA, 20 bp, Artificial
  CRISPR gRNA sequence
ggcaatgtaggggataggac

SEQ ID NO: 756678 - DNA, 20 bp, Artificial
  CRISPR gRNA sequence
taattaggaactgaccttaa

SEQ ID NO: 756679 - DNA, 20 bp, Artificial
  CRISPR gRNA sequence
attaggaactgaccttaaac

SEQ ID NO: 756680 - DNA, 20 bp, Artificial
  CRISPR gRNA sequence
ggaactgaccttaaacactc

SEQ ID NO: 756681 - DNA, 20 bp, Artificial
  CRISPR gRNA sequence
accttaaacactcccaccca

SEQ ID NO: 756682 - DNA, 20 bp, Artificial
  CRISPR gRNA sequence
aaacactcccacccagtaag

SEQ ID NO: 756683 - DNA, 20 bp, Artificial
  CRISPR gRNA sequence
aacactcccacccagtaagt

SEQ ID NO: 756684 - DNA, 20 bp, Artificial
  CRISPR gRNA sequence
ccacccagtaagtcatggct

SEQ ID NO: 756685 - DNA, 20 bp, Artificial
  CRISPR gRNA sequence
aagaccagaacctggcaaat

SEQ ID NO: 756686 - DNA, 20 bp, Artificial
  CRISPR gRNA sequence
gcaaatgttcaaacaagaga

SEQ ID NO: 756687 - DNA, 20 bp, Artificial
  CRISPR gRNA sequence
aaacaagagacaccagttag

SEQ ID NO: 756688 - DNA, 20 bp, Artificial
  CRISPR gRNA sequence
gcaaattcaagagttgacct

SEQ ID NO: 756689 - DNA, 20 bp, Artificial
  CRISPR gRNA sequence
aagagttgacctttgctcga

SEQ ID NO: 756690 - DNA, 20 bp, Artificial
  CRISPR gRNA sequence
acctttgctcgatacttaaa

SEQ ID NO: 756691 - DNA, 20 bp, Artificial
  CRISPR gRNA sequence
tgctcgatacttaaatcctg

SEQ ID NO: 756692 - DNA, 20 bp, Artificial
  CRISPR gRNA sequence
gctcgatacttaaatcctga

SEQ ID NO: 756693 - DNA, 20 bp, Artificial
  CRISPR gRNA sequence
ctcgatacttaaatcctgaa

SEQ ID NO: 756694 - DNA, 20 bp, Artificial
  CRISPR gRNA sequence
gatacttaaatcctgaaggt

SEQ ID NO: 756695 - DNA, 20 bp, Artificial
  CRISPR gRNA sequence
aaatcctgaaggtctgacac

SEQ ID NO: 756696 - DNA, 20 bp, Artificial
  CRISPR gRNA sequence
aatcctgaaggtctgacact

SEQ ID NO: 756697 - DNA, 20 bp, Artificial
  CRISPR gRNA sequence
aaggtctgacactgtgtaag

SEQ ID NO: 756698 - DNA, 20 bp, Artificial
  CRISPR gRNA sequence
acactgtgtaagtcaagcca

SEQ ID NO: 756699 - DNA, 20 bp, Artificial
  CRISPR gRNA sequence
tgtaagtcaagccataggag

SEQ ID NO: 756700 - DNA, 20 bp, Artificial
  CRISPR gRNA sequence
gctgcctttggtctcctgat

SEQ ID NO: 756701 - DNA, 20 bp, Artificial
  CRISPR gRNA sequence
cctttggtctcctgatggca

SEQ ID NO: 756702 - DNA, 20 bp, Artificial
  CRISPR gRNA sequence
tggtctcctgatggcagata

SEQ ID NO: 756703 - DNA, 20 bp, Artificial
  CRISPR gRNA sequence
ggtctcctgatggcagatag

SEQ ID NO: 756704 - DNA, 20 bp, Artificial
  CRISPR gRNA sequence
gtctcctgatggcagatagc

SEQ ID NO: 756705 - DNA, 20 bp, Artificial
  CRISPR gRNA sequence
ctgatggcagatagcgttct

SEQ ID NO: 756706 - DNA, 20 bp, Artificial
  CRISPR gRNA sequence
atggcagatagcgttcttac

SEQ ID NO: 756707 - DNA, 20 bp, Artificial
  CRISPR gRNA sequence
ttacactcctggaaaatgca

SEQ ID NO: 756708 - DNA, 20 bp, Artificial
  CRISPR gRNA sequence
acactcctggaaaatgcaga

SEQ ID NO: 756709 - DNA, 20 bp, Artificial
  CRISPR gRNA sequence
cactcctggaaaatgcagat

SEQ ID NO: 756710 - DNA, 20 bp, Artificial
  CRISPR gRNA sequence
ctggaaaatgcagatagagt

SEQ ID NO: 756711 - DNA, 20 bp, Artificial
  CRISPR gRNA sequence
gaaaatgcagatagagtttc

SEQ ID NO: 756712 - DNA, 20 bp, Artificial
  CRISPR gRNA sequence
catttatcagtcgtcaaaat

SEQ ID NO: 756713 - DNA, 20 bp, Artificial
  CRISPR gRNA sequence
atttatcagtcgtcaaaatg

SEQ ID NO: 756714 - DNA, 20 bp, Artificial
  CRISPR gRNA sequence
atcagtcgtcaaaatgggcc

SEQ ID NO: 756715 - DNA, 20 bp, Artificial
  CRISPR gRNA sequence
tcagtcgtcaaaatgggccc

SEQ ID NO: 756716 - DNA, 20 bp, Artificial
  CRISPR gRNA sequence
atggaggccccatctgctgg

SEQ ID NO: 756717 - DNA, 20 bp, Artificial
  CRISPR gRNA sequence
ctggacagacacgcagatcg

SEQ ID NO: 756718 - DNA, 20 bp, Artificial
  CRISPR gRNA sequence
gacagacacgcagatcgctt

SEQ ID NO: 756719 - DNA, 20 bp, Artificial
  CRISPR gRNA sequence
gctggacagcacccatgtga

SEQ ID NO: 756720 - DNA, 20 bp, Artificial
  CRISPR gRNA sequence
ctggacagcacccatgtgaa

SEQ ID NO: 756721 - DNA, 20 bp, Artificial
  CRISPR gRNA sequence
gacagcacccatgtgaaaag

SEQ ID NO: 756722 - DNA, 20 bp, Artificial
  CRISPR gRNA sequence
tgcagggccctcctgggctc

SEQ ID NO: 756723 - DNA, 20 bp, Artificial
  CRISPR gRNA sequence
ctgggctcgctcctgttccc

SEQ ID NO: 756724 - DNA, 20 bp, Artificial
  CRISPR gRNA sequence
ggctcgctcctgttccctgc

SEQ ID NO: 756725 - DNA, 20 bp, Artificial
  CRISPR gRNA sequence
gctcctgttccctgcagggc

SEQ ID NO: 756726 - DNA, 20 bp, Artificial
  CRISPR gRNA sequence
ctgttccctgcagggcatct

SEQ ID NO: 756727 - DNA, 20 bp, Artificial
  CRISPR gRNA sequence
ttccctgcagggcatctgcc

SEQ ID NO: 756728 - DNA, 20 bp, Artificial
  CRISPR gRNA sequence
cctgcagggcatctgccagc

SEQ ID NO: 756729 - DNA, 20 bp, Artificial
  CRISPR gRNA sequence
cagggcatctgccagcaggg

SEQ ID NO: 756730 - DNA, 20 bp, Artificial
  CRISPR gRNA sequence
ccagcaggggcagggatgtt

SEQ ID NO: 756731 - DNA, 20 bp, Artificial
  CRISPR gRNA sequence
tatggggaagccttcccttc

SEQ ID NO: 756732 - DNA, 20 bp, Artificial
  CRISPR gRNA sequence
cccttccatgaccagcttct

SEQ ID NO: 756733 - DNA, 20 bp, Artificial
  CRISPR gRNA sequence
ccttccatgaccagcttctc

SEQ ID NO: 756734 - DNA, 20 bp, Artificial
  CRISPR gRNA sequence
ccatgaccagcttctctgtc

SEQ ID NO: 756735 - DNA, 20 bp, Artificial
  CRISPR gRNA sequence
catgaccagcttctctgtct

SEQ ID NO: 756736 - DNA, 20 bp, Artificial
  CRISPR gRNA sequence
ctctgtctgtctgtccctag

SEQ ID NO: 756737 - DNA, 20 bp, Artificial
  CRISPR gRNA sequence
tctgtctgtctgtccctagg

SEQ ID NO: 756738 - DNA, 20 bp, Artificial
  CRISPR gRNA sequence
tgtctgtctgtccctaggtg

SEQ ID NO: 756739 - DNA, 20 bp, Artificial
  CRISPR gRNA sequence
tctgtctgtccctaggtgcc

SEQ ID NO: 756740 - DNA, 20 bp, Artificial
  CRISPR gRNA sequence
tctgtccctaggtgcccagg

SEQ ID NO: 756741 - DNA, 20 bp, Artificial
  CRISPR gRNA sequence
tccctaggtgcccaggagct

SEQ ID NO: 756742 - DNA, 20 bp, Artificial
  CRISPR gRNA sequence
ggtgcccaggagctggtgcg

SEQ ID NO: 756743 - DNA, 20 bp, Artificial
  CRISPR gRNA sequence
gtgcggatggacaggtaagg

SEQ ID NO: 756744 - DNA, 20 bp, Artificial
  CRISPR gRNA sequence
cttgagaaaacttcctgggc

SEQ ID NO: 756745 - DNA, 20 bp, Artificial
  CRISPR gRNA sequence
ttgagaaaacttcctgggcc

SEQ ID NO: 756746 - DNA, 20 bp, Artificial
  CRISPR gRNA sequence
gagaaaacttcctgggccgg

SEQ ID NO: 756747 - DNA, 20 bp, Artificial
  CRISPR gRNA sequence
agaaaacttcctgggccggc

SEQ ID NO: 756748 - DNA, 20 bp, Artificial
  CRISPR gRNA sequence
cctgggccggctatccagga

SEQ ID NO: 756749 - DNA, 20 bp, Artificial
  CRISPR gRNA sequence
ctgggccggctatccaggaa

SEQ ID NO: 756750 - DNA, 20 bp, Artificial
  CRISPR gRNA sequence
ggccggctatccaggaagag

SEQ ID NO: 756751 - DNA, 20 bp, Artificial
  CRISPR gRNA sequence
tccaggaagagatacttctg

SEQ ID NO: 756752 - DNA, 20 bp, Artificial
  CRISPR gRNA sequence
ctgtgcagtaggggccctgt

SEQ ID NO: 756753 - DNA, 20 bp, Artificial
  CRISPR gRNA sequence
tgtgcagtaggggccctgtt

SEQ ID NO: 756754 - DNA, 20 bp, Artificial
  CRISPR gRNA sequence
tgcagtaggggccctgttta

SEQ ID NO: 756755 - DNA, 20 bp, Artificial
  CRISPR gRNA sequence
tttagctgcctagagcagct

SEQ ID NO: 756756 - DNA, 20 bp, Artificial
  CRISPR gRNA sequence
agctgcctagagcagctggt

SEQ ID NO: 756757 - DNA, 20 bp, Artificial
  CRISPR gRNA sequence
gctgcctagagcagctggtc

SEQ ID NO: 756758 - DNA, 20 bp, Artificial
  CRISPR gRNA sequence
cctagagcagctggtcagaa

SEQ ID NO: 756759 - DNA, 20 bp, Artificial
  CRISPR gRNA sequence
gagcagctggtcagaagagc

SEQ ID NO: 756760 - DNA, 20 bp, Artificial
  CRISPR gRNA sequence
gtcagaagagcctctgccat

SEQ ID NO: 756761 - DNA, 20 bp, Artificial
  CRISPR gRNA sequence
tgccatctgctgctgaagcc

SEQ ID NO: 756762 - DNA, 20 bp, Artificial
  CRISPR gRNA sequence
ccatctgctgctgaagcctg

SEQ ID NO: 756763 - DNA, 20 bp, Artificial
  CRISPR gRNA sequence
ctgctgaagcctgcacatct

SEQ ID NO: 756764 - DNA, 20 bp, Artificial
  CRISPR gRNA sequence
ctgaagcctgcacatctgtg

SEQ ID NO: 756765 - DNA, 20 bp, Artificial
  CRISPR gRNA sequence
aagcctgcacatctgtgcag

SEQ ID NO: 756766 - DNA, 20 bp, Artificial
  CRISPR gRNA sequence
cacatctgtgcagattggct

SEQ ID NO: 756767 - DNA, 20 bp, Artificial
  CRISPR gRNA sequence
tgcagattggctgttctcct

SEQ ID NO: 756768 - DNA, 20 bp, Artificial
  CRISPR gRNA sequence
gctgttctcctgccaccccg

SEQ ID NO: 756769 - DNA, 20 bp, Artificial
  CRISPR gRNA sequence
ttctcctgccaccccgactc

SEQ ID NO: 756770 - DNA, 20 bp, Artificial
  CRISPR gRNA sequence
tcctgccaccccgactcagc

SEQ ID NO: 756771 - DNA, 20 bp, Artificial
  CRISPR gRNA sequence
ctgccaccccgactcagcag

SEQ ID NO: 756772 - DNA, 20 bp, Artificial
  CRISPR gRNA sequence
ccaccccgactcagcaggct

SEQ ID NO: 756773 - DNA, 20 bp, Artificial
  CRISPR gRNA sequence
agcaggctgagctctgattc

SEQ ID NO: 756774 - DNA, 20 bp, Artificial
  CRISPR gRNA sequence
agctctgattctgctcagat

SEQ ID NO: 756775 - DNA, 20 bp, Artificial
  CRISPR gRNA sequence
tgattctgctcagatgtgtc

SEQ ID NO: 756776 - DNA, 20 bp, Artificial
  CRISPR gRNA sequence
attctgctcagatgtgtcat

SEQ ID NO: 756777 - DNA, 20 bp, Artificial
  CRISPR gRNA sequence
tgctcagatgtgtcatgcac

SEQ ID NO: 756778 - DNA, 20 bp, Artificial
  CRISPR gRNA sequence
ctcagatgtgtcatgcaccc

SEQ ID NO: 756779 - DNA, 20 bp, Artificial
  CRISPR gRNA sequence
agatgtgtcatgcacccacc

SEQ ID NO: 756780 - DNA, 20 bp, Artificial
  CRISPR gRNA sequence
cgggtctcagtggtcagcct

SEQ ID NO: 756781 - DNA, 20 bp, Artificial
  CRISPR gRNA sequence
gggtctcagtggtcagcctg

SEQ ID NO: 756782 - DNA, 20 bp, Artificial
  CRISPR gRNA sequence
agtggtcagcctgggccagg

SEQ ID NO: 756783 - DNA, 20 bp, Artificial
  CRISPR gRNA sequence
ggccaggatggggacaggga

SEQ ID NO: 756784 - DNA, 20 bp, Artificial
  CRISPR gRNA sequence
tctggggcagacagtgagac

SEQ ID NO: 756785 - DNA, 20 bp, Artificial
  CRISPR gRNA sequence
gggcagacagtgagacatgc

SEQ ID NO: 756786 - DNA, 20 bp, Artificial
  CRISPR gRNA sequence
gagctgtgcctcctgcccgc

SEQ ID NO: 756787 - DNA, 20 bp, Artificial
  CRISPR gRNA sequence
agctgtgcctcctgcccgca

SEQ ID NO: 756788 - DNA, 20 bp, Artificial
  CRISPR gRNA sequence
tgcctcctgcccgcagagaa

SEQ ID NO: 756789 - DNA, 20 bp, Artificial
  CRISPR gRNA sequence
ctgcccgcagagaactccaa

SEQ ID NO: 756790 - DNA, 20 bp, Artificial
  CRISPR gRNA sequence
cccgcagagaactccaagga

SEQ ID NO: 756791 - DNA, 20 bp, Artificial
  CRISPR gRNA sequence
caaggagaaagctgttaggc

SEQ ID NO: 756792 - DNA, 20 bp, Artificial
  CRISPR gRNA sequence
ttaggccgctgcaggccaca

SEQ ID NO: 756793 - DNA, 20 bp, Artificial
  CRISPR gRNA sequence
ggccgctgcaggccacaagg

SEQ ID NO: 756794 - DNA, 20 bp, Artificial
  CRISPR gRNA sequence
caggccacaagggcagaggc

SEQ ID NO: 756795 - DNA, 20 bp, Artificial
  CRISPR gRNA sequence
aggggtcccagagtggtgca

SEQ ID NO: 756796 - DNA, 20 bp, Artificial
  CRISPR gRNA sequence
ggtctaggggcagaggggat

SEQ ID NO: 756797 - DNA, 20 bp, Artificial
  CRISPR gRNA sequence
ggggcagaggggatggggac

SEQ ID NO: 756798 - DNA, 20 bp, Artificial
  CRISPR gRNA sequence
tgtattggtgtgctctgggc

SEQ ID NO: 756799 - DNA, 20 bp, Artificial
  CRISPR gRNA sequence
gtgtgctctgggcaggaagc

SEQ ID NO: 756800 - DNA, 20 bp, Artificial
  CRISPR gRNA sequence
tgggcaggaagctgccatgc

SEQ ID NO: 756801 - DNA, 20 bp, Artificial
  CRISPR gRNA sequence
ggcaggaagctgccatgcag

SEQ ID NO: 756802 - DNA, 20 bp, Artificial
  CRISPR gRNA sequence
ccatgcagcctggcctggag

SEQ ID NO: 756803 - DNA, 20 bp, Artificial
  CRISPR gRNA sequence
gcctggagggtgtgttcagg

SEQ ID NO: 756804 - DNA, 20 bp, Artificial
  CRISPR gRNA sequence
gagggtgtgttcagggaacc

SEQ ID NO: 756805 - DNA, 20 bp, Artificial
  CRISPR gRNA sequence
agggaacccaagttcctgcc

SEQ ID NO: 756806 - DNA, 20 bp, Artificial
  CRISPR gRNA sequence
ctgccccggtacctgcaaca

SEQ ID NO: 756807 - DNA, 20 bp, Artificial
  CRISPR gRNA sequence
ccccggtacctgcaacacca

SEQ ID NO: 756808 - DNA, 20 bp, Artificial
  CRISPR gRNA sequence
caacaccaaacacaaagctc

SEQ ID NO: 756809 - DNA, 20 bp, Artificial
  CRISPR gRNA sequence
ctctaggtgtttgaaaggga

SEQ ID NO: 756810 - DNA, 20 bp, Artificial
  CRISPR gRNA sequence
taggtgtttgaaagggatga

SEQ ID NO: 756811 - DNA, 20 bp, Artificial
  CRISPR gRNA sequence
ggtgtttgaaagggatgatc

SEQ ID NO: 756812 - DNA, 20 bp, Artificial
  CRISPR gRNA sequence
gaaagggatgatcttcaaga

SEQ ID NO: 756813 - DNA, 20 bp, Artificial
  CRISPR gRNA sequence
aaagggatgatcttcaagac

SEQ ID NO: 756814 - DNA, 20 bp, Artificial
  CRISPR gRNA sequence
caagacaggttgaaggaagt

SEQ ID NO: 756815 - DNA, 20 bp, Artificial
  CRISPR gRNA sequence
aagacaggttgaaggaagtc

SEQ ID NO: 756816 - DNA, 20 bp, Artificial
  CRISPR gRNA sequence
aaggaagtcctgcttgcaac

SEQ ID NO: 756817 - DNA, 20 bp, Artificial
  CRISPR gRNA sequence
cttgcaactcatctagaatc

SEQ ID NO: 756818 - DNA, 20 bp, Artificial
  CRISPR gRNA sequence
gcaactcatctagaatctaa

SEQ ID NO: 756819 - DNA, 20 bp, Artificial
  CRISPR gRNA sequence
caactcatctagaatctaag

SEQ ID NO: 756820 - DNA, 20 bp, Artificial
  CRISPR gRNA sequence
atctagaatctaagagttgc

SEQ ID NO: 756821 - DNA, 20 bp, Artificial
  CRISPR gRNA sequence
gaatctaagagttgcagggg

SEQ ID NO: 756822 - DNA, 20 bp, Artificial
  CRISPR gRNA sequence
agagttgcaggggtcttcag

SEQ ID NO: 756823 - DNA, 20 bp, Artificial
  CRISPR gRNA sequence
caggggtcttcagaagttat

SEQ ID NO: 756824 - DNA, 20 bp, Artificial
  CRISPR gRNA sequence
cagaagttatcccactccca

SEQ ID NO: 756825 - DNA, 20 bp, Artificial
  CRISPR gRNA sequence
agaagttatcccactcccaa

SEQ ID NO: 756826 - DNA, 20 bp, Artificial
  CRISPR gRNA sequence
tcccactcccaactgggaag

SEQ ID NO: 756827 - DNA, 20 bp, Artificial
  CRISPR gRNA sequence
ccaactgggaagagaagaga

SEQ ID NO: 756828 - DNA, 20 bp, Artificial
  CRISPR gRNA sequence
ggaagagaagagaacccctc

SEQ ID NO: 756829 - DNA, 20 bp, Artificial
  CRISPR gRNA sequence
ccctcagctcaagacaggct

SEQ ID NO: 756830 - DNA, 20 bp, Artificial
  CRISPR gRNA sequence
agctcaagacaggctttggg

SEQ ID NO: 756831 - DNA, 20 bp, Artificial
  CRISPR gRNA sequence
aagacaggctttggggatgt

SEQ ID NO: 756832 - DNA, 20 bp, Artificial
  CRISPR gRNA sequence
tggggatgttcgatcctaat

SEQ ID NO: 756833 - DNA, 20 bp, Artificial
  CRISPR gRNA sequence
ggggatgttcgatcctaatg

SEQ ID NO: 756834 - DNA, 20 bp, Artificial
  CRISPR gRNA sequence
gggatgttcgatcctaatgc

SEQ ID NO: 756835 - DNA, 20 bp, Artificial
  CRISPR gRNA sequence
gatcctaatgccatcaactc

SEQ ID NO: 756836 - DNA, 20 bp, Artificial
  CRISPR gRNA sequence
atgccatcaactctattgac

SEQ ID NO: 756837 - DNA, 20 bp, Artificial
  CRISPR gRNA sequence
tattgaccaaagagaaactt

SEQ ID NO: 756838 - DNA, 20 bp, Artificial
  CRISPR gRNA sequence
ttgaccaaagagaaacttgt

SEQ ID NO: 756839 - DNA, 20 bp, Artificial
  CRISPR gRNA sequence
accaaagagaaacttgtccc

SEQ ID NO: 756840 - DNA, 20 bp, Artificial
  CRISPR gRNA sequence
gtccccaaattcctgaggct

SEQ ID NO: 756841 - DNA, 20 bp, Artificial
  CRISPR gRNA sequence
tccccaaattcctgaggctg

SEQ ID NO: 756842 - DNA, 20 bp, Artificial
  CRISPR gRNA sequence
ctgaggctgaagttctagaa

SEQ ID NO: 756843 - DNA, 20 bp, Artificial
  CRISPR gRNA sequence
aggctgaagttctagaagtg

SEQ ID NO: 756844 - DNA, 20 bp, Artificial
  CRISPR gRNA sequence
aagttctagaagtgtctgtg

SEQ ID NO: 756845 - DNA, 20 bp, Artificial
  CRISPR gRNA sequence
tagaagtgtctgtgattttt

SEQ ID NO: 756846 - DNA, 20 bp, Artificial
  CRISPR gRNA sequence
gaagtgtctgtgatttttgg

SEQ ID NO: 756847 - DNA, 20 bp, Artificial
  CRISPR gRNA sequence
tgatttttggcttcctggct

SEQ ID NO: 756848 - DNA, 20 bp, Artificial
  CRISPR gRNA sequence
ttggcttcctggctgtgccc

SEQ ID NO: 756849 - DNA, 20 bp, Artificial
  CRISPR gRNA sequence
tggcttcctggctgtgcccg

SEQ ID NO: 756850 - DNA, 20 bp, Artificial
  CRISPR gRNA sequence
ggcttcctggctgtgcccgg

SEQ ID NO: 756851 - DNA, 20 bp, Artificial
  CRISPR gRNA sequence
gcttcctggctgtgcccggg

SEQ ID NO: 756852 - DNA, 20 bp, Artificial
  CRISPR gRNA sequence
cctggctgtgcccggggttg

SEQ ID NO: 756853 - DNA, 20 bp, Artificial
  CRISPR gRNA sequence
ctggctgtgcccggggttga

SEQ ID NO: 756854 - DNA, 20 bp, Artificial
  CRISPR gRNA sequence
gctgtgcccggggttgatgg

SEQ ID NO: 756855 - DNA, 20 bp, Artificial
  CRISPR gRNA sequence
tgcccggggttgatggtcag

SEQ ID NO: 756856 - DNA, 20 bp, Artificial
  CRISPR gRNA sequence
atggtcagaccacagggagg

SEQ ID NO: 756857 - DNA, 20 bp, Artificial
  CRISPR gRNA sequence
gggtctgttctggtgggccc

SEQ ID NO: 756858 - DNA, 20 bp, Artificial
  CRISPR gRNA sequence
ttctggtgggccctgatgcc

SEQ ID NO: 756859 - DNA, 20 bp, Artificial
  CRISPR gRNA sequence
tggtgggccctgatgccctc

SEQ ID NO: 756860 - DNA, 20 bp, Artificial
  CRISPR gRNA sequence
gtgggccctgatgccctcag

SEQ ID NO: 756861 - DNA, 20 bp, Artificial
  CRISPR gRNA sequence
atgccctcagctcaggacag

SEQ ID NO: 756862 - DNA, 20 bp, Artificial
  CRISPR gRNA sequence
agctcaggacaggtgggcag

SEQ ID NO: 756863 - DNA, 20 bp, Artificial
  CRISPR gRNA sequence
aggacaggtgggcaggtgca

SEQ ID NO: 756864 - DNA, 20 bp, Artificial
  CRISPR gRNA sequence
tgctctgtgggcctggctcc

SEQ ID NO: 756865 - DNA, 20 bp, Artificial
  CRISPR gRNA sequence
gctctgtgggcctggctcct

SEQ ID NO: 756866 - DNA, 20 bp, Artificial
  CRISPR gRNA sequence
ctctgtgggcctggctcctg

SEQ ID NO: 756867 - DNA, 20 bp, Artificial
  CRISPR gRNA sequence
tgtgggcctggctcctgcct

SEQ ID NO: 756868 - DNA, 20 bp, Artificial
  CRISPR gRNA sequence
tgggcctggctcctgccttc

SEQ ID NO: 756869 - DNA, 20 bp, Artificial
  CRISPR gRNA sequence
gctcctgccttcttgcttgg

SEQ ID NO: 756870 - DNA, 20 bp, Artificial
  CRISPR gRNA sequence
ctgccttcttgcttggagat

SEQ ID NO: 756871 - DNA, 20 bp, Artificial
  CRISPR gRNA sequence
ccttcttgcttggagatgct

SEQ ID NO: 756872 - DNA, 20 bp, Artificial
  CRISPR gRNA sequence
cttgcttggagatgctgctg

SEQ ID NO: 756873 - DNA, 20 bp, Artificial
  CRISPR gRNA sequence
ttgcttggagatgctgctga

SEQ ID NO: 756874 - DNA, 20 bp, Artificial
  CRISPR gRNA sequence
gcttggagatgctgctgagg

SEQ ID NO: 756875 - DNA, 20 bp, Artificial
  CRISPR gRNA sequence
cttggagatgctgctgaggc

SEQ ID NO: 756876 - DNA, 20 bp, Artificial
  CRISPR gRNA sequence
ggagatgctgctgaggcttg

SEQ ID NO: 756877 - DNA, 20 bp, Artificial
  CRISPR gRNA sequence
gagatgctgctgaggcttgg

SEQ ID NO: 756878 - DNA, 20 bp, Artificial
  CRISPR gRNA sequence
ctgaggcttggggatgggga

SEQ ID NO: 756879 - DNA, 20 bp, Artificial
  CRISPR gRNA sequence
aggcttggggatggggatgt

SEQ ID NO: 756880 - DNA, 20 bp, Artificial
  CRISPR gRNA sequence
ggggatggggatgtaggtga

SEQ ID NO: 756881 - DNA, 20 bp, Artificial
  CRISPR gRNA sequence
gggatggggatgtaggtgag

SEQ ID NO: 756882 - DNA, 20 bp, Artificial
  CRISPR gRNA sequence
ggggcagggagggcagagtt

SEQ ID NO: 756883 - DNA, 20 bp, Artificial
  CRISPR gRNA sequence
acgctccggacagcacagat

SEQ ID NO: 756884 - DNA, 20 bp, Artificial
  CRISPR gRNA sequence
cggacagcacagatgacctt

SEQ ID NO: 756885 - DNA, 20 bp, Artificial
  CRISPR gRNA sequence
ccattctggttctgtggcag

SEQ ID NO: 756886 - DNA, 20 bp, Artificial
  CRISPR gRNA sequence
cattctggttctgtggcagc

SEQ ID NO: 756887 - DNA, 20 bp, Artificial
  CRISPR gRNA sequence
tggttctgtggcagcaacat

SEQ ID NO: 756888 - DNA, 20 bp, Artificial
  CRISPR gRNA sequence
gttctgtggcagcaacattc

SEQ ID NO: 756889 - DNA, 20 bp, Artificial
  CRISPR gRNA sequence
tgtggcagcaacattcaagg

SEQ ID NO: 756890 - DNA, 20 bp, Artificial
  CRISPR gRNA sequence
tggcagcaacattcaaggga

SEQ ID NO: 756891 - DNA, 20 bp, Artificial
  CRISPR gRNA sequence
aagggattgaaaaccccggc

SEQ ID NO: 756892 - DNA, 20 bp, Artificial
  CRISPR gRNA sequence
aaaaccccggctttgaagcc

SEQ ID NO: 756893 - DNA, 20 bp, Artificial
  CRISPR gRNA sequence
tgaagcctcaccacctgccc

SEQ ID NO: 756894 - DNA, 20 bp, Artificial
  CRISPR gRNA sequence
gaagcctcaccacctgccca

SEQ ID NO: 756895 - DNA, 20 bp, Artificial
  CRISPR gRNA sequence
aagcctcaccacctgcccag

SEQ ID NO: 756896 - DNA, 20 bp, Artificial
  CRISPR gRNA sequence
accacctgcccaggggatac

SEQ ID NO: 756897 - DNA, 20 bp, Artificial
  CRISPR gRNA sequence
cccaggggatacccgaggcc

SEQ ID NO: 756898 - DNA, 20 bp, Artificial
  CRISPR gRNA sequence
tcctatgtggcccagcggca

SEQ ID NO: 756899 - DNA, 20 bp, Artificial
  CRISPR gRNA sequence
tgtggcccagcggcagcctt

SEQ ID NO: 756900 - DNA, 20 bp, Artificial
  CRISPR gRNA sequence
ctgagtctgggcggcatctg

SEQ ID NO: 756901 - DNA, 20 bp, Artificial
  CRISPR gRNA sequence
tgagtctgggcggcatctgc

SEQ ID NO: 756902 - DNA, 20 bp, Artificial
  CRISPR gRNA sequence
agtctgggcggcatctgctt

SEQ ID NO: 756903 - DNA, 20 bp, Artificial
  CRISPR gRNA sequence
ggcggcatctgctttcggag

SEQ ID NO: 756904 - DNA, 20 bp, Artificial
  CRISPR gRNA sequence
ctttcggagcccagcacccc

SEQ ID NO: 756905 - DNA, 20 bp, Artificial
  CRISPR gRNA sequence
tcggagcccagcacccccct

SEQ ID NO: 756906 - DNA, 20 bp, Artificial
  CRISPR gRNA sequence
cggagcccagcacccccctg

SEQ ID NO: 756907 - DNA, 20 bp, Artificial
  CRISPR gRNA sequence
ggagcccagcacccccctgt

SEQ ID NO: 756908 - DNA, 20 bp, Artificial
  CRISPR gRNA sequence
tctcctccaggccccggaga

SEQ ID NO: 756909 - DNA, 20 bp, Artificial
  CRISPR gRNA sequence
ctccaggccccggagacgtc

SEQ ID NO: 756910 - DNA, 20 bp, Artificial
  CRISPR gRNA sequence
caggccccggagacgtcttc

SEQ ID NO: 756911 - DNA, 20 bp, Artificial
  CRISPR gRNA sequence
cttcccatccctgggtaagt

SEQ ID NO: 756912 - DNA, 20 bp, Artificial
  CRISPR gRNA sequence
ttcccatccctgggtaagtg

SEQ ID NO: 756913 - DNA, 20 bp, Artificial
  CRISPR gRNA sequence
cccatccctgggtaagtgtt

SEQ ID NO: 756914 - DNA, 20 bp, Artificial
  CRISPR gRNA sequence
ccatccctgggtaagtgttt

SEQ ID NO: 756915 - DNA, 20 bp, Artificial
  CRISPR gRNA sequence
ggtaagtgtttcctgacctt

SEQ ID NO: 756916 - DNA, 20 bp, Artificial
  CRISPR gRNA sequence
cctgaccttcacagcacgat

SEQ ID NO: 756917 - DNA, 20 bp, Artificial
  CRISPR gRNA sequence
ctgaccttcacagcacgatg

SEQ ID NO: 756918 - DNA, 20 bp, Artificial
  CRISPR gRNA sequence
accttcacagcacgatgacc

SEQ ID NO: 756919 - DNA, 20 bp, Artificial
  CRISPR gRNA sequence
cacagcacgatgacctgtaa

SEQ ID NO: 756920 - DNA, 20 bp, Artificial
  CRISPR gRNA sequence
acagcacgatgacctgtaag

SEQ ID NO: 756921 - DNA, 20 bp, Artificial
  CRISPR gRNA sequence
taaggtcatgacctcatggc

SEQ ID NO: 756922 - DNA, 20 bp, Artificial
  CRISPR gRNA sequence
atggcctgcagggcatcggc

SEQ ID NO: 756923 - DNA, 20 bp, Artificial
  CRISPR gRNA sequence
cagggcatcggcctcactcc

SEQ ID NO: 756924 - DNA, 20 bp, Artificial
  CRISPR gRNA sequence
actccctgccctccctgaag

SEQ ID NO: 756925 - DNA, 20 bp, Artificial
  CRISPR gRNA sequence
cctgccctccctgaagagtt

SEQ ID NO: 756926 - DNA, 20 bp, Artificial
  CRISPR gRNA sequence
ccctccctgaagagttccac

SEQ ID NO: 756927 - DNA, 20 bp, Artificial
  CRISPR gRNA sequence
cctgaagagttccacggcct

SEQ ID NO: 756928 - DNA, 20 bp, Artificial
  CRISPR gRNA sequence
aagagttccacggcctcacg

SEQ ID NO: 756929 - DNA, 20 bp, Artificial
  CRISPR gRNA sequence
cacggcctcacggggtgggg

SEQ ID NO: 756930 - DNA, 20 bp, Artificial
  CRISPR gRNA sequence
acggggtggggttgagggtg

SEQ ID NO: 756931 - DNA, 20 bp, Artificial
  CRISPR gRNA sequence
agggtgagggacagaggggc

SEQ ID NO: 756932 - DNA, 20 bp, Artificial
  CRISPR gRNA sequence
acctccctgaagagttccac

SEQ ID NO: 756933 - DNA, 20 bp, Artificial
  CRISPR gRNA sequence
cctgaagagttccacggcct

SEQ ID NO: 756934 - DNA, 20 bp, Artificial
  CRISPR gRNA sequence
aagagttccacggcctcacg

SEQ ID NO: 756935 - DNA, 20 bp, Artificial
  CRISPR gRNA sequence
cacggcctcacggggtgggg

SEQ ID NO: 756936 - DNA, 20 bp, Artificial
  CRISPR gRNA sequence
acggggtggggttgagggtg

SEQ ID NO: 756937 - DNA, 20 bp, Artificial
  CRISPR gRNA sequence
agggtgagggacagaggggc

SEQ ID NO: 756938 - DNA, 20 bp, Artificial
  CRISPR gRNA sequence
acctccctgaagagttccac

SEQ ID NO: 756939 - DNA, 20 bp, Artificial
  CRISPR gRNA sequence
cctgaagagttccacggcct

SEQ ID NO: 756940 - DNA, 20 bp, Artificial
  CRISPR gRNA sequence
aagagttccacggcctcacg

SEQ ID NO: 756941 - DNA, 20 bp, Artificial
  CRISPR gRNA sequence
cacggcctcacggggtgggg

SEQ ID NO: 756942 - DNA, 20 bp, Artificial
  CRISPR gRNA sequence
acggggtggggttgagggtg

SEQ ID NO: 756943 - DNA, 20 bp, Artificial
  CRISPR gRNA sequence
agggtgagggacagaggggc

SEQ ID NO: 756944 - DNA, 20 bp, Artificial
  CRISPR gRNA sequence
acctccctgaagagttccac

SEQ ID NO: 756945 - DNA, 20 bp, Artificial
  CRISPR gRNA sequence
cctgaagagttccacggcct

SEQ ID NO: 756946 - DNA, 20 bp, Artificial
  CRISPR gRNA sequence
aagagttccacggcctcacg

SEQ ID NO: 756947 - DNA, 20 bp, Artificial
  CRISPR gRNA sequence
cacggcctcacggggtgggg

SEQ ID NO: 756948 - DNA, 20 bp, Artificial
  CRISPR gRNA sequence
acggggtggggttgagggtg

SEQ ID NO: 756949 - DNA, 20 bp, Artificial
  CRISPR gRNA sequence
agggtgaggggcagaggggc

SEQ ID NO: 756950 - DNA, 20 bp, Artificial
  CRISPR gRNA sequence
actttgcttctccttttctt

SEQ ID NO: 756951 - DNA, 20 bp, Artificial
  CRISPR gRNA sequence
tgcttctccttttcttgcag

SEQ ID NO: 756952 - DNA, 20 bp, Artificial
  CRISPR gRNA sequence
gcttctccttttcttgcaga

SEQ ID NO: 756953 - DNA, 20 bp, Artificial
  CRISPR gRNA sequence
cttctccttttcttgcagac

SEQ ID NO: 756954 - DNA, 20 bp, Artificial
  CRISPR gRNA sequence
ctccttttcttgcagaccct

SEQ ID NO: 756955 - DNA, 20 bp, Artificial
  CRISPR gRNA sequence
tccttttcttgcagaccctg

SEQ ID NO: 756956 - DNA, 20 bp, Artificial
  CRISPR gRNA sequence
cttttcttgcagaccctgtc

SEQ ID NO: 756957 - DNA, 20 bp, Artificial
  CRISPR gRNA sequence
ttcttgcagaccctgtccct

SEQ ID NO: 756958 - DNA, 20 bp, Artificial
  CRISPR gRNA sequence
tcttgcagaccctgtccctg

SEQ ID NO: 756959 - DNA, 20 bp, Artificial
  CRISPR gRNA sequence
cttgcagaccctgtccctga

SEQ ID NO: 756960 - DNA, 20 bp, Artificial
  CRISPR gRNA sequence
ttgcagaccctgtccctgac

SEQ ID NO: 756961 - DNA, 20 bp, Artificial
  CRISPR gRNA sequence
gcagaccctgtccctgactc

SEQ ID NO: 756962 - DNA, 20 bp, Artificial
  CRISPR gRNA sequence
cagaccctgtccctgactct

SEQ ID NO: 756963 - DNA, 20 bp, Artificial
  CRISPR gRNA sequence
tccctgactctccaaacttt

SEQ ID NO: 756964 - DNA, 20 bp, Artificial
  CRISPR gRNA sequence
actctccaaactttgaggtc

SEQ ID NO: 756965 - DNA, 20 bp, Artificial
  CRISPR gRNA sequence
tccaaactttgaggtcatct

SEQ ID NO: 756966 - DNA, 20 bp, Artificial
  CRISPR gRNA sequence
caaactttgaggtcatctag

SEQ ID NO: 756967 - DNA, 20 bp, Artificial
  CRISPR gRNA sequence
tgaggtcatctagcccagct

SEQ ID NO: 756968 - DNA, 20 bp, Artificial
  CRISPR gRNA sequence
gaggtcatctagcccagctg

SEQ ID NO: 756969 - DNA, 20 bp, Artificial
  CRISPR gRNA sequence
aggtcatctagcccagctgg

SEQ ID NO: 756970 - DNA, 20 bp, Artificial
  CRISPR gRNA sequence
gcccagctgggggacagtgg

SEQ ID NO: 756971 - DNA, 20 bp, Artificial
  CRISPR gRNA sequence
ggggacagtgggctgttgtg

SEQ ID NO: 756972 - DNA, 20 bp, Artificial
  CRISPR gRNA sequence
ttgtggctgggtctggggca

SEQ ID NO: 756973 - DNA, 20 bp, Artificial
  CRISPR gRNA sequence
tggctgggtctggggcaggt

SEQ ID NO: 756974 - DNA, 20 bp, Artificial
  CRISPR gRNA sequence
ggtctggggcaggtgcattt

SEQ ID NO: 756975 - DNA, 20 bp, Artificial
  CRISPR gRNA sequence
gggcaggtgcatttgagcca

SEQ ID NO: 756976 - DNA, 20 bp, Artificial
  CRISPR gRNA sequence
gagccagggctggctctgtg

SEQ ID NO: 756977 - DNA, 20 bp, Artificial
  CRISPR gRNA sequence
agccagggctggctctgtga

SEQ ID NO: 756978 - DNA, 20 bp, Artificial
  CRISPR gRNA sequence
gctctgtgagtggcctcctt

SEQ ID NO: 756979 - DNA, 20 bp, Artificial
  CRISPR gRNA sequence
tgtgagtggcctccttggcc

SEQ ID NO: 756980 - DNA, 20 bp, Artificial
  CRISPR gRNA sequence
tgagtggcctccttggcctc

SEQ ID NO: 756981 - DNA, 20 bp, Artificial
  CRISPR gRNA sequence
cttggcctcggccctggttc

SEQ ID NO: 756982 - DNA, 20 bp, Artificial
  CRISPR gRNA sequence
ggcctcggccctggttccct

SEQ ID NO: 756983 - DNA, 20 bp, Artificial
  CRISPR gRNA sequence
gcctcggccctggttccctc

SEQ ID NO: 756984 - DNA, 20 bp, Artificial
  CRISPR gRNA sequence
ggccctggttccctccctcc

SEQ ID NO: 756985 - DNA, 20 bp, Artificial
  CRISPR gRNA sequence
gttccctccctcctgctctg

SEQ ID NO: 756986 - DNA, 20 bp, Artificial
  CRISPR gRNA sequence
cctccctcctgctctgggct

SEQ ID NO: 756987 - DNA, 20 bp, Artificial
  CRISPR gRNA sequence
cctcctgctctgggctcaga

SEQ ID NO: 756988 - DNA, 20 bp, Artificial
  CRISPR gRNA sequence
ctgctctgggctcagatact

SEQ ID NO: 756989 - DNA, 20 bp, Artificial
  CRISPR gRNA sequence
ctctgggctcagatactgtg

SEQ ID NO: 756990 - DNA, 20 bp, Artificial
  CRISPR gRNA sequence
tgggctcagatactgtgaca

SEQ ID NO: 756991 - DNA, 20 bp, Artificial
  CRISPR gRNA sequence
ggctcagatactgtgacatc

SEQ ID NO: 756992 - DNA, 20 bp, Artificial
  CRISPR gRNA sequence
agatactgtgacatcccaga

SEQ ID NO: 756993 - DNA, 20 bp, Artificial
  CRISPR gRNA sequence
tgacatcccagaagcccagc

SEQ ID NO: 756994 - DNA, 20 bp, Artificial
  CRISPR gRNA sequence
aacccctctggatgctacat

SEQ ID NO: 756995 - DNA, 20 bp, Artificial
  CRISPR gRNA sequence
tggatgctacatggggatgc

SEQ ID NO: 756996 - DNA, 20 bp, Artificial
  CRISPR gRNA sequence
gatgctacatggggatgctg

SEQ ID NO: 756997 - DNA, 20 bp, Artificial
  CRISPR gRNA sequence
catggggatgctggacggct

SEQ ID NO: 756998 - DNA, 20 bp, Artificial
  CRISPR gRNA sequence
gacggctcagcccctgttcc

SEQ ID NO: 756999 - DNA, 20 bp, Artificial
  CRISPR gRNA sequence
agcccctgttccaaggattt

SEQ ID NO: 757000 - DNA, 20 bp, Artificial
  CRISPR gRNA sequence
ttccaaggattttggggtgc

SEQ ID NO: 757001 - DNA, 20 bp, Artificial
  CRISPR gRNA sequence
caaggattttggggtgctga

SEQ ID NO: 757002 - DNA, 20 bp, Artificial
  CRISPR gRNA sequence
tggggtgctgagattctccc

SEQ ID NO: 757003 - DNA, 20 bp, Artificial
  CRISPR gRNA sequence
ggggtgctgagattctcccc

SEQ ID NO: 757004 - DNA, 20 bp, Artificial
  CRISPR gRNA sequence
gggtgctgagattctcccct

SEQ ID NO: 757005 - DNA, 20 bp, Artificial
  CRISPR gRNA sequence
agattctcccctagagacct

SEQ ID NO: 757006 - DNA, 20 bp, Artificial
  CRISPR gRNA sequence
tcccctagagacctgaaatt

SEQ ID NO: 757007 - DNA, 20 bp, Artificial
  CRISPR gRNA sequence
ccctagagacctgaaattca

SEQ ID NO: 757008 - DNA, 20 bp, Artificial
  CRISPR gRNA sequence
gagacctgaaattcaccagc

SEQ ID NO: 757009 - DNA, 20 bp, Artificial
  CRISPR gRNA sequence
aaattcaccagctacagatg

SEQ ID NO: 757010 - DNA, 20 bp, Artificial
  CRISPR gRNA sequence
accagctacagatgccaaat

SEQ ID NO: 757011 - DNA, 20 bp, Artificial
  CRISPR gRNA sequence
cagatgccaaatgacttaca

SEQ ID NO: 757012 - DNA, 20 bp, Artificial
  CRISPR gRNA sequence
acatcttaagaagtctcaga

SEQ ID NO: 757013 - DNA, 20 bp, Artificial
  CRISPR gRNA sequence
catcttaagaagtctcagaa

SEQ ID NO: 757014 - DNA, 20 bp, Artificial
  CRISPR gRNA sequence
aagaagtctcagaacgtcca

SEQ ID NO: 757015 - DNA, 20 bp, Artificial
  CRISPR gRNA sequence
agaagtctcagaacgtccag

SEQ ID NO: 757016 - DNA, 20 bp, Artificial
  CRISPR gRNA sequence
agaacgtccagcccttcagc

SEQ ID NO: 757017 - DNA, 20 bp, Artificial
  CRISPR gRNA sequence
cagcagctctcgttctgaga

SEQ ID NO: 757018 - DNA, 20 bp, Artificial
  CRISPR gRNA sequence
agcagctctcgttctgagac

SEQ ID NO: 757019 - DNA, 20 bp, Artificial
  CRISPR gRNA sequence
tcgttctgagacatgagcct

SEQ ID NO: 757020 - DNA, 20 bp, Artificial
  CRISPR gRNA sequence
gttctgagacatgagccttg

SEQ ID NO: 757021 - DNA, 20 bp, Artificial
  CRISPR gRNA sequence
tgagacatgagccttgggat

SEQ ID NO: 757022 - DNA, 20 bp, Artificial
  CRISPR gRNA sequence
agacatgagccttgggatgt

SEQ ID NO: 757023 - DNA, 20 bp, Artificial
  CRISPR gRNA sequence
gggatgtggcagcatcagtg

SEQ ID NO: 757024 - DNA, 20 bp, Artificial
  CRISPR gRNA sequence
ggatgtggcagcatcagtgg

SEQ ID NO: 757025 - DNA, 20 bp, Artificial
  CRISPR gRNA sequence
ggccaccctcccaggcacca

SEQ ID NO: 757026 - DNA, 20 bp, Artificial
  CRISPR gRNA sequence
ccaggcaccagacacagggc

SEQ ID NO: 757027 - DNA, 20 bp, Artificial
  CRISPR gRNA sequence
ctcccccgtggccgccttgg

SEQ ID NO: 757028 - DNA, 20 bp, Artificial
  CRISPR gRNA sequence
tcccccgtggccgccttggc

SEQ ID NO: 757029 - DNA, 20 bp, Artificial
  CRISPR gRNA sequence
ccccgtggccgccttggctc

SEQ ID NO: 757030 - DNA, 20 bp, Artificial
  CRISPR gRNA sequence
ggctcccccgttttgcccga

SEQ ID NO: 757031 - DNA, 20 bp, Artificial
  CRISPR gRNA sequence
gctcccccgttttgcccgag

SEQ ID NO: 757032 - DNA, 20 bp, Artificial
  CRISPR gRNA sequence
ccccgttttgcccgaggctg

SEQ ID NO: 757033 - DNA, 20 bp, Artificial
  CRISPR gRNA sequence
tgcccgaggctgctcttctg

SEQ ID NO: 757034 - DNA, 20 bp, Artificial
  CRISPR gRNA sequence
gcccgaggctgctcttctgt

SEQ ID NO: 757035 - DNA, 20 bp, Artificial
  CRISPR gRNA sequence
cccgaggctgctcttctgtc

SEQ ID NO: 757036 - DNA, 20 bp, Artificial
  CRISPR gRNA sequence
ctcttctgtcagacttcctc

SEQ ID NO: 757037 - DNA, 20 bp, Artificial
  CRISPR gRNA sequence
ttctgtcagacttcctcttt

SEQ ID NO: 757038 - DNA, 20 bp, Artificial
  CRISPR gRNA sequence
ctgtcagacttcctctttgt

SEQ ID NO: 757039 - DNA, 20 bp, Artificial
  CRISPR gRNA sequence
tgtcagacttcctctttgta

SEQ ID NO: 757040 - DNA, 20 bp, Artificial
  CRISPR gRNA sequence
tcagacttcctctttgtacc

SEQ ID NO: 757041 - DNA, 20 bp, Artificial
  CRISPR gRNA sequence
cctctttgtaccacagtggc

SEQ ID NO: 757042 - DNA, 20 bp, Artificial
  CRISPR gRNA sequence
ctctttgtaccacagtggct

SEQ ID NO: 757043 - DNA, 20 bp, Artificial
  CRISPR gRNA sequence
tttgtaccacagtggctctg

SEQ ID NO: 757044 - DNA, 20 bp, Artificial
  CRISPR gRNA sequence
tgtaccacagtggctctggg

SEQ ID NO: 757045 - DNA, 20 bp, Artificial
  CRISPR gRNA sequence
gtaccacagtggctctgggg

SEQ ID NO: 757046 - DNA, 20 bp, Artificial
  CRISPR gRNA sequence
taccacagtggctctggggc

SEQ ID NO: 757047 - DNA, 20 bp, Artificial
  CRISPR gRNA sequence
tggggccaggcctgcctgcc

SEQ ID NO: 757048 - DNA, 20 bp, Artificial
  CRISPR gRNA sequence
gggccaggcctgcctgccca

SEQ ID NO: 757049 - DNA, 20 bp, Artificial
  CRISPR gRNA sequence
cctgcccactggccatcgcc

SEQ ID NO: 757050 - DNA, 20 bp, Artificial
  CRISPR gRNA sequence
cccactggccatcgccacct

SEQ ID NO: 757051 - DNA, 20 bp, Artificial
  CRISPR gRNA sequence
gccatcgccaccttccccag

SEQ ID NO: 757052 - DNA, 20 bp, Artificial
  CRISPR gRNA sequence
ccccagctgcctcctaccag

SEQ ID NO: 757053 - DNA, 20 bp, Artificial
  CRISPR gRNA sequence
cccagctgcctcctaccagc

SEQ ID NO: 757054 - DNA, 20 bp, Artificial
  CRISPR gRNA sequence
cctcctaccagcagtttctc

SEQ ID NO: 757055 - DNA, 20 bp, Artificial
  CRISPR gRNA sequence
ctaccagcagtttctctgaa

SEQ ID NO: 757056 - DNA, 20 bp, Artificial
  CRISPR gRNA sequence
ccagcagtttctctgaagat

SEQ ID NO: 757057 - DNA, 20 bp, Artificial
  CRISPR gRNA sequence
ctctgaagatctgtcaacag

SEQ ID NO: 757058 - DNA, 20 bp, Artificial
  CRISPR gRNA sequence
tctgaagatctgtcaacagg

SEQ ID NO: 757059 - DNA, 20 bp, Artificial
  CRISPR gRNA sequence
tgaagatctgtcaacaggtt

SEQ ID NO: 757060 - DNA, 20 bp, Artificial
  CRISPR gRNA sequence
aagatctgtcaacaggttaa

SEQ ID NO: 757061 - DNA, 20 bp, Artificial
  CRISPR gRNA sequence
tcaacaggttaagtcaatct

SEQ ID NO: 757062 - DNA, 20 bp, Artificial
  CRISPR gRNA sequence
agtcaatctggggcttccac

SEQ ID NO: 757063 - DNA, 20 bp, Artificial
  CRISPR gRNA sequence
gggcttccactgcctgcatt

SEQ ID NO: 757064 - DNA, 20 bp, Artificial
  CRISPR gRNA sequence
ccactgcctgcattccagtc

SEQ ID NO: 757065 - DNA, 20 bp, Artificial
  CRISPR gRNA sequence
cactgcctgcattccagtcc

SEQ ID NO: 757066 - DNA, 20 bp, Artificial
  CRISPR gRNA sequence
cctgcattccagtccccaga

SEQ ID NO: 757067 - DNA, 20 bp, Artificial
  CRISPR gRNA sequence
cattccagtccccagagctt

SEQ ID NO: 757068 - DNA, 20 bp, Artificial
  CRISPR gRNA sequence
cagtccccagagcttggtgg

SEQ ID NO: 757069 - DNA, 20 bp, Artificial
  CRISPR gRNA sequence
ggtggtcccgaaacgggaag

SEQ ID NO: 757070 - DNA, 20 bp, Artificial
  CRISPR gRNA sequence
gtggtcccgaaacgggaagt

SEQ ID NO: 757071 - DNA, 20 bp, Artificial
  CRISPR gRNA sequence
gggcatggtggcctccgtga

SEQ ID NO: 757072 - DNA, 20 bp, Artificial
  CRISPR gRNA sequence
cgtgagcaaatggtgtcttg

SEQ ID NO: 757073 - DNA, 20 bp, Artificial
  CRISPR gRNA sequence
gggcaatctgaggccaggac

SEQ ID NO: 757074 - DNA, 20 bp, Artificial
  CRISPR gRNA sequence
ggcaatctgaggccaggaca

SEQ ID NO: 757075 - DNA, 20 bp, Artificial
  CRISPR gRNA sequence
aggccaggacagatgttgcc

SEQ ID NO: 757076 - DNA, 20 bp, Artificial
  CRISPR gRNA sequence
ccccacccactggagatggt

SEQ ID NO: 757077 - DNA, 20 bp, Artificial
  CRISPR gRNA sequence
gagatggtgctgagggaggt

SEQ ID NO: 757078 - DNA, 20 bp, Artificial
  CRISPR gRNA sequence
agggaggtgggtggggcctt

SEQ ID NO: 757079 - DNA, 20 bp, Artificial
  CRISPR gRNA sequence
ctgggaaggtgagtggagag

SEQ ID NO: 757080 - DNA, 20 bp, Artificial
  CRISPR gRNA sequence
tgggaaggtgagtggagagg

SEQ ID NO: 757081 - DNA, 20 bp, Artificial
  CRISPR gRNA sequence
ggaaggtgagtggagagggg

SEQ ID NO: 757082 - DNA, 20 bp, Artificial
  CRISPR gRNA sequence
ccccccgccctccccatccc

SEQ ID NO: 757083 - DNA, 20 bp, Artificial
  CRISPR gRNA sequence
cccatcccctactcccactg

SEQ ID NO: 757084 - DNA, 20 bp, Artificial
  CRISPR gRNA sequence
ctcccactgctcagcgcggg

SEQ ID NO: 757085 - DNA, 20 bp, Artificial
  CRISPR gRNA sequence
ccactgctcagcgcgggcca

SEQ ID NO: 757086 - DNA, 20 bp, Artificial
  CRISPR gRNA sequence
ctcagcgcgggccattgcaa

SEQ ID NO: 757087 - DNA, 20 bp, Artificial
  CRISPR gRNA sequence
agcgcgggccattgcaaggg

SEQ ID NO: 757088 - DNA, 20 bp, Artificial
  CRISPR gRNA sequence
caagggtgccacacaatgtc

SEQ ID NO: 757089 - DNA, 20 bp, Artificial
  CRISPR gRNA sequence
gtccaccctgggacacttct

SEQ ID NO: 757090 - DNA, 20 bp, Artificial
  CRISPR gRNA sequence
tccaccctgggacacttctg

SEQ ID NO: 757091 - DNA, 20 bp, Artificial
  CRISPR gRNA sequence
ggacacttctgagtatgaag

SEQ ID NO: 757092 - DNA, 20 bp, Artificial
  CRISPR gRNA sequence
ctgagtatgaagcgggatgc

SEQ ID NO: 757093 - DNA, 20 bp, Artificial
  CRISPR gRNA sequence
tgagtatgaagcgggatgct

SEQ ID NO: 757094 - DNA, 20 bp, Artificial
  CRISPR gRNA sequence
agtatgaagcgggatgctat

SEQ ID NO: 757095 - DNA, 20 bp, Artificial
  CRISPR gRNA sequence
ttaaaaactacatggggaaa

SEQ ID NO: 757096 - DNA, 20 bp, Artificial
  CRISPR gRNA sequence
aaaactacatggggaaacag

SEQ ID NO: 757097 - DNA, 20 bp, Artificial
  CRISPR gRNA sequence
catggggaaacaggtgcaaa

SEQ ID NO: 757098 - DNA, 20 bp, Artificial
  CRISPR gRNA sequence
gagatggattgtaagagcca

SEQ ID NO: 757099 - DNA, 20 bp, Artificial
  CRISPR gRNA sequence
taagagccagtttaaatctg

SEQ ID NO: 757100 - DNA, 20 bp, Artificial
  CRISPR gRNA sequence
aaatctgcactctgctgctc

SEQ ID NO: 757101 - DNA, 20 bp, Artificial
  CRISPR gRNA sequence
aatctgcactctgctgctcc

SEQ ID NO: 757102 - DNA, 20 bp, Artificial
  CRISPR gRNA sequence
cactctgctgctcctccccc

SEQ ID NO: 757103 - DNA, 20 bp, Artificial
  CRISPR gRNA sequence
tgctgctcctcccccacccc

SEQ ID NO: 757104 - DNA, 20 bp, Artificial
  CRISPR gRNA sequence
ctgctcctcccccaccccca

SEQ ID NO: 757105 - DNA, 20 bp, Artificial
  CRISPR gRNA sequence
ctcctcccccacccccacct

SEQ ID NO: 757106 - DNA, 20 bp, Artificial
  CRISPR gRNA sequence
ctcccccacccccaccttcc

SEQ ID NO: 757107 - DNA, 20 bp, Artificial
  CRISPR gRNA sequence
ccccacccccaccttccact

SEQ ID NO: 757108 - DNA, 20 bp, Artificial
  CRISPR gRNA sequence
ccactccatacaatctgggc

SEQ ID NO: 757109 - DNA, 20 bp, Artificial
  CRISPR gRNA sequence
cactccatacaatctgggcc

SEQ ID NO: 757110 - DNA, 20 bp, Artificial
  CRISPR gRNA sequence
catacaatctgggcctggtg

SEQ ID NO: 757111 - DNA, 20 bp, Artificial
  CRISPR gRNA sequence
ggcctggtggagtcttcgct

SEQ ID NO: 757112 - DNA, 20 bp, Artificial
  CRISPR gRNA sequence
gtggagtcttcgcttcagag

SEQ ID NO: 757113 - DNA, 20 bp, Artificial
  CRISPR gRNA sequence
cgcttcagagccattcggcc

SEQ ID NO: 757114 - DNA, 20 bp, Artificial
  CRISPR gRNA sequence
gcttcagagccattcggcca

SEQ ID NO: 757115 - DNA, 20 bp, Artificial
  CRISPR gRNA sequence
cagagccattcggccaggtg

SEQ ID NO: 757116 - DNA, 20 bp, Artificial
  CRISPR gRNA sequence
agagccattcggccaggtgc

SEQ ID NO: 757117 - DNA, 20 bp, Artificial
  CRISPR gRNA sequence
ggccaggtgcgggtgatgtt

SEQ ID NO: 757118 - DNA, 20 bp, Artificial
  CRISPR gRNA sequence
ccatctcctgcttgtgggca

SEQ ID NO: 757119 - DNA, 20 bp, Artificial
  CRISPR gRNA sequence
ctgcttgtgggcatgccctg

SEQ ID NO: 757120 - DNA, 20 bp, Artificial
  CRISPR gRNA sequence
cttgtgggcatgccctggct

SEQ ID NO: 757121 - DNA, 20 bp, Artificial
  CRISPR gRNA sequence
gtgggcatgccctggctttg

SEQ ID NO: 757122 - DNA, 20 bp, Artificial
  CRISPR gRNA sequence
tgggcatgccctggctttgt

SEQ ID NO: 757123 - DNA, 20 bp, Artificial
  CRISPR gRNA sequence
gctttgtttttatacacata

SEQ ID NO: 757124 - DNA, 20 bp, Artificial
  CRISPR gRNA sequence
tgtttttatacacataggca

SEQ ID NO: 757125 - DNA, 20 bp, Artificial
  CRISPR gRNA sequence
gtttttatacacataggcaa

SEQ ID NO: 757126 - DNA, 20 bp, Artificial
  CRISPR gRNA sequence
tttttatacacataggcaag

SEQ ID NO: 757127 - DNA, 20 bp, Artificial
  CRISPR gRNA sequence
ttatacacataggcaaggtg

SEQ ID NO: 757128 - DNA, 20 bp, Artificial
  CRISPR gRNA sequence
tatacacataggcaaggtga

SEQ ID NO: 757129 - DNA, 20 bp, Artificial
  CRISPR gRNA sequence
atacacataggcaaggtgag

SEQ ID NO: 757130 - DNA, 20 bp, Artificial
  CRISPR gRNA sequence
tacacataggcaaggtgagt

SEQ ID NO: 757131 - DNA, 20 bp, Artificial
  CRISPR gRNA sequence
tgtggaattgtgattgaagg

SEQ ID NO: 757132 - DNA, 20 bp, Artificial
  CRISPR gRNA sequence
tggaattgtgattgaaggat

SEQ ID NO: 757133 - DNA, 20 bp, Artificial
  CRISPR gRNA sequence
tgattgaaggattttaaagc

SEQ ID NO: 757134 - DNA, 20 bp, Artificial
  CRISPR gRNA sequence
aaggattttaaagcagggga

SEQ ID NO: 757135 - DNA, 20 bp, Artificial
  CRISPR gRNA sequence
taaagcaggggaggagagta

SEQ ID NO: 757136 - DNA, 20 bp, Artificial
  CRISPR gRNA sequence
aaagcaggggaggagagtag

SEQ ID NO: 757137 - DNA, 20 bp, Artificial
  CRISPR gRNA sequence
aagcaggggaggagagtagg

SEQ ID NO: 757138 - DNA, 20 bp, Artificial
  CRISPR gRNA sequence
tgtacactctgggggtaaaa

SEQ ID NO: 757139 - DNA, 20 bp, Artificial
  CRISPR gRNA sequence
tacactctgggggtaaaaca

SEQ ID NO: 757140 - DNA, 20 bp, Artificial
  CRISPR gRNA sequence
tgggggtaaaacagggaagg

SEQ ID NO: 757141 - DNA, 20 bp, Artificial
  CRISPR gRNA sequence
ggggtaaaacagggaaggca

SEQ ID NO: 757142 - DNA, 20 bp, Artificial
  CRISPR gRNA sequence
agcatggggacaggtgaggt

SEQ ID NO: 757143 - DNA, 20 bp, Artificial
  CRISPR gRNA sequence
ggcagaccccctgtagcgtt

SEQ ID NO: 757144 - DNA, 20 bp, Artificial
  CRISPR gRNA sequence
tagcgtttagcaggatgggg

SEQ ID NO: 757145 - DNA, 20 bp, Artificial
  CRISPR gRNA sequence
agcaggatgggggccccagg

SEQ ID NO: 757146 - DNA, 20 bp, Artificial
  CRISPR gRNA sequence
gcaggatgggggccccaggt

SEQ ID NO: 757147 - DNA, 20 bp, Artificial
  CRISPR gRNA sequence
tggagagcatagtccagcct

SEQ ID NO: 757148 - DNA, 20 bp, Artificial
  CRISPR gRNA sequence
ggcatttgtctcctagcagc

SEQ ID NO: 757149 - DNA, 20 bp, Artificial
  CRISPR gRNA sequence
gtctcctagcagcctacact

SEQ ID NO: 757150 - DNA, 20 bp, Artificial
  CRISPR gRNA sequence
tctcctagcagcctacactg

SEQ ID NO: 757151 - DNA, 20 bp, Artificial
  CRISPR gRNA sequence
ctagcagcctacactggctc

SEQ ID NO: 757152 - DNA, 20 bp, Artificial
  CRISPR gRNA sequence
gcagcctacactggctctgc

SEQ ID NO: 757153 - DNA, 20 bp, Artificial
  CRISPR gRNA sequence
cactggctctgctgagctgg

SEQ ID NO: 757154 - DNA, 20 bp, Artificial
  CRISPR gRNA sequence
gctctgctgagctgggcctg

SEQ ID NO: 757155 - DNA, 20 bp, Artificial
  CRISPR gRNA sequence
tgctgagctgggcctgggtg

SEQ ID NO: 757156 - DNA, 20 bp, Artificial
  CRISPR gRNA sequence
ctgagctgggcctgggtgct

SEQ ID NO: 757157 - DNA, 20 bp, Artificial
  CRISPR gRNA sequence
agctgggcctgggtgctgaa

SEQ ID NO: 757158 - DNA, 20 bp, Artificial
  CRISPR gRNA sequence
ggcctgggtgctgaaagcca

SEQ ID NO: 757159 - DNA, 20 bp, Artificial
  CRISPR gRNA sequence
ggtgctgaaagccaggattt

SEQ ID NO: 757160 - DNA, 20 bp, Artificial
  CRISPR gRNA sequence
aaagccaggatttggggcta

SEQ ID NO: 757161 - DNA, 20 bp, Artificial
  CRISPR gRNA sequence
ggggctaggcgggaagatgt

SEQ ID NO: 757162 - DNA, 20 bp, Artificial
  CRISPR gRNA sequence
gggctaggcgggaagatgtt

SEQ ID NO: 757163 - DNA, 20 bp, Artificial
  CRISPR gRNA sequence
ggcgggaagatgttcgccca

SEQ ID NO: 757164 - DNA, 20 bp, Artificial
  CRISPR gRNA sequence
gcccaattgcttggggggtt

SEQ ID NO: 757165 - DNA, 20 bp, Artificial
  CRISPR gRNA sequence
cttggggggttggggggatg

SEQ ID NO: 757166 - DNA, 20 bp, Artificial
  CRISPR gRNA sequence
ggggggttggggggatggaa

SEQ ID NO: 757167 - DNA, 20 bp, Artificial
  CRISPR gRNA sequence
gggggttggggggatggaaa

SEQ ID NO: 757168 - DNA, 20 bp, Artificial
  CRISPR gRNA sequence
gggggatggaaaaggggagc

SEQ ID NO: 757169 - DNA, 20 bp, Artificial
  CRISPR gRNA sequence
taggctgcctggcagcagtg

SEQ ID NO: 757170 - DNA, 20 bp, Artificial
  CRISPR gRNA sequence
ggctgcctggcagcagtgag

SEQ ID NO: 757171 - DNA, 20 bp, Artificial
  CRISPR gRNA sequence
cctggcagcagtgagccctg

SEQ ID NO: 757172 - DNA, 20 bp, Artificial
  CRISPR gRNA sequence
gcagcagtgagccctgggcc

SEQ ID NO: 757173 - DNA, 20 bp, Artificial
  CRISPR gRNA sequence
ggcctgtggctacagccagg

SEQ ID NO: 757174 - DNA, 20 bp, Artificial
  CRISPR gRNA sequence
tggctacagccagggaaccc

SEQ ID NO: 757175 - DNA, 20 bp, Artificial
  CRISPR gRNA sequence
cagccagggaaccccacctg

SEQ ID NO: 757176 - DNA, 20 bp, Artificial
  CRISPR gRNA sequence
gacacatggccctgcttcta

SEQ ID NO: 757177 - DNA, 20 bp, Artificial
  CRISPR gRNA sequence
cttctaagccccccagttag

SEQ ID NO: 757178 - DNA, 20 bp, Artificial
  CRISPR gRNA sequence
ctaagccccccagttaggcc

SEQ ID NO: 757179 - DNA, 20 bp, Artificial
  CRISPR gRNA sequence
taagccccccagttaggccc

SEQ ID NO: 757180 - DNA, 20 bp, Artificial
  CRISPR gRNA sequence
agccccccagttaggcccaa

SEQ ID NO: 757181 - DNA, 20 bp, Artificial
  CRISPR gRNA sequence
ggcccaaaggaatggtccac

SEQ ID NO: 757182 - DNA, 20 bp, Artificial
  CRISPR gRNA sequence
agggcctcctgctctgcctg

SEQ ID NO: 757183 - DNA, 20 bp, Artificial
  CRISPR gRNA sequence
ctgctctgcctgggctgggc

SEQ ID NO: 757184 - DNA, 20 bp, Artificial
  CRISPR gRNA sequence
ctctgcctgggctgggccag

SEQ ID NO: 757185 - DNA, 20 bp, Artificial
  CRISPR gRNA sequence
tgcctgggctgggccagggg

SEQ ID NO: 757186 - DNA, 20 bp, Artificial
  CRISPR gRNA sequence
cctgggctgggccaggggct

SEQ ID NO: 757187 - DNA, 20 bp, Artificial
  CRISPR gRNA sequence
ggctgggccaggggctttga

SEQ ID NO: 757188 - DNA, 20 bp, Artificial
  CRISPR gRNA sequence
ggccaggggctttgaggaga

SEQ ID NO: 757189 - DNA, 20 bp, Artificial
  CRISPR gRNA sequence
tgaggagagggtaaacatag

SEQ ID NO: 757190 - DNA, 20 bp, Artificial
  CRISPR gRNA sequence
gaggagagggtaaacatagg

SEQ ID NO: 757191 - DNA, 20 bp, Artificial
  CRISPR gRNA sequence
aggagagggtaaacataggc

SEQ ID NO: 757192 - DNA, 20 bp, Artificial
  CRISPR gRNA sequence
acacctcgagtggccagaat

SEQ ID NO: 757193 - DNA, 20 bp, Artificial
  CRISPR gRNA sequence
gagtggccagaatatgccca

SEQ ID NO: 757194 - DNA, 20 bp, Artificial
  CRISPR gRNA sequence
ctcccttgtccctaggcaga

SEQ ID NO: 757195 - DNA, 20 bp, Artificial
  CRISPR gRNA sequence
tcccttgtccctaggcagag

SEQ ID NO: 757196 - DNA, 20 bp, Artificial
  CRISPR gRNA sequence
ccttgtccctaggcagaggg

SEQ ID NO: 757197 - DNA, 20 bp, Artificial
  CRISPR gRNA sequence
gtccctaggcagaggggggt

SEQ ID NO: 757198 - DNA, 20 bp, Artificial
  CRISPR gRNA sequence
tccctaggcagaggggggtc

SEQ ID NO: 757199 - DNA, 20 bp, Artificial
  CRISPR gRNA sequence
ggcagaggggggtcccttct

SEQ ID NO: 757200 - DNA, 20 bp, Artificial
  CRISPR gRNA sequence
cttttgttccctctggtcac

SEQ ID NO: 757201 - DNA, 20 bp, Artificial
  CRISPR gRNA sequence
ttttgttccctctggtcacc

SEQ ID NO: 757202 - DNA, 20 bp, Artificial
  CRISPR gRNA sequence
ttgttccctctggtcaccac

SEQ ID NO: 757203 - DNA, 20 bp, Artificial
  CRISPR gRNA sequence
tgttccctctggtcaccaca

SEQ ID NO: 757204 - DNA, 20 bp, Artificial
  CRISPR gRNA sequence
gttccctctggtcaccacaa

SEQ ID NO: 757205 - DNA, 20 bp, Artificial
  CRISPR gRNA sequence
ttccctctggtcaccacaat

SEQ ID NO: 757206 - DNA, 20 bp, Artificial
  CRISPR gRNA sequence
cctctggtcaccacaatgct

SEQ ID NO: 757207 - DNA, 20 bp, Artificial
  CRISPR gRNA sequence
tggtcaccacaatgcttgat

SEQ ID NO: 757208 - DNA, 20 bp, Artificial
  CRISPR gRNA sequence
gtcaccacaatgcttgatgc

SEQ ID NO: 757209 - DNA, 20 bp, Artificial
  CRISPR gRNA sequence
gatgccagctgccataggaa

SEQ ID NO: 757210 - DNA, 20 bp, Artificial
  CRISPR gRNA sequence
atgccagctgccataggaag

SEQ ID NO: 757211 - DNA, 20 bp, Artificial
  CRISPR gRNA sequence
ccataggaagagggtgctgg

SEQ ID NO: 757212 - DNA, 20 bp, Artificial
  CRISPR gRNA sequence
gctggccatggtggcacaca

SEQ ID NO: 757213 - DNA, 20 bp, Artificial
  CRISPR gRNA sequence
gccatggtggcacacacctg

SEQ ID NO: 757214 - DNA, 20 bp, Artificial
  CRISPR gRNA sequence
tcctcccagcactttgcagg

SEQ ID NO: 757215 - DNA, 20 bp, Artificial
  CRISPR gRNA sequence
ccagcactttgcagggctga

SEQ ID NO: 757216 - DNA, 20 bp, Artificial
  CRISPR gRNA sequence
tgcagggctgaggtggaagg

SEQ ID NO: 757217 - DNA, 20 bp, Artificial
  CRISPR gRNA sequence
gcagggctgaggtggaagga

SEQ ID NO: 757218 - DNA, 20 bp, Artificial
  CRISPR gRNA sequence
cagggctgaggtggaaggac

SEQ ID NO: 757219 - DNA, 20 bp, Artificial
  CRISPR gRNA sequence
aggtggaaggaccgcttaag

SEQ ID NO: 757220 - DNA, 20 bp, Artificial
  CRISPR gRNA sequence
aagcccaggtgttcaaggct

SEQ ID NO: 757221 - DNA, 20 bp, Artificial
  CRISPR gRNA sequence
agcccaggtgttcaaggctg

SEQ ID NO: 757222 - DNA, 20 bp, Artificial
  CRISPR gRNA sequence
aaggctgctgtgagctgtgt

SEQ ID NO: 757223 - DNA, 20 bp, Artificial
  CRISPR gRNA sequence
ctgtgagctgtgttcgagcc

SEQ ID NO: 757224 - DNA, 20 bp, Artificial
  CRISPR gRNA sequence
tgagctgtgttcgagccact

SEQ ID NO: 757225 - DNA, 20 bp, Artificial
  CRISPR gRNA sequence
tgttcgagccactacactcc

SEQ ID NO: 757226 - DNA, 20 bp, Artificial
  CRISPR gRNA sequence
gagccactacactccagcct

SEQ ID NO: 757227 - DNA, 20 bp, Artificial
  CRISPR gRNA sequence
cactccagcctggggacgga

SEQ ID NO: 757228 - DNA, 20 bp, Artificial
  CRISPR gRNA sequence
cagcctggggacggagcaaa

SEQ ID NO: 757229 - DNA, 20 bp, Artificial
  CRISPR gRNA sequence
gggacggagcaaaactttgc

SEQ ID NO: 757230 - DNA, 20 bp, Artificial
  CRISPR gRNA sequence
tgcctcaaaacaaattttaa

SEQ ID NO: 757231 - DNA, 20 bp, Artificial
  CRISPR gRNA sequence
gcctcaaaacaaattttaaa

SEQ ID NO: 757232 - DNA, 20 bp, Artificial
  CRISPR gRNA sequence
cctcaaaacaaattttaaaa

SEQ ID NO: 757233 - DNA, 20 bp, Artificial
  CRISPR gRNA sequence
aaaacaaattttaaaaagaa

SEQ ID NO: 757234 - DNA, 20 bp, Artificial
  CRISPR gRNA sequence
taaaaagaaagaaagaagga

SEQ ID NO: 757235 - DNA, 20 bp, Artificial
  CRISPR gRNA sequence
aaaaagaaagaaagaaggaa

SEQ ID NO: 757236 - DNA, 20 bp, Artificial
  CRISPR gRNA sequence
aaaagaaagaaagaaggaaa

SEQ ID NO: 757237 - DNA, 20 bp, Artificial
  CRISPR gRNA sequence
ttcacaattcatgggggcct

SEQ ID NO: 757238 - DNA, 20 bp, Artificial
  CRISPR gRNA sequence
tcacaattcatgggggcctg

SEQ ID NO: 757239 - DNA, 20 bp, Artificial
  CRISPR gRNA sequence
cacaattcatgggggcctgc

SEQ ID NO: 757240 - DNA, 20 bp, Artificial
  CRISPR gRNA sequence
acaattcatgggggcctgca

SEQ ID NO: 757241 - DNA, 20 bp, Artificial
  CRISPR gRNA sequence
atgggggcctgcatggcagg

SEQ ID NO: 757242 - DNA, 20 bp, Artificial
  CRISPR gRNA sequence
catggcaggagtggggacag

SEQ ID NO: 757243 - DNA, 20 bp, Artificial
  CRISPR gRNA sequence
ctgttcctggagtcgaagga

SEQ ID NO: 757244 - DNA, 20 bp, Artificial
  CRISPR gRNA sequence
ttcctggagtcgaaggacaa

SEQ ID NO: 757245 - DNA, 20 bp, Artificial
  CRISPR gRNA sequence
ctggagtcgaaggacaagcc

SEQ ID NO: 757246 - DNA, 20 bp, Artificial
  CRISPR gRNA sequence
gagtcgaaggacaagcccac

SEQ ID NO: 757247 - DNA, 20 bp, Artificial
  CRISPR gRNA sequence
cggttctcccaactcaggaa

SEQ ID NO: 757248 - DNA, 20 bp, Artificial
  CRISPR gRNA sequence
tcccaactcaggaagagcat

SEQ ID NO: 757249 - DNA, 20 bp, Artificial
  CRISPR gRNA sequence
ccaactcaggaagagcatgc

SEQ ID NO: 757250 - DNA, 20 bp, Artificial
  CRISPR gRNA sequence
aggaagagcatgccctgccc

SEQ ID NO: 757251 - DNA, 20 bp, Artificial
  CRISPR gRNA sequence
ccctctggggaggctggcct

SEQ ID NO: 757252 - DNA, 20 bp, Artificial
  CRISPR gRNA sequence
tggggaggctggcctggccc

SEQ ID NO: 757253 - DNA, 20 bp, Artificial
  CRISPR gRNA sequence
gggaggctggcctggcccca

SEQ ID NO: 757254 - DNA, 20 bp, Artificial
  CRISPR gRNA sequence
gcctggccccagccctcagc

SEQ ID NO: 757255 - DNA, 20 bp, Artificial
  CRISPR gRNA sequence
gccccagccctcagctgctg

SEQ ID NO: 757256 - DNA, 20 bp, Artificial
  CRISPR gRNA sequence
agctgctgaccttgaggcag

SEQ ID NO: 757257 - DNA, 20 bp, Artificial
  CRISPR gRNA sequence
ctgaccttgaggcagagaca

SEQ ID NO: 757258 - DNA, 20 bp, Artificial
  CRISPR gRNA sequence
accttgaggcagagacaact

SEQ ID NO: 757259 - DNA, 20 bp, Artificial
  CRISPR gRNA sequence
gaggcagagacaacttctaa

SEQ ID NO: 757260 - DNA, 20 bp, Artificial
  CRISPR gRNA sequence
aggcagagacaacttctaag

SEQ ID NO: 757261 - DNA, 20 bp, Artificial
  CRISPR gRNA sequence
ctaagaatttggctgccaga

SEQ ID NO: 757262 - DNA, 20 bp, Artificial
  CRISPR gRNA sequence
taagaatttggctgccagac

SEQ ID NO: 757263 - DNA, 20 bp, Artificial
  CRISPR gRNA sequence
agaatttggctgccagaccc

SEQ ID NO: 757264 - DNA, 20 bp, Artificial
  CRISPR gRNA sequence
ggctgccagaccccaggcct

SEQ ID NO: 757265 - DNA, 20 bp, Artificial
  CRISPR gRNA sequence
gctgccagaccccaggcctg

SEQ ID NO: 757266 - DNA, 20 bp, Artificial
  CRISPR gRNA sequence
ccagaccccaggcctggctg

SEQ ID NO: 757267 - DNA, 20 bp, Artificial
  CRISPR gRNA sequence
gctgctgctgtgtggagagg

SEQ ID NO: 757268 - DNA, 20 bp, Artificial
  CRISPR gRNA sequence
ctgctgtgtggagagggagg

SEQ ID NO: 757269 - DNA, 20 bp, Artificial
  CRISPR gRNA sequence
ctgtgtggagagggaggcgg

SEQ ID NO: 757270 - DNA, 20 bp, Artificial
  CRISPR gRNA sequence
tgtggagagggaggcggccc

SEQ ID NO: 757271 - DNA, 20 bp, Artificial
  CRISPR gRNA sequence
cctcctcagcttcctctggt

SEQ ID NO: 757272 - DNA, 20 bp, Artificial
  CRISPR gRNA sequence
ctcctcagcttcctctggtg

SEQ ID NO: 757273 - DNA, 20 bp, Artificial
  CRISPR gRNA sequence
ctcagcttcctctggtgcgg

SEQ ID NO: 757274 - DNA, 20 bp, Artificial
  CRISPR gRNA sequence
agcttcctctggtgcggccc

SEQ ID NO: 757275 - DNA, 20 bp, Artificial
  CRISPR gRNA sequence
cctctggtgcggccctgccc

SEQ ID NO: 757276 - DNA, 20 bp, Artificial
  CRISPR gRNA sequence
ctctggtgcggccctgccct

SEQ ID NO: 757277 - DNA, 20 bp, Artificial
  CRISPR gRNA sequence
tggtgcggccctgccctctc

SEQ ID NO: 757278 - DNA, 20 bp, Artificial
  CRISPR gRNA sequence
gtgcggccctgccctctctt

SEQ ID NO: 757279 - DNA, 20 bp, Artificial
  CRISPR gRNA sequence
ccctctcttctctggaccct

SEQ ID NO: 757280 - DNA, 20 bp, Artificial
  CRISPR gRNA sequence
tcttctctggacccttttac

SEQ ID NO: 757281 - DNA, 20 bp, Artificial
  CRISPR gRNA sequence
ttctctggacccttttacaa

SEQ ID NO: 757282 - DNA, 20 bp, Artificial
  CRISPR gRNA sequence
ctctggacccttttacaact

SEQ ID NO: 757283 - DNA, 20 bp, Artificial
  CRISPR gRNA sequence
tctggacccttttacaactg

SEQ ID NO: 757284 - DNA, 20 bp, Artificial
  CRISPR gRNA sequence
tggacccttttacaactgaa

SEQ ID NO: 757285 - DNA, 20 bp, Artificial
  CRISPR gRNA sequence
gacccttttacaactgaacg

SEQ ID NO: 757286 - DNA, 20 bp, Artificial
  CRISPR gRNA sequence
ttacaactgaacgcatctgg

SEQ ID NO: 757287 - DNA, 20 bp, Artificial
  CRISPR gRNA sequence
tacaactgaacgcatctggg

SEQ ID NO: 757288 - DNA, 20 bp, Artificial
  CRISPR gRNA sequence
acaactgaacgcatctgggc

SEQ ID NO: 757289 - DNA, 20 bp, Artificial
  CRISPR gRNA sequence
caactgaacgcatctgggct

SEQ ID NO: 757290 - DNA, 20 bp, Artificial
  CRISPR gRNA sequence
aacgcatctgggcttcgtgg

SEQ ID NO: 757291 - DNA, 20 bp, Artificial
  CRISPR gRNA sequence
ggcttcgtggtttcctgttt

SEQ ID NO: 757292 - DNA, 20 bp, Artificial
  CRISPR gRNA sequence
cgtggtttcctgttttcagc

SEQ ID NO: 757293 - DNA, 20 bp, Artificial
  CRISPR gRNA sequence
gtggtttcctgttttcagcg

SEQ ID NO: 757294 - DNA, 20 bp, Artificial
  CRISPR gRNA sequence
cctgttttcagcgaaattta

SEQ ID NO: 757295 - DNA, 20 bp, Artificial
  CRISPR gRNA sequence
ctgttttcagcgaaatttac

SEQ ID NO: 757296 - DNA, 20 bp, Artificial
  CRISPR gRNA sequence
ttttcagcgaaatttactct

SEQ ID NO: 757297 - DNA, 20 bp, Artificial
  CRISPR gRNA sequence
tcagcgaaatttactctgag

SEQ ID NO: 757298 - DNA, 20 bp, Artificial
  CRISPR gRNA sequence
cagcgaaatttactctgagc

SEQ ID NO: 757299 - DNA, 20 bp, Artificial
  CRISPR gRNA sequence
agcgaaatttactctgagct

SEQ ID NO: 757300 - DNA, 20 bp, Artificial
  CRISPR gRNA sequence
actctgagctcccagttcca

SEQ ID NO: 757301 - DNA, 20 bp, Artificial
  CRISPR gRNA sequence
ctctgagctcccagttccat

SEQ ID NO: 757302 - DNA, 20 bp, Artificial
  CRISPR gRNA sequence
tgagctcccagttccatctt

SEQ ID NO: 757303 - DNA, 20 bp, Artificial
  CRISPR gRNA sequence
agctcccagttccatcttca

SEQ ID NO: 757304 - DNA, 20 bp, Artificial
  CRISPR gRNA sequence
ccagttccatcttcatccat

SEQ ID NO: 757305 - DNA, 20 bp, Artificial
  CRISPR gRNA sequence
catcttcatccatggccaca

SEQ ID NO: 757306 - DNA, 20 bp, Artificial
  CRISPR gRNA sequence
catccatggccacaggccct

SEQ ID NO: 757307 - DNA, 20 bp, Artificial
  CRISPR gRNA sequence
atccatggccacaggccctg

SEQ ID NO: 757308 - DNA, 20 bp, Artificial
  CRISPR gRNA sequence
cctacaacgcactagggacg

SEQ ID NO: 757309 - DNA, 20 bp, Artificial
  CRISPR gRNA sequence
caacgcactagggacgtccc

SEQ ID NO: 757310 - DNA, 20 bp, Artificial
  CRISPR gRNA sequence
gggacgtccctccctgctgc

SEQ ID NO: 757311 - DNA, 20 bp, Artificial
  CRISPR gRNA sequence
cctgctgctgctggggaggg

SEQ ID NO: 757312 - DNA, 20 bp, Artificial
  CRISPR gRNA sequence
ctgctgctggggaggggcag

SEQ ID NO: 757313 - DNA, 20 bp, Artificial
  CRISPR gRNA sequence
ctgctggggaggggcaggct

SEQ ID NO: 757314 - DNA, 20 bp, Artificial
  CRISPR gRNA sequence
ctggggaggggcaggctgct

SEQ ID NO: 757315 - DNA, 20 bp, Artificial
  CRISPR gRNA sequence
gggaggggcaggctgctgga

SEQ ID NO: 757316 - DNA, 20 bp, Artificial
  CRISPR gRNA sequence
ctggagccgccctctgagtt

SEQ ID NO: 757317 - DNA, 20 bp, Artificial
  CRISPR gRNA sequence
gagccgccctctgagttgcc

SEQ ID NO: 757318 - DNA, 20 bp, Artificial
  CRISPR gRNA sequence
tgagttgcccgggatggtag

SEQ ID NO: 757319 - DNA, 20 bp, Artificial
  CRISPR gRNA sequence
agttgcccgggatggtagtg

SEQ ID NO: 757320 - DNA, 20 bp, Artificial
  CRISPR gRNA sequence
cccgggatggtagtgcctct

SEQ ID NO: 757321 - DNA, 20 bp, Artificial
  CRISPR gRNA sequence
tgatgccagccctggtggct

SEQ ID NO: 757322 - DNA, 20 bp, Artificial
  CRISPR gRNA sequence
atgccagccctggtggctgt

SEQ ID NO: 757323 - DNA, 20 bp, Artificial
  CRISPR gRNA sequence
gtggctgtgggctggggtgc

SEQ ID NO: 757324 - DNA, 20 bp, Artificial
  CRISPR gRNA sequence
tgggctggggtgcatgggag

SEQ ID NO: 757325 - DNA, 20 bp, Artificial
  CRISPR gRNA sequence
gggtgcatgggagagctggg

SEQ ID NO: 757326 - DNA, 20 bp, Artificial
  CRISPR gRNA sequence
ggtgcgagaacatggcgcct

SEQ ID NO: 757327 - DNA, 20 bp, Artificial
  CRISPR gRNA sequence
cagggggcgggaggagcact

SEQ ID NO: 757328 - DNA, 20 bp, Artificial
  CRISPR gRNA sequence
ggggctggggcaggaggctc

SEQ ID NO: 757329 - DNA, 20 bp, Artificial
  CRISPR gRNA sequence
gggcaggaggctcctggagc

SEQ ID NO: 757330 - DNA, 20 bp, Artificial
  CRISPR gRNA sequence
ctggagcgctggattcgtgg

SEQ ID NO: 757331 - DNA, 20 bp, Artificial
  CRISPR gRNA sequence
gagcgctggattcgtggcac

SEQ ID NO: 757332 - DNA, 20 bp, Artificial
  CRISPR gRNA sequence
gattcgtggcacagtctgag

SEQ ID NO: 757333 - DNA, 20 bp, Artificial
  CRISPR gRNA sequence
gtggcacagtctgaggccct

SEQ ID NO: 757334 - DNA, 20 bp, Artificial
  CRISPR gRNA sequence
aggccctgagagggaaatcc

SEQ ID NO: 757335 - DNA, 20 bp, Artificial
  CRISPR gRNA sequence
agagggaaatccatgctttt

SEQ ID NO: 757336 - DNA, 20 bp, Artificial
  CRISPR gRNA sequence
ttaagaactaattcattgtt

SEQ ID NO: 757337 - DNA, 20 bp, Artificial
  CRISPR gRNA sequence
taagaactaattcattgtta

SEQ ID NO: 757338 - DNA, 20 bp, Artificial
  CRISPR gRNA sequence
aagaactaattcattgttag

SEQ ID NO: 757339 - DNA, 20 bp, Artificial
  CRISPR gRNA sequence
agaactaattcattgttagg

SEQ ID NO: 757340 - DNA, 20 bp, Artificial
  CRISPR gRNA sequence
attcattgttaggagatcaa

SEQ ID NO: 757341 - DNA, 20 bp, Artificial
  CRISPR gRNA sequence
attgttaggagatcaatcag

SEQ ID NO: 757342 - DNA, 20 bp, Artificial
  CRISPR gRNA sequence
ttaggagatcaatcaggaat

SEQ ID NO: 757343 - DNA, 20 bp, Artificial
  CRISPR gRNA sequence
ggagatcaatcaggaattag

SEQ ID NO: 757344 - DNA, 20 bp, Artificial
  CRISPR gRNA sequence
ggggccatcttacctatctc

SEQ ID NO: 757345 - DNA, 20 bp, Artificial
  CRISPR gRNA sequence
acctatctcctgacattcac

SEQ ID NO: 757346 - DNA, 20 bp, Artificial
  CRISPR gRNA sequence
cctatctcctgacattcaca

SEQ ID NO: 757347 - DNA, 20 bp, Artificial
  CRISPR gRNA sequence
tctcctgacattcacagttt

SEQ ID NO: 757348 - DNA, 20 bp, Artificial
  CRISPR gRNA sequence
ctgacattcacagtttaata

SEQ ID NO: 757349 - DNA, 20 bp, Artificial
  CRISPR gRNA sequence
acattcacagtttaatagag

SEQ ID NO: 757350 - DNA, 20 bp, Artificial
  CRISPR gRNA sequence
acagtttaatagagacttcc

SEQ ID NO: 757351 - DNA, 20 bp, Artificial
  CRISPR gRNA sequence
aatagagacttcctgccttt

SEQ ID NO: 757352 - DNA, 20 bp, Artificial
  CRISPR gRNA sequence
atagagacttcctgccttta

SEQ ID NO: 757353 - DNA, 20 bp, Artificial
  CRISPR gRNA sequence
cctgcctttattccctccca

SEQ ID NO: 757354 - DNA, 20 bp, Artificial
  CRISPR gRNA sequence
ctgcctttattccctcccag

SEQ ID NO: 757355 - DNA, 20 bp, Artificial
  CRISPR gRNA sequence
cctttattccctcccaggga

SEQ ID NO: 757356 - DNA, 20 bp, Artificial
  CRISPR gRNA sequence
tattccctcccagggagagg

SEQ ID NO: 757357 - DNA, 20 bp, Artificial
  CRISPR gRNA sequence
attccctcccagggagaggc

SEQ ID NO: 757358 - DNA, 20 bp, Artificial
  CRISPR gRNA sequence
ttccctcccagggagaggct

SEQ ID NO: 757359 - DNA, 20 bp, Artificial
  CRISPR gRNA sequence
cctcccagggagaggctgaa

SEQ ID NO: 757360 - DNA, 20 bp, Artificial
  CRISPR gRNA sequence
ccagggagaggctgaaggaa

SEQ ID NO: 757361 - DNA, 20 bp, Artificial
  CRISPR gRNA sequence
aaggaatggaattgaaagca

SEQ ID NO: 757362 - DNA, 20 bp, Artificial
  CRISPR gRNA sequence
aaagcaccatttggagggtt

SEQ ID NO: 757363 - DNA, 20 bp, Artificial
  CRISPR gRNA sequence
ggagggttttgctgacacag

SEQ ID NO: 757364 - DNA, 20 bp, Artificial
  CRISPR gRNA sequence
gagggttttgctgacacagc

SEQ ID NO: 757365 - DNA, 20 bp, Artificial
  CRISPR gRNA sequence
tgctgacacagcggggactg

SEQ ID NO: 757366 - DNA, 20 bp, Artificial
  CRISPR gRNA sequence
gctgacacagcggggactgc

SEQ ID NO: 757367 - DNA, 20 bp, Artificial
  CRISPR gRNA sequence
ctgacacagcggggactgct

SEQ ID NO: 757368 - DNA, 20 bp, Artificial
  CRISPR gRNA sequence
acacagcggggactgctcag

SEQ ID NO: 757369 - DNA, 20 bp, Artificial
  CRISPR gRNA sequence
ctcagcactccctaaaaaca

SEQ ID NO: 757370 - DNA, 20 bp, Artificial
  CRISPR gRNA sequence
agcactccctaaaaacacac

SEQ ID NO: 757371 - DNA, 20 bp, Artificial
  CRISPR gRNA sequence
cctaaaaacacaccatggag

SEQ ID NO: 757372 - DNA, 20 bp, Artificial
  CRISPR gRNA sequence
aaaacacaccatggaggcca

SEQ ID NO: 757373 - DNA, 20 bp, Artificial
  CRISPR gRNA sequence
gtgactgctggtgggcaggc

SEQ ID NO: 757374 - DNA, 20 bp, Artificial
  CRISPR gRNA sequence
ctggtgggcaggctggccct

SEQ ID NO: 757375 - DNA, 20 bp, Artificial
  CRISPR gRNA sequence
gtgggcaggctggccctgcc

SEQ ID NO: 757376 - DNA, 20 bp, Artificial
  CRISPR gRNA sequence
gccctgcctgggggagtccg

SEQ ID NO: 757377 - DNA, 20 bp, Artificial
  CRISPR gRNA sequence
cctgggggagtccgtggcga

SEQ ID NO: 757378 - DNA, 20 bp, Artificial
  CRISPR gRNA sequence
ggggagtccgtggcgatggg

SEQ ID NO: 757379 - DNA, 20 bp, Artificial
  CRISPR gRNA sequence
gggtggaggtgcaggagccc

SEQ ID NO: 757380 - DNA, 20 bp, Artificial
  CRISPR gRNA sequence
cttttcaaaagacttctgcc

SEQ ID NO: 757381 - DNA, 20 bp, Artificial
  CRISPR gRNA sequence
ttcaaaagacttctgcctga

SEQ ID NO: 757382 - DNA, 20 bp, Artificial
  CRISPR gRNA sequence
tcaaaagacttctgcctgac

SEQ ID NO: 757383 - DNA, 20 bp, Artificial
  CRISPR gRNA sequence
caaaagacttctgcctgacc

SEQ ID NO: 757384 - DNA, 20 bp, Artificial
  CRISPR gRNA sequence
aaaagacttctgcctgacca

SEQ ID NO: 757385 - DNA, 20 bp, Artificial
  CRISPR gRNA sequence
ctgcctgaccagagctccca

SEQ ID NO: 757386 - DNA, 20 bp, Artificial
  CRISPR gRNA sequence
tgcctgaccagagctcccac

SEQ ID NO: 757387 - DNA, 20 bp, Artificial
  CRISPR gRNA sequence
cctgaccagagctcccacta

SEQ ID NO: 757388 - DNA, 20 bp, Artificial
  CRISPR gRNA sequence
accagagctcccactacatg

SEQ ID NO: 757389 - DNA, 20 bp, Artificial
  CRISPR gRNA sequence
ccactacatgcagtggccca

SEQ ID NO: 757390 - DNA, 20 bp, Artificial
  CRISPR gRNA sequence
catgcagtggcccagggcag

SEQ ID NO: 757391 - DNA, 20 bp, Artificial
  CRISPR gRNA sequence
atacatggcctttttcaggg

SEQ ID NO: 757392 - DNA, 20 bp, Artificial
  CRISPR gRNA sequence
tttcagggggtgctcctcgc

SEQ ID NO: 757393 - DNA, 20 bp, Artificial
  CRISPR gRNA sequence
ttcagggggtgctcctcgcg

SEQ ID NO: 757394 - DNA, 20 bp, Artificial
  CRISPR gRNA sequence
tcagggggtgctcctcgcgg

SEQ ID NO: 757395 - DNA, 20 bp, Artificial
  CRISPR gRNA sequence
cagggggtgctcctcgcggg

SEQ ID NO: 757396 - DNA, 20 bp, Artificial
  CRISPR gRNA sequence
agggggtgctcctcgcgggg

SEQ ID NO: 757397 - DNA, 20 bp, Artificial
  CRISPR gRNA sequence
ctcgcggggtggacttggga

SEQ ID NO: 757398 - DNA, 20 bp, Artificial
  CRISPR gRNA sequence
gcggggtggacttgggagtg

SEQ ID NO: 757399 - DNA, 20 bp, Artificial
  CRISPR gRNA sequence
gggagtgtgcagtgggacag

SEQ ID NO: 757400 - DNA, 20 bp, Artificial
  CRISPR gRNA sequence
ggagtgtgcagtgggacagg

SEQ ID NO: 757401 - DNA, 20 bp, Artificial
  CRISPR gRNA sequence
caggggtcctgccaccaccg

SEQ ID NO: 757402 - DNA, 20 bp, Artificial
  CRISPR gRNA sequence
ccaccaccgagcaccaactt

SEQ ID NO: 757403 - DNA, 20 bp, Artificial
  CRISPR gRNA sequence
ggcccctggggtcctgcctc

SEQ ID NO: 757404 - DNA, 20 bp, Artificial
  CRISPR gRNA sequence
gcccctggggtcctgcctca

SEQ ID NO: 757405 - DNA, 20 bp, Artificial
  CRISPR gRNA sequence
gggtcctgcctcatgaatga

SEQ ID NO: 757406 - DNA, 20 bp, Artificial
  CRISPR gRNA sequence
cctcatgaatgaggccttcc

SEQ ID NO: 757407 - DNA, 20 bp, Artificial
  CRISPR gRNA sequence
atgaatgaggccttccccag

SEQ ID NO: 757408 - DNA, 20 bp, Artificial
  CRISPR gRNA sequence
ccccagggctggcctgactg

SEQ ID NO: 757409 - DNA, 20 bp, Artificial
  CRISPR gRNA sequence
cccagggctggcctgactgt

SEQ ID NO: 757410 - DNA, 20 bp, Artificial
  CRISPR gRNA sequence
gcctgactgtgctgggggct

SEQ ID NO: 757411 - DNA, 20 bp, Artificial
  CRISPR gRNA sequence
actgtgctgggggctgggtt

SEQ ID NO: 757412 - DNA, 20 bp, Artificial
  CRISPR gRNA sequence
tgctgggggctgggttaacg

SEQ ID NO: 757413 - DNA, 20 bp, Artificial
  CRISPR gRNA sequence
ggggctgggttaacgttttc

SEQ ID NO: 757414 - DNA, 20 bp, Artificial
  CRISPR gRNA sequence
ggttaacgttttctcaggga

SEQ ID NO: 757415 - DNA, 20 bp, Artificial
  CRISPR gRNA sequence
acgttttctcagggaaccac

SEQ ID NO: 757416 - DNA, 20 bp, Artificial
  CRISPR gRNA sequence
tctcagggaaccacaatgca

SEQ ID NO: 757417 - DNA, 20 bp, Artificial
  CRISPR gRNA sequence
ctcagggaaccacaatgcac

SEQ ID NO: 757418 - DNA, 20 bp, Artificial
  CRISPR gRNA sequence
tcagggaaccacaatgcacg

SEQ ID NO: 757419 - DNA, 20 bp, Artificial
  CRISPR gRNA sequence
agggaaccacaatgcacgaa

SEQ ID NO: 757420 - DNA, 20 bp, Artificial
  CRISPR gRNA sequence
gggttgctaaccaggatgct

SEQ ID NO: 757421 - DNA, 20 bp, Artificial
  CRISPR gRNA sequence
ctaaccaggatgctgggaac

SEQ ID NO: 757422 - DNA, 20 bp, Artificial
  CRISPR gRNA sequence
accaggatgctgggaacaaa

SEQ ID NO: 757423 - DNA, 20 bp, Artificial
  CRISPR gRNA sequence
ggaacaaaggcctcttgaag

SEQ ID NO: 757424 - DNA, 20 bp, Artificial
  CRISPR gRNA sequence
ttgaagcccagccacagccc

SEQ ID NO: 757425 - DNA, 20 bp, Artificial
  CRISPR gRNA sequence
gaagcccagccacagcccag

SEQ ID NO: 757426 - DNA, 20 bp, Artificial
  CRISPR gRNA sequence
aagcccagccacagcccagc

SEQ ID NO: 757427 - DNA, 20 bp, Artificial
  CRISPR gRNA sequence
agcatgaggcccagcccata

SEQ ID NO: 757428 - DNA, 20 bp, Artificial
  CRISPR gRNA sequence
gcccattccctgggcattcc

SEQ ID NO: 757429 - DNA, 20 bp, Artificial
  CRISPR gRNA sequence
cctgggcattccctgctttg

SEQ ID NO: 757430 - DNA, 20 bp, Artificial
  CRISPR gRNA sequence
ggcattccctgctttgcatt

SEQ ID NO: 757431 - DNA, 20 bp, Artificial
  CRISPR gRNA sequence
cctgctttgcattgctgctt

SEQ ID NO: 757432 - DNA, 20 bp, Artificial
  CRISPR gRNA sequence
ctttgcattgctgcttctct

SEQ ID NO: 757433 - DNA, 20 bp, Artificial
  CRISPR gRNA sequence
tgcattgctgcttctcttca

SEQ ID NO: 757434 - DNA, 20 bp, Artificial
  CRISPR gRNA sequence
gcattgctgcttctcttcac

SEQ ID NO: 757435 - DNA, 20 bp, Artificial
  CRISPR gRNA sequence
cattgctgcttctcttcacc

SEQ ID NO: 757436 - DNA, 20 bp, Artificial
  CRISPR gRNA sequence
ctgcttctcttcaccccatg

SEQ ID NO: 757437 - DNA, 20 bp, Artificial
  CRISPR gRNA sequence
cttctcttcaccccatggag

SEQ ID NO: 757438 - DNA, 20 bp, Artificial
  CRISPR gRNA sequence
ctcttcaccccatggaggct

SEQ ID NO: 757439 - DNA, 20 bp, Artificial
  CRISPR gRNA sequence
tcttcaccccatggaggcta

SEQ ID NO: 757440 - DNA, 20 bp, Artificial
  CRISPR gRNA sequence
ttcaccccatggaggctatg

SEQ ID NO: 757441 - DNA, 20 bp, Artificial
  CRISPR gRNA sequence
caccccatggaggctatgtc

SEQ ID NO: 757442 - DNA, 20 bp, Artificial
  CRISPR gRNA sequence
accccatggaggctatgtca

SEQ ID NO: 757443 - DNA, 20 bp, Artificial
  CRISPR gRNA sequence
tgtcaccctaactatcctgg

SEQ ID NO: 757444 - DNA, 20 bp, Artificial
  CRISPR gRNA sequence
actatcctggaatgtgttga

SEQ ID NO: 757445 - DNA, 20 bp, Artificial
  CRISPR gRNA sequence
tcctggaatgtgttgagagg

SEQ ID NO: 757446 - DNA, 20 bp, Artificial
  CRISPR gRNA sequence
gaatgtgttgagagggattc

SEQ ID NO: 757447 - DNA, 20 bp, Artificial
  CRISPR gRNA sequence
agagggattctgaatgatca

SEQ ID NO: 757448 - DNA, 20 bp, Artificial
  CRISPR gRNA sequence
tgaatgatcaatatagcttg

SEQ ID NO: 757449 - DNA, 20 bp, Artificial
  CRISPR gRNA sequence
aatgatcaatatagcttggt

SEQ ID NO: 757450 - DNA, 20 bp, Artificial
  CRISPR gRNA sequence
ggtgagacagtgccgagata

SEQ ID NO: 757451 - DNA, 20 bp, Artificial
  CRISPR gRNA sequence
gtgagacagtgccgagatag

SEQ ID NO: 757452 - DNA, 20 bp, Artificial
  CRISPR gRNA sequence
ccttgggcacgggagaggga

SEQ ID NO: 757453 - DNA, 20 bp, Artificial
  CRISPR gRNA sequence
gggcacgggagagggaagtg

SEQ ID NO: 757454 - DNA, 20 bp, Artificial
  CRISPR gRNA sequence
ggcacgggagagggaagtgg

SEQ ID NO: 757455 - DNA, 20 bp, Artificial
  CRISPR gRNA sequence
tttcttggccttttctgtta

SEQ ID NO: 757456 - DNA, 20 bp, Artificial
  CRISPR gRNA sequence
cttggccttttctgttagaa

SEQ ID NO: 757457 - DNA, 20 bp, Artificial
  CRISPR gRNA sequence
ttggccttttctgttagaat

SEQ ID NO: 757458 - DNA, 20 bp, Artificial
  CRISPR gRNA sequence
ggccttttctgttagaatac

SEQ ID NO: 757459 - DNA, 20 bp, Artificial
  CRISPR gRNA sequence
gccttttctgttagaatact

SEQ ID NO: 757460 - DNA, 20 bp, Artificial
  CRISPR gRNA sequence
ttctgttagaatacttggtg

SEQ ID NO: 757461 - DNA, 20 bp, Artificial
  CRISPR gRNA sequence
tctgttagaatacttggtgc

SEQ ID NO: 757462 - DNA, 20 bp, Artificial
  CRISPR gRNA sequence
ctgttagaatacttggtgct

SEQ ID NO: 757463 - DNA, 20 bp, Artificial
  CRISPR gRNA sequence
tgttagaatacttggtgctt

SEQ ID NO: 757464 - DNA, 20 bp, Artificial
  CRISPR gRNA sequence
ttagaatacttggtgctttc

SEQ ID NO: 757465 - DNA, 20 bp, Artificial
  CRISPR gRNA sequence
gaatacttggtgctttccaa

SEQ ID NO: 757466 - DNA, 20 bp, Artificial
  CRISPR gRNA sequence
ggtgctttccaacacacttt

SEQ ID NO: 757467 - DNA, 20 bp, Artificial
  CRISPR gRNA sequence
gtgctttccaacacactttc

SEQ ID NO: 757468 - DNA, 20 bp, Artificial
  CRISPR gRNA sequence
tccaacacactttcacatgt

SEQ ID NO: 757469 - DNA, 20 bp, Artificial
  CRISPR gRNA sequence
ccaacacactttcacatgtg

SEQ ID NO: 757470 - DNA, 20 bp, Artificial
  CRISPR gRNA sequence
caacacactttcacatgtgt

SEQ ID NO: 757471 - DNA, 20 bp, Artificial
  CRISPR gRNA sequence
tcacatgtgttgtaacttgt

SEQ ID NO: 757472 - DNA, 20 bp, Artificial
  CRISPR gRNA sequence
cacatgtgttgtaacttgtt

SEQ ID NO: 757473 - DNA, 20 bp, Artificial
  CRISPR gRNA sequence
acatgtgttgtaacttgttt

SEQ ID NO: 757474 - DNA, 20 bp, Artificial
  CRISPR gRNA sequence
taacttgtttgatccacccc

SEQ ID NO: 757475 - DNA, 20 bp, Artificial
  CRISPR gRNA sequence
gtttgatccacccccttccc

SEQ ID NO: 757476 - DNA, 20 bp, Artificial
  CRISPR gRNA sequence
tttgatccacccccttccct

SEQ ID NO: 757477 - DNA, 20 bp, Artificial
  CRISPR gRNA sequence
gatccacccccttccctgaa

SEQ ID NO: 757478 - DNA, 20 bp, Artificial
  CRISPR gRNA sequence
atccacccccttccctgaaa

SEQ ID NO: 757479 - DNA, 20 bp, Artificial
  CRISPR gRNA sequence
ccctgaaaatcctgggaggt

SEQ ID NO: 757480 - DNA, 20 bp, Artificial
  CRISPR gRNA sequence
cctgaaaatcctgggaggtt

SEQ ID NO: 757481 - DNA, 20 bp, Artificial
  CRISPR gRNA sequence
aaaatcctgggaggttttat

SEQ ID NO: 757482 - DNA, 20 bp, Artificial
  CRISPR gRNA sequence
ggaggttttattgctgccat

SEQ ID NO: 757483 - DNA, 20 bp, Artificial
  CRISPR gRNA sequence
tattgctgccatttaacaca

SEQ ID NO: 757484 - DNA, 20 bp, Artificial
  CRISPR gRNA sequence
attgctgccatttaacacag

SEQ ID NO: 757485 - DNA, 20 bp, Artificial
  CRISPR gRNA sequence
ttgctgccatttaacacaga

SEQ ID NO: 757486 - DNA, 20 bp, Artificial
  CRISPR gRNA sequence
ctgccatttaacacagaggg

SEQ ID NO: 757487 - DNA, 20 bp, Artificial
  CRISPR gRNA sequence
ccatttaacacagagggcaa

SEQ ID NO: 757488 - DNA, 20 bp, Artificial
  CRISPR gRNA sequence
aacacagagggcaatagagg

SEQ ID NO: 757489 - DNA, 20 bp, Artificial
  CRISPR gRNA sequence
acacagagggcaatagaggt

SEQ ID NO: 757490 - DNA, 20 bp, Artificial
  CRISPR gRNA sequence
tgaaaggtctgtgtcttgtc

SEQ ID NO: 757491 - DNA, 20 bp, Artificial
  CRISPR gRNA sequence
aaaggtctgtgtcttgtcaa

SEQ ID NO: 757492 - DNA, 20 bp, Artificial
  CRISPR gRNA sequence
tgtcttgtcaaaacaagtaa

SEQ ID NO: 757493 - DNA, 20 bp, Artificial
  CRISPR gRNA sequence
gtcaaaacaagtaaacggtg

SEQ ID NO: 757494 - DNA, 20 bp, Artificial
  CRISPR gRNA sequence
tcaaaacaagtaaacggtgg

SEQ ID NO: 757495 - DNA, 20 bp, Artificial
  CRISPR gRNA sequence
cgactaaaccctgggtctcc

SEQ ID NO: 757496 - DNA, 20 bp, Artificial
  CRISPR gRNA sequence
aaccctgggtctcctgcttc

SEQ ID NO: 757497 - DNA, 20 bp, Artificial
  CRISPR gRNA sequence
ggtctcctgcttcctcctca

SEQ ID NO: 757498 - DNA, 20 bp, Artificial
  CRISPR gRNA sequence
ctgcttcctcctcactgaat

SEQ ID NO: 757499 - DNA, 20 bp, Artificial
  CRISPR gRNA sequence
cttcctcctcactgaatgga

SEQ ID NO: 757500 - DNA, 20 bp, Artificial
  CRISPR gRNA sequence
cctcctcactgaatggattg

SEQ ID NO: 757501 - DNA, 20 bp, Artificial
  CRISPR gRNA sequence
ctcctcactgaatggattgg

SEQ ID NO: 757502 - DNA, 20 bp, Artificial
  CRISPR gRNA sequence
ctcactgaatggattggtat

SEQ ID NO: 757503 - DNA, 20 bp, Artificial
  CRISPR gRNA sequence
actgaatggattggtattat

SEQ ID NO: 757504 - DNA, 20 bp, Artificial
  CRISPR gRNA sequence
aatggattggtattatgggc

SEQ ID NO: 757505 - DNA, 20 bp, Artificial
  CRISPR gRNA sequence
gtattatgggccagggcctg

SEQ ID NO: 757506 - DNA, 20 bp, Artificial
  CRISPR gRNA sequence
tgggccagggcctggcttgg

SEQ ID NO: 757507 - DNA, 20 bp, Artificial
  CRISPR gRNA sequence
gcttggccttcaccttggac

SEQ ID NO: 757508 - DNA, 20 bp, Artificial
  CRISPR gRNA sequence
ggccttcaccttggacttgc

SEQ ID NO: 757509 - DNA, 20 bp, Artificial
  CRISPR gRNA sequence
gccttcaccttggacttgct

SEQ ID NO: 757510 - DNA, 20 bp, Artificial
  CRISPR gRNA sequence
caccttggacttgcttagag

SEQ ID NO: 757511 - DNA, 20 bp, Artificial
  CRISPR gRNA sequence
accttggacttgcttagagc

SEQ ID NO: 757512 - DNA, 20 bp, Artificial
  CRISPR gRNA sequence
ggacttgcttagagcacata

SEQ ID NO: 757513 - DNA, 20 bp, Artificial
  CRISPR gRNA sequence
gacttgcttagagcacatac

SEQ ID NO: 757514 - DNA, 20 bp, Artificial
  CRISPR gRNA sequence
gcttagagcacatacaaggg

SEQ ID NO: 757515 - DNA, 20 bp, Artificial
  CRISPR gRNA sequence
cttagagcacatacaagggc

SEQ ID NO: 757516 - DNA, 20 bp, Artificial
  CRISPR gRNA sequence
ggcctgggggcggggcgggg

SEQ ID NO: 757517 - DNA, 20 bp, Artificial
  CRISPR gRNA sequence
gcctgggggcggggcggggc

SEQ ID NO: 757518 - DNA, 20 bp, Artificial
  CRISPR gRNA sequence
cctgggggcggggcggggcg

SEQ ID NO: 757519 - DNA, 20 bp, Artificial
  CRISPR gRNA sequence
ctgggggcggggcggggcgg

SEQ ID NO: 757520 - DNA, 20 bp, Artificial
  CRISPR gRNA sequence
ggggcggggcggggcggggg

SEQ ID NO: 757521 - DNA, 20 bp, Artificial
  CRISPR gRNA sequence
gggcggggcggggcgggggc

SEQ ID NO: 757522 - DNA, 20 bp, Artificial
  CRISPR gRNA sequence
ggcggggcggggcgggggcg

SEQ ID NO: 757523 - DNA, 20 bp, Artificial
  CRISPR gRNA sequence
gcggggcggggcgggggcgg

SEQ ID NO: 757524 - DNA, 20 bp, Artificial
  CRISPR gRNA sequence
ggcggggcgggggcgggggc

SEQ ID NO: 757525 - DNA, 20 bp, Artificial
  CRISPR gRNA sequence
gcggggcgggggcgggggcc

SEQ ID NO: 757526 - DNA, 20 bp, Artificial
  CRISPR gRNA sequence
gccaggccgtgtgctctgcc

SEQ ID NO: 757527 - DNA, 20 bp, Artificial
  CRISPR gRNA sequence
aggccgtgtgctctgcccag

SEQ ID NO: 757528 - DNA, 20 bp, Artificial
  CRISPR gRNA sequence
ggccgtgtgctctgcccagc

SEQ ID NO: 757529 - DNA, 20 bp, Artificial
  CRISPR gRNA sequence
gtgtgctctgcccagcgggc

SEQ ID NO: 757530 - DNA, 20 bp, Artificial
  CRISPR gRNA sequence
ctctgcccagcgggctggct

SEQ ID NO: 757531 - DNA, 20 bp, Artificial
  CRISPR gRNA sequence
tctgcccagcgggctggctc

SEQ ID NO: 757532 - DNA, 20 bp, Artificial
  CRISPR gRNA sequence
cagcgggctggctcaggcct

SEQ ID NO: 757533 - DNA, 20 bp, Artificial
  CRISPR gRNA sequence
gggctggctcaggcctcggt

SEQ ID NO: 757534 - DNA, 20 bp, Artificial
  CRISPR gRNA sequence
ctggctcaggcctcggtcag

SEQ ID NO: 757535 - DNA, 20 bp, Artificial
  CRISPR gRNA sequence
tcggtcagcagccgccaccg

SEQ ID NO: 757536 - DNA, 20 bp, Artificial
  CRISPR gRNA sequence
cggtcagcagccgccaccgc

SEQ ID NO: 757537 - DNA, 20 bp, Artificial
  CRISPR gRNA sequence
ggtcagcagccgccaccgcg

SEQ ID NO: 757538 - DNA, 20 bp, Artificial
  CRISPR gRNA sequence
ccgccaccgcggggccaatc

SEQ ID NO: 757539 - DNA, 20 bp, Artificial
  CRISPR gRNA sequence
ccgcggggccaatccggcct

SEQ ID NO: 757540 - DNA, 20 bp, Artificial
  CRISPR gRNA sequence
cgcggggccaatccggcctc

SEQ ID NO: 757541 - DNA, 20 bp, Artificial
  CRISPR gRNA sequence
gcggggccaatccggcctca

SEQ ID NO: 757542 - DNA, 20 bp, Artificial
  CRISPR gRNA sequence
atccggcctcagggacgcac

SEQ ID NO: 757543 - DNA, 20 bp, Artificial
  CRISPR gRNA sequence
ccggcctcagggacgcaccg

SEQ ID NO: 757544 - DNA, 20 bp, Artificial
  CRISPR gRNA sequence
acgcaccggagccgcctttc

SEQ ID NO: 757545 - DNA, 20 bp, Artificial
  CRISPR gRNA sequence
cgcaccggagccgcctttcc

SEQ ID NO: 757546 - DNA, 20 bp, Artificial
  CRISPR gRNA sequence
ggagccgcctttccgggcct

SEQ ID NO: 757547 - DNA, 20 bp, Artificial
  CRISPR gRNA sequence
gagccgcctttccgggcctc

SEQ ID NO: 757548 - DNA, 20 bp, Artificial
  CRISPR gRNA sequence
ccgcctttccgggcctcagg

SEQ ID NO: 757549 - DNA, 20 bp, Artificial
  CRISPR gRNA sequence
cgggcctcaggcggattctc

SEQ ID NO: 757550 - DNA, 20 bp, Artificial
  CRISPR gRNA sequence
ctcaggcggattctccggcg

SEQ ID NO: 757551 - DNA, 20 bp, Artificial
  CRISPR gRNA sequence
gcgcggcccgccccgcccct

SEQ ID NO: 757552 - DNA, 20 bp, Artificial
  CRISPR gRNA sequence
gccccgcccctcggactccc

SEQ ID NO: 757553 - DNA, 20 bp, Artificial
  CRISPR gRNA sequence
ccccgcccctcggactcccc

SEQ ID NO: 757554 - DNA, 20 bp, Artificial
  CRISPR gRNA sequence
cggactccccgggccgcccc

SEQ ID NO: 757555 - DNA, 20 bp, Artificial
  CRISPR gRNA sequence
ggccgcccccggcccccatt

SEQ ID NO: 757556 - DNA, 20 bp, Artificial
  CRISPR gRNA sequence
gccgcccccggcccccattc

SEQ ID NO: 757557 - DNA, 20 bp, Artificial
  CRISPR gRNA sequence
cccccggcccccattcgggc

SEQ ID NO: 757558 - DNA, 20 bp, Artificial
  CRISPR gRNA sequence
ccccggcccccattcgggcc

SEQ ID NO: 757559 - DNA, 20 bp, Artificial
  CRISPR gRNA sequence
attcgggccgggcctcgctg

SEQ ID NO: 757560 - DNA, 20 bp, Artificial
  CRISPR gRNA sequence
cgggccgggcctcgctgcgg

SEQ ID NO: 757561 - DNA, 20 bp, Artificial
  CRISPR gRNA sequence
gcctcgctgcggcggcgact

SEQ ID NO: 757562 - DNA, 20 bp, Artificial
  CRISPR gRNA sequence
cgctgcggcggcgactgagc

SEQ ID NO: 757563 - DNA, 20 bp, Artificial
  CRISPR gRNA sequence
gctgcggcggcgactgagcc

SEQ ID NO: 757564 - DNA, 20 bp, Artificial
  CRISPR gRNA sequence
cggcggcgactgagccaggc

SEQ ID NO: 757565 - DNA, 20 bp, Artificial
  CRISPR gRNA sequence
ggcggcgactgagccaggct

SEQ ID NO: 757566 - DNA, 20 bp, Artificial
  CRISPR gRNA sequence
ccaggctgggccgcgtccct

SEQ ID NO: 757567 - DNA, 20 bp, Artificial
  CRISPR gRNA sequence
tgggccgcgtccctgagtcc

SEQ ID NO: 757568 - DNA, 20 bp, Artificial
  CRISPR gRNA sequence
ggccgcgtccctgagtccca

SEQ ID NO: 757569 - DNA, 20 bp, Artificial
  CRISPR gRNA sequence
gcgtccctgagtcccagagt

SEQ ID NO: 757570 - DNA, 20 bp, Artificial
  CRISPR gRNA sequence
cctgagtcccagagtcggcg

SEQ ID NO: 757571 - DNA, 20 bp, Artificial
  CRISPR gRNA sequence
gtcccagagtcggcgcggcg

SEQ ID NO: 757572 - DNA, 20 bp, Artificial
  CRISPR gRNA sequence
cagagtcggcgcggcgcggt

SEQ ID NO: 757573 - DNA, 20 bp, Artificial
  CRISPR gRNA sequence
cggcgcggcgcggtgagtgc

SEQ ID NO: 757574 - DNA, 20 bp, Artificial
  CRISPR gRNA sequence
cggcgcggtgagtgctggcg

SEQ ID NO: 757575 - DNA, 20 bp, Artificial
  CRISPR gRNA sequence
cggtgagtgctggcgtggcg

SEQ ID NO: 757576 - DNA, 20 bp, Artificial
  CRISPR gRNA sequence
ggtgagtgctggcgtggcgc

SEQ ID NO: 757577 - DNA, 20 bp, Artificial
  CRISPR gRNA sequence
gagtgctggcgtggcgcggg

SEQ ID NO: 757578 - DNA, 20 bp, Artificial
  CRISPR gRNA sequence
ctggcgtggcgcgggcggcg

SEQ ID NO: 757579 - DNA, 20 bp, Artificial
  CRISPR gRNA sequence
tggcgtggcgcgggcggcgc

SEQ ID NO: 757580 - DNA, 20 bp, Artificial
  CRISPR gRNA sequence
ggcgtggcgcgggcggcgcg

SEQ ID NO: 757581 - DNA, 20 bp, Artificial
  CRISPR gRNA sequence
gtggcgcgggcggcgcgggg

SEQ ID NO: 757582 - DNA, 20 bp, Artificial
  CRISPR gRNA sequence
tggcgcgggcggcgcggggt

SEQ ID NO: 757583 - DNA, 20 bp, Artificial
  CRISPR gRNA sequence
ggcgcgggcggcgcggggtg

SEQ ID NO: 757584 - DNA, 20 bp, Artificial
  CRISPR gRNA sequence
gcgggcggcgcggggtgggg

SEQ ID NO: 757585 - DNA, 20 bp, Artificial
  CRISPR gRNA sequence
ggggcggcctttgtctgctg

SEQ ID NO: 757586 - DNA, 20 bp, Artificial
  CRISPR gRNA sequence
gggcggcctttgtctgctgc

SEQ ID NO: 757587 - DNA, 20 bp, Artificial
  CRISPR gRNA sequence
ggcctttgtctgctgcgggc

SEQ ID NO: 757588 - DNA, 20 bp, Artificial
  CRISPR gRNA sequence
gcctttgtctgctgcgggcc

SEQ ID NO: 757589 - DNA, 20 bp, Artificial
  CRISPR gRNA sequence
tgtctgctgcgggccgggcc

SEQ ID NO: 757590 - DNA, 20 bp, Artificial
  CRISPR gRNA sequence
cgggccgggcctggatcccg

SEQ ID NO: 757591 - DNA, 20 bp, Artificial
  CRISPR gRNA sequence
ggccgggcctggatcccgcg

SEQ ID NO: 757592 - DNA, 20 bp, Artificial
  CRISPR gRNA sequence
gccgggcctggatcccgcgg

SEQ ID NO: 757593 - DNA, 20 bp, Artificial
  CRISPR gRNA sequence
gaggtccgcacgttcccgct

SEQ ID NO: 757594 - DNA, 20 bp, Artificial
  CRISPR gRNA sequence
aggtccgcacgttcccgctc

SEQ ID NO: 757595 - DNA, 20 bp, Artificial
  CRISPR gRNA sequence
ggtccgcacgttcccgctca

SEQ ID NO: 757596 - DNA, 20 bp, Artificial
  CRISPR gRNA sequence
cacgttcccgctcagggctg

SEQ ID NO: 757597 - DNA, 20 bp, Artificial
  CRISPR gRNA sequence
acgttcccgctcagggctgc

SEQ ID NO: 757598 - DNA, 20 bp, Artificial
  CRISPR gRNA sequence
gttcccgctcagggctgcag

SEQ ID NO: 757599 - DNA, 20 bp, Artificial
  CRISPR gRNA sequence
cgctcagggctgcaggagct

SEQ ID NO: 757600 - DNA, 20 bp, Artificial
  CRISPR gRNA sequence
tcagggctgcaggagctgag

SEQ ID NO: 757601 - DNA, 20 bp, Artificial
  CRISPR gRNA sequence
cagggctgcaggagctgagc

SEQ ID NO: 757602 - DNA, 20 bp, Artificial
  CRISPR gRNA sequence
agggctgcaggagctgagca

SEQ ID NO: 757603 - DNA, 20 bp, Artificial
  CRISPR gRNA sequence
tgagcagggcgccttccctc

SEQ ID NO: 757604 - DNA, 20 bp, Artificial
  CRISPR gRNA sequence
gagcagggcgccttccctcc

SEQ ID NO: 757605 - DNA, 20 bp, Artificial
  CRISPR gRNA sequence
cctgctcccctgccctcccc

SEQ ID NO: 757606 - DNA, 20 bp, Artificial
  CRISPR gRNA sequence
ctgctcccctgccctccccc

SEQ ID NO: 757607 - DNA, 20 bp, Artificial
  CRISPR gRNA sequence
cccctgccctcccccaggtc

SEQ ID NO: 757608 - DNA, 20 bp, Artificial
  CRISPR gRNA sequence
ccctgccctcccccaggtcc

SEQ ID NO: 757609 - DNA, 20 bp, Artificial
  CRISPR gRNA sequence
tgccctcccccaggtccggg

SEQ ID NO: 757610 - DNA, 20 bp, Artificial
  CRISPR gRNA sequence
tccgggcggcccccctcgca

SEQ ID NO: 757611 - DNA, 20 bp, Artificial
  CRISPR gRNA sequence
ccgggcggcccccctcgcac

SEQ ID NO: 757612 - DNA, 20 bp, Artificial
  CRISPR gRNA sequence
gggcggcccccctcgcacag

SEQ ID NO: 757613 - DNA, 20 bp, Artificial
  CRISPR gRNA sequence
cccccctcgcacaggagtcc

SEQ ID NO: 757614 - DNA, 20 bp, Artificial
  CRISPR gRNA sequence
ccccctcgcacaggagtccc

SEQ ID NO: 757615 - DNA, 20 bp, Artificial
  CRISPR gRNA sequence
cacaggagtcccgggaaccg

SEQ ID NO: 757616 - DNA, 20 bp, Artificial
  CRISPR gRNA sequence
acaggagtcccgggaaccgc

SEQ ID NO: 757617 - DNA, 20 bp, Artificial
  CRISPR gRNA sequence
cgcgggcgcccctcctgccc

SEQ ID NO: 757618 - DNA, 20 bp, Artificial
  CRISPR gRNA sequence
gcgggcgcccctcctgccct

SEQ ID NO: 757619 - DNA, 20 bp, Artificial
  CRISPR gRNA sequence
gcccctcctgccctgggctg

SEQ ID NO: 757620 - DNA, 20 bp, Artificial
  CRISPR gRNA sequence
cccctcctgccctgggctgt

SEQ ID NO: 757621 - DNA, 20 bp, Artificial
  CRISPR gRNA sequence
ccctcctgccctgggctgtg

SEQ ID NO: 757622 - DNA, 20 bp, Artificial
  CRISPR gRNA sequence
gccctgggctgtggggcccg

SEQ ID NO: 757623 - DNA, 20 bp, Artificial
  CRISPR gRNA sequence
cctgggctgtggggcccgcg

SEQ ID NO: 757624 - DNA, 20 bp, Artificial
  CRISPR gRNA sequence
tgggctgtggggcccgcgga

SEQ ID NO: 757625 - DNA, 20 bp, Artificial
  CRISPR gRNA sequence
ctgtggggcccgcggagagc

SEQ ID NO: 757626 - DNA, 20 bp, Artificial
  CRISPR gRNA sequence
tgtggggcccgcggagagct

SEQ ID NO: 757627 - DNA, 20 bp, Artificial
  CRISPR gRNA sequence
gtggggcccgcggagagctg

SEQ ID NO: 757628 - DNA, 20 bp, Artificial
  CRISPR gRNA sequence
tggggcccgcggagagctgg

SEQ ID NO: 757629 - DNA, 20 bp, Artificial
  CRISPR gRNA sequence
cgcggagagctgggggctcc

SEQ ID NO: 757630 - DNA, 20 bp, Artificial
  CRISPR gRNA sequence
ctaccccgcccccctttcct

SEQ ID NO: 757631 - DNA, 20 bp, Artificial
  CRISPR gRNA sequence
taccccgcccccctttcctc

SEQ ID NO: 757632 - DNA, 20 bp, Artificial
  CRISPR gRNA sequence
cgcccccctttcctcgggtt

SEQ ID NO: 757633 - DNA, 20 bp, Artificial
  CRISPR gRNA sequence
cccccctttcctcgggttga

SEQ ID NO: 757634 - DNA, 20 bp, Artificial
  CRISPR gRNA sequence
ccccctttcctcgggttgag

SEQ ID NO: 757635 - DNA, 20 bp, Artificial
  CRISPR gRNA sequence
cccctttcctcgggttgaga

SEQ ID NO: 757636 - DNA, 20 bp, Artificial
  CRISPR gRNA sequence
ccctttcctcgggttgagag

SEQ ID NO: 757637 - DNA, 20 bp, Artificial
  CRISPR gRNA sequence
tcctcgggttgagaggggcc

SEQ ID NO: 757638 - DNA, 20 bp, Artificial
  CRISPR gRNA sequence
cctcgggttgagaggggccc

SEQ ID NO: 757639 - DNA, 20 bp, Artificial
  CRISPR gRNA sequence
gagaggggcccgggcgccgt

SEQ ID NO: 757640 - DNA, 20 bp, Artificial
  CRISPR gRNA sequence
cccgggcgccgtcggacctg

SEQ ID NO: 757641 - DNA, 20 bp, Artificial
  CRISPR gRNA sequence
gccgtcggacctgcagaccc

SEQ ID NO: 757642 - DNA, 20 bp, Artificial
  CRISPR gRNA sequence
gtcggacctgcagaccccgg

SEQ ID NO: 757643 - DNA, 20 bp, Artificial
  CRISPR gRNA sequence
cctgcagaccccggaagctg

SEQ ID NO: 757644 - DNA, 20 bp, Artificial
  CRISPR gRNA sequence
agaccccggaagctgcggac

SEQ ID NO: 757645 - DNA, 20 bp, Artificial
  CRISPR gRNA sequence
gaccccggaagctgcggacc

SEQ ID NO: 757646 - DNA, 20 bp, Artificial
  CRISPR gRNA sequence
ccggaagctgcggaccgggc

SEQ ID NO: 757647 - DNA, 20 bp, Artificial
  CRISPR gRNA sequence
cggaagctgcggaccgggcc

SEQ ID NO: 757648 - DNA, 20 bp, Artificial
  CRISPR gRNA sequence
aagctgcggaccgggccggg

SEQ ID NO: 757649 - DNA, 20 bp, Artificial
  CRISPR gRNA sequence
agctgcggaccgggccgggt

SEQ ID NO: 757650 - DNA, 20 bp, Artificial
  CRISPR gRNA sequence
ggtgggtgaatgcgcttttg

SEQ ID NO: 757651 - DNA, 20 bp, Artificial
  CRISPR gRNA sequence
gtgggtgaatgcgcttttgc

SEQ ID NO: 757652 - DNA, 20 bp, Artificial
  CRISPR gRNA sequence
gaatgcgcttttgcaggccc

SEQ ID NO: 757653 - DNA, 20 bp, Artificial
  CRISPR gRNA sequence
aatgcgcttttgcaggcccc

SEQ ID NO: 757654 - DNA, 20 bp, Artificial
  CRISPR gRNA sequence
gcttttgcaggccccgggtc

SEQ ID NO: 757655 - DNA, 20 bp, Artificial
  CRISPR gRNA sequence
ttttgcaggccccgggtctg

SEQ ID NO: 757656 - DNA, 20 bp, Artificial
  CRISPR gRNA sequence
tgcaggccccgggtctggag

SEQ ID NO: 757657 - DNA, 20 bp, Artificial
  CRISPR gRNA sequence
gcaggccccgggtctggagc

SEQ ID NO: 757658 - DNA, 20 bp, Artificial
  CRISPR gRNA sequence
ccccgggtctggagcgggca

SEQ ID NO: 757659 - DNA, 20 bp, Artificial
  CRISPR gRNA sequence
cccgggtctggagcgggcat

SEQ ID NO: 757660 - DNA, 20 bp, Artificial
  CRISPR gRNA sequence
ccgggtctggagcgggcatg

SEQ ID NO: 757661 - DNA, 20 bp, Artificial
  CRISPR gRNA sequence
cgggtctggagcgggcatgg

SEQ ID NO: 757662 - DNA, 20 bp, Artificial
  CRISPR gRNA sequence
gtctggagcgggcatggggg

SEQ ID NO: 757663 - DNA, 20 bp, Artificial
  CRISPR gRNA sequence
ggcagatctgtcccgtgttg

SEQ ID NO: 757664 - DNA, 20 bp, Artificial
  CRISPR gRNA sequence
tcccgtgttgaagcttaacg

SEQ ID NO: 757665 - DNA, 20 bp, Artificial
  CRISPR gRNA sequence
ttgaagcttaacgaagccac

SEQ ID NO: 757666 - DNA, 20 bp, Artificial
  CRISPR gRNA sequence
agcttaacgaagccaccggc

SEQ ID NO: 757667 - DNA, 20 bp, Artificial
  CRISPR gRNA sequence
acgaagccaccggccggcgc

SEQ ID NO: 757668 - DNA, 20 bp, Artificial
  CRISPR gRNA sequence
cgaagccaccggccggcgct

SEQ ID NO: 757669 - DNA, 20 bp, Artificial
  CRISPR gRNA sequence
aagccaccggccggcgctgg

SEQ ID NO: 757670 - DNA, 20 bp, Artificial
  CRISPR gRNA sequence
agccaccggccggcgctggg

SEQ ID NO: 757671 - DNA, 20 bp, Artificial
  CRISPR gRNA sequence
accggccggcgctgggaggt

SEQ ID NO: 757672 - DNA, 20 bp, Artificial
  CRISPR gRNA sequence
ggccggcgctgggaggttag

SEQ ID NO: 757673 - DNA, 20 bp, Artificial
  CRISPR gRNA sequence
gccggcgctgggaggttagc

SEQ ID NO: 757674 - DNA, 20 bp, Artificial
  CRISPR gRNA sequence
ccggcgctgggaggttagcg

SEQ ID NO: 757675 - DNA, 20 bp, Artificial
  CRISPR gRNA sequence
ctgggaggttagcggggtct

SEQ ID NO: 757676 - DNA, 20 bp, Artificial
  CRISPR gRNA sequence
tgggaggttagcggggtctc

SEQ ID NO: 757677 - DNA, 20 bp, Artificial
  CRISPR gRNA sequence
tagcggggtctcgggtcctg

SEQ ID NO: 757678 - DNA, 20 bp, Artificial
  CRISPR gRNA sequence
gcggggtctcgggtcctgca

SEQ ID NO: 757679 - DNA, 20 bp, Artificial
  CRISPR gRNA sequence
cggggtctcgggtcctgcag

SEQ ID NO: 757680 - DNA, 20 bp, Artificial
  CRISPR gRNA sequence
gtcctgcagaggaaaacgcc

SEQ ID NO: 757681 - DNA, 20 bp, Artificial
  CRISPR gRNA sequence
cagaggaaaacgcccagctc

SEQ ID NO: 757682 - DNA, 20 bp, Artificial
  CRISPR gRNA sequence
agaggaaaacgcccagctcc

SEQ ID NO: 757683 - DNA, 20 bp, Artificial
  CRISPR gRNA sequence
aggaaaacgcccagctccgg

SEQ ID NO: 757684 - DNA, 20 bp, Artificial
  CRISPR gRNA sequence
ggaaaacgcccagctccggg

SEQ ID NO: 757685 - DNA, 20 bp, Artificial
  CRISPR gRNA sequence
gaaaacgcccagctccggga

SEQ ID NO: 757686 - DNA, 20 bp, Artificial
  CRISPR gRNA sequence
aaaacgcccagctccgggag

SEQ ID NO: 757687 - DNA, 20 bp, Artificial
  CRISPR gRNA sequence
aacgcccagctccgggaggg

SEQ ID NO: 757688 - DNA, 20 bp, Artificial
  CRISPR gRNA sequence
gcccagctccgggaggggag

SEQ ID NO: 757689 - DNA, 20 bp, Artificial
  CRISPR gRNA sequence
cagctccgggaggggagcgg

SEQ ID NO: 757690 - DNA, 20 bp, Artificial
  CRISPR gRNA sequence
agctccgggaggggagcggc

SEQ ID NO: 757691 - DNA, 20 bp, Artificial
  CRISPR gRNA sequence
gctccgggaggggagcggcg

SEQ ID NO: 757692 - DNA, 20 bp, Artificial
  CRISPR gRNA sequence
tccgggaggggagcggcggg

SEQ ID NO: 757693 - DNA, 20 bp, Artificial
  CRISPR gRNA sequence
ccgggaggggagcggcgggg

SEQ ID NO: 757694 - DNA, 20 bp, Artificial
  CRISPR gRNA sequence
cgggaggggagcggcgggga

SEQ ID NO: 757695 - DNA, 20 bp, Artificial
  CRISPR gRNA sequence
gaggggagcggcggggaggg

SEQ ID NO: 757696 - DNA, 20 bp, Artificial
  CRISPR gRNA sequence
aggggagcggcggggaggga

SEQ ID NO: 757697 - DNA, 20 bp, Artificial
  CRISPR gRNA sequence
gagcggcggggagggaaggc

SEQ ID NO: 757698 - DNA, 20 bp, Artificial
  CRISPR gRNA sequence
cggcggggagggaaggcgag

SEQ ID NO: 757699 - DNA, 20 bp, Artificial
  CRISPR gRNA sequence
ggggagggaaggcgagtggt

SEQ ID NO: 757700 - DNA, 20 bp, Artificial
  CRISPR gRNA sequence
gggagggaaggcgagtggtt

SEQ ID NO: 757701 - DNA, 20 bp, Artificial
  CRISPR gRNA sequence
ggttaggcgtgtccactctg

SEQ ID NO: 757702 - DNA, 20 bp, Artificial
  CRISPR gRNA sequence
gttaggcgtgtccactctgc

SEQ ID NO: 757703 - DNA, 20 bp, Artificial
  CRISPR gRNA sequence
ttaggcgtgtccactctgca

SEQ ID NO: 757704 - DNA, 20 bp, Artificial
  CRISPR gRNA sequence
cgtgtccactctgcagggcc

SEQ ID NO: 757705 - DNA, 20 bp, Artificial
  CRISPR gRNA sequence
gtccactctgcagggcccag

SEQ ID NO: 757706 - DNA, 20 bp, Artificial
  CRISPR gRNA sequence
tccactctgcagggcccagc

SEQ ID NO: 757707 - DNA, 20 bp, Artificial
  CRISPR gRNA sequence
ccactctgcagggcccagca

SEQ ID NO: 757708 - DNA, 20 bp, Artificial
  CRISPR gRNA sequence
ctgcagggcccagcagggcg

SEQ ID NO: 757709 - DNA, 20 bp, Artificial
  CRISPR gRNA sequence
tgcagggcccagcagggcga

SEQ ID NO: 757710 - DNA, 20 bp, Artificial
  CRISPR gRNA sequence
ggcccagcagggcgaaggtg

SEQ ID NO: 757711 - DNA, 20 bp, Artificial
  CRISPR gRNA sequence
gcccagcagggcgaaggtgt

SEQ ID NO: 757712 - DNA, 20 bp, Artificial
  CRISPR gRNA sequence
agggcgaaggtgtgggcgac

SEQ ID NO: 757713 - DNA, 20 bp, Artificial
  CRISPR gRNA sequence
gggcgactggtgcacttcca

SEQ ID NO: 757714 - DNA, 20 bp, Artificial
  CRISPR gRNA sequence
ggcgactggtgcacttccac

SEQ ID NO: 757715 - DNA, 20 bp, Artificial
  CRISPR gRNA sequence
gactggtgcacttccacagg

SEQ ID NO: 757716 - DNA, 20 bp, Artificial
  CRISPR gRNA sequence
tgcacttccacaggcagccg

SEQ ID NO: 757717 - DNA, 20 bp, Artificial
  CRISPR gRNA sequence
gcacttccacaggcagccgt

SEQ ID NO: 757718 - DNA, 20 bp, Artificial
  CRISPR gRNA sequence
cttccacaggcagccgtggg

SEQ ID NO: 757719 - DNA, 20 bp, Artificial
  CRISPR gRNA sequence
caggcagccgtgggcagcat

SEQ ID NO: 757720 - DNA, 20 bp, Artificial
  CRISPR gRNA sequence
aggcagccgtgggcagcatg

SEQ ID NO: 757721 - DNA, 20 bp, Artificial
  CRISPR gRNA sequence
ggcagccgtgggcagcatga

SEQ ID NO: 757722 - DNA, 20 bp, Artificial
  CRISPR gRNA sequence
gcagccgtgggcagcatgag

SEQ ID NO: 757723 - DNA, 20 bp, Artificial
  CRISPR gRNA sequence
ccgtgggcagcatgaggggt

SEQ ID NO: 757724 - DNA, 20 bp, Artificial
  CRISPR gRNA sequence
cagcatgaggggtcagattc

SEQ ID NO: 757725 - DNA, 20 bp, Artificial
  CRISPR gRNA sequence
agcatgaggggtcagattcc

SEQ ID NO: 757726 - DNA, 20 bp, Artificial
  CRISPR gRNA sequence
atgaggggtcagattccggg

SEQ ID NO: 757727 - DNA, 20 bp, Artificial
  CRISPR gRNA sequence
tgaggggtcagattccggga

SEQ ID NO: 757728 - DNA, 20 bp, Artificial
  CRISPR gRNA sequence
gggtcagattccgggaagga

SEQ ID NO: 757729 - DNA, 20 bp, Artificial
  CRISPR gRNA sequence
ggtcagattccgggaaggac

SEQ ID NO: 757730 - DNA, 20 bp, Artificial
  CRISPR gRNA sequence
cagattccgggaaggacagg

SEQ ID NO: 757731 - DNA, 20 bp, Artificial
  CRISPR gRNA sequence
gattccgggaaggacaggta

SEQ ID NO: 757732 - DNA, 20 bp, Artificial
  CRISPR gRNA sequence
ccgggaaggacaggtagaga

SEQ ID NO: 757733 - DNA, 20 bp, Artificial
  CRISPR gRNA sequence
gaaggacaggtagagacggc

SEQ ID NO: 757734 - DNA, 20 bp, Artificial
  CRISPR gRNA sequence
ggacaggtagagacggctgg

SEQ ID NO: 757735 - DNA, 20 bp, Artificial
  CRISPR gRNA sequence
gacaggtagagacggctggc

SEQ ID NO: 757736 - DNA, 20 bp, Artificial
  CRISPR gRNA sequence
acaggtagagacggctggca

SEQ ID NO: 757737 - DNA, 20 bp, Artificial
  CRISPR gRNA sequence
caggtagagacggctggcag

SEQ ID NO: 757738 - DNA, 20 bp, Artificial
  CRISPR gRNA sequence
gagacggctggcaggggcca

SEQ ID NO: 757739 - DNA, 20 bp, Artificial
  CRISPR gRNA sequence
agacggctggcaggggccac

SEQ ID NO: 757740 - DNA, 20 bp, Artificial
  CRISPR gRNA sequence
gacggctggcaggggccacg

SEQ ID NO: 757741 - DNA, 20 bp, Artificial
  CRISPR gRNA sequence
ggcaggggccacggggtgaa

SEQ ID NO: 757742 - DNA, 20 bp, Artificial
  CRISPR gRNA sequence
gcaggggccacggggtgaat

SEQ ID NO: 757743 - DNA, 20 bp, Artificial
  CRISPR gRNA sequence
gccacggggtgaataggtgt

SEQ ID NO: 757744 - DNA, 20 bp, Artificial
  CRISPR gRNA sequence
ccacggggtgaataggtgtt

SEQ ID NO: 757745 - DNA, 20 bp, Artificial
  CRISPR gRNA sequence
cacggggtgaataggtgttg

SEQ ID NO: 757746 - DNA, 20 bp, Artificial
  CRISPR gRNA sequence
acggggtgaataggtgttgg

SEQ ID NO: 757747 - DNA, 20 bp, Artificial
  CRISPR gRNA sequence
gggtgaataggtgttggggg

SEQ ID NO: 757748 - DNA, 20 bp, Artificial
  CRISPR gRNA sequence
ggtgaataggtgttgggggt

SEQ ID NO: 757749 - DNA, 20 bp, Artificial
  CRISPR gRNA sequence
gtgaataggtgttgggggtg

SEQ ID NO: 757750 - DNA, 20 bp, Artificial
  CRISPR gRNA sequence
gaataggtgttgggggtggg

SEQ ID NO: 757751 - DNA, 20 bp, Artificial
  CRISPR gRNA sequence
aataggtgttgggggtgggg

SEQ ID NO: 757752 - DNA, 20 bp, Artificial
  CRISPR gRNA sequence
ataggtgttgggggtgggga

SEQ ID NO: 757753 - DNA, 20 bp, Artificial
  CRISPR gRNA sequence
gttgggggtggggagggaat

SEQ ID NO: 757754 - DNA, 20 bp, Artificial
  CRISPR gRNA sequence
ttgggggtggggagggaatt

SEQ ID NO: 757755 - DNA, 20 bp, Artificial
  CRISPR gRNA sequence
gggtggggagggaattggga

SEQ ID NO: 757756 - DNA, 20 bp, Artificial
  CRISPR gRNA sequence
ggtggggagggaattgggat

SEQ ID NO: 757757 - DNA, 20 bp, Artificial
  CRISPR gRNA sequence
ggggagggaattgggatggg

SEQ ID NO: 757758 - DNA, 20 bp, Artificial
  CRISPR gRNA sequence
gggaattgggatgggcagtt

SEQ ID NO: 757759 - DNA, 20 bp, Artificial
  CRISPR gRNA sequence
ggaattgggatgggcagttt

SEQ ID NO: 757760 - DNA, 20 bp, Artificial
  CRISPR gRNA sequence
tgggatgggcagtttgggct

SEQ ID NO: 757761 - DNA, 20 bp, Artificial
  CRISPR gRNA sequence
gggatgggcagtttgggctt

SEQ ID NO: 757762 - DNA, 20 bp, Artificial
  CRISPR gRNA sequence
atgggcagtttgggcttggg

SEQ ID NO: 757763 - DNA, 20 bp, Artificial
  CRISPR gRNA sequence
agtttgggcttgggaagcct

SEQ ID NO: 757764 - DNA, 20 bp, Artificial
  CRISPR gRNA sequence
gtttgggcttgggaagcctc

SEQ ID NO: 757765 - DNA, 20 bp, Artificial
  CRISPR gRNA sequence
tttgggcttgggaagcctca

SEQ ID NO: 757766 - DNA, 20 bp, Artificial
  CRISPR gRNA sequence
tgggcttgggaagcctcagg

SEQ ID NO: 757767 - DNA, 20 bp, Artificial
  CRISPR gRNA sequence
gggcttgggaagcctcaggg

SEQ ID NO: 757768 - DNA, 20 bp, Artificial
  CRISPR gRNA sequence
cttgggaagcctcagggagg

SEQ ID NO: 757769 - DNA, 20 bp, Artificial
  CRISPR gRNA sequence
ttgggaagcctcagggaggt

SEQ ID NO: 757770 - DNA, 20 bp, Artificial
  CRISPR gRNA sequence
tgggaagcctcagggaggtg

SEQ ID NO: 757771 - DNA, 20 bp, Artificial
  CRISPR gRNA sequence
gggaagcctcagggaggtgg

SEQ ID NO: 757772 - DNA, 20 bp, Artificial
  CRISPR gRNA sequence
ggaagcctcagggaggtggg

SEQ ID NO: 757773 - DNA, 20 bp, Artificial
  CRISPR gRNA sequence
gcctcagggaggtggggggt

SEQ ID NO: 757774 - DNA, 20 bp, Artificial
  CRISPR gRNA sequence
cctcagggaggtggggggtg

SEQ ID NO: 757775 - DNA, 20 bp, Artificial
  CRISPR gRNA sequence
cagggaggtggggggtgagg

SEQ ID NO: 757776 - DNA, 20 bp, Artificial
  CRISPR gRNA sequence
agggaggtggggggtgaggt

SEQ ID NO: 757777 - DNA, 20 bp, Artificial
  CRISPR gRNA sequence
aggtggggggtgaggtggga

SEQ ID NO: 757778 - DNA, 20 bp, Artificial
  CRISPR gRNA sequence
gtggggggtgaggtgggatg

SEQ ID NO: 757779 - DNA, 20 bp, Artificial
  CRISPR gRNA sequence
ggggggtgaggtgggatgga

SEQ ID NO: 757780 - DNA, 20 bp, Artificial
  CRISPR gRNA sequence
gggggtgaggtgggatggag

SEQ ID NO: 757781 - DNA, 20 bp, Artificial
  CRISPR gRNA sequence
gggtgaggtgggatggagag

SEQ ID NO: 757782 - DNA, 20 bp, Artificial
  CRISPR gRNA sequence
ggtgggatggagaggagatg

SEQ ID NO: 757783 - DNA, 20 bp, Artificial
  CRISPR gRNA sequence
gtgggatggagaggagatgc

SEQ ID NO: 757784 - DNA, 20 bp, Artificial
  CRISPR gRNA sequence
tggagaggagatgcgggcga

SEQ ID NO: 757785 - DNA, 20 bp, Artificial
  CRISPR gRNA sequence
agaggagatgcgggcgacgg

SEQ ID NO: 757786 - DNA, 20 bp, Artificial
  CRISPR gRNA sequence
aggagatgcgggcgacggtg

SEQ ID NO: 757787 - DNA, 20 bp, Artificial
  CRISPR gRNA sequence
ggagatgcgggcgacggtgg

SEQ ID NO: 757788 - DNA, 20 bp, Artificial
  CRISPR gRNA sequence
gagatgcgggcgacggtgga

SEQ ID NO: 757789 - DNA, 20 bp, Artificial
  CRISPR gRNA sequence
gatgcgggcgacggtggagg

SEQ ID NO: 757790 - DNA, 20 bp, Artificial
  CRISPR gRNA sequence
atgcgggcgacggtggaggg

SEQ ID NO: 757791 - DNA, 20 bp, Artificial
  CRISPR gRNA sequence
cgggcgacggtggagggagg

SEQ ID NO: 757792 - DNA, 20 bp, Artificial
  CRISPR gRNA sequence
gggcgacggtggagggaggt

SEQ ID NO: 757793 - DNA, 20 bp, Artificial
  CRISPR gRNA sequence
ggcgacggtggagggaggtg

SEQ ID NO: 757794 - DNA, 20 bp, Artificial
  CRISPR gRNA sequence
tggagggaggtggggacccc

SEQ ID NO: 757795 - DNA, 20 bp, Artificial
  CRISPR gRNA sequence
agggaggtggggaccccgag

SEQ ID NO: 757796 - DNA, 20 bp, Artificial
  CRISPR gRNA sequence
gggaggtggggaccccgagt

SEQ ID NO: 757797 - DNA, 20 bp, Artificial
  CRISPR gRNA sequence
ggaggtggggaccccgagtg

SEQ ID NO: 757798 - DNA, 20 bp, Artificial
  CRISPR gRNA sequence
gaggtggggaccccgagtgg

SEQ ID NO: 757799 - DNA, 20 bp, Artificial
  CRISPR gRNA sequence
gaccccgagtgggggcacac

SEQ ID NO: 757800 - DNA, 20 bp, Artificial
  CRISPR gRNA sequence
cccgagtgggggcacactag

SEQ ID NO: 757801 - DNA, 20 bp, Artificial
  CRISPR gRNA sequence
ccgagtgggggcacactaga

SEQ ID NO: 757802 - DNA, 20 bp, Artificial
  CRISPR gRNA sequence
cgagtgggggcacactagaa

SEQ ID NO: 757803 - DNA, 20 bp, Artificial
  CRISPR gRNA sequence
agtgggggcacactagaagg

SEQ ID NO: 757804 - DNA, 20 bp, Artificial
  CRISPR gRNA sequence
gtgggggcacactagaaggg

SEQ ID NO: 757805 - DNA, 20 bp, Artificial
  CRISPR gRNA sequence
tgggggcacactagaaggga

SEQ ID NO: 757806 - DNA, 20 bp, Artificial
  CRISPR gRNA sequence
gggggcacactagaagggag

SEQ ID NO: 757807 - DNA, 20 bp, Artificial
  CRISPR gRNA sequence
gaagggaggggattgaattc

SEQ ID NO: 757808 - DNA, 20 bp, Artificial
  CRISPR gRNA sequence
ggggattgaattccagcgcc

SEQ ID NO: 757809 - DNA, 20 bp, Artificial
  CRISPR gRNA sequence
gggattgaattccagcgccc

SEQ ID NO: 757810 - DNA, 20 bp, Artificial
  CRISPR gRNA sequence
ggattgaattccagcgccca

SEQ ID NO: 757811 - DNA, 20 bp, Artificial
  CRISPR gRNA sequence
gggccctccctgcgaccgtt

SEQ ID NO: 757812 - DNA, 20 bp, Artificial
  CRISPR gRNA sequence
cctccctgcgaccgtttagc

SEQ ID NO: 757813 - DNA, 20 bp, Artificial
  CRISPR gRNA sequence
cgaccgtttagctagcgaat

SEQ ID NO: 757814 - DNA, 20 bp, Artificial
  CRISPR gRNA sequence
ccgtttagctagcgaattgg

SEQ ID NO: 757815 - DNA, 20 bp, Artificial
  CRISPR gRNA sequence
cgtttagctagcgaattggc

SEQ ID NO: 757816 - DNA, 20 bp, Artificial
  CRISPR gRNA sequence
agctagcgaattggcaggtt

SEQ ID NO: 757817 - DNA, 20 bp, Artificial
  CRISPR gRNA sequence
tagcgaattggcaggtttgg

SEQ ID NO: 757818 - DNA, 20 bp, Artificial
  CRISPR gRNA sequence
attggcaggtttggcagcct

SEQ ID NO: 757819 - DNA, 20 bp, Artificial
  CRISPR gRNA sequence
ttggcaggtttggcagccta

SEQ ID NO: 757820 - DNA, 20 bp, Artificial
  CRISPR gRNA sequence
gcaggtttggcagcctaagg

SEQ ID NO: 757821 - DNA, 20 bp, Artificial
  CRISPR gRNA sequence
caggtttggcagcctaaggc

SEQ ID NO: 757822 - DNA, 20 bp, Artificial
  CRISPR gRNA sequence
aggtttggcagcctaaggca

SEQ ID NO: 757823 - DNA, 20 bp, Artificial
  CRISPR gRNA sequence
ggtttggcagcctaaggcag

SEQ ID NO: 757824 - DNA, 20 bp, Artificial
  CRISPR gRNA sequence
aaggcaggggatttatttct

SEQ ID NO: 757825 - DNA, 20 bp, Artificial
  CRISPR gRNA sequence
taagccaaacctgctctaat

SEQ ID NO: 757826 - DNA, 20 bp, Artificial
  CRISPR gRNA sequence
caaacctgctctaatgagaa

SEQ ID NO: 757827 - DNA, 20 bp, Artificial
  CRISPR gRNA sequence
ctctaatgagaaaagcgtga

SEQ ID NO: 757828 - DNA, 20 bp, Artificial
  CRISPR gRNA sequence
gaaaagcgtgatagatgact

SEQ ID NO: 757829 - DNA, 20 bp, Artificial
  CRISPR gRNA sequence
cgtgatagatgactcagata

SEQ ID NO: 757830 - DNA, 20 bp, Artificial
  CRISPR gRNA sequence
gtgatagatgactcagatat

SEQ ID NO: 757831 - DNA, 20 bp, Artificial
  CRISPR gRNA sequence
cagatatgggatctatcact

SEQ ID NO: 757832 - DNA, 20 bp, Artificial
  CRISPR gRNA sequence
agatatgggatctatcactg

SEQ ID NO: 757833 - DNA, 20 bp, Artificial
  CRISPR gRNA sequence
gatatgggatctatcactga

SEQ ID NO: 757834 - DNA, 20 bp, Artificial
  CRISPR gRNA sequence
tatcactgagggaaaacatt

SEQ ID NO: 757835 - DNA, 20 bp, Artificial
  CRISPR gRNA sequence
gagggaaaacattaagcaaa

SEQ ID NO: 757836 - DNA, 20 bp, Artificial
  CRISPR gRNA sequence
aaaacattaagcaaatagta

SEQ ID NO: 757837 - DNA, 20 bp, Artificial
  CRISPR gRNA sequence
aagcaaatagtaaagcaaaa

SEQ ID NO: 757838 - DNA, 20 bp, Artificial
  CRISPR gRNA sequence
tgtgtgtgtgtgtgtgtgtg

SEQ ID NO: 757839 - DNA, 20 bp, Artificial
  CRISPR gRNA sequence
gtgtgtgtgtgtgtgtgtgg

SEQ ID NO: 757840 - DNA, 20 bp, Artificial
  CRISPR gRNA sequence
tgtgtgtgtgtgtgtgtggc

SEQ ID NO: 757841 - DNA, 20 bp, Artificial
  CRISPR gRNA sequence
gtgtgtgtgtgtgtggcggg

SEQ ID NO: 757842 - DNA, 20 bp, Artificial
  CRISPR gRNA sequence
tgtgtgtgtgtgtggcgggt

SEQ ID NO: 757843 - DNA, 20 bp, Artificial
  CRISPR gRNA sequence
gtgtgtgtgtgtggcgggtg

SEQ ID NO: 757844 - DNA, 20 bp, Artificial
  CRISPR gRNA sequence
tgtgtgtgtgtggcgggtgg

SEQ ID NO: 757845 - DNA, 20 bp, Artificial
  CRISPR gRNA sequence
gtgtgtgtgtggcgggtggg

SEQ ID NO: 757846 - DNA, 20 bp, Artificial
  CRISPR gRNA sequence
tgtgtgtgtggcgggtgggg

SEQ ID NO: 757847 - DNA, 20 bp, Artificial
  CRISPR gRNA sequence
tgtggcgggtgggggggtgt

SEQ ID NO: 757848 - DNA, 20 bp, Artificial
  CRISPR gRNA sequence
gggtgttagttgtcttaatt

SEQ ID NO: 757849 - DNA, 20 bp, Artificial
  CRISPR gRNA sequence
aaaacgatttaccttcaaat

SEQ ID NO: 757850 - DNA, 20 bp, Artificial
  CRISPR gRNA sequence
atttaccttcaaattggatg

SEQ ID NO: 757851 - DNA, 20 bp, Artificial
  CRISPR gRNA sequence
ggatgtggataattgtaaat

SEQ ID NO: 757852 - DNA, 20 bp, Artificial
  CRISPR gRNA sequence
tgagtctgatctcttcatta

SEQ ID NO: 757853 - DNA, 20 bp, Artificial
  CRISPR gRNA sequence
ctgatctcttcattaaagcc

SEQ ID NO: 757854 - DNA, 20 bp, Artificial
  CRISPR gRNA sequence
tgatctcttcattaaagccc

SEQ ID NO: 757855 - DNA, 20 bp, Artificial
  CRISPR gRNA sequence
gatctcttcattaaagcccg

SEQ ID NO: 757856 - DNA, 20 bp, Artificial
  CRISPR gRNA sequence
gcccggggtccttttcttat

SEQ ID NO: 757857 - DNA, 20 bp, Artificial
  CRISPR gRNA sequence
ttttcttataagcatgtctt

SEQ ID NO: 757858 - DNA, 20 bp, Artificial
  CRISPR gRNA sequence
tcttataagcatgtcttcag

SEQ ID NO: 757859 - DNA, 20 bp, Artificial
  CRISPR gRNA sequence
ataagcatgtcttcagcagt

SEQ ID NO: 757860 - DNA, 20 bp, Artificial
  CRISPR gRNA sequence
tcagcagttagtttctatat

SEQ ID NO: 757861 - DNA, 20 bp, Artificial
  CRISPR gRNA sequence
cagttagtttctatattaga

SEQ ID NO: 757862 - DNA, 20 bp, Artificial
  CRISPR gRNA sequence
ttctatattagaaagtaatg

SEQ ID NO: 757863 - DNA, 20 bp, Artificial
  CRISPR gRNA sequence
aatgaagctgctttgtcttt

SEQ ID NO: 757864 - DNA, 20 bp, Artificial
  CRISPR gRNA sequence
tgaagctgctttgtctttaa

SEQ ID NO: 757865 - DNA, 20 bp, Artificial
  CRISPR gRNA sequence
aagctgctttgtctttaaga

SEQ ID NO: 757866 - DNA, 20 bp, Artificial
  CRISPR gRNA sequence
ctttaagagagttctttatt

SEQ ID NO: 757867 - DNA, 20 bp, Artificial
  CRISPR gRNA sequence
agagagttctttatttagtg

SEQ ID NO: 757868 - DNA, 20 bp, Artificial
  CRISPR gRNA sequence
ttatttagtgcggcctcctc

SEQ ID NO: 757869 - DNA, 20 bp, Artificial
  CRISPR gRNA sequence
cggcctcctctagttccctc

SEQ ID NO: 757870 - DNA, 20 bp, Artificial
  CRISPR gRNA sequence
tctagttccctctggcctcc

SEQ ID NO: 757871 - DNA, 20 bp, Artificial
  CRISPR gRNA sequence
agttccctctggcctcccag

SEQ ID NO: 757872 - DNA, 20 bp, Artificial
  CRISPR gRNA sequence
tctggcctcccagaagtccc

SEQ ID NO: 757873 - DNA, 20 bp, Artificial
  CRISPR gRNA sequence
ctggcctcccagaagtccct

SEQ ID NO: 757874 - DNA, 20 bp, Artificial
  CRISPR gRNA sequence
ctaggaaatctgatgctgtg

SEQ ID NO: 757875 - DNA, 20 bp, Artificial
  CRISPR gRNA sequence
atgctgtgcagccttccttg

SEQ ID NO: 757876 - DNA, 20 bp, Artificial
  CRISPR gRNA sequence
gtgcagccttccttgtagtg

SEQ ID NO: 757877 - DNA, 20 bp, Artificial
  CRISPR gRNA sequence
tgcagccttccttgtagtgt

SEQ ID NO: 757878 - DNA, 20 bp, Artificial
  CRISPR gRNA sequence
gcagccttccttgtagtgtg

SEQ ID NO: 757879 - DNA, 20 bp, Artificial
  CRISPR gRNA sequence
cagccttccttgtagtgtgg

SEQ ID NO: 757880 - DNA, 20 bp, Artificial
  CRISPR gRNA sequence
gtagtgtgggggactgcaaa

SEQ ID NO: 757881 - DNA, 20 bp, Artificial
  CRISPR gRNA sequence
tagtgtgggggactgcaaat

SEQ ID NO: 757882 - DNA, 20 bp, Artificial
  CRISPR gRNA sequence
tgtgggggactgcaaatagg

SEQ ID NO: 757883 - DNA, 20 bp, Artificial
  CRISPR gRNA sequence
gtgggggactgcaaataggt

SEQ ID NO: 757884 - DNA, 20 bp, Artificial
  CRISPR gRNA sequence
gggactgcaaataggtggga

SEQ ID NO: 757885 - DNA, 20 bp, Artificial
  CRISPR gRNA sequence
gcaaataggtgggacagttt

SEQ ID NO: 757886 - DNA, 20 bp, Artificial
  CRISPR gRNA sequence
caaataggtgggacagtttg

SEQ ID NO: 757887 - DNA, 20 bp, Artificial
  CRISPR gRNA sequence
aggtgggacagtttgaggct

SEQ ID NO: 757888 - DNA, 20 bp, Artificial
  CRISPR gRNA sequence
ggtgggacagtttgaggctg

SEQ ID NO: 757889 - DNA, 20 bp, Artificial
  CRISPR gRNA sequence
gtgggacagtttgaggctga

SEQ ID NO: 757890 - DNA, 20 bp, Artificial
  CRISPR gRNA sequence
tgggacagtttgaggctgag

SEQ ID NO: 757891 - DNA, 20 bp, Artificial
  CRISPR gRNA sequence
tttgaggctgaggggaactg

SEQ ID NO: 757892 - DNA, 20 bp, Artificial
  CRISPR gRNA sequence
ggaactgaagtctaaacttg

SEQ ID NO: 757893 - DNA, 20 bp, Artificial
  CRISPR gRNA sequence
tgaagtctaaacctgtccga

SEQ ID NO: 757894 - DNA, 20 bp, Artificial
  CRISPR gRNA sequence
gaagtctaaacctgtccgat

SEQ ID NO: 757895 - DNA, 20 bp, Artificial
  CRISPR gRNA sequence
ctaaacctgtccgatgggtt

SEQ ID NO: 757896 - DNA, 20 bp, Artificial
  CRISPR gRNA sequence
ccgatgggttgagctgatct

SEQ ID NO: 757897 - DNA, 20 bp, Artificial
  CRISPR gRNA sequence
gggttgagctgatctgagtg

SEQ ID NO: 757898 - DNA, 20 bp, Artificial
  CRISPR gRNA sequence
ggttgagctgatctgagtgc

SEQ ID NO: 757899 - DNA, 20 bp, Artificial
  CRISPR gRNA sequence
gttgagctgatctgagtgca

SEQ ID NO: 757900 - DNA, 20 bp, Artificial
  CRISPR gRNA sequence
gagctgatctgagtgcaggg

SEQ ID NO: 757901 - DNA, 20 bp, Artificial
  CRISPR gRNA sequence
agctgatctgagtgcagggc

SEQ ID NO: 757902 - DNA, 20 bp, Artificial
  CRISPR gRNA sequence
gatctgagtgcagggcagga

SEQ ID NO: 757903 - DNA, 20 bp, Artificial
  CRISPR gRNA sequence
tctgagtgcagggcaggatg

SEQ ID NO: 757904 - DNA, 20 bp, Artificial
  CRISPR gRNA sequence
ctgagtgcagggcaggatgg

SEQ ID NO: 757905 - DNA, 20 bp, Artificial
  CRISPR gRNA sequence
tgagtgcagggcaggatgga

SEQ ID NO: 757906 - DNA, 20 bp, Artificial
  CRISPR gRNA sequence
cagggcaggatggagggcta

SEQ ID NO: 757907 - DNA, 20 bp, Artificial
  CRISPR gRNA sequence
agggcaggatggagggctat

SEQ ID NO: 757908 - DNA, 20 bp, Artificial
  CRISPR gRNA sequence
gggcaggatggagggctatg

SEQ ID NO: 757909 - DNA, 20 bp, Artificial
  CRISPR gRNA sequence
gatggagggctatggggctg

SEQ ID NO: 757910 - DNA, 20 bp, Artificial
  CRISPR gRNA sequence
atggagggctatggggctgt

SEQ ID NO: 757911 - DNA, 20 bp, Artificial
  CRISPR gRNA sequence
tggagggctatggggctgta

SEQ ID NO: 757912 - DNA, 20 bp, Artificial
  CRISPR gRNA sequence
ctatggggctgtagggtatg

SEQ ID NO: 757913 - DNA, 20 bp, Artificial
  CRISPR gRNA sequence
tggggctgtagggtatgaag

SEQ ID NO: 757914 - DNA, 20 bp, Artificial
  CRISPR gRNA sequence
ggtatgaagtggctcatttc

SEQ ID NO: 757915 - DNA, 20 bp, Artificial
  CRISPR gRNA sequence
gtatgaagtggctcatttca

SEQ ID NO: 757916 - DNA, 20 bp, Artificial
  CRISPR gRNA sequence
tatgaagtggctcatttcaa

SEQ ID NO: 757917 - DNA, 20 bp, Artificial
  CRISPR gRNA sequence
tgaagtggctcatttcaagg

SEQ ID NO: 757918 - DNA, 20 bp, Artificial
  CRISPR gRNA sequence
ctcatttcaagggagtattt

SEQ ID NO: 757919 - DNA, 20 bp, Artificial
  CRISPR gRNA sequence
tcatttcaagggagtatttt

SEQ ID NO: 757920 - DNA, 20 bp, Artificial
  CRISPR gRNA sequence
ttcaagggagtattttgggt

SEQ ID NO: 757921 - DNA, 20 bp, Artificial
  CRISPR gRNA sequence
gagtacattttcctgatatc

SEQ ID NO: 757922 - DNA, 20 bp, Artificial
  CRISPR gRNA sequence
gtacattttcctgatatctg

SEQ ID NO: 757923 - DNA, 20 bp, Artificial
  CRISPR gRNA sequence
tcctgatatctggagttctt

SEQ ID NO: 757924 - DNA, 20 bp, Artificial
  CRISPR gRNA sequence
tatctggagttcttgagatt

SEQ ID NO: 757925 - DNA, 20 bp, Artificial
  CRISPR gRNA sequence
tgagattaagcactaacact

SEQ ID NO: 757926 - DNA, 20 bp, Artificial
  CRISPR gRNA sequence
gagattaagcactaacactt

SEQ ID NO: 757927 - DNA, 20 bp, Artificial
  CRISPR gRNA sequence
agattaagcactaacactta

SEQ ID NO: 757928 - DNA, 20 bp, Artificial
  CRISPR gRNA sequence
cttagggtaactgttgaccg

SEQ ID NO: 757929 - DNA, 20 bp, Artificial
  CRISPR gRNA sequence
aaatttacatacgtcaccgt

SEQ ID NO: 757930 - DNA, 20 bp, Artificial
  CRISPR gRNA sequence
atacgtcaccgtcagcttac

SEQ ID NO: 757931 - DNA, 20 bp, Artificial
  CRISPR gRNA sequence
acgtcaccgtcagcttactg

SEQ ID NO: 757932 - DNA, 20 bp, Artificial
  CRISPR gRNA sequence
gaaattttccttcatgactt

SEQ ID NO: 757933 - DNA, 20 bp, Artificial
  CRISPR gRNA sequence
aaattttccttcatgacttt

SEQ ID NO: 757934 - DNA, 20 bp, Artificial
  CRISPR gRNA sequence
tttccttcatgactttgggt

SEQ ID NO: 757935 - DNA, 20 bp, Artificial
  CRISPR gRNA sequence
atgactttgggtcagccctg

SEQ ID NO: 757936 - DNA, 20 bp, Artificial
  CRISPR gRNA sequence
tgggtcagccctgtggacct

SEQ ID NO: 757937 - DNA, 20 bp, Artificial
  CRISPR gRNA sequence
tggacctcagtttttgttct

SEQ ID NO: 757938 - DNA, 20 bp, Artificial
  CRISPR gRNA sequence
ggacctcagtttttgttctg

SEQ ID NO: 757939 - DNA, 20 bp, Artificial
  CRISPR gRNA sequence
gacctcagtttttgttctga

SEQ ID NO: 757940 - DNA, 20 bp, Artificial
  CRISPR gRNA sequence
acctcagtttttgttctgag

SEQ ID NO: 757941 - DNA, 20 bp, Artificial
  CRISPR gRNA sequence
ttttgttctgaggggttgta

SEQ ID NO: 757942 - DNA, 20 bp, Artificial
  CRISPR gRNA sequence
gttctgaggggttgtatggc

SEQ ID NO: 757943 - DNA, 20 bp, Artificial
  CRISPR gRNA sequence
ttctgaggggttgtatggca

SEQ ID NO: 757944 - DNA, 20 bp, Artificial
  CRISPR gRNA sequence
tctgaggggttgtatggcaa

SEQ ID NO: 757945 - DNA, 20 bp, Artificial
  CRISPR gRNA sequence
ctgaggggttgtatggcaag

SEQ ID NO: 757946 - DNA, 20 bp, Artificial
  CRISPR gRNA sequence
gttgtatggcaaggggacgc

SEQ ID NO: 757947 - DNA, 20 bp, Artificial
  CRISPR gRNA sequence
gtatggcaaggggacgctgg

SEQ ID NO: 757948 - DNA, 20 bp, Artificial
  CRISPR gRNA sequence
tatggcaaggggacgctggc

SEQ ID NO: 757949 - DNA, 20 bp, Artificial
  CRISPR gRNA sequence
tggcaaggggacgctggcgg

SEQ ID NO: 757950 - DNA, 20 bp, Artificial
  CRISPR gRNA sequence
gcaaggggacgctggcggga

SEQ ID NO: 757951 - DNA, 20 bp, Artificial
  CRISPR gRNA sequence
aaggggacgctggcgggaga

SEQ ID NO: 757952 - DNA, 20 bp, Artificial
  CRISPR gRNA sequence
gagagcttcgttcctgcatt

SEQ ID NO: 757953 - DNA, 20 bp, Artificial
  CRISPR gRNA sequence
agcttcgttcctgcattaag

SEQ ID NO: 757954 - DNA, 20 bp, Artificial
  CRISPR gRNA sequence
gttcctgcattaagtggcct

SEQ ID NO: 757955 - DNA, 20 bp, Artificial
  CRISPR gRNA sequence
attaagtggcctcagtgatg

SEQ ID NO: 757956 - DNA, 20 bp, Artificial
  CRISPR gRNA sequence
agtggcctcagtgatgcagt

SEQ ID NO: 757957 - DNA, 20 bp, Artificial
  CRISPR gRNA sequence
gtggcctcagtgatgcagtc

SEQ ID NO: 757958 - DNA, 20 bp, Artificial
  CRISPR gRNA sequence
tggcctcagtgatgcagtca

SEQ ID NO: 757959 - DNA, 20 bp, Artificial
  CRISPR gRNA sequence
agggtcccatgactgacctt

SEQ ID NO: 757960 - DNA, 20 bp, Artificial
  CRISPR gRNA sequence
ggtcccatgactgacctttg

SEQ ID NO: 757961 - DNA, 20 bp, Artificial
  CRISPR gRNA sequence
ggagttcttccatgtcctta

SEQ ID NO: 757962 - DNA, 20 bp, Artificial
  CRISPR gRNA sequence
ccatgtccttatggcattac

SEQ ID NO: 757963 - DNA, 20 bp, Artificial
  CRISPR gRNA sequence
tgtccttatggcattactgg

SEQ ID NO: 757964 - DNA, 20 bp, Artificial
  CRISPR gRNA sequence
ctggtggtttctcctgcctg

SEQ ID NO: 757965 - DNA, 20 bp, Artificial
  CRISPR gRNA sequence
tggtttctcctgcctgcagt

SEQ ID NO: 757966 - DNA, 20 bp, Artificial
  CRISPR gRNA sequence
cctgcctgcagtaagctttc

SEQ ID NO: 757967 - DNA, 20 bp, Artificial
  CRISPR gRNA sequence
gtaagctttccagcttactc

SEQ ID NO: 757968 - DNA, 20 bp, Artificial
  CRISPR gRNA sequence
actctagactcctgtgctgt

SEQ ID NO: 757969 - DNA, 20 bp, Artificial
  CRISPR gRNA sequence
actcctgtgctgtgagacat

SEQ ID NO: 757970 - DNA, 20 bp, Artificial
  CRISPR gRNA sequence
gctgtgagacatgagcttgt

SEQ ID NO: 757971 - DNA, 20 bp, Artificial
  CRISPR gRNA sequence
tgtgagacatgagcttgtca

SEQ ID NO: 757972 - DNA, 20 bp, Artificial
  CRISPR gRNA sequence
gtgagacatgagcttgtcag

SEQ ID NO: 757973 - DNA, 20 bp, Artificial
  CRISPR gRNA sequence
gacatgagcttgtcagaggt

SEQ ID NO: 757974 - DNA, 20 bp, Artificial
  CRISPR gRNA sequence
acatgagcttgtcagaggta

SEQ ID NO: 757975 - DNA, 20 bp, Artificial
  CRISPR gRNA sequence
atgagcttgtcagaggtaag

SEQ ID NO: 757976 - DNA, 20 bp, Artificial
  CRISPR gRNA sequence
taaggagcctgtgttaatgc

SEQ ID NO: 757977 - DNA, 20 bp, Artificial
  CRISPR gRNA sequence
gcctgtgttaatgcaagtct

SEQ ID NO: 757978 - DNA, 20 bp, Artificial
  CRISPR gRNA sequence
cctgtgttaatgcaagtctc

SEQ ID NO: 757979 - DNA, 20 bp, Artificial
  CRISPR gRNA sequence
tgttaatgcaagtctcaggt

SEQ ID NO: 757980 - DNA, 20 bp, Artificial
  CRISPR gRNA sequence
taatgcaagtctcaggtgag

SEQ ID NO: 757981 - DNA, 20 bp, Artificial
  CRISPR gRNA sequence
aatgcaagtctcaggtgaga

SEQ ID NO: 757982 - DNA, 20 bp, Artificial
  CRISPR gRNA sequence
atgcaagtctcaggtgagaa

SEQ ID NO: 757983 - DNA, 20 bp, Artificial
  CRISPR gRNA sequence
tgcaagtctcaggtgagaag

SEQ ID NO: 757984 - DNA, 20 bp, Artificial
  CRISPR gRNA sequence
tctcaggtgagaaggggtgt

SEQ ID NO: 757985 - DNA, 20 bp, Artificial
  CRISPR gRNA sequence
gagaaggggtgttggaatct

SEQ ID NO: 757986 - DNA, 20 bp, Artificial
  CRISPR gRNA sequence
agaaggggtgttggaatctg

SEQ ID NO: 757987 - DNA, 20 bp, Artificial
  CRISPR gRNA sequence
tttccttcctgtcccctctt

SEQ ID NO: 757988 - DNA, 20 bp, Artificial
  CRISPR gRNA sequence
gtcccctcttcagctctgtc

SEQ ID NO: 757989 - DNA, 20 bp, Artificial
  CRISPR gRNA sequence
tcccctcttcagctctgtcc

SEQ ID NO: 757990 - DNA, 20 bp, Artificial
  CRISPR gRNA sequence
tctgtccaggcaccacccga

SEQ ID NO: 757991 - DNA, 20 bp, Artificial
  CRISPR gRNA sequence
tgtccaggcaccacccgatg

SEQ ID NO: 757992 - DNA, 20 bp, Artificial
  CRISPR gRNA sequence
gtccaggcaccacccgatgg

SEQ ID NO: 757993 - DNA, 20 bp, Artificial
  CRISPR gRNA sequence
tccaggcaccacccgatgga

SEQ ID NO: 757994 - DNA, 20 bp, Artificial
  CRISPR gRNA sequence
ggcaccacccgatggagggt

SEQ ID NO: 757995 - DNA, 20 bp, Artificial
  CRISPR gRNA sequence
tctcatgttcatatacctga

SEQ ID NO: 757996 - DNA, 20 bp, Artificial
  CRISPR gRNA sequence
atgttcatatacctgacagc

SEQ ID NO: 757997 - DNA, 20 bp, Artificial
  CRISPR gRNA sequence
atatacctgacagctggctt

SEQ ID NO: 757998 - DNA, 20 bp, Artificial
  CRISPR gRNA sequence
cttcggtgctttaatattta

SEQ ID NO: 757999 - DNA, 20 bp, Artificial
  CRISPR gRNA sequence
ggtgctttaatatttatgga

SEQ ID NO: 758000 - DNA, 20 bp, Artificial
  CRISPR gRNA sequence
gtgctttaatatttatggaa

SEQ ID NO: 758001 - DNA, 20 bp, Artificial
  CRISPR gRNA sequence
tttaatatttatggaaagga

SEQ ID NO: 758002 - DNA, 20 bp, Artificial
  CRISPR gRNA sequence
atttatggaaaggacagtta

SEQ ID NO: 758003 - DNA, 20 bp, Artificial
  CRISPR gRNA sequence
tatggaaaggacagttatag

SEQ ID NO: 758004 - DNA, 20 bp, Artificial
  CRISPR gRNA sequence
aaaggacagttatagaagtg

SEQ ID NO: 758005 - DNA, 20 bp, Artificial
  CRISPR gRNA sequence
atagaagtgtggtcccttca

SEQ ID NO: 758006 - DNA, 20 bp, Artificial
  CRISPR gRNA sequence
gaagtgtggtcccttcaaag

SEQ ID NO: 758007 - DNA, 20 bp, Artificial
  CRISPR gRNA sequence
gtcccttcaaagtagtcctc

SEQ ID NO: 758008 - DNA, 20 bp, Artificial
  CRISPR gRNA sequence
tcccttcaaagtagtcctct

SEQ ID NO: 758009 - DNA, 20 bp, Artificial
  CRISPR gRNA sequence
cccttcaaagtagtcctctg

SEQ ID NO: 758010 - DNA, 20 bp, Artificial
  CRISPR gRNA sequence
tggggtgtctgtgtccttat

SEQ ID NO: 758011 - DNA, 20 bp, Artificial
  CRISPR gRNA sequence
ggggtgtctgtgtccttatt

SEQ ID NO: 758012 - DNA, 20 bp, Artificial
  CRISPR gRNA sequence
tgacttctgaaacttcctgt

SEQ ID NO: 758013 - DNA, 20 bp, Artificial
  CRISPR gRNA sequence
agaattccatcattaaactt

SEQ ID NO: 758014 - DNA, 20 bp, Artificial
  CRISPR gRNA sequence
cattaaactttggctttctc

SEQ ID NO: 758015 - DNA, 20 bp, Artificial
  CRISPR gRNA sequence
ttaaactttggctttctctg

SEQ ID NO: 758016 - DNA, 20 bp, Artificial
  CRISPR gRNA sequence
taaactttggctttctctgg

SEQ ID NO: 758017 - DNA, 20 bp, Artificial
  CRISPR gRNA sequence
aaactttggctttctctgga

SEQ ID NO: 758018 - DNA, 20 bp, Artificial
  CRISPR gRNA sequence
aactttggctttctctggag

SEQ ID NO: 758019 - DNA, 20 bp, Artificial
  CRISPR gRNA sequence
aggggtaaatctttgttctt

SEQ ID NO: 758020 - DNA, 20 bp, Artificial
  CRISPR gRNA sequence
gggtaaatctttgttctttg

SEQ ID NO: 758021 - DNA, 20 bp, Artificial
  CRISPR gRNA sequence
taaatctttgttctttggag

SEQ ID NO: 758022 - DNA, 20 bp, Artificial
  CRISPR gRNA sequence
aaatctttgttctttggagt

SEQ ID NO: 758023 - DNA, 20 bp, Artificial
  CRISPR gRNA sequence
tgttctttggagtaggattt

SEQ ID NO: 758024 - DNA, 20 bp, Artificial
  CRISPR gRNA sequence
gagtaggatttgagtttgac

SEQ ID NO: 758025 - DNA, 20 bp, Artificial
  CRISPR gRNA sequence
agtaggatttgagtttgaca

SEQ ID NO: 758026 - DNA, 20 bp, Artificial
  CRISPR gRNA sequence
taggatttgagtttgacaag

SEQ ID NO: 758027 - DNA, 20 bp, Artificial
  CRISPR gRNA sequence
atttgagtttgacaaggagc

SEQ ID NO: 758028 - DNA, 20 bp, Artificial
  CRISPR gRNA sequence
aggagctggacaatgctgtt

SEQ ID NO: 758029 - DNA, 20 bp, Artificial
  CRISPR gRNA sequence
gagctggacaatgctgtttg

SEQ ID NO: 758030 - DNA, 20 bp, Artificial
  CRISPR gRNA sequence
tggacaatgctgtttggagt

SEQ ID NO: 758031 - DNA, 20 bp, Artificial
  CRISPR gRNA sequence
gacaatgctgtttggagtca

SEQ ID NO: 758032 - DNA, 20 bp, Artificial
  CRISPR gRNA sequence
gctgtttggagtcagagatg

SEQ ID NO: 758033 - DNA, 20 bp, Artificial
  CRISPR gRNA sequence
agtcagagatgcagtgtgat

SEQ ID NO: 758034 - DNA, 20 bp, Artificial
  CRISPR gRNA sequence
tcagagatgcagtgtgataa

SEQ ID NO: 758035 - DNA, 20 bp, Artificial
  CRISPR gRNA sequence
agagatgcagtgtgataaga

SEQ ID NO: 758036 - DNA, 20 bp, Artificial
  CRISPR gRNA sequence
cagtgtgataagagagctgt

SEQ ID NO: 758037 - DNA, 20 bp, Artificial
  CRISPR gRNA sequence
gtgataagagagctgtgagt

SEQ ID NO: 758038 - DNA, 20 bp, Artificial
  CRISPR gRNA sequence
agctgtgagttggaattcca

SEQ ID NO: 758039 - DNA, 20 bp, Artificial
  CRISPR gRNA sequence
ttggaattccacagcaccta

SEQ ID NO: 758040 - DNA, 20 bp, Artificial
  CRISPR gRNA sequence
ggaattccacagcacctaaa

SEQ ID NO: 758041 - DNA, 20 bp, Artificial
  CRISPR gRNA sequence
acagcacctaaagagactcc

SEQ ID NO: 758042 - DNA, 20 bp, Artificial
  CRISPR gRNA sequence
gagactcctagaaaatgttg

SEQ ID NO: 758043 - DNA, 20 bp, Artificial
  CRISPR gRNA sequence
cctagaaaatgttgtagaac

SEQ ID NO: 758044 - DNA, 20 bp, Artificial
  CRISPR gRNA sequence
agaaaatgttgtagaacaag

SEQ ID NO: 758045 - DNA, 20 bp, Artificial
  CRISPR gRNA sequence
aatgttgtagaacaagtggc

SEQ ID NO: 758046 - DNA, 20 bp, Artificial
  CRISPR gRNA sequence
ttgtagaacaagtggctgga

SEQ ID NO: 758047 - DNA, 20 bp, Artificial
  CRISPR gRNA sequence
acaagtggctggatggtact

SEQ ID NO: 758048 - DNA, 20 bp, Artificial
  CRISPR gRNA sequence
atggtacttggttgcacata

SEQ ID NO: 758049 - DNA, 20 bp, Artificial
  CRISPR gRNA sequence
tggtacttggttgcacatac

SEQ ID NO: 758050 - DNA, 20 bp, Artificial
  CRISPR gRNA sequence
ggtacttggttgcacatacg

SEQ ID NO: 758051 - DNA, 20 bp, Artificial
  CRISPR gRNA sequence
ttggttgcacatacggggtt

SEQ ID NO: 758052 - DNA, 20 bp, Artificial
  CRISPR gRNA sequence
tggttgcacatacggggttt

SEQ ID NO: 758053 - DNA, 20 bp, Artificial
  CRISPR gRNA sequence
ggttgcacatacggggtttg

SEQ ID NO: 758054 - DNA, 20 bp, Artificial
  CRISPR gRNA sequence
tacggggtttggggtctgtg

SEQ ID NO: 758055 - DNA, 20 bp, Artificial
  CRISPR gRNA sequence
gcagaaaaatgaccaaatcc

SEQ ID NO: 758056 - DNA, 20 bp, Artificial
  CRISPR gRNA sequence
gaaaaatgaccaaatccaag

SEQ ID NO: 758057 - DNA, 20 bp, Artificial
  CRISPR gRNA sequence
accaaatccaagcagcctct

SEQ ID NO: 758058 - DNA, 20 bp, Artificial
  CRISPR gRNA sequence
cctctgagattatgaccaca

SEQ ID NO: 758059 - DNA, 20 bp, Artificial
  CRISPR gRNA sequence
ctctgagattatgaccacat

SEQ ID NO: 758060 - DNA, 20 bp, Artificial
  CRISPR gRNA sequence
tctgagattatgaccacatg

SEQ ID NO: 758061 - DNA, 20 bp, Artificial
  CRISPR gRNA sequence
ctgagattatgaccacatgg

SEQ ID NO: 758062 - DNA, 20 bp, Artificial
  CRISPR gRNA sequence
atgaccacatgggggctgtt

SEQ ID NO: 758063 - DNA, 20 bp, Artificial
  CRISPR gRNA sequence
acatgggggctgttaagctg

SEQ ID NO: 758064 - DNA, 20 bp, Artificial
  CRISPR gRNA sequence
ggctgttaagctgtggatct

SEQ ID NO: 758065 - DNA, 20 bp, Artificial
  CRISPR gRNA sequence
taagctgtggatctgagtca

SEQ ID NO: 758066 - DNA, 20 bp, Artificial
  CRISPR gRNA sequence
aagctgtggatctgagtcat

SEQ ID NO: 758067 - DNA, 20 bp, Artificial
  CRISPR gRNA sequence
agctgtggatctgagtcata

SEQ ID NO: 758068 - DNA, 20 bp, Artificial
  CRISPR gRNA sequence
gtggatctgagtcatagggt

SEQ ID NO: 758069 - DNA, 20 bp, Artificial
  CRISPR gRNA sequence
tggatctgagtcatagggtc

SEQ ID NO: 758070 - DNA, 20 bp, Artificial
  CRISPR gRNA sequence
ggatctgagtcatagggtca

SEQ ID NO: 758071 - DNA, 20 bp, Artificial
  CRISPR gRNA sequence
ctgagtcatagggtcaggga

SEQ ID NO: 758072 - DNA, 20 bp, Artificial
  CRISPR gRNA sequence
gagtcatagggtcagggaaa

SEQ ID NO: 758073 - DNA, 20 bp, Artificial
  CRISPR gRNA sequence
agtcatagggtcagggaaag

SEQ ID NO: 758074 - DNA, 20 bp, Artificial
  CRISPR gRNA sequence
ggtcagggaaagaggaaaaa

SEQ ID NO: 758075 - DNA, 20 bp, Artificial
  CRISPR gRNA sequence
agggaaagaggaaaaatggc

SEQ ID NO: 758076 - DNA, 20 bp, Artificial
  CRISPR gRNA sequence
gggaaagaggaaaaatggca

SEQ ID NO: 758077 - DNA, 20 bp, Artificial
  CRISPR gRNA sequence
gaaagaggaaaaatggcaag

SEQ ID NO: 758078 - DNA, 20 bp, Artificial
  CRISPR gRNA sequence
aaagaggaaaaatggcaagg

SEQ ID NO: 758079 - DNA, 20 bp, Artificial
  CRISPR gRNA sequence
aggatgacgttactgcccat

SEQ ID NO: 758080 - DNA, 20 bp, Artificial
  CRISPR gRNA sequence
tgcccatgagcttatcctct

SEQ ID NO: 758081 - DNA, 20 bp, Artificial
  CRISPR gRNA sequence
ccatgagcttatcctctgag

SEQ ID NO: 758082 - DNA, 20 bp, Artificial
  CRISPR gRNA sequence
catgagcttatcctctgagt

SEQ ID NO: 758083 - DNA, 20 bp, Artificial
  CRISPR gRNA sequence
gagcttatcctctgagtggg

SEQ ID NO: 758084 - DNA, 20 bp, Artificial
  CRISPR gRNA sequence
ttgtccttttcccacatccc

SEQ ID NO: 758085 - DNA, 20 bp, Artificial
  CRISPR gRNA sequence
tgtccttttcccacatcccc

SEQ ID NO: 758086 - DNA, 20 bp, Artificial
  CRISPR gRNA sequence
gtccttttcccacatcccca

SEQ ID NO: 758087 - DNA, 20 bp, Artificial
  CRISPR gRNA sequence
cttttcccacatccccaggg

SEQ ID NO: 758088 - DNA, 20 bp, Artificial
  CRISPR gRNA sequence
ttttcccacatccccagggc

SEQ ID NO: 758089 - DNA, 20 bp, Artificial
  CRISPR gRNA sequence
ttcccacatccccagggcag

SEQ ID NO: 758090 - DNA, 20 bp, Artificial
  CRISPR gRNA sequence
catccccagggcaggagtgt

SEQ ID NO: 758091 - DNA, 20 bp, Artificial
  CRISPR gRNA sequence
atccccagggcaggagtgtt

SEQ ID NO: 758092 - DNA, 20 bp, Artificial
  CRISPR gRNA sequence
tccccagggcaggagtgtta

SEQ ID NO: 758093 - DNA, 20 bp, Artificial
  CRISPR gRNA sequence
ccagggcaggagtgttaggg

SEQ ID NO: 758094 - DNA, 20 bp, Artificial
  CRISPR gRNA sequence
ggagtgttagggaagtccac

SEQ ID NO: 758095 - DNA, 20 bp, Artificial
  CRISPR gRNA sequence
ttagggaagtccaccagcaa

SEQ ID NO: 758096 - DNA, 20 bp, Artificial
  CRISPR gRNA sequence
tagggaagtccaccagcaaa

SEQ ID NO: 758097 - DNA, 20 bp, Artificial
  CRISPR gRNA sequence
agggaagtccaccagcaaaa

SEQ ID NO: 758098 - DNA, 20 bp, Artificial
  CRISPR gRNA sequence
gggaagtccaccagcaaaag

SEQ ID NO: 758099 - DNA, 20 bp, Artificial
  CRISPR gRNA sequence
ggaagtccaccagcaaaagg

SEQ ID NO: 758100 - DNA, 20 bp, Artificial
  CRISPR gRNA sequence
aagtccaccagcaaaagggg

SEQ ID NO: 758101 - DNA, 20 bp, Artificial
  CRISPR gRNA sequence
agtccaccagcaaaaggggg

SEQ ID NO: 758102 - DNA, 20 bp, Artificial
  CRISPR gRNA sequence
gtccaccagcaaaaggggga

SEQ ID NO: 758103 - DNA, 20 bp, Artificial
  CRISPR gRNA sequence
caaaagggggagggcacacc

SEQ ID NO: 758104 - DNA, 20 bp, Artificial
  CRISPR gRNA sequence
aaaagggggagggcacaccc

SEQ ID NO: 758105 - DNA, 20 bp, Artificial
  CRISPR gRNA sequence
aaagggggagggcacaccca

SEQ ID NO: 758106 - DNA, 20 bp, Artificial
  CRISPR gRNA sequence
gggagggcacacccagggcc

SEQ ID NO: 758107 - DNA, 20 bp, Artificial
  CRISPR gRNA sequence
ggagggcacacccagggcct

SEQ ID NO: 758108 - DNA, 20 bp, Artificial
  CRISPR gRNA sequence
gagggcacacccagggccta

SEQ ID NO: 758109 - DNA, 20 bp, Artificial
  CRISPR gRNA sequence
agggcacacccagggcctag

SEQ ID NO: 758110 - DNA, 20 bp, Artificial
  CRISPR gRNA sequence
ggcacacccagggcctaggg

SEQ ID NO: 758111 - DNA, 20 bp, Artificial
  CRISPR gRNA sequence
gcacacccagggcctagggg

SEQ ID NO: 758112 - DNA, 20 bp, Artificial
  CRISPR gRNA sequence
cacacccagggcctagggga

SEQ ID NO: 758113 - DNA, 20 bp, Artificial
  CRISPR gRNA sequence
acacccagggcctaggggag

SEQ ID NO: 758114 - DNA, 20 bp, Artificial
  CRISPR gRNA sequence
cacccagggcctaggggagg

SEQ ID NO: 758115 - DNA, 20 bp, Artificial
  CRISPR gRNA sequence
cccagggcctaggggagggg

SEQ ID NO: 758116 - DNA, 20 bp, Artificial
  CRISPR gRNA sequence
cagggcctaggggaggggga

SEQ ID NO: 758117 - DNA, 20 bp, Artificial
  CRISPR gRNA sequence
agggcctaggggagggggag

SEQ ID NO: 758118 - DNA, 20 bp, Artificial
  CRISPR gRNA sequence
gggcctaggggagggggaga

SEQ ID NO: 758119 - DNA, 20 bp, Artificial
  CRISPR gRNA sequence
ggcctaggggagggggagag

SEQ ID NO: 758120 - DNA, 20 bp, Artificial
  CRISPR gRNA sequence
taggggagggggagaggggt

SEQ ID NO: 758121 - DNA, 20 bp, Artificial
  CRISPR gRNA sequence
aggggagggggagaggggtg

SEQ ID NO: 758122 - DNA, 20 bp, Artificial
  CRISPR gRNA sequence
agggggagaggggtgaggac

SEQ ID NO: 758123 - DNA, 20 bp, Artificial
  CRISPR gRNA sequence
gactggtccacatgattttt

SEQ ID NO: 758124 - DNA, 20 bp, Artificial
  CRISPR gRNA sequence
gatttttgagaaattgcctt

SEQ ID NO: 758125 - DNA, 20 bp, Artificial
  CRISPR gRNA sequence
gaaattgcctttggtcttgt

SEQ ID NO: 758126 - DNA, 20 bp, Artificial
  CRISPR gRNA sequence
tgcctttggtcttgttggct

SEQ ID NO: 758127 - DNA, 20 bp, Artificial
  CRISPR gRNA sequence
ttggtcttgttggctcagaa

SEQ ID NO: 758128 - DNA, 20 bp, Artificial
  CRISPR gRNA sequence
ctcagaatggaccccacacc

SEQ ID NO: 758129 - DNA, 20 bp, Artificial
  CRISPR gRNA sequence
agaatggaccccacacctgg

SEQ ID NO: 758130 - DNA, 20 bp, Artificial
  CRISPR gRNA sequence
gaatggaccccacacctgga

SEQ ID NO: 758131 - DNA, 20 bp, Artificial
  CRISPR gRNA sequence
aatggaccccacacctggaa

SEQ ID NO: 758132 - DNA, 20 bp, Artificial
  CRISPR gRNA sequence
atggaccccacacctggaag

SEQ ID NO: 758133 - DNA, 20 bp, Artificial
  CRISPR gRNA sequence
tggaccccacacctggaagg

SEQ ID NO: 758134 - DNA, 20 bp, Artificial
  CRISPR gRNA sequence
ctggaagggggccacgtgta

SEQ ID NO: 758135 - DNA, 20 bp, Artificial
  CRISPR gRNA sequence
caacccttgcctgccacccc

SEQ ID NO: 758136 - DNA, 20 bp, Artificial
  CRISPR gRNA sequence
ccccagttctaccgcccttg

SEQ ID NO: 758137 - DNA, 20 bp, Artificial
  CRISPR gRNA sequence
ctaccgcccttgcagtgtgc

SEQ ID NO: 758138 - DNA, 20 bp, Artificial
  CRISPR gRNA sequence
cgcccttgcagtgtgccaga

SEQ ID NO: 758139 - DNA, 20 bp, Artificial
  CRISPR gRNA sequence
gcccttgcagtgtgccagat

SEQ ID NO: 758140 - DNA, 20 bp, Artificial
  CRISPR gRNA sequence
ccttgcagtgtgccagatag

SEQ ID NO: 758141 - DNA, 20 bp, Artificial
  CRISPR gRNA sequence
agtgtgccagataggagcat

SEQ ID NO: 758142 - DNA, 20 bp, Artificial
  CRISPR gRNA sequence
gtgtgccagataggagcatt

SEQ ID NO: 758143 - DNA, 20 bp, Artificial
  CRISPR gRNA sequence
agataggagcattgggtttt

SEQ ID NO: 758144 - DNA, 20 bp, Artificial
  CRISPR gRNA sequence
gataggagcattgggttttc

SEQ ID NO: 758145 - DNA, 20 bp, Artificial
  CRISPR gRNA sequence
gagcattgggttttcaggtt

SEQ ID NO: 758146 - DNA, 20 bp, Artificial
  CRISPR gRNA sequence
agcattgggttttcaggttt

SEQ ID NO: 758147 - DNA, 20 bp, Artificial
  CRISPR gRNA sequence
cattgggttttcaggtttgg

SEQ ID NO: 758148 - DNA, 20 bp, Artificial
  CRISPR gRNA sequence
tgggttttcaggtttgggag

SEQ ID NO: 758149 - DNA, 20 bp, Artificial
  CRISPR gRNA sequence
gggttttcaggtttgggagt

SEQ ID NO: 758150 - DNA, 20 bp, Artificial
  CRISPR gRNA sequence
ttttcaggtttgggagtggg

SEQ ID NO: 758151 - DNA, 20 bp, Artificial
  CRISPR gRNA sequence
tttcaggtttgggagtgggt

SEQ ID NO: 758152 - DNA, 20 bp, Artificial
  CRISPR gRNA sequence
ttcaggtttgggagtgggta

SEQ ID NO: 758153 - DNA, 20 bp, Artificial
  CRISPR gRNA sequence
gggagtgggtagggttgtgc

SEQ ID NO: 758154 - DNA, 20 bp, Artificial
  CRISPR gRNA sequence
gagtgggtagggttgtgctg

SEQ ID NO: 758155 - DNA, 20 bp, Artificial
  CRISPR gRNA sequence
agtgggtagggttgtgctgg

SEQ ID NO: 758156 - DNA, 20 bp, Artificial
  CRISPR gRNA sequence
gggttgtgctggaggctaaa

SEQ ID NO: 758157 - DNA, 20 bp, Artificial
  CRISPR gRNA sequence
attatctcatgtaatcctca

SEQ ID NO: 758158 - DNA, 20 bp, Artificial
  CRISPR gRNA sequence
aatcctcatagtaatcctat

SEQ ID NO: 758159 - DNA, 20 bp, Artificial
  CRISPR gRNA sequence
atcctcatagtaatcctatg

SEQ ID NO: 758160 - DNA, 20 bp, Artificial
  CRISPR gRNA sequence
ctcatagtaatcctatgagg

SEQ ID NO: 758161 - DNA, 20 bp, Artificial
  CRISPR gRNA sequence
tcatagtaatcctatgaggt

SEQ ID NO: 758162 - DNA, 20 bp, Artificial
  CRISPR gRNA sequence
catagtaatcctatgaggta

SEQ ID NO: 758163 - DNA, 20 bp, Artificial
  CRISPR gRNA sequence
gtatcattaacaccattgta

SEQ ID NO: 758164 - DNA, 20 bp, Artificial
  CRISPR gRNA sequence
cattaacaccattgtacagt

SEQ ID NO: 758165 - DNA, 20 bp, Artificial
  CRISPR gRNA sequence
attaacaccattgtacagtt

SEQ ID NO: 758166 - DNA, 20 bp, Artificial
  CRISPR gRNA sequence
ttaacaccattgtacagttg

SEQ ID NO: 758167 - DNA, 20 bp, Artificial
  CRISPR gRNA sequence
attgtacagttggggaaact

SEQ ID NO: 758168 - DNA, 20 bp, Artificial
  CRISPR gRNA sequence
ttgtacagttggggaaactg

SEQ ID NO: 758169 - DNA, 20 bp, Artificial
  CRISPR gRNA sequence
cagttggggaaactgaggcc

SEQ ID NO: 758170 - DNA, 20 bp, Artificial
  CRISPR gRNA sequence
tggggaaactgaggcccaga

SEQ ID NO: 758171 - DNA, 20 bp, Artificial
  CRISPR gRNA sequence
ggggaaactgaggcccagaa

SEQ ID NO: 758172 - DNA, 20 bp, Artificial
  CRISPR gRNA sequence
gggaaactgaggcccagaaa

SEQ ID NO: 758173 - DNA, 20 bp, Artificial
  CRISPR gRNA sequence
aactgaggcccagaaagggt

SEQ ID NO: 758174 - DNA, 20 bp, Artificial
  CRISPR gRNA sequence
aagggtaagtcacatgccca

SEQ ID NO: 758175 - DNA, 20 bp, Artificial
  CRISPR gRNA sequence
gtcacatgcccaaagacaca

SEQ ID NO: 758176 - DNA, 20 bp, Artificial
  CRISPR gRNA sequence
catgcccaaagacacacagc

SEQ ID NO: 758177 - DNA, 20 bp, Artificial
  CRISPR gRNA sequence
aaagacacacagccggcaaa

SEQ ID NO: 758178 - DNA, 20 bp, Artificial
  CRISPR gRNA sequence
gacacacagccggcaaatgg

SEQ ID NO: 758179 - DNA, 20 bp, Artificial
  CRISPR gRNA sequence
cacacagccggcaaatggtg

SEQ ID NO: 758180 - DNA, 20 bp, Artificial
  CRISPR gRNA sequence
cagccggcaaatggtggagc

SEQ ID NO: 758181 - DNA, 20 bp, Artificial
  CRISPR gRNA sequence
agccggcaaatggtggagct

SEQ ID NO: 758182 - DNA, 20 bp, Artificial
  CRISPR gRNA sequence
gctgggctgttgtctgcttc

SEQ ID NO: 758183 - DNA, 20 bp, Artificial
  CRISPR gRNA sequence
ctgttgtctgcttccagaac

SEQ ID NO: 758184 - DNA, 20 bp, Artificial
  CRISPR gRNA sequence
actggctttttctgctgctc

SEQ ID NO: 758185 - DNA, 20 bp, Artificial
  CRISPR gRNA sequence
tggctttttctgctgctctg

SEQ ID NO: 758186 - DNA, 20 bp, Artificial
  CRISPR gRNA sequence
ggctttttctgctgctctgg

SEQ ID NO: 758187 - DNA, 20 bp, Artificial
  CRISPR gRNA sequence
tttttctgctgctctggagg

SEQ ID NO: 758188 - DNA, 20 bp, Artificial
  CRISPR gRNA sequence
ttttctgctgctctggaggt

SEQ ID NO: 758189 - DNA, 20 bp, Artificial
  CRISPR gRNA sequence
tgctgctctggaggtaggca

SEQ ID NO: 758190 - DNA, 20 bp, Artificial
  CRISPR gRNA sequence
gctgctctggaggtaggcac

SEQ ID NO: 758191 - DNA, 20 bp, Artificial
  CRISPR gRNA sequence
acaggttttacccctctttc

SEQ ID NO: 758192 - DNA, 20 bp, Artificial
  CRISPR gRNA sequence
aggttttacccctctttctg

SEQ ID NO: 758193 - DNA, 20 bp, Artificial
  CRISPR gRNA sequence
ttacccctctttctggagcc

SEQ ID NO: 758194 - DNA, 20 bp, Artificial
  CRISPR gRNA sequence
ccctctttctggagcccggt

SEQ ID NO: 758195 - DNA, 20 bp, Artificial
  CRISPR gRNA sequence
ggagcccggtaagatgtgcc

SEQ ID NO: 758196 - DNA, 20 bp, Artificial
  CRISPR gRNA sequence
gagcccggtaagatgtgcca

SEQ ID NO: 758197 - DNA, 20 bp, Artificial
  CRISPR gRNA sequence
agcccggtaagatgtgccaa

SEQ ID NO: 758198 - DNA, 20 bp, Artificial
  CRISPR gRNA sequence
agatgtgccaagggtctcct

SEQ ID NO: 758199 - DNA, 20 bp, Artificial
  CRISPR gRNA sequence
gtgccaagggtctccttagt

SEQ ID NO: 758200 - DNA, 20 bp, Artificial
  CRISPR gRNA sequence
caagggtctccttagtaagt

SEQ ID NO: 758201 - DNA, 20 bp, Artificial
  CRISPR gRNA sequence
aagggtctccttagtaagtc

SEQ ID NO: 758202 - DNA, 20 bp, Artificial
  CRISPR gRNA sequence
agggtctccttagtaagtca

SEQ ID NO: 758203 - DNA, 20 bp, Artificial
  CRISPR gRNA sequence
gtctccttagtaagtcaggg

SEQ ID NO: 758204 - DNA, 20 bp, Artificial
  CRISPR gRNA sequence
taagtcagggaagactcatc

SEQ ID NO: 758205 - DNA, 20 bp, Artificial
  CRISPR gRNA sequence
aagtcagggaagactcatct

SEQ ID NO: 758206 - DNA, 20 bp, Artificial
  CRISPR gRNA sequence
agtcagggaagactcatctg

SEQ ID NO: 758207 - DNA, 20 bp, Artificial
  CRISPR gRNA sequence
ggaagactcatctggggaac

SEQ ID NO: 758208 - DNA, 20 bp, Artificial
  CRISPR gRNA sequence
aagactcatctggggaacca

SEQ ID NO: 758209 - DNA, 20 bp, Artificial
  CRISPR gRNA sequence
actcatctggggaaccagag

SEQ ID NO: 758210 - DNA, 20 bp, Artificial
  CRISPR gRNA sequence
ctcatctggggaaccagaga

SEQ ID NO: 758211 - DNA, 20 bp, Artificial
  CRISPR gRNA sequence
tcatctggggaaccagagaa

SEQ ID NO: 758212 - DNA, 20 bp, Artificial
  CRISPR gRNA sequence
catctggggaaccagagaag

SEQ ID NO: 758213 - DNA, 20 bp, Artificial
  CRISPR gRNA sequence
ctggggaaccagagaagggg

SEQ ID NO: 758214 - DNA, 20 bp, Artificial
  CRISPR gRNA sequence
tggggaaccagagaaggggc

SEQ ID NO: 758215 - DNA, 20 bp, Artificial
  CRISPR gRNA sequence
gagaaggggcaggcctgacc

SEQ ID NO: 758216 - DNA, 20 bp, Artificial
  CRISPR gRNA sequence
agaaggggcaggcctgacct

SEQ ID NO: 758217 - DNA, 20 bp, Artificial
  CRISPR gRNA sequence
caggcctgacctgggtgacc

SEQ ID NO: 758218 - DNA, 20 bp, Artificial
  CRISPR gRNA sequence
gacctgggtgacccagtgac

SEQ ID NO: 758219 - DNA, 20 bp, Artificial
  CRISPR gRNA sequence
ctgggtgacccagtgactag

SEQ ID NO: 758220 - DNA, 20 bp, Artificial
  CRISPR gRNA sequence
ccagtgactagtggccttca

SEQ ID NO: 758221 - DNA, 20 bp, Artificial
  CRISPR gRNA sequence
gactagtggccttcacagca

SEQ ID NO: 758222 - DNA, 20 bp, Artificial
  CRISPR gRNA sequence
agtggccttcacagcatagt

SEQ ID NO: 758223 - DNA, 20 bp, Artificial
  CRISPR gRNA sequence
gtggccttcacagcatagtc

SEQ ID NO: 758224 - DNA, 20 bp, Artificial
  CRISPR gRNA sequence
tggccttcacagcatagtca

SEQ ID NO: 758225 - DNA, 20 bp, Artificial
  CRISPR gRNA sequence
gcatagtcagggcctttgct

SEQ ID NO: 758226 - DNA, 20 bp, Artificial
  CRISPR gRNA sequence
atagtcagggcctttgctga

SEQ ID NO: 758227 - DNA, 20 bp, Artificial
  CRISPR gRNA sequence
tgctgagagttcttctcttc

SEQ ID NO: 758228 - DNA, 20 bp, Artificial
  CRISPR gRNA sequence
ctgagagttcttctcttcca

SEQ ID NO: 758229 - DNA, 20 bp, Artificial
  CRISPR gRNA sequence
gttcttctcttccagagccc

SEQ ID NO: 758230 - DNA, 20 bp, Artificial
  CRISPR gRNA sequence
agccctggactttatcatgc

SEQ ID NO: 758231 - DNA, 20 bp, Artificial
  CRISPR gRNA sequence
gccctggactttatcatgct

SEQ ID NO: 758232 - DNA, 20 bp, Artificial
  CRISPR gRNA sequence
ccctggactttatcatgctg

SEQ ID NO: 758233 - DNA, 20 bp, Artificial
  CRISPR gRNA sequence
ctttatcatgctggggcttc

SEQ ID NO: 758234 - DNA, 20 bp, Artificial
  CRISPR gRNA sequence
tttatcatgctggggcttcc

SEQ ID NO: 758235 - DNA, 20 bp, Artificial
  CRISPR gRNA sequence
tatcatgctggggcttccag

SEQ ID NO: 758236 - DNA, 20 bp, Artificial
  CRISPR gRNA sequence
ggagttccccctccaccctc

SEQ ID NO: 758237 - DNA, 20 bp, Artificial
  CRISPR gRNA sequence
ctccaccctccagttctgac

SEQ ID NO: 758238 - DNA, 20 bp, Artificial
  CRISPR gRNA sequence
ccagttctgaccagtgctcc

SEQ ID NO: 758239 - DNA, 20 bp, Artificial
  CRISPR gRNA sequence
ttctgaccagtgctcccagc

SEQ ID NO: 758240 - DNA, 20 bp, Artificial
  CRISPR gRNA sequence
tctccctttctttctctttg

SEQ ID NO: 758241 - DNA, 20 bp, Artificial
  CRISPR gRNA sequence
ctttctttctctttgtggtc

SEQ ID NO: 758242 - DNA, 20 bp, Artificial
  CRISPR gRNA sequence
ttctttctctttgtggtcca

SEQ ID NO: 758243 - DNA, 20 bp, Artificial
  CRISPR gRNA sequence
ctccacacaccttatgccat

SEQ ID NO: 758244 - DNA, 20 bp, Artificial
  CRISPR gRNA sequence
tccacacaccttatgccatt

SEQ ID NO: 758245 - DNA, 20 bp, Artificial
  CRISPR gRNA sequence
attgggaatctgaccttctc

SEQ ID NO: 758246 - DNA, 20 bp, Artificial
  CRISPR gRNA sequence
ttgggaatctgaccttctct

SEQ ID NO: 758247 - DNA, 20 bp, Artificial
  CRISPR gRNA sequence
aatctgaccttctctaggca

SEQ ID NO: 758248 - DNA, 20 bp, Artificial
  CRISPR gRNA sequence
atctgaccttctctaggcat

SEQ ID NO: 758249 - DNA, 20 bp, Artificial
  CRISPR gRNA sequence
tctgaccttctctaggcata

SEQ ID NO: 758250 - DNA, 20 bp, Artificial
  CRISPR gRNA sequence
tgaccttctctaggcatagg

SEQ ID NO: 758251 - DNA, 20 bp, Artificial
  CRISPR gRNA sequence
ggcatagggagcttaatctg

SEQ ID NO: 758252 - DNA, 20 bp, Artificial
  CRISPR gRNA sequence
gcatagggagcttaatctgc

SEQ ID NO: 758253 - DNA, 20 bp, Artificial
  CRISPR gRNA sequence
tagggagcttaatctgcggg

SEQ ID NO: 758254 - DNA, 20 bp, Artificial
  CRISPR gRNA sequence
ggagcttaatctgcgggaag

SEQ ID NO: 758255 - DNA, 20 bp, Artificial
  CRISPR gRNA sequence
agcttaatctgcgggaagtg

SEQ ID NO: 758256 - DNA, 20 bp, Artificial
  CRISPR gRNA sequence
taatctgcgggaagtggagt

SEQ ID NO: 758257 - DNA, 20 bp, Artificial
  CRISPR gRNA sequence
tctgcgggaagtggagtgag

SEQ ID NO: 758258 - DNA, 20 bp, Artificial
  CRISPR gRNA sequence
gagtgagaagcatttcttgc

SEQ ID NO: 758259 - DNA, 20 bp, Artificial
  CRISPR gRNA sequence
agtgagaagcatttcttgct

SEQ ID NO: 758260 - DNA, 20 bp, Artificial
  CRISPR gRNA sequence
tgagaagcatttcttgctgg

SEQ ID NO: 758261 - DNA, 20 bp, Artificial
  CRISPR gRNA sequence
gcatttcttgctgggagcct

SEQ ID NO: 758262 - DNA, 20 bp, Artificial
  CRISPR gRNA sequence
atttcttgctgggagccttg

SEQ ID NO: 758263 - DNA, 20 bp, Artificial
  CRISPR gRNA sequence
tcttgctgggagccttggag

SEQ ID NO: 758264 - DNA, 20 bp, Artificial
  CRISPR gRNA sequence
cttgctgggagccttggagc

SEQ ID NO: 758265 - DNA, 20 bp, Artificial
  CRISPR gRNA sequence
ttgctgggagccttggagca

SEQ ID NO: 758266 - DNA, 20 bp, Artificial
  CRISPR gRNA sequence
gctgggagccttggagcagg

SEQ ID NO: 758267 - DNA, 20 bp, Artificial
  CRISPR gRNA sequence
tgggagccttggagcaggga

SEQ ID NO: 758268 - DNA, 20 bp, Artificial
  CRISPR gRNA sequence
gcagggagagatactgtctc

SEQ ID NO: 758269 - DNA, 20 bp, Artificial
  CRISPR gRNA sequence
cagggagagatactgtctct

SEQ ID NO: 758270 - DNA, 20 bp, Artificial
  CRISPR gRNA sequence
gggagagatactgtctctgg

SEQ ID NO: 758271 - DNA, 20 bp, Artificial
  CRISPR gRNA sequence
ggagagatactgtctctggg

SEQ ID NO: 758272 - DNA, 20 bp, Artificial
  CRISPR gRNA sequence
gagatactgtctctgggagg

SEQ ID NO: 758273 - DNA, 20 bp, Artificial
  CRISPR gRNA sequence
agatactgtctctgggaggc

SEQ ID NO: 758274 - DNA, 20 bp, Artificial
  CRISPR gRNA sequence
gatactgtctctgggaggca

SEQ ID NO: 758275 - DNA, 20 bp, Artificial
  CRISPR gRNA sequence
atactgtctctgggaggcag

SEQ ID NO: 758276 - DNA, 20 bp, Artificial
  CRISPR gRNA sequence
ctctgggaggcaggggtccc

SEQ ID NO: 758277 - DNA, 20 bp, Artificial
  CRISPR gRNA sequence
gcaggggtcccaagttaccc

SEQ ID NO: 758278 - DNA, 20 bp, Artificial
  CRISPR gRNA sequence
aggggtcccaagttacccta

SEQ ID NO: 758279 - DNA, 20 bp, Artificial
  CRISPR gRNA sequence
ggggtcccaagttaccctag

SEQ ID NO: 758280 - DNA, 20 bp, Artificial
  CRISPR gRNA sequence
aagttaccctagaggcaatg

SEQ ID NO: 758281 - DNA, 20 bp, Artificial
  CRISPR gRNA sequence
agttaccctagaggcaatgc

SEQ ID NO: 758282 - DNA, 20 bp, Artificial
  CRISPR gRNA sequence
ctagaggcaatgcaggctcc

SEQ ID NO: 758283 - DNA, 20 bp, Artificial
  CRISPR gRNA sequence
tagaggcaatgcaggctcct

SEQ ID NO: 758284 - DNA, 20 bp, Artificial
  CRISPR gRNA sequence
caatgcaggctcctaggaac

SEQ ID NO: 758285 - DNA, 20 bp, Artificial
  CRISPR gRNA sequence
aatgcaggctcctaggaact

SEQ ID NO: 758286 - DNA, 20 bp, Artificial
  CRISPR gRNA sequence
atgcaggctcctaggaactg

SEQ ID NO: 758287 - DNA, 20 bp, Artificial
  CRISPR gRNA sequence
taggaactggggctgccttg

SEQ ID NO: 758288 - DNA, 20 bp, Artificial
  CRISPR gRNA sequence
aggaactggggctgccttgt

SEQ ID NO: 758289 - DNA, 20 bp, Artificial
  CRISPR gRNA sequence
gaactggggctgccttgtgg

SEQ ID NO: 758290 - DNA, 20 bp, Artificial
  CRISPR gRNA sequence
ggctgccttgtgggagacat

SEQ ID NO: 758291 - DNA, 20 bp, Artificial
  CRISPR gRNA sequence
gacattggaatgtgtccctg

SEQ ID NO: 758292 - DNA, 20 bp, Artificial
  CRISPR gRNA sequence
acattggaatgtgtccctgt

SEQ ID NO: 758293 - DNA, 20 bp, Artificial
  CRISPR gRNA sequence
cctgtgggaatgctctgtgc

SEQ ID NO: 758294 - DNA, 20 bp, Artificial
  CRISPR gRNA sequence
ctgtgggaatgctctgtgct

SEQ ID NO: 758295 - DNA, 20 bp, Artificial
  CRISPR gRNA sequence
tgtgggaatgctctgtgcta

SEQ ID NO: 758296 - DNA, 20 bp, Artificial
  CRISPR gRNA sequence
gtgggaatgctctgtgctag

SEQ ID NO: 758297 - DNA, 20 bp, Artificial
  CRISPR gRNA sequence
atgctctgtgctaggggcta

SEQ ID NO: 758298 - DNA, 20 bp, Artificial
  CRISPR gRNA sequence
ctctgtgctaggggctatgg

SEQ ID NO: 758299 - DNA, 20 bp, Artificial
  CRISPR gRNA sequence
tgtgctaggggctatggcag

SEQ ID NO: 758300 - DNA, 20 bp, Artificial
  CRISPR gRNA sequence
gtgctaggggctatggcagc

SEQ ID NO: 758301 - DNA, 20 bp, Artificial
  CRISPR gRNA sequence
taggggctatggcagcagga

SEQ ID NO: 758302 - DNA, 20 bp, Artificial
  CRISPR gRNA sequence
gggctatggcagcaggacgg

SEQ ID NO: 758303 - DNA, 20 bp, Artificial
  CRISPR gRNA sequence
ggctatggcagcaggacggt

SEQ ID NO: 758304 - DNA, 20 bp, Artificial
  CRISPR gRNA sequence
ctatggcagcaggacggtag

SEQ ID NO: 758305 - DNA, 20 bp, Artificial
  CRISPR gRNA sequence
agcaggacggtaggagctca

SEQ ID NO: 758306 - DNA, 20 bp, Artificial
  CRISPR gRNA sequence
cggtaggagctcatggtact

SEQ ID NO: 758307 - DNA, 20 bp, Artificial
  CRISPR gRNA sequence
tggtacttggaactgtgacc

SEQ ID NO: 758308 - DNA, 20 bp, Artificial
  CRISPR gRNA sequence
actgtgaccaagcatctgcg

SEQ ID NO: 758309 - DNA, 20 bp, Artificial
  CRISPR gRNA sequence
tgtgaccaagcatctgcgaa

SEQ ID NO: 758310 - DNA, 20 bp, Artificial
  CRISPR gRNA sequence
gtgaccaagcatctgcgaag

SEQ ID NO: 758311 - DNA, 20 bp, Artificial
  CRISPR gRNA sequence
accaagcatctgcgaagagg

SEQ ID NO: 758312 - DNA, 20 bp, Artificial
  CRISPR gRNA sequence
ccaagcatctgcgaagagga

SEQ ID NO: 758313 - DNA, 20 bp, Artificial
  CRISPR gRNA sequence
caagcatctgcgaagaggaa

SEQ ID NO: 758314 - DNA, 20 bp, Artificial
  CRISPR gRNA sequence
aagcatctgcgaagaggaag

SEQ ID NO: 758315 - DNA, 20 bp, Artificial
  CRISPR gRNA sequence
tctgcgaagaggaaggggcc

SEQ ID NO: 758316 - DNA, 20 bp, Artificial
  CRISPR gRNA sequence
ctgcgaagaggaaggggccc

SEQ ID NO: 758317 - DNA, 20 bp, Artificial
  CRISPR gRNA sequence
aggaaggggcccaggaccac

SEQ ID NO: 758318 - DNA, 20 bp, Artificial
  CRISPR gRNA sequence
gggcccaggaccactagaat

SEQ ID NO: 758319 - DNA, 20 bp, Artificial
  CRISPR gRNA sequence
ccaggaccactagaatgagt

SEQ ID NO: 758320 - DNA, 20 bp, Artificial
  CRISPR gRNA sequence
aggaccactagaatgagtca

SEQ ID NO: 758321 - DNA, 20 bp, Artificial
  CRISPR gRNA sequence
ccactagaatgagtcagagc

SEQ ID NO: 758322 - DNA, 20 bp, Artificial
  CRISPR gRNA sequence
actagaatgagtcagagcca

SEQ ID NO: 758323 - DNA, 20 bp, Artificial
  CRISPR gRNA sequence
gaatgagtcagagccagaga

SEQ ID NO: 758324 - DNA, 20 bp, Artificial
  CRISPR gRNA sequence
atgagtcagagccagagatg

SEQ ID NO: 758325 - DNA, 20 bp, Artificial
  CRISPR gRNA sequence
tcagagccagagatggagtc

SEQ ID NO: 758326 - DNA, 20 bp, Artificial
  CRISPR gRNA sequence
gagttgtgcatttgctactt

SEQ ID NO: 758327 - DNA, 20 bp, Artificial
  CRISPR gRNA sequence
gttgtgcatttgctactttg

SEQ ID NO: 758328 - DNA, 20 bp, Artificial
  CRISPR gRNA sequence
tgcatttgctactttggagc

SEQ ID NO: 758329 - DNA, 20 bp, Artificial
  CRISPR gRNA sequence
gcatttgctactttggagct

SEQ ID NO: 758330 - DNA, 20 bp, Artificial
  CRISPR gRNA sequence
catttgctactttggagctg

SEQ ID NO: 758331 - DNA, 20 bp, Artificial
  CRISPR gRNA sequence
ctttggagctggggcactga

SEQ ID NO: 758332 - DNA, 20 bp, Artificial
  CRISPR gRNA sequence
tttggagctggggcactgat

SEQ ID NO: 758333 - DNA, 20 bp, Artificial
  CRISPR gRNA sequence
ttggagctggggcactgata

SEQ ID NO: 758334 - DNA, 20 bp, Artificial
  CRISPR gRNA sequence
ctggggcactgatagggctc

SEQ ID NO: 758335 - DNA, 20 bp, Artificial
  CRISPR gRNA sequence
tggggcactgatagggctct

SEQ ID NO: 758336 - DNA, 20 bp, Artificial
  CRISPR gRNA sequence
ctgatagggctctaggtgaa

SEQ ID NO: 758337 - DNA, 20 bp, Artificial
  CRISPR gRNA sequence
atagggctctaggtgaaaag

SEQ ID NO: 758338 - DNA, 20 bp, Artificial
  CRISPR gRNA sequence
tagggctctaggtgaaaagt

SEQ ID NO: 758339 - DNA, 20 bp, Artificial
  CRISPR gRNA sequence
agggctctaggtgaaaagta

SEQ ID NO: 758340 - DNA, 20 bp, Artificial
  CRISPR gRNA sequence
ctaggtgaaaagtagggata

SEQ ID NO: 758341 - DNA, 20 bp, Artificial
  CRISPR gRNA sequence
ggtgaaaagtagggatacag

SEQ ID NO: 758342 - DNA, 20 bp, Artificial
  CRISPR gRNA sequence
gtgaaaagtagggatacaga

SEQ ID NO: 758343 - DNA, 20 bp, Artificial
  CRISPR gRNA sequence
gaaaagtagggatacagaag

SEQ ID NO: 758344 - DNA, 20 bp, Artificial
  CRISPR gRNA sequence
tagggatacagaaggagtaa

SEQ ID NO: 758345 - DNA, 20 bp, Artificial
  CRISPR gRNA sequence
tacagaaggagtaatggtcc

SEQ ID NO: 758346 - DNA, 20 bp, Artificial
  CRISPR gRNA sequence
cagaaggagtaatggtccca

SEQ ID NO: 758347 - DNA, 20 bp, Artificial
  CRISPR gRNA sequence
agaaggagtaatggtcccag

SEQ ID NO: 758348 - DNA, 20 bp, Artificial
  CRISPR gRNA sequence
gagtaatggtcccagaggcc

SEQ ID NO: 758349 - DNA, 20 bp, Artificial
  CRISPR gRNA sequence
gtcccagaggcccagatgtg

SEQ ID NO: 758350 - DNA, 20 bp, Artificial
  CRISPR gRNA sequence
ggcccagatgtgtggcctga

SEQ ID NO: 758351 - DNA, 20 bp, Artificial
  CRISPR gRNA sequence
cccagatgtgtggcctgaca

SEQ ID NO: 758352 - DNA, 20 bp, Artificial
  CRISPR gRNA sequence
ccagatgtgtggcctgacag

SEQ ID NO: 758353 - DNA, 20 bp, Artificial
  CRISPR gRNA sequence
agatgtgtggcctgacagag

SEQ ID NO: 758354 - DNA, 20 bp, Artificial
  CRISPR gRNA sequence
gatgtgtggcctgacagagg

SEQ ID NO: 758355 - DNA, 20 bp, Artificial
  CRISPR gRNA sequence
tggcctgacagaggaggtct

SEQ ID NO: 758356 - DNA, 20 bp, Artificial
  CRISPR gRNA sequence
ctgacagaggaggtcttggc

SEQ ID NO: 758357 - DNA, 20 bp, Artificial
  CRISPR gRNA sequence
tgacagaggaggtcttggcc

SEQ ID NO: 758358 - DNA, 20 bp, Artificial
  CRISPR gRNA sequence
gacagaggaggtcttggcca

SEQ ID NO: 758359 - DNA, 20 bp, Artificial
  CRISPR gRNA sequence
cagaggaggtcttggccagg

SEQ ID NO: 758360 - DNA, 20 bp, Artificial
  CRISPR gRNA sequence
gaggaggtcttggccaggga

SEQ ID NO: 758361 - DNA, 20 bp, Artificial
  CRISPR gRNA sequence
gaggtcttggccagggagag

SEQ ID NO: 758362 - DNA, 20 bp, Artificial
  CRISPR gRNA sequence
aggtcttggccagggagagt

SEQ ID NO: 758363 - DNA, 20 bp, Artificial
  CRISPR gRNA sequence
ggtcttggccagggagagtg

SEQ ID NO: 758364 - DNA, 20 bp, Artificial
  CRISPR gRNA sequence
cttggccagggagagtgggg

SEQ ID NO: 758365 - DNA, 20 bp, Artificial
  CRISPR gRNA sequence
ttggccagggagagtggggt

SEQ ID NO: 758366 - DNA, 20 bp, Artificial
  CRISPR gRNA sequence
tggccagggagagtggggta

SEQ ID NO: 758367 - DNA, 20 bp, Artificial
  CRISPR gRNA sequence
ggccagggagagtggggtag

SEQ ID NO: 758368 - DNA, 20 bp, Artificial
  CRISPR gRNA sequence
gggagagtggggtaggggca

SEQ ID NO: 758369 - DNA, 20 bp, Artificial
  CRISPR gRNA sequence
gtaggggcaaagtgttcgct

SEQ ID NO: 758370 - DNA, 20 bp, Artificial
  CRISPR gRNA sequence
ggcaaagtgttcgctcagtg

SEQ ID NO: 758371 - DNA, 20 bp, Artificial
  CRISPR gRNA sequence
caaagtgttcgctcagtgca

SEQ ID NO: 758372 - DNA, 20 bp, Artificial
  CRISPR gRNA sequence
aaagtgttcgctcagtgcag

SEQ ID NO: 758373 - DNA, 20 bp, Artificial
  CRISPR gRNA sequence
ctcagtgcagaggccccatc

SEQ ID NO: 758374 - DNA, 20 bp, Artificial
  CRISPR gRNA sequence
tcagtgcagaggccccatct

SEQ ID NO: 758375 - DNA, 20 bp, Artificial
  CRISPR gRNA sequence
agtgcagaggccccatctag

SEQ ID NO: 758376 - DNA, 20 bp, Artificial
  CRISPR gRNA sequence
gtgcagaggccccatctagg

SEQ ID NO: 758377 - DNA, 20 bp, Artificial
  CRISPR gRNA sequence
aggccttgtccccatgcttg

SEQ ID NO: 758378 - DNA, 20 bp, Artificial
  CRISPR gRNA sequence
catgcttgcggcaataataa

SEQ ID NO: 758379 - DNA, 20 bp, Artificial
  CRISPR gRNA sequence
aataataataattattactg

SEQ ID NO: 758380 - DNA, 20 bp, Artificial
  CRISPR gRNA sequence
aataattattactgcagttt

SEQ ID NO: 758381 - DNA, 20 bp, Artificial
  CRISPR gRNA sequence
tattactgcagttttggtac

SEQ ID NO: 758382 - DNA, 20 bp, Artificial
  CRISPR gRNA sequence
attactgcagttttggtact

SEQ ID NO: 758383 - DNA, 20 bp, Artificial
  CRISPR gRNA sequence
ttggtactgggcactttcct

SEQ ID NO: 758384 - DNA, 20 bp, Artificial
  CRISPR gRNA sequence
attgtcttattttattctca

SEQ ID NO: 758385 - DNA, 20 bp, Artificial
  CRISPR gRNA sequence
gtcttattttattctcacag

SEQ ID NO: 758386 - DNA, 20 bp, Artificial
  CRISPR gRNA sequence
ttattctcacagcagccctg

SEQ ID NO: 758387 - DNA, 20 bp, Artificial
  CRISPR gRNA sequence
tattctcacagcagccctgt

SEQ ID NO: 758388 - DNA, 20 bp, Artificial
  CRISPR gRNA sequence
attctcacagcagccctgtg

SEQ ID NO: 758389 - DNA, 20 bp, Artificial
  CRISPR gRNA sequence
ctcacagcagccctgtgggg

SEQ ID NO: 758390 - DNA, 20 bp, Artificial
  CRISPR gRNA sequence
tcacagcagccctgtggggt

SEQ ID NO: 758391 - DNA, 20 bp, Artificial
  CRISPR gRNA sequence
cacagcagccctgtggggta

SEQ ID NO: 758392 - DNA, 20 bp, Artificial
  CRISPR gRNA sequence
agggattgttacccccattt

SEQ ID NO: 758393 - DNA, 20 bp, Artificial
  CRISPR gRNA sequence
ggattgttacccccatttta

SEQ ID NO: 758394 - DNA, 20 bp, Artificial
  CRISPR gRNA sequence
ttacccccattttagagatt

SEQ ID NO: 758395 - DNA, 20 bp, Artificial
  CRISPR gRNA sequence
ccattttagagatttggaat

SEQ ID NO: 758396 - DNA, 20 bp, Artificial
  CRISPR gRNA sequence
cattttagagatttggaatt

SEQ ID NO: 758397 - DNA, 20 bp, Artificial
  CRISPR gRNA sequence
atttggaattgggtctcaaa

SEQ ID NO: 758398 - DNA, 20 bp, Artificial
  CRISPR gRNA sequence
tttggaattgggtctcaaat

SEQ ID NO: 758399 - DNA, 20 bp, Artificial
  CRISPR gRNA sequence
aattgggtctcaaataggtt

SEQ ID NO: 758400 - DNA, 20 bp, Artificial
  CRISPR gRNA sequence
taggttaagtcatttaaact

SEQ ID NO: 758401 - DNA, 20 bp, Artificial
  CRISPR gRNA sequence
tttaaacttggtcatgtgtt

SEQ ID NO: 758402 - DNA, 20 bp, Artificial
  CRISPR gRNA sequence
aacttggtcatgtgttcagc

SEQ ID NO: 758403 - DNA, 20 bp, Artificial
  CRISPR gRNA sequence
acttggtcatgtgttcagca

SEQ ID NO: 758404 - DNA, 20 bp, Artificial
  CRISPR gRNA sequence
tcatgtgttcagcaaggcat

SEQ ID NO: 758405 - DNA, 20 bp, Artificial
  CRISPR gRNA sequence
gttcagcaaggcatcggtgt

SEQ ID NO: 758406 - DNA, 20 bp, Artificial
  CRISPR gRNA sequence
ttcagcaaggcatcggtgtc

SEQ ID NO: 758407 - DNA, 20 bp, Artificial
  CRISPR gRNA sequence
cggtgtcaggattgaaaccc

SEQ ID NO: 758408 - DNA, 20 bp, Artificial
  CRISPR gRNA sequence
ggtgtcaggattgaaaccca

SEQ ID NO: 758409 - DNA, 20 bp, Artificial
  CRISPR gRNA sequence
ggattgaaacccaaggctgc

SEQ ID NO: 758410 - DNA, 20 bp, Artificial
  CRISPR gRNA sequence
acccaaggctgctggcttct

SEQ ID NO: 758411 - DNA, 20 bp, Artificial
  CRISPR gRNA sequence
tctgagctcatgctgtaccc

SEQ ID NO: 758412 - DNA, 20 bp, Artificial
  CRISPR gRNA sequence
ctgagctcatgctgtaccct

SEQ ID NO: 758413 - DNA, 20 bp, Artificial
  CRISPR gRNA sequence
agctcatgctgtaccctggg

SEQ ID NO: 758414 - DNA, 20 bp, Artificial
  CRISPR gRNA sequence
gctcatgctgtaccctgggc

SEQ ID NO: 758415 - DNA, 20 bp, Artificial
  CRISPR gRNA sequence
atgctgtaccctgggcaggc

SEQ ID NO: 758416 - DNA, 20 bp, Artificial
  CRISPR gRNA sequence
tgctgtaccctgggcaggca

SEQ ID NO: 758417 - DNA, 20 bp, Artificial
  CRISPR gRNA sequence
tgtaccctgggcaggcaagg

SEQ ID NO: 758418 - DNA, 20 bp, Artificial
  CRISPR gRNA sequence
cctgggcaggcaaggcagcc

SEQ ID NO: 758419 - DNA, 20 bp, Artificial
  CRISPR gRNA sequence
gcctggtgattccattcaat

SEQ ID NO: 758420 - DNA, 20 bp, Artificial
  CRISPR gRNA sequence
ggtgattccattcaataagt

SEQ ID NO: 758421 - DNA, 20 bp, Artificial
  CRISPR gRNA sequence
gtgattccattcaataagtg

SEQ ID NO: 758422 - DNA, 20 bp, Artificial
  CRISPR gRNA sequence
attccattcaataagtgagg

SEQ ID NO: 758423 - DNA, 20 bp, Artificial
  CRISPR gRNA sequence
tccattcaataagtgaggaa

SEQ ID NO: 758424 - DNA, 20 bp, Artificial
  CRISPR gRNA sequence
cattcaataagtgaggaaga

SEQ ID NO: 758425 - DNA, 20 bp, Artificial
  CRISPR gRNA sequence
caataagtgaggaagagaga

SEQ ID NO: 758426 - DNA, 20 bp, Artificial
  CRISPR gRNA sequence
aataagtgaggaagagagat

SEQ ID NO: 758427 - DNA, 20 bp, Artificial
  CRISPR gRNA sequence
taagtgaggaagagagatag

SEQ ID NO: 758428 - DNA, 20 bp, Artificial
  CRISPR gRNA sequence
aggaagagagataggagcat

SEQ ID NO: 758429 - DNA, 20 bp, Artificial
  CRISPR gRNA sequence
agagagataggagcatcagc

SEQ ID NO: 758430 - DNA, 20 bp, Artificial
  CRISPR gRNA sequence
taggagcatcagctggctct

SEQ ID NO: 758431 - DNA, 20 bp, Artificial
  CRISPR gRNA sequence
tggctcttagtcacttctgc

SEQ ID NO: 758432 - DNA, 20 bp, Artificial
  CRISPR gRNA sequence
ctcttagtcacttctgctgg

SEQ ID NO: 758433 - DNA, 20 bp, Artificial
  CRISPR gRNA sequence
tctgctggtggctgataatt

SEQ ID NO: 758434 - DNA, 20 bp, Artificial
  CRISPR gRNA sequence
tggtggctgataattgagtg

SEQ ID NO: 758435 - DNA, 20 bp, Artificial
  CRISPR gRNA sequence
ggtggctgataattgagtgt

SEQ ID NO: 758436 - DNA, 20 bp, Artificial
  CRISPR gRNA sequence
gataattgagtgtgggccct

SEQ ID NO: 758437 - DNA, 20 bp, Artificial
  CRISPR gRNA sequence
attgagtgtgggcccttggc

SEQ ID NO: 758438 - DNA, 20 bp, Artificial
  CRISPR gRNA sequence
agtgtgggcccttggccagc

SEQ ID NO: 758439 - DNA, 20 bp, Artificial
  CRISPR gRNA sequence
tggccagccggccaccactc

SEQ ID NO: 758440 - DNA, 20 bp, Artificial
  CRISPR gRNA sequence
ggccagccggccaccactct

SEQ ID NO: 758441 - DNA, 20 bp, Artificial
  CRISPR gRNA sequence
gccggccaccactctgggtc

SEQ ID NO: 758442 - DNA, 20 bp, Artificial
  CRISPR gRNA sequence
ccagatttccatctgtacaa

SEQ ID NO: 758443 - DNA, 20 bp, Artificial
  CRISPR gRNA sequence
cagatttccatctgtacaat

SEQ ID NO: 758444 - DNA, 20 bp, Artificial
  CRISPR gRNA sequence
ttccatctgtacaatgggcc

SEQ ID NO: 758445 - DNA, 20 bp, Artificial
  CRISPR gRNA sequence
ccatctgtacaatgggcctg

SEQ ID NO: 758446 - DNA, 20 bp, Artificial
  CRISPR gRNA sequence
ctgtacaatgggcctggagc

SEQ ID NO: 758447 - DNA, 20 bp, Artificial
  CRISPR gRNA sequence
tgtacaatgggcctggagct

SEQ ID NO: 758448 - DNA, 20 bp, Artificial
  CRISPR gRNA sequence
atgggcctggagctaggcgc

SEQ ID NO: 758449 - DNA, 20 bp, Artificial
  CRISPR gRNA sequence
cctggagctaggcgctggac

SEQ ID NO: 758450 - DNA, 20 bp, Artificial
  CRISPR gRNA sequence
ctggagctaggcgctggacc

SEQ ID NO: 758451 - DNA, 20 bp, Artificial
  CRISPR gRNA sequence
cgctggaccaggtgtaccgt

SEQ ID NO: 758452 - DNA, 20 bp, Artificial
  CRISPR gRNA sequence
ctggaccaggtgtaccgtaa

SEQ ID NO: 758453 - DNA, 20 bp, Artificial
  CRISPR gRNA sequence
tggaccaggtgtaccgtaag

SEQ ID NO: 758454 - DNA, 20 bp, Artificial
  CRISPR gRNA sequence
gtgtaccgtaagaggccttc

SEQ ID NO: 758455 - DNA, 20 bp, Artificial
  CRISPR gRNA sequence
gtaagaggccttctagctct

SEQ ID NO: 758456 - DNA, 20 bp, Artificial
  CRISPR gRNA sequence
taagaggccttctagctctg

SEQ ID NO: 758457 - DNA, 20 bp, Artificial
  CRISPR gRNA sequence
ggccttctagctctgaggac

SEQ ID NO: 758458 - DNA, 20 bp, Artificial
  CRISPR gRNA sequence
cttctagctctgaggactgg

SEQ ID NO: 758459 - DNA, 20 bp, Artificial
  CRISPR gRNA sequence
tctagctctgaggactggtg

SEQ ID NO: 758460 - DNA, 20 bp, Artificial
  CRISPR gRNA sequence
ggtggagattgctacactcc

SEQ ID NO: 758461 - DNA, 20 bp, Artificial
  CRISPR gRNA sequence
tggagattgctacactccga

SEQ ID NO: 758462 - DNA, 20 bp, Artificial
  CRISPR gRNA sequence
ggagattgctacactccgag

SEQ ID NO: 758463 - DNA, 20 bp, Artificial
  CRISPR gRNA sequence
gagattgctacactccgaga

SEQ ID NO: 758464 - DNA, 20 bp, Artificial
  CRISPR gRNA sequence
agattgctacactccgagag

SEQ ID NO: 758465 - DNA, 20 bp, Artificial
  CRISPR gRNA sequence
gctacactccgagaggggtc

SEQ ID NO: 758466 - DNA, 20 bp, Artificial
  CRISPR gRNA sequence
tccgagaggggtctggtgct

SEQ ID NO: 758467 - DNA, 20 bp, Artificial
  CRISPR gRNA sequence
agaggggtctggtgcttaga

SEQ ID NO: 758468 - DNA, 20 bp, Artificial
  CRISPR gRNA sequence
aggggtctggtgcttagatg

SEQ ID NO: 758469 - DNA, 20 bp, Artificial
  CRISPR gRNA sequence
gggtctggtgcttagatgga

SEQ ID NO: 758470 - DNA, 20 bp, Artificial
  CRISPR gRNA sequence
ggtctggtgcttagatggag

SEQ ID NO: 758471 - DNA, 20 bp, Artificial
  CRISPR gRNA sequence
gtctggtgcttagatggaga

SEQ ID NO: 758472 - DNA, 20 bp, Artificial
  CRISPR gRNA sequence
tctggtgcttagatggagag

SEQ ID NO: 758473 - DNA, 20 bp, Artificial
  CRISPR gRNA sequence
gtgcttagatggagaggggt

SEQ ID NO: 758474 - DNA, 20 bp, Artificial
  CRISPR gRNA sequence
cttagatggagaggggtcgg

SEQ ID NO: 758475 - DNA, 20 bp, Artificial
  CRISPR gRNA sequence
tagatggagaggggtcggca

SEQ ID NO: 758476 - DNA, 20 bp, Artificial
  CRISPR gRNA sequence
gtcggcagagttgttctgct

SEQ ID NO: 758477 - DNA, 20 bp, Artificial
  CRISPR gRNA sequence
cagagttgttctgctaagct

SEQ ID NO: 758478 - DNA, 20 bp, Artificial
  CRISPR gRNA sequence
ctgctaagctgagcctcttt

SEQ ID NO: 758479 - DNA, 20 bp, Artificial
  CRISPR gRNA sequence
tgctaagctgagcctctttc

SEQ ID NO: 758480 - DNA, 20 bp, Artificial
  CRISPR gRNA sequence
gctaagctgagcctctttca

SEQ ID NO: 758481 - DNA, 20 bp, Artificial
  CRISPR gRNA sequence
aagctgagcctctttcaggg

SEQ ID NO: 758482 - DNA, 20 bp, Artificial
  CRISPR gRNA sequence
ctctttcagggtagaaacca

SEQ ID NO: 758483 - DNA, 20 bp, Artificial
  CRISPR gRNA sequence
tctttcagggtagaaaccaa

SEQ ID NO: 758484 - DNA, 20 bp, Artificial
  CRISPR gRNA sequence
gggtagaaaccaaaggaatt

SEQ ID NO: 758485 - DNA, 20 bp, Artificial
  CRISPR gRNA sequence
gtagaaaccaaaggaatttg

SEQ ID NO: 758486 - DNA, 20 bp, Artificial
  CRISPR gRNA sequence
tagaaaccaaaggaatttgg

SEQ ID NO: 758487 - DNA, 20 bp, Artificial
  CRISPR gRNA sequence
aaccaaaggaatttggaggc

SEQ ID NO: 758488 - DNA, 20 bp, Artificial
  CRISPR gRNA sequence
accaaaggaatttggaggca

SEQ ID NO: 758489 - DNA, 20 bp, Artificial
  CRISPR gRNA sequence
caaaggaatttggaggcaag

SEQ ID NO: 758490 - DNA, 20 bp, Artificial
  CRISPR gRNA sequence
aaaggaatttggaggcaagg

SEQ ID NO: 758491 - DNA, 20 bp, Artificial
  CRISPR gRNA sequence
tttggaggcaaggaggcatt

SEQ ID NO: 758492 - DNA, 20 bp, Artificial
  CRISPR gRNA sequence
ttggaggcaaggaggcattt

SEQ ID NO: 758493 - DNA, 20 bp, Artificial
  CRISPR gRNA sequence
gaggcaaggaggcatttagg

SEQ ID NO: 758494 - DNA, 20 bp, Artificial
  CRISPR gRNA sequence
gcatttaggcagatcacatc

SEQ ID NO: 758495 - DNA, 20 bp, Artificial
  CRISPR gRNA sequence
atttaggcagatcacatctg

SEQ ID NO: 758496 - DNA, 20 bp, Artificial
  CRISPR gRNA sequence
gagaaaatgcacccttcctt

SEQ ID NO: 758497 - DNA, 20 bp, Artificial
  CRISPR gRNA sequence
aatgcacccttccttgagtg

SEQ ID NO: 758498 - DNA, 20 bp, Artificial
  CRISPR gRNA sequence
acccttccttgagtgcagtc

SEQ ID NO: 758499 - DNA, 20 bp, Artificial
  CRISPR gRNA sequence
ttccttgagtgcagtctgga

SEQ ID NO: 758500 - DNA, 20 bp, Artificial
  CRISPR gRNA sequence
tccttgagtgcagtctggaa

SEQ ID NO: 758501 - DNA, 20 bp, Artificial
  CRISPR gRNA sequence
gtgcagtctggaaaggcttc

SEQ ID NO: 758502 - DNA, 20 bp, Artificial
  CRISPR gRNA sequence
agtctggaaaggcttctgga

SEQ ID NO: 758503 - DNA, 20 bp, Artificial
  CRISPR gRNA sequence
gtctggaaaggcttctggaa

SEQ ID NO: 758504 - DNA, 20 bp, Artificial
  CRISPR gRNA sequence
ggaaaggcttctggaaagga

SEQ ID NO: 758505 - DNA, 20 bp, Artificial
  CRISPR gRNA sequence
gaaaggcttctggaaaggat

SEQ ID NO: 758506 - DNA, 20 bp, Artificial
  CRISPR gRNA sequence
tctggaaaggataggatttc

SEQ ID NO: 758507 - DNA, 20 bp, Artificial
  CRISPR gRNA sequence
ataggatttccagatatgtt

SEQ ID NO: 758508 - DNA, 20 bp, Artificial
  CRISPR gRNA sequence
taggatttccagatatgttt

SEQ ID NO: 758509 - DNA, 20 bp, Artificial
  CRISPR gRNA sequence
gatttccagatatgtttagg

SEQ ID NO: 758510 - DNA, 20 bp, Artificial
  CRISPR gRNA sequence
atttccagatatgtttaggt

SEQ ID NO: 758511 - DNA, 20 bp, Artificial
  CRISPR gRNA sequence
gatatgtttaggtgggcacc

SEQ ID NO: 758512 - DNA, 20 bp, Artificial
  CRISPR gRNA sequence
atgtttaggtgggcacctag

SEQ ID NO: 758513 - DNA, 20 bp, Artificial
  CRISPR gRNA sequence
tgtttaggtgggcacctagc

SEQ ID NO: 758514 - DNA, 20 bp, Artificial
  CRISPR gRNA sequence
ggtgggcacctagcaggact

SEQ ID NO: 758515 - DNA, 20 bp, Artificial
  CRISPR gRNA sequence
gggcacctagcaggactcag

SEQ ID NO: 758516 - DNA, 20 bp, Artificial
  CRISPR gRNA sequence
agcaggactcagcagatatt

SEQ ID NO: 758517 - DNA, 20 bp, Artificial
  CRISPR gRNA sequence
cagcagatattgagtgaatg

SEQ ID NO: 758518 - DNA, 20 bp, Artificial
  CRISPR gRNA sequence
gaatgcagatgtgtgtgccc

SEQ ID NO: 758519 - DNA, 20 bp, Artificial
  CRISPR gRNA sequence
aatgcagatgtgtgtgccct

SEQ ID NO: 758520 - DNA, 20 bp, Artificial
  CRISPR gRNA sequence
tgtgtgtgccctgggcctgc

SEQ ID NO: 758521 - DNA, 20 bp, Artificial
  CRISPR gRNA sequence
ccgaaatctgcgctctgatg

SEQ ID NO: 758522 - DNA, 20 bp, Artificial
  CRISPR gRNA sequence
cttgttgccatcccttcttt

SEQ ID NO: 758523 - DNA, 20 bp, Artificial
  CRISPR gRNA sequence
ttgccatcccttcttttggc

SEQ ID NO: 758524 - DNA, 20 bp, Artificial
  CRISPR gRNA sequence
tcttttggctggacctcctc

SEQ ID NO: 758525 - DNA, 20 bp, Artificial
  CRISPR gRNA sequence
cttttggctggacctcctct

SEQ ID NO: 758526 - DNA, 20 bp, Artificial
  CRISPR gRNA sequence
gacctcctctgggcccaatg

SEQ ID NO: 758527 - DNA, 20 bp, Artificial
  CRISPR gRNA sequence
aatgtagctttcactttttt

SEQ ID NO: 758528 - DNA, 20 bp, Artificial
  CRISPR gRNA sequence
atgtagctttcacttttttc

SEQ ID NO: 758529 - DNA, 20 bp, Artificial
  CRISPR gRNA sequence
tgtagctttcacttttttca

SEQ ID NO: 758530 - DNA, 20 bp, Artificial
  CRISPR gRNA sequence
cacatttccacatgcatgta

SEQ ID NO: 758531 - DNA, 20 bp, Artificial
  CRISPR gRNA sequence
acatttccacatgcatgtat

SEQ ID NO: 758532 - DNA, 20 bp, Artificial
  CRISPR gRNA sequence
ttccacatgcatgtataggt

SEQ ID NO: 758533 - DNA, 20 bp, Artificial
  CRISPR gRNA sequence
gcatgtataggtcagttttg

SEQ ID NO: 758534 - DNA, 20 bp, Artificial
  CRISPR gRNA sequence
gcagcccctgcacatgcctc

SEQ ID NO: 758535 - DNA, 20 bp, Artificial
  CRISPR gRNA sequence
cctgcacatgcctctagttc

SEQ ID NO: 758536 - DNA, 20 bp, Artificial
  CRISPR gRNA sequence
ctgcacatgcctctagttcc

SEQ ID NO: 758537 - DNA, 20 bp, Artificial
  CRISPR gRNA sequence
tgcacatgcctctagttcca

SEQ ID NO: 758538 - DNA, 20 bp, Artificial
  CRISPR gRNA sequence
cacatgcctctagttccagg

SEQ ID NO: 758539 - DNA, 20 bp, Artificial
  CRISPR gRNA sequence
ctctagttccagggagacct

SEQ ID NO: 758540 - DNA, 20 bp, Artificial
  CRISPR gRNA sequence
agaccttagccctgctttgc

SEQ ID NO: 758541 - DNA, 20 bp, Artificial
  CRISPR gRNA sequence
cttagccctgctttgctggc

SEQ ID NO: 758542 - DNA, 20 bp, Artificial
  CRISPR gRNA sequence
tactactgtcctgactcaca

SEQ ID NO: 758543 - DNA, 20 bp, Artificial
  CRISPR gRNA sequence
tgactcacacagaaatcgct

SEQ ID NO: 758544 - DNA, 20 bp, Artificial
  CRISPR gRNA sequence
actcacacagaaatcgcttg

SEQ ID NO: 758545 - DNA, 20 bp, Artificial
  CRISPR gRNA sequence
tcacacagaaatcgcttgga

SEQ ID NO: 758546 - DNA, 20 bp, Artificial
  CRISPR gRNA sequence
cacacagaaatcgcttggag

SEQ ID NO: 758547 - DNA, 20 bp, Artificial
  CRISPR gRNA sequence
acagaaatcgcttggagagg

SEQ ID NO: 758548 - DNA, 20 bp, Artificial
  CRISPR gRNA sequence
gaagaactgattcctgctct

SEQ ID NO: 758549 - DNA, 20 bp, Artificial
  CRISPR gRNA sequence
aagaactgattcctgctctt

SEQ ID NO: 758550 - DNA, 20 bp, Artificial
  CRISPR gRNA sequence
aactgattcctgctcttggg

SEQ ID NO: 758551 - DNA, 20 bp, Artificial
  CRISPR gRNA sequence
actgattcctgctcttgggt

SEQ ID NO: 758552 - DNA, 20 bp, Artificial
  CRISPR gRNA sequence
cctgctcttgggtgggatca

SEQ ID NO: 758553 - DNA, 20 bp, Artificial
  CRISPR gRNA sequence
ctgctcttgggtgggatcac

SEQ ID NO: 758554 - DNA, 20 bp, Artificial
  CRISPR gRNA sequence
cttgggtgggatcacgggac

SEQ ID NO: 758555 - DNA, 20 bp, Artificial
  CRISPR gRNA sequence
ttgggtgggatcacgggact

SEQ ID NO: 758556 - DNA, 20 bp, Artificial
  CRISPR gRNA sequence
tgggtgggatcacgggactg

SEQ ID NO: 758557 - DNA, 20 bp, Artificial
  CRISPR gRNA sequence
ggtgggatcacgggactggg

SEQ ID NO: 758558 - DNA, 20 bp, Artificial
  CRISPR gRNA sequence
gggatcacgggactggggag

SEQ ID NO: 758559 - DNA, 20 bp, Artificial
  CRISPR gRNA sequence
cgggactggggagtggtgcc

SEQ ID NO: 758560 - DNA, 20 bp, Artificial
  CRISPR gRNA sequence
gactggggagtggtgcccag

SEQ ID NO: 758561 - DNA, 20 bp, Artificial
  CRISPR gRNA sequence
ggggagtggtgcccagtgga

SEQ ID NO: 758562 - DNA, 20 bp, Artificial
  CRISPR gRNA sequence
gtggacagccttgaacataa

SEQ ID NO: 758563 - DNA, 20 bp, Artificial
  CRISPR gRNA sequence
tggacagccttgaacataaa

SEQ ID NO: 758564 - DNA, 20 bp, Artificial
  CRISPR gRNA sequence
ataaaaggcccaaactgact

SEQ ID NO: 758565 - DNA, 20 bp, Artificial
  CRISPR gRNA sequence
cccaaactgactcagattat

SEQ ID NO: 758566 - DNA, 20 bp, Artificial
  CRISPR gRNA sequence
ccaaactgactcagattatc

SEQ ID NO: 758567 - DNA, 20 bp, Artificial
  CRISPR gRNA sequence
tgactcagattatcaggaaa

SEQ ID NO: 758568 - DNA, 20 bp, Artificial
  CRISPR gRNA sequence
gactcagattatcaggaaaa

SEQ ID NO: 758569 - DNA, 20 bp, Artificial
  CRISPR gRNA sequence
tcagattatcaggaaaaagg

SEQ ID NO: 758570 - DNA, 20 bp, Artificial
  CRISPR gRNA sequence
cagattatcaggaaaaagga

SEQ ID NO: 758571 - DNA, 20 bp, Artificial
  CRISPR gRNA sequence
tcaggaaaaaggaaggcaaa

SEQ ID NO: 758572 - DNA, 20 bp, Artificial
  CRISPR gRNA sequence
caggaaaaaggaaggcaaac

SEQ ID NO: 758573 - DNA, 20 bp, Artificial
  CRISPR gRNA sequence
aggaaaaaggaaggcaaaca

SEQ ID NO: 758574 - DNA, 20 bp, Artificial
  CRISPR gRNA sequence
gaaaaaggaaggcaaacagg

SEQ ID NO: 758575 - DNA, 20 bp, Artificial
  CRISPR gRNA sequence
aaaaaggaaggcaaacaggg

SEQ ID NO: 758576 - DNA, 20 bp, Artificial
  CRISPR gRNA sequence
gcaaacagggaggctgttcc

SEQ ID NO: 758577 - DNA, 20 bp, Artificial
  CRISPR gRNA sequence
caaacagggaggctgttccc

SEQ ID NO: 758578 - DNA, 20 bp, Artificial
  CRISPR gRNA sequence
aaacagggaggctgttccca

SEQ ID NO: 758579 - DNA, 20 bp, Artificial
  CRISPR gRNA sequence
aggctgttcccagggaactc

SEQ ID NO: 758580 - DNA, 20 bp, Artificial
  CRISPR gRNA sequence
ggctgttcccagggaactct

SEQ ID NO: 758581 - DNA, 20 bp, Artificial
  CRISPR gRNA sequence
gctgttcccagggaactcta

SEQ ID NO: 758582 - DNA, 20 bp, Artificial
  CRISPR gRNA sequence
gaccctcccatctcttttct

SEQ ID NO: 758583 - DNA, 20 bp, Artificial
  CRISPR gRNA sequence
accctcccatctcttttctg

SEQ ID NO: 758584 - DNA, 20 bp, Artificial
  CRISPR gRNA sequence
ctgaggctgctgcccattta

SEQ ID NO: 758585 - DNA, 20 bp, Artificial
  CRISPR gRNA sequence
gaggctgctgcccatttata

SEQ ID NO: 758586 - DNA, 20 bp, Artificial
  CRISPR gRNA sequence
ctgcccatttatagagcacc

SEQ ID NO: 758587 - DNA, 20 bp, Artificial
  CRISPR gRNA sequence
atagagcacctagtattaac

SEQ ID NO: 758588 - DNA, 20 bp, Artificial
  CRISPR gRNA sequence
tagagcacctagtattaact

SEQ ID NO: 758589 - DNA, 20 bp, Artificial
  CRISPR gRNA sequence
gcacctagtattaactaggt

SEQ ID NO: 758590 - DNA, 20 bp, Artificial
  CRISPR gRNA sequence
ttttgataattttgctcatt

SEQ ID NO: 758591 - DNA, 20 bp, Artificial
  CRISPR gRNA sequence
gagtcctataatcatcctat

SEQ ID NO: 758592 - DNA, 20 bp, Artificial
  CRISPR gRNA sequence
agtcctataatcatcctatg

SEQ ID NO: 758593 - DNA, 20 bp, Artificial
  CRISPR gRNA sequence
gtcctataatcatcctatga

SEQ ID NO: 758594 - DNA, 20 bp, Artificial
  CRISPR gRNA sequence
tataatcatcctatgagggt

SEQ ID NO: 758595 - DNA, 20 bp, Artificial
  CRISPR gRNA sequence
ataatcatcctatgagggta

SEQ ID NO: 758596 - DNA, 20 bp, Artificial
  CRISPR gRNA sequence
ataatccccattttacaaat

SEQ ID NO: 758597 - DNA, 20 bp, Artificial
  CRISPR gRNA sequence
attttacaaatgagcaaact

SEQ ID NO: 758598 - DNA, 20 bp, Artificial
  CRISPR gRNA sequence
ttttacaaatgagcaaactg

SEQ ID NO: 758599 - DNA, 20 bp, Artificial
  CRISPR gRNA sequence
caaatgagcaaactgaggct

SEQ ID NO: 758600 - DNA, 20 bp, Artificial
  CRISPR gRNA sequence
aatgagcaaactgaggctca

SEQ ID NO: 758601 - DNA, 20 bp, Artificial
  CRISPR gRNA sequence
tgagcaaactgaggctcaga

SEQ ID NO: 758602 - DNA, 20 bp, Artificial
  CRISPR gRNA sequence
gagcaaactgaggctcagag

SEQ ID NO: 758603 - DNA, 20 bp, Artificial
  CRISPR gRNA sequence
tcagagaggatattttcata

SEQ ID NO: 758604 - DNA, 20 bp, Artificial
  CRISPR gRNA sequence
ttttcataaagtttcattac

SEQ ID NO: 758605 - DNA, 20 bp, Artificial
  CRISPR gRNA sequence
tttcataaagtttcattact

SEQ ID NO: 758606 - DNA, 20 bp, Artificial
  CRISPR gRNA sequence
cataaagtttcattactagg

SEQ ID NO: 758607 - DNA, 20 bp, Artificial
  CRISPR gRNA sequence
gtttcattactaggaagtga

SEQ ID NO: 758608 - DNA, 20 bp, Artificial
  CRISPR gRNA sequence
ttcattactaggaagtgaca

SEQ ID NO: 758609 - DNA, 20 bp, Artificial
  CRISPR gRNA sequence
tactaggaagtgacagagtc

SEQ ID NO: 758610 - DNA, 20 bp, Artificial
  CRISPR gRNA sequence
aacctgtctctccaactcca

SEQ ID NO: 758611 - DNA, 20 bp, Artificial
  CRISPR gRNA sequence
aaagtcatcttcttaaacac

SEQ ID NO: 758612 - DNA, 20 bp, Artificial
  CRISPR gRNA sequence
tagtgctaacttcttccatg

SEQ ID NO: 758613 - DNA, 20 bp, Artificial
  CRISPR gRNA sequence
gaagcttcttgtgattacac

SEQ ID NO: 758614 - DNA, 20 bp, Artificial
  CRISPR gRNA sequence
caccagcccaacatgcgata

SEQ ID NO: 758615 - DNA, 20 bp, Artificial
  CRISPR gRNA sequence
cccaacatgcgatatggtca

SEQ ID NO: 758616 - DNA, 20 bp, Artificial
  CRISPR gRNA sequence
catgcgatatggtcacagca

SEQ ID NO: 758617 - DNA, 20 bp, Artificial
  CRISPR gRNA sequence
atgcgatatggtcacagcat

SEQ ID NO: 758618 - DNA, 20 bp, Artificial
  CRISPR gRNA sequence
gatatggtcacagcatggga

SEQ ID NO: 758619 - DNA, 20 bp, Artificial
  CRISPR gRNA sequence
atggtcacagcatgggatgg

SEQ ID NO: 758620 - DNA, 20 bp, Artificial
  CRISPR gRNA sequence
tcacagcatgggatggtggt

SEQ ID NO: 758621 - DNA, 20 bp, Artificial
  CRISPR gRNA sequence
cacagcatgggatggtggtc

SEQ ID NO: 758622 - DNA, 20 bp, Artificial
  CRISPR gRNA sequence
tggtggtcaggaccctttga

SEQ ID NO: 758623 - DNA, 20 bp, Artificial
  CRISPR gRNA sequence
gtcaggaccctttgatggtt

SEQ ID NO: 758624 - DNA, 20 bp, Artificial
  CRISPR gRNA sequence
tcaggaccctttgatggttg

SEQ ID NO: 758625 - DNA, 20 bp, Artificial
  CRISPR gRNA sequence
aggaccctttgatggttgag

SEQ ID NO: 758626 - DNA, 20 bp, Artificial
  CRISPR gRNA sequence
ctttgatggttgaggagatg

SEQ ID NO: 758627 - DNA, 20 bp, Artificial
  CRISPR gRNA sequence
tggttgaggagatgaagacc

SEQ ID NO: 758628 - DNA, 20 bp, Artificial
  CRISPR gRNA sequence
tgaggagatgaagacccaga

SEQ ID NO: 758629 - DNA, 20 bp, Artificial
  CRISPR gRNA sequence
gaggagatgaagacccagaa

SEQ ID NO: 758630 - DNA, 20 bp, Artificial
  CRISPR gRNA sequence
agatgaagacccagaaaggc

SEQ ID NO: 758631 - DNA, 20 bp, Artificial
  CRISPR gRNA sequence
gatgaagacccagaaaggca

SEQ ID NO: 758632 - DNA, 20 bp, Artificial
  CRISPR gRNA sequence
atgaagacccagaaaggcaa

SEQ ID NO: 758633 - DNA, 20 bp, Artificial
  CRISPR gRNA sequence
tgaagacccagaaaggcaag

SEQ ID NO: 758634 - DNA, 20 bp, Artificial
  CRISPR gRNA sequence
acccagaaaggcaaggggtt

SEQ ID NO: 758635 - DNA, 20 bp, Artificial
  CRISPR gRNA sequence
gaaaggcaaggggtttggcc

SEQ ID NO: 758636 - DNA, 20 bp, Artificial
  CRISPR gRNA sequence
aaaggcaaggggtttggcct

SEQ ID NO: 758637 - DNA, 20 bp, Artificial
  CRISPR gRNA sequence
aaggcaaggggtttggccta

SEQ ID NO: 758638 - DNA, 20 bp, Artificial
  CRISPR gRNA sequence
ggcaaggggtttggcctagg

SEQ ID NO: 758639 - DNA, 20 bp, Artificial
  CRISPR gRNA sequence
ggggtttggcctagggagcc

SEQ ID NO: 758640 - DNA, 20 bp, Artificial
  CRISPR gRNA sequence
tttggcctagggagcctggc

SEQ ID NO: 758641 - DNA, 20 bp, Artificial
  CRISPR gRNA sequence
gcctagggagcctggcaagt

SEQ ID NO: 758642 - DNA, 20 bp, Artificial
  CRISPR gRNA sequence
ggagcctggcaagtgagtga

SEQ ID NO: 758643 - DNA, 20 bp, Artificial
  CRISPR gRNA sequence
agcctggcaagtgagtgaca

SEQ ID NO: 758644 - DNA, 20 bp, Artificial
  CRISPR gRNA sequence
ggcaagtgagtgacagagcc

SEQ ID NO: 758645 - DNA, 20 bp, Artificial
  CRISPR gRNA sequence
gagtgacagagcctggtcta

SEQ ID NO: 758646 - DNA, 20 bp, Artificial
  CRISPR gRNA sequence
acagagcctggtctaaagtc

SEQ ID NO: 758647 - DNA, 20 bp, Artificial
  CRISPR gRNA sequence
cagagcctggtctaaagtcc

SEQ ID NO: 758648 - DNA, 20 bp, Artificial
  CRISPR gRNA sequence
ccttttttcgttaattgcaa

SEQ ID NO: 758649 - DNA, 20 bp, Artificial
  CRISPR gRNA sequence
caaaagaatttacatgttca

SEQ ID NO: 758650 - DNA, 20 bp, Artificial
  CRISPR gRNA sequence
tacatgttcatagttaaaaa

SEQ ID NO: 758651 - DNA, 20 bp, Artificial
  CRISPR gRNA sequence
catgttcatagttaaaaaca

SEQ ID NO: 758652 - DNA, 20 bp, Artificial
  CRISPR gRNA sequence
gttcatagttaaaaacagag

SEQ ID NO: 758653 - DNA, 20 bp, Artificial
  CRISPR gRNA sequence
taaaaacagagaagtgtatc

SEQ ID NO: 758654 - DNA, 20 bp, Artificial
  CRISPR gRNA sequence
aaacagagaagtgtatcaag

SEQ ID NO: 758655 - DNA, 20 bp, Artificial
  CRISPR gRNA sequence
gaagtgtatcaagtagaaaa

SEQ ID NO: 758656 - DNA, 20 bp, Artificial
  CRISPR gRNA sequence
gtgtatcaagtagaaaacag

SEQ ID NO: 758657 - DNA, 20 bp, Artificial
  CRISPR gRNA sequence
tcacccttattctgacactc

SEQ ID NO: 758658 - DNA, 20 bp, Artificial
  CRISPR gRNA sequence
acccttattctgacactcca

SEQ ID NO: 758659 - DNA, 20 bp, Artificial
  CRISPR gRNA sequence
tccagagttgcattcactct

SEQ ID NO: 758660 - DNA, 20 bp, Artificial
  CRISPR gRNA sequence
ccagagttgcattcactctc

SEQ ID NO: 758661 - DNA, 20 bp, Artificial
  CRISPR gRNA sequence
tgcattcactctcaggcatc

SEQ ID NO: 758662 - DNA, 20 bp, Artificial
  CRISPR gRNA sequence
cactcattgaatcgtgcatt

SEQ ID NO: 758663 - DNA, 20 bp, Artificial
  CRISPR gRNA sequence
ttgagaacccattatgtgcc

SEQ ID NO: 758664 - DNA, 20 bp, Artificial
  CRISPR gRNA sequence
attatgtgccaagccattgc

SEQ ID NO: 758665 - DNA, 20 bp, Artificial
  CRISPR gRNA sequence
gccaagccattgctagaatt

SEQ ID NO: 758666 - DNA, 20 bp, Artificial
  CRISPR gRNA sequence
ccaagccattgctagaatta

SEQ ID NO: 758667 - DNA, 20 bp, Artificial
  CRISPR gRNA sequence
tgctagaattaaggatgcaa

SEQ ID NO: 758668 - DNA, 20 bp, Artificial
  CRISPR gRNA sequence
aaggatgcaatagttaaata

SEQ ID NO: 758669 - DNA, 20 bp, Artificial
  CRISPR gRNA sequence
gatgcaatagttaaataaag

SEQ ID NO: 758670 - DNA, 20 bp, Artificial
  CRISPR gRNA sequence
atagttaaataaagcagatg

SEQ ID NO: 758671 - DNA, 20 bp, Artificial
  CRISPR gRNA sequence
aagcagatgtggttccttct

SEQ ID NO: 758672 - DNA, 20 bp, Artificial
  CRISPR gRNA sequence
agcagatgtggttccttctc

SEQ ID NO: 758673 - DNA, 20 bp, Artificial
  CRISPR gRNA sequence
gcagatgtggttccttctca

SEQ ID NO: 758674 - DNA, 20 bp, Artificial
  CRISPR gRNA sequence
agatgtggttccttctcagg

SEQ ID NO: 758675 - DNA, 20 bp, Artificial
  CRISPR gRNA sequence
gatgtggttccttctcaggg

SEQ ID NO: 758676 - DNA, 20 bp, Artificial
  CRISPR gRNA sequence
ggaggttctcatatatcatg

SEQ ID NO: 758677 - DNA, 20 bp, Artificial
  CRISPR gRNA sequence
ctcatatatcatgaagaaaa

SEQ ID NO: 758678 - DNA, 20 bp, Artificial
  CRISPR gRNA sequence
atatcatgaagaaaacagac

SEQ ID NO: 758679 - DNA, 20 bp, Artificial
  CRISPR gRNA sequence
tatcatgaagaaaacagact

SEQ ID NO: 758680 - DNA, 20 bp, Artificial
  CRISPR gRNA sequence
agactgggtgcaatgaatga

SEQ ID NO: 758681 - DNA, 20 bp, Artificial
  CRISPR gRNA sequence
gactgggtgcaatgaatgac

SEQ ID NO: 758682 - DNA, 20 bp, Artificial
  CRISPR gRNA sequence
actgggtgcaatgaatgaca

SEQ ID NO: 758683 - DNA, 20 bp, Artificial
  CRISPR gRNA sequence
atgaatgacagggtccttct

SEQ ID NO: 758684 - DNA, 20 bp, Artificial
  CRISPR gRNA sequence
gaatgacagggtccttctta

SEQ ID NO: 758685 - DNA, 20 bp, Artificial
  CRISPR gRNA sequence
tgacagggtccttcttagag

SEQ ID NO: 758686 - DNA, 20 bp, Artificial
  CRISPR gRNA sequence
cagggtccttcttagagtgg

SEQ ID NO: 758687 - DNA, 20 bp, Artificial
  CRISPR gRNA sequence
agagtggcagatctcttacc

SEQ ID NO: 758688 - DNA, 20 bp, Artificial
  CRISPR gRNA sequence
tcttacctggcttttctgtc

SEQ ID NO: 758689 - DNA, 20 bp, Artificial
  CRISPR gRNA sequence
cttacctggcttttctgtca

SEQ ID NO: 758690 - DNA, 20 bp, Artificial
  CRISPR gRNA sequence
ttttctgtcaaggtgaccct

SEQ ID NO: 758691 - DNA, 20 bp, Artificial
  CRISPR gRNA sequence
tcaaggtgaccctcagaata

SEQ ID NO: 758692 - DNA, 20 bp, Artificial
  CRISPR gRNA sequence
aaggtgaccctcagaatatg

SEQ ID NO: 758693 - DNA, 20 bp, Artificial
  CRISPR gRNA sequence
aggtgaccctcagaatatgg

SEQ ID NO: 758694 - DNA, 20 bp, Artificial
  CRISPR gRNA sequence
ggaggtgttaccttttatct

SEQ ID NO: 758695 - DNA, 20 bp, Artificial
  CRISPR gRNA sequence
tccatgttttactgctataa

SEQ ID NO: 758696 - DNA, 20 bp, Artificial
  CRISPR gRNA sequence
actgctataacagaatacca

SEQ ID NO: 758697 - DNA, 20 bp, Artificial
  CRISPR gRNA sequence
tataacagaataccacagcc

SEQ ID NO: 758698 - DNA, 20 bp, Artificial
  CRISPR gRNA sequence
ataacagaataccacagcct

SEQ ID NO: 758699 - DNA, 20 bp, Artificial
  CRISPR gRNA sequence
cacagcctgggtaatatata

SEQ ID NO: 758700 - DNA, 20 bp, Artificial
  CRISPR gRNA sequence
gggtaatatataaagaaaaa

SEQ ID NO: 758701 - DNA, 20 bp, Artificial
  CRISPR gRNA sequence
ggtaatatataaagaaaaaa

SEQ ID NO: 758702 - DNA, 20 bp, Artificial
  CRISPR gRNA sequence
ataaagaaaaaaaggttatt

SEQ ID NO: 758703 - DNA, 20 bp, Artificial
  CRISPR gRNA sequence
aaaaaaggttatttggcttg

SEQ ID NO: 758704 - DNA, 20 bp, Artificial
  CRISPR gRNA sequence
ggttatttggcttgtagttc

SEQ ID NO: 758705 - DNA, 20 bp, Artificial
  CRISPR gRNA sequence
ttatttggcttgtagttctg

SEQ ID NO: 758706 - DNA, 20 bp, Artificial
  CRISPR gRNA sequence
tggcttgtagttctggagac

SEQ ID NO: 758707 - DNA, 20 bp, Artificial
  CRISPR gRNA sequence
ggcttgtagttctggagact

SEQ ID NO: 758708 - DNA, 20 bp, Artificial
  CRISPR gRNA sequence
ttgtagttctggagactggg

SEQ ID NO: 758709 - DNA, 20 bp, Artificial
  CRISPR gRNA sequence
ttctggagactgggaagtcc

SEQ ID NO: 758710 - DNA, 20 bp, Artificial
  CRISPR gRNA sequence
tctggagactgggaagtcca

SEQ ID NO: 758711 - DNA, 20 bp, Artificial
  CRISPR gRNA sequence
ctggagactgggaagtccaa

SEQ ID NO: 758712 - DNA, 20 bp, Artificial
  CRISPR gRNA sequence
gactgggaagtccaagggca

SEQ ID NO: 758713 - DNA, 20 bp, Artificial
  CRISPR gRNA sequence
gaagtccaagggcatggtgc

SEQ ID NO: 758714 - DNA, 20 bp, Artificial
  CRISPR gRNA sequence
aagggcatggtgctggcatc

SEQ ID NO: 758715 - DNA, 20 bp, Artificial
  CRISPR gRNA sequence
gcatggtgctggcatctggc

SEQ ID NO: 758716 - DNA, 20 bp, Artificial
  CRISPR gRNA sequence
catggtgctggcatctggcg

SEQ ID NO: 758717 - DNA, 20 bp, Artificial
  CRISPR gRNA sequence
atggtgctggcatctggcga

SEQ ID NO: 758718 - DNA, 20 bp, Artificial
  CRISPR gRNA sequence
cttgctgcattatcctattg

SEQ ID NO: 758719 - DNA, 20 bp, Artificial
  CRISPR gRNA sequence
gctgcattatcctattgtgg

SEQ ID NO: 758720 - DNA, 20 bp, Artificial
  CRISPR gRNA sequence
ctgcattatcctattgtgga

SEQ ID NO: 758721 - DNA, 20 bp, Artificial
  CRISPR gRNA sequence
tgcattatcctattgtggaa

SEQ ID NO: 758722 - DNA, 20 bp, Artificial
  CRISPR gRNA sequence
cctattgtggaagggcatgt

SEQ ID NO: 758723 - DNA, 20 bp, Artificial
  CRISPR gRNA sequence
tggaagggcatgtgagcgtg

SEQ ID NO: 758724 - DNA, 20 bp, Artificial
  CRISPR gRNA sequence
gggcatgtgagcgtgcagta

SEQ ID NO: 758725 - DNA, 20 bp, Artificial
  CRISPR gRNA sequence
atgtgagcgtgcagtacaga

SEQ ID NO: 758726 - DNA, 20 bp, Artificial
  CRISPR gRNA sequence
agcgtgcagtacagacagta

SEQ ID NO: 758727 - DNA, 20 bp, Artificial
  CRISPR gRNA sequence
gcgtgcagtacagacagtat

SEQ ID NO: 758728 - DNA, 20 bp, Artificial
  CRISPR gRNA sequence
cgtgcagtacagacagtatg

SEQ ID NO: 758729 - DNA, 20 bp, Artificial
  CRISPR gRNA sequence
gtgcagtacagacagtatgg

SEQ ID NO: 758730 - DNA, 20 bp, Artificial
  CRISPR gRNA sequence
cagtacagacagtatggggg

SEQ ID NO: 758731 - DNA, 20 bp, Artificial
  CRISPR gRNA sequence
ggcagcacttacgcttttat

SEQ ID NO: 758732 - DNA, 20 bp, Artificial
  CRISPR gRNA sequence
gcagcacttacgcttttatc

SEQ ID NO: 758733 - DNA, 20 bp, Artificial
  CRISPR gRNA sequence
agcacttacgcttttatcag

SEQ ID NO: 758734 - DNA, 20 bp, Artificial
  CRISPR gRNA sequence
gcccacttttcctgtgataa

SEQ ID NO: 758735 - DNA, 20 bp, Artificial
  CRISPR gRNA sequence
attaatctcttcacttctta

SEQ ID NO: 758736 - DNA, 20 bp, Artificial
  CRISPR gRNA sequence
ttaatctcttcacttcttac

SEQ ID NO: 758737 - DNA, 20 bp, Artificial
  CRISPR gRNA sequence
cccacctcttaatactgtta

SEQ ID NO: 758738 - DNA, 20 bp, Artificial
  CRISPR gRNA sequence
acctcttaatactgttacag

SEQ ID NO: 758739 - DNA, 20 bp, Artificial
  CRISPR gRNA sequence
tggcaattaaatttcaacat

SEQ ID NO: 758740 - DNA, 20 bp, Artificial
  CRISPR gRNA sequence
aaatttcaacatgagtctta

SEQ ID NO: 758741 - DNA, 20 bp, Artificial
  CRISPR gRNA sequence
cttaaagcacccatgtcatc

SEQ ID NO: 758742 - DNA, 20 bp, Artificial
  CRISPR gRNA sequence
ttaaagcacccatgtcatct

SEQ ID NO: 758743 - DNA, 20 bp, Artificial
  CRISPR gRNA sequence
aagcacccatgtcatctagg

SEQ ID NO: 758744 - DNA, 20 bp, Artificial
  CRISPR gRNA sequence
cacccatgtcatctaggaag

SEQ ID NO: 758745 - DNA, 20 bp, Artificial
  CRISPR gRNA sequence
ggaagaagaaactgtatttg

SEQ ID NO: 758746 - DNA, 20 bp, Artificial
  CRISPR gRNA sequence
tgtatttgcagcaacactgt

SEQ ID NO: 758747 - DNA, 20 bp, Artificial
  CRISPR gRNA sequence
gtatttgcagcaacactgtg

SEQ ID NO: 758748 - DNA, 20 bp, Artificial
  CRISPR gRNA sequence
tttgcagcaacactgtgagg

SEQ ID NO: 758749 - DNA, 20 bp, Artificial
  CRISPR gRNA sequence
ttgcagcaacactgtgaggt

SEQ ID NO: 758750 - DNA, 20 bp, Artificial
  CRISPR gRNA sequence
agcaacactgtgaggtagga

SEQ ID NO: 758751 - DNA, 20 bp, Artificial
  CRISPR gRNA sequence
gcaacactgtgaggtaggaa

SEQ ID NO: 758752 - DNA, 20 bp, Artificial
  CRISPR gRNA sequence
caacactgtgaggtaggaaa

SEQ ID NO: 758753 - DNA, 20 bp, Artificial
  CRISPR gRNA sequence
acactgtgaggtaggaaagg

SEQ ID NO: 758754 - DNA, 20 bp, Artificial
  CRISPR gRNA sequence
ggaaagggagtcctatgttg

SEQ ID NO: 758755 - DNA, 20 bp, Artificial
  CRISPR gRNA sequence
gaaagggagtcctatgttgt

SEQ ID NO: 758756 - DNA, 20 bp, Artificial
  CRISPR gRNA sequence
gagtcctatgttgtaggaac

SEQ ID NO: 758757 - DNA, 20 bp, Artificial
  CRISPR gRNA sequence
tcctatgttgtaggaactgg

SEQ ID NO: 758758 - DNA, 20 bp, Artificial
  CRISPR gRNA sequence
tatgttgtaggaactggaag

SEQ ID NO: 758759 - DNA, 20 bp, Artificial
  CRISPR gRNA sequence
gaactggaagcagcccactg

SEQ ID NO: 758760 - DNA, 20 bp, Artificial
  CRISPR gRNA sequence
tggaagcagcccactgtggt

SEQ ID NO: 758761 - DNA, 20 bp, Artificial
  CRISPR gRNA sequence
ggaagcagcccactgtggtg

SEQ ID NO: 758762 - DNA, 20 bp, Artificial
  CRISPR gRNA sequence
gaagcagcccactgtggtga

SEQ ID NO: 758763 - DNA, 20 bp, Artificial
  CRISPR gRNA sequence
aagcagcccactgtggtgag

SEQ ID NO: 758764 - DNA, 20 bp, Artificial
  CRISPR gRNA sequence
agcccactgtggtgaggggc

SEQ ID NO: 758765 - DNA, 20 bp, Artificial
  CRISPR gRNA sequence
ccactgtggtgaggggcaag

SEQ ID NO: 758766 - DNA, 20 bp, Artificial
  CRISPR gRNA sequence
cactgtggtgaggggcaagt

SEQ ID NO: 758767 - DNA, 20 bp, Artificial
  CRISPR gRNA sequence
tgtggtgaggggcaagtagg

SEQ ID NO: 758768 - DNA, 20 bp, Artificial
  CRISPR gRNA sequence
tggtgaggggcaagtaggaa

SEQ ID NO: 758769 - DNA, 20 bp, Artificial
  CRISPR gRNA sequence
ggtgaggggcaagtaggaag

SEQ ID NO: 758770 - DNA, 20 bp, Artificial
  CRISPR gRNA sequence
aggggcaagtaggaagaggt

SEQ ID NO: 758771 - DNA, 20 bp, Artificial
  CRISPR gRNA sequence
ggggcaagtaggaagaggtg

SEQ ID NO: 758772 - DNA, 20 bp, Artificial
  CRISPR gRNA sequence
caagtaggaagaggtgaggc

SEQ ID NO: 758773 - DNA, 20 bp, Artificial
  CRISPR gRNA sequence
aagtaggaagaggtgaggct

SEQ ID NO: 758774 - DNA, 20 bp, Artificial
  CRISPR gRNA sequence
taggaagaggtgaggctggg

SEQ ID NO: 758775 - DNA, 20 bp, Artificial
  CRISPR gRNA sequence
aggaagaggtgaggctgggc

SEQ ID NO: 758776 - DNA, 20 bp, Artificial
  CRISPR gRNA sequence
aagaggtgaggctgggcagg

SEQ ID NO: 758777 - DNA, 20 bp, Artificial
  CRISPR gRNA sequence
agaggtgaggctgggcaggt

SEQ ID NO: 758778 - DNA, 20 bp, Artificial
  CRISPR gRNA sequence
ggtgaggctgggcaggtggg

SEQ ID NO: 758779 - DNA, 20 bp, Artificial
  CRISPR gRNA sequence
gtgaggctgggcaggtgggc

SEQ ID NO: 758780 - DNA, 20 bp, Artificial
  CRISPR gRNA sequence
tgaggctgggcaggtgggca

SEQ ID NO: 758781 - DNA, 20 bp, Artificial
  CRISPR gRNA sequence
gctgggcaggtgggcagggc

SEQ ID NO: 758782 - DNA, 20 bp, Artificial
  CRISPR gRNA sequence
ctgggcaggtgggcagggcc

SEQ ID NO: 758783 - DNA, 20 bp, Artificial
  CRISPR gRNA sequence
tgggcaggtgggcagggcca

SEQ ID NO: 758784 - DNA, 20 bp, Artificial
  CRISPR gRNA sequence
gcaggtgggcagggccaggg

SEQ ID NO: 758785 - DNA, 20 bp, Artificial
  CRISPR gRNA sequence
gtgggcagggccagggcaga

SEQ ID NO: 758786 - DNA, 20 bp, Artificial
  CRISPR gRNA sequence
tgggcagggccagggcagat

SEQ ID NO: 758787 - DNA, 20 bp, Artificial
  CRISPR gRNA sequence
gggcagggccagggcagatg

SEQ ID NO: 758788 - DNA, 20 bp, Artificial
  CRISPR gRNA sequence
ccagggcagatggggctctg

SEQ ID NO: 758789 - DNA, 20 bp, Artificial
  CRISPR gRNA sequence
cagggcagatggggctctgt

SEQ ID NO: 758790 - DNA, 20 bp, Artificial
  CRISPR gRNA sequence
agatggggctctgtaggcta

SEQ ID NO: 758791 - DNA, 20 bp, Artificial
  CRISPR gRNA sequence
atggggctctgtaggctatg

SEQ ID NO: 758792 - DNA, 20 bp, Artificial
  CRISPR gRNA sequence
tggggctctgtaggctatgg

SEQ ID NO: 758793 - DNA, 20 bp, Artificial
  CRISPR gRNA sequence
gggctctgtaggctatggag

SEQ ID NO: 758794 - DNA, 20 bp, Artificial
  CRISPR gRNA sequence
aggagctgcgatcttatcac

SEQ ID NO: 758795 - DNA, 20 bp, Artificial
  CRISPR gRNA sequence
ggagctgcgatcttatcaca

SEQ ID NO: 758796 - DNA, 20 bp, Artificial
  CRISPR gRNA sequence
ctgcgatcttatcacaagga

SEQ ID NO: 758797 - DNA, 20 bp, Artificial
  CRISPR gRNA sequence
cttatcacaaggaaagtgaa

SEQ ID NO: 758798 - DNA, 20 bp, Artificial
  CRISPR gRNA sequence
agccctatgattaactattg

SEQ ID NO: 758799 - DNA, 20 bp, Artificial
  CRISPR gRNA sequence
gccctatgattaactattga

SEQ ID NO: 758800 - DNA, 20 bp, Artificial
  CRISPR gRNA sequence
ctatgattaactattgaagg

SEQ ID NO: 758801 - DNA, 20 bp, Artificial
  CRISPR gRNA sequence
aatttatgcttttatattaa

SEQ ID NO: 758802 - DNA, 20 bp, Artificial
  CRISPR gRNA sequence
tatattaatagcaattattc

SEQ ID NO: 758803 - DNA, 20 bp, Artificial
  CRISPR gRNA sequence
caattattctggctgttgta

SEQ ID NO: 758804 - DNA, 20 bp, Artificial
  CRISPR gRNA sequence
attattctggctgttgtata

SEQ ID NO: 758805 - DNA, 20 bp, Artificial
  CRISPR gRNA sequence
tctggctgttgtatagagta

SEQ ID NO: 758806 - DNA, 20 bp, Artificial
  CRISPR gRNA sequence
ctgttgtatagagtatagat

SEQ ID NO: 758807 - DNA, 20 bp, Artificial
  CRISPR gRNA sequence
gttgtatagagtatagattg

SEQ ID NO: 758808 - DNA, 20 bp, Artificial
  CRISPR gRNA sequence
atagagtatagattggagaa

SEQ ID NO: 758809 - DNA, 20 bp, Artificial
  CRISPR gRNA sequence
tatagattggagaacagaat

SEQ ID NO: 758810 - DNA, 20 bp, Artificial
  CRISPR gRNA sequence
atagattggagaacagaatt

SEQ ID NO: 758811 - DNA, 20 bp, Artificial
  CRISPR gRNA sequence
gattggagaacagaattggg

SEQ ID NO: 758812 - DNA, 20 bp, Artificial
  CRISPR gRNA sequence
attggagaacagaattgggt

SEQ ID NO: 758813 - DNA, 20 bp, Artificial
  CRISPR gRNA sequence
ttggagaacagaattgggtg

SEQ ID NO: 758814 - DNA, 20 bp, Artificial
  CRISPR gRNA sequence
tggagaacagaattgggtgg

SEQ ID NO: 758815 - DNA, 20 bp, Artificial
  CRISPR gRNA sequence
acagaattgggtgggggaac

SEQ ID NO: 758816 - DNA, 20 bp, Artificial
  CRISPR gRNA sequence
agaattgggtgggggaacta

SEQ ID NO: 758817 - DNA, 20 bp, Artificial
  CRISPR gRNA sequence
attgggtgggggaactagag

SEQ ID NO: 758818 - DNA, 20 bp, Artificial
  CRISPR gRNA sequence
ttgggtgggggaactagaga

SEQ ID NO: 758819 - DNA, 20 bp, Artificial
  CRISPR gRNA sequence
ggggaactagagaaggtgaa

SEQ ID NO: 758820 - DNA, 20 bp, Artificial
  CRISPR gRNA sequence
actagagaaggtgaacagac

SEQ ID NO: 758821 - DNA, 20 bp, Artificial
  CRISPR gRNA sequence
agaaggtgaacagactggtg

SEQ ID NO: 758822 - DNA, 20 bp, Artificial
  CRISPR gRNA sequence
aaggtgaacagactggtgaa

SEQ ID NO: 758823 - DNA, 20 bp, Artificial
  CRISPR gRNA sequence
aggtgaacagactggtgaag

SEQ ID NO: 758824 - DNA, 20 bp, Artificial
  CRISPR gRNA sequence
gactggtgaagaggctttta

SEQ ID NO: 758825 - DNA, 20 bp, Artificial
  CRISPR gRNA sequence
aagaggcttttatagttatc

SEQ ID NO: 758826 - DNA, 20 bp, Artificial
  CRISPR gRNA sequence
agaggcttttatagttatcc

SEQ ID NO: 758827 - DNA, 20 bp, Artificial
  CRISPR gRNA sequence
gcttttatagttatccaggc

SEQ ID NO: 758828 - DNA, 20 bp, Artificial
  CRISPR gRNA sequence
ttttatagttatccaggcaa

SEQ ID NO: 758829 - DNA, 20 bp, Artificial
  CRISPR gRNA sequence
gttatccaggcaagagatga

SEQ ID NO: 758830 - DNA, 20 bp, Artificial
  CRISPR gRNA sequence
ggcaagagatgatggtgact

SEQ ID NO: 758831 - DNA, 20 bp, Artificial
  CRISPR gRNA sequence
aagagatgatggtgacttgg

SEQ ID NO: 758832 - DNA, 20 bp, Artificial
  CRISPR gRNA sequence
atgatggtgacttggaagac

SEQ ID NO: 758833 - DNA, 20 bp, Artificial
  CRISPR gRNA sequence
tgatggtgacttggaagacc

SEQ ID NO: 758834 - DNA, 20 bp, Artificial
  CRISPR gRNA sequence
tggtgacttggaagaccagg

SEQ ID NO: 758835 - DNA, 20 bp, Artificial
  CRISPR gRNA sequence
gtgacttggaagaccaggaa

SEQ ID NO: 758836 - DNA, 20 bp, Artificial
  CRISPR gRNA sequence
acttggaagaccaggaagag

SEQ ID NO: 758837 - DNA, 20 bp, Artificial
  CRISPR gRNA sequence
tggaagaccaggaagagaag

SEQ ID NO: 758838 - DNA, 20 bp, Artificial
  CRISPR gRNA sequence
ggaagaccaggaagagaagc

SEQ ID NO: 758839 - DNA, 20 bp, Artificial
  CRISPR gRNA sequence
gaagaccaggaagagaagca

SEQ ID NO: 758840 - DNA, 20 bp, Artificial
  CRISPR gRNA sequence
aagaccaggaagagaagcag

SEQ ID NO: 758841 - DNA, 20 bp, Artificial
  CRISPR gRNA sequence
accaggaagagaagcagggg

SEQ ID NO: 758842 - DNA, 20 bp, Artificial
  CRISPR gRNA sequence
caggaagagaagcaggggta

SEQ ID NO: 758843 - DNA, 20 bp, Artificial
  CRISPR gRNA sequence
ggaagagaagcaggggtaga

SEQ ID NO: 758844 - DNA, 20 bp, Artificial
  CRISPR gRNA sequence
gaagcaggggtagagagaaa

SEQ ID NO: 758845 - DNA, 20 bp, Artificial
  CRISPR gRNA sequence
agcaggggtagagagaaatg

SEQ ID NO: 758846 - DNA, 20 bp, Artificial
  CRISPR gRNA sequence
ggggtagagagaaatggaga

SEQ ID NO: 758847 - DNA, 20 bp, Artificial
  CRISPR gRNA sequence
agagagaaatggagatagtg

SEQ ID NO: 758848 - DNA, 20 bp, Artificial
  CRISPR gRNA sequence
aaatggagatagtgaagata

SEQ ID NO: 758849 - DNA, 20 bp, Artificial
  CRISPR gRNA sequence
tggagatagtgaagatatag

SEQ ID NO: 758850 - DNA, 20 bp, Artificial
  CRISPR gRNA sequence
aagatatagcagacatattt

SEQ ID NO: 758851 - DNA, 20 bp, Artificial
  CRISPR gRNA sequence
agatatagcagacatatttg

SEQ ID NO: 758852 - DNA, 20 bp, Artificial
  CRISPR gRNA sequence
atatagcagacatatttgag

SEQ ID NO: 758853 - DNA, 20 bp, Artificial
  CRISPR gRNA sequence
gacatatttgaggagtcctt

SEQ ID NO: 758854 - DNA, 20 bp, Artificial
  CRISPR gRNA sequence
tttgaggagtccttcagtta

SEQ ID NO: 758855 - DNA, 20 bp, Artificial
  CRISPR gRNA sequence
agtccttcagttacagataa

SEQ ID NO: 758856 - DNA, 20 bp, Artificial
  CRISPR gRNA sequence
agttacagataatagaaaac

SEQ ID NO: 758857 - DNA, 20 bp, Artificial
  CRISPR gRNA sequence
agataatagaaaactagctc

SEQ ID NO: 758858 - DNA, 20 bp, Artificial
  CRISPR gRNA sequence
aaactagctcaagcacattt

SEQ ID NO: 758859 - DNA, 20 bp, Artificial
  CRISPR gRNA sequence
cacatttaagaaaaaaaaaa

SEQ ID NO: 758860 - DNA, 20 bp, Artificial
  CRISPR gRNA sequence
aaaaaaaaaaagacttgttt

SEQ ID NO: 758861 - DNA, 20 bp, Artificial
  CRISPR gRNA sequence
aaaagacttgtttaagtacc

SEQ ID NO: 758862 - DNA, 20 bp, Artificial
  CRISPR gRNA sequence
aaagacttgtttaagtacct

SEQ ID NO: 758863 - DNA, 20 bp, Artificial
  CRISPR gRNA sequence
gacttgtttaagtacctagg

SEQ ID NO: 758864 - DNA, 20 bp, Artificial
  CRISPR gRNA sequence
acctaggcagtctatgtgtg

SEQ ID NO: 758865 - DNA, 20 bp, Artificial
  CRISPR gRNA sequence
tctatgtgtgcagcttgctt

SEQ ID NO: 758866 - DNA, 20 bp, Artificial
  CRISPR gRNA sequence
ctatgtgtgcagcttgcttc

SEQ ID NO: 758867 - DNA, 20 bp, Artificial
  CRISPR gRNA sequence
tgtgcagcttgcttcaggaa

SEQ ID NO: 758868 - DNA, 20 bp, Artificial
  CRISPR gRNA sequence
gtgcagcttgcttcaggaat

SEQ ID NO: 758869 - DNA, 20 bp, Artificial
  CRISPR gRNA sequence
tgcagcttgcttcaggaata

SEQ ID NO: 758870 - DNA, 20 bp, Artificial
  CRISPR gRNA sequence
gcagcttgcttcaggaatag

SEQ ID NO: 758871 - DNA, 20 bp, Artificial
  CRISPR gRNA sequence
aggaataggggcttaaatga

SEQ ID NO: 758872 - DNA, 20 bp, Artificial
  CRISPR gRNA sequence
aggggcttaaatgatggttt

SEQ ID NO: 758873 - DNA, 20 bp, Artificial
  CRISPR gRNA sequence
ggggcttaaatgatggtttt

SEQ ID NO: 758874 - DNA, 20 bp, Artificial
  CRISPR gRNA sequence
gggcttaaatgatggtttta

SEQ ID NO: 758875 - DNA, 20 bp, Artificial
  CRISPR gRNA sequence
tttagggctctatatccttc

SEQ ID NO: 758876 - DNA, 20 bp, Artificial
  CRISPR gRNA sequence
tctgcctctgttcatttgtt

SEQ ID NO: 758877 - DNA, 20 bp, Artificial
  CRISPR gRNA sequence
atttgtttggatcaattctt

SEQ ID NO: 758878 - DNA, 20 bp, Artificial
  CRISPR gRNA sequence
ggatcaattctttagattgt

SEQ ID NO: 758879 - DNA, 20 bp, Artificial
  CRISPR gRNA sequence
tcaattctttagattgttgg

SEQ ID NO: 758880 - DNA, 20 bp, Artificial
  CRISPR gRNA sequence
attctttagattgttggtag

SEQ ID NO: 758881 - DNA, 20 bp, Artificial
  CRISPR gRNA sequence
gcagacacatttattgctaa

SEQ ID NO: 758882 - DNA, 20 bp, Artificial
  CRISPR gRNA sequence
acatttattgctaacagtcc

SEQ ID NO: 758883 - DNA, 20 bp, Artificial
  CRISPR gRNA sequence
gtcccagaccgtatccttct

SEQ ID NO: 758884 - DNA, 20 bp, Artificial
  CRISPR gRNA sequence
tccttcttagtaatctcaac

SEQ ID NO: 758885 - DNA, 20 bp, Artificial
  CRISPR gRNA sequence
tcttagtaatctcaacaaga

SEQ ID NO: 758886 - DNA, 20 bp, Artificial
  CRISPR gRNA sequence
ttagtaatctcaacaagaaa

SEQ ID NO: 758887 - DNA, 20 bp, Artificial
  CRISPR gRNA sequence
caagaaagagtcttttttga

SEQ ID NO: 758888 - DNA, 20 bp, Artificial
  CRISPR gRNA sequence
agagtcttttttgatggctg

SEQ ID NO: 758889 - DNA, 20 bp, Artificial
  CRISPR gRNA sequence
gtcttttttgatggctgcag

SEQ ID NO: 758890 - DNA, 20 bp, Artificial
  CRISPR gRNA sequence
tttttgatggctgcagcagc

SEQ ID NO: 758891 - DNA, 20 bp, Artificial
  CRISPR gRNA sequence
ttttgatggctgcagcagca

SEQ ID NO: 758892 - DNA, 20 bp, Artificial
  CRISPR gRNA sequence
tggctgcagcagcaaggctc

SEQ ID NO: 758893 - DNA, 20 bp, Artificial
  CRISPR gRNA sequence
ggctgcagcagcaaggctct

SEQ ID NO: 758894 - DNA, 20 bp, Artificial
  CRISPR gRNA sequence
gctgcagcagcaaggctctg

SEQ ID NO: 758895 - DNA, 20 bp, Artificial
  CRISPR gRNA sequence
gcagcagcaaggctctgggg

SEQ ID NO: 758896 - DNA, 20 bp, Artificial
  CRISPR gRNA sequence
gctctggggaagtctctgat

SEQ ID NO: 758897 - DNA, 20 bp, Artificial
  CRISPR gRNA sequence
ctctggggaagtctctgatt

SEQ ID NO: 758898 - DNA, 20 bp, Artificial
  CRISPR gRNA sequence
gggaagtctctgattgggtg

SEQ ID NO: 758899 - DNA, 20 bp, Artificial
  CRISPR gRNA sequence
gtctctgattgggtgtggct

SEQ ID NO: 758900 - DNA, 20 bp, Artificial
  CRISPR gRNA sequence
attgggtgtggcttggctta

SEQ ID NO: 758901 - DNA, 20 bp, Artificial
  CRISPR gRNA sequence
tcattctcgaactaatcact

SEQ ID NO: 758902 - DNA, 20 bp, Artificial
  CRISPR gRNA sequence
ttctcgaactaatcactgag

SEQ ID NO: 758903 - DNA, 20 bp, Artificial
  CRISPR gRNA sequence
tctcgaactaatcactgagt

SEQ ID NO: 758904 - DNA, 20 bp, Artificial
  CRISPR gRNA sequence
ctcgaactaatcactgagtg

SEQ ID NO: 758905 - DNA, 20 bp, Artificial
  CRISPR gRNA sequence
tcgaactaatcactgagtgg

SEQ ID NO: 758906 - DNA, 20 bp, Artificial
  CRISPR gRNA sequence
aactaatcactgagtggggg

SEQ ID NO: 758907 - DNA, 20 bp, Artificial
  CRISPR gRNA sequence
actaatcactgagtgggggc

SEQ ID NO: 758908 - DNA, 20 bp, Artificial
  CRISPR gRNA sequence
ctaatcactgagtgggggca

SEQ ID NO: 758909 - DNA, 20 bp, Artificial
  CRISPR gRNA sequence
atcactgagtgggggcaggg

SEQ ID NO: 758910 - DNA, 20 bp, Artificial
  CRISPR gRNA sequence
tcactgagtgggggcagggc

SEQ ID NO: 758911 - DNA, 20 bp, Artificial
  CRISPR gRNA sequence
ggcagggcaggtttctccat

SEQ ID NO: 758912 - DNA, 20 bp, Artificial
  CRISPR gRNA sequence
gggcaggtttctccatgagc

SEQ ID NO: 758913 - DNA, 20 bp, Artificial
  CRISPR gRNA sequence
ggcaggtttctccatgagcc

SEQ ID NO: 758914 - DNA, 20 bp, Artificial
  CRISPR gRNA sequence
gccaggtcttgtaacatgcc

SEQ ID NO: 758915 - DNA, 20 bp, Artificial
  CRISPR gRNA sequence
ccaggtcttgtaacatgccc

SEQ ID NO: 758916 - DNA, 20 bp, Artificial
  CRISPR gRNA sequence
cttgtaacatgcccaggccc

SEQ ID NO: 758917 - DNA, 20 bp, Artificial
  CRISPR gRNA sequence
ttgtaacatgcccaggccct

SEQ ID NO: 758918 - DNA, 20 bp, Artificial
  CRISPR gRNA sequence
aacatgcccaggccctaggc

SEQ ID NO: 758919 - DNA, 20 bp, Artificial
  CRISPR gRNA sequence
acatgcccaggccctaggct

SEQ ID NO: 758920 - DNA, 20 bp, Artificial
  CRISPR gRNA sequence
atgcccaggccctaggctgg

SEQ ID NO: 758921 - DNA, 20 bp, Artificial
  CRISPR gRNA sequence
tgcccaggccctaggctggg

SEQ ID NO: 758922 - DNA, 20 bp, Artificial
  CRISPR gRNA sequence
caggccctaggctgggagga

SEQ ID NO: 758923 - DNA, 20 bp, Artificial
  CRISPR gRNA sequence
ggctgggaggacagctccac

SEQ ID NO: 758924 - DNA, 20 bp, Artificial
  CRISPR gRNA sequence
ggaggacagctccaccagta

SEQ ID NO: 758925 - DNA, 20 bp, Artificial
  CRISPR gRNA sequence
acagctccaccagtacagca

SEQ ID NO: 758926 - DNA, 20 bp, Artificial
  CRISPR gRNA sequence
tccaccagtacagcatggac

SEQ ID NO: 758927 - DNA, 20 bp, Artificial
  CRISPR gRNA sequence
ccaccagtacagcatggact

SEQ ID NO: 758928 - DNA, 20 bp, Artificial
  CRISPR gRNA sequence
agcatggactgggctccctg

SEQ ID NO: 758929 - DNA, 20 bp, Artificial
  CRISPR gRNA sequence
gcatggactgggctccctgc

SEQ ID NO: 758930 - DNA, 20 bp, Artificial
  CRISPR gRNA sequence
atggactgggctccctgcag

SEQ ID NO: 758931 - DNA, 20 bp, Artificial
  CRISPR gRNA sequence
ctgggctccctgcaggagtg

SEQ ID NO: 758932 - DNA, 20 bp, Artificial
  CRISPR gRNA sequence
gggctccctgcaggagtgcg

SEQ ID NO: 758933 - DNA, 20 bp, Artificial
  CRISPR gRNA sequence
ggagtgcggagccttgctac

SEQ ID NO: 758934 - DNA, 20 bp, Artificial
  CRISPR gRNA sequence
gtgcggagccttgctaccag

SEQ ID NO: 758935 - DNA, 20 bp, Artificial
  CRISPR gRNA sequence
tgcggagccttgctaccaga

SEQ ID NO: 758936 - DNA, 20 bp, Artificial
  CRISPR gRNA sequence
gcggagccttgctaccagaa

SEQ ID NO: 758937 - DNA, 20 bp, Artificial
  CRISPR gRNA sequence
cggagccttgctaccagaag

SEQ ID NO: 758938 - DNA, 20 bp, Artificial
  CRISPR gRNA sequence
gccttgctaccagaaggggc

SEQ ID NO: 758939 - DNA, 20 bp, Artificial
  CRISPR gRNA sequence
gctaccagaaggggccagca

SEQ ID NO: 758940 - DNA, 20 bp, Artificial
  CRISPR gRNA sequence
agaaggggccagcatagacc

SEQ ID NO: 758941 - DNA, 20 bp, Artificial
  CRISPR gRNA sequence
aaggggccagcatagaccaa

SEQ ID NO: 758942 - DNA, 20 bp, Artificial
  CRISPR gRNA sequence
gggccagcatagaccaagag

SEQ ID NO: 758943 - DNA, 20 bp, Artificial
  CRISPR gRNA sequence
ggccagcatagaccaagaga

SEQ ID NO: 758944 - DNA, 20 bp, Artificial
  CRISPR gRNA sequence
gccagcatagaccaagagaa

SEQ ID NO: 758945 - DNA, 20 bp, Artificial
  CRISPR gRNA sequence
agaccaagagaagggcactg

SEQ ID NO: 758946 - DNA, 20 bp, Artificial
  CRISPR gRNA sequence
gagaagggcactgtagaata

SEQ ID NO: 758947 - DNA, 20 bp, Artificial
  CRISPR gRNA sequence
agaagggcactgtagaataa

SEQ ID NO: 758948 - DNA, 20 bp, Artificial
  CRISPR gRNA sequence
gcactgtagaataaaggaca

SEQ ID NO: 758949 - DNA, 20 bp, Artificial
  CRISPR gRNA sequence
actgtagaataaaggacatg

SEQ ID NO: 758950 - DNA, 20 bp, Artificial
  CRISPR gRNA sequence
tggagcaaaataactgtgtt

SEQ ID NO: 758951 - DNA, 20 bp, Artificial
  CRISPR gRNA sequence
caaaataactgtgttaagac

SEQ ID NO: 758952 - DNA, 20 bp, Artificial
  CRISPR gRNA sequence
tgtgttaagactagctacca

SEQ ID NO: 758953 - DNA, 20 bp, Artificial
  CRISPR gRNA sequence
ttaagactagctaccaaaga

SEQ ID NO: 758954 - DNA, 20 bp, Artificial
  CRISPR gRNA sequence
aagactagctaccaaagacg

SEQ ID NO: 758955 - DNA, 20 bp, Artificial
  CRISPR gRNA sequence
aaagacggagacgatctgct

SEQ ID NO: 758956 - DNA, 20 bp, Artificial
  CRISPR gRNA sequence
attgaatttgcctctttgtc

SEQ ID NO: 758957 - DNA, 20 bp, Artificial
  CRISPR gRNA sequence
ttgaatttgcctctttgtca

SEQ ID NO: 758958 - DNA, 20 bp, Artificial
  CRISPR gRNA sequence
atttgcctctttgtcaagga

SEQ ID NO: 758959 - DNA, 20 bp, Artificial
  CRISPR gRNA sequence
tgcctctttgtcaaggaaag

SEQ ID NO: 758960 - DNA, 20 bp, Artificial
  CRISPR gRNA sequence
gcctctttgtcaaggaaaga

SEQ ID NO: 758961 - DNA, 20 bp, Artificial
  CRISPR gRNA sequence
ctctttgtcaaggaaagaag

SEQ ID NO: 758962 - DNA, 20 bp, Artificial
  CRISPR gRNA sequence
tttgtcaaggaaagaaggag

SEQ ID NO: 758963 - DNA, 20 bp, Artificial
  CRISPR gRNA sequence
gtcaaggaaagaaggagcag

SEQ ID NO: 758964 - DNA, 20 bp, Artificial
  CRISPR gRNA sequence
aagaaggagcagaagatgtt

SEQ ID NO: 758965 - DNA, 20 bp, Artificial
  CRISPR gRNA sequence
aaggagcagaagatgttaag

SEQ ID NO: 758966 - DNA, 20 bp, Artificial
  CRISPR gRNA sequence
aggagcagaagatgttaaga

SEQ ID NO: 758967 - DNA, 20 bp, Artificial
  CRISPR gRNA sequence
aagatgttaagaaggaattg

SEQ ID NO: 758968 - DNA, 20 bp, Artificial
  CRISPR gRNA sequence
gttaagaaggaattgaagtt

SEQ ID NO: 758969 - DNA, 20 bp, Artificial
  CRISPR gRNA sequence
ttaagaaggaattgaagttt

SEQ ID NO: 758970 - DNA, 20 bp, Artificial
  CRISPR gRNA sequence
gaattgaagtttaggccata

SEQ ID NO: 758971 - DNA, 20 bp, Artificial
  CRISPR gRNA sequence
aattgaagtttaggccatac

SEQ ID NO: 758972 - DNA, 20 bp, Artificial
  CRISPR gRNA sequence
attgaagtttaggccatacg

SEQ ID NO: 758973 - DNA, 20 bp, Artificial
  CRISPR gRNA sequence
tgaagtttaggccatacggg

SEQ ID NO: 758974 - DNA, 20 bp, Artificial
  CRISPR gRNA sequence
gaagtttaggccatacgggg

SEQ ID NO: 758975 - DNA, 20 bp, Artificial
  CRISPR gRNA sequence
ttttaactgtatttgtcttc

SEQ ID NO: 758976 - DNA, 20 bp, Artificial
  CRISPR gRNA sequence
tgtatttgtcttctggcccc

SEQ ID NO: 758977 - DNA, 20 bp, Artificial
  CRISPR gRNA sequence
gtatttgtcttctggcccct

SEQ ID NO: 758978 - DNA, 20 bp, Artificial
  CRISPR gRNA sequence
gcccctgggattgcctgtcc

SEQ ID NO: 758979 - DNA, 20 bp, Artificial
  CRISPR gRNA sequence
tgggattgcctgtcctggtg

SEQ ID NO: 758980 - DNA, 20 bp, Artificial
  CRISPR gRNA sequence
gggattgcctgtcctggtgt

SEQ ID NO: 758981 - DNA, 20 bp, Artificial
  CRISPR gRNA sequence
ggattgcctgtcctggtgtg

SEQ ID NO: 758982 - DNA, 20 bp, Artificial
  CRISPR gRNA sequence
gtcctggtgtggggtgaact

SEQ ID NO: 758983 - DNA, 20 bp, Artificial
  CRISPR gRNA sequence
cctggtgtggggtgaacttg

SEQ ID NO: 758984 - DNA, 20 bp, Artificial
  CRISPR gRNA sequence
gtgtggggtgaacttggaga

SEQ ID NO: 758985 - DNA, 20 bp, Artificial
  CRISPR gRNA sequence
aacttggagacagaatctct

SEQ ID NO: 758986 - DNA, 20 bp, Artificial
  CRISPR gRNA sequence
ttggagacagaatctctgag

SEQ ID NO: 758987 - DNA, 20 bp, Artificial
  CRISPR gRNA sequence
cagaatctctgagaagctgt

SEQ ID NO: 758988 - DNA, 20 bp, Artificial
  CRISPR gRNA sequence
agaatctctgagaagctgtc

SEQ ID NO: 758989 - DNA, 20 bp, Artificial
  CRISPR gRNA sequence
gaatctctgagaagctgtca

SEQ ID NO: 758990 - DNA, 20 bp, Artificial
  CRISPR gRNA sequence
agaagctgtcagggatattt

SEQ ID NO: 758991 - DNA, 20 bp, Artificial
  CRISPR gRNA sequence
gaagctgtcagggatatttc

SEQ ID NO: 758992 - DNA, 20 bp, Artificial
  CRISPR gRNA sequence
ctgtcagggatatttcaggc

SEQ ID NO: 758993 - DNA, 20 bp, Artificial
  CRISPR gRNA sequence
agggatatttcaggccagtc

SEQ ID NO: 758994 - DNA, 20 bp, Artificial
  CRISPR gRNA sequence
gggatatttcaggccagtct

SEQ ID NO: 758995 - DNA, 20 bp, Artificial
  CRISPR gRNA sequence
ggatatttcaggccagtcta

SEQ ID NO: 758996 - DNA, 20 bp, Artificial
  CRISPR gRNA sequence
tatttcaggccagtctaggg

SEQ ID NO: 758997 - DNA, 20 bp, Artificial
  CRISPR gRNA sequence
ttcaggccagtctagggtag

SEQ ID NO: 758998 - DNA, 20 bp, Artificial
  CRISPR gRNA sequence
caggccagtctagggtagaa

SEQ ID NO: 758999 - DNA, 20 bp, Artificial
  CRISPR gRNA sequence
aggccagtctagggtagaag

SEQ ID NO: 759000 - DNA, 20 bp, Artificial
  CRISPR gRNA sequence
ggccagtctagggtagaaga

SEQ ID NO: 759001 - DNA, 20 bp, Artificial
  CRISPR gRNA sequence
agtctagggtagaagagggt

SEQ ID NO: 759002 - DNA, 20 bp, Artificial
  CRISPR gRNA sequence
gtagaagagggttggacacg

SEQ ID NO: 759003 - DNA, 20 bp, Artificial
  CRISPR gRNA sequence
tagaagagggttggacacgt

SEQ ID NO: 759004 - DNA, 20 bp, Artificial
  CRISPR gRNA sequence
agggttggacacgtgggtca

SEQ ID NO: 759005 - DNA, 20 bp, Artificial
  CRISPR gRNA sequence
acgtgggtcacagtattcca

SEQ ID NO: 759006 - DNA, 20 bp, Artificial
  CRISPR gRNA sequence
ccacagtttcctgctgtgca

SEQ ID NO: 759007 - DNA, 20 bp, Artificial
  CRISPR gRNA sequence
gctgtgcacagattcaatcc

SEQ ID NO: 759008 - DNA, 20 bp, Artificial
  CRISPR gRNA sequence
cctcccttgcctcctctcct

SEQ ID NO: 759009 - DNA, 20 bp, Artificial
  CRISPR gRNA sequence
ttgcctcctctcctgagtct

SEQ ID NO: 759010 - DNA, 20 bp, Artificial
  CRISPR gRNA sequence
tcctgagtctcagcctctcc

SEQ ID NO: 759011 - DNA, 20 bp, Artificial
  CRISPR gRNA sequence
ctgagtctcagcctctcctg

SEQ ID NO: 759012 - DNA, 20 bp, Artificial
  CRISPR gRNA sequence
ctcctggagtcccatcttcc

SEQ ID NO: 759013 - DNA, 20 bp, Artificial
  CRISPR gRNA sequence
catcttcccagaatatgctg

SEQ ID NO: 759014 - DNA, 20 bp, Artificial
  CRISPR gRNA sequence
tttcatgctgtcccctccgc

SEQ ID NO: 759015 - DNA, 20 bp, Artificial
  CRISPR gRNA sequence
atgctgtcccctccgccaga

SEQ ID NO: 759016 - DNA, 20 bp, Artificial
  CRISPR gRNA sequence
gtcccctccgccagatagcc

SEQ ID NO: 759017 - DNA, 20 bp, Artificial
  CRISPR gRNA sequence
gagatgtctcctcctctgtg

SEQ ID NO: 759018 - DNA, 20 bp, Artificial
  CRISPR gRNA sequence
tcctctgtgcagtccttact

SEQ ID NO: 759019 - DNA, 20 bp, Artificial
  CRISPR gRNA sequence
cagtccttactgagcctccc

SEQ ID NO: 759020 - DNA, 20 bp, Artificial
  CRISPR gRNA sequence
tactgagcctccccagcccc

SEQ ID NO: 759021 - DNA, 20 bp, Artificial
  CRISPR gRNA sequence
cctccccagcccccagtgaa

SEQ ID NO: 759022 - DNA, 20 bp, Artificial
  CRISPR gRNA sequence
aatggcttgaccctttcatc

SEQ ID NO: 759023 - DNA, 20 bp, Artificial
  CRISPR gRNA sequence
atggcttgaccctttcatcc

SEQ ID NO: 759024 - DNA, 20 bp, Artificial
  CRISPR gRNA sequence
tgaccctttcatccaggttt

SEQ ID NO: 759025 - DNA, 20 bp, Artificial
  CRISPR gRNA sequence
ataaatgtgtaccaaaaaac

SEQ ID NO: 759026 - DNA, 20 bp, Artificial
  CRISPR gRNA sequence
ctatttttaatatgaaaatg

SEQ ID NO: 759027 - DNA, 20 bp, Artificial
  CRISPR gRNA sequence
tatttttaatatgaaaatgt

SEQ ID NO: 759028 - DNA, 20 bp, Artificial
  CRISPR gRNA sequence
gggattttaaatatgccatt

SEQ ID NO: 759029 - DNA, 20 bp, Artificial
  CRISPR gRNA sequence
attttaaatatgccatttag

SEQ ID NO: 759030 - DNA, 20 bp, Artificial
  CRISPR gRNA sequence
tttagcagctctgtaatctt

SEQ ID NO: 759031 - DNA, 20 bp, Artificial
  CRISPR gRNA sequence
gcagctctgtaatcttgagc

SEQ ID NO: 759032 - DNA, 20 bp, Artificial
  CRISPR gRNA sequence
ccatccctgaatttactcct

SEQ ID NO: 759033 - DNA, 20 bp, Artificial
  CRISPR gRNA sequence
gaatttactcctcggtgaaa

SEQ ID NO: 759034 - DNA, 20 bp, Artificial
  CRISPR gRNA sequence
aatttactcctcggtgaaat

SEQ ID NO: 759035 - DNA, 20 bp, Artificial
  CRISPR gRNA sequence
tcggtgaaataggataataa

SEQ ID NO: 759036 - DNA, 20 bp, Artificial
  CRISPR gRNA sequence
taataatagtacctacttca

SEQ ID NO: 759037 - DNA, 20 bp, Artificial
  CRISPR gRNA sequence
tacctacttcacagaattgt

SEQ ID NO: 759038 - DNA, 20 bp, Artificial
  CRISPR gRNA sequence
acctacttcacagaattgtt

SEQ ID NO: 759039 - DNA, 20 bp, Artificial
  CRISPR gRNA sequence
tacttcacagaattgttggg

SEQ ID NO: 759040 - DNA, 20 bp, Artificial
  CRISPR gRNA sequence
aattgttgggaagcttaaat

SEQ ID NO: 759041 - DNA, 20 bp, Artificial
  CRISPR gRNA sequence
aaatgagttaatatgtgtaa

SEQ ID NO: 759042 - DNA, 20 bp, Artificial
  CRISPR gRNA sequence
ttaatatgtgtaaaagcatt

SEQ ID NO: 759043 - DNA, 20 bp, Artificial
  CRISPR gRNA sequence
atgtgtaaaagcatttagaa

SEQ ID NO: 759044 - DNA, 20 bp, Artificial
  CRISPR gRNA sequence
gtgtaaaagcatttagaaca

SEQ ID NO: 759045 - DNA, 20 bp, Artificial
  CRISPR gRNA sequence
aaagcatttagaacagagcc

SEQ ID NO: 759046 - DNA, 20 bp, Artificial
  CRISPR gRNA sequence
ttagaacagagcctggtgca

SEQ ID NO: 759047 - DNA, 20 bp, Artificial
  CRISPR gRNA sequence
tgcatggctttcaacaaaac

SEQ ID NO: 759048 - DNA, 20 bp, Artificial
  CRISPR gRNA sequence
atgttattattatttgataa

SEQ ID NO: 759049 - DNA, 20 bp, Artificial
  CRISPR gRNA sequence
gcaaaataatatatataaca

SEQ ID NO: 759050 - DNA, 20 bp, Artificial
  CRISPR gRNA sequence
caaaataatatatataacat

SEQ ID NO: 759051 - DNA, 20 bp, Artificial
  CRISPR gRNA sequence
tataacatgggtaacttttg

SEQ ID NO: 759052 - DNA, 20 bp, Artificial
  CRISPR gRNA sequence
ataaacatacctcccaactt

SEQ ID NO: 759053 - DNA, 20 bp, Artificial
  CRISPR gRNA sequence
atacctcccaacttgagaat

SEQ ID NO: 759054 - DNA, 20 bp, Artificial
  CRISPR gRNA sequence
cttgagaatgagaacccctg

SEQ ID NO: 759055 - DNA, 20 bp, Artificial
  CRISPR gRNA sequence
ctccattcatattgcatgca

SEQ ID NO: 759056 - DNA, 20 bp, Artificial
  CRISPR gRNA sequence
ttgcatgcatggccaatgcc

SEQ ID NO: 759057 - DNA, 20 bp, Artificial
  CRISPR gRNA sequence
catggccaatgcctggcatg

SEQ ID NO: 759058 - DNA, 20 bp, Artificial
  CRISPR gRNA sequence
ctggcatgtggatcatgaat

SEQ ID NO: 759059 - DNA, 20 bp, Artificial
  CRISPR gRNA sequence
atgaataaatgaacaaatgc

SEQ ID NO: 759060 - DNA, 20 bp, Artificial
  CRISPR gRNA sequence
aataaatgaacaaatgccag

SEQ ID NO: 759061 - DNA, 20 bp, Artificial
  CRISPR gRNA sequence
gaacaaatgccagaagactt

SEQ ID NO: 759062 - DNA, 20 bp, Artificial
  CRISPR gRNA sequence
aaatgccagaagacttgaga

SEQ ID NO: 759063 - DNA, 20 bp, Artificial
  CRISPR gRNA sequence
aatgccagaagacttgagac

SEQ ID NO: 759064 - DNA, 20 bp, Artificial
  CRISPR gRNA sequence
atgccagaagacttgagaca

SEQ ID NO: 759065 - DNA, 20 bp, Artificial
  CRISPR gRNA sequence
acttgagacagggaaataac

SEQ ID NO: 759066 - DNA, 20 bp, Artificial
  CRISPR gRNA sequence
cagggaaataaccagtttta

SEQ ID NO: 759067 - DNA, 20 bp, Artificial
  CRISPR gRNA sequence
agggaaataaccagttttat

SEQ ID NO: 759068 - DNA, 20 bp, Artificial
  CRISPR gRNA sequence
gggaaataaccagttttatg

SEQ ID NO: 759069 - DNA, 20 bp, Artificial
  CRISPR gRNA sequence
aaataaccagttttatgggg

SEQ ID NO: 759070 - DNA, 20 bp, Artificial
  CRISPR gRNA sequence
aaccagttttatggggaaga

SEQ ID NO: 759071 - DNA, 20 bp, Artificial
  CRISPR gRNA sequence
cagttttatggggaagatgg

SEQ ID NO: 759072 - DNA, 20 bp, Artificial
  CRISPR gRNA sequence
atggggaagatggtagatta

SEQ ID NO: 759073 - DNA, 20 bp, Artificial
  CRISPR gRNA sequence
tggggaagatggtagattat

SEQ ID NO: 759074 - DNA, 20 bp, Artificial
  CRISPR gRNA sequence
atggtagattatgggaacaa

SEQ ID NO: 759075 - DNA, 20 bp, Artificial
  CRISPR gRNA sequence
cttgttcttaatccttgaca

SEQ ID NO: 759076 - DNA, 20 bp, Artificial
  CRISPR gRNA sequence
cttaatccttgacaaagtcc

SEQ ID NO: 759077 - DNA, 20 bp, Artificial
  CRISPR gRNA sequence
gacaaagtcctggaaccaat

SEQ ID NO: 759078 - DNA, 20 bp, Artificial
  CRISPR gRNA sequence
ctggaaccaatgagcacttg

SEQ ID NO: 759079 - DNA, 20 bp, Artificial
  CRISPR gRNA sequence
gaaccaatgagcacttgaag

SEQ ID NO: 759080 - DNA, 20 bp, Artificial
  CRISPR gRNA sequence
accaatgagcacttgaagaa

SEQ ID NO: 759081 - DNA, 20 bp, Artificial
  CRISPR gRNA sequence
gcacttgaagaagagcccac

SEQ ID NO: 759082 - DNA, 20 bp, Artificial
  CRISPR gRNA sequence
cttgaagaagagcccactag

SEQ ID NO: 759083 - DNA, 20 bp, Artificial
  CRISPR gRNA sequence
ttgaagaagagcccactagt

SEQ ID NO: 759084 - DNA, 20 bp, Artificial
  CRISPR gRNA sequence
cccactagtaggcacttgca

SEQ ID NO: 759085 - DNA, 20 bp, Artificial
  CRISPR gRNA sequence
aggcacttgcatggcttcac

SEQ ID NO: 759086 - DNA, 20 bp, Artificial
  CRISPR gRNA sequence
ggcacttgcatggcttcact

SEQ ID NO: 759087 - DNA, 20 bp, Artificial
  CRISPR gRNA sequence
gcacttgcatggcttcactg

SEQ ID NO: 759088 - DNA, 20 bp, Artificial
  CRISPR gRNA sequence
cttcttttcttgttcttctc

SEQ ID NO: 759089 - DNA, 20 bp, Artificial
  CRISPR gRNA sequence
cttgttcttctccagttgat

SEQ ID NO: 759090 - DNA, 20 bp, Artificial
  CRISPR gRNA sequence
ttctccagttgattggtccc

SEQ ID NO: 759091 - DNA, 20 bp, Artificial
  CRISPR gRNA sequence
ccagttgattggtccccagc

SEQ ID NO: 759092 - DNA, 20 bp, Artificial
  CRISPR gRNA sequence
gttgattggtccccagccag

SEQ ID NO: 759093 - DNA, 20 bp, Artificial
  CRISPR gRNA sequence
gattggtccccagccagaag

SEQ ID NO: 759094 - DNA, 20 bp, Artificial
  CRISPR gRNA sequence
gtccccagccagaagcagtg

SEQ ID NO: 759095 - DNA, 20 bp, Artificial
  CRISPR gRNA sequence
agcagtgaagcttctcatga

SEQ ID NO: 759096 - DNA, 20 bp, Artificial
  CRISPR gRNA sequence
gaagcttctcatgacagccc

SEQ ID NO: 759097 - DNA, 20 bp, Artificial
  CRISPR gRNA sequence
aagcttctcatgacagccct

SEQ ID NO: 759098 - DNA, 20 bp, Artificial
  CRISPR gRNA sequence
agcttctcatgacagccctg

SEQ ID NO: 759099 - DNA, 20 bp, Artificial
  CRISPR gRNA sequence
ctcatgacagccctggggat

SEQ ID NO: 759100 - DNA, 20 bp, Artificial
  CRISPR gRNA sequence
tgacagccctggggatgaga

SEQ ID NO: 759101 - DNA, 20 bp, Artificial
  CRISPR gRNA sequence
gacagccctggggatgagat

SEQ ID NO: 759102 - DNA, 20 bp, Artificial
  CRISPR gRNA sequence
agccctggggatgagatggg

SEQ ID NO: 759103 - DNA, 20 bp, Artificial
  CRISPR gRNA sequence
ctggggatgagatgggtaga

SEQ ID NO: 759104 - DNA, 20 bp, Artificial
  CRISPR gRNA sequence
tggggatgagatgggtagat

SEQ ID NO: 759105 - DNA, 20 bp, Artificial
  CRISPR gRNA sequence
gggatgagatgggtagatgg

SEQ ID NO: 759106 - DNA, 20 bp, Artificial
  CRISPR gRNA sequence
tgagatgggtagatgggagc

SEQ ID NO: 759107 - DNA, 20 bp, Artificial
  CRISPR gRNA sequence
gagatgggtagatgggagct

SEQ ID NO: 759108 - DNA, 20 bp, Artificial
  CRISPR gRNA sequence
atgggtagatgggagctggg

SEQ ID NO: 759109 - DNA, 20 bp, Artificial
  CRISPR gRNA sequence
ggtagatgggagctgggtag

SEQ ID NO: 759110 - DNA, 20 bp, Artificial
  CRISPR gRNA sequence
atgggagctgggtagcagca

SEQ ID NO: 759111 - DNA, 20 bp, Artificial
  CRISPR gRNA sequence
tgggagctgggtagcagcac

SEQ ID NO: 759112 - DNA, 20 bp, Artificial
  CRISPR gRNA sequence
gagctgggtagcagcacagg

SEQ ID NO: 759113 - DNA, 20 bp, Artificial
  CRISPR gRNA sequence
agctgggtagcagcacaggt

SEQ ID NO: 759114 - DNA, 20 bp, Artificial
  CRISPR gRNA sequence
ggtaggaacactcctaaccc

SEQ ID NO: 759115 - DNA, 20 bp, Artificial
  CRISPR gRNA sequence
cctaaccccggtgtactgaa

SEQ ID NO: 759116 - DNA, 20 bp, Artificial
  CRISPR gRNA sequence
aaccccggtgtactgaatgg

SEQ ID NO: 759117 - DNA, 20 bp, Artificial
  CRISPR gRNA sequence
ccggtgtactgaatggtgga

SEQ ID NO: 759118 - DNA, 20 bp, Artificial
  CRISPR gRNA sequence
gtggatggacattgatcatc

SEQ ID NO: 759119 - DNA, 20 bp, Artificial
  CRISPR gRNA sequence
tggatggacattgatcatcc

SEQ ID NO: 759120 - DNA, 20 bp, Artificial
  CRISPR gRNA sequence
ggatggacattgatcatcca

SEQ ID NO: 759121 - DNA, 20 bp, Artificial
  CRISPR gRNA sequence
ggacattgatcatccaggga

SEQ ID NO: 759122 - DNA, 20 bp, Artificial
  CRISPR gRNA sequence
attgatcatccagggacaga

SEQ ID NO: 759123 - DNA, 20 bp, Artificial
  CRISPR gRNA sequence
tccagggacagatggtgctg

SEQ ID NO: 759124 - DNA, 20 bp, Artificial
  CRISPR gRNA sequence
ccagggacagatggtgctgt

SEQ ID NO: 759125 - DNA, 20 bp, Artificial
  CRISPR gRNA sequence
cctattcctgtcctctccct

SEQ ID NO: 759126 - DNA, 20 bp, Artificial
  CRISPR gRNA sequence
ctattcctgtcctctccctg

SEQ ID NO: 759127 - DNA, 20 bp, Artificial
  CRISPR gRNA sequence
ctgaggaccttgatgacacc

SEQ ID NO: 759128 - DNA, 20 bp, Artificial
  CRISPR gRNA sequence
ccttgatgacacccagacac

SEQ ID NO: 759129 - DNA, 20 bp, Artificial
  CRISPR gRNA sequence
tgatgacacccagacaccag

SEQ ID NO: 759130 - DNA, 20 bp, Artificial
  CRISPR gRNA sequence
atgacacccagacaccagca

SEQ ID NO: 759131 - DNA, 20 bp, Artificial
  CRISPR gRNA sequence
gacacccagacaccagcaga

SEQ ID NO: 759132 - DNA, 20 bp, Artificial
  CRISPR gRNA sequence
cacccagacaccagcagaga

SEQ ID NO: 759133 - DNA, 20 bp, Artificial
  CRISPR gRNA sequence
acccagacaccagcagagag

SEQ ID NO: 759134 - DNA, 20 bp, Artificial
  CRISPR gRNA sequence
ccagacaccagcagagagag

SEQ ID NO: 759135 - DNA, 20 bp, Artificial
  CRISPR gRNA sequence
agacaccagcagagagagga

SEQ ID NO: 759136 - DNA, 20 bp, Artificial
  CRISPR gRNA sequence
agagaggagagtaacctttt

SEQ ID NO: 759137 - DNA, 20 bp, Artificial
  CRISPR gRNA sequence
taatccaccaacaaattatt

SEQ ID NO: 759138 - DNA, 20 bp, Artificial
  CRISPR gRNA sequence
attgagcattgtctatgcac

SEQ ID NO: 759139 - DNA, 20 bp, Artificial
  CRISPR gRNA sequence
gcattgtctatgcaccagaa

SEQ ID NO: 759140 - DNA, 20 bp, Artificial
  CRISPR gRNA sequence
ctatgcaccagaacagtcaa

SEQ ID NO: 759141 - DNA, 20 bp, Artificial
  CRISPR gRNA sequence
atgcaccagaacagtcaaaa

SEQ ID NO: 759142 - DNA, 20 bp, Artificial
  CRISPR gRNA sequence
cagtcaaaagagtacttcaa

SEQ ID NO: 759143 - DNA, 20 bp, Artificial
  CRISPR gRNA sequence
agtacttcaaaagatcacga

SEQ ID NO: 759144 - DNA, 20 bp, Artificial
  CRISPR gRNA sequence
gtacttcaaaagatcacgac

SEQ ID NO: 759145 - DNA, 20 bp, Artificial
  CRISPR gRNA sequence
tacttcaaaagatcacgaca

SEQ ID NO: 759146 - DNA, 20 bp, Artificial
  CRISPR gRNA sequence
aagatcacgacagggttaca

SEQ ID NO: 759147 - DNA, 20 bp, Artificial
  CRISPR gRNA sequence
gttacacagcattgtaaata

SEQ ID NO: 759148 - DNA, 20 bp, Artificial
  CRISPR gRNA sequence
ccgacttatacacttaaacc

SEQ ID NO: 759149 - DNA, 20 bp, Artificial
  CRISPR gRNA sequence
acacttaaacctggataaaa

SEQ ID NO: 759150 - DNA, 20 bp, Artificial
  CRISPR gRNA sequence
caacaatgaaaaaaatgttg

SEQ ID NO: 759151 - DNA, 20 bp, Artificial
  CRISPR gRNA sequence
caatgaaaaaaatgttgtgg

SEQ ID NO: 759152 - DNA, 20 bp, Artificial
  CRISPR gRNA sequence
gaaaaaaatgttgtggcagt

SEQ ID NO: 759153 - DNA, 20 bp, Artificial
  CRISPR gRNA sequence
aaaaaatgttgtggcagttg

SEQ ID NO: 759154 - DNA, 20 bp, Artificial
  CRISPR gRNA sequence
aaaaatgttgtggcagttgg

SEQ ID NO: 759155 - DNA, 20 bp, Artificial
  CRISPR gRNA sequence
tgttgtggcagttggaggaa

SEQ ID NO: 759156 - DNA, 20 bp, Artificial
  CRISPR gRNA sequence
ggcagttggaggaatggact

SEQ ID NO: 759157 - DNA, 20 bp, Artificial
  CRISPR gRNA sequence
aggaatggactcagtttaac

SEQ ID NO: 759158 - DNA, 20 bp, Artificial
  CRISPR gRNA sequence
ggaatggactcagtttaact

SEQ ID NO: 759159 - DNA, 20 bp, Artificial
  CRISPR gRNA sequence
ctcagtttaactgggtgaaa

SEQ ID NO: 759160 - DNA, 20 bp, Artificial
  CRISPR gRNA sequence
tttaactgggtgaaatggaa

SEQ ID NO: 759161 - DNA, 20 bp, Artificial
  CRISPR gRNA sequence
ctccccattctgaactccat

SEQ ID NO: 759162 - DNA, 20 bp, Artificial
  CRISPR gRNA sequence
cccattctgaactccatcag

SEQ ID NO: 759163 - DNA, 20 bp, Artificial
  CRISPR gRNA sequence
cattctgaactccatcagaa

SEQ ID NO: 759164 - DNA, 20 bp, Artificial
  CRISPR gRNA sequence
attctgaactccatcagaag

SEQ ID NO: 759165 - DNA, 20 bp, Artificial
  CRISPR gRNA sequence
tgaactccatcagaagagga

SEQ ID NO: 759166 - DNA, 20 bp, Artificial
  CRISPR gRNA sequence
actccatcagaagaggatgg

SEQ ID NO: 759167 - DNA, 20 bp, Artificial
  CRISPR gRNA sequence
tccatcagaagaggatggca

SEQ ID NO: 759168 - DNA, 20 bp, Artificial
  CRISPR gRNA sequence
ccatcagaagaggatggcag

SEQ ID NO: 759169 - DNA, 20 bp, Artificial
  CRISPR gRNA sequence
agaagaggatggcagaggtg

SEQ ID NO: 759170 - DNA, 20 bp, Artificial
  CRISPR gRNA sequence
aggatggcagaggtgtggat

SEQ ID NO: 759171 - DNA, 20 bp, Artificial
  CRISPR gRNA sequence
atggcagaggtgtggattag

SEQ ID NO: 759172 - DNA, 20 bp, Artificial
  CRISPR gRNA sequence
aggtgtggattagcagcaat

SEQ ID NO: 759173 - DNA, 20 bp, Artificial
  CRISPR gRNA sequence
ggattagcagcaatgagtgt

SEQ ID NO: 759174 - DNA, 20 bp, Artificial
  CRISPR gRNA sequence
tgagtgtgagtgacttctga

SEQ ID NO: 759175 - DNA, 20 bp, Artificial
  CRISPR gRNA sequence
tgtgagtgacttctgatggt

SEQ ID NO: 759176 - DNA, 20 bp, Artificial
  CRISPR gRNA sequence
tgacttctgatggttggcta

SEQ ID NO: 759177 - DNA, 20 bp, Artificial
  CRISPR gRNA sequence
atggttggctacagatttga

SEQ ID NO: 759178 - DNA, 20 bp, Artificial
  CRISPR gRNA sequence
gatttgatagtctgttattt

SEQ ID NO: 759179 - DNA, 20 bp, Artificial
  CRISPR gRNA sequence
atttgatagtctgttatttt

SEQ ID NO: 759180 - DNA, 20 bp, Artificial
  CRISPR gRNA sequence
tctgttattttgggttattt

SEQ ID NO: 759181 - DNA, 20 bp, Artificial
  CRISPR gRNA sequence
ttttgggttattttggtgaa

SEQ ID NO: 759182 - DNA, 20 bp, Artificial
  CRISPR gRNA sequence
ttttggtgaatggtgtgaca

SEQ ID NO: 759183 - DNA, 20 bp, Artificial
  CRISPR gRNA sequence
ggtgtgacatggctgctcaa

SEQ ID NO: 759184 - DNA, 20 bp, Artificial
  CRISPR gRNA sequence
tgctcaatggtgacttcgtc

SEQ ID NO: 759185 - DNA, 20 bp, Artificial
  CRISPR gRNA sequence
gctcaatggtgacttcgtca

SEQ ID NO: 759186 - DNA, 20 bp, Artificial
  CRISPR gRNA sequence
caatggtgacttcgtcaagg

SEQ ID NO: 759187 - DNA, 20 bp, Artificial
  CRISPR gRNA sequence
caaggaagatcaaatacttg

SEQ ID NO: 759188 - DNA, 20 bp, Artificial
  CRISPR gRNA sequence
aaggaagatcaaatacttgc

SEQ ID NO: 759189 - DNA, 20 bp, Artificial
  CRISPR gRNA sequence
aggaagatcaaatacttgca

SEQ ID NO: 759190 - DNA, 20 bp, Artificial
  CRISPR gRNA sequence
aatacttgcagggctttgat

SEQ ID NO: 759191 - DNA, 20 bp, Artificial
  CRISPR gRNA sequence
atacttgcagggctttgata

SEQ ID NO: 759192 - DNA, 20 bp, Artificial
  CRISPR gRNA sequence
cttgcagggctttgataagg

SEQ ID NO: 759193 - DNA, 20 bp, Artificial
  CRISPR gRNA sequence
ttgcagggctttgataagga

SEQ ID NO: 759194 - DNA, 20 bp, Artificial
  CRISPR gRNA sequence
tgcagggctttgataaggaa

SEQ ID NO: 759195 - DNA, 20 bp, Artificial
  CRISPR gRNA sequence
gcagggctttgataaggaag

SEQ ID NO: 759196 - DNA, 20 bp, Artificial
  CRISPR gRNA sequence
cagggctttgataaggaagg

SEQ ID NO: 759197 - DNA, 20 bp, Artificial
  CRISPR gRNA sequence
ggctttgataaggaaggggg

SEQ ID NO: 759198 - DNA, 20 bp, Artificial
  CRISPR gRNA sequence
gggggcagactcattctgtg

SEQ ID NO: 759199 - DNA, 20 bp, Artificial
  CRISPR gRNA sequence
agactcattctgtgtggtcc

SEQ ID NO: 759200 - DNA, 20 bp, Artificial
  CRISPR gRNA sequence
gactcattctgtgtggtcca

SEQ ID NO: 759201 - DNA, 20 bp, Artificial
  CRISPR gRNA sequence
actcattctgtgtggtccaa

SEQ ID NO: 759202 - DNA, 20 bp, Artificial
  CRISPR gRNA sequence
ctcattctgtgtggtccaag

SEQ ID NO: 759203 - DNA, 20 bp, Artificial
  CRISPR gRNA sequence
tgtggtccaaggggtcacat

SEQ ID NO: 759204 - DNA, 20 bp, Artificial
  CRISPR gRNA sequence
gtggtccaaggggtcacatg

SEQ ID NO: 759205 - DNA, 20 bp, Artificial
  CRISPR gRNA sequence
gggtcacatgaggactgttg

SEQ ID NO: 759206 - DNA, 20 bp, Artificial
  CRISPR gRNA sequence
ggtcacatgaggactgttgt

SEQ ID NO: 759207 - DNA, 20 bp, Artificial
  CRISPR gRNA sequence
aggactgttgtgggctgtat

SEQ ID NO: 759208 - DNA, 20 bp, Artificial
  CRISPR gRNA sequence
ggactgttgtgggctgtatt

SEQ ID NO: 759209 - DNA, 20 bp, Artificial
  CRISPR gRNA sequence
actgttgtgggctgtattgg

SEQ ID NO: 759210 - DNA, 20 bp, Artificial
  CRISPR gRNA sequence
gctgtattgggagacaaatt

SEQ ID NO: 759211 - DNA, 20 bp, Artificial
  CRISPR gRNA sequence
ctgtattgggagacaaattt

SEQ ID NO: 759212 - DNA, 20 bp, Artificial
  CRISPR gRNA sequence
ttgggagacaaatttgggct

SEQ ID NO: 759213 - DNA, 20 bp, Artificial
  CRISPR gRNA sequence
gacaaatttgggctaagtat

SEQ ID NO: 759214 - DNA, 20 bp, Artificial
  CRISPR gRNA sequence
acaaatttgggctaagtata

SEQ ID NO: 759215 - DNA, 20 bp, Artificial
  CRISPR gRNA sequence
aatttgggctaagtataagg

SEQ ID NO: 759216 - DNA, 20 bp, Artificial
  CRISPR gRNA sequence
tttgggctaagtataaggta

SEQ ID NO: 759217 - DNA, 20 bp, Artificial
  CRISPR gRNA sequence
caccgatgaacgctgtccaa

SEQ ID NO: 759218 - DNA, 20 bp, Artificial
  CRISPR gRNA sequence
gatgaacgctgtccaaaagc

SEQ ID NO: 759219 - DNA, 20 bp, Artificial
  CRISPR gRNA sequence
gaacgctgtccaaaagcaag

SEQ ID NO: 759220 - DNA, 20 bp, Artificial
  CRISPR gRNA sequence
gctgtccaaaagcaagtgga

SEQ ID NO: 759221 - DNA, 20 bp, Artificial
  CRISPR gRNA sequence
aagcaagtggatagcccatg

SEQ ID NO: 759222 - DNA, 20 bp, Artificial
  CRISPR gRNA sequence
agcaagtggatagcccatgc

SEQ ID NO: 759223 - DNA, 20 bp, Artificial
  CRISPR gRNA sequence
tggatagcccatgcaggcca

SEQ ID NO: 759224 - DNA, 20 bp, Artificial
  CRISPR gRNA sequence
ggatagcccatgcaggccat

SEQ ID NO: 759225 - DNA, 20 bp, Artificial
  CRISPR gRNA sequence
caggccatgggtgcccatca

SEQ ID NO: 759226 - DNA, 20 bp, Artificial
  CRISPR gRNA sequence
aggccatgggtgcccatcac

SEQ ID NO: 759227 - DNA, 20 bp, Artificial
  CRISPR gRNA sequence
gccatgggtgcccatcacgg

SEQ ID NO: 759228 - DNA, 20 bp, Artificial
  CRISPR gRNA sequence
ccatgggtgcccatcacggg

SEQ ID NO: 759229 - DNA, 20 bp, Artificial
  CRISPR gRNA sequence
catgggtgcccatcacggga

SEQ ID NO: 759230 - DNA, 20 bp, Artificial
  CRISPR gRNA sequence
gcccatcacgggagggcaaa

SEQ ID NO: 759231 - DNA, 20 bp, Artificial
  CRISPR gRNA sequence
ccatcacgggagggcaaaca

SEQ ID NO: 759232 - DNA, 20 bp, Artificial
  CRISPR gRNA sequence
aaacagagattgtgtgtatg

SEQ ID NO: 759233 - DNA, 20 bp, Artificial
  CRISPR gRNA sequence
cagagattgtgtgtatgcgg

SEQ ID NO: 759234 - DNA, 20 bp, Artificial
  CRISPR gRNA sequence
agagattgtgtgtatgcggt

SEQ ID NO: 759235 - DNA, 20 bp, Artificial
  CRISPR gRNA sequence
gattgtgtgtatgcggtggg

SEQ ID NO: 759236 - DNA, 20 bp, Artificial
  CRISPR gRNA sequence
attgtgtgtatgcggtgggt

SEQ ID NO: 759237 - DNA, 20 bp, Artificial
  CRISPR gRNA sequence
ttgtgtgtatgcggtgggtg

SEQ ID NO: 759238 - DNA, 20 bp, Artificial
  CRISPR gRNA sequence
tgtgtgtatgcggtgggtgg

SEQ ID NO: 759239 - DNA, 20 bp, Artificial
  CRISPR gRNA sequence
gtgtgtatgcggtgggtggg

SEQ ID NO: 759240 - DNA, 20 bp, Artificial
  CRISPR gRNA sequence
gtgtatgcggtgggtggggg

SEQ ID NO: 759241 - DNA, 20 bp, Artificial
  CRISPR gRNA sequence
tgtatgcggtgggtgggggg

SEQ ID NO: 759242 - DNA, 20 bp, Artificial
  CRISPR gRNA sequence
gtatgcggtgggtgggggga

SEQ ID NO: 759243 - DNA, 20 bp, Artificial
  CRISPR gRNA sequence
tatgcggtgggtggggggag

SEQ ID NO: 759244 - DNA, 20 bp, Artificial
  CRISPR gRNA sequence
gcggtgggtggggggagggg

SEQ ID NO: 759245 - DNA, 20 bp, Artificial
  CRISPR gRNA sequence
cggtgggtggggggaggggc

SEQ ID NO: 759246 - DNA, 20 bp, Artificial
  CRISPR gRNA sequence
ggtgggtggggggaggggca

SEQ ID NO: 759247 - DNA, 20 bp, Artificial
  CRISPR gRNA sequence
ggtggggggaggggcaggga

SEQ ID NO: 759248 - DNA, 20 bp, Artificial
  CRISPR gRNA sequence
gtggggggaggggcagggaa

SEQ ID NO: 759249 - DNA, 20 bp, Artificial
  CRISPR gRNA sequence
tacttgatcattaatttctg

SEQ ID NO: 759250 - DNA, 20 bp, Artificial
  CRISPR gRNA sequence
attaatttctgcagtttccc

SEQ ID NO: 759251 - DNA, 20 bp, Artificial
  CRISPR gRNA sequence
ttccccagaatttgttctca

SEQ ID NO: 759252 - DNA, 20 bp, Artificial
  CRISPR gRNA sequence
tctcatggcatcatctccct

SEQ ID NO: 759253 - DNA, 20 bp, Artificial
  CRISPR gRNA sequence
tccctcagtgaccccacctt

SEQ ID NO: 759254 - DNA, 20 bp, Artificial
  CRISPR gRNA sequence
ctgccatgtccctctgttct

SEQ ID NO: 759255 - DNA, 20 bp, Artificial
  CRISPR gRNA sequence
tgtccctctgttctgagctg

SEQ ID NO: 759256 - DNA, 20 bp, Artificial
  CRISPR gRNA sequence
ctctgttctgagctgcagct

SEQ ID NO: 759257 - DNA, 20 bp, Artificial
  CRISPR gRNA sequence
gagctgcagctcagtgtgtc

SEQ ID NO: 759258 - DNA, 20 bp, Artificial
  CRISPR gRNA sequence
agctgcagctcagtgtgtct

SEQ ID NO: 759259 - DNA, 20 bp, Artificial
  CRISPR gRNA sequence
ctgcagctcagtgtgtctgg

SEQ ID NO: 759260 - DNA, 20 bp, Artificial
  CRISPR gRNA sequence
tcagtgtgtctgggagtcca

SEQ ID NO: 759261 - DNA, 20 bp, Artificial
  CRISPR gRNA sequence
cagtgtgtctgggagtccat

SEQ ID NO: 759262 - DNA, 20 bp, Artificial
  CRISPR gRNA sequence
tgggagtccataggacattt

SEQ ID NO: 759263 - DNA, 20 bp, Artificial
  CRISPR gRNA sequence
gtccataggacattttggtg

SEQ ID NO: 759264 - DNA, 20 bp, Artificial
  CRISPR gRNA sequence
attttggtgtggatgatcca

SEQ ID NO: 759265 - DNA, 20 bp, Artificial
  CRISPR gRNA sequence
ggtgtggatgatccatagtc

SEQ ID NO: 759266 - DNA, 20 bp, Artificial
  CRISPR gRNA sequence
ggatgatccatagtcgagct

SEQ ID NO: 759267 - DNA, 20 bp, Artificial
  CRISPR gRNA sequence
tgatccatagtcgagctcag

SEQ ID NO: 759268 - DNA, 20 bp, Artificial
  CRISPR gRNA sequence
gatccatagtcgagctcagt

SEQ ID NO: 759269 - DNA, 20 bp, Artificial
  CRISPR gRNA sequence
ccctccacgtgcttcatctc

SEQ ID NO: 759270 - DNA, 20 bp, Artificial
  CRISPR gRNA sequence
cctccacgtgcttcatctcc

SEQ ID NO: 759271 - DNA, 20 bp, Artificial
  CRISPR gRNA sequence
tccatgtttgcccattgctc

SEQ ID NO: 759272 - DNA, 20 bp, Artificial
  CRISPR gRNA sequence
ttgcccattgctcaagcctt

SEQ ID NO: 759273 - DNA, 20 bp, Artificial
  CRISPR gRNA sequence
cagtgccctcttgacacctt

SEQ ID NO: 759274 - DNA, 20 bp, Artificial
  CRISPR gRNA sequence
agcccctccctcaatacaaa

SEQ ID NO: 759275 - DNA, 20 bp, Artificial
  CRISPR gRNA sequence
cctcaatacaaacagtcccc

SEQ ID NO: 759276 - DNA, 20 bp, Artificial
  CRISPR gRNA sequence
atacaaacagtccccaagcc

SEQ ID NO: 759277 - DNA, 20 bp, Artificial
  CRISPR gRNA sequence
ctacccttgacatttgtcca

SEQ ID NO: 759278 - DNA, 20 bp, Artificial
  CRISPR gRNA sequence
ccttgacatttgtccaaagc

SEQ ID NO: 759279 - DNA, 20 bp, Artificial
  CRISPR gRNA sequence
cttgacatttgtccaaagct

SEQ ID NO: 759280 - DNA, 20 bp, Artificial
  CRISPR gRNA sequence
catttgtccaaagctgggct

SEQ ID NO: 759281 - DNA, 20 bp, Artificial
  CRISPR gRNA sequence
atttgtccaaagctgggctc

SEQ ID NO: 759282 - DNA, 20 bp, Artificial
  CRISPR gRNA sequence
agctgggctcaggcatcact

SEQ ID NO: 759283 - DNA, 20 bp, Artificial
  CRISPR gRNA sequence
catcactcggtgactctgat

SEQ ID NO: 759284 - DNA, 20 bp, Artificial
  CRISPR gRNA sequence
actcggtgactctgatgaga

SEQ ID NO: 759285 - DNA, 20 bp, Artificial
  CRISPR gRNA sequence
tagtctcctgttcgtatttt

SEQ ID NO: 759286 - DNA, 20 bp, Artificial
  CRISPR gRNA sequence
gtattttgagatacctattt

SEQ ID NO: 759287 - DNA, 20 bp, Artificial
  CRISPR gRNA sequence
tgagatacctattttagatg

SEQ ID NO: 759288 - DNA, 20 bp, Artificial
  CRISPR gRNA sequence
ttagatgtggtttccttttg

SEQ ID NO: 759289 - DNA, 20 bp, Artificial
  CRISPR gRNA sequence
tggtttccttttgtggctct

SEQ ID NO: 759290 - DNA, 20 bp, Artificial
  CRISPR gRNA sequence
tttccttttgtggctctgag

SEQ ID NO: 759291 - DNA, 20 bp, Artificial
  CRISPR gRNA sequence
ccttttgtggctctgagcag

SEQ ID NO: 759292 - DNA, 20 bp, Artificial
  CRISPR gRNA sequence
tgagcagtggcaatgctcat

SEQ ID NO: 759293 - DNA, 20 bp, Artificial
  CRISPR gRNA sequence
gagcagtggcaatgctcatc

SEQ ID NO: 759294 - DNA, 20 bp, Artificial
  CRISPR gRNA sequence
gtggcaatgctcatcgggta

SEQ ID NO: 759295 - DNA, 20 bp, Artificial
  CRISPR gRNA sequence
ggcaatgctcatcgggtacg

SEQ ID NO: 759296 - DNA, 20 bp, Artificial
  CRISPR gRNA sequence
atgctcatcgggtacggaga

SEQ ID NO: 759297 - DNA, 20 bp, Artificial
  CRISPR gRNA sequence
tgctcatcgggtacggagac

SEQ ID NO: 759298 - DNA, 20 bp, Artificial
  CRISPR gRNA sequence
gctcatcgggtacggagacg

SEQ ID NO: 759299 - DNA, 20 bp, Artificial
  CRISPR gRNA sequence
catcgggtacggagacgggg

SEQ ID NO: 759300 - DNA, 20 bp, Artificial
  CRISPR gRNA sequence
tcgggtacggagacggggaa

SEQ ID NO: 759301 - DNA, 20 bp, Artificial
  CRISPR gRNA sequence
ggtacggagacggggaagag

SEQ ID NO: 759302 - DNA, 20 bp, Artificial
  CRISPR gRNA sequence
gtacggagacggggaagaga

SEQ ID NO: 759303 - DNA, 20 bp, Artificial
  CRISPR gRNA sequence
acggagacggggaagagaag

SEQ ID NO: 759304 - DNA, 20 bp, Artificial
  CRISPR gRNA sequence
cggagacggggaagagaagg

SEQ ID NO: 759305 - DNA, 20 bp, Artificial
  CRISPR gRNA sequence
ggagacggggaagagaagga

SEQ ID NO: 759306 - DNA, 20 bp, Artificial
  CRISPR gRNA sequence
acggggaagagaaggaggga

SEQ ID NO: 759307 - DNA, 20 bp, Artificial
  CRISPR gRNA sequence
ggaagagaaggagggaaagt

SEQ ID NO: 759308 - DNA, 20 bp, Artificial
  CRISPR gRNA sequence
gaagagaaggagggaaagta

SEQ ID NO: 759309 - DNA, 20 bp, Artificial
  CRISPR gRNA sequence
aagagaaggagggaaagtaa

SEQ ID NO: 759310 - DNA, 20 bp, Artificial
  CRISPR gRNA sequence
agaaggagggaaagtaaggg

SEQ ID NO: 759311 - DNA, 20 bp, Artificial
  CRISPR gRNA sequence
gaaggagggaaagtaagggt

SEQ ID NO: 759312 - DNA, 20 bp, Artificial
  CRISPR gRNA sequence
gagggaaagtaagggtggga

SEQ ID NO: 759313 - DNA, 20 bp, Artificial
  CRISPR gRNA sequence
gtaagggtgggatggctcct

SEQ ID NO: 759314 - DNA, 20 bp, Artificial
  CRISPR gRNA sequence
gggtgggatggctccttagt

SEQ ID NO: 759315 - DNA, 20 bp, Artificial
  CRISPR gRNA sequence
ggatggctccttagttagtt

SEQ ID NO: 759316 - DNA, 20 bp, Artificial
  CRISPR gRNA sequence
ttagttagttcagatgctgt

SEQ ID NO: 759317 - DNA, 20 bp, Artificial
  CRISPR gRNA sequence
ttagttcagatgctgtaaga

SEQ ID NO: 759318 - DNA, 20 bp, Artificial
  CRISPR gRNA sequence
tagttcagatgctgtaagaa

SEQ ID NO: 759319 - DNA, 20 bp, Artificial
  CRISPR gRNA sequence
gctgtaagaaaggcccaaaa

SEQ ID NO: 759320 - DNA, 20 bp, Artificial
  CRISPR gRNA sequence
aaaatagcaatgacttatgc

SEQ ID NO: 759321 - DNA, 20 bp, Artificial
  CRISPR gRNA sequence
atagcaatgacttatgctgg

SEQ ID NO: 759322 - DNA, 20 bp, Artificial
  CRISPR gRNA sequence
agcaatgacttatgctggaa

SEQ ID NO: 759323 - DNA, 20 bp, Artificial
  CRISPR gRNA sequence
ttctcacccatgtgaccatc

SEQ ID NO: 759324 - DNA, 20 bp, Artificial
  CRISPR gRNA sequence
tctcacccatgtgaccatct

SEQ ID NO: 759325 - DNA, 20 bp, Artificial
  CRISPR gRNA sequence
tgtgaccatctgggtatatc

SEQ ID NO: 759326 - DNA, 20 bp, Artificial
  CRISPR gRNA sequence
gtgaccatctgggtatatcc

SEQ ID NO: 759327 - DNA, 20 bp, Artificial
  CRISPR gRNA sequence
tgaccatctgggtatatcca

SEQ ID NO: 759328 - DNA, 20 bp, Artificial
  CRISPR gRNA sequence
tatatccagggctgatacta

SEQ ID NO: 759329 - DNA, 20 bp, Artificial
  CRISPR gRNA sequence
gggctgatactacagtccct

SEQ ID NO: 759330 - DNA, 20 bp, Artificial
  CRISPR gRNA sequence
ggctgatactacagtccctc

SEQ ID NO: 759331 - DNA, 20 bp, Artificial
  CRISPR gRNA sequence
gctgatactacagtccctca

SEQ ID NO: 759332 - DNA, 20 bp, Artificial
  CRISPR gRNA sequence
gtctgctgctctgccgtcct

SEQ ID NO: 759333 - DNA, 20 bp, Artificial
  CRISPR gRNA sequence
tctgctgctctgccgtcctc

SEQ ID NO: 759334 - DNA, 20 bp, Artificial
  CRISPR gRNA sequence
ctgctgctctgccgtcctca

SEQ ID NO: 759335 - DNA, 20 bp, Artificial
  CRISPR gRNA sequence
cgtcctcagggtgttgcctt

SEQ ID NO: 759336 - DNA, 20 bp, Artificial
  CRISPR gRNA sequence
cctcagggtgttgcctttgg

SEQ ID NO: 759337 - DNA, 20 bp, Artificial
  CRISPR gRNA sequence
cacacaccacatctatgttc

SEQ ID NO: 759338 - DNA, 20 bp, Artificial
  CRISPR gRNA sequence
caccacatctatgttccagc

SEQ ID NO: 759339 - DNA, 20 bp, Artificial
  CRISPR gRNA sequence
cacatctatgttccagccag

SEQ ID NO: 759340 - DNA, 20 bp, Artificial
  CRISPR gRNA sequence
acatctatgttccagccagt

SEQ ID NO: 759341 - DNA, 20 bp, Artificial
  CRISPR gRNA sequence
tctatgttccagccagtggg

SEQ ID NO: 759342 - DNA, 20 bp, Artificial
  CRISPR gRNA sequence
ctatgttccagccagtggga

SEQ ID NO: 759343 - DNA, 20 bp, Artificial
  CRISPR gRNA sequence
tatgttccagccagtgggaa

SEQ ID NO: 759344 - DNA, 20 bp, Artificial
  CRISPR gRNA sequence
atgttccagccagtgggaag

SEQ ID NO: 759345 - DNA, 20 bp, Artificial
  CRISPR gRNA sequence
tgttccagccagtgggaagg

SEQ ID NO: 759346 - DNA, 20 bp, Artificial
  CRISPR gRNA sequence
ttccagccagtgggaagggg

SEQ ID NO: 759347 - DNA, 20 bp, Artificial
  CRISPR gRNA sequence
tccagccagtgggaaggggg

SEQ ID NO: 759348 - DNA, 20 bp, Artificial
  CRISPR gRNA sequence
ccagccagtgggaaggggga

SEQ ID NO: 759349 - DNA, 20 bp, Artificial
  CRISPR gRNA sequence
cagccagtgggaagggggag

SEQ ID NO: 759350 - DNA, 20 bp, Artificial
  CRISPR gRNA sequence
cagtgggaagggggagggga

SEQ ID NO: 759351 - DNA, 20 bp, Artificial
  CRISPR gRNA sequence
agtgggaagggggaggggaa

SEQ ID NO: 759352 - DNA, 20 bp, Artificial
  CRISPR gRNA sequence
gtgggaagggggaggggaaa

SEQ ID NO: 759353 - DNA, 20 bp, Artificial
  CRISPR gRNA sequence
gggaagggggaggggaaagg

SEQ ID NO: 759354 - DNA, 20 bp, Artificial
  CRISPR gRNA sequence
ggaagggggaggggaaaggg

SEQ ID NO: 759355 - DNA, 20 bp, Artificial
  CRISPR gRNA sequence
gaagggggaggggaaaggga

SEQ ID NO: 759356 - DNA, 20 bp, Artificial
  CRISPR gRNA sequence
aagggggaggggaaagggag

SEQ ID NO: 759357 - DNA, 20 bp, Artificial
  CRISPR gRNA sequence
gggggaggggaaagggaggg

SEQ ID NO: 759358 - DNA, 20 bp, Artificial
  CRISPR gRNA sequence
ggggaggggaaagggagggg

SEQ ID NO: 759359 - DNA, 20 bp, Artificial
  CRISPR gRNA sequence
gggaggggaaagggagggga

SEQ ID NO: 759360 - DNA, 20 bp, Artificial
  CRISPR gRNA sequence
gagggcatgcttctctcttt

SEQ ID NO: 759361 - DNA, 20 bp, Artificial
  CRISPR gRNA sequence
agggcatgcttctctctttc

SEQ ID NO: 759362 - DNA, 20 bp, Artificial
  CRISPR gRNA sequence
gggcatgcttctctctttca

SEQ ID NO: 759363 - DNA, 20 bp, Artificial
  CRISPR gRNA sequence
ctctctttcagggcatgacc

SEQ ID NO: 759364 - DNA, 20 bp, Artificial
  CRISPR gRNA sequence
tctttcagggcatgacccag

SEQ ID NO: 759365 - DNA, 20 bp, Artificial
  CRISPR gRNA sequence
gacccagaagctgtacacat

SEQ ID NO: 759366 - DNA, 20 bp, Artificial
  CRISPR gRNA sequence
acatcagtgtacacattgca

SEQ ID NO: 759367 - DNA, 20 bp, Artificial
  CRISPR gRNA sequence
acacattgcatggccacact

SEQ ID NO: 759368 - DNA, 20 bp, Artificial
  CRISPR gRNA sequence
gcatggccacactcagctgc

SEQ ID NO: 759369 - DNA, 20 bp, Artificial
  CRISPR gRNA sequence
ggccacactcagctgcaagt

SEQ ID NO: 759370 - DNA, 20 bp, Artificial
  CRISPR gRNA sequence
gccacactcagctgcaagta

SEQ ID NO: 759371 - DNA, 20 bp, Artificial
  CRISPR gRNA sequence
cactcagctgcaagtaaggc

SEQ ID NO: 759372 - DNA, 20 bp, Artificial
  CRISPR gRNA sequence
actcagctgcaagtaaggct

SEQ ID NO: 759373 - DNA, 20 bp, Artificial
  CRISPR gRNA sequence
gcaagtaaggctgggatctg

SEQ ID NO: 759374 - DNA, 20 bp, Artificial
  CRISPR gRNA sequence
aggctgggatctgcagtcgt

SEQ ID NO: 759375 - DNA, 20 bp, Artificial
  CRISPR gRNA sequence
gggatctgcagtcgttagct

SEQ ID NO: 759376 - DNA, 20 bp, Artificial
  CRISPR gRNA sequence
atctgcagtcgttagctgag

SEQ ID NO: 759377 - DNA, 20 bp, Artificial
  CRISPR gRNA sequence
gtgcctaactaaaaatgcta

SEQ ID NO: 759378 - DNA, 20 bp, Artificial
  CRISPR gRNA sequence
cctaactaaaaatgctatgg

SEQ ID NO: 759379 - DNA, 20 bp, Artificial
  CRISPR gRNA sequence
aactaaaaatgctatggaag

SEQ ID NO: 759380 - DNA, 20 bp, Artificial
  CRISPR gRNA sequence
actaaaaatgctatggaaga

SEQ ID NO: 759381 - DNA, 20 bp, Artificial
  CRISPR gRNA sequence
ctaaaaatgctatggaagaa

SEQ ID NO: 759382 - DNA, 20 bp, Artificial
  CRISPR gRNA sequence
taaaaatgctatggaagaag

SEQ ID NO: 759383 - DNA, 20 bp, Artificial
  CRISPR gRNA sequence
aaaatgctatggaagaaggg

SEQ ID NO: 759384 - DNA, 20 bp, Artificial
  CRISPR gRNA sequence
aatgctatggaagaagggga

SEQ ID NO: 759385 - DNA, 20 bp, Artificial
  CRISPR gRNA sequence
ctatggaagaaggggagagc

SEQ ID NO: 759386 - DNA, 20 bp, Artificial
  CRISPR gRNA sequence
tatggaagaaggggagagct

SEQ ID NO: 759387 - DNA, 20 bp, Artificial
  CRISPR gRNA sequence
aaggggagagctgggtgtgc

SEQ ID NO: 759388 - DNA, 20 bp, Artificial
  CRISPR gRNA sequence
gggagagctgggtgtgctgg

SEQ ID NO: 759389 - DNA, 20 bp, Artificial
  CRISPR gRNA sequence
gggtgtgctggcagcacctg

SEQ ID NO: 759390 - DNA, 20 bp, Artificial
  CRISPR gRNA sequence
cacctgtagtccctgttact

SEQ ID NO: 759391 - DNA, 20 bp, Artificial
  CRISPR gRNA sequence
acctgtagtccctgttactc

SEQ ID NO: 759392 - DNA, 20 bp, Artificial
  CRISPR gRNA sequence
ctgtagtccctgttactcgg

SEQ ID NO: 759393 - DNA, 20 bp, Artificial
  CRISPR gRNA sequence
tgtagtccctgttactcggg

SEQ ID NO: 759394 - DNA, 20 bp, Artificial
  CRISPR gRNA sequence
tccctgttactcgggaggct

SEQ ID NO: 759395 - DNA, 20 bp, Artificial
  CRISPR gRNA sequence
ccctgttactcgggaggctg

SEQ ID NO: 759396 - DNA, 20 bp, Artificial
  CRISPR gRNA sequence
tgttactcgggaggctgagg

SEQ ID NO: 759397 - DNA, 20 bp, Artificial
  CRISPR gRNA sequence
gttactcgggaggctgaggc

SEQ ID NO: 759398 - DNA, 20 bp, Artificial
  CRISPR gRNA sequence
tactcgggaggctgaggcag

SEQ ID NO: 759399 - DNA, 20 bp, Artificial
  CRISPR gRNA sequence
actcgggaggctgaggcagg

SEQ ID NO: 759400 - DNA, 20 bp, Artificial
  CRISPR gRNA sequence
ctgaggcaggaggatcactt

SEQ ID NO: 759401 - DNA, 20 bp, Artificial
  CRISPR gRNA sequence
gcaggaggatcacttgagcc

SEQ ID NO: 759402 - DNA, 20 bp, Artificial
  CRISPR gRNA sequence
caggaggatcacttgagccc

SEQ ID NO: 759403 - DNA, 20 bp, Artificial
  CRISPR gRNA sequence
ggaggatcacttgagcccag

SEQ ID NO: 759404 - DNA, 20 bp, Artificial
  CRISPR gRNA sequence
cacttgagcccaggagttac

SEQ ID NO: 759405 - DNA, 20 bp, Artificial
  CRISPR gRNA sequence
acttgagcccaggagttaca

SEQ ID NO: 759406 - DNA, 20 bp, Artificial
  CRISPR gRNA sequence
cttgagcccaggagttacaa

SEQ ID NO: 759407 - DNA, 20 bp, Artificial
  CRISPR gRNA sequence
gcccaggagttacaagggtg

SEQ ID NO: 759408 - DNA, 20 bp, Artificial
  CRISPR gRNA sequence
caggagttacaagggtgcag

SEQ ID NO: 759409 - DNA, 20 bp, Artificial
  CRISPR gRNA sequence
aggagttacaagggtgcagt

SEQ ID NO: 759410 - DNA, 20 bp, Artificial
  CRISPR gRNA sequence
attgcaccactgaactatga

SEQ ID NO: 759411 - DNA, 20 bp, Artificial
  CRISPR gRNA sequence
gaactatgatggtaccactc

SEQ ID NO: 759412 - DNA, 20 bp, Artificial
  CRISPR gRNA sequence
atgatggtaccactccagcc

SEQ ID NO: 759413 - DNA, 20 bp, Artificial
  CRISPR gRNA sequence
tgatggtaccactccagcct

SEQ ID NO: 759414 - DNA, 20 bp, Artificial
  CRISPR gRNA sequence
taccactccagcctgggtga

SEQ ID NO: 759415 - DNA, 20 bp, Artificial
  CRISPR gRNA sequence
ccactccagcctgggtgaca

SEQ ID NO: 759416 - DNA, 20 bp, Artificial
  CRISPR gRNA sequence
ctccagcctgggtgacagag

SEQ ID NO: 759417 - DNA, 20 bp, Artificial
  CRISPR gRNA sequence
tccagcctgggtgacagagc

SEQ ID NO: 759418 - DNA, 20 bp, Artificial
  CRISPR gRNA sequence
gcgggaccctgtctcttaaa

SEQ ID NO: 759419 - DNA, 20 bp, Artificial
  CRISPR gRNA sequence
cgggaccctgtctcttaaaa

SEQ ID NO: 759420 - DNA, 20 bp, Artificial
  CRISPR gRNA sequence
gggaccctgtctcttaaaaa

SEQ ID NO: 759421 - DNA, 20 bp, Artificial
  CRISPR gRNA sequence
gaccctgtctcttaaaaagg

SEQ ID NO: 759422 - DNA, 20 bp, Artificial
  CRISPR gRNA sequence
tctcttaaaaagggagaaaa

SEQ ID NO: 759423 - DNA, 20 bp, Artificial
  CRISPR gRNA sequence
ctcttaaaaagggagaaaat

SEQ ID NO: 759424 - DNA, 20 bp, Artificial
  CRISPR gRNA sequence
aaaagggagaaaatgggtgt

SEQ ID NO: 759425 - DNA, 20 bp, Artificial
  CRISPR gRNA sequence
agggagaaaatgggtgtaag

SEQ ID NO: 759426 - DNA, 20 bp, Artificial
  CRISPR gRNA sequence
gggtgtaagtggacaacaac

SEQ ID NO: 759427 - DNA, 20 bp, Artificial
  CRISPR gRNA sequence
tgtaagtggacaacaactag

SEQ ID NO: 759428 - DNA, 20 bp, Artificial
  CRISPR gRNA sequence
acaactagcagtttctgcca

SEQ ID NO: 759429 - DNA, 20 bp, Artificial
  CRISPR gRNA sequence
cacagtcactttgtgcattt

SEQ ID NO: 759430 - DNA, 20 bp, Artificial
  CRISPR gRNA sequence
agtcactttgtgcatttcag

SEQ ID NO: 759431 - DNA, 20 bp, Artificial
  CRISPR gRNA sequence
gtcactttgtgcatttcagt

SEQ ID NO: 759432 - DNA, 20 bp, Artificial
  CRISPR gRNA sequence
gcatttcagtgggaactgtg

SEQ ID NO: 759433 - DNA, 20 bp, Artificial
  CRISPR gRNA sequence
ggaactgtgtggctgtgaac

SEQ ID NO: 759434 - DNA, 20 bp, Artificial
  CRISPR gRNA sequence
tgtgtggctgtgaactggtt

SEQ ID NO: 759435 - DNA, 20 bp, Artificial
  CRISPR gRNA sequence
ctgtgaactggttaagcctt

SEQ ID NO: 759436 - DNA, 20 bp, Artificial
  CRISPR gRNA sequence
tgtgaactggttaagcctta

SEQ ID NO: 759437 - DNA, 20 bp, Artificial
  CRISPR gRNA sequence
ctggttaagccttaaggata

SEQ ID NO: 759438 - DNA, 20 bp, Artificial
  CRISPR gRNA sequence
cttaaggatatagtccctga

SEQ ID NO: 759439 - DNA, 20 bp, Artificial
  CRISPR gRNA sequence
atatagtccctgaaagcttc

SEQ ID NO: 759440 - DNA, 20 bp, Artificial
  CRISPR gRNA sequence
gaaagcttcaagtactgata

SEQ ID NO: 759441 - DNA, 20 bp, Artificial
  CRISPR gRNA sequence
aagtactgataaagttccac

SEQ ID NO: 759442 - DNA, 20 bp, Artificial
  CRISPR gRNA sequence
aagttccactagcatccaca

SEQ ID NO: 759443 - DNA, 20 bp, Artificial
  CRISPR gRNA sequence
tccacaaagcttttctttta

SEQ ID NO: 759444 - DNA, 20 bp, Artificial
  CRISPR gRNA sequence
ccacaaagcttttcttttat

SEQ ID NO: 759445 - DNA, 20 bp, Artificial
  CRISPR gRNA sequence
caaagcttttcttttatagg

SEQ ID NO: 759446 - DNA, 20 bp, Artificial
  CRISPR gRNA sequence
aaagcttttcttttataggt

SEQ ID NO: 759447 - DNA, 20 bp, Artificial
  CRISPR gRNA sequence
cttttataggtaggaacact

SEQ ID NO: 759448 - DNA, 20 bp, Artificial
  CRISPR gRNA sequence
ataggtaggaacactgagct

SEQ ID NO: 759449 - DNA, 20 bp, Artificial
  CRISPR gRNA sequence
aggtaggaacactgagctca

SEQ ID NO: 759450 - DNA, 20 bp, Artificial
  CRISPR gRNA sequence
taggaacactgagctcagag

SEQ ID NO: 759451 - DNA, 20 bp, Artificial
  CRISPR gRNA sequence
ctgagctcagagaagttgcc

SEQ ID NO: 759452 - DNA, 20 bp, Artificial
  CRISPR gRNA sequence
ctcagagaagttgcctagtt

SEQ ID NO: 759453 - DNA, 20 bp, Artificial
  CRISPR gRNA sequence
ctagttaagattgcataaca

SEQ ID NO: 759454 - DNA, 20 bp, Artificial
  CRISPR gRNA sequence
aagattgcataacaaagtgt

SEQ ID NO: 759455 - DNA, 20 bp, Artificial
  CRISPR gRNA sequence
gattgcataacaaagtgtca

SEQ ID NO: 759456 - DNA, 20 bp, Artificial
  CRISPR gRNA sequence
gcataacaaagtgtcagagc

SEQ ID NO: 759457 - DNA, 20 bp, Artificial
  CRISPR gRNA sequence
cataacaaagtgtcagagct

SEQ ID NO: 759458 - DNA, 20 bp, Artificial
  CRISPR gRNA sequence
caaagtgtcagagctgggac

SEQ ID NO: 759459 - DNA, 20 bp, Artificial
  CRISPR gRNA sequence
gggaccagaaccccacactt

SEQ ID NO: 759460 - DNA, 20 bp, Artificial
  CRISPR gRNA sequence
ggaccagaaccccacacttt

SEQ ID NO: 759461 - DNA, 20 bp, Artificial
  CRISPR gRNA sequence
cacactttgggctcattttc

SEQ ID NO: 759462 - DNA, 20 bp, Artificial
  CRISPR gRNA sequence
gggctcattttctagaattc

SEQ ID NO: 759463 - DNA, 20 bp, Artificial
  CRISPR gRNA sequence
ggctcattttctagaattcc

SEQ ID NO: 759464 - DNA, 20 bp, Artificial
  CRISPR gRNA sequence
gctcattttctagaattcca

SEQ ID NO: 759465 - DNA, 20 bp, Artificial
  CRISPR gRNA sequence
tctagaattccagggtgatc

SEQ ID NO: 759466 - DNA, 20 bp, Artificial
  CRISPR gRNA sequence
aattccagggtgatctggct

SEQ ID NO: 759467 - DNA, 20 bp, Artificial
  CRISPR gRNA sequence
attccagggtgatctggctg

SEQ ID NO: 759468 - DNA, 20 bp, Artificial
  CRISPR gRNA sequence
ttccagggtgatctggctga

SEQ ID NO: 759469 - DNA, 20 bp, Artificial
  CRISPR gRNA sequence
tccagggtgatctggctgag

SEQ ID NO: 759470 - DNA, 20 bp, Artificial
  CRISPR gRNA sequence
agggtgatctggctgagggg

SEQ ID NO: 759471 - DNA, 20 bp, Artificial
  CRISPR gRNA sequence
tgatctggctgaggggcaga

SEQ ID NO: 759472 - DNA, 20 bp, Artificial
  CRISPR gRNA sequence
gatctggctgaggggcagac

SEQ ID NO: 759473 - DNA, 20 bp, Artificial
  CRISPR gRNA sequence
ctggctgaggggcagacagg

SEQ ID NO: 759474 - DNA, 20 bp, Artificial
  CRISPR gRNA sequence
gaggggcagacaggcagtgt

SEQ ID NO: 759475 - DNA, 20 bp, Artificial
  CRISPR gRNA sequence
aggggcagacaggcagtgtc

SEQ ID NO: 759476 - DNA, 20 bp, Artificial
  CRISPR gRNA sequence
gggcagacaggcagtgtcag

SEQ ID NO: 759477 - DNA, 20 bp, Artificial
  CRISPR gRNA sequence
ggcagacaggcagtgtcagg

SEQ ID NO: 759478 - DNA, 20 bp, Artificial
  CRISPR gRNA sequence
gacaggcagtgtcaggagga

SEQ ID NO: 759479 - DNA, 20 bp, Artificial
  CRISPR gRNA sequence
acaggcagtgtcaggaggac

SEQ ID NO: 759480 - DNA, 20 bp, Artificial
  CRISPR gRNA sequence
gtgtcaggaggacgggtctc

SEQ ID NO: 759481 - DNA, 20 bp, Artificial
  CRISPR gRNA sequence
gtcaggaggacgggtctctg

SEQ ID NO: 759482 - DNA, 20 bp, Artificial
  CRISPR gRNA sequence
gaggacgggtctctggagtt

SEQ ID NO: 759483 - DNA, 20 bp, Artificial
  CRISPR gRNA sequence
aggacgggtctctggagttc

SEQ ID NO: 759484 - DNA, 20 bp, Artificial
  CRISPR gRNA sequence
cgggtctctggagttcagga

SEQ ID NO: 759485 - DNA, 20 bp, Artificial
  CRISPR gRNA sequence
gggtctctggagttcaggaa

SEQ ID NO: 759486 - DNA, 20 bp, Artificial
  CRISPR gRNA sequence
ggtctctggagttcaggaaa

SEQ ID NO: 759487 - DNA, 20 bp, Artificial
  CRISPR gRNA sequence
caggaaagggttacctttcc

SEQ ID NO: 759488 - DNA, 20 bp, Artificial
  CRISPR gRNA sequence
aagggttacctttcccagcg

SEQ ID NO: 759489 - DNA, 20 bp, Artificial
  CRISPR gRNA sequence
cctttcccagcgcggctacc

SEQ ID NO: 759490 - DNA, 20 bp, Artificial
  CRISPR gRNA sequence
ctttcccagcgcggctacct

SEQ ID NO: 759491 - DNA, 20 bp, Artificial
  CRISPR gRNA sequence
tttcccagcgcggctacctg

SEQ ID NO: 759492 - DNA, 20 bp, Artificial
  CRISPR gRNA sequence
tcccagcgcggctacctggg

SEQ ID NO: 759493 - DNA, 20 bp, Artificial
  CRISPR gRNA sequence
gggagctgctcatgactttt

SEQ ID NO: 759494 - DNA, 20 bp, Artificial
  CRISPR gRNA sequence
ggagctgctcatgacttttc

SEQ ID NO: 759495 - DNA, 20 bp, Artificial
  CRISPR gRNA sequence
gagctgctcatgacttttca

SEQ ID NO: 759496 - DNA, 20 bp, Artificial
  CRISPR gRNA sequence
gacttttcagggatcatctc

SEQ ID NO: 759497 - DNA, 20 bp, Artificial
  CRISPR gRNA sequence
acttttcagggatcatctct

SEQ ID NO: 759498 - DNA, 20 bp, Artificial
  CRISPR gRNA sequence
cttttcagggatcatctctg

SEQ ID NO: 759499 - DNA, 20 bp, Artificial
  CRISPR gRNA sequence
tctggggttatcatgcctct

SEQ ID NO: 759500 - DNA, 20 bp, Artificial
  CRISPR gRNA sequence
ctggggttatcatgcctctg

SEQ ID NO: 759501 - DNA, 20 bp, Artificial
  CRISPR gRNA sequence
cgccctgaccatatcataaa

SEQ ID NO: 759502 - DNA, 20 bp, Artificial
  CRISPR gRNA sequence
tagtatactataccaaactg

SEQ ID NO: 759503 - DNA, 20 bp, Artificial
  CRISPR gRNA sequence
tgcatgtcccccttccctat

SEQ ID NO: 759504 - DNA, 20 bp, Artificial
  CRISPR gRNA sequence
cctattagaatctgctcctt

SEQ ID NO: 759505 - DNA, 20 bp, Artificial
  CRISPR gRNA sequence
ctattagaatctgctccttg

SEQ ID NO: 759506 - DNA, 20 bp, Artificial
  CRISPR gRNA sequence
tagaatctgctccttgagga

SEQ ID NO: 759507 - DNA, 20 bp, Artificial
  CRISPR gRNA sequence
ttgaggacagacgtgtacct

SEQ ID NO: 759508 - DNA, 20 bp, Artificial
  CRISPR gRNA sequence
cttagttatctctctgcccc

SEQ ID NO: 759509 - DNA, 20 bp, Artificial
  CRISPR gRNA sequence
tgcccctagtacgtccctac

SEQ ID NO: 759510 - DNA, 20 bp, Artificial
  CRISPR gRNA sequence
gcccctagtacgtccctacc

SEQ ID NO: 759511 - DNA, 20 bp, Artificial
  CRISPR gRNA sequence
gtccctaccaggaactccgt

SEQ ID NO: 759512 - DNA, 20 bp, Artificial
  CRISPR gRNA sequence
cctaccaggaactccgtaag

SEQ ID NO: 759513 - DNA, 20 bp, Artificial
  CRISPR gRNA sequence
agtagtgaaatgaattacta

SEQ ID NO: 759514 - DNA, 20 bp, Artificial
  CRISPR gRNA sequence
actaaagacatgaatgcatg

SEQ ID NO: 759515 - DNA, 20 bp, Artificial
  CRISPR gRNA sequence
acatgaatgcatgtggattc

SEQ ID NO: 759516 - DNA, 20 bp, Artificial
  CRISPR gRNA sequence
catgaatgcatgtggattca

SEQ ID NO: 759517 - DNA, 20 bp, Artificial
  CRISPR gRNA sequence
tgtggattcaaggactcctt

SEQ ID NO: 759518 - DNA, 20 bp, Artificial
  CRISPR gRNA sequence
ttcaaggactccttcggttg

SEQ ID NO: 759519 - DNA, 20 bp, Artificial
  CRISPR gRNA sequence
actccttcggttgcagacaa

SEQ ID NO: 759520 - DNA, 20 bp, Artificial
  CRISPR gRNA sequence
ggttgcagacaatagaaact

SEQ ID NO: 759521 - DNA, 20 bp, Artificial
  CRISPR gRNA sequence
aatagaaacttagttcaaac

SEQ ID NO: 759522 - DNA, 20 bp, Artificial
  CRISPR gRNA sequence
aacttagttcaaactggttt

SEQ ID NO: 759523 - DNA, 20 bp, Artificial
  CRISPR gRNA sequence
acttagttcaaactggttta

SEQ ID NO: 759524 - DNA, 20 bp, Artificial
  CRISPR gRNA sequence
cttagttcaaactggtttaa

SEQ ID NO: 759525 - DNA, 20 bp, Artificial
  CRISPR gRNA sequence
tttaagggaaaaaaaatgat

SEQ ID NO: 759526 - DNA, 20 bp, Artificial
  CRISPR gRNA sequence
aaatgattggctcaaatatc

SEQ ID NO: 759527 - DNA, 20 bp, Artificial
  CRISPR gRNA sequence
aatgattggctcaaatatct

SEQ ID NO: 759528 - DNA, 20 bp, Artificial
  CRISPR gRNA sequence
gattggctcaaatatctggg

SEQ ID NO: 759529 - DNA, 20 bp, Artificial
  CRISPR gRNA sequence
gctcaaatatctgggcggtc

SEQ ID NO: 759530 - DNA, 20 bp, Artificial
  CRISPR gRNA sequence
ctcaaatatctgggcggtct

SEQ ID NO: 759531 - DNA, 20 bp, Artificial
  CRISPR gRNA sequence
atctgggcggtctaggtctg

SEQ ID NO: 759532 - DNA, 20 bp, Artificial
  CRISPR gRNA sequence
tctaggtctgcagcttgctt

SEQ ID NO: 759533 - DNA, 20 bp, Artificial
  CRISPR gRNA sequence
ctaggtctgcagcttgcttc

SEQ ID NO: 759534 - DNA, 20 bp, Artificial
  CRISPR gRNA sequence
tctgcagcttgcttcaggca

SEQ ID NO: 759535 - DNA, 20 bp, Artificial
  CRISPR gRNA sequence
cagcttgcttcaggcatagc

SEQ ID NO: 759536 - DNA, 20 bp, Artificial
  CRISPR gRNA sequence
gcttcaggcatagctggatc

SEQ ID NO: 759537 - DNA, 20 bp, Artificial
  CRISPR gRNA sequence
cttcaggcatagctggatcc

SEQ ID NO: 759538 - DNA, 20 bp, Artificial
  CRISPR gRNA sequence
ttcaggcatagctggatcca

SEQ ID NO: 759539 - DNA, 20 bp, Artificial
  CRISPR gRNA sequence
agggacttgtctgacatttt

SEQ ID NO: 759540 - DNA, 20 bp, Artificial
  CRISPR gRNA sequence
tgaccctttttgtccctttg

SEQ ID NO: 759541 - DNA, 20 bp, Artificial
  CRISPR gRNA sequence
gaccctttttgtccctttgt

SEQ ID NO: 759542 - DNA, 20 bp, Artificial
  CRISPR gRNA sequence
cctttttgtccctttgtggg

SEQ ID NO: 759543 - DNA, 20 bp, Artificial
  CRISPR gRNA sequence
ctttgtgggaagtgttgccc

SEQ ID NO: 759544 - DNA, 20 bp, Artificial
  CRISPR gRNA sequence
tttgtgggaagtgttgccca

SEQ ID NO: 759545 - DNA, 20 bp, Artificial
  CRISPR gRNA sequence
tgtgggaagtgttgcccaag

SEQ ID NO: 759546 - DNA, 20 bp, Artificial
  CRISPR gRNA sequence
tgttgcccaaggagcccctg

SEQ ID NO: 759547 - DNA, 20 bp, Artificial
  CRISPR gRNA sequence
gttgcccaaggagcccctgc

SEQ ID NO: 759548 - DNA, 20 bp, Artificial
  CRISPR gRNA sequence
ttgcccaaggagcccctgcg

SEQ ID NO: 759549 - DNA, 20 bp, Artificial
  CRISPR gRNA sequence
caaggagcccctgcggggat

SEQ ID NO: 759550 - DNA, 20 bp, Artificial
  CRISPR gRNA sequence
aaggagcccctgcggggatt

SEQ ID NO: 759551 - DNA, 20 bp, Artificial
  CRISPR gRNA sequence
ggagcccctgcggggattgg

SEQ ID NO: 759552 - DNA, 20 bp, Artificial
  CRISPR gRNA sequence
gagcccctgcggggattggg

SEQ ID NO: 759553 - DNA, 20 bp, Artificial
  CRISPR gRNA sequence
cccctgcggggattgggagg

SEQ ID NO: 759554 - DNA, 20 bp, Artificial
  CRISPR gRNA sequence
ctgcggggattgggaggaag

SEQ ID NO: 759555 - DNA, 20 bp, Artificial
  CRISPR gRNA sequence
tgcggggattgggaggaagt

SEQ ID NO: 759556 - DNA, 20 bp, Artificial
  CRISPR gRNA sequence
gcggggattgggaggaagta

SEQ ID NO: 759557 - DNA, 20 bp, Artificial
  CRISPR gRNA sequence
cggggattgggaggaagtag

SEQ ID NO: 759558 - DNA, 20 bp, Artificial
  CRISPR gRNA sequence
ggggattgggaggaagtagg

SEQ ID NO: 759559 - DNA, 20 bp, Artificial
  CRISPR gRNA sequence
attgggaggaagtagggggt

SEQ ID NO: 759560 - DNA, 20 bp, Artificial
  CRISPR gRNA sequence
ttgggaggaagtagggggtt

SEQ ID NO: 759561 - DNA, 20 bp, Artificial
  CRISPR gRNA sequence
gggaggaagtagggggttag

SEQ ID NO: 759562 - DNA, 20 bp, Artificial
  CRISPR gRNA sequence
ggaggaagtagggggttagg

SEQ ID NO: 759563 - DNA, 20 bp, Artificial
  CRISPR gRNA sequence
ggaagtagggggttaggagg

SEQ ID NO: 759564 - DNA, 20 bp, Artificial
  CRISPR gRNA sequence
agtagggggttaggaggaag

SEQ ID NO: 759565 - DNA, 20 bp, Artificial
  CRISPR gRNA sequence
tagggggttaggaggaagtg

SEQ ID NO: 759566 - DNA, 20 bp, Artificial
  CRISPR gRNA sequence
taggaggaagtggagtgatg

SEQ ID NO: 759567 - DNA, 20 bp, Artificial
  CRISPR gRNA sequence
aggaggaagtggagtgatgt

SEQ ID NO: 759568 - DNA, 20 bp, Artificial
  CRISPR gRNA sequence
tggagtgatgtgggtgatta

SEQ ID NO: 759569 - DNA, 20 bp, Artificial
  CRISPR gRNA sequence
agtgatgtgggtgattatgg

SEQ ID NO: 759570 - DNA, 20 bp, Artificial
  CRISPR gRNA sequence
gtgatgtgggtgattatggt

SEQ ID NO: 759571 - DNA, 20 bp, Artificial
  CRISPR gRNA sequence
tgatgtgggtgattatggtg

SEQ ID NO: 759572 - DNA, 20 bp, Artificial
  CRISPR gRNA sequence
gatgtgggtgattatggtgg

SEQ ID NO: 759573 - DNA, 20 bp, Artificial
  CRISPR gRNA sequence
atgtgggtgattatggtggg

SEQ ID NO: 759574 - DNA, 20 bp, Artificial
  CRISPR gRNA sequence
gggtgattatggtggggggc

SEQ ID NO: 759575 - DNA, 20 bp, Artificial
  CRISPR gRNA sequence
ggtgattatggtggggggca

SEQ ID NO: 759576 - DNA, 20 bp, Artificial
  CRISPR gRNA sequence
tgattatggtggggggcaag

SEQ ID NO: 759577 - DNA, 20 bp, Artificial
  CRISPR gRNA sequence
ggggggcaaggagaccctct

SEQ ID NO: 759578 - DNA, 20 bp, Artificial
  CRISPR gRNA sequence
gggggcaaggagaccctctt

SEQ ID NO: 759579 - DNA, 20 bp, Artificial
  CRISPR gRNA sequence
gagaccctcttgggcatccc

SEQ ID NO: 759580 - DNA, 20 bp, Artificial
  CRISPR gRNA sequence
agaccctcttgggcatcccc

SEQ ID NO: 759581 - DNA, 20 bp, Artificial
  CRISPR gRNA sequence
ctcttgggcatccccaggcc

SEQ ID NO: 759582 - DNA, 20 bp, Artificial
  CRISPR gRNA sequence
tcttgggcatccccaggccc

SEQ ID NO: 759583 - DNA, 20 bp, Artificial
  CRISPR gRNA sequence
cttgggcatccccaggccca

SEQ ID NO: 759584 - DNA, 20 bp, Artificial
  CRISPR gRNA sequence
tccccaggcccagggcattt

SEQ ID NO: 759585 - DNA, 20 bp, Artificial
  CRISPR gRNA sequence
gcccagggcattttggccct

SEQ ID NO: 759586 - DNA, 20 bp, Artificial
  CRISPR gRNA sequence
gggcattttggccctgagcc

SEQ ID NO: 759587 - DNA, 20 bp, Artificial
  CRISPR gRNA sequence
ggcattttggccctgagccc

SEQ ID NO: 759588 - DNA, 20 bp, Artificial
  CRISPR gRNA sequence
tttggccctgagcccaggtg

SEQ ID NO: 759589 - DNA, 20 bp, Artificial
  CRISPR gRNA sequence
ccctgagcccaggtgcagtc

SEQ ID NO: 759590 - DNA, 20 bp, Artificial
  CRISPR gRNA sequence
ggtgcagtctggatttgttg

SEQ ID NO: 759591 - DNA, 20 bp, Artificial
  CRISPR gRNA sequence
tggatttgttgtagctttct

SEQ ID NO: 759592 - DNA, 20 bp, Artificial
  CRISPR gRNA sequence
ggatttgttgtagctttctg

SEQ ID NO: 759593 - DNA, 20 bp, Artificial
  CRISPR gRNA sequence
gatttgttgtagctttctga

SEQ ID NO: 759594 - DNA, 20 bp, Artificial
  CRISPR gRNA sequence
agctttctgagggcacatct

SEQ ID NO: 759595 - DNA, 20 bp, Artificial
  CRISPR gRNA sequence
gctttctgagggcacatctt

SEQ ID NO: 759596 - DNA, 20 bp, Artificial
  CRISPR gRNA sequence
gcacatcttgggtcatctct

SEQ ID NO: 759597 - DNA, 20 bp, Artificial
  CRISPR gRNA sequence
cacatcttgggtcatctctt

SEQ ID NO: 759598 - DNA, 20 bp, Artificial
  CRISPR gRNA sequence
catcttgggtcatctcttgg

SEQ ID NO: 759599 - DNA, 20 bp, Artificial
  CRISPR gRNA sequence
atctcttgggagcctccctg

SEQ ID NO: 759600 - DNA, 20 bp, Artificial
  CRISPR gRNA sequence
tccctgtggccctgcttctg

SEQ ID NO: 759601 - DNA, 20 bp, Artificial
  CRISPR gRNA sequence
ccctgtggccctgcttctgc

SEQ ID NO: 759602 - DNA, 20 bp, Artificial
  CRISPR gRNA sequence
cctgtggccctgcttctgca

SEQ ID NO: 759603 - DNA, 20 bp, Artificial
  CRISPR gRNA sequence
tggccctgcttctgcagggt

SEQ ID NO: 759604 - DNA, 20 bp, Artificial
  CRISPR gRNA sequence
tggatgcccttgctgtacct

SEQ ID NO: 759605 - DNA, 20 bp, Artificial
  CRISPR gRNA sequence
ggatgcccttgctgtacctt

SEQ ID NO: 759606 - DNA, 20 bp, Artificial
  CRISPR gRNA sequence
cccttgctgtaccttaggct

SEQ ID NO: 759607 - DNA, 20 bp, Artificial
  CRISPR gRNA sequence
ccttgctgtaccttaggctg

SEQ ID NO: 759608 - DNA, 20 bp, Artificial
  CRISPR gRNA sequence
gctgtaccttaggctgagga

SEQ ID NO: 759609 - DNA, 20 bp, Artificial
  CRISPR gRNA sequence
tctctcctgctgctctgtga

SEQ ID NO: 759610 - DNA, 20 bp, Artificial
  CRISPR gRNA sequence
ctgctgctctgtgaaagccg

SEQ ID NO: 759611 - DNA, 20 bp, Artificial
  CRISPR gRNA sequence
tgctgctctgtgaaagccga

SEQ ID NO: 759612 - DNA, 20 bp, Artificial
  CRISPR gRNA sequence
tgaaagccgaaggtgctctg

SEQ ID NO: 759613 - DNA, 20 bp, Artificial
  CRISPR gRNA sequence
ccgaaggtgctctgtggttt

SEQ ID NO: 759614 - DNA, 20 bp, Artificial
  CRISPR gRNA sequence
cgaaggtgctctgtggtttt

SEQ ID NO: 759615 - DNA, 20 bp, Artificial
  CRISPR gRNA sequence
ggtgctctgtggttttggga

SEQ ID NO: 759616 - DNA, 20 bp, Artificial
  CRISPR gRNA sequence
tgctctgtggttttgggata

SEQ ID NO: 759617 - DNA, 20 bp, Artificial
  CRISPR gRNA sequence
tctgtggttttgggatagag

SEQ ID NO: 759618 - DNA, 20 bp, Artificial
  CRISPR gRNA sequence
ctgtggttttgggatagagc

SEQ ID NO: 759619 - DNA, 20 bp, Artificial
  CRISPR gRNA sequence
tggttttgggatagagcagg

SEQ ID NO: 759620 - DNA, 20 bp, Artificial
  CRISPR gRNA sequence
ggttttgggatagagcagga

SEQ ID NO: 759621 - DNA, 20 bp, Artificial
  CRISPR gRNA sequence
ttttgggatagagcaggaag

SEQ ID NO: 759622 - DNA, 20 bp, Artificial
  CRISPR gRNA sequence
tgggatagagcaggaaggag

SEQ ID NO: 759623 - DNA, 20 bp, Artificial
  CRISPR gRNA sequence
gggatagagcaggaaggaga

SEQ ID NO: 759624 - DNA, 20 bp, Artificial
  CRISPR gRNA sequence
agagcaggaaggagaaggac

SEQ ID NO: 759625 - DNA, 20 bp, Artificial
  CRISPR gRNA sequence
gagcaggaaggagaaggacg

SEQ ID NO: 759626 - DNA, 20 bp, Artificial
  CRISPR gRNA sequence
gcaggaaggagaaggacgag

SEQ ID NO: 759627 - DNA, 20 bp, Artificial
  CRISPR gRNA sequence
ggaaggagaaggacgaggag

SEQ ID NO: 759628 - DNA, 20 bp, Artificial
  CRISPR gRNA sequence
gaaggagaaggacgaggagt

SEQ ID NO: 759629 - DNA, 20 bp, Artificial
  CRISPR gRNA sequence
gaaggacgaggagtgggcac

SEQ ID NO: 759630 - DNA, 20 bp, Artificial
  CRISPR gRNA sequence
ggacgaggagtgggcactgg

SEQ ID NO: 759631 - DNA, 20 bp, Artificial
  CRISPR gRNA sequence
gacgaggagtgggcactggc

SEQ ID NO: 759632 - DNA, 20 bp, Artificial
  CRISPR gRNA sequence
ggcactggcaggtgactcac

SEQ ID NO: 759633 - DNA, 20 bp, Artificial
  CRISPR gRNA sequence
gcactggcaggtgactcacc

SEQ ID NO: 759634 - DNA, 20 bp, Artificial
  CRISPR gRNA sequence
tggcaggtgactcaccggga

SEQ ID NO: 759635 - DNA, 20 bp, Artificial
  CRISPR gRNA sequence
ggcaggtgactcaccgggac

SEQ ID NO: 759636 - DNA, 20 bp, Artificial
  CRISPR gRNA sequence
aggtgactcaccgggacggg

SEQ ID NO: 759637 - DNA, 20 bp, Artificial
  CRISPR gRNA sequence
cgggtggcacatgctgactc

SEQ ID NO: 759638 - DNA, 20 bp, Artificial
  CRISPR gRNA sequence
gggtggcacatgctgactcc

SEQ ID NO: 759639 - DNA, 20 bp, Artificial
  CRISPR gRNA sequence
ggtggcacatgctgactcca

SEQ ID NO: 759640 - DNA, 20 bp, Artificial
  CRISPR gRNA sequence
ggcacatgctgactccaggg

SEQ ID NO: 759641 - DNA, 20 bp, Artificial
  CRISPR gRNA sequence
gcacatgctgactccagggc

SEQ ID NO: 759642 - DNA, 20 bp, Artificial
  CRISPR gRNA sequence
gctgactccagggcaggtcc

SEQ ID NO: 759643 - DNA, 20 bp, Artificial
  CRISPR gRNA sequence
actccagggcaggtcccggc

SEQ ID NO: 759644 - DNA, 20 bp, Artificial
  CRISPR gRNA sequence
ctccagggcaggtcccggct

SEQ ID NO: 759645 - DNA, 20 bp, Artificial
  CRISPR gRNA sequence
tccagggcaggtcccggctg

SEQ ID NO: 759646 - DNA, 20 bp, Artificial
  CRISPR gRNA sequence
ggcaggtcccggctggggat

SEQ ID NO: 759647 - DNA, 20 bp, Artificial
  CRISPR gRNA sequence
ggggatgagattcccctttg

SEQ ID NO: 759648 - DNA, 20 bp, Artificial
  CRISPR gRNA sequence
attcccctttgtggaaaaca

SEQ ID NO: 759649 - DNA, 20 bp, Artificial
  CRISPR gRNA sequence
ttcccctttgtggaaaacat

SEQ ID NO: 759650 - DNA, 20 bp, Artificial
  CRISPR gRNA sequence
ccctttgtggaaaacatggg

SEQ ID NO: 759651 - DNA, 20 bp, Artificial
  CRISPR gRNA sequence
ctttgtggaaaacatgggtg

SEQ ID NO: 759652 - DNA, 20 bp, Artificial
  CRISPR gRNA sequence
tttgtggaaaacatgggtgg

SEQ ID NO: 759653 - DNA, 20 bp, Artificial
  CRISPR gRNA sequence
ttgtggaaaacatgggtgga

SEQ ID NO: 759654 - DNA, 20 bp, Artificial
  CRISPR gRNA sequence
tgtggaaaacatgggtggag

SEQ ID NO: 759655 - DNA, 20 bp, Artificial
  CRISPR gRNA sequence
gtggaaaacatgggtggagg

SEQ ID NO: 759656 - DNA, 20 bp, Artificial
  CRISPR gRNA sequence
gaaaacatgggtggaggggg

SEQ ID NO: 759657 - DNA, 20 bp, Artificial
  CRISPR gRNA sequence
tgggtggagggggtggtacg

SEQ ID NO: 759658 - DNA, 20 bp, Artificial
  CRISPR gRNA sequence
gggtggagggggtggtacgc

SEQ ID NO: 759659 - DNA, 20 bp, Artificial
  CRISPR gRNA sequence
tggagggggtggtacgcagg

SEQ ID NO: 759660 - DNA, 20 bp, Artificial
  CRISPR gRNA sequence
gggtggtacgcaggcagcat

SEQ ID NO: 759661 - DNA, 20 bp, Artificial
  CRISPR gRNA sequence
ggtggtacgcaggcagcatg

SEQ ID NO: 759662 - DNA, 20 bp, Artificial
  CRISPR gRNA sequence
caggcagcatgaggcctgcg

SEQ ID NO: 759663 - DNA, 20 bp, Artificial
  CRISPR gRNA sequence
gaggcctgcgtggctccacg

SEQ ID NO: 759664 - DNA, 20 bp, Artificial
  CRISPR gRNA sequence
tgcgtggctccacgtggctc

SEQ ID NO: 759665 - DNA, 20 bp, Artificial
  CRISPR gRNA sequence
gcgtggctccacgtggctct

SEQ ID NO: 759666 - DNA, 20 bp, Artificial
  CRISPR gRNA sequence
ctccacgtggctctgggtcc

SEQ ID NO: 759667 - DNA, 20 bp, Artificial
  CRISPR gRNA sequence
tccacgtggctctgggtccc

SEQ ID NO: 759668 - DNA, 20 bp, Artificial
  CRISPR gRNA sequence
gctctgggtcccgggccgac

SEQ ID NO: 759669 - DNA, 20 bp, Artificial
  CRISPR gRNA sequence
gccgaccagctctgtgttca

SEQ ID NO: 759670 - DNA, 20 bp, Artificial
  CRISPR gRNA sequence
ccgaccagctctgtgttcac

SEQ ID NO: 759671 - DNA, 20 bp, Artificial
  CRISPR gRNA sequence
caggacactctcccattctc

SEQ ID NO: 759672 - DNA, 20 bp, Artificial
  CRISPR gRNA sequence
aggacactctcccattctcc

SEQ ID NO: 759673 - DNA, 20 bp, Artificial
  CRISPR gRNA sequence
ggacactctcccattctcca

SEQ ID NO: 759674 - DNA, 20 bp, Artificial
  CRISPR gRNA sequence
acactctcccattctccagg

SEQ ID NO: 759675 - DNA, 20 bp, Artificial
  CRISPR gRNA sequence
ccagggagcacttcctttct

SEQ ID NO: 759676 - DNA, 20 bp, Artificial
  CRISPR gRNA sequence
ctgtctctttctcctgtcct

SEQ ID NO: 759677 - DNA, 20 bp, Artificial
  CRISPR gRNA sequence
tctcctgtcctcagctcctc

SEQ ID NO: 759678 - DNA, 20 bp, Artificial
  CRISPR gRNA sequence
ctcctgtcctcagctcctcc

SEQ ID NO: 759679 - DNA, 20 bp, Artificial
  CRISPR gRNA sequence
gtcctcagctcctccaggcc

SEQ ID NO: 759680 - DNA, 20 bp, Artificial
  CRISPR gRNA sequence
gctcctccaggcccagctgt

SEQ ID NO: 759681 - DNA, 20 bp, Artificial
  CRISPR gRNA sequence
tccaggcccagctgtcagcg

SEQ ID NO: 759682 - DNA, 20 bp, Artificial
  CRISPR gRNA sequence
ccaggcccagctgtcagcgt

SEQ ID NO: 759683 - DNA, 20 bp, Artificial
  CRISPR gRNA sequence
caggcccagctgtcagcgta

SEQ ID NO: 759684 - DNA, 20 bp, Artificial
  CRISPR gRNA sequence
aggcccagctgtcagcgtag

SEQ ID NO: 759685 - DNA, 20 bp, Artificial
  CRISPR gRNA sequence
gctgtcagcgtaggggtctc

SEQ ID NO: 759686 - DNA, 20 bp, Artificial
  CRISPR gRNA sequence
ctgtcagcgtaggggtctct

SEQ ID NO: 759687 - DNA, 20 bp, Artificial
  CRISPR gRNA sequence
gtaggggtctctgggtgccg

SEQ ID NO: 759688 - DNA, 20 bp, Artificial
  CRISPR gRNA sequence
ctgggtgccgtggactcttc

SEQ ID NO: 759689 - DNA, 20 bp, Artificial
  CRISPR gRNA sequence
tcttctggtctctttgcttc

SEQ ID NO: 759690 - DNA, 20 bp, Artificial
  CRISPR gRNA sequence
cttctggtctctttgcttct

SEQ ID NO: 759691 - DNA, 20 bp, Artificial
  CRISPR gRNA sequence
gctgtcaaactgcttctctc

SEQ ID NO: 759692 - DNA, 20 bp, Artificial
  CRISPR gRNA sequence
ctgtcaaactgcttctctcc

SEQ ID NO: 759693 - DNA, 20 bp, Artificial
  CRISPR gRNA sequence
tgtcaaactgcttctctcca

SEQ ID NO: 759694 - DNA, 20 bp, Artificial
  CRISPR gRNA sequence
caaactgcttctctccaggg

SEQ ID NO: 759695 - DNA, 20 bp, Artificial
  CRISPR gRNA sequence
aaactgcttctctccagggc

SEQ ID NO: 759696 - DNA, 20 bp, Artificial
  CRISPR gRNA sequence
ttctctccagggcaggtttc

SEQ ID NO: 759697 - DNA, 20 bp, Artificial
  CRISPR gRNA sequence
tctctccagggcaggtttcc

SEQ ID NO: 759698 - DNA, 20 bp, Artificial
  CRISPR gRNA sequence
cagggcaggtttccaggatc

SEQ ID NO: 759699 - DNA, 20 bp, Artificial
  CRISPR gRNA sequence
gggcaggtttccaggatcca

SEQ ID NO: 759700 - DNA, 20 bp, Artificial
  CRISPR gRNA sequence
ggtttccaggatccagagtc

SEQ ID NO: 759701 - DNA, 20 bp, Artificial
  CRISPR gRNA sequence
gtttccaggatccagagtct

SEQ ID NO: 759702 - DNA, 20 bp, Artificial
  CRISPR gRNA sequence
ccaggatccagagtctagga

SEQ ID NO: 759703 - DNA, 20 bp, Artificial
  CRISPR gRNA sequence
caggatccagagtctaggaa

SEQ ID NO: 759704 - DNA, 20 bp, Artificial
  CRISPR gRNA sequence
agagtctaggaaaggaatga

SEQ ID NO: 759705 - DNA, 20 bp, Artificial
  CRISPR gRNA sequence
gagtctaggaaaggaatgaa

SEQ ID NO: 759706 - DNA, 20 bp, Artificial
  CRISPR gRNA sequence
agtctaggaaaggaatgaaa

SEQ ID NO: 759707 - DNA, 20 bp, Artificial
  CRISPR gRNA sequence
tctaggaaaggaatgaaagg

SEQ ID NO: 759708 - DNA, 20 bp, Artificial
  CRISPR gRNA sequence
ggaaaggaatgaaagggagc

SEQ ID NO: 759709 - DNA, 20 bp, Artificial
  CRISPR gRNA sequence
ggaatgaaagggagcaagtc

SEQ ID NO: 759710 - DNA, 20 bp, Artificial
  CRISPR gRNA sequence
gaatgaaagggagcaagtcc

SEQ ID NO: 759711 - DNA, 20 bp, Artificial
  CRISPR gRNA sequence
aatgaaagggagcaagtcca

SEQ ID NO: 759712 - DNA, 20 bp, Artificial
  CRISPR gRNA sequence
aagggagcaagtccagggcg

SEQ ID NO: 759713 - DNA, 20 bp, Artificial
  CRISPR gRNA sequence
gcaagtccagggcgcagccc

SEQ ID NO: 759714 - DNA, 20 bp, Artificial
  CRISPR gRNA sequence
agtccagggcgcagccctgg

SEQ ID NO: 759715 - DNA, 20 bp, Artificial
  CRISPR gRNA sequence
gaagtccctcatcttccctc

SEQ ID NO: 759716 - DNA, 20 bp, Artificial
  CRISPR gRNA sequence
agtccctcatcttccctctg

SEQ ID NO: 759717 - DNA, 20 bp, Artificial
  CRISPR gRNA sequence
gtccctcatcttccctctgg

SEQ ID NO: 759718 - DNA, 20 bp, Artificial
  CRISPR gRNA sequence
tccctcatcttccctctgga

SEQ ID NO: 759719 - DNA, 20 bp, Artificial
  CRISPR gRNA sequence
ctcatcttccctctggaggg

SEQ ID NO: 759720 - DNA, 20 bp, Artificial
  CRISPR gRNA sequence
cttccctctggagggaagcg

SEQ ID NO: 759721 - DNA, 20 bp, Artificial
  CRISPR gRNA sequence
ctctggagggaagcgcagct

SEQ ID NO: 759722 - DNA, 20 bp, Artificial
  CRISPR gRNA sequence
agggaagcgcagctcggccc

SEQ ID NO: 759723 - DNA, 20 bp, Artificial
  CRISPR gRNA sequence
gggaagcgcagctcggccct

SEQ ID NO: 759724 - DNA, 20 bp, Artificial
  CRISPR gRNA sequence
gaagcgcagctcggccctgg

SEQ ID NO: 759725 - DNA, 20 bp, Artificial
  CRISPR gRNA sequence
agcgcagctcggccctggga

SEQ ID NO: 759726 - DNA, 20 bp, Artificial
  CRISPR gRNA sequence
agctcggccctgggagagcc

SEQ ID NO: 759727 - DNA, 20 bp, Artificial
  CRISPR gRNA sequence
gctcggccctgggagagcct

SEQ ID NO: 759728 - DNA, 20 bp, Artificial
  CRISPR gRNA sequence
cggccctgggagagcctggg

SEQ ID NO: 759729 - DNA, 20 bp, Artificial
  CRISPR gRNA sequence
ggccctgggagagcctgggt

SEQ ID NO: 759730 - DNA, 20 bp, Artificial
  CRISPR gRNA sequence
agagcctgggtaggtctgat

SEQ ID NO: 759731 - DNA, 20 bp, Artificial
  CRISPR gRNA sequence
gagcctgggtaggtctgatc

SEQ ID NO: 759732 - DNA, 20 bp, Artificial
  CRISPR gRNA sequence
agcctgggtaggtctgatca

SEQ ID NO: 759733 - DNA, 20 bp, Artificial
  CRISPR gRNA sequence
gcctgggtaggtctgatcag

SEQ ID NO: 759734 - DNA, 20 bp, Artificial
  CRISPR gRNA sequence
ctgggtaggtctgatcaggg

SEQ ID NO: 759735 - DNA, 20 bp, Artificial
  CRISPR gRNA sequence
tgggtaggtctgatcagggg

SEQ ID NO: 759736 - DNA, 20 bp, Artificial
  CRISPR gRNA sequence
ctctgctccctgtacctgcc

SEQ ID NO: 759737 - DNA, 20 bp, Artificial
  CRISPR gRNA sequence
ctgctccctgtacctgccca

SEQ ID NO: 759738 - DNA, 20 bp, Artificial
  CRISPR gRNA sequence
ctccctgtacctgcccagag

SEQ ID NO: 759739 - DNA, 20 bp, Artificial
  CRISPR gRNA sequence
cctgtacctgcccagagtgg

SEQ ID NO: 759740 - DNA, 20 bp, Artificial
  CRISPR gRNA sequence
ctgtacctgcccagagtggc

SEQ ID NO: 759741 - DNA, 20 bp, Artificial
  CRISPR gRNA sequence
ctgcccagagtggcaggaat

SEQ ID NO: 759742 - DNA, 20 bp, Artificial
  CRISPR gRNA sequence
aggaattagcctgatatatg

SEQ ID NO: 759743 - DNA, 20 bp, Artificial
  CRISPR gRNA sequence
ggaattagcctgatatatga

SEQ ID NO: 759744 - DNA, 20 bp, Artificial
  CRISPR gRNA sequence
aattagcctgatatatgaag

SEQ ID NO: 759745 - DNA, 20 bp, Artificial
  CRISPR gRNA sequence
atgaaggagacaattatatg

SEQ ID NO: 759746 - DNA, 20 bp, Artificial
  CRISPR gRNA sequence
gaaggagacaattatatgaa

SEQ ID NO: 759747 - DNA, 20 bp, Artificial
  CRISPR gRNA sequence
acaattatatgaagagtctt

SEQ ID NO: 759748 - DNA, 20 bp, Artificial
  CRISPR gRNA sequence
atatgaagagtcttgagtac

SEQ ID NO: 759749 - DNA, 20 bp, Artificial
  CRISPR gRNA sequence
tatgaagagtcttgagtacc

SEQ ID NO: 759750 - DNA, 20 bp, Artificial
  CRISPR gRNA sequence
gaagagtcttgagtaccagg

SEQ ID NO: 759751 - DNA, 20 bp, Artificial
  CRISPR gRNA sequence
agagtcttgagtaccaggca

SEQ ID NO: 759752 - DNA, 20 bp, Artificial
  CRISPR gRNA sequence
gagtcttgagtaccaggcag

SEQ ID NO: 759753 - DNA, 20 bp, Artificial
  CRISPR gRNA sequence
ttgagtaccaggcagaggaa

SEQ ID NO: 759754 - DNA, 20 bp, Artificial
  CRISPR gRNA sequence
tgagtaccaggcagaggaat

SEQ ID NO: 759755 - DNA, 20 bp, Artificial
  CRISPR gRNA sequence
gagtaccaggcagaggaatg

SEQ ID NO: 759756 - DNA, 20 bp, Artificial
  CRISPR gRNA sequence
ggaatggggtctgacttcta

SEQ ID NO: 759757 - DNA, 20 bp, Artificial
  CRISPR gRNA sequence
ggtctgacttctatagtgaa

SEQ ID NO: 759758 - DNA, 20 bp, Artificial
  CRISPR gRNA sequence
gtctgacttctatagtgaat

SEQ ID NO: 759759 - DNA, 20 bp, Artificial
  CRISPR gRNA sequence
tctgacttctatagtgaatg

SEQ ID NO: 759760 - DNA, 20 bp, Artificial
  CRISPR gRNA sequence
tgacttctatagtgaatggg

SEQ ID NO: 759761 - DNA, 20 bp, Artificial
  CRISPR gRNA sequence
ctatagtgaatggggagcca

SEQ ID NO: 759762 - DNA, 20 bp, Artificial
  CRISPR gRNA sequence
tatagtgaatggggagccat

SEQ ID NO: 759763 - DNA, 20 bp, Artificial
  CRISPR gRNA sequence
agtgaatggggagccatggg

SEQ ID NO: 759764 - DNA, 20 bp, Artificial
  CRISPR gRNA sequence
gggagccatgggaagttctt

SEQ ID NO: 759765 - DNA, 20 bp, Artificial
  CRISPR gRNA sequence
agccatgggaagttcttgag

SEQ ID NO: 759766 - DNA, 20 bp, Artificial
  CRISPR gRNA sequence
gccatgggaagttcttgagc

SEQ ID NO: 759767 - DNA, 20 bp, Artificial
  CRISPR gRNA sequence
ccatgggaagttcttgagca

SEQ ID NO: 759768 - DNA, 20 bp, Artificial
  CRISPR gRNA sequence
catgggaagttcttgagcag

SEQ ID NO: 759769 - DNA, 20 bp, Artificial
  CRISPR gRNA sequence
tgggaagttcttgagcaggg

SEQ ID NO: 759770 - DNA, 20 bp, Artificial
  CRISPR gRNA sequence
gggaagttcttgagcagggg

SEQ ID NO: 759771 - DNA, 20 bp, Artificial
  CRISPR gRNA sequence
ggaagttcttgagcagggga

SEQ ID NO: 759772 - DNA, 20 bp, Artificial
  CRISPR gRNA sequence
cttgagcaggggagggacat

SEQ ID NO: 759773 - DNA, 20 bp, Artificial
  CRISPR gRNA sequence
gagcaggggagggacatgag

SEQ ID NO: 759774 - DNA, 20 bp, Artificial
  CRISPR gRNA sequence
acatgagcagattcctgtct

SEQ ID NO: 759775 - DNA, 20 bp, Artificial
  CRISPR gRNA sequence
catgagcagattcctgtctt

SEQ ID NO: 759776 - DNA, 20 bp, Artificial
  CRISPR gRNA sequence
agattcctgtcttaggtcct

SEQ ID NO: 759777 - DNA, 20 bp, Artificial
  CRISPR gRNA sequence
attcctgtcttaggtcctaa

SEQ ID NO: 759778 - DNA, 20 bp, Artificial
  CRISPR gRNA sequence
cctgtcttaggtcctaagag

SEQ ID NO: 759779 - DNA, 20 bp, Artificial
  CRISPR gRNA sequence
ctgtcttaggtcctaagaga

SEQ ID NO: 759780 - DNA, 20 bp, Artificial
  CRISPR gRNA sequence
ggtcctaagagaaggcacct

SEQ ID NO: 759781 - DNA, 20 bp, Artificial
  CRISPR gRNA sequence
tcctaagagaaggcacctta

SEQ ID NO: 759782 - DNA, 20 bp, Artificial
  CRISPR gRNA sequence
agagaaggcaccttagagaa

SEQ ID NO: 759783 - DNA, 20 bp, Artificial
  CRISPR gRNA sequence
gagaaggcaccttagagaat

SEQ ID NO: 759784 - DNA, 20 bp, Artificial
  CRISPR gRNA sequence
agaaggcaccttagagaatg

SEQ ID NO: 759785 - DNA, 20 bp, Artificial
  CRISPR gRNA sequence
ggcaccttagagaatggggc

SEQ ID NO: 759786 - DNA, 20 bp, Artificial
  CRISPR gRNA sequence
accttagagaatggggctgg

SEQ ID NO: 759787 - DNA, 20 bp, Artificial
  CRISPR gRNA sequence
ccttagagaatggggctggc

SEQ ID NO: 759788 - DNA, 20 bp, Artificial
  CRISPR gRNA sequence
cttagagaatggggctggca

SEQ ID NO: 759789 - DNA, 20 bp, Artificial
  CRISPR gRNA sequence
gagaatggggctggcaggga

SEQ ID NO: 759790 - DNA, 20 bp, Artificial
  CRISPR gRNA sequence
gaatggggctggcagggaaa

SEQ ID NO: 759791 - DNA, 20 bp, Artificial
  CRISPR gRNA sequence
atggggctggcagggaaaga

SEQ ID NO: 759792 - DNA, 20 bp, Artificial
  CRISPR gRNA sequence
tggggctggcagggaaagag

SEQ ID NO: 759793 - DNA, 20 bp, Artificial
  CRISPR gRNA sequence
gggctggcagggaaagagag

SEQ ID NO: 759794 - DNA, 20 bp, Artificial
  CRISPR gRNA sequence
tggcagggaaagagaggagc

SEQ ID NO: 759795 - DNA, 20 bp, Artificial
  CRISPR gRNA sequence
cagggaaagagaggagcaag

SEQ ID NO: 759796 - DNA, 20 bp, Artificial
  CRISPR gRNA sequence
agggaaagagaggagcaagc

SEQ ID NO: 759797 - DNA, 20 bp, Artificial
  CRISPR gRNA sequence
gggaaagagaggagcaagca

SEQ ID NO: 759798 - DNA, 20 bp, Artificial
  CRISPR gRNA sequence
aagagaggagcaagcagggc

SEQ ID NO: 759799 - DNA, 20 bp, Artificial
  CRISPR gRNA sequence
gaggagcaagcagggccagt

SEQ ID NO: 759800 - DNA, 20 bp, Artificial
  CRISPR gRNA sequence
aggagcaagcagggccagtg

SEQ ID NO: 759801 - DNA, 20 bp, Artificial
  CRISPR gRNA sequence
ggagcaagcagggccagtga

SEQ ID NO: 759802 - DNA, 20 bp, Artificial
  CRISPR gRNA sequence
gagcaagcagggccagtgag

SEQ ID NO: 759803 - DNA, 20 bp, Artificial
  CRISPR gRNA sequence
agcaagcagggccagtgagg

SEQ ID NO: 759804 - DNA, 20 bp, Artificial
  CRISPR gRNA sequence
gcaagcagggccagtgaggg

SEQ ID NO: 759805 - DNA, 20 bp, Artificial
  CRISPR gRNA sequence
agggccagtgaggggggtga

SEQ ID NO: 759806 - DNA, 20 bp, Artificial
  CRISPR gRNA sequence
gggccagtgaggggggtgat

SEQ ID NO: 759807 - DNA, 20 bp, Artificial
  CRISPR gRNA sequence
cagtgaggggggtgatgggt

SEQ ID NO: 759808 - DNA, 20 bp, Artificial
  CRISPR gRNA sequence
agtgaggggggtgatgggtc

SEQ ID NO: 759809 - DNA, 20 bp, Artificial
  CRISPR gRNA sequence
gtgaggggggtgatgggtca

SEQ ID NO: 759810 - DNA, 20 bp, Artificial
  CRISPR gRNA sequence
aggggggtgatgggtcaggg

SEQ ID NO: 759811 - DNA, 20 bp, Artificial
  CRISPR gRNA sequence
ggggggtgatgggtcagggt

SEQ ID NO: 759812 - DNA, 20 bp, Artificial
  CRISPR gRNA sequence
ggggtgatgggtcagggtgg

SEQ ID NO: 759813 - DNA, 20 bp, Artificial
  CRISPR gRNA sequence
tgatgggtcagggtgggaga

SEQ ID NO: 759814 - DNA, 20 bp, Artificial
  CRISPR gRNA sequence
tgggtcagggtgggagatgg

SEQ ID NO: 759815 - DNA, 20 bp, Artificial
  CRISPR gRNA sequence
agggtgggagatggaagctt

SEQ ID NO: 759816 - DNA, 20 bp, Artificial
  CRISPR gRNA sequence
gtgggagatggaagcttgag

SEQ ID NO: 759817 - DNA, 20 bp, Artificial
  CRISPR gRNA sequence
ggagatggaagcttgagaag

SEQ ID NO: 759818 - DNA, 20 bp, Artificial
  CRISPR gRNA sequence
tggaagcttgagaagcagtg

SEQ ID NO: 759819 - DNA, 20 bp, Artificial
  CRISPR gRNA sequence
gaagcttgagaagcagtgtg

SEQ ID NO: 759820 - DNA, 20 bp, Artificial
  CRISPR gRNA sequence
agcttgagaagcagtgtgga

SEQ ID NO: 759821 - DNA, 20 bp, Artificial
  CRISPR gRNA sequence
tgagaagcagtgtggagagt

SEQ ID NO: 759822 - DNA, 20 bp, Artificial
  CRISPR gRNA sequence
gagaagcagtgtggagagtg

SEQ ID NO: 759823 - DNA, 20 bp, Artificial
  CRISPR gRNA sequence
agaagcagtgtggagagtga

SEQ ID NO: 759824 - DNA, 20 bp, Artificial
  CRISPR gRNA sequence
aagcagtgtggagagtgagg

SEQ ID NO: 759825 - DNA, 20 bp, Artificial
  CRISPR gRNA sequence
agcagtgtggagagtgaggg

SEQ ID NO: 759826 - DNA, 20 bp, Artificial
  CRISPR gRNA sequence
agtgtggagagtgagggagg

SEQ ID NO: 759827 - DNA, 20 bp, Artificial
  CRISPR gRNA sequence
ggagagtgagggaggcggcc

SEQ ID NO: 759828 - DNA, 20 bp, Artificial
  CRISPR gRNA sequence
gagagtgagggaggcggccc

SEQ ID NO: 759829 - DNA, 20 bp, Artificial
  CRISPR gRNA sequence
agtgagggaggcggcccagg

SEQ ID NO: 759830 - DNA, 20 bp, Artificial
  CRISPR gRNA sequence
ggcggcccaggaagaaccca

SEQ ID NO: 759831 - DNA, 20 bp, Artificial
  CRISPR gRNA sequence
gcggcccaggaagaacccac

SEQ ID NO: 759832 - DNA, 20 bp, Artificial
  CRISPR gRNA sequence
caggaagaacccacaggcct

SEQ ID NO: 759833 - DNA, 20 bp, Artificial
  CRISPR gRNA sequence
ccacaggccttggttctgtc

SEQ ID NO: 759834 - DNA, 20 bp, Artificial
  CRISPR gRNA sequence
cacaggccttggttctgtct

SEQ ID NO: 759835 - DNA, 20 bp, Artificial
  CRISPR gRNA sequence
acaggccttggttctgtctg

SEQ ID NO: 759836 - DNA, 20 bp, Artificial
  CRISPR gRNA sequence
cttggttctgtctggggtta

SEQ ID NO: 759837 - DNA, 20 bp, Artificial
  CRISPR gRNA sequence
tggttctgtctggggttaaa

SEQ ID NO: 759838 - DNA, 20 bp, Artificial
  CRISPR gRNA sequence
gttctgtctggggttaaaga

SEQ ID NO: 759839 - DNA, 20 bp, Artificial
  CRISPR gRNA sequence
ttctgtctggggttaaagag

SEQ ID NO: 759840 - DNA, 20 bp, Artificial
  CRISPR gRNA sequence
tgtctggggttaaagagagg

SEQ ID NO: 759841 - DNA, 20 bp, Artificial
  CRISPR gRNA sequence
gtctggggttaaagagaggc

SEQ ID NO: 759842 - DNA, 20 bp, Artificial
  CRISPR gRNA sequence
tctggggttaaagagaggca

SEQ ID NO: 759843 - DNA, 20 bp, Artificial
  CRISPR gRNA sequence
tggggttaaagagaggcagg

SEQ ID NO: 759844 - DNA, 20 bp, Artificial
  CRISPR gRNA sequence
taaagagaggcagggagatg

SEQ ID NO: 759845 - DNA, 20 bp, Artificial
  CRISPR gRNA sequence
aggcagggagatgtggaatc

SEQ ID NO: 759846 - DNA, 20 bp, Artificial
  CRISPR gRNA sequence
ggcagggagatgtggaatct

SEQ ID NO: 759847 - DNA, 20 bp, Artificial
  CRISPR gRNA sequence
tctgggcgttcgttcatcct

SEQ ID NO: 759848 - DNA, 20 bp, Artificial
  CRISPR gRNA sequence
cgttcgttcatccttagccc

SEQ ID NO: 759849 - DNA, 20 bp, Artificial
  CRISPR gRNA sequence
cttagccctggtgcttcccg

SEQ ID NO: 759850 - DNA, 20 bp, Artificial
  CRISPR gRNA sequence
ttagccctggtgcttcccgc

SEQ ID NO: 759851 - DNA, 20 bp, Artificial
  CRISPR gRNA sequence
tagccctggtgcttcccgca

SEQ ID NO: 759852 - DNA, 20 bp, Artificial
  CRISPR gRNA sequence
agccctggtgcttcccgcag

SEQ ID NO: 759853 - DNA, 20 bp, Artificial
  CRISPR gRNA sequence
ctggtgcttcccgcaggggt

SEQ ID NO: 759854 - DNA, 20 bp, Artificial
  CRISPR gRNA sequence
tggtgcttcccgcaggggtt

SEQ ID NO: 759855 - DNA, 20 bp, Artificial
  CRISPR gRNA sequence
tgcttcccgcaggggttggg

SEQ ID NO: 759856 - DNA, 20 bp, Artificial
  CRISPR gRNA sequence
gcttcccgcaggggttgggc

SEQ ID NO: 759857 - DNA, 20 bp, Artificial
  CRISPR gRNA sequence
caggggttgggcaggtcctg

SEQ ID NO: 759858 - DNA, 20 bp, Artificial
  CRISPR gRNA sequence
aggggttgggcaggtcctgc

SEQ ID NO: 759859 - DNA, 20 bp, Artificial
  CRISPR gRNA sequence
ggttgggcaggtcctgcagg

SEQ ID NO: 759860 - DNA, 20 bp, Artificial
  CRISPR gRNA sequence
tcctgcaggcagctgcctgc

SEQ ID NO: 759861 - DNA, 20 bp, Artificial
  CRISPR gRNA sequence
ctgcctgctggatcttcctg

SEQ ID NO: 759862 - DNA, 20 bp, Artificial
  CRISPR gRNA sequence
tgcctgctggatcttcctgt

SEQ ID NO: 759863 - DNA, 20 bp, Artificial
  CRISPR gRNA sequence
ctggatcttcctgtgggcct

SEQ ID NO: 759864 - DNA, 20 bp, Artificial
  CRISPR gRNA sequence
tggatcttcctgtgggcctc

SEQ ID NO: 759865 - DNA, 20 bp, Artificial
  CRISPR gRNA sequence
ggatcttcctgtgggcctca

SEQ ID NO: 759866 - DNA, 20 bp, Artificial
  CRISPR gRNA sequence
tcttcctgtgggcctcaggg

SEQ ID NO: 759867 - DNA, 20 bp, Artificial
  CRISPR gRNA sequence
gggcctcagggtggcccttg

SEQ ID NO: 759868 - DNA, 20 bp, Artificial
  CRISPR gRNA sequence
ggcctcagggtggcccttgt

SEQ ID NO: 759869 - DNA, 20 bp, Artificial
  CRISPR gRNA sequence
gcctcagggtggcccttgtg

SEQ ID NO: 759870 - DNA, 20 bp, Artificial
  CRISPR gRNA sequence
tcagggtggcccttgtgggg

SEQ ID NO: 759871 - DNA, 20 bp, Artificial
  CRISPR gRNA sequence
cagggtggcccttgtggggc

SEQ ID NO: 759872 - DNA, 20 bp, Artificial
  CRISPR gRNA sequence
ggcccttgtggggcaggatg

SEQ ID NO: 759873 - DNA, 20 bp, Artificial
  CRISPR gRNA sequence
gcaggatgtggtgcctgcca

SEQ ID NO: 759874 - DNA, 20 bp, Artificial
  CRISPR gRNA sequence
caggatgtggtgcctgccaa

SEQ ID NO: 759875 - DNA, 20 bp, Artificial
  CRISPR gRNA sequence
tgccaaaggtgctttatgaa

SEQ ID NO: 759876 - DNA, 20 bp, Artificial
  CRISPR gRNA sequence
ccaaaggtgctttatgaatg

SEQ ID NO: 759877 - DNA, 20 bp, Artificial
  CRISPR gRNA sequence
aggtgctttatgaatggagc

SEQ ID NO: 759878 - DNA, 20 bp, Artificial
  CRISPR gRNA sequence
ggtgctttatgaatggagcc

SEQ ID NO: 759879 - DNA, 20 bp, Artificial
  CRISPR gRNA sequence
gtgctttatgaatggagccg

SEQ ID NO: 759880 - DNA, 20 bp, Artificial
  CRISPR gRNA sequence
ctttatgaatggagccgggg

SEQ ID NO: 759881 - DNA, 20 bp, Artificial
  CRISPR gRNA sequence
tttatgaatggagccgggga

SEQ ID NO: 759882 - DNA, 20 bp, Artificial
  CRISPR gRNA sequence
gccggggaaggctgctgact

SEQ ID NO: 759883 - DNA, 20 bp, Artificial
  CRISPR gRNA sequence
ggggaaggctgctgactcag

SEQ ID NO: 759884 - DNA, 20 bp, Artificial
  CRISPR gRNA sequence
gggaaggctgctgactcagc

SEQ ID NO: 759885 - DNA, 20 bp, Artificial
  CRISPR gRNA sequence
aaggctgctgactcagcagg

SEQ ID NO: 759886 - DNA, 20 bp, Artificial
  CRISPR gRNA sequence
ctgctgactcagcaggcagt

SEQ ID NO: 759887 - DNA, 20 bp, Artificial
  CRISPR gRNA sequence
tgctgactcagcaggcagta

SEQ ID NO: 759888 - DNA, 20 bp, Artificial
  CRISPR gRNA sequence
tcagcaggcagtaaggcttt

SEQ ID NO: 759889 - DNA, 20 bp, Artificial
  CRISPR gRNA sequence
cagcaggcagtaaggctttg

SEQ ID NO: 759890 - DNA, 20 bp, Artificial
  CRISPR gRNA sequence
aggcagtaaggctttgaggc

SEQ ID NO: 759891 - DNA, 20 bp, Artificial
  CRISPR gRNA sequence
cagtaaggctttgaggccgg

SEQ ID NO: 759892 - DNA, 20 bp, Artificial
  CRISPR gRNA sequence
gctttgaggccggaagcgtc

SEQ ID NO: 759893 - DNA, 20 bp, Artificial
  CRISPR gRNA sequence
tgaggccggaagcgtctgga

SEQ ID NO: 759894 - DNA, 20 bp, Artificial
  CRISPR gRNA sequence
gaggccggaagcgtctggaa

SEQ ID NO: 759895 - DNA, 20 bp, Artificial
  CRISPR gRNA sequence
gccggaagcgtctggaaagg

SEQ ID NO: 759896 - DNA, 20 bp, Artificial
  CRISPR gRNA sequence
ggaagcgtctggaaaggaag

SEQ ID NO: 759897 - DNA, 20 bp, Artificial
  CRISPR gRNA sequence
ctggaaaggaagtggctgct

SEQ ID NO: 759898 - DNA, 20 bp, Artificial
  CRISPR gRNA sequence
tggaaaggaagtggctgctc

SEQ ID NO: 759899 - DNA, 20 bp, Artificial
  CRISPR gRNA sequence
ggaaaggaagtggctgctca

SEQ ID NO: 759900 - DNA, 20 bp, Artificial
  CRISPR gRNA sequence
tgctcagggcttccccactg

SEQ ID NO: 759901 - DNA, 20 bp, Artificial
  CRISPR gRNA sequence
cagggcttccccactgtaga

SEQ ID NO: 759902 - DNA, 20 bp, Artificial
  CRISPR gRNA sequence
gcttccccactgtagacagc

SEQ ID NO: 759903 - DNA, 20 bp, Artificial
  CRISPR gRNA sequence
cttccccactgtagacagct

SEQ ID NO: 759904 - DNA, 20 bp, Artificial
  CRISPR gRNA sequence
tccccactgtagacagctgg

SEQ ID NO: 759905 - DNA, 20 bp, Artificial
  CRISPR gRNA sequence
cccactgtagacagctggga

SEQ ID NO: 759906 - DNA, 20 bp, Artificial
  CRISPR gRNA sequence
actgtagacagctgggagag

SEQ ID NO: 759907 - DNA, 20 bp, Artificial
  CRISPR gRNA sequence
ctgtagacagctgggagaga

SEQ ID NO: 759908 - DNA, 20 bp, Artificial
  CRISPR gRNA sequence
tgtagacagctgggagagaa

SEQ ID NO: 759909 - DNA, 20 bp, Artificial
  CRISPR gRNA sequence
gtagacagctgggagagaag

SEQ ID NO: 759910 - DNA, 20 bp, Artificial
  CRISPR gRNA sequence
tagacagctgggagagaagg

SEQ ID NO: 759911 - DNA, 20 bp, Artificial
  CRISPR gRNA sequence
agacagctgggagagaaggg

SEQ ID NO: 759912 - DNA, 20 bp, Artificial
  CRISPR gRNA sequence
agctgggagagaaggggggc

SEQ ID NO: 759913 - DNA, 20 bp, Artificial
  CRISPR gRNA sequence
gggagagaaggggggctggc

SEQ ID NO: 759914 - DNA, 20 bp, Artificial
  CRISPR gRNA sequence
ggagagaaggggggctggcc

SEQ ID NO: 759915 - DNA, 20 bp, Artificial
  CRISPR gRNA sequence
ggggctggccaggatgcaca

SEQ ID NO: 759916 - DNA, 20 bp, Artificial
  CRISPR gRNA sequence
tggccaggatgcacatggtt

SEQ ID NO: 759917 - DNA, 20 bp, Artificial
  CRISPR gRNA sequence
aggatgcacatggtttggct

SEQ ID NO: 759918 - DNA, 20 bp, Artificial
  CRISPR gRNA sequence
ggatgcacatggtttggctg

SEQ ID NO: 759919 - DNA, 20 bp, Artificial
  CRISPR gRNA sequence
gatgcacatggtttggctga

SEQ ID NO: 759920 - DNA, 20 bp, Artificial
  CRISPR gRNA sequence
gtttggctgagggactccct

SEQ ID NO: 759921 - DNA, 20 bp, Artificial
  CRISPR gRNA sequence
gctgagggactcccttggcc

SEQ ID NO: 759922 - DNA, 20 bp, Artificial
  CRISPR gRNA sequence
gactcccttggcccagctgc

SEQ ID NO: 759923 - DNA, 20 bp, Artificial
  CRISPR gRNA sequence
actcccttggcccagctgct

SEQ ID NO: 759924 - DNA, 20 bp, Artificial
  CRISPR gRNA sequence
ctcccttggcccagctgctg

SEQ ID NO: 759925 - DNA, 20 bp, Artificial
  CRISPR gRNA sequence
tcccttggcccagctgctgg

SEQ ID NO: 759926 - DNA, 20 bp, Artificial
  CRISPR gRNA sequence
ctgctgggggtgtgtgtgtg

SEQ ID NO: 759927 - DNA, 20 bp, Artificial
  CRISPR gRNA sequence
tgctgggggtgtgtgtgtgt

SEQ ID NO: 759928 - DNA, 20 bp, Artificial
  CRISPR gRNA sequence
ctgggggtgtgtgtgtgtag

SEQ ID NO: 759929 - DNA, 20 bp, Artificial
  CRISPR gRNA sequence
ggggtgtgtgtgtgtaggag

SEQ ID NO: 759930 - DNA, 20 bp, Artificial
  CRISPR gRNA sequence
ggtgtgtgtgtgtaggagtg

SEQ ID NO: 759931 - DNA, 20 bp, Artificial
  CRISPR gRNA sequence
gtgtgtgtgtgtaggagtgg

SEQ ID NO: 759932 - DNA, 20 bp, Artificial
  CRISPR gRNA sequence
tgtgtgtgtgtaggagtgga

SEQ ID NO: 759933 - DNA, 20 bp, Artificial
  CRISPR gRNA sequence
gtgtgtgtaggagtggaggg

SEQ ID NO: 759934 - DNA, 20 bp, Artificial
  CRISPR gRNA sequence
tgtgtaggagtggagggtgg

SEQ ID NO: 759935 - DNA, 20 bp, Artificial
  CRISPR gRNA sequence
gtgtaggagtggagggtggc

SEQ ID NO: 759936 - DNA, 20 bp, Artificial
  CRISPR gRNA sequence
tgtaggagtggagggtggcg

SEQ ID NO: 759937 - DNA, 20 bp, Artificial
  CRISPR gRNA sequence
gtaggagtggagggtggcgg

SEQ ID NO: 759938 - DNA, 20 bp, Artificial
  CRISPR gRNA sequence
taggagtggagggtggcggg

SEQ ID NO: 759939 - DNA, 20 bp, Artificial
  CRISPR gRNA sequence
gagtggagggtggcgggggg

SEQ ID NO: 759940 - DNA, 20 bp, Artificial
  CRISPR gRNA sequence
agtggagggtggcggggggc

SEQ ID NO: 759941 - DNA, 20 bp, Artificial
  CRISPR gRNA sequence
tggcggggggcgggtgtgcc

SEQ ID NO: 759942 - DNA, 20 bp, Artificial
  CRISPR gRNA sequence
ggggggcgggtgtgcctggc

SEQ ID NO: 759943 - DNA, 20 bp, Artificial
  CRISPR gRNA sequence
gggggcgggtgtgcctggct

SEQ ID NO: 759944 - DNA, 20 bp, Artificial
  CRISPR gRNA sequence
cgggtgtgcctggctgggat

SEQ ID NO: 759945 - DNA, 20 bp, Artificial
  CRISPR gRNA sequence
gtgtgcctggctgggattgg

SEQ ID NO: 759946 - DNA, 20 bp, Artificial
  CRISPR gRNA sequence
tgtgcctggctgggattgga

SEQ ID NO: 759947 - DNA, 20 bp, Artificial
  CRISPR gRNA sequence
tggctgggattggaaggatt

SEQ ID NO: 759948 - DNA, 20 bp, Artificial
  CRISPR gRNA sequence
ggctgggattggaaggattg

SEQ ID NO: 759949 - DNA, 20 bp, Artificial
  CRISPR gRNA sequence
gggattggaaggattgaggc

SEQ ID NO: 759950 - DNA, 20 bp, Artificial
  CRISPR gRNA sequence
ggattggaaggattgaggct

SEQ ID NO: 759951 - DNA, 20 bp, Artificial
  CRISPR gRNA sequence
aaggattgaggctgggcgcc

SEQ ID NO: 759952 - DNA, 20 bp, Artificial
  CRISPR gRNA sequence
ttgaggctgggcgcctggaa

SEQ ID NO: 759953 - DNA, 20 bp, Artificial
  CRISPR gRNA sequence
tgggcgcctggaatggaatt

SEQ ID NO: 759954 - DNA, 20 bp, Artificial
  CRISPR gRNA sequence
gggcgcctggaatggaattg

SEQ ID NO: 759955 - DNA, 20 bp, Artificial
  CRISPR gRNA sequence
gcctggaatggaattgaggc

SEQ ID NO: 759956 - DNA, 20 bp, Artificial
  CRISPR gRNA sequence
tggaatggaattgaggctag

SEQ ID NO: 759957 - DNA, 20 bp, Artificial
  CRISPR gRNA sequence
tgaggctagcagctgttgat

SEQ ID NO: 759958 - DNA, 20 bp, Artificial
  CRISPR gRNA sequence
gaggctagcagctgttgatg

SEQ ID NO: 759959 - DNA, 20 bp, Artificial
  CRISPR gRNA sequence
tgttgatgaggtttgctccg

SEQ ID NO: 759960 - DNA, 20 bp, Artificial
  CRISPR gRNA sequence
tgatgaggtttgctccgtgg

SEQ ID NO: 759961 - DNA, 20 bp, Artificial
  CRISPR gRNA sequence
gatgaggtttgctccgtgga

SEQ ID NO: 759962 - DNA, 20 bp, Artificial
  CRISPR gRNA sequence
atgaggtttgctccgtggaa

SEQ ID NO: 759963 - DNA, 20 bp, Artificial
  CRISPR gRNA sequence
aggtttgctccgtggaaggg

SEQ ID NO: 759964 - DNA, 20 bp, Artificial
  CRISPR gRNA sequence
ttgctccgtggaagggtgga

SEQ ID NO: 759965 - DNA, 20 bp, Artificial
  CRISPR gRNA sequence
tgctccgtggaagggtggaa

SEQ ID NO: 759966 - DNA, 20 bp, Artificial
  CRISPR gRNA sequence
cgtggaagggtggaaaggtg

SEQ ID NO: 759967 - DNA, 20 bp, Artificial
  CRISPR gRNA sequence
ggaagggtggaaaggtgtag

SEQ ID NO: 759968 - DNA, 20 bp, Artificial
  CRISPR gRNA sequence
gtggaaaggtgtagcagaat

SEQ ID NO: 759969 - DNA, 20 bp, Artificial
  CRISPR gRNA sequence
tagcagaattggactctttt

SEQ ID NO: 759970 - DNA, 20 bp, Artificial
  CRISPR gRNA sequence
ctctttttggctgtgctgac

SEQ ID NO: 759971 - DNA, 20 bp, Artificial
  CRISPR gRNA sequence
caaattacttgacattaaca

SEQ ID NO: 759972 - DNA, 20 bp, Artificial
  CRISPR gRNA sequence
cattaacaaagtcacttatc

SEQ ID NO: 759973 - DNA, 20 bp, Artificial
  CRISPR gRNA sequence
attaacaaagtcacttatct

SEQ ID NO: 759974 - DNA, 20 bp, Artificial
  CRISPR gRNA sequence
attttttttttttttttttt

SEQ ID NO: 759975 - DNA, 20 bp, Artificial
  CRISPR gRNA sequence
ttttttttttttttttgaga

SEQ ID NO: 759976 - DNA, 20 bp, Artificial
  CRISPR gRNA sequence
ttttttttttttttgagaca

SEQ ID NO: 759977 - DNA, 20 bp, Artificial
  CRISPR gRNA sequence
ttttttgagacagagtcttg

SEQ ID NO: 759978 - DNA, 20 bp, Artificial
  CRISPR gRNA sequence
cagagtcttgcagtatcgcc

SEQ ID NO: 759979 - DNA, 20 bp, Artificial
  CRISPR gRNA sequence
tcttgcagtatcgcccagac

SEQ ID NO: 759980 - DNA, 20 bp, Artificial
  CRISPR gRNA sequence
ttgcagtatcgcccagactg

SEQ ID NO: 759981 - DNA, 20 bp, Artificial
  CRISPR gRNA sequence
gtatcgcccagactggagta

SEQ ID NO: 759982 - DNA, 20 bp, Artificial
  CRISPR gRNA sequence
tcgcccagactggagtacag

SEQ ID NO: 759983 - DNA, 20 bp, Artificial
  CRISPR gRNA sequence
tcactacaacctccgcctcc

SEQ ID NO: 759984 - DNA, 20 bp, Artificial
  CRISPR gRNA sequence
cactacaacctccgcctcct

SEQ ID NO: 759985 - DNA, 20 bp, Artificial
  CRISPR gRNA sequence
aacctccgcctcctgggttc

SEQ ID NO: 759986 - DNA, 20 bp, Artificial
  CRISPR gRNA sequence
ttcaagcaattctcctgcct

SEQ ID NO: 759987 - DNA, 20 bp, Artificial
  CRISPR gRNA sequence
ttctcctgcctcagcctcct

SEQ ID NO: 759988 - DNA, 20 bp, Artificial
  CRISPR gRNA sequence
tcctgcctcagcctcctgag

SEQ ID NO: 759989 - DNA, 20 bp, Artificial
  CRISPR gRNA sequence
gcctcagcctcctgagtagc

SEQ ID NO: 759990 - DNA, 20 bp, Artificial
  CRISPR gRNA sequence
ctcctgagtagctggtatta

SEQ ID NO: 759991 - DNA, 20 bp, Artificial
  CRISPR gRNA sequence
tcctgagtagctggtattac

SEQ ID NO: 759992 - DNA, 20 bp, Artificial
  CRISPR gRNA sequence
gtagctggtattacaggcct

SEQ ID NO: 759993 - DNA, 20 bp, Artificial
  CRISPR gRNA sequence
caggcctgagccaccacgcc

SEQ ID NO: 759994 - DNA, 20 bp, Artificial
  CRISPR gRNA sequence
ccagctaatgtttatatttt

SEQ ID NO: 759995 - DNA, 20 bp, Artificial
  CRISPR gRNA sequence
gctaatgtttatatttttag

SEQ ID NO: 759996 - DNA, 20 bp, Artificial
  CRISPR gRNA sequence
gtttatatttttagtagaca

SEQ ID NO: 759997 - DNA, 20 bp, Artificial
  CRISPR gRNA sequence
tttatatttttagtagacac

SEQ ID NO: 759998 - DNA, 20 bp, Artificial
  CRISPR gRNA sequence
ttatatttttagtagacaca

SEQ ID NO: 759999 - DNA, 20 bp, Artificial
  CRISPR gRNA sequence
gacacagggtttcaccatgt

SEQ ID NO: 760000 - DNA, 20 bp, Artificial
  CRISPR gRNA sequence
cagggtttcaccatgttggt

SEQ ID NO: 760001 - DNA, 20 bp, Artificial
  CRISPR gRNA sequence
agggtttcaccatgttggtc

SEQ ID NO: 760002 - DNA, 20 bp, Artificial
  CRISPR gRNA sequence
tttcaccatgttggtcaggc

SEQ ID NO: 760003 - DNA, 20 bp, Artificial
  CRISPR gRNA sequence
acctcgtgatccacccacct

SEQ ID NO: 760004 - DNA, 20 bp, Artificial
  CRISPR gRNA sequence
ccacccacctcggcctccca

SEQ ID NO: 760005 - DNA, 20 bp, Artificial
  CRISPR gRNA sequence
acctcggcctcccaaagtgc

SEQ ID NO: 760006 - DNA, 20 bp, Artificial
  CRISPR gRNA sequence
cctcggcctcccaaagtgct

SEQ ID NO: 760007 - DNA, 20 bp, Artificial
  CRISPR gRNA sequence
ctcccaaagtgctgggatta

SEQ ID NO: 760008 - DNA, 20 bp, Artificial
  CRISPR gRNA sequence
tcccaaagtgctgggattac

SEQ ID NO: 760009 - DNA, 20 bp, Artificial
  CRISPR gRNA sequence
agtgctgggattacaggcat

SEQ ID NO: 760010 - DNA, 20 bp, Artificial
  CRISPR gRNA sequence
caggcatgagccaccacacc

SEQ ID NO: 760011 - DNA, 20 bp, Artificial
  CRISPR gRNA sequence
tgagccaccacacccagcca

SEQ ID NO: 760012 - DNA, 20 bp, Artificial
  CRISPR gRNA sequence
gagccaccacacccagccat

SEQ ID NO: 760013 - DNA, 20 bp, Artificial
  CRISPR gRNA sequence
ccatgggctttaatttttta

SEQ ID NO: 760014 - DNA, 20 bp, Artificial
  CRISPR gRNA sequence
tttttaaagtcctgcaaaaa

SEQ ID NO: 760015 - DNA, 20 bp, Artificial
  CRISPR gRNA sequence
ttttaaagtcctgcaaaaat

SEQ ID NO: 760016 - DNA, 20 bp, Artificial
  CRISPR gRNA sequence
agtcctgcaaaaataggacc

SEQ ID NO: 760017 - DNA, 20 bp, Artificial
  CRISPR gRNA sequence
aaaaataggaccaagtgtta

SEQ ID NO: 760018 - DNA, 20 bp, Artificial
  CRISPR gRNA sequence
aagtgttacagcctatctcc

SEQ ID NO: 760019 - DNA, 20 bp, Artificial
  CRISPR gRNA sequence
agtgttacagcctatctccc

SEQ ID NO: 760020 - DNA, 20 bp, Artificial
  CRISPR gRNA sequence
gtgttacagcctatctccca

SEQ ID NO: 760021 - DNA, 20 bp, Artificial
  CRISPR gRNA sequence
cagcctatctcccagggtat

SEQ ID NO: 760022 - DNA, 20 bp, Artificial
  CRISPR gRNA sequence
agcctatctcccagggtatt

SEQ ID NO: 760023 - DNA, 20 bp, Artificial
  CRISPR gRNA sequence
cctatctcccagggtattag

SEQ ID NO: 760024 - DNA, 20 bp, Artificial
  CRISPR gRNA sequence
ctatctcccagggtattagg

SEQ ID NO: 760025 - DNA, 20 bp, Artificial
  CRISPR gRNA sequence
tcatttctattcttgttgat

SEQ ID NO: 760026 - DNA, 20 bp, Artificial
  CRISPR gRNA sequence
ctattcttgttgatcagtgt

SEQ ID NO: 760027 - DNA, 20 bp, Artificial
  CRISPR gRNA sequence
tcttgttgatcagtgttggt

SEQ ID NO: 760028 - DNA, 20 bp, Artificial
  CRISPR gRNA sequence
ttgatcagtgttggttggca

SEQ ID NO: 760029 - DNA, 20 bp, Artificial
  CRISPR gRNA sequence
agtgttggttggcatagatg

SEQ ID NO: 760030 - DNA, 20 bp, Artificial
  CRISPR gRNA sequence
tggcatagatgtggcttgat

SEQ ID NO: 760031 - DNA, 20 bp, Artificial
  CRISPR gRNA sequence
ggcatagatgtggcttgatc

SEQ ID NO: 760032 - DNA, 20 bp, Artificial
  CRISPR gRNA sequence
gatgtggcttgatcaggaca

SEQ ID NO: 760033 - DNA, 20 bp, Artificial
  CRISPR gRNA sequence
caggacatggcacaaatgtt

SEQ ID NO: 760034 - DNA, 20 bp, Artificial
  CRISPR gRNA sequence
aggacatggcacaaatgttt

SEQ ID NO: 760035 - DNA, 20 bp, Artificial
  CRISPR gRNA sequence
acatggcacaaatgtttagg

SEQ ID NO: 760036 - DNA, 20 bp, Artificial
  CRISPR gRNA sequence
tggcacaaatgtttaggcag

SEQ ID NO: 760037 - DNA, 20 bp, Artificial
  CRISPR gRNA sequence
aaatgtttaggcagcagctg

SEQ ID NO: 760038 - DNA, 20 bp, Artificial
  CRISPR gRNA sequence
aatgtttaggcagcagctgt

SEQ ID NO: 760039 - DNA, 20 bp, Artificial
  CRISPR gRNA sequence
taggcagcagctgtgggact

SEQ ID NO: 760040 - DNA, 20 bp, Artificial
  CRISPR gRNA sequence
aggcagcagctgtgggactc

SEQ ID NO: 760041 - DNA, 20 bp, Artificial
  CRISPR gRNA sequence
ggcagcagctgtgggactca

SEQ ID NO: 760042 - DNA, 20 bp, Artificial
  CRISPR gRNA sequence
cagctgtgggactcagggac

SEQ ID NO: 760043 - DNA, 20 bp, Artificial
  CRISPR gRNA sequence
agctgtgggactcagggaca

SEQ ID NO: 760044 - DNA, 20 bp, Artificial
  CRISPR gRNA sequence
actcagggacaaggtgtgtg

SEQ ID NO: 760045 - DNA, 20 bp, Artificial
  CRISPR gRNA sequence
gggacaaggtgtgtgcagcc

SEQ ID NO: 760046 - DNA, 20 bp, Artificial
  CRISPR gRNA sequence
gacaaggtgtgtgcagcctg

SEQ ID NO: 760047 - DNA, 20 bp, Artificial
  CRISPR gRNA sequence
acaaggtgtgtgcagcctgg

SEQ ID NO: 760048 - DNA, 20 bp, Artificial
  CRISPR gRNA sequence
caaggtgtgtgcagcctgga

SEQ ID NO: 760049 - DNA, 20 bp, Artificial
  CRISPR gRNA sequence
ggtgtgtgcagcctggaggg

SEQ ID NO: 760050 - DNA, 20 bp, Artificial
  CRISPR gRNA sequence
tgtgcagcctggagggtggc

SEQ ID NO: 760051 - DNA, 20 bp, Artificial
  CRISPR gRNA sequence
gtgcagcctggagggtggct

SEQ ID NO: 760052 - DNA, 20 bp, Artificial
  CRISPR gRNA sequence
gcctggagggtggctgggat

SEQ ID NO: 760053 - DNA, 20 bp, Artificial
  CRISPR gRNA sequence
cctggagggtggctgggatt

SEQ ID NO: 760054 - DNA, 20 bp, Artificial
  CRISPR gRNA sequence
tggagggtggctgggattgg

SEQ ID NO: 760055 - DNA, 20 bp, Artificial
  CRISPR gRNA sequence
agggtggctgggattgggag

SEQ ID NO: 760056 - DNA, 20 bp, Artificial
  CRISPR gRNA sequence
gggtggctgggattgggagc

SEQ ID NO: 760057 - DNA, 20 bp, Artificial
  CRISPR gRNA sequence
ggtggctgggattgggagca

SEQ ID NO: 760058 - DNA, 20 bp, Artificial
  CRISPR gRNA sequence
gctgggattgggagcagggc

SEQ ID NO: 760059 - DNA, 20 bp, Artificial
  CRISPR gRNA sequence
attgggagcagggctggatt

SEQ ID NO: 760060 - DNA, 20 bp, Artificial
  CRISPR gRNA sequence
ttgggagcagggctggattt

SEQ ID NO: 760061 - DNA, 20 bp, Artificial
  CRISPR gRNA sequence
tgggagcagggctggattta

SEQ ID NO: 760062 - DNA, 20 bp, Artificial
  CRISPR gRNA sequence
atgtctgcccttctcatccc

SEQ ID NO: 760063 - DNA, 20 bp, Artificial
  CRISPR gRNA sequence
tgcccttctcatccccagct

SEQ ID NO: 760064 - DNA, 20 bp, Artificial
  CRISPR gRNA sequence
gcccttctcatccccagctc

SEQ ID NO: 760065 - DNA, 20 bp, Artificial
  CRISPR gRNA sequence
cccagctcaggcctgacctg

SEQ ID NO: 760066 - DNA, 20 bp, Artificial
  CRISPR gRNA sequence
tcaggcctgacctgcagcca

SEQ ID NO: 760067 - DNA, 20 bp, Artificial
  CRISPR gRNA sequence
ccacagacttgcctcttact

SEQ ID NO: 760068 - DNA, 20 bp, Artificial
  CRISPR gRNA sequence
ctcttactcagtcctgactc

SEQ ID NO: 760069 - DNA, 20 bp, Artificial
  CRISPR gRNA sequence
tcagtcctgactccagcctt

SEQ ID NO: 760070 - DNA, 20 bp, Artificial
  CRISPR gRNA sequence
cagtcctgactccagccttg

SEQ ID NO: 760071 - DNA, 20 bp, Artificial
  CRISPR gRNA sequence
ccagccttgaggtcatcccc

SEQ ID NO: 760072 - DNA, 20 bp, Artificial
  CRISPR gRNA sequence
cttccacttctgatctgtct

SEQ ID NO: 760073 - DNA, 20 bp, Artificial
  CRISPR gRNA sequence
tctgtcttggtcactcaata

SEQ ID NO: 760074 - DNA, 20 bp, Artificial
  CRISPR gRNA sequence
tcactcaatacagatgtgtt

SEQ ID NO: 760075 - DNA, 20 bp, Artificial
  CRISPR gRNA sequence
tcaatacagatgtgttaagc

SEQ ID NO: 760076 - DNA, 20 bp, Artificial
  CRISPR gRNA sequence
cattcccacactcatacacc

SEQ ID NO: 760077 - DNA, 20 bp, Artificial
  CRISPR gRNA sequence
cgcctcctaaaactctgtcc

SEQ ID NO: 760078 - DNA, 20 bp, Artificial
  CRISPR gRNA sequence
ctcctaaaactctgtcctag

SEQ ID NO: 760079 - DNA, 20 bp, Artificial
  CRISPR gRNA sequence
aaatactgctgatttcacac

SEQ ID NO: 760080 - DNA, 20 bp, Artificial
  CRISPR gRNA sequence
cccttccattttctctgcct

SEQ ID NO: 760081 - DNA, 20 bp, Artificial
  CRISPR gRNA sequence
gaatgctccaccctgtcact

SEQ ID NO: 760082 - DNA, 20 bp, Artificial
  CRISPR gRNA sequence
aatgctccaccctgtcactg

SEQ ID NO: 760083 - DNA, 20 bp, Artificial
  CRISPR gRNA sequence
gtcactgaggctcaaaacca

SEQ ID NO: 760084 - DNA, 20 bp, Artificial
  CRISPR gRNA sequence
actgctctttctctctaccc

SEQ ID NO: 760085 - DNA, 20 bp, Artificial
  CRISPR gRNA sequence
tttctctctacccaagtcct

SEQ ID NO: 760086 - DNA, 20 bp, Artificial
  CRISPR gRNA sequence
cagatactgtcacttttacc

SEQ ID NO: 760087 - DNA, 20 bp, Artificial
  CRISPR gRNA sequence
gacatgctttgtctcctgtc

SEQ ID NO: 760088 - DNA, 20 bp, Artificial
  CRISPR gRNA sequence
tccaccactataccttccta

SEQ ID NO: 760089 - DNA, 20 bp, Artificial
  CRISPR gRNA sequence
ccaccactataccttcctac

SEQ ID NO: 760090 - DNA, 20 bp, Artificial
  CRISPR gRNA sequence
caccactataccttcctaca

SEQ ID NO: 760091 - DNA, 20 bp, Artificial
  CRISPR gRNA sequence
actataccttcctacaggga

SEQ ID NO: 760092 - DNA, 20 bp, Artificial
  CRISPR gRNA sequence
tcctacagggatggctatat

SEQ ID NO: 760093 - DNA, 20 bp, Artificial
  CRISPR gRNA sequence
tttttttatttttatttttt

SEQ ID NO: 760094 - DNA, 20 bp, Artificial
  CRISPR gRNA sequence
tatttttattttttgagatc

SEQ ID NO: 760095 - DNA, 20 bp, Artificial
  CRISPR gRNA sequence
ttattttttgagatcgagtc

SEQ ID NO: 760096 - DNA, 20 bp, Artificial
  CRISPR gRNA sequence
tcgagtctggctctgtcacc

SEQ ID NO: 760097 - DNA, 20 bp, Artificial
  CRISPR gRNA sequence
tctggctctgtcacccagtc

SEQ ID NO: 760098 - DNA, 20 bp, Artificial
  CRISPR gRNA sequence
tggctctgtcacccagtctg

SEQ ID NO: 760099 - DNA, 20 bp, Artificial
  CRISPR gRNA sequence
ctgtcacccagtctggagtg

SEQ ID NO: 760100 - DNA, 20 bp, Artificial
  CRISPR gRNA sequence
tcacccagtctggagtgcag

SEQ ID NO: 760101 - DNA, 20 bp, Artificial
  CRISPR gRNA sequence
ggagtgcagtggtgcaatct

SEQ ID NO: 760102 - DNA, 20 bp, Artificial
  CRISPR gRNA sequence
ttactgcaacctctgcctcc

SEQ ID NO: 760103 - DNA, 20 bp, Artificial
  CRISPR gRNA sequence
tactgcaacctctgcctcct

SEQ ID NO: 760104 - DNA, 20 bp, Artificial
  CRISPR gRNA sequence
aacctctgcctcctgggttc

SEQ ID NO: 760105 - DNA, 20 bp, Artificial
  CRISPR gRNA sequence
ttctcctgcctcaccctccc

SEQ ID NO: 760106 - DNA, 20 bp, Artificial
  CRISPR gRNA sequence
tcctgcctcaccctcccaag

SEQ ID NO: 760107 - DNA, 20 bp, Artificial
  CRISPR gRNA sequence
gcctcaccctcccaagtagc

SEQ ID NO: 760108 - DNA, 20 bp, Artificial
  CRISPR gRNA sequence
cctcaccctcccaagtagct

SEQ ID NO: 760109 - DNA, 20 bp, Artificial
  CRISPR gRNA sequence
ctcccaagtagctgggatta

SEQ ID NO: 760110 - DNA, 20 bp, Artificial
  CRISPR gRNA sequence
tcccaagtagctgggattac

SEQ ID NO: 760111 - DNA, 20 bp, Artificial
  CRISPR gRNA sequence
caggtgcccaccaccatgcc

SEQ ID NO: 760112 - DNA, 20 bp, Artificial
  CRISPR gRNA sequence
cagctaattatttgtatttt

SEQ ID NO: 760113 - DNA, 20 bp, Artificial
  CRISPR gRNA sequence
ctaattatttgtatttttag

SEQ ID NO: 760114 - DNA, 20 bp, Artificial
  CRISPR gRNA sequence
aattatttgtatttttagta

SEQ ID NO: 760115 - DNA, 20 bp, Artificial
  CRISPR gRNA sequence
atttgtatttttagtagaga

SEQ ID NO: 760116 - DNA, 20 bp, Artificial
  CRISPR gRNA sequence
tttgtatttttagtagagat

SEQ ID NO: 760117 - DNA, 20 bp, Artificial
  CRISPR gRNA sequence
ttgtatttttagtagagatg

SEQ ID NO: 760118 - DNA, 20 bp, Artificial
  CRISPR gRNA sequence
tttcaccatgttgttcaaac

SEQ ID NO: 760119 - DNA, 20 bp, Artificial
  CRISPR gRNA sequence
ggtcacaaactcctgacttc

SEQ ID NO: 760120 - DNA, 20 bp, Artificial
  CRISPR gRNA sequence
ttcaagtgattcgcctgcct

SEQ ID NO: 760121 - DNA, 20 bp, Artificial
  CRISPR gRNA sequence
tcgcctgcctcagcctccca

SEQ ID NO: 760122 - DNA, 20 bp, Artificial
  CRISPR gRNA sequence
gcctcagcctcccaaagtgc

SEQ ID NO: 760123 - DNA, 20 bp, Artificial
  CRISPR gRNA sequence
cctcagcctcccaaagtgct

SEQ ID NO: 760124 - DNA, 20 bp, Artificial
  CRISPR gRNA sequence
ctcccaaagtgctgggatta

SEQ ID NO: 760125 - DNA, 20 bp, Artificial
  CRISPR gRNA sequence
tcccaaagtgctgggattac

SEQ ID NO: 760126 - DNA, 20 bp, Artificial
  CRISPR gRNA sequence
agtgctgggattacaggcat

SEQ ID NO: 760127 - DNA, 20 bp, Artificial
  CRISPR gRNA sequence
caggcatgagccactgcact

SEQ ID NO: 760128 - DNA, 20 bp, Artificial
  CRISPR gRNA sequence
ccactgcactcagcctgaaa

SEQ ID NO: 760129 - DNA, 20 bp, Artificial
  CRISPR gRNA sequence
gcctgaaatagcctcttaac

SEQ ID NO: 760130 - DNA, 20 bp, Artificial
  CRISPR gRNA sequence
tcccttgccctgatacaatc

SEQ ID NO: 760131 - DNA, 20 bp, Artificial
  CRISPR gRNA sequence
gatacaatccagtctatgct

SEQ ID NO: 760132 - DNA, 20 bp, Artificial
  CRISPR gRNA sequence
atacaatccagtctatgctg

SEQ ID NO: 760133 - DNA, 20 bp, Artificial
  CRISPR gRNA sequence
acaatccagtctatgctgag

SEQ ID NO: 760134 - DNA, 20 bp, Artificial
  CRISPR gRNA sequence
tccagtctatgctgaggagc

SEQ ID NO: 760135 - DNA, 20 bp, Artificial
  CRISPR gRNA sequence
cagtctatgctgaggagcta

SEQ ID NO: 760136 - DNA, 20 bp, Artificial
  CRISPR gRNA sequence
tctatgctgaggagctagag

SEQ ID NO: 760137 - DNA, 20 bp, Artificial
  CRISPR gRNA sequence
ctatgctgaggagctagagt

SEQ ID NO: 760138 - DNA, 20 bp, Artificial
  CRISPR gRNA sequence
gggttttaaacattgttacc

SEQ ID NO: 760139 - DNA, 20 bp, Artificial
  CRISPR gRNA sequence
tgtgtgattaaaatgctccc

SEQ ID NO: 760140 - DNA, 20 bp, Artificial
  CRISPR gRNA sequence
ccagtgattcccattactca

SEQ ID NO: 760141 - DNA, 20 bp, Artificial
  CRISPR gRNA sequence
gaaaaacccaaattcctcac

SEQ ID NO: 760142 - DNA, 20 bp, Artificial
  CRISPR gRNA sequence
aattcctcactggtctctca

SEQ ID NO: 760143 - DNA, 20 bp, Artificial
  CRISPR gRNA sequence
tctcaaagccctgcttgatc

SEQ ID NO: 760144 - DNA, 20 bp, Artificial
  CRISPR gRNA sequence
gctgaaacataccctcccat

SEQ ID NO: 760145 - DNA, 20 bp, Artificial
  CRISPR gRNA sequence
aaacataccctcccatcaga

SEQ ID NO: 760146 - DNA, 20 bp, Artificial
  CRISPR gRNA sequence
cataccctcccatcagatag

SEQ ID NO: 760147 - DNA, 20 bp, Artificial
  CRISPR gRNA sequence
ataccctcccatcagatagc

SEQ ID NO: 760148 - DNA, 20 bp, Artificial
  CRISPR gRNA sequence
ccctcccatcagatagcggg

SEQ ID NO: 760149 - DNA, 20 bp, Artificial
  CRISPR gRNA sequence
ctcccatcagatagcgggtg

SEQ ID NO: 760150 - DNA, 20 bp, Artificial
  CRISPR gRNA sequence
tcccatcagatagcgggtgg

SEQ ID NO: 760151 - DNA, 20 bp, Artificial
  CRISPR gRNA sequence
atagcgggtggaggtgctgt

SEQ ID NO: 760152 - DNA, 20 bp, Artificial
  CRISPR gRNA sequence
ctgtcagattaatcttcatg

SEQ ID NO: 760153 - DNA, 20 bp, Artificial
  CRISPR gRNA sequence
agattaatcttcatgaagct

SEQ ID NO: 760154 - DNA, 20 bp, Artificial
  CRISPR gRNA sequence
gaccgtgtatttcccttatt

SEQ ID NO: 760155 - DNA, 20 bp, Artificial
  CRISPR gRNA sequence
accgtgtatttcccttattc

SEQ ID NO: 760156 - DNA, 20 bp, Artificial
  CRISPR gRNA sequence
gtgtatttcccttattcagg

SEQ ID NO: 760157 - DNA, 20 bp, Artificial
  CRISPR gRNA sequence
ttcccttattcaggaagctt

SEQ ID NO: 760158 - DNA, 20 bp, Artificial
  CRISPR gRNA sequence
ccttattcaggaagcttcag

SEQ ID NO: 760159 - DNA, 20 bp, Artificial
  CRISPR gRNA sequence
cagtggctctcaactgcctt

SEQ ID NO: 760160 - DNA, 20 bp, Artificial
  CRISPR gRNA sequence
agtggctctcaactgccttt

SEQ ID NO: 760161 - DNA, 20 bp, Artificial
  CRISPR gRNA sequence
aggatacatttcacacctgt

SEQ ID NO: 760162 - DNA, 20 bp, Artificial
  CRISPR gRNA sequence
acacctgtcagcccatctct

SEQ ID NO: 760163 - DNA, 20 bp, Artificial
  CRISPR gRNA sequence
tgtcagcccatctctaagtc

SEQ ID NO: 760164 - DNA, 20 bp, Artificial
  CRISPR gRNA sequence
atctctaagtctggccccca

SEQ ID NO: 760165 - DNA, 20 bp, Artificial
  CRISPR gRNA sequence
tctctaagtctggcccccac

SEQ ID NO: 760166 - DNA, 20 bp, Artificial
  CRISPR gRNA sequence
tctaagtctggcccccacag

SEQ ID NO: 760167 - DNA, 20 bp, Artificial
  CRISPR gRNA sequence
gagctcctgctctgccctac

SEQ ID NO: 760168 - DNA, 20 bp, Artificial
  CRISPR gRNA sequence
aaattgatctgcacacatcc

SEQ ID NO: 760169 - DNA, 20 bp, Artificial
  CRISPR gRNA sequence
atctgcacacatcctagccc

SEQ ID NO: 760170 - DNA, 20 bp, Artificial
  CRISPR gRNA sequence
ctgcacacatcctagcccca

SEQ ID NO: 760171 - DNA, 20 bp, Artificial
  CRISPR gRNA sequence
acacatcctagccccagagc

SEQ ID NO: 760172 - DNA, 20 bp, Artificial
  CRISPR gRNA sequence
tgcctcctcttccttatatt

SEQ ID NO: 760173 - DNA, 20 bp, Artificial
  CRISPR gRNA sequence
atatttggatactaacatct

SEQ ID NO: 760174 - DNA, 20 bp, Artificial
  CRISPR gRNA sequence
gatactaacatcttagctga

SEQ ID NO: 760175 - DNA, 20 bp, Artificial
  CRISPR gRNA sequence
atactaacatcttagctgaa

SEQ ID NO: 760176 - DNA, 20 bp, Artificial
  CRISPR gRNA sequence
tactaacatcttagctgaaa

SEQ ID NO: 760177 - DNA, 20 bp, Artificial
  CRISPR gRNA sequence
taacatcttagctgaaaggg

SEQ ID NO: 760178 - DNA, 20 bp, Artificial
  CRISPR gRNA sequence
ttagctgaaagggtggatcc

SEQ ID NO: 760179 - DNA, 20 bp, Artificial
  CRISPR gRNA sequence
ccctaccccatcttccctgt

SEQ ID NO: 760180 - DNA, 20 bp, Artificial
  CRISPR gRNA sequence
cctaccccatcttccctgtc

SEQ ID NO: 760181 - DNA, 20 bp, Artificial
  CRISPR gRNA sequence
tcttccctgtcaggcctccc

SEQ ID NO: 760182 - DNA, 20 bp, Artificial
  CRISPR gRNA sequence
cttccctgtcaggcctcccc

SEQ ID NO: 760183 - DNA, 20 bp, Artificial
  CRISPR gRNA sequence
ttccctgtcaggcctcccca

SEQ ID NO: 760184 - DNA, 20 bp, Artificial
  CRISPR gRNA sequence
ctccccagggactccctgcc

SEQ ID NO: 760185 - DNA, 20 bp, Artificial
  CRISPR gRNA sequence
cctgccaagcatctgtcacc

SEQ ID NO: 760186 - DNA, 20 bp, Artificial
  CRISPR gRNA sequence
catctgtcaccaagattcct

SEQ ID NO: 760187 - DNA, 20 bp, Artificial
  CRISPR gRNA sequence
ctgtcaccaagattcctcag

SEQ ID NO: 760188 - DNA, 20 bp, Artificial
  CRISPR gRNA sequence
tgtcaccaagattcctcagc

SEQ ID NO: 760189 - DNA, 20 bp, Artificial
  CRISPR gRNA sequence
gtcaccaagattcctcagca

SEQ ID NO: 760190 - DNA, 20 bp, Artificial
  CRISPR gRNA sequence
tcaccaagattcctcagcag

SEQ ID NO: 760191 - DNA, 20 bp, Artificial
  CRISPR gRNA sequence
caccaagattcctcagcagg

SEQ ID NO: 760192 - DNA, 20 bp, Artificial
  CRISPR gRNA sequence
agattcctcagcagggggcc

SEQ ID NO: 760193 - DNA, 20 bp, Artificial
  CRISPR gRNA sequence
ttcctcagcagggggcccgg

SEQ ID NO: 760194 - DNA, 20 bp, Artificial
  CRISPR gRNA sequence
tcctcagcagggggcccggt

SEQ ID NO: 760195 - DNA, 20 bp, Artificial
  CRISPR gRNA sequence
gcagggggcccggtgggata

SEQ ID NO: 760196 - DNA, 20 bp, Artificial
  CRISPR gRNA sequence
cagggggcccggtgggatat

SEQ ID NO: 760197 - DNA, 20 bp, Artificial
  CRISPR gRNA sequence
gcccggtgggatatgggaat

SEQ ID NO: 760198 - DNA, 20 bp, Artificial
  CRISPR gRNA sequence
cccggtgggatatgggaatg

SEQ ID NO: 760199 - DNA, 20 bp, Artificial
  CRISPR gRNA sequence
atatgggaatgaggacctcc

SEQ ID NO: 760200 - DNA, 20 bp, Artificial
  CRISPR gRNA sequence
tgggaatgaggacctcccag

SEQ ID NO: 760201 - DNA, 20 bp, Artificial
  CRISPR gRNA sequence
gggaatgaggacctcccagt

SEQ ID NO: 760202 - DNA, 20 bp, Artificial
  CRISPR gRNA sequence
aatgaggacctcccagtggg

SEQ ID NO: 760203 - DNA, 20 bp, Artificial
  CRISPR gRNA sequence
gacctcccagtgggcagttg

SEQ ID NO: 760204 - DNA, 20 bp, Artificial
  CRISPR gRNA sequence
agttgcagccttccccactc

SEQ ID NO: 760205 - DNA, 20 bp, Artificial
  CRISPR gRNA sequence
cagccttccccactctggtc

SEQ ID NO: 760206 - DNA, 20 bp, Artificial
  CRISPR gRNA sequence
agccttccccactctggtcc

SEQ ID NO: 760207 - DNA, 20 bp, Artificial
  CRISPR gRNA sequence
ccttccccactctggtccag

SEQ ID NO: 760208 - DNA, 20 bp, Artificial
  CRISPR gRNA sequence
ttccccactctggtccagga

SEQ ID NO: 760209 - DNA, 20 bp, Artificial
  CRISPR gRNA sequence
cactctggtccaggagagat

SEQ ID NO: 760210 - DNA, 20 bp, Artificial
  CRISPR gRNA sequence
actctggtccaggagagatg

SEQ ID NO: 760211 - DNA, 20 bp, Artificial
  CRISPR gRNA sequence
tggtccaggagagatgaggc

SEQ ID NO: 760212 - DNA, 20 bp, Artificial
  CRISPR gRNA sequence
gtccaggagagatgaggcaa

SEQ ID NO: 760213 - DNA, 20 bp, Artificial
  CRISPR gRNA sequence
aggagagatgaggcaagaga

SEQ ID NO: 760214 - DNA, 20 bp, Artificial
  CRISPR gRNA sequence
agatgaggcaagagatggtc

SEQ ID NO: 760215 - DNA, 20 bp, Artificial
  CRISPR gRNA sequence
gatgaggcaagagatggtct

SEQ ID NO: 760216 - DNA, 20 bp, Artificial
  CRISPR gRNA sequence
atgaggcaagagatggtctg

SEQ ID NO: 760217 - DNA, 20 bp, Artificial
  CRISPR gRNA sequence
gaggcaagagatggtctggg

SEQ ID NO: 760218 - DNA, 20 bp, Artificial
  CRISPR gRNA sequence
gatggtctggggagaacctt

SEQ ID NO: 760219 - DNA, 20 bp, Artificial
  CRISPR gRNA sequence
tggtctggggagaacctttg

SEQ ID NO: 760220 - DNA, 20 bp, Artificial
  CRISPR gRNA sequence
ggggagaacctttggagaca

SEQ ID NO: 760221 - DNA, 20 bp, Artificial
  CRISPR gRNA sequence
gggagaacctttggagacaa

SEQ ID NO: 760222 - DNA, 20 bp, Artificial
  CRISPR gRNA sequence
gccttgcgtcctctttctcc

SEQ ID NO: 760223 - DNA, 20 bp, Artificial
  CRISPR gRNA sequence
ccttgcgtcctctttctccc

SEQ ID NO: 760224 - DNA, 20 bp, Artificial
  CRISPR gRNA sequence
tgcgtcctctttctcccagg

SEQ ID NO: 760225 - DNA, 20 bp, Artificial
  CRISPR gRNA sequence
gcgtcctctttctcccaggc

SEQ ID NO: 760226 - DNA, 20 bp, Artificial
  CRISPR gRNA sequence
cgtcctctttctcccaggca

SEQ ID NO: 760227 - DNA, 20 bp, Artificial
  CRISPR gRNA sequence
gtcctctttctcccaggcag

SEQ ID NO: 760228 - DNA, 20 bp, Artificial
  CRISPR gRNA sequence
ctctttctcccaggcagggg

SEQ ID NO: 760229 - DNA, 20 bp, Artificial
  CRISPR gRNA sequence
gcaggggcagccttccacca

SEQ ID NO: 760230 - DNA, 20 bp, Artificial
  CRISPR gRNA sequence
caggggcagccttccaccac

SEQ ID NO: 760231 - DNA, 20 bp, Artificial
  CRISPR gRNA sequence
aggggcagccttccaccacg

SEQ ID NO: 760232 - DNA, 20 bp, Artificial
  CRISPR gRNA sequence
gggcagccttccaccacggg

SEQ ID NO: 760233 - DNA, 20 bp, Artificial
  CRISPR gRNA sequence
gccttccaccacggggagcc

SEQ ID NO: 760234 - DNA, 20 bp, Artificial
  CRISPR gRNA sequence
accacggggagcccagctgt

SEQ ID NO: 760235 - DNA, 20 bp, Artificial
  CRISPR gRNA sequence
cccagctgtcagccgcctca

SEQ ID NO: 760236 - DNA, 20 bp, Artificial
  CRISPR gRNA sequence
ccagctgtcagccgcctcac

SEQ ID NO: 760237 - DNA, 20 bp, Artificial
  CRISPR gRNA sequence
gctgtcagccgcctcacagg

SEQ ID NO: 760238 - DNA, 20 bp, Artificial
  CRISPR gRNA sequence
ctcacaggaagatgctgcgt

SEQ ID NO: 760239 - DNA, 20 bp, Artificial
  CRISPR gRNA sequence
acaggaagatgctgcgtcgg

SEQ ID NO: 760240 - DNA, 20 bp, Artificial
  CRISPR gRNA sequence
caggaagatgctgcgtcggc

SEQ ID NO: 760241 - DNA, 20 bp, Artificial
  CRISPR gRNA sequence
aggaagatgctgcgtcggcg

SEQ ID NO: 760242 - DNA, 20 bp, Artificial
  CRISPR gRNA sequence
aagatgctgcgtcggcgggg

SEQ ID NO: 760243 - DNA, 20 bp, Artificial
  CRISPR gRNA sequence
ctgcgtcggcggggcagccc

SEQ ID NO: 760244 - DNA, 20 bp, Artificial
  CRISPR gRNA sequence
tcggcggggcagccctggca

SEQ ID NO: 760245 - DNA, 20 bp, Artificial
  CRISPR gRNA sequence
cggcggggcagccctggcat

SEQ ID NO: 760246 - DNA, 20 bp, Artificial
  CRISPR gRNA sequence
ccctggcatgggtgtgcatg

SEQ ID NO: 760247 - DNA, 20 bp, Artificial
  CRISPR gRNA sequence
cctggcatgggtgtgcatgt

SEQ ID NO: 760248 - DNA, 20 bp, Artificial
  CRISPR gRNA sequence
catgggtgtgcatgtgggtg

SEQ ID NO: 760249 - DNA, 20 bp, Artificial
  CRISPR gRNA sequence
tgtgcatgtgggtgcagccc

SEQ ID NO: 760250 - DNA, 20 bp, Artificial
  CRISPR gRNA sequence
gtgcatgtgggtgcagccct

SEQ ID NO: 760251 - DNA, 20 bp, Artificial
  CRISPR gRNA sequence
gcatgtgggtgcagccctgg

SEQ ID NO: 760252 - DNA, 20 bp, Artificial
  CRISPR gRNA sequence
gtgcagccctgggagcactg

SEQ ID NO: 760253 - DNA, 20 bp, Artificial
  CRISPR gRNA sequence
agcactgtggttctgcctca

SEQ ID NO: 760254 - DNA, 20 bp, Artificial
  CRISPR gRNA sequence
gcactgtggttctgcctcac

SEQ ID NO: 760255 - DNA, 20 bp, Artificial
  CRISPR gRNA sequence
tgtggttctgcctcacaggt

SEQ ID NO: 760256 - DNA, 20 bp, Artificial
  CRISPR gRNA sequence
gtggttctgcctcacaggtg

SEQ ID NO: 760257 - DNA, 20 bp, Artificial
  CRISPR gRNA sequence
tggttctgcctcacaggtga

SEQ ID NO: 760258 - DNA, 20 bp, Artificial
  CRISPR gRNA sequence
ttctgcctcacaggtgaggg

SEQ ID NO: 760259 - DNA, 20 bp, Artificial
  CRISPR gRNA sequence
tgcctcacaggtgagggtag

SEQ ID NO: 760260 - DNA, 20 bp, Artificial
  CRISPR gRNA sequence
cacaggtgagggtagcagca

SEQ ID NO: 760261 - DNA, 20 bp, Artificial
  CRISPR gRNA sequence
acaggtgagggtagcagcat

SEQ ID NO: 760262 - DNA, 20 bp, Artificial
  CRISPR gRNA sequence
caggtgagggtagcagcatg

SEQ ID NO: 760263 - DNA, 20 bp, Artificial
  CRISPR gRNA sequence
tgagggtagcagcatgggga

SEQ ID NO: 760264 - DNA, 20 bp, Artificial
  CRISPR gRNA sequence
gagggtagcagcatggggac

SEQ ID NO: 760265 - DNA, 20 bp, Artificial
  CRISPR gRNA sequence
gggtagcagcatggggacgg

SEQ ID NO: 760266 - DNA, 20 bp, Artificial
  CRISPR gRNA sequence
ggtagcagcatggggacggg

SEQ ID NO: 760267 - DNA, 20 bp, Artificial
  CRISPR gRNA sequence
gtagcagcatggggacggga

SEQ ID NO: 760268 - DNA, 20 bp, Artificial
  CRISPR gRNA sequence
tagcagcatggggacgggag

SEQ ID NO: 760269 - DNA, 20 bp, Artificial
  CRISPR gRNA sequence
gcagcatggggacgggaggg

SEQ ID NO: 760270 - DNA, 20 bp, Artificial
  CRISPR gRNA sequence
cagcatggggacgggagggg

SEQ ID NO: 760271 - DNA, 20 bp, Artificial
  CRISPR gRNA sequence
agcatggggacgggagggga

SEQ ID NO: 760272 - DNA, 20 bp, Artificial
  CRISPR gRNA sequence
tggggacgggaggggaggga

SEQ ID NO: 760273 - DNA, 20 bp, Artificial
  CRISPR gRNA sequence
gaggggagggacagtgattg

SEQ ID NO: 760274 - DNA, 20 bp, Artificial
  CRISPR gRNA sequence
gggagggacagtgattgtgg

SEQ ID NO: 760275 - DNA, 20 bp, Artificial
  CRISPR gRNA sequence
gggacagtgattgtggcagt

SEQ ID NO: 760276 - DNA, 20 bp, Artificial
  CRISPR gRNA sequence
ggacagtgattgtggcagtt

SEQ ID NO: 760277 - DNA, 20 bp, Artificial
  CRISPR gRNA sequence
gacagtgattgtggcagttg

SEQ ID NO: 760278 - DNA, 20 bp, Artificial
  CRISPR gRNA sequence
cagtgattgtggcagttggg

SEQ ID NO: 760279 - DNA, 20 bp, Artificial
  CRISPR gRNA sequence
agtgattgtggcagttgggg

SEQ ID NO: 760280 - DNA, 20 bp, Artificial
  CRISPR gRNA sequence
gtgattgtggcagttgggga

SEQ ID NO: 760281 - DNA, 20 bp, Artificial
  CRISPR gRNA sequence
tgattgtggcagttggggag

SEQ ID NO: 760282 - DNA, 20 bp, Artificial
  CRISPR gRNA sequence
gattgtggcagttggggagg

SEQ ID NO: 760283 - DNA, 20 bp, Artificial
  CRISPR gRNA sequence
gagggggtgcccacgcctgt

SEQ ID NO: 760284 - DNA, 20 bp, Artificial
  CRISPR gRNA sequence
agggggtgcccacgcctgtt

SEQ ID NO: 760285 - DNA, 20 bp, Artificial
  CRISPR gRNA sequence
gggggtgcccacgcctgtta

SEQ ID NO: 760286 - DNA, 20 bp, Artificial
  CRISPR gRNA sequence
ggggtgcccacgcctgttag

SEQ ID NO: 760287 - DNA, 20 bp, Artificial
  CRISPR gRNA sequence
cgcctgttaggggtcctgcc

SEQ ID NO: 760288 - DNA, 20 bp, Artificial
  CRISPR gRNA sequence
tgttaggggtcctgccaagc

SEQ ID NO: 760289 - DNA, 20 bp, Artificial
  CRISPR gRNA sequence
gggtcctgccaagccagctc

SEQ ID NO: 760290 - DNA, 20 bp, Artificial
  CRISPR gRNA sequence
cctgccaagccagctctggc

SEQ ID NO: 760291 - DNA, 20 bp, Artificial
  CRISPR gRNA sequence
gccaagccagctctggctag

SEQ ID NO: 760292 - DNA, 20 bp, Artificial
  CRISPR gRNA sequence
ccaagccagctctggctagc

SEQ ID NO: 760293 - DNA, 20 bp, Artificial
  CRISPR gRNA sequence
caagccagctctggctagca

SEQ ID NO: 760294 - DNA, 20 bp, Artificial
  CRISPR gRNA sequence
ccataccttacttccacctg

SEQ ID NO: 760295 - DNA, 20 bp, Artificial
  CRISPR gRNA sequence
cataccttacttccacctgt

SEQ ID NO: 760296 - DNA, 20 bp, Artificial
  CRISPR gRNA sequence
ttacttccacctgtgggatc

SEQ ID NO: 760297 - DNA, 20 bp, Artificial
  CRISPR gRNA sequence
cttccacctgtgggatccag

SEQ ID NO: 760298 - DNA, 20 bp, Artificial
  CRISPR gRNA sequence
ttccacctgtgggatccagt

SEQ ID NO: 760299 - DNA, 20 bp, Artificial
  CRISPR gRNA sequence
gcaactcacgttactgttct

SEQ ID NO: 760300 - DNA, 20 bp, Artificial
  CRISPR gRNA sequence
ccatttccttgtctgtaaaa

SEQ ID NO: 760301 - DNA, 20 bp, Artificial
  CRISPR gRNA sequence
catttccttgtctgtaaaat

SEQ ID NO: 760302 - DNA, 20 bp, Artificial
  CRISPR gRNA sequence
tgtctgtaaaatgggaacat

SEQ ID NO: 760303 - DNA, 20 bp, Artificial
  CRISPR gRNA sequence
tgggaacatgagtgctaaat

SEQ ID NO: 760304 - DNA, 20 bp, Artificial
  CRISPR gRNA sequence
acactgtgtgcgccccctcc

SEQ ID NO: 760305 - DNA, 20 bp, Artificial
  CRISPR gRNA sequence
cactgtgtgcgccccctccc

SEQ ID NO: 760306 - DNA, 20 bp, Artificial
  CRISPR gRNA sequence
cacttgctctttcctctgcc

SEQ ID NO: 760307 - DNA, 20 bp, Artificial
  CRISPR gRNA sequence
cccctaaacgtctgcatgac

SEQ ID NO: 760308 - DNA, 20 bp, Artificial
  CRISPR gRNA sequence
tgactggatcccatattttg

SEQ ID NO: 760309 - DNA, 20 bp, Artificial
  CRISPR gRNA sequence
actggatcccatattttgtg

SEQ ID NO: 760310 - DNA, 20 bp, Artificial
  CRISPR gRNA sequence
ctggatcccatattttgtgg

SEQ ID NO: 760311 - DNA, 20 bp, Artificial
  CRISPR gRNA sequence
gctcaatgtcacctcctctc

SEQ ID NO: 760312 - DNA, 20 bp, Artificial
  CRISPR gRNA sequence
ctcaatgtcacctcctctca

SEQ ID NO: 760313 - DNA, 20 bp, Artificial
  CRISPR gRNA sequence
acctcctctcaaggctctcc

SEQ ID NO: 760314 - DNA, 20 bp, Artificial
  CRISPR gRNA sequence
cctagctcccttgtataaaa

SEQ ID NO: 760315 - DNA, 20 bp, Artificial
  CRISPR gRNA sequence
cgctcctccctccctatccc

SEQ ID NO: 760316 - DNA, 20 bp, Artificial
  CRISPR gRNA sequence
cctccctgcgttattctgcc

SEQ ID NO: 760317 - DNA, 20 bp, Artificial
  CRISPR gRNA sequence
tgcctagattcgcccccacc

SEQ ID NO: 760318 - DNA, 20 bp, Artificial
  CRISPR gRNA sequence
gcttgcttcctccctgttca

SEQ ID NO: 760319 - DNA, 20 bp, Artificial
  CRISPR gRNA sequence
ttgcttcctccctgttcaaa

SEQ ID NO: 760320 - DNA, 20 bp, Artificial
  CRISPR gRNA sequence
cttcctccctgttcaaagag

SEQ ID NO: 760321 - DNA, 20 bp, Artificial
  CRISPR gRNA sequence
ttcctccctgttcaaagagc

SEQ ID NO: 760322 - DNA, 20 bp, Artificial
  CRISPR gRNA sequence
tcctccctgttcaaagagca

SEQ ID NO: 760323 - DNA, 20 bp, Artificial
  CRISPR gRNA sequence
tcaaagagcagggtccatct

SEQ ID NO: 760324 - DNA, 20 bp, Artificial
  CRISPR gRNA sequence
caaagagcagggtccatctc

SEQ ID NO: 760325 - DNA, 20 bp, Artificial
  CRISPR gRNA sequence
aaagagcagggtccatctca

SEQ ID NO: 760326 - DNA, 20 bp, Artificial
  CRISPR gRNA sequence
agcagggtccatctcagggc

SEQ ID NO: 760327 - DNA, 20 bp, Artificial
  CRISPR gRNA sequence
cagggtccatctcagggcca

SEQ ID NO: 760328 - DNA, 20 bp, Artificial
  CRISPR gRNA sequence
ggtccatctcagggccagag

SEQ ID NO: 760329 - DNA, 20 bp, Artificial
  CRISPR gRNA sequence
gggccagagcggctgttgca

SEQ ID NO: 760330 - DNA, 20 bp, Artificial
  CRISPR gRNA sequence
ccagagcggctgttgcatag

SEQ ID NO: 760331 - DNA, 20 bp, Artificial
  CRISPR gRNA sequence
cagagcggctgttgcatagt

SEQ ID NO: 760332 - DNA, 20 bp, Artificial
  CRISPR gRNA sequence
gtaggtgcccaataactgtg

SEQ ID NO: 760333 - DNA, 20 bp, Artificial
  CRISPR gRNA sequence
acgatgtgactctccccaca

SEQ ID NO: 760334 - DNA, 20 bp, Artificial
  CRISPR gRNA sequence
gactctccccacacggtgct

SEQ ID NO: 760335 - DNA, 20 bp, Artificial
  CRISPR gRNA sequence
cccacacggtgcttggcaca

SEQ ID NO: 760336 - DNA, 20 bp, Artificial
  CRISPR gRNA sequence
ccacacggtgcttggcacac

SEQ ID NO: 760337 - DNA, 20 bp, Artificial
  CRISPR gRNA sequence
cacggtgcttggcacacagg

SEQ ID NO: 760338 - DNA, 20 bp, Artificial
  CRISPR gRNA sequence
caggaagcactcaataataa

SEQ ID NO: 760339 - DNA, 20 bp, Artificial
  CRISPR gRNA sequence
atcacatttcaaattctcat

SEQ ID NO: 760340 - DNA, 20 bp, Artificial
  CRISPR gRNA sequence
ctcatcagcatctctgctct

SEQ ID NO: 760341 - DNA, 20 bp, Artificial
  CRISPR gRNA sequence
tcagcatctctgctctgaga

SEQ ID NO: 760342 - DNA, 20 bp, Artificial
  CRISPR gRNA sequence
ctctgagacggcttcctccg

SEQ ID NO: 760343 - DNA, 20 bp, Artificial
  CRISPR gRNA sequence
tctgagacggcttcctccgt

SEQ ID NO: 760344 - DNA, 20 bp, Artificial
  CRISPR gRNA sequence
ctgagacggcttcctccgtg

SEQ ID NO: 760345 - DNA, 20 bp, Artificial
  CRISPR gRNA sequence
agacggcttcctccgtgggg

SEQ ID NO: 760346 - DNA, 20 bp, Artificial
  CRISPR gRNA sequence
cttcctccgtggggaagaca

SEQ ID NO: 760347 - DNA, 20 bp, Artificial
  CRISPR gRNA sequence
tccgtggggaagacaaagct

SEQ ID NO: 760348 - DNA, 20 bp, Artificial
  CRISPR gRNA sequence
ccgtggggaagacaaagctg

SEQ ID NO: 760349 - DNA, 20 bp, Artificial
  CRISPR gRNA sequence
cgtggggaagacaaagctga

SEQ ID NO: 760350 - DNA, 20 bp, Artificial
  CRISPR gRNA sequence
ggaagacaaagctgagggtc

SEQ ID NO: 760351 - DNA, 20 bp, Artificial
  CRISPR gRNA sequence
gagggtctggcgccatcttg

SEQ ID NO: 760352 - DNA, 20 bp, Artificial
  CRISPR gRNA sequence
ggcgccatcttgtggccata

SEQ ID NO: 760353 - DNA, 20 bp, Artificial
  CRISPR gRNA sequence
gccatcttgtggccataaag

SEQ ID NO: 760354 - DNA, 20 bp, Artificial
  CRISPR gRNA sequence
gaagtgcctgtctctaccca

SEQ ID NO: 760355 - DNA, 20 bp, Artificial
  CRISPR gRNA sequence
cacggctgctctgatttctc

SEQ ID NO: 760356 - DNA, 20 bp, Artificial
  CRISPR gRNA sequence
cggctgctctgatttctcta

SEQ ID NO: 760357 - DNA, 20 bp, Artificial
  CRISPR gRNA sequence
tgctctgatttctctagagc

SEQ ID NO: 760358 - DNA, 20 bp, Artificial
  CRISPR gRNA sequence
ctgatttctctagagcaaga

SEQ ID NO: 760359 - DNA, 20 bp, Artificial
  CRISPR gRNA sequence
tgatttctctagagcaagaa

SEQ ID NO: 760360 - DNA, 20 bp, Artificial
  CRISPR gRNA sequence
gatttctctagagcaagaaa

SEQ ID NO: 760361 - DNA, 20 bp, Artificial
  CRISPR gRNA sequence
gagcaagaaagggttttgtc

SEQ ID NO: 760362 - DNA, 20 bp, Artificial
  CRISPR gRNA sequence
agcaagaaagggttttgtct

SEQ ID NO: 760363 - DNA, 20 bp, Artificial
  CRISPR gRNA sequence
gttttgtctgggtgacttac

SEQ ID NO: 760364 - DNA, 20 bp, Artificial
  CRISPR gRNA sequence
ttttgtctgggtgacttacc

SEQ ID NO: 760365 - DNA, 20 bp, Artificial
  CRISPR gRNA sequence
ttcccccaaatgtcccctcc

SEQ ID NO: 760366 - DNA, 20 bp, Artificial
  CRISPR gRNA sequence
tcccccaaatgtcccctcca

SEQ ID NO: 760367 - DNA, 20 bp, Artificial
  CRISPR gRNA sequence
cccccaaatgtcccctccaa

SEQ ID NO: 760368 - DNA, 20 bp, Artificial
  CRISPR gRNA sequence
ccccaaatgtcccctccaag

SEQ ID NO: 760369 - DNA, 20 bp, Artificial
  CRISPR gRNA sequence
gtcccctccaaggggcaccc

SEQ ID NO: 760370 - DNA, 20 bp, Artificial
  CRISPR gRNA sequence
gggcaccctggttcgactga

SEQ ID NO: 760371 - DNA, 20 bp, Artificial
  CRISPR gRNA sequence
ggcaccctggttcgactgac

SEQ ID NO: 760372 - DNA, 20 bp, Artificial
  CRISPR gRNA sequence
gcaccctggttcgactgaca

SEQ ID NO: 760373 - DNA, 20 bp, Artificial
  CRISPR gRNA sequence
tggttcgactgacagggcat

SEQ ID NO: 760374 - DNA, 20 bp, Artificial
  CRISPR gRNA sequence
gactgacagggcatgagaac

SEQ ID NO: 760375 - DNA, 20 bp, Artificial
  CRISPR gRNA sequence
acagggcatgagaactggcc

SEQ ID NO: 760376 - DNA, 20 bp, Artificial
  CRISPR gRNA sequence
cagggcatgagaactggcct

SEQ ID NO: 760377 - DNA, 20 bp, Artificial
  CRISPR gRNA sequence
agggcatgagaactggcctg

SEQ ID NO: 760378 - DNA, 20 bp, Artificial
  CRISPR gRNA sequence
tgagaactggcctggggcac

SEQ ID NO: 760379 - DNA, 20 bp, Artificial
  CRISPR gRNA sequence
gagaactggcctggggcacc

SEQ ID NO: 760380 - DNA, 20 bp, Artificial
  CRISPR gRNA sequence
agaactggcctggggcacca

SEQ ID NO: 760381 - DNA, 20 bp, Artificial
  CRISPR gRNA sequence
gaactggcctggggcaccag

SEQ ID NO: 760382 - DNA, 20 bp, Artificial
  CRISPR gRNA sequence
gcctggggcaccaggggttt

SEQ ID NO: 760383 - DNA, 20 bp, Artificial
  CRISPR gRNA sequence
ggggcaccaggggtttcagc

SEQ ID NO: 760384 - DNA, 20 bp, Artificial
  CRISPR gRNA sequence
ggcaccaggggtttcagcaa

SEQ ID NO: 760385 - DNA, 20 bp, Artificial
  CRISPR gRNA sequence
ggggtttcagcaagagatcc

SEQ ID NO: 760386 - DNA, 20 bp, Artificial
  CRISPR gRNA sequence
gggtttcagcaagagatcca

SEQ ID NO: 760387 - DNA, 20 bp, Artificial
  CRISPR gRNA sequence
ttcagcaagagatccaaggc

SEQ ID NO: 760388 - DNA, 20 bp, Artificial
  CRISPR gRNA sequence
aagagatccaaggctagctt

SEQ ID NO: 760389 - DNA, 20 bp, Artificial
  CRISPR gRNA sequence
caaggctagcttaagaactt

SEQ ID NO: 760390 - DNA, 20 bp, Artificial
  CRISPR gRNA sequence
aggctagcttaagaacttta

SEQ ID NO: 760391 - DNA, 20 bp, Artificial
  CRISPR gRNA sequence
ttaagaactttagagatctc

SEQ ID NO: 760392 - DNA, 20 bp, Artificial
  CRISPR gRNA sequence
taagaactttagagatctct

SEQ ID NO: 760393 - DNA, 20 bp, Artificial
  CRISPR gRNA sequence
agagatctctaggtactgca

SEQ ID NO: 760394 - DNA, 20 bp, Artificial
  CRISPR gRNA sequence
actgcaaagattatgatact

SEQ ID NO: 760395 - DNA, 20 bp, Artificial
  CRISPR gRNA sequence
caataaaaataataaccata

SEQ ID NO: 760396 - DNA, 20 bp, Artificial
  CRISPR gRNA sequence
caatgttatttttctaaatg

SEQ ID NO: 760397 - DNA, 20 bp, Artificial
  CRISPR gRNA sequence
aatgttatttttctaaatgc

SEQ ID NO: 760398 - DNA, 20 bp, Artificial
  CRISPR gRNA sequence
aaatgcaggaaacctttaat

SEQ ID NO: 760399 - DNA, 20 bp, Artificial
  CRISPR gRNA sequence
taatgagtgctgtattcaat

SEQ ID NO: 760400 - DNA, 20 bp, Artificial
  CRISPR gRNA sequence
tattcaattagcattgtttc

SEQ ID NO: 760401 - DNA, 20 bp, Artificial
  CRISPR gRNA sequence
attcaattagcattgtttca

SEQ ID NO: 760402 - DNA, 20 bp, Artificial
  CRISPR gRNA sequence
ggttgatcttcccacatttt

SEQ ID NO: 760403 - DNA, 20 bp, Artificial
  CRISPR gRNA sequence
tttgagtgtgcctgctttgc

SEQ ID NO: 760404 - DNA, 20 bp, Artificial
  CRISPR gRNA sequence
gcctgctttgctagtgctcg

SEQ ID NO: 760405 - DNA, 20 bp, Artificial
  CRISPR gRNA sequence
gcacacaatctaaccattac

SEQ ID NO: 760406 - DNA, 20 bp, Artificial
  CRISPR gRNA sequence
acacaatctaaccattaccg

SEQ ID NO: 760407 - DNA, 20 bp, Artificial
  CRISPR gRNA sequence
atctaaccattaccggagaa

SEQ ID NO: 760408 - DNA, 20 bp, Artificial
  CRISPR gRNA sequence
taaccattaccggagaatgg

SEQ ID NO: 760409 - DNA, 20 bp, Artificial
  CRISPR gRNA sequence
ttaccggagaatggtagtgc

SEQ ID NO: 760410 - DNA, 20 bp, Artificial
  CRISPR gRNA sequence
taccggagaatggtagtgcc

SEQ ID NO: 760411 - DNA, 20 bp, Artificial
  CRISPR gRNA sequence
accggagaatggtagtgcca

SEQ ID NO: 760412 - DNA, 20 bp, Artificial
  CRISPR gRNA sequence
ggagaatggtagtgccaggg

SEQ ID NO: 760413 - DNA, 20 bp, Artificial
  CRISPR gRNA sequence
gagaatggtagtgccagggt

SEQ ID NO: 760414 - DNA, 20 bp, Artificial
  CRISPR gRNA sequence
agaatggtagtgccagggtg

SEQ ID NO: 760415 - DNA, 20 bp, Artificial
  CRISPR gRNA sequence
gaatggtagtgccagggtgg

SEQ ID NO: 760416 - DNA, 20 bp, Artificial
  CRISPR gRNA sequence
aatggtagtgccagggtggg

SEQ ID NO: 760417 - DNA, 20 bp, Artificial
  CRISPR gRNA sequence
atggtagtgccagggtgggg

SEQ ID NO: 760418 - DNA, 20 bp, Artificial
  CRISPR gRNA sequence
cctcctcttttttttttttt

SEQ ID NO: 760419 - DNA, 20 bp, Artificial
  CRISPR gRNA sequence
ctctttttttttttttgaga

SEQ ID NO: 760420 - DNA, 20 bp, Artificial
  CRISPR gRNA sequence
tctttttttttttttgagat

SEQ ID NO: 760421 - DNA, 20 bp, Artificial
  CRISPR gRNA sequence
ctttttttttttttgagatg

SEQ ID NO: 760422 - DNA, 20 bp, Artificial
  CRISPR gRNA sequence
tggggtcttgctctgttgcc

SEQ ID NO: 760423 - DNA, 20 bp, Artificial
  CRISPR gRNA sequence
ggggtcttgctctgttgcca

SEQ ID NO: 760424 - DNA, 20 bp, Artificial
  CRISPR gRNA sequence
tcttgctctgttgccaagga

SEQ ID NO: 760425 - DNA, 20 bp, Artificial
  CRISPR gRNA sequence
ttgctctgttgccaaggatg

SEQ ID NO: 760426 - DNA, 20 bp, Artificial
  CRISPR gRNA sequence
ctgttgccaaggatggagtg

SEQ ID NO: 760427 - DNA, 20 bp, Artificial
  CRISPR gRNA sequence
ttgccaaggatggagtgcag

SEQ ID NO: 760428 - DNA, 20 bp, Artificial
  CRISPR gRNA sequence
ggagtgcagtggcgcgatct

SEQ ID NO: 760429 - DNA, 20 bp, Artificial
  CRISPR gRNA sequence
tcactgcaacctccacctcc

SEQ ID NO: 760430 - DNA, 20 bp, Artificial
  CRISPR gRNA sequence
cactgcaacctccacctccc

SEQ ID NO: 760431 - DNA, 20 bp, Artificial
  CRISPR gRNA sequence
aacctccacctcccaggttc

SEQ ID NO: 760432 - DNA, 20 bp, Artificial
  CRISPR gRNA sequence
ttcaagcaattctcctgcct

SEQ ID NO: 760433 - DNA, 20 bp, Artificial
  CRISPR gRNA sequence
ttctcctgcctcagcctcct

SEQ ID NO: 760434 - DNA, 20 bp, Artificial
  CRISPR gRNA sequence
tcctgcctcagcctcctgag

SEQ ID NO: 760435 - DNA, 20 bp, Artificial
  CRISPR gRNA sequence
gcctcagcctcctgagtagc

SEQ ID NO: 760436 - DNA, 20 bp, Artificial
  CRISPR gRNA sequence
cctcagcctcctgagtagct

SEQ ID NO: 760437 - DNA, 20 bp, Artificial
  CRISPR gRNA sequence
ctcctgagtagctgggatta

SEQ ID NO: 760438 - DNA, 20 bp, Artificial
  CRISPR gRNA sequence
tcctgagtagctgggattac

SEQ ID NO: 760439 - DNA, 20 bp, Artificial
  CRISPR gRNA sequence
caggtgtgttccaccacccc

SEQ ID NO: 760440 - DNA, 20 bp, Artificial
  CRISPR gRNA sequence
caccacccctggctattttt

SEQ ID NO: 760441 - DNA, 20 bp, Artificial
  CRISPR gRNA sequence
cacccctggctattttttag

SEQ ID NO: 760442 - DNA, 20 bp, Artificial
  CRISPR gRNA sequence
cccctggctattttttagta

SEQ ID NO: 760443 - DNA, 20 bp, Artificial
  CRISPR gRNA sequence
ccctggctattttttagtag

SEQ ID NO: 760444 - DNA, 20 bp, Artificial
  CRISPR gRNA sequence
tggctattttttagtagagg

SEQ ID NO: 760445 - DNA, 20 bp, Artificial
  CRISPR gRNA sequence
ggctattttttagtagaggt

SEQ ID NO: 760446 - DNA, 20 bp, Artificial
  CRISPR gRNA sequence
gctattttttagtagaggtg

SEQ ID NO: 760447 - DNA, 20 bp, Artificial
  CRISPR gRNA sequence
tggggtttcaccatatctgc

SEQ ID NO: 760448 - DNA, 20 bp, Artificial
  CRISPR gRNA sequence
ggggtttcaccatatctgct

SEQ ID NO: 760449 - DNA, 20 bp, Artificial
  CRISPR gRNA sequence
tttcaccatatctgctaggc

SEQ ID NO: 760450 - DNA, 20 bp, Artificial
  CRISPR gRNA sequence
tggtctcgaacgcctgacct

SEQ ID NO: 760451 - DNA, 20 bp, Artificial
  CRISPR gRNA sequence
ggtctcgaacgcctgacctc

SEQ ID NO: 760452 - DNA, 20 bp, Artificial
  CRISPR gRNA sequence
ctcaggtgatccacctgcct

SEQ ID NO: 760453 - DNA, 20 bp, Artificial
  CRISPR gRNA sequence
cctgcctcggcctcccatgc

SEQ ID NO: 760454 - DNA, 20 bp, Artificial
  CRISPR gRNA sequence
ctgcctcggcctcccatgcc

SEQ ID NO: 760455 - DNA, 20 bp, Artificial
  CRISPR gRNA sequence
tcccctcacttctgactcat

SEQ ID NO: 760456 - DNA, 20 bp, Artificial
  CRISPR gRNA sequence
ctcacttctgactcatcagc

SEQ ID NO: 760457 - DNA, 20 bp, Artificial
  CRISPR gRNA sequence
ttctctactaccaccctttg

SEQ ID NO: 760458 - DNA, 20 bp, Artificial
  CRISPR gRNA sequence
cacaccaccctcacctctta

SEQ ID NO: 760459 - DNA, 20 bp, Artificial
  CRISPR gRNA sequence
acaccaccctcacctcttac

SEQ ID NO: 760460 - DNA, 20 bp, Artificial
  CRISPR gRNA sequence
caccaccctcacctcttaca

SEQ ID NO: 760461 - DNA, 20 bp, Artificial
  CRISPR gRNA sequence
accctcacctcttacaggga

SEQ ID NO: 760462 - DNA, 20 bp, Artificial
  CRISPR gRNA sequence
cagctgaaaccgcccctaac

SEQ ID NO: 760463 - DNA, 20 bp, Artificial
  CRISPR gRNA sequence
gcctcccccttgccctgcca

SEQ ID NO: 760464 - DNA, 20 bp, Artificial
  CRISPR gRNA sequence
ccccttgccctgccacagtc

SEQ ID NO: 760465 - DNA, 20 bp, Artificial
  CRISPR gRNA sequence
ctgccacagtccagtctcca

SEQ ID NO: 760466 - DNA, 20 bp, Artificial
  CRISPR gRNA sequence
gccacagtccagtctccaca

SEQ ID NO: 760467 - DNA, 20 bp, Artificial
  CRISPR gRNA sequence
ccacagtccagtctccacag

SEQ ID NO: 760468 - DNA, 20 bp, Artificial
  CRISPR gRNA sequence
acagtccagtctccacagag

SEQ ID NO: 760469 - DNA, 20 bp, Artificial
  CRISPR gRNA sequence
tccagtctccacagaggagc

SEQ ID NO: 760470 - DNA, 20 bp, Artificial
  CRISPR gRNA sequence
cagtctccacagaggagcta

SEQ ID NO: 760471 - DNA, 20 bp, Artificial
  CRISPR gRNA sequence
ctccacagaggagctagagt

SEQ ID NO: 760472 - DNA, 20 bp, Artificial
  CRISPR gRNA sequence
gaggagctagagtgagtttt

SEQ ID NO: 760473 - DNA, 20 bp, Artificial
  CRISPR gRNA sequence
gagttttaagcattgctact

SEQ ID NO: 760474 - DNA, 20 bp, Artificial
  CRISPR gRNA sequence
tgcgtgattaaaacactccc

SEQ ID NO: 760475 - DNA, 20 bp, Artificial
  CRISPR gRNA sequence
ccagtgattcccattactca

SEQ ID NO: 760476 - DNA, 20 bp, Artificial
  CRISPR gRNA sequence
attcccattactcatagaaa

SEQ ID NO: 760477 - DNA, 20 bp, Artificial
  CRISPR gRNA sequence
ccattactcatagaaaaagt

SEQ ID NO: 760478 - DNA, 20 bp, Artificial
  CRISPR gRNA sequence
gaaaaagttagattcctcac

SEQ ID NO: 760479 - DNA, 20 bp, Artificial
  CRISPR gRNA sequence
gattcctcactggtctcttc

SEQ ID NO: 760480 - DNA, 20 bp, Artificial
  CRISPR gRNA sequence
tggtctcttcaagtcatctt

SEQ ID NO: 760481 - DNA, 20 bp, Artificial
  CRISPR gRNA sequence
tcttcaagtcatctttggtc

SEQ ID NO: 760482 - DNA, 20 bp, Artificial
  CRISPR gRNA sequence
cttcaagtcatctttggtct

SEQ ID NO: 760483 - DNA, 20 bp, Artificial
  CRISPR gRNA sequence
caagtcatctttggtctggg

SEQ ID NO: 760484 - DNA, 20 bp, Artificial
  CRISPR gRNA sequence
aagtcatctttggtctgggt

SEQ ID NO: 760485 - DNA, 20 bp, Artificial
  CRISPR gRNA sequence
ggtgggacatgccctcccat

SEQ ID NO: 760486 - DNA, 20 bp, Artificial
  CRISPR gRNA sequence
atcagatgtgtctgccacac

SEQ ID NO: 760487 - DNA, 20 bp, Artificial
  CRISPR gRNA sequence
cgctccccgatattttcaca

SEQ ID NO: 760488 - DNA, 20 bp, Artificial
  CRISPR gRNA sequence
ccccgatattttcacacagc

SEQ ID NO: 760489 - DNA, 20 bp, Artificial
  CRISPR gRNA sequence
cccgatattttcacacagca

SEQ ID NO: 760490 - DNA, 20 bp, Artificial
  CRISPR gRNA sequence
atattttcacacagcaaggc

SEQ ID NO: 760491 - DNA, 20 bp, Artificial
  CRISPR gRNA sequence
cagcaaggccagtcttgcct

SEQ ID NO: 760492 - DNA, 20 bp, Artificial
  CRISPR gRNA sequence
agcaaggccagtcttgcctc

SEQ ID NO: 760493 - DNA, 20 bp, Artificial
  CRISPR gRNA sequence
gcaaggccagtcttgcctca

SEQ ID NO: 760494 - DNA, 20 bp, Artificial
  CRISPR gRNA sequence
tccacctgctgtttcctcta

SEQ ID NO: 760495 - DNA, 20 bp, Artificial
  CRISPR gRNA sequence
ccacctgctgtttcctctac

SEQ ID NO: 760496 - DNA, 20 bp, Artificial
  CRISPR gRNA sequence
cacctgctgtttcctctacg

SEQ ID NO: 760497 - DNA, 20 bp, Artificial
  CRISPR gRNA sequence
ctacggggttctctgtatgt

SEQ ID NO: 760498 - DNA, 20 bp, Artificial
  CRISPR gRNA sequence
ttttcattccctataaattt

SEQ ID NO: 760499 - DNA, 20 bp, Artificial
  CRISPR gRNA sequence
atttcagcttaattgcttta

SEQ ID NO: 760500 - DNA, 20 bp, Artificial
  CRISPR gRNA sequence
ttcagcttaattgctttaaa

SEQ ID NO: 760501 - DNA, 20 bp, Artificial
  CRISPR gRNA sequence
gtgcctcaccaccatattta

SEQ ID NO: 760502 - DNA, 20 bp, Artificial
  CRISPR gRNA sequence
tgcctcaccaccatatttaa

SEQ ID NO: 760503 - DNA, 20 bp, Artificial
  CRISPR gRNA sequence
caccaccatatttaaaggta

SEQ ID NO: 760504 - DNA, 20 bp, Artificial
  CRISPR gRNA sequence
accaccatatttaaaggtac

SEQ ID NO: 760505 - DNA, 20 bp, Artificial
  CRISPR gRNA sequence
aaaaacaaatcgtgtttcgt

SEQ ID NO: 760506 - DNA, 20 bp, Artificial
  CRISPR gRNA sequence
aaaacaaatcgtgtttcgtt

SEQ ID NO: 760507 - DNA, 20 bp, Artificial
  CRISPR gRNA sequence
aaatcgtgtttcgttaggaa

SEQ ID NO: 760508 - DNA, 20 bp, Artificial
  CRISPR gRNA sequence
tcgttaggaaaagaaaaaaa

SEQ ID NO: 760509 - DNA, 20 bp, Artificial
  CRISPR gRNA sequence
aaaagaaaaaaaaagaaaaa

SEQ ID NO: 760510 - DNA, 20 bp, Artificial
  CRISPR gRNA sequence
aaaaaaaagaaaaaaagaaa

SEQ ID NO: 760511 - DNA, 20 bp, Artificial
  CRISPR gRNA sequence
acttgtgattctctctcctc

SEQ ID NO: 760512 - DNA, 20 bp, Artificial
  CRISPR gRNA sequence
ttgtgattctctctcctcca

SEQ ID NO: 760513 - DNA, 20 bp, Artificial
  CRISPR gRNA sequence
gaaaccactattgacatttt

SEQ ID NO: 760514 - DNA, 20 bp, Artificial
  CRISPR gRNA sequence
accactattgacatttttgg

SEQ ID NO: 760515 - DNA, 20 bp, Artificial
  CRISPR gRNA sequence
atttttggtggatacttttt

SEQ ID NO: 760516 - DNA, 20 bp, Artificial
  CRISPR gRNA sequence
tataacattacttacgctca

SEQ ID NO: 760517 - DNA, 20 bp, Artificial
  CRISPR gRNA sequence
ataacattacttacgctcat

SEQ ID NO: 760518 - DNA, 20 bp, Artificial
  CRISPR gRNA sequence
taacattacttacgctcatg

SEQ ID NO: 760519 - DNA, 20 bp, Artificial
  CRISPR gRNA sequence
cgctcatggggaaatgcaca

SEQ ID NO: 760520 - DNA, 20 bp, Artificial
  CRISPR gRNA sequence
atggggaaatgcacatggtg

SEQ ID NO: 760521 - DNA, 20 bp, Artificial
  CRISPR gRNA sequence
tggggaaatgcacatggtgc

SEQ ID NO: 760522 - DNA, 20 bp, Artificial
  CRISPR gRNA sequence
ggaaatgcacatggtgcagg

SEQ ID NO: 760523 - DNA, 20 bp, Artificial
  CRISPR gRNA sequence
gaaatgcacatggtgcaggc

SEQ ID NO: 760524 - DNA, 20 bp, Artificial
  CRISPR gRNA sequence
acatggtgcaggcaggtgta

SEQ ID NO: 760525 - DNA, 20 bp, Artificial
  CRISPR gRNA sequence
ggcaggtgtaaagtacctgc

SEQ ID NO: 760526 - DNA, 20 bp, Artificial
  CRISPR gRNA sequence
gtacctgccagatttttgaa

SEQ ID NO: 760527 - DNA, 20 bp, Artificial
  CRISPR gRNA sequence
tgctttacttactaacctgc

SEQ ID NO: 760528 - DNA, 20 bp, Artificial
  CRISPR gRNA sequence
ctccttttcctcacatacct

SEQ ID NO: 760529 - DNA, 20 bp, Artificial
  CRISPR gRNA sequence
taccttagtcacatgctgac

SEQ ID NO: 760530 - DNA, 20 bp, Artificial
  CRISPR gRNA sequence
tctctctcccattaaaatgt

SEQ ID NO: 760531 - DNA, 20 bp, Artificial
  CRISPR gRNA sequence
ccattaaaatgtaagttctg

SEQ ID NO: 760532 - DNA, 20 bp, Artificial
  CRISPR gRNA sequence
cattaaaatgtaagttctgt

SEQ ID NO: 760533 - DNA, 20 bp, Artificial
  CRISPR gRNA sequence
attaaaatgtaagttctgtg

SEQ ID NO: 760534 - DNA, 20 bp, Artificial
  CRISPR gRNA sequence
gttctgtggggatgtgaccg

SEQ ID NO: 760535 - DNA, 20 bp, Artificial
  CRISPR gRNA sequence
gcatttctgacttttatgct

SEQ ID NO: 760536 - DNA, 20 bp, Artificial
  CRISPR gRNA sequence
acttttatgcttggcacctg

SEQ ID NO: 760537 - DNA, 20 bp, Artificial
  CRISPR gRNA sequence
cttttatgcttggcacctgt

SEQ ID NO: 760538 - DNA, 20 bp, Artificial
  CRISPR gRNA sequence
gactatattcttgactgaat

SEQ ID NO: 760539 - DNA, 20 bp, Artificial
  CRISPR gRNA sequence
actatattcttgactgaatg

SEQ ID NO: 760540 - DNA, 20 bp, Artificial
  CRISPR gRNA sequence
tcttgactgaatgaggtcct

SEQ ID NO: 760541 - DNA, 20 bp, Artificial
  CRISPR gRNA sequence
cctaagacaataaattactt

SEQ ID NO: 760542 - DNA, 20 bp, Artificial
  CRISPR gRNA sequence
ctaagacaataaattacttt

SEQ ID NO: 760543 - DNA, 20 bp, Artificial
  CRISPR gRNA sequence
caataaattactttgggtct

SEQ ID NO: 760544 - DNA, 20 bp, Artificial
  CRISPR gRNA sequence
aataaattactttgggtctc

SEQ ID NO: 760545 - DNA, 20 bp, Artificial
  CRISPR gRNA sequence
actttgggtctcaggcctaa

SEQ ID NO: 760546 - DNA, 20 bp, Artificial
  CRISPR gRNA sequence
ctttgggtctcaggcctaaa

SEQ ID NO: 760547 - DNA, 20 bp, Artificial
  CRISPR gRNA sequence
ttgggtctcaggcctaaaag

SEQ ID NO: 760548 - DNA, 20 bp, Artificial
  CRISPR gRNA sequence
tgggtctcaggcctaaaagg

SEQ ID NO: 760549 - DNA, 20 bp, Artificial
  CRISPR gRNA sequence
gggtctcaggcctaaaagga

SEQ ID NO: 760550 - DNA, 20 bp, Artificial
  CRISPR gRNA sequence
ggtctcaggcctaaaaggag

SEQ ID NO: 760551 - DNA, 20 bp, Artificial
  CRISPR gRNA sequence
ctcaggcctaaaaggagggg

SEQ ID NO: 760552 - DNA, 20 bp, Artificial
  CRISPR gRNA sequence
ggcctaaaaggaggggtgga

SEQ ID NO: 760553 - DNA, 20 bp, Artificial
  CRISPR gRNA sequence
gcctaaaaggaggggtggac

SEQ ID NO: 760554 - DNA, 20 bp, Artificial
  CRISPR gRNA sequence
cctaaaaggaggggtggaca

SEQ ID NO: 760555 - DNA, 20 bp, Artificial
  CRISPR gRNA sequence
aaggaggggtggacagggcc

SEQ ID NO: 760556 - DNA, 20 bp, Artificial
  CRISPR gRNA sequence
aggaggggtggacagggcct

SEQ ID NO: 760557 - DNA, 20 bp, Artificial
  CRISPR gRNA sequence
ggaggggtggacagggcctg

SEQ ID NO: 760558 - DNA, 20 bp, Artificial
  CRISPR gRNA sequence
gggtggacagggcctggggt

SEQ ID NO: 760559 - DNA, 20 bp, Artificial
  CRISPR gRNA sequence
tggacagggcctggggttag

SEQ ID NO: 760560 - DNA, 20 bp, Artificial
  CRISPR gRNA sequence
ggacagggcctggggttagc

SEQ ID NO: 760561 - DNA, 20 bp, Artificial
  CRISPR gRNA sequence
gacagggcctggggttagca

SEQ ID NO: 760562 - DNA, 20 bp, Artificial
  CRISPR gRNA sequence
acagggcctggggttagcag

SEQ ID NO: 760563 - DNA, 20 bp, Artificial
  CRISPR gRNA sequence
gggcctggggttagcagggg

SEQ ID NO: 760564 - DNA, 20 bp, Artificial
  CRISPR gRNA sequence
ggcctggggttagcaggggc

SEQ ID NO: 760565 - DNA, 20 bp, Artificial
  CRISPR gRNA sequence
gcctggggttagcaggggca

SEQ ID NO: 760566 - DNA, 20 bp, Artificial
  CRISPR gRNA sequence
ctggggttagcaggggcagg

SEQ ID NO: 760567 - DNA, 20 bp, Artificial
  CRISPR gRNA sequence
gggttagcaggggcagggag

SEQ ID NO: 760568 - DNA, 20 bp, Artificial
  CRISPR gRNA sequence
ggttagcaggggcagggagc

SEQ ID NO: 760569 - DNA, 20 bp, Artificial
  CRISPR gRNA sequence
gcaggggcagggagcgggac

SEQ ID NO: 760570 - DNA, 20 bp, Artificial
  CRISPR gRNA sequence
caggggcagggagcgggact

SEQ ID NO: 760571 - DNA, 20 bp, Artificial
  CRISPR gRNA sequence
aggggcagggagcgggacta

SEQ ID NO: 760572 - DNA, 20 bp, Artificial
  CRISPR gRNA sequence
gggcagggagcgggactagg

SEQ ID NO: 760573 - DNA, 20 bp, Artificial
  CRISPR gRNA sequence
ggcagggagcgggactaggg

SEQ ID NO: 760574 - DNA, 20 bp, Artificial
  CRISPR gRNA sequence
tagggaggcccacccctcct

SEQ ID NO: 760575 - DNA, 20 bp, Artificial
  CRISPR gRNA sequence
ttctccactccccctacccc

SEQ ID NO: 760576 - DNA, 20 bp, Artificial
  CRISPR gRNA sequence
tctccactccccctaccccc

SEQ ID NO: 760577 - DNA, 20 bp, Artificial
  CRISPR gRNA sequence
tccactccccctacccccag

SEQ ID NO: 760578 - DNA, 20 bp, Artificial
  CRISPR gRNA sequence
ccccctacccccaggagccc

SEQ ID NO: 760579 - DNA, 20 bp, Artificial
  CRISPR gRNA sequence
ccctacccccaggagccctg

SEQ ID NO: 760580 - DNA, 20 bp, Artificial
  CRISPR gRNA sequence
cctacccccaggagccctgg

SEQ ID NO: 760581 - DNA, 20 bp, Artificial
  CRISPR gRNA sequence
ccccaggagccctggaggtc

SEQ ID NO: 760582 - DNA, 20 bp, Artificial
  CRISPR gRNA sequence
cccaggagccctggaggtcc

SEQ ID NO: 760583 - DNA, 20 bp, Artificial
  CRISPR gRNA sequence
cctggaggtccaggtccctg

SEQ ID NO: 760584 - DNA, 20 bp, Artificial
  CRISPR gRNA sequence
ggtccaggtccctgaagacc

SEQ ID NO: 760585 - DNA, 20 bp, Artificial
  CRISPR gRNA sequence
ccaggtccctgaagacccag

SEQ ID NO: 760586 - DNA, 20 bp, Artificial
  CRISPR gRNA sequence
ggtccctgaagacccagtgg

SEQ ID NO: 760587 - DNA, 20 bp, Artificial
  CRISPR gRNA sequence
tgaagacccagtggtggcac

SEQ ID NO: 760588 - DNA, 20 bp, Artificial
  CRISPR gRNA sequence
agacccagtggtggcactgg

SEQ ID NO: 760589 - DNA, 20 bp, Artificial
  CRISPR gRNA sequence
gacccagtggtggcactggt

SEQ ID NO: 760590 - DNA, 20 bp, Artificial
  CRISPR gRNA sequence
tgtgctgctccttctcccct

SEQ ID NO: 760591 - DNA, 20 bp, Artificial
  CRISPR gRNA sequence
tgctccttctcccctgagcc

SEQ ID NO: 760592 - DNA, 20 bp, Artificial
  CRISPR gRNA sequence
ttctcccctgagcctggctt

SEQ ID NO: 760593 - DNA, 20 bp, Artificial
  CRISPR gRNA sequence
ccctgagcctggcttcagcc

SEQ ID NO: 760594 - DNA, 20 bp, Artificial
  CRISPR gRNA sequence
agcctggcttcagcctggca

SEQ ID NO: 760595 - DNA, 20 bp, Artificial
  CRISPR gRNA sequence
tggcacagctcaacctcatc

SEQ ID NO: 760596 - DNA, 20 bp, Artificial
  CRISPR gRNA sequence
cacagctcaacctcatctgg

SEQ ID NO: 760597 - DNA, 20 bp, Artificial
  CRISPR gRNA sequence
caacctcatctggcagctga

SEQ ID NO: 760598 - DNA, 20 bp, Artificial
  CRISPR gRNA sequence
ggcagctgacagataccaaa

SEQ ID NO: 760599 - DNA, 20 bp, Artificial
  CRISPR gRNA sequence
gctgacagataccaaacagc

SEQ ID NO: 760600 - DNA, 20 bp, Artificial
  CRISPR gRNA sequence
gataccaaacagctggtgca

SEQ ID NO: 760601 - DNA, 20 bp, Artificial
  CRISPR gRNA sequence
agctggtgcacagctttgct

SEQ ID NO: 760602 - DNA, 20 bp, Artificial
  CRISPR gRNA sequence
gctggtgcacagctttgctg

SEQ ID NO: 760603 - DNA, 20 bp, Artificial
  CRISPR gRNA sequence
ctggtgcacagctttgctga

SEQ ID NO: 760604 - DNA, 20 bp, Artificial
  CRISPR gRNA sequence
tgcacagctttgctgagggc

SEQ ID NO: 760605 - DNA, 20 bp, Artificial
  CRISPR gRNA sequence
gcacagctttgctgagggcc

SEQ ID NO: 760606 - DNA, 20 bp, Artificial
  CRISPR gRNA sequence
gctttgctgagggccaggac

SEQ ID NO: 760607 - DNA, 20 bp, Artificial
  CRISPR gRNA sequence
ctttgctgagggccaggacc

SEQ ID NO: 760608 - DNA, 20 bp, Artificial
  CRISPR gRNA sequence
tttgctgagggccaggacca

SEQ ID NO: 760609 - DNA, 20 bp, Artificial
  CRISPR gRNA sequence
gctgagggccaggaccaggg

SEQ ID NO: 760610 - DNA, 20 bp, Artificial
  CRISPR gRNA sequence
cagcgcctatgccaaccgca

SEQ ID NO: 760611 - DNA, 20 bp, Artificial
  CRISPR gRNA sequence
caaccgcacggccctcttcc

SEQ ID NO: 760612 - DNA, 20 bp, Artificial
  CRISPR gRNA sequence
ggccctcttcccggacctgc

SEQ ID NO: 760613 - DNA, 20 bp, Artificial
  CRISPR gRNA sequence
tcttcccggacctgctggca

SEQ ID NO: 760614 - DNA, 20 bp, Artificial
  CRISPR gRNA sequence
cttcccggacctgctggcac

SEQ ID NO: 760615 - DNA, 20 bp, Artificial
  CRISPR gRNA sequence
ttcccggacctgctggcaca

SEQ ID NO: 760616 - DNA, 20 bp, Artificial
  CRISPR gRNA sequence
gcacagggcaacgcatccct

SEQ ID NO: 760617 - DNA, 20 bp, Artificial
  CRISPR gRNA sequence
cacagggcaacgcatccctg

SEQ ID NO: 760618 - DNA, 20 bp, Artificial
  CRISPR gRNA sequence
gcaacgcatccctgaggctg

SEQ ID NO: 760619 - DNA, 20 bp, Artificial
  CRISPR gRNA sequence
gaggctgcagcgcgtgcgtg

SEQ ID NO: 760620 - DNA, 20 bp, Artificial
  CRISPR gRNA sequence
gctgcagcgcgtgcgtgtgg

SEQ ID NO: 760621 - DNA, 20 bp, Artificial
  CRISPR gRNA sequence
agcgcgtgcgtgtggcggac

SEQ ID NO: 760622 - DNA, 20 bp, Artificial
  CRISPR gRNA sequence
gcgcgtgcgtgtggcggacg

SEQ ID NO: 760623 - DNA, 20 bp, Artificial
  CRISPR gRNA sequence
cgcgtgcgtgtggcggacga

SEQ ID NO: 760624 - DNA, 20 bp, Artificial
  CRISPR gRNA sequence
gtgcgtgtggcggacgaggg

SEQ ID NO: 760625 - DNA, 20 bp, Artificial
  CRISPR gRNA sequence
ggcagcttcacctgcttcgt

SEQ ID NO: 760626 - DNA, 20 bp, Artificial
  CRISPR gRNA sequence
tcacctgcttcgtgagcatc

SEQ ID NO: 760627 - DNA, 20 bp, Artificial
  CRISPR gRNA sequence
cacctgcttcgtgagcatcc

SEQ ID NO: 760628 - DNA, 20 bp, Artificial
  CRISPR gRNA sequence
ttcgtgagcatccgggattt

SEQ ID NO: 760629 - DNA, 20 bp, Artificial
  CRISPR gRNA sequence
gtgagcatccgggatttcgg

SEQ ID NO: 760630 - DNA, 20 bp, Artificial
  CRISPR gRNA sequence
gatttcggcagcgctgccgt

SEQ ID NO: 760631 - DNA, 20 bp, Artificial
  CRISPR gRNA sequence
gcagcgctgccgtcagcctg

SEQ ID NO: 760632 - DNA, 20 bp, Artificial
  CRISPR gRNA sequence
cagcgctgccgtcagcctgc

SEQ ID NO: 760633 - DNA, 20 bp, Artificial
  CRISPR gRNA sequence
cgctgccgtcagcctgcagg

SEQ ID NO: 760634 - DNA, 20 bp, Artificial
  CRISPR gRNA sequence
gccgtcagcctgcaggtggc

SEQ ID NO: 760635 - DNA, 20 bp, Artificial
  CRISPR gRNA sequence
tcagcctgcaggtggccggt

SEQ ID NO: 760636 - DNA, 20 bp, Artificial
  CRISPR gRNA sequence
tgcaggtggccggtgagcac

SEQ ID NO: 760637 - DNA, 20 bp, Artificial
  CRISPR gRNA sequence
gcaggtggccggtgagcacc

SEQ ID NO: 760638 - DNA, 20 bp, Artificial
  CRISPR gRNA sequence
aggtggccggtgagcaccag

SEQ ID NO: 760639 - DNA, 20 bp, Artificial
  CRISPR gRNA sequence
ggtggccggtgagcaccagg

SEQ ID NO: 760640 - DNA, 20 bp, Artificial
  CRISPR gRNA sequence
gtggccggtgagcaccagga

SEQ ID NO: 760641 - DNA, 20 bp, Artificial
  CRISPR gRNA sequence
tggccggtgagcaccaggag

SEQ ID NO: 760642 - DNA, 20 bp, Artificial
  CRISPR gRNA sequence
ggccggtgagcaccaggagg

SEQ ID NO: 760643 - DNA, 20 bp, Artificial
  CRISPR gRNA sequence
ggagggggacgccttcccct

SEQ ID NO: 760644 - DNA, 20 bp, Artificial
  CRISPR gRNA sequence
ttcaccctccattccccctg

SEQ ID NO: 760645 - DNA, 20 bp, Artificial
  CRISPR gRNA sequence
ccctgctgcaccactgctcc

SEQ ID NO: 760646 - DNA, 20 bp, Artificial
  CRISPR gRNA sequence
caccactgctcccagaaccc

SEQ ID NO: 760647 - DNA, 20 bp, Artificial
  CRISPR gRNA sequence
ccagtgctgattcctgtact

SEQ ID NO: 760648 - DNA, 20 bp, Artificial
  CRISPR gRNA sequence
cccctgccctctgtcacctc

SEQ ID NO: 760649 - DNA, 20 bp, Artificial
  CRISPR gRNA sequence
cacctccagctccctactcg

SEQ ID NO: 760650 - DNA, 20 bp, Artificial
  CRISPR gRNA sequence
ccagctccctactcgaagcc

SEQ ID NO: 760651 - DNA, 20 bp, Artificial
  CRISPR gRNA sequence
ctcgaagcccagcatgaccc

SEQ ID NO: 760652 - DNA, 20 bp, Artificial
  CRISPR gRNA sequence
cgaagcccagcatgaccctg

SEQ ID NO: 760653 - DNA, 20 bp, Artificial
  CRISPR gRNA sequence
gcatgaccctggagcccaac

SEQ ID NO: 760654 - DNA, 20 bp, Artificial
  CRISPR gRNA sequence
catgaccctggagcccaaca

SEQ ID NO: 760655 - DNA, 20 bp, Artificial
  CRISPR gRNA sequence
tggagcccaacaaggacctg

SEQ ID NO: 760656 - DNA, 20 bp, Artificial
  CRISPR gRNA sequence
gcccaacaaggacctgcggc

SEQ ID NO: 760657 - DNA, 20 bp, Artificial
  CRISPR gRNA sequence
cccaacaaggacctgcggcc

SEQ ID NO: 760658 - DNA, 20 bp, Artificial
  CRISPR gRNA sequence
ccaacaaggacctgcggcca

SEQ ID NO: 760659 - DNA, 20 bp, Artificial
  CRISPR gRNA sequence
caacaaggacctgcggccag

SEQ ID NO: 760660 - DNA, 20 bp, Artificial
  CRISPR gRNA sequence
ggacctgcggccaggggaca

SEQ ID NO: 760661 - DNA, 20 bp, Artificial
  CRISPR gRNA sequence
acggtgaccatcacgtgctc

SEQ ID NO: 760662 - DNA, 20 bp, Artificial
  CRISPR gRNA sequence
ccatcacgtgctccagctac

SEQ ID NO: 760663 - DNA, 20 bp, Artificial
  CRISPR gRNA sequence
catcacgtgctccagctacc

SEQ ID NO: 760664 - DNA, 20 bp, Artificial
  CRISPR gRNA sequence
atcacgtgctccagctacca

SEQ ID NO: 760665 - DNA, 20 bp, Artificial
  CRISPR gRNA sequence
ccagctaccagggctaccct

SEQ ID NO: 760666 - DNA, 20 bp, Artificial
  CRISPR gRNA sequence
cagctaccagggctaccctg

SEQ ID NO: 760667 - DNA, 20 bp, Artificial
  CRISPR gRNA sequence
accagggctaccctgaggct

SEQ ID NO: 760668 - DNA, 20 bp, Artificial
  CRISPR gRNA sequence
ccagggctaccctgaggctg

SEQ ID NO: 760669 - DNA, 20 bp, Artificial
  CRISPR gRNA sequence
accctgaggctgaggtgttc

SEQ ID NO: 760670 - DNA, 20 bp, Artificial
  CRISPR gRNA sequence
ctgaggctgaggtgttctgg

SEQ ID NO: 760671 - DNA, 20 bp, Artificial
  CRISPR gRNA sequence
tgaggctgaggtgttctggc

SEQ ID NO: 760672 - DNA, 20 bp, Artificial
  CRISPR gRNA sequence
gctgaggtgttctggcagga

SEQ ID NO: 760673 - DNA, 20 bp, Artificial
  CRISPR gRNA sequence
ctgaggtgttctggcaggat

SEQ ID NO: 760674 - DNA, 20 bp, Artificial
  CRISPR gRNA sequence
aggtgttctggcaggatggg

SEQ ID NO: 760675 - DNA, 20 bp, Artificial
  CRISPR gRNA sequence
ggtgttctggcaggatgggc

SEQ ID NO: 760676 - DNA, 20 bp, Artificial
  CRISPR gRNA sequence
gtgttctggcaggatgggca

SEQ ID NO: 760677 - DNA, 20 bp, Artificial
  CRISPR gRNA sequence
gggcagggtgtgcccctgac

SEQ ID NO: 760678 - DNA, 20 bp, Artificial
  CRISPR gRNA sequence
ctggcaacgtgaccacgtcg

SEQ ID NO: 760679 - DNA, 20 bp, Artificial
  CRISPR gRNA sequence
caacgtgaccacgtcgcaga

SEQ ID NO: 760680 - DNA, 20 bp, Artificial
  CRISPR gRNA sequence
ccacgtcgcagatggccaac

SEQ ID NO: 760681 - DNA, 20 bp, Artificial
  CRISPR gRNA sequence
cgtcgcagatggccaacgag

SEQ ID NO: 760682 - DNA, 20 bp, Artificial
  CRISPR gRNA sequence
gtcgcagatggccaacgagc

SEQ ID NO: 760683 - DNA, 20 bp, Artificial
  CRISPR gRNA sequence
tcgcagatggccaacgagca

SEQ ID NO: 760684 - DNA, 20 bp, Artificial
  CRISPR gRNA sequence
cagggcttgtttgatgtgca

SEQ ID NO: 760685 - DNA, 20 bp, Artificial
  CRISPR gRNA sequence
ttgatgtgcacagcatcctg

SEQ ID NO: 760686 - DNA, 20 bp, Artificial
  CRISPR gRNA sequence
tgatgtgcacagcatcctgc

SEQ ID NO: 760687 - DNA, 20 bp, Artificial
  CRISPR gRNA sequence
tgtgcacagcatcctgcggg

SEQ ID NO: 760688 - DNA, 20 bp, Artificial
  CRISPR gRNA sequence
cagcatcctgcgggtggtgc

SEQ ID NO: 760689 - DNA, 20 bp, Artificial
  CRISPR gRNA sequence
agcatcctgcgggtggtgct

SEQ ID NO: 760690 - DNA, 20 bp, Artificial
  CRISPR gRNA sequence
cgggtggtgctgggtgcaaa

SEQ ID NO: 760691 - DNA, 20 bp, Artificial
  CRISPR gRNA sequence
ctgggtgcaaatggcaccta

SEQ ID NO: 760692 - DNA, 20 bp, Artificial
  CRISPR gRNA sequence
aaatggcacctacagctgcc

SEQ ID NO: 760693 - DNA, 20 bp, Artificial
  CRISPR gRNA sequence
tggtgcgcaaccccgtgctg

SEQ ID NO: 760694 - DNA, 20 bp, Artificial
  CRISPR gRNA sequence
tgcgcaaccccgtgctgcag

SEQ ID NO: 760695 - DNA, 20 bp, Artificial
  CRISPR gRNA sequence
gcgcaaccccgtgctgcagc

SEQ ID NO: 760696 - DNA, 20 bp, Artificial
  CRISPR gRNA sequence
gtgctgcagcaggatgcgca

SEQ ID NO: 760697 - DNA, 20 bp, Artificial
  CRISPR gRNA sequence
gctctgtcaccatcacaccc

SEQ ID NO: 760698 - DNA, 20 bp, Artificial
  CRISPR gRNA sequence
tctgtcaccatcacacccca

SEQ ID NO: 760699 - DNA, 20 bp, Artificial
  CRISPR gRNA sequence
gtcaccatcacaccccagag

SEQ ID NO: 760700 - DNA, 20 bp, Artificial
  CRISPR gRNA sequence
cacaccccagagaagcccca

SEQ ID NO: 760701 - DNA, 20 bp, Artificial
  CRISPR gRNA sequence
acaccccagagaagccccac

SEQ ID NO: 760702 - DNA, 20 bp, Artificial
  CRISPR gRNA sequence
gctttgcttaaatgtcccct

SEQ ID NO: 760703 - DNA, 20 bp, Artificial
  CRISPR gRNA sequence
ctttgcttaaatgtcccctt

SEQ ID NO: 760704 - DNA, 20 bp, Artificial
  CRISPR gRNA sequence
tttgcttaaatgtccccttg

SEQ ID NO: 760705 - DNA, 20 bp, Artificial
  CRISPR gRNA sequence
ttgcttaaatgtccccttgg

SEQ ID NO: 760706 - DNA, 20 bp, Artificial
  CRISPR gRNA sequence
gcttaaatgtccccttgggg

SEQ ID NO: 760707 - DNA, 20 bp, Artificial
  CRISPR gRNA sequence
cttaaatgtccccttggggg

SEQ ID NO: 760708 - DNA, 20 bp, Artificial
  CRISPR gRNA sequence
ttaaatgtccccttggggga

SEQ ID NO: 760709 - DNA, 20 bp, Artificial
  CRISPR gRNA sequence
taaatgtccccttgggggag

SEQ ID NO: 760710 - DNA, 20 bp, Artificial
  CRISPR gRNA sequence
aaatgtccccttgggggagg

SEQ ID NO: 760711 - DNA, 20 bp, Artificial
  CRISPR gRNA sequence
aatgtccccttgggggaggg

SEQ ID NO: 760712 - DNA, 20 bp, Artificial
  CRISPR gRNA sequence
gaggggggttctgcttctgt

SEQ ID NO: 760713 - DNA, 20 bp, Artificial
  CRISPR gRNA sequence
gggggttctgcttctgtcgg

SEQ ID NO: 760714 - DNA, 20 bp, Artificial
  CRISPR gRNA sequence
ggggttctgcttctgtcggc

SEQ ID NO: 760715 - DNA, 20 bp, Artificial
  CRISPR gRNA sequence
gggttctgcttctgtcggca

SEQ ID NO: 760716 - DNA, 20 bp, Artificial
  CRISPR gRNA sequence
ggttctgcttctgtcggcag

SEQ ID NO: 760717 - DNA, 20 bp, Artificial
  CRISPR gRNA sequence
ctgcttctgtcggcaggggt

SEQ ID NO: 760718 - DNA, 20 bp, Artificial
  CRISPR gRNA sequence
tgcttctgtcggcaggggtt

SEQ ID NO: 760719 - DNA, 20 bp, Artificial
  CRISPR gRNA sequence
cttctgtcggcaggggttgg

SEQ ID NO: 760720 - DNA, 20 bp, Artificial
  CRISPR gRNA sequence
ggggttgggagctccgaatc

SEQ ID NO: 760721 - DNA, 20 bp, Artificial
  CRISPR gRNA sequence
tggccccaccttcaatctcc

SEQ ID NO: 760722 - DNA, 20 bp, Artificial
  CRISPR gRNA sequence
ccaccttcaatctcccagaa

SEQ ID NO: 760723 - DNA, 20 bp, Artificial
  CRISPR gRNA sequence
cttcaatctcccagaacagc

SEQ ID NO: 760724 - DNA, 20 bp, Artificial
  CRISPR gRNA sequence
agcaagttgcctcctaatga

SEQ ID NO: 760725 - DNA, 20 bp, Artificial
  CRISPR gRNA sequence
gcaagttgcctcctaatgat

SEQ ID NO: 760726 - DNA, 20 bp, Artificial
  CRISPR gRNA sequence
caagttgcctcctaatgata

SEQ ID NO: 760727 - DNA, 20 bp, Artificial
  CRISPR gRNA sequence
agttgcctcctaatgatagg

SEQ ID NO: 760728 - DNA, 20 bp, Artificial
  CRISPR gRNA sequence
gcctcctaatgatagggaga

SEQ ID NO: 760729 - DNA, 20 bp, Artificial
  CRISPR gRNA sequence
aatgatagggagaaagataa

SEQ ID NO: 760730 - DNA, 20 bp, Artificial
  CRISPR gRNA sequence
atgatagggagaaagataac

SEQ ID NO: 760731 - DNA, 20 bp, Artificial
  CRISPR gRNA sequence
tgatagggagaaagataacg

SEQ ID NO: 760732 - DNA, 20 bp, Artificial
  CRISPR gRNA sequence
atagggagaaagataacggg

SEQ ID NO: 760733 - DNA, 20 bp, Artificial
  CRISPR gRNA sequence
tagggagaaagataacgggg

SEQ ID NO: 760734 - DNA, 20 bp, Artificial
  CRISPR gRNA sequence
ggagaaagataacggggagg

SEQ ID NO: 760735 - DNA, 20 bp, Artificial
  CRISPR gRNA sequence
gagaaagataacggggaggt

SEQ ID NO: 760736 - DNA, 20 bp, Artificial
  CRISPR gRNA sequence
agaaagataacggggaggtg

SEQ ID NO: 760737 - DNA, 20 bp, Artificial
  CRISPR gRNA sequence
ggggaggtggggatgttcac

SEQ ID NO: 760738 - DNA, 20 bp, Artificial
  CRISPR gRNA sequence
ggaggtggggatgttcactg

SEQ ID NO: 760739 - DNA, 20 bp, Artificial
  CRISPR gRNA sequence
gaggtggggatgttcactgg

SEQ ID NO: 760740 - DNA, 20 bp, Artificial
  CRISPR gRNA sequence
aggtggggatgttcactgga

SEQ ID NO: 760741 - DNA, 20 bp, Artificial
  CRISPR gRNA sequence
ggtggggatgttcactggag

SEQ ID NO: 760742 - DNA, 20 bp, Artificial
  CRISPR gRNA sequence
gggatgttcactggaggggt

SEQ ID NO: 760743 - DNA, 20 bp, Artificial
  CRISPR gRNA sequence
ggatgttcactggaggggtt

SEQ ID NO: 760744 - DNA, 20 bp, Artificial
  CRISPR gRNA sequence
gatgttcactggaggggttg

SEQ ID NO: 760745 - DNA, 20 bp, Artificial
  CRISPR gRNA sequence
atgttcactggaggggttgg

SEQ ID NO: 760746 - DNA, 20 bp, Artificial
  CRISPR gRNA sequence
ttcactggaggggttggggg

SEQ ID NO: 760747 - DNA, 20 bp, Artificial
  CRISPR gRNA sequence
cactggaggggttgggggcg

SEQ ID NO: 760748 - DNA, 20 bp, Artificial
  CRISPR gRNA sequence
ggttgggggcggagaaatca

SEQ ID NO: 760749 - DNA, 20 bp, Artificial
  CRISPR gRNA sequence
gttgggggcggagaaatcac

SEQ ID NO: 760750 - DNA, 20 bp, Artificial
  CRISPR gRNA sequence
gagaaatcacaggccttctt

SEQ ID NO: 760751 - DNA, 20 bp, Artificial
  CRISPR gRNA sequence
agaaatcacaggccttctta

SEQ ID NO: 760752 - DNA, 20 bp, Artificial
  CRISPR gRNA sequence
cttaaggctctcctgacttc

SEQ ID NO: 760753 - DNA, 20 bp, Artificial
  CRISPR gRNA sequence
ttaaggctctcctgacttca

SEQ ID NO: 760754 - DNA, 20 bp, Artificial
  CRISPR gRNA sequence
ctctcctgacttcaaggctc

SEQ ID NO: 760755 - DNA, 20 bp, Artificial
  CRISPR gRNA sequence
tcctgacttcaaggctctgg

SEQ ID NO: 760756 - DNA, 20 bp, Artificial
  CRISPR gRNA sequence
ttcaaggctctggaagcctc

SEQ ID NO: 760757 - DNA, 20 bp, Artificial
  CRISPR gRNA sequence
tcaaggctctggaagcctct

SEQ ID NO: 760758 - DNA, 20 bp, Artificial
  CRISPR gRNA sequence
aggctctggaagcctctggg

SEQ ID NO: 760759 - DNA, 20 bp, Artificial
  CRISPR gRNA sequence
ctggaagcctctgggaagaa

SEQ ID NO: 760760 - DNA, 20 bp, Artificial
  CRISPR gRNA sequence
ggaagcctctgggaagaatg

SEQ ID NO: 760761 - DNA, 20 bp, Artificial
  CRISPR gRNA sequence
gggaagaatggagccacatc

SEQ ID NO: 760762 - DNA, 20 bp, Artificial
  CRISPR gRNA sequence
ggaagaatggagccacatct

SEQ ID NO: 760763 - DNA, 20 bp, Artificial
  CRISPR gRNA sequence
gaatggagccacatctgggt

SEQ ID NO: 760764 - DNA, 20 bp, Artificial
  CRISPR gRNA sequence
tggagccacatctgggtcag

SEQ ID NO: 760765 - DNA, 20 bp, Artificial
  CRISPR gRNA sequence
gagccacatctgggtcagca

SEQ ID NO: 760766 - DNA, 20 bp, Artificial
  CRISPR gRNA sequence
agccacatctgggtcagcag

SEQ ID NO: 760767 - DNA, 20 bp, Artificial
  CRISPR gRNA sequence
gccacatctgggtcagcaga

SEQ ID NO: 760768 - DNA, 20 bp, Artificial
  CRISPR gRNA sequence
ccacatctgggtcagcagag

SEQ ID NO: 760769 - DNA, 20 bp, Artificial
  CRISPR gRNA sequence
catctgggtcagcagagggg

SEQ ID NO: 760770 - DNA, 20 bp, Artificial
  CRISPR gRNA sequence
atctgggtcagcagaggggt

SEQ ID NO: 760771 - DNA, 20 bp, Artificial
  CRISPR gRNA sequence
ggtcagcagaggggtgggcg

SEQ ID NO: 760772 - DNA, 20 bp, Artificial
  CRISPR gRNA sequence
gtcagcagaggggtgggcga

SEQ ID NO: 760773 - DNA, 20 bp, Artificial
  CRISPR gRNA sequence
gcagaggggtgggcgaagga

SEQ ID NO: 760774 - DNA, 20 bp, Artificial
  CRISPR gRNA sequence
cagaggggtgggcgaaggaa

SEQ ID NO: 760775 - DNA, 20 bp, Artificial
  CRISPR gRNA sequence
gaggggtgggcgaaggaaag

SEQ ID NO: 760776 - DNA, 20 bp, Artificial
  CRISPR gRNA sequence
gcgaaggaaaggagtcctga

SEQ ID NO: 760777 - DNA, 20 bp, Artificial
  CRISPR gRNA sequence
aaggaaaggagtcctgatgg

SEQ ID NO: 760778 - DNA, 20 bp, Artificial
  CRISPR gRNA sequence
aggaaaggagtcctgatggc

SEQ ID NO: 760779 - DNA, 20 bp, Artificial
  CRISPR gRNA sequence
gtcctgatggcaggattcac

SEQ ID NO: 760780 - DNA, 20 bp, Artificial
  CRISPR gRNA sequence
tcctgatggcaggattcacc

SEQ ID NO: 760781 - DNA, 20 bp, Artificial
  CRISPR gRNA sequence
cctgatggcaggattcacca

SEQ ID NO: 760782 - DNA, 20 bp, Artificial
  CRISPR gRNA sequence
atggcaggattcaccagggc

SEQ ID NO: 760783 - DNA, 20 bp, Artificial
  CRISPR gRNA sequence
ggcaggattcaccagggctg

SEQ ID NO: 760784 - DNA, 20 bp, Artificial
  CRISPR gRNA sequence
ggattcaccagggctggagc

SEQ ID NO: 760785 - DNA, 20 bp, Artificial
  CRISPR gRNA sequence
tcaccagggctggagctggt

SEQ ID NO: 760786 - DNA, 20 bp, Artificial
  CRISPR gRNA sequence
accagggctggagctggtga

SEQ ID NO: 760787 - DNA, 20 bp, Artificial
  CRISPR gRNA sequence
ctggtgagagtcacctgccc

SEQ ID NO: 760788 - DNA, 20 bp, Artificial
  CRISPR gRNA sequence
tggtgagagtcacctgcccc

SEQ ID NO: 760789 - DNA, 20 bp, Artificial
  CRISPR gRNA sequence
agagtcacctgccccaggcc

SEQ ID NO: 760790 - DNA, 20 bp, Artificial
  CRISPR gRNA sequence
acctgccccaggcctggccc

SEQ ID NO: 760791 - DNA, 20 bp, Artificial
  CRISPR gRNA sequence
cctgccccaggcctggccct

SEQ ID NO: 760792 - DNA, 20 bp, Artificial
  CRISPR gRNA sequence
cccaggcctggccctgggat

SEQ ID NO: 760793 - DNA, 20 bp, Artificial
  CRISPR gRNA sequence
gcctggccctgggattggtc

SEQ ID NO: 760794 - DNA, 20 bp, Artificial
  CRISPR gRNA sequence
ggccctgggattggtctggt

SEQ ID NO: 760795 - DNA, 20 bp, Artificial
  CRISPR gRNA sequence
gccctgggattggtctggtc

SEQ ID NO: 760796 - DNA, 20 bp, Artificial
  CRISPR gRNA sequence
gggattggtctggtcaggcc

SEQ ID NO: 760797 - DNA, 20 bp, Artificial
  CRISPR gRNA sequence
ccacctgctgtgattgttct

SEQ ID NO: 760798 - DNA, 20 bp, Artificial
  CRISPR gRNA sequence
cctgctgtgattgttctcag

SEQ ID NO: 760799 - DNA, 20 bp, Artificial
  CRISPR gRNA sequence
tgtgattgttctcagaagat

SEQ ID NO: 760800 - DNA, 20 bp, Artificial
  CRISPR gRNA sequence
gtgattgttctcagaagatt

SEQ ID NO: 760801 - DNA, 20 bp, Artificial
  CRISPR gRNA sequence
tgattgttctcagaagattg

SEQ ID NO: 760802 - DNA, 20 bp, Artificial
  CRISPR gRNA sequence
attgttctcagaagattggg

SEQ ID NO: 760803 - DNA, 20 bp, Artificial
  CRISPR gRNA sequence
attggggagactccatatct

SEQ ID NO: 760804 - DNA, 20 bp, Artificial
  CRISPR gRNA sequence
tggggagactccatatctga

SEQ ID NO: 760805 - DNA, 20 bp, Artificial
  CRISPR gRNA sequence
actccatatctgagagtcct

SEQ ID NO: 760806 - DNA, 20 bp, Artificial
  CRISPR gRNA sequence
cttaatctgcttttgcatct

SEQ ID NO: 760807 - DNA, 20 bp, Artificial
  CRISPR gRNA sequence
aatctgcttttgcatctaag

SEQ ID NO: 760808 - DNA, 20 bp, Artificial
  CRISPR gRNA sequence
ttttgcatctaagaagaaaa

SEQ ID NO: 760809 - DNA, 20 bp, Artificial
  CRISPR gRNA sequence
tttgcatctaagaagaaaat

SEQ ID NO: 760810 - DNA, 20 bp, Artificial
  CRISPR gRNA sequence
gcatctaagaagaaaatagg

SEQ ID NO: 760811 - DNA, 20 bp, Artificial
  CRISPR gRNA sequence
ctaagaagaaaataggaaga

SEQ ID NO: 760812 - DNA, 20 bp, Artificial
  CRISPR gRNA sequence
aagaaaataggaagatggaa

SEQ ID NO: 760813 - DNA, 20 bp, Artificial
  CRISPR gRNA sequence
agaaaataggaagatggaac

SEQ ID NO: 760814 - DNA, 20 bp, Artificial
  CRISPR gRNA sequence
gaaaataggaagatggaaca

SEQ ID NO: 760815 - DNA, 20 bp, Artificial
  CRISPR gRNA sequence
taggaagatggaacagggtc

SEQ ID NO: 760816 - DNA, 20 bp, Artificial
  CRISPR gRNA sequence
aggaagatggaacagggtct

SEQ ID NO: 760817 - DNA, 20 bp, Artificial
  CRISPR gRNA sequence
gaacagggtctgggaattga

SEQ ID NO: 760818 - DNA, 20 bp, Artificial
  CRISPR gRNA sequence
aacagggtctgggaattgat

SEQ ID NO: 760819 - DNA, 20 bp, Artificial
  CRISPR gRNA sequence
acagggtctgggaattgatg

SEQ ID NO: 760820 - DNA, 20 bp, Artificial
  CRISPR gRNA sequence
cagggtctgggaattgatgg

SEQ ID NO: 760821 - DNA, 20 bp, Artificial
  CRISPR gRNA sequence
ggtctgggaattgatggggg

SEQ ID NO: 760822 - DNA, 20 bp, Artificial
  CRISPR gRNA sequence
tctgggaattgatgggggaa

SEQ ID NO: 760823 - DNA, 20 bp, Artificial
  CRISPR gRNA sequence
gaattgatgggggaagagtt

SEQ ID NO: 760824 - DNA, 20 bp, Artificial
  CRISPR gRNA sequence
aattgatgggggaagagttt

SEQ ID NO: 760825 - DNA, 20 bp, Artificial
  CRISPR gRNA sequence
attgatgggggaagagtttg

SEQ ID NO: 760826 - DNA, 20 bp, Artificial
  CRISPR gRNA sequence
ttgatgggggaagagtttgg

SEQ ID NO: 760827 - DNA, 20 bp, Artificial
  CRISPR gRNA sequence
ggggaagagtttgggggact

SEQ ID NO: 760828 - DNA, 20 bp, Artificial
  CRISPR gRNA sequence
gggaagagtttgggggactc

SEQ ID NO: 760829 - DNA, 20 bp, Artificial
  CRISPR gRNA sequence
aagagtttgggggactcggg

SEQ ID NO: 760830 - DNA, 20 bp, Artificial
  CRISPR gRNA sequence
agtttgggggactcgggtgg

SEQ ID NO: 760831 - DNA, 20 bp, Artificial
  CRISPR gRNA sequence
gggggactcgggtggtagcc

SEQ ID NO: 760832 - DNA, 20 bp, Artificial
  CRISPR gRNA sequence
gggactcgggtggtagccta

SEQ ID NO: 760833 - DNA, 20 bp, Artificial
  CRISPR gRNA sequence
gactcgggtggtagcctaga

SEQ ID NO: 760834 - DNA, 20 bp, Artificial
  CRISPR gRNA sequence
tgcccctctgaccccgcccc

SEQ ID NO: 760835 - DNA, 20 bp, Artificial
  CRISPR gRNA sequence
gcccctctgaccccgccccc

SEQ ID NO: 760836 - DNA, 20 bp, Artificial
  CRISPR gRNA sequence
ccctctgaccccgcccccag

SEQ ID NO: 760837 - DNA, 20 bp, Artificial
  CRISPR gRNA sequence
gaccccgcccccaggagccg

SEQ ID NO: 760838 - DNA, 20 bp, Artificial
  CRISPR gRNA sequence
ccccgcccccaggagccgtg

SEQ ID NO: 760839 - DNA, 20 bp, Artificial
  CRISPR gRNA sequence
cccgcccccaggagccgtgg

SEQ ID NO: 760840 - DNA, 20 bp, Artificial
  CRISPR gRNA sequence
ccccaggagccgtggaggtc

SEQ ID NO: 760841 - DNA, 20 bp, Artificial
  CRISPR gRNA sequence
cccaggagccgtggaggtcc

SEQ ID NO: 760842 - DNA, 20 bp, Artificial
  CRISPR gRNA sequence
ccgtggaggtccaggtccct

SEQ ID NO: 760843 - DNA, 20 bp, Artificial
  CRISPR gRNA sequence
cgtggaggtccaggtccctg

SEQ ID NO: 760844 - DNA, 20 bp, Artificial
  CRISPR gRNA sequence
ggtccaggtccctgaggacc

SEQ ID NO: 760845 - DNA, 20 bp, Artificial
  CRISPR gRNA sequence
ccaggtccctgaggacccgg

SEQ ID NO: 760846 - DNA, 20 bp, Artificial
  CRISPR gRNA sequence
ggtccctgaggacccggtgg

SEQ ID NO: 760847 - DNA, 20 bp, Artificial
  CRISPR gRNA sequence
tgaggacccggtggtggccc

SEQ ID NO: 760848 - DNA, 20 bp, Artificial
  CRISPR gRNA sequence
ggacccggtggtggccctag

SEQ ID NO: 760849 - DNA, 20 bp, Artificial
  CRISPR gRNA sequence
gacccggtggtggccctagt

SEQ ID NO: 760850 - DNA, 20 bp, Artificial
  CRISPR gRNA sequence
tgcgctgctccttctccccc

SEQ ID NO: 760851 - DNA, 20 bp, Artificial
  CRISPR gRNA sequence
tgctccttctcccccgagcc

SEQ ID NO: 760852 - DNA, 20 bp, Artificial
  CRISPR gRNA sequence
ttctcccccgagcctggctt

SEQ ID NO: 760853 - DNA, 20 bp, Artificial
  CRISPR gRNA sequence
ccccgagcctggcttcagcc

SEQ ID NO: 760854 - DNA, 20 bp, Artificial
  CRISPR gRNA sequence
agcctggcttcagcctggca

SEQ ID NO: 760855 - DNA, 20 bp, Artificial
  CRISPR gRNA sequence
tggcacagctcaacctcatc

SEQ ID NO: 760856 - DNA, 20 bp, Artificial
  CRISPR gRNA sequence
cacagctcaacctcatctgg

SEQ ID NO: 760857 - DNA, 20 bp, Artificial
  CRISPR gRNA sequence
caacctcatctggcagctga

SEQ ID NO: 760858 - DNA, 20 bp, Artificial
  CRISPR gRNA sequence
ggcagctgacagacaccaaa

SEQ ID NO: 760859 - DNA, 20 bp, Artificial
  CRISPR gRNA sequence
gctgacagacaccaaacagc

SEQ ID NO: 760860 - DNA, 20 bp, Artificial
  CRISPR gRNA sequence
gacaccaaacagctggtgca

SEQ ID NO: 760861 - DNA, 20 bp, Artificial
  CRISPR gRNA sequence
gctggtgcacagtttcaccg

SEQ ID NO: 760862 - DNA, 20 bp, Artificial
  CRISPR gRNA sequence
ctggtgcacagtttcaccga

SEQ ID NO: 760863 - DNA, 20 bp, Artificial
  CRISPR gRNA sequence
tgcacagtttcaccgaaggc

SEQ ID NO: 760864 - DNA, 20 bp, Artificial
  CRISPR gRNA sequence
gcacagtttcaccgaaggcc

SEQ ID NO: 760865 - DNA, 20 bp, Artificial
  CRISPR gRNA sequence
gtttcaccgaaggccgggac

SEQ ID NO: 760866 - DNA, 20 bp, Artificial
  CRISPR gRNA sequence
tttcaccgaaggccgggacc

SEQ ID NO: 760867 - DNA, 20 bp, Artificial
  CRISPR gRNA sequence
ttcaccgaaggccgggacca

SEQ ID NO: 760868 - DNA, 20 bp, Artificial
  CRISPR gRNA sequence
accgaaggccgggaccaggg

SEQ ID NO: 760869 - DNA, 20 bp, Artificial
  CRISPR gRNA sequence
cagcgcctatgccaaccgca

SEQ ID NO: 760870 - DNA, 20 bp, Artificial
  CRISPR gRNA sequence
caaccgcacggccctcttcc

SEQ ID NO: 760871 - DNA, 20 bp, Artificial
  CRISPR gRNA sequence
ggccctcttcccggacctgc

SEQ ID NO: 760872 - DNA, 20 bp, Artificial
  CRISPR gRNA sequence
cttcccggacctgctggcac

SEQ ID NO: 760873 - DNA, 20 bp, Artificial
  CRISPR gRNA sequence
ttcccggacctgctggcaca

SEQ ID NO: 760874 - DNA, 20 bp, Artificial
  CRISPR gRNA sequence
gcacaaggcaatgcatccct

SEQ ID NO: 760875 - DNA, 20 bp, Artificial
  CRISPR gRNA sequence
cacaaggcaatgcatccctg

SEQ ID NO: 760876 - DNA, 20 bp, Artificial
  CRISPR gRNA sequence
gcaatgcatccctgaggctg

SEQ ID NO: 760877 - DNA, 20 bp, Artificial
  CRISPR gRNA sequence
gaggctgcagcgcgtgcgtg

SEQ ID NO: 760878 - DNA, 20 bp, Artificial
  CRISPR gRNA sequence
gctgcagcgcgtgcgtgtgg

SEQ ID NO: 760879 - DNA, 20 bp, Artificial
  CRISPR gRNA sequence
agcgcgtgcgtgtggcggac

SEQ ID NO: 760880 - DNA, 20 bp, Artificial
  CRISPR gRNA sequence
gcgcgtgcgtgtggcggacg

SEQ ID NO: 760881 - DNA, 20 bp, Artificial
  CRISPR gRNA sequence
cgcgtgcgtgtggcggacga

SEQ ID NO: 760882 - DNA, 20 bp, Artificial
  CRISPR gRNA sequence
gtgcgtgtggcggacgaggg

SEQ ID NO: 760883 - DNA, 20 bp, Artificial
  CRISPR gRNA sequence
ggcagcttcacctgcttcgt

SEQ ID NO: 760884 - DNA, 20 bp, Artificial
  CRISPR gRNA sequence
tcacctgcttcgtgagcatc

SEQ ID NO: 760885 - DNA, 20 bp, Artificial
  CRISPR gRNA sequence
cacctgcttcgtgagcatcc

SEQ ID NO: 760886 - DNA, 20 bp, Artificial
  CRISPR gRNA sequence
ttcgtgagcatccgggattt

SEQ ID NO: 760887 - DNA, 20 bp, Artificial
  CRISPR gRNA sequence
gtgagcatccgggatttcgg

SEQ ID NO: 760888 - DNA, 20 bp, Artificial
  CRISPR gRNA sequence
gatttcggcagcgctgccgt

SEQ ID NO: 760889 - DNA, 20 bp, Artificial
  CRISPR gRNA sequence
gcagcgctgccgtcagcctg

SEQ ID NO: 760890 - DNA, 20 bp, Artificial
  CRISPR gRNA sequence
cagcgctgccgtcagcctgc

SEQ ID NO: 760891 - DNA, 20 bp, Artificial
  CRISPR gRNA sequence
cgctgccgtcagcctgcagg

SEQ ID NO: 760892 - DNA, 20 bp, Artificial
  CRISPR gRNA sequence
gccgtcagcctgcaggtggc

SEQ ID NO: 760893 - DNA, 20 bp, Artificial
  CRISPR gRNA sequence
tcagcctgcaggtggccggt

SEQ ID NO: 760894 - DNA, 20 bp, Artificial
  CRISPR gRNA sequence
tgcaggtggccggtgagcac

SEQ ID NO: 760895 - DNA, 20 bp, Artificial
  CRISPR gRNA sequence
gcaggtggccggtgagcacc

SEQ ID NO: 760896 - DNA, 20 bp, Artificial
  CRISPR gRNA sequence
aggtggccggtgagcaccag

SEQ ID NO: 760897 - DNA, 20 bp, Artificial
  CRISPR gRNA sequence
ggtggccggtgagcaccagg

SEQ ID NO: 760898 - DNA, 20 bp, Artificial
  CRISPR gRNA sequence
gtggccggtgagcaccagga

SEQ ID NO: 760899 - DNA, 20 bp, Artificial
  CRISPR gRNA sequence
ggagggcgacgccttcccct

SEQ ID NO: 760900 - DNA, 20 bp, Artificial
  CRISPR gRNA sequence
ttcaccctccattccctctg

SEQ ID NO: 760901 - DNA, 20 bp, Artificial
  CRISPR gRNA sequence
ctctgctgcaccactgctcc

SEQ ID NO: 760902 - DNA, 20 bp, Artificial
  CRISPR gRNA sequence
caccactgctcccagaaccc

SEQ ID NO: 760903 - DNA, 20 bp, Artificial
  CRISPR gRNA sequence
ccagtgctgattcctgtact

SEQ ID NO: 760904 - DNA, 20 bp, Artificial
  CRISPR gRNA sequence
cccctgccctctgtcacctc

SEQ ID NO: 760905 - DNA, 20 bp, Artificial
  CRISPR gRNA sequence
cacctccagctccctactcg

SEQ ID NO: 760906 - DNA, 20 bp, Artificial
  CRISPR gRNA sequence
ccagctccctactcgaagcc

SEQ ID NO: 760907 - DNA, 20 bp, Artificial
  CRISPR gRNA sequence
ctcgaagcccagcatgaccc

SEQ ID NO: 760908 - DNA, 20 bp, Artificial
  CRISPR gRNA sequence
cgaagcccagcatgaccctg

SEQ ID NO: 760909 - DNA, 20 bp, Artificial
  CRISPR gRNA sequence
gcatgaccctggagcccaac

SEQ ID NO: 760910 - DNA, 20 bp, Artificial
  CRISPR gRNA sequence
catgaccctggagcccaaca

SEQ ID NO: 760911 - DNA, 20 bp, Artificial
  CRISPR gRNA sequence
tggagcccaacaaggacctg

SEQ ID NO: 760912 - DNA, 20 bp, Artificial
  CRISPR gRNA sequence
gcccaacaaggacctgcggc

SEQ ID NO: 760913 - DNA, 20 bp, Artificial
  CRISPR gRNA sequence
cccaacaaggacctgcggcc

SEQ ID NO: 760914 - DNA, 20 bp, Artificial
  CRISPR gRNA sequence
ccaacaaggacctgcggcca

SEQ ID NO: 760915 - DNA, 20 bp, Artificial
  CRISPR gRNA sequence
caacaaggacctgcggccag

SEQ ID NO: 760916 - DNA, 20 bp, Artificial
  CRISPR gRNA sequence
ggacctgcggccaggggaca

SEQ ID NO: 760917 - DNA, 20 bp, Artificial
  CRISPR gRNA sequence
acggtgaccatcacgtgctc

SEQ ID NO: 760918 - DNA, 20 bp, Artificial
  CRISPR gRNA sequence
ccatcacgtgctccagctac

SEQ ID NO: 760919 - DNA, 20 bp, Artificial
  CRISPR gRNA sequence
catcacgtgctccagctacc

SEQ ID NO: 760920 - DNA, 20 bp, Artificial
  CRISPR gRNA sequence
atcacgtgctccagctaccg

SEQ ID NO: 760921 - DNA, 20 bp, Artificial
  CRISPR gRNA sequence
ccagctaccggggctaccct

SEQ ID NO: 760922 - DNA, 20 bp, Artificial
  CRISPR gRNA sequence
cagctaccggggctaccctg

SEQ ID NO: 760923 - DNA, 20 bp, Artificial
  CRISPR gRNA sequence
accggggctaccctgaggct

SEQ ID NO: 760924 - DNA, 20 bp, Artificial
  CRISPR gRNA sequence
ccggggctaccctgaggctg

SEQ ID NO: 760925 - DNA, 20 bp, Artificial
  CRISPR gRNA sequence
accctgaggctgaggtgttc

SEQ ID NO: 760926 - DNA, 20 bp, Artificial
  CRISPR gRNA sequence
ctgaggctgaggtgttctgg

SEQ ID NO: 760927 - DNA, 20 bp, Artificial
  CRISPR gRNA sequence
tgaggctgaggtgttctggc

SEQ ID NO: 760928 - DNA, 20 bp, Artificial
  CRISPR gRNA sequence
gctgaggtgttctggcagga

SEQ ID NO: 760929 - DNA, 20 bp, Artificial
  CRISPR gRNA sequence
ctgaggtgttctggcaggat

SEQ ID NO: 760930 - DNA, 20 bp, Artificial
  CRISPR gRNA sequence
aggtgttctggcaggatggg

SEQ ID NO: 760931 - DNA, 20 bp, Artificial
  CRISPR gRNA sequence
ggtgttctggcaggatgggc

SEQ ID NO: 760932 - DNA, 20 bp, Artificial
  CRISPR gRNA sequence
gtgttctggcaggatgggca

SEQ ID NO: 760933 - DNA, 20 bp, Artificial
  CRISPR gRNA sequence
gggcagggtgtgcccctgac

SEQ ID NO: 760934 - DNA, 20 bp, Artificial
  CRISPR gRNA sequence
ctggcaacgtgaccacgtcg

SEQ ID NO: 760935 - DNA, 20 bp, Artificial
  CRISPR gRNA sequence
caacgtgaccacgtcgcaga

SEQ ID NO: 760936 - DNA, 20 bp, Artificial
  CRISPR gRNA sequence
ccacgtcgcagatggccaac

SEQ ID NO: 760937 - DNA, 20 bp, Artificial
  CRISPR gRNA sequence
cgtcgcagatggccaacgag

SEQ ID NO: 760938 - DNA, 20 bp, Artificial
  CRISPR gRNA sequence
gtcgcagatggccaacgagc

SEQ ID NO: 760939 - DNA, 20 bp, Artificial
  CRISPR gRNA sequence
tcgcagatggccaacgagca

SEQ ID NO: 760940 - DNA, 20 bp, Artificial
  CRISPR gRNA sequence
cagggcttgtttgatgtgca

SEQ ID NO: 760941 - DNA, 20 bp, Artificial
  CRISPR gRNA sequence
ttgatgtgcacagcgtcctg

SEQ ID NO: 760942 - DNA, 20 bp, Artificial
  CRISPR gRNA sequence
tgatgtgcacagcgtcctgc

SEQ ID NO: 760943 - DNA, 20 bp, Artificial
  CRISPR gRNA sequence
tgtgcacagcgtcctgcggg

SEQ ID NO: 760944 - DNA, 20 bp, Artificial
  CRISPR gRNA sequence
cagcgtcctgcgggtggtgc

SEQ ID NO: 760945 - DNA, 20 bp, Artificial
  CRISPR gRNA sequence
agcgtcctgcgggtggtgct

SEQ ID NO: 760946 - DNA, 20 bp, Artificial
  CRISPR gRNA sequence
cgggtggtgctgggtgcgaa

SEQ ID NO: 760947 - DNA, 20 bp, Artificial
  CRISPR gRNA sequence
ctgggtgcgaatggcaccta

SEQ ID NO: 760948 - DNA, 20 bp, Artificial
  CRISPR gRNA sequence
gaatggcacctacagctgcc

SEQ ID NO: 760949 - DNA, 20 bp, Artificial
  CRISPR gRNA sequence
tggtgcgcaaccccgtgctg

SEQ ID NO: 760950 - DNA, 20 bp, Artificial
  CRISPR gRNA sequence
tgcgcaaccccgtgctgcag

SEQ ID NO: 760951 - DNA, 20 bp, Artificial
  CRISPR gRNA sequence
gcgcaaccccgtgctgcagc

SEQ ID NO: 760952 - DNA, 20 bp, Artificial
  CRISPR gRNA sequence
gtgctgcagcaggatgcgca

SEQ ID NO: 760953 - DNA, 20 bp, Artificial
  CRISPR gRNA sequence
gcacggctctgtcaccatca

SEQ ID NO: 760954 - DNA, 20 bp, Artificial
  CRISPR gRNA sequence
cacggctctgtcaccatcac

SEQ ID NO: 760955 - DNA, 20 bp, Artificial
  CRISPR gRNA sequence
gctctgtcaccatcacaggt

SEQ ID NO: 760956 - DNA, 20 bp, Artificial
  CRISPR gRNA sequence
ctctgtcaccatcacaggta

SEQ ID NO: 760957 - DNA, 20 bp, Artificial
  CRISPR gRNA sequence
tctgtcaccatcacaggtaa

SEQ ID NO: 760958 - DNA, 20 bp, Artificial
  CRISPR gRNA sequence
gtcaccatcacaggtaaggg

SEQ ID NO: 760959 - DNA, 20 bp, Artificial
  CRISPR gRNA sequence
cacaggtaagggcagatgaa

SEQ ID NO: 760960 - DNA, 20 bp, Artificial
  CRISPR gRNA sequence
ggtaagggcagatgaacagc

SEQ ID NO: 760961 - DNA, 20 bp, Artificial
  CRISPR gRNA sequence
gtaagggcagatgaacagct

SEQ ID NO: 760962 - DNA, 20 bp, Artificial
  CRISPR gRNA sequence
taagggcagatgaacagctg

SEQ ID NO: 760963 - DNA, 20 bp, Artificial
  CRISPR gRNA sequence
gggcagatgaacagctgggg

SEQ ID NO: 760964 - DNA, 20 bp, Artificial
  CRISPR gRNA sequence
ggcagatgaacagctgggga

SEQ ID NO: 760965 - DNA, 20 bp, Artificial
  CRISPR gRNA sequence
gatgaacagctggggaagga

SEQ ID NO: 760966 - DNA, 20 bp, Artificial
  CRISPR gRNA sequence
tgaacagctggggaaggacg

SEQ ID NO: 760967 - DNA, 20 bp, Artificial
  CRISPR gRNA sequence
cagctggggaaggacggagc

SEQ ID NO: 760968 - DNA, 20 bp, Artificial
  CRISPR gRNA sequence
gcgagtaactccctctttac

SEQ ID NO: 760969 - DNA, 20 bp, Artificial
  CRISPR gRNA sequence
ctctttactggaccctaacg

SEQ ID NO: 760970 - DNA, 20 bp, Artificial
  CRISPR gRNA sequence
accctaacgtggaatttcca

SEQ ID NO: 760971 - DNA, 20 bp, Artificial
  CRISPR gRNA sequence
ccctaacgtggaatttccat

SEQ ID NO: 760972 - DNA, 20 bp, Artificial
  CRISPR gRNA sequence
acgtggaatttccataggtt

SEQ ID NO: 760973 - DNA, 20 bp, Artificial
  CRISPR gRNA sequence
cgtggaatttccataggttt

SEQ ID NO: 760974 - DNA, 20 bp, Artificial
  CRISPR gRNA sequence
ggaatttccataggtttggg

SEQ ID NO: 760975 - DNA, 20 bp, Artificial
  CRISPR gRNA sequence
tttccataggtttgggtggc

SEQ ID NO: 760976 - DNA, 20 bp, Artificial
  CRISPR gRNA sequence
ccataggtttgggtggccag

SEQ ID NO: 760977 - DNA, 20 bp, Artificial
  CRISPR gRNA sequence
gactttcaaaatccctttca

SEQ ID NO: 760978 - DNA, 20 bp, Artificial
  CRISPR gRNA sequence
aaaatccctttcatagactt

SEQ ID NO: 760979 - DNA, 20 bp, Artificial
  CRISPR gRNA sequence
aaatccctttcatagacttc

SEQ ID NO: 760980 - DNA, 20 bp, Artificial
  CRISPR gRNA sequence
gtgctcacactcttccccac

SEQ ID NO: 760981 - DNA, 20 bp, Artificial
  CRISPR gRNA sequence
actcttccccacaagtcctt

SEQ ID NO: 760982 - DNA, 20 bp, Artificial
  CRISPR gRNA sequence
ctcttccccacaagtcctta

SEQ ID NO: 760983 - DNA, 20 bp, Artificial
  CRISPR gRNA sequence
tcttccccacaagtccttaa

SEQ ID NO: 760984 - DNA, 20 bp, Artificial
  CRISPR gRNA sequence
cacaagtccttaagggactc

SEQ ID NO: 760985 - DNA, 20 bp, Artificial
  CRISPR gRNA sequence
cttaagggactcgagctgat

SEQ ID NO: 760986 - DNA, 20 bp, Artificial
  CRISPR gRNA sequence
tttataatgtttgccttcct

SEQ ID NO: 760987 - DNA, 20 bp, Artificial
  CRISPR gRNA sequence
tataatgtttgccttcctaa

SEQ ID NO: 760988 - DNA, 20 bp, Artificial
  CRISPR gRNA sequence
cttcctaagagtgcttttcg

SEQ ID NO: 760989 - DNA, 20 bp, Artificial
  CRISPR gRNA sequence
tggcacttatgcttcttatg

SEQ ID NO: 760990 - DNA, 20 bp, Artificial
  CRISPR gRNA sequence
gcacttatgcttcttatgca

SEQ ID NO: 760991 - DNA, 20 bp, Artificial
  CRISPR gRNA sequence
cacttatgcttcttatgcag

SEQ ID NO: 760992 - DNA, 20 bp, Artificial
  CRISPR gRNA sequence
atgcttcttatgcagaggac

SEQ ID NO: 760993 - DNA, 20 bp, Artificial
  CRISPR gRNA sequence
tgcttcttatgcagaggaca

SEQ ID NO: 760994 - DNA, 20 bp, Artificial
  CRISPR gRNA sequence
caaggtacctgcccgaaatt

SEQ ID NO: 760995 - DNA, 20 bp, Artificial
  CRISPR gRNA sequence
aggtacctgcccgaaatttg

SEQ ID NO: 760996 - DNA, 20 bp, Artificial
  CRISPR gRNA sequence
ggtacctgcccgaaatttgg

SEQ ID NO: 760997 - DNA, 20 bp, Artificial
  CRISPR gRNA sequence
ctgcccgaaatttggaggca

SEQ ID NO: 760998 - DNA, 20 bp, Artificial
  CRISPR gRNA sequence
tgcccgaaatttggaggcat

SEQ ID NO: 760999 - DNA, 20 bp, Artificial
  CRISPR gRNA sequence
ccgaaatttggaggcatggg

SEQ ID NO: 761000 - DNA, 20 bp, Artificial
  CRISPR gRNA sequence
cgaaatttggaggcatgggc

SEQ ID NO: 761001 - DNA, 20 bp, Artificial
  CRISPR gRNA sequence
ggaggcatgggcaggaattc

SEQ ID NO: 761002 - DNA, 20 bp, Artificial
  CRISPR gRNA sequence
gaggcatgggcaggaattct

SEQ ID NO: 761003 - DNA, 20 bp, Artificial
  CRISPR gRNA sequence
aggcatgggcaggaattctg

SEQ ID NO: 761004 - DNA, 20 bp, Artificial
  CRISPR gRNA sequence
catgggcaggaattctgggg

SEQ ID NO: 761005 - DNA, 20 bp, Artificial
  CRISPR gRNA sequence
aggaattctggggcagccac

SEQ ID NO: 761006 - DNA, 20 bp, Artificial
  CRISPR gRNA sequence
ggaattctggggcagccaca

SEQ ID NO: 761007 - DNA, 20 bp, Artificial
  CRISPR gRNA sequence
tctggggcagccacaaggtg

SEQ ID NO: 761008 - DNA, 20 bp, Artificial
  CRISPR gRNA sequence
ggcagccacaaggtgtggcc

SEQ ID NO: 761009 - DNA, 20 bp, Artificial
  CRISPR gRNA sequence
gcagccacaaggtgtggccc

SEQ ID NO: 761010 - DNA, 20 bp, Artificial
  CRISPR gRNA sequence
cagccacaaggtgtggccca

SEQ ID NO: 761011 - DNA, 20 bp, Artificial
  CRISPR gRNA sequence
agccacaaggtgtggcccag

SEQ ID NO: 761012 - DNA, 20 bp, Artificial
  CRISPR gRNA sequence
aaggtgtggcccaggggact

SEQ ID NO: 761013 - DNA, 20 bp, Artificial
  CRISPR gRNA sequence
gtggcccaggggacttggtg

SEQ ID NO: 761014 - DNA, 20 bp, Artificial
  CRISPR gRNA sequence
tggcccaggggacttggtgt

SEQ ID NO: 761015 - DNA, 20 bp, Artificial
  CRISPR gRNA sequence
cttggtgtgggtgtgctttc

SEQ ID NO: 761016 - DNA, 20 bp, Artificial
  CRISPR gRNA sequence
ggtgtgggtgtgctttccag

SEQ ID NO: 761017 - DNA, 20 bp, Artificial
  CRISPR gRNA sequence
gtgtgggtgtgctttccagc

SEQ ID NO: 761018 - DNA, 20 bp, Artificial
  CRISPR gRNA sequence
tttccagcaggaactcctct

SEQ ID NO: 761019 - DNA, 20 bp, Artificial
  CRISPR gRNA sequence
ccagcaggaactcctctgag

SEQ ID NO: 761020 - DNA, 20 bp, Artificial
  CRISPR gRNA sequence
gcaggaactcctctgagtgg

SEQ ID NO: 761021 - DNA, 20 bp, Artificial
  CRISPR gRNA sequence
caggaactcctctgagtggt

SEQ ID NO: 761022 - DNA, 20 bp, Artificial
  CRISPR gRNA sequence
gaactcctctgagtggtagg

SEQ ID NO: 761023 - DNA, 20 bp, Artificial
  CRISPR gRNA sequence
aactcctctgagtggtagga

SEQ ID NO: 761024 - DNA, 20 bp, Artificial
  CRISPR gRNA sequence
tgagtggtaggaaggtattc

SEQ ID NO: 761025 - DNA, 20 bp, Artificial
  CRISPR gRNA sequence
gagtggtaggaaggtattct

SEQ ID NO: 761026 - DNA, 20 bp, Artificial
  CRISPR gRNA sequence
ggtaggaaggtattctgggt

SEQ ID NO: 761027 - DNA, 20 bp, Artificial
  CRISPR gRNA sequence
aggaaggtattctgggtcag

SEQ ID NO: 761028 - DNA, 20 bp, Artificial
  CRISPR gRNA sequence
ggaaggtattctgggtcagt

SEQ ID NO: 761029 - DNA, 20 bp, Artificial
  CRISPR gRNA sequence
gtgggcgccatctgattctg

SEQ ID NO: 761030 - DNA, 20 bp, Artificial
  CRISPR gRNA sequence
gccatctgattctgaagcct

SEQ ID NO: 761031 - DNA, 20 bp, Artificial
  CRISPR gRNA sequence
tgattctgaagcctgagtga

SEQ ID NO: 761032 - DNA, 20 bp, Artificial
  CRISPR gRNA sequence
tctgaagcctgagtgacagc

SEQ ID NO: 761033 - DNA, 20 bp, Artificial
  CRISPR gRNA sequence
gagtgacagctggccctccc

SEQ ID NO: 761034 - DNA, 20 bp, Artificial
  CRISPR gRNA sequence
gacagctggccctccctagt

SEQ ID NO: 761035 - DNA, 20 bp, Artificial
  CRISPR gRNA sequence
ctagttagtccccaacacct

SEQ ID NO: 761036 - DNA, 20 bp, Artificial
  CRISPR gRNA sequence
cccaacacctgagtcaacgt

SEQ ID NO: 761037 - DNA, 20 bp, Artificial
  CRISPR gRNA sequence
aacgtcagctcttcttcctg

SEQ ID NO: 761038 - DNA, 20 bp, Artificial
  CRISPR gRNA sequence
ctgcagacttgcgctccacc

SEQ ID NO: 761039 - DNA, 20 bp, Artificial
  CRISPR gRNA sequence
tgcagacttgcgctccaccc

SEQ ID NO: 761040 - DNA, 20 bp, Artificial
  CRISPR gRNA sequence
agacttgcgctccacccagg

SEQ ID NO: 761041 - DNA, 20 bp, Artificial
  CRISPR gRNA sequence
cgctccacccaggcagccgt

SEQ ID NO: 761042 - DNA, 20 bp, Artificial
  CRISPR gRNA sequence
ccacccaggcagccgttgga

SEQ ID NO: 761043 - DNA, 20 bp, Artificial
  CRISPR gRNA sequence
cacccaggcagccgttggat

SEQ ID NO: 761044 - DNA, 20 bp, Artificial
  CRISPR gRNA sequence
ccaggcagccgttggatggg

SEQ ID NO: 761045 - DNA, 20 bp, Artificial
  CRISPR gRNA sequence
caggcagccgttggatgggc

SEQ ID NO: 761046 - DNA, 20 bp, Artificial
  CRISPR gRNA sequence
aggcagccgttggatgggca

SEQ ID NO: 761047 - DNA, 20 bp, Artificial
  CRISPR gRNA sequence
ggcagccgttggatgggcag

SEQ ID NO: 761048 - DNA, 20 bp, Artificial
  CRISPR gRNA sequence
ctgtctctgctgcccccgtg

SEQ ID NO: 761049 - DNA, 20 bp, Artificial
  CRISPR gRNA sequence
gcccccgtgtggtcaaacac

SEQ ID NO: 761050 - DNA, 20 bp, Artificial
  CRISPR gRNA sequence
ccgtgtggtcaaacaccaga

SEQ ID NO: 761051 - DNA, 20 bp, Artificial
  CRISPR gRNA sequence
gtgtggtcaaacaccagata

SEQ ID NO: 761052 - DNA, 20 bp, Artificial
  CRISPR gRNA sequence
tgtggtcaaacaccagatag

SEQ ID NO: 761053 - DNA, 20 bp, Artificial
  CRISPR gRNA sequence
ccagatagaggccacccctt

SEQ ID NO: 761054 - DNA, 20 bp, Artificial
  CRISPR gRNA sequence
gccacccctttagtgattgt

SEQ ID NO: 761055 - DNA, 20 bp, Artificial
  CRISPR gRNA sequence
ctttagtgattgttagtctc

SEQ ID NO: 761056 - DNA, 20 bp, Artificial
  CRISPR gRNA sequence
gattgttagtctctggtttc

SEQ ID NO: 761057 - DNA, 20 bp, Artificial
  CRISPR gRNA sequence
attgttagtctctggtttcc

SEQ ID NO: 761058 - DNA, 20 bp, Artificial
  CRISPR gRNA sequence
agtctctggtttccaggttc

SEQ ID NO: 761059 - DNA, 20 bp, Artificial
  CRISPR gRNA sequence
gtttccaggttctagcctcg

SEQ ID NO: 761060 - DNA, 20 bp, Artificial
  CRISPR gRNA sequence
tttccaggttctagcctcgt

SEQ ID NO: 761061 - DNA, 20 bp, Artificial
  CRISPR gRNA sequence
cgtgggcacctcttgtgcct

SEQ ID NO: 761062 - DNA, 20 bp, Artificial
  CRISPR gRNA sequence
gtgggcacctcttgtgcctg

SEQ ID NO: 761063 - DNA, 20 bp, Artificial
  CRISPR gRNA sequence
tgggcacctcttgtgcctga

SEQ ID NO: 761064 - DNA, 20 bp, Artificial
  CRISPR gRNA sequence
ctcttgtgcctgagggtgtg

SEQ ID NO: 761065 - DNA, 20 bp, Artificial
  CRISPR gRNA sequence
cttgtgcctgagggtgtgaa

SEQ ID NO: 761066 - DNA, 20 bp, Artificial
  CRISPR gRNA sequence
ttgtgcctgagggtgtgaag

SEQ ID NO: 761067 - DNA, 20 bp, Artificial
  CRISPR gRNA sequence
tgtgcctgagggtgtgaaga

SEQ ID NO: 761068 - DNA, 20 bp, Artificial
  CRISPR gRNA sequence
ctgagggtgtgaagagggtt

SEQ ID NO: 761069 - DNA, 20 bp, Artificial
  CRISPR gRNA sequence
tgagggtgtgaagagggttg

SEQ ID NO: 761070 - DNA, 20 bp, Artificial
  CRISPR gRNA sequence
gtgtgaagagggttgaggtc

SEQ ID NO: 761071 - DNA, 20 bp, Artificial
  CRISPR gRNA sequence
gtgaagagggttgaggtcaa

SEQ ID NO: 761072 - DNA, 20 bp, Artificial
  CRISPR gRNA sequence
agggttgaggtcaagagccg

SEQ ID NO: 761073 - DNA, 20 bp, Artificial
  CRISPR gRNA sequence
ccgcagtctccatctgtgtt

SEQ ID NO: 761074 - DNA, 20 bp, Artificial
  CRISPR gRNA sequence
ctccatctgtgtttggccct

SEQ ID NO: 761075 - DNA, 20 bp, Artificial
  CRISPR gRNA sequence
ccatctgtgtttggccctga

SEQ ID NO: 761076 - DNA, 20 bp, Artificial
  CRISPR gRNA sequence
catctgtgtttggccctgag

SEQ ID NO: 761077 - DNA, 20 bp, Artificial
  CRISPR gRNA sequence
gtttggccctgagaggcctc

SEQ ID NO: 761078 - DNA, 20 bp, Artificial
  CRISPR gRNA sequence
ggccctgagaggcctctggt

SEQ ID NO: 761079 - DNA, 20 bp, Artificial
  CRISPR gRNA sequence
gcctctggtcagtcacttcc

SEQ ID NO: 761080 - DNA, 20 bp, Artificial
  CRISPR gRNA sequence
cctctggtcagtcacttcct

SEQ ID NO: 761081 - DNA, 20 bp, Artificial
  CRISPR gRNA sequence
acttcctgggccgacgtgct

SEQ ID NO: 761082 - DNA, 20 bp, Artificial
  CRISPR gRNA sequence
ctgggccgacgtgctcagtc

SEQ ID NO: 761083 - DNA, 20 bp, Artificial
  CRISPR gRNA sequence
acgtgctcagtctggctctt

SEQ ID NO: 761084 - DNA, 20 bp, Artificial
  CRISPR gRNA sequence
ggctcttcagtatctctccc

SEQ ID NO: 761085 - DNA, 20 bp, Artificial
  CRISPR gRNA sequence
gtatctctccctggccaact

SEQ ID NO: 761086 - DNA, 20 bp, Artificial
  CRISPR gRNA sequence
cctggccaactgagctttcc

SEQ ID NO: 761087 - DNA, 20 bp, Artificial
  CRISPR gRNA sequence
ctggccaactgagctttccc

SEQ ID NO: 761088 - DNA, 20 bp, Artificial
  CRISPR gRNA sequence
tggccaactgagctttccca

SEQ ID NO: 761089 - DNA, 20 bp, Artificial
  CRISPR gRNA sequence
ctttcccagggacctcgccc

SEQ ID NO: 761090 - DNA, 20 bp, Artificial
  CRISPR gRNA sequence
agggacctcgccctggtgca

SEQ ID NO: 761091 - DNA, 20 bp, Artificial
  CRISPR gRNA sequence
acctcgccctggtgcacagt

SEQ ID NO: 761092 - DNA, 20 bp, Artificial
  CRISPR gRNA sequence
cctcgccctggtgcacagtg

SEQ ID NO: 761093 - DNA, 20 bp, Artificial
  CRISPR gRNA sequence
gccctggtgcacagtgaggt

SEQ ID NO: 761094 - DNA, 20 bp, Artificial
  CRISPR gRNA sequence
ccctggtgcacagtgaggtc

SEQ ID NO: 761095 - DNA, 20 bp, Artificial
  CRISPR gRNA sequence
ggtgcacagtgaggtcagga

SEQ ID NO: 761096 - DNA, 20 bp, Artificial
  CRISPR gRNA sequence
gcacagtgaggtcaggacag

SEQ ID NO: 761097 - DNA, 20 bp, Artificial
  CRISPR gRNA sequence
cacagtgaggtcaggacagc

SEQ ID NO: 761098 - DNA, 20 bp, Artificial
  CRISPR gRNA sequence
gacagcaggttttgtctgtc

SEQ ID NO: 761099 - DNA, 20 bp, Artificial
  CRISPR gRNA sequence
gatgacttccatctgcccct

SEQ ID NO: 761100 - DNA, 20 bp, Artificial
  CRISPR gRNA sequence
atctgcccctcagcccatcc

SEQ ID NO: 761101 - DNA, 20 bp, Artificial
  CRISPR gRNA sequence
ccaagttctgatctcacccc

SEQ ID NO: 761102 - DNA, 20 bp, Artificial
  CRISPR gRNA sequence
ctgatctcaccccaagtttc

SEQ ID NO: 761103 - DNA, 20 bp, Artificial
  CRISPR gRNA sequence
tgatctcaccccaagtttcc

SEQ ID NO: 761104 - DNA, 20 bp, Artificial
  CRISPR gRNA sequence
ttccaggtctgcatgcacct

SEQ ID NO: 761105 - DNA, 20 bp, Artificial
  CRISPR gRNA sequence
tccaggtctgcatgcacctc

SEQ ID NO: 761106 - DNA, 20 bp, Artificial
  CRISPR gRNA sequence
attcctgtcctctccctctt

SEQ ID NO: 761107 - DNA, 20 bp, Artificial
  CRISPR gRNA sequence
tctccctcttgagacctatg

SEQ ID NO: 761108 - DNA, 20 bp, Artificial
  CRISPR gRNA sequence
atgtggtccccacttctgac

SEQ ID NO: 761109 - DNA, 20 bp, Artificial
  CRISPR gRNA sequence
gtccccacttctgacaagct

SEQ ID NO: 761110 - DNA, 20 bp, Artificial
  CRISPR gRNA sequence
ccccacttctgacaagctcg

SEQ ID NO: 761111 - DNA, 20 bp, Artificial
  CRISPR gRNA sequence
acttctgacaagctcggagc

SEQ ID NO: 761112 - DNA, 20 bp, Artificial
  CRISPR gRNA sequence
cttctgacaagctcggagcc

SEQ ID NO: 761113 - DNA, 20 bp, Artificial
  CRISPR gRNA sequence
ttctgacaagctcggagcca

SEQ ID NO: 761114 - DNA, 20 bp, Artificial
  CRISPR gRNA sequence
ggcccgtcacatcgtctgct

SEQ ID NO: 761115 - DNA, 20 bp, Artificial
  CRISPR gRNA sequence
cccgtcacatcgtctgcttg

SEQ ID NO: 761116 - DNA, 20 bp, Artificial
  CRISPR gRNA sequence
cacatcgtctgcttggagtt

SEQ ID NO: 761117 - DNA, 20 bp, Artificial
  CRISPR gRNA sequence
acatcgtctgcttggagttc

SEQ ID NO: 761118 - DNA, 20 bp, Artificial
  CRISPR gRNA sequence
ctctcttacgtgtttccttc

SEQ ID NO: 761119 - DNA, 20 bp, Artificial
  CRISPR gRNA sequence
cttacgtgtttccttctggc

SEQ ID NO: 761120 - DNA, 20 bp, Artificial
  CRISPR gRNA sequence
ttacgtgtttccttctggca

SEQ ID NO: 761121 - DNA, 20 bp, Artificial
  CRISPR gRNA sequence
cttctgcccaccccttcccc

SEQ ID NO: 761122 - DNA, 20 bp, Artificial
  CRISPR gRNA sequence
tgcccaccccttccccaaga

SEQ ID NO: 761123 - DNA, 20 bp, Artificial
  CRISPR gRNA sequence
cactcccttcctgtgctctc

SEQ ID NO: 761124 - DNA, 20 bp, Artificial
  CRISPR gRNA sequence
actcccttcctgtgctctcc

SEQ ID NO: 761125 - DNA, 20 bp, Artificial
  CRISPR gRNA sequence
tcccttcctgtgctctccag

SEQ ID NO: 761126 - DNA, 20 bp, Artificial
  CRISPR gRNA sequence
ccttcctgtgctctccagga

SEQ ID NO: 761127 - DNA, 20 bp, Artificial
  CRISPR gRNA sequence
ttcctgtgctctccaggaga

SEQ ID NO: 761128 - DNA, 20 bp, Artificial
  CRISPR gRNA sequence
ctgtgctctccaggagagag

SEQ ID NO: 761129 - DNA, 20 bp, Artificial
  CRISPR gRNA sequence
caggagagagtagctgccct

SEQ ID NO: 761130 - DNA, 20 bp, Artificial
  CRISPR gRNA sequence
cctgagctcttgaatgttct

SEQ ID NO: 761131 - DNA, 20 bp, Artificial
  CRISPR gRNA sequence
gagacatgtccttgaccttt

SEQ ID NO: 761132 - DNA, 20 bp, Artificial
  CRISPR gRNA sequence
gacatgtccttgacctttta

SEQ ID NO: 761133 - DNA, 20 bp, Artificial
  CRISPR gRNA sequence
gtccttgaccttttagagaa

SEQ ID NO: 761134 - DNA, 20 bp, Artificial
  CRISPR gRNA sequence
accttttagagaacagcata

SEQ ID NO: 761135 - DNA, 20 bp, Artificial
  CRISPR gRNA sequence
ttagagaacagcatatggtt

SEQ ID NO: 761136 - DNA, 20 bp, Artificial
  CRISPR gRNA sequence
gagaacagcatatggtttgg

SEQ ID NO: 761137 - DNA, 20 bp, Artificial
  CRISPR gRNA sequence
ggtggtgaaaatgctgttca

SEQ ID NO: 761138 - DNA, 20 bp, Artificial
  CRISPR gRNA sequence
gtggtgaaaatgctgttcac

SEQ ID NO: 761139 - DNA, 20 bp, Artificial
  CRISPR gRNA sequence
aaatgctgttcacaggcgaa

SEQ ID NO: 761140 - DNA, 20 bp, Artificial
  CRISPR gRNA sequence
tgctgttcacaggcgaaaag

SEQ ID NO: 761141 - DNA, 20 bp, Artificial
  CRISPR gRNA sequence
tcacaggcgaaaagaagaaa

SEQ ID NO: 761142 - DNA, 20 bp, Artificial
  CRISPR gRNA sequence
caggcgaaaagaagaaatag

SEQ ID NO: 761143 - DNA, 20 bp, Artificial
  CRISPR gRNA sequence
cgaaaagaagaaatagaaga

SEQ ID NO: 761144 - DNA, 20 bp, Artificial
  CRISPR gRNA sequence
aaaagaagaaatagaagata

SEQ ID NO: 761145 - DNA, 20 bp, Artificial
  CRISPR gRNA sequence
aatagaagatagagtgatct

SEQ ID NO: 761146 - DNA, 20 bp, Artificial
  CRISPR gRNA sequence
agaagatagagtgatcttgg

SEQ ID NO: 761147 - DNA, 20 bp, Artificial
  CRISPR gRNA sequence
aagatagagtgatcttggca

SEQ ID NO: 761148 - DNA, 20 bp, Artificial
  CRISPR gRNA sequence
agatagagtgatcttggcag

SEQ ID NO: 761149 - DNA, 20 bp, Artificial
  CRISPR gRNA sequence
tgatcttggcagaggatatg

SEQ ID NO: 761150 - DNA, 20 bp, Artificial
  CRISPR gRNA sequence
ggcagaggatatgaagcttt

SEQ ID NO: 761151 - DNA, 20 bp, Artificial
  CRISPR gRNA sequence
cagaggatatgaagctttca

SEQ ID NO: 761152 - DNA, 20 bp, Artificial
  CRISPR gRNA sequence
agaggatatgaagctttcag

SEQ ID NO: 761153 - DNA, 20 bp, Artificial
  CRISPR gRNA sequence
aggatatgaagctttcagag

SEQ ID NO: 761154 - DNA, 20 bp, Artificial
  CRISPR gRNA sequence
ggatatgaagctttcagagg

SEQ ID NO: 761155 - DNA, 20 bp, Artificial
  CRISPR gRNA sequence
gatatgaagctttcagagga

SEQ ID NO: 761156 - DNA, 20 bp, Artificial
  CRISPR gRNA sequence
tatgaagctttcagaggagg

SEQ ID NO: 761157 - DNA, 20 bp, Artificial
  CRISPR gRNA sequence
atgaagctttcagaggaggg

SEQ ID NO: 761158 - DNA, 20 bp, Artificial
  CRISPR gRNA sequence
tgaagctttcagaggaggga

SEQ ID NO: 761159 - DNA, 20 bp, Artificial
  CRISPR gRNA sequence
agctttcagaggagggaggg

SEQ ID NO: 761160 - DNA, 20 bp, Artificial
  CRISPR gRNA sequence
tttcagaggagggagggtgg

SEQ ID NO: 761161 - DNA, 20 bp, Artificial
  CRISPR gRNA sequence
agaggagggagggtggtagt

SEQ ID NO: 761162 - DNA, 20 bp, Artificial
  CRISPR gRNA sequence
gaggagggagggtggtagtg

SEQ ID NO: 761163 - DNA, 20 bp, Artificial
  CRISPR gRNA sequence
ggtggtagtgaggacacctc

SEQ ID NO: 761164 - DNA, 20 bp, Artificial
  CRISPR gRNA sequence
gtggtagtgaggacacctcc

SEQ ID NO: 761165 - DNA, 20 bp, Artificial
  CRISPR gRNA sequence
tggtagtgaggacacctcca

SEQ ID NO: 761166 - DNA, 20 bp, Artificial
  CRISPR gRNA sequence
ggtagtgaggacacctccag

SEQ ID NO: 761167 - DNA, 20 bp, Artificial
  CRISPR gRNA sequence
aggacacctccaggggcaaa

SEQ ID NO: 761168 - DNA, 20 bp, Artificial
  CRISPR gRNA sequence
ggacacctccaggggcaaat

SEQ ID NO: 761169 - DNA, 20 bp, Artificial
  CRISPR gRNA sequence
acacctccaggggcaaatgg

SEQ ID NO: 761170 - DNA, 20 bp, Artificial
  CRISPR gRNA sequence
tccaggggcaaatgggagct

SEQ ID NO: 761171 - DNA, 20 bp, Artificial
  CRISPR gRNA sequence
aggggcaaatgggagctgag

SEQ ID NO: 761172 - DNA, 20 bp, Artificial
  CRISPR gRNA sequence
ggggcaaatgggagctgaga

SEQ ID NO: 761173 - DNA, 20 bp, Artificial
  CRISPR gRNA sequence
tgggagctgagaaggccttg

SEQ ID NO: 761174 - DNA, 20 bp, Artificial
  CRISPR gRNA sequence
gggagctgagaaggccttga

SEQ ID NO: 761175 - DNA, 20 bp, Artificial
  CRISPR gRNA sequence
ctgagaaggccttgaaggat

SEQ ID NO: 761176 - DNA, 20 bp, Artificial
  CRISPR gRNA sequence
tgagaaggccttgaaggata

SEQ ID NO: 761177 - DNA, 20 bp, Artificial
  CRISPR gRNA sequence
gagaaggccttgaaggataa

SEQ ID NO: 761178 - DNA, 20 bp, Artificial
  CRISPR gRNA sequence
agaaggccttgaaggataag

SEQ ID NO: 761179 - DNA, 20 bp, Artificial
  CRISPR gRNA sequence
tgaaggataaggggtctttg

SEQ ID NO: 761180 - DNA, 20 bp, Artificial
  CRISPR gRNA sequence
ctttgtggtcatttgcaccc

SEQ ID NO: 761181 - DNA, 20 bp, Artificial
  CRISPR gRNA sequence
tttgtggtcatttgcaccct

SEQ ID NO: 761182 - DNA, 20 bp, Artificial
  CRISPR gRNA sequence
ggtcatttgcaccctgggct

SEQ ID NO: 761183 - DNA, 20 bp, Artificial
  CRISPR gRNA sequence
atttgcaccctgggctgagc

SEQ ID NO: 761184 - DNA, 20 bp, Artificial
  CRISPR gRNA sequence
tggatatttgcgatgctgtg

SEQ ID NO: 761185 - DNA, 20 bp, Artificial
  CRISPR gRNA sequence
tatttgcgatgctgtgcaga

SEQ ID NO: 761186 - DNA, 20 bp, Artificial
  CRISPR gRNA sequence
atttgcgatgctgtgcagaa

SEQ ID NO: 761187 - DNA, 20 bp, Artificial
  CRISPR gRNA sequence
gctgtgcagaaaggacttat

SEQ ID NO: 761188 - DNA, 20 bp, Artificial
  CRISPR gRNA sequence
tgagtataaatgtgattgca

SEQ ID NO: 761189 - DNA, 20 bp, Artificial
  CRISPR gRNA sequence
agtataaatgtgattgcaaa

SEQ ID NO: 761190 - DNA, 20 bp, Artificial
  CRISPR gRNA sequence
agagaatgtttatctcacct

SEQ ID NO: 761191 - DNA, 20 bp, Artificial
  CRISPR gRNA sequence
agaatgtttatctcacctaa

SEQ ID NO: 761192 - DNA, 20 bp, Artificial
  CRISPR gRNA sequence
aaattctctattttaaactt

SEQ ID NO: 761193 - DNA, 20 bp, Artificial
  CRISPR gRNA sequence
ttctctattttaaacttgag

SEQ ID NO: 761194 - DNA, 20 bp, Artificial
  CRISPR gRNA sequence
acttgagtagctaacattta

SEQ ID NO: 761195 - DNA, 20 bp, Artificial
  CRISPR gRNA sequence
aaagtgatttcaaaaaaatt

SEQ ID NO: 761196 - DNA, 20 bp, Artificial
  CRISPR gRNA sequence
aagtgatttcaaaaaaattt

SEQ ID NO: 761197 - DNA, 20 bp, Artificial
  CRISPR gRNA sequence
agtgatttcaaaaaaattta

SEQ ID NO: 761198 - DNA, 20 bp, Artificial
  CRISPR gRNA sequence
atttcaaaaaaatttagggc

SEQ ID NO: 761199 - DNA, 20 bp, Artificial
  CRISPR gRNA sequence
tttcaaaaaaatttagggct

SEQ ID NO: 761200 - DNA, 20 bp, Artificial
  CRISPR gRNA sequence
aaaaaatttagggctgggca

SEQ ID NO: 761201 - DNA, 20 bp, Artificial
  CRISPR gRNA sequence
aaatttagggctgggcatgg

SEQ ID NO: 761202 - DNA, 20 bp, Artificial
  CRISPR gRNA sequence
gtggctcacacctgtaatcc

SEQ ID NO: 761203 - DNA, 20 bp, Artificial
  CRISPR gRNA sequence
cacctgtaatcccagcactt

SEQ ID NO: 761204 - DNA, 20 bp, Artificial
  CRISPR gRNA sequence
acctgtaatcccagcacttt

SEQ ID NO: 761205 - DNA, 20 bp, Artificial
  CRISPR gRNA sequence
ctgtaatcccagcactttgg

SEQ ID NO: 761206 - DNA, 20 bp, Artificial
  CRISPR gRNA sequence
tgtaatcccagcactttggg

SEQ ID NO: 761207 - DNA, 20 bp, Artificial
  CRISPR gRNA sequence
tcccagcactttgggaggcc

SEQ ID NO: 761208 - DNA, 20 bp, Artificial
  CRISPR gRNA sequence
cccagcactttgggaggcca

SEQ ID NO: 761209 - DNA, 20 bp, Artificial
  CRISPR gRNA sequence
agcactttgggaggccaagg

SEQ ID NO: 761210 - DNA, 20 bp, Artificial
  CRISPR gRNA sequence
gcactttgggaggccaaggc

SEQ ID NO: 761211 - DNA, 20 bp, Artificial
  CRISPR gRNA sequence
ctttgggaggccaaggcggg

SEQ ID NO: 761212 - DNA, 20 bp, Artificial
  CRISPR gRNA sequence
ccaaggcgggtggatcactt

SEQ ID NO: 761213 - DNA, 20 bp, Artificial
  CRISPR gRNA sequence
caaggcgggtggatcacttg

SEQ ID NO: 761214 - DNA, 20 bp, Artificial
  CRISPR gRNA sequence
gcgggtggatcacttgaggt

SEQ ID NO: 761215 - DNA, 20 bp, Artificial
  CRISPR gRNA sequence
cgggtggatcacttgaggtc

SEQ ID NO: 761216 - DNA, 20 bp, Artificial
  CRISPR gRNA sequence
ggtggatcacttgaggtcag

SEQ ID NO: 761217 - DNA, 20 bp, Artificial
  CRISPR gRNA sequence
tcacttgaggtcaggagttc

SEQ ID NO: 761218 - DNA, 20 bp, Artificial
  CRISPR gRNA sequence
tgaggtcaggagttcgagac

SEQ ID NO: 761219 - DNA, 20 bp, Artificial
  CRISPR gRNA sequence
gagttcgagaccagcctgat

SEQ ID NO: 761220 - DNA, 20 bp, Artificial
  CRISPR gRNA sequence
cgagaccagcctgatcagca

SEQ ID NO: 761221 - DNA, 20 bp, Artificial
  CRISPR gRNA sequence
tctactgaaaacacaaaaat

SEQ ID NO: 761222 - DNA, 20 bp, Artificial
  CRISPR gRNA sequence
ctgaaaacacaaaaattagc

SEQ ID NO: 761223 - DNA, 20 bp, Artificial
  CRISPR gRNA sequence
tgaaaacacaaaaattagct

SEQ ID NO: 761224 - DNA, 20 bp, Artificial
  CRISPR gRNA sequence
acacaaaaattagctgggcg

SEQ ID NO: 761225 - DNA, 20 bp, Artificial
  CRISPR gRNA sequence
caaaaattagctgggcgtgg

SEQ ID NO: 761226 - DNA, 20 bp, Artificial
  CRISPR gRNA sequence
ggcgtggtggcatgcacctg

SEQ ID NO: 761227 - DNA, 20 bp, Artificial
  CRISPR gRNA sequence
gtggcatgcacctgtggtcc

SEQ ID NO: 761228 - DNA, 20 bp, Artificial
  CRISPR gRNA sequence
cacctgtggtcccagctact

SEQ ID NO: 761229 - DNA, 20 bp, Artificial
  CRISPR gRNA sequence
acctgtggtcccagctactt

SEQ ID NO: 761230 - DNA, 20 bp, Artificial
  CRISPR gRNA sequence
ctgtggtcccagctacttgg

SEQ ID NO: 761231 - DNA, 20 bp, Artificial
  CRISPR gRNA sequence
tgtggtcccagctacttggg

SEQ ID NO: 761232 - DNA, 20 bp, Artificial
  CRISPR gRNA sequence
gtcccagctacttgggaggc

SEQ ID NO: 761233 - DNA, 20 bp, Artificial
  CRISPR gRNA sequence
tcccagctacttgggaggct

SEQ ID NO: 761234 - DNA, 20 bp, Artificial
  CRISPR gRNA sequence
cccagctacttgggaggctg

SEQ ID NO: 761235 - DNA, 20 bp, Artificial
  CRISPR gRNA sequence
gctacttgggaggctggggc

SEQ ID NO: 761236 - DNA, 20 bp, Artificial
  CRISPR gRNA sequence
tacttgggaggctggggcaa

SEQ ID NO: 761237 - DNA, 20 bp, Artificial
  CRISPR gRNA sequence
gcaagagaattgcttgaacc

SEQ ID NO: 761238 - DNA, 20 bp, Artificial
  CRISPR gRNA sequence
caagagaattgcttgaacct

SEQ ID NO: 761239 - DNA, 20 bp, Artificial
  CRISPR gRNA sequence
agagaattgcttgaacctgg

SEQ ID NO: 761240 - DNA, 20 bp, Artificial
  CRISPR gRNA sequence
gagaattgcttgaacctggg

SEQ ID NO: 761241 - DNA, 20 bp, Artificial
  CRISPR gRNA sequence
aattgcttgaacctgggagg

SEQ ID NO: 761242 - DNA, 20 bp, Artificial
  CRISPR gRNA sequence
ttgcttgaacctgggaggcg

SEQ ID NO: 761243 - DNA, 20 bp, Artificial
  CRISPR gRNA sequence
tgcttgaacctgggaggcgg

SEQ ID NO: 761244 - DNA, 20 bp, Artificial
  CRISPR gRNA sequence
aacctgggaggcggaggttg

SEQ ID NO: 761245 - DNA, 20 bp, Artificial
  CRISPR gRNA sequence
tgggaggcggaggttgcagt

SEQ ID NO: 761246 - DNA, 20 bp, Artificial
  CRISPR gRNA sequence
ggcggaggttgcagtgagcc

SEQ ID NO: 761247 - DNA, 20 bp, Artificial
  CRISPR gRNA sequence
gaggttgcagtgagccgaga

SEQ ID NO: 761248 - DNA, 20 bp, Artificial
  CRISPR gRNA sequence
gagacagtgtcactgcactc

SEQ ID NO: 761249 - DNA, 20 bp, Artificial
  CRISPR gRNA sequence
agtgtcactgcactccagcc

SEQ ID NO: 761250 - DNA, 20 bp, Artificial
  CRISPR gRNA sequence
gtgtcactgcactccagcct

SEQ ID NO: 761251 - DNA, 20 bp, Artificial
  CRISPR gRNA sequence
ctgcactccagcctgggtga

SEQ ID NO: 761252 - DNA, 20 bp, Artificial
  CRISPR gRNA sequence
gcactccagcctgggtgaca

SEQ ID NO: 761253 - DNA, 20 bp, Artificial
  CRISPR gRNA sequence
tccagcctgggtgacagagc

SEQ ID NO: 761254 - DNA, 20 bp, Artificial
  CRISPR gRNA sequence
aaataaataaaataaaaata

SEQ ID NO: 761255 - DNA, 20 bp, Artificial
  CRISPR gRNA sequence
aaaaataaagtgatttcatt

SEQ ID NO: 761256 - DNA, 20 bp, Artificial
  CRISPR gRNA sequence
aaaataaagtgatttcattg

SEQ ID NO: 761257 - DNA, 20 bp, Artificial
  CRISPR gRNA sequence
tcattgaggccattgttgcc

SEQ ID NO: 761258 - DNA, 20 bp, Artificial
  CRISPR gRNA sequence
ttgttgccaagcacatttca

SEQ ID NO: 761259 - DNA, 20 bp, Artificial
  CRISPR gRNA sequence
ccaagcacatttcacagacg

SEQ ID NO: 761260 - DNA, 20 bp, Artificial
  CRISPR gRNA sequence
atttcacagacgaagaaact

SEQ ID NO: 761261 - DNA, 20 bp, Artificial
  CRISPR gRNA sequence
tttcacagacgaagaaactg

SEQ ID NO: 761262 - DNA, 20 bp, Artificial
  CRISPR gRNA sequence
gacgaagaaactgaggtcca

SEQ ID NO: 761263 - DNA, 20 bp, Artificial
  CRISPR gRNA sequence
cgaagaaactgaggtccaca

SEQ ID NO: 761264 - DNA, 20 bp, Artificial
  CRISPR gRNA sequence
agaaactgaggtccacagag

SEQ ID NO: 761265 - DNA, 20 bp, Artificial
  CRISPR gRNA sequence
gaaactgaggtccacagaga

SEQ ID NO: 761266 - DNA, 20 bp, Artificial
  CRISPR gRNA sequence
aaactgaggtccacagagaa

SEQ ID NO: 761267 - DNA, 20 bp, Artificial
  CRISPR gRNA sequence
aactgaggtccacagagaag

SEQ ID NO: 761268 - DNA, 20 bp, Artificial
  CRISPR gRNA sequence
actgaggtccacagagaagg

SEQ ID NO: 761269 - DNA, 20 bp, Artificial
  CRISPR gRNA sequence
agagaagggggaactttccc

SEQ ID NO: 761270 - DNA, 20 bp, Artificial
  CRISPR gRNA sequence
gagaagggggaactttccca

SEQ ID NO: 761271 - DNA, 20 bp, Artificial
  CRISPR gRNA sequence
ggggaactttcccaaggtca

SEQ ID NO: 761272 - DNA, 20 bp, Artificial
  CRISPR gRNA sequence
actttcccaaggtcacagac

SEQ ID NO: 761273 - DNA, 20 bp, Artificial
  CRISPR gRNA sequence
cccaaggtcacagactggca

SEQ ID NO: 761274 - DNA, 20 bp, Artificial
  CRISPR gRNA sequence
aaggtcacagactggcacag

SEQ ID NO: 761275 - DNA, 20 bp, Artificial
  CRISPR gRNA sequence
gcacagcggctctcaatctt

SEQ ID NO: 761276 - DNA, 20 bp, Artificial
  CRISPR gRNA sequence
cacagcggctctcaatcttt

SEQ ID NO: 761277 - DNA, 20 bp, Artificial
  CRISPR gRNA sequence
acagcggctctcaatctttg

SEQ ID NO: 761278 - DNA, 20 bp, Artificial
  CRISPR gRNA sequence
cagcggctctcaatctttgg

SEQ ID NO: 761279 - DNA, 20 bp, Artificial
  CRISPR gRNA sequence
ggctctcaatctttgggggt

SEQ ID NO: 761280 - DNA, 20 bp, Artificial
  CRISPR gRNA sequence
tcagacccttctttgaaaat

SEQ ID NO: 761281 - DNA, 20 bp, Artificial
  CRISPR gRNA sequence
aattggataaatgatcaatg

SEQ ID NO: 761282 - DNA, 20 bp, Artificial
  CRISPR gRNA sequence
tggataaatgatcaatgcag

SEQ ID NO: 761283 - DNA, 20 bp, Artificial
  CRISPR gRNA sequence
cagcagtttgcacataactc

SEQ ID NO: 761284 - DNA, 20 bp, Artificial
  CRISPR gRNA sequence
gcagtttgcacataactctg

SEQ ID NO: 761285 - DNA, 20 bp, Artificial
  CRISPR gRNA sequence
cagtttgcacataactctgg

SEQ ID NO: 761286 - DNA, 20 bp, Artificial
  CRISPR gRNA sequence
agtttgcacataactctgga

SEQ ID NO: 761287 - DNA, 20 bp, Artificial
  CRISPR gRNA sequence
tgcctctctaaactcctccg

SEQ ID NO: 761288 - DNA, 20 bp, Artificial
  CRISPR gRNA sequence
gcctctctaaactcctccgt

SEQ ID NO: 761289 - DNA, 20 bp, Artificial
  CRISPR gRNA sequence
taaactcctccgtgggtctg

SEQ ID NO: 761290 - DNA, 20 bp, Artificial
  CRISPR gRNA sequence
cctccgtgggtctgtagacc

SEQ ID NO: 761291 - DNA, 20 bp, Artificial
  CRISPR gRNA sequence
ctccgtgggtctgtagacct

SEQ ID NO: 761292 - DNA, 20 bp, Artificial
  CRISPR gRNA sequence
gggtctgtagacctgggctc

SEQ ID NO: 761293 - DNA, 20 bp, Artificial
  CRISPR gRNA sequence
acctgggctccagtgccctg

SEQ ID NO: 761294 - DNA, 20 bp, Artificial
  CRISPR gRNA sequence
gggctccagtgccctgcagt

SEQ ID NO: 761295 - DNA, 20 bp, Artificial
  CRISPR gRNA sequence
ggctccagtgccctgcagtg

SEQ ID NO: 761296 - DNA, 20 bp, Artificial
  CRISPR gRNA sequence
ctccagtgccctgcagtgag

SEQ ID NO: 761297 - DNA, 20 bp, Artificial
  CRISPR gRNA sequence
gtgccctgcagtgaggagat

SEQ ID NO: 761298 - DNA, 20 bp, Artificial
  CRISPR gRNA sequence
gtgaggagatgagccatgat

SEQ ID NO: 761299 - DNA, 20 bp, Artificial
  CRISPR gRNA sequence
ccatgatcagaatccaactt

SEQ ID NO: 761300 - DNA, 20 bp, Artificial
  CRISPR gRNA sequence
agaatccaactttggcctct

SEQ ID NO: 761301 - DNA, 20 bp, Artificial
  CRISPR gRNA sequence
taatttcctctccttcccac

SEQ ID NO: 761302 - DNA, 20 bp, Artificial
  CRISPR gRNA sequence
ttcctctccttcccaccagc

SEQ ID NO: 761303 - DNA, 20 bp, Artificial
  CRISPR gRNA sequence
agccagcctcctgtttctgt

SEQ ID NO: 761304 - DNA, 20 bp, Artificial
  CRISPR gRNA sequence
ccagcctcctgtttctgtta

SEQ ID NO: 761305 - DNA, 20 bp, Artificial
  CRISPR gRNA sequence
gcctcctgtttctgttagag

SEQ ID NO: 761306 - DNA, 20 bp, Artificial
  CRISPR gRNA sequence
cctcctgtttctgttagagc

SEQ ID NO: 761307 - DNA, 20 bp, Artificial
  CRISPR gRNA sequence
tgtttctgttagagcaggtc

SEQ ID NO: 761308 - DNA, 20 bp, Artificial
  CRISPR gRNA sequence
agagcaggtctggcctactt

SEQ ID NO: 761309 - DNA, 20 bp, Artificial
  CRISPR gRNA sequence
agcaggtctggcctactttg

SEQ ID NO: 761310 - DNA, 20 bp, Artificial
  CRISPR gRNA sequence
ctggcctactttggagccct

SEQ ID NO: 761311 - DNA, 20 bp, Artificial
  CRISPR gRNA sequence
ccttggcctgtattttgctt

SEQ ID NO: 761312 - DNA, 20 bp, Artificial
  CRISPR gRNA sequence
cttggcctgtattttgcttc

SEQ ID NO: 761313 - DNA, 20 bp, Artificial
  CRISPR gRNA sequence
ggcctgtattttgcttcggg

SEQ ID NO: 761314 - DNA, 20 bp, Artificial
  CRISPR gRNA sequence
ttgtatcatgtcaaacattc

SEQ ID NO: 761315 - DNA, 20 bp, Artificial
  CRISPR gRNA sequence
tgtatcatgtcaaacattct

SEQ ID NO: 761316 - DNA, 20 bp, Artificial
  CRISPR gRNA sequence
atgtcaaacattctgggatt

SEQ ID NO: 761317 - DNA, 20 bp, Artificial
  CRISPR gRNA sequence
cattctgggattcagacttt

SEQ ID NO: 761318 - DNA, 20 bp, Artificial
  CRISPR gRNA sequence
gattcagactttcagtcctc

SEQ ID NO: 761319 - DNA, 20 bp, Artificial
  CRISPR gRNA sequence
cagactttcagtcctccagc

SEQ ID NO: 761320 - DNA, 20 bp, Artificial
  CRISPR gRNA sequence
ggtctctcccgtacctgatg

SEQ ID NO: 761321 - DNA, 20 bp, Artificial
  CRISPR gRNA sequence
tctcccgtacctgatgaagt

SEQ ID NO: 761322 - DNA, 20 bp, Artificial
  CRISPR gRNA sequence
cgtacctgatgaagttagtg

SEQ ID NO: 761323 - DNA, 20 bp, Artificial
  CRISPR gRNA sequence
tagtgaagttgtgtgctgtg

SEQ ID NO: 761324 - DNA, 20 bp, Artificial
  CRISPR gRNA sequence
gtgaagttgtgtgctgtgca

SEQ ID NO: 761325 - DNA, 20 bp, Artificial
  CRISPR gRNA sequence
gtgtgctgtgcagagcctct

SEQ ID NO: 761326 - DNA, 20 bp, Artificial
  CRISPR gRNA sequence
gtgctgtgcagagcctcttg

SEQ ID NO: 761327 - DNA, 20 bp, Artificial
  CRISPR gRNA sequence
tgctgtgcagagcctcttgg

SEQ ID NO: 761328 - DNA, 20 bp, Artificial
  CRISPR gRNA sequence
gctgtgcagagcctcttgga

SEQ ID NO: 761329 - DNA, 20 bp, Artificial
  CRISPR gRNA sequence
ctgtgcagagcctcttggag

SEQ ID NO: 761330 - DNA, 20 bp, Artificial
  CRISPR gRNA sequence
tgtgcagagcctcttggagg

SEQ ID NO: 761331 - DNA, 20 bp, Artificial
  CRISPR gRNA sequence
gcctcttggagggggattta

SEQ ID NO: 761332 - DNA, 20 bp, Artificial
  CRISPR gRNA sequence
ctcttggagggggatttatg

SEQ ID NO: 761333 - DNA, 20 bp, Artificial
  CRISPR gRNA sequence
tggagggggatttatggagc

SEQ ID NO: 761334 - DNA, 20 bp, Artificial
  CRISPR gRNA sequence
gggatttatggagcaagccc

SEQ ID NO: 761335 - DNA, 20 bp, Artificial
  CRISPR gRNA sequence
gatttatggagcaagcccta

SEQ ID NO: 761336 - DNA, 20 bp, Artificial
  CRISPR gRNA sequence
tggagcaagccctagagacg

SEQ ID NO: 761337 - DNA, 20 bp, Artificial
  CRISPR gRNA sequence
aagccctagagacgtggcct

SEQ ID NO: 761338 - DNA, 20 bp, Artificial
  CRISPR gRNA sequence
ggcctgagcctgtcctttct

SEQ ID NO: 761339 - DNA, 20 bp, Artificial
  CRISPR gRNA sequence
gcctgagcctgtcctttctt

SEQ ID NO: 761340 - DNA, 20 bp, Artificial
  CRISPR gRNA sequence
cctgtcctttcttgggtgaa

SEQ ID NO: 761341 - DNA, 20 bp, Artificial
  CRISPR gRNA sequence
ctgtcctttcttgggtgaac

SEQ ID NO: 761342 - DNA, 20 bp, Artificial
  CRISPR gRNA sequence
tgtcctttcttgggtgaaca

SEQ ID NO: 761343 - DNA, 20 bp, Artificial
  CRISPR gRNA sequence
ggcaaatgtaatttgtgttc

SEQ ID NO: 761344 - DNA, 20 bp, Artificial
  CRISPR gRNA sequence
gcaaatgtaatttgtgttcc

SEQ ID NO: 761345 - DNA, 20 bp, Artificial
  CRISPR gRNA sequence
caaatgtaatttgtgttcca

SEQ ID NO: 761346 - DNA, 20 bp, Artificial
  CRISPR gRNA sequence
ttgtgttccagggacaccac

SEQ ID NO: 761347 - DNA, 20 bp, Artificial
  CRISPR gRNA sequence
ttccagggacaccaccagtt

SEQ ID NO: 761348 - DNA, 20 bp, Artificial
  CRISPR gRNA sequence
tccagggacaccaccagtta

SEQ ID NO: 761349 - DNA, 20 bp, Artificial
  CRISPR gRNA sequence
ccagggacaccaccagttaa

SEQ ID NO: 761350 - DNA, 20 bp, Artificial
  CRISPR gRNA sequence
cagggacaccaccagttaag

SEQ ID NO: 761351 - DNA, 20 bp, Artificial
  CRISPR gRNA sequence
agggacaccaccagttaagg

SEQ ID NO: 761352 - DNA, 20 bp, Artificial
  CRISPR gRNA sequence
ccaccagttaagggggaaca

SEQ ID NO: 761353 - DNA, 20 bp, Artificial
  CRISPR gRNA sequence
accagttaagggggaacata

SEQ ID NO: 761354 - DNA, 20 bp, Artificial
  CRISPR gRNA sequence
aacatagagaccctctgctt

SEQ ID NO: 761355 - DNA, 20 bp, Artificial
  CRISPR gRNA sequence
cctctgcttgagtatttcca

SEQ ID NO: 761356 - DNA, 20 bp, Artificial
  CRISPR gRNA sequence
tctgccccctcctctgctgt

SEQ ID NO: 761357 - DNA, 20 bp, Artificial
  CRISPR gRNA sequence
tgccccctcctctgctgtca

SEQ ID NO: 761358 - DNA, 20 bp, Artificial
  CRISPR gRNA sequence
ctgctgtcagagccccatga

SEQ ID NO: 761359 - DNA, 20 bp, Artificial
  CRISPR gRNA sequence
tgctgtcagagccccatgat

SEQ ID NO: 761360 - DNA, 20 bp, Artificial
  CRISPR gRNA sequence
gagccccatgatgggatttc

SEQ ID NO: 761361 - DNA, 20 bp, Artificial
  CRISPR gRNA sequence
agccccatgatgggatttcc

SEQ ID NO: 761362 - DNA, 20 bp, Artificial
  CRISPR gRNA sequence
gccccatgatgggatttcca

SEQ ID NO: 761363 - DNA, 20 bp, Artificial
  CRISPR gRNA sequence
ccatgatgggatttccaggg

SEQ ID NO: 761364 - DNA, 20 bp, Artificial
  CRISPR gRNA sequence
gttttttaatgtgtgctctg

SEQ ID NO: 761365 - DNA, 20 bp, Artificial
  CRISPR gRNA sequence
tttaatgtgtgctctgtgga

SEQ ID NO: 761366 - DNA, 20 bp, Artificial
  CRISPR gRNA sequence
ttaatgtgtgctctgtggat

SEQ ID NO: 761367 - DNA, 20 bp, Artificial
  CRISPR gRNA sequence
gctctgtggatgggccctct

SEQ ID NO: 761368 - DNA, 20 bp, Artificial
  CRISPR gRNA sequence
atgggccctcttggccacat

SEQ ID NO: 761369 - DNA, 20 bp, Artificial
  CRISPR gRNA sequence
tgcacacctctcttcatcac

SEQ ID NO: 761370 - DNA, 20 bp, Artificial
  CRISPR gRNA sequence
gcacacctctcttcatcact

SEQ ID NO: 761371 - DNA, 20 bp, Artificial
  CRISPR gRNA sequence
cacacctctcttcatcactg

SEQ ID NO: 761372 - DNA, 20 bp, Artificial
  CRISPR gRNA sequence
tctcttcatcactggggtga

SEQ ID NO: 761373 - DNA, 20 bp, Artificial
  CRISPR gRNA sequence
atggatccctgtgcttccaa

SEQ ID NO: 761374 - DNA, 20 bp, Artificial
  CRISPR gRNA sequence
atccctgtgcttccaatggc

SEQ ID NO: 761375 - DNA, 20 bp, Artificial
  CRISPR gRNA sequence
ccctgtgcttccaatggcca

SEQ ID NO: 761376 - DNA, 20 bp, Artificial
  CRISPR gRNA sequence
tgtgcttccaatggccagag

SEQ ID NO: 761377 - DNA, 20 bp, Artificial
  CRISPR gRNA sequence
gcttccaatggccagagcag

SEQ ID NO: 761378 - DNA, 20 bp, Artificial
  CRISPR gRNA sequence
ggccagagcagcagttttgc

SEQ ID NO: 761379 - DNA, 20 bp, Artificial
  CRISPR gRNA sequence
cagagcagcagttttgccag

SEQ ID NO: 761380 - DNA, 20 bp, Artificial
  CRISPR gRNA sequence
tttgccagcagtgcctattg

SEQ ID NO: 761381 - DNA, 20 bp, Artificial
  CRISPR gRNA sequence
ttgccagcagtgcctattga

SEQ ID NO: 761382 - DNA, 20 bp, Artificial
  CRISPR gRNA sequence
cctattgaaggtgacatctg

SEQ ID NO: 761383 - DNA, 20 bp, Artificial
  CRISPR gRNA sequence
acatctgcagatccatgcac

SEQ ID NO: 761384 - DNA, 20 bp, Artificial
  CRISPR gRNA sequence
catctgcagatccatgcacg

SEQ ID NO: 761385 - DNA, 20 bp, Artificial
  CRISPR gRNA sequence
tgcacgaggtgcatctatgc

SEQ ID NO: 761386 - DNA, 20 bp, Artificial
  CRISPR gRNA sequence
gcacgaggtgcatctatgct

SEQ ID NO: 761387 - DNA, 20 bp, Artificial
  CRISPR gRNA sequence
cacgaggtgcatctatgctg

SEQ ID NO: 761388 - DNA, 20 bp, Artificial
  CRISPR gRNA sequence
tgctggggtctctgccgcca

SEQ ID NO: 761389 - DNA, 20 bp, Artificial
  CRISPR gRNA sequence
gctggggtctctgccgccaa

SEQ ID NO: 761390 - DNA, 20 bp, Artificial
  CRISPR gRNA sequence
ctggggtctctgccgccaaa

SEQ ID NO: 761391 - DNA, 20 bp, Artificial
  CRISPR gRNA sequence
ctctgccgccaaagggtcca

SEQ ID NO: 761392 - DNA, 20 bp, Artificial
  CRISPR gRNA sequence
agcaccgcgcactgcactga

SEQ ID NO: 761393 - DNA, 20 bp, Artificial
  CRISPR gRNA sequence
gcaccgcgcactgcactgac

SEQ ID NO: 761394 - DNA, 20 bp, Artificial
  CRISPR gRNA sequence
caccgcgcactgcactgaca

SEQ ID NO: 761395 - DNA, 20 bp, Artificial
  CRISPR gRNA sequence
tgcactgacagggcctcctg

SEQ ID NO: 761396 - DNA, 20 bp, Artificial
  CRISPR gRNA sequence
actgacagggcctcctgcag

SEQ ID NO: 761397 - DNA, 20 bp, Artificial
  CRISPR gRNA sequence
ggcctcctgcagaagctgct

SEQ ID NO: 761398 - DNA, 20 bp, Artificial
  CRISPR gRNA sequence
gcctcctgcagaagctgctg

SEQ ID NO: 761399 - DNA, 20 bp, Artificial
  CRISPR gRNA sequence
tgcagaagctgctgaggccc

SEQ ID NO: 761400 - DNA, 20 bp, Artificial
  CRISPR gRNA sequence
gcagaagctgctgaggccct

SEQ ID NO: 761401 - DNA, 20 bp, Artificial
  CRISPR gRNA sequence
ccctgggtgtgcatcgtctc

SEQ ID NO: 761402 - DNA, 20 bp, Artificial
  CRISPR gRNA sequence
gggtgtgcatcgtctccaga

SEQ ID NO: 761403 - DNA, 20 bp, Artificial
  CRISPR gRNA sequence
tgcatcgtctccagacagca

SEQ ID NO: 761404 - DNA, 20 bp, Artificial
  CRISPR gRNA sequence
gcatcgtctccagacagcaa

SEQ ID NO: 761405 - DNA, 20 bp, Artificial
  CRISPR gRNA sequence
cgtctccagacagcaaagga

SEQ ID NO: 761406 - DNA, 20 bp, Artificial
  CRISPR gRNA sequence
ctccagacagcaaaggaaag

SEQ ID NO: 761407 - DNA, 20 bp, Artificial
  CRISPR gRNA sequence
aaagcagcactgtcttttgt

SEQ ID NO: 761408 - DNA, 20 bp, Artificial
  CRISPR gRNA sequence
aagcagcactgtcttttgtc

SEQ ID NO: 761409 - DNA, 20 bp, Artificial
  CRISPR gRNA sequence
tttgtcaggcttttcctctc

SEQ ID NO: 761410 - DNA, 20 bp, Artificial
  CRISPR gRNA sequence
ttcctctcaagacttctccc

SEQ ID NO: 761411 - DNA, 20 bp, Artificial
  CRISPR gRNA sequence
tcctctcaagacttctccct

SEQ ID NO: 761412 - DNA, 20 bp, Artificial
  CRISPR gRNA sequence
caagacttctccctaggacc

SEQ ID NO: 761413 - DNA, 20 bp, Artificial
  CRISPR gRNA sequence
acttctccctaggacccagc

SEQ ID NO: 761414 - DNA, 20 bp, Artificial
  CRISPR gRNA sequence
cttctccctaggacccagct

SEQ ID NO: 761415 - DNA, 20 bp, Artificial
  CRISPR gRNA sequence
ccctaggacccagctgggtg

SEQ ID NO: 761416 - DNA, 20 bp, Artificial
  CRISPR gRNA sequence
cctaggacccagctgggtgc

SEQ ID NO: 761417 - DNA, 20 bp, Artificial
  CRISPR gRNA sequence
ctaggacccagctgggtgca

SEQ ID NO: 761418 - DNA, 20 bp, Artificial
  CRISPR gRNA sequence
taggacccagctgggtgcag

SEQ ID NO: 761419 - DNA, 20 bp, Artificial
  CRISPR gRNA sequence
acccagctgggtgcaggggc

SEQ ID NO: 761420 - DNA, 20 bp, Artificial
  CRISPR gRNA sequence
cccagctgggtgcaggggct

SEQ ID NO: 761421 - DNA, 20 bp, Artificial
  CRISPR gRNA sequence
gctgggtgcaggggctgggc

SEQ ID NO: 761422 - DNA, 20 bp, Artificial
  CRISPR gRNA sequence
tgggtgcaggggctgggcta

SEQ ID NO: 761423 - DNA, 20 bp, Artificial
  CRISPR gRNA sequence
gggtgcaggggctgggctag

SEQ ID NO: 761424 - DNA, 20 bp, Artificial
  CRISPR gRNA sequence
gcaggggctgggctagagga

SEQ ID NO: 761425 - DNA, 20 bp, Artificial
  CRISPR gRNA sequence
tgggctagaggatggtatgt

SEQ ID NO: 761426 - DNA, 20 bp, Artificial
  CRISPR gRNA sequence
ctagaggatggtatgtaaga

SEQ ID NO: 761427 - DNA, 20 bp, Artificial
  CRISPR gRNA sequence
agaggatggtatgtaagatg

SEQ ID NO: 761428 - DNA, 20 bp, Artificial
  CRISPR gRNA sequence
gtatgtaagatggagtcaca

SEQ ID NO: 761429 - DNA, 20 bp, Artificial
  CRISPR gRNA sequence
tatgtaagatggagtcacac

SEQ ID NO: 761430 - DNA, 20 bp, Artificial
  CRISPR gRNA sequence
ggagtcacacaggctgtgct

SEQ ID NO: 761431 - DNA, 20 bp, Artificial
  CRISPR gRNA sequence
cacacaggctgtgctcagaa

SEQ ID NO: 761432 - DNA, 20 bp, Artificial
  CRISPR gRNA sequence
gctgtgctcagaacagctcc

SEQ ID NO: 761433 - DNA, 20 bp, Artificial
  CRISPR gRNA sequence
gaacagctcctggccctacc

SEQ ID NO: 761434 - DNA, 20 bp, Artificial
  CRISPR gRNA sequence
ctcctggccctacccagctt

SEQ ID NO: 761435 - DNA, 20 bp, Artificial
  CRISPR gRNA sequence
tcctggccctacccagcttt

SEQ ID NO: 761436 - DNA, 20 bp, Artificial
  CRISPR gRNA sequence
cttcatccctcttgacgtga

SEQ ID NO: 761437 - DNA, 20 bp, Artificial
  CRISPR gRNA sequence
cctcttgacgtgacagctct

SEQ ID NO: 761438 - DNA, 20 bp, Artificial
  CRISPR gRNA sequence
tcttgacgtgacagctctaa

SEQ ID NO: 761439 - DNA, 20 bp, Artificial
  CRISPR gRNA sequence
cttgacgtgacagctctaag

SEQ ID NO: 761440 - DNA, 20 bp, Artificial
  CRISPR gRNA sequence
tgacgtgacagctctaagag

SEQ ID NO: 761441 - DNA, 20 bp, Artificial
  CRISPR gRNA sequence
gacgtgacagctctaagagg

SEQ ID NO: 761442 - DNA, 20 bp, Artificial
  CRISPR gRNA sequence
acgtgacagctctaagagga

SEQ ID NO: 761443 - DNA, 20 bp, Artificial
  CRISPR gRNA sequence
cgtgacagctctaagaggag

SEQ ID NO: 761444 - DNA, 20 bp, Artificial
  CRISPR gRNA sequence
agctctaagaggaggggcct

SEQ ID NO: 761445 - DNA, 20 bp, Artificial
  CRISPR gRNA sequence
gtttcatgttaatatccccc

SEQ ID NO: 761446 - DNA, 20 bp, Artificial
  CRISPR gRNA sequence
catgttaatatccccctggc

SEQ ID NO: 761447 - DNA, 20 bp, Artificial
  CRISPR gRNA sequence
atgttaatatccccctggca

SEQ ID NO: 761448 - DNA, 20 bp, Artificial
  CRISPR gRNA sequence
tccccctggcaaggcccctg

SEQ ID NO: 761449 - DNA, 20 bp, Artificial
  CRISPR gRNA sequence
tgcagacctacctgactcct

SEQ ID NO: 761450 - DNA, 20 bp, Artificial
  CRISPR gRNA sequence
gcagacctacctgactcctt

SEQ ID NO: 761451 - DNA, 20 bp, Artificial
  CRISPR gRNA sequence
cagacctacctgactccttg

SEQ ID NO: 761452 - DNA, 20 bp, Artificial
  CRISPR gRNA sequence
tgactccttggggaaactcc

SEQ ID NO: 761453 - DNA, 20 bp, Artificial
  CRISPR gRNA sequence
gaaactccaagccctcactc

SEQ ID NO: 761454 - DNA, 20 bp, Artificial
  CRISPR gRNA sequence
agccctcactccagccccgt

SEQ ID NO: 761455 - DNA, 20 bp, Artificial
  CRISPR gRNA sequence
tcagtgacctcatctgtatg

SEQ ID NO: 761456 - DNA, 20 bp, Artificial
  CRISPR gRNA sequence
cagtgacctcatctgtatgt

SEQ ID NO: 761457 - DNA, 20 bp, Artificial
  CRISPR gRNA sequence
cctcatctgtatgtaggact

SEQ ID NO: 761458 - DNA, 20 bp, Artificial
  CRISPR gRNA sequence
cagcgaacattttctgtaaa

SEQ ID NO: 761459 - DNA, 20 bp, Artificial
  CRISPR gRNA sequence
gaacattttctgtaaatggc

SEQ ID NO: 761460 - DNA, 20 bp, Artificial
  CRISPR gRNA sequence
aacattttctgtaaatggcc

SEQ ID NO: 761461 - DNA, 20 bp, Artificial
  CRISPR gRNA sequence
acattttctgtaaatggcca

SEQ ID NO: 761462 - DNA, 20 bp, Artificial
  CRISPR gRNA sequence
attttctgtaaatggccagg

SEQ ID NO: 761463 - DNA, 20 bp, Artificial
  CRISPR gRNA sequence
ggccagggagtaaatgtttt

SEQ ID NO: 761464 - DNA, 20 bp, Artificial
  CRISPR gRNA sequence
gccagggagtaaatgttttt

SEQ ID NO: 761465 - DNA, 20 bp, Artificial
  CRISPR gRNA sequence
gtaaatgtttttaggcatcg

SEQ ID NO: 761466 - DNA, 20 bp, Artificial
  CRISPR gRNA sequence
taaatgtttttaggcatcgt

SEQ ID NO: 761467 - DNA, 20 bp, Artificial
  CRISPR gRNA sequence
cgccttcccccatctttttt

SEQ ID NO: 761468 - DNA, 20 bp, Artificial
  CRISPR gRNA sequence
acaaatgtaaaaaccatcac

SEQ ID NO: 761469 - DNA, 20 bp, Artificial
  CRISPR gRNA sequence
taaaaaccatcactagtttg

SEQ ID NO: 761470 - DNA, 20 bp, Artificial
  CRISPR gRNA sequence
gtttgtggactgtacaaaaa

SEQ ID NO: 761471 - DNA, 20 bp, Artificial
  CRISPR gRNA sequence
tttgtggactgtacaaaaac

SEQ ID NO: 761472 - DNA, 20 bp, Artificial
  CRISPR gRNA sequence
actgtacaaaaacaggccac

SEQ ID NO: 761473 - DNA, 20 bp, Artificial
  CRISPR gRNA sequence
tacaaaaacaggccacaagc

SEQ ID NO: 761474 - DNA, 20 bp, Artificial
  CRISPR gRNA sequence
aacaggccacaagccagctt

SEQ ID NO: 761475 - DNA, 20 bp, Artificial
  CRISPR gRNA sequence
cacaagccagctttggccca

SEQ ID NO: 761476 - DNA, 20 bp, Artificial
  CRISPR gRNA sequence
acaagccagctttggcccat

SEQ ID NO: 761477 - DNA, 20 bp, Artificial
  CRISPR gRNA sequence
cagctttggcccatgggctg

SEQ ID NO: 761478 - DNA, 20 bp, Artificial
  CRISPR gRNA sequence
gtttgctgccttctgatcca

SEQ ID NO: 761479 - DNA, 20 bp, Artificial
  CRISPR gRNA sequence
ctgccttctgatccatagaa

SEQ ID NO: 761480 - DNA, 20 bp, Artificial
  CRISPR gRNA sequence
tgccttctgatccatagaat

SEQ ID NO: 761481 - DNA, 20 bp, Artificial
  CRISPR gRNA sequence
ccttctgatccatagaatgg

SEQ ID NO: 761482 - DNA, 20 bp, Artificial
  CRISPR gRNA sequence
catagaatgggagatgtcac

SEQ ID NO: 761483 - DNA, 20 bp, Artificial
  CRISPR gRNA sequence
atagaatgggagatgtcacc

SEQ ID NO: 761484 - DNA, 20 bp, Artificial
  CRISPR gRNA sequence
gaatgggagatgtcaccagg

SEQ ID NO: 761485 - DNA, 20 bp, Artificial
  CRISPR gRNA sequence
aatgggagatgtcaccaggt

SEQ ID NO: 761486 - DNA, 20 bp, Artificial
  CRISPR gRNA sequence
atgggagatgtcaccaggta

SEQ ID NO: 761487 - DNA, 20 bp, Artificial
  CRISPR gRNA sequence
gatgtcaccaggtagggctg

SEQ ID NO: 761488 - DNA, 20 bp, Artificial
  CRISPR gRNA sequence
gtcaccaggtagggctgaag

SEQ ID NO: 761489 - DNA, 20 bp, Artificial
  CRISPR gRNA sequence
ggtagggctgaagcagtcaa

SEQ ID NO: 761490 - DNA, 20 bp, Artificial
  CRISPR gRNA sequence
tagggctgaagcagtcaaaa

SEQ ID NO: 761491 - DNA, 20 bp, Artificial
  CRISPR gRNA sequence
agggctgaagcagtcaaaag

SEQ ID NO: 761492 - DNA, 20 bp, Artificial
  CRISPR gRNA sequence
gggctgaagcagtcaaaaga

SEQ ID NO: 761493 - DNA, 20 bp, Artificial
  CRISPR gRNA sequence
agcagtcaaaagagggcctc

SEQ ID NO: 761494 - DNA, 20 bp, Artificial
  CRISPR gRNA sequence
cagtcaaaagagggcctctg

SEQ ID NO: 761495 - DNA, 20 bp, Artificial
  CRISPR gRNA sequence
agtcaaaagagggcctctgg

SEQ ID NO: 761496 - DNA, 20 bp, Artificial
  CRISPR gRNA sequence
tcaaaagagggcctctggag

SEQ ID NO: 761497 - DNA, 20 bp, Artificial
  CRISPR gRNA sequence
caaaagagggcctctggagg

SEQ ID NO: 761498 - DNA, 20 bp, Artificial
  CRISPR gRNA sequence
ctctggaggaggtgaatatt

SEQ ID NO: 761499 - DNA, 20 bp, Artificial
  CRISPR gRNA sequence
gaggaggtgaatattgagct

SEQ ID NO: 761500 - DNA, 20 bp, Artificial
  CRISPR gRNA sequence
gaggtgaatattgagctaag

SEQ ID NO: 761501 - DNA, 20 bp, Artificial
  CRISPR gRNA sequence
ggtgaatattgagctaagca

SEQ ID NO: 761502 - DNA, 20 bp, Artificial
  CRISPR gRNA sequence
attgagctaagcagagaatt

SEQ ID NO: 761503 - DNA, 20 bp, Artificial
  CRISPR gRNA sequence
ttgagctaagcagagaattt

SEQ ID NO: 761504 - DNA, 20 bp, Artificial
  CRISPR gRNA sequence
cagagaatttgggaaactga

SEQ ID NO: 761505 - DNA, 20 bp, Artificial
  CRISPR gRNA sequence
atttgggaaactgatagcat

SEQ ID NO: 761506 - DNA, 20 bp, Artificial
  CRISPR gRNA sequence
ggaaactgatagcattagtg

SEQ ID NO: 761507 - DNA, 20 bp, Artificial
  CRISPR gRNA sequence
aaactgatagcattagtgca

SEQ ID NO: 761508 - DNA, 20 bp, Artificial
  CRISPR gRNA sequence
aactgatagcattagtgcag

SEQ ID NO: 761509 - DNA, 20 bp, Artificial
  CRISPR gRNA sequence
gatagcattagtgcagaggc

SEQ ID NO: 761510 - DNA, 20 bp, Artificial
  CRISPR gRNA sequence
agcattagtgcagaggctgg

SEQ ID NO: 761511 - DNA, 20 bp, Artificial
  CRISPR gRNA sequence
gcattagtgcagaggctgga

SEQ ID NO: 761512 - DNA, 20 bp, Artificial
  CRISPR gRNA sequence
attagtgcagaggctggaag

SEQ ID NO: 761513 - DNA, 20 bp, Artificial
  CRISPR gRNA sequence
gtgcagaggctggaaggagc

SEQ ID NO: 761514 - DNA, 20 bp, Artificial
  CRISPR gRNA sequence
tggaaggagccagttgcttc

SEQ ID NO: 761515 - DNA, 20 bp, Artificial
  CRISPR gRNA sequence
gaaggagccagttgcttctg

SEQ ID NO: 761516 - DNA, 20 bp, Artificial
  CRISPR gRNA sequence
aggagccagttgcttctgga

SEQ ID NO: 761517 - DNA, 20 bp, Artificial
  CRISPR gRNA sequence
ccagttgcttctggagagaa

SEQ ID NO: 761518 - DNA, 20 bp, Artificial
  CRISPR gRNA sequence
ttgcttctggagagaatggt

SEQ ID NO: 761519 - DNA, 20 bp, Artificial
  CRISPR gRNA sequence
tgcttctggagagaatggtt

SEQ ID NO: 761520 - DNA, 20 bp, Artificial
  CRISPR gRNA sequence
ggagagaatggttaggacac

SEQ ID NO: 761521 - DNA, 20 bp, Artificial
  CRISPR gRNA sequence
gaatggttaggacaccagtt

SEQ ID NO: 761522 - DNA, 20 bp, Artificial
  CRISPR gRNA sequence
ttaggacaccagtttggctg

SEQ ID NO: 761523 - DNA, 20 bp, Artificial
  CRISPR gRNA sequence
acaccagtttggctgaagct

SEQ ID NO: 761524 - DNA, 20 bp, Artificial
  CRISPR gRNA sequence
caccagtttggctgaagctg

SEQ ID NO: 761525 - DNA, 20 bp, Artificial
  CRISPR gRNA sequence
ggctgaagctgaggctccta

SEQ ID NO: 761526 - DNA, 20 bp, Artificial
  CRISPR gRNA sequence
tgaagctgaggctcctacag

SEQ ID NO: 761527 - DNA, 20 bp, Artificial
  CRISPR gRNA sequence
tgaggctcctacagtagaat

SEQ ID NO: 761528 - DNA, 20 bp, Artificial
  CRISPR gRNA sequence
tacagtagaattagaaaact

SEQ ID NO: 761529 - DNA, 20 bp, Artificial
  CRISPR gRNA sequence
acagtagaattagaaaactt

SEQ ID NO: 761530 - DNA, 20 bp, Artificial
  CRISPR gRNA sequence
cagtagaattagaaaactta

SEQ ID NO: 761531 - DNA, 20 bp, Artificial
  CRISPR gRNA sequence
agtagaattagaaaacttag

SEQ ID NO: 761532 - DNA, 20 bp, Artificial
  CRISPR gRNA sequence
tagaattagaaaacttaggg

SEQ ID NO: 761533 - DNA, 20 bp, Artificial
  CRISPR gRNA sequence
agaattagaaaacttagggg

SEQ ID NO: 761534 - DNA, 20 bp, Artificial
  CRISPR gRNA sequence
gaattagaaaacttagggga

SEQ ID NO: 761535 - DNA, 20 bp, Artificial
  CRISPR gRNA sequence
tagaaaacttaggggagggt

SEQ ID NO: 761536 - DNA, 20 bp, Artificial
  CRISPR gRNA sequence
aaaacttaggggagggtaag

SEQ ID NO: 761537 - DNA, 20 bp, Artificial
  CRISPR gRNA sequence
acttaggggagggtaagcag

SEQ ID NO: 761538 - DNA, 20 bp, Artificial
  CRISPR gRNA sequence
ggtaagcagcagccaacttc

SEQ ID NO: 761539 - DNA, 20 bp, Artificial
  CRISPR gRNA sequence
taagcagcagccaacttcta

SEQ ID NO: 761540 - DNA, 20 bp, Artificial
  CRISPR gRNA sequence
aagcagcagccaacttctag

SEQ ID NO: 761541 - DNA, 20 bp, Artificial
  CRISPR gRNA sequence
aggtccttgaatcacgcttg

SEQ ID NO: 761542 - DNA, 20 bp, Artificial
  CRISPR gRNA sequence
tgaatcacgcttgaagcttg

SEQ ID NO: 761543 - DNA, 20 bp, Artificial
  CRISPR gRNA sequence
aagcttgaagcattattcta

SEQ ID NO: 761544 - DNA, 20 bp, Artificial
  CRISPR gRNA sequence
aagcattattctaaagtcac

SEQ ID NO: 761545 - DNA, 20 bp, Artificial
  CRISPR gRNA sequence
agcattattctaaagtcact

SEQ ID NO: 761546 - DNA, 20 bp, Artificial
  CRISPR gRNA sequence
gcattattctaaagtcacta

SEQ ID NO: 761547 - DNA, 20 bp, Artificial
  CRISPR gRNA sequence
attattctaaagtcactagg

SEQ ID NO: 761548 - DNA, 20 bp, Artificial
  CRISPR gRNA sequence
ctaaagtcactagggagcca

SEQ ID NO: 761549 - DNA, 20 bp, Artificial
  CRISPR gRNA sequence
aagtcactagggagccatag

SEQ ID NO: 761550 - DNA, 20 bp, Artificial
  CRISPR gRNA sequence
agtcactagggagccataga

SEQ ID NO: 761551 - DNA, 20 bp, Artificial
  CRISPR gRNA sequence
gggagccatagaaggtactt

SEQ ID NO: 761552 - DNA, 20 bp, Artificial
  CRISPR gRNA sequence
cttgagcatcaattcaacca

SEQ ID NO: 761553 - DNA, 20 bp, Artificial
  CRISPR gRNA sequence
ttgagcatcaattcaaccac

SEQ ID NO: 761554 - DNA, 20 bp, Artificial
  CRISPR gRNA sequence
caattcaaccacaggctctt

SEQ ID NO: 761555 - DNA, 20 bp, Artificial
  CRISPR gRNA sequence
acaggctcttcagcccttcc

SEQ ID NO: 761556 - DNA, 20 bp, Artificial
  CRISPR gRNA sequence
ctcttcagcccttcctggtt

SEQ ID NO: 761557 - DNA, 20 bp, Artificial
  CRISPR gRNA sequence
tcttcagcccttcctggttg

SEQ ID NO: 761558 - DNA, 20 bp, Artificial
  CRISPR gRNA sequence
tggttgaggcgtgtccacat

SEQ ID NO: 761559 - DNA, 20 bp, Artificial
  CRISPR gRNA sequence
tgaggcgtgtccacatcagc

SEQ ID NO: 761560 - DNA, 20 bp, Artificial
  CRISPR gRNA sequence
gaggcgtgtccacatcagcc

SEQ ID NO: 761561 - DNA, 20 bp, Artificial
  CRISPR gRNA sequence
aggcgtgtccacatcagcca

SEQ ID NO: 761562 - DNA, 20 bp, Artificial
  CRISPR gRNA sequence
cacatcagccagggttgtat

SEQ ID NO: 761563 - DNA, 20 bp, Artificial
  CRISPR gRNA sequence
acatcagccagggttgtatc

SEQ ID NO: 761564 - DNA, 20 bp, Artificial
  CRISPR gRNA sequence
catcagccagggttgtatca

SEQ ID NO: 761565 - DNA, 20 bp, Artificial
  CRISPR gRNA sequence
gccagggttgtatcagggtt

SEQ ID NO: 761566 - DNA, 20 bp, Artificial
  CRISPR gRNA sequence
ccagggttgtatcagggttt

SEQ ID NO: 761567 - DNA, 20 bp, Artificial
  CRISPR gRNA sequence
cagggttgtatcagggtttg

SEQ ID NO: 761568 - DNA, 20 bp, Artificial
  CRISPR gRNA sequence
gggttgtatcagggtttggg

SEQ ID NO: 761569 - DNA, 20 bp, Artificial
  CRISPR gRNA sequence
atcagggtttggggagtgta

SEQ ID NO: 761570 - DNA, 20 bp, Artificial
  CRISPR gRNA sequence
ggtttggggagtgtatggcg

SEQ ID NO: 761571 - DNA, 20 bp, Artificial
  CRISPR gRNA sequence
gtttggggagtgtatggcga

SEQ ID NO: 761572 - DNA, 20 bp, Artificial
  CRISPR gRNA sequence
tttggggagtgtatggcgaa

SEQ ID NO: 761573 - DNA, 20 bp, Artificial
  CRISPR gRNA sequence
agtgtatggcgaagggactg

SEQ ID NO: 761574 - DNA, 20 bp, Artificial
  CRISPR gRNA sequence
gtgtatggcgaagggactgt

SEQ ID NO: 761575 - DNA, 20 bp, Artificial
  CRISPR gRNA sequence
cgaagggactgtaggaactt

SEQ ID NO: 761576 - DNA, 20 bp, Artificial
  CRISPR gRNA sequence
gggactgtaggaacttaagt

SEQ ID NO: 761577 - DNA, 20 bp, Artificial
  CRISPR gRNA sequence
acttaagtgagctttattca

SEQ ID NO: 761578 - DNA, 20 bp, Artificial
  CRISPR gRNA sequence
gtgagctttattcatagtgt

SEQ ID NO: 761579 - DNA, 20 bp, Artificial
  CRISPR gRNA sequence
tgagctttattcatagtgtt

SEQ ID NO: 761580 - DNA, 20 bp, Artificial
  CRISPR gRNA sequence
gagctttattcatagtgtta

SEQ ID NO: 761581 - DNA, 20 bp, Artificial
  CRISPR gRNA sequence
ttattcatagtgttagggcc

SEQ ID NO: 761582 - DNA, 20 bp, Artificial
  CRISPR gRNA sequence
tcatagtgttagggcccagt

SEQ ID NO: 761583 - DNA, 20 bp, Artificial
  CRISPR gRNA sequence
catagtgttagggcccagtg

SEQ ID NO: 761584 - DNA, 20 bp, Artificial
  CRISPR gRNA sequence
atagtgttagggcccagtga

SEQ ID NO: 761585 - DNA, 20 bp, Artificial
  CRISPR gRNA sequence
gtgttagggcccagtgaggg

SEQ ID NO: 761586 - DNA, 20 bp, Artificial
  CRISPR gRNA sequence
tgttagggcccagtgagggt

SEQ ID NO: 761587 - DNA, 20 bp, Artificial
  CRISPR gRNA sequence
ttagggcccagtgagggtgg

SEQ ID NO: 761588 - DNA, 20 bp, Artificial
  CRISPR gRNA sequence
tgggagcccctgttcacact

SEQ ID NO: 761589 - DNA, 20 bp, Artificial
  CRISPR gRNA sequence
ggagcccctgttcacacttg

SEQ ID NO: 761590 - DNA, 20 bp, Artificial
  CRISPR gRNA sequence
ctgttcacacttggagccaa

SEQ ID NO: 761591 - DNA, 20 bp, Artificial
  CRISPR gRNA sequence
gagccaatggtgctgtcctc

SEQ ID NO: 761592 - DNA, 20 bp, Artificial
  CRISPR gRNA sequence
agccaatggtgctgtcctcc

SEQ ID NO: 761593 - DNA, 20 bp, Artificial
  CRISPR gRNA sequence
tggtgctgtcctccgggaca

SEQ ID NO: 761594 - DNA, 20 bp, Artificial
  CRISPR gRNA sequence
ggtgctgtcctccgggacat

SEQ ID NO: 761595 - DNA, 20 bp, Artificial
  CRISPR gRNA sequence
gtgctgtcctccgggacatg

SEQ ID NO: 761596 - DNA, 20 bp, Artificial
  CRISPR gRNA sequence
tgtcctccgggacatggggc

SEQ ID NO: 761597 - DNA, 20 bp, Artificial
  CRISPR gRNA sequence
gtcctccgggacatggggcc

SEQ ID NO: 761598 - DNA, 20 bp, Artificial
  CRISPR gRNA sequence
ggacatggggccaggcatga

SEQ ID NO: 761599 - DNA, 20 bp, Artificial
  CRISPR gRNA sequence
actgttgctacttttcctct

SEQ ID NO: 761600 - DNA, 20 bp, Artificial
  CRISPR gRNA sequence
ctgttgctacttttcctctc

SEQ ID NO: 761601 - DNA, 20 bp, Artificial
  CRISPR gRNA sequence
tgttgctacttttcctctca

SEQ ID NO: 761602 - DNA, 20 bp, Artificial
  CRISPR gRNA sequence
tgctacttttcctctcaggg

SEQ ID NO: 761603 - DNA, 20 bp, Artificial
  CRISPR gRNA sequence
gcagcctatgacattccccc

SEQ ID NO: 761604 - DNA, 20 bp, Artificial
  CRISPR gRNA sequence
agcctatgacattcccccca

SEQ ID NO: 761605 - DNA, 20 bp, Artificial
  CRISPR gRNA sequence
gcctatgacattccccccag

SEQ ID NO: 761606 - DNA, 20 bp, Artificial
  CRISPR gRNA sequence
cattccccccagaggccctg

SEQ ID NO: 761607 - DNA, 20 bp, Artificial
  CRISPR gRNA sequence
attccccccagaggccctgt

SEQ ID NO: 761608 - DNA, 20 bp, Artificial
  CRISPR gRNA sequence
agaggccctgtgggtgaccg

SEQ ID NO: 761609 - DNA, 20 bp, Artificial
  CRISPR gRNA sequence
gaggccctgtgggtgaccgt

SEQ ID NO: 761610 - DNA, 20 bp, Artificial
  CRISPR gRNA sequence
aggccctgtgggtgaccgtg

SEQ ID NO: 761611 - DNA, 20 bp, Artificial
  CRISPR gRNA sequence
tgtctgtctcattgcactgc

SEQ ID NO: 761612 - DNA, 20 bp, Artificial
  CRISPR gRNA sequence
ctgtctcattgcactgctgg

SEQ ID NO: 761613 - DNA, 20 bp, Artificial
  CRISPR gRNA sequence
cattgcactgctggtggccc

SEQ ID NO: 761614 - DNA, 20 bp, Artificial
  CRISPR gRNA sequence
tggccctggctttcgtgtgc

SEQ ID NO: 761615 - DNA, 20 bp, Artificial
  CRISPR gRNA sequence
gccctggctttcgtgtgctg

SEQ ID NO: 761616 - DNA, 20 bp, Artificial
  CRISPR gRNA sequence
tggctttcgtgtgctggaga

SEQ ID NO: 761617 - DNA, 20 bp, Artificial
  CRISPR gRNA sequence
tgtgctggagaaagatcaaa

SEQ ID NO: 761618 - DNA, 20 bp, Artificial
  CRISPR gRNA sequence
tgctggagaaagatcaaaca

SEQ ID NO: 761619 - DNA, 20 bp, Artificial
  CRISPR gRNA sequence
gaaagatcaaacagagctgt

SEQ ID NO: 761620 - DNA, 20 bp, Artificial
  CRISPR gRNA sequence
aaagatcaaacagagctgtg

SEQ ID NO: 761621 - DNA, 20 bp, Artificial
  CRISPR gRNA sequence
agatcaaacagagctgtgag

SEQ ID NO: 761622 - DNA, 20 bp, Artificial
  CRISPR gRNA sequence
gatcaaacagagctgtgagg

SEQ ID NO: 761623 - DNA, 20 bp, Artificial
  CRISPR gRNA sequence
tcaaacagagctgtgaggag

SEQ ID NO: 761624 - DNA, 20 bp, Artificial
  CRISPR gRNA sequence
gagctgtgaggaggagaatg

SEQ ID NO: 761625 - DNA, 20 bp, Artificial
  CRISPR gRNA sequence
agctgtgaggaggagaatgc

SEQ ID NO: 761626 - DNA, 20 bp, Artificial
  CRISPR gRNA sequence
gtgaggaggagaatgcaggt

SEQ ID NO: 761627 - DNA, 20 bp, Artificial
  CRISPR gRNA sequence
gcatgcacacttatgtgtct

SEQ ID NO: 761628 - DNA, 20 bp, Artificial
  CRISPR gRNA sequence
catgcacacttatgtgtctt

SEQ ID NO: 761629 - DNA, 20 bp, Artificial
  CRISPR gRNA sequence
atgcacacttatgtgtcttg

SEQ ID NO: 761630 - DNA, 20 bp, Artificial
  CRISPR gRNA sequence
gttgctgtctttgatgtcaa

SEQ ID NO: 761631 - DNA, 20 bp, Artificial
  CRISPR gRNA sequence
tgctgtctttgatgtcaata

SEQ ID NO: 761632 - DNA, 20 bp, Artificial
  CRISPR gRNA sequence
gtcaatagagtgtcactttc

SEQ ID NO: 761633 - DNA, 20 bp, Artificial
  CRISPR gRNA sequence
agagtgtcactttctagtga

SEQ ID NO: 761634 - DNA, 20 bp, Artificial
  CRISPR gRNA sequence
tcactttctagtgacagaac

SEQ ID NO: 761635 - DNA, 20 bp, Artificial
  CRISPR gRNA sequence
acagaacgagtgtgtgtgtg

SEQ ID NO: 761636 - DNA, 20 bp, Artificial
  CRISPR gRNA sequence
aacgagtgtgtgtgtgcaga

SEQ ID NO: 761637 - DNA, 20 bp, Artificial
  CRISPR gRNA sequence
acgagtgtgtgtgtgcagat

SEQ ID NO: 761638 - DNA, 20 bp, Artificial
  CRISPR gRNA sequence
cgagtgtgtgtgtgcagatg

SEQ ID NO: 761639 - DNA, 20 bp, Artificial
  CRISPR gRNA sequence
tgtgtgtgtgcagatggggc

SEQ ID NO: 761640 - DNA, 20 bp, Artificial
  CRISPR gRNA sequence
atttgtctgtgtgtgacctt

SEQ ID NO: 761641 - DNA, 20 bp, Artificial
  CRISPR gRNA sequence
tacgtcttgtgtgtgtgaac

SEQ ID NO: 761642 - DNA, 20 bp, Artificial
  CRISPR gRNA sequence
ttgtgtgtgtgaacaagcgt

SEQ ID NO: 761643 - DNA, 20 bp, Artificial
  CRISPR gRNA sequence
tgagcctgtctgtccatgtg

SEQ ID NO: 761644 - DNA, 20 bp, Artificial
  CRISPR gRNA sequence
ctgtccatgtgcagatacca

SEQ ID NO: 761645 - DNA, 20 bp, Artificial
  CRISPR gRNA sequence
tgtccatgtgcagataccac

SEQ ID NO: 761646 - DNA, 20 bp, Artificial
  CRISPR gRNA sequence
cagataccacaggatgaatg

SEQ ID NO: 761647 - DNA, 20 bp, Artificial
  CRISPR gRNA sequence
accacaggatgaatgtggat

SEQ ID NO: 761648 - DNA, 20 bp, Artificial
  CRISPR gRNA sequence
tgaatgtggatgagtgtgac

SEQ ID NO: 761649 - DNA, 20 bp, Artificial
  CRISPR gRNA sequence
atgtggatgagtgtgactgg

SEQ ID NO: 761650 - DNA, 20 bp, Artificial
  CRISPR gRNA sequence
tgtggatgagtgtgactgga

SEQ ID NO: 761651 - DNA, 20 bp, Artificial
  CRISPR gRNA sequence
ggatgagtgtgactggaagg

SEQ ID NO: 761652 - DNA, 20 bp, Artificial
  CRISPR gRNA sequence
tgagtgtgactggaaggtgg

SEQ ID NO: 761653 - DNA, 20 bp, Artificial
  CRISPR gRNA sequence
gagtgtgactggaaggtggt

SEQ ID NO: 761654 - DNA, 20 bp, Artificial
  CRISPR gRNA sequence
gtgtgactggaaggtggtgg

SEQ ID NO: 761655 - DNA, 20 bp, Artificial
  CRISPR gRNA sequence
ctggaaggtggtgggagtgt

SEQ ID NO: 761656 - DNA, 20 bp, Artificial
  CRISPR gRNA sequence
tggaaggtggtgggagtgta

SEQ ID NO: 761657 - DNA, 20 bp, Artificial
  CRISPR gRNA sequence
ggtggtgggagtgtaaggcc

SEQ ID NO: 761658 - DNA, 20 bp, Artificial
  CRISPR gRNA sequence
gtgtaaggccaagtgctaca

SEQ ID NO: 761659 - DNA, 20 bp, Artificial
  CRISPR gRNA sequence
tgtaaggccaagtgctacaa

SEQ ID NO: 761660 - DNA, 20 bp, Artificial
  CRISPR gRNA sequence
gtaaggccaagtgctacaaa

SEQ ID NO: 761661 - DNA, 20 bp, Artificial
  CRISPR gRNA sequence
gccaagtgctacaaagggat

SEQ ID NO: 761662 - DNA, 20 bp, Artificial
  CRISPR gRNA sequence
agggatgagtgtgtgccaac

SEQ ID NO: 761663 - DNA, 20 bp, Artificial
  CRISPR gRNA sequence
gccaacaagtgtgcctgtga

SEQ ID NO: 761664 - DNA, 20 bp, Artificial
  CRISPR gRNA sequence
aagtgtgcctgtgaaagtgt

SEQ ID NO: 761665 - DNA, 20 bp, Artificial
  CRISPR gRNA sequence
gtgcctgtgaaagtgtaagt

SEQ ID NO: 761666 - DNA, 20 bp, Artificial
  CRISPR gRNA sequence
taagtcagtcacgtgtgtgt

SEQ ID NO: 761667 - DNA, 20 bp, Artificial
  CRISPR gRNA sequence
agtcagtcacgtgtgtgtga

SEQ ID NO: 761668 - DNA, 20 bp, Artificial
  CRISPR gRNA sequence
tcagtcacgtgtgtgtgaga

SEQ ID NO: 761669 - DNA, 20 bp, Artificial
  CRISPR gRNA sequence
gtcacgtgtgtgtgagagag

SEQ ID NO: 761670 - DNA, 20 bp, Artificial
  CRISPR gRNA sequence
tcacgtgtgtgtgagagagc

SEQ ID NO: 761671 - DNA, 20 bp, Artificial
  CRISPR gRNA sequence
gtgtgtgtgagagagcaggc

SEQ ID NO: 761672 - DNA, 20 bp, Artificial
  CRISPR gRNA sequence
gtgtgtgagagagcaggcca

SEQ ID NO: 761673 - DNA, 20 bp, Artificial
  CRISPR gRNA sequence
tgagagagcaggccagagca

SEQ ID NO: 761674 - DNA, 20 bp, Artificial
  CRISPR gRNA sequence
gagagcaggccagagcatgg

SEQ ID NO: 761675 - DNA, 20 bp, Artificial
  CRISPR gRNA sequence
gccagagcatggaagctgtg

SEQ ID NO: 761676 - DNA, 20 bp, Artificial
  CRISPR gRNA sequence
gaagctgtgcggcacaaatg

SEQ ID NO: 761677 - DNA, 20 bp, Artificial
  CRISPR gRNA sequence
aagctgtgcggcacaaatgt

SEQ ID NO: 761678 - DNA, 20 bp, Artificial
  CRISPR gRNA sequence
cggcacaaatgtaggcatgc

SEQ ID NO: 761679 - DNA, 20 bp, Artificial
  CRISPR gRNA sequence
ggcacaaatgtaggcatgcc

SEQ ID NO: 761680 - DNA, 20 bp, Artificial
  CRISPR gRNA sequence
gcacaaatgtaggcatgcca

SEQ ID NO: 761681 - DNA, 20 bp, Artificial
  CRISPR gRNA sequence
cacaaatgtaggcatgccag

SEQ ID NO: 761682 - DNA, 20 bp, Artificial
  CRISPR gRNA sequence
aggcatgccaggggcgtgca

SEQ ID NO: 761683 - DNA, 20 bp, Artificial
  CRISPR gRNA sequence
gccaggggcgtgcatggcac

SEQ ID NO: 761684 - DNA, 20 bp, Artificial
  CRISPR gRNA sequence
ccaggggcgtgcatggcact

SEQ ID NO: 761685 - DNA, 20 bp, Artificial
  CRISPR gRNA sequence
caggggcgtgcatggcactg

SEQ ID NO: 761686 - DNA, 20 bp, Artificial
  CRISPR gRNA sequence
aggggcgtgcatggcactgg

SEQ ID NO: 761687 - DNA, 20 bp, Artificial
  CRISPR gRNA sequence
gggggtgatcgtgcctgcct

SEQ ID NO: 761688 - DNA, 20 bp, Artificial
  CRISPR gRNA sequence
gggtgatcgtgcctgccttg

SEQ ID NO: 761689 - DNA, 20 bp, Artificial
  CRISPR gRNA sequence
gatcgtgcctgccttggagt

SEQ ID NO: 761690 - DNA, 20 bp, Artificial
  CRISPR gRNA sequence
cctgccttggagtgagtttg

SEQ ID NO: 761691 - DNA, 20 bp, Artificial
  CRISPR gRNA sequence
gccttggagtgagtttgaag

SEQ ID NO: 761692 - DNA, 20 bp, Artificial
  CRISPR gRNA sequence
tttgaagcagctgccatttg

SEQ ID NO: 761693 - DNA, 20 bp, Artificial
  CRISPR gRNA sequence
ttgaagcagctgccatttgc

SEQ ID NO: 761694 - DNA, 20 bp, Artificial
  CRISPR gRNA sequence
tgaagcagctgccatttgcg

SEQ ID NO: 761695 - DNA, 20 bp, Artificial
  CRISPR gRNA sequence
cagctgccatttgcggggct

SEQ ID NO: 761696 - DNA, 20 bp, Artificial
  CRISPR gRNA sequence
agctgccatttgcggggctg

SEQ ID NO: 761697 - DNA, 20 bp, Artificial
  CRISPR gRNA sequence
gctgccatttgcggggctga

SEQ ID NO: 761698 - DNA, 20 bp, Artificial
  CRISPR gRNA sequence
ccatttgcggggctgagggt

SEQ ID NO: 761699 - DNA, 20 bp, Artificial
  CRISPR gRNA sequence
gcggggctgagggtcagccc

SEQ ID NO: 761700 - DNA, 20 bp, Artificial
  CRISPR gRNA sequence
ggctgagggtcagcccgagc

SEQ ID NO: 761701 - DNA, 20 bp, Artificial
  CRISPR gRNA sequence
gggtcagcccgagctggcat

SEQ ID NO: 761702 - DNA, 20 bp, Artificial
  CRISPR gRNA sequence
cccgagctggcattggtgac

SEQ ID NO: 761703 - DNA, 20 bp, Artificial
  CRISPR gRNA sequence
agctggcattggtgactggt

SEQ ID NO: 761704 - DNA, 20 bp, Artificial
  CRISPR gRNA sequence
tggcattggtgactggtaag

SEQ ID NO: 761705 - DNA, 20 bp, Artificial
  CRISPR gRNA sequence
ggcattggtgactggtaagt

SEQ ID NO: 761706 - DNA, 20 bp, Artificial
  CRISPR gRNA sequence
ttggtgactggtaagtgggt

SEQ ID NO: 761707 - DNA, 20 bp, Artificial
  CRISPR gRNA sequence
ggtgactggtaagtgggtga

SEQ ID NO: 761708 - DNA, 20 bp, Artificial
  CRISPR gRNA sequence
gtgactggtaagtgggtgag

SEQ ID NO: 761709 - DNA, 20 bp, Artificial
  CRISPR gRNA sequence
gtaagtgggtgagaggacat

SEQ ID NO: 761710 - DNA, 20 bp, Artificial
  CRISPR gRNA sequence
agtgggtgagaggacattgg

SEQ ID NO: 761711 - DNA, 20 bp, Artificial
  CRISPR gRNA sequence
gtgggtgagaggacattggt

SEQ ID NO: 761712 - DNA, 20 bp, Artificial
  CRISPR gRNA sequence
ggtgagaggacattggtggg

SEQ ID NO: 761713 - DNA, 20 bp, Artificial
  CRISPR gRNA sequence
agaggacattggtgggtggt

SEQ ID NO: 761714 - DNA, 20 bp, Artificial
  CRISPR gRNA sequence
ggtgggtggtgagttgaccc

SEQ ID NO: 761715 - DNA, 20 bp, Artificial
  CRISPR gRNA sequence
gggtggtgagttgaccctgg

SEQ ID NO: 761716 - DNA, 20 bp, Artificial
  CRISPR gRNA sequence
ggtggtgagttgaccctggt

SEQ ID NO: 761717 - DNA, 20 bp, Artificial
  CRISPR gRNA sequence
agttgaccctggtgggtaaa

SEQ ID NO: 761718 - DNA, 20 bp, Artificial
  CRISPR gRNA sequence
tggtgggtaaacagatgcat

SEQ ID NO: 761719 - DNA, 20 bp, Artificial
  CRISPR gRNA sequence
gtgggtaaacagatgcatga

SEQ ID NO: 761720 - DNA, 20 bp, Artificial
  CRISPR gRNA sequence
ggtaaacagatgcatgagag

SEQ ID NO: 761721 - DNA, 20 bp, Artificial
  CRISPR gRNA sequence
aacagatgcatgagagtaga

SEQ ID NO: 761722 - DNA, 20 bp, Artificial
  CRISPR gRNA sequence
acagatgcatgagagtagat

SEQ ID NO: 761723 - DNA, 20 bp, Artificial
  CRISPR gRNA sequence
gatgcatgagagtagatggg

SEQ ID NO: 761724 - DNA, 20 bp, Artificial
  CRISPR gRNA sequence
catgagagtagatgggtagt

SEQ ID NO: 761725 - DNA, 20 bp, Artificial
  CRISPR gRNA sequence
tgagagtagatgggtagtca

SEQ ID NO: 761726 - DNA, 20 bp, Artificial
  CRISPR gRNA sequence
gagagtagatgggtagtcag

SEQ ID NO: 761727 - DNA, 20 bp, Artificial
  CRISPR gRNA sequence
gtagatgggtagtcagaggc

SEQ ID NO: 761728 - DNA, 20 bp, Artificial
  CRISPR gRNA sequence
tagatgggtagtcagaggct

SEQ ID NO: 761729 - DNA, 20 bp, Artificial
  CRISPR gRNA sequence
agatgggtagtcagaggctg

SEQ ID NO: 761730 - DNA, 20 bp, Artificial
  CRISPR gRNA sequence
gggtagtcagaggctgggga

SEQ ID NO: 761731 - DNA, 20 bp, Artificial
  CRISPR gRNA sequence
agtcagaggctggggatggc

SEQ ID NO: 761732 - DNA, 20 bp, Artificial
  CRISPR gRNA sequence
tcagaggctggggatggctg

SEQ ID NO: 761733 - DNA, 20 bp, Artificial
  CRISPR gRNA sequence
cagaggctggggatggctgg

SEQ ID NO: 761734 - DNA, 20 bp, Artificial
  CRISPR gRNA sequence
ggctggggatggctggaggt

SEQ ID NO: 761735 - DNA, 20 bp, Artificial
  CRISPR gRNA sequence
gctggggatggctggaggtt

SEQ ID NO: 761736 - DNA, 20 bp, Artificial
  CRISPR gRNA sequence
ggggatggctggaggttggg

SEQ ID NO: 761737 - DNA, 20 bp, Artificial
  CRISPR gRNA sequence
gggatggctggaggttggga

SEQ ID NO: 761738 - DNA, 20 bp, Artificial
  CRISPR gRNA sequence
gatggctggaggttgggaag

SEQ ID NO: 761739 - DNA, 20 bp, Artificial
  CRISPR gRNA sequence
tggctggaggttgggaagga

SEQ ID NO: 761740 - DNA, 20 bp, Artificial
  CRISPR gRNA sequence
ggctggaggttgggaaggag

SEQ ID NO: 761741 - DNA, 20 bp, Artificial
  CRISPR gRNA sequence
gctggaggttgggaaggaga

SEQ ID NO: 761742 - DNA, 20 bp, Artificial
  CRISPR gRNA sequence
ggaggttgggaaggagaggg

SEQ ID NO: 761743 - DNA, 20 bp, Artificial
  CRISPR gRNA sequence
ggttgggaaggagagggaag

SEQ ID NO: 761744 - DNA, 20 bp, Artificial
  CRISPR gRNA sequence
ttgggaaggagagggaagaa

SEQ ID NO: 761745 - DNA, 20 bp, Artificial
  CRISPR gRNA sequence
ggaaggagagggaagaagag

SEQ ID NO: 761746 - DNA, 20 bp, Artificial
  CRISPR gRNA sequence
ggagagggaagaagagtggt

SEQ ID NO: 761747 - DNA, 20 bp, Artificial
  CRISPR gRNA sequence
agggaagaagagtggtcagt

SEQ ID NO: 761748 - DNA, 20 bp, Artificial
  CRISPR gRNA sequence
gaagaagagtggtcagttgg

SEQ ID NO: 761749 - DNA, 20 bp, Artificial
  CRISPR gRNA sequence
aagagtggtcagttggcaga

SEQ ID NO: 761750 - DNA, 20 bp, Artificial
  CRISPR gRNA sequence
agagtggtcagttggcagat

SEQ ID NO: 761751 - DNA, 20 bp, Artificial
  CRISPR gRNA sequence
tggtcagttggcagataggt

SEQ ID NO: 761752 - DNA, 20 bp, Artificial
  CRISPR gRNA sequence
gcagataggtgagtacttgt

SEQ ID NO: 761753 - DNA, 20 bp, Artificial
  CRISPR gRNA sequence
cagataggtgagtacttgtg

SEQ ID NO: 761754 - DNA, 20 bp, Artificial
  CRISPR gRNA sequence
ataggtgagtacttgtgagg

SEQ ID NO: 761755 - DNA, 20 bp, Artificial
  CRISPR gRNA sequence
gtgagtacttgtgaggtaga

SEQ ID NO: 761756 - DNA, 20 bp, Artificial
  CRISPR gRNA sequence
tgagtacttgtgaggtagac

SEQ ID NO: 761757 - DNA, 20 bp, Artificial
  CRISPR gRNA sequence
gtacttgtgaggtagacagg

SEQ ID NO: 761758 - DNA, 20 bp, Artificial
  CRISPR gRNA sequence
cttgtgaggtagacaggtgg

SEQ ID NO: 761759 - DNA, 20 bp, Artificial
  CRISPR gRNA sequence
ttgtgaggtagacaggtgga

SEQ ID NO: 761760 - DNA, 20 bp, Artificial
  CRISPR gRNA sequence
aggtagacaggtggaaggat

SEQ ID NO: 761761 - DNA, 20 bp, Artificial
  CRISPR gRNA sequence
tagacaggtggaaggatgag

SEQ ID NO: 761762 - DNA, 20 bp, Artificial
  CRISPR gRNA sequence
agacaggtggaaggatgagc

SEQ ID NO: 761763 - DNA, 20 bp, Artificial
  CRISPR gRNA sequence
caggtggaaggatgagcagg

SEQ ID NO: 761764 - DNA, 20 bp, Artificial
  CRISPR gRNA sequence
tggaaggatgagcaggtaga

SEQ ID NO: 761765 - DNA, 20 bp, Artificial
  CRISPR gRNA sequence
aggatgagcaggtagacggc

SEQ ID NO: 761766 - DNA, 20 bp, Artificial
  CRISPR gRNA sequence
tgagcaggtagacggctggt

SEQ ID NO: 761767 - DNA, 20 bp, Artificial
  CRISPR gRNA sequence
ggctggttggttacatctgt

SEQ ID NO: 761768 - DNA, 20 bp, Artificial
  CRISPR gRNA sequence
ctggttggttacatctgttg

SEQ ID NO: 761769 - DNA, 20 bp, Artificial
  CRISPR gRNA sequence
tggttggttacatctgttgg

SEQ ID NO: 761770 - DNA, 20 bp, Artificial
  CRISPR gRNA sequence
ttacatctgttggaggttga

SEQ ID NO: 761771 - DNA, 20 bp, Artificial
  CRISPR gRNA sequence
atctgttggaggttgatggt

SEQ ID NO: 761772 - DNA, 20 bp, Artificial
  CRISPR gRNA sequence
tgttggaggttgatggttgg

SEQ ID NO: 761773 - DNA, 20 bp, Artificial
  CRISPR gRNA sequence
gttggaggttgatggttggc

SEQ ID NO: 761774 - DNA, 20 bp, Artificial
  CRISPR gRNA sequence
ttggaggttgatggttggca

SEQ ID NO: 761775 - DNA, 20 bp, Artificial
  CRISPR gRNA sequence
tgatggttggcagggctact

SEQ ID NO: 761776 - DNA, 20 bp, Artificial
  CRISPR gRNA sequence
ggttggcagggctactgagc

SEQ ID NO: 761777 - DNA, 20 bp, Artificial
  CRISPR gRNA sequence
tggcagggctactgagcgag

SEQ ID NO: 761778 - DNA, 20 bp, Artificial
  CRISPR gRNA sequence
agggctactgagcgagcgga

SEQ ID NO: 761779 - DNA, 20 bp, Artificial
  CRISPR gRNA sequence
gggctactgagcgagcggat

SEQ ID NO: 761780 - DNA, 20 bp, Artificial
  CRISPR gRNA sequence
tactgagcgagcggatgggt

SEQ ID NO: 761781 - DNA, 20 bp, Artificial
  CRISPR gRNA sequence
actgagcgagcggatgggtg

SEQ ID NO: 761782 - DNA, 20 bp, Artificial
  CRISPR gRNA sequence
cgagcggatgggtgaggtga

SEQ ID NO: 761783 - DNA, 20 bp, Artificial
  CRISPR gRNA sequence
gagcggatgggtgaggtgat

SEQ ID NO: 761784 - DNA, 20 bp, Artificial
  CRISPR gRNA sequence
cggatgggtgaggtgatggg

SEQ ID NO: 761785 - DNA, 20 bp, Artificial
  CRISPR gRNA sequence
ggatgggtgaggtgatgggt

SEQ ID NO: 761786 - DNA, 20 bp, Artificial
  CRISPR gRNA sequence
tgggtgaggtgatgggtggg

SEQ ID NO: 761787 - DNA, 20 bp, Artificial
  CRISPR gRNA sequence
gggtgaggtgatgggtgggt

SEQ ID NO: 761788 - DNA, 20 bp, Artificial
  CRISPR gRNA sequence
gaggtgatgggtgggtgggc

SEQ ID NO: 761789 - DNA, 20 bp, Artificial
  CRISPR gRNA sequence
gtgatgggtgggtgggctgg

SEQ ID NO: 761790 - DNA, 20 bp, Artificial
  CRISPR gRNA sequence
gatgggtgggtgggctggtg

SEQ ID NO: 761791 - DNA, 20 bp, Artificial
  CRISPR gRNA sequence
atgggtgggtgggctggtgg

SEQ ID NO: 761792 - DNA, 20 bp, Artificial
  CRISPR gRNA sequence
tgggtgggtgggctggtgga

SEQ ID NO: 761793 - DNA, 20 bp, Artificial
  CRISPR gRNA sequence
gtgggtgggctggtggaggg

SEQ ID NO: 761794 - DNA, 20 bp, Artificial
  CRISPR gRNA sequence
tgggtgggctggtggagggt

SEQ ID NO: 761795 - DNA, 20 bp, Artificial
  CRISPR gRNA sequence
gtgggctggtggagggtagg

SEQ ID NO: 761796 - DNA, 20 bp, Artificial
  CRISPR gRNA sequence
gctggtggagggtaggtgga

SEQ ID NO: 761797 - DNA, 20 bp, Artificial
  CRISPR gRNA sequence
gagggtaggtggatggtctt

SEQ ID NO: 761798 - DNA, 20 bp, Artificial
  CRISPR gRNA sequence
gtaggtggatggtctttggc

SEQ ID NO: 761799 - DNA, 20 bp, Artificial
  CRISPR gRNA sequence
taggtggatggtctttggct

SEQ ID NO: 761800 - DNA, 20 bp, Artificial
  CRISPR gRNA sequence
atggtctttggctgggtgtg

SEQ ID NO: 761801 - DNA, 20 bp, Artificial
  CRISPR gRNA sequence
gtctttggctgggtgtgtgg

SEQ ID NO: 761802 - DNA, 20 bp, Artificial
  CRISPR gRNA sequence
tctttggctgggtgtgtggc

SEQ ID NO: 761803 - DNA, 20 bp, Artificial
  CRISPR gRNA sequence
ctttggctgggtgtgtggcg

SEQ ID NO: 761804 - DNA, 20 bp, Artificial
  CRISPR gRNA sequence
tttggctgggtgtgtggcgg

SEQ ID NO: 761805 - DNA, 20 bp, Artificial
  CRISPR gRNA sequence
tgggtgtgtggcgggggctc

SEQ ID NO: 761806 - DNA, 20 bp, Artificial
  CRISPR gRNA sequence
gggtgtgtggcgggggctcc

SEQ ID NO: 761807 - DNA, 20 bp, Artificial
  CRISPR gRNA sequence
tgtggcgggggctccaggtt

SEQ ID NO: 761808 - DNA, 20 bp, Artificial
  CRISPR gRNA sequence
ggcgggggctccaggttgag

SEQ ID NO: 761809 - DNA, 20 bp, Artificial
  CRISPR gRNA sequence
ggggctccaggttgagtgga

SEQ ID NO: 761810 - DNA, 20 bp, Artificial
  CRISPR gRNA sequence
caggttgagtggatggtctt

SEQ ID NO: 761811 - DNA, 20 bp, Artificial
  CRISPR gRNA sequence
ttgagtggatggtctttggc

SEQ ID NO: 761812 - DNA, 20 bp, Artificial
  CRISPR gRNA sequence
tgagtggatggtctttggct

SEQ ID NO: 761813 - DNA, 20 bp, Artificial
  CRISPR gRNA sequence
tggatggtctttggctgggt

SEQ ID NO: 761814 - DNA, 20 bp, Artificial
  CRISPR gRNA sequence
atggtctttggctgggtgag

SEQ ID NO: 761815 - DNA, 20 bp, Artificial
  CRISPR gRNA sequence
gtctttggctgggtgagtgg

SEQ ID NO: 761816 - DNA, 20 bp, Artificial
  CRISPR gRNA sequence
tctttggctgggtgagtggt

SEQ ID NO: 761817 - DNA, 20 bp, Artificial
  CRISPR gRNA sequence
gctgggtgagtggtgggctc

SEQ ID NO: 761818 - DNA, 20 bp, Artificial
  CRISPR gRNA sequence
ctgggtgagtggtgggctcc

SEQ ID NO: 761819 - DNA, 20 bp, Artificial
  CRISPR gRNA sequence
gtgagtggtgggctccaggc

SEQ ID NO: 761820 - DNA, 20 bp, Artificial
  CRISPR gRNA sequence
tgagtggtgggctccaggct

SEQ ID NO: 761821 - DNA, 20 bp, Artificial
  CRISPR gRNA sequence
gtggtgggctccaggctggg

SEQ ID NO: 761822 - DNA, 20 bp, Artificial
  CRISPR gRNA sequence
tgggctccaggctgggtgga

SEQ ID NO: 761823 - DNA, 20 bp, Artificial
  CRISPR gRNA sequence
ctgggtggatggtccttgac

SEQ ID NO: 761824 - DNA, 20 bp, Artificial
  CRISPR gRNA sequence
tgggtggatggtccttgact

SEQ ID NO: 761825 - DNA, 20 bp, Artificial
  CRISPR gRNA sequence
tggatggtccttgactgggt

SEQ ID NO: 761826 - DNA, 20 bp, Artificial
  CRISPR gRNA sequence
atggtccttgactgggtaag

SEQ ID NO: 761827 - DNA, 20 bp, Artificial
  CRISPR gRNA sequence
actgggtaagtggtgcactc

SEQ ID NO: 761828 - DNA, 20 bp, Artificial
  CRISPR gRNA sequence
ctgggtaagtggtgcactcc

SEQ ID NO: 761829 - DNA, 20 bp, Artificial
  CRISPR gRNA sequence
gtaagtggtgcactccaggc

SEQ ID NO: 761830 - DNA, 20 bp, Artificial
  CRISPR gRNA sequence
taagtggtgcactccaggct

SEQ ID NO: 761831 - DNA, 20 bp, Artificial
  CRISPR gRNA sequence
gtggtgcactccaggctggg

SEQ ID NO: 761832 - DNA, 20 bp, Artificial
  CRISPR gRNA sequence
tgcactccaggctgggtgga

SEQ ID NO: 761833 - DNA, 20 bp, Artificial
  CRISPR gRNA sequence
caggctgggtggatggtctt

SEQ ID NO: 761834 - DNA, 20 bp, Artificial
  CRISPR gRNA sequence
ctgggtggatggtctttggc

SEQ ID NO: 761835 - DNA, 20 bp, Artificial
  CRISPR gRNA sequence
tgggtggatggtctttggct

SEQ ID NO: 761836 - DNA, 20 bp, Artificial
  CRISPR gRNA sequence
tggatggtctttggctgggt

SEQ ID NO: 761837 - DNA, 20 bp, Artificial
  CRISPR gRNA sequence
atggtctttggctgggtgag

SEQ ID NO: 761838 - DNA, 20 bp, Artificial
  CRISPR gRNA sequence
gtctttggctgggtgagtgg

SEQ ID NO: 761839 - DNA, 20 bp, Artificial
  CRISPR gRNA sequence
tctttggctgggtgagtggt

SEQ ID NO: 761840 - DNA, 20 bp, Artificial
  CRISPR gRNA sequence
ctttggctgggtgagtggtg

SEQ ID NO: 761841 - DNA, 20 bp, Artificial
  CRISPR gRNA sequence
tttggctgggtgagtggtgg

SEQ ID NO: 761842 - DNA, 20 bp, Artificial
  CRISPR gRNA sequence
tgggtgagtggtgggggcgc

SEQ ID NO: 761843 - DNA, 20 bp, Artificial
  CRISPR gRNA sequence
gggtgagtggtgggggcgcc

SEQ ID NO: 761844 - DNA, 20 bp, Artificial
  CRISPR gRNA sequence
gagtggtgggggcgccaggc

SEQ ID NO: 761845 - DNA, 20 bp, Artificial
  CRISPR gRNA sequence
agtggtgggggcgccaggct

SEQ ID NO: 761846 - DNA, 20 bp, Artificial
  CRISPR gRNA sequence
ggtgggggcgccaggctggg

SEQ ID NO: 761847 - DNA, 20 bp, Artificial
  CRISPR gRNA sequence
gcgccaggctgggtagtttt

SEQ ID NO: 761848 - DNA, 20 bp, Artificial
  CRISPR gRNA sequence
caggctgggtagtttttggc

SEQ ID NO: 761849 - DNA, 20 bp, Artificial
  CRISPR gRNA sequence
aggctgggtagtttttggct

SEQ ID NO: 761850 - DNA, 20 bp, Artificial
  CRISPR gRNA sequence
tgggtagtttttggctgggt

SEQ ID NO: 761851 - DNA, 20 bp, Artificial
  CRISPR gRNA sequence
gtagtttttggctgggtgag

SEQ ID NO: 761852 - DNA, 20 bp, Artificial
  CRISPR gRNA sequence
gtttttggctgggtgagtgg

SEQ ID NO: 761853 - DNA, 20 bp, Artificial
  CRISPR gRNA sequence
tttttggctgggtgagtggt

SEQ ID NO: 761854 - DNA, 20 bp, Artificial
  CRISPR gRNA sequence
gctgggtgagtggtgggctc

SEQ ID NO: 761855 - DNA, 20 bp, Artificial
  CRISPR gRNA sequence
ctgggtgagtggtgggctcc

SEQ ID NO: 761856 - DNA, 20 bp, Artificial
  CRISPR gRNA sequence
gtgagtggtgggctccaggc

SEQ ID NO: 761857 - DNA, 20 bp, Artificial
  CRISPR gRNA sequence
tgagtggtgggctccaggct

SEQ ID NO: 761858 - DNA, 20 bp, Artificial
  CRISPR gRNA sequence
agtggtgggctccaggctgg

SEQ ID NO: 761859 - DNA, 20 bp, Artificial
  CRISPR gRNA sequence
ggagccccttcatgttgtca

SEQ ID NO: 761860 - DNA, 20 bp, Artificial
  CRISPR gRNA sequence
gagccccttcatgttgtcac

SEQ ID NO: 761861 - DNA, 20 bp, Artificial
  CRISPR gRNA sequence
ccttcatgttgtcacaggct

SEQ ID NO: 761862 - DNA, 20 bp, Artificial
  CRISPR gRNA sequence
gctctgctgtgctctgctct

SEQ ID NO: 761863 - DNA, 20 bp, Artificial
  CRISPR gRNA sequence
ctctgctgtgctctgctctc

SEQ ID NO: 761864 - DNA, 20 bp, Artificial
  CRISPR gRNA sequence
ctcgggctctaacccgtgtc

SEQ ID NO: 761865 - DNA, 20 bp, Artificial
  CRISPR gRNA sequence
tctaacccgtgtctagcatt

SEQ ID NO: 761866 - DNA, 20 bp, Artificial
  CRISPR gRNA sequence
cgtgtctagcatttggtccg

SEQ ID NO: 761867 - DNA, 20 bp, Artificial
  CRISPR gRNA sequence
gtgtctagcatttggtccgc

SEQ ID NO: 761868 - DNA, 20 bp, Artificial
  CRISPR gRNA sequence
ctagcatttggtccgcaggt

SEQ ID NO: 761869 - DNA, 20 bp, Artificial
  CRISPR gRNA sequence
tagcatttggtccgcaggtc

SEQ ID NO: 761870 - DNA, 20 bp, Artificial
  CRISPR gRNA sequence
gtccgcaggtcaggcccact

SEQ ID NO: 761871 - DNA, 20 bp, Artificial
  CRISPR gRNA sequence
tccgcaggtcaggcccactc

SEQ ID NO: 761872 - DNA, 20 bp, Artificial
  CRISPR gRNA sequence
cccactcaggccctgttcac

SEQ ID NO: 761873 - DNA, 20 bp, Artificial
  CRISPR gRNA sequence
tcaccagcttcctgcactct

SEQ ID NO: 761874 - DNA, 20 bp, Artificial
  CRISPR gRNA sequence
caccagcttcctgcactctc

SEQ ID NO: 761875 - DNA, 20 bp, Artificial
  CRISPR gRNA sequence
cagcttcctgcactctcagg

SEQ ID NO: 761876 - DNA, 20 bp, Artificial
  CRISPR gRNA sequence
agcttcctgcactctcaggt

SEQ ID NO: 761877 - DNA, 20 bp, Artificial
  CRISPR gRNA sequence
tcctgcactctcaggtggga

SEQ ID NO: 761878 - DNA, 20 bp, Artificial
  CRISPR gRNA sequence
actctcaggtgggaaagtgc

SEQ ID NO: 761879 - DNA, 20 bp, Artificial
  CRISPR gRNA sequence
ggaaagtgctggcatgaaaa

SEQ ID NO: 761880 - DNA, 20 bp, Artificial
  CRISPR gRNA sequence
gaaagtgctggcatgaaaat

SEQ ID NO: 761881 - DNA, 20 bp, Artificial
  CRISPR gRNA sequence
gcatgaaaatgggcttgcaa

SEQ ID NO: 761882 - DNA, 20 bp, Artificial
  CRISPR gRNA sequence
aaaagatttttgtttattct

SEQ ID NO: 761883 - DNA, 20 bp, Artificial
  CRISPR gRNA sequence
attctgagttcttgcctttg

SEQ ID NO: 761884 - DNA, 20 bp, Artificial
  CRISPR gRNA sequence
ttctgagttcttgcctttgc

SEQ ID NO: 761885 - DNA, 20 bp, Artificial
  CRISPR gRNA sequence
ctgagttcttgcctttgcag

SEQ ID NO: 761886 - DNA, 20 bp, Artificial
  CRISPR gRNA sequence
ttcttgcctttgcaggagct

SEQ ID NO: 761887 - DNA, 20 bp, Artificial
  CRISPR gRNA sequence
tcttgcctttgcaggagctg

SEQ ID NO: 761888 - DNA, 20 bp, Artificial
  CRISPR gRNA sequence
cctttgcaggagctgaggac

SEQ ID NO: 761889 - DNA, 20 bp, Artificial
  CRISPR gRNA sequence
ctttgcaggagctgaggacc

SEQ ID NO: 761890 - DNA, 20 bp, Artificial
  CRISPR gRNA sequence
gcaggagctgaggaccagga

SEQ ID NO: 761891 - DNA, 20 bp, Artificial
  CRISPR gRNA sequence
caggagctgaggaccaggat

SEQ ID NO: 761892 - DNA, 20 bp, Artificial
  CRISPR gRNA sequence
aggagctgaggaccaggatg

SEQ ID NO: 761893 - DNA, 20 bp, Artificial
  CRISPR gRNA sequence
gagctgaggaccaggatggg

SEQ ID NO: 761894 - DNA, 20 bp, Artificial
  CRISPR gRNA sequence
agctgaggaccaggatgggg

SEQ ID NO: 761895 - DNA, 20 bp, Artificial
  CRISPR gRNA sequence
gctgaggaccaggatgggga

SEQ ID NO: 761896 - DNA, 20 bp, Artificial
  CRISPR gRNA sequence
tgaggaccaggatggggagg

SEQ ID NO: 761897 - DNA, 20 bp, Artificial
  CRISPR gRNA sequence
ggaccaggatggggagggag

SEQ ID NO: 761898 - DNA, 20 bp, Artificial
  CRISPR gRNA sequence
gaccaggatggggagggaga

SEQ ID NO: 761899 - DNA, 20 bp, Artificial
  CRISPR gRNA sequence
atggggagggagaaggctcc

SEQ ID NO: 761900 - DNA, 20 bp, Artificial
  CRISPR gRNA sequence
ggagggagaaggctccaaga

SEQ ID NO: 761901 - DNA, 20 bp, Artificial
  CRISPR gRNA sequence
gagggagaaggctccaagac

SEQ ID NO: 761902 - DNA, 20 bp, Artificial
  CRISPR gRNA sequence
gagaaggctccaagacaggt

SEQ ID NO: 761903 - DNA, 20 bp, Artificial
  CRISPR gRNA sequence
aagacaggtgagtctgaact

SEQ ID NO: 761904 - DNA, 20 bp, Artificial
  CRISPR gRNA sequence
gacaggtgagtctgaacttg

SEQ ID NO: 761905 - DNA, 20 bp, Artificial
  CRISPR gRNA sequence
ggtgagtctgaacttggagc

SEQ ID NO: 761906 - DNA, 20 bp, Artificial
  CRISPR gRNA sequence
gaacttggagctggccctct

SEQ ID NO: 761907 - DNA, 20 bp, Artificial
  CRISPR gRNA sequence
ttggagctggccctcttggc

SEQ ID NO: 761908 - DNA, 20 bp, Artificial
  CRISPR gRNA sequence
tggagctggccctcttggct

SEQ ID NO: 761909 - DNA, 20 bp, Artificial
  CRISPR gRNA sequence
gagctggccctcttggctgg

SEQ ID NO: 761910 - DNA, 20 bp, Artificial
  CRISPR gRNA sequence
gctggccctcttggctggga

SEQ ID NO: 761911 - DNA, 20 bp, Artificial
  CRISPR gRNA sequence
ctggccctcttggctgggag

SEQ ID NO: 761912 - DNA, 20 bp, Artificial
  CRISPR gRNA sequence
tggccctcttggctgggaga

SEQ ID NO: 761913 - DNA, 20 bp, Artificial
  CRISPR gRNA sequence
ttggctgggagagggacata

SEQ ID NO: 761914 - DNA, 20 bp, Artificial
  CRISPR gRNA sequence
tggctgggagagggacatat

SEQ ID NO: 761915 - DNA, 20 bp, Artificial
  CRISPR gRNA sequence
tgggagagggacatatggga

SEQ ID NO: 761916 - DNA, 20 bp, Artificial
  CRISPR gRNA sequence
gggagagggacatatgggaa

SEQ ID NO: 761917 - DNA, 20 bp, Artificial
  CRISPR gRNA sequence
gagagggacatatgggaaag

SEQ ID NO: 761918 - DNA, 20 bp, Artificial
  CRISPR gRNA sequence
gagggacatatgggaaagga

SEQ ID NO: 761919 - DNA, 20 bp, Artificial
  CRISPR gRNA sequence
gggacatatgggaaaggaga

SEQ ID NO: 761920 - DNA, 20 bp, Artificial
  CRISPR gRNA sequence
ggacatatgggaaaggagag

SEQ ID NO: 761921 - DNA, 20 bp, Artificial
  CRISPR gRNA sequence
tgggaaaggagagaggactc

SEQ ID NO: 761922 - DNA, 20 bp, Artificial
  CRISPR gRNA sequence
gggaaaggagagaggactct

SEQ ID NO: 761923 - DNA, 20 bp, Artificial
  CRISPR gRNA sequence
ggagagaggactctaggatc

SEQ ID NO: 761924 - DNA, 20 bp, Artificial
  CRISPR gRNA sequence
agagaggactctaggatctg

SEQ ID NO: 761925 - DNA, 20 bp, Artificial
  CRISPR gRNA sequence
gagaggactctaggatctgg

SEQ ID NO: 761926 - DNA, 20 bp, Artificial
  CRISPR gRNA sequence
agaggactctaggatctgga

SEQ ID NO: 761927 - DNA, 20 bp, Artificial
  CRISPR gRNA sequence
gaggactctaggatctggag

SEQ ID NO: 761928 - DNA, 20 bp, Artificial
  CRISPR gRNA sequence
actctaggatctggaggggc

SEQ ID NO: 761929 - DNA, 20 bp, Artificial
  CRISPR gRNA sequence
ggaggggccagatttgctgt

SEQ ID NO: 761930 - DNA, 20 bp, Artificial
  CRISPR gRNA sequence
gaggggccagatttgctgta

SEQ ID NO: 761931 - DNA, 20 bp, Artificial
  CRISPR gRNA sequence
tttgaatgaaatgtgttctg

SEQ ID NO: 761932 - DNA, 20 bp, Artificial
  CRISPR gRNA sequence
tgaaatgtgttctgtggact

SEQ ID NO: 761933 - DNA, 20 bp, Artificial
  CRISPR gRNA sequence
ggactcagacctccccaccc

SEQ ID NO: 761934 - DNA, 20 bp, Artificial
  CRISPR gRNA sequence
tcagacctccccaccccggt

SEQ ID NO: 761935 - DNA, 20 bp, Artificial
  CRISPR gRNA sequence
cggtgagtctgctctttgcc

SEQ ID NO: 761936 - DNA, 20 bp, Artificial
  CRISPR gRNA sequence
gtgagtctgctctttgccca

SEQ ID NO: 761937 - DNA, 20 bp, Artificial
  CRISPR gRNA sequence
gtctgctctttgcccagagt

SEQ ID NO: 761938 - DNA, 20 bp, Artificial
  CRISPR gRNA sequence
tctgctctttgcccagagtt

SEQ ID NO: 761939 - DNA, 20 bp, Artificial
  CRISPR gRNA sequence
gctctttgcccagagttagg

SEQ ID NO: 761940 - DNA, 20 bp, Artificial
  CRISPR gRNA sequence
ctctttgcccagagttaggc

SEQ ID NO: 761941 - DNA, 20 bp, Artificial
  CRISPR gRNA sequence
tttgcccagagttaggcagg

SEQ ID NO: 761942 - DNA, 20 bp, Artificial
  CRISPR gRNA sequence
gcccagagttaggcaggaag

SEQ ID NO: 761943 - DNA, 20 bp, Artificial
  CRISPR gRNA sequence
taggcaggaagtggatcacc

SEQ ID NO: 761944 - DNA, 20 bp, Artificial
  CRISPR gRNA sequence
tggatcacccagttccctcc

SEQ ID NO: 761945 - DNA, 20 bp, Artificial
  CRISPR gRNA sequence
ggatcacccagttccctccc

SEQ ID NO: 761946 - DNA, 20 bp, Artificial
  CRISPR gRNA sequence
acccagttccctcccaggtg

SEQ ID NO: 761947 - DNA, 20 bp, Artificial
  CRISPR gRNA sequence
gccaacctttacccatctgc

SEQ ID NO: 761948 - DNA, 20 bp, Artificial
  CRISPR gRNA sequence
ccaacctttacccatctgcc

SEQ ID NO: 761949 - DNA, 20 bp, Artificial
  CRISPR gRNA sequence
caacctttacccatctgcca

SEQ ID NO: 761950 - DNA, 20 bp, Artificial
  CRISPR gRNA sequence
cagggccgattccacctgat

SEQ ID NO: 761951 - DNA, 20 bp, Artificial
  CRISPR gRNA sequence
acctgattggccccacaccg

SEQ ID NO: 761952 - DNA, 20 bp, Artificial
  CRISPR gRNA sequence
ctgattggccccacaccgtg

SEQ ID NO: 761953 - DNA, 20 bp, Artificial
  CRISPR gRNA sequence
tggccccacaccgtggagtc

SEQ ID NO: 761954 - DNA, 20 bp, Artificial
  CRISPR gRNA sequence
ccccacaccgtggagtctgg

SEQ ID NO: 761955 - DNA, 20 bp, Artificial
  CRISPR gRNA sequence
cgtggagtctggtggcttcc

SEQ ID NO: 761956 - DNA, 20 bp, Artificial
  CRISPR gRNA sequence
gtggagtctggtggcttcct

SEQ ID NO: 761957 - DNA, 20 bp, Artificial
  CRISPR gRNA sequence
tggagtctggtggcttccta

SEQ ID NO: 761958 - DNA, 20 bp, Artificial
  CRISPR gRNA sequence
ggagtctggtggcttcctag

SEQ ID NO: 761959 - DNA, 20 bp, Artificial
  CRISPR gRNA sequence
gtctggtggcttcctagggg

SEQ ID NO: 761960 - DNA, 20 bp, Artificial
  CRISPR gRNA sequence
tctggtggcttcctaggggt

SEQ ID NO: 761961 - DNA, 20 bp, Artificial
  CRISPR gRNA sequence
tggtggcttcctaggggtgg

SEQ ID NO: 761962 - DNA, 20 bp, Artificial
  CRISPR gRNA sequence
tggcttcctaggggtgggag

SEQ ID NO: 761963 - DNA, 20 bp, Artificial
  CRISPR gRNA sequence
ggcttcctaggggtgggagc

SEQ ID NO: 761964 - DNA, 20 bp, Artificial
  CRISPR gRNA sequence
gcttcctaggggtgggagca

SEQ ID NO: 761965 - DNA, 20 bp, Artificial
  CRISPR gRNA sequence
cttcctaggggtgggagcag

SEQ ID NO: 761966 - DNA, 20 bp, Artificial
  CRISPR gRNA sequence
aggggtgggagcaggggctc

SEQ ID NO: 761967 - DNA, 20 bp, Artificial
  CRISPR gRNA sequence
gggtgggagcaggggctccg

SEQ ID NO: 761968 - DNA, 20 bp, Artificial
  CRISPR gRNA sequence
gggagcaggggctccggaga

SEQ ID NO: 761969 - DNA, 20 bp, Artificial
  CRISPR gRNA sequence
ggagcaggggctccggagat

SEQ ID NO: 761970 - DNA, 20 bp, Artificial
  CRISPR gRNA sequence
gagcaggggctccggagata

SEQ ID NO: 761971 - DNA, 20 bp, Artificial
  CRISPR gRNA sequence
gcaggggctccggagatagg

SEQ ID NO: 761972 - DNA, 20 bp, Artificial
  CRISPR gRNA sequence
ggctccggagatagggagtc

SEQ ID NO: 761973 - DNA, 20 bp, Artificial
  CRISPR gRNA sequence
gctccggagatagggagtct

SEQ ID NO: 761974 - DNA, 20 bp, Artificial
  CRISPR gRNA sequence
gagatagggagtctgggttt

SEQ ID NO: 761975 - DNA, 20 bp, Artificial
  CRISPR gRNA sequence
tttaagttcctgctccatct

SEQ ID NO: 761976 - DNA, 20 bp, Artificial
  CRISPR gRNA sequence
ttaagttcctgctccatctc

SEQ ID NO: 761977 - DNA, 20 bp, Artificial
  CRISPR gRNA sequence
cctgctccatctcaggtaaa

SEQ ID NO: 761978 - DNA, 20 bp, Artificial
  CRISPR gRNA sequence
tgctccatctcaggtaaaca

SEQ ID NO: 761979 - DNA, 20 bp, Artificial
  CRISPR gRNA sequence
tccatctcaggtaaacagag

SEQ ID NO: 761980 - DNA, 20 bp, Artificial
  CRISPR gRNA sequence
caggtaaacagagtggcctt

SEQ ID NO: 761981 - DNA, 20 bp, Artificial
  CRISPR gRNA sequence
taaacagagtggccttgagc

SEQ ID NO: 761982 - DNA, 20 bp, Artificial
  CRISPR gRNA sequence
agcaagatgctttgcctctc

SEQ ID NO: 761983 - DNA, 20 bp, Artificial
  CRISPR gRNA sequence
atgctttgcctctctggctt

SEQ ID NO: 761984 - DNA, 20 bp, Artificial
  CRISPR gRNA sequence
ggtttcctcttatgtaaaat

SEQ ID NO: 761985 - DNA, 20 bp, Artificial
  CRISPR gRNA sequence
gtttcctcttatgtaaaatg

SEQ ID NO: 761986 - DNA, 20 bp, Artificial
  CRISPR gRNA sequence
atgtaaaatgaggataatca

SEQ ID NO: 761987 - DNA, 20 bp, Artificial
  CRISPR gRNA sequence
tgaggataatcacagattca

SEQ ID NO: 761988 - DNA, 20 bp, Artificial
  CRISPR gRNA sequence
gaggataatcacagattcat

SEQ ID NO: 761989 - DNA, 20 bp, Artificial
  CRISPR gRNA sequence
ggttgtttgaattattaatt

SEQ ID NO: 761990 - DNA, 20 bp, Artificial
  CRISPR gRNA sequence
taattgagataatgtatata

SEQ ID NO: 761991 - DNA, 20 bp, Artificial
  CRISPR gRNA sequence
aattgagataatgtatataa

SEQ ID NO: 761992 - DNA, 20 bp, Artificial
  CRISPR gRNA sequence
gataatgtatataaaggacc

SEQ ID NO: 761993 - DNA, 20 bp, Artificial
  CRISPR gRNA sequence
aaaggacctagtatcatatc

SEQ ID NO: 761994 - DNA, 20 bp, Artificial
  CRISPR gRNA sequence
ctagtatcatatctagtgcc

SEQ ID NO: 761995 - DNA, 20 bp, Artificial
  CRISPR gRNA sequence
gtgccaagtgcttaatactc

SEQ ID NO: 761996 - DNA, 20 bp, Artificial
  CRISPR gRNA sequence
gccaagtgcttaatactctg

SEQ ID NO: 761997 - DNA, 20 bp, Artificial
  CRISPR gRNA sequence
ctctggagtcctattactat

SEQ ID NO: 761998 - DNA, 20 bp, Artificial
  CRISPR gRNA sequence
tctggagtcctattactatt

SEQ ID NO: 761999 - DNA, 20 bp, Artificial
  CRISPR gRNA sequence
tcctattactattaggcaaa

SEQ ID NO: 762000 - DNA, 20 bp, Artificial
  CRISPR gRNA sequence
tactattaggcaaacagctt

SEQ ID NO: 762001 - DNA, 20 bp, Artificial
  CRISPR gRNA sequence
agcttaagacaatactgttc

SEQ ID NO: 762002 - DNA, 20 bp, Artificial
  CRISPR gRNA sequence
agacaatactgttctagtta

SEQ ID NO: 762003 - DNA, 20 bp, Artificial
  CRISPR gRNA sequence
tgttctagttacagactgtg

SEQ ID NO: 762004 - DNA, 20 bp, Artificial
  CRISPR gRNA sequence
agttacagactgtgtagctt

SEQ ID NO: 762005 - DNA, 20 bp, Artificial
  CRISPR gRNA sequence
gttacagactgtgtagcttt

SEQ ID NO: 762006 - DNA, 20 bp, Artificial
  CRISPR gRNA sequence
cagactgtgtagctttgggc

SEQ ID NO: 762007 - DNA, 20 bp, Artificial
  CRISPR gRNA sequence
agactgtgtagctttgggca

SEQ ID NO: 762008 - DNA, 20 bp, Artificial
  CRISPR gRNA sequence
ggcaaggtgccttgctcctc

SEQ ID NO: 762009 - DNA, 20 bp, Artificial
  CRISPR gRNA sequence
gcaaggtgccttgctcctct

SEQ ID NO: 762010 - DNA, 20 bp, Artificial
  CRISPR gRNA sequence
tgccttgctcctctgggcat

SEQ ID NO: 762011 - DNA, 20 bp, Artificial
  CRISPR gRNA sequence
tcatcctgaccctgccctga

SEQ ID NO: 762012 - DNA, 20 bp, Artificial
  CRISPR gRNA sequence
tgaccctgccctgatggcac

SEQ ID NO: 762013 - DNA, 20 bp, Artificial
  CRISPR gRNA sequence
accctgccctgatggcacca

SEQ ID NO: 762014 - DNA, 20 bp, Artificial
  CRISPR gRNA sequence
ccctgccctgatggcaccag

SEQ ID NO: 762015 - DNA, 20 bp, Artificial
  CRISPR gRNA sequence
cctgccctgatggcaccaga

SEQ ID NO: 762016 - DNA, 20 bp, Artificial
  CRISPR gRNA sequence
ggcaccagagggctgttttg

SEQ ID NO: 762017 - DNA, 20 bp, Artificial
  CRISPR gRNA sequence
gggctgttttgaagctcttt

SEQ ID NO: 762018 - DNA, 20 bp, Artificial
  CRISPR gRNA sequence
ggctgttttgaagctctttc

SEQ ID NO: 762019 - DNA, 20 bp, Artificial
  CRISPR gRNA sequence
ttgaagctctttcaggtgac

SEQ ID NO: 762020 - DNA, 20 bp, Artificial
  CRISPR gRNA sequence
gaagctctttcaggtgactg

SEQ ID NO: 762021 - DNA, 20 bp, Artificial
  CRISPR gRNA sequence
agctctttcaggtgactgga

SEQ ID NO: 762022 - DNA, 20 bp, Artificial
  CRISPR gRNA sequence
gctctttcaggtgactggag

SEQ ID NO: 762023 - DNA, 20 bp, Artificial
  CRISPR gRNA sequence
ctctttcaggtgactggaga

SEQ ID NO: 762024 - DNA, 20 bp, Artificial
  CRISPR gRNA sequence
ctttcaggtgactggagagg

SEQ ID NO: 762025 - DNA, 20 bp, Artificial
  CRISPR gRNA sequence
tttcaggtgactggagaggg

SEQ ID NO: 762026 - DNA, 20 bp, Artificial
  CRISPR gRNA sequence
tggagagggaggtacttgca

SEQ ID NO: 762027 - DNA, 20 bp, Artificial
  CRISPR gRNA sequence
ggagagggaggtacttgcaa

SEQ ID NO: 762028 - DNA, 20 bp, Artificial
  CRISPR gRNA sequence
ggaggtacttgcaaaggaca

SEQ ID NO: 762029 - DNA, 20 bp, Artificial
  CRISPR gRNA sequence
gaggtacttgcaaaggacat

SEQ ID NO: 762030 - DNA, 20 bp, Artificial
  CRISPR gRNA sequence
ggtacttgcaaaggacatag

SEQ ID NO: 762031 - DNA, 20 bp, Artificial
  CRISPR gRNA sequence
ttgcaaaggacataggagca

SEQ ID NO: 762032 - DNA, 20 bp, Artificial
  CRISPR gRNA sequence
aaggacataggagcatggca

SEQ ID NO: 762033 - DNA, 20 bp, Artificial
  CRISPR gRNA sequence
acataggagcatggcacagt

SEQ ID NO: 762034 - DNA, 20 bp, Artificial
  CRISPR gRNA sequence
aggagcatggcacagtaagc

SEQ ID NO: 762035 - DNA, 20 bp, Artificial
  CRISPR gRNA sequence
ggagcatggcacagtaagct

SEQ ID NO: 762036 - DNA, 20 bp, Artificial
  CRISPR gRNA sequence
gagcatggcacagtaagctg

SEQ ID NO: 762037 - DNA, 20 bp, Artificial
  CRISPR gRNA sequence
agcatggcacagtaagctgg

SEQ ID NO: 762038 - DNA, 20 bp, Artificial
  CRISPR gRNA sequence
ggcacagtaagctgggggcc

SEQ ID NO: 762039 - DNA, 20 bp, Artificial
  CRISPR gRNA sequence
agtaagctgggggcccagct

SEQ ID NO: 762040 - DNA, 20 bp, Artificial
  CRISPR gRNA sequence
gtaagctgggggcccagctt

SEQ ID NO: 762041 - DNA, 20 bp, Artificial
  CRISPR gRNA sequence
agctgggggcccagcttggg

SEQ ID NO: 762042 - DNA, 20 bp, Artificial
  CRISPR gRNA sequence
gctgggggcccagcttgggt

SEQ ID NO: 762043 - DNA, 20 bp, Artificial
  CRISPR gRNA sequence
gcccagcttgggtgggtgcc

SEQ ID NO: 762044 - DNA, 20 bp, Artificial
  CRISPR gRNA sequence
cccagcttgggtgggtgcca

SEQ ID NO: 762045 - DNA, 20 bp, Artificial
  CRISPR gRNA sequence
ttgggtgggtgccaaggcac

SEQ ID NO: 762046 - DNA, 20 bp, Artificial
  CRISPR gRNA sequence
tgccaaggcactggtgccca

SEQ ID NO: 762047 - DNA, 20 bp, Artificial
  CRISPR gRNA sequence
tggtgcccatggccgactcc

SEQ ID NO: 762048 - DNA, 20 bp, Artificial
  CRISPR gRNA sequence
ggtgcccatggccgactccc

SEQ ID NO: 762049 - DNA, 20 bp, Artificial
  CRISPR gRNA sequence
gtgcccatggccgactccca

SEQ ID NO: 762050 - DNA, 20 bp, Artificial
  CRISPR gRNA sequence
tgcccatggccgactcccag

SEQ ID NO: 762051 - DNA, 20 bp, Artificial
  CRISPR gRNA sequence
ggccgactcccaggggatcc

SEQ ID NO: 762052 - DNA, 20 bp, Artificial
  CRISPR gRNA sequence
gccgactcccaggggatcct

SEQ ID NO: 762053 - DNA, 20 bp, Artificial
  CRISPR gRNA sequence
actcccaggggatcctgggc

SEQ ID NO: 762054 - DNA, 20 bp, Artificial
  CRISPR gRNA sequence
ctcccaggggatcctgggct

SEQ ID NO: 762055 - DNA, 20 bp, Artificial
  CRISPR gRNA sequence
cccaggggatcctgggctgg

SEQ ID NO: 762056 - DNA, 20 bp, Artificial
  CRISPR gRNA sequence
caggggatcctgggctggga

SEQ ID NO: 762057 - DNA, 20 bp, Artificial
  CRISPR gRNA sequence
aggggatcctgggctgggag

SEQ ID NO: 762058 - DNA, 20 bp, Artificial
  CRISPR gRNA sequence
ggatcctgggctgggagagg

SEQ ID NO: 762059 - DNA, 20 bp, Artificial
  CRISPR gRNA sequence
gatcctgggctgggagaggc

SEQ ID NO: 762060 - DNA, 20 bp, Artificial
  CRISPR gRNA sequence
gggagaggcaggtttccgct

SEQ ID NO: 762061 - DNA, 20 bp, Artificial
  CRISPR gRNA sequence
caggtttccgctgagccatt

SEQ ID NO: 762062 - DNA, 20 bp, Artificial
  CRISPR gRNA sequence
aggtttccgctgagccattt

SEQ ID NO: 762063 - DNA, 20 bp, Artificial
  CRISPR gRNA sequence
ttccgctgagccatttggga

SEQ ID NO: 762064 - DNA, 20 bp, Artificial
  CRISPR gRNA sequence
tgagccatttgggatggttc

SEQ ID NO: 762065 - DNA, 20 bp, Artificial
  CRISPR gRNA sequence
gggatggttccagttaatgc

SEQ ID NO: 762066 - DNA, 20 bp, Artificial
  CRISPR gRNA sequence
cagttccctccccacccccg

SEQ ID NO: 762067 - DNA, 20 bp, Artificial
  CRISPR gRNA sequence
ttccctccccacccccgcag

SEQ ID NO: 762068 - DNA, 20 bp, Artificial
  CRISPR gRNA sequence
tccctccccacccccgcaga

SEQ ID NO: 762069 - DNA, 20 bp, Artificial
  CRISPR gRNA sequence
ctccccacccccgcagaagg

SEQ ID NO: 762070 - DNA, 20 bp, Artificial
  CRISPR gRNA sequence
tccccacccccgcagaagga

SEQ ID NO: 762071 - DNA, 20 bp, Artificial
  CRISPR gRNA sequence
ccccacccccgcagaaggaa

SEQ ID NO: 762072 - DNA, 20 bp, Artificial
  CRISPR gRNA sequence
cacccccgcagaaggaaggg

SEQ ID NO: 762073 - DNA, 20 bp, Artificial
  CRISPR gRNA sequence
acccccgcagaaggaagggc

SEQ ID NO: 762074 - DNA, 20 bp, Artificial
  CRISPR gRNA sequence
ccccgcagaaggaagggcag

SEQ ID NO: 762075 - DNA, 20 bp, Artificial
  CRISPR gRNA sequence
aagggcaggagattgacact

SEQ ID NO: 762076 - DNA, 20 bp, Artificial
  CRISPR gRNA sequence
agggcaggagattgacactt

SEQ ID NO: 762077 - DNA, 20 bp, Artificial
  CRISPR gRNA sequence
gggcaggagattgacacttg

SEQ ID NO: 762078 - DNA, 20 bp, Artificial
  CRISPR gRNA sequence
ccaattaattctttgcctgt

SEQ ID NO: 762079 - DNA, 20 bp, Artificial
  CRISPR gRNA sequence
attctttgcctgttggtgcc

SEQ ID NO: 762080 - DNA, 20 bp, Artificial
  CRISPR gRNA sequence
ttgcctgttggtgcccagcg

SEQ ID NO: 762081 - DNA, 20 bp, Artificial
  CRISPR gRNA sequence
cctgttggtgcccagcgtgg

SEQ ID NO: 762082 - DNA, 20 bp, Artificial
  CRISPR gRNA sequence
ctgttggtgcccagcgtggc

SEQ ID NO: 762083 - DNA, 20 bp, Artificial
  CRISPR gRNA sequence
ggtgcccagcgtggcaggcg

SEQ ID NO: 762084 - DNA, 20 bp, Artificial
  CRISPR gRNA sequence
tgcccagcgtggcaggcgta

SEQ ID NO: 762085 - DNA, 20 bp, Artificial
  CRISPR gRNA sequence
cagcgtggcaggcgtagaga

SEQ ID NO: 762086 - DNA, 20 bp, Artificial
  CRISPR gRNA sequence
ggcaggcgtagagacagctc

SEQ ID NO: 762087 - DNA, 20 bp, Artificial
  CRISPR gRNA sequence
gcaggcgtagagacagctct

SEQ ID NO: 762088 - DNA, 20 bp, Artificial
  CRISPR gRNA sequence
cgtagagacagctctgggat

SEQ ID NO: 762089 - DNA, 20 bp, Artificial
  CRISPR gRNA sequence
cagacctcattcttcatgct

SEQ ID NO: 762090 - DNA, 20 bp, Artificial
  CRISPR gRNA sequence
gacctcattcttcatgctca

SEQ ID NO: 762091 - DNA, 20 bp, Artificial
  CRISPR gRNA sequence
acctcattcttcatgctcag

SEQ ID NO: 762092 - DNA, 20 bp, Artificial
  CRISPR gRNA sequence
tcattcttcatgctcagagg

SEQ ID NO: 762093 - DNA, 20 bp, Artificial
  CRISPR gRNA sequence
ttcatgctcagaggcagatg

SEQ ID NO: 762094 - DNA, 20 bp, Artificial
  CRISPR gRNA sequence
tgctcagaggcagatgtagt

SEQ ID NO: 762095 - DNA, 20 bp, Artificial
  CRISPR gRNA sequence
tcagaggcagatgtagttgg

SEQ ID NO: 762096 - DNA, 20 bp, Artificial
  CRISPR gRNA sequence
gaggcagatgtagttggcag

SEQ ID NO: 762097 - DNA, 20 bp, Artificial
  CRISPR gRNA sequence
aggcagatgtagttggcaga

SEQ ID NO: 762098 - DNA, 20 bp, Artificial
  CRISPR gRNA sequence
ggcagatgtagttggcagaa

SEQ ID NO: 762099 - DNA, 20 bp, Artificial
  CRISPR gRNA sequence
cagatgtagttggcagaagg

SEQ ID NO: 762100 - DNA, 20 bp, Artificial
  CRISPR gRNA sequence
agatgtagttggcagaaggg

SEQ ID NO: 762101 - DNA, 20 bp, Artificial
  CRISPR gRNA sequence
gatgtagttggcagaaggga

SEQ ID NO: 762102 - DNA, 20 bp, Artificial
  CRISPR gRNA sequence
tgtagttggcagaagggagg

SEQ ID NO: 762103 - DNA, 20 bp, Artificial
  CRISPR gRNA sequence
gttggcagaagggagggagt

SEQ ID NO: 762104 - DNA, 20 bp, Artificial
  CRISPR gRNA sequence
ttggcagaagggagggagtg

SEQ ID NO: 762105 - DNA, 20 bp, Artificial
  CRISPR gRNA sequence
ggcagaagggagggagtgag

SEQ ID NO: 762106 - DNA, 20 bp, Artificial
  CRISPR gRNA sequence
agaagggagggagtgaggag

SEQ ID NO: 762107 - DNA, 20 bp, Artificial
  CRISPR gRNA sequence
aagggagggagtgaggagaa

SEQ ID NO: 762108 - DNA, 20 bp, Artificial
  CRISPR gRNA sequence
agggagtgaggagaagagtg

SEQ ID NO: 762109 - DNA, 20 bp, Artificial
  CRISPR gRNA sequence
gggagtgaggagaagagtgt

SEQ ID NO: 762110 - DNA, 20 bp, Artificial
  CRISPR gRNA sequence
gaggagaagagtgtgggtga

SEQ ID NO: 762111 - DNA, 20 bp, Artificial
  CRISPR gRNA sequence
ggagaagagtgtgggtgatg

SEQ ID NO: 762112 - DNA, 20 bp, Artificial
  CRISPR gRNA sequence
aagagtgtgggtgatggagt

SEQ ID NO: 762113 - DNA, 20 bp, Artificial
  CRISPR gRNA sequence
gtgtgggtgatggagttggt

SEQ ID NO: 762114 - DNA, 20 bp, Artificial
  CRISPR gRNA sequence
ttggtcagtctcattccaca

SEQ ID NO: 762115 - DNA, 20 bp, Artificial
  CRISPR gRNA sequence
agtctcattccacatggtcc

SEQ ID NO: 762116 - DNA, 20 bp, Artificial
  CRISPR gRNA sequence
gtctcattccacatggtccc

SEQ ID NO: 762117 - DNA, 20 bp, Artificial
  CRISPR gRNA sequence
aggcccacctgcaaatctgc

SEQ ID NO: 762118 - DNA, 20 bp, Artificial
  CRISPR gRNA sequence
gcaaatctgccagcctcctt

SEQ ID NO: 762119 - DNA, 20 bp, Artificial
  CRISPR gRNA sequence
acatcaccctgtgtgtacat

SEQ ID NO: 762120 - DNA, 20 bp, Artificial
  CRISPR gRNA sequence
catcaccctgtgtgtacatt

SEQ ID NO: 762121 - DNA, 20 bp, Artificial
  CRISPR gRNA sequence
ccctgtgtgtacattgggct

SEQ ID NO: 762122 - DNA, 20 bp, Artificial
  CRISPR gRNA sequence
cctgtgtgtacattgggctc

SEQ ID NO: 762123 - DNA, 20 bp, Artificial
  CRISPR gRNA sequence
ctgtgtgtacattgggctca

SEQ ID NO: 762124 - DNA, 20 bp, Artificial
  CRISPR gRNA sequence
tcagggcacttccgcatctc

SEQ ID NO: 762125 - DNA, 20 bp, Artificial
  CRISPR gRNA sequence
ggcacttccgcatctccagc

SEQ ID NO: 762126 - DNA, 20 bp, Artificial
  CRISPR gRNA sequence
cacttccgcatctccagctg

SEQ ID NO: 762127 - DNA, 20 bp, Artificial
  CRISPR gRNA sequence
acttccgcatctccagctgg

SEQ ID NO: 762128 - DNA, 20 bp, Artificial
  CRISPR gRNA sequence
tccgcatctccagctggagg

SEQ ID NO: 762129 - DNA, 20 bp, Artificial
  CRISPR gRNA sequence
cgcatctccagctggaggtg

SEQ ID NO: 762130 - DNA, 20 bp, Artificial
  CRISPR gRNA sequence
gcatctccagctggaggtgg

SEQ ID NO: 762131 - DNA, 20 bp, Artificial
  CRISPR gRNA sequence
catctccagctggaggtgga

SEQ ID NO: 762132 - DNA, 20 bp, Artificial
  CRISPR gRNA sequence
cagctggaggtggagggctc

SEQ ID NO: 762133 - DNA, 20 bp, Artificial
  CRISPR gRNA sequence
agctggaggtggagggctcg

SEQ ID NO: 762134 - DNA, 20 bp, Artificial
  CRISPR gRNA sequence
gctggaggtggagggctcga

SEQ ID NO: 762135 - DNA, 20 bp, Artificial
  CRISPR gRNA sequence
tcgagggttgtcccattcta

SEQ ID NO: 762136 - DNA, 20 bp, Artificial
  CRISPR gRNA sequence
gttgtcccattctatagatg

SEQ ID NO: 762137 - DNA, 20 bp, Artificial
  CRISPR gRNA sequence
ttctatagatgcagaaaact

SEQ ID NO: 762138 - DNA, 20 bp, Artificial
  CRISPR gRNA sequence
tctatagatgcagaaaacta

SEQ ID NO: 762139 - DNA, 20 bp, Artificial
  CRISPR gRNA sequence
agatgcagaaaactaaggcc

SEQ ID NO: 762140 - DNA, 20 bp, Artificial
  CRISPR gRNA sequence
atgcagaaaactaaggccca

SEQ ID NO: 762141 - DNA, 20 bp, Artificial
  CRISPR gRNA sequence
gcagaaaactaaggcccaga

SEQ ID NO: 762142 - DNA, 20 bp, Artificial
  CRISPR gRNA sequence
cagaaaactaaggcccagag

SEQ ID NO: 762143 - DNA, 20 bp, Artificial
  CRISPR gRNA sequence
gaaaactaaggcccagagag

SEQ ID NO: 762144 - DNA, 20 bp, Artificial
  CRISPR gRNA sequence
ggcccagagaggagaatgac

SEQ ID NO: 762145 - DNA, 20 bp, Artificial
  CRISPR gRNA sequence
gagaggagaatgacaagcca

SEQ ID NO: 762146 - DNA, 20 bp, Artificial
  CRISPR gRNA sequence
gaggagaatgacaagccaca

SEQ ID NO: 762147 - DNA, 20 bp, Artificial
  CRISPR gRNA sequence
gagaatgacaagccacagag

SEQ ID NO: 762148 - DNA, 20 bp, Artificial
  CRISPR gRNA sequence
gacaagccacagagtggaac

SEQ ID NO: 762149 - DNA, 20 bp, Artificial
  CRISPR gRNA sequence
acaagccacagagtggaact

SEQ ID NO: 762150 - DNA, 20 bp, Artificial
  CRISPR gRNA sequence
cacagagtggaactgggacc

SEQ ID NO: 762151 - DNA, 20 bp, Artificial
  CRISPR gRNA sequence
acagagtggaactgggacct

SEQ ID NO: 762152 - DNA, 20 bp, Artificial
  CRISPR gRNA sequence
gtggaactgggacctgggac

SEQ ID NO: 762153 - DNA, 20 bp, Artificial
  CRISPR gRNA sequence
tggaactgggacctgggact

SEQ ID NO: 762154 - DNA, 20 bp, Artificial
  CRISPR gRNA sequence
ggaactgggacctgggactg

SEQ ID NO: 762155 - DNA, 20 bp, Artificial
  CRISPR gRNA sequence
tgggacctgggactggggct

SEQ ID NO: 762156 - DNA, 20 bp, Artificial
  CRISPR gRNA sequence
gggacctgggactggggctt

SEQ ID NO: 762157 - DNA, 20 bp, Artificial
  CRISPR gRNA sequence
cctgggactggggcttggga

SEQ ID NO: 762158 - DNA, 20 bp, Artificial
  CRISPR gRNA sequence
tggggcttgggacagcaacc

SEQ ID NO: 762159 - DNA, 20 bp, Artificial
  CRISPR gRNA sequence
ggggcttgggacagcaacct

SEQ ID NO: 762160 - DNA, 20 bp, Artificial
  CRISPR gRNA sequence
gggcttgggacagcaaccta

SEQ ID NO: 762161 - DNA, 20 bp, Artificial
  CRISPR gRNA sequence
gccccttcccttgtgctatg

SEQ ID NO: 762162 - DNA, 20 bp, Artificial
  CRISPR gRNA sequence
ccttcccttgtgctatgaag

SEQ ID NO: 762163 - DNA, 20 bp, Artificial
  CRISPR gRNA sequence
ctgacttgtcccgccccttc

SEQ ID NO: 762164 - DNA, 20 bp, Artificial
  CRISPR gRNA sequence
ccctaccccaccacttccca

SEQ ID NO: 762165 - DNA, 20 bp, Artificial
  CRISPR gRNA sequence
tgtgcgccttccttttttta

SEQ ID NO: 762166 - DNA, 20 bp, Artificial
  CRISPR gRNA sequence
ttcctttttttacagccctg

SEQ ID NO: 762167 - DNA, 20 bp, Artificial
  CRISPR gRNA sequence
cagcctctgaaacactctga

SEQ ID NO: 762168 - DNA, 20 bp, Artificial
  CRISPR gRNA sequence
tctgaaacactctgacagca

SEQ ID NO: 762169 - DNA, 20 bp, Artificial
  CRISPR gRNA sequence
gaaacactctgacagcaaag

SEQ ID NO: 762170 - DNA, 20 bp, Artificial
  CRISPR gRNA sequence
aaacactctgacagcaaaga

SEQ ID NO: 762171 - DNA, 20 bp, Artificial
  CRISPR gRNA sequence
ctctgacagcaaagaaggta

SEQ ID NO: 762172 - DNA, 20 bp, Artificial
  CRISPR gRNA sequence
gcaaagaaggtaaagacacc

SEQ ID NO: 762173 - DNA, 20 bp, Artificial
  CRISPR gRNA sequence
caaagaaggtaaagacacct

SEQ ID NO: 762174 - DNA, 20 bp, Artificial
  CRISPR gRNA sequence
aggtaaagacacctgggctt

SEQ ID NO: 762175 - DNA, 20 bp, Artificial
  CRISPR gRNA sequence
ggtaaagacacctgggcttg

SEQ ID NO: 762176 - DNA, 20 bp, Artificial
  CRISPR gRNA sequence
gtatgcacacatctgtgtgt

SEQ ID NO: 762177 - DNA, 20 bp, Artificial
  CRISPR gRNA sequence
atgcacacatctgtgtgtga

SEQ ID NO: 762178 - DNA, 20 bp, Artificial
  CRISPR gRNA sequence
tgcacacatctgtgtgtgag

SEQ ID NO: 762179 - DNA, 20 bp, Artificial
  CRISPR gRNA sequence
acatctgtgtgtgagaggct

SEQ ID NO: 762180 - DNA, 20 bp, Artificial
  CRISPR gRNA sequence
atctgtgtgtgagaggctga

SEQ ID NO: 762181 - DNA, 20 bp, Artificial
  CRISPR gRNA sequence
tctgtgtgtgagaggctgag

SEQ ID NO: 762182 - DNA, 20 bp, Artificial
  CRISPR gRNA sequence
ctgtgtgtgagaggctgaga

SEQ ID NO: 762183 - DNA, 20 bp, Artificial
  CRISPR gRNA sequence
tgtgtgagaggctgagaggg

SEQ ID NO: 762184 - DNA, 20 bp, Artificial
  CRISPR gRNA sequence
gtgtgagaggctgagagggt

SEQ ID NO: 762185 - DNA, 20 bp, Artificial
  CRISPR gRNA sequence
tgagaggctgagagggtggg

SEQ ID NO: 762186 - DNA, 20 bp, Artificial
  CRISPR gRNA sequence
gagaggctgagagggtgggt

SEQ ID NO: 762187 - DNA, 20 bp, Artificial
  CRISPR gRNA sequence
ggtaggcatcatcctttcac

SEQ ID NO: 762188 - DNA, 20 bp, Artificial
  CRISPR gRNA sequence
catcctttcactagtgacct

SEQ ID NO: 762189 - DNA, 20 bp, Artificial
  CRISPR gRNA sequence
atcctttcactagtgacctg

SEQ ID NO: 762190 - DNA, 20 bp, Artificial
  CRISPR gRNA sequence
gtgacctgaggccccctctg

SEQ ID NO: 762191 - DNA, 20 bp, Artificial
  CRISPR gRNA sequence
acctgaggccccctctgcag

SEQ ID NO: 762192 - DNA, 20 bp, Artificial
  CRISPR gRNA sequence
ctgaggccccctctgcagaa

SEQ ID NO: 762193 - DNA, 20 bp, Artificial
  CRISPR gRNA sequence
aggccccctctgcagaagag

SEQ ID NO: 762194 - DNA, 20 bp, Artificial
  CRISPR gRNA sequence
gagcagcctcaacttccccc

SEQ ID NO: 762195 - DNA, 20 bp, Artificial
  CRISPR gRNA sequence
agcctcaacttccccctggt

SEQ ID NO: 762196 - DNA, 20 bp, Artificial
  CRISPR gRNA sequence
tcaacttccccctggtgaga

SEQ ID NO: 762197 - DNA, 20 bp, Artificial
  CRISPR gRNA sequence
acttccccctggtgagatgg

SEQ ID NO: 762198 - DNA, 20 bp, Artificial
  CRISPR gRNA sequence
ttccccctggtgagatggca

SEQ ID NO: 762199 - DNA, 20 bp, Artificial
  CRISPR gRNA sequence
tccccctggtgagatggcag

SEQ ID NO: 762200 - DNA, 20 bp, Artificial
  CRISPR gRNA sequence
ccccctggtgagatggcaga

SEQ ID NO: 762201 - DNA, 20 bp, Artificial
  CRISPR gRNA sequence
tggtgagatggcagagggct

SEQ ID NO: 762202 - DNA, 20 bp, Artificial
  CRISPR gRNA sequence
tggcagagggctgagtaacc

SEQ ID NO: 762203 - DNA, 20 bp, Artificial
  CRISPR gRNA sequence
ggcagagggctgagtaacca

SEQ ID NO: 762204 - DNA, 20 bp, Artificial
  CRISPR gRNA sequence
gggctgagtaaccaaggtcc

SEQ ID NO: 762205 - DNA, 20 bp, Artificial
  CRISPR gRNA sequence
caaggtcccagctgctctga

SEQ ID NO: 762206 - DNA, 20 bp, Artificial
  CRISPR gRNA sequence
aaggtcccagctgctctgat

SEQ ID NO: 762207 - DNA, 20 bp, Artificial
  CRISPR gRNA sequence
ctgatgggacccaaatacga

SEQ ID NO: 762208 - DNA, 20 bp, Artificial
  CRISPR gRNA sequence
gatgggacccaaatacgaca

SEQ ID NO: 762209 - DNA, 20 bp, Artificial
  CRISPR gRNA sequence
atgggacccaaatacgacag

SEQ ID NO: 762210 - DNA, 20 bp, Artificial
  CRISPR gRNA sequence
cccaaatacgacagaggctt

SEQ ID NO: 762211 - DNA, 20 bp, Artificial
  CRISPR gRNA sequence
aaatacgacagaggcttaag

SEQ ID NO: 762212 - DNA, 20 bp, Artificial
  CRISPR gRNA sequence
aatacgacagaggcttaagc

SEQ ID NO: 762213 - DNA, 20 bp, Artificial
  CRISPR gRNA sequence
cgacagaggcttaagcagga

SEQ ID NO: 762214 - DNA, 20 bp, Artificial
  CRISPR gRNA sequence
gacagaggcttaagcaggac

SEQ ID NO: 762215 - DNA, 20 bp, Artificial
  CRISPR gRNA sequence
cagaggcttaagcaggacag

SEQ ID NO: 762216 - DNA, 20 bp, Artificial
  CRISPR gRNA sequence
tttattcctccttcctgtga

SEQ ID NO: 762217 - DNA, 20 bp, Artificial
  CRISPR gRNA sequence
cctccttcctgtgatagtgt

SEQ ID NO: 762218 - DNA, 20 bp, Artificial
  CRISPR gRNA sequence
ttcctgtgatagtgtgagca

SEQ ID NO: 762219 - DNA, 20 bp, Artificial
  CRISPR gRNA sequence
tcctgtgatagtgtgagcat

SEQ ID NO: 762220 - DNA, 20 bp, Artificial
  CRISPR gRNA sequence
tcgtaaaaccactgatgacc

SEQ ID NO: 762221 - DNA, 20 bp, Artificial
  CRISPR gRNA sequence
gtaaaaccactgatgacctg

SEQ ID NO: 762222 - DNA, 20 bp, Artificial
  CRISPR gRNA sequence
aaccactgatgacctggagc

SEQ ID NO: 762223 - DNA, 20 bp, Artificial
  CRISPR gRNA sequence
accactgatgacctggagcc

SEQ ID NO: 762224 - DNA, 20 bp, Artificial
  CRISPR gRNA sequence
ggagccaggttccacttacc

SEQ ID NO: 762225 - DNA, 20 bp, Artificial
  CRISPR gRNA sequence
attctgccctcttcaacttc

SEQ ID NO: 762226 - DNA, 20 bp, Artificial
  CRISPR gRNA sequence
caacttcaagctttcactcc

SEQ ID NO: 762227 - DNA, 20 bp, Artificial
  CRISPR gRNA sequence
aacttcaagctttcactcct

SEQ ID NO: 762228 - DNA, 20 bp, Artificial
  CRISPR gRNA sequence
aagctttcactcctaggtct

SEQ ID NO: 762229 - DNA, 20 bp, Artificial
  CRISPR gRNA sequence
gctttcactcctaggtctaa

SEQ ID NO: 762230 - DNA, 20 bp, Artificial
  CRISPR gRNA sequence
ctttcactcctaggtctaag

SEQ ID NO: 762231 - DNA, 20 bp, Artificial
  CRISPR gRNA sequence
ttgtgctcccacgccccctc

SEQ ID NO: 762232 - DNA, 20 bp, Artificial
  CRISPR gRNA sequence
gtgctcccacgccccctcca

SEQ ID NO: 762233 - DNA, 20 bp, Artificial
  CRISPR gRNA sequence
cccacgccccctccagagcc

SEQ ID NO: 762234 - DNA, 20 bp, Artificial
  CRISPR gRNA sequence
cacgccccctccagagccaa

SEQ ID NO: 762235 - DNA, 20 bp, Artificial
  CRISPR gRNA sequence
acgccccctccagagccaag

SEQ ID NO: 762236 - DNA, 20 bp, Artificial
  CRISPR gRNA sequence
cgccccctccagagccaaga

SEQ ID NO: 762237 - DNA, 20 bp, Artificial
  CRISPR gRNA sequence
ccccctccagagccaagagg

SEQ ID NO: 762238 - DNA, 20 bp, Artificial
  CRISPR gRNA sequence
ccctccagagccaagaggga

SEQ ID NO: 762239 - DNA, 20 bp, Artificial
  CRISPR gRNA sequence
ccagagccaagagggagaga

SEQ ID NO: 762240 - DNA, 20 bp, Artificial
  CRISPR gRNA sequence
cagagccaagagggagagaa

SEQ ID NO: 762241 - DNA, 20 bp, Artificial
  CRISPR gRNA sequence
agccaagagggagagaaagg

SEQ ID NO: 762242 - DNA, 20 bp, Artificial
  CRISPR gRNA sequence
gccaagagggagagaaagga

SEQ ID NO: 762243 - DNA, 20 bp, Artificial
  CRISPR gRNA sequence
aggaaggatatgtttccttc

SEQ ID NO: 762244 - DNA, 20 bp, Artificial
  CRISPR gRNA sequence
gaaggatatgtttccttcta

SEQ ID NO: 762245 - DNA, 20 bp, Artificial
  CRISPR gRNA sequence
tatgtttccttctagagctt

SEQ ID NO: 762246 - DNA, 20 bp, Artificial
  CRISPR gRNA sequence
gtttccttctagagcttgag

SEQ ID NO: 762247 - DNA, 20 bp, Artificial
  CRISPR gRNA sequence
tccttctagagcttgagtgg

SEQ ID NO: 762248 - DNA, 20 bp, Artificial
  CRISPR gRNA sequence
ttctagagcttgagtggaag

SEQ ID NO: 762249 - DNA, 20 bp, Artificial
  CRISPR gRNA sequence
cacttccgcttacattccat

SEQ ID NO: 762250 - DNA, 20 bp, Artificial
  CRISPR gRNA sequence
tccgcttacattccattggt

SEQ ID NO: 762251 - DNA, 20 bp, Artificial
  CRISPR gRNA sequence
acattccattggtcagaacc

SEQ ID NO: 762252 - DNA, 20 bp, Artificial
  CRISPR gRNA sequence
cattccattggtcagaaccc

SEQ ID NO: 762253 - DNA, 20 bp, Artificial
  CRISPR gRNA sequence
tggtcagaacccaggcatat

SEQ ID NO: 762254 - DNA, 20 bp, Artificial
  CRISPR gRNA sequence
caggcatatgagccctaact

SEQ ID NO: 762255 - DNA, 20 bp, Artificial
  CRISPR gRNA sequence
aggcatatgagccctaactc

SEQ ID NO: 762256 - DNA, 20 bp, Artificial
  CRISPR gRNA sequence
ggcatatgagccctaactca

SEQ ID NO: 762257 - DNA, 20 bp, Artificial
  CRISPR gRNA sequence
gcatatgagccctaactcag

SEQ ID NO: 762258 - DNA, 20 bp, Artificial
  CRISPR gRNA sequence
atatgagccctaactcaggg

SEQ ID NO: 762259 - DNA, 20 bp, Artificial
  CRISPR gRNA sequence
tatgagccctaactcagggg

SEQ ID NO: 762260 - DNA, 20 bp, Artificial
  CRISPR gRNA sequence
agccctaactcaggggaggc

SEQ ID NO: 762261 - DNA, 20 bp, Artificial
  CRISPR gRNA sequence
taactcaggggaggctagaa

SEQ ID NO: 762262 - DNA, 20 bp, Artificial
  CRISPR gRNA sequence
ggggaggctagaaaagtgtt

SEQ ID NO: 762263 - DNA, 20 bp, Artificial
  CRISPR gRNA sequence
aggctagaaaagtgttcagc

SEQ ID NO: 762264 - DNA, 20 bp, Artificial
  CRISPR gRNA sequence
ggctagaaaagtgttcagct

SEQ ID NO: 762265 - DNA, 20 bp, Artificial
  CRISPR gRNA sequence
tagaaaagtgttcagctggg

SEQ ID NO: 762266 - DNA, 20 bp, Artificial
  CRISPR gRNA sequence
cagctgggtagccatgtccc

SEQ ID NO: 762267 - DNA, 20 bp, Artificial
  CRISPR gRNA sequence
gtagccatgtccctggcgca

SEQ ID NO: 762268 - DNA, 20 bp, Artificial
  CRISPR gRNA sequence
gccatgtccctggcgcacag

SEQ ID NO: 762269 - DNA, 20 bp, Artificial
  CRISPR gRNA sequence
ccatgtccctggcgcacagt

SEQ ID NO: 762270 - DNA, 20 bp, Artificial
  CRISPR gRNA sequence
tgtccctggcgcacagtggg

SEQ ID NO: 762271 - DNA, 20 bp, Artificial
  CRISPR gRNA sequence
cctggcgcacagtgggtggt

SEQ ID NO: 762272 - DNA, 20 bp, Artificial
  CRISPR gRNA sequence
gggtggttagtaaatgtcca

SEQ ID NO: 762273 - DNA, 20 bp, Artificial
  CRISPR gRNA sequence
taaatgtccatagtcattat

SEQ ID NO: 762274 - DNA, 20 bp, Artificial
  CRISPR gRNA sequence
aaatgtccatagtcattatt

SEQ ID NO: 762275 - DNA, 20 bp, Artificial
  CRISPR gRNA sequence
tgggcctattgttataatgt

SEQ ID NO: 762276 - DNA, 20 bp, Artificial
  CRISPR gRNA sequence
ataatgtcagtgatgacatt

SEQ ID NO: 762277 - DNA, 20 bp, Artificial
  CRISPR gRNA sequence
agtgatgacatttggaaata

SEQ ID NO: 762278 - DNA, 20 bp, Artificial
  CRISPR gRNA sequence
gtgatgacatttggaaatac

SEQ ID NO: 762279 - DNA, 20 bp, Artificial
  CRISPR gRNA sequence
gatgacatttggaaatacag

SEQ ID NO: 762280 - DNA, 20 bp, Artificial
  CRISPR gRNA sequence
acatttggaaatacaggaga

SEQ ID NO: 762281 - DNA, 20 bp, Artificial
  CRISPR gRNA sequence
catttggaaatacaggagat

SEQ ID NO: 762282 - DNA, 20 bp, Artificial
  CRISPR gRNA sequence
gtcatttccttcctgttttt

SEQ ID NO: 762283 - DNA, 20 bp, Artificial
  CRISPR gRNA sequence
ttttcagaatcaaataacca

SEQ ID NO: 762284 - DNA, 20 bp, Artificial
  CRISPR gRNA sequence
tcagaatcaaataaccatag

SEQ ID NO: 762285 - DNA, 20 bp, Artificial
  CRISPR gRNA sequence
agaatcaaataaccatagaa

SEQ ID NO: 762286 - DNA, 20 bp, Artificial
  CRISPR gRNA sequence
tcaaataaccatagaagagc

SEQ ID NO: 762287 - DNA, 20 bp, Artificial
  CRISPR gRNA sequence
caaataaccatagaagagct

SEQ ID NO: 762288 - DNA, 20 bp, Artificial
  CRISPR gRNA sequence
ataaccatagaagagctggg

SEQ ID NO: 762289 - DNA, 20 bp, Artificial
  CRISPR gRNA sequence
ccatagaagagctgggcaga

SEQ ID NO: 762290 - DNA, 20 bp, Artificial
  CRISPR gRNA sequence
atagaagagctgggcagatg

SEQ ID NO: 762291 - DNA, 20 bp, Artificial
  CRISPR gRNA sequence
gctgggcagatggagataaa

SEQ ID NO: 762292 - DNA, 20 bp, Artificial
  CRISPR gRNA sequence
cagatggagataaaaagtgt

SEQ ID NO: 762293 - DNA, 20 bp, Artificial
  CRISPR gRNA sequence
ggagataaaaagtgtcagct

SEQ ID NO: 762294 - DNA, 20 bp, Artificial
  CRISPR gRNA sequence
gagataaaaagtgtcagctt

SEQ ID NO: 762295 - DNA, 20 bp, Artificial
  CRISPR gRNA sequence
taaaaagtgtcagcttaggc

SEQ ID NO: 762296 - DNA, 20 bp, Artificial
  CRISPR gRNA sequence
aaaaagtgtcagcttaggcc

SEQ ID NO: 762297 - DNA, 20 bp, Artificial
  CRISPR gRNA sequence
gtgtcagcttaggccaggca

SEQ ID NO: 762298 - DNA, 20 bp, Artificial
  CRISPR gRNA sequence
gtacttcacacctgtaatct

SEQ ID NO: 762299 - DNA, 20 bp, Artificial
  CRISPR gRNA sequence
cacctgtaatctcagcactt

SEQ ID NO: 762300 - DNA, 20 bp, Artificial
  CRISPR gRNA sequence
acctgtaatctcagcacttt

SEQ ID NO: 762301 - DNA, 20 bp, Artificial
  CRISPR gRNA sequence
ctgtaatctcagcactttgg

SEQ ID NO: 762302 - DNA, 20 bp, Artificial
  CRISPR gRNA sequence
tgtaatctcagcactttggg

SEQ ID NO: 762303 - DNA, 20 bp, Artificial
  CRISPR gRNA sequence
tctcagcactttgggaggcc

SEQ ID NO: 762304 - DNA, 20 bp, Artificial
  CRISPR gRNA sequence
ctcagcactttgggaggccg

SEQ ID NO: 762305 - DNA, 20 bp, Artificial
  CRISPR gRNA sequence
agcactttgggaggccgagg

SEQ ID NO: 762306 - DNA, 20 bp, Artificial
  CRISPR gRNA sequence
gcactttgggaggccgaggt

SEQ ID NO: 762307 - DNA, 20 bp, Artificial
  CRISPR gRNA sequence
ctttgggaggccgaggtggg

SEQ ID NO: 762308 - DNA, 20 bp, Artificial
  CRISPR gRNA sequence
ccgaggtgggtggatcactt

SEQ ID NO: 762309 - DNA, 20 bp, Artificial
  CRISPR gRNA sequence
cgaggtgggtggatcacttg

SEQ ID NO: 762310 - DNA, 20 bp, Artificial
  CRISPR gRNA sequence
gtgggtggatcacttgaggt

SEQ ID NO: 762311 - DNA, 20 bp, Artificial
  CRISPR gRNA sequence
tgggtggatcacttgaggtc

SEQ ID NO: 762312 - DNA, 20 bp, Artificial
  CRISPR gRNA sequence
ggtggatcacttgaggtcag

SEQ ID NO: 762313 - DNA, 20 bp, Artificial
  CRISPR gRNA sequence
tcacttgaggtcaggagttt

SEQ ID NO: 762314 - DNA, 20 bp, Artificial
  CRISPR gRNA sequence
tgaggtcaggagtttgagac

SEQ ID NO: 762315 - DNA, 20 bp, Artificial
  CRISPR gRNA sequence
tcaggagtttgagaccagcc

SEQ ID NO: 762316 - DNA, 20 bp, Artificial
  CRISPR gRNA sequence
tgagaccagcctggccaaca

SEQ ID NO: 762317 - DNA, 20 bp, Artificial
  CRISPR gRNA sequence
tctactaaaaatacaaaact

SEQ ID NO: 762318 - DNA, 20 bp, Artificial
  CRISPR gRNA sequence
ctaaaaatacaaaacttagc

SEQ ID NO: 762319 - DNA, 20 bp, Artificial
  CRISPR gRNA sequence
taaaaatacaaaacttagcc

SEQ ID NO: 762320 - DNA, 20 bp, Artificial
  CRISPR gRNA sequence
atacaaaacttagccgggcg

SEQ ID NO: 762321 - DNA, 20 bp, Artificial
  CRISPR gRNA sequence
caaaacttagccgggcgtgg

SEQ ID NO: 762322 - DNA, 20 bp, Artificial
  CRISPR gRNA sequence
gtggtgcatgcctgtaatcc

SEQ ID NO: 762323 - DNA, 20 bp, Artificial
  CRISPR gRNA sequence
tgcctgtaatcccagctact

SEQ ID NO: 762324 - DNA, 20 bp, Artificial
  CRISPR gRNA sequence
gcctgtaatcccagctactt

SEQ ID NO: 762325 - DNA, 20 bp, Artificial
  CRISPR gRNA sequence
tgtaatcccagctacttggg

SEQ ID NO: 762326 - DNA, 20 bp, Artificial
  CRISPR gRNA sequence
tcccagctacttgggaagct

SEQ ID NO: 762327 - DNA, 20 bp, Artificial
  CRISPR gRNA sequence
cccagctacttgggaagctg

SEQ ID NO: 762328 - DNA, 20 bp, Artificial
  CRISPR gRNA sequence
agctacttgggaagctgagg

SEQ ID NO: 762329 - DNA, 20 bp, Artificial
  CRISPR gRNA sequence
gctacttgggaagctgaggc

SEQ ID NO: 762330 - DNA, 20 bp, Artificial
  CRISPR gRNA sequence
tacttgggaagctgaggcgg

SEQ ID NO: 762331 - DNA, 20 bp, Artificial
  CRISPR gRNA sequence
gcgggagaatcacttgaacc

SEQ ID NO: 762332 - DNA, 20 bp, Artificial
  CRISPR gRNA sequence
cgggagaatcacttgaacct

SEQ ID NO: 762333 - DNA, 20 bp, Artificial
  CRISPR gRNA sequence
ggagaatcacttgaacctgg

SEQ ID NO: 762334 - DNA, 20 bp, Artificial
  CRISPR gRNA sequence
gagaatcacttgaacctggg

SEQ ID NO: 762335 - DNA, 20 bp, Artificial
  CRISPR gRNA sequence
aatcacttgaacctgggagg

SEQ ID NO: 762336 - DNA, 20 bp, Artificial
  CRISPR gRNA sequence
tcacttgaacctgggaggca

SEQ ID NO: 762337 - DNA, 20 bp, Artificial
  CRISPR gRNA sequence
cacttgaacctgggaggcag

SEQ ID NO: 762338 - DNA, 20 bp, Artificial
  CRISPR gRNA sequence
aacctgggaggcagaggttg

SEQ ID NO: 762339 - DNA, 20 bp, Artificial
  CRISPR gRNA sequence
ggcagaggttgcagtgaact

SEQ ID NO: 762340 - DNA, 20 bp, Artificial
  CRISPR gRNA sequence
gagattgcacctgtgcactc

SEQ ID NO: 762341 - DNA, 20 bp, Artificial
  CRISPR gRNA sequence
tgcacctgtgcactccagcc

SEQ ID NO: 762342 - DNA, 20 bp, Artificial
  CRISPR gRNA sequence
gcacctgtgcactccagcct

SEQ ID NO: 762343 - DNA, 20 bp, Artificial
  CRISPR gRNA sequence
gtgcactccagcctgggcaa

SEQ ID NO: 762344 - DNA, 20 bp, Artificial
  CRISPR gRNA sequence
gcactccagcctgggcaaca

SEQ ID NO: 762345 - DNA, 20 bp, Artificial
  CRISPR gRNA sequence
tccagcctgggcaacagagc

SEQ ID NO: 762346 - DNA, 20 bp, Artificial
  CRISPR gRNA sequence
tcaaaaaaaaaaaaaaaaaa

SEQ ID NO: 762347 - DNA, 20 bp, Artificial
  CRISPR gRNA sequence
aaaaaaaaaaaaaaaaaagt

SEQ ID NO: 762348 - DNA, 20 bp, Artificial
  CRISPR gRNA sequence
aaaaaaaaaaaaagtcagct

SEQ ID NO: 762349 - DNA, 20 bp, Artificial
  CRISPR gRNA sequence
aaaaagtcagcttggttttg

SEQ ID NO: 762350 - DNA, 20 bp, Artificial
  CRISPR gRNA sequence
aaagtcagcttggttttgaa

SEQ ID NO: 762351 - DNA, 20 bp, Artificial
  CRISPR gRNA sequence
gcttggttttgaagagttgc

SEQ ID NO: 762352 - DNA, 20 bp, Artificial
  CRISPR gRNA sequence
ttggttttgaagagttgctg

SEQ ID NO: 762353 - DNA, 20 bp, Artificial
  CRISPR gRNA sequence
tgaagagttgctggagaatg

SEQ ID NO: 762354 - DNA, 20 bp, Artificial
  CRISPR gRNA sequence
agttgctggagaatgtggcc

SEQ ID NO: 762355 - DNA, 20 bp, Artificial
  CRISPR gRNA sequence
gctggagaatgtggcctgga

SEQ ID NO: 762356 - DNA, 20 bp, Artificial
  CRISPR gRNA sequence
ctggagaatgtggcctggat

SEQ ID NO: 762357 - DNA, 20 bp, Artificial
  CRISPR gRNA sequence
tgtggcctggatgggcaaac

SEQ ID NO: 762358 - DNA, 20 bp, Artificial
  CRISPR gRNA sequence
tgcttcctaaccctgctcct

SEQ ID NO: 762359 - DNA, 20 bp, Artificial
  CRISPR gRNA sequence
tcctaaccctgctccttggt

SEQ ID NO: 762360 - DNA, 20 bp, Artificial
  CRISPR gRNA sequence
cctaaccctgctccttggtg

SEQ ID NO: 762361 - DNA, 20 bp, Artificial
  CRISPR gRNA sequence
aaccctgctccttggtgagg

SEQ ID NO: 762362 - DNA, 20 bp, Artificial
  CRISPR gRNA sequence
ggtgaggcagcctgccccct

SEQ ID NO: 762363 - DNA, 20 bp, Artificial
  CRISPR gRNA sequence
cagcctgccccctcagtctc

SEQ ID NO: 762364 - DNA, 20 bp, Artificial
  CRISPR gRNA sequence
ccctcagtctctggccatgc

SEQ ID NO: 762365 - DNA, 20 bp, Artificial
  CRISPR gRNA sequence
ctggccatgctggacaacca

SEQ ID NO: 762366 - DNA, 20 bp, Artificial
  CRISPR gRNA sequence
ggccatgctggacaaccaca

SEQ ID NO: 762367 - DNA, 20 bp, Artificial
  CRISPR gRNA sequence
gccatgctggacaaccacag

SEQ ID NO: 762368 - DNA, 20 bp, Artificial
  CRISPR gRNA sequence
atgctggacaaccacagagg

SEQ ID NO: 762369 - DNA, 20 bp, Artificial
  CRISPR gRNA sequence
acaaccacagaggcagtgcc

SEQ ID NO: 762370 - DNA, 20 bp, Artificial
  CRISPR gRNA sequence
ccacagaggcagtgcccaga

SEQ ID NO: 762371 - DNA, 20 bp, Artificial
  CRISPR gRNA sequence
cacagaggcagtgcccagat

SEQ ID NO: 762372 - DNA, 20 bp, Artificial
  CRISPR gRNA sequence
acagaggcagtgcccagatg

SEQ ID NO: 762373 - DNA, 20 bp, Artificial
  CRISPR gRNA sequence
cagaggcagtgcccagatgg

SEQ ID NO: 762374 - DNA, 20 bp, Artificial
  CRISPR gRNA sequence
gaggcagtgcccagatgggg

SEQ ID NO: 762375 - DNA, 20 bp, Artificial
  CRISPR gRNA sequence
gggagctcttctcctctccc

SEQ ID NO: 762376 - DNA, 20 bp, Artificial
  CRISPR gRNA sequence
ggagctcttctcctctcccc

SEQ ID NO: 762377 - DNA, 20 bp, Artificial
  CRISPR gRNA sequence
gagctcttctcctctcccca

SEQ ID NO: 762378 - DNA, 20 bp, Artificial
  CRISPR gRNA sequence
ctcctctccccagggacata

SEQ ID NO: 762379 - DNA, 20 bp, Artificial
  CRISPR gRNA sequence
cctctccccagggacataca

SEQ ID NO: 762380 - DNA, 20 bp, Artificial
  CRISPR gRNA sequence
ccagggacatacagagcccc

SEQ ID NO: 762381 - DNA, 20 bp, Artificial
  CRISPR gRNA sequence
gacatacagagccccaagaa

SEQ ID NO: 762382 - DNA, 20 bp, Artificial
  CRISPR gRNA sequence
acatacagagccccaagaat

SEQ ID NO: 762383 - DNA, 20 bp, Artificial
  CRISPR gRNA sequence
acagagccccaagaatgggt

SEQ ID NO: 762384 - DNA, 20 bp, Artificial
  CRISPR gRNA sequence
cagagccccaagaatgggtg

SEQ ID NO: 762385 - DNA, 20 bp, Artificial
  CRISPR gRNA sequence
agagccccaagaatgggtga

SEQ ID NO: 762386 - DNA, 20 bp, Artificial
  CRISPR gRNA sequence
agccccaagaatgggtgagg

SEQ ID NO: 762387 - DNA, 20 bp, Artificial
  CRISPR gRNA sequence
ccccaagaatgggtgaggga

SEQ ID NO: 762388 - DNA, 20 bp, Artificial
  CRISPR gRNA sequence
cccaagaatgggtgagggag

SEQ ID NO: 762389 - DNA, 20 bp, Artificial
  CRISPR gRNA sequence
ccaagaatgggtgagggaga

SEQ ID NO: 762390 - DNA, 20 bp, Artificial
  CRISPR gRNA sequence
agaatgggtgagggagaggg

SEQ ID NO: 762391 - DNA, 20 bp, Artificial
  CRISPR gRNA sequence
gaatgggtgagggagagggc

SEQ ID NO: 762392 - DNA, 20 bp, Artificial
  CRISPR gRNA sequence
aatgggtgagggagagggca

SEQ ID NO: 762393 - DNA, 20 bp, Artificial
  CRISPR gRNA sequence
atgggtgagggagagggcag

SEQ ID NO: 762394 - DNA, 20 bp, Artificial
  CRISPR gRNA sequence
ggtgagggagagggcagggg

SEQ ID NO: 762395 - DNA, 20 bp, Artificial
  CRISPR gRNA sequence
gtgagggagagggcagggga

SEQ ID NO: 762396 - DNA, 20 bp, Artificial
  CRISPR gRNA sequence
tgagggagagggcaggggaa

SEQ ID NO: 762397 - DNA, 20 bp, Artificial
  CRISPR gRNA sequence
agagggcaggggaagggccc

SEQ ID NO: 762398 - DNA, 20 bp, Artificial
  CRISPR gRNA sequence
gggcccaagcccttcttccc

SEQ ID NO: 762399 - DNA, 20 bp, Artificial
  CRISPR gRNA sequence
cttcttcccaagtctccatt

SEQ ID NO: 762400 - DNA, 20 bp, Artificial
  CRISPR gRNA sequence
cccaagtctccattcagctt

SEQ ID NO: 762401 - DNA, 20 bp, Artificial
  CRISPR gRNA sequence
tctccattcagcttcagatg

SEQ ID NO: 762402 - DNA, 20 bp, Artificial
  CRISPR gRNA sequence
tccattcagcttcagatgca

SEQ ID NO: 762403 - DNA, 20 bp, Artificial
  CRISPR gRNA sequence
attcagcttcagatgcagag

SEQ ID NO: 762404 - DNA, 20 bp, Artificial
  CRISPR gRNA sequence
ttcagcttcagatgcagagt

SEQ ID NO: 762405 - DNA, 20 bp, Artificial
  CRISPR gRNA sequence
tcagcttcagatgcagagtg

SEQ ID NO: 762406 - DNA, 20 bp, Artificial
  CRISPR gRNA sequence
agatgcagagtggggtctga

SEQ ID NO: 762407 - DNA, 20 bp, Artificial
  CRISPR gRNA sequence
cagagtggggtctgaaagat

SEQ ID NO: 762408 - DNA, 20 bp, Artificial
  CRISPR gRNA sequence
gggtctgaaagatgagtctt

SEQ ID NO: 762409 - DNA, 20 bp, Artificial
  CRISPR gRNA sequence
ggtctgaaagatgagtcttt

SEQ ID NO: 762410 - DNA, 20 bp, Artificial
  CRISPR gRNA sequence
tgaaagatgagtctttggga

SEQ ID NO: 762411 - DNA, 20 bp, Artificial
  CRISPR gRNA sequence
ctttgggatggccctccaca

SEQ ID NO: 762412 - DNA, 20 bp, Artificial
  CRISPR gRNA sequence
ttgggatggccctccacatg

SEQ ID NO: 762413 - DNA, 20 bp, Artificial
  CRISPR gRNA sequence
gatggccctccacatggaga

SEQ ID NO: 762414 - DNA, 20 bp, Artificial
  CRISPR gRNA sequence
atggccctccacatggagac

SEQ ID NO: 762415 - DNA, 20 bp, Artificial
  CRISPR gRNA sequence
gccctccacatggagacagg

SEQ ID NO: 762416 - DNA, 20 bp, Artificial
  CRISPR gRNA sequence
cacatggagacaggaagccc

SEQ ID NO: 762417 - DNA, 20 bp, Artificial
  CRISPR gRNA sequence
acatggagacaggaagccca

SEQ ID NO: 762418 - DNA, 20 bp, Artificial
  CRISPR gRNA sequence
catggagacaggaagcccaa

SEQ ID NO: 762419 - DNA, 20 bp, Artificial
  CRISPR gRNA sequence
ggagacaggaagcccaaggg

SEQ ID NO: 762420 - DNA, 20 bp, Artificial
  CRISPR gRNA sequence
gagacaggaagcccaaggga

SEQ ID NO: 762421 - DNA, 20 bp, Artificial
  CRISPR gRNA sequence
gacaggaagcccaagggaag

SEQ ID NO: 762422 - DNA, 20 bp, Artificial
  CRISPR gRNA sequence
acaggaagcccaagggaagg

SEQ ID NO: 762423 - DNA, 20 bp, Artificial
  CRISPR gRNA sequence
aggaagcccaagggaaggag

SEQ ID NO: 762424 - DNA, 20 bp, Artificial
  CRISPR gRNA sequence
ggaagcccaagggaaggagg

SEQ ID NO: 762425 - DNA, 20 bp, Artificial
  CRISPR gRNA sequence
gaagcccaagggaaggagga

SEQ ID NO: 762426 - DNA, 20 bp, Artificial
  CRISPR gRNA sequence
ggcccctgccgtgtcactct

SEQ ID NO: 762427 - DNA, 20 bp, Artificial
  CRISPR gRNA sequence
gcccctgccgtgtcactctc

SEQ ID NO: 762428 - DNA, 20 bp, Artificial
  CRISPR gRNA sequence
cccctgccgtgtcactctca

SEQ ID NO: 762429 - DNA, 20 bp, Artificial
  CRISPR gRNA sequence
cgtgtcactctcagggaaac

SEQ ID NO: 762430 - DNA, 20 bp, Artificial
  CRISPR gRNA sequence
cactctcagggaaaccagtg

SEQ ID NO: 762431 - DNA, 20 bp, Artificial
  CRISPR gRNA sequence
ctctcagggaaaccagtgtg

SEQ ID NO: 762432 - DNA, 20 bp, Artificial
  CRISPR gRNA sequence
tctcagggaaaccagtgtgg

SEQ ID NO: 762433 - DNA, 20 bp, Artificial
  CRISPR gRNA sequence
ctcagggaaaccagtgtgga

SEQ ID NO: 762434 - DNA, 20 bp, Artificial
  CRISPR gRNA sequence
tcagggaaaccagtgtggag

SEQ ID NO: 762435 - DNA, 20 bp, Artificial
  CRISPR gRNA sequence
aaccagtgtggaggggacac

SEQ ID NO: 762436 - DNA, 20 bp, Artificial
  CRISPR gRNA sequence
accagtgtggaggggacact

SEQ ID NO: 762437 - DNA, 20 bp, Artificial
  CRISPR gRNA sequence
agtgtggaggggacactggg

SEQ ID NO: 762438 - DNA, 20 bp, Artificial
  CRISPR gRNA sequence
gtgtggaggggacactggga

SEQ ID NO: 762439 - DNA, 20 bp, Artificial
  CRISPR gRNA sequence
acactgggaaggctgcctgc

SEQ ID NO: 762440 - DNA, 20 bp, Artificial
  CRISPR gRNA sequence
gggaaggctgcctgctggac

SEQ ID NO: 762441 - DNA, 20 bp, Artificial
  CRISPR gRNA sequence
ggaaggctgcctgctggacg

SEQ ID NO: 762442 - DNA, 20 bp, Artificial
  CRISPR gRNA sequence
gaaggctgcctgctggacga

SEQ ID NO: 762443 - DNA, 20 bp, Artificial
  CRISPR gRNA sequence
aggctgcctgctggacgagg

SEQ ID NO: 762444 - DNA, 20 bp, Artificial
  CRISPR gRNA sequence
tgcctgctggacgagggagt

SEQ ID NO: 762445 - DNA, 20 bp, Artificial
  CRISPR gRNA sequence
gcctgctggacgagggagtt

SEQ ID NO: 762446 - DNA, 20 bp, Artificial
  CRISPR gRNA sequence
gctggacgagggagttgggc

SEQ ID NO: 762447 - DNA, 20 bp, Artificial
  CRISPR gRNA sequence
ctggacgagggagttgggcc

SEQ ID NO: 762448 - DNA, 20 bp, Artificial
  CRISPR gRNA sequence
gagggagttgggccaggcct

SEQ ID NO: 762449 - DNA, 20 bp, Artificial
  CRISPR gRNA sequence
gggagttgggccaggccttg

SEQ ID NO: 762450 - DNA, 20 bp, Artificial
  CRISPR gRNA sequence
ggagttgggccaggccttgg

SEQ ID NO: 762451 - DNA, 20 bp, Artificial
  CRISPR gRNA sequence
gagttgggccaggccttgga

SEQ ID NO: 762452 - DNA, 20 bp, Artificial
  CRISPR gRNA sequence
ttgggccaggccttggaggg

SEQ ID NO: 762453 - DNA, 20 bp, Artificial
  CRISPR gRNA sequence
gccaggccttggagggtgga

SEQ ID NO: 762454 - DNA, 20 bp, Artificial
  CRISPR gRNA sequence
ccaggccttggagggtggat

SEQ ID NO: 762455 - DNA, 20 bp, Artificial
  CRISPR gRNA sequence
gccttggagggtggatggga

SEQ ID NO: 762456 - DNA, 20 bp, Artificial
  CRISPR gRNA sequence
gggtggatgggatggacaaa

SEQ ID NO: 762457 - DNA, 20 bp, Artificial
  CRISPR gRNA sequence
ggtggatgggatggacaaac

SEQ ID NO: 762458 - DNA, 20 bp, Artificial
  CRISPR gRNA sequence
tggatgggatggacaaacag

SEQ ID NO: 762459 - DNA, 20 bp, Artificial
  CRISPR gRNA sequence
gggatggacaaacaggagat

SEQ ID NO: 762460 - DNA, 20 bp, Artificial
  CRISPR gRNA sequence
atggacaaacaggagatgag

SEQ ID NO: 762461 - DNA, 20 bp, Artificial
  CRISPR gRNA sequence
tggacaaacaggagatgaga

SEQ ID NO: 762462 - DNA, 20 bp, Artificial
  CRISPR gRNA sequence
ggacaaacaggagatgagaa

SEQ ID NO: 762463 - DNA, 20 bp, Artificial
  CRISPR gRNA sequence
aacaggagatgagaagggaa

SEQ ID NO: 762464 - DNA, 20 bp, Artificial
  CRISPR gRNA sequence
gaagggaaaagtgttgcacg

SEQ ID NO: 762465 - DNA, 20 bp, Artificial
  CRISPR gRNA sequence
agggaaaagtgttgcacgta

SEQ ID NO: 762466 - DNA, 20 bp, Artificial
  CRISPR gRNA sequence
gggaaaagtgttgcacgtag

SEQ ID NO: 762467 - DNA, 20 bp, Artificial
  CRISPR gRNA sequence
ggaaaagtgttgcacgtaga

SEQ ID NO: 762468 - DNA, 20 bp, Artificial
  CRISPR gRNA sequence
aaaagtgttgcacgtagagg

SEQ ID NO: 762469 - DNA, 20 bp, Artificial
  CRISPR gRNA sequence
aagtgttgcacgtagaggga

SEQ ID NO: 762470 - DNA, 20 bp, Artificial
  CRISPR gRNA sequence
tgttgcacgtagagggagag

SEQ ID NO: 762471 - DNA, 20 bp, Artificial
  CRISPR gRNA sequence
ttgcacgtagagggagagtg

SEQ ID NO: 762472 - DNA, 20 bp, Artificial
  CRISPR gRNA sequence
tgcacgtagagggagagtgg

SEQ ID NO: 762473 - DNA, 20 bp, Artificial
  CRISPR gRNA sequence
gcacgtagagggagagtgga

SEQ ID NO: 762474 - DNA, 20 bp, Artificial
  CRISPR gRNA sequence
cgtagagggagagtggaggg

SEQ ID NO: 762475 - DNA, 20 bp, Artificial
  CRISPR gRNA sequence
gagagtggagggaagtgtat

SEQ ID NO: 762476 - DNA, 20 bp, Artificial
  CRISPR gRNA sequence
agagtggagggaagtgtatc

SEQ ID NO: 762477 - DNA, 20 bp, Artificial
  CRISPR gRNA sequence
gagggaagtgtatcgggctg

SEQ ID NO: 762478 - DNA, 20 bp, Artificial
  CRISPR gRNA sequence
agggaagtgtatcgggctgt

SEQ ID NO: 762479 - DNA, 20 bp, Artificial
  CRISPR gRNA sequence
tgtatcgggctgtgggcctg

SEQ ID NO: 762480 - DNA, 20 bp, Artificial
  CRISPR gRNA sequence
gtatcgggctgtgggcctgt

SEQ ID NO: 762481 - DNA, 20 bp, Artificial
  CRISPR gRNA sequence
gctgtgggcctgtgggtact

SEQ ID NO: 762482 - DNA, 20 bp, Artificial
  CRISPR gRNA sequence
tgtgggcctgtgggtactga

SEQ ID NO: 762483 - DNA, 20 bp, Artificial
  CRISPR gRNA sequence
gtgggcctgtgggtactgag

SEQ ID NO: 762484 - DNA, 20 bp, Artificial
  CRISPR gRNA sequence
tgggcctgtgggtactgaga

SEQ ID NO: 762485 - DNA, 20 bp, Artificial
  CRISPR gRNA sequence
gggcctgtgggtactgagag

SEQ ID NO: 762486 - DNA, 20 bp, Artificial
  CRISPR gRNA sequence
ggcctgtgggtactgagagg

SEQ ID NO: 762487 - DNA, 20 bp, Artificial
  CRISPR gRNA sequence
gtactgagagggggctgcgt

SEQ ID NO: 762488 - DNA, 20 bp, Artificial
  CRISPR gRNA sequence
tactgagagggggctgcgtg

SEQ ID NO: 762489 - DNA, 20 bp, Artificial
  CRISPR gRNA sequence
tgagagggggctgcgtgagg

SEQ ID NO: 762490 - DNA, 20 bp, Artificial
  CRISPR gRNA sequence
ctgcgtgaggtggtccccct

SEQ ID NO: 762491 - DNA, 20 bp, Artificial
  CRISPR gRNA sequence
tgcgtgaggtggtccccctc

SEQ ID NO: 762492 - DNA, 20 bp, Artificial
  CRISPR gRNA sequence
gtggtccccctcaggtgccc

SEQ ID NO: 762493 - DNA, 20 bp, Artificial
  CRISPR gRNA sequence
ctcaggtgccccggcgtgcc

SEQ ID NO: 762494 - DNA, 20 bp, Artificial
  CRISPR gRNA sequence
ctggcacctgcatctgtgtc

SEQ ID NO: 762495 - DNA, 20 bp, Artificial
  CRISPR gRNA sequence
tggcacctgcatctgtgtct

SEQ ID NO: 762496 - DNA, 20 bp, Artificial
  CRISPR gRNA sequence
tgcatctgtgtctgggcctc

SEQ ID NO: 762497 - DNA, 20 bp, Artificial
  CRISPR gRNA sequence
gcatctgtgtctgggcctcc

SEQ ID NO: 762498 - DNA, 20 bp, Artificial
  CRISPR gRNA sequence
catctgtgtctgggcctcca

SEQ ID NO: 762499 - DNA, 20 bp, Artificial
  CRISPR gRNA sequence
tgtctgggcctccagggccg

SEQ ID NO: 762500 - DNA, 20 bp, Artificial
  CRISPR gRNA sequence
tgggcctccagggccgtggt

SEQ ID NO: 762501 - DNA, 20 bp, Artificial
  CRISPR gRNA sequence
ctccagggccgtggtcagca

SEQ ID NO: 762502 - DNA, 20 bp, Artificial
  CRISPR gRNA sequence
tccagggccgtggtcagcac

SEQ ID NO: 762503 - DNA, 20 bp, Artificial
  CRISPR gRNA sequence
ccagggccgtggtcagcacg

SEQ ID NO: 762504 - DNA, 20 bp, Artificial
  CRISPR gRNA sequence
cagggccgtggtcagcacgg

SEQ ID NO: 762505 - DNA, 20 bp, Artificial
  CRISPR gRNA sequence
tcagcacgggggctgtccgt

SEQ ID NO: 762506 - DNA, 20 bp, Artificial
  CRISPR gRNA sequence
cagcacgggggctgtccgtt

SEQ ID NO: 762507 - DNA, 20 bp, Artificial
  CRISPR gRNA sequence
tcacacacactccccacttg

SEQ ID NO: 762508 - DNA, 20 bp, Artificial
  CRISPR gRNA sequence
ctccccacttgaagtctgac

SEQ ID NO: 762509 - DNA, 20 bp, Artificial
  CRISPR gRNA sequence
tccccacttgaagtctgacc

SEQ ID NO: 762510 - DNA, 20 bp, Artificial
  CRISPR gRNA sequence
ttgaagtctgaccaggtgct

SEQ ID NO: 762511 - DNA, 20 bp, Artificial
  CRISPR gRNA sequence
tgaagtctgaccaggtgctt

SEQ ID NO: 762512 - DNA, 20 bp, Artificial
  CRISPR gRNA sequence
tgaccaggtgcttgggcttc

SEQ ID NO: 762513 - DNA, 20 bp, Artificial
  CRISPR gRNA sequence
ttctggcataatcccaaaaa

SEQ ID NO: 762514 - DNA, 20 bp, Artificial
  CRISPR gRNA sequence
aatcccaaaaatagatcttc

SEQ ID NO: 762515 - DNA, 20 bp, Artificial
  CRISPR gRNA sequence
tttcttcccatcatgaaatg

SEQ ID NO: 762516 - DNA, 20 bp, Artificial
  CRISPR gRNA sequence
ccatcatgaaatgaagatga

SEQ ID NO: 762517 - DNA, 20 bp, Artificial
  CRISPR gRNA sequence
atgaaatgaagatgatggac

SEQ ID NO: 762518 - DNA, 20 bp, Artificial
  CRISPR gRNA sequence
tgaagatgatggacaagaaa

SEQ ID NO: 762519 - DNA, 20 bp, Artificial
  CRISPR gRNA sequence
acaagaaatagcctgaccat

SEQ ID NO: 762520 - DNA, 20 bp, Artificial
  CRISPR gRNA sequence
caagaaatagcctgaccatg

SEQ ID NO: 762521 - DNA, 20 bp, Artificial
  CRISPR gRNA sequence
aatagcctgaccatgaggac

SEQ ID NO: 762522 - DNA, 20 bp, Artificial
  CRISPR gRNA sequence
atagcctgaccatgaggacc

SEQ ID NO: 762523 - DNA, 20 bp, Artificial
  CRISPR gRNA sequence
tagcctgaccatgaggacca

SEQ ID NO: 762524 - DNA, 20 bp, Artificial
  CRISPR gRNA sequence
gcctgaccatgaggaccagg

SEQ ID NO: 762525 - DNA, 20 bp, Artificial
  CRISPR gRNA sequence
ggagctgctacccctcccta

SEQ ID NO: 762526 - DNA, 20 bp, Artificial
  CRISPR gRNA sequence
tccctacagctcctaccctc

SEQ ID NO: 762527 - DNA, 20 bp, Artificial
  CRISPR gRNA sequence
ctcctaccctctggctgcaa

SEQ ID NO: 762528 - DNA, 20 bp, Artificial
  CRISPR gRNA sequence
tcctaccctctggctgcaat

SEQ ID NO: 762529 - DNA, 20 bp, Artificial
  CRISPR gRNA sequence
cctaccctctggctgcaatg

SEQ ID NO: 762530 - DNA, 20 bp, Artificial
  CRISPR gRNA sequence
ctgcaatggggctgcactgt

SEQ ID NO: 762531 - DNA, 20 bp, Artificial
  CRISPR gRNA sequence
actgtgagccctgcccccaa

SEQ ID NO: 762532 - DNA, 20 bp, Artificial
  CRISPR gRNA sequence
acagatgcatcctgctctga

SEQ ID NO: 762533 - DNA, 20 bp, Artificial
  CRISPR gRNA sequence
cagatgcatcctgctctgac

SEQ ID NO: 762534 - DNA, 20 bp, Artificial
  CRISPR gRNA sequence
atgcatcctgctctgacagg

SEQ ID NO: 762535 - DNA, 20 bp, Artificial
  CRISPR gRNA sequence
tgcatcctgctctgacaggt

SEQ ID NO: 762536 - DNA, 20 bp, Artificial
  CRISPR gRNA sequence
acaggtgggctccttctcca

SEQ ID NO: 762537 - DNA, 20 bp, Artificial
  CRISPR gRNA sequence
caggtgggctccttctccaa

SEQ ID NO: 762538 - DNA, 20 bp, Artificial
  CRISPR gRNA sequence
tctccaaaggatgcgataca

SEQ ID NO: 762539 - DNA, 20 bp, Artificial
  CRISPR gRNA sequence
gcgatacacagaccactgtg

SEQ ID NO: 762540 - DNA, 20 bp, Artificial
  CRISPR gRNA sequence
gtgcagccttatttctccaa

SEQ ID NO: 762541 - DNA, 20 bp, Artificial
  CRISPR gRNA sequence
ctccaatggacatgattccc

SEQ ID NO: 762542 - DNA, 20 bp, Artificial
  CRISPR gRNA sequence
tcctgctgccttttttctta

SEQ ID NO: 762543 - DNA, 20 bp, Artificial
  CRISPR gRNA sequence
tttcttatagacacaatgaa

SEQ ID NO: 762544 - DNA, 20 bp, Artificial
  CRISPR gRNA sequence
gaacagaccacccacaacct

SEQ ID NO: 762545 - DNA, 20 bp, Artificial
  CRISPR gRNA sequence
acccacaaccttagttctct

SEQ ID NO: 762546 - DNA, 20 bp, Artificial
  CRISPR gRNA sequence
ctgcctgctgccttatttca

SEQ ID NO: 762547 - DNA, 20 bp, Artificial
  CRISPR gRNA sequence
ttcacagtacatacatttct

SEQ ID NO: 762548 - DNA, 20 bp, Artificial
  CRISPR gRNA sequence
tcacagtacatacatttctt

SEQ ID NO: 762549 - DNA, 20 bp, Artificial
  CRISPR gRNA sequence
cacagtacatacatttctta

SEQ ID NO: 762550 - DNA, 20 bp, Artificial
  CRISPR gRNA sequence
acatacatttcttagggaca

SEQ ID NO: 762551 - DNA, 20 bp, Artificial
  CRISPR gRNA sequence
acatcaccaccctcttcttc

SEQ ID NO: 762552 - DNA, 20 bp, Artificial
  CRISPR gRNA sequence
cctcttcttccagtgctgcg

SEQ ID NO: 762553 - DNA, 20 bp, Artificial
  CRISPR gRNA sequence
ccagtgctgcgtggaccatc

SEQ ID NO: 762554 - DNA, 20 bp, Artificial
  CRISPR gRNA sequence
tggctgccttttttctccaa

SEQ ID NO: 762555 - DNA, 20 bp, Artificial
  CRISPR gRNA sequence
tctccaaaagatgcaatatt

SEQ ID NO: 762556 - DNA, 20 bp, Artificial
  CRISPR gRNA sequence
ccccctgccttatttcacca

SEQ ID NO: 762557 - DNA, 20 bp, Artificial
  CRISPR gRNA sequence
ttcaccaaagacacgatgca

SEQ ID NO: 762558 - DNA, 20 bp, Artificial
  CRISPR gRNA sequence
gacacgatgcatagtcaccc

SEQ ID NO: 762559 - DNA, 20 bp, Artificial
  CRISPR gRNA sequence
ccccggccttgtttctccaa

SEQ ID NO: 762560 - DNA, 20 bp, Artificial
  CRISPR gRNA sequence
ctccaatggccgtgatacac

SEQ ID NO: 762561 - DNA, 20 bp, Artificial
  CRISPR gRNA sequence
gatacactagtgatcatgtt

SEQ ID NO: 762562 - DNA, 20 bp, Artificial
  CRISPR gRNA sequence
cagccctgcttccacctgca

SEQ ID NO: 762563 - DNA, 20 bp, Artificial
  CRISPR gRNA sequence
tgcatagaatcttttcttct

SEQ ID NO: 762564 - DNA, 20 bp, Artificial
  CRISPR gRNA sequence
tagaatcttttcttctcaga

SEQ ID NO: 762565 - DNA, 20 bp, Artificial
  CRISPR gRNA sequence
agaatcttttcttctcagac

SEQ ID NO: 762566 - DNA, 20 bp, Artificial
  CRISPR gRNA sequence
gaatcttttcttctcagaca

SEQ ID NO: 762567 - DNA, 20 bp, Artificial
  CRISPR gRNA sequence
cttttcttctcagacaggga

SEQ ID NO: 762568 - DNA, 20 bp, Artificial
  CRISPR gRNA sequence
cttctcagacagggacagtg

SEQ ID NO: 762569 - DNA, 20 bp, Artificial
  CRISPR gRNA sequence
agtgcggcctcaacatctcc

SEQ ID NO: 762570 - DNA, 20 bp, Artificial
  CRISPR gRNA sequence
tgcggcctcaacatctcctg

SEQ ID NO: 762571 - DNA, 20 bp, Artificial
  CRISPR gRNA sequence
cctcaacatctcctggagtc

SEQ ID NO: 762572 - DNA, 20 bp, Artificial
  CRISPR gRNA sequence
caacatctcctggagtctag

SEQ ID NO: 762573 - DNA, 20 bp, Artificial
  CRISPR gRNA sequence
cctccttcctcctcttgctc

SEQ ID NO: 762574 - DNA, 20 bp, Artificial
  CRISPR gRNA sequence
tcttgctctagccttaatac

SEQ ID NO: 762575 - DNA, 20 bp, Artificial
  CRISPR gRNA sequence
gccttttccctccctgcccc

SEQ ID NO: 762576 - DNA, 20 bp, Artificial
  CRISPR gRNA sequence
ttccctccctgccccaagtg

SEQ ID NO: 762577 - DNA, 20 bp, Artificial
  CRISPR gRNA sequence
ctccctgccccaagtgaaga

SEQ ID NO: 762578 - DNA, 20 bp, Artificial
  CRISPR gRNA sequence
tccctgccccaagtgaagac

SEQ ID NO: 762579 - DNA, 20 bp, Artificial
  CRISPR gRNA sequence
ccctgccccaagtgaagaca

SEQ ID NO: 762580 - DNA, 20 bp, Artificial
  CRISPR gRNA sequence
ctctgcgcccaccacatgca

SEQ ID NO: 762581 - DNA, 20 bp, Artificial
  CRISPR gRNA sequence
accacatgcacagctgtgca

SEQ ID NO: 762582 - DNA, 20 bp, Artificial
  CRISPR gRNA sequence
cacatgcacagctgtgcatg

SEQ ID NO: 762583 - DNA, 20 bp, Artificial
  CRISPR gRNA sequence
cagctgtgcatggagacctg

SEQ ID NO: 762584 - DNA, 20 bp, Artificial
  CRISPR gRNA sequence
agctgtgcatggagacctgc

SEQ ID NO: 762585 - DNA, 20 bp, Artificial
  CRISPR gRNA sequence
agacctgcaggtgcacgtgc

SEQ ID NO: 762586 - DNA, 20 bp, Artificial
  CRISPR gRNA sequence
tgcacgtgctggaacacgtg

SEQ ID NO: 762587 - DNA, 20 bp, Artificial
  CRISPR gRNA sequence
gaacacgtgtggttcccccc

SEQ ID NO: 762588 - DNA, 20 bp, Artificial
  CRISPR gRNA sequence
cgtgtggttcccccctggcc

SEQ ID NO: 762589 - DNA, 20 bp, Artificial
  CRISPR gRNA sequence
ccctggcccagcctcctctg

SEQ ID NO: 762590 - DNA, 20 bp, Artificial
  CRISPR gRNA sequence
tcccctgcccatcctcccca

SEQ ID NO: 762591 - DNA, 20 bp, Artificial
  CRISPR gRNA sequence
cctgcccatcctccccacgg

SEQ ID NO: 762592 - DNA, 20 bp, Artificial
  CRISPR gRNA sequence
ctccccacggaagcatgtgc

SEQ ID NO: 762593 - DNA, 20 bp, Artificial
  CRISPR gRNA sequence
gaagcatgtgctggtcacac

SEQ ID NO: 762594 - DNA, 20 bp, Artificial
  CRISPR gRNA sequence
tgctggtcacactggttctc

SEQ ID NO: 762595 - DNA, 20 bp, Artificial
  CRISPR gRNA sequence
gctggtcacactggttctcc

SEQ ID NO: 762596 - DNA, 20 bp, Artificial
  CRISPR gRNA sequence
ctggtcacactggttctcca

SEQ ID NO: 762597 - DNA, 20 bp, Artificial
  CRISPR gRNA sequence
tggtcacactggttctccag

SEQ ID NO: 762598 - DNA, 20 bp, Artificial
  CRISPR gRNA sequence
ggttctccaggggtctgtga

SEQ ID NO: 762599 - DNA, 20 bp, Artificial
  CRISPR gRNA sequence
gttctccaggggtctgtgat

SEQ ID NO: 762600 - DNA, 20 bp, Artificial
  CRISPR gRNA sequence
ttctccaggggtctgtgatg

SEQ ID NO: 762601 - DNA, 20 bp, Artificial
  CRISPR gRNA sequence
ggggtctgtgatggggcccc

SEQ ID NO: 762602 - DNA, 20 bp, Artificial
  CRISPR gRNA sequence
gggtctgtgatggggcccct

SEQ ID NO: 762603 - DNA, 20 bp, Artificial
  CRISPR gRNA sequence
ggtctgtgatggggcccctg

SEQ ID NO: 762604 - DNA, 20 bp, Artificial
  CRISPR gRNA sequence
gtctgtgatggggcccctgg

SEQ ID NO: 762605 - DNA, 20 bp, Artificial
  CRISPR gRNA sequence
gtgatggggcccctgggggt

SEQ ID NO: 762606 - DNA, 20 bp, Artificial
  CRISPR gRNA sequence
tttcttttcatgtatccatt

SEQ ID NO: 762607 - DNA, 20 bp, Artificial
  CRISPR gRNA sequence
ccattcagttgatgtttatt

SEQ ID NO: 762608 - DNA, 20 bp, Artificial
  CRISPR gRNA sequence
tgatgtttattgagcaacta

SEQ ID NO: 762609 - DNA, 20 bp, Artificial
  CRISPR gRNA sequence
tattgagcaactacagatgt

SEQ ID NO: 762610 - DNA, 20 bp, Artificial
  CRISPR gRNA sequence
tacagatgtcagcactgtgt

SEQ ID NO: 762611 - DNA, 20 bp, Artificial
  CRISPR gRNA sequence
acagatgtcagcactgtgtt

SEQ ID NO: 762612 - DNA, 20 bp, Artificial
  CRISPR gRNA sequence
gtcagcactgtgttaggtgc

SEQ ID NO: 762613 - DNA, 20 bp, Artificial
  CRISPR gRNA sequence
tcagcactgtgttaggtgct

SEQ ID NO: 762614 - DNA, 20 bp, Artificial
  CRISPR gRNA sequence
cagcactgtgttaggtgctg

SEQ ID NO: 762615 - DNA, 20 bp, Artificial
  CRISPR gRNA sequence
agcactgtgttaggtgctgg

SEQ ID NO: 762616 - DNA, 20 bp, Artificial
  CRISPR gRNA sequence
taggtgctgggggccctgcg

SEQ ID NO: 762617 - DNA, 20 bp, Artificial
  CRISPR gRNA sequence
aggtgctgggggccctgcgt

SEQ ID NO: 762618 - DNA, 20 bp, Artificial
  CRISPR gRNA sequence
tgctgggggccctgcgtggg

SEQ ID NO: 762619 - DNA, 20 bp, Artificial
  CRISPR gRNA sequence
gggccctgcgtgggaagata

SEQ ID NO: 762620 - DNA, 20 bp, Artificial
  CRISPR gRNA sequence
gaagataaagttcctccctc

SEQ ID NO: 762621 - DNA, 20 bp, Artificial
  CRISPR gRNA sequence
aagataaagttcctccctca

SEQ ID NO: 762622 - DNA, 20 bp, Artificial
  CRISPR gRNA sequence
tccctcaaggactccccatc

SEQ ID NO: 762623 - DNA, 20 bp, Artificial
  CRISPR gRNA sequence
tcaaggactccccatccagc

SEQ ID NO: 762624 - DNA, 20 bp, Artificial
  CRISPR gRNA sequence
caaggactccccatccagct

SEQ ID NO: 762625 - DNA, 20 bp, Artificial
  CRISPR gRNA sequence
aggactccccatccagctgg

SEQ ID NO: 762626 - DNA, 20 bp, Artificial
  CRISPR gRNA sequence
ctccccatccagctgggaga

SEQ ID NO: 762627 - DNA, 20 bp, Artificial
  CRISPR gRNA sequence
actaactacactgcaccctg

SEQ ID NO: 762628 - DNA, 20 bp, Artificial
  CRISPR gRNA sequence
acactgcaccctgcggtttg

SEQ ID NO: 762629 - DNA, 20 bp, Artificial
  CRISPR gRNA sequence
cactgcaccctgcggtttgc

SEQ ID NO: 762630 - DNA, 20 bp, Artificial
  CRISPR gRNA sequence
actgcaccctgcggtttgca

SEQ ID NO: 762631 - DNA, 20 bp, Artificial
  CRISPR gRNA sequence
ctgcaccctgcggtttgcag

SEQ ID NO: 762632 - DNA, 20 bp, Artificial
  CRISPR gRNA sequence
tgcaccctgcggtttgcagg

SEQ ID NO: 762633 - DNA, 20 bp, Artificial
  CRISPR gRNA sequence
gtttgcagggggctcctgcc

SEQ ID NO: 762634 - DNA, 20 bp, Artificial
  CRISPR gRNA sequence
cctgctccacacctcctctg

SEQ ID NO: 762635 - DNA, 20 bp, Artificial
  CRISPR gRNA sequence
ccacacctcctctgtggctc

SEQ ID NO: 762636 - DNA, 20 bp, Artificial
  CRISPR gRNA sequence
cacacctcctctgtggctca

SEQ ID NO: 762637 - DNA, 20 bp, Artificial
  CRISPR gRNA sequence
ctctgtggctcaaggcttcc

SEQ ID NO: 762638 - DNA, 20 bp, Artificial
  CRISPR gRNA sequence
tcccacccataattcttacc

SEQ ID NO: 762639 - DNA, 20 bp, Artificial
  CRISPR gRNA sequence
ccacccataattcttaccca

SEQ ID NO: 762640 - DNA, 20 bp, Artificial
  CRISPR gRNA sequence
cataattcttacccagagca

SEQ ID NO: 762641 - DNA, 20 bp, Artificial
  CRISPR gRNA sequence
ataattcttacccagagcat

SEQ ID NO: 762642 - DNA, 20 bp, Artificial
  CRISPR gRNA sequence
taattcttacccagagcatg

SEQ ID NO: 762643 - DNA, 20 bp, Artificial
  CRISPR gRNA sequence
tcttacccagagcatggggt

SEQ ID NO: 762644 - DNA, 20 bp, Artificial
  CRISPR gRNA sequence
cttacccagagcatggggtt

SEQ ID NO: 762645 - DNA, 20 bp, Artificial
  CRISPR gRNA sequence
ttacccagagcatggggttg

SEQ ID NO: 762646 - DNA, 20 bp, Artificial
  CRISPR gRNA sequence
cccagagcatggggttgggg

SEQ ID NO: 762647 - DNA, 20 bp, Artificial
  CRISPR gRNA sequence
atggggttggggcggaaacc

SEQ ID NO: 762648 - DNA, 20 bp, Artificial
  CRISPR gRNA sequence
ggggttggggcggaaacctg

SEQ ID NO: 762649 - DNA, 20 bp, Artificial
  CRISPR gRNA sequence
ggttggggcggaaacctgga

SEQ ID NO: 762650 - DNA, 20 bp, Artificial
  CRISPR gRNA sequence
ttggggcggaaacctggaga

SEQ ID NO: 762651 - DNA, 20 bp, Artificial
  CRISPR gRNA sequence
tggggcggaaacctggagag

SEQ ID NO: 762652 - DNA, 20 bp, Artificial
  CRISPR gRNA sequence
ggggcggaaacctggagaga

SEQ ID NO: 762653 - DNA, 20 bp, Artificial
  CRISPR gRNA sequence
gaaacctggagagagggaca

SEQ ID NO: 762654 - DNA, 20 bp, Artificial
  CRISPR gRNA sequence
agggacatagcccctcgcca

SEQ ID NO: 762655 - DNA, 20 bp, Artificial
  CRISPR gRNA sequence
acatagcccctcgccacggc

SEQ ID NO: 762656 - DNA, 20 bp, Artificial
  CRISPR gRNA sequence
atagcccctcgccacggcta

SEQ ID NO: 762657 - DNA, 20 bp, Artificial
  CRISPR gRNA sequence
ctcgccacggctagagaatc

SEQ ID NO: 762658 - DNA, 20 bp, Artificial
  CRISPR gRNA sequence
gccacggctagagaatctgg

SEQ ID NO: 762659 - DNA, 20 bp, Artificial
  CRISPR gRNA sequence
tggtgtccaaaatgtctgtc

SEQ ID NO: 762660 - DNA, 20 bp, Artificial
  CRISPR gRNA sequence
ggtgtccaaaatgtctgtcc

SEQ ID NO: 762661 - DNA, 20 bp, Artificial
  CRISPR gRNA sequence
ccaaaatgtctgtccaggtg

SEQ ID NO: 762662 - DNA, 20 bp, Artificial
  CRISPR gRNA sequence
caaaatgtctgtccaggtgt

SEQ ID NO: 762663 - DNA, 20 bp, Artificial
  CRISPR gRNA sequence
aatgtctgtccaggtgtggg

SEQ ID NO: 762664 - DNA, 20 bp, Artificial
  CRISPR gRNA sequence
atgtctgtccaggtgtgggc

SEQ ID NO: 762665 - DNA, 20 bp, Artificial
  CRISPR gRNA sequence
tctgtccaggtgtgggcagg

SEQ ID NO: 762666 - DNA, 20 bp, Artificial
  CRISPR gRNA sequence
ctgtccaggtgtgggcaggt

SEQ ID NO: 762667 - DNA, 20 bp, Artificial
  CRISPR gRNA sequence
tccaggtgtgggcaggtggg

SEQ ID NO: 762668 - DNA, 20 bp, Artificial
  CRISPR gRNA sequence
ccaggtgtgggcaggtgggc

SEQ ID NO: 762669 - DNA, 20 bp, Artificial
  CRISPR gRNA sequence
tgggcaggtgggcaggcacc

SEQ ID NO: 762670 - DNA, 20 bp, Artificial
  CRISPR gRNA sequence
gggcaggtgggcaggcacca

SEQ ID NO: 762671 - DNA, 20 bp, Artificial
  CRISPR gRNA sequence
gggcaggcaccaaggccctc

SEQ ID NO: 762672 - DNA, 20 bp, Artificial
  CRISPR gRNA sequence
aaggccctctggacctttca

SEQ ID NO: 762673 - DNA, 20 bp, Artificial
  CRISPR gRNA sequence
gccctctggacctttcatag

SEQ ID NO: 762674 - DNA, 20 bp, Artificial
  CRISPR gRNA sequence
ctctggacctttcatagcag

SEQ ID NO: 762675 - DNA, 20 bp, Artificial
  CRISPR gRNA sequence
gacctttcatagcagcagaa

SEQ ID NO: 762676 - DNA, 20 bp, Artificial
  CRISPR gRNA sequence
acctttcatagcagcagaaa

SEQ ID NO: 762677 - DNA, 20 bp, Artificial
  CRISPR gRNA sequence
tttcatagcagcagaaaagg

SEQ ID NO: 762678 - DNA, 20 bp, Artificial
  CRISPR gRNA sequence
tcatagcagcagaaaaggca

SEQ ID NO: 762679 - DNA, 20 bp, Artificial
  CRISPR gRNA sequence
gcagcagaaaaggcagagcc

SEQ ID NO: 762680 - DNA, 20 bp, Artificial
  CRISPR gRNA sequence
cagcagaaaaggcagagcct

SEQ ID NO: 762681 - DNA, 20 bp, Artificial
  CRISPR gRNA sequence
agcagaaaaggcagagcctg

SEQ ID NO: 762682 - DNA, 20 bp, Artificial
  CRISPR gRNA sequence
agaaaaggcagagcctgggg

SEQ ID NO: 762683 - DNA, 20 bp, Artificial
  CRISPR gRNA sequence
gaaaaggcagagcctggggc

SEQ ID NO: 762684 - DNA, 20 bp, Artificial
  CRISPR gRNA sequence
aaaaggcagagcctggggca

SEQ ID NO: 762685 - DNA, 20 bp, Artificial
  CRISPR gRNA sequence
aggcagagcctggggcaggg

SEQ ID NO: 762686 - DNA, 20 bp, Artificial
  CRISPR gRNA sequence
ggcagagcctggggcagggc

SEQ ID NO: 762687 - DNA, 20 bp, Artificial
  CRISPR gRNA sequence
gcagagcctggggcagggca

SEQ ID NO: 762688 - DNA, 20 bp, Artificial
  CRISPR gRNA sequence
agcctggggcagggcagggc

SEQ ID NO: 762689 - DNA, 20 bp, Artificial
  CRISPR gRNA sequence
gcctggggcagggcagggcc

SEQ ID NO: 762690 - DNA, 20 bp, Artificial
  CRISPR gRNA sequence
gggcagggccaggaatgctt

SEQ ID NO: 762691 - DNA, 20 bp, Artificial
  CRISPR gRNA sequence
ggcagggccaggaatgcttt

SEQ ID NO: 762692 - DNA, 20 bp, Artificial
  CRISPR gRNA sequence
gcagggccaggaatgctttg

SEQ ID NO: 762693 - DNA, 20 bp, Artificial
  CRISPR gRNA sequence
aggaatgctttggggacacc

SEQ ID NO: 762694 - DNA, 20 bp, Artificial
  CRISPR gRNA sequence
ggaatgctttggggacaccg

SEQ ID NO: 762695 - DNA, 20 bp, Artificial
  CRISPR gRNA sequence
gaatgctttggggacaccga

SEQ ID NO: 762696 - DNA, 20 bp, Artificial
  CRISPR gRNA sequence
aatgctttggggacaccgag

SEQ ID NO: 762697 - DNA, 20 bp, Artificial
  CRISPR gRNA sequence
actgccccccacccccacca

SEQ ID NO: 762698 - DNA, 20 bp, Artificial
  CRISPR gRNA sequence
cccccaccatggtgctattc

SEQ ID NO: 762699 - DNA, 20 bp, Artificial
  CRISPR gRNA sequence
ccccaccatggtgctattct

SEQ ID NO: 762700 - DNA, 20 bp, Artificial
  CRISPR gRNA sequence
cccaccatggtgctattctg

SEQ ID NO: 762701 - DNA, 20 bp, Artificial
  CRISPR gRNA sequence
ccatggtgctattctggggc

SEQ ID NO: 762702 - DNA, 20 bp, Artificial
  CRISPR gRNA sequence
catggtgctattctggggct

SEQ ID NO: 762703 - DNA, 20 bp, Artificial
  CRISPR gRNA sequence
atggtgctattctggggctg

SEQ ID NO: 762704 - DNA, 20 bp, Artificial
  CRISPR gRNA sequence
gtgctattctggggctgggg

SEQ ID NO: 762705 - DNA, 20 bp, Artificial
  CRISPR gRNA sequence
gggctggggcagtcttttcc

SEQ ID NO: 762706 - DNA, 20 bp, Artificial
  CRISPR gRNA sequence
gtcttttcctggcttgcctc

SEQ ID NO: 762707 - DNA, 20 bp, Artificial
  CRISPR gRNA sequence
tttcctggcttgcctctggc

SEQ ID NO: 762708 - DNA, 20 bp, Artificial
  CRISPR gRNA sequence
gcttgcctctggccagctcc

SEQ ID NO: 762709 - DNA, 20 bp, Artificial
  CRISPR gRNA sequence
tctggccagctcctggcctc

SEQ ID NO: 762710 - DNA, 20 bp, Artificial
  CRISPR gRNA sequence
ggccagctcctggcctctgg

SEQ ID NO: 762711 - DNA, 20 bp, Artificial
  CRISPR gRNA sequence
ccagctcctggcctctggta

SEQ ID NO: 762712 - DNA, 20 bp, Artificial
  CRISPR gRNA sequence
ctcctggcctctggtagagt

SEQ ID NO: 762713 - DNA, 20 bp, Artificial
  CRISPR gRNA sequence
cctctggtagagtgagactt

SEQ ID NO: 762714 - DNA, 20 bp, Artificial
  CRISPR gRNA sequence
tcagacgttctgatgccttc

SEQ ID NO: 762715 - DNA, 20 bp, Artificial
  CRISPR gRNA sequence
gatgtcatctctccctgccc

SEQ ID NO: 762716 - DNA, 20 bp, Artificial
  CRISPR gRNA sequence
atgtcatctctccctgcccc

SEQ ID NO: 762717 - DNA, 20 bp, Artificial
  CRISPR gRNA sequence
atctctccctgccccaggaa

SEQ ID NO: 762718 - DNA, 20 bp, Artificial
  CRISPR gRNA sequence
tctccctgccccaggaatgg

SEQ ID NO: 762719 - DNA, 20 bp, Artificial
  CRISPR gRNA sequence
gccccaggaatggaagatgt

SEQ ID NO: 762720 - DNA, 20 bp, Artificial
  CRISPR gRNA sequence
ccccaggaatggaagatgtg

SEQ ID NO: 762721 - DNA, 20 bp, Artificial
  CRISPR gRNA sequence
gaggacttctaatttaaatg

SEQ ID NO: 762722 - DNA, 20 bp, Artificial
  CRISPR gRNA sequence
aggacttctaatttaaatgt

SEQ ID NO: 762723 - DNA, 20 bp, Artificial
  CRISPR gRNA sequence
tctaatttaaatgtgggact

SEQ ID NO: 762724 - DNA, 20 bp, Artificial
  CRISPR gRNA sequence
taatttaaatgtgggactcg

SEQ ID NO: 762725 - DNA, 20 bp, Artificial
  CRISPR gRNA sequence
aatttaaatgtgggactcgg

SEQ ID NO: 762726 - DNA, 20 bp, Artificial
  CRISPR gRNA sequence
atttaaatgtgggactcgga

SEQ ID NO: 762727 - DNA, 20 bp, Artificial
  CRISPR gRNA sequence
ctcggagggattttgtaaac

SEQ ID NO: 762728 - DNA, 20 bp, Artificial
  CRISPR gRNA sequence
tcggagggattttgtaaact

SEQ ID NO: 762729 - DNA, 20 bp, Artificial
  CRISPR gRNA sequence
cggagggattttgtaaactg

SEQ ID NO: 762730 - DNA, 20 bp, Artificial
  CRISPR gRNA sequence
ggagggattttgtaaactgg

SEQ ID NO: 762731 - DNA, 20 bp, Artificial
  CRISPR gRNA sequence
tgtaaactgggggtatattt

SEQ ID NO: 762732 - DNA, 20 bp, Artificial
  CRISPR gRNA sequence
gtaaactgggggtatatttt

SEQ ID NO: 762733 - DNA, 20 bp, Artificial
  CRISPR gRNA sequence
taaactgggggtatattttg

SEQ ID NO: 762734 - DNA, 20 bp, Artificial
  CRISPR gRNA sequence
aaaataaatgtctttgtaaa

SEQ ID NO: 762735 - DNA, 20 bp, Artificial
  CRISPR gRNA sequence
taaaaagctttttctctgtg

SEQ ID NO: 762736 - DNA, 20 bp, Artificial
  CRISPR gRNA sequence
ctttttctctgtgaagtgtt

SEQ ID NO: 762737 - DNA, 20 bp, Artificial
  CRISPR gRNA sequence
tttctctgtgaagtgtttgg

SEQ ID NO: 762738 - DNA, 20 bp, Artificial
  CRISPR gRNA sequence
ctctgtgaagtgtttggaag

SEQ ID NO: 762739 - DNA, 20 bp, Artificial
  CRISPR gRNA sequence
tctgtgaagtgtttggaagc

SEQ ID NO: 762740 - DNA, 20 bp, Artificial
  CRISPR gRNA sequence
ctgtgaagtgtttggaagca

SEQ ID NO: 762741 - DNA, 20 bp, Artificial
  CRISPR gRNA sequence
tgaagtgtttggaagcaggg

SEQ ID NO: 762742 - DNA, 20 bp, Artificial
  CRISPR gRNA sequence
gaagtgtttggaagcagggt

SEQ ID NO: 762743 - DNA, 20 bp, Artificial
  CRISPR gRNA sequence
tttggaagcagggtgggccc

SEQ ID NO: 762744 - DNA, 20 bp, Artificial
  CRISPR gRNA sequence
ttggaagcagggtgggcccc

SEQ ID NO: 762745 - DNA, 20 bp, Artificial
  CRISPR gRNA sequence
ggtgggccccaggactcaac

SEQ ID NO: 762746 - DNA, 20 bp, Artificial
  CRISPR gRNA sequence
gggccccaggactcaaccag

SEQ ID NO: 762747 - DNA, 20 bp, Artificial
  CRISPR gRNA sequence
ggccccaggactcaaccagc

SEQ ID NO: 762748 - DNA, 20 bp, Artificial
  CRISPR gRNA sequence
caaccagcaggattctctcc

SEQ ID NO: 762749 - DNA, 20 bp, Artificial
  CRISPR gRNA sequence
ggattctctcctggatgttg

SEQ ID NO: 762750 - DNA, 20 bp, Artificial
  CRISPR gRNA sequence
gattctctcctggatgttgc

SEQ ID NO: 762751 - DNA, 20 bp, Artificial
  CRISPR gRNA sequence
ctctcctggatgttgcaggc

SEQ ID NO: 762752 - DNA, 20 bp, Artificial
  CRISPR gRNA sequence
tctcctggatgttgcaggct

SEQ ID NO: 762753 - DNA, 20 bp, Artificial
  CRISPR gRNA sequence
ctcctggatgttgcaggctg

SEQ ID NO: 762754 - DNA, 20 bp, Artificial
  CRISPR gRNA sequence
ctggatgttgcaggctgggg

SEQ ID NO: 762755 - DNA, 20 bp, Artificial
  CRISPR gRNA sequence
tggatgttgcaggctggggt

SEQ ID NO: 762756 - DNA, 20 bp, Artificial
  CRISPR gRNA sequence
ggatgttgcaggctggggta

SEQ ID NO: 762757 - DNA, 20 bp, Artificial
  CRISPR gRNA sequence
tgttgcaggctggggtaggg

SEQ ID NO: 762758 - DNA, 20 bp, Artificial
  CRISPR gRNA sequence
caggctggggtagggaagcc

SEQ ID NO: 762759 - DNA, 20 bp, Artificial
  CRISPR gRNA sequence
agggccaggcttccctaccc

SEQ ID NO: 762760 - DNA, 20 bp, Artificial
  CRISPR gRNA sequence
ctaccccagcctgcaacatc

SEQ ID NO: 762761 - DNA, 20 bp, Artificial
  CRISPR gRNA sequence
taccccagcctgcaacatcc

SEQ ID NO: 762762 - DNA, 20 bp, Artificial
  CRISPR gRNA sequence
ccccagcctgcaacatccag

SEQ ID NO: 762763 - DNA, 20 bp, Artificial
  CRISPR gRNA sequence
ccagcctgcaacatccagga

SEQ ID NO: 762764 - DNA, 20 bp, Artificial
  CRISPR gRNA sequence
catccaggagagaatcctgc

SEQ ID NO: 762765 - DNA, 20 bp, Artificial
  CRISPR gRNA sequence
aggagagaatcctgctggtt

SEQ ID NO: 762766 - DNA, 20 bp, Artificial
  CRISPR gRNA sequence
gaatcctgctggttgagtcc

SEQ ID NO: 762767 - DNA, 20 bp, Artificial
  CRISPR gRNA sequence
aatcctgctggttgagtcct

SEQ ID NO: 762768 - DNA, 20 bp, Artificial
  CRISPR gRNA sequence
atcctgctggttgagtcctg

SEQ ID NO: 762769 - DNA, 20 bp, Artificial
  CRISPR gRNA sequence
ccctgcttccaaacacttca

SEQ ID NO: 762770 - DNA, 20 bp, Artificial
  CRISPR gRNA sequence
ctgcttccaaacacttcaca

SEQ ID NO: 762771 - DNA, 20 bp, Artificial
  CRISPR gRNA sequence
ccaaacacttcacagagaaa

SEQ ID NO: 762772 - DNA, 20 bp, Artificial
  CRISPR gRNA sequence
cagagaaaaagctttttaca

SEQ ID NO: 762773 - DNA, 20 bp, Artificial
  CRISPR gRNA sequence
ttttccccaaaatatacccc

SEQ ID NO: 762774 - DNA, 20 bp, Artificial
  CRISPR gRNA sequence
ccagtttacaaaatccctcc

SEQ ID NO: 762775 - DNA, 20 bp, Artificial
  CRISPR gRNA sequence
tccgagtcccacatttaaat

SEQ ID NO: 762776 - DNA, 20 bp, Artificial
  CRISPR gRNA sequence
gagtcccacatttaaattag

SEQ ID NO: 762777 - DNA, 20 bp, Artificial
  CRISPR gRNA sequence
gtcctcacatcttccattcc

SEQ ID NO: 762778 - DNA, 20 bp, Artificial
  CRISPR gRNA sequence
tcctcacatcttccattcct

SEQ ID NO: 762779 - DNA, 20 bp, Artificial
  CRISPR gRNA sequence
cctcacatcttccattcctg

SEQ ID NO: 762780 - DNA, 20 bp, Artificial
  CRISPR gRNA sequence
cacatcttccattcctgggg

SEQ ID NO: 762781 - DNA, 20 bp, Artificial
  CRISPR gRNA sequence
acatcttccattcctggggc

SEQ ID NO: 762782 - DNA, 20 bp, Artificial
  CRISPR gRNA sequence
catcttccattcctggggca

SEQ ID NO: 762783 - DNA, 20 bp, Artificial
  CRISPR gRNA sequence
tcttccattcctggggcagg

SEQ ID NO: 762784 - DNA, 20 bp, Artificial
  CRISPR gRNA sequence
ttccattcctggggcaggga

SEQ ID NO: 762785 - DNA, 20 bp, Artificial
  CRISPR gRNA sequence
gggcagggagagatgacatc

SEQ ID NO: 762786 - DNA, 20 bp, Artificial
  CRISPR gRNA sequence
cagggagagatgacatccgg

SEQ ID NO: 762787 - DNA, 20 bp, Artificial
  CRISPR gRNA sequence
agggagagatgacatccgga

SEQ ID NO: 762788 - DNA, 20 bp, Artificial
  CRISPR gRNA sequence
agatgacatccggaaggcat

SEQ ID NO: 762789 - DNA, 20 bp, Artificial
  CRISPR gRNA sequence
ggaaggcatcagaacgtctg

SEQ ID NO: 762790 - DNA, 20 bp, Artificial
  CRISPR gRNA sequence
cgtctgaagtctcactctac

SEQ ID NO: 762791 - DNA, 20 bp, Artificial
  CRISPR gRNA sequence
tctgaagtctcactctacca

SEQ ID NO: 762792 - DNA, 20 bp, Artificial
  CRISPR gRNA sequence
ctgaagtctcactctaccag

SEQ ID NO: 762793 - DNA, 20 bp, Artificial
  CRISPR gRNA sequence
agtctcactctaccagaggc

SEQ ID NO: 762794 - DNA, 20 bp, Artificial
  CRISPR gRNA sequence
gtctcactctaccagaggcc

SEQ ID NO: 762795 - DNA, 20 bp, Artificial
  CRISPR gRNA sequence
ctcactctaccagaggccag

SEQ ID NO: 762796 - DNA, 20 bp, Artificial
  CRISPR gRNA sequence
ctctaccagaggccaggagc

SEQ ID NO: 762797 - DNA, 20 bp, Artificial
  CRISPR gRNA sequence
accagaggccaggagctggc

SEQ ID NO: 762798 - DNA, 20 bp, Artificial
  CRISPR gRNA sequence
cagaggccaggagctggcca

SEQ ID NO: 762799 - DNA, 20 bp, Artificial
  CRISPR gRNA sequence
agaggccaggagctggccag

SEQ ID NO: 762800 - DNA, 20 bp, Artificial
  CRISPR gRNA sequence
gccaggagctggccagaggc

SEQ ID NO: 762801 - DNA, 20 bp, Artificial
  CRISPR gRNA sequence
ggagctggccagaggcaagc

SEQ ID NO: 762802 - DNA, 20 bp, Artificial
  CRISPR gRNA sequence
gagctggccagaggcaagcc

SEQ ID NO: 762803 - DNA, 20 bp, Artificial
  CRISPR gRNA sequence
ggccagaggcaagccaggaa

SEQ ID NO: 762804 - DNA, 20 bp, Artificial
  CRISPR gRNA sequence
aagccaggaaaagactgccc

SEQ ID NO: 762805 - DNA, 20 bp, Artificial
  CRISPR gRNA sequence
ggaaaagactgccccagccc

SEQ ID NO: 762806 - DNA, 20 bp, Artificial
  CRISPR gRNA sequence
agactgccccagccccagaa

SEQ ID NO: 762807 - DNA, 20 bp, Artificial
  CRISPR gRNA sequence
ccagccccagaatagcacca

SEQ ID NO: 762808 - DNA, 20 bp, Artificial
  CRISPR gRNA sequence
gccccagaatagcaccatgg

SEQ ID NO: 762809 - DNA, 20 bp, Artificial
  CRISPR gRNA sequence
ccccagaatagcaccatggt

SEQ ID NO: 762810 - DNA, 20 bp, Artificial
  CRISPR gRNA sequence
cccagaatagcaccatggtg

SEQ ID NO: 762811 - DNA, 20 bp, Artificial
  CRISPR gRNA sequence
ccagaatagcaccatggtgg

SEQ ID NO: 762812 - DNA, 20 bp, Artificial
  CRISPR gRNA sequence
gaatagcaccatggtggggg

SEQ ID NO: 762813 - DNA, 20 bp, Artificial
  CRISPR gRNA sequence
aatagcaccatggtgggggt

SEQ ID NO: 762814 - DNA, 20 bp, Artificial
  CRISPR gRNA sequence
atagcaccatggtgggggtg

SEQ ID NO: 762815 - DNA, 20 bp, Artificial
  CRISPR gRNA sequence
tagcaccatggtgggggtgg

SEQ ID NO: 762816 - DNA, 20 bp, Artificial
  CRISPR gRNA sequence
agcaccatggtgggggtggg

SEQ ID NO: 762817 - DNA, 20 bp, Artificial
  CRISPR gRNA sequence
accatggtgggggtgggggg

SEQ ID NO: 762818 - DNA, 20 bp, Artificial
  CRISPR gRNA sequence
ggggtggggggcagtcccct

SEQ ID NO: 762819 - DNA, 20 bp, Artificial
  CRISPR gRNA sequence
cagtcccctcggtgtcccca

SEQ ID NO: 762820 - DNA, 20 bp, Artificial
  CRISPR gRNA sequence
cggtgtccccaaagcattcc

SEQ ID NO: 762821 - DNA, 20 bp, Artificial
  CRISPR gRNA sequence
ttcctggccctgccctgccc

SEQ ID NO: 762822 - DNA, 20 bp, Artificial
  CRISPR gRNA sequence
tcctggccctgccctgcccc

SEQ ID NO: 762823 - DNA, 20 bp, Artificial
  CRISPR gRNA sequence
tgccttttctgctgctatga

SEQ ID NO: 762824 - DNA, 20 bp, Artificial
  CRISPR gRNA sequence
gccttttctgctgctatgaa

SEQ ID NO: 762825 - DNA, 20 bp, Artificial
  CRISPR gRNA sequence
ttctgctgctatgaaaggtc

SEQ ID NO: 762826 - DNA, 20 bp, Artificial
  CRISPR gRNA sequence
ctgctgctatgaaaggtcca

SEQ ID NO: 762827 - DNA, 20 bp, Artificial
  CRISPR gRNA sequence
tgctgctatgaaaggtccag

SEQ ID NO: 762828 - DNA, 20 bp, Artificial
  CRISPR gRNA sequence
gctgctatgaaaggtccaga

SEQ ID NO: 762829 - DNA, 20 bp, Artificial
  CRISPR gRNA sequence
atgaaaggtccagagggcct

SEQ ID NO: 762830 - DNA, 20 bp, Artificial
  CRISPR gRNA sequence
cctgcccacctgcccacacc

SEQ ID NO: 762831 - DNA, 20 bp, Artificial
  CRISPR gRNA sequence
cccacctgcccacacctgga

SEQ ID NO: 762832 - DNA, 20 bp, Artificial
  CRISPR gRNA sequence
ccacacctggacagacattt

SEQ ID NO: 762833 - DNA, 20 bp, Artificial
  CRISPR gRNA sequence
acagacattttggacaccac

SEQ ID NO: 762834 - DNA, 20 bp, Artificial
  CRISPR gRNA sequence
ttggacaccaccagattctc

SEQ ID NO: 762835 - DNA, 20 bp, Artificial
  CRISPR gRNA sequence
accaccagattctctagccg

SEQ ID NO: 762836 - DNA, 20 bp, Artificial
  CRISPR gRNA sequence
ccagattctctagccgtggc

SEQ ID NO: 762837 - DNA, 20 bp, Artificial
  CRISPR gRNA sequence
cagattctctagccgtggcg

SEQ ID NO: 762838 - DNA, 20 bp, Artificial
  CRISPR gRNA sequence
agattctctagccgtggcga

SEQ ID NO: 762839 - DNA, 20 bp, Artificial
  CRISPR gRNA sequence
gattctctagccgtggcgag

SEQ ID NO: 762840 - DNA, 20 bp, Artificial
  CRISPR gRNA sequence
aggggctatgtccctctctc

SEQ ID NO: 762841 - DNA, 20 bp, Artificial
  CRISPR gRNA sequence
ggggctatgtccctctctcc

SEQ ID NO: 762842 - DNA, 20 bp, Artificial
  CRISPR gRNA sequence
tccgccccaaccccatgctc

SEQ ID NO: 762843 - DNA, 20 bp, Artificial
  CRISPR gRNA sequence
ccgccccaaccccatgctct

SEQ ID NO: 762844 - DNA, 20 bp, Artificial
  CRISPR gRNA sequence
cccaaccccatgctctgggt

SEQ ID NO: 762845 - DNA, 20 bp, Artificial
  CRISPR gRNA sequence
catgctctgggtaagaatta

SEQ ID NO: 762846 - DNA, 20 bp, Artificial
  CRISPR gRNA sequence
atgctctgggtaagaattat

SEQ ID NO: 762847 - DNA, 20 bp, Artificial
  CRISPR gRNA sequence
ctctgggtaagaattatggg

SEQ ID NO: 762848 - DNA, 20 bp, Artificial
  CRISPR gRNA sequence
tctgggtaagaattatgggt

SEQ ID NO: 762849 - DNA, 20 bp, Artificial
  CRISPR gRNA sequence
ggtaagaattatgggtggga

SEQ ID NO: 762850 - DNA, 20 bp, Artificial
  CRISPR gRNA sequence
gtaagaattatgggtgggat

SEQ ID NO: 762851 - DNA, 20 bp, Artificial
  CRISPR gRNA sequence
taagaattatgggtgggatg

SEQ ID NO: 762852 - DNA, 20 bp, Artificial
  CRISPR gRNA sequence
aagaattatgggtgggatgg

SEQ ID NO: 762853 - DNA, 20 bp, Artificial
  CRISPR gRNA sequence
attatgggtgggatgggggt

SEQ ID NO: 762854 - DNA, 20 bp, Artificial
  CRISPR gRNA sequence
ttatgggtgggatgggggtg

SEQ ID NO: 762855 - DNA, 20 bp, Artificial
  CRISPR gRNA sequence
tgggatgggggtgaggtatc

SEQ ID NO: 762856 - DNA, 20 bp, Artificial
  CRISPR gRNA sequence
gggatgggggtgaggtatcc

SEQ ID NO: 762857 - DNA, 20 bp, Artificial
  CRISPR gRNA sequence
atgggggtgaggtatccagg

SEQ ID NO: 762858 - DNA, 20 bp, Artificial
  CRISPR gRNA sequence
tgaggtatccaggaagcctt

SEQ ID NO: 762859 - DNA, 20 bp, Artificial
  CRISPR gRNA sequence
atccaggaagccttgagcca

SEQ ID NO: 762860 - DNA, 20 bp, Artificial
  CRISPR gRNA sequence
ccaggaagccttgagccaca

SEQ ID NO: 762861 - DNA, 20 bp, Artificial
  CRISPR gRNA sequence
caggaagccttgagccacag

SEQ ID NO: 762862 - DNA, 20 bp, Artificial
  CRISPR gRNA sequence
ggaagccttgagccacagag

SEQ ID NO: 762863 - DNA, 20 bp, Artificial
  CRISPR gRNA sequence
gaagccttgagccacagagg

SEQ ID NO: 762864 - DNA, 20 bp, Artificial
  CRISPR gRNA sequence
cttgagccacagaggaggtg

SEQ ID NO: 762865 - DNA, 20 bp, Artificial
  CRISPR gRNA sequence
tgagccacagaggaggtgtg

SEQ ID NO: 762866 - DNA, 20 bp, Artificial
  CRISPR gRNA sequence
gccacagaggaggtgtggag

SEQ ID NO: 762867 - DNA, 20 bp, Artificial
  CRISPR gRNA sequence
ccacagaggaggtgtggagc

SEQ ID NO: 762868 - DNA, 20 bp, Artificial
  CRISPR gRNA sequence
cacagaggaggtgtggagca

SEQ ID NO: 762869 - DNA, 20 bp, Artificial
  CRISPR gRNA sequence
cagaggaggtgtggagcagg

SEQ ID NO: 762870 - DNA, 20 bp, Artificial
  CRISPR gRNA sequence
ggaggtgtggagcagggagc

SEQ ID NO: 762871 - DNA, 20 bp, Artificial
  CRISPR gRNA sequence
gaggtgtggagcagggagcc

SEQ ID NO: 762872 - DNA, 20 bp, Artificial
  CRISPR gRNA sequence
gtgtggagcagggagccagg

SEQ ID NO: 762873 - DNA, 20 bp, Artificial
  CRISPR gRNA sequence
tgtggagcagggagccaggc

SEQ ID NO: 762874 - DNA, 20 bp, Artificial
  CRISPR gRNA sequence
tggagcagggagccaggcag

SEQ ID NO: 762875 - DNA, 20 bp, Artificial
  CRISPR gRNA sequence
caggagccccctgcaaaccg

SEQ ID NO: 762876 - DNA, 20 bp, Artificial
  CRISPR gRNA sequence
aggagccccctgcaaaccgc

SEQ ID NO: 762877 - DNA, 20 bp, Artificial
  CRISPR gRNA sequence
ggagccccctgcaaaccgca

SEQ ID NO: 762878 - DNA, 20 bp, Artificial
  CRISPR gRNA sequence
cccctgcaaaccgcagggtg

SEQ ID NO: 762879 - DNA, 20 bp, Artificial
  CRISPR gRNA sequence
gcaaaccgcagggtgcagtg

SEQ ID NO: 762880 - DNA, 20 bp, Artificial
  CRISPR gRNA sequence
accgcagggtgcagtgtagt

SEQ ID NO: 762881 - DNA, 20 bp, Artificial
  CRISPR gRNA sequence
gtagttagttgtctgtctcc

SEQ ID NO: 762882 - DNA, 20 bp, Artificial
  CRISPR gRNA sequence
ttagttgtctgtctcccagc

SEQ ID NO: 762883 - DNA, 20 bp, Artificial
  CRISPR gRNA sequence
ttgtctgtctcccagctgga

SEQ ID NO: 762884 - DNA, 20 bp, Artificial
  CRISPR gRNA sequence
tgtctgtctcccagctggat

SEQ ID NO: 762885 - DNA, 20 bp, Artificial
  CRISPR gRNA sequence
gtctgtctcccagctggatg

SEQ ID NO: 762886 - DNA, 20 bp, Artificial
  CRISPR gRNA sequence
ctgtctcccagctggatggg

SEQ ID NO: 762887 - DNA, 20 bp, Artificial
  CRISPR gRNA sequence
cagctggatggggagtcctt

SEQ ID NO: 762888 - DNA, 20 bp, Artificial
  CRISPR gRNA sequence
agctggatggggagtccttg

SEQ ID NO: 762889 - DNA, 20 bp, Artificial
  CRISPR gRNA sequence
gctggatggggagtccttga

SEQ ID NO: 762890 - DNA, 20 bp, Artificial
  CRISPR gRNA sequence
tggatggggagtccttgagg

SEQ ID NO: 762891 - DNA, 20 bp, Artificial
  CRISPR gRNA sequence
ggatggggagtccttgaggg

SEQ ID NO: 762892 - DNA, 20 bp, Artificial
  CRISPR gRNA sequence
aggaactttatcttcccacg

SEQ ID NO: 762893 - DNA, 20 bp, Artificial
  CRISPR gRNA sequence
ggaactttatcttcccacgc

SEQ ID NO: 762894 - DNA, 20 bp, Artificial
  CRISPR gRNA sequence
gaactttatcttcccacgca

SEQ ID NO: 762895 - DNA, 20 bp, Artificial
  CRISPR gRNA sequence
atcttcccacgcagggcccc

SEQ ID NO: 762896 - DNA, 20 bp, Artificial
  CRISPR gRNA sequence
agggcccccagcacctaaca

SEQ ID NO: 762897 - DNA, 20 bp, Artificial
  CRISPR gRNA sequence
taacacagtgctgacatctg

SEQ ID NO: 762898 - DNA, 20 bp, Artificial
  CRISPR gRNA sequence
ctcaataaacatcaactgaa

SEQ ID NO: 762899 - DNA, 20 bp, Artificial
  CRISPR gRNA sequence
caactgaatggatacatgaa

SEQ ID NO: 762900 - DNA, 20 bp, Artificial
  CRISPR gRNA sequence
tgaatggatacatgaaaaga

SEQ ID NO: 762901 - DNA, 20 bp, Artificial
  CRISPR gRNA sequence
gaatggatacatgaaaagaa

SEQ ID NO: 762902 - DNA, 20 bp, Artificial
  CRISPR gRNA sequence
tacatgaaaagaaaggaaca

SEQ ID NO: 762903 - DNA, 20 bp, Artificial
  CRISPR gRNA sequence
catgaaaagaaaggaacaaa

SEQ ID NO: 762904 - DNA, 20 bp, Artificial
  CRISPR gRNA sequence
atgaaaagaaaggaacaaag

SEQ ID NO: 762905 - DNA, 20 bp, Artificial
  CRISPR gRNA sequence
aaagaaaggaacaaagaggt

SEQ ID NO: 762906 - DNA, 20 bp, Artificial
  CRISPR gRNA sequence
gaaaggaacaaagaggtgag

SEQ ID NO: 762907 - DNA, 20 bp, Artificial
  CRISPR gRNA sequence
aaaggaacaaagaggtgaga

SEQ ID NO: 762908 - DNA, 20 bp, Artificial
  CRISPR gRNA sequence
ggaacaaagaggtgagaagg

SEQ ID NO: 762909 - DNA, 20 bp, Artificial
  CRISPR gRNA sequence
aacaaagaggtgagaaggca

SEQ ID NO: 762910 - DNA, 20 bp, Artificial
  CRISPR gRNA sequence
acaaagaggtgagaaggcag

SEQ ID NO: 762911 - DNA, 20 bp, Artificial
  CRISPR gRNA sequence
caaagaggtgagaaggcaga

SEQ ID NO: 762912 - DNA, 20 bp, Artificial
  CRISPR gRNA sequence
gaggtgagaaggcagaggga

SEQ ID NO: 762913 - DNA, 20 bp, Artificial
  CRISPR gRNA sequence
gtgagaaggcagagggacag

SEQ ID NO: 762914 - DNA, 20 bp, Artificial
  CRISPR gRNA sequence
gagggacagaagctgacccc

SEQ ID NO: 762915 - DNA, 20 bp, Artificial
  CRISPR gRNA sequence
agggacagaagctgaccccc

SEQ ID NO: 762916 - DNA, 20 bp, Artificial
  CRISPR gRNA sequence
gggacagaagctgaccccca

SEQ ID NO: 762917 - DNA, 20 bp, Artificial
  CRISPR gRNA sequence
ggacagaagctgacccccag

SEQ ID NO: 762918 - DNA, 20 bp, Artificial
  CRISPR gRNA sequence
gacccccaggggccccatca

SEQ ID NO: 762919 - DNA, 20 bp, Artificial
  CRISPR gRNA sequence
ggggccccatcacagacccc

SEQ ID NO: 762920 - DNA, 20 bp, Artificial
  CRISPR gRNA sequence
ggccccatcacagacccctg

SEQ ID NO: 762921 - DNA, 20 bp, Artificial
  CRISPR gRNA sequence
atcacagacccctggagaac

SEQ ID NO: 762922 - DNA, 20 bp, Artificial
  CRISPR gRNA sequence
ccctggagaaccagtgtgac

SEQ ID NO: 762923 - DNA, 20 bp, Artificial
  CRISPR gRNA sequence
gtgaccagcacatgcttccg

SEQ ID NO: 762924 - DNA, 20 bp, Artificial
  CRISPR gRNA sequence
tgaccagcacatgcttccgt

SEQ ID NO: 762925 - DNA, 20 bp, Artificial
  CRISPR gRNA sequence
gaccagcacatgcttccgtg

SEQ ID NO: 762926 - DNA, 20 bp, Artificial
  CRISPR gRNA sequence
ccagcacatgcttccgtggg

SEQ ID NO: 762927 - DNA, 20 bp, Artificial
  CRISPR gRNA sequence
cagcacatgcttccgtgggg

SEQ ID NO: 762928 - DNA, 20 bp, Artificial
  CRISPR gRNA sequence
acatgcttccgtggggagga

SEQ ID NO: 762929 - DNA, 20 bp, Artificial
  CRISPR gRNA sequence
catgcttccgtggggaggat

SEQ ID NO: 762930 - DNA, 20 bp, Artificial
  CRISPR gRNA sequence
gcttccgtggggaggatggg

SEQ ID NO: 762931 - DNA, 20 bp, Artificial
  CRISPR gRNA sequence
cttccgtggggaggatgggc

SEQ ID NO: 762932 - DNA, 20 bp, Artificial
  CRISPR gRNA sequence
ttccgtggggaggatgggca

SEQ ID NO: 762933 - DNA, 20 bp, Artificial
  CRISPR gRNA sequence
tccgtggggaggatgggcag

SEQ ID NO: 762934 - DNA, 20 bp, Artificial
  CRISPR gRNA sequence
cgtggggaggatgggcaggg

SEQ ID NO: 762935 - DNA, 20 bp, Artificial
  CRISPR gRNA sequence
tggggaggatgggcagggga

SEQ ID NO: 762936 - DNA, 20 bp, Artificial
  CRISPR gRNA sequence
ggggaggatgggcaggggag

SEQ ID NO: 762937 - DNA, 20 bp, Artificial
  CRISPR gRNA sequence
gggaggatgggcaggggaga

SEQ ID NO: 762938 - DNA, 20 bp, Artificial
  CRISPR gRNA sequence
ggaggatgggcaggggagag

SEQ ID NO: 762939 - DNA, 20 bp, Artificial
  CRISPR gRNA sequence
ggcaggggagaggggcactg

SEQ ID NO: 762940 - DNA, 20 bp, Artificial
  CRISPR gRNA sequence
caggggagaggggcactgca

SEQ ID NO: 762941 - DNA, 20 bp, Artificial
  CRISPR gRNA sequence
aggggagaggggcactgcag

SEQ ID NO: 762942 - DNA, 20 bp, Artificial
  CRISPR gRNA sequence
gggagaggggcactgcagag

SEQ ID NO: 762943 - DNA, 20 bp, Artificial
  CRISPR gRNA sequence
ggagaggggcactgcagagg

SEQ ID NO: 762944 - DNA, 20 bp, Artificial
  CRISPR gRNA sequence
aggggcactgcagaggaggc

SEQ ID NO: 762945 - DNA, 20 bp, Artificial
  CRISPR gRNA sequence
ggggcactgcagaggaggct

SEQ ID NO: 762946 - DNA, 20 bp, Artificial
  CRISPR gRNA sequence
cactgcagaggaggctgggc

SEQ ID NO: 762947 - DNA, 20 bp, Artificial
  CRISPR gRNA sequence
actgcagaggaggctgggcc

SEQ ID NO: 762948 - DNA, 20 bp, Artificial
  CRISPR gRNA sequence
ctgcagaggaggctgggcca

SEQ ID NO: 762949 - DNA, 20 bp, Artificial
  CRISPR gRNA sequence
tgcagaggaggctgggccag

SEQ ID NO: 762950 - DNA, 20 bp, Artificial
  CRISPR gRNA sequence
gcagaggaggctgggccagg

SEQ ID NO: 762951 - DNA, 20 bp, Artificial
  CRISPR gRNA sequence
cagaggaggctgggccaggg

SEQ ID NO: 762952 - DNA, 20 bp, Artificial
  CRISPR gRNA sequence
ggggggaaccacacgtgttc

SEQ ID NO: 762953 - DNA, 20 bp, Artificial
  CRISPR gRNA sequence
tgttccagcacgtgcacctg

SEQ ID NO: 762954 - DNA, 20 bp, Artificial
  CRISPR gRNA sequence
gttccagcacgtgcacctgc

SEQ ID NO: 762955 - DNA, 20 bp, Artificial
  CRISPR gRNA sequence
cacctgcaggtctccatgca

SEQ ID NO: 762956 - DNA, 20 bp, Artificial
  CRISPR gRNA sequence
tccatgcacagctgtgcatg

SEQ ID NO: 762957 - DNA, 20 bp, Artificial
  CRISPR gRNA sequence
atgcacagctgtgcatgtgg

SEQ ID NO: 762958 - DNA, 20 bp, Artificial
  CRISPR gRNA sequence
tgcacagctgtgcatgtggt

SEQ ID NO: 762959 - DNA, 20 bp, Artificial
  CRISPR gRNA sequence
agctgtgcatgtggtgggcg

SEQ ID NO: 762960 - DNA, 20 bp, Artificial
  CRISPR gRNA sequence
ctgtgcatgtggtgggcgca

SEQ ID NO: 762961 - DNA, 20 bp, Artificial
  CRISPR gRNA sequence
cagagtgccctgtcttcact

SEQ ID NO: 762962 - DNA, 20 bp, Artificial
  CRISPR gRNA sequence
agagtgccctgtcttcactt

SEQ ID NO: 762963 - DNA, 20 bp, Artificial
  CRISPR gRNA sequence
gagtgccctgtcttcacttg

SEQ ID NO: 762964 - DNA, 20 bp, Artificial
  CRISPR gRNA sequence
tgccctgtcttcacttgggg

SEQ ID NO: 762965 - DNA, 20 bp, Artificial
  CRISPR gRNA sequence
gccctgtcttcacttggggc

SEQ ID NO: 762966 - DNA, 20 bp, Artificial
  CRISPR gRNA sequence
ccctgtcttcacttggggca

SEQ ID NO: 762967 - DNA, 20 bp, Artificial
  CRISPR gRNA sequence
ctgtcttcacttggggcagg

SEQ ID NO: 762968 - DNA, 20 bp, Artificial
  CRISPR gRNA sequence
tgtcttcacttggggcaggg

SEQ ID NO: 762969 - DNA, 20 bp, Artificial
  CRISPR gRNA sequence
gtcttcacttggggcaggga

SEQ ID NO: 762970 - DNA, 20 bp, Artificial
  CRISPR gRNA sequence
cacttggggcagggagggaa

SEQ ID NO: 762971 - DNA, 20 bp, Artificial
  CRISPR gRNA sequence
acttggggcagggagggaaa

SEQ ID NO: 762972 - DNA, 20 bp, Artificial
  CRISPR gRNA sequence
ggggcagggagggaaaaggc

SEQ ID NO: 762973 - DNA, 20 bp, Artificial
  CRISPR gRNA sequence
ggagggaaaaggccagtatt

SEQ ID NO: 762974 - DNA, 20 bp, Artificial
  CRISPR gRNA sequence
gagggaaaaggccagtatta

SEQ ID NO: 762975 - DNA, 20 bp, Artificial
  CRISPR gRNA sequence
gaaaaggccagtattaaggc

SEQ ID NO: 762976 - DNA, 20 bp, Artificial
  CRISPR gRNA sequence
aaaggccagtattaaggcta

SEQ ID NO: 762977 - DNA, 20 bp, Artificial
  CRISPR gRNA sequence
gccagtattaaggctagagc

SEQ ID NO: 762978 - DNA, 20 bp, Artificial
  CRISPR gRNA sequence
cagtattaaggctagagcaa

SEQ ID NO: 762979 - DNA, 20 bp, Artificial
  CRISPR gRNA sequence
agtattaaggctagagcaag

SEQ ID NO: 762980 - DNA, 20 bp, Artificial
  CRISPR gRNA sequence
tattaaggctagagcaagag

SEQ ID NO: 762981 - DNA, 20 bp, Artificial
  CRISPR gRNA sequence
attaaggctagagcaagagg

SEQ ID NO: 762982 - DNA, 20 bp, Artificial
  CRISPR gRNA sequence
aaggctagagcaagaggagg

SEQ ID NO: 762983 - DNA, 20 bp, Artificial
  CRISPR gRNA sequence
aggctagagcaagaggagga

SEQ ID NO: 762984 - DNA, 20 bp, Artificial
  CRISPR gRNA sequence
gctagagcaagaggaggaag

SEQ ID NO: 762985 - DNA, 20 bp, Artificial
  CRISPR gRNA sequence
ctagagcaagaggaggaagg

SEQ ID NO: 762986 - DNA, 20 bp, Artificial
  CRISPR gRNA sequence
tagagcaagaggaggaagga

SEQ ID NO: 762987 - DNA, 20 bp, Artificial
  CRISPR gRNA sequence
agagcaagaggaggaaggag

SEQ ID NO: 762988 - DNA, 20 bp, Artificial
  CRISPR gRNA sequence
caagaggaggaaggagggga

SEQ ID NO: 762989 - DNA, 20 bp, Artificial
  CRISPR gRNA sequence
aagaggaggaaggaggggaa

SEQ ID NO: 762990 - DNA, 20 bp, Artificial
  CRISPR gRNA sequence
aggaaggaggggaaaggaaa

SEQ ID NO: 762991 - DNA, 20 bp, Artificial
  CRISPR gRNA sequence
aggggaaaggaaacagcttc

SEQ ID NO: 762992 - DNA, 20 bp, Artificial
  CRISPR gRNA sequence
aggaaacagcttctagactc

SEQ ID NO: 762993 - DNA, 20 bp, Artificial
  CRISPR gRNA sequence
ggaaacagcttctagactcc

SEQ ID NO: 762994 - DNA, 20 bp, Artificial
  CRISPR gRNA sequence
aaacagcttctagactccag

SEQ ID NO: 762995 - DNA, 20 bp, Artificial
  CRISPR gRNA sequence
tctagactccaggagatgtt

SEQ ID NO: 762996 - DNA, 20 bp, Artificial
  CRISPR gRNA sequence
ctagactccaggagatgttg

SEQ ID NO: 762997 - DNA, 20 bp, Artificial
  CRISPR gRNA sequence
aggccgcactgtccctgtct

SEQ ID NO: 762998 - DNA, 20 bp, Artificial
  CRISPR gRNA sequence
ccgcactgtccctgtctgag

SEQ ID NO: 762999 - DNA, 20 bp, Artificial
  CRISPR gRNA sequence
ctgtccctgtctgagaagaa

SEQ ID NO: 763000 - DNA, 20 bp, Artificial
  CRISPR gRNA sequence
tgagaagaaaagattctatg

SEQ ID NO: 763001 - DNA, 20 bp, Artificial
  CRISPR gRNA sequence
gagaagaaaagattctatgc

SEQ ID NO: 763002 - DNA, 20 bp, Artificial
  CRISPR gRNA sequence
aagaaaagattctatgcagg

SEQ ID NO: 763003 - DNA, 20 bp, Artificial
  CRISPR gRNA sequence
aaaagattctatgcaggtgg

SEQ ID NO: 763004 - DNA, 20 bp, Artificial
  CRISPR gRNA sequence
agattctatgcaggtggaag

SEQ ID NO: 763005 - DNA, 20 bp, Artificial
  CRISPR gRNA sequence
gattctatgcaggtggaagc

SEQ ID NO: 763006 - DNA, 20 bp, Artificial
  CRISPR gRNA sequence
attctatgcaggtggaagca

SEQ ID NO: 763007 - DNA, 20 bp, Artificial
  CRISPR gRNA sequence
gcagggctgaacatgatcac

SEQ ID NO: 763008 - DNA, 20 bp, Artificial
  CRISPR gRNA sequence
acatgatcactagtgtatca

SEQ ID NO: 763009 - DNA, 20 bp, Artificial
  CRISPR gRNA sequence
cactagtgtatcacggccat

SEQ ID NO: 763010 - DNA, 20 bp, Artificial
  CRISPR gRNA sequence
ctagtgtatcacggccattg

SEQ ID NO: 763011 - DNA, 20 bp, Artificial
  CRISPR gRNA sequence
atcacggccattggagaaac

SEQ ID NO: 763012 - DNA, 20 bp, Artificial
  CRISPR gRNA sequence
tcacggccattggagaaaca

SEQ ID NO: 763013 - DNA, 20 bp, Artificial
  CRISPR gRNA sequence
ggccattggagaaacaaggc

SEQ ID NO: 763014 - DNA, 20 bp, Artificial
  CRISPR gRNA sequence
gccattggagaaacaaggcc

SEQ ID NO: 763015 - DNA, 20 bp, Artificial
  CRISPR gRNA sequence
ccattggagaaacaaggccg

SEQ ID NO: 763016 - DNA, 20 bp, Artificial
  CRISPR gRNA sequence
gtgactatgcatcgtgtctt

SEQ ID NO: 763017 - DNA, 20 bp, Artificial
  CRISPR gRNA sequence
catcgtgtctttggtgaaat

SEQ ID NO: 763018 - DNA, 20 bp, Artificial
  CRISPR gRNA sequence
atcgtgtctttggtgaaata

SEQ ID NO: 763019 - DNA, 20 bp, Artificial
  CRISPR gRNA sequence
gtgtctttggtgaaataagg

SEQ ID NO: 763020 - DNA, 20 bp, Artificial
  CRISPR gRNA sequence
tgtctttggtgaaataaggc

SEQ ID NO: 763021 - DNA, 20 bp, Artificial
  CRISPR gRNA sequence
gtctttggtgaaataaggca

SEQ ID NO: 763022 - DNA, 20 bp, Artificial
  CRISPR gRNA sequence
tctttggtgaaataaggcag

SEQ ID NO: 763023 - DNA, 20 bp, Artificial
  CRISPR gRNA sequence
ctttggtgaaataaggcagg

SEQ ID NO: 763024 - DNA, 20 bp, Artificial
  CRISPR gRNA sequence
ggtgaaataaggcagggggt

SEQ ID NO: 763025 - DNA, 20 bp, Artificial
  CRISPR gRNA sequence
aaataaggcagggggtcagt

SEQ ID NO: 763026 - DNA, 20 bp, Artificial
  CRISPR gRNA sequence
agtctgaatattgcatcttt

SEQ ID NO: 763027 - DNA, 20 bp, Artificial
  CRISPR gRNA sequence
tctgaatattgcatcttttg

SEQ ID NO: 763028 - DNA, 20 bp, Artificial
  CRISPR gRNA sequence
attgcatcttttggagaaaa

SEQ ID NO: 763029 - DNA, 20 bp, Artificial
  CRISPR gRNA sequence
ttgcatcttttggagaaaaa

SEQ ID NO: 763030 - DNA, 20 bp, Artificial
  CRISPR gRNA sequence
catcttttggagaaaaaagg

SEQ ID NO: 763031 - DNA, 20 bp, Artificial
  CRISPR gRNA sequence
ttttggagaaaaaaggcagc

SEQ ID NO: 763032 - DNA, 20 bp, Artificial
  CRISPR gRNA sequence
ggagaaaaaaggcagccaga

SEQ ID NO: 763033 - DNA, 20 bp, Artificial
  CRISPR gRNA sequence
aggcagccagatggtccacg

SEQ ID NO: 763034 - DNA, 20 bp, Artificial
  CRISPR gRNA sequence
ccagatggtccacgcagcac

SEQ ID NO: 763035 - DNA, 20 bp, Artificial
  CRISPR gRNA sequence
gatggtccacgcagcactgg

SEQ ID NO: 763036 - DNA, 20 bp, Artificial
  CRISPR gRNA sequence
ggtccacgcagcactggaag

SEQ ID NO: 763037 - DNA, 20 bp, Artificial
  CRISPR gRNA sequence
tccacgcagcactggaagaa

SEQ ID NO: 763038 - DNA, 20 bp, Artificial
  CRISPR gRNA sequence
ccacgcagcactggaagaag

SEQ ID NO: 763039 - DNA, 20 bp, Artificial
  CRISPR gRNA sequence
cacgcagcactggaagaaga

SEQ ID NO: 763040 - DNA, 20 bp, Artificial
  CRISPR gRNA sequence
gcagcactggaagaagaggg

SEQ ID NO: 763041 - DNA, 20 bp, Artificial
  CRISPR gRNA sequence
ggaagaagagggtggtgatg

SEQ ID NO: 763042 - DNA, 20 bp, Artificial
  CRISPR gRNA sequence
gaagagggtggtgatgtggt

SEQ ID NO: 763043 - DNA, 20 bp, Artificial
  CRISPR gRNA sequence
ggtcagtgtactgtgtccct

SEQ ID NO: 763044 - DNA, 20 bp, Artificial
  CRISPR gRNA sequence
aaatgtatgtactgtgaaat

SEQ ID NO: 763045 - DNA, 20 bp, Artificial
  CRISPR gRNA sequence
aatgtatgtactgtgaaata

SEQ ID NO: 763046 - DNA, 20 bp, Artificial
  CRISPR gRNA sequence
gtatgtactgtgaaataagg

SEQ ID NO: 763047 - DNA, 20 bp, Artificial
  CRISPR gRNA sequence
tgtactgtgaaataaggcag

SEQ ID NO: 763048 - DNA, 20 bp, Artificial
  CRISPR gRNA sequence
gtactgtgaaataaggcagc

SEQ ID NO: 763049 - DNA, 20 bp, Artificial
  CRISPR gRNA sequence
ctgtgaaataaggcagcagg

SEQ ID NO: 763050 - DNA, 20 bp, Artificial
  CRISPR gRNA sequence
tgtgaaataaggcagcaggc

SEQ ID NO: 763051 - DNA, 20 bp, Artificial
  CRISPR gRNA sequence
aggcagcaggcaggatgact

SEQ ID NO: 763052 - DNA, 20 bp, Artificial
  CRISPR gRNA sequence
gcagcaggcaggatgactta

SEQ ID NO: 763053 - DNA, 20 bp, Artificial
  CRISPR gRNA sequence
gcaggatgacttagagaact

SEQ ID NO: 763054 - DNA, 20 bp, Artificial
  CRISPR gRNA sequence
caggatgacttagagaacta

SEQ ID NO: 763055 - DNA, 20 bp, Artificial
  CRISPR gRNA sequence
gacttagagaactaaggttg

SEQ ID NO: 763056 - DNA, 20 bp, Artificial
  CRISPR gRNA sequence
acttagagaactaaggttgt

SEQ ID NO: 763057 - DNA, 20 bp, Artificial
  CRISPR gRNA sequence
tagagaactaaggttgtggg

SEQ ID NO: 763058 - DNA, 20 bp, Artificial
  CRISPR gRNA sequence
ggtctgttcattgtgtctat

SEQ ID NO: 763059 - DNA, 20 bp, Artificial
  CRISPR gRNA sequence
tcattgtgtctataagaaaa

SEQ ID NO: 763060 - DNA, 20 bp, Artificial
  CRISPR gRNA sequence
cattgtgtctataagaaaaa

SEQ ID NO: 763061 - DNA, 20 bp, Artificial
  CRISPR gRNA sequence
tgtgtctataagaaaaaagg

SEQ ID NO: 763062 - DNA, 20 bp, Artificial
  CRISPR gRNA sequence
gtctataagaaaaaaggcag

SEQ ID NO: 763063 - DNA, 20 bp, Artificial
  CRISPR gRNA sequence
tctataagaaaaaaggcagc

SEQ ID NO: 763064 - DNA, 20 bp, Artificial
  CRISPR gRNA sequence
aaaaaggcagcaggatgact

SEQ ID NO: 763065 - DNA, 20 bp, Artificial
  CRISPR gRNA sequence
aaaaggcagcaggatgactt

SEQ ID NO: 763066 - DNA, 20 bp, Artificial
  CRISPR gRNA sequence
gacttgggaatcatgtccat

SEQ ID NO: 763067 - DNA, 20 bp, Artificial
  CRISPR gRNA sequence
cttgggaatcatgtccattg

SEQ ID NO: 763068 - DNA, 20 bp, Artificial
  CRISPR gRNA sequence
atcatgtccattggagaaat

SEQ ID NO: 763069 - DNA, 20 bp, Artificial
  CRISPR gRNA sequence
tcatgtccattggagaaata

SEQ ID NO: 763070 - DNA, 20 bp, Artificial
  CRISPR gRNA sequence
attggagaaataaggctgca

SEQ ID NO: 763071 - DNA, 20 bp, Artificial
  CRISPR gRNA sequence
ggagaaataaggctgcacag

SEQ ID NO: 763072 - DNA, 20 bp, Artificial
  CRISPR gRNA sequence
ggtctgtgtatcgcatcctt

SEQ ID NO: 763073 - DNA, 20 bp, Artificial
  CRISPR gRNA sequence
tctgtgtatcgcatcctttg

SEQ ID NO: 763074 - DNA, 20 bp, Artificial
  CRISPR gRNA sequence
gtgtatcgcatcctttggag

SEQ ID NO: 763075 - DNA, 20 bp, Artificial
  CRISPR gRNA sequence
tgtatcgcatcctttggaga

SEQ ID NO: 763076 - DNA, 20 bp, Artificial
  CRISPR gRNA sequence
tatcgcatcctttggagaag

SEQ ID NO: 763077 - DNA, 20 bp, Artificial
  CRISPR gRNA sequence
tggagaaggagcccacctgt

SEQ ID NO: 763078 - DNA, 20 bp, Artificial
  CRISPR gRNA sequence
gagaaggagcccacctgtca

SEQ ID NO: 763079 - DNA, 20 bp, Artificial
  CRISPR gRNA sequence
aaggagcccacctgtcagag

SEQ ID NO: 763080 - DNA, 20 bp, Artificial
  CRISPR gRNA sequence
aggagcccacctgtcagagc

SEQ ID NO: 763081 - DNA, 20 bp, Artificial
  CRISPR gRNA sequence
tcagagcaggatgcatctgt

SEQ ID NO: 763082 - DNA, 20 bp, Artificial
  CRISPR gRNA sequence
cagagcaggatgcatctgtt

SEQ ID NO: 763083 - DNA, 20 bp, Artificial
  CRISPR gRNA sequence
agagcaggatgcatctgttg

SEQ ID NO: 763084 - DNA, 20 bp, Artificial
  CRISPR gRNA sequence
gagcaggatgcatctgttgg

SEQ ID NO: 763085 - DNA, 20 bp, Artificial
  CRISPR gRNA sequence
caggatgcatctgttggggg

SEQ ID NO: 763086 - DNA, 20 bp, Artificial
  CRISPR gRNA sequence
aggatgcatctgttgggggc

SEQ ID NO: 763087 - DNA, 20 bp, Artificial
  CRISPR gRNA sequence
ggatgcatctgttgggggca

SEQ ID NO: 763088 - DNA, 20 bp, Artificial
  CRISPR gRNA sequence
tctgttgggggcagggctca

SEQ ID NO: 763089 - DNA, 20 bp, Artificial
  CRISPR gRNA sequence
tgggggcagggctcacagtg

SEQ ID NO: 763090 - DNA, 20 bp, Artificial
  CRISPR gRNA sequence
ctcacagtgcagccccattg

SEQ ID NO: 763091 - DNA, 20 bp, Artificial
  CRISPR gRNA sequence
cagtgcagccccattgcagc

SEQ ID NO: 763092 - DNA, 20 bp, Artificial
  CRISPR gRNA sequence
gtgcagccccattgcagcca

SEQ ID NO: 763093 - DNA, 20 bp, Artificial
  CRISPR gRNA sequence
tgcagccccattgcagccag

SEQ ID NO: 763094 - DNA, 20 bp, Artificial
  CRISPR gRNA sequence
gcagccccattgcagccaga

SEQ ID NO: 763095 - DNA, 20 bp, Artificial
  CRISPR gRNA sequence
gccccattgcagccagaggg

SEQ ID NO: 763096 - DNA, 20 bp, Artificial
  CRISPR gRNA sequence
ccccattgcagccagagggt

SEQ ID NO: 763097 - DNA, 20 bp, Artificial
  CRISPR gRNA sequence
ccattgcagccagagggtag

SEQ ID NO: 763098 - DNA, 20 bp, Artificial
  CRISPR gRNA sequence
cagccagagggtaggagctg

SEQ ID NO: 763099 - DNA, 20 bp, Artificial
  CRISPR gRNA sequence
agccagagggtaggagctgt

SEQ ID NO: 763100 - DNA, 20 bp, Artificial
  CRISPR gRNA sequence
gccagagggtaggagctgta

SEQ ID NO: 763101 - DNA, 20 bp, Artificial
  CRISPR gRNA sequence
cagagggtaggagctgtagg

SEQ ID NO: 763102 - DNA, 20 bp, Artificial
  CRISPR gRNA sequence
agagggtaggagctgtaggg

SEQ ID NO: 763103 - DNA, 20 bp, Artificial
  CRISPR gRNA sequence
gagggtaggagctgtaggga

SEQ ID NO: 763104 - DNA, 20 bp, Artificial
  CRISPR gRNA sequence
agggtaggagctgtagggag

SEQ ID NO: 763105 - DNA, 20 bp, Artificial
  CRISPR gRNA sequence
gtaggagctgtagggagggg

SEQ ID NO: 763106 - DNA, 20 bp, Artificial
  CRISPR gRNA sequence
ggagctgtagggaggggtag

SEQ ID NO: 763107 - DNA, 20 bp, Artificial
  CRISPR gRNA sequence
agggaggggtagcagctccc

SEQ ID NO: 763108 - DNA, 20 bp, Artificial
  CRISPR gRNA sequence
tagcagctccctggtcctca

SEQ ID NO: 763109 - DNA, 20 bp, Artificial
  CRISPR gRNA sequence
agctccctggtcctcatggt

SEQ ID NO: 763110 - DNA, 20 bp, Artificial
  CRISPR gRNA sequence
gctccctggtcctcatggtc

SEQ ID NO: 763111 - DNA, 20 bp, Artificial
  CRISPR gRNA sequence
ccatcatcttcatttcatga

SEQ ID NO: 763112 - DNA, 20 bp, Artificial
  CRISPR gRNA sequence
catcatcttcatttcatgat

SEQ ID NO: 763113 - DNA, 20 bp, Artificial
  CRISPR gRNA sequence
catcttcatttcatgatggg

SEQ ID NO: 763114 - DNA, 20 bp, Artificial
  CRISPR gRNA sequence
ttcatgatgggaagaaaaaa

SEQ ID NO: 763115 - DNA, 20 bp, Artificial
  CRISPR gRNA sequence
tcatgatgggaagaaaaaaa

SEQ ID NO: 763116 - DNA, 20 bp, Artificial
  CRISPR gRNA sequence
catgatgggaagaaaaaaaa

SEQ ID NO: 763117 - DNA, 20 bp, Artificial
  CRISPR gRNA sequence
gatgggaagaaaaaaaaggg

SEQ ID NO: 763118 - DNA, 20 bp, Artificial
  CRISPR gRNA sequence
atgggaagaaaaaaaaggga

SEQ ID NO: 763119 - DNA, 20 bp, Artificial
  CRISPR gRNA sequence
tgggaagaaaaaaaagggaa

SEQ ID NO: 763120 - DNA, 20 bp, Artificial
  CRISPR gRNA sequence
agaaaaaaaagggaagggaa

SEQ ID NO: 763121 - DNA, 20 bp, Artificial
  CRISPR gRNA sequence
aaaagggaagggaaaagcat

SEQ ID NO: 763122 - DNA, 20 bp, Artificial
  CRISPR gRNA sequence
aagggaaaagcattagatgc

SEQ ID NO: 763123 - DNA, 20 bp, Artificial
  CRISPR gRNA sequence
ggaaaagcattagatgccag

SEQ ID NO: 763124 - DNA, 20 bp, Artificial
  CRISPR gRNA sequence
gatgccagaagatctatttt

SEQ ID NO: 763125 - DNA, 20 bp, Artificial
  CRISPR gRNA sequence
atgccagaagatctattttt

SEQ ID NO: 763126 - DNA, 20 bp, Artificial
  CRISPR gRNA sequence
atctatttttgggattatgc

SEQ ID NO: 763127 - DNA, 20 bp, Artificial
  CRISPR gRNA sequence
tatttttgggattatgccag

SEQ ID NO: 763128 - DNA, 20 bp, Artificial
  CRISPR gRNA sequence
tgggattatgccagaagccc

SEQ ID NO: 763129 - DNA, 20 bp, Artificial
  CRISPR gRNA sequence
atgccagaagcccaagcacc

SEQ ID NO: 763130 - DNA, 20 bp, Artificial
  CRISPR gRNA sequence
cagaagcccaagcacctggt

SEQ ID NO: 763131 - DNA, 20 bp, Artificial
  CRISPR gRNA sequence
caagcacctggtcagacttc

SEQ ID NO: 763132 - DNA, 20 bp, Artificial
  CRISPR gRNA sequence
gcacctggtcagacttcaag

SEQ ID NO: 763133 - DNA, 20 bp, Artificial
  CRISPR gRNA sequence
cacctggtcagacttcaagt

SEQ ID NO: 763134 - DNA, 20 bp, Artificial
  CRISPR gRNA sequence
acctggtcagacttcaagtg

SEQ ID NO: 763135 - DNA, 20 bp, Artificial
  CRISPR gRNA sequence
ctggtcagacttcaagtggg

SEQ ID NO: 763136 - DNA, 20 bp, Artificial
  CRISPR gRNA sequence
ttcaagtggggagtgtgtgt

SEQ ID NO: 763137 - DNA, 20 bp, Artificial
  CRISPR gRNA sequence
agtggggagtgtgtgtgaga

SEQ ID NO: 763138 - DNA, 20 bp, Artificial
  CRISPR gRNA sequence
ggggagtgtgtgtgagacag

SEQ ID NO: 763139 - DNA, 20 bp, Artificial
  CRISPR gRNA sequence
tgtgtgagacagcagcccaa

SEQ ID NO: 763140 - DNA, 20 bp, Artificial
  CRISPR gRNA sequence
tgagacagcagcccaacgga

SEQ ID NO: 763141 - DNA, 20 bp, Artificial
  CRISPR gRNA sequence
gacagcccccgtgctgacca

SEQ ID NO: 763142 - DNA, 20 bp, Artificial
  CRISPR gRNA sequence
ccccgtgctgaccacggccc

SEQ ID NO: 763143 - DNA, 20 bp, Artificial
  CRISPR gRNA sequence
ccgtgctgaccacggccctg

SEQ ID NO: 763144 - DNA, 20 bp, Artificial
  CRISPR gRNA sequence
cgtgctgaccacggccctgg

SEQ ID NO: 763145 - DNA, 20 bp, Artificial
  CRISPR gRNA sequence
tgaccacggccctggaggcc

SEQ ID NO: 763146 - DNA, 20 bp, Artificial
  CRISPR gRNA sequence
cggccctggaggcccagaca

SEQ ID NO: 763147 - DNA, 20 bp, Artificial
  CRISPR gRNA sequence
tggaggcccagacacagatg

SEQ ID NO: 763148 - DNA, 20 bp, Artificial
  CRISPR gRNA sequence
ggaggcccagacacagatgc

SEQ ID NO: 763149 - DNA, 20 bp, Artificial
  CRISPR gRNA sequence
ccagacacagatgcaggtgc

SEQ ID NO: 763150 - DNA, 20 bp, Artificial
  CRISPR gRNA sequence
cagacacagatgcaggtgcc

SEQ ID NO: 763151 - DNA, 20 bp, Artificial
  CRISPR gRNA sequence
gatgcaggtgccaggcacgc

SEQ ID NO: 763152 - DNA, 20 bp, Artificial
  CRISPR gRNA sequence
atgcaggtgccaggcacgcc

SEQ ID NO: 763153 - DNA, 20 bp, Artificial
  CRISPR gRNA sequence
tgcaggtgccaggcacgccg

SEQ ID NO: 763154 - DNA, 20 bp, Artificial
  CRISPR gRNA sequence
ccaggcacgccggggcacct

SEQ ID NO: 763155 - DNA, 20 bp, Artificial
  CRISPR gRNA sequence
caggcacgccggggcacctg

SEQ ID NO: 763156 - DNA, 20 bp, Artificial
  CRISPR gRNA sequence
aggcacgccggggcacctga

SEQ ID NO: 763157 - DNA, 20 bp, Artificial
  CRISPR gRNA sequence
ggcacgccggggcacctgag

SEQ ID NO: 763158 - DNA, 20 bp, Artificial
  CRISPR gRNA sequence
gcacgccggggcacctgagg

SEQ ID NO: 763159 - DNA, 20 bp, Artificial
  CRISPR gRNA sequence
ctgagggggaccacctcacg

SEQ ID NO: 763160 - DNA, 20 bp, Artificial
  CRISPR gRNA sequence
cacctcacgcagccccctct

SEQ ID NO: 763161 - DNA, 20 bp, Artificial
  CRISPR gRNA sequence
cagccccctctcagtaccca

SEQ ID NO: 763162 - DNA, 20 bp, Artificial
  CRISPR gRNA sequence
agccccctctcagtacccac

SEQ ID NO: 763163 - DNA, 20 bp, Artificial
  CRISPR gRNA sequence
tctcagtacccacaggccca

SEQ ID NO: 763164 - DNA, 20 bp, Artificial
  CRISPR gRNA sequence
gtccatcccatccaccctcc

SEQ ID NO: 763165 - DNA, 20 bp, Artificial
  CRISPR gRNA sequence
tccatcccatccaccctcca

SEQ ID NO: 763166 - DNA, 20 bp, Artificial
  CRISPR gRNA sequence
cccatccaccctccaaggcc

SEQ ID NO: 763167 - DNA, 20 bp, Artificial
  CRISPR gRNA sequence
cctggcccaactccctcgtc

SEQ ID NO: 763168 - DNA, 20 bp, Artificial
  CRISPR gRNA sequence
ggcccaactccctcgtccag

SEQ ID NO: 763169 - DNA, 20 bp, Artificial
  CRISPR gRNA sequence
gcccaactccctcgtccagc

SEQ ID NO: 763170 - DNA, 20 bp, Artificial
  CRISPR gRNA sequence
caactccctcgtccagcagg

SEQ ID NO: 763171 - DNA, 20 bp, Artificial
  CRISPR gRNA sequence
cgtccagcaggcagccttcc

SEQ ID NO: 763172 - DNA, 20 bp, Artificial
  CRISPR gRNA sequence
tcccagtgtcccctccacac

SEQ ID NO: 763173 - DNA, 20 bp, Artificial
  CRISPR gRNA sequence
ccctccacactggtttccct

SEQ ID NO: 763174 - DNA, 20 bp, Artificial
  CRISPR gRNA sequence
ctccacactggtttccctga

SEQ ID NO: 763175 - DNA, 20 bp, Artificial
  CRISPR gRNA sequence
tggtttccctgagagtgaca

SEQ ID NO: 763176 - DNA, 20 bp, Artificial
  CRISPR gRNA sequence
tttccctgagagtgacacgg

SEQ ID NO: 763177 - DNA, 20 bp, Artificial
  CRISPR gRNA sequence
ttccctgagagtgacacggc

SEQ ID NO: 763178 - DNA, 20 bp, Artificial
  CRISPR gRNA sequence
tccctgagagtgacacggca

SEQ ID NO: 763179 - DNA, 20 bp, Artificial
  CRISPR gRNA sequence
ccctgagagtgacacggcag

SEQ ID NO: 763180 - DNA, 20 bp, Artificial
  CRISPR gRNA sequence
aggggccctcctccttccct

SEQ ID NO: 763181 - DNA, 20 bp, Artificial
  CRISPR gRNA sequence
ggggccctcctccttccctt

SEQ ID NO: 763182 - DNA, 20 bp, Artificial
  CRISPR gRNA sequence
ttgggcttcctgtctccatg

SEQ ID NO: 763183 - DNA, 20 bp, Artificial
  CRISPR gRNA sequence
gggcttcctgtctccatgtg

SEQ ID NO: 763184 - DNA, 20 bp, Artificial
  CRISPR gRNA sequence
ggcttcctgtctccatgtgg

SEQ ID NO: 763185 - DNA, 20 bp, Artificial
  CRISPR gRNA sequence
gcttcctgtctccatgtgga

SEQ ID NO: 763186 - DNA, 20 bp, Artificial
  CRISPR gRNA sequence
ccatgtggagggccatccca

SEQ ID NO: 763187 - DNA, 20 bp, Artificial
  CRISPR gRNA sequence
catcccaaagactcatcttt

SEQ ID NO: 763188 - DNA, 20 bp, Artificial
  CRISPR gRNA sequence
cagaccccactctgcatctg

SEQ ID NO: 763189 - DNA, 20 bp, Artificial
  CRISPR gRNA sequence
actctgcatctgaagctgaa

SEQ ID NO: 763190 - DNA, 20 bp, Artificial
  CRISPR gRNA sequence
tctgcatctgaagctgaatg

SEQ ID NO: 763191 - DNA, 20 bp, Artificial
  CRISPR gRNA sequence
tctgaagctgaatggagact

SEQ ID NO: 763192 - DNA, 20 bp, Artificial
  CRISPR gRNA sequence
ctgaagctgaatggagactt

SEQ ID NO: 763193 - DNA, 20 bp, Artificial
  CRISPR gRNA sequence
aagctgaatggagacttggg

SEQ ID NO: 763194 - DNA, 20 bp, Artificial
  CRISPR gRNA sequence
ctgaatggagacttgggaag

SEQ ID NO: 763195 - DNA, 20 bp, Artificial
  CRISPR gRNA sequence
tgaatggagacttgggaaga

SEQ ID NO: 763196 - DNA, 20 bp, Artificial
  CRISPR gRNA sequence
gaatggagacttgggaagaa

SEQ ID NO: 763197 - DNA, 20 bp, Artificial
  CRISPR gRNA sequence
gagacttgggaagaagggct

SEQ ID NO: 763198 - DNA, 20 bp, Artificial
  CRISPR gRNA sequence
agacttgggaagaagggctt

SEQ ID NO: 763199 - DNA, 20 bp, Artificial
  CRISPR gRNA sequence
ccctctccctcacccattct

SEQ ID NO: 763200 - DNA, 20 bp, Artificial
  CRISPR gRNA sequence
cctctccctcacccattctt

SEQ ID NO: 763201 - DNA, 20 bp, Artificial
  CRISPR gRNA sequence
ctctccctcacccattcttg

SEQ ID NO: 763202 - DNA, 20 bp, Artificial
  CRISPR gRNA sequence
cttggggctctgtatgtccc

SEQ ID NO: 763203 - DNA, 20 bp, Artificial
  CRISPR gRNA sequence
ttggggctctgtatgtccct

SEQ ID NO: 763204 - DNA, 20 bp, Artificial
  CRISPR gRNA sequence
tggggctctgtatgtccctg

SEQ ID NO: 763205 - DNA, 20 bp, Artificial
  CRISPR gRNA sequence
gggctctgtatgtccctggg

SEQ ID NO: 763206 - DNA, 20 bp, Artificial
  CRISPR gRNA sequence
gctctgtatgtccctgggga

SEQ ID NO: 763207 - DNA, 20 bp, Artificial
  CRISPR gRNA sequence
ctctgtatgtccctggggag

SEQ ID NO: 763208 - DNA, 20 bp, Artificial
  CRISPR gRNA sequence
ctgtatgtccctggggagag

SEQ ID NO: 763209 - DNA, 20 bp, Artificial
  CRISPR gRNA sequence
tatgtccctggggagaggag

SEQ ID NO: 763210 - DNA, 20 bp, Artificial
  CRISPR gRNA sequence
tgtccctggggagaggagaa

SEQ ID NO: 763211 - DNA, 20 bp, Artificial
  CRISPR gRNA sequence
aggagaagagctcccccatc

SEQ ID NO: 763212 - DNA, 20 bp, Artificial
  CRISPR gRNA sequence
ggagaagagctcccccatct

SEQ ID NO: 763213 - DNA, 20 bp, Artificial
  CRISPR gRNA sequence
ccatctgggcactgcctctg

SEQ ID NO: 763214 - DNA, 20 bp, Artificial
  CRISPR gRNA sequence
gcactgcctctgtggttgtc

SEQ ID NO: 763215 - DNA, 20 bp, Artificial
  CRISPR gRNA sequence
gcctctgtggttgtccagca

SEQ ID NO: 763216 - DNA, 20 bp, Artificial
  CRISPR gRNA sequence
ctgtggttgtccagcatggc

SEQ ID NO: 763217 - DNA, 20 bp, Artificial
  CRISPR gRNA sequence
gtggttgtccagcatggcca

SEQ ID NO: 763218 - DNA, 20 bp, Artificial
  CRISPR gRNA sequence
gtccagcatggccagagact

SEQ ID NO: 763219 - DNA, 20 bp, Artificial
  CRISPR gRNA sequence
tccagcatggccagagactg

SEQ ID NO: 763220 - DNA, 20 bp, Artificial
  CRISPR gRNA sequence
ccagcatggccagagactga

SEQ ID NO: 763221 - DNA, 20 bp, Artificial
  CRISPR gRNA sequence
cagcatggccagagactgag

SEQ ID NO: 763222 - DNA, 20 bp, Artificial
  CRISPR gRNA sequence
agcatggccagagactgagg

SEQ ID NO: 763223 - DNA, 20 bp, Artificial
  CRISPR gRNA sequence
atggccagagactgaggggg

SEQ ID NO: 763224 - DNA, 20 bp, Artificial
  CRISPR gRNA sequence
tggccagagactgagggggc

SEQ ID NO: 763225 - DNA, 20 bp, Artificial
  CRISPR gRNA sequence
agggggcaggctgcctcacc

SEQ ID NO: 763226 - DNA, 20 bp, Artificial
  CRISPR gRNA sequence
gggggcaggctgcctcacca

SEQ ID NO: 763227 - DNA, 20 bp, Artificial
  CRISPR gRNA sequence
gggcaggctgcctcaccaag

SEQ ID NO: 763228 - DNA, 20 bp, Artificial
  CRISPR gRNA sequence
caggctgcctcaccaaggag

SEQ ID NO: 763229 - DNA, 20 bp, Artificial
  CRISPR gRNA sequence
aggctgcctcaccaaggagc

SEQ ID NO: 763230 - DNA, 20 bp, Artificial
  CRISPR gRNA sequence
ggctgcctcaccaaggagca

SEQ ID NO: 763231 - DNA, 20 bp, Artificial
  CRISPR gRNA sequence
gcctcaccaaggagcagggt

SEQ ID NO: 763232 - DNA, 20 bp, Artificial
  CRISPR gRNA sequence
cctcaccaaggagcagggtt

SEQ ID NO: 763233 - DNA, 20 bp, Artificial
  CRISPR gRNA sequence
caccaaggagcagggttagg

SEQ ID NO: 763234 - DNA, 20 bp, Artificial
  CRISPR gRNA sequence
agcagggttaggaagcaaac

SEQ ID NO: 763235 - DNA, 20 bp, Artificial
  CRISPR gRNA sequence
agcaaactggtttgcccatc

SEQ ID NO: 763236 - DNA, 20 bp, Artificial
  CRISPR gRNA sequence
gcaaactggtttgcccatcc

SEQ ID NO: 763237 - DNA, 20 bp, Artificial
  CRISPR gRNA sequence
cccatccaggccacattctc

SEQ ID NO: 763238 - DNA, 20 bp, Artificial
  CRISPR gRNA sequence
tccagcaactcttcaaaacc

SEQ ID NO: 763239 - DNA, 20 bp, Artificial
  CRISPR gRNA sequence
tttttttttttttttttttt

SEQ ID NO: 763240 - DNA, 20 bp, Artificial
  CRISPR gRNA sequence
ttttttttttttttttgaga

SEQ ID NO: 763241 - DNA, 20 bp, Artificial
  CRISPR gRNA sequence
tggaatcttgctctgttgcc

SEQ ID NO: 763242 - DNA, 20 bp, Artificial
  CRISPR gRNA sequence
ggaatcttgctctgttgccc

SEQ ID NO: 763243 - DNA, 20 bp, Artificial
  CRISPR gRNA sequence
tcttgctctgttgcccaggc

SEQ ID NO: 763244 - DNA, 20 bp, Artificial
  CRISPR gRNA sequence
ttgctctgttgcccaggctg

SEQ ID NO: 763245 - DNA, 20 bp, Artificial
  CRISPR gRNA sequence
gttgcccaggctggagtgca

SEQ ID NO: 763246 - DNA, 20 bp, Artificial
  CRISPR gRNA sequence
ttgcccaggctggagtgcac

SEQ ID NO: 763247 - DNA, 20 bp, Artificial
  CRISPR gRNA sequence
ggagtgcacaggtgcaatct

SEQ ID NO: 763248 - DNA, 20 bp, Artificial
  CRISPR gRNA sequence
tcactgcaacctctgcctcc

SEQ ID NO: 763249 - DNA, 20 bp, Artificial
  CRISPR gRNA sequence
cactgcaacctctgcctccc

SEQ ID NO: 763250 - DNA, 20 bp, Artificial
  CRISPR gRNA sequence
aacctctgcctcccaggttc

SEQ ID NO: 763251 - DNA, 20 bp, Artificial
  CRISPR gRNA sequence
ttcaagtgattctcccgcct

SEQ ID NO: 763252 - DNA, 20 bp, Artificial
  CRISPR gRNA sequence
ttctcccgcctcagcttccc

SEQ ID NO: 763253 - DNA, 20 bp, Artificial
  CRISPR gRNA sequence
tcccgcctcagcttcccaag

SEQ ID NO: 763254 - DNA, 20 bp, Artificial
  CRISPR gRNA sequence
gcctcagcttcccaagtagc

SEQ ID NO: 763255 - DNA, 20 bp, Artificial
  CRISPR gRNA sequence
cctcagcttcccaagtagct

SEQ ID NO: 763256 - DNA, 20 bp, Artificial
  CRISPR gRNA sequence
ttcccaagtagctgggatta

SEQ ID NO: 763257 - DNA, 20 bp, Artificial
  CRISPR gRNA sequence
tcccaagtagctgggattac

SEQ ID NO: 763258 - DNA, 20 bp, Artificial
  CRISPR gRNA sequence
caggcatgcaccaccacgcc

SEQ ID NO: 763259 - DNA, 20 bp, Artificial
  CRISPR gRNA sequence
atgcaccaccacgcccggct

SEQ ID NO: 763260 - DNA, 20 bp, Artificial
  CRISPR gRNA sequence
ccggctaagttttgtatttt

SEQ ID NO: 763261 - DNA, 20 bp, Artificial
  CRISPR gRNA sequence
gctaagttttgtatttttag

SEQ ID NO: 763262 - DNA, 20 bp, Artificial
  CRISPR gRNA sequence
taagttttgtatttttagta

SEQ ID NO: 763263 - DNA, 20 bp, Artificial
  CRISPR gRNA sequence
ttttgtatttttagtagaga

SEQ ID NO: 763264 - DNA, 20 bp, Artificial
  CRISPR gRNA sequence
tttgtatttttagtagagac

SEQ ID NO: 763265 - DNA, 20 bp, Artificial
  CRISPR gRNA sequence
ttgtatttttagtagagaca

SEQ ID NO: 763266 - DNA, 20 bp, Artificial
  CRISPR gRNA sequence
gagacagggtttcaccatgt

SEQ ID NO: 763267 - DNA, 20 bp, Artificial
  CRISPR gRNA sequence
cagggtttcaccatgttggc

SEQ ID NO: 763268 - DNA, 20 bp, Artificial
  CRISPR gRNA sequence
agggtttcaccatgttggcc

SEQ ID NO: 763269 - DNA, 20 bp, Artificial
  CRISPR gRNA sequence
tttcaccatgttggccaggc

SEQ ID NO: 763270 - DNA, 20 bp, Artificial
  CRISPR gRNA sequence
ggtctcaaactcctgacctc

SEQ ID NO: 763271 - DNA, 20 bp, Artificial
  CRISPR gRNA sequence
ctcaagtgatccacccacct

SEQ ID NO: 763272 - DNA, 20 bp, Artificial
  CRISPR gRNA sequence
ccacccacctcggcctccca

SEQ ID NO: 763273 - DNA, 20 bp, Artificial
  CRISPR gRNA sequence
cctcggcctcccaaagtgct

SEQ ID NO: 763274 - DNA, 20 bp, Artificial
  CRISPR gRNA sequence
ctcccaaagtgctgagatta

SEQ ID NO: 763275 - DNA, 20 bp, Artificial
  CRISPR gRNA sequence
tcccaaagtgctgagattac

SEQ ID NO: 763276 - DNA, 20 bp, Artificial
  CRISPR gRNA sequence
gtgctgagattacaggtgtg

SEQ ID NO: 763277 - DNA, 20 bp, Artificial
  CRISPR gRNA sequence
caggtgtgaagtaccatgcc

SEQ ID NO: 763278 - DNA, 20 bp, Artificial
  CRISPR gRNA sequence
tgaagtaccatgcctggcct

SEQ ID NO: 763279 - DNA, 20 bp, Artificial
  CRISPR gRNA sequence
actttttatctccatctgcc

SEQ ID NO: 763280 - DNA, 20 bp, Artificial
  CRISPR gRNA sequence
ccatctgcccagctcttcta

SEQ ID NO: 763281 - DNA, 20 bp, Artificial
  CRISPR gRNA sequence
ggttatttgattctgaaaaa

SEQ ID NO: 763282 - DNA, 20 bp, Artificial
  CRISPR gRNA sequence
gttatttgattctgaaaaac

SEQ ID NO: 763283 - DNA, 20 bp, Artificial
  CRISPR gRNA sequence
atttgattctgaaaaacagg

SEQ ID NO: 763284 - DNA, 20 bp, Artificial
  CRISPR gRNA sequence
tttgattctgaaaaacagga

SEQ ID NO: 763285 - DNA, 20 bp, Artificial
  CRISPR gRNA sequence
catcactgacattataacaa

SEQ ID NO: 763286 - DNA, 20 bp, Artificial
  CRISPR gRNA sequence
atcactgacattataacaat

SEQ ID NO: 763287 - DNA, 20 bp, Artificial
  CRISPR gRNA sequence
aataggcccaataatgacta

SEQ ID NO: 763288 - DNA, 20 bp, Artificial
  CRISPR gRNA sequence
actaaccacccactgtgcgc

SEQ ID NO: 763289 - DNA, 20 bp, Artificial
  CRISPR gRNA sequence
ctaaccacccactgtgcgcc

SEQ ID NO: 763290 - DNA, 20 bp, Artificial
  CRISPR gRNA sequence
taaccacccactgtgcgcca

SEQ ID NO: 763291 - DNA, 20 bp, Artificial
  CRISPR gRNA sequence
cccactgtgcgccagggaca

SEQ ID NO: 763292 - DNA, 20 bp, Artificial
  CRISPR gRNA sequence
gcgccagggacatggctacc

SEQ ID NO: 763293 - DNA, 20 bp, Artificial
  CRISPR gRNA sequence
tacccagctgaacacttttc

SEQ ID NO: 763294 - DNA, 20 bp, Artificial
  CRISPR gRNA sequence
acacttttctagcctcccct

SEQ ID NO: 763295 - DNA, 20 bp, Artificial
  CRISPR gRNA sequence
ttttctagcctcccctgagt

SEQ ID NO: 763296 - DNA, 20 bp, Artificial
  CRISPR gRNA sequence
tttctagcctcccctgagtt

SEQ ID NO: 763297 - DNA, 20 bp, Artificial
  CRISPR gRNA sequence
ttctagcctcccctgagtta

SEQ ID NO: 763298 - DNA, 20 bp, Artificial
  CRISPR gRNA sequence
tgagttagggctcatatgcc

SEQ ID NO: 763299 - DNA, 20 bp, Artificial
  CRISPR gRNA sequence
gagttagggctcatatgcct

SEQ ID NO: 763300 - DNA, 20 bp, Artificial
  CRISPR gRNA sequence
tatgcctgggttctgaccaa

SEQ ID NO: 763301 - DNA, 20 bp, Artificial
  CRISPR gRNA sequence
ggttctgaccaatggaatgt

SEQ ID NO: 763302 - DNA, 20 bp, Artificial
  CRISPR gRNA sequence
tctgaccaatggaatgtaag

SEQ ID NO: 763303 - DNA, 20 bp, Artificial
  CRISPR gRNA sequence
gaccaatggaatgtaagcgg

SEQ ID NO: 763304 - DNA, 20 bp, Artificial
  CRISPR gRNA sequence
gaatgtaagcggaagtgatg

SEQ ID NO: 763305 - DNA, 20 bp, Artificial
  CRISPR gRNA sequence
aatgtaagcggaagtgatgc

SEQ ID NO: 763306 - DNA, 20 bp, Artificial
  CRISPR gRNA sequence
gatgcaggctacttccactc

SEQ ID NO: 763307 - DNA, 20 bp, Artificial
  CRISPR gRNA sequence
ggctacttccactcaagctc

SEQ ID NO: 763308 - DNA, 20 bp, Artificial
  CRISPR gRNA sequence
tacttccactcaagctctag

SEQ ID NO: 763309 - DNA, 20 bp, Artificial
  CRISPR gRNA sequence
acttccactcaagctctaga

SEQ ID NO: 763310 - DNA, 20 bp, Artificial
  CRISPR gRNA sequence
tccttcctttctctccctct

SEQ ID NO: 763311 - DNA, 20 bp, Artificial
  CRISPR gRNA sequence
ctttctctccctcttggctc

SEQ ID NO: 763312 - DNA, 20 bp, Artificial
  CRISPR gRNA sequence
ttctctccctcttggctctg

SEQ ID NO: 763313 - DNA, 20 bp, Artificial
  CRISPR gRNA sequence
tctctccctcttggctctgg

SEQ ID NO: 763314 - DNA, 20 bp, Artificial
  CRISPR gRNA sequence
ctctccctcttggctctgga

SEQ ID NO: 763315 - DNA, 20 bp, Artificial
  CRISPR gRNA sequence
tctccctcttggctctggag

SEQ ID NO: 763316 - DNA, 20 bp, Artificial
  CRISPR gRNA sequence
ctccctcttggctctggagg

SEQ ID NO: 763317 - DNA, 20 bp, Artificial
  CRISPR gRNA sequence
tcttggctctggagggggcg

SEQ ID NO: 763318 - DNA, 20 bp, Artificial
  CRISPR gRNA sequence
cttggctctggagggggcgt

SEQ ID NO: 763319 - DNA, 20 bp, Artificial
  CRISPR gRNA sequence
tggctctggagggggcgtgg

SEQ ID NO: 763320 - DNA, 20 bp, Artificial
  CRISPR gRNA sequence
agggggcgtgggagcacaaa

SEQ ID NO: 763321 - DNA, 20 bp, Artificial
  CRISPR gRNA sequence
tgggagcacaaacagcctct

SEQ ID NO: 763322 - DNA, 20 bp, Artificial
  CRISPR gRNA sequence
cacaaacagcctcttagacc

SEQ ID NO: 763323 - DNA, 20 bp, Artificial
  CRISPR gRNA sequence
acaaacagcctcttagacct

SEQ ID NO: 763324 - DNA, 20 bp, Artificial
  CRISPR gRNA sequence
aaacagcctcttagacctag

SEQ ID NO: 763325 - DNA, 20 bp, Artificial
  CRISPR gRNA sequence
cctcttagacctaggagtga

SEQ ID NO: 763326 - DNA, 20 bp, Artificial
  CRISPR gRNA sequence
gacctaggagtgaaagcttg

SEQ ID NO: 763327 - DNA, 20 bp, Artificial
  CRISPR gRNA sequence
ggagtgaaagcttgaagttg

SEQ ID NO: 763328 - DNA, 20 bp, Artificial
  CRISPR gRNA sequence
agtgaaagcttgaagttgaa

SEQ ID NO: 763329 - DNA, 20 bp, Artificial
  CRISPR gRNA sequence
gtgaaagcttgaagttgaag

SEQ ID NO: 763330 - DNA, 20 bp, Artificial
  CRISPR gRNA sequence
tgaaagcttgaagttgaaga

SEQ ID NO: 763331 - DNA, 20 bp, Artificial
  CRISPR gRNA sequence
aagcttgaagttgaagaggg

SEQ ID NO: 763332 - DNA, 20 bp, Artificial
  CRISPR gRNA sequence
aagttgaagagggcagaatc

SEQ ID NO: 763333 - DNA, 20 bp, Artificial
  CRISPR gRNA sequence
agttgaagagggcagaatcc

SEQ ID NO: 763334 - DNA, 20 bp, Artificial
  CRISPR gRNA sequence
gaagagggcagaatccaggt

SEQ ID NO: 763335 - DNA, 20 bp, Artificial
  CRISPR gRNA sequence
gagggcagaatccaggtaag

SEQ ID NO: 763336 - DNA, 20 bp, Artificial
  CRISPR gRNA sequence
gaatccaggtaagtggaacc

SEQ ID NO: 763337 - DNA, 20 bp, Artificial
  CRISPR gRNA sequence
aggtaagtggaacctggctc

SEQ ID NO: 763338 - DNA, 20 bp, Artificial
  CRISPR gRNA sequence
ggtaagtggaacctggctcc

SEQ ID NO: 763339 - DNA, 20 bp, Artificial
  CRISPR gRNA sequence
ggaacctggctccaggtcat

SEQ ID NO: 763340 - DNA, 20 bp, Artificial
  CRISPR gRNA sequence
acctggctccaggtcatcag

SEQ ID NO: 763341 - DNA, 20 bp, Artificial
  CRISPR gRNA sequence
tacctatgctcacactatca

SEQ ID NO: 763342 - DNA, 20 bp, Artificial
  CRISPR gRNA sequence
acctatgctcacactatcac

SEQ ID NO: 763343 - DNA, 20 bp, Artificial
  CRISPR gRNA sequence
tatgctcacactatcacagg

SEQ ID NO: 763344 - DNA, 20 bp, Artificial
  CRISPR gRNA sequence
atgctcacactatcacagga

SEQ ID NO: 763345 - DNA, 20 bp, Artificial
  CRISPR gRNA sequence
gctcacactatcacaggaag

SEQ ID NO: 763346 - DNA, 20 bp, Artificial
  CRISPR gRNA sequence
ctcacactatcacaggaagg

SEQ ID NO: 763347 - DNA, 20 bp, Artificial
  CRISPR gRNA sequence
aataaactcctgtcctgctt

SEQ ID NO: 763348 - DNA, 20 bp, Artificial
  CRISPR gRNA sequence
gcttaagcctctgtcgtatt

SEQ ID NO: 763349 - DNA, 20 bp, Artificial
  CRISPR gRNA sequence
cttaagcctctgtcgtattt

SEQ ID NO: 763350 - DNA, 20 bp, Artificial
  CRISPR gRNA sequence
ctgtcgtatttgggtcccat

SEQ ID NO: 763351 - DNA, 20 bp, Artificial
  CRISPR gRNA sequence
gtcgtatttgggtcccatca

SEQ ID NO: 763352 - DNA, 20 bp, Artificial
  CRISPR gRNA sequence
gtatttgggtcccatcagag

SEQ ID NO: 763353 - DNA, 20 bp, Artificial
  CRISPR gRNA sequence
ttgggtcccatcagagcagc

SEQ ID NO: 763354 - DNA, 20 bp, Artificial
  CRISPR gRNA sequence
tgggtcccatcagagcagct

SEQ ID NO: 763355 - DNA, 20 bp, Artificial
  CRISPR gRNA sequence
catcagagcagctgggacct

SEQ ID NO: 763356 - DNA, 20 bp, Artificial
  CRISPR gRNA sequence
cagctgggaccttggttact

SEQ ID NO: 763357 - DNA, 20 bp, Artificial
  CRISPR gRNA sequence
tcagccctctgccatctcac

SEQ ID NO: 763358 - DNA, 20 bp, Artificial
  CRISPR gRNA sequence
cagccctctgccatctcacc

SEQ ID NO: 763359 - DNA, 20 bp, Artificial
  CRISPR gRNA sequence
agccctctgccatctcacca

SEQ ID NO: 763360 - DNA, 20 bp, Artificial
  CRISPR gRNA sequence
gccctctgccatctcaccag

SEQ ID NO: 763361 - DNA, 20 bp, Artificial
  CRISPR gRNA sequence
ccctctgccatctcaccagg

SEQ ID NO: 763362 - DNA, 20 bp, Artificial
  CRISPR gRNA sequence
tctgccatctcaccaggggg

SEQ ID NO: 763363 - DNA, 20 bp, Artificial
  CRISPR gRNA sequence
catctcaccagggggaagtt

SEQ ID NO: 763364 - DNA, 20 bp, Artificial
  CRISPR gRNA sequence
atctcaccagggggaagttg

SEQ ID NO: 763365 - DNA, 20 bp, Artificial
  CRISPR gRNA sequence
aagttgaggctgctcttctg

SEQ ID NO: 763366 - DNA, 20 bp, Artificial
  CRISPR gRNA sequence
gttgaggctgctcttctgca

SEQ ID NO: 763367 - DNA, 20 bp, Artificial
  CRISPR gRNA sequence
ttgaggctgctcttctgcag

SEQ ID NO: 763368 - DNA, 20 bp, Artificial
  CRISPR gRNA sequence
tgaggctgctcttctgcaga

SEQ ID NO: 763369 - DNA, 20 bp, Artificial
  CRISPR gRNA sequence
gaggctgctcttctgcagag

SEQ ID NO: 763370 - DNA, 20 bp, Artificial
  CRISPR gRNA sequence
aggctgctcttctgcagagg

SEQ ID NO: 763371 - DNA, 20 bp, Artificial
  CRISPR gRNA sequence
ctcttctgcagagggggcct

SEQ ID NO: 763372 - DNA, 20 bp, Artificial
  CRISPR gRNA sequence
tcttctgcagagggggcctc

SEQ ID NO: 763373 - DNA, 20 bp, Artificial
  CRISPR gRNA sequence
cagagggggcctcaggtcac

SEQ ID NO: 763374 - DNA, 20 bp, Artificial
  CRISPR gRNA sequence
gggcctcaggtcactagtga

SEQ ID NO: 763375 - DNA, 20 bp, Artificial
  CRISPR gRNA sequence
ggcctcaggtcactagtgaa

SEQ ID NO: 763376 - DNA, 20 bp, Artificial
  CRISPR gRNA sequence
atgatgcctacccaccctct

SEQ ID NO: 763377 - DNA, 20 bp, Artificial
  CRISPR gRNA sequence
ccctctcagcctctcacaca

SEQ ID NO: 763378 - DNA, 20 bp, Artificial
  CRISPR gRNA sequence
cacacagatgtgtgcataca

SEQ ID NO: 763379 - DNA, 20 bp, Artificial
  CRISPR gRNA sequence
gcatacacagacacaacctc

SEQ ID NO: 763380 - DNA, 20 bp, Artificial
  CRISPR gRNA sequence
cacagacacaacctcaagcc

SEQ ID NO: 763381 - DNA, 20 bp, Artificial
  CRISPR gRNA sequence
acagacacaacctcaagccc

SEQ ID NO: 763382 - DNA, 20 bp, Artificial
  CRISPR gRNA sequence
gtctttaccttctttgctgt

SEQ ID NO: 763383 - DNA, 20 bp, Artificial
  CRISPR gRNA sequence
ctttaccttctttgctgtca

SEQ ID NO: 763384 - DNA, 20 bp, Artificial
  CRISPR gRNA sequence
tctttgctgtcagagtgttt

SEQ ID NO: 763385 - DNA, 20 bp, Artificial
  CRISPR gRNA sequence
tttgctgtcagagtgtttca

SEQ ID NO: 763386 - DNA, 20 bp, Artificial
  CRISPR gRNA sequence
ttgctgtcagagtgtttcag

SEQ ID NO: 763387 - DNA, 20 bp, Artificial
  CRISPR gRNA sequence
tcagagtgtttcagaggctg

SEQ ID NO: 763388 - DNA, 20 bp, Artificial
  CRISPR gRNA sequence
cagagtgtttcagaggctgc

SEQ ID NO: 763389 - DNA, 20 bp, Artificial
  CRISPR gRNA sequence
agagtgtttcagaggctgca

SEQ ID NO: 763390 - DNA, 20 bp, Artificial
  CRISPR gRNA sequence
aggctgcagggctgtaaaaa

SEQ ID NO: 763391 - DNA, 20 bp, Artificial
  CRISPR gRNA sequence
ggctgcagggctgtaaaaaa

SEQ ID NO: 763392 - DNA, 20 bp, Artificial
  CRISPR gRNA sequence
tgcagggctgtaaaaaaagg

SEQ ID NO: 763393 - DNA, 20 bp, Artificial
  CRISPR gRNA sequence
gcagggctgtaaaaaaagga

SEQ ID NO: 763394 - DNA, 20 bp, Artificial
  CRISPR gRNA sequence
taaaaaaaggaaggcgcaca

SEQ ID NO: 763395 - DNA, 20 bp, Artificial
  CRISPR gRNA sequence
aaaaggaaggcgcacacggt

SEQ ID NO: 763396 - DNA, 20 bp, Artificial
  CRISPR gRNA sequence
aaaggaaggcgcacacggtg

SEQ ID NO: 763397 - DNA, 20 bp, Artificial
  CRISPR gRNA sequence
aaggaaggcgcacacggtga

SEQ ID NO: 763398 - DNA, 20 bp, Artificial
  CRISPR gRNA sequence
ggaaggcgcacacggtgagg

SEQ ID NO: 763399 - DNA, 20 bp, Artificial
  CRISPR gRNA sequence
gaaggcgcacacggtgaggg

SEQ ID NO: 763400 - DNA, 20 bp, Artificial
  CRISPR gRNA sequence
acacggtgagggaggaacca

SEQ ID NO: 763401 - DNA, 20 bp, Artificial
  CRISPR gRNA sequence
cacggtgagggaggaaccat

SEQ ID NO: 763402 - DNA, 20 bp, Artificial
  CRISPR gRNA sequence
ggtgagggaggaaccatggg

SEQ ID NO: 763403 - DNA, 20 bp, Artificial
  CRISPR gRNA sequence
gagggaggaaccatgggaag

SEQ ID NO: 763404 - DNA, 20 bp, Artificial
  CRISPR gRNA sequence
ggaggaaccatgggaagtgg

SEQ ID NO: 763405 - DNA, 20 bp, Artificial
  CRISPR gRNA sequence
gaggaaccatgggaagtggt

SEQ ID NO: 763406 - DNA, 20 bp, Artificial
  CRISPR gRNA sequence
aggaaccatgggaagtggtg

SEQ ID NO: 763407 - DNA, 20 bp, Artificial
  CRISPR gRNA sequence
aaccatgggaagtggtgggg

SEQ ID NO: 763408 - DNA, 20 bp, Artificial
  CRISPR gRNA sequence
accatgggaagtggtggggt

SEQ ID NO: 763409 - DNA, 20 bp, Artificial
  CRISPR gRNA sequence
ccatgggaagtggtggggta

SEQ ID NO: 763410 - DNA, 20 bp, Artificial
  CRISPR gRNA sequence
atgggaagtggtggggtagg

SEQ ID NO: 763411 - DNA, 20 bp, Artificial
  CRISPR gRNA sequence
gaagtggtggggtagggagt

SEQ ID NO: 763412 - DNA, 20 bp, Artificial
  CRISPR gRNA sequence
aagtggtggggtagggagtc

SEQ ID NO: 763413 - DNA, 20 bp, Artificial
  CRISPR gRNA sequence
tggtggggtagggagtcagg

SEQ ID NO: 763414 - DNA, 20 bp, Artificial
  CRISPR gRNA sequence
gtggggtagggagtcaggca

SEQ ID NO: 763415 - DNA, 20 bp, Artificial
  CRISPR gRNA sequence
tggggtagggagtcaggcag

SEQ ID NO: 763416 - DNA, 20 bp, Artificial
  CRISPR gRNA sequence
ggggtagggagtcaggcaga

SEQ ID NO: 763417 - DNA, 20 bp, Artificial
  CRISPR gRNA sequence
ggtagggagtcaggcagagg

SEQ ID NO: 763418 - DNA, 20 bp, Artificial
  CRISPR gRNA sequence
gtagggagtcaggcagaggg

SEQ ID NO: 763419 - DNA, 20 bp, Artificial
  CRISPR gRNA sequence
agggagtcaggcagagggag

SEQ ID NO: 763420 - DNA, 20 bp, Artificial
  CRISPR gRNA sequence
agtcaggcagagggaggagt

SEQ ID NO: 763421 - DNA, 20 bp, Artificial
  CRISPR gRNA sequence
gtcaggcagagggaggagtg

SEQ ID NO: 763422 - DNA, 20 bp, Artificial
  CRISPR gRNA sequence
tcaggcagagggaggagtga

SEQ ID NO: 763423 - DNA, 20 bp, Artificial
  CRISPR gRNA sequence
gcagagggaggagtgagggc

SEQ ID NO: 763424 - DNA, 20 bp, Artificial
  CRISPR gRNA sequence
gagggaggagtgagggctgg

SEQ ID NO: 763425 - DNA, 20 bp, Artificial
  CRISPR gRNA sequence
agggaggagtgagggctgga

SEQ ID NO: 763426 - DNA, 20 bp, Artificial
  CRISPR gRNA sequence
gggaggagtgagggctggaa

SEQ ID NO: 763427 - DNA, 20 bp, Artificial
  CRISPR gRNA sequence
ggaggagtgagggctggaag

SEQ ID NO: 763428 - DNA, 20 bp, Artificial
  CRISPR gRNA sequence
ggagtgagggctggaagggg

SEQ ID NO: 763429 - DNA, 20 bp, Artificial
  CRISPR gRNA sequence
gagtgagggctggaaggggc

SEQ ID NO: 763430 - DNA, 20 bp, Artificial
  CRISPR gRNA sequence
agggctggaaggggcgggac

SEQ ID NO: 763431 - DNA, 20 bp, Artificial
  CRISPR gRNA sequence
ctggaaggggcgggacaagt

SEQ ID NO: 763432 - DNA, 20 bp, Artificial
  CRISPR gRNA sequence
gaaggggcgggacaagtcag

SEQ ID NO: 763433 - DNA, 20 bp, Artificial
  CRISPR gRNA sequence
aggggcgggacaagtcagca

SEQ ID NO: 763434 - DNA, 20 bp, Artificial
  CRISPR gRNA sequence
ggcgggacaagtcagcagag

SEQ ID NO: 763435 - DNA, 20 bp, Artificial
  CRISPR gRNA sequence
gcgggacaagtcagcagagt

SEQ ID NO: 763436 - DNA, 20 bp, Artificial
  CRISPR gRNA sequence
agcagagtgggaccacttca

SEQ ID NO: 763437 - DNA, 20 bp, Artificial
  CRISPR gRNA sequence
gtgggaccacttcatagcac

SEQ ID NO: 763438 - DNA, 20 bp, Artificial
  CRISPR gRNA sequence
tgggaccacttcatagcaca

SEQ ID NO: 763439 - DNA, 20 bp, Artificial
  CRISPR gRNA sequence
gggaccacttcatagcacaa

SEQ ID NO: 763440 - DNA, 20 bp, Artificial
  CRISPR gRNA sequence
accacttcatagcacaaggg

SEQ ID NO: 763441 - DNA, 20 bp, Artificial
  CRISPR gRNA sequence
ccacttcatagcacaaggga

SEQ ID NO: 763442 - DNA, 20 bp, Artificial
  CRISPR gRNA sequence
cacttcatagcacaagggaa

SEQ ID NO: 763443 - DNA, 20 bp, Artificial
  CRISPR gRNA sequence
acttcatagcacaagggaag

SEQ ID NO: 763444 - DNA, 20 bp, Artificial
  CRISPR gRNA sequence
tagcacaagggaaggggccc

SEQ ID NO: 763445 - DNA, 20 bp, Artificial
  CRISPR gRNA sequence
agcacaagggaaggggccct

SEQ ID NO: 763446 - DNA, 20 bp, Artificial
  CRISPR gRNA sequence
gggccctaggttgctgtccc

SEQ ID NO: 763447 - DNA, 20 bp, Artificial
  CRISPR gRNA sequence
taggttgctgtcccaagccc

SEQ ID NO: 763448 - DNA, 20 bp, Artificial
  CRISPR gRNA sequence
gctgtcccaagccccagtcc

SEQ ID NO: 763449 - DNA, 20 bp, Artificial
  CRISPR gRNA sequence
ctgtcccaagccccagtccc

SEQ ID NO: 763450 - DNA, 20 bp, Artificial
  CRISPR gRNA sequence
caagccccagtcccaggtcc

SEQ ID NO: 763451 - DNA, 20 bp, Artificial
  CRISPR gRNA sequence
caggtcccagttccactctg

SEQ ID NO: 763452 - DNA, 20 bp, Artificial
  CRISPR gRNA sequence
tggcttgtcattctcctctc

SEQ ID NO: 763453 - DNA, 20 bp, Artificial
  CRISPR gRNA sequence
ggcttgtcattctcctctct

SEQ ID NO: 763454 - DNA, 20 bp, Artificial
  CRISPR gRNA sequence
tcattctcctctctgggcct

SEQ ID NO: 763455 - DNA, 20 bp, Artificial
  CRISPR gRNA sequence
gccttagttttctgcatcta

SEQ ID NO: 763456 - DNA, 20 bp, Artificial
  CRISPR gRNA sequence
agttttctgcatctatagaa

SEQ ID NO: 763457 - DNA, 20 bp, Artificial
  CRISPR gRNA sequence
gttttctgcatctatagaat

SEQ ID NO: 763458 - DNA, 20 bp, Artificial
  CRISPR gRNA sequence
tatagaatgggacaaccctc

SEQ ID NO: 763459 - DNA, 20 bp, Artificial
  CRISPR gRNA sequence
accctcgagccctccacctc

SEQ ID NO: 763460 - DNA, 20 bp, Artificial
  CRISPR gRNA sequence
tcgagccctccacctccagc

SEQ ID NO: 763461 - DNA, 20 bp, Artificial
  CRISPR gRNA sequence
gagccctccacctccagctg

SEQ ID NO: 763462 - DNA, 20 bp, Artificial
  CRISPR gRNA sequence
tccacctccagctggagatg

SEQ ID NO: 763463 - DNA, 20 bp, Artificial
  CRISPR gRNA sequence
acctccagctggagatgcgg

SEQ ID NO: 763464 - DNA, 20 bp, Artificial
  CRISPR gRNA sequence
tggagatgcggaagtgccct

SEQ ID NO: 763465 - DNA, 20 bp, Artificial
  CRISPR gRNA sequence
ccctgagcccaatgtacaca

SEQ ID NO: 763466 - DNA, 20 bp, Artificial
  CRISPR gRNA sequence
cctgagcccaatgtacacac

SEQ ID NO: 763467 - DNA, 20 bp, Artificial
  CRISPR gRNA sequence
ctgagcccaatgtacacaca

SEQ ID NO: 763468 - DNA, 20 bp, Artificial
  CRISPR gRNA sequence
atgtacacacagggtgatgt

SEQ ID NO: 763469 - DNA, 20 bp, Artificial
  CRISPR gRNA sequence
tacacacagggtgatgtgag

SEQ ID NO: 763470 - DNA, 20 bp, Artificial
  CRISPR gRNA sequence
cagggtgatgtgagaagcta

SEQ ID NO: 763471 - DNA, 20 bp, Artificial
  CRISPR gRNA sequence
agggtgatgtgagaagctaa

SEQ ID NO: 763472 - DNA, 20 bp, Artificial
  CRISPR gRNA sequence
ggtgatgtgagaagctaaag

SEQ ID NO: 763473 - DNA, 20 bp, Artificial
  CRISPR gRNA sequence
gtgatgtgagaagctaaagg

SEQ ID NO: 763474 - DNA, 20 bp, Artificial
  CRISPR gRNA sequence
tgtgagaagctaaaggaggc

SEQ ID NO: 763475 - DNA, 20 bp, Artificial
  CRISPR gRNA sequence
gagaagctaaaggaggctgg

SEQ ID NO: 763476 - DNA, 20 bp, Artificial
  CRISPR gRNA sequence
aaaggaggctggcagatttg

SEQ ID NO: 763477 - DNA, 20 bp, Artificial
  CRISPR gRNA sequence
aaggaggctggcagatttgc

SEQ ID NO: 763478 - DNA, 20 bp, Artificial
  CRISPR gRNA sequence
gaggctggcagatttgcagg

SEQ ID NO: 763479 - DNA, 20 bp, Artificial
  CRISPR gRNA sequence
aggctggcagatttgcaggt

SEQ ID NO: 763480 - DNA, 20 bp, Artificial
  CRISPR gRNA sequence
ggcagatttgcaggtgggcc

SEQ ID NO: 763481 - DNA, 20 bp, Artificial
  CRISPR gRNA sequence
gcagatttgcaggtgggcct

SEQ ID NO: 763482 - DNA, 20 bp, Artificial
  CRISPR gRNA sequence
caggtgggcctgggaccatg

SEQ ID NO: 763483 - DNA, 20 bp, Artificial
  CRISPR gRNA sequence
ggcctgggaccatgtggaat

SEQ ID NO: 763484 - DNA, 20 bp, Artificial
  CRISPR gRNA sequence
tgccaactacatctgcctct

SEQ ID NO: 763485 - DNA, 20 bp, Artificial
  CRISPR gRNA sequence
tacatctgcctctgagcatg

SEQ ID NO: 763486 - DNA, 20 bp, Artificial
  CRISPR gRNA sequence
tgcctctgagcatgaagaat

SEQ ID NO: 763487 - DNA, 20 bp, Artificial
  CRISPR gRNA sequence
gcctctgagcatgaagaatg

SEQ ID NO: 763488 - DNA, 20 bp, Artificial
  CRISPR gRNA sequence
tgaagaatgaggtctgatcc

SEQ ID NO: 763489 - DNA, 20 bp, Artificial
  CRISPR gRNA sequence
aagaatgaggtctgatccca

SEQ ID NO: 763490 - DNA, 20 bp, Artificial
  CRISPR gRNA sequence
tgtctctacgcctgccacgc

SEQ ID NO: 763491 - DNA, 20 bp, Artificial
  CRISPR gRNA sequence
gtctctacgcctgccacgct

SEQ ID NO: 763492 - DNA, 20 bp, Artificial
  CRISPR gRNA sequence
cctgccacgctgggcaccaa

SEQ ID NO: 763493 - DNA, 20 bp, Artificial
  CRISPR gRNA sequence
ctgccacgctgggcaccaac

SEQ ID NO: 763494 - DNA, 20 bp, Artificial
  CRISPR gRNA sequence
acgctgggcaccaacaggca

SEQ ID NO: 763495 - DNA, 20 bp, Artificial
  CRISPR gRNA sequence
ccaacaggcaaagaattaat

SEQ ID NO: 763496 - DNA, 20 bp, Artificial
  CRISPR gRNA sequence
gaattaattggcataattta

SEQ ID NO: 763497 - DNA, 20 bp, Artificial
  CRISPR gRNA sequence
ttaattggcataatttatag

SEQ ID NO: 763498 - DNA, 20 bp, Artificial
  CRISPR gRNA sequence
cataatttatagcagtcccc

SEQ ID NO: 763499 - DNA, 20 bp, Artificial
  CRISPR gRNA sequence
atctcctgcccttccttctg

SEQ ID NO: 763500 - DNA, 20 bp, Artificial
  CRISPR gRNA sequence
tctcctgcccttccttctgc

SEQ ID NO: 763501 - DNA, 20 bp, Artificial
  CRISPR gRNA sequence
ctcctgcccttccttctgcg

SEQ ID NO: 763502 - DNA, 20 bp, Artificial
  CRISPR gRNA sequence
tcctgcccttccttctgcgg

SEQ ID NO: 763503 - DNA, 20 bp, Artificial
  CRISPR gRNA sequence
tgcccttccttctgcggggg

SEQ ID NO: 763504 - DNA, 20 bp, Artificial
  CRISPR gRNA sequence
gcccttccttctgcgggggt

SEQ ID NO: 763505 - DNA, 20 bp, Artificial
  CRISPR gRNA sequence
cccttccttctgcgggggtg

SEQ ID NO: 763506 - DNA, 20 bp, Artificial
  CRISPR gRNA sequence
cttccttctgcgggggtggg

SEQ ID NO: 763507 - DNA, 20 bp, Artificial
  CRISPR gRNA sequence
ttccttctgcgggggtgggg

SEQ ID NO: 763508 - DNA, 20 bp, Artificial
  CRISPR gRNA sequence
tccttctgcgggggtgggga

SEQ ID NO: 763509 - DNA, 20 bp, Artificial
  CRISPR gRNA sequence
tgcgggggtggggagggaac

SEQ ID NO: 763510 - DNA, 20 bp, Artificial
  CRISPR gRNA sequence
gggagggaactggcattaac

SEQ ID NO: 763511 - DNA, 20 bp, Artificial
  CRISPR gRNA sequence
ttaactggaaccatcccaaa

SEQ ID NO: 763512 - DNA, 20 bp, Artificial
  CRISPR gRNA sequence
tggaaccatcccaaatggct

SEQ ID NO: 763513 - DNA, 20 bp, Artificial
  CRISPR gRNA sequence
aaccatcccaaatggctcag

SEQ ID NO: 763514 - DNA, 20 bp, Artificial
  CRISPR gRNA sequence
cagcggaaacctgcctctcc

SEQ ID NO: 763515 - DNA, 20 bp, Artificial
  CRISPR gRNA sequence
gaaacctgcctctcccagcc

SEQ ID NO: 763516 - DNA, 20 bp, Artificial
  CRISPR gRNA sequence
aaacctgcctctcccagccc

SEQ ID NO: 763517 - DNA, 20 bp, Artificial
  CRISPR gRNA sequence
tctcccagcccaggatcccc

SEQ ID NO: 763518 - DNA, 20 bp, Artificial
  CRISPR gRNA sequence
ctcccagcccaggatcccct

SEQ ID NO: 763519 - DNA, 20 bp, Artificial
  CRISPR gRNA sequence
cccagcccaggatcccctgg

SEQ ID NO: 763520 - DNA, 20 bp, Artificial
  CRISPR gRNA sequence
gcccaggatcccctgggagt

SEQ ID NO: 763521 - DNA, 20 bp, Artificial
  CRISPR gRNA sequence
gatcccctgggagtcggcca

SEQ ID NO: 763522 - DNA, 20 bp, Artificial
  CRISPR gRNA sequence
atcccctgggagtcggccat

SEQ ID NO: 763523 - DNA, 20 bp, Artificial
  CRISPR gRNA sequence
tgggagtcggccatgggcac

SEQ ID NO: 763524 - DNA, 20 bp, Artificial
  CRISPR gRNA sequence
ggccatgggcaccagtgcct

SEQ ID NO: 763525 - DNA, 20 bp, Artificial
  CRISPR gRNA sequence
cagtgccttggcacccaccc

SEQ ID NO: 763526 - DNA, 20 bp, Artificial
  CRISPR gRNA sequence
gccttggcacccacccaagc

SEQ ID NO: 763527 - DNA, 20 bp, Artificial
  CRISPR gRNA sequence
ccttggcacccacccaagct

SEQ ID NO: 763528 - DNA, 20 bp, Artificial
  CRISPR gRNA sequence
acccacccaagctgggcccc

SEQ ID NO: 763529 - DNA, 20 bp, Artificial
  CRISPR gRNA sequence
catgctcctatgtcctttgc

SEQ ID NO: 763530 - DNA, 20 bp, Artificial
  CRISPR gRNA sequence
tttgcaagtacctccctctc

SEQ ID NO: 763531 - DNA, 20 bp, Artificial
  CRISPR gRNA sequence
ctccctctccagtcacctga

SEQ ID NO: 763532 - DNA, 20 bp, Artificial
  CRISPR gRNA sequence
ccctctccagtcacctgaaa

SEQ ID NO: 763533 - DNA, 20 bp, Artificial
  CRISPR gRNA sequence
cacctgaaagagcttcaaaa

SEQ ID NO: 763534 - DNA, 20 bp, Artificial
  CRISPR gRNA sequence
agagcttcaaaacagccctc

SEQ ID NO: 763535 - DNA, 20 bp, Artificial
  CRISPR gRNA sequence
aaacagccctctggtgccat

SEQ ID NO: 763536 - DNA, 20 bp, Artificial
  CRISPR gRNA sequence
aacagccctctggtgccatc

SEQ ID NO: 763537 - DNA, 20 bp, Artificial
  CRISPR gRNA sequence
acagccctctggtgccatca

SEQ ID NO: 763538 - DNA, 20 bp, Artificial
  CRISPR gRNA sequence
gccctctggtgccatcaggg

SEQ ID NO: 763539 - DNA, 20 bp, Artificial
  CRISPR gRNA sequence
ccctctggtgccatcagggc

SEQ ID NO: 763540 - DNA, 20 bp, Artificial
  CRISPR gRNA sequence
cctctggtgccatcagggca

SEQ ID NO: 763541 - DNA, 20 bp, Artificial
  CRISPR gRNA sequence
tggtgccatcagggcagggt

SEQ ID NO: 763542 - DNA, 20 bp, Artificial
  CRISPR gRNA sequence
ggtgccatcagggcagggtc

SEQ ID NO: 763543 - DNA, 20 bp, Artificial
  CRISPR gRNA sequence
agggtcaggatgacatttta

SEQ ID NO: 763544 - DNA, 20 bp, Artificial
  CRISPR gRNA sequence
tcaggatgacattttacaga

SEQ ID NO: 763545 - DNA, 20 bp, Artificial
  CRISPR gRNA sequence
caggatgacattttacagat

SEQ ID NO: 763546 - DNA, 20 bp, Artificial
  CRISPR gRNA sequence
acagatgggaaactgatgcc

SEQ ID NO: 763547 - DNA, 20 bp, Artificial
  CRISPR gRNA sequence
agatgggaaactgatgccca

SEQ ID NO: 763548 - DNA, 20 bp, Artificial
  CRISPR gRNA sequence
gatgggaaactgatgcccag

SEQ ID NO: 763549 - DNA, 20 bp, Artificial
  CRISPR gRNA sequence
tgggaaactgatgcccagag

SEQ ID NO: 763550 - DNA, 20 bp, Artificial
  CRISPR gRNA sequence
aaactgatgcccagaggagc

SEQ ID NO: 763551 - DNA, 20 bp, Artificial
  CRISPR gRNA sequence
aactgatgcccagaggagca

SEQ ID NO: 763552 - DNA, 20 bp, Artificial
  CRISPR gRNA sequence
ggagcaaggcaccttgccca

SEQ ID NO: 763553 - DNA, 20 bp, Artificial
  CRISPR gRNA sequence
gcaccttgcccaaagctaca

SEQ ID NO: 763554 - DNA, 20 bp, Artificial
  CRISPR gRNA sequence
aaagctacacagtctgtaac

SEQ ID NO: 763555 - DNA, 20 bp, Artificial
  CRISPR gRNA sequence
tacacagtctgtaactagaa

SEQ ID NO: 763556 - DNA, 20 bp, Artificial
  CRISPR gRNA sequence
aactagaacagtattgtctt

SEQ ID NO: 763557 - DNA, 20 bp, Artificial
  CRISPR gRNA sequence
gtcttaagctgtttgcctaa

SEQ ID NO: 763558 - DNA, 20 bp, Artificial
  CRISPR gRNA sequence
agctgtttgcctaatagtaa

SEQ ID NO: 763559 - DNA, 20 bp, Artificial
  CRISPR gRNA sequence
gctgtttgcctaatagtaat

SEQ ID NO: 763560 - DNA, 20 bp, Artificial
  CRISPR gRNA sequence
gcctaatagtaataggactc

SEQ ID NO: 763561 - DNA, 20 bp, Artificial
  CRISPR gRNA sequence
ctaatagtaataggactcca

SEQ ID NO: 763562 - DNA, 20 bp, Artificial
  CRISPR gRNA sequence
taataggactccagagtatt

SEQ ID NO: 763563 - DNA, 20 bp, Artificial
  CRISPR gRNA sequence
actccagagtattaagcact

SEQ ID NO: 763564 - DNA, 20 bp, Artificial
  CRISPR gRNA sequence
gagtattaagcacttggcac

SEQ ID NO: 763565 - DNA, 20 bp, Artificial
  CRISPR gRNA sequence
cttggcactagatatgatac

SEQ ID NO: 763566 - DNA, 20 bp, Artificial
  CRISPR gRNA sequence
ttggcactagatatgatact

SEQ ID NO: 763567 - DNA, 20 bp, Artificial
  CRISPR gRNA sequence
tgattatcctcattttacat

SEQ ID NO: 763568 - DNA, 20 bp, Artificial
  CRISPR gRNA sequence
attatcctcattttacataa

SEQ ID NO: 763569 - DNA, 20 bp, Artificial
  CRISPR gRNA sequence
ttatcctcattttacataag

SEQ ID NO: 763570 - DNA, 20 bp, Artificial
  CRISPR gRNA sequence
ttttacataagaggaaaccg

SEQ ID NO: 763571 - DNA, 20 bp, Artificial
  CRISPR gRNA sequence
acataagaggaaaccgaagc

SEQ ID NO: 763572 - DNA, 20 bp, Artificial
  CRISPR gRNA sequence
ataagaggaaaccgaagcca

SEQ ID NO: 763573 - DNA, 20 bp, Artificial
  CRISPR gRNA sequence
aagaggaaaccgaagccaga

SEQ ID NO: 763574 - DNA, 20 bp, Artificial
  CRISPR gRNA sequence
agaggaaaccgaagccagag

SEQ ID NO: 763575 - DNA, 20 bp, Artificial
  CRISPR gRNA sequence
aaaccgaagccagagaggca

SEQ ID NO: 763576 - DNA, 20 bp, Artificial
  CRISPR gRNA sequence
agaggcaaagcatcttgctc

SEQ ID NO: 763577 - DNA, 20 bp, Artificial
  CRISPR gRNA sequence
gaggcaaagcatcttgctca

SEQ ID NO: 763578 - DNA, 20 bp, Artificial
  CRISPR gRNA sequence
caaggccactctgtttacct

SEQ ID NO: 763579 - DNA, 20 bp, Artificial
  CRISPR gRNA sequence
gccactctgtttacctgaga

SEQ ID NO: 763580 - DNA, 20 bp, Artificial
  CRISPR gRNA sequence
cactctgtttacctgagatg

SEQ ID NO: 763581 - DNA, 20 bp, Artificial
  CRISPR gRNA sequence
tctgtttacctgagatggag

SEQ ID NO: 763582 - DNA, 20 bp, Artificial
  CRISPR gRNA sequence
ctgtttacctgagatggagc

SEQ ID NO: 763583 - DNA, 20 bp, Artificial
  CRISPR gRNA sequence
atggagcaggaacttaaacc

SEQ ID NO: 763584 - DNA, 20 bp, Artificial
  CRISPR gRNA sequence
aaacccagactccctatctc

SEQ ID NO: 763585 - DNA, 20 bp, Artificial
  CRISPR gRNA sequence
acccagactccctatctccg

SEQ ID NO: 763586 - DNA, 20 bp, Artificial
  CRISPR gRNA sequence
ggagcccctgctcccacccc

SEQ ID NO: 763587 - DNA, 20 bp, Artificial
  CRISPR gRNA sequence
gagcccctgctcccacccct

SEQ ID NO: 763588 - DNA, 20 bp, Artificial
  CRISPR gRNA sequence
cccctgctcccacccctagg

SEQ ID NO: 763589 - DNA, 20 bp, Artificial
  CRISPR gRNA sequence
tcccacccctaggaagccac

SEQ ID NO: 763590 - DNA, 20 bp, Artificial
  CRISPR gRNA sequence
taggaagccaccagactcca

SEQ ID NO: 763591 - DNA, 20 bp, Artificial
  CRISPR gRNA sequence
agccaccagactccacggtg

SEQ ID NO: 763592 - DNA, 20 bp, Artificial
  CRISPR gRNA sequence
gccaccagactccacggtgt

SEQ ID NO: 763593 - DNA, 20 bp, Artificial
  CRISPR gRNA sequence
ccaccagactccacggtgtg

SEQ ID NO: 763594 - DNA, 20 bp, Artificial
  CRISPR gRNA sequence
ctccacggtgtggggccaat

SEQ ID NO: 763595 - DNA, 20 bp, Artificial
  CRISPR gRNA sequence
tccacggtgtggggccaatc

SEQ ID NO: 763596 - DNA, 20 bp, Artificial
  CRISPR gRNA sequence
acggtgtggggccaatcagg

SEQ ID NO: 763597 - DNA, 20 bp, Artificial
  CRISPR gRNA sequence
tggggccaatcaggtggaat

SEQ ID NO: 763598 - DNA, 20 bp, Artificial
  CRISPR gRNA sequence
caatcaggtggaatcggccc

SEQ ID NO: 763599 - DNA, 20 bp, Artificial
  CRISPR gRNA sequence
tcaggtggaatcggccctgg

SEQ ID NO: 763600 - DNA, 20 bp, Artificial
  CRISPR gRNA sequence
gtggaatcggccctggcaga

SEQ ID NO: 763601 - DNA, 20 bp, Artificial
  CRISPR gRNA sequence
tggaatcggccctggcagat

SEQ ID NO: 763602 - DNA, 20 bp, Artificial
  CRISPR gRNA sequence
tcggccctggcagatgggta

SEQ ID NO: 763603 - DNA, 20 bp, Artificial
  CRISPR gRNA sequence
cggccctggcagatgggtaa

SEQ ID NO: 763604 - DNA, 20 bp, Artificial
  CRISPR gRNA sequence
cctggcagatgggtaaaggt

SEQ ID NO: 763605 - DNA, 20 bp, Artificial
  CRISPR gRNA sequence
ggcagatgggtaaaggttgg

SEQ ID NO: 763606 - DNA, 20 bp, Artificial
  CRISPR gRNA sequence
gcagatgggtaaaggttggc

SEQ ID NO: 763607 - DNA, 20 bp, Artificial
  CRISPR gRNA sequence
agatgggtaaaggttggcag

SEQ ID NO: 763608 - DNA, 20 bp, Artificial
  CRISPR gRNA sequence
aaaggttggcaggagaaatg

SEQ ID NO: 763609 - DNA, 20 bp, Artificial
  CRISPR gRNA sequence
aggagaaatgaagccacacc

SEQ ID NO: 763610 - DNA, 20 bp, Artificial
  CRISPR gRNA sequence
ggagaaatgaagccacacct

SEQ ID NO: 763611 - DNA, 20 bp, Artificial
  CRISPR gRNA sequence
agaaatgaagccacacctgg

SEQ ID NO: 763612 - DNA, 20 bp, Artificial
  CRISPR gRNA sequence
gaaatgaagccacacctggg

SEQ ID NO: 763613 - DNA, 20 bp, Artificial
  CRISPR gRNA sequence
aaatgaagccacacctggga

SEQ ID NO: 763614 - DNA, 20 bp, Artificial
  CRISPR gRNA sequence
agccacacctgggagggaac

SEQ ID NO: 763615 - DNA, 20 bp, Artificial
  CRISPR gRNA sequence
gccacacctgggagggaact

SEQ ID NO: 763616 - DNA, 20 bp, Artificial
  CRISPR gRNA sequence
atccacttcctgcctaactc

SEQ ID NO: 763617 - DNA, 20 bp, Artificial
  CRISPR gRNA sequence
tccacttcctgcctaactct

SEQ ID NO: 763618 - DNA, 20 bp, Artificial
  CRISPR gRNA sequence
ttcctgcctaactctgggca

SEQ ID NO: 763619 - DNA, 20 bp, Artificial
  CRISPR gRNA sequence
cctgcctaactctgggcaaa

SEQ ID NO: 763620 - DNA, 20 bp, Artificial
  CRISPR gRNA sequence
gcctaactctgggcaaagag

SEQ ID NO: 763621 - DNA, 20 bp, Artificial
  CRISPR gRNA sequence
tgggcaaagagcagactcac

SEQ ID NO: 763622 - DNA, 20 bp, Artificial
  CRISPR gRNA sequence
gggcaaagagcagactcacc

SEQ ID NO: 763623 - DNA, 20 bp, Artificial
  CRISPR gRNA sequence
ggcaaagagcagactcaccg

SEQ ID NO: 763624 - DNA, 20 bp, Artificial
  CRISPR gRNA sequence
aaagagcagactcaccgggg

SEQ ID NO: 763625 - DNA, 20 bp, Artificial
  CRISPR gRNA sequence
aagagcagactcaccggggt

SEQ ID NO: 763626 - DNA, 20 bp, Artificial
  CRISPR gRNA sequence
agagcagactcaccggggtg

SEQ ID NO: 763627 - DNA, 20 bp, Artificial
  CRISPR gRNA sequence
agcagactcaccggggtggg

SEQ ID NO: 763628 - DNA, 20 bp, Artificial
  CRISPR gRNA sequence
gcagactcaccggggtgggg

SEQ ID NO: 763629 - DNA, 20 bp, Artificial
  CRISPR gRNA sequence
tcaccggggtggggaggtct

SEQ ID NO: 763630 - DNA, 20 bp, Artificial
  CRISPR gRNA sequence
ggtggggaggtctgagtcca

SEQ ID NO: 763631 - DNA, 20 bp, Artificial
  CRISPR gRNA sequence
cacatttcattcaaacctta

SEQ ID NO: 763632 - DNA, 20 bp, Artificial
  CRISPR gRNA sequence
ttcaaaccttacagcaaatc

SEQ ID NO: 763633 - DNA, 20 bp, Artificial
  CRISPR gRNA sequence
tacagcaaatctggcccctc

SEQ ID NO: 763634 - DNA, 20 bp, Artificial
  CRISPR gRNA sequence
aatctggcccctccagatcc

SEQ ID NO: 763635 - DNA, 20 bp, Artificial
  CRISPR gRNA sequence
tctggcccctccagatccta

SEQ ID NO: 763636 - DNA, 20 bp, Artificial
  CRISPR gRNA sequence
tttcccatatgtccctctcc

SEQ ID NO: 763637 - DNA, 20 bp, Artificial
  CRISPR gRNA sequence
catatgtccctctcccagcc

SEQ ID NO: 763638 - DNA, 20 bp, Artificial
  CRISPR gRNA sequence
tatgtccctctcccagccaa

SEQ ID NO: 763639 - DNA, 20 bp, Artificial
  CRISPR gRNA sequence
atgtccctctcccagccaag

SEQ ID NO: 763640 - DNA, 20 bp, Artificial
  CRISPR gRNA sequence
tgtccctctcccagccaaga

SEQ ID NO: 763641 - DNA, 20 bp, Artificial
  CRISPR gRNA sequence
cctctcccagccaagagggc

SEQ ID NO: 763642 - DNA, 20 bp, Artificial
  CRISPR gRNA sequence
cagccaagagggccagctcc

SEQ ID NO: 763643 - DNA, 20 bp, Artificial
  CRISPR gRNA sequence
aagagggccagctccaagtt

SEQ ID NO: 763644 - DNA, 20 bp, Artificial
  CRISPR gRNA sequence
aagttcagactcacctgtct

SEQ ID NO: 763645 - DNA, 20 bp, Artificial
  CRISPR gRNA sequence
gttcagactcacctgtcttg

SEQ ID NO: 763646 - DNA, 20 bp, Artificial
  CRISPR gRNA sequence
agccttctccctccccatcc

SEQ ID NO: 763647 - DNA, 20 bp, Artificial
  CRISPR gRNA sequence
tccctccccatcctggtcct

SEQ ID NO: 763648 - DNA, 20 bp, Artificial
  CRISPR gRNA sequence
cctggtcctcagctcctgca

SEQ ID NO: 763649 - DNA, 20 bp, Artificial
  CRISPR gRNA sequence
ctggtcctcagctcctgcaa

SEQ ID NO: 763650 - DNA, 20 bp, Artificial
  CRISPR gRNA sequence
tcctcagctcctgcaaaggc

SEQ ID NO: 763651 - DNA, 20 bp, Artificial
  CRISPR gRNA sequence
ctcctgcaaaggcaagaact

SEQ ID NO: 763652 - DNA, 20 bp, Artificial
  CRISPR gRNA sequence
aataaacaaaaatcttttgc

SEQ ID NO: 763653 - DNA, 20 bp, Artificial
  CRISPR gRNA sequence
ttgcaagcccattttcatgc

SEQ ID NO: 763654 - DNA, 20 bp, Artificial
  CRISPR gRNA sequence
atgccagcactttcccacct

SEQ ID NO: 763655 - DNA, 20 bp, Artificial
  CRISPR gRNA sequence
gccagcactttcccacctga

SEQ ID NO: 763656 - DNA, 20 bp, Artificial
  CRISPR gRNA sequence
cactttcccacctgagagtg

SEQ ID NO: 763657 - DNA, 20 bp, Artificial
  CRISPR gRNA sequence
actttcccacctgagagtgc

SEQ ID NO: 763658 - DNA, 20 bp, Artificial
  CRISPR gRNA sequence
ttcccacctgagagtgcagg

SEQ ID NO: 763659 - DNA, 20 bp, Artificial
  CRISPR gRNA sequence
cacctgagagtgcaggaagc

SEQ ID NO: 763660 - DNA, 20 bp, Artificial
  CRISPR gRNA sequence
gagtgcaggaagctggtgaa

SEQ ID NO: 763661 - DNA, 20 bp, Artificial
  CRISPR gRNA sequence
agtgcaggaagctggtgaac

SEQ ID NO: 763662 - DNA, 20 bp, Artificial
  CRISPR gRNA sequence
gtgcaggaagctggtgaaca

SEQ ID NO: 763663 - DNA, 20 bp, Artificial
  CRISPR gRNA sequence
gaagctggtgaacagggcct

SEQ ID NO: 763664 - DNA, 20 bp, Artificial
  CRISPR gRNA sequence
gctggtgaacagggcctgag

SEQ ID NO: 763665 - DNA, 20 bp, Artificial
  CRISPR gRNA sequence
ctggtgaacagggcctgagt

SEQ ID NO: 763666 - DNA, 20 bp, Artificial
  CRISPR gRNA sequence
gcctgagtgggcctgacctg

SEQ ID NO: 763667 - DNA, 20 bp, Artificial
  CRISPR gRNA sequence
ctgacctgcggaccaaatgc

SEQ ID NO: 763668 - DNA, 20 bp, Artificial
  CRISPR gRNA sequence
tgcggaccaaatgctagaca

SEQ ID NO: 763669 - DNA, 20 bp, Artificial
  CRISPR gRNA sequence
gcggaccaaatgctagacac

SEQ ID NO: 763670 - DNA, 20 bp, Artificial
  CRISPR gRNA sequence
accaaatgctagacacgggt

SEQ ID NO: 763671 - DNA, 20 bp, Artificial
  CRISPR gRNA sequence
caaatgctagacacgggtta

SEQ ID NO: 763672 - DNA, 20 bp, Artificial
  CRISPR gRNA sequence
ctagacacgggttagagccc

SEQ ID NO: 763673 - DNA, 20 bp, Artificial
  CRISPR gRNA sequence
agacacgggttagagcccga

SEQ ID NO: 763674 - DNA, 20 bp, Artificial
  CRISPR gRNA sequence
cacgggttagagcccgagag

SEQ ID NO: 763675 - DNA, 20 bp, Artificial
  CRISPR gRNA sequence
cgggttagagcccgagagca

SEQ ID NO: 763676 - DNA, 20 bp, Artificial
  CRISPR gRNA sequence
tagagcccgagagcagagca

SEQ ID NO: 763677 - DNA, 20 bp, Artificial
  CRISPR gRNA sequence
agcccgagagcagagcacag

SEQ ID NO: 763678 - DNA, 20 bp, Artificial
  CRISPR gRNA sequence
cccgagagcagagcacagca

SEQ ID NO: 763679 - DNA, 20 bp, Artificial
  CRISPR gRNA sequence
gagcagagcacagcagagcc

SEQ ID NO: 763680 - DNA, 20 bp, Artificial
  CRISPR gRNA sequence
gccgagcctgtgacaacatg

SEQ ID NO: 763681 - DNA, 20 bp, Artificial
  CRISPR gRNA sequence
ccgagcctgtgacaacatga

SEQ ID NO: 763682 - DNA, 20 bp, Artificial
  CRISPR gRNA sequence
cgagcctgtgacaacatgaa

SEQ ID NO: 763683 - DNA, 20 bp, Artificial
  CRISPR gRNA sequence
gagcctgtgacaacatgaag

SEQ ID NO: 763684 - DNA, 20 bp, Artificial
  CRISPR gRNA sequence
tgacaacatgaaggggctcc

SEQ ID NO: 763685 - DNA, 20 bp, Artificial
  CRISPR gRNA sequence
acatgaaggggctcccagcc

SEQ ID NO: 763686 - DNA, 20 bp, Artificial
  CRISPR gRNA sequence
atgaaggggctcccagcctg

SEQ ID NO: 763687 - DNA, 20 bp, Artificial
  CRISPR gRNA sequence
cctggagcccaccactcacc

SEQ ID NO: 763688 - DNA, 20 bp, Artificial
  CRISPR gRNA sequence
tcacccagccaaaaactacc

SEQ ID NO: 763689 - DNA, 20 bp, Artificial
  CRISPR gRNA sequence
cagccaaaaactacccagcc

SEQ ID NO: 763690 - DNA, 20 bp, Artificial
  CRISPR gRNA sequence
tggcgcccccaccactcacc

SEQ ID NO: 763691 - DNA, 20 bp, Artificial
  CRISPR gRNA sequence
ccccaccactcacccagcca

SEQ ID NO: 763692 - DNA, 20 bp, Artificial
  CRISPR gRNA sequence
ccagccaaagaccatccacc

SEQ ID NO: 763693 - DNA, 20 bp, Artificial
  CRISPR gRNA sequence
caaagaccatccacccagcc

SEQ ID NO: 763694 - DNA, 20 bp, Artificial
  CRISPR gRNA sequence
aagaccatccacccagcctg

SEQ ID NO: 763695 - DNA, 20 bp, Artificial
  CRISPR gRNA sequence
cctggagtgcaccacttacc

SEQ ID NO: 763696 - DNA, 20 bp, Artificial
  CRISPR gRNA sequence
agtgcaccacttacccagtc

SEQ ID NO: 763697 - DNA, 20 bp, Artificial
  CRISPR gRNA sequence
gtgcaccacttacccagtca

SEQ ID NO: 763698 - DNA, 20 bp, Artificial
  CRISPR gRNA sequence
ccagtcaaggaccatccacc

SEQ ID NO: 763699 - DNA, 20 bp, Artificial
  CRISPR gRNA sequence
caaggaccatccacccagcc

SEQ ID NO: 763700 - DNA, 20 bp, Artificial
  CRISPR gRNA sequence
aggaccatccacccagcctg

SEQ ID NO: 763701 - DNA, 20 bp, Artificial
  CRISPR gRNA sequence
cctggagcccaccactcacc

SEQ ID NO: 763702 - DNA, 20 bp, Artificial
  CRISPR gRNA sequence
gcccaccactcacccagcca

SEQ ID NO: 763703 - DNA, 20 bp, Artificial
  CRISPR gRNA sequence
caaagaccatccactcaacc

SEQ ID NO: 763704 - DNA, 20 bp, Artificial
  CRISPR gRNA sequence
aagaccatccactcaacctg

SEQ ID NO: 763705 - DNA, 20 bp, Artificial
  CRISPR gRNA sequence
tggagcccccgccacacacc

SEQ ID NO: 763706 - DNA, 20 bp, Artificial
  CRISPR gRNA sequence
ccccgccacacacccagcca

SEQ ID NO: 763707 - DNA, 20 bp, Artificial
  CRISPR gRNA sequence
accatccacctaccctccac

SEQ ID NO: 763708 - DNA, 20 bp, Artificial
  CRISPR gRNA sequence
acctcacccatccgctcgct

SEQ ID NO: 763709 - DNA, 20 bp, Artificial
  CRISPR gRNA sequence
tcacccatccgctcgctcag

SEQ ID NO: 763710 - DNA, 20 bp, Artificial
  CRISPR gRNA sequence
tgccaaccatcaacctccaa

SEQ ID NO: 763711 - DNA, 20 bp, Artificial
  CRISPR gRNA sequence
ctccaacagatgtaaccaac

SEQ ID NO: 763712 - DNA, 20 bp, Artificial
  CRISPR gRNA sequence
cttccacctgtctacctcac

SEQ ID NO: 763713 - DNA, 20 bp, Artificial
  CRISPR gRNA sequence
tccctctccttcccaacctc

SEQ ID NO: 763714 - DNA, 20 bp, Artificial
  CRISPR gRNA sequence
tcccaacctccagccatccc

SEQ ID NO: 763715 - DNA, 20 bp, Artificial
  CRISPR gRNA sequence
tcatgcatctgtttacccac

SEQ ID NO: 763716 - DNA, 20 bp, Artificial
  CRISPR gRNA sequence
catgcatctgtttacccacc

SEQ ID NO: 763717 - DNA, 20 bp, Artificial
  CRISPR gRNA sequence
atgcatctgtttacccacca

SEQ ID NO: 763718 - DNA, 20 bp, Artificial
  CRISPR gRNA sequence
atgtcctctcacccacttac

SEQ ID NO: 763719 - DNA, 20 bp, Artificial
  CRISPR gRNA sequence
cacttaccagtcaccaatgc

SEQ ID NO: 763720 - DNA, 20 bp, Artificial
  CRISPR gRNA sequence
accagtcaccaatgccagct

SEQ ID NO: 763721 - DNA, 20 bp, Artificial
  CRISPR gRNA sequence
ccagtcaccaatgccagctc

SEQ ID NO: 763722 - DNA, 20 bp, Artificial
  CRISPR gRNA sequence
tgccagctcgggctgaccct

SEQ ID NO: 763723 - DNA, 20 bp, Artificial
  CRISPR gRNA sequence
ctgaccctcagccccgcaaa

SEQ ID NO: 763724 - DNA, 20 bp, Artificial
  CRISPR gRNA sequence
accctcagccccgcaaatgg

SEQ ID NO: 763725 - DNA, 20 bp, Artificial
  CRISPR gRNA sequence
agctgcttcaaactcactcc

SEQ ID NO: 763726 - DNA, 20 bp, Artificial
  CRISPR gRNA sequence
gctgcttcaaactcactcca

SEQ ID NO: 763727 - DNA, 20 bp, Artificial
  CRISPR gRNA sequence
gcttcaaactcactccaagg

SEQ ID NO: 763728 - DNA, 20 bp, Artificial
  CRISPR gRNA sequence
cttcaaactcactccaaggc

SEQ ID NO: 763729 - DNA, 20 bp, Artificial
  CRISPR gRNA sequence
aaggcaggcacgatcacccc

SEQ ID NO: 763730 - DNA, 20 bp, Artificial
  CRISPR gRNA sequence
cccagtgccatgcacgcccc

SEQ ID NO: 763731 - DNA, 20 bp, Artificial
  CRISPR gRNA sequence
atgcctacatttgtgccgca

SEQ ID NO: 763732 - DNA, 20 bp, Artificial
  CRISPR gRNA sequence
gccgcacagcttccatgctc

SEQ ID NO: 763733 - DNA, 20 bp, Artificial
  CRISPR gRNA sequence
gtgactgacttacactttca

SEQ ID NO: 763734 - DNA, 20 bp, Artificial
  CRISPR gRNA sequence
tgactgacttacactttcac

SEQ ID NO: 763735 - DNA, 20 bp, Artificial
  CRISPR gRNA sequence
actttcacaggcacacttgt

SEQ ID NO: 763736 - DNA, 20 bp, Artificial
  CRISPR gRNA sequence
ggcacacactcatccctttg

SEQ ID NO: 763737 - DNA, 20 bp, Artificial
  CRISPR gRNA sequence
actcatccctttgtagcact

SEQ ID NO: 763738 - DNA, 20 bp, Artificial
  CRISPR gRNA sequence
cttacactcccaccaccttc

SEQ ID NO: 763739 - DNA, 20 bp, Artificial
  CRISPR gRNA sequence
actcatccacattcatcctg

SEQ ID NO: 763740 - DNA, 20 bp, Artificial
  CRISPR gRNA sequence
catcctgtggtatctgcaca

SEQ ID NO: 763741 - DNA, 20 bp, Artificial
  CRISPR gRNA sequence
ctgtggtatctgcacatgga

SEQ ID NO: 763742 - DNA, 20 bp, Artificial
  CRISPR gRNA sequence
ggtatctgcacatggacaga

SEQ ID NO: 763743 - DNA, 20 bp, Artificial
  CRISPR gRNA sequence
gtatctgcacatggacagac

SEQ ID NO: 763744 - DNA, 20 bp, Artificial
  CRISPR gRNA sequence
tcacgcttgttcacacacac

SEQ ID NO: 763745 - DNA, 20 bp, Artificial
  CRISPR gRNA sequence
ttgttcacacacacaagacg

SEQ ID NO: 763746 - DNA, 20 bp, Artificial
  CRISPR gRNA sequence
cacacacaagacgtagactc

SEQ ID NO: 763747 - DNA, 20 bp, Artificial
  CRISPR gRNA sequence
acacacaagacgtagactca

SEQ ID NO: 763748 - DNA, 20 bp, Artificial
  CRISPR gRNA sequence
cgtagactcaaggtcacaca

SEQ ID NO: 763749 - DNA, 20 bp, Artificial
  CRISPR gRNA sequence
aggtcacacacagacaaatc

SEQ ID NO: 763750 - DNA, 20 bp, Artificial
  CRISPR gRNA sequence
acacacactcgttctgtcac

SEQ ID NO: 763751 - DNA, 20 bp, Artificial
  CRISPR gRNA sequence
acactcgttctgtcactaga

SEQ ID NO: 763752 - DNA, 20 bp, Artificial
  CRISPR gRNA sequence
gtgacactctattgacatca

SEQ ID NO: 763753 - DNA, 20 bp, Artificial
  CRISPR gRNA sequence
cactctattgacatcaaaga

SEQ ID NO: 763754 - DNA, 20 bp, Artificial
  CRISPR gRNA sequence
caaagacagcaacatacccc

SEQ ID NO: 763755 - DNA, 20 bp, Artificial
  CRISPR gRNA sequence
caacataccccaagacacat

SEQ ID NO: 763756 - DNA, 20 bp, Artificial
  CRISPR gRNA sequence
cacctgcattctcctcctca

SEQ ID NO: 763757 - DNA, 20 bp, Artificial
  CRISPR gRNA sequence
agctctgtttgatctttctc

SEQ ID NO: 763758 - DNA, 20 bp, Artificial
  CRISPR gRNA sequence
gatctttctccagcacacga

SEQ ID NO: 763759 - DNA, 20 bp, Artificial
  CRISPR gRNA sequence
tttctccagcacacgaaagc

SEQ ID NO: 763760 - DNA, 20 bp, Artificial
  CRISPR gRNA sequence
ttctccagcacacgaaagcc

SEQ ID NO: 763761 - DNA, 20 bp, Artificial
  CRISPR gRNA sequence
tctccagcacacgaaagcca

SEQ ID NO: 763762 - DNA, 20 bp, Artificial
  CRISPR gRNA sequence
cacacgaaagccagggccac

SEQ ID NO: 763763 - DNA, 20 bp, Artificial
  CRISPR gRNA sequence
acgaaagccagggccaccag

SEQ ID NO: 763764 - DNA, 20 bp, Artificial
  CRISPR gRNA sequence
agggccaccagcagtgcaat

SEQ ID NO: 763765 - DNA, 20 bp, Artificial
  CRISPR gRNA sequence
ccaccagcagtgcaatgaga

SEQ ID NO: 763766 - DNA, 20 bp, Artificial
  CRISPR gRNA sequence
cagcagtgcaatgagacaga

SEQ ID NO: 763767 - DNA, 20 bp, Artificial
  CRISPR gRNA sequence
agtgcaatgagacagacaga

SEQ ID NO: 763768 - DNA, 20 bp, Artificial
  CRISPR gRNA sequence
gagacagacagacagcccca

SEQ ID NO: 763769 - DNA, 20 bp, Artificial
  CRISPR gRNA sequence
gacagccccacggtcaccca

SEQ ID NO: 763770 - DNA, 20 bp, Artificial
  CRISPR gRNA sequence
acagccccacggtcacccac

SEQ ID NO: 763771 - DNA, 20 bp, Artificial
  CRISPR gRNA sequence
cagccccacggtcacccaca

SEQ ID NO: 763772 - DNA, 20 bp, Artificial
  CRISPR gRNA sequence
acggtcacccacagggcctc

SEQ ID NO: 763773 - DNA, 20 bp, Artificial
  CRISPR gRNA sequence
cggtcacccacagggcctct

SEQ ID NO: 763774 - DNA, 20 bp, Artificial
  CRISPR gRNA sequence
ggtcacccacagggcctctg

SEQ ID NO: 763775 - DNA, 20 bp, Artificial
  CRISPR gRNA sequence
gtcacccacagggcctctgg

SEQ ID NO: 763776 - DNA, 20 bp, Artificial
  CRISPR gRNA sequence
tcacccacagggcctctggg

SEQ ID NO: 763777 - DNA, 20 bp, Artificial
  CRISPR gRNA sequence
ggcctctggggggaatgtca

SEQ ID NO: 763778 - DNA, 20 bp, Artificial
  CRISPR gRNA sequence
gcctctggggggaatgtcat

SEQ ID NO: 763779 - DNA, 20 bp, Artificial
  CRISPR gRNA sequence
ggaatgtcataggctgccct

SEQ ID NO: 763780 - DNA, 20 bp, Artificial
  CRISPR gRNA sequence
aatgtcataggctgccctga

SEQ ID NO: 763781 - DNA, 20 bp, Artificial
  CRISPR gRNA sequence
atgtcataggctgccctgag

SEQ ID NO: 763782 - DNA, 20 bp, Artificial
  CRISPR gRNA sequence
ataggctgccctgagaggaa

SEQ ID NO: 763783 - DNA, 20 bp, Artificial
  CRISPR gRNA sequence
ggctgccctgagaggaaaag

SEQ ID NO: 763784 - DNA, 20 bp, Artificial
  CRISPR gRNA sequence
cctgagaggaaaagtagcaa

SEQ ID NO: 763785 - DNA, 20 bp, Artificial
  CRISPR gRNA sequence
agaggaaaagtagcaacagt

SEQ ID NO: 763786 - DNA, 20 bp, Artificial
  CRISPR gRNA sequence
aacagtgagactgtcatgcc

SEQ ID NO: 763787 - DNA, 20 bp, Artificial
  CRISPR gRNA sequence
tcatgcctggccccatgtcc

SEQ ID NO: 763788 - DNA, 20 bp, Artificial
  CRISPR gRNA sequence
atgcctggccccatgtcccg

SEQ ID NO: 763789 - DNA, 20 bp, Artificial
  CRISPR gRNA sequence
tgcctggccccatgtcccgg

SEQ ID NO: 763790 - DNA, 20 bp, Artificial
  CRISPR gRNA sequence
tggccccatgtcccggagga

SEQ ID NO: 763791 - DNA, 20 bp, Artificial
  CRISPR gRNA sequence
gtcccggaggacagcaccat

SEQ ID NO: 763792 - DNA, 20 bp, Artificial
  CRISPR gRNA sequence
aggacagcaccattggctcc

SEQ ID NO: 763793 - DNA, 20 bp, Artificial
  CRISPR gRNA sequence
ccattggctccaagtgtgaa

SEQ ID NO: 763794 - DNA, 20 bp, Artificial
  CRISPR gRNA sequence
cattggctccaagtgtgaac

SEQ ID NO: 763795 - DNA, 20 bp, Artificial
  CRISPR gRNA sequence
attggctccaagtgtgaaca

SEQ ID NO: 763796 - DNA, 20 bp, Artificial
  CRISPR gRNA sequence
ttggctccaagtgtgaacag

SEQ ID NO: 763797 - DNA, 20 bp, Artificial
  CRISPR gRNA sequence
acaggggctcccaccctcac

SEQ ID NO: 763798 - DNA, 20 bp, Artificial
  CRISPR gRNA sequence
caggggctcccaccctcact

SEQ ID NO: 763799 - DNA, 20 bp, Artificial
  CRISPR gRNA sequence
gggccctaacactatgaata

SEQ ID NO: 763800 - DNA, 20 bp, Artificial
  CRISPR gRNA sequence
actatgaataaagctcactt

SEQ ID NO: 763801 - DNA, 20 bp, Artificial
  CRISPR gRNA sequence
aaagctcacttaagttccta

SEQ ID NO: 763802 - DNA, 20 bp, Artificial
  CRISPR gRNA sequence
cccaaaccctgatacaaccc

SEQ ID NO: 763803 - DNA, 20 bp, Artificial
  CRISPR gRNA sequence
tgatacaaccctggctgatg

SEQ ID NO: 763804 - DNA, 20 bp, Artificial
  CRISPR gRNA sequence
tgatgtggacacgcctcaac

SEQ ID NO: 763805 - DNA, 20 bp, Artificial
  CRISPR gRNA sequence
gatgtggacacgcctcaacc

SEQ ID NO: 763806 - DNA, 20 bp, Artificial
  CRISPR gRNA sequence
gtggacacgcctcaaccagg

SEQ ID NO: 763807 - DNA, 20 bp, Artificial
  CRISPR gRNA sequence
tggacacgcctcaaccagga

SEQ ID NO: 763808 - DNA, 20 bp, Artificial
  CRISPR gRNA sequence
ggacacgcctcaaccaggaa

SEQ ID NO: 763809 - DNA, 20 bp, Artificial
  CRISPR gRNA sequence
gcctcaaccaggaagggctg

SEQ ID NO: 763810 - DNA, 20 bp, Artificial
  CRISPR gRNA sequence
ctcaaccaggaagggctgaa

SEQ ID NO: 763811 - DNA, 20 bp, Artificial
  CRISPR gRNA sequence
aggaagggctgaagagcctg

SEQ ID NO: 763812 - DNA, 20 bp, Artificial
  CRISPR gRNA sequence
ctgtggttgaattgatgctc

SEQ ID NO: 763813 - DNA, 20 bp, Artificial
  CRISPR gRNA sequence
tgatgctcaagtaccttcta

SEQ ID NO: 763814 - DNA, 20 bp, Artificial
  CRISPR gRNA sequence
aagtaccttctatggctccc

SEQ ID NO: 763815 - DNA, 20 bp, Artificial
  CRISPR gRNA sequence
ctatggctccctagtgactt

SEQ ID NO: 763816 - DNA, 20 bp, Artificial
  CRISPR gRNA sequence
tgactttagaataatgcttc

SEQ ID NO: 763817 - DNA, 20 bp, Artificial
  CRISPR gRNA sequence
agaataatgcttcaagcttc

SEQ ID NO: 763818 - DNA, 20 bp, Artificial
  CRISPR gRNA sequence
tcaagcttcaagcgtgattc

SEQ ID NO: 763819 - DNA, 20 bp, Artificial
  CRISPR gRNA sequence
caagcttcaagcgtgattca

SEQ ID NO: 763820 - DNA, 20 bp, Artificial
  CRISPR gRNA sequence
aagcgtgattcaaggacctc

SEQ ID NO: 763821 - DNA, 20 bp, Artificial
  CRISPR gRNA sequence
cgtgattcaaggacctctag

SEQ ID NO: 763822 - DNA, 20 bp, Artificial
  CRISPR gRNA sequence
attcaaggacctctagaagt

SEQ ID NO: 763823 - DNA, 20 bp, Artificial
  CRISPR gRNA sequence
gctgctgcttaccctcccct

SEQ ID NO: 763824 - DNA, 20 bp, Artificial
  CRISPR gRNA sequence
taagttttctaattctactg

SEQ ID NO: 763825 - DNA, 20 bp, Artificial
  CRISPR gRNA sequence
aagttttctaattctactgt

SEQ ID NO: 763826 - DNA, 20 bp, Artificial
  CRISPR gRNA sequence
gttttctaattctactgtag

SEQ ID NO: 763827 - DNA, 20 bp, Artificial
  CRISPR gRNA sequence
taattctactgtaggagcct

SEQ ID NO: 763828 - DNA, 20 bp, Artificial
  CRISPR gRNA sequence
tactgtaggagcctcagctt

SEQ ID NO: 763829 - DNA, 20 bp, Artificial
  CRISPR gRNA sequence
agcctcagcttcagccaaac

SEQ ID NO: 763830 - DNA, 20 bp, Artificial
  CRISPR gRNA sequence
ggtgtcctaaccattctctc

SEQ ID NO: 763831 - DNA, 20 bp, Artificial
  CRISPR gRNA sequence
gtcctaaccattctctccag

SEQ ID NO: 763832 - DNA, 20 bp, Artificial
  CRISPR gRNA sequence
ccattctctccagaagcaac

SEQ ID NO: 763833 - DNA, 20 bp, Artificial
  CRISPR gRNA sequence
cagaagcaactggctccttc

SEQ ID NO: 763834 - DNA, 20 bp, Artificial
  CRISPR gRNA sequence
agcctctgcactaatgctat

SEQ ID NO: 763835 - DNA, 20 bp, Artificial
  CRISPR gRNA sequence
agtttcccaaattctctgct

SEQ ID NO: 763836 - DNA, 20 bp, Artificial
  CRISPR gRNA sequence
agctcaatattcacctcctc

SEQ ID NO: 763837 - DNA, 20 bp, Artificial
  CRISPR gRNA sequence
ctcaatattcacctcctcca

SEQ ID NO: 763838 - DNA, 20 bp, Artificial
  CRISPR gRNA sequence
tcaatattcacctcctccag

SEQ ID NO: 763839 - DNA, 20 bp, Artificial
  CRISPR gRNA sequence
aggccctcttttgactgctt

SEQ ID NO: 763840 - DNA, 20 bp, Artificial
  CRISPR gRNA sequence
ttgactgcttcagccctacc

SEQ ID NO: 763841 - DNA, 20 bp, Artificial
  CRISPR gRNA sequence
tggtgacatctcccattcta

SEQ ID NO: 763842 - DNA, 20 bp, Artificial
  CRISPR gRNA sequence
acatctcccattctatggat

SEQ ID NO: 763843 - DNA, 20 bp, Artificial
  CRISPR gRNA sequence
tctcccattctatggatcag

SEQ ID NO: 763844 - DNA, 20 bp, Artificial
  CRISPR gRNA sequence
ctcccattctatggatcaga

SEQ ID NO: 763845 - DNA, 20 bp, Artificial
  CRISPR gRNA sequence
ccattctatggatcagaagg

SEQ ID NO: 763846 - DNA, 20 bp, Artificial
  CRISPR gRNA sequence
gatcagaaggcagcaaacta

SEQ ID NO: 763847 - DNA, 20 bp, Artificial
  CRISPR gRNA sequence
aggcagcaaactacagccca

SEQ ID NO: 763848 - DNA, 20 bp, Artificial
  CRISPR gRNA sequence
ggcagcaaactacagcccat

SEQ ID NO: 763849 - DNA, 20 bp, Artificial
  CRISPR gRNA sequence
aaactacagcccatgggcca

SEQ ID NO: 763850 - DNA, 20 bp, Artificial
  CRISPR gRNA sequence
tacagcccatgggccaaagc

SEQ ID NO: 763851 - DNA, 20 bp, Artificial
  CRISPR gRNA sequence
catgggccaaagctggcttg

SEQ ID NO: 763852 - DNA, 20 bp, Artificial
  CRISPR gRNA sequence
gcttgtggcctgtttttgta

SEQ ID NO: 763853 - DNA, 20 bp, Artificial
  CRISPR gRNA sequence
tttttgtacagtccacaaac

SEQ ID NO: 763854 - DNA, 20 bp, Artificial
  CRISPR gRNA sequence
tacagtccacaaactagtga

SEQ ID NO: 763855 - DNA, 20 bp, Artificial
  CRISPR gRNA sequence
tgatggtttttacatttgta

SEQ ID NO: 763856 - DNA, 20 bp, Artificial
  CRISPR gRNA sequence
gatggtttttacatttgtaa

SEQ ID NO: 763857 - DNA, 20 bp, Artificial
  CRISPR gRNA sequence
atggtttttacatttgtaaa

SEQ ID NO: 763858 - DNA, 20 bp, Artificial
  CRISPR gRNA sequence
ttgtaaagggttaccaaaaa

SEQ ID NO: 763859 - DNA, 20 bp, Artificial
  CRISPR gRNA sequence
aaagggttaccaaaaaaaga

SEQ ID NO: 763860 - DNA, 20 bp, Artificial
  CRISPR gRNA sequence
aagggttaccaaaaaaagat

SEQ ID NO: 763861 - DNA, 20 bp, Artificial
  CRISPR gRNA sequence
agggttaccaaaaaaagatg

SEQ ID NO: 763862 - DNA, 20 bp, Artificial
  CRISPR gRNA sequence
gggttaccaaaaaaagatgg

SEQ ID NO: 763863 - DNA, 20 bp, Artificial
  CRISPR gRNA sequence
ttaccaaaaaaagatggggg

SEQ ID NO: 763864 - DNA, 20 bp, Artificial
  CRISPR gRNA sequence
taccaaaaaaagatggggga

SEQ ID NO: 763865 - DNA, 20 bp, Artificial
  CRISPR gRNA sequence
caaaaaaagatgggggaagg

SEQ ID NO: 763866 - DNA, 20 bp, Artificial
  CRISPR gRNA sequence
aaaaaagatgggggaaggcg

SEQ ID NO: 763867 - DNA, 20 bp, Artificial
  CRISPR gRNA sequence
aaaaagatgggggaaggcgg

SEQ ID NO: 763868 - DNA, 20 bp, Artificial
  CRISPR gRNA sequence
aaagatgggggaaggcggag

SEQ ID NO: 763869 - DNA, 20 bp, Artificial
  CRISPR gRNA sequence
aagatgggggaaggcggagg

SEQ ID NO: 763870 - DNA, 20 bp, Artificial
  CRISPR gRNA sequence
gggggaaggcggaggaggaa

SEQ ID NO: 763871 - DNA, 20 bp, Artificial
  CRISPR gRNA sequence
ggaaggcggaggaggaacag

SEQ ID NO: 763872 - DNA, 20 bp, Artificial
  CRISPR gRNA sequence
gaaggcggaggaggaacaga

SEQ ID NO: 763873 - DNA, 20 bp, Artificial
  CRISPR gRNA sequence
aggcggaggaggaacagaag

SEQ ID NO: 763874 - DNA, 20 bp, Artificial
  CRISPR gRNA sequence
cggaggaggaacagaaggag

SEQ ID NO: 763875 - DNA, 20 bp, Artificial
  CRISPR gRNA sequence
aggaggaacagaaggagaag

SEQ ID NO: 763876 - DNA, 20 bp, Artificial
  CRISPR gRNA sequence
aggaacagaaggagaagcag

SEQ ID NO: 763877 - DNA, 20 bp, Artificial
  CRISPR gRNA sequence
agaaggagaagcagcagcaa

SEQ ID NO: 763878 - DNA, 20 bp, Artificial
  CRISPR gRNA sequence
aaggagaagcagcagcaaca

SEQ ID NO: 763879 - DNA, 20 bp, Artificial
  CRISPR gRNA sequence
agaagcagcagcaacagaga

SEQ ID NO: 763880 - DNA, 20 bp, Artificial
  CRISPR gRNA sequence
gcagcaacagagatggtgtg

SEQ ID NO: 763881 - DNA, 20 bp, Artificial
  CRISPR gRNA sequence
gcctaaaaacatttactccc

SEQ ID NO: 763882 - DNA, 20 bp, Artificial
  CRISPR gRNA sequence
atttactccctggccattta

SEQ ID NO: 763883 - DNA, 20 bp, Artificial
  CRISPR gRNA sequence
atttacagaaaatgttcgct

SEQ ID NO: 763884 - DNA, 20 bp, Artificial
  CRISPR gRNA sequence
tgttcgctgagtcctacata

SEQ ID NO: 763885 - DNA, 20 bp, Artificial
  CRISPR gRNA sequence
gctgagtcctacatacagat

SEQ ID NO: 763886 - DNA, 20 bp, Artificial
  CRISPR gRNA sequence
ctgagtcctacatacagatg

SEQ ID NO: 763887 - DNA, 20 bp, Artificial
  CRISPR gRNA sequence
catacagatgaggtcactga

SEQ ID NO: 763888 - DNA, 20 bp, Artificial
  CRISPR gRNA sequence
atacagatgaggtcactgac

SEQ ID NO: 763889 - DNA, 20 bp, Artificial
  CRISPR gRNA sequence
tacagatgaggtcactgacg

SEQ ID NO: 763890 - DNA, 20 bp, Artificial
  CRISPR gRNA sequence
gatgaggtcactgacggggc

SEQ ID NO: 763891 - DNA, 20 bp, Artificial
  CRISPR gRNA sequence
tgaggtcactgacggggctg

SEQ ID NO: 763892 - DNA, 20 bp, Artificial
  CRISPR gRNA sequence
gtcactgacggggctggagt

SEQ ID NO: 763893 - DNA, 20 bp, Artificial
  CRISPR gRNA sequence
tcactgacggggctggagtg

SEQ ID NO: 763894 - DNA, 20 bp, Artificial
  CRISPR gRNA sequence
cactgacggggctggagtga

SEQ ID NO: 763895 - DNA, 20 bp, Artificial
  CRISPR gRNA sequence
acggggctggagtgagggct

SEQ ID NO: 763896 - DNA, 20 bp, Artificial
  CRISPR gRNA sequence
ggggctggagtgagggcttg

SEQ ID NO: 763897 - DNA, 20 bp, Artificial
  CRISPR gRNA sequence
tgagggcttggagtttcccc

SEQ ID NO: 763898 - DNA, 20 bp, Artificial
  CRISPR gRNA sequence
gagggcttggagtttcccca

SEQ ID NO: 763899 - DNA, 20 bp, Artificial
  CRISPR gRNA sequence
gggcttggagtttccccaag

SEQ ID NO: 763900 - DNA, 20 bp, Artificial
  CRISPR gRNA sequence
ttggagtttccccaaggagt

SEQ ID NO: 763901 - DNA, 20 bp, Artificial
  CRISPR gRNA sequence
tggagtttccccaaggagtc

SEQ ID NO: 763902 - DNA, 20 bp, Artificial
  CRISPR gRNA sequence
agtttccccaaggagtcagg

SEQ ID NO: 763903 - DNA, 20 bp, Artificial
  CRISPR gRNA sequence
gtttccccaaggagtcaggt

SEQ ID NO: 763904 - DNA, 20 bp, Artificial
  CRISPR gRNA sequence
caaggagtcaggtaggtctg

SEQ ID NO: 763905 - DNA, 20 bp, Artificial
  CRISPR gRNA sequence
aaggagtcaggtaggtctgc

SEQ ID NO: 763906 - DNA, 20 bp, Artificial
  CRISPR gRNA sequence
aggagtcaggtaggtctgca

SEQ ID NO: 763907 - DNA, 20 bp, Artificial
  CRISPR gRNA sequence
ggagtcaggtaggtctgcag

SEQ ID NO: 763908 - DNA, 20 bp, Artificial
  CRISPR gRNA sequence
taggtctgcaggggccttgc

SEQ ID NO: 763909 - DNA, 20 bp, Artificial
  CRISPR gRNA sequence
aggtctgcaggggccttgcc

SEQ ID NO: 763910 - DNA, 20 bp, Artificial
  CRISPR gRNA sequence
ggtctgcaggggccttgcca

SEQ ID NO: 763911 - DNA, 20 bp, Artificial
  CRISPR gRNA sequence
gtctgcaggggccttgccag

SEQ ID NO: 763912 - DNA, 20 bp, Artificial
  CRISPR gRNA sequence
tctgcaggggccttgccagg

SEQ ID NO: 763913 - DNA, 20 bp, Artificial
  CRISPR gRNA sequence
ggatattaacatgaaacact

SEQ ID NO: 763914 - DNA, 20 bp, Artificial
  CRISPR gRNA sequence
gatattaacatgaaacactg

SEQ ID NO: 763915 - DNA, 20 bp, Artificial
  CRISPR gRNA sequence
aacactgaggcccctcctct

SEQ ID NO: 763916 - DNA, 20 bp, Artificial
  CRISPR gRNA sequence
cactgaggcccctcctctta

SEQ ID NO: 763917 - DNA, 20 bp, Artificial
  CRISPR gRNA sequence
cctcttagagctgtcacgtc

SEQ ID NO: 763918 - DNA, 20 bp, Artificial
  CRISPR gRNA sequence
tcttagagctgtcacgtcaa

SEQ ID NO: 763919 - DNA, 20 bp, Artificial
  CRISPR gRNA sequence
cttagagctgtcacgtcaag

SEQ ID NO: 763920 - DNA, 20 bp, Artificial
  CRISPR gRNA sequence
ttagagctgtcacgtcaaga

SEQ ID NO: 763921 - DNA, 20 bp, Artificial
  CRISPR gRNA sequence
ctgtcacgtcaagagggatg

SEQ ID NO: 763922 - DNA, 20 bp, Artificial
  CRISPR gRNA sequence
acgtcaagagggatgaagtt

SEQ ID NO: 763923 - DNA, 20 bp, Artificial
  CRISPR gRNA sequence
cgtcaagagggatgaagttg

SEQ ID NO: 763924 - DNA, 20 bp, Artificial
  CRISPR gRNA sequence
gggatgaagttgaggaccca

SEQ ID NO: 763925 - DNA, 20 bp, Artificial
  CRISPR gRNA sequence
tgaagttgaggacccaaagc

SEQ ID NO: 763926 - DNA, 20 bp, Artificial
  CRISPR gRNA sequence
gaagttgaggacccaaagct

SEQ ID NO: 763927 - DNA, 20 bp, Artificial
  CRISPR gRNA sequence
gttgaggacccaaagctggg

SEQ ID NO: 763928 - DNA, 20 bp, Artificial
  CRISPR gRNA sequence
ttgaggacccaaagctgggt

SEQ ID NO: 763929 - DNA, 20 bp, Artificial
  CRISPR gRNA sequence
tgaggacccaaagctgggta

SEQ ID NO: 763930 - DNA, 20 bp, Artificial
  CRISPR gRNA sequence
gacccaaagctgggtagggc

SEQ ID NO: 763931 - DNA, 20 bp, Artificial
  CRISPR gRNA sequence
acccaaagctgggtagggcc

SEQ ID NO: 763932 - DNA, 20 bp, Artificial
  CRISPR gRNA sequence
ccaaagctgggtagggccag

SEQ ID NO: 763933 - DNA, 20 bp, Artificial
  CRISPR gRNA sequence
gtagggccaggagctgttct

SEQ ID NO: 763934 - DNA, 20 bp, Artificial
  CRISPR gRNA sequence
gccaggagctgttctgagca

SEQ ID NO: 763935 - DNA, 20 bp, Artificial
  CRISPR gRNA sequence
ccatcttacataccatcctc

SEQ ID NO: 763936 - DNA, 20 bp, Artificial
  CRISPR gRNA sequence
ttacataccatcctctagcc

SEQ ID NO: 763937 - DNA, 20 bp, Artificial
  CRISPR gRNA sequence
tctagcccagcccctgcacc

SEQ ID NO: 763938 - DNA, 20 bp, Artificial
  CRISPR gRNA sequence
gcccagcccctgcacccagc

SEQ ID NO: 763939 - DNA, 20 bp, Artificial
  CRISPR gRNA sequence
cccagcccctgcacccagct

SEQ ID NO: 763940 - DNA, 20 bp, Artificial
  CRISPR gRNA sequence
ccctgcacccagctgggtcc

SEQ ID NO: 763941 - DNA, 20 bp, Artificial
  CRISPR gRNA sequence
cctgcacccagctgggtcct

SEQ ID NO: 763942 - DNA, 20 bp, Artificial
  CRISPR gRNA sequence
ctgcacccagctgggtccta

SEQ ID NO: 763943 - DNA, 20 bp, Artificial
  CRISPR gRNA sequence
gcacccagctgggtcctagg

SEQ ID NO: 763944 - DNA, 20 bp, Artificial
  CRISPR gRNA sequence
cccagctgggtcctagggag

SEQ ID NO: 763945 - DNA, 20 bp, Artificial
  CRISPR gRNA sequence
gggtcctagggagaagtctt

SEQ ID NO: 763946 - DNA, 20 bp, Artificial
  CRISPR gRNA sequence
gtcctagggagaagtcttga

SEQ ID NO: 763947 - DNA, 20 bp, Artificial
  CRISPR gRNA sequence
tcctagggagaagtcttgag

SEQ ID NO: 763948 - DNA, 20 bp, Artificial
  CRISPR gRNA sequence
gggagaagtcttgagaggaa

SEQ ID NO: 763949 - DNA, 20 bp, Artificial
  CRISPR gRNA sequence
tgagaggaaaagcctgacaa

SEQ ID NO: 763950 - DNA, 20 bp, Artificial
  CRISPR gRNA sequence
aggaaaagcctgacaaaaga

SEQ ID NO: 763951 - DNA, 20 bp, Artificial
  CRISPR gRNA sequence
tgctgctttcctttgctgtc

SEQ ID NO: 763952 - DNA, 20 bp, Artificial
  CRISPR gRNA sequence
ctgctttcctttgctgtctg

SEQ ID NO: 763953 - DNA, 20 bp, Artificial
  CRISPR gRNA sequence
gtctggagacgatgcacacc

SEQ ID NO: 763954 - DNA, 20 bp, Artificial
  CRISPR gRNA sequence
tctggagacgatgcacaccc

SEQ ID NO: 763955 - DNA, 20 bp, Artificial
  CRISPR gRNA sequence
ctggagacgatgcacaccca

SEQ ID NO: 763956 - DNA, 20 bp, Artificial
  CRISPR gRNA sequence
acgatgcacacccagggcct

SEQ ID NO: 763957 - DNA, 20 bp, Artificial
  CRISPR gRNA sequence
atgcacacccagggcctcag

SEQ ID NO: 763958 - DNA, 20 bp, Artificial
  CRISPR gRNA sequence
cagggcctcagcagcttctg

SEQ ID NO: 763959 - DNA, 20 bp, Artificial
  CRISPR gRNA sequence
agggcctcagcagcttctgc

SEQ ID NO: 763960 - DNA, 20 bp, Artificial
  CRISPR gRNA sequence
ggcctcagcagcttctgcag

SEQ ID NO: 763961 - DNA, 20 bp, Artificial
  CRISPR gRNA sequence
gcctcagcagcttctgcagg

SEQ ID NO: 763962 - DNA, 20 bp, Artificial
  CRISPR gRNA sequence
gcttctgcaggaggccctgt

SEQ ID NO: 763963 - DNA, 20 bp, Artificial
  CRISPR gRNA sequence
tgcaggaggccctgtcagtg

SEQ ID NO: 763964 - DNA, 20 bp, Artificial
  CRISPR gRNA sequence
ggccctgtcagtgcagtgcg

SEQ ID NO: 763965 - DNA, 20 bp, Artificial
  CRISPR gRNA sequence
cagtgcagtgcgcggtgcta

SEQ ID NO: 763966 - DNA, 20 bp, Artificial
  CRISPR gRNA sequence
gcgcggtgctatggaccctt

SEQ ID NO: 763967 - DNA, 20 bp, Artificial
  CRISPR gRNA sequence
cggtgctatggaccctttgg

SEQ ID NO: 763968 - DNA, 20 bp, Artificial
  CRISPR gRNA sequence
tgctatggaccctttggcgg

SEQ ID NO: 763969 - DNA, 20 bp, Artificial
  CRISPR gRNA sequence
ctatggaccctttggcggca

SEQ ID NO: 763970 - DNA, 20 bp, Artificial
  CRISPR gRNA sequence
ccctttggcggcagagaccc

SEQ ID NO: 763971 - DNA, 20 bp, Artificial
  CRISPR gRNA sequence
tggcggcagagaccccagca

SEQ ID NO: 763972 - DNA, 20 bp, Artificial
  CRISPR gRNA sequence
gcatagatgcacctcgtgca

SEQ ID NO: 763973 - DNA, 20 bp, Artificial
  CRISPR gRNA sequence
gcacctcgtgcatggatctg

SEQ ID NO: 763974 - DNA, 20 bp, Artificial
  CRISPR gRNA sequence
tctgcagatgtcaccttcaa

SEQ ID NO: 763975 - DNA, 20 bp, Artificial
  CRISPR gRNA sequence
ctgcagatgtcaccttcaat

SEQ ID NO: 763976 - DNA, 20 bp, Artificial
  CRISPR gRNA sequence
tcaccttcaataggcactgc

SEQ ID NO: 763977 - DNA, 20 bp, Artificial
  CRISPR gRNA sequence
tgctggcaaaactgctgctc

SEQ ID NO: 763978 - DNA, 20 bp, Artificial
  CRISPR gRNA sequence
aaaactgctgctctggccat

SEQ ID NO: 763979 - DNA, 20 bp, Artificial
  CRISPR gRNA sequence
actgctgctctggccattgg

SEQ ID NO: 763980 - DNA, 20 bp, Artificial
  CRISPR gRNA sequence
tgctctggccattggaagca

SEQ ID NO: 763981 - DNA, 20 bp, Artificial
  CRISPR gRNA sequence
gctctggccattggaagcac

SEQ ID NO: 763982 - DNA, 20 bp, Artificial
  CRISPR gRNA sequence
ctctggccattggaagcaca

SEQ ID NO: 763983 - DNA, 20 bp, Artificial
  CRISPR gRNA sequence
agcacagggatccatcaccc

SEQ ID NO: 763984 - DNA, 20 bp, Artificial
  CRISPR gRNA sequence
gatccatcaccccagtgatg

SEQ ID NO: 763985 - DNA, 20 bp, Artificial
  CRISPR gRNA sequence
tccatcaccccagtgatgaa

SEQ ID NO: 763986 - DNA, 20 bp, Artificial
  CRISPR gRNA sequence
catcaccccagtgatgaaga

SEQ ID NO: 763987 - DNA, 20 bp, Artificial
  CRISPR gRNA sequence
atcaccccagtgatgaagag

SEQ ID NO: 763988 - DNA, 20 bp, Artificial
  CRISPR gRNA sequence
cagtgatgaagagaggtgtg

SEQ ID NO: 763989 - DNA, 20 bp, Artificial
  CRISPR gRNA sequence
atgaagagaggtgtgcagaa

SEQ ID NO: 763990 - DNA, 20 bp, Artificial
  CRISPR gRNA sequence
tgaagagaggtgtgcagaaa

SEQ ID NO: 763991 - DNA, 20 bp, Artificial
  CRISPR gRNA sequence
aagagaggtgtgcagaaaag

SEQ ID NO: 763992 - DNA, 20 bp, Artificial
  CRISPR gRNA sequence
agagaggtgtgcagaaaagg

SEQ ID NO: 763993 - DNA, 20 bp, Artificial
  CRISPR gRNA sequence
gagaggtgtgcagaaaagga

SEQ ID NO: 763994 - DNA, 20 bp, Artificial
  CRISPR gRNA sequence
aggtgtgcagaaaaggaggg

SEQ ID NO: 763995 - DNA, 20 bp, Artificial
  CRISPR gRNA sequence
tgtgcagaaaaggagggcag

SEQ ID NO: 763996 - DNA, 20 bp, Artificial
  CRISPR gRNA sequence
aaggagggcagcagctgatg

SEQ ID NO: 763997 - DNA, 20 bp, Artificial
  CRISPR gRNA sequence
gggcagcagctgatgtggcc

SEQ ID NO: 763998 - DNA, 20 bp, Artificial
  CRISPR gRNA sequence
gcagcagctgatgtggccaa

SEQ ID NO: 763999 - DNA, 20 bp, Artificial
  CRISPR gRNA sequence
cagcagctgatgtggccaag

SEQ ID NO: 764000 - DNA, 20 bp, Artificial
  CRISPR gRNA sequence
agcagctgatgtggccaaga

SEQ ID NO: 764001 - DNA, 20 bp, Artificial
  CRISPR gRNA sequence
tggccaagagggcccatcca

SEQ ID NO: 764002 - DNA, 20 bp, Artificial
  CRISPR gRNA sequence
gccaagagggcccatccaca

SEQ ID NO: 764003 - DNA, 20 bp, Artificial
  CRISPR gRNA sequence
ttaaaaaacaataaccaccc

SEQ ID NO: 764004 - DNA, 20 bp, Artificial
  CRISPR gRNA sequence
ccaccctggaaatcccatca

SEQ ID NO: 764005 - DNA, 20 bp, Artificial
  CRISPR gRNA sequence
caccctggaaatcccatcat

SEQ ID NO: 764006 - DNA, 20 bp, Artificial
  CRISPR gRNA sequence
accctggaaatcccatcatg

SEQ ID NO: 764007 - DNA, 20 bp, Artificial
  CRISPR gRNA sequence
atcccatcatggggctctga

SEQ ID NO: 764008 - DNA, 20 bp, Artificial
  CRISPR gRNA sequence
ccatcatggggctctgacag

SEQ ID NO: 764009 - DNA, 20 bp, Artificial
  CRISPR gRNA sequence
atcatggggctctgacagca

SEQ ID NO: 764010 - DNA, 20 bp, Artificial
  CRISPR gRNA sequence
tcatggggctctgacagcag

SEQ ID NO: 764011 - DNA, 20 bp, Artificial
  CRISPR gRNA sequence
atggggctctgacagcagag

SEQ ID NO: 764012 - DNA, 20 bp, Artificial
  CRISPR gRNA sequence
tggggctctgacagcagagg

SEQ ID NO: 764013 - DNA, 20 bp, Artificial
  CRISPR gRNA sequence
ggggctctgacagcagagga

SEQ ID NO: 764014 - DNA, 20 bp, Artificial
  CRISPR gRNA sequence
gggctctgacagcagaggag

SEQ ID NO: 764015 - DNA, 20 bp, Artificial
  CRISPR gRNA sequence
ggctctgacagcagaggagg

SEQ ID NO: 764016 - DNA, 20 bp, Artificial
  CRISPR gRNA sequence
tctgacagcagaggaggggg

SEQ ID NO: 764017 - DNA, 20 bp, Artificial
  CRISPR gRNA sequence
tgacagcagaggagggggca

SEQ ID NO: 764018 - DNA, 20 bp, Artificial
  CRISPR gRNA sequence
cagaggagggggcagagcca

SEQ ID NO: 764019 - DNA, 20 bp, Artificial
  CRISPR gRNA sequence
gcagagccatggaaatactc

SEQ ID NO: 764020 - DNA, 20 bp, Artificial
  CRISPR gRNA sequence
gagccatggaaatactcaag

SEQ ID NO: 764021 - DNA, 20 bp, Artificial
  CRISPR gRNA sequence
gccatggaaatactcaagca

SEQ ID NO: 764022 - DNA, 20 bp, Artificial
  CRISPR gRNA sequence
ccatggaaatactcaagcag

SEQ ID NO: 764023 - DNA, 20 bp, Artificial
  CRISPR gRNA sequence
catggaaatactcaagcaga

SEQ ID NO: 764024 - DNA, 20 bp, Artificial
  CRISPR gRNA sequence
tctctatgttcccccttaac

SEQ ID NO: 764025 - DNA, 20 bp, Artificial
  CRISPR gRNA sequence
ctatgttcccccttaactgg

SEQ ID NO: 764026 - DNA, 20 bp, Artificial
  CRISPR gRNA sequence
cccttaactggtggtgtccc

SEQ ID NO: 764027 - DNA, 20 bp, Artificial
  CRISPR gRNA sequence
tacatttgccctgttcaccc

SEQ ID NO: 764028 - DNA, 20 bp, Artificial
  CRISPR gRNA sequence
tttgccctgttcacccaaga

SEQ ID NO: 764029 - DNA, 20 bp, Artificial
  CRISPR gRNA sequence
ttgccctgttcacccaagaa

SEQ ID NO: 764030 - DNA, 20 bp, Artificial
  CRISPR gRNA sequence
cctgttcacccaagaaagga

SEQ ID NO: 764031 - DNA, 20 bp, Artificial
  CRISPR gRNA sequence
ctgttcacccaagaaaggac

SEQ ID NO: 764032 - DNA, 20 bp, Artificial
  CRISPR gRNA sequence
cacccaagaaaggacaggct

SEQ ID NO: 764033 - DNA, 20 bp, Artificial
  CRISPR gRNA sequence
acccaagaaaggacaggctc

SEQ ID NO: 764034 - DNA, 20 bp, Artificial
  CRISPR gRNA sequence
acaggctcaggccacgtctc

SEQ ID NO: 764035 - DNA, 20 bp, Artificial
  CRISPR gRNA sequence
caggctcaggccacgtctct

SEQ ID NO: 764036 - DNA, 20 bp, Artificial
  CRISPR gRNA sequence
aggctcaggccacgtctcta

SEQ ID NO: 764037 - DNA, 20 bp, Artificial
  CRISPR gRNA sequence
tgctccataaatccccctcc

SEQ ID NO: 764038 - DNA, 20 bp, Artificial
  CRISPR gRNA sequence
ctccataaatccccctccaa

SEQ ID NO: 764039 - DNA, 20 bp, Artificial
  CRISPR gRNA sequence
tccataaatccccctccaag

SEQ ID NO: 764040 - DNA, 20 bp, Artificial
  CRISPR gRNA sequence
cccctccaagaggctctgca

SEQ ID NO: 764041 - DNA, 20 bp, Artificial
  CRISPR gRNA sequence
cacaacttcactaacttcat

SEQ ID NO: 764042 - DNA, 20 bp, Artificial
  CRISPR gRNA sequence
acaacttcactaacttcatc

SEQ ID NO: 764043 - DNA, 20 bp, Artificial
  CRISPR gRNA sequence
ttcactaacttcatcaggta

SEQ ID NO: 764044 - DNA, 20 bp, Artificial
  CRISPR gRNA sequence
tcactaacttcatcaggtac

SEQ ID NO: 764045 - DNA, 20 bp, Artificial
  CRISPR gRNA sequence
actaacttcatcaggtacgg

SEQ ID NO: 764046 - DNA, 20 bp, Artificial
  CRISPR gRNA sequence
taacttcatcaggtacggga

SEQ ID NO: 764047 - DNA, 20 bp, Artificial
  CRISPR gRNA sequence
tcatcaggtacgggagagac

SEQ ID NO: 764048 - DNA, 20 bp, Artificial
  CRISPR gRNA sequence
caggtacgggagagaccagc

SEQ ID NO: 764049 - DNA, 20 bp, Artificial
  CRISPR gRNA sequence
ggtacgggagagaccagctg

SEQ ID NO: 764050 - DNA, 20 bp, Artificial
  CRISPR gRNA sequence
gtacgggagagaccagctgg

SEQ ID NO: 764051 - DNA, 20 bp, Artificial
  CRISPR gRNA sequence
gagaccagctggaggactga

SEQ ID NO: 764052 - DNA, 20 bp, Artificial
  CRISPR gRNA sequence
aggactgaaagtctgaatcc

SEQ ID NO: 764053 - DNA, 20 bp, Artificial
  CRISPR gRNA sequence
agaatgtttgacatgataca

SEQ ID NO: 764054 - DNA, 20 bp, Artificial
  CRISPR gRNA sequence
acatgatacaaagctgcccg

SEQ ID NO: 764055 - DNA, 20 bp, Artificial
  CRISPR gRNA sequence
aagctgcccgaagcaaaata

SEQ ID NO: 764056 - DNA, 20 bp, Artificial
  CRISPR gRNA sequence
agctgcccgaagcaaaatac

SEQ ID NO: 764057 - DNA, 20 bp, Artificial
  CRISPR gRNA sequence
cccgaagcaaaatacaggcc

SEQ ID NO: 764058 - DNA, 20 bp, Artificial
  CRISPR gRNA sequence
ccgaagcaaaatacaggcca

SEQ ID NO: 764059 - DNA, 20 bp, Artificial
  CRISPR gRNA sequence
cgaagcaaaatacaggccaa

SEQ ID NO: 764060 - DNA, 20 bp, Artificial
  CRISPR gRNA sequence
aatacaggccaagggctcca

SEQ ID NO: 764061 - DNA, 20 bp, Artificial
  CRISPR gRNA sequence
acaggccaagggctccaaag

SEQ ID NO: 764062 - DNA, 20 bp, Artificial
  CRISPR gRNA sequence
caggccaagggctccaaagt

SEQ ID NO: 764063 - DNA, 20 bp, Artificial
  CRISPR gRNA sequence
ccaagggctccaaagtaggc

SEQ ID NO: 764064 - DNA, 20 bp, Artificial
  CRISPR gRNA sequence
gtaggccagacctgctctaa

SEQ ID NO: 764065 - DNA, 20 bp, Artificial
  CRISPR gRNA sequence
cagacctgctctaacagaaa

SEQ ID NO: 764066 - DNA, 20 bp, Artificial
  CRISPR gRNA sequence
agacctgctctaacagaaac

SEQ ID NO: 764067 - DNA, 20 bp, Artificial
  CRISPR gRNA sequence
acctgctctaacagaaacag

SEQ ID NO: 764068 - DNA, 20 bp, Artificial
  CRISPR gRNA sequence
cctgctctaacagaaacagg

SEQ ID NO: 764069 - DNA, 20 bp, Artificial
  CRISPR gRNA sequence
ctctaacagaaacaggaggc

SEQ ID NO: 764070 - DNA, 20 bp, Artificial
  CRISPR gRNA sequence
aacagaaacaggaggctggc

SEQ ID NO: 764071 - DNA, 20 bp, Artificial
  CRISPR gRNA sequence
agaaacaggaggctggctgg

SEQ ID NO: 764072 - DNA, 20 bp, Artificial
  CRISPR gRNA sequence
gaaacaggaggctggctggt

SEQ ID NO: 764073 - DNA, 20 bp, Artificial
  CRISPR gRNA sequence
acaggaggctggctggtggg

SEQ ID NO: 764074 - DNA, 20 bp, Artificial
  CRISPR gRNA sequence
caggaggctggctggtggga

SEQ ID NO: 764075 - DNA, 20 bp, Artificial
  CRISPR gRNA sequence
ggaggctggctggtgggaag

SEQ ID NO: 764076 - DNA, 20 bp, Artificial
  CRISPR gRNA sequence
aggctggctggtgggaagga

SEQ ID NO: 764077 - DNA, 20 bp, Artificial
  CRISPR gRNA sequence
ggctggctggtgggaaggag

SEQ ID NO: 764078 - DNA, 20 bp, Artificial
  CRISPR gRNA sequence
tggtgggaaggagaggaaat

SEQ ID NO: 764079 - DNA, 20 bp, Artificial
  CRISPR gRNA sequence
ggtgggaaggagaggaaatt

SEQ ID NO: 764080 - DNA, 20 bp, Artificial
  CRISPR gRNA sequence
gaaggagaggaaattaggct

SEQ ID NO: 764081 - DNA, 20 bp, Artificial
  CRISPR gRNA sequence
aggagaggaaattaggctga

SEQ ID NO: 764082 - DNA, 20 bp, Artificial
  CRISPR gRNA sequence
ggagaggaaattaggctgag

SEQ ID NO: 764083 - DNA, 20 bp, Artificial
  CRISPR gRNA sequence
gaaattaggctgagaggcca

SEQ ID NO: 764084 - DNA, 20 bp, Artificial
  CRISPR gRNA sequence
ttaggctgagaggccaaagt

SEQ ID NO: 764085 - DNA, 20 bp, Artificial
  CRISPR gRNA sequence
ccaaagttggattctgatca

SEQ ID NO: 764086 - DNA, 20 bp, Artificial
  CRISPR gRNA sequence
catggctcatctcctcactg

SEQ ID NO: 764087 - DNA, 20 bp, Artificial
  CRISPR gRNA sequence
atggctcatctcctcactgc

SEQ ID NO: 764088 - DNA, 20 bp, Artificial
  CRISPR gRNA sequence
tggctcatctcctcactgca

SEQ ID NO: 764089 - DNA, 20 bp, Artificial
  CRISPR gRNA sequence
atctcctcactgcagggcac

SEQ ID NO: 764090 - DNA, 20 bp, Artificial
  CRISPR gRNA sequence
ctcctcactgcagggcactg

SEQ ID NO: 764091 - DNA, 20 bp, Artificial
  CRISPR gRNA sequence
cactgcagggcactggagcc

SEQ ID NO: 764092 - DNA, 20 bp, Artificial
  CRISPR gRNA sequence
actgcagggcactggagccc

SEQ ID NO: 764093 - DNA, 20 bp, Artificial
  CRISPR gRNA sequence
ggcactggagcccaggtcta

SEQ ID NO: 764094 - DNA, 20 bp, Artificial
  CRISPR gRNA sequence
agcccaggtctacagaccca

SEQ ID NO: 764095 - DNA, 20 bp, Artificial
  CRISPR gRNA sequence
cccaggtctacagacccacg

SEQ ID NO: 764096 - DNA, 20 bp, Artificial
  CRISPR gRNA sequence
ccaggtctacagacccacgg

SEQ ID NO: 764097 - DNA, 20 bp, Artificial
  CRISPR gRNA sequence
aggtctacagacccacggag

SEQ ID NO: 764098 - DNA, 20 bp, Artificial
  CRISPR gRNA sequence
tacagacccacggaggagtt

SEQ ID NO: 764099 - DNA, 20 bp, Artificial
  CRISPR gRNA sequence
cagacccacggaggagttta

SEQ ID NO: 764100 - DNA, 20 bp, Artificial
  CRISPR gRNA sequence
gacccacggaggagtttaga

SEQ ID NO: 764101 - DNA, 20 bp, Artificial
  CRISPR gRNA sequence
acccacggaggagtttagag

SEQ ID NO: 764102 - DNA, 20 bp, Artificial
  CRISPR gRNA sequence
cacggaggagtttagagagg

SEQ ID NO: 764103 - DNA, 20 bp, Artificial
  CRISPR gRNA sequence
tagagaggcagcgaaccctc

SEQ ID NO: 764104 - DNA, 20 bp, Artificial
  CRISPR gRNA sequence
gagaggcagcgaaccctcca

SEQ ID NO: 764105 - DNA, 20 bp, Artificial
  CRISPR gRNA sequence
gatcatttatccaattttca

SEQ ID NO: 764106 - DNA, 20 bp, Artificial
  CRISPR gRNA sequence
catttatccaattttcaaag

SEQ ID NO: 764107 - DNA, 20 bp, Artificial
  CRISPR gRNA sequence
atttatccaattttcaaaga

SEQ ID NO: 764108 - DNA, 20 bp, Artificial
  CRISPR gRNA sequence
tttatccaattttcaaagaa

SEQ ID NO: 764109 - DNA, 20 bp, Artificial
  CRISPR gRNA sequence
aaagaagggtctgaccccca

SEQ ID NO: 764110 - DNA, 20 bp, Artificial
  CRISPR gRNA sequence
gggtctgacccccaaagatt

SEQ ID NO: 764111 - DNA, 20 bp, Artificial
  CRISPR gRNA sequence
gtctgacccccaaagattga

SEQ ID NO: 764112 - DNA, 20 bp, Artificial
  CRISPR gRNA sequence
aagattgagagccgctgtgc

SEQ ID NO: 764113 - DNA, 20 bp, Artificial
  CRISPR gRNA sequence
gctgtgccagtctgtgacct

SEQ ID NO: 764114 - DNA, 20 bp, Artificial
  CRISPR gRNA sequence
ctgtgccagtctgtgacctt

SEQ ID NO: 764115 - DNA, 20 bp, Artificial
  CRISPR gRNA sequence
gccagtctgtgaccttggga

SEQ ID NO: 764116 - DNA, 20 bp, Artificial
  CRISPR gRNA sequence
ggaaagttcccccttctctg

SEQ ID NO: 764117 - DNA, 20 bp, Artificial
  CRISPR gRNA sequence
tcccccttctctgtggacct

SEQ ID NO: 764118 - DNA, 20 bp, Artificial
  CRISPR gRNA sequence
cttcgtctgtgaaatgtgct

SEQ ID NO: 764119 - DNA, 20 bp, Artificial
  CRISPR gRNA sequence
tgaaatgtgcttggcaacaa

SEQ ID NO: 764120 - DNA, 20 bp, Artificial
  CRISPR gRNA sequence
ttttattttatttatttttt

SEQ ID NO: 764121 - DNA, 20 bp, Artificial
  CRISPR gRNA sequence
attttatttattttttgaga

SEQ ID NO: 764122 - DNA, 20 bp, Artificial
  CRISPR gRNA sequence
cagtgtcttgctctgtcacc

SEQ ID NO: 764123 - DNA, 20 bp, Artificial
  CRISPR gRNA sequence
agtgtcttgctctgtcaccc

SEQ ID NO: 764124 - DNA, 20 bp, Artificial
  CRISPR gRNA sequence
tcttgctctgtcacccaggc

SEQ ID NO: 764125 - DNA, 20 bp, Artificial
  CRISPR gRNA sequence
ttgctctgtcacccaggctg

SEQ ID NO: 764126 - DNA, 20 bp, Artificial
  CRISPR gRNA sequence
ctgtcacccaggctggagtg

SEQ ID NO: 764127 - DNA, 20 bp, Artificial
  CRISPR gRNA sequence
ggagtgcagtgacactgtct

SEQ ID NO: 764128 - DNA, 20 bp, Artificial
  CRISPR gRNA sequence
tcactgcaacctccgcctcc

SEQ ID NO: 764129 - DNA, 20 bp, Artificial
  CRISPR gRNA sequence
cactgcaacctccgcctccc

SEQ ID NO: 764130 - DNA, 20 bp, Artificial
  CRISPR gRNA sequence
aacctccgcctcccaggttc

SEQ ID NO: 764131 - DNA, 20 bp, Artificial
  CRISPR gRNA sequence
ttcaagcaattctcttgccc

SEQ ID NO: 764132 - DNA, 20 bp, Artificial
  CRISPR gRNA sequence
ttctcttgccccagcctccc

SEQ ID NO: 764133 - DNA, 20 bp, Artificial
  CRISPR gRNA sequence
tcttgccccagcctcccaag

SEQ ID NO: 764134 - DNA, 20 bp, Artificial
  CRISPR gRNA sequence
gccccagcctcccaagtagc

SEQ ID NO: 764135 - DNA, 20 bp, Artificial
  CRISPR gRNA sequence
ccccagcctcccaagtagct

SEQ ID NO: 764136 - DNA, 20 bp, Artificial
  CRISPR gRNA sequence
ctcccaagtagctgggacca

SEQ ID NO: 764137 - DNA, 20 bp, Artificial
  CRISPR gRNA sequence
tcccaagtagctgggaccac

SEQ ID NO: 764138 - DNA, 20 bp, Artificial
  CRISPR gRNA sequence
caggtgcatgccaccacgcc

SEQ ID NO: 764139 - DNA, 20 bp, Artificial
  CRISPR gRNA sequence
ccagctaatttttgtgtttt

SEQ ID NO: 764140 - DNA, 20 bp, Artificial
  CRISPR gRNA sequence
gctaatttttgtgttttcag

SEQ ID NO: 764141 - DNA, 20 bp, Artificial
  CRISPR gRNA sequence
taatttttgtgttttcagta

SEQ ID NO: 764142 - DNA, 20 bp, Artificial
  CRISPR gRNA sequence
ttttgtgttttcagtagaga

SEQ ID NO: 764143 - DNA, 20 bp, Artificial
  CRISPR gRNA sequence
tttgtgttttcagtagagac

SEQ ID NO: 764144 - DNA, 20 bp, Artificial
  CRISPR gRNA sequence
ttgtgttttcagtagagaca

SEQ ID NO: 764145 - DNA, 20 bp, Artificial
  CRISPR gRNA sequence
cagggtttcaccatgctgat

SEQ ID NO: 764146 - DNA, 20 bp, Artificial
  CRISPR gRNA sequence
agggtttcaccatgctgatc

SEQ ID NO: 764147 - DNA, 20 bp, Artificial
  CRISPR gRNA sequence
tttcaccatgctgatcaggc

SEQ ID NO: 764148 - DNA, 20 bp, Artificial
  CRISPR gRNA sequence
ggtctcgaactcctgacctc

SEQ ID NO: 764149 - DNA, 20 bp, Artificial
  CRISPR gRNA sequence
ctcaagtgatccacccgcct

SEQ ID NO: 764150 - DNA, 20 bp, Artificial
  CRISPR gRNA sequence
ccacccgccttggcctccca

SEQ ID NO: 764151 - DNA, 20 bp, Artificial
  CRISPR gRNA sequence
gccttggcctcccaaagtgc

SEQ ID NO: 764152 - DNA, 20 bp, Artificial
  CRISPR gRNA sequence
ccttggcctcccaaagtgct

SEQ ID NO: 764153 - DNA, 20 bp, Artificial
  CRISPR gRNA sequence
ctcccaaagtgctgggatta

SEQ ID NO: 764154 - DNA, 20 bp, Artificial
  CRISPR gRNA sequence
tcccaaagtgctgggattac

SEQ ID NO: 764155 - DNA, 20 bp, Artificial
  CRISPR gRNA sequence
agtgctgggattacaggtgt

SEQ ID NO: 764156 - DNA, 20 bp, Artificial
  CRISPR gRNA sequence
caggtgtgagccaccatgcc

SEQ ID NO: 764157 - DNA, 20 bp, Artificial
  CRISPR gRNA sequence
tttgaaatcactttaaatgt

SEQ ID NO: 764158 - DNA, 20 bp, Artificial
  CRISPR gRNA sequence
actttaaatgttagctactc

SEQ ID NO: 764159 - DNA, 20 bp, Artificial
  CRISPR gRNA sequence
ttagctactcaagtttaaaa

SEQ ID NO: 764160 - DNA, 20 bp, Artificial
  CRISPR gRNA sequence
agctactcaagtttaaaata

SEQ ID NO: 764161 - DNA, 20 bp, Artificial
  CRISPR gRNA sequence
taaaatagagaattttctct

SEQ ID NO: 764162 - DNA, 20 bp, Artificial
  CRISPR gRNA sequence
aaaatagagaattttctctt

SEQ ID NO: 764163 - DNA, 20 bp, Artificial
  CRISPR gRNA sequence
tagagaattttctcttaggt

SEQ ID NO: 764164 - DNA, 20 bp, Artificial
  CRISPR gRNA sequence
gcaatcacatttatactcat

SEQ ID NO: 764165 - DNA, 20 bp, Artificial
  CRISPR gRNA sequence
actcataagtcctttctgca

SEQ ID NO: 764166 - DNA, 20 bp, Artificial
  CRISPR gRNA sequence
tgcacagcatcgcaaatatc

SEQ ID NO: 764167 - DNA, 20 bp, Artificial
  CRISPR gRNA sequence
agcatcgcaaatatccagct

SEQ ID NO: 764168 - DNA, 20 bp, Artificial
  CRISPR gRNA sequence
cgcaaatatccagctcagcc

SEQ ID NO: 764169 - DNA, 20 bp, Artificial
  CRISPR gRNA sequence
gcaaatatccagctcagccc

SEQ ID NO: 764170 - DNA, 20 bp, Artificial
  CRISPR gRNA sequence
caaatatccagctcagccca

SEQ ID NO: 764171 - DNA, 20 bp, Artificial
  CRISPR gRNA sequence
ccagggtgcaaatgaccaca

SEQ ID NO: 764172 - DNA, 20 bp, Artificial
  CRISPR gRNA sequence
acaaagaccccttatccttc

SEQ ID NO: 764173 - DNA, 20 bp, Artificial
  CRISPR gRNA sequence
caaagaccccttatccttca

SEQ ID NO: 764174 - DNA, 20 bp, Artificial
  CRISPR gRNA sequence
cttatccttcaaggccttct

SEQ ID NO: 764175 - DNA, 20 bp, Artificial
  CRISPR gRNA sequence
tctcagctcccatttgcccc

SEQ ID NO: 764176 - DNA, 20 bp, Artificial
  CRISPR gRNA sequence
tcagctcccatttgcccctg

SEQ ID NO: 764177 - DNA, 20 bp, Artificial
  CRISPR gRNA sequence
cagctcccatttgcccctgg

SEQ ID NO: 764178 - DNA, 20 bp, Artificial
  CRISPR gRNA sequence
taccaccctccctcctctga

SEQ ID NO: 764179 - DNA, 20 bp, Artificial
  CRISPR gRNA sequence
aaagcttcatatcctctgcc

SEQ ID NO: 764180 - DNA, 20 bp, Artificial
  CRISPR gRNA sequence
ttcttcttttcgcctgtgaa

SEQ ID NO: 764181 - DNA, 20 bp, Artificial
  CRISPR gRNA sequence
aaccatatgctgttctctaa

SEQ ID NO: 764182 - DNA, 20 bp, Artificial
  CRISPR gRNA sequence
accatatgctgttctctaaa

SEQ ID NO: 764183 - DNA, 20 bp, Artificial
  CRISPR gRNA sequence
atgctgttctctaaaaggtc

SEQ ID NO: 764184 - DNA, 20 bp, Artificial
  CRISPR gRNA sequence
tgctgttctctaaaaggtca

SEQ ID NO: 764185 - DNA, 20 bp, Artificial
  CRISPR gRNA sequence
aaaaggtcaaggacatgtct

SEQ ID NO: 764186 - DNA, 20 bp, Artificial
  CRISPR gRNA sequence
ggacatgtctcagaacattc

SEQ ID NO: 764187 - DNA, 20 bp, Artificial
  CRISPR gRNA sequence
acatgtctcagaacattcaa

SEQ ID NO: 764188 - DNA, 20 bp, Artificial
  CRISPR gRNA sequence
tctcagaacattcaagagct

SEQ ID NO: 764189 - DNA, 20 bp, Artificial
  CRISPR gRNA sequence
ctcagaacattcaagagctc

SEQ ID NO: 764190 - DNA, 20 bp, Artificial
  CRISPR gRNA sequence
tcagaacattcaagagctca

SEQ ID NO: 764191 - DNA, 20 bp, Artificial
  CRISPR gRNA sequence
gaacattcaagagctcaggg

SEQ ID NO: 764192 - DNA, 20 bp, Artificial
  CRISPR gRNA sequence
tcagggcagctactctctcc

SEQ ID NO: 764193 - DNA, 20 bp, Artificial
  CRISPR gRNA sequence
agggcagctactctctcctg

SEQ ID NO: 764194 - DNA, 20 bp, Artificial
  CRISPR gRNA sequence
ggcagctactctctcctgga

SEQ ID NO: 764195 - DNA, 20 bp, Artificial
  CRISPR gRNA sequence
ctactctctcctggagagca

SEQ ID NO: 764196 - DNA, 20 bp, Artificial
  CRISPR gRNA sequence
tactctctcctggagagcac

SEQ ID NO: 764197 - DNA, 20 bp, Artificial
  CRISPR gRNA sequence
tctctcctggagagcacagg

SEQ ID NO: 764198 - DNA, 20 bp, Artificial
  CRISPR gRNA sequence
ctctcctggagagcacagga

SEQ ID NO: 764199 - DNA, 20 bp, Artificial
  CRISPR gRNA sequence
tctcctggagagcacaggaa

SEQ ID NO: 764200 - DNA, 20 bp, Artificial
  CRISPR gRNA sequence
tcctggagagcacaggaagg

SEQ ID NO: 764201 - DNA, 20 bp, Artificial
  CRISPR gRNA sequence
gaagggagtgttttccatct

SEQ ID NO: 764202 - DNA, 20 bp, Artificial
  CRISPR gRNA sequence
aagggagtgttttccatctt

SEQ ID NO: 764203 - DNA, 20 bp, Artificial
  CRISPR gRNA sequence
agggagtgttttccatcttg

SEQ ID NO: 764204 - DNA, 20 bp, Artificial
  CRISPR gRNA sequence
gagtgttttccatcttgggg

SEQ ID NO: 764205 - DNA, 20 bp, Artificial
  CRISPR gRNA sequence
agtgttttccatcttgggga

SEQ ID NO: 764206 - DNA, 20 bp, Artificial
  CRISPR gRNA sequence
gtgttttccatcttggggaa

SEQ ID NO: 764207 - DNA, 20 bp, Artificial
  CRISPR gRNA sequence
tgttttccatcttggggaag

SEQ ID NO: 764208 - DNA, 20 bp, Artificial
  CRISPR gRNA sequence
tttccatcttggggaagggg

SEQ ID NO: 764209 - DNA, 20 bp, Artificial
  CRISPR gRNA sequence
ttccatcttggggaaggggt

SEQ ID NO: 764210 - DNA, 20 bp, Artificial
  CRISPR gRNA sequence
catcttggggaaggggtggg

SEQ ID NO: 764211 - DNA, 20 bp, Artificial
  CRISPR gRNA sequence
cttggggaaggggtgggcag

SEQ ID NO: 764212 - DNA, 20 bp, Artificial
  CRISPR gRNA sequence
ttggggaaggggtgggcaga

SEQ ID NO: 764213 - DNA, 20 bp, Artificial
  CRISPR gRNA sequence
ggggaaggggtgggcagaag

SEQ ID NO: 764214 - DNA, 20 bp, Artificial
  CRISPR gRNA sequence
cagaaggagcacaaccttgc

SEQ ID NO: 764215 - DNA, 20 bp, Artificial
  CRISPR gRNA sequence
aaggagcacaaccttgccag

SEQ ID NO: 764216 - DNA, 20 bp, Artificial
  CRISPR gRNA sequence
aggagcacaaccttgccaga

SEQ ID NO: 764217 - DNA, 20 bp, Artificial
  CRISPR gRNA sequence
cttgccagaaggaaacacgt

SEQ ID NO: 764218 - DNA, 20 bp, Artificial
  CRISPR gRNA sequence
tgccagaaggaaacacgtaa

SEQ ID NO: 764219 - DNA, 20 bp, Artificial
  CRISPR gRNA sequence
ccagaaggaaacacgtaaga

SEQ ID NO: 764220 - DNA, 20 bp, Artificial
  CRISPR gRNA sequence
gaaggaaacacgtaagagag

SEQ ID NO: 764221 - DNA, 20 bp, Artificial
  CRISPR gRNA sequence
aaggaaacacgtaagagaga

SEQ ID NO: 764222 - DNA, 20 bp, Artificial
  CRISPR gRNA sequence
ggaaacacgtaagagagaag

SEQ ID NO: 764223 - DNA, 20 bp, Artificial
  CRISPR gRNA sequence
gaaacacgtaagagagaagg

SEQ ID NO: 764224 - DNA, 20 bp, Artificial
  CRISPR gRNA sequence
aacacgtaagagagaaggag

SEQ ID NO: 764225 - DNA, 20 bp, Artificial
  CRISPR gRNA sequence
cgtaagagagaaggaggagt

SEQ ID NO: 764226 - DNA, 20 bp, Artificial
  CRISPR gRNA sequence
gaggagtgagcctgaactcc

SEQ ID NO: 764227 - DNA, 20 bp, Artificial
  CRISPR gRNA sequence
gagtgagcctgaactccaag

SEQ ID NO: 764228 - DNA, 20 bp, Artificial
  CRISPR gRNA sequence
actccaagcagacgatgtga

SEQ ID NO: 764229 - DNA, 20 bp, Artificial
  CRISPR gRNA sequence
ctccaagcagacgatgtgac

SEQ ID NO: 764230 - DNA, 20 bp, Artificial
  CRISPR gRNA sequence
gcagacgatgtgacgggccc

SEQ ID NO: 764231 - DNA, 20 bp, Artificial
  CRISPR gRNA sequence
atgtgacgggccctggctcc

SEQ ID NO: 764232 - DNA, 20 bp, Artificial
  CRISPR gRNA sequence
ggccctggctccgagcttgt

SEQ ID NO: 764233 - DNA, 20 bp, Artificial
  CRISPR gRNA sequence
cctggctccgagcttgtcag

SEQ ID NO: 764234 - DNA, 20 bp, Artificial
  CRISPR gRNA sequence
ggctccgagcttgtcagaag

SEQ ID NO: 764235 - DNA, 20 bp, Artificial
  CRISPR gRNA sequence
gctccgagcttgtcagaagt

SEQ ID NO: 764236 - DNA, 20 bp, Artificial
  CRISPR gRNA sequence
ctccgagcttgtcagaagtg

SEQ ID NO: 764237 - DNA, 20 bp, Artificial
  CRISPR gRNA sequence
tgtcagaagtggggaccaca

SEQ ID NO: 764238 - DNA, 20 bp, Artificial
  CRISPR gRNA sequence
gtcagaagtggggaccacat

SEQ ID NO: 764239 - DNA, 20 bp, Artificial
  CRISPR gRNA sequence
gtggggaccacataggtctc

SEQ ID NO: 764240 - DNA, 20 bp, Artificial
  CRISPR gRNA sequence
ggggaccacataggtctcaa

SEQ ID NO: 764241 - DNA, 20 bp, Artificial
  CRISPR gRNA sequence
gggaccacataggtctcaag

SEQ ID NO: 764242 - DNA, 20 bp, Artificial
  CRISPR gRNA sequence
ggaccacataggtctcaaga

SEQ ID NO: 764243 - DNA, 20 bp, Artificial
  CRISPR gRNA sequence
accacataggtctcaagagg

SEQ ID NO: 764244 - DNA, 20 bp, Artificial
  CRISPR gRNA sequence
cacataggtctcaagaggga

SEQ ID NO: 764245 - DNA, 20 bp, Artificial
  CRISPR gRNA sequence
acataggtctcaagagggag

SEQ ID NO: 764246 - DNA, 20 bp, Artificial
  CRISPR gRNA sequence
aggtctcaagagggagagga

SEQ ID NO: 764247 - DNA, 20 bp, Artificial
  CRISPR gRNA sequence
ggtctcaagagggagaggac

SEQ ID NO: 764248 - DNA, 20 bp, Artificial
  CRISPR gRNA sequence
aagagggagaggacaggaat

SEQ ID NO: 764249 - DNA, 20 bp, Artificial
  CRISPR gRNA sequence
gggagaggacaggaataagt

SEQ ID NO: 764250 - DNA, 20 bp, Artificial
  CRISPR gRNA sequence
gacaggaataagtgagtcct

SEQ ID NO: 764251 - DNA, 20 bp, Artificial
  CRISPR gRNA sequence
acaggaataagtgagtcctg

SEQ ID NO: 764252 - DNA, 20 bp, Artificial
  CRISPR gRNA sequence
agtgagtcctgaggtgcatg

SEQ ID NO: 764253 - DNA, 20 bp, Artificial
  CRISPR gRNA sequence
tcctgaggtgcatgcagacc

SEQ ID NO: 764254 - DNA, 20 bp, Artificial
  CRISPR gRNA sequence
tgcatgcagacctggaaact

SEQ ID NO: 764255 - DNA, 20 bp, Artificial
  CRISPR gRNA sequence
gcatgcagacctggaaactt

SEQ ID NO: 764256 - DNA, 20 bp, Artificial
  CRISPR gRNA sequence
catgcagacctggaaacttg

SEQ ID NO: 764257 - DNA, 20 bp, Artificial
  CRISPR gRNA sequence
cagacctggaaacttggggt

SEQ ID NO: 764258 - DNA, 20 bp, Artificial
  CRISPR gRNA sequence
ctggaaacttggggtgagat

SEQ ID NO: 764259 - DNA, 20 bp, Artificial
  CRISPR gRNA sequence
cttggggtgagatcagaact

SEQ ID NO: 764260 - DNA, 20 bp, Artificial
  CRISPR gRNA sequence
gggtgagatcagaacttgga

SEQ ID NO: 764261 - DNA, 20 bp, Artificial
  CRISPR gRNA sequence
ggtgagatcagaacttggat

SEQ ID NO: 764262 - DNA, 20 bp, Artificial
  CRISPR gRNA sequence
gatcagaacttggatgggct

SEQ ID NO: 764263 - DNA, 20 bp, Artificial
  CRISPR gRNA sequence
atcagaacttggatgggctg

SEQ ID NO: 764264 - DNA, 20 bp, Artificial
  CRISPR gRNA sequence
tcagaacttggatgggctga

SEQ ID NO: 764265 - DNA, 20 bp, Artificial
  CRISPR gRNA sequence
cagaacttggatgggctgag

SEQ ID NO: 764266 - DNA, 20 bp, Artificial
  CRISPR gRNA sequence
aacttggatgggctgagggg

SEQ ID NO: 764267 - DNA, 20 bp, Artificial
  CRISPR gRNA sequence
tggatgggctgaggggcaga

SEQ ID NO: 764268 - DNA, 20 bp, Artificial
  CRISPR gRNA sequence
atgggctgaggggcagatgg

SEQ ID NO: 764269 - DNA, 20 bp, Artificial
  CRISPR gRNA sequence
gaggggcagatggaagtcat

SEQ ID NO: 764270 - DNA, 20 bp, Artificial
  CRISPR gRNA sequence
gggcagatggaagtcatcag

SEQ ID NO: 764271 - DNA, 20 bp, Artificial
  CRISPR gRNA sequence
gatggaagtcatcagaagac

SEQ ID NO: 764272 - DNA, 20 bp, Artificial
  CRISPR gRNA sequence
tggaagtcatcagaagacaa

SEQ ID NO: 764273 - DNA, 20 bp, Artificial
  CRISPR gRNA sequence
ggaagtcatcagaagacaag

SEQ ID NO: 764274 - DNA, 20 bp, Artificial
  CRISPR gRNA sequence
aagtcatcagaagacaagag

SEQ ID NO: 764275 - DNA, 20 bp, Artificial
  CRISPR gRNA sequence
tcagaagacaagaggagaac

SEQ ID NO: 764276 - DNA, 20 bp, Artificial
  CRISPR gRNA sequence
aagacaagaggagaaccaga

SEQ ID NO: 764277 - DNA, 20 bp, Artificial
  CRISPR gRNA sequence
gtcctgacctcactgtgcac

SEQ ID NO: 764278 - DNA, 20 bp, Artificial
  CRISPR gRNA sequence
tcctgacctcactgtgcacc

SEQ ID NO: 764279 - DNA, 20 bp, Artificial
  CRISPR gRNA sequence
cctgacctcactgtgcacca

SEQ ID NO: 764280 - DNA, 20 bp, Artificial
  CRISPR gRNA sequence
acctcactgtgcaccagggc

SEQ ID NO: 764281 - DNA, 20 bp, Artificial
  CRISPR gRNA sequence
cctcactgtgcaccagggcg

SEQ ID NO: 764282 - DNA, 20 bp, Artificial
  CRISPR gRNA sequence
gtgcaccagggcgaggtccc

SEQ ID NO: 764283 - DNA, 20 bp, Artificial
  CRISPR gRNA sequence
tgcaccagggcgaggtccct

SEQ ID NO: 764284 - DNA, 20 bp, Artificial
  CRISPR gRNA sequence
ccagggcgaggtccctggga

SEQ ID NO: 764285 - DNA, 20 bp, Artificial
  CRISPR gRNA sequence
gcgaggtccctgggaaagct

SEQ ID NO: 764286 - DNA, 20 bp, Artificial
  CRISPR gRNA sequence
ggtccctgggaaagctcagt

SEQ ID NO: 764287 - DNA, 20 bp, Artificial
  CRISPR gRNA sequence
cctgggaaagctcagttggc

SEQ ID NO: 764288 - DNA, 20 bp, Artificial
  CRISPR gRNA sequence
ctgggaaagctcagttggcc

SEQ ID NO: 764289 - DNA, 20 bp, Artificial
  CRISPR gRNA sequence
tgggaaagctcagttggcca

SEQ ID NO: 764290 - DNA, 20 bp, Artificial
  CRISPR gRNA sequence
ggaaagctcagttggccagg

SEQ ID NO: 764291 - DNA, 20 bp, Artificial
  CRISPR gRNA sequence
aaagctcagttggccaggga

SEQ ID NO: 764292 - DNA, 20 bp, Artificial
  CRISPR gRNA sequence
ttggccagggagagatactg

SEQ ID NO: 764293 - DNA, 20 bp, Artificial
  CRISPR gRNA sequence
ggccagggagagatactgaa

SEQ ID NO: 764294 - DNA, 20 bp, Artificial
  CRISPR gRNA sequence
agggagagatactgaagagc

SEQ ID NO: 764295 - DNA, 20 bp, Artificial
  CRISPR gRNA sequence
agatactgaagagccagact

SEQ ID NO: 764296 - DNA, 20 bp, Artificial
  CRISPR gRNA sequence
aagagccagactgagcacgt

SEQ ID NO: 764297 - DNA, 20 bp, Artificial
  CRISPR gRNA sequence
ccagactgagcacgtcggcc

SEQ ID NO: 764298 - DNA, 20 bp, Artificial
  CRISPR gRNA sequence
cagactgagcacgtcggccc

SEQ ID NO: 764299 - DNA, 20 bp, Artificial
  CRISPR gRNA sequence
actgagcacgtcggcccagg

SEQ ID NO: 764300 - DNA, 20 bp, Artificial
  CRISPR gRNA sequence
cggcccaggaagtgactgac

SEQ ID NO: 764301 - DNA, 20 bp, Artificial
  CRISPR gRNA sequence
gcccaggaagtgactgacca

SEQ ID NO: 764302 - DNA, 20 bp, Artificial
  CRISPR gRNA sequence
cccaggaagtgactgaccag

SEQ ID NO: 764303 - DNA, 20 bp, Artificial
  CRISPR gRNA sequence
gtgactgaccagaggcctct

SEQ ID NO: 764304 - DNA, 20 bp, Artificial
  CRISPR gRNA sequence
tgactgaccagaggcctctc

SEQ ID NO: 764305 - DNA, 20 bp, Artificial
  CRISPR gRNA sequence
gactgaccagaggcctctca

SEQ ID NO: 764306 - DNA, 20 bp, Artificial
  CRISPR gRNA sequence
aggcctctcagggccaaaca

SEQ ID NO: 764307 - DNA, 20 bp, Artificial
  CRISPR gRNA sequence
ctctcagggccaaacacaga

SEQ ID NO: 764308 - DNA, 20 bp, Artificial
  CRISPR gRNA sequence
ctcagggccaaacacagatg

SEQ ID NO: 764309 - DNA, 20 bp, Artificial
  CRISPR gRNA sequence
ccaaacacagatggagactg

SEQ ID NO: 764310 - DNA, 20 bp, Artificial
  CRISPR gRNA sequence
ctcaaccctcttcacaccct

SEQ ID NO: 764311 - DNA, 20 bp, Artificial
  CRISPR gRNA sequence
tcaaccctcttcacaccctc

SEQ ID NO: 764312 - DNA, 20 bp, Artificial
  CRISPR gRNA sequence
ctcttcacaccctcaggcac

SEQ ID NO: 764313 - DNA, 20 bp, Artificial
  CRISPR gRNA sequence
cttcacaccctcaggcacaa

SEQ ID NO: 764314 - DNA, 20 bp, Artificial
  CRISPR gRNA sequence
ttcacaccctcaggcacaag

SEQ ID NO: 764315 - DNA, 20 bp, Artificial
  CRISPR gRNA sequence
caggcacaagaggtgcccac

SEQ ID NO: 764316 - DNA, 20 bp, Artificial
  CRISPR gRNA sequence
aggcacaagaggtgcccacg

SEQ ID NO: 764317 - DNA, 20 bp, Artificial
  CRISPR gRNA sequence
acaagaggtgcccacgaggc

SEQ ID NO: 764318 - DNA, 20 bp, Artificial
  CRISPR gRNA sequence
gtgcccacgaggctagaacc

SEQ ID NO: 764319 - DNA, 20 bp, Artificial
  CRISPR gRNA sequence
cgaggctagaacctggaaac

SEQ ID NO: 764320 - DNA, 20 bp, Artificial
  CRISPR gRNA sequence
aggctagaacctggaaacca

SEQ ID NO: 764321 - DNA, 20 bp, Artificial
  CRISPR gRNA sequence
ccagagactaacaatcacta

SEQ ID NO: 764322 - DNA, 20 bp, Artificial
  CRISPR gRNA sequence
cagagactaacaatcactaa

SEQ ID NO: 764323 - DNA, 20 bp, Artificial
  CRISPR gRNA sequence
agagactaacaatcactaaa

SEQ ID NO: 764324 - DNA, 20 bp, Artificial
  CRISPR gRNA sequence
gagactaacaatcactaaag

SEQ ID NO: 764325 - DNA, 20 bp, Artificial
  CRISPR gRNA sequence
actaacaatcactaaagggg

SEQ ID NO: 764326 - DNA, 20 bp, Artificial
  CRISPR gRNA sequence
ctaaaggggtggcctctatc

SEQ ID NO: 764327 - DNA, 20 bp, Artificial
  CRISPR gRNA sequence
ctatctggtgtttgaccaca

SEQ ID NO: 764328 - DNA, 20 bp, Artificial
  CRISPR gRNA sequence
tatctggtgtttgaccacac

SEQ ID NO: 764329 - DNA, 20 bp, Artificial
  CRISPR gRNA sequence
atctggtgtttgaccacacg

SEQ ID NO: 764330 - DNA, 20 bp, Artificial
  CRISPR gRNA sequence
tctggtgtttgaccacacgg

SEQ ID NO: 764331 - DNA, 20 bp, Artificial
  CRISPR gRNA sequence
ggtgtttgaccacacggggg

SEQ ID NO: 764332 - DNA, 20 bp, Artificial
  CRISPR gRNA sequence
gtttgaccacacgggggcag

SEQ ID NO: 764333 - DNA, 20 bp, Artificial
  CRISPR gRNA sequence
ttgaccacacgggggcagca

SEQ ID NO: 764334 - DNA, 20 bp, Artificial
  CRISPR gRNA sequence
ccacacgggggcagcagaga

SEQ ID NO: 764335 - DNA, 20 bp, Artificial
  CRISPR gRNA sequence
gacagcccctgcccatccaa

SEQ ID NO: 764336 - DNA, 20 bp, Artificial
  CRISPR gRNA sequence
ctgcccatccaacggctgcc

SEQ ID NO: 764337 - DNA, 20 bp, Artificial
  CRISPR gRNA sequence
tgcccatccaacggctgcct

SEQ ID NO: 764338 - DNA, 20 bp, Artificial
  CRISPR gRNA sequence
ccatccaacggctgcctggg

SEQ ID NO: 764339 - DNA, 20 bp, Artificial
  CRISPR gRNA sequence
atccaacggctgcctgggtg

SEQ ID NO: 764340 - DNA, 20 bp, Artificial
  CRISPR gRNA sequence
cggctgcctgggtggagcgc

SEQ ID NO: 764341 - DNA, 20 bp, Artificial
  CRISPR gRNA sequence
ctgggtggagcgcaagtctg

SEQ ID NO: 764342 - DNA, 20 bp, Artificial
  CRISPR gRNA sequence
tgggtggagcgcaagtctgc

SEQ ID NO: 764343 - DNA, 20 bp, Artificial
  CRISPR gRNA sequence
gtggagcgcaagtctgcagg

SEQ ID NO: 764344 - DNA, 20 bp, Artificial
  CRISPR gRNA sequence
gagcgcaagtctgcaggaag

SEQ ID NO: 764345 - DNA, 20 bp, Artificial
  CRISPR gRNA sequence
gcgcaagtctgcaggaagaa

SEQ ID NO: 764346 - DNA, 20 bp, Artificial
  CRISPR gRNA sequence
aagaagagctgacgttgact

SEQ ID NO: 764347 - DNA, 20 bp, Artificial
  CRISPR gRNA sequence
agaagagctgacgttgactc

SEQ ID NO: 764348 - DNA, 20 bp, Artificial
  CRISPR gRNA sequence
gctgacgttgactcaggtgt

SEQ ID NO: 764349 - DNA, 20 bp, Artificial
  CRISPR gRNA sequence
ctgacgttgactcaggtgtt

SEQ ID NO: 764350 - DNA, 20 bp, Artificial
  CRISPR gRNA sequence
tgacgttgactcaggtgttg

SEQ ID NO: 764351 - DNA, 20 bp, Artificial
  CRISPR gRNA sequence
ctcaggtgttggggactaac

SEQ ID NO: 764352 - DNA, 20 bp, Artificial
  CRISPR gRNA sequence
tcaggtgttggggactaact

SEQ ID NO: 764353 - DNA, 20 bp, Artificial
  CRISPR gRNA sequence
caggtgttggggactaacta

SEQ ID NO: 764354 - DNA, 20 bp, Artificial
  CRISPR gRNA sequence
ggtgttggggactaactagg

SEQ ID NO: 764355 - DNA, 20 bp, Artificial
  CRISPR gRNA sequence
gtgttggggactaactaggg

SEQ ID NO: 764356 - DNA, 20 bp, Artificial
  CRISPR gRNA sequence
tgttggggactaactaggga

SEQ ID NO: 764357 - DNA, 20 bp, Artificial
  CRISPR gRNA sequence
ggggactaactagggagggc

SEQ ID NO: 764358 - DNA, 20 bp, Artificial
  CRISPR gRNA sequence
agggagggccagctgtcact

SEQ ID NO: 764359 - DNA, 20 bp, Artificial
  CRISPR gRNA sequence
gggagggccagctgtcactc

SEQ ID NO: 764360 - DNA, 20 bp, Artificial
  CRISPR gRNA sequence
gccagctgtcactcaggctt

SEQ ID NO: 764361 - DNA, 20 bp, Artificial
  CRISPR gRNA sequence
tgtcactcaggcttcagaat

SEQ ID NO: 764362 - DNA, 20 bp, Artificial
  CRISPR gRNA sequence
actcaggcttcagaatcaga

SEQ ID NO: 764363 - DNA, 20 bp, Artificial
  CRISPR gRNA sequence
tcagatggcgcccactgacc

SEQ ID NO: 764364 - DNA, 20 bp, Artificial
  CRISPR gRNA sequence
cagaataccttcctaccact

SEQ ID NO: 764365 - DNA, 20 bp, Artificial
  CRISPR gRNA sequence
gaataccttcctaccactca

SEQ ID NO: 764366 - DNA, 20 bp, Artificial
  CRISPR gRNA sequence
aataccttcctaccactcag

SEQ ID NO: 764367 - DNA, 20 bp, Artificial
  CRISPR gRNA sequence
taccttcctaccactcagag

SEQ ID NO: 764368 - DNA, 20 bp, Artificial
  CRISPR gRNA sequence
ccactcagaggagttcctgc

SEQ ID NO: 764369 - DNA, 20 bp, Artificial
  CRISPR gRNA sequence
tcagaggagttcctgctgga

SEQ ID NO: 764370 - DNA, 20 bp, Artificial
  CRISPR gRNA sequence
ctggaaagcacacccacacc

SEQ ID NO: 764371 - DNA, 20 bp, Artificial
  CRISPR gRNA sequence
cacacccacaccaagtcccc

SEQ ID NO: 764372 - DNA, 20 bp, Artificial
  CRISPR gRNA sequence
acacccacaccaagtcccct

SEQ ID NO: 764373 - DNA, 20 bp, Artificial
  CRISPR gRNA sequence
gtcccctgggccacaccttg

SEQ ID NO: 764374 - DNA, 20 bp, Artificial
  CRISPR gRNA sequence
gccacaccttgtggctgccc

SEQ ID NO: 764375 - DNA, 20 bp, Artificial
  CRISPR gRNA sequence
ctgcccatgcctccaaattt

SEQ ID NO: 764376 - DNA, 20 bp, Artificial
  CRISPR gRNA sequence
tgcccatgcctccaaatttc

SEQ ID NO: 764377 - DNA, 20 bp, Artificial
  CRISPR gRNA sequence
ccatgcctccaaatttcggg

SEQ ID NO: 764378 - DNA, 20 bp, Artificial
  CRISPR gRNA sequence
catgcctccaaatttcgggc

SEQ ID NO: 764379 - DNA, 20 bp, Artificial
  CRISPR gRNA sequence
aggtaccttgtcctctgcat

SEQ ID NO: 764380 - DNA, 20 bp, Artificial
  CRISPR gRNA sequence
taccttgtcctctgcataag

SEQ ID NO: 764381 - DNA, 20 bp, Artificial
  CRISPR gRNA sequence
gtcctctgcataagaagcat

SEQ ID NO: 764382 - DNA, 20 bp, Artificial
  CRISPR gRNA sequence
agaagcataagtgccacgaa

SEQ ID NO: 764383 - DNA, 20 bp, Artificial
  CRISPR gRNA sequence
agtgccacgaaaagcactct

SEQ ID NO: 764384 - DNA, 20 bp, Artificial
  CRISPR gRNA sequence
gtgccacgaaaagcactctt

SEQ ID NO: 764385 - DNA, 20 bp, Artificial
  CRISPR gRNA sequence
ccacgaaaagcactcttagg

SEQ ID NO: 764386 - DNA, 20 bp, Artificial
  CRISPR gRNA sequence
cacgaaaagcactcttagga

SEQ ID NO: 764387 - DNA, 20 bp, Artificial
  CRISPR gRNA sequence
aggaaggcaaacattataaa

SEQ ID NO: 764388 - DNA, 20 bp, Artificial
  CRISPR gRNA sequence
acattataaatggttcttat

SEQ ID NO: 764389 - DNA, 20 bp, Artificial
  CRISPR gRNA sequence
taaatggttcttatcagctc

SEQ ID NO: 764390 - DNA, 20 bp, Artificial
  CRISPR gRNA sequence
cttatcagctcgagtccctt

SEQ ID NO: 764391 - DNA, 20 bp, Artificial
  CRISPR gRNA sequence
ttatcagctcgagtccctta

SEQ ID NO: 764392 - DNA, 20 bp, Artificial
  CRISPR gRNA sequence
tcgagtcccttaaggacttg

SEQ ID NO: 764393 - DNA, 20 bp, Artificial
  CRISPR gRNA sequence
cgagtcccttaaggacttgt

SEQ ID NO: 764394 - DNA, 20 bp, Artificial
  CRISPR gRNA sequence
gagtcccttaaggacttgtg

SEQ ID NO: 764395 - DNA, 20 bp, Artificial
  CRISPR gRNA sequence
tcccttaaggacttgtgggg

SEQ ID NO: 764396 - DNA, 20 bp, Artificial
  CRISPR gRNA sequence
ccttaaggacttgtggggaa

SEQ ID NO: 764397 - DNA, 20 bp, Artificial
  CRISPR gRNA sequence
ggacttgtggggaagagtgt

SEQ ID NO: 764398 - DNA, 20 bp, Artificial
  CRISPR gRNA sequence
gggaagagtgtgagcacctg

SEQ ID NO: 764399 - DNA, 20 bp, Artificial
  CRISPR gRNA sequence
tgagcacctgaagtctatga

SEQ ID NO: 764400 - DNA, 20 bp, Artificial
  CRISPR gRNA sequence
gagcacctgaagtctatgaa

SEQ ID NO: 764401 - DNA, 20 bp, Artificial
  CRISPR gRNA sequence
agcacctgaagtctatgaaa

SEQ ID NO: 764402 - DNA, 20 bp, Artificial
  CRISPR gRNA sequence
gtctatgaaagggattttga

SEQ ID NO: 764403 - DNA, 20 bp, Artificial
  CRISPR gRNA sequence
aagggattttgaaagtcttc

SEQ ID NO: 764404 - DNA, 20 bp, Artificial
  CRISPR gRNA sequence
cttctggccacccaaaccta

SEQ ID NO: 764405 - DNA, 20 bp, Artificial
  CRISPR gRNA sequence
aacctatggaaattccacgt

SEQ ID NO: 764406 - DNA, 20 bp, Artificial
  CRISPR gRNA sequence
acctatggaaattccacgtt

SEQ ID NO: 764407 - DNA, 20 bp, Artificial
  CRISPR gRNA sequence
cctatggaaattccacgtta

SEQ ID NO: 764408 - DNA, 20 bp, Artificial
  CRISPR gRNA sequence
ggaaattccacgttagggtc

SEQ ID NO: 764409 - DNA, 20 bp, Artificial
  CRISPR gRNA sequence
ttccacgttagggtccagta

SEQ ID NO: 764410 - DNA, 20 bp, Artificial
  CRISPR gRNA sequence
ccacgttagggtccagtaaa

SEQ ID NO: 764411 - DNA, 20 bp, Artificial
  CRISPR gRNA sequence
cacgttagggtccagtaaag

SEQ ID NO: 764412 - DNA, 20 bp, Artificial
  CRISPR gRNA sequence
acgttagggtccagtaaaga

SEQ ID NO: 764413 - DNA, 20 bp, Artificial
  CRISPR gRNA sequence
gttagggtccagtaaagagg

SEQ ID NO: 764414 - DNA, 20 bp, Artificial
  CRISPR gRNA sequence
ttactcgctccgtccttccc

SEQ ID NO: 764415 - DNA, 20 bp, Artificial
  CRISPR gRNA sequence
tcatctgcccttacctgtga

SEQ ID NO: 764416 - DNA, 20 bp, Artificial
  CRISPR gRNA sequence
gcccttacctgtgatggtga

SEQ ID NO: 764417 - DNA, 20 bp, Artificial
  CRISPR gRNA sequence
ccttacctgtgatggtgaca

SEQ ID NO: 764418 - DNA, 20 bp, Artificial
  CRISPR gRNA sequence
gagccgtgcgcatcctgctg

SEQ ID NO: 764419 - DNA, 20 bp, Artificial
  CRISPR gRNA sequence
gtgcgcatcctgctgcagca

SEQ ID NO: 764420 - DNA, 20 bp, Artificial
  CRISPR gRNA sequence
tgcgcatcctgctgcagcac

SEQ ID NO: 764421 - DNA, 20 bp, Artificial
  CRISPR gRNA sequence
gcgcatcctgctgcagcacg

SEQ ID NO: 764422 - DNA, 20 bp, Artificial
  CRISPR gRNA sequence
tgcagcacggggttgcgcac

SEQ ID NO: 764423 - DNA, 20 bp, Artificial
  CRISPR gRNA sequence
gcagcacggggttgcgcacc

SEQ ID NO: 764424 - DNA, 20 bp, Artificial
  CRISPR gRNA sequence
gcacggggttgcgcaccagg

SEQ ID NO: 764425 - DNA, 20 bp, Artificial
  CRISPR gRNA sequence
ggttgcgcaccaggcagctg

SEQ ID NO: 764426 - DNA, 20 bp, Artificial
  CRISPR gRNA sequence
gttgcgcaccaggcagctgt

SEQ ID NO: 764427 - DNA, 20 bp, Artificial
  CRISPR gRNA sequence
ctgtaggtgccattcgcacc

SEQ ID NO: 764428 - DNA, 20 bp, Artificial
  CRISPR gRNA sequence
ttcgcacccagcaccacccg

SEQ ID NO: 764429 - DNA, 20 bp, Artificial
  CRISPR gRNA sequence
tcgcacccagcaccacccgc

SEQ ID NO: 764430 - DNA, 20 bp, Artificial
  CRISPR gRNA sequence
ggacgctgtgcacatcaaac

SEQ ID NO: 764431 - DNA, 20 bp, Artificial
  CRISPR gRNA sequence
atcaaacaagccctgctcgt

SEQ ID NO: 764432 - DNA, 20 bp, Artificial
  CRISPR gRNA sequence
ctcgttggccatctgcgacg

SEQ ID NO: 764433 - DNA, 20 bp, Artificial
  CRISPR gRNA sequence
ctgcgacgtggtcacgttgc

SEQ ID NO: 764434 - DNA, 20 bp, Artificial
  CRISPR gRNA sequence
gacgtggtcacgttgccagt

SEQ ID NO: 764435 - DNA, 20 bp, Artificial
  CRISPR gRNA sequence
acgtggtcacgttgccagtc

SEQ ID NO: 764436 - DNA, 20 bp, Artificial
  CRISPR gRNA sequence
cgtggtcacgttgccagtca

SEQ ID NO: 764437 - DNA, 20 bp, Artificial
  CRISPR gRNA sequence
gtggtcacgttgccagtcag

SEQ ID NO: 764438 - DNA, 20 bp, Artificial
  CRISPR gRNA sequence
gcacaccctgcccatcctgc

SEQ ID NO: 764439 - DNA, 20 bp, Artificial
  CRISPR gRNA sequence
cccatcctgccagaacacct

SEQ ID NO: 764440 - DNA, 20 bp, Artificial
  CRISPR gRNA sequence
ctgccagaacacctcagcct

SEQ ID NO: 764441 - DNA, 20 bp, Artificial
  CRISPR gRNA sequence
tgccagaacacctcagcctc

SEQ ID NO: 764442 - DNA, 20 bp, Artificial
  CRISPR gRNA sequence
gccagaacacctcagcctca

SEQ ID NO: 764443 - DNA, 20 bp, Artificial
  CRISPR gRNA sequence
agaacacctcagcctcaggg

SEQ ID NO: 764444 - DNA, 20 bp, Artificial
  CRISPR gRNA sequence
cctcagcctcagggtagccc

SEQ ID NO: 764445 - DNA, 20 bp, Artificial
  CRISPR gRNA sequence
cagcctcagggtagccccgg

SEQ ID NO: 764446 - DNA, 20 bp, Artificial
  CRISPR gRNA sequence
ctcagggtagccccggtagc

SEQ ID NO: 764447 - DNA, 20 bp, Artificial
  CRISPR gRNA sequence
cagggtagccccggtagctg

SEQ ID NO: 764448 - DNA, 20 bp, Artificial
  CRISPR gRNA sequence
ccggtagctggagcacgtga

SEQ ID NO: 764449 - DNA, 20 bp, Artificial
  CRISPR gRNA sequence
gtgatggtcaccgtgtcccc

SEQ ID NO: 764450 - DNA, 20 bp, Artificial
  CRISPR gRNA sequence
gtcaccgtgtcccctggccg

SEQ ID NO: 764451 - DNA, 20 bp, Artificial
  CRISPR gRNA sequence
tcaccgtgtcccctggccgc

SEQ ID NO: 764452 - DNA, 20 bp, Artificial
  CRISPR gRNA sequence
ccctggccgcaggtccttgt

SEQ ID NO: 764453 - DNA, 20 bp, Artificial
  CRISPR gRNA sequence
cctggccgcaggtccttgtt

SEQ ID NO: 764454 - DNA, 20 bp, Artificial
  CRISPR gRNA sequence
cgcaggtccttgttgggctc

SEQ ID NO: 764455 - DNA, 20 bp, Artificial
  CRISPR gRNA sequence
gcaggtccttgttgggctcc

SEQ ID NO: 764456 - DNA, 20 bp, Artificial
  CRISPR gRNA sequence
caggtccttgttgggctcca

SEQ ID NO: 764457 - DNA, 20 bp, Artificial
  CRISPR gRNA sequence
gttgggctccagggtcatgc

SEQ ID NO: 764458 - DNA, 20 bp, Artificial
  CRISPR gRNA sequence
ttgggctccagggtcatgct

SEQ ID NO: 764459 - DNA, 20 bp, Artificial
  CRISPR gRNA sequence
ccagggtcatgctgggcttc

SEQ ID NO: 764460 - DNA, 20 bp, Artificial
  CRISPR gRNA sequence
gggtcatgctgggcttcgag

SEQ ID NO: 764461 - DNA, 20 bp, Artificial
  CRISPR gRNA sequence
ggtcatgctgggcttcgagt

SEQ ID NO: 764462 - DNA, 20 bp, Artificial
  CRISPR gRNA sequence
gtcatgctgggcttcgagta

SEQ ID NO: 764463 - DNA, 20 bp, Artificial
  CRISPR gRNA sequence
catgctgggcttcgagtagg

SEQ ID NO: 764464 - DNA, 20 bp, Artificial
  CRISPR gRNA sequence
ctgggcttcgagtagggagc

SEQ ID NO: 764465 - DNA, 20 bp, Artificial
  CRISPR gRNA sequence
gggcttcgagtagggagctg

SEQ ID NO: 764466 - DNA, 20 bp, Artificial
  CRISPR gRNA sequence
ggcttcgagtagggagctgg

SEQ ID NO: 764467 - DNA, 20 bp, Artificial
  CRISPR gRNA sequence
gagtagggagctggaggtga

SEQ ID NO: 764468 - DNA, 20 bp, Artificial
  CRISPR gRNA sequence
gtagggagctggaggtgaca

SEQ ID NO: 764469 - DNA, 20 bp, Artificial
  CRISPR gRNA sequence
tagggagctggaggtgacag

SEQ ID NO: 764470 - DNA, 20 bp, Artificial
  CRISPR gRNA sequence
agggagctggaggtgacaga

SEQ ID NO: 764471 - DNA, 20 bp, Artificial
  CRISPR gRNA sequence
gagctggaggtgacagaggg

SEQ ID NO: 764472 - DNA, 20 bp, Artificial
  CRISPR gRNA sequence
agctggaggtgacagagggc

SEQ ID NO: 764473 - DNA, 20 bp, Artificial
  CRISPR gRNA sequence
gctggaggtgacagagggca

SEQ ID NO: 764474 - DNA, 20 bp, Artificial
  CRISPR gRNA sequence
ctggaggtgacagagggcag

SEQ ID NO: 764475 - DNA, 20 bp, Artificial
  CRISPR gRNA sequence
ggtgacagagggcaggggtc

SEQ ID NO: 764476 - DNA, 20 bp, Artificial
  CRISPR gRNA sequence
gtgacagagggcaggggtca

SEQ ID NO: 764477 - DNA, 20 bp, Artificial
  CRISPR gRNA sequence
tgacagagggcaggggtcaa

SEQ ID NO: 764478 - DNA, 20 bp, Artificial
  CRISPR gRNA sequence
cagagggcaggggtcaaggg

SEQ ID NO: 764479 - DNA, 20 bp, Artificial
  CRISPR gRNA sequence
agagggcaggggtcaagggc

SEQ ID NO: 764480 - DNA, 20 bp, Artificial
  CRISPR gRNA sequence
gagggcaggggtcaagggca

SEQ ID NO: 764481 - DNA, 20 bp, Artificial
  CRISPR gRNA sequence
aggggtcaagggcagggcaa

SEQ ID NO: 764482 - DNA, 20 bp, Artificial
  CRISPR gRNA sequence
ggtcaagggcagggcaatgg

SEQ ID NO: 764483 - DNA, 20 bp, Artificial
  CRISPR gRNA sequence
gtcaagggcagggcaatggc

SEQ ID NO: 764484 - DNA, 20 bp, Artificial
  CRISPR gRNA sequence
tcaagggcagggcaatggca

SEQ ID NO: 764485 - DNA, 20 bp, Artificial
  CRISPR gRNA sequence
caagggcagggcaatggcag

SEQ ID NO: 764486 - DNA, 20 bp, Artificial
  CRISPR gRNA sequence
agggcagggcaatggcaggg

SEQ ID NO: 764487 - DNA, 20 bp, Artificial
  CRISPR gRNA sequence
gggcagggcaatggcagggg

SEQ ID NO: 764488 - DNA, 20 bp, Artificial
  CRISPR gRNA sequence
gggcaatggcaggggaggaa

SEQ ID NO: 764489 - DNA, 20 bp, Artificial
  CRISPR gRNA sequence
ggcaatggcaggggaggaaa

SEQ ID NO: 764490 - DNA, 20 bp, Artificial
  CRISPR gRNA sequence
caggggaggaaaaggatgca

SEQ ID NO: 764491 - DNA, 20 bp, Artificial
  CRISPR gRNA sequence
aggggaggaaaaggatgcat

SEQ ID NO: 764492 - DNA, 20 bp, Artificial
  CRISPR gRNA sequence
ggggaggaaaaggatgcatg

SEQ ID NO: 764493 - DNA, 20 bp, Artificial
  CRISPR gRNA sequence
ggaaaaggatgcatggggct

SEQ ID NO: 764494 - DNA, 20 bp, Artificial
  CRISPR gRNA sequence
aggatgcatggggctgagta

SEQ ID NO: 764495 - DNA, 20 bp, Artificial
  CRISPR gRNA sequence
ggatgcatggggctgagtac

SEQ ID NO: 764496 - DNA, 20 bp, Artificial
  CRISPR gRNA sequence
atggggctgagtacaggaat

SEQ ID NO: 764497 - DNA, 20 bp, Artificial
  CRISPR gRNA sequence
ctgagtacaggaatcagcac

SEQ ID NO: 764498 - DNA, 20 bp, Artificial
  CRISPR gRNA sequence
tgagtacaggaatcagcact

SEQ ID NO: 764499 - DNA, 20 bp, Artificial
  CRISPR gRNA sequence
gagtacaggaatcagcactg

SEQ ID NO: 764500 - DNA, 20 bp, Artificial
  CRISPR gRNA sequence
aggaatcagcactggggttc

SEQ ID NO: 764501 - DNA, 20 bp, Artificial
  CRISPR gRNA sequence
ggaatcagcactggggttct

SEQ ID NO: 764502 - DNA, 20 bp, Artificial
  CRISPR gRNA sequence
aatcagcactggggttctgg

SEQ ID NO: 764503 - DNA, 20 bp, Artificial
  CRISPR gRNA sequence
cagcactggggttctgggag

SEQ ID NO: 764504 - DNA, 20 bp, Artificial
  CRISPR gRNA sequence
cactggggttctgggagcag

SEQ ID NO: 764505 - DNA, 20 bp, Artificial
  CRISPR gRNA sequence
gggttctgggagcagtggtg

SEQ ID NO: 764506 - DNA, 20 bp, Artificial
  CRISPR gRNA sequence
ttctgggagcagtggtgcag

SEQ ID NO: 764507 - DNA, 20 bp, Artificial
  CRISPR gRNA sequence
ctgggagcagtggtgcagca

SEQ ID NO: 764508 - DNA, 20 bp, Artificial
  CRISPR gRNA sequence
tgggagcagtggtgcagcag

SEQ ID NO: 764509 - DNA, 20 bp, Artificial
  CRISPR gRNA sequence
gggagcagtggtgcagcaga

SEQ ID NO: 764510 - DNA, 20 bp, Artificial
  CRISPR gRNA sequence
agcagtggtgcagcagaggg

SEQ ID NO: 764511 - DNA, 20 bp, Artificial
  CRISPR gRNA sequence
gcagtggtgcagcagagggt

SEQ ID NO: 764512 - DNA, 20 bp, Artificial
  CRISPR gRNA sequence
gtgcagcagagggtgggctg

SEQ ID NO: 764513 - DNA, 20 bp, Artificial
  CRISPR gRNA sequence
gcagcagagggtgggctgca

SEQ ID NO: 764514 - DNA, 20 bp, Artificial
  CRISPR gRNA sequence
cagcagagggtgggctgcag

SEQ ID NO: 764515 - DNA, 20 bp, Artificial
  CRISPR gRNA sequence
agcagagggtgggctgcaga

SEQ ID NO: 764516 - DNA, 20 bp, Artificial
  CRISPR gRNA sequence
agggtgggctgcagagggaa

SEQ ID NO: 764517 - DNA, 20 bp, Artificial
  CRISPR gRNA sequence
ggtgggctgcagagggaatg

SEQ ID NO: 764518 - DNA, 20 bp, Artificial
  CRISPR gRNA sequence
gtgggctgcagagggaatgg

SEQ ID NO: 764519 - DNA, 20 bp, Artificial
  CRISPR gRNA sequence
tgggctgcagagggaatgga

SEQ ID NO: 764520 - DNA, 20 bp, Artificial
  CRISPR gRNA sequence
gagggaatggagggtgaacc

SEQ ID NO: 764521 - DNA, 20 bp, Artificial
  CRISPR gRNA sequence
agggaatggagggtgaacca

SEQ ID NO: 764522 - DNA, 20 bp, Artificial
  CRISPR gRNA sequence
gggaatggagggtgaaccaa

SEQ ID NO: 764523 - DNA, 20 bp, Artificial
  CRISPR gRNA sequence
ggaatggagggtgaaccaag

SEQ ID NO: 764524 - DNA, 20 bp, Artificial
  CRISPR gRNA sequence
atggagggtgaaccaagggg

SEQ ID NO: 764525 - DNA, 20 bp, Artificial
  CRISPR gRNA sequence
tggagggtgaaccaagggga

SEQ ID NO: 764526 - DNA, 20 bp, Artificial
  CRISPR gRNA sequence
aggggaaggcgtcgccctcc

SEQ ID NO: 764527 - DNA, 20 bp, Artificial
  CRISPR gRNA sequence
gtcgccctcctggtgctcac

SEQ ID NO: 764528 - DNA, 20 bp, Artificial
  CRISPR gRNA sequence
tggtgctcaccggccacctg

SEQ ID NO: 764529 - DNA, 20 bp, Artificial
  CRISPR gRNA sequence
ggtgctcaccggccacctgc

SEQ ID NO: 764530 - DNA, 20 bp, Artificial
  CRISPR gRNA sequence
accggccacctgcaggctga

SEQ ID NO: 764531 - DNA, 20 bp, Artificial
  CRISPR gRNA sequence
ggccacctgcaggctgacgg

SEQ ID NO: 764532 - DNA, 20 bp, Artificial
  CRISPR gRNA sequence
cggcagcgctgccgaaatcc

SEQ ID NO: 764533 - DNA, 20 bp, Artificial
  CRISPR gRNA sequence
cgaaatcccggatgctcacg

SEQ ID NO: 764534 - DNA, 20 bp, Artificial
  CRISPR gRNA sequence
aatcccggatgctcacgaag

SEQ ID NO: 764535 - DNA, 20 bp, Artificial
  CRISPR gRNA sequence
atcccggatgctcacgaagc

SEQ ID NO: 764536 - DNA, 20 bp, Artificial
  CRISPR gRNA sequence
ggatgctcacgaagcaggtg

SEQ ID NO: 764537 - DNA, 20 bp, Artificial
  CRISPR gRNA sequence
tccgccacacgcacgcgctg

SEQ ID NO: 764538 - DNA, 20 bp, Artificial
  CRISPR gRNA sequence
acacgcacgcgctgcagcct

SEQ ID NO: 764539 - DNA, 20 bp, Artificial
  CRISPR gRNA sequence
cacgcacgcgctgcagcctc

SEQ ID NO: 764540 - DNA, 20 bp, Artificial
  CRISPR gRNA sequence
acgcacgcgctgcagcctca

SEQ ID NO: 764541 - DNA, 20 bp, Artificial
  CRISPR gRNA sequence
agggatgcattgccttgtgc

SEQ ID NO: 764542 - DNA, 20 bp, Artificial
  CRISPR gRNA sequence
gatgcattgccttgtgccag

SEQ ID NO: 764543 - DNA, 20 bp, Artificial
  CRISPR gRNA sequence
atgcattgccttgtgccagc

SEQ ID NO: 764544 - DNA, 20 bp, Artificial
  CRISPR gRNA sequence
ttgccttgtgccagcaggtc

SEQ ID NO: 764545 - DNA, 20 bp, Artificial
  CRISPR gRNA sequence
tgccttgtgccagcaggtcc

SEQ ID NO: 764546 - DNA, 20 bp, Artificial
  CRISPR gRNA sequence
cttgtgccagcaggtccggg

SEQ ID NO: 764547 - DNA, 20 bp, Artificial
  CRISPR gRNA sequence
tgtgccagcaggtccgggaa

SEQ ID NO: 764548 - DNA, 20 bp, Artificial
  CRISPR gRNA sequence
gtgccagcaggtccgggaag

SEQ ID NO: 764549 - DNA, 20 bp, Artificial
  CRISPR gRNA sequence
tgccagcaggtccgggaaga

SEQ ID NO: 764550 - DNA, 20 bp, Artificial
  CRISPR gRNA sequence
ggtccgggaagagggccgtg

SEQ ID NO: 764551 - DNA, 20 bp, Artificial
  CRISPR gRNA sequence
cgggaagagggccgtgcggt

SEQ ID NO: 764552 - DNA, 20 bp, Artificial
  CRISPR gRNA sequence
agagggccgtgcggttggca

SEQ ID NO: 764553 - DNA, 20 bp, Artificial
  CRISPR gRNA sequence
gagggccgtgcggttggcat

SEQ ID NO: 764554 - DNA, 20 bp, Artificial
  CRISPR gRNA sequence
ggttggcataggcgctgccc

SEQ ID NO: 764555 - DNA, 20 bp, Artificial
  CRISPR gRNA sequence
cataggcgctgccctggtcc

SEQ ID NO: 764556 - DNA, 20 bp, Artificial
  CRISPR gRNA sequence
gctgccctggtcccggcctt

SEQ ID NO: 764557 - DNA, 20 bp, Artificial
  CRISPR gRNA sequence
ccttcggtgaaactgtgcac

SEQ ID NO: 764558 - DNA, 20 bp, Artificial
  CRISPR gRNA sequence
gaaactgtgcaccagctgtt

SEQ ID NO: 764559 - DNA, 20 bp, Artificial
  CRISPR gRNA sequence
accagctgtttggtgtctgt

SEQ ID NO: 764560 - DNA, 20 bp, Artificial
  CRISPR gRNA sequence
gtttggtgtctgtcagctgc

SEQ ID NO: 764561 - DNA, 20 bp, Artificial
  CRISPR gRNA sequence
gtgtctgtcagctgccagat

SEQ ID NO: 764562 - DNA, 20 bp, Artificial
  CRISPR gRNA sequence
tgtctgtcagctgccagatg

SEQ ID NO: 764563 - DNA, 20 bp, Artificial
  CRISPR gRNA sequence
gtcagctgccagatgaggtt

SEQ ID NO: 764564 - DNA, 20 bp, Artificial
  CRISPR gRNA sequence
cagatgaggttgagctgtgc

SEQ ID NO: 764565 - DNA, 20 bp, Artificial
  CRISPR gRNA sequence
agatgaggttgagctgtgcc

SEQ ID NO: 764566 - DNA, 20 bp, Artificial
  CRISPR gRNA sequence
ggttgagctgtgccaggctg

SEQ ID NO: 764567 - DNA, 20 bp, Artificial
  CRISPR gRNA sequence
gagctgtgccaggctgaagc

SEQ ID NO: 764568 - DNA, 20 bp, Artificial
  CRISPR gRNA sequence
agctgtgccaggctgaagcc

SEQ ID NO: 764569 - DNA, 20 bp, Artificial
  CRISPR gRNA sequence
tgccaggctgaagccaggct

SEQ ID NO: 764570 - DNA, 20 bp, Artificial
  CRISPR gRNA sequence
gccaggctgaagccaggctc

SEQ ID NO: 764571 - DNA, 20 bp, Artificial
  CRISPR gRNA sequence
ccaggctgaagccaggctcg

SEQ ID NO: 764572 - DNA, 20 bp, Artificial
  CRISPR gRNA sequence
caggctgaagccaggctcgg

SEQ ID NO: 764573 - DNA, 20 bp, Artificial
  CRISPR gRNA sequence
ggctgaagccaggctcgggg

SEQ ID NO: 764574 - DNA, 20 bp, Artificial
  CRISPR gRNA sequence
tgaagccaggctcgggggag

SEQ ID NO: 764575 - DNA, 20 bp, Artificial
  CRISPR gRNA sequence
gaagccaggctcgggggaga

SEQ ID NO: 764576 - DNA, 20 bp, Artificial
  CRISPR gRNA sequence
agccaggctcgggggagaag

SEQ ID NO: 764577 - DNA, 20 bp, Artificial
  CRISPR gRNA sequence
caggctcgggggagaaggag

SEQ ID NO: 764578 - DNA, 20 bp, Artificial
  CRISPR gRNA sequence
tcgggggagaaggagcagcg

SEQ ID NO: 764579 - DNA, 20 bp, Artificial
  CRISPR gRNA sequence
cgggggagaaggagcagcgc

SEQ ID NO: 764580 - DNA, 20 bp, Artificial
  CRISPR gRNA sequence
gggggagaaggagcagcgca

SEQ ID NO: 764581 - DNA, 20 bp, Artificial
  CRISPR gRNA sequence
ggagaaggagcagcgcaggg

SEQ ID NO: 764582 - DNA, 20 bp, Artificial
  CRISPR gRNA sequence
ggagcagcgcagggtggcat

SEQ ID NO: 764583 - DNA, 20 bp, Artificial
  CRISPR gRNA sequence
agggtggcatcggtgcccac

SEQ ID NO: 764584 - DNA, 20 bp, Artificial
  CRISPR gRNA sequence
gggtggcatcggtgcccact

SEQ ID NO: 764585 - DNA, 20 bp, Artificial
  CRISPR gRNA sequence
ggtggcatcggtgcccacta

SEQ ID NO: 764586 - DNA, 20 bp, Artificial
  CRISPR gRNA sequence
gtgcccactagggccaccac

SEQ ID NO: 764587 - DNA, 20 bp, Artificial
  CRISPR gRNA sequence
tgcccactagggccaccacc

SEQ ID NO: 764588 - DNA, 20 bp, Artificial
  CRISPR gRNA sequence
tagggccaccaccgggtcct

SEQ ID NO: 764589 - DNA, 20 bp, Artificial
  CRISPR gRNA sequence
agggccaccaccgggtcctc

SEQ ID NO: 764590 - DNA, 20 bp, Artificial
  CRISPR gRNA sequence
gggccaccaccgggtcctca

SEQ ID NO: 764591 - DNA, 20 bp, Artificial
  CRISPR gRNA sequence
ccaccgggtcctcagggacc

SEQ ID NO: 764592 - DNA, 20 bp, Artificial
  CRISPR gRNA sequence
ctcagggacctggacctcca

SEQ ID NO: 764593 - DNA, 20 bp, Artificial
  CRISPR gRNA sequence
acctggacctccacggctcc

SEQ ID NO: 764594 - DNA, 20 bp, Artificial
  CRISPR gRNA sequence
cctggacctccacggctcct

SEQ ID NO: 764595 - DNA, 20 bp, Artificial
  CRISPR gRNA sequence
ctggacctccacggctcctg

SEQ ID NO: 764596 - DNA, 20 bp, Artificial
  CRISPR gRNA sequence
tggacctccacggctcctgg

SEQ ID NO: 764597 - DNA, 20 bp, Artificial
  CRISPR gRNA sequence
acctccacggctcctggggg

SEQ ID NO: 764598 - DNA, 20 bp, Artificial
  CRISPR gRNA sequence
cctccacggctcctgggggc

SEQ ID NO: 764599 - DNA, 20 bp, Artificial
  CRISPR gRNA sequence
ctccacggctcctgggggcg

SEQ ID NO: 764600 - DNA, 20 bp, Artificial
  CRISPR gRNA sequence
acggctcctgggggcggggt

SEQ ID NO: 764601 - DNA, 20 bp, Artificial
  CRISPR gRNA sequence
ggctcctgggggcggggtca

SEQ ID NO: 764602 - DNA, 20 bp, Artificial
  CRISPR gRNA sequence
gctcctgggggcggggtcag

SEQ ID NO: 764603 - DNA, 20 bp, Artificial
  CRISPR gRNA sequence
ctcctgggggcggggtcaga

SEQ ID NO: 764604 - DNA, 20 bp, Artificial
  CRISPR gRNA sequence
tcctgggggcggggtcagag

SEQ ID NO: 764605 - DNA, 20 bp, Artificial
  CRISPR gRNA sequence
tgggggcggggtcagagggg

SEQ ID NO: 764606 - DNA, 20 bp, Artificial
  CRISPR gRNA sequence
gggggcggggtcagaggggc

SEQ ID NO: 764607 - DNA, 20 bp, Artificial
  CRISPR gRNA sequence
ggggcggggtcagaggggca

SEQ ID NO: 764608 - DNA, 20 bp, Artificial
  CRISPR gRNA sequence
gcggggtcagaggggcaggg

SEQ ID NO: 764609 - DNA, 20 bp, Artificial
  CRISPR gRNA sequence
ggtcagaggggcagggtggt

SEQ ID NO: 764610 - DNA, 20 bp, Artificial
  CRISPR gRNA sequence
gtcagaggggcagggtggtg

SEQ ID NO: 764611 - DNA, 20 bp, Artificial
  CRISPR gRNA sequence
cagaggggcagggtggtgag

SEQ ID NO: 764612 - DNA, 20 bp, Artificial
  CRISPR gRNA sequence
ggcagggtggtgaggagaaa

SEQ ID NO: 764613 - DNA, 20 bp, Artificial
  CRISPR gRNA sequence
gcagggtggtgaggagaaat

SEQ ID NO: 764614 - DNA, 20 bp, Artificial
  CRISPR gRNA sequence
tgaggagaaatgggactctc

SEQ ID NO: 764615 - DNA, 20 bp, Artificial
  CRISPR gRNA sequence
gaggagaaatgggactctct

SEQ ID NO: 764616 - DNA, 20 bp, Artificial
  CRISPR gRNA sequence
gactctctaggctaccaccc

SEQ ID NO: 764617 - DNA, 20 bp, Artificial
  CRISPR gRNA sequence
actcttcccccatcaattcc

SEQ ID NO: 764618 - DNA, 20 bp, Artificial
  CRISPR gRNA sequence
ccatcttcctattttcttct

SEQ ID NO: 764619 - DNA, 20 bp, Artificial
  CRISPR gRNA sequence
tattttcttcttagatgcaa

SEQ ID NO: 764620 - DNA, 20 bp, Artificial
  CRISPR gRNA sequence
tttcttcttagatgcaaaag

SEQ ID NO: 764621 - DNA, 20 bp, Artificial
  CRISPR gRNA sequence
cttagatgcaaaagcagatt

SEQ ID NO: 764622 - DNA, 20 bp, Artificial
  CRISPR gRNA sequence
tgcaaaagcagattaagtct

SEQ ID NO: 764623 - DNA, 20 bp, Artificial
  CRISPR gRNA sequence
gcaaaagcagattaagtctg

SEQ ID NO: 764624 - DNA, 20 bp, Artificial
  CRISPR gRNA sequence
agattaagtctgaggactct

SEQ ID NO: 764625 - DNA, 20 bp, Artificial
  CRISPR gRNA sequence
agtctgaggactctcagata

SEQ ID NO: 764626 - DNA, 20 bp, Artificial
  CRISPR gRNA sequence
tctgaggactctcagatatg

SEQ ID NO: 764627 - DNA, 20 bp, Artificial
  CRISPR gRNA sequence
tggagtctccccaatcttct

SEQ ID NO: 764628 - DNA, 20 bp, Artificial
  CRISPR gRNA sequence
caatcttctgagaacaatca

SEQ ID NO: 764629 - DNA, 20 bp, Artificial
  CRISPR gRNA sequence
tcttctgagaacaatcacag

SEQ ID NO: 764630 - DNA, 20 bp, Artificial
  CRISPR gRNA sequence
cttctgagaacaatcacagc

SEQ ID NO: 764631 - DNA, 20 bp, Artificial
  CRISPR gRNA sequence
ctgagaacaatcacagcagg

SEQ ID NO: 764632 - DNA, 20 bp, Artificial
  CRISPR gRNA sequence
tgagaacaatcacagcaggt

SEQ ID NO: 764633 - DNA, 20 bp, Artificial
  CRISPR gRNA sequence
caatcacagcaggtgggtct

SEQ ID NO: 764634 - DNA, 20 bp, Artificial
  CRISPR gRNA sequence
caggtgggtcttggcctgac

SEQ ID NO: 764635 - DNA, 20 bp, Artificial
  CRISPR gRNA sequence
tggcctgaccagaccaatcc

SEQ ID NO: 764636 - DNA, 20 bp, Artificial
  CRISPR gRNA sequence
ggcctgaccagaccaatccc

SEQ ID NO: 764637 - DNA, 20 bp, Artificial
  CRISPR gRNA sequence
gcctgaccagaccaatccca

SEQ ID NO: 764638 - DNA, 20 bp, Artificial
  CRISPR gRNA sequence
gaccagaccaatcccagggc

SEQ ID NO: 764639 - DNA, 20 bp, Artificial
  CRISPR gRNA sequence
accagaccaatcccagggcc

SEQ ID NO: 764640 - DNA, 20 bp, Artificial
  CRISPR gRNA sequence
accaatcccagggccaggcc

SEQ ID NO: 764641 - DNA, 20 bp, Artificial
  CRISPR gRNA sequence
ccaatcccagggccaggcct

SEQ ID NO: 764642 - DNA, 20 bp, Artificial
  CRISPR gRNA sequence
caatcccagggccaggcctg

SEQ ID NO: 764643 - DNA, 20 bp, Artificial
  CRISPR gRNA sequence
tcccagggccaggcctgggg

SEQ ID NO: 764644 - DNA, 20 bp, Artificial
  CRISPR gRNA sequence
cccagggccaggcctggggc

SEQ ID NO: 764645 - DNA, 20 bp, Artificial
  CRISPR gRNA sequence
ctggggcaggtgactctcac

SEQ ID NO: 764646 - DNA, 20 bp, Artificial
  CRISPR gRNA sequence
caggtgactctcaccagctc

SEQ ID NO: 764647 - DNA, 20 bp, Artificial
  CRISPR gRNA sequence
actctcaccagctccagccc

SEQ ID NO: 764648 - DNA, 20 bp, Artificial
  CRISPR gRNA sequence
gccctggtgaatcctgccat

SEQ ID NO: 764649 - DNA, 20 bp, Artificial
  CRISPR gRNA sequence
ccctggtgaatcctgccatc

SEQ ID NO: 764650 - DNA, 20 bp, Artificial
  CRISPR gRNA sequence
cgcccacccctctgctgacc

SEQ ID NO: 764651 - DNA, 20 bp, Artificial
  CRISPR gRNA sequence
cccctctgctgacccagatg

SEQ ID NO: 764652 - DNA, 20 bp, Artificial
  CRISPR gRNA sequence
agatgtggctccattcttcc

SEQ ID NO: 764653 - DNA, 20 bp, Artificial
  CRISPR gRNA sequence
atgtggctccattcttccca

SEQ ID NO: 764654 - DNA, 20 bp, Artificial
  CRISPR gRNA sequence
tgtggctccattcttcccag

SEQ ID NO: 764655 - DNA, 20 bp, Artificial
  CRISPR gRNA sequence
ccattcttcccagaggcttc

SEQ ID NO: 764656 - DNA, 20 bp, Artificial
  CRISPR gRNA sequence
attcttcccagaggcttcca

SEQ ID NO: 764657 - DNA, 20 bp, Artificial
  CRISPR gRNA sequence
cagaggcttccagagccttg

SEQ ID NO: 764658 - DNA, 20 bp, Artificial
  CRISPR gRNA sequence
ggcttccagagccttgaagt

SEQ ID NO: 764659 - DNA, 20 bp, Artificial
  CRISPR gRNA sequence
gcttccagagccttgaagtc

SEQ ID NO: 764660 - DNA, 20 bp, Artificial
  CRISPR gRNA sequence
ttccagagccttgaagtcag

SEQ ID NO: 764661 - DNA, 20 bp, Artificial
  CRISPR gRNA sequence
ccagagccttgaagtcagga

SEQ ID NO: 764662 - DNA, 20 bp, Artificial
  CRISPR gRNA sequence
cttgaagtcaggagagcctt

SEQ ID NO: 764663 - DNA, 20 bp, Artificial
  CRISPR gRNA sequence
gaagtcaggagagccttaag

SEQ ID NO: 764664 - DNA, 20 bp, Artificial
  CRISPR gRNA sequence
aagtcaggagagccttaaga

SEQ ID NO: 764665 - DNA, 20 bp, Artificial
  CRISPR gRNA sequence
ttctccgcccccaacccctc

SEQ ID NO: 764666 - DNA, 20 bp, Artificial
  CRISPR gRNA sequence
gttatctttctccctatcat

SEQ ID NO: 764667 - DNA, 20 bp, Artificial
  CRISPR gRNA sequence
ttatctttctccctatcatt

SEQ ID NO: 764668 - DNA, 20 bp, Artificial
  CRISPR gRNA sequence
atctttctccctatcattag

SEQ ID NO: 764669 - DNA, 20 bp, Artificial
  CRISPR gRNA sequence
tctttctccctatcattagg

SEQ ID NO: 764670 - DNA, 20 bp, Artificial
  CRISPR gRNA sequence
taggaggcaacttgctgttc

SEQ ID NO: 764671 - DNA, 20 bp, Artificial
  CRISPR gRNA sequence
aggaggcaacttgctgttct

SEQ ID NO: 764672 - DNA, 20 bp, Artificial
  CRISPR gRNA sequence
gaggcaacttgctgttctgg

SEQ ID NO: 764673 - DNA, 20 bp, Artificial
  CRISPR gRNA sequence
cttgctgttctgggagattg

SEQ ID NO: 764674 - DNA, 20 bp, Artificial
  CRISPR gRNA sequence
ttgctgttctgggagattga

SEQ ID NO: 764675 - DNA, 20 bp, Artificial
  CRISPR gRNA sequence
ctgttctgggagattgaagg

SEQ ID NO: 764676 - DNA, 20 bp, Artificial
  CRISPR gRNA sequence
tgttctgggagattgaaggt

SEQ ID NO: 764677 - DNA, 20 bp, Artificial
  CRISPR gRNA sequence
gttctgggagattgaaggtg

SEQ ID NO: 764678 - DNA, 20 bp, Artificial
  CRISPR gRNA sequence
tgggagattgaaggtggggc

SEQ ID NO: 764679 - DNA, 20 bp, Artificial
  CRISPR gRNA sequence
attgaaggtggggccagatt

SEQ ID NO: 764680 - DNA, 20 bp, Artificial
  CRISPR gRNA sequence
tgaaggtggggccagattcg

SEQ ID NO: 764681 - DNA, 20 bp, Artificial
  CRISPR gRNA sequence
gagctcccaacccctgccga

SEQ ID NO: 764682 - DNA, 20 bp, Artificial
  CRISPR gRNA sequence
ctcccaacccctgccgacag

SEQ ID NO: 764683 - DNA, 20 bp, Artificial
  CRISPR gRNA sequence
ccaacccctgccgacagaag

SEQ ID NO: 764684 - DNA, 20 bp, Artificial
  CRISPR gRNA sequence
aagcagaacccccctccccc

SEQ ID NO: 764685 - DNA, 20 bp, Artificial
  CRISPR gRNA sequence
agcagaacccccctccccca

SEQ ID NO: 764686 - DNA, 20 bp, Artificial
  CRISPR gRNA sequence
gcagaacccccctcccccaa

SEQ ID NO: 764687 - DNA, 20 bp, Artificial
  CRISPR gRNA sequence
cagaacccccctcccccaag

SEQ ID NO: 764688 - DNA, 20 bp, Artificial
  CRISPR gRNA sequence
cctcccccaaggggacattt

SEQ ID NO: 764689 - DNA, 20 bp, Artificial
  CRISPR gRNA sequence
cccaaggggacatttaagca

SEQ ID NO: 764690 - DNA, 20 bp, Artificial
  CRISPR gRNA sequence
catttaagcaaagcaacctg

SEQ ID NO: 764691 - DNA, 20 bp, Artificial
  CRISPR gRNA sequence
atttaagcaaagcaacctgt

SEQ ID NO: 764692 - DNA, 20 bp, Artificial
  CRISPR gRNA sequence
tttaagcaaagcaacctgtg

SEQ ID NO: 764693 - DNA, 20 bp, Artificial
  CRISPR gRNA sequence
agcaacctgtggggcttctc

SEQ ID NO: 764694 - DNA, 20 bp, Artificial
  CRISPR gRNA sequence
gcaacctgtggggcttctct

SEQ ID NO: 764695 - DNA, 20 bp, Artificial
  CRISPR gRNA sequence
caacctgtggggcttctctg

SEQ ID NO: 764696 - DNA, 20 bp, Artificial
  CRISPR gRNA sequence
ggggcttctctggggtgtga

SEQ ID NO: 764697 - DNA, 20 bp, Artificial
  CRISPR gRNA sequence
tctctggggtgtgatggtga

SEQ ID NO: 764698 - DNA, 20 bp, Artificial
  CRISPR gRNA sequence
tctggggtgtgatggtgaca

SEQ ID NO: 764699 - DNA, 20 bp, Artificial
  CRISPR gRNA sequence
gagctgtgcgcatcctgctg

SEQ ID NO: 764700 - DNA, 20 bp, Artificial
  CRISPR gRNA sequence
gtgcgcatcctgctgcagca

SEQ ID NO: 764701 - DNA, 20 bp, Artificial
  CRISPR gRNA sequence
tgcgcatcctgctgcagcac

SEQ ID NO: 764702 - DNA, 20 bp, Artificial
  CRISPR gRNA sequence
gcgcatcctgctgcagcacg

SEQ ID NO: 764703 - DNA, 20 bp, Artificial
  CRISPR gRNA sequence
tgcagcacggggttgcgcac

SEQ ID NO: 764704 - DNA, 20 bp, Artificial
  CRISPR gRNA sequence
gcagcacggggttgcgcacc

SEQ ID NO: 764705 - DNA, 20 bp, Artificial
  CRISPR gRNA sequence
gcacggggttgcgcaccagg

SEQ ID NO: 764706 - DNA, 20 bp, Artificial
  CRISPR gRNA sequence
ggttgcgcaccaggcagctg

SEQ ID NO: 764707 - DNA, 20 bp, Artificial
  CRISPR gRNA sequence
gttgcgcaccaggcagctgt

SEQ ID NO: 764708 - DNA, 20 bp, Artificial
  CRISPR gRNA sequence
ctgtaggtgccatttgcacc

SEQ ID NO: 764709 - DNA, 20 bp, Artificial
  CRISPR gRNA sequence
tttgcacccagcaccacccg

SEQ ID NO: 764710 - DNA, 20 bp, Artificial
  CRISPR gRNA sequence
ttgcacccagcaccacccgc

SEQ ID NO: 764711 - DNA, 20 bp, Artificial
  CRISPR gRNA sequence
ggatgctgtgcacatcaaac

SEQ ID NO: 764712 - DNA, 20 bp, Artificial
  CRISPR gRNA sequence
atcaaacaagccctgctcgt

SEQ ID NO: 764713 - DNA, 20 bp, Artificial
  CRISPR gRNA sequence
ctcgttggccatctgcgacg

SEQ ID NO: 764714 - DNA, 20 bp, Artificial
  CRISPR gRNA sequence
ctgcgacgtggtcacgttgc

SEQ ID NO: 764715 - DNA, 20 bp, Artificial
  CRISPR gRNA sequence
gacgtggtcacgttgccagt

SEQ ID NO: 764716 - DNA, 20 bp, Artificial
  CRISPR gRNA sequence
acgtggtcacgttgccagtc

SEQ ID NO: 764717 - DNA, 20 bp, Artificial
  CRISPR gRNA sequence
cgtggtcacgttgccagtca

SEQ ID NO: 764718 - DNA, 20 bp, Artificial
  CRISPR gRNA sequence
gtggtcacgttgccagtcag

SEQ ID NO: 764719 - DNA, 20 bp, Artificial
  CRISPR gRNA sequence
gcacaccctgcccatcctgc

SEQ ID NO: 764720 - DNA, 20 bp, Artificial
  CRISPR gRNA sequence
cccatcctgccagaacacct

SEQ ID NO: 764721 - DNA, 20 bp, Artificial
  CRISPR gRNA sequence
ctgccagaacacctcagcct

SEQ ID NO: 764722 - DNA, 20 bp, Artificial
  CRISPR gRNA sequence
tgccagaacacctcagcctc

SEQ ID NO: 764723 - DNA, 20 bp, Artificial
  CRISPR gRNA sequence
gccagaacacctcagcctca

SEQ ID NO: 764724 - DNA, 20 bp, Artificial
  CRISPR gRNA sequence
agaacacctcagcctcaggg

SEQ ID NO: 764725 - DNA, 20 bp, Artificial
  CRISPR gRNA sequence
cctcagcctcagggtagccc

SEQ ID NO: 764726 - DNA, 20 bp, Artificial
  CRISPR gRNA sequence
cagcctcagggtagccctgg

SEQ ID NO: 764727 - DNA, 20 bp, Artificial
  CRISPR gRNA sequence
ctcagggtagccctggtagc

SEQ ID NO: 764728 - DNA, 20 bp, Artificial
  CRISPR gRNA sequence
cagggtagccctggtagctg

SEQ ID NO: 764729 - DNA, 20 bp, Artificial
  CRISPR gRNA sequence
ctggtagctggagcacgtga

SEQ ID NO: 764730 - DNA, 20 bp, Artificial
  CRISPR gRNA sequence
gtgatggtcaccgtgtcccc

SEQ ID NO: 764731 - DNA, 20 bp, Artificial
  CRISPR gRNA sequence
gtcaccgtgtcccctggccg

SEQ ID NO: 764732 - DNA, 20 bp, Artificial
  CRISPR gRNA sequence
tcaccgtgtcccctggccgc

SEQ ID NO: 764733 - DNA, 20 bp, Artificial
  CRISPR gRNA sequence
ccctggccgcaggtccttgt

SEQ ID NO: 764734 - DNA, 20 bp, Artificial
  CRISPR gRNA sequence
cctggccgcaggtccttgtt

SEQ ID NO: 764735 - DNA, 20 bp, Artificial
  CRISPR gRNA sequence
cgcaggtccttgttgggctc

SEQ ID NO: 764736 - DNA, 20 bp, Artificial
  CRISPR gRNA sequence
gcaggtccttgttgggctcc

SEQ ID NO: 764737 - DNA, 20 bp, Artificial
  CRISPR gRNA sequence
caggtccttgttgggctcca

SEQ ID NO: 764738 - DNA, 20 bp, Artificial
  CRISPR gRNA sequence
gttgggctccagggtcatgc

SEQ ID NO: 764739 - DNA, 20 bp, Artificial
  CRISPR gRNA sequence
ttgggctccagggtcatgct

SEQ ID NO: 764740 - DNA, 20 bp, Artificial
  CRISPR gRNA sequence
ccagggtcatgctgggcttc

SEQ ID NO: 764741 - DNA, 20 bp, Artificial
  CRISPR gRNA sequence
gggtcatgctgggcttcgag

SEQ ID NO: 764742 - DNA, 20 bp, Artificial
  CRISPR gRNA sequence
ggtcatgctgggcttcgagt

SEQ ID NO: 764743 - DNA, 20 bp, Artificial
  CRISPR gRNA sequence
gtcatgctgggcttcgagta

SEQ ID NO: 764744 - DNA, 20 bp, Artificial
  CRISPR gRNA sequence
catgctgggcttcgagtagg

SEQ ID NO: 764745 - DNA, 20 bp, Artificial
  CRISPR gRNA sequence
ctgggcttcgagtagggagc

SEQ ID NO: 764746 - DNA, 20 bp, Artificial
  CRISPR gRNA sequence
gggcttcgagtagggagctg

SEQ ID NO: 764747 - DNA, 20 bp, Artificial
  CRISPR gRNA sequence
ggcttcgagtagggagctgg

SEQ ID NO: 764748 - DNA, 20 bp, Artificial
  CRISPR gRNA sequence
gagtagggagctggaggtga

SEQ ID NO: 764749 - DNA, 20 bp, Artificial
  CRISPR gRNA sequence
gtagggagctggaggtgaca

SEQ ID NO: 764750 - DNA, 20 bp, Artificial
  CRISPR gRNA sequence
tagggagctggaggtgacag

SEQ ID NO: 764751 - DNA, 20 bp, Artificial
  CRISPR gRNA sequence
agggagctggaggtgacaga

SEQ ID NO: 764752 - DNA, 20 bp, Artificial
  CRISPR gRNA sequence
gagctggaggtgacagaggg

SEQ ID NO: 764753 - DNA, 20 bp, Artificial
  CRISPR gRNA sequence
agctggaggtgacagagggc

SEQ ID NO: 764754 - DNA, 20 bp, Artificial
  CRISPR gRNA sequence
gctggaggtgacagagggca

SEQ ID NO: 764755 - DNA, 20 bp, Artificial
  CRISPR gRNA sequence
ctggaggtgacagagggcag

SEQ ID NO: 764756 - DNA, 20 bp, Artificial
  CRISPR gRNA sequence
ggtgacagagggcaggggtc

SEQ ID NO: 764757 - DNA, 20 bp, Artificial
  CRISPR gRNA sequence
gtgacagagggcaggggtca

SEQ ID NO: 764758 - DNA, 20 bp, Artificial
  CRISPR gRNA sequence
tgacagagggcaggggtcaa

SEQ ID NO: 764759 - DNA, 20 bp, Artificial
  CRISPR gRNA sequence
cagagggcaggggtcaaggg

SEQ ID NO: 764760 - DNA, 20 bp, Artificial
  CRISPR gRNA sequence
agagggcaggggtcaagggc

SEQ ID NO: 764761 - DNA, 20 bp, Artificial
  CRISPR gRNA sequence
gagggcaggggtcaagggca

SEQ ID NO: 764762 - DNA, 20 bp, Artificial
  CRISPR gRNA sequence
aggggtcaagggcagggcaa

SEQ ID NO: 764763 - DNA, 20 bp, Artificial
  CRISPR gRNA sequence
ggtcaagggcagggcaatgg

SEQ ID NO: 764764 - DNA, 20 bp, Artificial
  CRISPR gRNA sequence
tcaagggcagggcaatggca

SEQ ID NO: 764765 - DNA, 20 bp, Artificial
  CRISPR gRNA sequence
caagggcagggcaatggcag

SEQ ID NO: 764766 - DNA, 20 bp, Artificial
  CRISPR gRNA sequence
gggcaatggcagaggacgaa

SEQ ID NO: 764767 - DNA, 20 bp, Artificial
  CRISPR gRNA sequence
ggcaatggcagaggacgaaa

SEQ ID NO: 764768 - DNA, 20 bp, Artificial
  CRISPR gRNA sequence
cagaggacgaaaaggatgca

SEQ ID NO: 764769 - DNA, 20 bp, Artificial
  CRISPR gRNA sequence
agaggacgaaaaggatgcat

SEQ ID NO: 764770 - DNA, 20 bp, Artificial
  CRISPR gRNA sequence
gaggacgaaaaggatgcatg

SEQ ID NO: 764771 - DNA, 20 bp, Artificial
  CRISPR gRNA sequence
cgaaaaggatgcatggggct

SEQ ID NO: 764772 - DNA, 20 bp, Artificial
  CRISPR gRNA sequence
aggatgcatggggctgagta

SEQ ID NO: 764773 - DNA, 20 bp, Artificial
  CRISPR gRNA sequence
ggatgcatggggctgagtac

SEQ ID NO: 764774 - DNA, 20 bp, Artificial
  CRISPR gRNA sequence
atggggctgagtacaggaat

SEQ ID NO: 764775 - DNA, 20 bp, Artificial
  CRISPR gRNA sequence
ctgagtacaggaatcagcac

SEQ ID NO: 764776 - DNA, 20 bp, Artificial
  CRISPR gRNA sequence
tgagtacaggaatcagcact

SEQ ID NO: 764777 - DNA, 20 bp, Artificial
  CRISPR gRNA sequence
gagtacaggaatcagcactg

SEQ ID NO: 764778 - DNA, 20 bp, Artificial
  CRISPR gRNA sequence
aggaatcagcactggggttc

SEQ ID NO: 764779 - DNA, 20 bp, Artificial
  CRISPR gRNA sequence
ggaatcagcactggggttct

SEQ ID NO: 764780 - DNA, 20 bp, Artificial
  CRISPR gRNA sequence
aatcagcactggggttctgg

SEQ ID NO: 764781 - DNA, 20 bp, Artificial
  CRISPR gRNA sequence
cagcactggggttctgggag

SEQ ID NO: 764782 - DNA, 20 bp, Artificial
  CRISPR gRNA sequence
cactggggttctgggagcag

SEQ ID NO: 764783 - DNA, 20 bp, Artificial
  CRISPR gRNA sequence
gggttctgggagcagtggtg

SEQ ID NO: 764784 - DNA, 20 bp, Artificial
  CRISPR gRNA sequence
ttctgggagcagtggtgcag

SEQ ID NO: 764785 - DNA, 20 bp, Artificial
  CRISPR gRNA sequence
tctgggagcagtggtgcagc

SEQ ID NO: 764786 - DNA, 20 bp, Artificial
  CRISPR gRNA sequence
ctgggagcagtggtgcagca

SEQ ID NO: 764787 - DNA, 20 bp, Artificial
  CRISPR gRNA sequence
tgggagcagtggtgcagcag

SEQ ID NO: 764788 - DNA, 20 bp, Artificial
  CRISPR gRNA sequence
gggagcagtggtgcagcagg

SEQ ID NO: 764789 - DNA, 20 bp, Artificial
  CRISPR gRNA sequence
agcagtggtgcagcaggggg

SEQ ID NO: 764790 - DNA, 20 bp, Artificial
  CRISPR gRNA sequence
gcagtggtgcagcagggggt

SEQ ID NO: 764791 - DNA, 20 bp, Artificial
  CRISPR gRNA sequence
gtgcagcagggggtgggctg

SEQ ID NO: 764792 - DNA, 20 bp, Artificial
  CRISPR gRNA sequence
tgcagcagggggtgggctgc

SEQ ID NO: 764793 - DNA, 20 bp, Artificial
  CRISPR gRNA sequence
gcagcagggggtgggctgca

SEQ ID NO: 764794 - DNA, 20 bp, Artificial
  CRISPR gRNA sequence
cagcagggggtgggctgcag

SEQ ID NO: 764795 - DNA, 20 bp, Artificial
  CRISPR gRNA sequence
agcagggggtgggctgcagg

SEQ ID NO: 764796 - DNA, 20 bp, Artificial
  CRISPR gRNA sequence
ggggtgggctgcagggggaa

SEQ ID NO: 764797 - DNA, 20 bp, Artificial
  CRISPR gRNA sequence
ggtgggctgcagggggaatg

SEQ ID NO: 764798 - DNA, 20 bp, Artificial
  CRISPR gRNA sequence
gtgggctgcagggggaatgg

SEQ ID NO: 764799 - DNA, 20 bp, Artificial
  CRISPR gRNA sequence
tgggctgcagggggaatgga

SEQ ID NO: 764800 - DNA, 20 bp, Artificial
  CRISPR gRNA sequence
gggggaatggagggtgaact

SEQ ID NO: 764801 - DNA, 20 bp, Artificial
  CRISPR gRNA sequence
ggggaatggagggtgaacta

SEQ ID NO: 764802 - DNA, 20 bp, Artificial
  CRISPR gRNA sequence
gggaatggagggtgaactaa

SEQ ID NO: 764803 - DNA, 20 bp, Artificial
  CRISPR gRNA sequence
ggaatggagggtgaactaag

SEQ ID NO: 764804 - DNA, 20 bp, Artificial
  CRISPR gRNA sequence
atggagggtgaactaagggg

SEQ ID NO: 764805 - DNA, 20 bp, Artificial
  CRISPR gRNA sequence
tggagggtgaactaagggga

SEQ ID NO: 764806 - DNA, 20 bp, Artificial
  CRISPR gRNA sequence
aggggaaggcgtccccctcc

SEQ ID NO: 764807 - DNA, 20 bp, Artificial
  CRISPR gRNA sequence
gtccccctcctggtgctcac

SEQ ID NO: 764808 - DNA, 20 bp, Artificial
  CRISPR gRNA sequence
tggtgctcaccggccacctg

SEQ ID NO: 764809 - DNA, 20 bp, Artificial
  CRISPR gRNA sequence
ggtgctcaccggccacctgc

SEQ ID NO: 764810 - DNA, 20 bp, Artificial
  CRISPR gRNA sequence
accggccacctgcaggctga

SEQ ID NO: 764811 - DNA, 20 bp, Artificial
  CRISPR gRNA sequence
ggccacctgcaggctgacgg

SEQ ID NO: 764812 - DNA, 20 bp, Artificial
  CRISPR gRNA sequence
cggcagcgctgccgaaatcc

SEQ ID NO: 764813 - DNA, 20 bp, Artificial
  CRISPR gRNA sequence
cgaaatcccggatgctcacg

SEQ ID NO: 764814 - DNA, 20 bp, Artificial
  CRISPR gRNA sequence
aatcccggatgctcacgaag

SEQ ID NO: 764815 - DNA, 20 bp, Artificial
  CRISPR gRNA sequence
atcccggatgctcacgaagc

SEQ ID NO: 764816 - DNA, 20 bp, Artificial
  CRISPR gRNA sequence
ggatgctcacgaagcaggtg

SEQ ID NO: 764817 - DNA, 20 bp, Artificial
  CRISPR gRNA sequence
tccgccacacgcacgcgctg

SEQ ID NO: 764818 - DNA, 20 bp, Artificial
  CRISPR gRNA sequence
acacgcacgcgctgcagcct

SEQ ID NO: 764819 - DNA, 20 bp, Artificial
  CRISPR gRNA sequence
cacgcacgcgctgcagcctc

SEQ ID NO: 764820 - DNA, 20 bp, Artificial
  CRISPR gRNA sequence
acgcacgcgctgcagcctca

SEQ ID NO: 764821 - DNA, 20 bp, Artificial
  CRISPR gRNA sequence
agggatgcgttgccctgtgc

SEQ ID NO: 764822 - DNA, 20 bp, Artificial
  CRISPR gRNA sequence
gatgcgttgccctgtgccag

SEQ ID NO: 764823 - DNA, 20 bp, Artificial
  CRISPR gRNA sequence
atgcgttgccctgtgccagc

SEQ ID NO: 764824 - DNA, 20 bp, Artificial
  CRISPR gRNA sequence
ttgccctgtgccagcaggtc

SEQ ID NO: 764825 - DNA, 20 bp, Artificial
  CRISPR gRNA sequence
tgccctgtgccagcaggtcc

SEQ ID NO: 764826 - DNA, 20 bp, Artificial
  CRISPR gRNA sequence
cctgtgccagcaggtccggg

SEQ ID NO: 764827 - DNA, 20 bp, Artificial
  CRISPR gRNA sequence
tgtgccagcaggtccgggaa

SEQ ID NO: 764828 - DNA, 20 bp, Artificial
  CRISPR gRNA sequence
gtgccagcaggtccgggaag

SEQ ID NO: 764829 - DNA, 20 bp, Artificial
  CRISPR gRNA sequence
tgccagcaggtccgggaaga

SEQ ID NO: 764830 - DNA, 20 bp, Artificial
  CRISPR gRNA sequence
ggtccgggaagagggccgtg

SEQ ID NO: 764831 - DNA, 20 bp, Artificial
  CRISPR gRNA sequence
cgggaagagggccgtgcggt

SEQ ID NO: 764832 - DNA, 20 bp, Artificial
  CRISPR gRNA sequence
agagggccgtgcggttggca

SEQ ID NO: 764833 - DNA, 20 bp, Artificial
  CRISPR gRNA sequence
gagggccgtgcggttggcat

SEQ ID NO: 764834 - DNA, 20 bp, Artificial
  CRISPR gRNA sequence
ggttggcataggcgctgccc

SEQ ID NO: 764835 - DNA, 20 bp, Artificial
  CRISPR gRNA sequence
cataggcgctgccctggtcc

SEQ ID NO: 764836 - DNA, 20 bp, Artificial
  CRISPR gRNA sequence
gctgccctggtcctggccct

SEQ ID NO: 764837 - DNA, 20 bp, Artificial
  CRISPR gRNA sequence
cctggtcctggccctcagca

SEQ ID NO: 764838 - DNA, 20 bp, Artificial
  CRISPR gRNA sequence
ccctcagcaaagctgtgcac

SEQ ID NO: 764839 - DNA, 20 bp, Artificial
  CRISPR gRNA sequence
aaagctgtgcaccagctgtt

SEQ ID NO: 764840 - DNA, 20 bp, Artificial
  CRISPR gRNA sequence
accagctgtttggtatctgt

SEQ ID NO: 764841 - DNA, 20 bp, Artificial
  CRISPR gRNA sequence
gtttggtatctgtcagctgc

SEQ ID NO: 764842 - DNA, 20 bp, Artificial
  CRISPR gRNA sequence
gtatctgtcagctgccagat

SEQ ID NO: 764843 - DNA, 20 bp, Artificial
  CRISPR gRNA sequence
tatctgtcagctgccagatg

SEQ ID NO: 764844 - DNA, 20 bp, Artificial
  CRISPR gRNA sequence
gtcagctgccagatgaggtt

SEQ ID NO: 764845 - DNA, 20 bp, Artificial
  CRISPR gRNA sequence
cagatgaggttgagctgtgc

SEQ ID NO: 764846 - DNA, 20 bp, Artificial
  CRISPR gRNA sequence
agatgaggttgagctgtgcc

SEQ ID NO: 764847 - DNA, 20 bp, Artificial
  CRISPR gRNA sequence
ggttgagctgtgccaggctg

SEQ ID NO: 764848 - DNA, 20 bp, Artificial
  CRISPR gRNA sequence
gagctgtgccaggctgaagc

SEQ ID NO: 764849 - DNA, 20 bp, Artificial
  CRISPR gRNA sequence
agctgtgccaggctgaagcc

SEQ ID NO: 764850 - DNA, 20 bp, Artificial
  CRISPR gRNA sequence
tgccaggctgaagccaggct

SEQ ID NO: 764851 - DNA, 20 bp, Artificial
  CRISPR gRNA sequence
gccaggctgaagccaggctc

SEQ ID NO: 764852 - DNA, 20 bp, Artificial
  CRISPR gRNA sequence
ccaggctgaagccaggctca

SEQ ID NO: 764853 - DNA, 20 bp, Artificial
  CRISPR gRNA sequence
caggctgaagccaggctcag

SEQ ID NO: 764854 - DNA, 20 bp, Artificial
  CRISPR gRNA sequence
ggctgaagccaggctcaggg

SEQ ID NO: 764855 - DNA, 20 bp, Artificial
  CRISPR gRNA sequence
tgaagccaggctcaggggag

SEQ ID NO: 764856 - DNA, 20 bp, Artificial
  CRISPR gRNA sequence
gaagccaggctcaggggaga

SEQ ID NO: 764857 - DNA, 20 bp, Artificial
  CRISPR gRNA sequence
agccaggctcaggggagaag

SEQ ID NO: 764858 - DNA, 20 bp, Artificial
  CRISPR gRNA sequence
caggctcaggggagaaggag

SEQ ID NO: 764859 - DNA, 20 bp, Artificial
  CRISPR gRNA sequence
tcaggggagaaggagcagca

SEQ ID NO: 764860 - DNA, 20 bp, Artificial
  CRISPR gRNA sequence
caggggagaaggagcagcac

SEQ ID NO: 764861 - DNA, 20 bp, Artificial
  CRISPR gRNA sequence
aggggagaaggagcagcaca

SEQ ID NO: 764862 - DNA, 20 bp, Artificial
  CRISPR gRNA sequence
ggagaaggagcagcacaggg

SEQ ID NO: 764863 - DNA, 20 bp, Artificial
  CRISPR gRNA sequence
ggagcagcacagggtggcat

SEQ ID NO: 764864 - DNA, 20 bp, Artificial
  CRISPR gRNA sequence
agggtggcatcggtgcccac

SEQ ID NO: 764865 - DNA, 20 bp, Artificial
  CRISPR gRNA sequence
gtgcccaccagtgccaccac

SEQ ID NO: 764866 - DNA, 20 bp, Artificial
  CRISPR gRNA sequence
tgcccaccagtgccaccact

SEQ ID NO: 764867 - DNA, 20 bp, Artificial
  CRISPR gRNA sequence
cagtgccaccactgggtctt

SEQ ID NO: 764868 - DNA, 20 bp, Artificial
  CRISPR gRNA sequence
agtgccaccactgggtcttc

SEQ ID NO: 764869 - DNA, 20 bp, Artificial
  CRISPR gRNA sequence
gtgccaccactgggtcttca

SEQ ID NO: 764870 - DNA, 20 bp, Artificial
  CRISPR gRNA sequence
ccactgggtcttcagggacc

SEQ ID NO: 764871 - DNA, 20 bp, Artificial
  CRISPR gRNA sequence
tcttcagggacctggacctc

SEQ ID NO: 764872 - DNA, 20 bp, Artificial
  CRISPR gRNA sequence
cttcagggacctggacctcc

SEQ ID NO: 764873 - DNA, 20 bp, Artificial
  CRISPR gRNA sequence
ttcagggacctggacctcca

SEQ ID NO: 764874 - DNA, 20 bp, Artificial
  CRISPR gRNA sequence
acctggacctccagggctcc

SEQ ID NO: 764875 - DNA, 20 bp, Artificial
  CRISPR gRNA sequence
cctggacctccagggctcct

SEQ ID NO: 764876 - DNA, 20 bp, Artificial
  CRISPR gRNA sequence
ctggacctccagggctcctg

SEQ ID NO: 764877 - DNA, 20 bp, Artificial
  CRISPR gRNA sequence
tggacctccagggctcctgg

SEQ ID NO: 764878 - DNA, 20 bp, Artificial
  CRISPR gRNA sequence
acctccagggctcctggggg

SEQ ID NO: 764879 - DNA, 20 bp, Artificial
  CRISPR gRNA sequence
cctccagggctcctgggggt

SEQ ID NO: 764880 - DNA, 20 bp, Artificial
  CRISPR gRNA sequence
ctccagggctcctgggggta

SEQ ID NO: 764881 - DNA, 20 bp, Artificial
  CRISPR gRNA sequence
tccagggctcctgggggtag

SEQ ID NO: 764882 - DNA, 20 bp, Artificial
  CRISPR gRNA sequence
ccagggctcctgggggtagg

SEQ ID NO: 764883 - DNA, 20 bp, Artificial
  CRISPR gRNA sequence
agggctcctgggggtagggg

SEQ ID NO: 764884 - DNA, 20 bp, Artificial
  CRISPR gRNA sequence
gctcctgggggtagggggag

SEQ ID NO: 764885 - DNA, 20 bp, Artificial
  CRISPR gRNA sequence
tcctgggggtagggggagtg

SEQ ID NO: 764886 - DNA, 20 bp, Artificial
  CRISPR gRNA sequence
agggggagtggagaacatat

SEQ ID NO: 764887 - DNA, 20 bp, Artificial
  CRISPR gRNA sequence
gggggagtggagaacatata

SEQ ID NO: 764888 - DNA, 20 bp, Artificial
  CRISPR gRNA sequence
ggggagtggagaacatataa

SEQ ID NO: 764889 - DNA, 20 bp, Artificial
  CRISPR gRNA sequence
gggagtggagaacatataag

SEQ ID NO: 764890 - DNA, 20 bp, Artificial
  CRISPR gRNA sequence
ggagtggagaacatataagg

SEQ ID NO: 764891 - DNA, 20 bp, Artificial
  CRISPR gRNA sequence
gagaacatataagggggact

SEQ ID NO: 764892 - DNA, 20 bp, Artificial
  CRISPR gRNA sequence
agaacatataagggggactg

SEQ ID NO: 764893 - DNA, 20 bp, Artificial
  CRISPR gRNA sequence
aacatataagggggactgag

SEQ ID NO: 764894 - DNA, 20 bp, Artificial
  CRISPR gRNA sequence
acatataagggggactgagg

SEQ ID NO: 764895 - DNA, 20 bp, Artificial
  CRISPR gRNA sequence
catataagggggactgagga

SEQ ID NO: 764896 - DNA, 20 bp, Artificial
  CRISPR gRNA sequence
atataagggggactgaggag

SEQ ID NO: 764897 - DNA, 20 bp, Artificial
  CRISPR gRNA sequence
taagggggactgaggagggg

SEQ ID NO: 764898 - DNA, 20 bp, Artificial
  CRISPR gRNA sequence
aagggggactgaggaggggt

SEQ ID NO: 764899 - DNA, 20 bp, Artificial
  CRISPR gRNA sequence
tgaggaggggtgggcctccc

SEQ ID NO: 764900 - DNA, 20 bp, Artificial
  CRISPR gRNA sequence
ctccctgcccctgctaaccc

SEQ ID NO: 764901 - DNA, 20 bp, Artificial
  CRISPR gRNA sequence
tccctgcccctgctaacccc

SEQ ID NO: 764902 - DNA, 20 bp, Artificial
  CRISPR gRNA sequence
gccctgtccacccctccttt

SEQ ID NO: 764903 - DNA, 20 bp, Artificial
  CRISPR gRNA sequence
ccctgtccacccctcctttt

SEQ ID NO: 764904 - DNA, 20 bp, Artificial
  CRISPR gRNA sequence
ccacccctccttttaggcct

SEQ ID NO: 764905 - DNA, 20 bp, Artificial
  CRISPR gRNA sequence
ccttttaggcctgagaccca

SEQ ID NO: 764906 - DNA, 20 bp, Artificial
  CRISPR gRNA sequence
cccaaagtaatttattgtct

SEQ ID NO: 764907 - DNA, 20 bp, Artificial
  CRISPR gRNA sequence
ccaaagtaatttattgtctt

SEQ ID NO: 764908 - DNA, 20 bp, Artificial
  CRISPR gRNA sequence
tattgtcttaggacctcatt

SEQ ID NO: 764909 - DNA, 20 bp, Artificial
  CRISPR gRNA sequence
tcttaggacctcattcagtc

SEQ ID NO: 764910 - DNA, 20 bp, Artificial
  CRISPR gRNA sequence
acctcattcagtcaagaata

SEQ ID NO: 764911 - DNA, 20 bp, Artificial
  CRISPR gRNA sequence
cattcagtcaagaatatagt

SEQ ID NO: 764912 - DNA, 20 bp, Artificial
  CRISPR gRNA sequence
aagaatatagtcagcaccta

SEQ ID NO: 764913 - DNA, 20 bp, Artificial
  CRISPR gRNA sequence
agaatatagtcagcacctac

SEQ ID NO: 764914 - DNA, 20 bp, Artificial
  CRISPR gRNA sequence
agtcagcacctacaggtgcc

SEQ ID NO: 764915 - DNA, 20 bp, Artificial
  CRISPR gRNA sequence
cctacaggtgccaagcataa

SEQ ID NO: 764916 - DNA, 20 bp, Artificial
  CRISPR gRNA sequence
caggtgccaagcataaaagt

SEQ ID NO: 764917 - DNA, 20 bp, Artificial
  CRISPR gRNA sequence
cataaaagtcagaaatgcaa

SEQ ID NO: 764918 - DNA, 20 bp, Artificial
  CRISPR gRNA sequence
taaaagtcagaaatgcaaca

SEQ ID NO: 764919 - DNA, 20 bp, Artificial
  CRISPR gRNA sequence
aaagtcagaaatgcaacaga

SEQ ID NO: 764920 - DNA, 20 bp, Artificial
  CRISPR gRNA sequence
tgcaacagagagcaatacta

SEQ ID NO: 764921 - DNA, 20 bp, Artificial
  CRISPR gRNA sequence
atactacggtcacatcccca

SEQ ID NO: 764922 - DNA, 20 bp, Artificial
  CRISPR gRNA sequence
ccacagaacttacattttaa

SEQ ID NO: 764923 - DNA, 20 bp, Artificial
  CRISPR gRNA sequence
cacagaacttacattttaat

SEQ ID NO: 764924 - DNA, 20 bp, Artificial
  CRISPR gRNA sequence
cagaacttacattttaatgg

SEQ ID NO: 764925 - DNA, 20 bp, Artificial
  CRISPR gRNA sequence
gaacttacattttaatggga

SEQ ID NO: 764926 - DNA, 20 bp, Artificial
  CRISPR gRNA sequence
acttacattttaatgggaga

SEQ ID NO: 764927 - DNA, 20 bp, Artificial
  CRISPR gRNA sequence
ttacattttaatgggagaga

SEQ ID NO: 764928 - DNA, 20 bp, Artificial
  CRISPR gRNA sequence
taatgggagagagagacaaa

SEQ ID NO: 764929 - DNA, 20 bp, Artificial
  CRISPR gRNA sequence
aatgggagagagagacaaat

SEQ ID NO: 764930 - DNA, 20 bp, Artificial
  CRISPR gRNA sequence
gagagagacaaatgggcaca

SEQ ID NO: 764931 - DNA, 20 bp, Artificial
  CRISPR gRNA sequence
atgggcacacagattctcgt

SEQ ID NO: 764932 - DNA, 20 bp, Artificial
  CRISPR gRNA sequence
attctcgtcagcatgtgact

SEQ ID NO: 764933 - DNA, 20 bp, Artificial
  CRISPR gRNA sequence
ttctcgtcagcatgtgacta

SEQ ID NO: 764934 - DNA, 20 bp, Artificial
  CRISPR gRNA sequence
agcatgtgactaaggtatgt

SEQ ID NO: 764935 - DNA, 20 bp, Artificial
  CRISPR gRNA sequence
gcatgtgactaaggtatgtg

SEQ ID NO: 764936 - DNA, 20 bp, Artificial
  CRISPR gRNA sequence
tgactaaggtatgtgaggaa

SEQ ID NO: 764937 - DNA, 20 bp, Artificial
  CRISPR gRNA sequence
gactaaggtatgtgaggaaa

SEQ ID NO: 764938 - DNA, 20 bp, Artificial
  CRISPR gRNA sequence
ctaaggtatgtgaggaaaag

SEQ ID NO: 764939 - DNA, 20 bp, Artificial
  CRISPR gRNA sequence
ggtatgtgaggaaaaggagc

SEQ ID NO: 764940 - DNA, 20 bp, Artificial
  CRISPR gRNA sequence
atgtgaggaaaaggagccag

SEQ ID NO: 764941 - DNA, 20 bp, Artificial
  CRISPR gRNA sequence
tgtgaggaaaaggagccagc

SEQ ID NO: 764942 - DNA, 20 bp, Artificial
  CRISPR gRNA sequence
aggaaaaggagccagcaggt

SEQ ID NO: 764943 - DNA, 20 bp, Artificial
  CRISPR gRNA sequence
aaaggagccagcaggttagt

SEQ ID NO: 764944 - DNA, 20 bp, Artificial
  CRISPR gRNA sequence
agccagcaggttagtaagta

SEQ ID NO: 764945 - DNA, 20 bp, Artificial
  CRISPR gRNA sequence
caggttagtaagtaaagcaa

SEQ ID NO: 764946 - DNA, 20 bp, Artificial
  CRISPR gRNA sequence
gcaacagcttttcaaaaatc

SEQ ID NO: 764947 - DNA, 20 bp, Artificial
  CRISPR gRNA sequence
acagcttttcaaaaatctgg

SEQ ID NO: 764948 - DNA, 20 bp, Artificial
  CRISPR gRNA sequence
cagcttttcaaaaatctggc

SEQ ID NO: 764949 - DNA, 20 bp, Artificial
  CRISPR gRNA sequence
caccatgtgcatttccccat

SEQ ID NO: 764950 - DNA, 20 bp, Artificial
  CRISPR gRNA sequence
gtgcatttccccatgagcgt

SEQ ID NO: 764951 - DNA, 20 bp, Artificial
  CRISPR gRNA sequence
gcgtaagtaatgttataaat

SEQ ID NO: 764952 - DNA, 20 bp, Artificial
  CRISPR gRNA sequence
cgtaagtaatgttataaatt

SEQ ID NO: 764953 - DNA, 20 bp, Artificial
  CRISPR gRNA sequence
gtaagtaatgttataaattg

SEQ ID NO: 764954 - DNA, 20 bp, Artificial
  CRISPR gRNA sequence
aagtaatgttataaattggg

SEQ ID NO: 764955 - DNA, 20 bp, Artificial
  CRISPR gRNA sequence
ataaattggggagtccaaaa

SEQ ID NO: 764956 - DNA, 20 bp, Artificial
  CRISPR gRNA sequence
gtatccaccaaaaatgtcaa

SEQ ID NO: 764957 - DNA, 20 bp, Artificial
  CRISPR gRNA sequence
tccaccaaaaatgtcaatag

SEQ ID NO: 764958 - DNA, 20 bp, Artificial
  CRISPR gRNA sequence
aatgtcaatagtggtttctc

SEQ ID NO: 764959 - DNA, 20 bp, Artificial
  CRISPR gRNA sequence
tgtcaatagtggtttctctg

SEQ ID NO: 764960 - DNA, 20 bp, Artificial
  CRISPR gRNA sequence
gtcaatagtggtttctctgg

SEQ ID NO: 764961 - DNA, 20 bp, Artificial
  CRISPR gRNA sequence
caatagtggtttctctggag

SEQ ID NO: 764962 - DNA, 20 bp, Artificial
  CRISPR gRNA sequence
atagtggtttctctggagga

SEQ ID NO: 764963 - DNA, 20 bp, Artificial
  CRISPR gRNA sequence
agtggtttctctggaggaga

SEQ ID NO: 764964 - DNA, 20 bp, Artificial
  CRISPR gRNA sequence
tctggaggagagagaatcac

SEQ ID NO: 764965 - DNA, 20 bp, Artificial
  CRISPR gRNA sequence
aacacgatttgtttttatac

SEQ ID NO: 764966 - DNA, 20 bp, Artificial
  CRISPR gRNA sequence
cgatttgtttttatacaaga

SEQ ID NO: 764967 - DNA, 20 bp, Artificial
  CRISPR gRNA sequence
aatacccgtacctttaaata

SEQ ID NO: 764968 - DNA, 20 bp, Artificial
  CRISPR gRNA sequence
acccgtacctttaaatatgg

SEQ ID NO: 764969 - DNA, 20 bp, Artificial
  CRISPR gRNA sequence
gtacctttaaatatggtggt

SEQ ID NO: 764970 - DNA, 20 bp, Artificial
  CRISPR gRNA sequence
tacctttaaatatggtggtg

SEQ ID NO: 764971 - DNA, 20 bp, Artificial
  CRISPR gRNA sequence
ggtgaggcacatgctcttta

SEQ ID NO: 764972 - DNA, 20 bp, Artificial
  CRISPR gRNA sequence
acatgctctttaaagcaatt

SEQ ID NO: 764973 - DNA, 20 bp, Artificial
  CRISPR gRNA sequence
agcaattaagctgaaattta

SEQ ID NO: 764974 - DNA, 20 bp, Artificial
  CRISPR gRNA sequence
gcaattaagctgaaatttat

SEQ ID NO: 764975 - DNA, 20 bp, Artificial
  CRISPR gRNA sequence
caattaagctgaaatttata

SEQ ID NO: 764976 - DNA, 20 bp, Artificial
  CRISPR gRNA sequence
gaaatttatagggaatgaaa

SEQ ID NO: 764977 - DNA, 20 bp, Artificial
  CRISPR gRNA sequence
aatttatagggaatgaaaaa

SEQ ID NO: 764978 - DNA, 20 bp, Artificial
  CRISPR gRNA sequence
aatgaaaaagagctgacata

SEQ ID NO: 764979 - DNA, 20 bp, Artificial
  CRISPR gRNA sequence
tgaaaaagagctgacataca

SEQ ID NO: 764980 - DNA, 20 bp, Artificial
  CRISPR gRNA sequence
ctgacatacagagaaccccg

SEQ ID NO: 764981 - DNA, 20 bp, Artificial
  CRISPR gRNA sequence
gacatacagagaaccccgta

SEQ ID NO: 764982 - DNA, 20 bp, Artificial
  CRISPR gRNA sequence
acatacagagaaccccgtag

SEQ ID NO: 764983 - DNA, 20 bp, Artificial
  CRISPR gRNA sequence
agagaaccccgtagaggaaa

SEQ ID NO: 764984 - DNA, 20 bp, Artificial
  CRISPR gRNA sequence
gaaccccgtagaggaaacag

SEQ ID NO: 764985 - DNA, 20 bp, Artificial
  CRISPR gRNA sequence
aaccccgtagaggaaacagc

SEQ ID NO: 764986 - DNA, 20 bp, Artificial
  CRISPR gRNA sequence
cccgtagaggaaacagcagg

SEQ ID NO: 764987 - DNA, 20 bp, Artificial
  CRISPR gRNA sequence
gtagaggaaacagcaggtgg

SEQ ID NO: 764988 - DNA, 20 bp, Artificial
  CRISPR gRNA sequence
tagaggaaacagcaggtgga

SEQ ID NO: 764989 - DNA, 20 bp, Artificial
  CRISPR gRNA sequence
aacagcaggtggaaggccct

SEQ ID NO: 764990 - DNA, 20 bp, Artificial
  CRISPR gRNA sequence
acagcaggtggaaggccctg

SEQ ID NO: 764991 - DNA, 20 bp, Artificial
  CRISPR gRNA sequence
caggtggaaggccctgaggc

SEQ ID NO: 764992 - DNA, 20 bp, Artificial
  CRISPR gRNA sequence
ggaaggccctgaggcaagac

SEQ ID NO: 764993 - DNA, 20 bp, Artificial
  CRISPR gRNA sequence
gccttgctgtgtgaaaatat

SEQ ID NO: 764994 - DNA, 20 bp, Artificial
  CRISPR gRNA sequence
ccttgctgtgtgaaaatatc

SEQ ID NO: 764995 - DNA, 20 bp, Artificial
  CRISPR gRNA sequence
cttgctgtgtgaaaatatcg

SEQ ID NO: 764996 - DNA, 20 bp, Artificial
  CRISPR gRNA sequence
tgctgtgtgaaaatatcggg

SEQ ID NO: 764997 - DNA, 20 bp, Artificial
  CRISPR gRNA sequence
tgaaaatatcggggagcgtc

SEQ ID NO: 764998 - DNA, 20 bp, Artificial
  CRISPR gRNA sequence
atatcggggagcgtccagtg

SEQ ID NO: 764999 - DNA, 20 bp, Artificial
  CRISPR gRNA sequence
tcggggagcgtccagtgtgg

SEQ ID NO: 765000 - DNA, 20 bp, Artificial
  CRISPR gRNA sequence
agtgtggcagacacatctga

SEQ ID NO: 765001 - DNA, 20 bp, Artificial
  CRISPR gRNA sequence
gtgtggcagacacatctgat

SEQ ID NO: 765002 - DNA, 20 bp, Artificial
  CRISPR gRNA sequence
gtggcagacacatctgatgg

SEQ ID NO: 765003 - DNA, 20 bp, Artificial
  CRISPR gRNA sequence
tggcagacacatctgatggg

SEQ ID NO: 765004 - DNA, 20 bp, Artificial
  CRISPR gRNA sequence
ggcagacacatctgatggga

SEQ ID NO: 765005 - DNA, 20 bp, Artificial
  CRISPR gRNA sequence
atgggagggcatgtcccacc

SEQ ID NO: 765006 - DNA, 20 bp, Artificial
  CRISPR gRNA sequence
ggcatgtcccacccagacca

SEQ ID NO: 765007 - DNA, 20 bp, Artificial
  CRISPR gRNA sequence
cccagaccaaagatgacttg

SEQ ID NO: 765008 - DNA, 20 bp, Artificial
  CRISPR gRNA sequence
cagaccaaagatgacttgaa

SEQ ID NO: 765009 - DNA, 20 bp, Artificial
  CRISPR gRNA sequence
caaagatgacttgaagagac

SEQ ID NO: 765010 - DNA, 20 bp, Artificial
  CRISPR gRNA sequence
gatgacttgaagagaccagt

SEQ ID NO: 765011 - DNA, 20 bp, Artificial
  CRISPR gRNA sequence
atgacttgaagagaccagtg

SEQ ID NO: 765012 - DNA, 20 bp, Artificial
  CRISPR gRNA sequence
aggaatctaactttttctat

SEQ ID NO: 765013 - DNA, 20 bp, Artificial
  CRISPR gRNA sequence
ctaactttttctatgagtaa

SEQ ID NO: 765014 - DNA, 20 bp, Artificial
  CRISPR gRNA sequence
taactttttctatgagtaat

SEQ ID NO: 765015 - DNA, 20 bp, Artificial
  CRISPR gRNA sequence
ctatgagtaatgggaatcac

SEQ ID NO: 765016 - DNA, 20 bp, Artificial
  CRISPR gRNA sequence
tatgagtaatgggaatcact

SEQ ID NO: 765017 - DNA, 20 bp, Artificial
  CRISPR gRNA sequence
atgagtaatgggaatcactg

SEQ ID NO: 765018 - DNA, 20 bp, Artificial
  CRISPR gRNA sequence
gagtaatgggaatcactggg

SEQ ID NO: 765019 - DNA, 20 bp, Artificial
  CRISPR gRNA sequence
gttttaatcacgcataatct

SEQ ID NO: 765020 - DNA, 20 bp, Artificial
  CRISPR gRNA sequence
ttaatcacgcataatctgag

SEQ ID NO: 765021 - DNA, 20 bp, Artificial
  CRISPR gRNA sequence
gcaatgcttaaaactcactc

SEQ ID NO: 765022 - DNA, 20 bp, Artificial
  CRISPR gRNA sequence
aactcactctagctcctctg

SEQ ID NO: 765023 - DNA, 20 bp, Artificial
  CRISPR gRNA sequence
ctcactctagctcctctgtg

SEQ ID NO: 765024 - DNA, 20 bp, Artificial
  CRISPR gRNA sequence
tctagctcctctgtggagac

SEQ ID NO: 765025 - DNA, 20 bp, Artificial
  CRISPR gRNA sequence
cctctgtggagactggactg

SEQ ID NO: 765026 - DNA, 20 bp, Artificial
  CRISPR gRNA sequence
ctgtggagactggactgtgg

SEQ ID NO: 765027 - DNA, 20 bp, Artificial
  CRISPR gRNA sequence
tgtggagactggactgtggc

SEQ ID NO: 765028 - DNA, 20 bp, Artificial
  CRISPR gRNA sequence
gtggagactggactgtggca

SEQ ID NO: 765029 - DNA, 20 bp, Artificial
  CRISPR gRNA sequence
agactggactgtggcagggc

SEQ ID NO: 765030 - DNA, 20 bp, Artificial
  CRISPR gRNA sequence
gactggactgtggcagggca

SEQ ID NO: 765031 - DNA, 20 bp, Artificial
  CRISPR gRNA sequence
actggactgtggcagggcaa

SEQ ID NO: 765032 - DNA, 20 bp, Artificial
  CRISPR gRNA sequence
ctggactgtggcagggcaag

SEQ ID NO: 765033 - DNA, 20 bp, Artificial
  CRISPR gRNA sequence
tggactgtggcagggcaagg

SEQ ID NO: 765034 - DNA, 20 bp, Artificial
  CRISPR gRNA sequence
gactgtggcagggcaagggg

SEQ ID NO: 765035 - DNA, 20 bp, Artificial
  CRISPR gRNA sequence
actgtggcagggcaaggggg

SEQ ID NO: 765036 - DNA, 20 bp, Artificial
  CRISPR gRNA sequence
tggcagggcaagggggaggc

SEQ ID NO: 765037 - DNA, 20 bp, Artificial
  CRISPR gRNA sequence
agggcaagggggaggccagt

SEQ ID NO: 765038 - DNA, 20 bp, Artificial
  CRISPR gRNA sequence
gggcaagggggaggccagtt

SEQ ID NO: 765039 - DNA, 20 bp, Artificial
  CRISPR gRNA sequence
ggcaagggggaggccagtta

SEQ ID NO: 765040 - DNA, 20 bp, Artificial
  CRISPR gRNA sequence
gcaagggggaggccagttag

SEQ ID NO: 765041 - DNA, 20 bp, Artificial
  CRISPR gRNA sequence
agggggaggccagttagggg

SEQ ID NO: 765042 - DNA, 20 bp, Artificial
  CRISPR gRNA sequence
aggccagttaggggcggttt

SEQ ID NO: 765043 - DNA, 20 bp, Artificial
  CRISPR gRNA sequence
gcggtttcagctgtccctgt

SEQ ID NO: 765044 - DNA, 20 bp, Artificial
  CRISPR gRNA sequence
ggtttcagctgtccctgtaa

SEQ ID NO: 765045 - DNA, 20 bp, Artificial
  CRISPR gRNA sequence
gtttcagctgtccctgtaag

SEQ ID NO: 765046 - DNA, 20 bp, Artificial
  CRISPR gRNA sequence
cagctgtccctgtaagaggt

SEQ ID NO: 765047 - DNA, 20 bp, Artificial
  CRISPR gRNA sequence
agctgtccctgtaagaggtg

SEQ ID NO: 765048 - DNA, 20 bp, Artificial
  CRISPR gRNA sequence
gctgtccctgtaagaggtga

SEQ ID NO: 765049 - DNA, 20 bp, Artificial
  CRISPR gRNA sequence
gtccctgtaagaggtgaggg

SEQ ID NO: 765050 - DNA, 20 bp, Artificial
  CRISPR gRNA sequence
tgtaagaggtgagggtggtg

SEQ ID NO: 765051 - DNA, 20 bp, Artificial
  CRISPR gRNA sequence
gtgagggtggtgtggcttca

SEQ ID NO: 765052 - DNA, 20 bp, Artificial
  CRISPR gRNA sequence
tgagggtggtgtggcttcaa

SEQ ID NO: 765053 - DNA, 20 bp, Artificial
  CRISPR gRNA sequence
gagggtggtgtggcttcaaa

SEQ ID NO: 765054 - DNA, 20 bp, Artificial
  CRISPR gRNA sequence
ggtggtgtggcttcaaaggg

SEQ ID NO: 765055 - DNA, 20 bp, Artificial
  CRISPR gRNA sequence
ggtgtggcttcaaagggtgg

SEQ ID NO: 765056 - DNA, 20 bp, Artificial
  CRISPR gRNA sequence
gtggcttcaaagggtggtag

SEQ ID NO: 765057 - DNA, 20 bp, Artificial
  CRISPR gRNA sequence
ggcttcaaagggtggtagta

SEQ ID NO: 765058 - DNA, 20 bp, Artificial
  CRISPR gRNA sequence
ttcaaagggtggtagtagag

SEQ ID NO: 765059 - DNA, 20 bp, Artificial
  CRISPR gRNA sequence
aaagggtggtagtagagaag

SEQ ID NO: 765060 - DNA, 20 bp, Artificial
  CRISPR gRNA sequence
agggtggtagtagagaagaa

SEQ ID NO: 765061 - DNA, 20 bp, Artificial
  CRISPR gRNA sequence
ggtggtagtagagaagaaga

SEQ ID NO: 765062 - DNA, 20 bp, Artificial
  CRISPR gRNA sequence
gtggtagtagagaagaagag

SEQ ID NO: 765063 - DNA, 20 bp, Artificial
  CRISPR gRNA sequence
tggtagtagagaagaagaga

SEQ ID NO: 765064 - DNA, 20 bp, Artificial
  CRISPR gRNA sequence
gtagagaagaagagagggat

SEQ ID NO: 765065 - DNA, 20 bp, Artificial
  CRISPR gRNA sequence
agaagagagggatcagattc

SEQ ID NO: 765066 - DNA, 20 bp, Artificial
  CRISPR gRNA sequence
gaagagagggatcagattca

SEQ ID NO: 765067 - DNA, 20 bp, Artificial
  CRISPR gRNA sequence
gatcagattcaaggtttatt

SEQ ID NO: 765068 - DNA, 20 bp, Artificial
  CRISPR gRNA sequence
atcagattcaaggtttattt

SEQ ID NO: 765069 - DNA, 20 bp, Artificial
  CRISPR gRNA sequence
cagattcaaggtttatttag

SEQ ID NO: 765070 - DNA, 20 bp, Artificial
  CRISPR gRNA sequence
agattcaaggtttatttagg

SEQ ID NO: 765071 - DNA, 20 bp, Artificial
  CRISPR gRNA sequence
gattcaaggtttatttagga

SEQ ID NO: 765072 - DNA, 20 bp, Artificial
  CRISPR gRNA sequence
tttatttaggagggaatcaa

SEQ ID NO: 765073 - DNA, 20 bp, Artificial
  CRISPR gRNA sequence
ttatttaggagggaatcaac

SEQ ID NO: 765074 - DNA, 20 bp, Artificial
  CRISPR gRNA sequence
aatcaacaggacttgctgat

SEQ ID NO: 765075 - DNA, 20 bp, Artificial
  CRISPR gRNA sequence
aacaggacttgctgatgagt

SEQ ID NO: 765076 - DNA, 20 bp, Artificial
  CRISPR gRNA sequence
aggacttgctgatgagtcag

SEQ ID NO: 765077 - DNA, 20 bp, Artificial
  CRISPR gRNA sequence
cttgctgatgagtcagaagt

SEQ ID NO: 765078 - DNA, 20 bp, Artificial
  CRISPR gRNA sequence
ttgctgatgagtcagaagtg

SEQ ID NO: 765079 - DNA, 20 bp, Artificial
  CRISPR gRNA sequence
tgctgatgagtcagaagtga

SEQ ID NO: 765080 - DNA, 20 bp, Artificial
  CRISPR gRNA sequence
gctgatgagtcagaagtgag

SEQ ID NO: 765081 - DNA, 20 bp, Artificial
  CRISPR gRNA sequence
tgagtcagaagtgaggggaa

SEQ ID NO: 765082 - DNA, 20 bp, Artificial
  CRISPR gRNA sequence
gagtcagaagtgaggggaaa

SEQ ID NO: 765083 - DNA, 20 bp, Artificial
  CRISPR gRNA sequence
agaagtgaggggaaaaggcc

SEQ ID NO: 765084 - DNA, 20 bp, Artificial
  CRISPR gRNA sequence
tgaggggaaaaggcccggca

SEQ ID NO: 765085 - DNA, 20 bp, Artificial
  CRISPR gRNA sequence
gaggggaaaaggcccggcat

SEQ ID NO: 765086 - DNA, 20 bp, Artificial
  CRISPR gRNA sequence
ggggaaaaggcccggcatgg

SEQ ID NO: 765087 - DNA, 20 bp, Artificial
  CRISPR gRNA sequence
gggaaaaggcccggcatggg

SEQ ID NO: 765088 - DNA, 20 bp, Artificial
  CRISPR gRNA sequence
aaggcccggcatgggaggcc

SEQ ID NO: 765089 - DNA, 20 bp, Artificial
  CRISPR gRNA sequence
aggcccggcatgggaggccg

SEQ ID NO: 765090 - DNA, 20 bp, Artificial
  CRISPR gRNA sequence
cccggcatgggaggccgagg

SEQ ID NO: 765091 - DNA, 20 bp, Artificial
  CRISPR gRNA sequence
ccggcatgggaggccgaggc

SEQ ID NO: 765092 - DNA, 20 bp, Artificial
  CRISPR gRNA sequence
gcatgggaggccgaggcagg

SEQ ID NO: 765093 - DNA, 20 bp, Artificial
  CRISPR gRNA sequence
ccgaggcaggtggatcacct

SEQ ID NO: 765094 - DNA, 20 bp, Artificial
  CRISPR gRNA sequence
cgaggcaggtggatcacctg

SEQ ID NO: 765095 - DNA, 20 bp, Artificial
  CRISPR gRNA sequence
gcaggtggatcacctgaggt

SEQ ID NO: 765096 - DNA, 20 bp, Artificial
  CRISPR gRNA sequence
caggtggatcacctgaggtc

SEQ ID NO: 765097 - DNA, 20 bp, Artificial
  CRISPR gRNA sequence
tcacctgaggtcaggcgttc

SEQ ID NO: 765098 - DNA, 20 bp, Artificial
  CRISPR gRNA sequence
tgaggtcaggcgttcgagac

SEQ ID NO: 765099 - DNA, 20 bp, Artificial
  CRISPR gRNA sequence
tcaggcgttcgagaccagcc

SEQ ID NO: 765100 - DNA, 20 bp, Artificial
  CRISPR gRNA sequence
ggcgttcgagaccagcctag

SEQ ID NO: 765101 - DNA, 20 bp, Artificial
  CRISPR gRNA sequence
cgagaccagcctagcagata

SEQ ID NO: 765102 - DNA, 20 bp, Artificial
  CRISPR gRNA sequence
accccacctctactaaaaaa

SEQ ID NO: 765103 - DNA, 20 bp, Artificial
  CRISPR gRNA sequence
cacctctactaaaaaatagc

SEQ ID NO: 765104 - DNA, 20 bp, Artificial
  CRISPR gRNA sequence
acctctactaaaaaatagcc

SEQ ID NO: 765105 - DNA, 20 bp, Artificial
  CRISPR gRNA sequence
cctctactaaaaaatagcca

SEQ ID NO: 765106 - DNA, 20 bp, Artificial
  CRISPR gRNA sequence
ctctactaaaaaatagccag

SEQ ID NO: 765107 - DNA, 20 bp, Artificial
  CRISPR gRNA sequence
tactaaaaaatagccagggg

SEQ ID NO: 765108 - DNA, 20 bp, Artificial
  CRISPR gRNA sequence
taaaaaatagccaggggtgg

SEQ ID NO: 765109 - DNA, 20 bp, Artificial
  CRISPR gRNA sequence
gtggaacacacctgtaatcc

SEQ ID NO: 765110 - DNA, 20 bp, Artificial
  CRISPR gRNA sequence
cacctgtaatcccagctact

SEQ ID NO: 765111 - DNA, 20 bp, Artificial
  CRISPR gRNA sequence
acctgtaatcccagctactc

SEQ ID NO: 765112 - DNA, 20 bp, Artificial
  CRISPR gRNA sequence
ctgtaatcccagctactcag

SEQ ID NO: 765113 - DNA, 20 bp, Artificial
  CRISPR gRNA sequence
tgtaatcccagctactcagg

SEQ ID NO: 765114 - DNA, 20 bp, Artificial
  CRISPR gRNA sequence
tcccagctactcaggaggct

SEQ ID NO: 765115 - DNA, 20 bp, Artificial
  CRISPR gRNA sequence
cccagctactcaggaggctg

SEQ ID NO: 765116 - DNA, 20 bp, Artificial
  CRISPR gRNA sequence
agctactcaggaggctgagg

SEQ ID NO: 765117 - DNA, 20 bp, Artificial
  CRISPR gRNA sequence
gctactcaggaggctgaggc

SEQ ID NO: 765118 - DNA, 20 bp, Artificial
  CRISPR gRNA sequence
tactcaggaggctgaggcag

SEQ ID NO: 765119 - DNA, 20 bp, Artificial
  CRISPR gRNA sequence
gcaggagaattgcttgaacc

SEQ ID NO: 765120 - DNA, 20 bp, Artificial
  CRISPR gRNA sequence
caggagaattgcttgaacct

SEQ ID NO: 765121 - DNA, 20 bp, Artificial
  CRISPR gRNA sequence
ggagaattgcttgaacctgg

SEQ ID NO: 765122 - DNA, 20 bp, Artificial
  CRISPR gRNA sequence
gagaattgcttgaacctggg

SEQ ID NO: 765123 - DNA, 20 bp, Artificial
  CRISPR gRNA sequence
aattgcttgaacctgggagg

SEQ ID NO: 765124 - DNA, 20 bp, Artificial
  CRISPR gRNA sequence
ttgcttgaacctgggaggtg

SEQ ID NO: 765125 - DNA, 20 bp, Artificial
  CRISPR gRNA sequence
tgcttgaacctgggaggtgg

SEQ ID NO: 765126 - DNA, 20 bp, Artificial
  CRISPR gRNA sequence
aacctgggaggtggaggttg

SEQ ID NO: 765127 - DNA, 20 bp, Artificial
  CRISPR gRNA sequence
tgggaggtggaggttgcagt

SEQ ID NO: 765128 - DNA, 20 bp, Artificial
  CRISPR gRNA sequence
ggtggaggttgcagtgagcc

SEQ ID NO: 765129 - DNA, 20 bp, Artificial
  CRISPR gRNA sequence
gcgccactgcactccatcct

SEQ ID NO: 765130 - DNA, 20 bp, Artificial
  CRISPR gRNA sequence
ctgcactccatccttggcaa

SEQ ID NO: 765131 - DNA, 20 bp, Artificial
  CRISPR gRNA sequence
gcactccatccttggcaaca

SEQ ID NO: 765132 - DNA, 20 bp, Artificial
  CRISPR gRNA sequence
tccatccttggcaacagagc

SEQ ID NO: 765133 - DNA, 20 bp, Artificial
  CRISPR gRNA sequence
ccccatctcaaaaaaaaaaa

SEQ ID NO: 765134 - DNA, 20 bp, Artificial
  CRISPR gRNA sequence
ccatctcaaaaaaaaaaaaa

SEQ ID NO: 765135 - DNA, 20 bp, Artificial
  CRISPR gRNA sequence
catctcaaaaaaaaaaaaag

SEQ ID NO: 765136 - DNA, 20 bp, Artificial
  CRISPR gRNA sequence
tctcaaaaaaaaaaaaagag

SEQ ID NO: 765137 - DNA, 20 bp, Artificial
  CRISPR gRNA sequence
ctcaaaaaaaaaaaaagagg

SEQ ID NO: 765138 - DNA, 20 bp, Artificial
  CRISPR gRNA sequence
caaaaaaaaaaaaagaggag

SEQ ID NO: 765139 - DNA, 20 bp, Artificial
  CRISPR gRNA sequence
aaaaaaaaaaaaagaggagg

SEQ ID NO: 765140 - DNA, 20 bp, Artificial
  CRISPR gRNA sequence
aaaaaaaaaaagaggaggag

SEQ ID NO: 765141 - DNA, 20 bp, Artificial
  CRISPR gRNA sequence
aaaaaaaaaagaggaggagg

SEQ ID NO: 765142 - DNA, 20 bp, Artificial
  CRISPR gRNA sequence
aaaaaaaagaggaggaggag

SEQ ID NO: 765143 - DNA, 20 bp, Artificial
  CRISPR gRNA sequence
aaaaaaagaggaggaggagg

SEQ ID NO: 765144 - DNA, 20 bp, Artificial
  CRISPR gRNA sequence
aaaaaagaggaggaggagga

SEQ ID NO: 765145 - DNA, 20 bp, Artificial
  CRISPR gRNA sequence
aaaaagaggaggaggaggag

SEQ ID NO: 765146 - DNA, 20 bp, Artificial
  CRISPR gRNA sequence
aaagaggaggaggaggaggg

SEQ ID NO: 765147 - DNA, 20 bp, Artificial
  CRISPR gRNA sequence
aagaggaggaggaggagggg

SEQ ID NO: 765148 - DNA, 20 bp, Artificial
  CRISPR gRNA sequence
gaggaggaggaggaggggag

SEQ ID NO: 765149 - DNA, 20 bp, Artificial
  CRISPR gRNA sequence
aggaggaggaggaggggagg

SEQ ID NO: 765150 - DNA, 20 bp, Artificial
  CRISPR gRNA sequence
ggaggaggaggaggggagga

SEQ ID NO: 765151 - DNA, 20 bp, Artificial
  CRISPR gRNA sequence
gaggaggaggaggggaggag

SEQ ID NO: 765152 - DNA, 20 bp, Artificial
  CRISPR gRNA sequence
gaggaggaggggaggagggg

SEQ ID NO: 765153 - DNA, 20 bp, Artificial
  CRISPR gRNA sequence
ggaagcgaacccccccaccc

SEQ ID NO: 765154 - DNA, 20 bp, Artificial
  CRISPR gRNA sequence
accctggcactaccattctc

SEQ ID NO: 765155 - DNA, 20 bp, Artificial
  CRISPR gRNA sequence
gcactaccattctccggtaa

SEQ ID NO: 765156 - DNA, 20 bp, Artificial
  CRISPR gRNA sequence
taccattctccggtaatggt

SEQ ID NO: 765157 - DNA, 20 bp, Artificial
  CRISPR gRNA sequence
atggttagattgtgtgcttc

SEQ ID NO: 765158 - DNA, 20 bp, Artificial
  CRISPR gRNA sequence
agattgtgtgcttcgagcac

SEQ ID NO: 765159 - DNA, 20 bp, Artificial
  CRISPR gRNA sequence
gtgtgcttcgagcactagca

SEQ ID NO: 765160 - DNA, 20 bp, Artificial
  CRISPR gRNA sequence
tgcttcgagcactagcaaag

SEQ ID NO: 765161 - DNA, 20 bp, Artificial
  CRISPR gRNA sequence
gcttcgagcactagcaaagc

SEQ ID NO: 765162 - DNA, 20 bp, Artificial
  CRISPR gRNA sequence
aagcaggcacactcaaaatg

SEQ ID NO: 765163 - DNA, 20 bp, Artificial
  CRISPR gRNA sequence
agcaggcacactcaaaatgt

SEQ ID NO: 765164 - DNA, 20 bp, Artificial
  CRISPR gRNA sequence
aggcacactcaaaatgtggg

SEQ ID NO: 765165 - DNA, 20 bp, Artificial
  CRISPR gRNA sequence
gaaacaatgctaattgaata

SEQ ID NO: 765166 - DNA, 20 bp, Artificial
  CRISPR gRNA sequence
attgaatacagcactcatta

SEQ ID NO: 765167 - DNA, 20 bp, Artificial
  CRISPR gRNA sequence
ttgaatacagcactcattaa

SEQ ID NO: 765168 - DNA, 20 bp, Artificial
  CRISPR gRNA sequence
cattaaaggtttcctgcatt

SEQ ID NO: 765169 - DNA, 20 bp, Artificial
  CRISPR gRNA sequence
gaaaaataacattgacttta

SEQ ID NO: 765170 - DNA, 20 bp, Artificial
  CRISPR gRNA sequence
tttttattgtgaatcatact

SEQ ID NO: 765171 - DNA, 20 bp, Artificial
  CRISPR gRNA sequence
actcagtatcataatctttg

SEQ ID NO: 765172 - DNA, 20 bp, Artificial
  CRISPR gRNA sequence
atcataatctttgcagtacc

SEQ ID NO: 765173 - DNA, 20 bp, Artificial
  CRISPR gRNA sequence
cataatctttgcagtaccta

SEQ ID NO: 765174 - DNA, 20 bp, Artificial
  CRISPR gRNA sequence
gcagtacctagagatctcta

SEQ ID NO: 765175 - DNA, 20 bp, Artificial
  CRISPR gRNA sequence
tagagatctctaaagttctt

SEQ ID NO: 765176 - DNA, 20 bp, Artificial
  CRISPR gRNA sequence
gatctctaaagttcttaagc

SEQ ID NO: 765177 - DNA, 20 bp, Artificial
  CRISPR gRNA sequence
taaagttcttaagctagcct

SEQ ID NO: 765178 - DNA, 20 bp, Artificial
  CRISPR gRNA sequence
ggatctcttgctgaaacccc

SEQ ID NO: 765179 - DNA, 20 bp, Artificial
  CRISPR gRNA sequence
tgctgaaacccctggtgccc

SEQ ID NO: 765180 - DNA, 20 bp, Artificial
  CRISPR gRNA sequence
gctgaaacccctggtgcccc

SEQ ID NO: 765181 - DNA, 20 bp, Artificial
  CRISPR gRNA sequence
aaacccctggtgccccaggc

SEQ ID NO: 765182 - DNA, 20 bp, Artificial
  CRISPR gRNA sequence
ggccagttctcatgccctgt

SEQ ID NO: 765183 - DNA, 20 bp, Artificial
  CRISPR gRNA sequence
tcatgccctgtcagtcgaac

SEQ ID NO: 765184 - DNA, 20 bp, Artificial
  CRISPR gRNA sequence
catgccctgtcagtcgaacc

SEQ ID NO: 765185 - DNA, 20 bp, Artificial
  CRISPR gRNA sequence
atgccctgtcagtcgaacca

SEQ ID NO: 765186 - DNA, 20 bp, Artificial
  CRISPR gRNA sequence
agtcgaaccagggtgcccct

SEQ ID NO: 765187 - DNA, 20 bp, Artificial
  CRISPR gRNA sequence
tcgaaccagggtgccccttg

SEQ ID NO: 765188 - DNA, 20 bp, Artificial
  CRISPR gRNA sequence
cgaaccagggtgccccttgg

SEQ ID NO: 765189 - DNA, 20 bp, Artificial
  CRISPR gRNA sequence
gaaccagggtgccccttgga

SEQ ID NO: 765190 - DNA, 20 bp, Artificial
  CRISPR gRNA sequence
aaccagggtgccccttggag

SEQ ID NO: 765191 - DNA, 20 bp, Artificial
  CRISPR gRNA sequence
tgccccttggaggggacatt

SEQ ID NO: 765192 - DNA, 20 bp, Artificial
  CRISPR gRNA sequence
gccccttggaggggacattt

SEQ ID NO: 765193 - DNA, 20 bp, Artificial
  CRISPR gRNA sequence
ccccttggaggggacatttg

SEQ ID NO: 765194 - DNA, 20 bp, Artificial
  CRISPR gRNA sequence
cccttggaggggacatttgg

SEQ ID NO: 765195 - DNA, 20 bp, Artificial
  CRISPR gRNA sequence
acatttgggggaatgaaacc

SEQ ID NO: 765196 - DNA, 20 bp, Artificial
  CRISPR gRNA sequence
ttgggggaatgaaacctggt

SEQ ID NO: 765197 - DNA, 20 bp, Artificial
  CRISPR gRNA sequence
atgaaacctggtaagtcacc

SEQ ID NO: 765198 - DNA, 20 bp, Artificial
  CRISPR gRNA sequence
gacaaaaccctttcttgctc

SEQ ID NO: 765199 - DNA, 20 bp, Artificial
  CRISPR gRNA sequence
caaaaccctttcttgctcta

SEQ ID NO: 765200 - DNA, 20 bp, Artificial
  CRISPR gRNA sequence
ctttcttgctctagagaaat

SEQ ID NO: 765201 - DNA, 20 bp, Artificial
  CRISPR gRNA sequence
ttcttgctctagagaaatca

SEQ ID NO: 765202 - DNA, 20 bp, Artificial
  CRISPR gRNA sequence
ttgctctagagaaatcagag

SEQ ID NO: 765203 - DNA, 20 bp, Artificial
  CRISPR gRNA sequence
tagagaaatcagagcagccg

SEQ ID NO: 765204 - DNA, 20 bp, Artificial
  CRISPR gRNA sequence
agagaaatcagagcagccgt

SEQ ID NO: 765205 - DNA, 20 bp, Artificial
  CRISPR gRNA sequence
gaaatcagagcagccgtggg

SEQ ID NO: 765206 - DNA, 20 bp, Artificial
  CRISPR gRNA sequence
aatcagagcagccgtgggta

SEQ ID NO: 765207 - DNA, 20 bp, Artificial
  CRISPR gRNA sequence
agagcagccgtgggtagaga

SEQ ID NO: 765208 - DNA, 20 bp, Artificial
  CRISPR gRNA sequence
gagcagccgtgggtagagac

SEQ ID NO: 765209 - DNA, 20 bp, Artificial
  CRISPR gRNA sequence
tagagacaggcacttcttta

SEQ ID NO: 765210 - DNA, 20 bp, Artificial
  CRISPR gRNA sequence
aggcacttctttatggccac

SEQ ID NO: 765211 - DNA, 20 bp, Artificial
  CRISPR gRNA sequence
acttctttatggccacaaga

SEQ ID NO: 765212 - DNA, 20 bp, Artificial
  CRISPR gRNA sequence
ttatggccacaagatggcgc

SEQ ID NO: 765213 - DNA, 20 bp, Artificial
  CRISPR gRNA sequence
acaagatggcgccagaccct

SEQ ID NO: 765214 - DNA, 20 bp, Artificial
  CRISPR gRNA sequence
cctcagctttgtcttcccca

SEQ ID NO: 765215 - DNA, 20 bp, Artificial
  CRISPR gRNA sequence
tcagctttgtcttccccacg

SEQ ID NO: 765216 - DNA, 20 bp, Artificial
  CRISPR gRNA sequence
cagctttgtcttccccacgg

SEQ ID NO: 765217 - DNA, 20 bp, Artificial
  CRISPR gRNA sequence
ctttgtcttccccacggagg

SEQ ID NO: 765218 - DNA, 20 bp, Artificial
  CRISPR gRNA sequence
ccccacggaggaagccgtct

SEQ ID NO: 765219 - DNA, 20 bp, Artificial
  CRISPR gRNA sequence
ccacggaggaagccgtctca

SEQ ID NO: 765220 - DNA, 20 bp, Artificial
  CRISPR gRNA sequence
cggaggaagccgtctcagag

SEQ ID NO: 765221 - DNA, 20 bp, Artificial
  CRISPR gRNA sequence
gaggaagccgtctcagagca

SEQ ID NO: 765222 - DNA, 20 bp, Artificial
  CRISPR gRNA sequence
ctcagagcagagatgctgat

SEQ ID NO: 765223 - DNA, 20 bp, Artificial
  CRISPR gRNA sequence
atgagaatttgaaatgtgat

SEQ ID NO: 765224 - DNA, 20 bp, Artificial
  CRISPR gRNA sequence
tgagaatttgaaatgtgatg

SEQ ID NO: 765225 - DNA, 20 bp, Artificial
  CRISPR gRNA sequence
tgatgaggatattgttatta

SEQ ID NO: 765226 - DNA, 20 bp, Artificial
  CRISPR gRNA sequence
tgaggatattgttattaaag

SEQ ID NO: 765227 - DNA, 20 bp, Artificial
  CRISPR gRNA sequence
ttaaagtagctattattatt

SEQ ID NO: 765228 - DNA, 20 bp, Artificial
  CRISPR gRNA sequence
ttgagtgcttcctgtgtgcc

SEQ ID NO: 765229 - DNA, 20 bp, Artificial
  CRISPR gRNA sequence
cctgtgtgccaagcaccgtg

SEQ ID NO: 765230 - DNA, 20 bp, Artificial
  CRISPR gRNA sequence
ctgtgtgccaagcaccgtgt

SEQ ID NO: 765231 - DNA, 20 bp, Artificial
  CRISPR gRNA sequence
tgtgtgccaagcaccgtgtg

SEQ ID NO: 765232 - DNA, 20 bp, Artificial
  CRISPR gRNA sequence
tgtgccaagcaccgtgtggg

SEQ ID NO: 765233 - DNA, 20 bp, Artificial
  CRISPR gRNA sequence
tgccaagcaccgtgtgggga

SEQ ID NO: 765234 - DNA, 20 bp, Artificial
  CRISPR gRNA sequence
gtcacatcgtttattctaca

SEQ ID NO: 765235 - DNA, 20 bp, Artificial
  CRISPR gRNA sequence
cgtttattctacacagttat

SEQ ID NO: 765236 - DNA, 20 bp, Artificial
  CRISPR gRNA sequence
gtttattctacacagttatt

SEQ ID NO: 765237 - DNA, 20 bp, Artificial
  CRISPR gRNA sequence
attgggcacctactatgcaa

SEQ ID NO: 765238 - DNA, 20 bp, Artificial
  CRISPR gRNA sequence
ctactatgcaacagccgctc

SEQ ID NO: 765239 - DNA, 20 bp, Artificial
  CRISPR gRNA sequence
gcaacagccgctctggccct

SEQ ID NO: 765240 - DNA, 20 bp, Artificial
  CRISPR gRNA sequence
cagccgctctggccctgaga

SEQ ID NO: 765241 - DNA, 20 bp, Artificial
  CRISPR gRNA sequence
gatggaccctgctctttgaa

SEQ ID NO: 765242 - DNA, 20 bp, Artificial
  CRISPR gRNA sequence
atggaccctgctctttgaac

SEQ ID NO: 765243 - DNA, 20 bp, Artificial
  CRISPR gRNA sequence
tggaccctgctctttgaaca

SEQ ID NO: 765244 - DNA, 20 bp, Artificial
  CRISPR gRNA sequence
gaccctgctctttgaacagg

SEQ ID NO: 765245 - DNA, 20 bp, Artificial
  CRISPR gRNA sequence
accctgctctttgaacaggg

SEQ ID NO: 765246 - DNA, 20 bp, Artificial
  CRISPR gRNA sequence
ctgctctttgaacagggagg

SEQ ID NO: 765247 - DNA, 20 bp, Artificial
  CRISPR gRNA sequence
tctttgaacagggaggaagc

SEQ ID NO: 765248 - DNA, 20 bp, Artificial
  CRISPR gRNA sequence
gggaggaagcaagcaaacgc

SEQ ID NO: 765249 - DNA, 20 bp, Artificial
  CRISPR gRNA sequence
ggaggaagcaagcaaacgcc

SEQ ID NO: 765250 - DNA, 20 bp, Artificial
  CRISPR gRNA sequence
ggaagcaagcaaacgccagg

SEQ ID NO: 765251 - DNA, 20 bp, Artificial
  CRISPR gRNA sequence
gaagcaagcaaacgccaggt

SEQ ID NO: 765252 - DNA, 20 bp, Artificial
  CRISPR gRNA sequence
aagcaagcaaacgccaggtg

SEQ ID NO: 765253 - DNA, 20 bp, Artificial
  CRISPR gRNA sequence
agcaagcaaacgccaggtgg

SEQ ID NO: 765254 - DNA, 20 bp, Artificial
  CRISPR gRNA sequence
acgccaggtgggggcgaatc

SEQ ID NO: 765255 - DNA, 20 bp, Artificial
  CRISPR gRNA sequence
cgccaggtgggggcgaatct

SEQ ID NO: 765256 - DNA, 20 bp, Artificial
  CRISPR gRNA sequence
caggtgggggcgaatctagg

SEQ ID NO: 765257 - DNA, 20 bp, Artificial
  CRISPR gRNA sequence
cgaatctaggcagaataacg

SEQ ID NO: 765258 - DNA, 20 bp, Artificial
  CRISPR gRNA sequence
gaatctaggcagaataacgc

SEQ ID NO: 765259 - DNA, 20 bp, Artificial
  CRISPR gRNA sequence
aatctaggcagaataacgca

SEQ ID NO: 765260 - DNA, 20 bp, Artificial
  CRISPR gRNA sequence
tctaggcagaataacgcagg

SEQ ID NO: 765261 - DNA, 20 bp, Artificial
  CRISPR gRNA sequence
ctaggcagaataacgcaggg

SEQ ID NO: 765262 - DNA, 20 bp, Artificial
  CRISPR gRNA sequence
gcagaataacgcagggaggc

SEQ ID NO: 765263 - DNA, 20 bp, Artificial
  CRISPR gRNA sequence
cagaataacgcagggaggcc

SEQ ID NO: 765264 - DNA, 20 bp, Artificial
  CRISPR gRNA sequence
agaataacgcagggaggcca

SEQ ID NO: 765265 - DNA, 20 bp, Artificial
  CRISPR gRNA sequence
taacgcagggaggccaggga

SEQ ID NO: 765266 - DNA, 20 bp, Artificial
  CRISPR gRNA sequence
aacgcagggaggccagggat

SEQ ID NO: 765267 - DNA, 20 bp, Artificial
  CRISPR gRNA sequence
acgcagggaggccagggata

SEQ ID NO: 765268 - DNA, 20 bp, Artificial
  CRISPR gRNA sequence
gcagggaggccagggatagg

SEQ ID NO: 765269 - DNA, 20 bp, Artificial
  CRISPR gRNA sequence
cagggaggccagggataggg

SEQ ID NO: 765270 - DNA, 20 bp, Artificial
  CRISPR gRNA sequence
agggaggccagggataggga

SEQ ID NO: 765271 - DNA, 20 bp, Artificial
  CRISPR gRNA sequence
ggaggccagggatagggagg

SEQ ID NO: 765272 - DNA, 20 bp, Artificial
  CRISPR gRNA sequence
gaggccagggatagggaggg

SEQ ID NO: 765273 - DNA, 20 bp, Artificial
  CRISPR gRNA sequence
ggccagggatagggagggag

SEQ ID NO: 765274 - DNA, 20 bp, Artificial
  CRISPR gRNA sequence
cagggatagggagggaggag

SEQ ID NO: 765275 - DNA, 20 bp, Artificial
  CRISPR gRNA sequence
gggatagggagggaggagcg

SEQ ID NO: 765276 - DNA, 20 bp, Artificial
  CRISPR gRNA sequence
ggatagggagggaggagcgg

SEQ ID NO: 765277 - DNA, 20 bp, Artificial
  CRISPR gRNA sequence
ggaggtgtgctattttatac

SEQ ID NO: 765278 - DNA, 20 bp, Artificial
  CRISPR gRNA sequence
gaggtgtgctattttataca

SEQ ID NO: 765279 - DNA, 20 bp, Artificial
  CRISPR gRNA sequence
aggtgtgctattttatacaa

SEQ ID NO: 765280 - DNA, 20 bp, Artificial
  CRISPR gRNA sequence
gtgtgctattttatacaagg

SEQ ID NO: 765281 - DNA, 20 bp, Artificial
  CRISPR gRNA sequence
gctattttatacaagggagc

SEQ ID NO: 765282 - DNA, 20 bp, Artificial
  CRISPR gRNA sequence
ctattttatacaagggagct

SEQ ID NO: 765283 - DNA, 20 bp, Artificial
  CRISPR gRNA sequence
attttatacaagggagctag

SEQ ID NO: 765284 - DNA, 20 bp, Artificial
  CRISPR gRNA sequence
tttatacaagggagctagga

SEQ ID NO: 765285 - DNA, 20 bp, Artificial
  CRISPR gRNA sequence
aagggagctaggagagcctt

SEQ ID NO: 765286 - DNA, 20 bp, Artificial
  CRISPR gRNA sequence
gggagctaggagagccttga

SEQ ID NO: 765287 - DNA, 20 bp, Artificial
  CRISPR gRNA sequence
ggagctaggagagccttgag

SEQ ID NO: 765288 - DNA, 20 bp, Artificial
  CRISPR gRNA sequence
agctaggagagccttgagag

SEQ ID NO: 765289 - DNA, 20 bp, Artificial
  CRISPR gRNA sequence
gctaggagagccttgagagg

SEQ ID NO: 765290 - DNA, 20 bp, Artificial
  CRISPR gRNA sequence
ccttgagaggaggtgacatt

SEQ ID NO: 765291 - DNA, 20 bp, Artificial
  CRISPR gRNA sequence
agaggaggtgacattgagca

SEQ ID NO: 765292 - DNA, 20 bp, Artificial
  CRISPR gRNA sequence
gcaaagacctccacaaaata

SEQ ID NO: 765293 - DNA, 20 bp, Artificial
  CRISPR gRNA sequence
caaagacctccacaaaatat

SEQ ID NO: 765294 - DNA, 20 bp, Artificial
  CRISPR gRNA sequence
cctccacaaaatatgggatc

SEQ ID NO: 765295 - DNA, 20 bp, Artificial
  CRISPR gRNA sequence
aaatatgggatccagtcatg

SEQ ID NO: 765296 - DNA, 20 bp, Artificial
  CRISPR gRNA sequence
gatccagtcatgcagacgtt

SEQ ID NO: 765297 - DNA, 20 bp, Artificial
  CRISPR gRNA sequence
atccagtcatgcagacgttt

SEQ ID NO: 765298 - DNA, 20 bp, Artificial
  CRISPR gRNA sequence
tccagtcatgcagacgttta

SEQ ID NO: 765299 - DNA, 20 bp, Artificial
  CRISPR gRNA sequence
ccagtcatgcagacgtttag

SEQ ID NO: 765300 - DNA, 20 bp, Artificial
  CRISPR gRNA sequence
gtcatgcagacgtttagggg

SEQ ID NO: 765301 - DNA, 20 bp, Artificial
  CRISPR gRNA sequence
tgcagacgtttaggggcaga

SEQ ID NO: 765302 - DNA, 20 bp, Artificial
  CRISPR gRNA sequence
cgtttaggggcagaaagttc

SEQ ID NO: 765303 - DNA, 20 bp, Artificial
  CRISPR gRNA sequence
gtttaggggcagaaagttcc

SEQ ID NO: 765304 - DNA, 20 bp, Artificial
  CRISPR gRNA sequence
taggggcagaaagttccagg

SEQ ID NO: 765305 - DNA, 20 bp, Artificial
  CRISPR gRNA sequence
ggggcagaaagttccaggca

SEQ ID NO: 765306 - DNA, 20 bp, Artificial
  CRISPR gRNA sequence
gggcagaaagttccaggcag

SEQ ID NO: 765307 - DNA, 20 bp, Artificial
  CRISPR gRNA sequence
agaaagttccaggcagagga

SEQ ID NO: 765308 - DNA, 20 bp, Artificial
  CRISPR gRNA sequence
aaagttccaggcagaggaaa

SEQ ID NO: 765309 - DNA, 20 bp, Artificial
  CRISPR gRNA sequence
ttccaggcagaggaaagagc

SEQ ID NO: 765310 - DNA, 20 bp, Artificial
  CRISPR gRNA sequence
caggcagaggaaagagcaag

SEQ ID NO: 765311 - DNA, 20 bp, Artificial
  CRISPR gRNA sequence
cagaggaaagagcaagtgga

SEQ ID NO: 765312 - DNA, 20 bp, Artificial
  CRISPR gRNA sequence
agaggaaagagcaagtggaa

SEQ ID NO: 765313 - DNA, 20 bp, Artificial
  CRISPR gRNA sequence
aagagcaagtggaaaggtcc

SEQ ID NO: 765314 - DNA, 20 bp, Artificial
  CRISPR gRNA sequence
agagcaagtggaaaggtcct

SEQ ID NO: 765315 - DNA, 20 bp, Artificial
  CRISPR gRNA sequence
agcaagtggaaaggtcctgg

SEQ ID NO: 765316 - DNA, 20 bp, Artificial
  CRISPR gRNA sequence
gcaagtggaaaggtcctggg

SEQ ID NO: 765317 - DNA, 20 bp, Artificial
  CRISPR gRNA sequence
caagtggaaaggtcctggga

SEQ ID NO: 765318 - DNA, 20 bp, Artificial
  CRISPR gRNA sequence
aagtggaaaggtcctgggag

SEQ ID NO: 765319 - DNA, 20 bp, Artificial
  CRISPR gRNA sequence
agtggaaaggtcctgggagg

SEQ ID NO: 765320 - DNA, 20 bp, Artificial
  CRISPR gRNA sequence
gtcctgggagggggcgcaca

SEQ ID NO: 765321 - DNA, 20 bp, Artificial
  CRISPR gRNA sequence
ggggcgcacacagtgtattc

SEQ ID NO: 765322 - DNA, 20 bp, Artificial
  CRISPR gRNA sequence
cacacagtgtattcaagaaa

SEQ ID NO: 765323 - DNA, 20 bp, Artificial
  CRISPR gRNA sequence
agaaatagcacgatctcatt

SEQ ID NO: 765324 - DNA, 20 bp, Artificial
  CRISPR gRNA sequence
gcactcatgttcccatttta

SEQ ID NO: 765325 - DNA, 20 bp, Artificial
  CRISPR gRNA sequence
catgttcccattttacagac

SEQ ID NO: 765326 - DNA, 20 bp, Artificial
  CRISPR gRNA sequence
atgttcccattttacagaca

SEQ ID NO: 765327 - DNA, 20 bp, Artificial
  CRISPR gRNA sequence
ccattttacagacaaggaaa

SEQ ID NO: 765328 - DNA, 20 bp, Artificial
  CRISPR gRNA sequence
attttacagacaaggaaatg

SEQ ID NO: 765329 - DNA, 20 bp, Artificial
  CRISPR gRNA sequence
ttttacagacaaggaaatgg

SEQ ID NO: 765330 - DNA, 20 bp, Artificial
  CRISPR gRNA sequence
cagacaaggaaatggaggct

SEQ ID NO: 765331 - DNA, 20 bp, Artificial
  CRISPR gRNA sequence
aaggaaatggaggctaagaa

SEQ ID NO: 765332 - DNA, 20 bp, Artificial
  CRISPR gRNA sequence
gaggctaagaacagtaacgt

SEQ ID NO: 765333 - DNA, 20 bp, Artificial
  CRISPR gRNA sequence
cagtaacgtgagttgcctac

SEQ ID NO: 765334 - DNA, 20 bp, Artificial
  CRISPR gRNA sequence
gagttgcctactggatccca

SEQ ID NO: 765335 - DNA, 20 bp, Artificial
  CRISPR gRNA sequence
agttgcctactggatcccac

SEQ ID NO: 765336 - DNA, 20 bp, Artificial
  CRISPR gRNA sequence
tgcctactggatcccacagg

SEQ ID NO: 765337 - DNA, 20 bp, Artificial
  CRISPR gRNA sequence
ctactggatcccacaggtgg

SEQ ID NO: 765338 - DNA, 20 bp, Artificial
  CRISPR gRNA sequence
tggatcccacaggtggaagt

SEQ ID NO: 765339 - DNA, 20 bp, Artificial
  CRISPR gRNA sequence
ggatcccacaggtggaagta

SEQ ID NO: 765340 - DNA, 20 bp, Artificial
  CRISPR gRNA sequence
ccacaggtggaagtaaggta

SEQ ID NO: 765341 - DNA, 20 bp, Artificial
  CRISPR gRNA sequence
gaagtaaggtatggccctgc

SEQ ID NO: 765342 - DNA, 20 bp, Artificial
  CRISPR gRNA sequence
taaggtatggccctgctagc

SEQ ID NO: 765343 - DNA, 20 bp, Artificial
  CRISPR gRNA sequence
aggtatggccctgctagcca

SEQ ID NO: 765344 - DNA, 20 bp, Artificial
  CRISPR gRNA sequence
atggccctgctagccagagc

SEQ ID NO: 765345 - DNA, 20 bp, Artificial
  CRISPR gRNA sequence
cctgctagccagagctggct

SEQ ID NO: 765346 - DNA, 20 bp, Artificial
  CRISPR gRNA sequence
gctagccagagctggcttgg

SEQ ID NO: 765347 - DNA, 20 bp, Artificial
  CRISPR gRNA sequence
ctagccagagctggcttggc

SEQ ID NO: 765348 - DNA, 20 bp, Artificial
  CRISPR gRNA sequence
tggcttggcaggacccctaa

SEQ ID NO: 765349 - DNA, 20 bp, Artificial
  CRISPR gRNA sequence
ggcttggcaggacccctaac

SEQ ID NO: 765350 - DNA, 20 bp, Artificial
  CRISPR gRNA sequence
ggcaggacccctaacaggcg

SEQ ID NO: 765351 - DNA, 20 bp, Artificial
  CRISPR gRNA sequence
gcaggacccctaacaggcgt

SEQ ID NO: 765352 - DNA, 20 bp, Artificial
  CRISPR gRNA sequence
atgctgctaccctcacctgt

SEQ ID NO: 765353 - DNA, 20 bp, Artificial
  CRISPR gRNA sequence
tgctgctaccctcacctgtg

SEQ ID NO: 765354 - DNA, 20 bp, Artificial
  CRISPR gRNA sequence
tgctaccctcacctgtgagg

SEQ ID NO: 765355 - DNA, 20 bp, Artificial
  CRISPR gRNA sequence
tcacctgtgaggcagaacca

SEQ ID NO: 765356 - DNA, 20 bp, Artificial
  CRISPR gRNA sequence
aggcagaaccacagtgctcc

SEQ ID NO: 765357 - DNA, 20 bp, Artificial
  CRISPR gRNA sequence
ggcagaaccacagtgctccc

SEQ ID NO: 765358 - DNA, 20 bp, Artificial
  CRISPR gRNA sequence
gcagaaccacagtgctccca

SEQ ID NO: 765359 - DNA, 20 bp, Artificial
  CRISPR gRNA sequence
acccacatgcacacccatgc

SEQ ID NO: 765360 - DNA, 20 bp, Artificial
  CRISPR gRNA sequence
cccacatgcacacccatgcc

SEQ ID NO: 765361 - DNA, 20 bp, Artificial
  CRISPR gRNA sequence
ccacatgcacacccatgcca

SEQ ID NO: 765362 - DNA, 20 bp, Artificial
  CRISPR gRNA sequence
ccagggctgccccgccgacg

SEQ ID NO: 765363 - DNA, 20 bp, Artificial
  CRISPR gRNA sequence
ccgacgcagcatcttcctgt

SEQ ID NO: 765364 - DNA, 20 bp, Artificial
  CRISPR gRNA sequence
cgacgcagcatcttcctgtg

SEQ ID NO: 765365 - DNA, 20 bp, Artificial
  CRISPR gRNA sequence
cgcagcatcttcctgtgagg

SEQ ID NO: 765366 - DNA, 20 bp, Artificial
  CRISPR gRNA sequence
tcttcctgtgaggcggctga

SEQ ID NO: 765367 - DNA, 20 bp, Artificial
  CRISPR gRNA sequence
cctgtgaggcggctgacagc

SEQ ID NO: 765368 - DNA, 20 bp, Artificial
  CRISPR gRNA sequence
ctgtgaggcggctgacagct

SEQ ID NO: 765369 - DNA, 20 bp, Artificial
  CRISPR gRNA sequence
gctgacagctgggctccccg

SEQ ID NO: 765370 - DNA, 20 bp, Artificial
  CRISPR gRNA sequence
gacagctgggctccccgtgg

SEQ ID NO: 765371 - DNA, 20 bp, Artificial
  CRISPR gRNA sequence
agctgggctccccgtggtgg

SEQ ID NO: 765372 - DNA, 20 bp, Artificial
  CRISPR gRNA sequence
gctgggctccccgtggtgga

SEQ ID NO: 765373 - DNA, 20 bp, Artificial
  CRISPR gRNA sequence
ggtggaaggctgcccctgcc

SEQ ID NO: 765374 - DNA, 20 bp, Artificial
  CRISPR gRNA sequence
gtggaaggctgcccctgcct

SEQ ID NO: 765375 - DNA, 20 bp, Artificial
  CRISPR gRNA sequence
ggaaggctgcccctgcctgg

SEQ ID NO: 765376 - DNA, 20 bp, Artificial
  CRISPR gRNA sequence
ggctgcccctgcctgggaga

SEQ ID NO: 765377 - DNA, 20 bp, Artificial
  CRISPR gRNA sequence
ctgcccctgcctgggagaaa

SEQ ID NO: 765378 - DNA, 20 bp, Artificial
  CRISPR gRNA sequence
tgcccctgcctgggagaaag

SEQ ID NO: 765379 - DNA, 20 bp, Artificial
  CRISPR gRNA sequence
gcctgggagaaagaggacgc

SEQ ID NO: 765380 - DNA, 20 bp, Artificial
  CRISPR gRNA sequence
cctgggagaaagaggacgca

SEQ ID NO: 765381 - DNA, 20 bp, Artificial
  CRISPR gRNA sequence
acgcaaggcctttgtctcca

SEQ ID NO: 765382 - DNA, 20 bp, Artificial
  CRISPR gRNA sequence
cgcaaggcctttgtctccaa

SEQ ID NO: 765383 - DNA, 20 bp, Artificial
  CRISPR gRNA sequence
ttgtctccaaaggttctccc

SEQ ID NO: 765384 - DNA, 20 bp, Artificial
  CRISPR gRNA sequence
atctcttgcctcatctctcc

SEQ ID NO: 765385 - DNA, 20 bp, Artificial
  CRISPR gRNA sequence
ttgcctcatctctcctggac

SEQ ID NO: 765386 - DNA, 20 bp, Artificial
  CRISPR gRNA sequence
gcctcatctctcctggacca

SEQ ID NO: 765387 - DNA, 20 bp, Artificial
  CRISPR gRNA sequence
tcatctctcctggaccagag

SEQ ID NO: 765388 - DNA, 20 bp, Artificial
  CRISPR gRNA sequence
catctctcctggaccagagt

SEQ ID NO: 765389 - DNA, 20 bp, Artificial
  CRISPR gRNA sequence
atctctcctggaccagagtg

SEQ ID NO: 765390 - DNA, 20 bp, Artificial
  CRISPR gRNA sequence
tctcctggaccagagtgggg

SEQ ID NO: 765391 - DNA, 20 bp, Artificial
  CRISPR gRNA sequence
ctcctggaccagagtgggga

SEQ ID NO: 765392 - DNA, 20 bp, Artificial
  CRISPR gRNA sequence
ggaaggctgcaactgcccac

SEQ ID NO: 765393 - DNA, 20 bp, Artificial
  CRISPR gRNA sequence
gaaggctgcaactgcccact

SEQ ID NO: 765394 - DNA, 20 bp, Artificial
  CRISPR gRNA sequence
aggctgcaactgcccactgg

SEQ ID NO: 765395 - DNA, 20 bp, Artificial
  CRISPR gRNA sequence
ggctgcaactgcccactggg

SEQ ID NO: 765396 - DNA, 20 bp, Artificial
  CRISPR gRNA sequence
tcctcattcccatatcccac

SEQ ID NO: 765397 - DNA, 20 bp, Artificial
  CRISPR gRNA sequence
cctcattcccatatcccacc

SEQ ID NO: 765398 - DNA, 20 bp, Artificial
  CRISPR gRNA sequence
atcccaccgggccccctgct

SEQ ID NO: 765399 - DNA, 20 bp, Artificial
  CRISPR gRNA sequence
tcccaccgggccccctgctg

SEQ ID NO: 765400 - DNA, 20 bp, Artificial
  CRISPR gRNA sequence
ggccccctgctgaggaatct

SEQ ID NO: 765401 - DNA, 20 bp, Artificial
  CRISPR gRNA sequence
ctgctgaggaatcttggtga

SEQ ID NO: 765402 - DNA, 20 bp, Artificial
  CRISPR gRNA sequence
gaatcttggtgacagatgct

SEQ ID NO: 765403 - DNA, 20 bp, Artificial
  CRISPR gRNA sequence
tcttggtgacagatgcttgg

SEQ ID NO: 765404 - DNA, 20 bp, Artificial
  CRISPR gRNA sequence
cttggtgacagatgcttggc

SEQ ID NO: 765405 - DNA, 20 bp, Artificial
  CRISPR gRNA sequence
ttggtgacagatgcttggca

SEQ ID NO: 765406 - DNA, 20 bp, Artificial
  CRISPR gRNA sequence
ggtgacagatgcttggcagg

SEQ ID NO: 765407 - DNA, 20 bp, Artificial
  CRISPR gRNA sequence
gatgcttggcagggagtccc

SEQ ID NO: 765408 - DNA, 20 bp, Artificial
  CRISPR gRNA sequence
atgcttggcagggagtccct

SEQ ID NO: 765409 - DNA, 20 bp, Artificial
  CRISPR gRNA sequence
tgcttggcagggagtccctg

SEQ ID NO: 765410 - DNA, 20 bp, Artificial
  CRISPR gRNA sequence
cttggcagggagtccctggg

SEQ ID NO: 765411 - DNA, 20 bp, Artificial
  CRISPR gRNA sequence
ttggcagggagtccctgggg

SEQ ID NO: 765412 - DNA, 20 bp, Artificial
  CRISPR gRNA sequence
gagtccctggggaggcctga

SEQ ID NO: 765413 - DNA, 20 bp, Artificial
  CRISPR gRNA sequence
agtccctggggaggcctgac

SEQ ID NO: 765414 - DNA, 20 bp, Artificial
  CRISPR gRNA sequence
gtccctggggaggcctgaca

SEQ ID NO: 765415 - DNA, 20 bp, Artificial
  CRISPR gRNA sequence
cctggggaggcctgacaggg

SEQ ID NO: 765416 - DNA, 20 bp, Artificial
  CRISPR gRNA sequence
gggaggcctgacagggaaga

SEQ ID NO: 765417 - DNA, 20 bp, Artificial
  CRISPR gRNA sequence
ggaggcctgacagggaagat

SEQ ID NO: 765418 - DNA, 20 bp, Artificial
  CRISPR gRNA sequence
gaggcctgacagggaagatg

SEQ ID NO: 765419 - DNA, 20 bp, Artificial
  CRISPR gRNA sequence
gcctgacagggaagatgggg

SEQ ID NO: 765420 - DNA, 20 bp, Artificial
  CRISPR gRNA sequence
cctgacagggaagatggggt

SEQ ID NO: 765421 - DNA, 20 bp, Artificial
  CRISPR gRNA sequence
ctgacagggaagatggggta

SEQ ID NO: 765422 - DNA, 20 bp, Artificial
  CRISPR gRNA sequence
tgacagggaagatggggtag

SEQ ID NO: 765423 - DNA, 20 bp, Artificial
  CRISPR gRNA sequence
gacagggaagatggggtagg

SEQ ID NO: 765424 - DNA, 20 bp, Artificial
  CRISPR gRNA sequence
agggaagatggggtaggggg

SEQ ID NO: 765425 - DNA, 20 bp, Artificial
  CRISPR gRNA sequence
aagatggggtagggggcagc

SEQ ID NO: 765426 - DNA, 20 bp, Artificial
  CRISPR gRNA sequence
agatggggtagggggcagct

SEQ ID NO: 765427 - DNA, 20 bp, Artificial
  CRISPR gRNA sequence
gcagctgggatccacccttt

SEQ ID NO: 765428 - DNA, 20 bp, Artificial
  CRISPR gRNA sequence
tgggatccaccctttcagct

SEQ ID NO: 765429 - DNA, 20 bp, Artificial
  CRISPR gRNA sequence
caccctttcagctaagatgt

SEQ ID NO: 765430 - DNA, 20 bp, Artificial
  CRISPR gRNA sequence
agatgttagtatccaaatat

SEQ ID NO: 765431 - DNA, 20 bp, Artificial
  CRISPR gRNA sequence
gatgttagtatccaaatata

SEQ ID NO: 765432 - DNA, 20 bp, Artificial
  CRISPR gRNA sequence
gttagtatccaaatataagg

SEQ ID NO: 765433 - DNA, 20 bp, Artificial
  CRISPR gRNA sequence
tagtatccaaatataaggaa

SEQ ID NO: 765434 - DNA, 20 bp, Artificial
  CRISPR gRNA sequence
agtatccaaatataaggaag

SEQ ID NO: 765435 - DNA, 20 bp, Artificial
  CRISPR gRNA sequence
tatccaaatataaggaagag

SEQ ID NO: 765436 - DNA, 20 bp, Artificial
  CRISPR gRNA sequence
atccaaatataaggaagagg

SEQ ID NO: 765437 - DNA, 20 bp, Artificial
  CRISPR gRNA sequence
aaatataaggaagaggaggc

SEQ ID NO: 765438 - DNA, 20 bp, Artificial
  CRISPR gRNA sequence
aatataaggaagaggaggca

SEQ ID NO: 765439 - DNA, 20 bp, Artificial
  CRISPR gRNA sequence
ataaggaagaggaggcaagg

SEQ ID NO: 765440 - DNA, 20 bp, Artificial
  CRISPR gRNA sequence
ggaagaggaggcaaggcggc

SEQ ID NO: 765441 - DNA, 20 bp, Artificial
  CRISPR gRNA sequence
aggaggcaaggcggcaagtg

SEQ ID NO: 765442 - DNA, 20 bp, Artificial
  CRISPR gRNA sequence
ggaggcaaggcggcaagtga

SEQ ID NO: 765443 - DNA, 20 bp, Artificial
  CRISPR gRNA sequence
gcaaggcggcaagtgaaggc

SEQ ID NO: 765444 - DNA, 20 bp, Artificial
  CRISPR gRNA sequence
caaggcggcaagtgaaggca

SEQ ID NO: 765445 - DNA, 20 bp, Artificial
  CRISPR gRNA sequence
gcggcaagtgaaggcaaggt

SEQ ID NO: 765446 - DNA, 20 bp, Artificial
  CRISPR gRNA sequence
aaggcaaggttggcttgctc

SEQ ID NO: 765447 - DNA, 20 bp, Artificial
  CRISPR gRNA sequence
aggcaaggttggcttgctct

SEQ ID NO: 765448 - DNA, 20 bp, Artificial
  CRISPR gRNA sequence
ggcaaggttggcttgctctg

SEQ ID NO: 765449 - DNA, 20 bp, Artificial
  CRISPR gRNA sequence
aggttggcttgctctggggc

SEQ ID NO: 765450 - DNA, 20 bp, Artificial
  CRISPR gRNA sequence
ggttggcttgctctggggct

SEQ ID NO: 765451 - DNA, 20 bp, Artificial
  CRISPR gRNA sequence
ctctggggctaggatgtgtg

SEQ ID NO: 765452 - DNA, 20 bp, Artificial
  CRISPR gRNA sequence
aggatgtgtgcagatcaatt

SEQ ID NO: 765453 - DNA, 20 bp, Artificial
  CRISPR gRNA sequence
atgtgtgcagatcaatttgg

SEQ ID NO: 765454 - DNA, 20 bp, Artificial
  CRISPR gRNA sequence
gtgcagatcaatttggcaga

SEQ ID NO: 765455 - DNA, 20 bp, Artificial
  CRISPR gRNA sequence
cagatcaatttggcagacag

SEQ ID NO: 765456 - DNA, 20 bp, Artificial
  CRISPR gRNA sequence
tcaatttggcagacagtagc

SEQ ID NO: 765457 - DNA, 20 bp, Artificial
  CRISPR gRNA sequence
atttggcagacagtagctgg

SEQ ID NO: 765458 - DNA, 20 bp, Artificial
  CRISPR gRNA sequence
tttggcagacagtagctggt

SEQ ID NO: 765459 - DNA, 20 bp, Artificial
  CRISPR gRNA sequence
ttggcagacagtagctggta

SEQ ID NO: 765460 - DNA, 20 bp, Artificial
  CRISPR gRNA sequence
gcagacagtagctggtaggg

SEQ ID NO: 765461 - DNA, 20 bp, Artificial
  CRISPR gRNA sequence
agacagtagctggtagggca

SEQ ID NO: 765462 - DNA, 20 bp, Artificial
  CRISPR gRNA sequence
cagtagctggtagggcagag

SEQ ID NO: 765463 - DNA, 20 bp, Artificial
  CRISPR gRNA sequence
agtagctggtagggcagagc

SEQ ID NO: 765464 - DNA, 20 bp, Artificial
  CRISPR gRNA sequence
tagctggtagggcagagcag

SEQ ID NO: 765465 - DNA, 20 bp, Artificial
  CRISPR gRNA sequence
gggcagagcaggagctcctg

SEQ ID NO: 765466 - DNA, 20 bp, Artificial
  CRISPR gRNA sequence
ggcagagcaggagctcctgt

SEQ ID NO: 765467 - DNA, 20 bp, Artificial
  CRISPR gRNA sequence
gcagagcaggagctcctgtg

SEQ ID NO: 765468 - DNA, 20 bp, Artificial
  CRISPR gRNA sequence
cagagcaggagctcctgtgg

SEQ ID NO: 765469 - DNA, 20 bp, Artificial
  CRISPR gRNA sequence
gcaggagctcctgtgggggc

SEQ ID NO: 765470 - DNA, 20 bp, Artificial
  CRISPR gRNA sequence
gctcctgtgggggccagact

SEQ ID NO: 765471 - DNA, 20 bp, Artificial
  CRISPR gRNA sequence
tcctgtgggggccagactta

SEQ ID NO: 765472 - DNA, 20 bp, Artificial
  CRISPR gRNA sequence
gtgggggccagacttagaga

SEQ ID NO: 765473 - DNA, 20 bp, Artificial
  CRISPR gRNA sequence
tgggggccagacttagagat

SEQ ID NO: 765474 - DNA, 20 bp, Artificial
  CRISPR gRNA sequence
cagacttagagatgggctga

SEQ ID NO: 765475 - DNA, 20 bp, Artificial
  CRISPR gRNA sequence
agacttagagatgggctgac

SEQ ID NO: 765476 - DNA, 20 bp, Artificial
  CRISPR gRNA sequence
caggtgtgaaatgtatccta

SEQ ID NO: 765477 - DNA, 20 bp, Artificial
  CRISPR gRNA sequence
aggtgtgaaatgtatcctaa

SEQ ID NO: 765478 - DNA, 20 bp, Artificial
  CRISPR gRNA sequence
tgtgaaatgtatcctaaagg

SEQ ID NO: 765479 - DNA, 20 bp, Artificial
  CRISPR gRNA sequence
aatgtatcctaaaggcagtt

SEQ ID NO: 765480 - DNA, 20 bp, Artificial
  CRISPR gRNA sequence
tgtatcctaaaggcagttga

SEQ ID NO: 765481 - DNA, 20 bp, Artificial
  CRISPR gRNA sequence
aaggcagttgagagccactg

SEQ ID NO: 765482 - DNA, 20 bp, Artificial
  CRISPR gRNA sequence
gccactgaagcttcctgaat

SEQ ID NO: 765483 - DNA, 20 bp, Artificial
  CRISPR gRNA sequence
ccactgaagcttcctgaata

SEQ ID NO: 765484 - DNA, 20 bp, Artificial
  CRISPR gRNA sequence
cactgaagcttcctgaataa

SEQ ID NO: 765485 - DNA, 20 bp, Artificial
  CRISPR gRNA sequence
tcctgaataagggaaataca

SEQ ID NO: 765486 - DNA, 20 bp, Artificial
  CRISPR gRNA sequence
gaataagggaaatacacggt

SEQ ID NO: 765487 - DNA, 20 bp, Artificial
  CRISPR gRNA sequence
ataagggaaatacacggtca

SEQ ID NO: 765488 - DNA, 20 bp, Artificial
  CRISPR gRNA sequence
ggaaatacacggtcagagct

SEQ ID NO: 765489 - DNA, 20 bp, Artificial
  CRISPR gRNA sequence
ggtcagagctgagcttcatg

SEQ ID NO: 765490 - DNA, 20 bp, Artificial
  CRISPR gRNA sequence
cttcatgaagattaatctga

SEQ ID NO: 765491 - DNA, 20 bp, Artificial
  CRISPR gRNA sequence
cacctccacccgctatctga

SEQ ID NO: 765492 - DNA, 20 bp, Artificial
  CRISPR gRNA sequence
acctccacccgctatctgat

SEQ ID NO: 765493 - DNA, 20 bp, Artificial
  CRISPR gRNA sequence
ctccacccgctatctgatgg

SEQ ID NO: 765494 - DNA, 20 bp, Artificial
  CRISPR gRNA sequence
tccacccgctatctgatggg

SEQ ID NO: 765495 - DNA, 20 bp, Artificial
  CRISPR gRNA sequence
ccacccgctatctgatggga

SEQ ID NO: 765496 - DNA, 20 bp, Artificial
  CRISPR gRNA sequence
tctgatgggagggtatgttt

SEQ ID NO: 765497 - DNA, 20 bp, Artificial
  CRISPR gRNA sequence
atgggagggtatgtttcagc

SEQ ID NO: 765498 - DNA, 20 bp, Artificial
  CRISPR gRNA sequence
gggtatgtttcagccagatc

SEQ ID NO: 765499 - DNA, 20 bp, Artificial
  CRISPR gRNA sequence
tatgtttcagccagatcaag

SEQ ID NO: 765500 - DNA, 20 bp, Artificial
  CRISPR gRNA sequence
atgtttcagccagatcaagc

SEQ ID NO: 765501 - DNA, 20 bp, Artificial
  CRISPR gRNA sequence
tgtttcagccagatcaagca

SEQ ID NO: 765502 - DNA, 20 bp, Artificial
  CRISPR gRNA sequence
gccagatcaagcagggcttt

SEQ ID NO: 765503 - DNA, 20 bp, Artificial
  CRISPR gRNA sequence
cagatcaagcagggctttga

SEQ ID NO: 765504 - DNA, 20 bp, Artificial
  CRISPR gRNA sequence
caagcagggctttgagagac

SEQ ID NO: 765505 - DNA, 20 bp, Artificial
  CRISPR gRNA sequence
cagggctttgagagaccagt

SEQ ID NO: 765506 - DNA, 20 bp, Artificial
  CRISPR gRNA sequence
agggctttgagagaccagtg

SEQ ID NO: 765507 - DNA, 20 bp, Artificial
  CRISPR gRNA sequence
tgagagaccagtgaggaatt

SEQ ID NO: 765508 - DNA, 20 bp, Artificial
  CRISPR gRNA sequence
gagagaccagtgaggaattt

SEQ ID NO: 765509 - DNA, 20 bp, Artificial
  CRISPR gRNA sequence
aggaatttgggtttttctat

SEQ ID NO: 765510 - DNA, 20 bp, Artificial
  CRISPR gRNA sequence
ttgggtttttctatgagtaa

SEQ ID NO: 765511 - DNA, 20 bp, Artificial
  CRISPR gRNA sequence
tgggtttttctatgagtaat

SEQ ID NO: 765512 - DNA, 20 bp, Artificial
  CRISPR gRNA sequence
ctatgagtaatgggaatcac

SEQ ID NO: 765513 - DNA, 20 bp, Artificial
  CRISPR gRNA sequence
tatgagtaatgggaatcact

SEQ ID NO: 765514 - DNA, 20 bp, Artificial
  CRISPR gRNA sequence
atgagtaatgggaatcactg

SEQ ID NO: 765515 - DNA, 20 bp, Artificial
  CRISPR gRNA sequence
gagtaatgggaatcactggg

SEQ ID NO: 765516 - DNA, 20 bp, Artificial
  CRISPR gRNA sequence
cattttaatcacacataatc

SEQ ID NO: 765517 - DNA, 20 bp, Artificial
  CRISPR gRNA sequence
attttaatcacacataatct

SEQ ID NO: 765518 - DNA, 20 bp, Artificial
  CRISPR gRNA sequence
acaatgtttaaaacccactc

SEQ ID NO: 765519 - DNA, 20 bp, Artificial
  CRISPR gRNA sequence
taaaacccactctagctcct

SEQ ID NO: 765520 - DNA, 20 bp, Artificial
  CRISPR gRNA sequence
cccactctagctcctcagca

SEQ ID NO: 765521 - DNA, 20 bp, Artificial
  CRISPR gRNA sequence
tctagctcctcagcatagac

SEQ ID NO: 765522 - DNA, 20 bp, Artificial
  CRISPR gRNA sequence
cagcatagactggattgtat

SEQ ID NO: 765523 - DNA, 20 bp, Artificial
  CRISPR gRNA sequence
agcatagactggattgtatc

SEQ ID NO: 765524 - DNA, 20 bp, Artificial
  CRISPR gRNA sequence
gcatagactggattgtatca

SEQ ID NO: 765525 - DNA, 20 bp, Artificial
  CRISPR gRNA sequence
agactggattgtatcagggc

SEQ ID NO: 765526 - DNA, 20 bp, Artificial
  CRISPR gRNA sequence
gactggattgtatcagggca

SEQ ID NO: 765527 - DNA, 20 bp, Artificial
  CRISPR gRNA sequence
actggattgtatcagggcaa

SEQ ID NO: 765528 - DNA, 20 bp, Artificial
  CRISPR gRNA sequence
tggattgtatcagggcaagg

SEQ ID NO: 765529 - DNA, 20 bp, Artificial
  CRISPR gRNA sequence
gattgtatcagggcaaggga

SEQ ID NO: 765530 - DNA, 20 bp, Artificial
  CRISPR gRNA sequence
attgtatcagggcaagggag

SEQ ID NO: 765531 - DNA, 20 bp, Artificial
  CRISPR gRNA sequence
tatcagggcaagggagaggc

SEQ ID NO: 765532 - DNA, 20 bp, Artificial
  CRISPR gRNA sequence
gggcaagggagaggccagtt

SEQ ID NO: 765533 - DNA, 20 bp, Artificial
  CRISPR gRNA sequence
gcaagggagaggccagttaa

SEQ ID NO: 765534 - DNA, 20 bp, Artificial
  CRISPR gRNA sequence
caagggagaggccagttaag

SEQ ID NO: 765535 - DNA, 20 bp, Artificial
  CRISPR gRNA sequence
ggccagttaagaggctattt

SEQ ID NO: 765536 - DNA, 20 bp, Artificial
  CRISPR gRNA sequence
gccagttaagaggctatttc

SEQ ID NO: 765537 - DNA, 20 bp, Artificial
  CRISPR gRNA sequence
ttaagaggctatttcaggct

SEQ ID NO: 765538 - DNA, 20 bp, Artificial
  CRISPR gRNA sequence
aggctatttcaggctgagtg

SEQ ID NO: 765539 - DNA, 20 bp, Artificial
  CRISPR gRNA sequence
ctatttcaggctgagtgcag

SEQ ID NO: 765540 - DNA, 20 bp, Artificial
  CRISPR gRNA sequence
gtggctcatgcctgtaatcc

SEQ ID NO: 765541 - DNA, 20 bp, Artificial
  CRISPR gRNA sequence
tgcctgtaatcccagcactt

SEQ ID NO: 765542 - DNA, 20 bp, Artificial
  CRISPR gRNA sequence
gcctgtaatcccagcacttt

SEQ ID NO: 765543 - DNA, 20 bp, Artificial
  CRISPR gRNA sequence
ctgtaatcccagcactttgg

SEQ ID NO: 765544 - DNA, 20 bp, Artificial
  CRISPR gRNA sequence
tgtaatcccagcactttggg

SEQ ID NO: 765545 - DNA, 20 bp, Artificial
  CRISPR gRNA sequence
tcccagcactttgggaggct

SEQ ID NO: 765546 - DNA, 20 bp, Artificial
  CRISPR gRNA sequence
cccagcactttgggaggctg

SEQ ID NO: 765547 - DNA, 20 bp, Artificial
  CRISPR gRNA sequence
agcactttgggaggctgagg

SEQ ID NO: 765548 - DNA, 20 bp, Artificial
  CRISPR gRNA sequence
gcactttgggaggctgaggc

SEQ ID NO: 765549 - DNA, 20 bp, Artificial
  CRISPR gRNA sequence
tgaggcaggcgaatcacttg

SEQ ID NO: 765550 - DNA, 20 bp, Artificial
  CRISPR gRNA sequence
gcaggcgaatcacttgaagt

SEQ ID NO: 765551 - DNA, 20 bp, Artificial
  CRISPR gRNA sequence
caggcgaatcacttgaagtc

SEQ ID NO: 765552 - DNA, 20 bp, Artificial
  CRISPR gRNA sequence
ggcgaatcacttgaagtcag

SEQ ID NO: 765553 - DNA, 20 bp, Artificial
  CRISPR gRNA sequence
tgaagtcaggagtttgtgac

SEQ ID NO: 765554 - DNA, 20 bp, Artificial
  CRISPR gRNA sequence
tgtgaccggtttgaacaaca

SEQ ID NO: 765555 - DNA, 20 bp, Artificial
  CRISPR gRNA sequence
ctactaaaaatacaaataat

SEQ ID NO: 765556 - DNA, 20 bp, Artificial
  CRISPR gRNA sequence
taaaaatacaaataattagc

SEQ ID NO: 765557 - DNA, 20 bp, Artificial
  CRISPR gRNA sequence
aaaaatacaaataattagct

SEQ ID NO: 765558 - DNA, 20 bp, Artificial
  CRISPR gRNA sequence
tacaaataattagctgggca

SEQ ID NO: 765559 - DNA, 20 bp, Artificial
  CRISPR gRNA sequence
aaataattagctgggcatgg

SEQ ID NO: 765560 - DNA, 20 bp, Artificial
  CRISPR gRNA sequence
taattagctgggcatggtgg

SEQ ID NO: 765561 - DNA, 20 bp, Artificial
  CRISPR gRNA sequence
aattagctgggcatggtggt

SEQ ID NO: 765562 - DNA, 20 bp, Artificial
  CRISPR gRNA sequence
gtggtgggcacctgtaatcc

SEQ ID NO: 765563 - DNA, 20 bp, Artificial
  CRISPR gRNA sequence
cacctgtaatcccagctact

SEQ ID NO: 765564 - DNA, 20 bp, Artificial
  CRISPR gRNA sequence
acctgtaatcccagctactt

SEQ ID NO: 765565 - DNA, 20 bp, Artificial
  CRISPR gRNA sequence
ctgtaatcccagctacttgg

SEQ ID NO: 765566 - DNA, 20 bp, Artificial
  CRISPR gRNA sequence
tgtaatcccagctacttggg

SEQ ID NO: 765567 - DNA, 20 bp, Artificial
  CRISPR gRNA sequence
gtaatcccagctacttggga

SEQ ID NO: 765568 - DNA, 20 bp, Artificial
  CRISPR gRNA sequence
tcccagctacttgggagggt

SEQ ID NO: 765569 - DNA, 20 bp, Artificial
  CRISPR gRNA sequence
cccagctacttgggagggtg

SEQ ID NO: 765570 - DNA, 20 bp, Artificial
  CRISPR gRNA sequence
agctacttgggagggtgagg

SEQ ID NO: 765571 - DNA, 20 bp, Artificial
  CRISPR gRNA sequence
gctacttgggagggtgaggc

SEQ ID NO: 765572 - DNA, 20 bp, Artificial
  CRISPR gRNA sequence
tacttgggagggtgaggcag

SEQ ID NO: 765573 - DNA, 20 bp, Artificial
  CRISPR gRNA sequence
gggtgaggcaggagaattgc

SEQ ID NO: 765574 - DNA, 20 bp, Artificial
  CRISPR gRNA sequence
gcaggagaattgctagaacc

SEQ ID NO: 765575 - DNA, 20 bp, Artificial
  CRISPR gRNA sequence
caggagaattgctagaaccc

SEQ ID NO: 765576 - DNA, 20 bp, Artificial
  CRISPR gRNA sequence
ggagaattgctagaacccag

SEQ ID NO: 765577 - DNA, 20 bp, Artificial
  CRISPR gRNA sequence
gagaattgctagaacccagg

SEQ ID NO: 765578 - DNA, 20 bp, Artificial
  CRISPR gRNA sequence
aattgctagaacccaggagg

SEQ ID NO: 765579 - DNA, 20 bp, Artificial
  CRISPR gRNA sequence
ttgctagaacccaggaggca

SEQ ID NO: 765580 - DNA, 20 bp, Artificial
  CRISPR gRNA sequence
tgctagaacccaggaggcag

SEQ ID NO: 765581 - DNA, 20 bp, Artificial
  CRISPR gRNA sequence
aacccaggaggcagaggttg

SEQ ID NO: 765582 - DNA, 20 bp, Artificial
  CRISPR gRNA sequence
caggaggcagaggttgcagt

SEQ ID NO: 765583 - DNA, 20 bp, Artificial
  CRISPR gRNA sequence
ggcagaggttgcagtaagcc

SEQ ID NO: 765584 - DNA, 20 bp, Artificial
  CRISPR gRNA sequence
aagattgcaccactgcactc

SEQ ID NO: 765585 - DNA, 20 bp, Artificial
  CRISPR gRNA sequence
tgcaccactgcactccagac

SEQ ID NO: 765586 - DNA, 20 bp, Artificial
  CRISPR gRNA sequence
gcaccactgcactccagact

SEQ ID NO: 765587 - DNA, 20 bp, Artificial
  CRISPR gRNA sequence
ctgcactccagactgggtga

SEQ ID NO: 765588 - DNA, 20 bp, Artificial
  CRISPR gRNA sequence
gcactccagactgggtgaca

SEQ ID NO: 765589 - DNA, 20 bp, Artificial
  CRISPR gRNA sequence
tccagactgggtgacagagc

SEQ ID NO: 765590 - DNA, 20 bp, Artificial
  CRISPR gRNA sequence
tcaaaaaataaaaataaaaa

SEQ ID NO: 765591 - DNA, 20 bp, Artificial
  CRISPR gRNA sequence
aaaaaataaaaataaaaaaa

SEQ ID NO: 765592 - DNA, 20 bp, Artificial
  CRISPR gRNA sequence
aaaaataaaaataaaaaaag

SEQ ID NO: 765593 - DNA, 20 bp, Artificial
  CRISPR gRNA sequence
aataaaaaaagaggctaata

SEQ ID NO: 765594 - DNA, 20 bp, Artificial
  CRISPR gRNA sequence
ggctaatatagccatccctg

SEQ ID NO: 765595 - DNA, 20 bp, Artificial
  CRISPR gRNA sequence
gctaatatagccatccctgt

SEQ ID NO: 765596 - DNA, 20 bp, Artificial
  CRISPR gRNA sequence
aatatagccatccctgtagg

SEQ ID NO: 765597 - DNA, 20 bp, Artificial
  CRISPR gRNA sequence
atatagccatccctgtagga

SEQ ID NO: 765598 - DNA, 20 bp, Artificial
  CRISPR gRNA sequence
gccatccctgtaggaaggta

SEQ ID NO: 765599 - DNA, 20 bp, Artificial
  CRISPR gRNA sequence
atccctgtaggaaggtatag

SEQ ID NO: 765600 - DNA, 20 bp, Artificial
  CRISPR gRNA sequence
cctgtaggaaggtatagtgg

SEQ ID NO: 765601 - DNA, 20 bp, Artificial
  CRISPR gRNA sequence
gtatagtggtggaataaatg

SEQ ID NO: 765602 - DNA, 20 bp, Artificial
  CRISPR gRNA sequence
tatagtggtggaataaatga

SEQ ID NO: 765603 - DNA, 20 bp, Artificial
  CRISPR gRNA sequence
atagtggtggaataaatgaa

SEQ ID NO: 765604 - DNA, 20 bp, Artificial
  CRISPR gRNA sequence
tggtggaataaatgaagggc

SEQ ID NO: 765605 - DNA, 20 bp, Artificial
  CRISPR gRNA sequence
ggaataaatgaagggccaga

SEQ ID NO: 765606 - DNA, 20 bp, Artificial
  CRISPR gRNA sequence
gaataaatgaagggccagac

SEQ ID NO: 765607 - DNA, 20 bp, Artificial
  CRISPR gRNA sequence
ataaatgaagggccagacag

SEQ ID NO: 765608 - DNA, 20 bp, Artificial
  CRISPR gRNA sequence
gaagggccagacaggagaca

SEQ ID NO: 765609 - DNA, 20 bp, Artificial
  CRISPR gRNA sequence
gacaggagacaaagcatgtc

SEQ ID NO: 765610 - DNA, 20 bp, Artificial
  CRISPR gRNA sequence
acaggagacaaagcatgtct

SEQ ID NO: 765611 - DNA, 20 bp, Artificial
  CRISPR gRNA sequence
gacaaagcatgtctgggtaa

SEQ ID NO: 765612 - DNA, 20 bp, Artificial
  CRISPR gRNA sequence
gcatgtctgggtaaaagtga

SEQ ID NO: 765613 - DNA, 20 bp, Artificial
  CRISPR gRNA sequence
gggtaaaagtgacagtatct

SEQ ID NO: 765614 - DNA, 20 bp, Artificial
  CRISPR gRNA sequence
ggtaaaagtgacagtatctg

SEQ ID NO: 765615 - DNA, 20 bp, Artificial
  CRISPR gRNA sequence
agtgacagtatctgaggact

SEQ ID NO: 765616 - DNA, 20 bp, Artificial
  CRISPR gRNA sequence
gtgacagtatctgaggactt

SEQ ID NO: 765617 - DNA, 20 bp, Artificial
  CRISPR gRNA sequence
acagtatctgaggacttggg

SEQ ID NO: 765618 - DNA, 20 bp, Artificial
  CRISPR gRNA sequence
agtatctgaggacttgggta

SEQ ID NO: 765619 - DNA, 20 bp, Artificial
  CRISPR gRNA sequence
tatctgaggacttgggtaga

SEQ ID NO: 765620 - DNA, 20 bp, Artificial
  CRISPR gRNA sequence
tgaggacttgggtagagaga

SEQ ID NO: 765621 - DNA, 20 bp, Artificial
  CRISPR gRNA sequence
aggacttgggtagagagaaa

SEQ ID NO: 765622 - DNA, 20 bp, Artificial
  CRISPR gRNA sequence
acttgggtagagagaaagag

SEQ ID NO: 765623 - DNA, 20 bp, Artificial
  CRISPR gRNA sequence
gggtagagagaaagagcagt

SEQ ID NO: 765624 - DNA, 20 bp, Artificial
  CRISPR gRNA sequence
ggtagagagaaagagcagtc

SEQ ID NO: 765625 - DNA, 20 bp, Artificial
  CRISPR gRNA sequence
gagagaaagagcagtcaggt

SEQ ID NO: 765626 - DNA, 20 bp, Artificial
  CRISPR gRNA sequence
aagagcagtcaggttggccg

SEQ ID NO: 765627 - DNA, 20 bp, Artificial
  CRISPR gRNA sequence
gtcaggttggccgtggtttt

SEQ ID NO: 765628 - DNA, 20 bp, Artificial
  CRISPR gRNA sequence
ttggccgtggttttgagcct

SEQ ID NO: 765629 - DNA, 20 bp, Artificial
  CRISPR gRNA sequence
gtggttttgagcctcagtga

SEQ ID NO: 765630 - DNA, 20 bp, Artificial
  CRISPR gRNA sequence
tggttttgagcctcagtgac

SEQ ID NO: 765631 - DNA, 20 bp, Artificial
  CRISPR gRNA sequence
ggttttgagcctcagtgaca

SEQ ID NO: 765632 - DNA, 20 bp, Artificial
  CRISPR gRNA sequence
tttgagcctcagtgacaggg

SEQ ID NO: 765633 - DNA, 20 bp, Artificial
  CRISPR gRNA sequence
tgagcctcagtgacagggtg

SEQ ID NO: 765634 - DNA, 20 bp, Artificial
  CRISPR gRNA sequence
gacagggtggagcattcact

SEQ ID NO: 765635 - DNA, 20 bp, Artificial
  CRISPR gRNA sequence
acagggtggagcattcactg

SEQ ID NO: 765636 - DNA, 20 bp, Artificial
  CRISPR gRNA sequence
gggtggagcattcactgagg

SEQ ID NO: 765637 - DNA, 20 bp, Artificial
  CRISPR gRNA sequence
gtggagcattcactgaggca

SEQ ID NO: 765638 - DNA, 20 bp, Artificial
  CRISPR gRNA sequence
attcactgaggcagagaaaa

SEQ ID NO: 765639 - DNA, 20 bp, Artificial
  CRISPR gRNA sequence
cactgaggcagagaaaatgg

SEQ ID NO: 765640 - DNA, 20 bp, Artificial
  CRISPR gRNA sequence
actgaggcagagaaaatgga

SEQ ID NO: 765641 - DNA, 20 bp, Artificial
  CRISPR gRNA sequence
ctgaggcagagaaaatggaa

SEQ ID NO: 765642 - DNA, 20 bp, Artificial
  CRISPR gRNA sequence
gcagagaaaatggaagggtt

SEQ ID NO: 765643 - DNA, 20 bp, Artificial
  CRISPR gRNA sequence
gaaaatggaagggttcagta

SEQ ID NO: 765644 - DNA, 20 bp, Artificial
  CRISPR gRNA sequence
cagtatagcttgtgtgaaat

SEQ ID NO: 765645 - DNA, 20 bp, Artificial
  CRISPR gRNA sequence
tatagcttgtgtgaaatcag

SEQ ID NO: 765646 - DNA, 20 bp, Artificial
  CRISPR gRNA sequence
tgaaatcagcagtatttgca

SEQ ID NO: 765647 - DNA, 20 bp, Artificial
  CRISPR gRNA sequence
aatcagcagtatttgcaaag

SEQ ID NO: 765648 - DNA, 20 bp, Artificial
  CRISPR gRNA sequence
agtatttgcaaagaagcttc

SEQ ID NO: 765649 - DNA, 20 bp, Artificial
  CRISPR gRNA sequence
gtatttgcaaagaagcttct

SEQ ID NO: 765650 - DNA, 20 bp, Artificial
  CRISPR gRNA sequence
ttgcaaagaagcttctagga

SEQ ID NO: 765651 - DNA, 20 bp, Artificial
  CRISPR gRNA sequence
gcaaagaagcttctaggaca

SEQ ID NO: 765652 - DNA, 20 bp, Artificial
  CRISPR gRNA sequence
aagcttctaggacagagttt

SEQ ID NO: 765653 - DNA, 20 bp, Artificial
  CRISPR gRNA sequence
agcttctaggacagagtttt

SEQ ID NO: 765654 - DNA, 20 bp, Artificial
  CRISPR gRNA sequence
cttctaggacagagttttag

SEQ ID NO: 765655 - DNA, 20 bp, Artificial
  CRISPR gRNA sequence
ttctaggacagagttttagg

SEQ ID NO: 765656 - DNA, 20 bp, Artificial
  CRISPR gRNA sequence
acagagttttaggaggcgac

SEQ ID NO: 765657 - DNA, 20 bp, Artificial
  CRISPR gRNA sequence
cagagttttaggaggcgact

SEQ ID NO: 765658 - DNA, 20 bp, Artificial
  CRISPR gRNA sequence
taggaggcgactaggtgtat

SEQ ID NO: 765659 - DNA, 20 bp, Artificial
  CRISPR gRNA sequence
ggcgactaggtgtatgagtg

SEQ ID NO: 765660 - DNA, 20 bp, Artificial
  CRISPR gRNA sequence
gcgactaggtgtatgagtgt

SEQ ID NO: 765661 - DNA, 20 bp, Artificial
  CRISPR gRNA sequence
ggtgtatgagtgtgggaatg

SEQ ID NO: 765662 - DNA, 20 bp, Artificial
  CRISPR gRNA sequence
tgtatgagtgtgggaatgca

SEQ ID NO: 765663 - DNA, 20 bp, Artificial
  CRISPR gRNA sequence
tatgagtgtgggaatgcaga

SEQ ID NO: 765664 - DNA, 20 bp, Artificial
  CRISPR gRNA sequence
tgagtgtgggaatgcagaga

SEQ ID NO: 765665 - DNA, 20 bp, Artificial
  CRISPR gRNA sequence
tgcagagagagaacatttgc

SEQ ID NO: 765666 - DNA, 20 bp, Artificial
  CRISPR gRNA sequence
tagcttaacacatctgtatt

SEQ ID NO: 765667 - DNA, 20 bp, Artificial
  CRISPR gRNA sequence
cacatctgtattgagtgacc

SEQ ID NO: 765668 - DNA, 20 bp, Artificial
  CRISPR gRNA sequence
tctgtattgagtgaccaaga

SEQ ID NO: 765669 - DNA, 20 bp, Artificial
  CRISPR gRNA sequence
attgagtgaccaagacagat

SEQ ID NO: 765670 - DNA, 20 bp, Artificial
  CRISPR gRNA sequence
gagtgaccaagacagatcag

SEQ ID NO: 765671 - DNA, 20 bp, Artificial
  CRISPR gRNA sequence
tgaccaagacagatcagaag

SEQ ID NO: 765672 - DNA, 20 bp, Artificial
  CRISPR gRNA sequence
ccaagacagatcagaagtgg

SEQ ID NO: 765673 - DNA, 20 bp, Artificial
  CRISPR gRNA sequence
aagacagatcagaagtggaa

SEQ ID NO: 765674 - DNA, 20 bp, Artificial
  CRISPR gRNA sequence
agacagatcagaagtggaag

SEQ ID NO: 765675 - DNA, 20 bp, Artificial
  CRISPR gRNA sequence
agatcagaagtggaagaggc

SEQ ID NO: 765676 - DNA, 20 bp, Artificial
  CRISPR gRNA sequence
gatcagaagtggaagaggca

SEQ ID NO: 765677 - DNA, 20 bp, Artificial
  CRISPR gRNA sequence
aagtggaagaggcaaggact

SEQ ID NO: 765678 - DNA, 20 bp, Artificial
  CRISPR gRNA sequence
agtggaagaggcaaggactt

SEQ ID NO: 765679 - DNA, 20 bp, Artificial
  CRISPR gRNA sequence
gtggaagaggcaaggacttg

SEQ ID NO: 765680 - DNA, 20 bp, Artificial
  CRISPR gRNA sequence
aaggacttggggatgacctc

SEQ ID NO: 765681 - DNA, 20 bp, Artificial
  CRISPR gRNA sequence
aggacttggggatgacctca

SEQ ID NO: 765682 - DNA, 20 bp, Artificial
  CRISPR gRNA sequence
cttggggatgacctcaaggc

SEQ ID NO: 765683 - DNA, 20 bp, Artificial
  CRISPR gRNA sequence
tggggatgacctcaaggctg

SEQ ID NO: 765684 - DNA, 20 bp, Artificial
  CRISPR gRNA sequence
gatgacctcaaggctggagt

SEQ ID NO: 765685 - DNA, 20 bp, Artificial
  CRISPR gRNA sequence
atgacctcaaggctggagtc

SEQ ID NO: 765686 - DNA, 20 bp, Artificial
  CRISPR gRNA sequence
tcaaggctggagtcaggact

SEQ ID NO: 765687 - DNA, 20 bp, Artificial
  CRISPR gRNA sequence
ggctggagtcaggactgagt

SEQ ID NO: 765688 - DNA, 20 bp, Artificial
  CRISPR gRNA sequence
ctggagtcaggactgagtaa

SEQ ID NO: 765689 - DNA, 20 bp, Artificial
  CRISPR gRNA sequence
tggagtcaggactgagtaag

SEQ ID NO: 765690 - DNA, 20 bp, Artificial
  CRISPR gRNA sequence
gtcaggactgagtaagaggc

SEQ ID NO: 765691 - DNA, 20 bp, Artificial
  CRISPR gRNA sequence
ctgagtaagaggcaagtctg

SEQ ID NO: 765692 - DNA, 20 bp, Artificial
  CRISPR gRNA sequence
aagaggcaagtctgtggctg

SEQ ID NO: 765693 - DNA, 20 bp, Artificial
  CRISPR gRNA sequence
agaggcaagtctgtggctgc

SEQ ID NO: 765694 - DNA, 20 bp, Artificial
  CRISPR gRNA sequence
gcaagtctgtggctgcaggt

SEQ ID NO: 765695 - DNA, 20 bp, Artificial
  CRISPR gRNA sequence
caagtctgtggctgcaggtc

SEQ ID NO: 765696 - DNA, 20 bp, Artificial
  CRISPR gRNA sequence
tgtggctgcaggtcaggcct

SEQ ID NO: 765697 - DNA, 20 bp, Artificial
  CRISPR gRNA sequence
gctgcaggtcaggcctgagc

SEQ ID NO: 765698 - DNA, 20 bp, Artificial
  CRISPR gRNA sequence
ctgcaggtcaggcctgagct

SEQ ID NO: 765699 - DNA, 20 bp, Artificial
  CRISPR gRNA sequence
tgcaggtcaggcctgagctg

SEQ ID NO: 765700 - DNA, 20 bp, Artificial
  CRISPR gRNA sequence
gtcaggcctgagctggggat

SEQ ID NO: 765701 - DNA, 20 bp, Artificial
  CRISPR gRNA sequence
aggcctgagctggggatgag

SEQ ID NO: 765702 - DNA, 20 bp, Artificial
  CRISPR gRNA sequence
ggcctgagctggggatgaga

SEQ ID NO: 765703 - DNA, 20 bp, Artificial
  CRISPR gRNA sequence
gcctgagctggggatgagaa

SEQ ID NO: 765704 - DNA, 20 bp, Artificial
  CRISPR gRNA sequence
tgagctggggatgagaaggg

SEQ ID NO: 765705 - DNA, 20 bp, Artificial
  CRISPR gRNA sequence
agggcagacatccctaaatc

SEQ ID NO: 765706 - DNA, 20 bp, Artificial
  CRISPR gRNA sequence
tccagccctgctcccaatcc

SEQ ID NO: 765707 - DNA, 20 bp, Artificial
  CRISPR gRNA sequence
tcccaatcccagccaccctc

SEQ ID NO: 765708 - DNA, 20 bp, Artificial
  CRISPR gRNA sequence
cccaatcccagccaccctcc

SEQ ID NO: 765709 - DNA, 20 bp, Artificial
  CRISPR gRNA sequence
gctgcacacaccttgtccct

SEQ ID NO: 765710 - DNA, 20 bp, Artificial
  CRISPR gRNA sequence
caccttgtccctgagtccca

SEQ ID NO: 765711 - DNA, 20 bp, Artificial
  CRISPR gRNA sequence
atttgtgccatgtcctgatc

SEQ ID NO: 765712 - DNA, 20 bp, Artificial
  CRISPR gRNA sequence
gccaaccaacactgatcaac

SEQ ID NO: 765713 - DNA, 20 bp, Artificial
  CRISPR gRNA sequence
ccaacactgatcaacaagaa

SEQ ID NO: 765714 - DNA, 20 bp, Artificial
  CRISPR gRNA sequence
ttcacgtcctcctaataccc

SEQ ID NO: 765715 - DNA, 20 bp, Artificial
  CRISPR gRNA sequence
tcacgtcctcctaataccct

SEQ ID NO: 765716 - DNA, 20 bp, Artificial
  CRISPR gRNA sequence
acgtcctcctaataccctgg

SEQ ID NO: 765717 - DNA, 20 bp, Artificial
  CRISPR gRNA sequence
cctcctaataccctgggaga

SEQ ID NO: 765718 - DNA, 20 bp, Artificial
  CRISPR gRNA sequence
ctcctaataccctgggagat

SEQ ID NO: 765719 - DNA, 20 bp, Artificial
  CRISPR gRNA sequence
gggagataggctgtaacact

SEQ ID NO: 765720 - DNA, 20 bp, Artificial
  CRISPR gRNA sequence
aacacttggtcctatttttg

SEQ ID NO: 765721 - DNA, 20 bp, Artificial
  CRISPR gRNA sequence
acacttggtcctatttttgc

SEQ ID NO: 765722 - DNA, 20 bp, Artificial
  CRISPR gRNA sequence
tgcaggactttaaaaaatta

SEQ ID NO: 765723 - DNA, 20 bp, Artificial
  CRISPR gRNA sequence
ctttaaaaaattaaagccca

SEQ ID NO: 765724 - DNA, 20 bp, Artificial
  CRISPR gRNA sequence
aaaaaattaaagcccatggc

SEQ ID NO: 765725 - DNA, 20 bp, Artificial
  CRISPR gRNA sequence
aaaaattaaagcccatggct

SEQ ID NO: 765726 - DNA, 20 bp, Artificial
  CRISPR gRNA sequence
ttaaagcccatggctgggtg

SEQ ID NO: 765727 - DNA, 20 bp, Artificial
  CRISPR gRNA sequence
aagcccatggctgggtgtgg

SEQ ID NO: 765728 - DNA, 20 bp, Artificial
  CRISPR gRNA sequence
gtggctcatgcctgtaatcc

SEQ ID NO: 765729 - DNA, 20 bp, Artificial
  CRISPR gRNA sequence
tgcctgtaatcccagcactt

SEQ ID NO: 765730 - DNA, 20 bp, Artificial
  CRISPR gRNA sequence
gcctgtaatcccagcacttt

SEQ ID NO: 765731 - DNA, 20 bp, Artificial
  CRISPR gRNA sequence
ctgtaatcccagcactttgg

SEQ ID NO: 765732 - DNA, 20 bp, Artificial
  CRISPR gRNA sequence
tgtaatcccagcactttggg

SEQ ID NO: 765733 - DNA, 20 bp, Artificial
  CRISPR gRNA sequence
tcccagcactttgggaggcc

SEQ ID NO: 765734 - DNA, 20 bp, Artificial
  CRISPR gRNA sequence
cccagcactttgggaggccg

SEQ ID NO: 765735 - DNA, 20 bp, Artificial
  CRISPR gRNA sequence
agcactttgggaggccgagg

SEQ ID NO: 765736 - DNA, 20 bp, Artificial
  CRISPR gRNA sequence
gcactttgggaggccgaggt

SEQ ID NO: 765737 - DNA, 20 bp, Artificial
  CRISPR gRNA sequence
ctttgggaggccgaggtggg

SEQ ID NO: 765738 - DNA, 20 bp, Artificial
  CRISPR gRNA sequence
ggccgaggtgggtggatcac

SEQ ID NO: 765739 - DNA, 20 bp, Artificial
  CRISPR gRNA sequence
gccgaggtgggtggatcacg

SEQ ID NO: 765740 - DNA, 20 bp, Artificial
  CRISPR gRNA sequence
aggtgggtggatcacgaggt

SEQ ID NO: 765741 - DNA, 20 bp, Artificial
  CRISPR gRNA sequence
ggtgggtggatcacgaggtc

SEQ ID NO: 765742 - DNA, 20 bp, Artificial
  CRISPR gRNA sequence
tgggtggatcacgaggtcag

SEQ ID NO: 765743 - DNA, 20 bp, Artificial
  CRISPR gRNA sequence
gatcacgaggtcaggagttt

SEQ ID NO: 765744 - DNA, 20 bp, Artificial
  CRISPR gRNA sequence
cgaggtcaggagtttgagac

SEQ ID NO: 765745 - DNA, 20 bp, Artificial
  CRISPR gRNA sequence
tgagaccagcctgaccaaca

SEQ ID NO: 765746 - DNA, 20 bp, Artificial
  CRISPR gRNA sequence
tctactaaaaatataaacat

SEQ ID NO: 765747 - DNA, 20 bp, Artificial
  CRISPR gRNA sequence
ctaaaaatataaacattagc

SEQ ID NO: 765748 - DNA, 20 bp, Artificial
  CRISPR gRNA sequence
taaaaatataaacattagct

SEQ ID NO: 765749 - DNA, 20 bp, Artificial
  CRISPR gRNA sequence
atataaacattagctgggcg

SEQ ID NO: 765750 - DNA, 20 bp, Artificial
  CRISPR gRNA sequence
taaacattagctgggcgtgg

SEQ ID NO: 765751 - DNA, 20 bp, Artificial
  CRISPR gRNA sequence
attagctgggcgtggtggct

SEQ ID NO: 765752 - DNA, 20 bp, Artificial
  CRISPR gRNA sequence
ttagctgggcgtggtggctc

SEQ ID NO: 765753 - DNA, 20 bp, Artificial
  CRISPR gRNA sequence
gtggctcaggcctgtaatac

SEQ ID NO: 765754 - DNA, 20 bp, Artificial
  CRISPR gRNA sequence
ggcctgtaataccagctact

SEQ ID NO: 765755 - DNA, 20 bp, Artificial
  CRISPR gRNA sequence
gcctgtaataccagctactc

SEQ ID NO: 765756 - DNA, 20 bp, Artificial
  CRISPR gRNA sequence
ctgtaataccagctactcag

SEQ ID NO: 765757 - DNA, 20 bp, Artificial
  CRISPR gRNA sequence
tgtaataccagctactcagg

SEQ ID NO: 765758 - DNA, 20 bp, Artificial
  CRISPR gRNA sequence
taccagctactcaggaggct

SEQ ID NO: 765759 - DNA, 20 bp, Artificial
  CRISPR gRNA sequence
accagctactcaggaggctg

SEQ ID NO: 765760 - DNA, 20 bp, Artificial
  CRISPR gRNA sequence
agctactcaggaggctgagg

SEQ ID NO: 765761 - DNA, 20 bp, Artificial
  CRISPR gRNA sequence
gctactcaggaggctgaggc

SEQ ID NO: 765762 - DNA, 20 bp, Artificial
  CRISPR gRNA sequence
tactcaggaggctgaggcag

SEQ ID NO: 765763 - DNA, 20 bp, Artificial
  CRISPR gRNA sequence
gcaggagaattgcttgaacc

SEQ ID NO: 765764 - DNA, 20 bp, Artificial
  CRISPR gRNA sequence
caggagaattgcttgaaccc

SEQ ID NO: 765765 - DNA, 20 bp, Artificial
  CRISPR gRNA sequence
ggagaattgcttgaacccag

SEQ ID NO: 765766 - DNA, 20 bp, Artificial
  CRISPR gRNA sequence
gagaattgcttgaacccagg

SEQ ID NO: 765767 - DNA, 20 bp, Artificial
  CRISPR gRNA sequence
aattgcttgaacccaggagg

SEQ ID NO: 765768 - DNA, 20 bp, Artificial
  CRISPR gRNA sequence
ttgcttgaacccaggaggcg

SEQ ID NO: 765769 - DNA, 20 bp, Artificial
  CRISPR gRNA sequence
tgcttgaacccaggaggcgg

SEQ ID NO: 765770 - DNA, 20 bp, Artificial
  CRISPR gRNA sequence
aacccaggaggcggaggttg

SEQ ID NO: 765771 - DNA, 20 bp, Artificial
  CRISPR gRNA sequence
caggaggcggaggttgtagt

SEQ ID NO: 765772 - DNA, 20 bp, Artificial
  CRISPR gRNA sequence
gaggcggaggttgtagtgag

SEQ ID NO: 765773 - DNA, 20 bp, Artificial
  CRISPR gRNA sequence
gaaatcgcgccactgtactc

SEQ ID NO: 765774 - DNA, 20 bp, Artificial
  CRISPR gRNA sequence
cgcgccactgtactccagtc

SEQ ID NO: 765775 - DNA, 20 bp, Artificial
  CRISPR gRNA sequence
gcgccactgtactccagtct

SEQ ID NO: 765776 - DNA, 20 bp, Artificial
  CRISPR gRNA sequence
tccagtctgggcgatactgc

SEQ ID NO: 765777 - DNA, 20 bp, Artificial
  CRISPR gRNA sequence
aaaaaaaaaaaaaaaaatta

SEQ ID NO: 765778 - DNA, 20 bp, Artificial
  CRISPR gRNA sequence
aaaaaaaaaaaattaaagcc

SEQ ID NO: 765779 - DNA, 20 bp, Artificial
  CRISPR gRNA sequence
aaaaaaattaaagcccagat

SEQ ID NO: 765780 - DNA, 20 bp, Artificial
  CRISPR gRNA sequence
taagtgactttgttaatgtc

SEQ ID NO: 765781 - DNA, 20 bp, Artificial
  CRISPR gRNA sequence
gttaatgtcaagtaatttgc

SEQ ID NO: 765782 - DNA, 20 bp, Artificial
  CRISPR gRNA sequence
atgtcaagtaatttgccagt

SEQ ID NO: 765783 - DNA, 20 bp, Artificial
  CRISPR gRNA sequence
aagtaatttgccagtcagca

SEQ ID NO: 765784 - DNA, 20 bp, Artificial
  CRISPR gRNA sequence
tgccagtcagcacagccaaa

SEQ ID NO: 765785 - DNA, 20 bp, Artificial
  CRISPR gRNA sequence
ccagtcagcacagccaaaaa

SEQ ID NO: 765786 - DNA, 20 bp, Artificial
  CRISPR gRNA sequence
tacacctttccacccttcca

SEQ ID NO: 765787 - DNA, 20 bp, Artificial
  CRISPR gRNA sequence
cacctttccacccttccacg

SEQ ID NO: 765788 - DNA, 20 bp, Artificial
  CRISPR gRNA sequence
cacggagcaaacctcatcaa

SEQ ID NO: 765789 - DNA, 20 bp, Artificial
  CRISPR gRNA sequence
caaacctcatcaacagctgc

SEQ ID NO: 765790 - DNA, 20 bp, Artificial
  CRISPR gRNA sequence
tgctagcctcaattccattc

SEQ ID NO: 765791 - DNA, 20 bp, Artificial
  CRISPR gRNA sequence
gctagcctcaattccattcc

SEQ ID NO: 765792 - DNA, 20 bp, Artificial
  CRISPR gRNA sequence
tcaattccattccaggcgcc

SEQ ID NO: 765793 - DNA, 20 bp, Artificial
  CRISPR gRNA sequence
agcctcaatccttccaatcc

SEQ ID NO: 765794 - DNA, 20 bp, Artificial
  CRISPR gRNA sequence
tcaatccttccaatcccagc

SEQ ID NO: 765795 - DNA, 20 bp, Artificial
  CRISPR gRNA sequence
caatccttccaatcccagcc

SEQ ID NO: 765796 - DNA, 20 bp, Artificial
  CRISPR gRNA sequence
ctcctacacacacacacccc

SEQ ID NO: 765797 - DNA, 20 bp, Artificial
  CRISPR gRNA sequence
ctacacacacacacccccag

SEQ ID NO: 765798 - DNA, 20 bp, Artificial
  CRISPR gRNA sequence
acacacacacccccagcagc

SEQ ID NO: 765799 - DNA, 20 bp, Artificial
  CRISPR gRNA sequence
cacacacacccccagcagct

SEQ ID NO: 765800 - DNA, 20 bp, Artificial
  CRISPR gRNA sequence
acacccccagcagctgggcc

SEQ ID NO: 765801 - DNA, 20 bp, Artificial
  CRISPR gRNA sequence
cacccccagcagctgggcca

SEQ ID NO: 765802 - DNA, 20 bp, Artificial
  CRISPR gRNA sequence
acccccagcagctgggccaa

SEQ ID NO: 765803 - DNA, 20 bp, Artificial
  CRISPR gRNA sequence
ccccagcagctgggccaagg

SEQ ID NO: 765804 - DNA, 20 bp, Artificial
  CRISPR gRNA sequence
gctgggccaagggagtccct

SEQ ID NO: 765805 - DNA, 20 bp, Artificial
  CRISPR gRNA sequence
cagccaaaccatgtgcatcc

SEQ ID NO: 765806 - DNA, 20 bp, Artificial
  CRISPR gRNA sequence
caaaccatgtgcatcctggc

SEQ ID NO: 765807 - DNA, 20 bp, Artificial
  CRISPR gRNA sequence
ggccagccccccttctctcc

SEQ ID NO: 765808 - DNA, 20 bp, Artificial
  CRISPR gRNA sequence
ccttctctcccagctgtcta

SEQ ID NO: 765809 - DNA, 20 bp, Artificial
  CRISPR gRNA sequence
tctctcccagctgtctacag

SEQ ID NO: 765810 - DNA, 20 bp, Artificial
  CRISPR gRNA sequence
ctctcccagctgtctacagt

SEQ ID NO: 765811 - DNA, 20 bp, Artificial
  CRISPR gRNA sequence
tctcccagctgtctacagtg

SEQ ID NO: 765812 - DNA, 20 bp, Artificial
  CRISPR gRNA sequence
cccagctgtctacagtgggg

SEQ ID NO: 765813 - DNA, 20 bp, Artificial
  CRISPR gRNA sequence
gtctacagtggggaagccct

SEQ ID NO: 765814 - DNA, 20 bp, Artificial
  CRISPR gRNA sequence
tacagtggggaagccctgag

SEQ ID NO: 765815 - DNA, 20 bp, Artificial
  CRISPR gRNA sequence
ctgagcagccacttcctttc

SEQ ID NO: 765816 - DNA, 20 bp, Artificial
  CRISPR gRNA sequence
acttcctttccagacgcttc

SEQ ID NO: 765817 - DNA, 20 bp, Artificial
  CRISPR gRNA sequence
tccagacgcttccggcctca

SEQ ID NO: 765818 - DNA, 20 bp, Artificial
  CRISPR gRNA sequence
tcaaagccttactgcctgct

SEQ ID NO: 765819 - DNA, 20 bp, Artificial
  CRISPR gRNA sequence
agccttactgcctgctgagt

SEQ ID NO: 765820 - DNA, 20 bp, Artificial
  CRISPR gRNA sequence
cttactgcctgctgagtcag

SEQ ID NO: 765821 - DNA, 20 bp, Artificial
  CRISPR gRNA sequence
gctgagtcagcagccttccc

SEQ ID NO: 765822 - DNA, 20 bp, Artificial
  CRISPR gRNA sequence
cttccccggctccattcata

SEQ ID NO: 765823 - DNA, 20 bp, Artificial
  CRISPR gRNA sequence
ctccattcataaagcacctt

SEQ ID NO: 765824 - DNA, 20 bp, Artificial
  CRISPR gRNA sequence
cattcataaagcacctttgg

SEQ ID NO: 765825 - DNA, 20 bp, Artificial
  CRISPR gRNA sequence
attcataaagcacctttggc

SEQ ID NO: 765826 - DNA, 20 bp, Artificial
  CRISPR gRNA sequence
ggcaccacatcctgccccac

SEQ ID NO: 765827 - DNA, 20 bp, Artificial
  CRISPR gRNA sequence
gcaccacatcctgccccaca

SEQ ID NO: 765828 - DNA, 20 bp, Artificial
  CRISPR gRNA sequence
caccacatcctgccccacaa

SEQ ID NO: 765829 - DNA, 20 bp, Artificial
  CRISPR gRNA sequence
tgccccacaagggccaccct

SEQ ID NO: 765830 - DNA, 20 bp, Artificial
  CRISPR gRNA sequence
gccccacaagggccaccctg

SEQ ID NO: 765831 - DNA, 20 bp, Artificial
  CRISPR gRNA sequence
aagggccaccctgaggccca

SEQ ID NO: 765832 - DNA, 20 bp, Artificial
  CRISPR gRNA sequence
agggccaccctgaggcccac

SEQ ID NO: 765833 - DNA, 20 bp, Artificial
  CRISPR gRNA sequence
gccaccctgaggcccacagg

SEQ ID NO: 765834 - DNA, 20 bp, Artificial
  CRISPR gRNA sequence
ctgaggcccacaggaagatc

SEQ ID NO: 765835 - DNA, 20 bp, Artificial
  CRISPR gRNA sequence
aggcccacaggaagatccag

SEQ ID NO: 765836 - DNA, 20 bp, Artificial
  CRISPR gRNA sequence
ggcccacaggaagatccagc

SEQ ID NO: 765837 - DNA, 20 bp, Artificial
  CRISPR gRNA sequence
ccacaggaagatccagcagg

SEQ ID NO: 765838 - DNA, 20 bp, Artificial
  CRISPR gRNA sequence
atccagcaggcagctgcctg

SEQ ID NO: 765839 - DNA, 20 bp, Artificial
  CRISPR gRNA sequence
tccagcaggcagctgcctgc

SEQ ID NO: 765840 - DNA, 20 bp, Artificial
  CRISPR gRNA sequence
caggacctgcccaacccctg

SEQ ID NO: 765841 - DNA, 20 bp, Artificial
  CRISPR gRNA sequence
aggacctgcccaacccctgc

SEQ ID NO: 765842 - DNA, 20 bp, Artificial
  CRISPR gRNA sequence
acctgcccaacccctgcggg

SEQ ID NO: 765843 - DNA, 20 bp, Artificial
  CRISPR gRNA sequence
ccaacccctgcgggaagcac

SEQ ID NO: 765844 - DNA, 20 bp, Artificial
  CRISPR gRNA sequence
caacccctgcgggaagcacc

SEQ ID NO: 765845 - DNA, 20 bp, Artificial
  CRISPR gRNA sequence
aacccctgcgggaagcacca

SEQ ID NO: 765846 - DNA, 20 bp, Artificial
  CRISPR gRNA sequence
ctgcgggaagcaccagggct

SEQ ID NO: 765847 - DNA, 20 bp, Artificial
  CRISPR gRNA sequence
tgcgggaagcaccagggcta

SEQ ID NO: 765848 - DNA, 20 bp, Artificial
  CRISPR gRNA sequence
gctaaggatgaacgaacgcc

SEQ ID NO: 765849 - DNA, 20 bp, Artificial
  CRISPR gRNA sequence
tccctgcctctctttaaccc

SEQ ID NO: 765850 - DNA, 20 bp, Artificial
  CRISPR gRNA sequence
tgcctctctttaaccccaga

SEQ ID NO: 765851 - DNA, 20 bp, Artificial
  CRISPR gRNA sequence
ctttaaccccagacagaacc

SEQ ID NO: 765852 - DNA, 20 bp, Artificial
  CRISPR gRNA sequence
tttaaccccagacagaacca

SEQ ID NO: 765853 - DNA, 20 bp, Artificial
  CRISPR gRNA sequence
ccagacagaaccaaggcctg

SEQ ID NO: 765854 - DNA, 20 bp, Artificial
  CRISPR gRNA sequence
cagacagaaccaaggcctgt

SEQ ID NO: 765855 - DNA, 20 bp, Artificial
  CRISPR gRNA sequence
caaggcctgtgggttcttcc

SEQ ID NO: 765856 - DNA, 20 bp, Artificial
  CRISPR gRNA sequence
aaggcctgtgggttcttcct

SEQ ID NO: 765857 - DNA, 20 bp, Artificial
  CRISPR gRNA sequence
cactctccacactgcttctc

SEQ ID NO: 765858 - DNA, 20 bp, Artificial
  CRISPR gRNA sequence
tgacccatcacccccctcac

SEQ ID NO: 765859 - DNA, 20 bp, Artificial
  CRISPR gRNA sequence
ttgctcctctctttccctgc

SEQ ID NO: 765860 - DNA, 20 bp, Artificial
  CRISPR gRNA sequence
ccctgccagccccattctct

SEQ ID NO: 765861 - DNA, 20 bp, Artificial
  CRISPR gRNA sequence
cctgccagccccattctcta

SEQ ID NO: 765862 - DNA, 20 bp, Artificial
  CRISPR gRNA sequence
ttctctaaggtgccttctct

SEQ ID NO: 765863 - DNA, 20 bp, Artificial
  CRISPR gRNA sequence
tctctaaggtgccttctctt

SEQ ID NO: 765864 - DNA, 20 bp, Artificial
  CRISPR gRNA sequence
ggtgccttctcttaggacct

SEQ ID NO: 765865 - DNA, 20 bp, Artificial
  CRISPR gRNA sequence
ccttctcttaggacctaaga

SEQ ID NO: 765866 - DNA, 20 bp, Artificial
  CRISPR gRNA sequence
cttctcttaggacctaagac

SEQ ID NO: 765867 - DNA, 20 bp, Artificial
  CRISPR gRNA sequence
ctcatgtccctcccctgctc

SEQ ID NO: 765868 - DNA, 20 bp, Artificial
  CRISPR gRNA sequence
ccctgctcaagaacttccca

SEQ ID NO: 765869 - DNA, 20 bp, Artificial
  CRISPR gRNA sequence
ccatggctccccattcacta

SEQ ID NO: 765870 - DNA, 20 bp, Artificial
  CRISPR gRNA sequence
tggctccccattcactatag

SEQ ID NO: 765871 - DNA, 20 bp, Artificial
  CRISPR gRNA sequence
tccccattcactatagaagt

SEQ ID NO: 765872 - DNA, 20 bp, Artificial
  CRISPR gRNA sequence
tcagaccccattcctctgcc

SEQ ID NO: 765873 - DNA, 20 bp, Artificial
  CRISPR gRNA sequence
cattcctctgcctggtactc

SEQ ID NO: 765874 - DNA, 20 bp, Artificial
  CRISPR gRNA sequence
taattgtctccttcatatat

SEQ ID NO: 765875 - DNA, 20 bp, Artificial
  CRISPR gRNA sequence
aattgtctccttcatatatc

SEQ ID NO: 765876 - DNA, 20 bp, Artificial
  CRISPR gRNA sequence
caggctaattcctgccactc

SEQ ID NO: 765877 - DNA, 20 bp, Artificial
  CRISPR gRNA sequence
aggctaattcctgccactct

SEQ ID NO: 765878 - DNA, 20 bp, Artificial
  CRISPR gRNA sequence
ctaattcctgccactctggg

SEQ ID NO: 765879 - DNA, 20 bp, Artificial
  CRISPR gRNA sequence
taattcctgccactctgggc

SEQ ID NO: 765880 - DNA, 20 bp, Artificial
  CRISPR gRNA sequence
cctgccactctgggcaggta

SEQ ID NO: 765881 - DNA, 20 bp, Artificial
  CRISPR gRNA sequence
ctgccactctgggcaggtac

SEQ ID NO: 765882 - DNA, 20 bp, Artificial
  CRISPR gRNA sequence
tgccactctgggcaggtaca

SEQ ID NO: 765883 - DNA, 20 bp, Artificial
  CRISPR gRNA sequence
ccactctgggcaggtacagg

SEQ ID NO: 765884 - DNA, 20 bp, Artificial
  CRISPR gRNA sequence
ctctgggcaggtacagggag

SEQ ID NO: 765885 - DNA, 20 bp, Artificial
  CRISPR gRNA sequence
ctgggcaggtacagggagca

SEQ ID NO: 765886 - DNA, 20 bp, Artificial
  CRISPR gRNA sequence
tgggcaggtacagggagcag

SEQ ID NO: 765887 - DNA, 20 bp, Artificial
  CRISPR gRNA sequence
gggcaggtacagggagcaga

SEQ ID NO: 765888 - DNA, 20 bp, Artificial
  CRISPR gRNA sequence
cagagggcacctcccctgat

SEQ ID NO: 765889 - DNA, 20 bp, Artificial
  CRISPR gRNA sequence
ctcccctgatcagacctacc

SEQ ID NO: 765890 - DNA, 20 bp, Artificial
  CRISPR gRNA sequence
tcccctgatcagacctaccc

SEQ ID NO: 765891 - DNA, 20 bp, Artificial
  CRISPR gRNA sequence
cagacctacccaggctctcc

SEQ ID NO: 765892 - DNA, 20 bp, Artificial
  CRISPR gRNA sequence
agacctacccaggctctccc

SEQ ID NO: 765893 - DNA, 20 bp, Artificial
  CRISPR gRNA sequence
gacctacccaggctctccca

SEQ ID NO: 765894 - DNA, 20 bp, Artificial
  CRISPR gRNA sequence
acccaggctctcccagggcc

SEQ ID NO: 765895 - DNA, 20 bp, Artificial
  CRISPR gRNA sequence
ggccgagctgcgcttccctc

SEQ ID NO: 765896 - DNA, 20 bp, Artificial
  CRISPR gRNA sequence
ccgagctgcgcttccctcca

SEQ ID NO: 765897 - DNA, 20 bp, Artificial
  CRISPR gRNA sequence
cgagctgcgcttccctccag

SEQ ID NO: 765898 - DNA, 20 bp, Artificial
  CRISPR gRNA sequence
gagctgcgcttccctccaga

SEQ ID NO: 765899 - DNA, 20 bp, Artificial
  CRISPR gRNA sequence
ctgcgcttccctccagaggg

SEQ ID NO: 765900 - DNA, 20 bp, Artificial
  CRISPR gRNA sequence
cttccctccagagggaagat

SEQ ID NO: 765901 - DNA, 20 bp, Artificial
  CRISPR gRNA sequence
ttccctccagagggaagatg

SEQ ID NO: 765902 - DNA, 20 bp, Artificial
  CRISPR gRNA sequence
tccctccagagggaagatga

SEQ ID NO: 765903 - DNA, 20 bp, Artificial
  CRISPR gRNA sequence
gagggaagatgagggacttc

SEQ ID NO: 765904 - DNA, 20 bp, Artificial
  CRISPR gRNA sequence
agggaagatgagggacttcc

SEQ ID NO: 765905 - DNA, 20 bp, Artificial
  CRISPR gRNA sequence
gggaagatgagggacttcca

SEQ ID NO: 765906 - DNA, 20 bp, Artificial
  CRISPR gRNA sequence
ggacttccagggctgcgccc

SEQ ID NO: 765907 - DNA, 20 bp, Artificial
  CRISPR gRNA sequence
gctccctttcattcctttcc

SEQ ID NO: 765908 - DNA, 20 bp, Artificial
  CRISPR gRNA sequence
ttcattcctttcctagactc

SEQ ID NO: 765909 - DNA, 20 bp, Artificial
  CRISPR gRNA sequence
ctttcctagactctggatcc

SEQ ID NO: 765910 - DNA, 20 bp, Artificial
  CRISPR gRNA sequence
tggatcctggaaacctgccc

SEQ ID NO: 765911 - DNA, 20 bp, Artificial
  CRISPR gRNA sequence
gatcctggaaacctgccctg

SEQ ID NO: 765912 - DNA, 20 bp, Artificial
  CRISPR gRNA sequence
tcctggaaacctgccctgga

SEQ ID NO: 765913 - DNA, 20 bp, Artificial
  CRISPR gRNA sequence
tggaaacctgccctggagag

SEQ ID NO: 765914 - DNA, 20 bp, Artificial
  CRISPR gRNA sequence
aaacctgccctggagagaag

SEQ ID NO: 765915 - DNA, 20 bp, Artificial
  CRISPR gRNA sequence
cctggagagaagcagtttga

SEQ ID NO: 765916 - DNA, 20 bp, Artificial
  CRISPR gRNA sequence
agagaagcagtttgacagcc

SEQ ID NO: 765917 - DNA, 20 bp, Artificial
  CRISPR gRNA sequence
gaagcagtttgacagcccag

SEQ ID NO: 765918 - DNA, 20 bp, Artificial
  CRISPR gRNA sequence
agtttgacagcccagaagca

SEQ ID NO: 765919 - DNA, 20 bp, Artificial
  CRISPR gRNA sequence
tttgacagcccagaagcaaa

SEQ ID NO: 765920 - DNA, 20 bp, Artificial
  CRISPR gRNA sequence
cagcccagaagcaaagagac

SEQ ID NO: 765921 - DNA, 20 bp, Artificial
  CRISPR gRNA sequence
cccagaagcaaagagaccag

SEQ ID NO: 765922 - DNA, 20 bp, Artificial
  CRISPR gRNA sequence
cagaagcaaagagaccagaa

SEQ ID NO: 765923 - DNA, 20 bp, Artificial
  CRISPR gRNA sequence
aaagagaccagaagagtcca

SEQ ID NO: 765924 - DNA, 20 bp, Artificial
  CRISPR gRNA sequence
ccagaagagtccacggcacc

SEQ ID NO: 765925 - DNA, 20 bp, Artificial
  CRISPR gRNA sequence
agaagagtccacggcaccca

SEQ ID NO: 765926 - DNA, 20 bp, Artificial
  CRISPR gRNA sequence
cccagagacccctacgctga

SEQ ID NO: 765927 - DNA, 20 bp, Artificial
  CRISPR gRNA sequence
gagacccctacgctgacagc

SEQ ID NO: 765928 - DNA, 20 bp, Artificial
  CRISPR gRNA sequence
agacccctacgctgacagct

SEQ ID NO: 765929 - DNA, 20 bp, Artificial
  CRISPR gRNA sequence
cctacgctgacagctgggcc

SEQ ID NO: 765930 - DNA, 20 bp, Artificial
  CRISPR gRNA sequence
tacgctgacagctgggcctg

SEQ ID NO: 765931 - DNA, 20 bp, Artificial
  CRISPR gRNA sequence
acgctgacagctgggcctgg

SEQ ID NO: 765932 - DNA, 20 bp, Artificial
  CRISPR gRNA sequence
gctgacagctgggcctggag

SEQ ID NO: 765933 - DNA, 20 bp, Artificial
  CRISPR gRNA sequence
cagctgggcctggaggagct

SEQ ID NO: 765934 - DNA, 20 bp, Artificial
  CRISPR gRNA sequence
agctgggcctggaggagctg

SEQ ID NO: 765935 - DNA, 20 bp, Artificial
  CRISPR gRNA sequence
gggcctggaggagctgagga

SEQ ID NO: 765936 - DNA, 20 bp, Artificial
  CRISPR gRNA sequence
ggcctggaggagctgaggac

SEQ ID NO: 765937 - DNA, 20 bp, Artificial
  CRISPR gRNA sequence
cctggaggagctgaggacag

SEQ ID NO: 765938 - DNA, 20 bp, Artificial
  CRISPR gRNA sequence
gaggagctgaggacaggaga

SEQ ID NO: 765939 - DNA, 20 bp, Artificial
  CRISPR gRNA sequence
ggagctgaggacaggagaaa

SEQ ID NO: 765940 - DNA, 20 bp, Artificial
  CRISPR gRNA sequence
ctgaggacaggagaaagaga

SEQ ID NO: 765941 - DNA, 20 bp, Artificial
  CRISPR gRNA sequence
gaggacaggagaaagagaca

SEQ ID NO: 765942 - DNA, 20 bp, Artificial
  CRISPR gRNA sequence
caggagaaagagacagagct

SEQ ID NO: 765943 - DNA, 20 bp, Artificial
  CRISPR gRNA sequence
agaaagagacagagctcaga

SEQ ID NO: 765944 - DNA, 20 bp, Artificial
  CRISPR gRNA sequence
gaaagagacagagctcagaa

SEQ ID NO: 765945 - DNA, 20 bp, Artificial
  CRISPR gRNA sequence
agagacagagctcagaaagg

SEQ ID NO: 765946 - DNA, 20 bp, Artificial
  CRISPR gRNA sequence
ctcagaaaggaagtgctccc

SEQ ID NO: 765947 - DNA, 20 bp, Artificial
  CRISPR gRNA sequence
cagaaaggaagtgctccctg

SEQ ID NO: 765948 - DNA, 20 bp, Artificial
  CRISPR gRNA sequence
aggaagtgctccctggagaa

SEQ ID NO: 765949 - DNA, 20 bp, Artificial
  CRISPR gRNA sequence
ggaagtgctccctggagaat

SEQ ID NO: 765950 - DNA, 20 bp, Artificial
  CRISPR gRNA sequence
aagtgctccctggagaatgg

SEQ ID NO: 765951 - DNA, 20 bp, Artificial
  CRISPR gRNA sequence
gtgctccctggagaatggga

SEQ ID NO: 765952 - DNA, 20 bp, Artificial
  CRISPR gRNA sequence
gggagagtgtcctgtgaaca

SEQ ID NO: 765953 - DNA, 20 bp, Artificial
  CRISPR gRNA sequence
gagagtgtcctgtgaacaca

SEQ ID NO: 765954 - DNA, 20 bp, Artificial
  CRISPR gRNA sequence
gtgtcctgtgaacacagagc

SEQ ID NO: 765955 - DNA, 20 bp, Artificial
  CRISPR gRNA sequence
cctgtgaacacagagctggt

SEQ ID NO: 765956 - DNA, 20 bp, Artificial
  CRISPR gRNA sequence
gaacacagagctggtcggcc

SEQ ID NO: 765957 - DNA, 20 bp, Artificial
  CRISPR gRNA sequence
aacacagagctggtcggccc

SEQ ID NO: 765958 - DNA, 20 bp, Artificial
  CRISPR gRNA sequence
gagctggtcggcccgggacc

SEQ ID NO: 765959 - DNA, 20 bp, Artificial
  CRISPR gRNA sequence
gctggtcggcccgggaccca

SEQ ID NO: 765960 - DNA, 20 bp, Artificial
  CRISPR gRNA sequence
gcccgggacccagagccacg

SEQ ID NO: 765961 - DNA, 20 bp, Artificial
  CRISPR gRNA sequence
ccgggacccagagccacgtg

SEQ ID NO: 765962 - DNA, 20 bp, Artificial
  CRISPR gRNA sequence
cagagccacgtggagccacg

SEQ ID NO: 765963 - DNA, 20 bp, Artificial
  CRISPR gRNA sequence
agagccacgtggagccacgc

SEQ ID NO: 765964 - DNA, 20 bp, Artificial
  CRISPR gRNA sequence
ctccacccatgttttccaca

SEQ ID NO: 765965 - DNA, 20 bp, Artificial
  CRISPR gRNA sequence
tccacccatgttttccacaa

SEQ ID NO: 765966 - DNA, 20 bp, Artificial
  CRISPR gRNA sequence
ccacccatgttttccacaaa

SEQ ID NO: 765967 - DNA, 20 bp, Artificial
  CRISPR gRNA sequence
cacccatgttttccacaaag

SEQ ID NO: 765968 - DNA, 20 bp, Artificial
  CRISPR gRNA sequence
acaaaggggaatctcatccc

SEQ ID NO: 765969 - DNA, 20 bp, Artificial
  CRISPR gRNA sequence
aggggaatctcatccccagc

SEQ ID NO: 765970 - DNA, 20 bp, Artificial
  CRISPR gRNA sequence
ggggaatctcatccccagcc

SEQ ID NO: 765971 - DNA, 20 bp, Artificial
  CRISPR gRNA sequence
tccccagccgggacctgccc

SEQ ID NO: 765972 - DNA, 20 bp, Artificial
  CRISPR gRNA sequence
cccagccgggacctgccctg

SEQ ID NO: 765973 - DNA, 20 bp, Artificial
  CRISPR gRNA sequence
gccgggacctgccctggagt

SEQ ID NO: 765974 - DNA, 20 bp, Artificial
  CRISPR gRNA sequence
tcagcatgtgccacccgtcc

SEQ ID NO: 765975 - DNA, 20 bp, Artificial
  CRISPR gRNA sequence
catgtgccacccgtcccggt

SEQ ID NO: 765976 - DNA, 20 bp, Artificial
  CRISPR gRNA sequence
cgtcccggtgagtcacctgc

SEQ ID NO: 765977 - DNA, 20 bp, Artificial
  CRISPR gRNA sequence
cctgctctatcccaaaacca

SEQ ID NO: 765978 - DNA, 20 bp, Artificial
  CRISPR gRNA sequence
tgctctatcccaaaaccaca

SEQ ID NO: 765979 - DNA, 20 bp, Artificial
  CRISPR gRNA sequence
ccaaaaccacagagcacctt

SEQ ID NO: 765980 - DNA, 20 bp, Artificial
  CRISPR gRNA sequence
cagagcaccttcggctttca

SEQ ID NO: 765981 - DNA, 20 bp, Artificial
  CRISPR gRNA sequence
gagcaccttcggctttcaca

SEQ ID NO: 765982 - DNA, 20 bp, Artificial
  CRISPR gRNA sequence
caccttcggctttcacagag

SEQ ID NO: 765983 - DNA, 20 bp, Artificial
  CRISPR gRNA sequence
cttcggctttcacagagcag

SEQ ID NO: 765984 - DNA, 20 bp, Artificial
  CRISPR gRNA sequence
ttcggctttcacagagcagc

SEQ ID NO: 765985 - DNA, 20 bp, Artificial
  CRISPR gRNA sequence
cggctttcacagagcagcag

SEQ ID NO: 765986 - DNA, 20 bp, Artificial
  CRISPR gRNA sequence
gctttcacagagcagcagga

SEQ ID NO: 765987 - DNA, 20 bp, Artificial
  CRISPR gRNA sequence
tttcacagagcagcaggaga

SEQ ID NO: 765988 - DNA, 20 bp, Artificial
  CRISPR gRNA sequence
ttcacagagcagcaggagag

SEQ ID NO: 765989 - DNA, 20 bp, Artificial
  CRISPR gRNA sequence
tcacagagcagcaggagaga

SEQ ID NO: 765990 - DNA, 20 bp, Artificial
  CRISPR gRNA sequence
cacagagcagcaggagagag

SEQ ID NO: 765991 - DNA, 20 bp, Artificial
  CRISPR gRNA sequence
gagcagcaggagagaggggt

SEQ ID NO: 765992 - DNA, 20 bp, Artificial
  CRISPR gRNA sequence
agcagcaggagagaggggtc

SEQ ID NO: 765993 - DNA, 20 bp, Artificial
  CRISPR gRNA sequence
gagaggggtcaggctgtcct

SEQ ID NO: 765994 - DNA, 20 bp, Artificial
  CRISPR gRNA sequence
ggtcaggctgtcctcagcct

SEQ ID NO: 765995 - DNA, 20 bp, Artificial
  CRISPR gRNA sequence
gtcaggctgtcctcagccta

SEQ ID NO: 765996 - DNA, 20 bp, Artificial
  CRISPR gRNA sequence
gctgtcctcagcctaaggta

SEQ ID NO: 765997 - DNA, 20 bp, Artificial
  CRISPR gRNA sequence
tcctcagcctaaggtacagc

SEQ ID NO: 765998 - DNA, 20 bp, Artificial
  CRISPR gRNA sequence
cctcagcctaaggtacagca

SEQ ID NO: 765999 - DNA, 20 bp, Artificial
  CRISPR gRNA sequence
ctcagcctaaggtacagcaa

SEQ ID NO: 766000 - DNA, 20 bp, Artificial
  CRISPR gRNA sequence
agcaagggcatccaaccctg

SEQ ID NO: 766001 - DNA, 20 bp, Artificial
  CRISPR gRNA sequence
aagggcatccaaccctgcag

SEQ ID NO: 766002 - DNA, 20 bp, Artificial
  CRISPR gRNA sequence
ggcatccaaccctgcagaag

SEQ ID NO: 766003 - DNA, 20 bp, Artificial
  CRISPR gRNA sequence
gcatccaaccctgcagaagc

SEQ ID NO: 766004 - DNA, 20 bp, Artificial
  CRISPR gRNA sequence
catccaaccctgcagaagca

SEQ ID NO: 766005 - DNA, 20 bp, Artificial
  CRISPR gRNA sequence
accctgcagaagcagggcca

SEQ ID NO: 766006 - DNA, 20 bp, Artificial
  CRISPR gRNA sequence
ccctgcagaagcagggccac

SEQ ID NO: 766007 - DNA, 20 bp, Artificial
  CRISPR gRNA sequence
cctgcagaagcagggccaca

SEQ ID NO: 766008 - DNA, 20 bp, Artificial
  CRISPR gRNA sequence
tgcagaagcagggccacagg

SEQ ID NO: 766009 - DNA, 20 bp, Artificial
  CRISPR gRNA sequence
gcagaagcagggccacaggg

SEQ ID NO: 766010 - DNA, 20 bp, Artificial
  CRISPR gRNA sequence
agggccacagggaggctccc

SEQ ID NO: 766011 - DNA, 20 bp, Artificial
  CRISPR gRNA sequence
ggccacagggaggctcccaa

SEQ ID NO: 766012 - DNA, 20 bp, Artificial
  CRISPR gRNA sequence
aggctcccaagagatgaccc

SEQ ID NO: 766013 - DNA, 20 bp, Artificial
  CRISPR gRNA sequence
gatgacccaagatgtgccct

SEQ ID NO: 766014 - DNA, 20 bp, Artificial
  CRISPR gRNA sequence
acccaagatgtgccctcaga

SEQ ID NO: 766015 - DNA, 20 bp, Artificial
  CRISPR gRNA sequence
tcagaaagctacaacaaatc

SEQ ID NO: 766016 - DNA, 20 bp, Artificial
  CRISPR gRNA sequence
caacaaatccagactgcacc

SEQ ID NO: 766017 - DNA, 20 bp, Artificial
  CRISPR gRNA sequence
aacaaatccagactgcacct

SEQ ID NO: 766018 - DNA, 20 bp, Artificial
  CRISPR gRNA sequence
atccagactgcacctgggct

SEQ ID NO: 766019 - DNA, 20 bp, Artificial
  CRISPR gRNA sequence
tccagactgcacctgggctc

SEQ ID NO: 766020 - DNA, 20 bp, Artificial
  CRISPR gRNA sequence
ccagactgcacctgggctca

SEQ ID NO: 766021 - DNA, 20 bp, Artificial
  CRISPR gRNA sequence
ggctcagggccaaaatgccc

SEQ ID NO: 766022 - DNA, 20 bp, Artificial
  CRISPR gRNA sequence
gctcagggccaaaatgccct

SEQ ID NO: 766023 - DNA, 20 bp, Artificial
  CRISPR gRNA sequence
gggccaaaatgccctgggcc

SEQ ID NO: 766024 - DNA, 20 bp, Artificial
  CRISPR gRNA sequence
ggccaaaatgccctgggcct

SEQ ID NO: 766025 - DNA, 20 bp, Artificial
  CRISPR gRNA sequence
gccaaaatgccctgggcctg

SEQ ID NO: 766026 - DNA, 20 bp, Artificial
  CRISPR gRNA sequence
ccctgggcctggggatgccc

SEQ ID NO: 766027 - DNA, 20 bp, Artificial
  CRISPR gRNA sequence
ctgggcctggggatgcccaa

SEQ ID NO: 766028 - DNA, 20 bp, Artificial
  CRISPR gRNA sequence
tgggcctggggatgcccaag

SEQ ID NO: 766029 - DNA, 20 bp, Artificial
  CRISPR gRNA sequence
gggcctggggatgcccaaga

SEQ ID NO: 766030 - DNA, 20 bp, Artificial
  CRISPR gRNA sequence
ctacttcctcccaatccccg

SEQ ID NO: 766031 - DNA, 20 bp, Artificial
  CRISPR gRNA sequence
tacttcctcccaatccccgc

SEQ ID NO: 766032 - DNA, 20 bp, Artificial
  CRISPR gRNA sequence
acttcctcccaatccccgca

SEQ ID NO: 766033 - DNA, 20 bp, Artificial
  CRISPR gRNA sequence
cttcctcccaatccccgcag

SEQ ID NO: 766034 - DNA, 20 bp, Artificial
  CRISPR gRNA sequence
caatccccgcaggggctcct

SEQ ID NO: 766035 - DNA, 20 bp, Artificial
  CRISPR gRNA sequence
aatccccgcaggggctcctt

SEQ ID NO: 766036 - DNA, 20 bp, Artificial
  CRISPR gRNA sequence
cttgggcaacacttcccaca

SEQ ID NO: 766037 - DNA, 20 bp, Artificial
  CRISPR gRNA sequence
ttgggcaacacttcccacaa

SEQ ID NO: 766038 - DNA, 20 bp, Artificial
  CRISPR gRNA sequence
tgggcaacacttcccacaaa

SEQ ID NO: 766039 - DNA, 20 bp, Artificial
  CRISPR gRNA sequence
acttcccacaaagggacaaa

SEQ ID NO: 766040 - DNA, 20 bp, Artificial
  CRISPR gRNA sequence
cttcccacaaagggacaaaa

SEQ ID NO: 766041 - DNA, 20 bp, Artificial
  CRISPR gRNA sequence
ttcccacaaagggacaaaaa

SEQ ID NO: 766042 - DNA, 20 bp, Artificial
  CRISPR gRNA sequence
cacaaagggacaaaaagggt

SEQ ID NO: 766043 - DNA, 20 bp, Artificial
  CRISPR gRNA sequence
aagggacaaaaagggtcaga

SEQ ID NO: 766044 - DNA, 20 bp, Artificial
  CRISPR gRNA sequence
aaaagggtcagaaagacaca

SEQ ID NO: 766045 - DNA, 20 bp, Artificial
  CRISPR gRNA sequence
acacaaagttctgaaaatgt

SEQ ID NO: 766046 - DNA, 20 bp, Artificial
  CRISPR gRNA sequence
aagttctgaaaatgtcagac

SEQ ID NO: 766047 - DNA, 20 bp, Artificial
  CRISPR gRNA sequence
gaaaatgtcagacaagtccc

SEQ ID NO: 766048 - DNA, 20 bp, Artificial
  CRISPR gRNA sequence
gtcagacaagtccctggatc

SEQ ID NO: 766049 - DNA, 20 bp, Artificial
  CRISPR gRNA sequence
cctggatccagctatgcctg

SEQ ID NO: 766050 - DNA, 20 bp, Artificial
  CRISPR gRNA sequence
gatccagctatgcctgaagc

SEQ ID NO: 766051 - DNA, 20 bp, Artificial
  CRISPR gRNA sequence
gctatgcctgaagcaagctg

SEQ ID NO: 766052 - DNA, 20 bp, Artificial
  CRISPR gRNA sequence
cctgaagcaagctgcagacc

SEQ ID NO: 766053 - DNA, 20 bp, Artificial
  CRISPR gRNA sequence
agctgcagacctagaccgcc

SEQ ID NO: 766054 - DNA, 20 bp, Artificial
  CRISPR gRNA sequence
cctagaccgcccagatattt

SEQ ID NO: 766055 - DNA, 20 bp, Artificial
  CRISPR gRNA sequence
tcattttttttcccttaaac

SEQ ID NO: 766056 - DNA, 20 bp, Artificial
  CRISPR gRNA sequence
cccttaaaccagtttgaact

SEQ ID NO: 766057 - DNA, 20 bp, Artificial
  CRISPR gRNA sequence
gtttctattgtctgcaaccg

SEQ ID NO: 766058 - DNA, 20 bp, Artificial
  CRISPR gRNA sequence
tttctattgtctgcaaccga

SEQ ID NO: 766059 - DNA, 20 bp, Artificial
  CRISPR gRNA sequence
tctattgtctgcaaccgaag

SEQ ID NO: 766060 - DNA, 20 bp, Artificial
  CRISPR gRNA sequence
tccacatgcattcatgtctt

SEQ ID NO: 766061 - DNA, 20 bp, Artificial
  CRISPR gRNA sequence
gtaattcatttcactactta

SEQ ID NO: 766062 - DNA, 20 bp, Artificial
  CRISPR gRNA sequence
aattcatttcactacttacg

SEQ ID NO: 766063 - DNA, 20 bp, Artificial
  CRISPR gRNA sequence
ttcactacttacggagttcc

SEQ ID NO: 766064 - DNA, 20 bp, Artificial
  CRISPR gRNA sequence
actacttacggagttcctgg

SEQ ID NO: 766065 - DNA, 20 bp, Artificial
  CRISPR gRNA sequence
ctacttacggagttcctggt

SEQ ID NO: 766066 - DNA, 20 bp, Artificial
  CRISPR gRNA sequence
tacttacggagttcctggta

SEQ ID NO: 766067 - DNA, 20 bp, Artificial
  CRISPR gRNA sequence
agttcctggtagggacgtac

SEQ ID NO: 766068 - DNA, 20 bp, Artificial
  CRISPR gRNA sequence
gttcctggtagggacgtact

SEQ ID NO: 766069 - DNA, 20 bp, Artificial
  CRISPR gRNA sequence
ttcctggtagggacgtacta

SEQ ID NO: 766070 - DNA, 20 bp, Artificial
  CRISPR gRNA sequence
tcctggtagggacgtactag

SEQ ID NO: 766071 - DNA, 20 bp, Artificial
  CRISPR gRNA sequence
tggtagggacgtactagggg

SEQ ID NO: 766072 - DNA, 20 bp, Artificial
  CRISPR gRNA sequence
gtagggacgtactaggggca

SEQ ID NO: 766073 - DNA, 20 bp, Artificial
  CRISPR gRNA sequence
agggacgtactaggggcaga

SEQ ID NO: 766074 - DNA, 20 bp, Artificial
  CRISPR gRNA sequence
ctaggggcagagagataact

SEQ ID NO: 766075 - DNA, 20 bp, Artificial
  CRISPR gRNA sequence
taggggcagagagataacta

SEQ ID NO: 766076 - DNA, 20 bp, Artificial
  CRISPR gRNA sequence
taaggtacacgtctgtcctc

SEQ ID NO: 766077 - DNA, 20 bp, Artificial
  CRISPR gRNA sequence
aaggtacacgtctgtcctca

SEQ ID NO: 766078 - DNA, 20 bp, Artificial
  CRISPR gRNA sequence
ggtacacgtctgtcctcaag

SEQ ID NO: 766079 - DNA, 20 bp, Artificial
  CRISPR gRNA sequence
acacgtctgtcctcaaggag

SEQ ID NO: 766080 - DNA, 20 bp, Artificial
  CRISPR gRNA sequence
cctcaaggagcagattctaa

SEQ ID NO: 766081 - DNA, 20 bp, Artificial
  CRISPR gRNA sequence
ctcaaggagcagattctaat

SEQ ID NO: 766082 - DNA, 20 bp, Artificial
  CRISPR gRNA sequence
tcaaggagcagattctaata

SEQ ID NO: 766083 - DNA, 20 bp, Artificial
  CRISPR gRNA sequence
aggagcagattctaataggg

SEQ ID NO: 766084 - DNA, 20 bp, Artificial
  CRISPR gRNA sequence
ggagcagattctaataggga

SEQ ID NO: 766085 - DNA, 20 bp, Artificial
  CRISPR gRNA sequence
gagcagattctaatagggaa

SEQ ID NO: 766086 - DNA, 20 bp, Artificial
  CRISPR gRNA sequence
agcagattctaatagggaag

SEQ ID NO: 766087 - DNA, 20 bp, Artificial
  CRISPR gRNA sequence
gcagattctaatagggaagg

SEQ ID NO: 766088 - DNA, 20 bp, Artificial
  CRISPR gRNA sequence
taatagggaagggggacatg

SEQ ID NO: 766089 - DNA, 20 bp, Artificial
  CRISPR gRNA sequence
agggaagggggacatgcagt

SEQ ID NO: 766090 - DNA, 20 bp, Artificial
  CRISPR gRNA sequence
gacatgcagttagatcactg

SEQ ID NO: 766091 - DNA, 20 bp, Artificial
  CRISPR gRNA sequence
gcagttagatcactgcagtt

SEQ ID NO: 766092 - DNA, 20 bp, Artificial
  CRISPR gRNA sequence
tagatcactgcagtttggta

SEQ ID NO: 766093 - DNA, 20 bp, Artificial
  CRISPR gRNA sequence
atagtatactatttatgata

SEQ ID NO: 766094 - DNA, 20 bp, Artificial
  CRISPR gRNA sequence
tatactatttatgatatggt

SEQ ID NO: 766095 - DNA, 20 bp, Artificial
  CRISPR gRNA sequence
atactatttatgatatggtc

SEQ ID NO: 766096 - DNA, 20 bp, Artificial
  CRISPR gRNA sequence
tactatttatgatatggtca

SEQ ID NO: 766097 - DNA, 20 bp, Artificial
  CRISPR gRNA sequence
atgatatggtcagggcgaat

SEQ ID NO: 766098 - DNA, 20 bp, Artificial
  CRISPR gRNA sequence
gatatggtcagggcgaattg

SEQ ID NO: 766099 - DNA, 20 bp, Artificial
  CRISPR gRNA sequence
atatggtcagggcgaattgg

SEQ ID NO: 766100 - DNA, 20 bp, Artificial
  CRISPR gRNA sequence
agggcgaattggaggcacct

SEQ ID NO: 766101 - DNA, 20 bp, Artificial
  CRISPR gRNA sequence
ggcgaattggaggcacctca

SEQ ID NO: 766102 - DNA, 20 bp, Artificial
  CRISPR gRNA sequence
gcgaattggaggcacctcag

SEQ ID NO: 766103 - DNA, 20 bp, Artificial
  CRISPR gRNA sequence
cctcagaggcatgataaccc

SEQ ID NO: 766104 - DNA, 20 bp, Artificial
  CRISPR gRNA sequence
tcagaggcatgataacccca

SEQ ID NO: 766105 - DNA, 20 bp, Artificial
  CRISPR gRNA sequence
ccccagagatgatccctgaa

SEQ ID NO: 766106 - DNA, 20 bp, Artificial
  CRISPR gRNA sequence
gatgatccctgaaaagtcat

SEQ ID NO: 766107 - DNA, 20 bp, Artificial
  CRISPR gRNA sequence
gatccctgaaaagtcatgag

SEQ ID NO: 766108 - DNA, 20 bp, Artificial
  CRISPR gRNA sequence
aaaagtcatgagcagctccc

SEQ ID NO: 766109 - DNA, 20 bp, Artificial
  CRISPR gRNA sequence
aaagtcatgagcagctcccc

SEQ ID NO: 766110 - DNA, 20 bp, Artificial
  CRISPR gRNA sequence
gtcatgagcagctccccagg

SEQ ID NO: 766111 - DNA, 20 bp, Artificial
  CRISPR gRNA sequence
agctccccaggtagccgcgc

SEQ ID NO: 766112 - DNA, 20 bp, Artificial
  CRISPR gRNA sequence
gctccccaggtagccgcgct

SEQ ID NO: 766113 - DNA, 20 bp, Artificial
  CRISPR gRNA sequence
cccaggtagccgcgctggga

SEQ ID NO: 766114 - DNA, 20 bp, Artificial
  CRISPR gRNA sequence
ccaggtagccgcgctgggaa

SEQ ID NO: 766115 - DNA, 20 bp, Artificial
  CRISPR gRNA sequence
ggtaaccctttcctgaactc

SEQ ID NO: 766116 - DNA, 20 bp, Artificial
  CRISPR gRNA sequence
taaccctttcctgaactcca

SEQ ID NO: 766117 - DNA, 20 bp, Artificial
  CRISPR gRNA sequence
gacactgcctgtctgcccct

SEQ ID NO: 766118 - DNA, 20 bp, Artificial
  CRISPR gRNA sequence
ctgcctgtctgcccctcagc

SEQ ID NO: 766119 - DNA, 20 bp, Artificial
  CRISPR gRNA sequence
gcccctcagccagatcaccc

SEQ ID NO: 766120 - DNA, 20 bp, Artificial
  CRISPR gRNA sequence
gccagatcaccctggaattc

SEQ ID NO: 766121 - DNA, 20 bp, Artificial
  CRISPR gRNA sequence
accctggaattctagaaaat

SEQ ID NO: 766122 - DNA, 20 bp, Artificial
  CRISPR gRNA sequence
aattctagaaaatgagccca

SEQ ID NO: 766123 - DNA, 20 bp, Artificial
  CRISPR gRNA sequence
tagaaaatgagcccaaagtg

SEQ ID NO: 766124 - DNA, 20 bp, Artificial
  CRISPR gRNA sequence
agaaaatgagcccaaagtgt

SEQ ID NO: 766125 - DNA, 20 bp, Artificial
  CRISPR gRNA sequence
gaaaatgagcccaaagtgtg

SEQ ID NO: 766126 - DNA, 20 bp, Artificial
  CRISPR gRNA sequence
gagcccaaagtgtggggttc

SEQ ID NO: 766127 - DNA, 20 bp, Artificial
  CRISPR gRNA sequence
aaagtgtggggttctggtcc

SEQ ID NO: 766128 - DNA, 20 bp, Artificial
  CRISPR gRNA sequence
ctttgttatgcaatcttaac

SEQ ID NO: 766129 - DNA, 20 bp, Artificial
  CRISPR gRNA sequence
tttgttatgcaatcttaact

SEQ ID NO: 766130 - DNA, 20 bp, Artificial
  CRISPR gRNA sequence
cttaactaggcaacttctct

SEQ ID NO: 766131 - DNA, 20 bp, Artificial
  CRISPR gRNA sequence
ctaggcaacttctctgagct

SEQ ID NO: 766132 - DNA, 20 bp, Artificial
  CRISPR gRNA sequence
ctcagtgttcctacctataa

SEQ ID NO: 766133 - DNA, 20 bp, Artificial
  CRISPR gRNA sequence
tgttcctacctataaaagaa

SEQ ID NO: 766134 - DNA, 20 bp, Artificial
  CRISPR gRNA sequence
cctataaaagaaaagctttg

SEQ ID NO: 766135 - DNA, 20 bp, Artificial
  CRISPR gRNA sequence
aagaaaagctttgtggatgc

SEQ ID NO: 766136 - DNA, 20 bp, Artificial
  CRISPR gRNA sequence
aaaagctttgtggatgctag

SEQ ID NO: 766137 - DNA, 20 bp, Artificial
  CRISPR gRNA sequence
ggatgctagtggaactttat

SEQ ID NO: 766138 - DNA, 20 bp, Artificial
  CRISPR gRNA sequence
tggaactttatcagtacttg

SEQ ID NO: 766139 - DNA, 20 bp, Artificial
  CRISPR gRNA sequence
ttatcagtacttgaagcttt

SEQ ID NO: 766140 - DNA, 20 bp, Artificial
  CRISPR gRNA sequence
tatcagtacttgaagctttc

SEQ ID NO: 766141 - DNA, 20 bp, Artificial
  CRISPR gRNA sequence
atcagtacttgaagctttca

SEQ ID NO: 766142 - DNA, 20 bp, Artificial
  CRISPR gRNA sequence
ctttcagggactatatcctt

SEQ ID NO: 766143 - DNA, 20 bp, Artificial
  CRISPR gRNA sequence
tttcagggactatatcctta

SEQ ID NO: 766144 - DNA, 20 bp, Artificial
  CRISPR gRNA sequence
ctatatccttaaggcttaac

SEQ ID NO: 766145 - DNA, 20 bp, Artificial
  CRISPR gRNA sequence
cttaaggcttaaccagttca

SEQ ID NO: 766146 - DNA, 20 bp, Artificial
  CRISPR gRNA sequence
ttaaccagttcacagccaca

SEQ ID NO: 766147 - DNA, 20 bp, Artificial
  CRISPR gRNA sequence
agttcccactgaaatgcaca

SEQ ID NO: 766148 - DNA, 20 bp, Artificial
  CRISPR gRNA sequence
tgaaatgcacaaagtgactg

SEQ ID NO: 766149 - DNA, 20 bp, Artificial
  CRISPR gRNA sequence
aatgcacaaagtgactgtgg

SEQ ID NO: 766150 - DNA, 20 bp, Artificial
  CRISPR gRNA sequence
gtgactgtggcagaaactgc

SEQ ID NO: 766151 - DNA, 20 bp, Artificial
  CRISPR gRNA sequence
cacccattttctcccttttt

SEQ ID NO: 766152 - DNA, 20 bp, Artificial
  CRISPR gRNA sequence
cccattttctccctttttaa

SEQ ID NO: 766153 - DNA, 20 bp, Artificial
  CRISPR gRNA sequence
ttttctccctttttaagaga

SEQ ID NO: 766154 - DNA, 20 bp, Artificial
  CRISPR gRNA sequence
tttctccctttttaagagac

SEQ ID NO: 766155 - DNA, 20 bp, Artificial
  CRISPR gRNA sequence
ttctccctttttaagagaca

SEQ ID NO: 766156 - DNA, 20 bp, Artificial
  CRISPR gRNA sequence
cagggtcccgctctgtcacc

SEQ ID NO: 766157 - DNA, 20 bp, Artificial
  CRISPR gRNA sequence
agggtcccgctctgtcaccc

SEQ ID NO: 766158 - DNA, 20 bp, Artificial
  CRISPR gRNA sequence
tcccgctctgtcacccaggc

SEQ ID NO: 766159 - DNA, 20 bp, Artificial
  CRISPR gRNA sequence
ccgctctgtcacccaggctg

SEQ ID NO: 766160 - DNA, 20 bp, Artificial
  CRISPR gRNA sequence
ctctgtcacccaggctggag

SEQ ID NO: 766161 - DNA, 20 bp, Artificial
  CRISPR gRNA sequence
aggctggagtggtaccatca

SEQ ID NO: 766162 - DNA, 20 bp, Artificial
  CRISPR gRNA sequence
ggagtggtaccatcatagtt

SEQ ID NO: 766163 - DNA, 20 bp, Artificial
  CRISPR gRNA sequence
gtggtaccatcatagttcag

SEQ ID NO: 766164 - DNA, 20 bp, Artificial
  CRISPR gRNA sequence
tcatagttcagtggtgcaat

SEQ ID NO: 766165 - DNA, 20 bp, Artificial
  CRISPR gRNA sequence
cactgcacccttgtaactcc

SEQ ID NO: 766166 - DNA, 20 bp, Artificial
  CRISPR gRNA sequence
actgcacccttgtaactcct

SEQ ID NO: 766167 - DNA, 20 bp, Artificial
  CRISPR gRNA sequence
cccttgtaactcctgggctc

SEQ ID NO: 766168 - DNA, 20 bp, Artificial
  CRISPR gRNA sequence
ctcaagtgatcctcctgcct

SEQ ID NO: 766169 - DNA, 20 bp, Artificial
  CRISPR gRNA sequence
tcctcctgcctcagcctccc

SEQ ID NO: 766170 - DNA, 20 bp, Artificial
  CRISPR gRNA sequence
tgcctcagcctcccgagtaa

SEQ ID NO: 766171 - DNA, 20 bp, Artificial
  CRISPR gRNA sequence
gcctcagcctcccgagtaac

SEQ ID NO: 766172 - DNA, 20 bp, Artificial
  CRISPR gRNA sequence
cctcagcctcccgagtaaca

SEQ ID NO: 766173 - DNA, 20 bp, Artificial
  CRISPR gRNA sequence
ctcccgagtaacagggacta

SEQ ID NO: 766174 - DNA, 20 bp, Artificial
  CRISPR gRNA sequence
tcccgagtaacagggactac

SEQ ID NO: 766175 - DNA, 20 bp, Artificial
  CRISPR gRNA sequence
acagggactacaggtgctgc

SEQ ID NO: 766176 - DNA, 20 bp, Artificial
  CRISPR gRNA sequence
acaggtgctgccagcacacc

SEQ ID NO: 766177 - DNA, 20 bp, Artificial
  CRISPR gRNA sequence
ccagctctccccttcttcca

SEQ ID NO: 766178 - DNA, 20 bp, Artificial
  CRISPR gRNA sequence
cccttcttccatagcatttt

SEQ ID NO: 766179 - DNA, 20 bp, Artificial
  CRISPR gRNA sequence
tcttccatagcatttttagt

SEQ ID NO: 766180 - DNA, 20 bp, Artificial
  CRISPR gRNA sequence
cttccatagcatttttagtt

SEQ ID NO: 766181 - DNA, 20 bp, Artificial
  CRISPR gRNA sequence
agcatttttagttaggcaca

SEQ ID NO: 766182 - DNA, 20 bp, Artificial
  CRISPR gRNA sequence
tagttaggcacacggccact

SEQ ID NO: 766183 - DNA, 20 bp, Artificial
  CRISPR gRNA sequence
ggccactcagctaacgactg

SEQ ID NO: 766184 - DNA, 20 bp, Artificial
  CRISPR gRNA sequence
cagctaacgactgcagatcc

SEQ ID NO: 766185 - DNA, 20 bp, Artificial
  CRISPR gRNA sequence
gcagatcccagccttacttg

SEQ ID NO: 766186 - DNA, 20 bp, Artificial
  CRISPR gRNA sequence
tcccagccttacttgcagct

SEQ ID NO: 766187 - DNA, 20 bp, Artificial
  CRISPR gRNA sequence
gccttacttgcagctgagtg

SEQ ID NO: 766188 - DNA, 20 bp, Artificial
  CRISPR gRNA sequence
aatgtgtacactgatgtgta

SEQ ID NO: 766189 - DNA, 20 bp, Artificial
  CRISPR gRNA sequence
acactgatgtgtacagcttc

SEQ ID NO: 766190 - DNA, 20 bp, Artificial
  CRISPR gRNA sequence
cactgatgtgtacagcttct

SEQ ID NO: 766191 - DNA, 20 bp, Artificial
  CRISPR gRNA sequence
gcttctgggtcatgccctga

SEQ ID NO: 766192 - DNA, 20 bp, Artificial
  CRISPR gRNA sequence
ttctgggtcatgccctgaaa

SEQ ID NO: 766193 - DNA, 20 bp, Artificial
  CRISPR gRNA sequence
ctgggtcatgccctgaaaga

SEQ ID NO: 766194 - DNA, 20 bp, Artificial
  CRISPR gRNA sequence
ggtcatgccctgaaagagag

SEQ ID NO: 766195 - DNA, 20 bp, Artificial
  CRISPR gRNA sequence
tttcccctcccccttcccac

SEQ ID NO: 766196 - DNA, 20 bp, Artificial
  CRISPR gRNA sequence
ccctcccccttcccactggc

SEQ ID NO: 766197 - DNA, 20 bp, Artificial
  CRISPR gRNA sequence
ccttcccactggctggaaca

SEQ ID NO: 766198 - DNA, 20 bp, Artificial
  CRISPR gRNA sequence
cactggctggaacatagatg

SEQ ID NO: 766199 - DNA, 20 bp, Artificial
  CRISPR gRNA sequence
gaacatagatgtggtgtgtg

SEQ ID NO: 766200 - DNA, 20 bp, Artificial
  CRISPR gRNA sequence
gtgtggcgatcatactgcca

SEQ ID NO: 766201 - DNA, 20 bp, Artificial
  CRISPR gRNA sequence
tgtggcgatcatactgccaa

SEQ ID NO: 766202 - DNA, 20 bp, Artificial
  CRISPR gRNA sequence
actgccaaaggcaacaccct

SEQ ID NO: 766203 - DNA, 20 bp, Artificial
  CRISPR gRNA sequence
ctgccaaaggcaacaccctg

SEQ ID NO: 766204 - DNA, 20 bp, Artificial
  CRISPR gRNA sequence
caaaggcaacaccctgagga

SEQ ID NO: 766205 - DNA, 20 bp, Artificial
  CRISPR gRNA sequence
aggcaacaccctgaggacgg

SEQ ID NO: 766206 - DNA, 20 bp, Artificial
  CRISPR gRNA sequence
gcaacaccctgaggacggca

SEQ ID NO: 766207 - DNA, 20 bp, Artificial
  CRISPR gRNA sequence
acaccctgaggacggcagag

SEQ ID NO: 766208 - DNA, 20 bp, Artificial
  CRISPR gRNA sequence
ccctgaggacggcagagcag

SEQ ID NO: 766209 - DNA, 20 bp, Artificial
  CRISPR gRNA sequence
gaggacggcagagcagcaga

SEQ ID NO: 766210 - DNA, 20 bp, Artificial
  CRISPR gRNA sequence
gacggcagagcagcagacag

SEQ ID NO: 766211 - DNA, 20 bp, Artificial
  CRISPR gRNA sequence
gcagcagacagaagaaccct

SEQ ID NO: 766212 - DNA, 20 bp, Artificial
  CRISPR gRNA sequence
cagcagacagaagaaccctg

SEQ ID NO: 766213 - DNA, 20 bp, Artificial
  CRISPR gRNA sequence
agcagacagaagaaccctga

SEQ ID NO: 766214 - DNA, 20 bp, Artificial
  CRISPR gRNA sequence
agaagaaccctgagggactg

SEQ ID NO: 766215 - DNA, 20 bp, Artificial
  CRISPR gRNA sequence
accctgagggactgtagtat

SEQ ID NO: 766216 - DNA, 20 bp, Artificial
  CRISPR gRNA sequence
agggactgtagtatcagccc

SEQ ID NO: 766217 - DNA, 20 bp, Artificial
  CRISPR gRNA sequence
gtatcagccctggatatacc

SEQ ID NO: 766218 - DNA, 20 bp, Artificial
  CRISPR gRNA sequence
cagccctggatatacccaga

SEQ ID NO: 766219 - DNA, 20 bp, Artificial
  CRISPR gRNA sequence
gatatacccagatggtcaca

SEQ ID NO: 766220 - DNA, 20 bp, Artificial
  CRISPR gRNA sequence
atatacccagatggtcacat

SEQ ID NO: 766221 - DNA, 20 bp, Artificial
  CRISPR gRNA sequence
acccagatggtcacatgggt

SEQ ID NO: 766222 - DNA, 20 bp, Artificial
  CRISPR gRNA sequence
tgagaaataaacatctcttc

SEQ ID NO: 766223 - DNA, 20 bp, Artificial
  CRISPR gRNA sequence
ataaacatctcttccagcat

SEQ ID NO: 766224 - DNA, 20 bp, Artificial
  CRISPR gRNA sequence
agcataagtcattgctattt

SEQ ID NO: 766225 - DNA, 20 bp, Artificial
  CRISPR gRNA sequence
gcataagtcattgctatttt

SEQ ID NO: 766226 - DNA, 20 bp, Artificial
  CRISPR gRNA sequence
gctattttgggcctttctta

SEQ ID NO: 766227 - DNA, 20 bp, Artificial
  CRISPR gRNA sequence
ttacagcatctgaactaact

SEQ ID NO: 766228 - DNA, 20 bp, Artificial
  CRISPR gRNA sequence
tacagcatctgaactaacta

SEQ ID NO: 766229 - DNA, 20 bp, Artificial
  CRISPR gRNA sequence
cagcatctgaactaactaag

SEQ ID NO: 766230 - DNA, 20 bp, Artificial
  CRISPR gRNA sequence
tccccgtctccgtacccgat

SEQ ID NO: 766231 - DNA, 20 bp, Artificial
  CRISPR gRNA sequence
cgatgagcattgccactgct

SEQ ID NO: 766232 - DNA, 20 bp, Artificial
  CRISPR gRNA sequence
atgagcattgccactgctca

SEQ ID NO: 766233 - DNA, 20 bp, Artificial
  CRISPR gRNA sequence
gccactgctcagagccacaa

SEQ ID NO: 766234 - DNA, 20 bp, Artificial
  CRISPR gRNA sequence
ccactgctcagagccacaaa

SEQ ID NO: 766235 - DNA, 20 bp, Artificial
  CRISPR gRNA sequence
aaaggaaaccacatctaaaa

SEQ ID NO: 766236 - DNA, 20 bp, Artificial
  CRISPR gRNA sequence
aaggaaaccacatctaaaat

SEQ ID NO: 766237 - DNA, 20 bp, Artificial
  CRISPR gRNA sequence
taggtatctcaaaatacgaa

SEQ ID NO: 766238 - DNA, 20 bp, Artificial
  CRISPR gRNA sequence
aggtatctcaaaatacgaac

SEQ ID NO: 766239 - DNA, 20 bp, Artificial
  CRISPR gRNA sequence
gtatctcaaaatacgaacag

SEQ ID NO: 766240 - DNA, 20 bp, Artificial
  CRISPR gRNA sequence
cgaacaggagactatctcat

SEQ ID NO: 766241 - DNA, 20 bp, Artificial
  CRISPR gRNA sequence
aacaggagactatctcatca

SEQ ID NO: 766242 - DNA, 20 bp, Artificial
  CRISPR gRNA sequence
actatctcatcagagtcacc

SEQ ID NO: 766243 - DNA, 20 bp, Artificial
  CRISPR gRNA sequence
agagtcaccgagtgatgcct

SEQ ID NO: 766244 - DNA, 20 bp, Artificial
  CRISPR gRNA sequence
caccgagtgatgcctgagcc

SEQ ID NO: 766245 - DNA, 20 bp, Artificial
  CRISPR gRNA sequence
gtgatgcctgagcccagctt

SEQ ID NO: 766246 - DNA, 20 bp, Artificial
  CRISPR gRNA sequence
cccagctttggacaaatgtc

SEQ ID NO: 766247 - DNA, 20 bp, Artificial
  CRISPR gRNA sequence
ccagctttggacaaatgtca

SEQ ID NO: 766248 - DNA, 20 bp, Artificial
  CRISPR gRNA sequence
cagctttggacaaatgtcaa

SEQ ID NO: 766249 - DNA, 20 bp, Artificial
  CRISPR gRNA sequence
ctttggacaaatgtcaaggg

SEQ ID NO: 766250 - DNA, 20 bp, Artificial
  CRISPR gRNA sequence
tggacaaatgtcaagggtag

SEQ ID NO: 766251 - DNA, 20 bp, Artificial
  CRISPR gRNA sequence
atgtcaagggtagaagtgac

SEQ ID NO: 766252 - DNA, 20 bp, Artificial
  CRISPR gRNA sequence
tgtcaagggtagaagtgacc

SEQ ID NO: 766253 - DNA, 20 bp, Artificial
  CRISPR gRNA sequence
agggtagaagtgaccaggct

SEQ ID NO: 766254 - DNA, 20 bp, Artificial
  CRISPR gRNA sequence
gggtagaagtgaccaggctt

SEQ ID NO: 766255 - DNA, 20 bp, Artificial
  CRISPR gRNA sequence
ggtagaagtgaccaggcttg

SEQ ID NO: 766256 - DNA, 20 bp, Artificial
  CRISPR gRNA sequence
gcttggggactgtttgtatt

SEQ ID NO: 766257 - DNA, 20 bp, Artificial
  CRISPR gRNA sequence
cttggggactgtttgtattg

SEQ ID NO: 766258 - DNA, 20 bp, Artificial
  CRISPR gRNA sequence
ttggggactgtttgtattga

SEQ ID NO: 766259 - DNA, 20 bp, Artificial
  CRISPR gRNA sequence
ggggactgtttgtattgagg

SEQ ID NO: 766260 - DNA, 20 bp, Artificial
  CRISPR gRNA sequence
gggactgtttgtattgaggg

SEQ ID NO: 766261 - DNA, 20 bp, Artificial
  CRISPR gRNA sequence
ggactgtttgtattgaggga

SEQ ID NO: 766262 - DNA, 20 bp, Artificial
  CRISPR gRNA sequence
gactgtttgtattgagggag

SEQ ID NO: 766263 - DNA, 20 bp, Artificial
  CRISPR gRNA sequence
ttgtattgagggaggggctg

SEQ ID NO: 766264 - DNA, 20 bp, Artificial
  CRISPR gRNA sequence
tgtattgagggaggggctga

SEQ ID NO: 766265 - DNA, 20 bp, Artificial
  CRISPR gRNA sequence
agggaggggctgaaggtgtc

SEQ ID NO: 766266 - DNA, 20 bp, Artificial
  CRISPR gRNA sequence
ggaggggctgaaggtgtcaa

SEQ ID NO: 766267 - DNA, 20 bp, Artificial
  CRISPR gRNA sequence
gaggggctgaaggtgtcaag

SEQ ID NO: 766268 - DNA, 20 bp, Artificial
  CRISPR gRNA sequence
aggggctgaaggtgtcaaga

SEQ ID NO: 766269 - DNA, 20 bp, Artificial
  CRISPR gRNA sequence
aaggtgtcaagagggcactg

SEQ ID NO: 766270 - DNA, 20 bp, Artificial
  CRISPR gRNA sequence
aggtgtcaagagggcactga

SEQ ID NO: 766271 - DNA, 20 bp, Artificial
  CRISPR gRNA sequence
caagagggcactgaaggctt

SEQ ID NO: 766272 - DNA, 20 bp, Artificial
  CRISPR gRNA sequence
ggcactgaaggcttgagcaa

SEQ ID NO: 766273 - DNA, 20 bp, Artificial
  CRISPR gRNA sequence
gcactgaaggcttgagcaat

SEQ ID NO: 766274 - DNA, 20 bp, Artificial
  CRISPR gRNA sequence
gcttgagcaatgggcaaaca

SEQ ID NO: 766275 - DNA, 20 bp, Artificial
  CRISPR gRNA sequence
caaacatggacacacataac

SEQ ID NO: 766276 - DNA, 20 bp, Artificial
  CRISPR gRNA sequence
aaacatggacacacataaca

SEQ ID NO: 766277 - DNA, 20 bp, Artificial
  CRISPR gRNA sequence
acatggacacacataacaag

SEQ ID NO: 766278 - DNA, 20 bp, Artificial
  CRISPR gRNA sequence
acacacataacaaggagacc

SEQ ID NO: 766279 - DNA, 20 bp, Artificial
  CRISPR gRNA sequence
acacataacaaggagacctg

SEQ ID NO: 766280 - DNA, 20 bp, Artificial
  CRISPR gRNA sequence
aacaaggagacctggagatg

SEQ ID NO: 766281 - DNA, 20 bp, Artificial
  CRISPR gRNA sequence
agacctggagatgaagcacg

SEQ ID NO: 766282 - DNA, 20 bp, Artificial
  CRISPR gRNA sequence
acctggagatgaagcacgtg

SEQ ID NO: 766283 - DNA, 20 bp, Artificial
  CRISPR gRNA sequence
cctggagatgaagcacgtgg

SEQ ID NO: 766284 - DNA, 20 bp, Artificial
  CRISPR gRNA sequence
ctggagatgaagcacgtgga

SEQ ID NO: 766285 - DNA, 20 bp, Artificial
  CRISPR gRNA sequence
tggagatgaagcacgtggag

SEQ ID NO: 766286 - DNA, 20 bp, Artificial
  CRISPR gRNA sequence
ggagatgaagcacgtggagg

SEQ ID NO: 766287 - DNA, 20 bp, Artificial
  CRISPR gRNA sequence
gatgaagcacgtggaggggg

SEQ ID NO: 766288 - DNA, 20 bp, Artificial
  CRISPR gRNA sequence
agcacgtggagggggaagat

SEQ ID NO: 766289 - DNA, 20 bp, Artificial
  CRISPR gRNA sequence
ggggaagatcagttcctact

SEQ ID NO: 766290 - DNA, 20 bp, Artificial
  CRISPR gRNA sequence
gttcctactgagctcgacta

SEQ ID NO: 766291 - DNA, 20 bp, Artificial
  CRISPR gRNA sequence
atccacaccaaaatgtccta

SEQ ID NO: 766292 - DNA, 20 bp, Artificial
  CRISPR gRNA sequence
caaaatgtcctatggactcc

SEQ ID NO: 766293 - DNA, 20 bp, Artificial
  CRISPR gRNA sequence
tatggactcccagacacact

SEQ ID NO: 766294 - DNA, 20 bp, Artificial
  CRISPR gRNA sequence
ctcccagacacactgagctg

SEQ ID NO: 766295 - DNA, 20 bp, Artificial
  CRISPR gRNA sequence
agacacactgagctgcagct

SEQ ID NO: 766296 - DNA, 20 bp, Artificial
  CRISPR gRNA sequence
cactgagctgcagctcagaa

SEQ ID NO: 766297 - DNA, 20 bp, Artificial
  CRISPR gRNA sequence
ctgagctgcagctcagaaca

SEQ ID NO: 766298 - DNA, 20 bp, Artificial
  CRISPR gRNA sequence
tgagctgcagctcagaacag

SEQ ID NO: 766299 - DNA, 20 bp, Artificial
  CRISPR gRNA sequence
gagctgcagctcagaacaga

SEQ ID NO: 766300 - DNA, 20 bp, Artificial
  CRISPR gRNA sequence
cagctcagaacagagggaca

SEQ ID NO: 766301 - DNA, 20 bp, Artificial
  CRISPR gRNA sequence
ctcagaacagagggacatgg

SEQ ID NO: 766302 - DNA, 20 bp, Artificial
  CRISPR gRNA sequence
ggacatggcagtcattcgtg

SEQ ID NO: 766303 - DNA, 20 bp, Artificial
  CRISPR gRNA sequence
catggcagtcattcgtgcag

SEQ ID NO: 766304 - DNA, 20 bp, Artificial
  CRISPR gRNA sequence
ggcagtcattcgtgcagtgg

SEQ ID NO: 766305 - DNA, 20 bp, Artificial
  CRISPR gRNA sequence
cattcgtgcagtggtggtga

SEQ ID NO: 766306 - DNA, 20 bp, Artificial
  CRISPR gRNA sequence
cagtggtggtgacagaacca

SEQ ID NO: 766307 - DNA, 20 bp, Artificial
  CRISPR gRNA sequence
agtggtggtgacagaaccaa

SEQ ID NO: 766308 - DNA, 20 bp, Artificial
  CRISPR gRNA sequence
ggtggtgacagaaccaaagg

SEQ ID NO: 766309 - DNA, 20 bp, Artificial
  CRISPR gRNA sequence
gtggtgacagaaccaaaggt

SEQ ID NO: 766310 - DNA, 20 bp, Artificial
  CRISPR gRNA sequence
tggtgacagaaccaaaggtg

SEQ ID NO: 766311 - DNA, 20 bp, Artificial
  CRISPR gRNA sequence
gaaccaaaggtggggtcact

SEQ ID NO: 766312 - DNA, 20 bp, Artificial
  CRISPR gRNA sequence
aaccaaaggtggggtcactg

SEQ ID NO: 766313 - DNA, 20 bp, Artificial
  CRISPR gRNA sequence
accaaaggtggggtcactga

SEQ ID NO: 766314 - DNA, 20 bp, Artificial
  CRISPR gRNA sequence
caaaggtggggtcactgagg

SEQ ID NO: 766315 - DNA, 20 bp, Artificial
  CRISPR gRNA sequence
actgagggagatgatgccat

SEQ ID NO: 766316 - DNA, 20 bp, Artificial
  CRISPR gRNA sequence
gatgccatgagaacaaattc

SEQ ID NO: 766317 - DNA, 20 bp, Artificial
  CRISPR gRNA sequence
atgccatgagaacaaattct

SEQ ID NO: 766318 - DNA, 20 bp, Artificial
  CRISPR gRNA sequence
tgccatgagaacaaattctg

SEQ ID NO: 766319 - DNA, 20 bp, Artificial
  CRISPR gRNA sequence
aacaaattctggggaaactg

SEQ ID NO: 766320 - DNA, 20 bp, Artificial
  CRISPR gRNA sequence
aactgcagaaattaatgatc

SEQ ID NO: 766321 - DNA, 20 bp, Artificial
  CRISPR gRNA sequence
agaaattaatgatcaagtat

SEQ ID NO: 766322 - DNA, 20 bp, Artificial
  CRISPR gRNA sequence
ttaatgatcaagtatcagaa

SEQ ID NO: 766323 - DNA, 20 bp, Artificial
  CRISPR gRNA sequence
taatgatcaagtatcagaac

SEQ ID NO: 766324 - DNA, 20 bp, Artificial
  CRISPR gRNA sequence
aatgatcaagtatcagaaca

SEQ ID NO: 766325 - DNA, 20 bp, Artificial
  CRISPR gRNA sequence
ctctgtttgccctcccgtga

SEQ ID NO: 766326 - DNA, 20 bp, Artificial
  CRISPR gRNA sequence
tctgtttgccctcccgtgat

SEQ ID NO: 766327 - DNA, 20 bp, Artificial
  CRISPR gRNA sequence
cctcccgtgatgggcaccca

SEQ ID NO: 766328 - DNA, 20 bp, Artificial
  CRISPR gRNA sequence
atgggcacccatggcctgca

SEQ ID NO: 766329 - DNA, 20 bp, Artificial
  CRISPR gRNA sequence
tgggcacccatggcctgcat

SEQ ID NO: 766330 - DNA, 20 bp, Artificial
  CRISPR gRNA sequence
atgggctatccacttgcttt

SEQ ID NO: 766331 - DNA, 20 bp, Artificial
  CRISPR gRNA sequence
gctatccacttgcttttgga

SEQ ID NO: 766332 - DNA, 20 bp, Artificial
  CRISPR gRNA sequence
tgcttttggacagcgttcat

SEQ ID NO: 766333 - DNA, 20 bp, Artificial
  CRISPR gRNA sequence
tttggacagcgttcatcggt

SEQ ID NO: 766334 - DNA, 20 bp, Artificial
  CRISPR gRNA sequence
ggacagcgttcatcggtgag

SEQ ID NO: 766335 - DNA, 20 bp, Artificial
  CRISPR gRNA sequence
gagaagctctaccttatact

SEQ ID NO: 766336 - DNA, 20 bp, Artificial
  CRISPR gRNA sequence
cccaaatttgtctcccaata

SEQ ID NO: 766337 - DNA, 20 bp, Artificial
  CRISPR gRNA sequence
tctcccaatacagcccacaa

SEQ ID NO: 766338 - DNA, 20 bp, Artificial
  CRISPR gRNA sequence
acagtcctcatgtgacccct

SEQ ID NO: 766339 - DNA, 20 bp, Artificial
  CRISPR gRNA sequence
atgtgaccccttggaccaca

SEQ ID NO: 766340 - DNA, 20 bp, Artificial
  CRISPR gRNA sequence
ccccttggaccacacagaat

SEQ ID NO: 766341 - DNA, 20 bp, Artificial
  CRISPR gRNA sequence
gtctgcccccttccttatca

SEQ ID NO: 766342 - DNA, 20 bp, Artificial
  CRISPR gRNA sequence
cttccttatcaaagccctgc

SEQ ID NO: 766343 - DNA, 20 bp, Artificial
  CRISPR gRNA sequence
gtatttgatcttccttgacg

SEQ ID NO: 766344 - DNA, 20 bp, Artificial
  CRISPR gRNA sequence
tccttgacgaagtcaccatt

SEQ ID NO: 766345 - DNA, 20 bp, Artificial
  CRISPR gRNA sequence
ttgacgaagtcaccattgag

SEQ ID NO: 766346 - DNA, 20 bp, Artificial
  CRISPR gRNA sequence
accaaaataacccaaaataa

SEQ ID NO: 766347 - DNA, 20 bp, Artificial
  CRISPR gRNA sequence
ataacagactatcaaatctg

SEQ ID NO: 766348 - DNA, 20 bp, Artificial
  CRISPR gRNA sequence
tcaaatctgtagccaaccat

SEQ ID NO: 766349 - DNA, 20 bp, Artificial
  CRISPR gRNA sequence
aatctgtagccaaccatcag

SEQ ID NO: 766350 - DNA, 20 bp, Artificial
  CRISPR gRNA sequence
cctctgccatcctcttctga

SEQ ID NO: 766351 - DNA, 20 bp, Artificial
  CRISPR gRNA sequence
tctgccatcctcttctgatg

SEQ ID NO: 766352 - DNA, 20 bp, Artificial
  CRISPR gRNA sequence
catcctcttctgatggagtt

SEQ ID NO: 766353 - DNA, 20 bp, Artificial
  CRISPR gRNA sequence
tcttctgatggagttcagaa

SEQ ID NO: 766354 - DNA, 20 bp, Artificial
  CRISPR gRNA sequence
cttctgatggagttcagaat

SEQ ID NO: 766355 - DNA, 20 bp, Artificial
  CRISPR gRNA sequence
ttctgatggagttcagaatg

SEQ ID NO: 766356 - DNA, 20 bp, Artificial
  CRISPR gRNA sequence
ctgatggagttcagaatggg

SEQ ID NO: 766357 - DNA, 20 bp, Artificial
  CRISPR gRNA sequence
tgatggagttcagaatgggg

SEQ ID NO: 766358 - DNA, 20 bp, Artificial
  CRISPR gRNA sequence
atggagttcagaatggggag

SEQ ID NO: 766359 - DNA, 20 bp, Artificial
  CRISPR gRNA sequence
cagaatggggaggagtttta

SEQ ID NO: 766360 - DNA, 20 bp, Artificial
  CRISPR gRNA sequence
agaatggggaggagttttac

SEQ ID NO: 766361 - DNA, 20 bp, Artificial
  CRISPR gRNA sequence
tgttactattccatttcacc

SEQ ID NO: 766362 - DNA, 20 bp, Artificial
  CRISPR gRNA sequence
ccatttcacccagttaaact

SEQ ID NO: 766363 - DNA, 20 bp, Artificial
  CRISPR gRNA sequence
tgtaaaatatatataacatg

SEQ ID NO: 766364 - DNA, 20 bp, Artificial
  CRISPR gRNA sequence
aaatatatataacatgaagt

SEQ ID NO: 766365 - DNA, 20 bp, Artificial
  CRISPR gRNA sequence
atgaagttggccattttatc

SEQ ID NO: 766366 - DNA, 20 bp, Artificial
  CRISPR gRNA sequence
tgaagttggccattttatcc

SEQ ID NO: 766367 - DNA, 20 bp, Artificial
  CRISPR gRNA sequence
tggccattttatccaggttt

SEQ ID NO: 766368 - DNA, 20 bp, Artificial
  CRISPR gRNA sequence
ttatccaggtttaagtgtat

SEQ ID NO: 766369 - DNA, 20 bp, Artificial
  CRISPR gRNA sequence
ccaggtttaagtgtataagt

SEQ ID NO: 766370 - DNA, 20 bp, Artificial
  CRISPR gRNA sequence
ggtttaagtgtataagtcgg

SEQ ID NO: 766371 - DNA, 20 bp, Artificial
  CRISPR gRNA sequence
aaccctgtcgtgatcttttg

SEQ ID NO: 766372 - DNA, 20 bp, Artificial
  CRISPR gRNA sequence
aagtactcttttgactgttc

SEQ ID NO: 766373 - DNA, 20 bp, Artificial
  CRISPR gRNA sequence
cttttgactgttctggtgca

SEQ ID NO: 766374 - DNA, 20 bp, Artificial
  CRISPR gRNA sequence
gacaatgctcaataatttgt

SEQ ID NO: 766375 - DNA, 20 bp, Artificial
  CRISPR gRNA sequence
aatgctcaataatttgttgg

SEQ ID NO: 766376 - DNA, 20 bp, Artificial
  CRISPR gRNA sequence
atttgttggtggattaaaaa

SEQ ID NO: 766377 - DNA, 20 bp, Artificial
  CRISPR gRNA sequence
atgaatgaatatcatctgaa

SEQ ID NO: 766378 - DNA, 20 bp, Artificial
  CRISPR gRNA sequence
tgaatgaatatcatctgaaa

SEQ ID NO: 766379 - DNA, 20 bp, Artificial
  CRISPR gRNA sequence
ggttactctcctctctctgc

SEQ ID NO: 766380 - DNA, 20 bp, Artificial
  CRISPR gRNA sequence
ctcctctctctgctggtgtc

SEQ ID NO: 766381 - DNA, 20 bp, Artificial
  CRISPR gRNA sequence
tcctctctctgctggtgtct

SEQ ID NO: 766382 - DNA, 20 bp, Artificial
  CRISPR gRNA sequence
gctggtgtctgggtgtcatc

SEQ ID NO: 766383 - DNA, 20 bp, Artificial
  CRISPR gRNA sequence
ctggtgtctgggtgtcatca

SEQ ID NO: 766384 - DNA, 20 bp, Artificial
  CRISPR gRNA sequence
ctgggtgtcatcaaggtcct

SEQ ID NO: 766385 - DNA, 20 bp, Artificial
  CRISPR gRNA sequence
tgggtgtcatcaaggtcctc

SEQ ID NO: 766386 - DNA, 20 bp, Artificial
  CRISPR gRNA sequence
gggtgtcatcaaggtcctca

SEQ ID NO: 766387 - DNA, 20 bp, Artificial
  CRISPR gRNA sequence
gtgtcatcaaggtcctcagg

SEQ ID NO: 766388 - DNA, 20 bp, Artificial
  CRISPR gRNA sequence
gtcatcaaggtcctcaggga

SEQ ID NO: 766389 - DNA, 20 bp, Artificial
  CRISPR gRNA sequence
tcatcaaggtcctcagggag

SEQ ID NO: 766390 - DNA, 20 bp, Artificial
  CRISPR gRNA sequence
caaggtcctcagggagagga

SEQ ID NO: 766391 - DNA, 20 bp, Artificial
  CRISPR gRNA sequence
aaggtcctcagggagaggac

SEQ ID NO: 766392 - DNA, 20 bp, Artificial
  CRISPR gRNA sequence
cctcagggagaggacaggaa

SEQ ID NO: 766393 - DNA, 20 bp, Artificial
  CRISPR gRNA sequence
ctcagggagaggacaggaat

SEQ ID NO: 766394 - DNA, 20 bp, Artificial
  CRISPR gRNA sequence
gggagaggacaggaatagga

SEQ ID NO: 766395 - DNA, 20 bp, Artificial
  CRISPR gRNA sequence
gacaggaataggaaagccca

SEQ ID NO: 766396 - DNA, 20 bp, Artificial
  CRISPR gRNA sequence
cccacagcaccatctgtccc

SEQ ID NO: 766397 - DNA, 20 bp, Artificial
  CRISPR gRNA sequence
atcaatgtccatccaccatt

SEQ ID NO: 766398 - DNA, 20 bp, Artificial
  CRISPR gRNA sequence
ccatccaccattcagtacac

SEQ ID NO: 766399 - DNA, 20 bp, Artificial
  CRISPR gRNA sequence
catccaccattcagtacacc

SEQ ID NO: 766400 - DNA, 20 bp, Artificial
  CRISPR gRNA sequence
atccaccattcagtacaccg

SEQ ID NO: 766401 - DNA, 20 bp, Artificial
  CRISPR gRNA sequence
accattcagtacaccggggt

SEQ ID NO: 766402 - DNA, 20 bp, Artificial
  CRISPR gRNA sequence
ccattcagtacaccggggtt

SEQ ID NO: 766403 - DNA, 20 bp, Artificial
  CRISPR gRNA sequence
attcagtacaccggggttag

SEQ ID NO: 766404 - DNA, 20 bp, Artificial
  CRISPR gRNA sequence
ttcctacctgtgctgctacc

SEQ ID NO: 766405 - DNA, 20 bp, Artificial
  CRISPR gRNA sequence
ccatctacccatctcatccc

SEQ ID NO: 766406 - DNA, 20 bp, Artificial
  CRISPR gRNA sequence
catctacccatctcatcccc

SEQ ID NO: 766407 - DNA, 20 bp, Artificial
  CRISPR gRNA sequence
atctacccatctcatcccca

SEQ ID NO: 766408 - DNA, 20 bp, Artificial
  CRISPR gRNA sequence
ctcatccccagggctgtcat

SEQ ID NO: 766409 - DNA, 20 bp, Artificial
  CRISPR gRNA sequence
atccccagggctgtcatgag

SEQ ID NO: 766410 - DNA, 20 bp, Artificial
  CRISPR gRNA sequence
atgagaagcttcactgcttc

SEQ ID NO: 766411 - DNA, 20 bp, Artificial
  CRISPR gRNA sequence
gaagcttcactgcttctggc

SEQ ID NO: 766412 - DNA, 20 bp, Artificial
  CRISPR gRNA sequence
aagcttcactgcttctggct

SEQ ID NO: 766413 - DNA, 20 bp, Artificial
  CRISPR gRNA sequence
agcttcactgcttctggctg

SEQ ID NO: 766414 - DNA, 20 bp, Artificial
  CRISPR gRNA sequence
ctggctggggaccaatcaac

SEQ ID NO: 766415 - DNA, 20 bp, Artificial
  CRISPR gRNA sequence
ggctggggaccaatcaactg

SEQ ID NO: 766416 - DNA, 20 bp, Artificial
  CRISPR gRNA sequence
tggggaccaatcaactggag

SEQ ID NO: 766417 - DNA, 20 bp, Artificial
  CRISPR gRNA sequence
ccaatcaactggagaagaac

SEQ ID NO: 766418 - DNA, 20 bp, Artificial
  CRISPR gRNA sequence
caactggagaagaacaagaa

SEQ ID NO: 766419 - DNA, 20 bp, Artificial
  CRISPR gRNA sequence
ctggagaagaacaagaaaag

SEQ ID NO: 766420 - DNA, 20 bp, Artificial
  CRISPR gRNA sequence
gaagtgcattttcaaaaccc

SEQ ID NO: 766421 - DNA, 20 bp, Artificial
  CRISPR gRNA sequence
gcattttcaaaaccccagtg

SEQ ID NO: 766422 - DNA, 20 bp, Artificial
  CRISPR gRNA sequence
aaaccccagtgaagccatgc

SEQ ID NO: 766423 - DNA, 20 bp, Artificial
  CRISPR gRNA sequence
gaagccatgcaagtgcctac

SEQ ID NO: 766424 - DNA, 20 bp, Artificial
  CRISPR gRNA sequence
gccatgcaagtgcctactag

SEQ ID NO: 766425 - DNA, 20 bp, Artificial
  CRISPR gRNA sequence
ccatgcaagtgcctactagt

SEQ ID NO: 766426 - DNA, 20 bp, Artificial
  CRISPR gRNA sequence
ctactagtgggctcttcttc

SEQ ID NO: 766427 - DNA, 20 bp, Artificial
  CRISPR gRNA sequence
gctcttcttcaagtgctcat

SEQ ID NO: 766428 - DNA, 20 bp, Artificial
  CRISPR gRNA sequence
cttcaagtgctcattggttc

SEQ ID NO: 766429 - DNA, 20 bp, Artificial
  CRISPR gRNA sequence
ttcaagtgctcattggttcc

SEQ ID NO: 766430 - DNA, 20 bp, Artificial
  CRISPR gRNA sequence
attggttccaggactttgtc

SEQ ID NO: 766431 - DNA, 20 bp, Artificial
  CRISPR gRNA sequence
ttggttccaggactttgtca

SEQ ID NO: 766432 - DNA, 20 bp, Artificial
  CRISPR gRNA sequence
ccaggactttgtcaaggatt

SEQ ID NO: 766433 - DNA, 20 bp, Artificial
  CRISPR gRNA sequence
ctttgtcaaggattaagaac

SEQ ID NO: 766434 - DNA, 20 bp, Artificial
  CRISPR gRNA sequence
taccatcttccccataaaac

SEQ ID NO: 766435 - DNA, 20 bp, Artificial
  CRISPR gRNA sequence
actggttatttccctgtctc

SEQ ID NO: 766436 - DNA, 20 bp, Artificial
  CRISPR gRNA sequence
tttccctgtctcaagtcttc

SEQ ID NO: 766437 - DNA, 20 bp, Artificial
  CRISPR gRNA sequence
cttattcatgatccacatgc

SEQ ID NO: 766438 - DNA, 20 bp, Artificial
  CRISPR gRNA sequence
ttattcatgatccacatgcc

SEQ ID NO: 766439 - DNA, 20 bp, Artificial
  CRISPR gRNA sequence
atgatccacatgccaggcat

SEQ ID NO: 766440 - DNA, 20 bp, Artificial
  CRISPR gRNA sequence
ggccatgcatgcaatatgaa

SEQ ID NO: 766441 - DNA, 20 bp, Artificial
  CRISPR gRNA sequence
ccatgcatgcaatatgaatg

SEQ ID NO: 766442 - DNA, 20 bp, Artificial
  CRISPR gRNA sequence
atgcaatatgaatggagatg

SEQ ID NO: 766443 - DNA, 20 bp, Artificial
  CRISPR gRNA sequence
tacatataaatattcaacta

SEQ ID NO: 766444 - DNA, 20 bp, Artificial
  CRISPR gRNA sequence
acatataaatattcaactac

SEQ ID NO: 766445 - DNA, 20 bp, Artificial
  CRISPR gRNA sequence
catataaatattcaactaca

SEQ ID NO: 766446 - DNA, 20 bp, Artificial
  CRISPR gRNA sequence
atataaatattcaactacag

SEQ ID NO: 766447 - DNA, 20 bp, Artificial
  CRISPR gRNA sequence
ctacaggggttctcattctc

SEQ ID NO: 766448 - DNA, 20 bp, Artificial
  CRISPR gRNA sequence
aggggttctcattctcaagt

SEQ ID NO: 766449 - DNA, 20 bp, Artificial
  CRISPR gRNA sequence
ggggttctcattctcaagtt

SEQ ID NO: 766450 - DNA, 20 bp, Artificial
  CRISPR gRNA sequence
ggttctcattctcaagttgg

SEQ ID NO: 766451 - DNA, 20 bp, Artificial
  CRISPR gRNA sequence
gttctcattctcaagttggg

SEQ ID NO: 766452 - DNA, 20 bp, Artificial
  CRISPR gRNA sequence
tgtttattattatgcttcaa

SEQ ID NO: 766453 - DNA, 20 bp, Artificial
  CRISPR gRNA sequence
tttatcaaataataataaca

SEQ ID NO: 766454 - DNA, 20 bp, Artificial
  CRISPR gRNA sequence
ttatcaaataataataacat

SEQ ID NO: 766455 - DNA, 20 bp, Artificial
  CRISPR gRNA sequence
caaataataataacataggc

SEQ ID NO: 766456 - DNA, 20 bp, Artificial
  CRISPR gRNA sequence
acataggccagttttgttga

SEQ ID NO: 766457 - DNA, 20 bp, Artificial
  CRISPR gRNA sequence
ttttgttgaaagccatgcac

SEQ ID NO: 766458 - DNA, 20 bp, Artificial
  CRISPR gRNA sequence
tttgttgaaagccatgcacc

SEQ ID NO: 766459 - DNA, 20 bp, Artificial
  CRISPR gRNA sequence
ttacacatattaactcattt

SEQ ID NO: 766460 - DNA, 20 bp, Artificial
  CRISPR gRNA sequence
agcttcccaacaattctgtg

SEQ ID NO: 766461 - DNA, 20 bp, Artificial
  CRISPR gRNA sequence
ttcccaacaattctgtgaag

SEQ ID NO: 766462 - DNA, 20 bp, Artificial
  CRISPR gRNA sequence
tcccaacaattctgtgaagt

SEQ ID NO: 766463 - DNA, 20 bp, Artificial
  CRISPR gRNA sequence
tattattatcctatttcacc

SEQ ID NO: 766464 - DNA, 20 bp, Artificial
  CRISPR gRNA sequence
attattatcctatttcaccg

SEQ ID NO: 766465 - DNA, 20 bp, Artificial
  CRISPR gRNA sequence
tattatcctatttcaccgag

SEQ ID NO: 766466 - DNA, 20 bp, Artificial
  CRISPR gRNA sequence
atttcaccgaggagtaaatt

SEQ ID NO: 766467 - DNA, 20 bp, Artificial
  CRISPR gRNA sequence
tttcaccgaggagtaaattc

SEQ ID NO: 766468 - DNA, 20 bp, Artificial
  CRISPR gRNA sequence
ttcaccgaggagtaaattca

SEQ ID NO: 766469 - DNA, 20 bp, Artificial
  CRISPR gRNA sequence
ccgaggagtaaattcaggga

SEQ ID NO: 766470 - DNA, 20 bp, Artificial
  CRISPR gRNA sequence
gaggagtaaattcagggatg

SEQ ID NO: 766471 - DNA, 20 bp, Artificial
  CRISPR gRNA sequence
ggagtaaattcagggatgga

SEQ ID NO: 766472 - DNA, 20 bp, Artificial
  CRISPR gRNA sequence
agagatttaataacttgctc

SEQ ID NO: 766473 - DNA, 20 bp, Artificial
  CRISPR gRNA sequence
taataacttgctcaagatta

SEQ ID NO: 766474 - DNA, 20 bp, Artificial
  CRISPR gRNA sequence
ataacttgctcaagattaca

SEQ ID NO: 766475 - DNA, 20 bp, Artificial
  CRISPR gRNA sequence
aagattacagagctgctaaa

SEQ ID NO: 766476 - DNA, 20 bp, Artificial
  CRISPR gRNA sequence
ccacattttcatattaaaaa

SEQ ID NO: 766477 - DNA, 20 bp, Artificial
  CRISPR gRNA sequence
ttcatattaaaaatagaaaa

SEQ ID NO: 766478 - DNA, 20 bp, Artificial
  CRISPR gRNA sequence
tcatattaaaaatagaaaaa

SEQ ID NO: 766479 - DNA, 20 bp, Artificial
  CRISPR gRNA sequence
ttaaaaatagaaaaaaggtt

SEQ ID NO: 766480 - DNA, 20 bp, Artificial
  CRISPR gRNA sequence
taaaaatagaaaaaaggttt

SEQ ID NO: 766481 - DNA, 20 bp, Artificial
  CRISPR gRNA sequence
aaacaaatatatcattaaaa

SEQ ID NO: 766482 - DNA, 20 bp, Artificial
  CRISPR gRNA sequence
tcattaaaatagaatatgac

SEQ ID NO: 766483 - DNA, 20 bp, Artificial
  CRISPR gRNA sequence
atagaatatgaccagttttt

SEQ ID NO: 766484 - DNA, 20 bp, Artificial
  CRISPR gRNA sequence
tttttggtacacatttatac

SEQ ID NO: 766485 - DNA, 20 bp, Artificial
  CRISPR gRNA sequence
ttttggtacacatttataca

SEQ ID NO: 766486 - DNA, 20 bp, Artificial
  CRISPR gRNA sequence
cacatttatacaaggtattg

SEQ ID NO: 766487 - DNA, 20 bp, Artificial
  CRISPR gRNA sequence
acatttatacaaggtattgt

SEQ ID NO: 766488 - DNA, 20 bp, Artificial
  CRISPR gRNA sequence
tatacaaggtattgtgggaa

SEQ ID NO: 766489 - DNA, 20 bp, Artificial
  CRISPR gRNA sequence
aaggtattgtgggaatggac

SEQ ID NO: 766490 - DNA, 20 bp, Artificial
  CRISPR gRNA sequence
aggtattgtgggaatggacg

SEQ ID NO: 766491 - DNA, 20 bp, Artificial
  CRISPR gRNA sequence
tattgtgggaatggacgagg

SEQ ID NO: 766492 - DNA, 20 bp, Artificial
  CRISPR gRNA sequence
tgtgggaatggacgaggcag

SEQ ID NO: 766493 - DNA, 20 bp, Artificial
  CRISPR gRNA sequence
gtgggaatggacgaggcagt

SEQ ID NO: 766494 - DNA, 20 bp, Artificial
  CRISPR gRNA sequence
cgaggcagtaggcttaaacc

SEQ ID NO: 766495 - DNA, 20 bp, Artificial
  CRISPR gRNA sequence
gtaggcttaaacctggatga

SEQ ID NO: 766496 - DNA, 20 bp, Artificial
  CRISPR gRNA sequence
taggcttaaacctggatgaa

SEQ ID NO: 766497 - DNA, 20 bp, Artificial
  CRISPR gRNA sequence
aggcttaaacctggatgaaa

SEQ ID NO: 766498 - DNA, 20 bp, Artificial
  CRISPR gRNA sequence
taaacctggatgaaagggtc

SEQ ID NO: 766499 - DNA, 20 bp, Artificial
  CRISPR gRNA sequence
gaaagggtcaagccattcac

SEQ ID NO: 766500 - DNA, 20 bp, Artificial
  CRISPR gRNA sequence
aaagggtcaagccattcact

SEQ ID NO: 766501 - DNA, 20 bp, Artificial
  CRISPR gRNA sequence
aagggtcaagccattcactg

SEQ ID NO: 766502 - DNA, 20 bp, Artificial
  CRISPR gRNA sequence
agggtcaagccattcactgg

SEQ ID NO: 766503 - DNA, 20 bp, Artificial
  CRISPR gRNA sequence
tcaagccattcactgggggc

SEQ ID NO: 766504 - DNA, 20 bp, Artificial
  CRISPR gRNA sequence
caagccattcactgggggct

SEQ ID NO: 766505 - DNA, 20 bp, Artificial
  CRISPR gRNA sequence
aagccattcactgggggctg

SEQ ID NO: 766506 - DNA, 20 bp, Artificial
  CRISPR gRNA sequence
gccattcactgggggctggg

SEQ ID NO: 766507 - DNA, 20 bp, Artificial
  CRISPR gRNA sequence
ccattcactgggggctgggg

SEQ ID NO: 766508 - DNA, 20 bp, Artificial
  CRISPR gRNA sequence
cactgggggctggggaggct

SEQ ID NO: 766509 - DNA, 20 bp, Artificial
  CRISPR gRNA sequence
gggggctggggaggctcagt

SEQ ID NO: 766510 - DNA, 20 bp, Artificial
  CRISPR gRNA sequence
ggggctggggaggctcagta

SEQ ID NO: 766511 - DNA, 20 bp, Artificial
  CRISPR gRNA sequence
gaggctcagtaaggactgca

SEQ ID NO: 766512 - DNA, 20 bp, Artificial
  CRISPR gRNA sequence
ggctcagtaaggactgcaca

SEQ ID NO: 766513 - DNA, 20 bp, Artificial
  CRISPR gRNA sequence
gctcagtaaggactgcacag

SEQ ID NO: 766514 - DNA, 20 bp, Artificial
  CRISPR gRNA sequence
tcagtaaggactgcacagag

SEQ ID NO: 766515 - DNA, 20 bp, Artificial
  CRISPR gRNA sequence
cagtaaggactgcacagagg

SEQ ID NO: 766516 - DNA, 20 bp, Artificial
  CRISPR gRNA sequence
gtaaggactgcacagaggag

SEQ ID NO: 766517 - DNA, 20 bp, Artificial
  CRISPR gRNA sequence
gcacagaggaggagacatct

SEQ ID NO: 766518 - DNA, 20 bp, Artificial
  CRISPR gRNA sequence
gaggagacatctcggctatc

SEQ ID NO: 766519 - DNA, 20 bp, Artificial
  CRISPR gRNA sequence
gagacatctcggctatctgg

SEQ ID NO: 766520 - DNA, 20 bp, Artificial
  CRISPR gRNA sequence
gacatctcggctatctggcg

SEQ ID NO: 766521 - DNA, 20 bp, Artificial
  CRISPR gRNA sequence
acatctcggctatctggcgg

SEQ ID NO: 766522 - DNA, 20 bp, Artificial
  CRISPR gRNA sequence
catctcggctatctggcgga

SEQ ID NO: 766523 - DNA, 20 bp, Artificial
  CRISPR gRNA sequence
atctcggctatctggcggag

SEQ ID NO: 766524 - DNA, 20 bp, Artificial
  CRISPR gRNA sequence
cggctatctggcggagggga

SEQ ID NO: 766525 - DNA, 20 bp, Artificial
  CRISPR gRNA sequence
ggcggaggggacagcatgaa

SEQ ID NO: 766526 - DNA, 20 bp, Artificial
  CRISPR gRNA sequence
ggggacagcatgaaaagtca

SEQ ID NO: 766527 - DNA, 20 bp, Artificial
  CRISPR gRNA sequence
gacagcatgaaaagtcacag

SEQ ID NO: 766528 - DNA, 20 bp, Artificial
  CRISPR gRNA sequence
cagcatgaaaagtcacagaa

SEQ ID NO: 766529 - DNA, 20 bp, Artificial
  CRISPR gRNA sequence
agcatgaaaagtcacagaag

SEQ ID NO: 766530 - DNA, 20 bp, Artificial
  CRISPR gRNA sequence
catgaaaagtcacagaagag

SEQ ID NO: 766531 - DNA, 20 bp, Artificial
  CRISPR gRNA sequence
cacagaagaggagatgtcca

SEQ ID NO: 766532 - DNA, 20 bp, Artificial
  CRISPR gRNA sequence
gagatgtccacagcatattc

SEQ ID NO: 766533 - DNA, 20 bp, Artificial
  CRISPR gRNA sequence
agatgtccacagcatattct

SEQ ID NO: 766534 - DNA, 20 bp, Artificial
  CRISPR gRNA sequence
tgtccacagcatattctggg

SEQ ID NO: 766535 - DNA, 20 bp, Artificial
  CRISPR gRNA sequence
cacagcatattctgggaaga

SEQ ID NO: 766536 - DNA, 20 bp, Artificial
  CRISPR gRNA sequence
acagcatattctgggaagat

SEQ ID NO: 766537 - DNA, 20 bp, Artificial
  CRISPR gRNA sequence
attctgggaagatgggactc

SEQ ID NO: 766538 - DNA, 20 bp, Artificial
  CRISPR gRNA sequence
ttctgggaagatgggactcc

SEQ ID NO: 766539 - DNA, 20 bp, Artificial
  CRISPR gRNA sequence
ctgggaagatgggactccag

SEQ ID NO: 766540 - DNA, 20 bp, Artificial
  CRISPR gRNA sequence
gggaagatgggactccagga

SEQ ID NO: 766541 - DNA, 20 bp, Artificial
  CRISPR gRNA sequence
ggaagatgggactccaggag

SEQ ID NO: 766542 - DNA, 20 bp, Artificial
  CRISPR gRNA sequence
atgggactccaggagaggct

SEQ ID NO: 766543 - DNA, 20 bp, Artificial
  CRISPR gRNA sequence
ctccaggagaggctgagact

SEQ ID NO: 766544 - DNA, 20 bp, Artificial
  CRISPR gRNA sequence
tccaggagaggctgagactc

SEQ ID NO: 766545 - DNA, 20 bp, Artificial
  CRISPR gRNA sequence
caggagaggctgagactcag

SEQ ID NO: 766546 - DNA, 20 bp, Artificial
  CRISPR gRNA sequence
ggagaggctgagactcagga

SEQ ID NO: 766547 - DNA, 20 bp, Artificial
  CRISPR gRNA sequence
gagaggctgagactcaggag

SEQ ID NO: 766548 - DNA, 20 bp, Artificial
  CRISPR gRNA sequence
gaggctgagactcaggagag

SEQ ID NO: 766549 - DNA, 20 bp, Artificial
  CRISPR gRNA sequence
aggctgagactcaggagagg

SEQ ID NO: 766550 - DNA, 20 bp, Artificial
  CRISPR gRNA sequence
tgagactcaggagaggaggc

SEQ ID NO: 766551 - DNA, 20 bp, Artificial
  CRISPR gRNA sequence
gagactcaggagaggaggca

SEQ ID NO: 766552 - DNA, 20 bp, Artificial
  CRISPR gRNA sequence
agactcaggagaggaggcaa

SEQ ID NO: 766553 - DNA, 20 bp, Artificial
  CRISPR gRNA sequence
actcaggagaggaggcaagg

SEQ ID NO: 766554 - DNA, 20 bp, Artificial
  CRISPR gRNA sequence
ctcaggagaggaggcaaggg

SEQ ID NO: 766555 - DNA, 20 bp, Artificial
  CRISPR gRNA sequence
aggagaggaggcaagggagg

SEQ ID NO: 766556 - DNA, 20 bp, Artificial
  CRISPR gRNA sequence
gaggaggcaagggaggtagt

SEQ ID NO: 766557 - DNA, 20 bp, Artificial
  CRISPR gRNA sequence
aggaggcaagggaggtagtg

SEQ ID NO: 766558 - DNA, 20 bp, Artificial
  CRISPR gRNA sequence
ggaggcaagggaggtagtga

SEQ ID NO: 766559 - DNA, 20 bp, Artificial
  CRISPR gRNA sequence
aagggaggtagtgagggacg

SEQ ID NO: 766560 - DNA, 20 bp, Artificial
  CRISPR gRNA sequence
gaggtagtgagggacgtaga

SEQ ID NO: 766561 - DNA, 20 bp, Artificial
  CRISPR gRNA sequence
aggtagtgagggacgtagat

SEQ ID NO: 766562 - DNA, 20 bp, Artificial
  CRISPR gRNA sequence
ggtagtgagggacgtagatg

SEQ ID NO: 766563 - DNA, 20 bp, Artificial
  CRISPR gRNA sequence
gagggacgtagatggggact

SEQ ID NO: 766564 - DNA, 20 bp, Artificial
  CRISPR gRNA sequence
actcggattgaatctgtgca

SEQ ID NO: 766565 - DNA, 20 bp, Artificial
  CRISPR gRNA sequence
cggattgaatctgtgcacag

SEQ ID NO: 766566 - DNA, 20 bp, Artificial
  CRISPR gRNA sequence
ggattgaatctgtgcacagc

SEQ ID NO: 766567 - DNA, 20 bp, Artificial
  CRISPR gRNA sequence
ctgtgcacagcaggaaactg

SEQ ID NO: 766568 - DNA, 20 bp, Artificial
  CRISPR gRNA sequence
tgtccaaccctcttctaccc

SEQ ID NO: 766569 - DNA, 20 bp, Artificial
  CRISPR gRNA sequence
aaccctcttctaccctagac

SEQ ID NO: 766570 - DNA, 20 bp, Artificial
  CRISPR gRNA sequence
ctggcctgaaatatccctga

SEQ ID NO: 766571 - DNA, 20 bp, Artificial
  CRISPR gRNA sequence
aaatatccctgacagcttct

SEQ ID NO: 766572 - DNA, 20 bp, Artificial
  CRISPR gRNA sequence
atatccctgacagcttctca

SEQ ID NO: 766573 - DNA, 20 bp, Artificial
  CRISPR gRNA sequence
ttctcagagattctgtctcc

SEQ ID NO: 766574 - DNA, 20 bp, Artificial
  CRISPR gRNA sequence
tctccaagttcaccccacac

SEQ ID NO: 766575 - DNA, 20 bp, Artificial
  CRISPR gRNA sequence
ctccaagttcaccccacacc

SEQ ID NO: 766576 - DNA, 20 bp, Artificial
  CRISPR gRNA sequence
aagttcaccccacaccagga

SEQ ID NO: 766577 - DNA, 20 bp, Artificial
  CRISPR gRNA sequence
agttcaccccacaccaggac

SEQ ID NO: 766578 - DNA, 20 bp, Artificial
  CRISPR gRNA sequence
cacaccaggacaggcaatcc

SEQ ID NO: 766579 - DNA, 20 bp, Artificial
  CRISPR gRNA sequence
acaccaggacaggcaatccc

SEQ ID NO: 766580 - DNA, 20 bp, Artificial
  CRISPR gRNA sequence
caccaggacaggcaatccca

SEQ ID NO: 766581 - DNA, 20 bp, Artificial
  CRISPR gRNA sequence
accaggacaggcaatcccag

SEQ ID NO: 766582 - DNA, 20 bp, Artificial
  CRISPR gRNA sequence
ggacaggcaatcccaggggc

SEQ ID NO: 766583 - DNA, 20 bp, Artificial
  CRISPR gRNA sequence
caggcaatcccaggggccag

SEQ ID NO: 766584 - DNA, 20 bp, Artificial
  CRISPR gRNA sequence
caggggccagaagacaaata

SEQ ID NO: 766585 - DNA, 20 bp, Artificial
  CRISPR gRNA sequence
gaagacaaatacagttaaaa

SEQ ID NO: 766586 - DNA, 20 bp, Artificial
  CRISPR gRNA sequence
caaatacagttaaaacagat

SEQ ID NO: 766587 - DNA, 20 bp, Artificial
  CRISPR gRNA sequence
cagatgagcacctccccgta

SEQ ID NO: 766588 - DNA, 20 bp, Artificial
  CRISPR gRNA sequence
tgctccttctttccttgaca

SEQ ID NO: 766589 - DNA, 20 bp, Artificial
  CRISPR gRNA sequence
ctccttctttccttgacaaa

SEQ ID NO: 766590 - DNA, 20 bp, Artificial
  CRISPR gRNA sequence
tccttctttccttgacaaag

SEQ ID NO: 766591 - DNA, 20 bp, Artificial
  CRISPR gRNA sequence
aaagaggcaaattcaatgcc

SEQ ID NO: 766592 - DNA, 20 bp, Artificial
  CRISPR gRNA sequence
gaggcaaattcaatgccgag

SEQ ID NO: 766593 - DNA, 20 bp, Artificial
  CRISPR gRNA sequence
gagcagatcgtctccgtctt

SEQ ID NO: 766594 - DNA, 20 bp, Artificial
  CRISPR gRNA sequence
cagatcgtctccgtctttgg

SEQ ID NO: 766595 - DNA, 20 bp, Artificial
  CRISPR gRNA sequence
tcgtctccgtctttggtagc

SEQ ID NO: 766596 - DNA, 20 bp, Artificial
  CRISPR gRNA sequence
tttggtagctagtcttaaca

SEQ ID NO: 766597 - DNA, 20 bp, Artificial
  CRISPR gRNA sequence
gctccatgtcctttattcta

SEQ ID NO: 766598 - DNA, 20 bp, Artificial
  CRISPR gRNA sequence
attctacagtgcccttctct

SEQ ID NO: 766599 - DNA, 20 bp, Artificial
  CRISPR gRNA sequence
gcccttctcttggtctatgc

SEQ ID NO: 766600 - DNA, 20 bp, Artificial
  CRISPR gRNA sequence
tggtctatgctggccccttc

SEQ ID NO: 766601 - DNA, 20 bp, Artificial
  CRISPR gRNA sequence
tctatgctggccccttctgg

SEQ ID NO: 766602 - DNA, 20 bp, Artificial
  CRISPR gRNA sequence
tgctggccccttctggtagc

SEQ ID NO: 766603 - DNA, 20 bp, Artificial
  CRISPR gRNA sequence
gctggccccttctggtagca

SEQ ID NO: 766604 - DNA, 20 bp, Artificial
  CRISPR gRNA sequence
agcaaggctccgcactcctg

SEQ ID NO: 766605 - DNA, 20 bp, Artificial
  CRISPR gRNA sequence
gcaaggctccgcactcctgc

SEQ ID NO: 766606 - DNA, 20 bp, Artificial
  CRISPR gRNA sequence
caaggctccgcactcctgca

SEQ ID NO: 766607 - DNA, 20 bp, Artificial
  CRISPR gRNA sequence
aggctccgcactcctgcagg

SEQ ID NO: 766608 - DNA, 20 bp, Artificial
  CRISPR gRNA sequence
ccgcactcctgcagggagcc

SEQ ID NO: 766609 - DNA, 20 bp, Artificial
  CRISPR gRNA sequence
gagcccagtccatgctgtac

SEQ ID NO: 766610 - DNA, 20 bp, Artificial
  CRISPR gRNA sequence
cccagtccatgctgtactgg

SEQ ID NO: 766611 - DNA, 20 bp, Artificial
  CRISPR gRNA sequence
cagtccatgctgtactggtg

SEQ ID NO: 766612 - DNA, 20 bp, Artificial
  CRISPR gRNA sequence
tactggtggagctgtcctcc

SEQ ID NO: 766613 - DNA, 20 bp, Artificial
  CRISPR gRNA sequence
gtggagctgtcctcccagcc

SEQ ID NO: 766614 - DNA, 20 bp, Artificial
  CRISPR gRNA sequence
tggagctgtcctcccagcct

SEQ ID NO: 766615 - DNA, 20 bp, Artificial
  CRISPR gRNA sequence
ggagctgtcctcccagccta

SEQ ID NO: 766616 - DNA, 20 bp, Artificial
  CRISPR gRNA sequence
tgtcctcccagcctagggcc

SEQ ID NO: 766617 - DNA, 20 bp, Artificial
  CRISPR gRNA sequence
gtcctcccagcctagggcct

SEQ ID NO: 766618 - DNA, 20 bp, Artificial
  CRISPR gRNA sequence
ctagggcctgggcatgttac

SEQ ID NO: 766619 - DNA, 20 bp, Artificial
  CRISPR gRNA sequence
cctgggcatgttacaagacc

SEQ ID NO: 766620 - DNA, 20 bp, Artificial
  CRISPR gRNA sequence
atgttacaagacctggctca

SEQ ID NO: 766621 - DNA, 20 bp, Artificial
  CRISPR gRNA sequence
gttacaagacctggctcatg

SEQ ID NO: 766622 - DNA, 20 bp, Artificial
  CRISPR gRNA sequence
aaacctgccctgcccccact

SEQ ID NO: 766623 - DNA, 20 bp, Artificial
  CRISPR gRNA sequence
ccctgcccccactcagtgat

SEQ ID NO: 766624 - DNA, 20 bp, Artificial
  CRISPR gRNA sequence
ccccactcagtgattagttc

SEQ ID NO: 766625 - DNA, 20 bp, Artificial
  CRISPR gRNA sequence
tcagtgattagttcgagaat

SEQ ID NO: 766626 - DNA, 20 bp, Artificial
  CRISPR gRNA sequence
ttagttcgagaatgagctgt

SEQ ID NO: 766627 - DNA, 20 bp, Artificial
  CRISPR gRNA sequence
tcgagaatgagctgtaagcc

SEQ ID NO: 766628 - DNA, 20 bp, Artificial
  CRISPR gRNA sequence
taagccaagccacacccaat

SEQ ID NO: 766629 - DNA, 20 bp, Artificial
  CRISPR gRNA sequence
agccaagccacacccaatca

SEQ ID NO: 766630 - DNA, 20 bp, Artificial
  CRISPR gRNA sequence
cacccaatcagagacttccc

SEQ ID NO: 766631 - DNA, 20 bp, Artificial
  CRISPR gRNA sequence
cccaatcagagacttcccca

SEQ ID NO: 766632 - DNA, 20 bp, Artificial
  CRISPR gRNA sequence
tccccagagccttgctgctg

SEQ ID NO: 766633 - DNA, 20 bp, Artificial
  CRISPR gRNA sequence
tgctgctgcagccatcaaaa

SEQ ID NO: 766634 - DNA, 20 bp, Artificial
  CRISPR gRNA sequence
aaaaaagactctttcttgtt

SEQ ID NO: 766635 - DNA, 20 bp, Artificial
  CRISPR gRNA sequence
tctttcttgttgagattact

SEQ ID NO: 766636 - DNA, 20 bp, Artificial
  CRISPR gRNA sequence
ttcttgttgagattactaag

SEQ ID NO: 766637 - DNA, 20 bp, Artificial
  CRISPR gRNA sequence
tcttgttgagattactaaga

SEQ ID NO: 766638 - DNA, 20 bp, Artificial
  CRISPR gRNA sequence
tgagattactaagaaggata

SEQ ID NO: 766639 - DNA, 20 bp, Artificial
  CRISPR gRNA sequence
ttactaagaaggatacggtc

SEQ ID NO: 766640 - DNA, 20 bp, Artificial
  CRISPR gRNA sequence
tactaagaaggatacggtct

SEQ ID NO: 766641 - DNA, 20 bp, Artificial
  CRISPR gRNA sequence
aggatacggtctgggactgt

SEQ ID NO: 766642 - DNA, 20 bp, Artificial
  CRISPR gRNA sequence
tgtctgctaccaacaatcta

SEQ ID NO: 766643 - DNA, 20 bp, Artificial
  CRISPR gRNA sequence
aattgatccaaacaaatgaa

SEQ ID NO: 766644 - DNA, 20 bp, Artificial
  CRISPR gRNA sequence
ttgatccaaacaaatgaaca

SEQ ID NO: 766645 - DNA, 20 bp, Artificial
  CRISPR gRNA sequence
tgatccaaacaaatgaacag

SEQ ID NO: 766646 - DNA, 20 bp, Artificial
  CRISPR gRNA sequence
tccaaacaaatgaacagagg

SEQ ID NO: 766647 - DNA, 20 bp, Artificial
  CRISPR gRNA sequence
caaacaaatgaacagaggca

SEQ ID NO: 766648 - DNA, 20 bp, Artificial
  CRISPR gRNA sequence
caaatgaacagaggcagaga

SEQ ID NO: 766649 - DNA, 20 bp, Artificial
  CRISPR gRNA sequence
atgaacagaggcagagatgg

SEQ ID NO: 766650 - DNA, 20 bp, Artificial
  CRISPR gRNA sequence
acagaggcagagatggaagc

SEQ ID NO: 766651 - DNA, 20 bp, Artificial
  CRISPR gRNA sequence
gaggcagagatggaagctag

SEQ ID NO: 766652 - DNA, 20 bp, Artificial
  CRISPR gRNA sequence
aggcagagatggaagctaga

SEQ ID NO: 766653 - DNA, 20 bp, Artificial
  CRISPR gRNA sequence
agatggaagctagaaggata

SEQ ID NO: 766654 - DNA, 20 bp, Artificial
  CRISPR gRNA sequence
atggaagctagaaggatata

SEQ ID NO: 766655 - DNA, 20 bp, Artificial
  CRISPR gRNA sequence
gagccctaaaaccatcattt

SEQ ID NO: 766656 - DNA, 20 bp, Artificial
  CRISPR gRNA sequence
catttaagcccctattcctg

SEQ ID NO: 766657 - DNA, 20 bp, Artificial
  CRISPR gRNA sequence
taagcccctattcctgaagc

SEQ ID NO: 766658 - DNA, 20 bp, Artificial
  CRISPR gRNA sequence
cctgaagcaagctgcacaca

SEQ ID NO: 766659 - DNA, 20 bp, Artificial
  CRISPR gRNA sequence
agctgcacacatagactgcc

SEQ ID NO: 766660 - DNA, 20 bp, Artificial
  CRISPR gRNA sequence
gctgcacacatagactgcct

SEQ ID NO: 766661 - DNA, 20 bp, Artificial
  CRISPR gRNA sequence
gactgcctaggtacttaaac

SEQ ID NO: 766662 - DNA, 20 bp, Artificial
  CRISPR gRNA sequence
tttttttcttaaatgtgctt

SEQ ID NO: 766663 - DNA, 20 bp, Artificial
  CRISPR gRNA sequence
tttcttaaatgtgcttgagc

SEQ ID NO: 766664 - DNA, 20 bp, Artificial
  CRISPR gRNA sequence
ttttctattatctgtaactg

SEQ ID NO: 766665 - DNA, 20 bp, Artificial
  CRISPR gRNA sequence
tttctattatctgtaactga

SEQ ID NO: 766666 - DNA, 20 bp, Artificial
  CRISPR gRNA sequence
tctacccctgcttctcttcc

SEQ ID NO: 766667 - DNA, 20 bp, Artificial
  CRISPR gRNA sequence
gcttctcttcctggtcttcc

SEQ ID NO: 766668 - DNA, 20 bp, Artificial
  CRISPR gRNA sequence
agtcaccatcatctcttgcc

SEQ ID NO: 766669 - DNA, 20 bp, Artificial
  CRISPR gRNA sequence
tcttgcctggataactataa

SEQ ID NO: 766670 - DNA, 20 bp, Artificial
  CRISPR gRNA sequence
aactataaaagcctcttcac

SEQ ID NO: 766671 - DNA, 20 bp, Artificial
  CRISPR gRNA sequence
accagtctgttcaccttctc

SEQ ID NO: 766672 - DNA, 20 bp, Artificial
  CRISPR gRNA sequence
ccaatctatactctatacaa

SEQ ID NO: 766673 - DNA, 20 bp, Artificial
  CRISPR gRNA sequence
tctatactctatacaacagc

SEQ ID NO: 766674 - DNA, 20 bp, Artificial
  CRISPR gRNA sequence
aataattgctattaatataa

SEQ ID NO: 766675 - DNA, 20 bp, Artificial
  CRISPR gRNA sequence
aattatatcactgccttcaa

SEQ ID NO: 766676 - DNA, 20 bp, Artificial
  CRISPR gRNA sequence
ctgccttcaatagttaatca

SEQ ID NO: 766677 - DNA, 20 bp, Artificial
  CRISPR gRNA sequence
tgccttcaatagttaatcat

SEQ ID NO: 766678 - DNA, 20 bp, Artificial
  CRISPR gRNA sequence
gccttcaatagttaatcata

SEQ ID NO: 766679 - DNA, 20 bp, Artificial
  CRISPR gRNA sequence
ctgttcactttccttgtgat

SEQ ID NO: 766680 - DNA, 20 bp, Artificial
  CRISPR gRNA sequence
ctttccttgtgataagatcg

SEQ ID NO: 766681 - DNA, 20 bp, Artificial
  CRISPR gRNA sequence
ataagatcgcagctcctcca

SEQ ID NO: 766682 - DNA, 20 bp, Artificial
  CRISPR gRNA sequence
cgcagctcctccatagccta

SEQ ID NO: 766683 - DNA, 20 bp, Artificial
  CRISPR gRNA sequence
cagctcctccatagcctaca

SEQ ID NO: 766684 - DNA, 20 bp, Artificial
  CRISPR gRNA sequence
ctacagagccccatctgccc

SEQ ID NO: 766685 - DNA, 20 bp, Artificial
  CRISPR gRNA sequence
cctggccctgcccacctgcc

SEQ ID NO: 766686 - DNA, 20 bp, Artificial
  CRISPR gRNA sequence
ttcctacttgcccctcacca

SEQ ID NO: 766687 - DNA, 20 bp, Artificial
  CRISPR gRNA sequence
ctacttgcccctcaccacag

SEQ ID NO: 766688 - DNA, 20 bp, Artificial
  CRISPR gRNA sequence
tacttgcccctcaccacagt

SEQ ID NO: 766689 - DNA, 20 bp, Artificial
  CRISPR gRNA sequence
tcaccacagtgggctgcttc

SEQ ID NO: 766690 - DNA, 20 bp, Artificial
  CRISPR gRNA sequence
tgcttccagttcctacaaca

SEQ ID NO: 766691 - DNA, 20 bp, Artificial
  CRISPR gRNA sequence
gcttccagttcctacaacat

SEQ ID NO: 766692 - DNA, 20 bp, Artificial
  CRISPR gRNA sequence
ggactccctttcctacctca

SEQ ID NO: 766693 - DNA, 20 bp, Artificial
  CRISPR gRNA sequence
tcacagtgttgctgcaaata

SEQ ID NO: 766694 - DNA, 20 bp, Artificial
  CRISPR gRNA sequence
caaatacagtttcttcttcc

SEQ ID NO: 766695 - DNA, 20 bp, Artificial
  CRISPR gRNA sequence
tttcttcttcctagatgaca

SEQ ID NO: 766696 - DNA, 20 bp, Artificial
  CRISPR gRNA sequence
ttcttcttcctagatgacat

SEQ ID NO: 766697 - DNA, 20 bp, Artificial
  CRISPR gRNA sequence
ctagatgacatgggtgcttt

SEQ ID NO: 766698 - DNA, 20 bp, Artificial
  CRISPR gRNA sequence
aaatttaattgccactgtaa

SEQ ID NO: 766699 - DNA, 20 bp, Artificial
  CRISPR gRNA sequence
attgccactgtaacagtatt

SEQ ID NO: 766700 - DNA, 20 bp, Artificial
  CRISPR gRNA sequence
tgccactgtaacagtattaa

SEQ ID NO: 766701 - DNA, 20 bp, Artificial
  CRISPR gRNA sequence
gccactgtaacagtattaag

SEQ ID NO: 766702 - DNA, 20 bp, Artificial
  CRISPR gRNA sequence
actgtaacagtattaagagg

SEQ ID NO: 766703 - DNA, 20 bp, Artificial
  CRISPR gRNA sequence
ctgtaacagtattaagaggt

SEQ ID NO: 766704 - DNA, 20 bp, Artificial
  CRISPR gRNA sequence
tgtaacagtattaagaggtg

SEQ ID NO: 766705 - DNA, 20 bp, Artificial
  CRISPR gRNA sequence
tattaagaggtggggcctgt

SEQ ID NO: 766706 - DNA, 20 bp, Artificial
  CRISPR gRNA sequence
taagaggtggggcctgtaag

SEQ ID NO: 766707 - DNA, 20 bp, Artificial
  CRISPR gRNA sequence
ggtggggcctgtaagaagtg

SEQ ID NO: 766708 - DNA, 20 bp, Artificial
  CRISPR gRNA sequence
tggggcctgtaagaagtgaa

SEQ ID NO: 766709 - DNA, 20 bp, Artificial
  CRISPR gRNA sequence
agagattaatgctgttatca

SEQ ID NO: 766710 - DNA, 20 bp, Artificial
  CRISPR gRNA sequence
gagattaatgctgttatcac

SEQ ID NO: 766711 - DNA, 20 bp, Artificial
  CRISPR gRNA sequence
taatgctgttatcacaggaa

SEQ ID NO: 766712 - DNA, 20 bp, Artificial
  CRISPR gRNA sequence
tgctgttatcacaggaaaag

SEQ ID NO: 766713 - DNA, 20 bp, Artificial
  CRISPR gRNA sequence
gctgttatcacaggaaaagt

SEQ ID NO: 766714 - DNA, 20 bp, Artificial
  CRISPR gRNA sequence
gaaaagtgggctcctgataa

SEQ ID NO: 766715 - DNA, 20 bp, Artificial
  CRISPR gRNA sequence
tgggctcctgataaaagcgt

SEQ ID NO: 766716 - DNA, 20 bp, Artificial
  CRISPR gRNA sequence
gctcacatgcccttccacaa

SEQ ID NO: 766717 - DNA, 20 bp, Artificial
  CRISPR gRNA sequence
ctcacatgcccttccacaat

SEQ ID NO: 766718 - DNA, 20 bp, Artificial
  CRISPR gRNA sequence
ccttccacaataggataatg

SEQ ID NO: 766719 - DNA, 20 bp, Artificial
  CRISPR gRNA sequence
ccacaataggataatgcagc

SEQ ID NO: 766720 - DNA, 20 bp, Artificial
  CRISPR gRNA sequence
caataggataatgcagcaag

SEQ ID NO: 766721 - DNA, 20 bp, Artificial
  CRISPR gRNA sequence
aataggataatgcagcaaga

SEQ ID NO: 766722 - DNA, 20 bp, Artificial
  CRISPR gRNA sequence
tgcagcaagaaggccctcgc

SEQ ID NO: 766723 - DNA, 20 bp, Artificial
  CRISPR gRNA sequence
agaaggccctcgccagatgc

SEQ ID NO: 766724 - DNA, 20 bp, Artificial
  CRISPR gRNA sequence
agatgccagcaccatgccct

SEQ ID NO: 766725 - DNA, 20 bp, Artificial
  CRISPR gRNA sequence
caccatgcccttggacttcc

SEQ ID NO: 766726 - DNA, 20 bp, Artificial
  CRISPR gRNA sequence
cccttggacttcccagtctc

SEQ ID NO: 766727 - DNA, 20 bp, Artificial
  CRISPR gRNA sequence
ttcccagtctccagaactac

SEQ ID NO: 766728 - DNA, 20 bp, Artificial
  CRISPR gRNA sequence
ttttttctttatatattacc

SEQ ID NO: 766729 - DNA, 20 bp, Artificial
  CRISPR gRNA sequence
tttttctttatatattaccc

SEQ ID NO: 766730 - DNA, 20 bp, Artificial
  CRISPR gRNA sequence
tttatatattacccaggctg

SEQ ID NO: 766731 - DNA, 20 bp, Artificial
  CRISPR gRNA sequence
caggctgtggtattctgtta

SEQ ID NO: 766732 - DNA, 20 bp, Artificial
  CRISPR gRNA sequence
gctgtggtattctgttatag

SEQ ID NO: 766733 - DNA, 20 bp, Artificial
  CRISPR gRNA sequence
tctgttatagcagtaaaaca

SEQ ID NO: 766734 - DNA, 20 bp, Artificial
  CRISPR gRNA sequence
atagcagtaaaacatggact

SEQ ID NO: 766735 - DNA, 20 bp, Artificial
  CRISPR gRNA sequence
taaaacatggactaagataa

SEQ ID NO: 766736 - DNA, 20 bp, Artificial
  CRISPR gRNA sequence
aaaacatggactaagataaa

SEQ ID NO: 766737 - DNA, 20 bp, Artificial
  CRISPR gRNA sequence
aggtaacacctccatattct

SEQ ID NO: 766738 - DNA, 20 bp, Artificial
  CRISPR gRNA sequence
ggtaacacctccatattctg

SEQ ID NO: 766739 - DNA, 20 bp, Artificial
  CRISPR gRNA sequence
gtaacacctccatattctga

SEQ ID NO: 766740 - DNA, 20 bp, Artificial
  CRISPR gRNA sequence
tattctgagggtcaccttga

SEQ ID NO: 766741 - DNA, 20 bp, Artificial
  CRISPR gRNA sequence
tgagggtcaccttgacagaa

SEQ ID NO: 766742 - DNA, 20 bp, Artificial
  CRISPR gRNA sequence
ggtcaccttgacagaaaagc

SEQ ID NO: 766743 - DNA, 20 bp, Artificial
  CRISPR gRNA sequence
gtcaccttgacagaaaagcc

SEQ ID NO: 766744 - DNA, 20 bp, Artificial
  CRISPR gRNA sequence
ccttgacagaaaagccaggt

SEQ ID NO: 766745 - DNA, 20 bp, Artificial
  CRISPR gRNA sequence
ttgacagaaaagccaggtaa

SEQ ID NO: 766746 - DNA, 20 bp, Artificial
  CRISPR gRNA sequence
ggtaagagatctgccactct

SEQ ID NO: 766747 - DNA, 20 bp, Artificial
  CRISPR gRNA sequence
aagagatctgccactctaag

SEQ ID NO: 766748 - DNA, 20 bp, Artificial
  CRISPR gRNA sequence
agagatctgccactctaaga

SEQ ID NO: 766749 - DNA, 20 bp, Artificial
  CRISPR gRNA sequence
accctgtcattcattgcacc

SEQ ID NO: 766750 - DNA, 20 bp, Artificial
  CRISPR gRNA sequence
ctgttttcttcatgatatat

SEQ ID NO: 766751 - DNA, 20 bp, Artificial
  CRISPR gRNA sequence
tgatatatgagaacctccct

SEQ ID NO: 766752 - DNA, 20 bp, Artificial
  CRISPR gRNA sequence
tatatgagaacctccctgag

SEQ ID NO: 766753 - DNA, 20 bp, Artificial
  CRISPR gRNA sequence
atatgagaacctccctgaga

SEQ ID NO: 766754 - DNA, 20 bp, Artificial
  CRISPR gRNA sequence
aactattgcatccttaattc

SEQ ID NO: 766755 - DNA, 20 bp, Artificial
  CRISPR gRNA sequence
tgcatccttaattctagcaa

SEQ ID NO: 766756 - DNA, 20 bp, Artificial
  CRISPR gRNA sequence
ccttaattctagcaatggct

SEQ ID NO: 766757 - DNA, 20 bp, Artificial
  CRISPR gRNA sequence
agcaatggcttggcacataa

SEQ ID NO: 766758 - DNA, 20 bp, Artificial
  CRISPR gRNA sequence
gcaatggcttggcacataat

SEQ ID NO: 766759 - DNA, 20 bp, Artificial
  CRISPR gRNA sequence
ttctcaatgcacgattcaat

SEQ ID NO: 766760 - DNA, 20 bp, Artificial
  CRISPR gRNA sequence
cgaatgaatgcatgtgtgtt

SEQ ID NO: 766761 - DNA, 20 bp, Artificial
  CRISPR gRNA sequence
tgaatgcatgtgtgtttaga

SEQ ID NO: 766762 - DNA, 20 bp, Artificial
  CRISPR gRNA sequence
aatgcatgtgtgtttagata

SEQ ID NO: 766763 - DNA, 20 bp, Artificial
  CRISPR gRNA sequence
tgcatgtgtgtttagataga

SEQ ID NO: 766764 - DNA, 20 bp, Artificial
  CRISPR gRNA sequence
tgtgtgtttagatagagaga

SEQ ID NO: 766765 - DNA, 20 bp, Artificial
  CRISPR gRNA sequence
tgtttagatagagagatgga

SEQ ID NO: 766766 - DNA, 20 bp, Artificial
  CRISPR gRNA sequence
tagagagatggatagatata

SEQ ID NO: 766767 - DNA, 20 bp, Artificial
  CRISPR gRNA sequence
gagatggatagatatatgga

SEQ ID NO: 766768 - DNA, 20 bp, Artificial
  CRISPR gRNA sequence
tggatagatatatggatgga

SEQ ID NO: 766769 - DNA, 20 bp, Artificial
  CRISPR gRNA sequence
gatggatggatgtttgtata

SEQ ID NO: 766770 - DNA, 20 bp, Artificial
  CRISPR gRNA sequence
atggatggatgtttgtatat

SEQ ID NO: 766771 - DNA, 20 bp, Artificial
  CRISPR gRNA sequence
tggatggatgtttgtatatg

SEQ ID NO: 766772 - DNA, 20 bp, Artificial
  CRISPR gRNA sequence
tggatgtttgtatatgggga

SEQ ID NO: 766773 - DNA, 20 bp, Artificial
  CRISPR gRNA sequence
ggatgtttgtatatggggaa

SEQ ID NO: 766774 - DNA, 20 bp, Artificial
  CRISPR gRNA sequence
ttgtatatggggaaaggatc

SEQ ID NO: 766775 - DNA, 20 bp, Artificial
  CRISPR gRNA sequence
gggaaaggatctggatgcct

SEQ ID NO: 766776 - DNA, 20 bp, Artificial
  CRISPR gRNA sequence
gaaaggatctggatgcctga

SEQ ID NO: 766777 - DNA, 20 bp, Artificial
  CRISPR gRNA sequence
cctgagagtgaatgcaactc

SEQ ID NO: 766778 - DNA, 20 bp, Artificial
  CRISPR gRNA sequence
tgagagtgaatgcaactctg

SEQ ID NO: 766779 - DNA, 20 bp, Artificial
  CRISPR gRNA sequence
tgaatgcaactctggagtgt

SEQ ID NO: 766780 - DNA, 20 bp, Artificial
  CRISPR gRNA sequence
caactctggagtgtcagaat

SEQ ID NO: 766781 - DNA, 20 bp, Artificial
  CRISPR gRNA sequence
aactctggagtgtcagaata

SEQ ID NO: 766782 - DNA, 20 bp, Artificial
  CRISPR gRNA sequence
actctggagtgtcagaataa

SEQ ID NO: 766783 - DNA, 20 bp, Artificial
  CRISPR gRNA sequence
tggagtgtcagaataagggt

SEQ ID NO: 766784 - DNA, 20 bp, Artificial
  CRISPR gRNA sequence
gagtgtcagaataagggtga

SEQ ID NO: 766785 - DNA, 20 bp, Artificial
  CRISPR gRNA sequence
tcttttgcaattaacgaaaa

SEQ ID NO: 766786 - DNA, 20 bp, Artificial
  CRISPR gRNA sequence
cttttgcaattaacgaaaaa

SEQ ID NO: 766787 - DNA, 20 bp, Artificial
  CRISPR gRNA sequence
aattaacgaaaaaaggaaaa

SEQ ID NO: 766788 - DNA, 20 bp, Artificial
  CRISPR gRNA sequence
aaaaaggaaaacagcaacaa

SEQ ID NO: 766789 - DNA, 20 bp, Artificial
  CRISPR gRNA sequence
aaaggaaaacagcaacaaca

SEQ ID NO: 766790 - DNA, 20 bp, Artificial
  CRISPR gRNA sequence
cagcaacaacagagatatcc

SEQ ID NO: 766791 - DNA, 20 bp, Artificial
  CRISPR gRNA sequence
aacagagatatcctggactt

SEQ ID NO: 766792 - DNA, 20 bp, Artificial
  CRISPR gRNA sequence
agatatcctggactttagac

SEQ ID NO: 766793 - DNA, 20 bp, Artificial
  CRISPR gRNA sequence
gatatcctggactttagacc

SEQ ID NO: 766794 - DNA, 20 bp, Artificial
  CRISPR gRNA sequence
aggctctgtcactcacttgc

SEQ ID NO: 766795 - DNA, 20 bp, Artificial
  CRISPR gRNA sequence
ggctctgtcactcacttgcc

SEQ ID NO: 766796 - DNA, 20 bp, Artificial
  CRISPR gRNA sequence
cactcacttgccaggctccc

SEQ ID NO: 766797 - DNA, 20 bp, Artificial
  CRISPR gRNA sequence
actcacttgccaggctccct

SEQ ID NO: 766798 - DNA, 20 bp, Artificial
  CRISPR gRNA sequence
ggccaaaccccttgcctttc

SEQ ID NO: 766799 - DNA, 20 bp, Artificial
  CRISPR gRNA sequence
gccaaaccccttgcctttct

SEQ ID NO: 766800 - DNA, 20 bp, Artificial
  CRISPR gRNA sequence
cttcatctcctcaaccatca

SEQ ID NO: 766801 - DNA, 20 bp, Artificial
  CRISPR gRNA sequence
ttcatctcctcaaccatcaa

SEQ ID NO: 766802 - DNA, 20 bp, Artificial
  CRISPR gRNA sequence
tcatctcctcaaccatcaaa

SEQ ID NO: 766803 - DNA, 20 bp, Artificial
  CRISPR gRNA sequence
gctgtgaccatatcgcatgt

SEQ ID NO: 766804 - DNA, 20 bp, Artificial
  CRISPR gRNA sequence
ctgtgaccatatcgcatgtt

SEQ ID NO: 766805 - DNA, 20 bp, Artificial
  CRISPR gRNA sequence
gaccatatcgcatgttgggc

SEQ ID NO: 766806 - DNA, 20 bp, Artificial
  CRISPR gRNA sequence
tgttgggctggtgtaatcac

SEQ ID NO: 766807 - DNA, 20 bp, Artificial
  CRISPR gRNA sequence
tgggctggtgtaatcacaag

SEQ ID NO: 766808 - DNA, 20 bp, Artificial
  CRISPR gRNA sequence
tgtaatcacaagaagcttca

SEQ ID NO: 766809 - DNA, 20 bp, Artificial
  CRISPR gRNA sequence
aatcacaagaagcttcatgg

SEQ ID NO: 766810 - DNA, 20 bp, Artificial
  CRISPR gRNA sequence
cacaagaagcttcatggaag

SEQ ID NO: 766811 - DNA, 20 bp, Artificial
  CRISPR gRNA sequence
agaagcttcatggaagaagt

SEQ ID NO: 766812 - DNA, 20 bp, Artificial
  CRISPR gRNA sequence
ttcatggaagaagttagcac

SEQ ID NO: 766813 - DNA, 20 bp, Artificial
  CRISPR gRNA sequence
agaagttagcactagtgttt

SEQ ID NO: 766814 - DNA, 20 bp, Artificial
  CRISPR gRNA sequence
agttagcactagtgtttaag

SEQ ID NO: 766815 - DNA, 20 bp, Artificial
  CRISPR gRNA sequence
agtgtttaagaagatgactt

SEQ ID NO: 766816 - DNA, 20 bp, Artificial
  CRISPR gRNA sequence
tgtttaagaagatgactttg

SEQ ID NO: 766817 - DNA, 20 bp, Artificial
  CRISPR gRNA sequence
taagaagatgactttggagt

SEQ ID NO: 766818 - DNA, 20 bp, Artificial
  CRISPR gRNA sequence
agaagatgactttggagttg

SEQ ID NO: 766819 - DNA, 20 bp, Artificial
  CRISPR gRNA sequence
aagatgactttggagttgga

SEQ ID NO: 766820 - DNA, 20 bp, Artificial
  CRISPR gRNA sequence
tgactttggagttggagaga

SEQ ID NO: 766821 - DNA, 20 bp, Artificial
  CRISPR gRNA sequence
gactttggagttggagagac

SEQ ID NO: 766822 - DNA, 20 bp, Artificial
  CRISPR gRNA sequence
tggagagacaggttcaaatc

SEQ ID NO: 766823 - DNA, 20 bp, Artificial
  CRISPR gRNA sequence
atccagactctgtcacttcc

SEQ ID NO: 766824 - DNA, 20 bp, Artificial
  CRISPR gRNA sequence
tttatgaaaatatcctctct

SEQ ID NO: 766825 - DNA, 20 bp, Artificial
  CRISPR gRNA sequence
aaaatatcctctctgagcct

SEQ ID NO: 766826 - DNA, 20 bp, Artificial
  CRISPR gRNA sequence
cagtttgctcatttgtaaaa

SEQ ID NO: 766827 - DNA, 20 bp, Artificial
  CRISPR gRNA sequence
agtttgctcatttgtaaaat

SEQ ID NO: 766828 - DNA, 20 bp, Artificial
  CRISPR gRNA sequence
gtttgctcatttgtaaaatg

SEQ ID NO: 766829 - DNA, 20 bp, Artificial
  CRISPR gRNA sequence
gattataaaccttaccctca

SEQ ID NO: 766830 - DNA, 20 bp, Artificial
  CRISPR gRNA sequence
attataaaccttaccctcat

SEQ ID NO: 766831 - DNA, 20 bp, Artificial
  CRISPR gRNA sequence
ttaccctcataggatgatta

SEQ ID NO: 766832 - DNA, 20 bp, Artificial
  CRISPR gRNA sequence
taccctcataggatgattat

SEQ ID NO: 766833 - DNA, 20 bp, Artificial
  CRISPR gRNA sequence
ggatgattataggactcaat

SEQ ID NO: 766834 - DNA, 20 bp, Artificial
  CRISPR gRNA sequence
caaaattatcaaaactgacc

SEQ ID NO: 766835 - DNA, 20 bp, Artificial
  CRISPR gRNA sequence
aaaactgacctagttaatac

SEQ ID NO: 766836 - DNA, 20 bp, Artificial
  CRISPR gRNA sequence
aaactgacctagttaatact

SEQ ID NO: 766837 - DNA, 20 bp, Artificial
  CRISPR gRNA sequence
aatactaggtgctctataaa

SEQ ID NO: 766838 - DNA, 20 bp, Artificial
  CRISPR gRNA sequence
atactaggtgctctataaat

SEQ ID NO: 766839 - DNA, 20 bp, Artificial
  CRISPR gRNA sequence
ctaggtgctctataaatggg

SEQ ID NO: 766840 - DNA, 20 bp, Artificial
  CRISPR gRNA sequence
ggtgctctataaatgggcag

SEQ ID NO: 766841 - DNA, 20 bp, Artificial
  CRISPR gRNA sequence
ctataaatgggcagcagcct

SEQ ID NO: 766842 - DNA, 20 bp, Artificial
  CRISPR gRNA sequence
aatgggcagcagcctcagaa

SEQ ID NO: 766843 - DNA, 20 bp, Artificial
  CRISPR gRNA sequence
tgggcagcagcctcagaaaa

SEQ ID NO: 766844 - DNA, 20 bp, Artificial
  CRISPR gRNA sequence
cagcagcctcagaaaagaga

SEQ ID NO: 766845 - DNA, 20 bp, Artificial
  CRISPR gRNA sequence
agcagcctcagaaaagagat

SEQ ID NO: 766846 - DNA, 20 bp, Artificial
  CRISPR gRNA sequence
cagcctcagaaaagagatgg

SEQ ID NO: 766847 - DNA, 20 bp, Artificial
  CRISPR gRNA sequence
agcctcagaaaagagatggg

SEQ ID NO: 766848 - DNA, 20 bp, Artificial
  CRISPR gRNA sequence
gcctcagaaaagagatggga

SEQ ID NO: 766849 - DNA, 20 bp, Artificial
  CRISPR gRNA sequence
aaaagagatgggagggtccc

SEQ ID NO: 766850 - DNA, 20 bp, Artificial
  CRISPR gRNA sequence
aagagatgggagggtcccta

SEQ ID NO: 766851 - DNA, 20 bp, Artificial
  CRISPR gRNA sequence
ggagggtccctagagttccc

SEQ ID NO: 766852 - DNA, 20 bp, Artificial
  CRISPR gRNA sequence
gagggtccctagagttccct

SEQ ID NO: 766853 - DNA, 20 bp, Artificial
  CRISPR gRNA sequence
tccctagagttccctgggaa

SEQ ID NO: 766854 - DNA, 20 bp, Artificial
  CRISPR gRNA sequence
ttcctttttcctgataatct

SEQ ID NO: 766855 - DNA, 20 bp, Artificial
  CRISPR gRNA sequence
tttttcctgataatctgagt

SEQ ID NO: 766856 - DNA, 20 bp, Artificial
  CRISPR gRNA sequence
cctgataatctgagtcagtt

SEQ ID NO: 766857 - DNA, 20 bp, Artificial
  CRISPR gRNA sequence
ctgataatctgagtcagttt

SEQ ID NO: 766858 - DNA, 20 bp, Artificial
  CRISPR gRNA sequence
agtttgggccttttatgttc

SEQ ID NO: 766859 - DNA, 20 bp, Artificial
  CRISPR gRNA sequence
gtttgggccttttatgttca

SEQ ID NO: 766860 - DNA, 20 bp, Artificial
  CRISPR gRNA sequence
ttatgttcaaggctgtccac

SEQ ID NO: 766861 - DNA, 20 bp, Artificial
  CRISPR gRNA sequence
tatgttcaaggctgtccact

SEQ ID NO: 766862 - DNA, 20 bp, Artificial
  CRISPR gRNA sequence
gtccactgggcaccactccc

SEQ ID NO: 766863 - DNA, 20 bp, Artificial
  CRISPR gRNA sequence
ccagtcccgtgatcccaccc

SEQ ID NO: 766864 - DNA, 20 bp, Artificial
  CRISPR gRNA sequence
agtcccgtgatcccacccaa

SEQ ID NO: 766865 - DNA, 20 bp, Artificial
  CRISPR gRNA sequence
cccgtgatcccacccaagag

SEQ ID NO: 766866 - DNA, 20 bp, Artificial
  CRISPR gRNA sequence
ccgtgatcccacccaagagc

SEQ ID NO: 766867 - DNA, 20 bp, Artificial
  CRISPR gRNA sequence
tcccacccaagagcaggaat

SEQ ID NO: 766868 - DNA, 20 bp, Artificial
  CRISPR gRNA sequence
ggaatcagttcttcctctcc

SEQ ID NO: 766869 - DNA, 20 bp, Artificial
  CRISPR gRNA sequence
tctccaagcgatttctgtgt

SEQ ID NO: 766870 - DNA, 20 bp, Artificial
  CRISPR gRNA sequence
caagcgatttctgtgtgagt

SEQ ID NO: 766871 - DNA, 20 bp, Artificial
  CRISPR gRNA sequence
aagcgatttctgtgtgagtc

SEQ ID NO: 766872 - DNA, 20 bp, Artificial
  CRISPR gRNA sequence
gatttctgtgtgagtcagga

SEQ ID NO: 766873 - DNA, 20 bp, Artificial
  CRISPR gRNA sequence
ttctgtgtgagtcaggacag

SEQ ID NO: 766874 - DNA, 20 bp, Artificial
  CRISPR gRNA sequence
tcaggacagtagtatgtcat

SEQ ID NO: 766875 - DNA, 20 bp, Artificial
  CRISPR gRNA sequence
caggacagtagtatgtcatc

SEQ ID NO: 766876 - DNA, 20 bp, Artificial
  CRISPR gRNA sequence
aggacagtagtatgtcatca

SEQ ID NO: 766877 - DNA, 20 bp, Artificial
  CRISPR gRNA sequence
cagtagtatgtcatcagggc

SEQ ID NO: 766878 - DNA, 20 bp, Artificial
  CRISPR gRNA sequence
agtatgtcatcagggctggc

SEQ ID NO: 766879 - DNA, 20 bp, Artificial
  CRISPR gRNA sequence
gtcatcagggctggccagca

SEQ ID NO: 766880 - DNA, 20 bp, Artificial
  CRISPR gRNA sequence
atcagggctggccagcaaag

SEQ ID NO: 766881 - DNA, 20 bp, Artificial
  CRISPR gRNA sequence
tcagggctggccagcaaagc

SEQ ID NO: 766882 - DNA, 20 bp, Artificial
  CRISPR gRNA sequence
cagggctggccagcaaagca

SEQ ID NO: 766883 - DNA, 20 bp, Artificial
  CRISPR gRNA sequence
ctggccagcaaagcagggct

SEQ ID NO: 766884 - DNA, 20 bp, Artificial
  CRISPR gRNA sequence
tggccagcaaagcagggcta

SEQ ID NO: 766885 - DNA, 20 bp, Artificial
  CRISPR gRNA sequence
aagcagggctaaggtctccc

SEQ ID NO: 766886 - DNA, 20 bp, Artificial
  CRISPR gRNA sequence
ggctaaggtctccctggaac

SEQ ID NO: 766887 - DNA, 20 bp, Artificial
  CRISPR gRNA sequence
ctaaggtctccctggaacta

SEQ ID NO: 766888 - DNA, 20 bp, Artificial
  CRISPR gRNA sequence
taaggtctccctggaactag

SEQ ID NO: 766889 - DNA, 20 bp, Artificial
  CRISPR gRNA sequence
cctggaactagaggcatgtg

SEQ ID NO: 766890 - DNA, 20 bp, Artificial
  CRISPR gRNA sequence
ctggaactagaggcatgtgc

SEQ ID NO: 766891 - DNA, 20 bp, Artificial
  CRISPR gRNA sequence
tggaactagaggcatgtgca

SEQ ID NO: 766892 - DNA, 20 bp, Artificial
  CRISPR gRNA sequence
ggaactagaggcatgtgcag

SEQ ID NO: 766893 - DNA, 20 bp, Artificial
  CRISPR gRNA sequence
aactgacctatacatgcatg

SEQ ID NO: 766894 - DNA, 20 bp, Artificial
  CRISPR gRNA sequence
cacacacacacacacacaca

SEQ ID NO: 766895 - DNA, 20 bp, Artificial
  CRISPR gRNA sequence
acacacacacacacacacac

SEQ ID NO: 766896 - DNA, 20 bp, Artificial
  CRISPR gRNA sequence
acacacacacacacacacag

SEQ ID NO: 766897 - DNA, 20 bp, Artificial
  CRISPR gRNA sequence
cacacacacacacacacagg

SEQ ID NO: 766898 - DNA, 20 bp, Artificial
  CRISPR gRNA sequence
acacacacacacaggaggca

SEQ ID NO: 766899 - DNA, 20 bp, Artificial
  CRISPR gRNA sequence
acacacacacaggaggcaca

SEQ ID NO: 766900 - DNA, 20 bp, Artificial
  CRISPR gRNA sequence
gaggcacagagccctgaaaa

SEQ ID NO: 766901 - DNA, 20 bp, Artificial
  CRISPR gRNA sequence
cagagccctgaaaaaagtga

SEQ ID NO: 766902 - DNA, 20 bp, Artificial
  CRISPR gRNA sequence
gaaaaaagtgaaagctacat

SEQ ID NO: 766903 - DNA, 20 bp, Artificial
  CRISPR gRNA sequence
aaaaaagtgaaagctacatt

SEQ ID NO: 766904 - DNA, 20 bp, Artificial
  CRISPR gRNA sequence
agtgaaagctacattgggcc

SEQ ID NO: 766905 - DNA, 20 bp, Artificial
  CRISPR gRNA sequence
tgaaagctacattgggccca

SEQ ID NO: 766906 - DNA, 20 bp, Artificial
  CRISPR gRNA sequence
gaaagctacattgggcccag

SEQ ID NO: 766907 - DNA, 20 bp, Artificial
  CRISPR gRNA sequence
aagctacattgggcccagag

SEQ ID NO: 766908 - DNA, 20 bp, Artificial
  CRISPR gRNA sequence
agctacattgggcccagagg

SEQ ID NO: 766909 - DNA, 20 bp, Artificial
  CRISPR gRNA sequence
cattgggcccagaggaggtc

SEQ ID NO: 766910 - DNA, 20 bp, Artificial
  CRISPR gRNA sequence
cccagaggaggtccagccaa

SEQ ID NO: 766911 - DNA, 20 bp, Artificial
  CRISPR gRNA sequence
agaggaggtccagccaaaag

SEQ ID NO: 766912 - DNA, 20 bp, Artificial
  CRISPR gRNA sequence
gaggaggtccagccaaaaga

SEQ ID NO: 766913 - DNA, 20 bp, Artificial
  CRISPR gRNA sequence
aggaggtccagccaaaagaa

SEQ ID NO: 766914 - DNA, 20 bp, Artificial
  CRISPR gRNA sequence
ggtccagccaaaagaaggga

SEQ ID NO: 766915 - DNA, 20 bp, Artificial
  CRISPR gRNA sequence
ccaaaagaagggatggcaac

SEQ ID NO: 766916 - DNA, 20 bp, Artificial
  CRISPR gRNA sequence
caaaagaagggatggcaaca

SEQ ID NO: 766917 - DNA, 20 bp, Artificial
  CRISPR gRNA sequence
aaagaagggatggcaacaag

SEQ ID NO: 766918 - DNA, 20 bp, Artificial
  CRISPR gRNA sequence
agggatggcaacaaggagaa

SEQ ID NO: 766919 - DNA, 20 bp, Artificial
  CRISPR gRNA sequence
gggatggcaacaaggagaat

SEQ ID NO: 766920 - DNA, 20 bp, Artificial
  CRISPR gRNA sequence
ggatggcaacaaggagaata

SEQ ID NO: 766921 - DNA, 20 bp, Artificial
  CRISPR gRNA sequence
atggcaacaaggagaatagg

SEQ ID NO: 766922 - DNA, 20 bp, Artificial
  CRISPR gRNA sequence
ggcaacaaggagaataggga

SEQ ID NO: 766923 - DNA, 20 bp, Artificial
  CRISPR gRNA sequence
gcaacaaggagaatagggag

SEQ ID NO: 766924 - DNA, 20 bp, Artificial
  CRISPR gRNA sequence
acaaggagaatagggagagg

SEQ ID NO: 766925 - DNA, 20 bp, Artificial
  CRISPR gRNA sequence
caaggagaatagggagagga

SEQ ID NO: 766926 - DNA, 20 bp, Artificial
  CRISPR gRNA sequence
gagaatagggagaggaagga

SEQ ID NO: 766927 - DNA, 20 bp, Artificial
  CRISPR gRNA sequence
agaatagggagaggaaggaa

SEQ ID NO: 766928 - DNA, 20 bp, Artificial
  CRISPR gRNA sequence
gaatagggagaggaaggaaa

SEQ ID NO: 766929 - DNA, 20 bp, Artificial
  CRISPR gRNA sequence
gggagaggaaggaaagggat

SEQ ID NO: 766930 - DNA, 20 bp, Artificial
  CRISPR gRNA sequence
gagaggaaggaaagggatga

SEQ ID NO: 766931 - DNA, 20 bp, Artificial
  CRISPR gRNA sequence
ggaaagggatgagagcacat

SEQ ID NO: 766932 - DNA, 20 bp, Artificial
  CRISPR gRNA sequence
gagagcacatgagaccacat

SEQ ID NO: 766933 - DNA, 20 bp, Artificial
  CRISPR gRNA sequence
gagcacatgagaccacatca

SEQ ID NO: 766934 - DNA, 20 bp, Artificial
  CRISPR gRNA sequence
catgagaccacatcagagcg

SEQ ID NO: 766935 - DNA, 20 bp, Artificial
  CRISPR gRNA sequence
ccacatcagagcgcagattt

SEQ ID NO: 766936 - DNA, 20 bp, Artificial
  CRISPR gRNA sequence
cacatcagagcgcagatttc

SEQ ID NO: 766937 - DNA, 20 bp, Artificial
  CRISPR gRNA sequence
tcagagcgcagatttcgggt

SEQ ID NO: 766938 - DNA, 20 bp, Artificial
  CRISPR gRNA sequence
gcagatttcgggtcagacac

SEQ ID NO: 766939 - DNA, 20 bp, Artificial
  CRISPR gRNA sequence
gatttcgggtcagacactgg

SEQ ID NO: 766940 - DNA, 20 bp, Artificial
  CRISPR gRNA sequence
atttcgggtcagacactggc

SEQ ID NO: 766941 - DNA, 20 bp, Artificial
  CRISPR gRNA sequence
gggtcagacactggcaggcc

SEQ ID NO: 766942 - DNA, 20 bp, Artificial
  CRISPR gRNA sequence
ggtcagacactggcaggccc

SEQ ID NO: 766943 - DNA, 20 bp, Artificial
  CRISPR gRNA sequence
gtcagacactggcaggccca

SEQ ID NO: 766944 - DNA, 20 bp, Artificial
  CRISPR gRNA sequence
gcattcactcaatatctgct

SEQ ID NO: 766945 - DNA, 20 bp, Artificial
  CRISPR gRNA sequence
caatatctgctgagtcctgc

SEQ ID NO: 766946 - DNA, 20 bp, Artificial
  CRISPR gRNA sequence
aatatctgctgagtcctgct

SEQ ID NO: 766947 - DNA, 20 bp, Artificial
  CRISPR gRNA sequence
ggtgcccacctaaacatatc

SEQ ID NO: 766948 - DNA, 20 bp, Artificial
  CRISPR gRNA sequence
tctggaaatcctatcctttc

SEQ ID NO: 766949 - DNA, 20 bp, Artificial
  CRISPR gRNA sequence
ggaaatcctatcctttccag

SEQ ID NO: 766950 - DNA, 20 bp, Artificial
  CRISPR gRNA sequence
atcctttccagaagcctttc

SEQ ID NO: 766951 - DNA, 20 bp, Artificial
  CRISPR gRNA sequence
agcctttccagactgcactc

SEQ ID NO: 766952 - DNA, 20 bp, Artificial
  CRISPR gRNA sequence
gcctttccagactgcactca

SEQ ID NO: 766953 - DNA, 20 bp, Artificial
  CRISPR gRNA sequence
tttccagactgcactcaagg

SEQ ID NO: 766954 - DNA, 20 bp, Artificial
  CRISPR gRNA sequence
ttccagactgcactcaagga

SEQ ID NO: 766955 - DNA, 20 bp, Artificial
  CRISPR gRNA sequence
tccagactgcactcaaggaa

SEQ ID NO: 766956 - DNA, 20 bp, Artificial
  CRISPR gRNA sequence
aaggaagggtgcattttctc

SEQ ID NO: 766957 - DNA, 20 bp, Artificial
  CRISPR gRNA sequence
tccttgcctccaaattcctt

SEQ ID NO: 766958 - DNA, 20 bp, Artificial
  CRISPR gRNA sequence
tcctttggtttctaccctga

SEQ ID NO: 766959 - DNA, 20 bp, Artificial
  CRISPR gRNA sequence
ctttggtttctaccctgaaa

SEQ ID NO: 766960 - DNA, 20 bp, Artificial
  CRISPR gRNA sequence
tttggtttctaccctgaaag

SEQ ID NO: 766961 - DNA, 20 bp, Artificial
  CRISPR gRNA sequence
tttctaccctgaaagaggct

SEQ ID NO: 766962 - DNA, 20 bp, Artificial
  CRISPR gRNA sequence
accctgaaagaggctcagct

SEQ ID NO: 766963 - DNA, 20 bp, Artificial
  CRISPR gRNA sequence
ctgaaagaggctcagcttag

SEQ ID NO: 766964 - DNA, 20 bp, Artificial
  CRISPR gRNA sequence
ctgccgacccctctccatct

SEQ ID NO: 766965 - DNA, 20 bp, Artificial
  CRISPR gRNA sequence
acccctctccatctaagcac

SEQ ID NO: 766966 - DNA, 20 bp, Artificial
  CRISPR gRNA sequence
tctaagcaccagacccctct

SEQ ID NO: 766967 - DNA, 20 bp, Artificial
  CRISPR gRNA sequence
taagcaccagacccctctcg

SEQ ID NO: 766968 - DNA, 20 bp, Artificial
  CRISPR gRNA sequence
accagacccctctcggagtg

SEQ ID NO: 766969 - DNA, 20 bp, Artificial
  CRISPR gRNA sequence
cggagtgtagcaatctccac

SEQ ID NO: 766970 - DNA, 20 bp, Artificial
  CRISPR gRNA sequence
tagcaatctccaccagtcct

SEQ ID NO: 766971 - DNA, 20 bp, Artificial
  CRISPR gRNA sequence
gcaatctccaccagtcctca

SEQ ID NO: 766972 - DNA, 20 bp, Artificial
  CRISPR gRNA sequence
tctccaccagtcctcagagc

SEQ ID NO: 766973 - DNA, 20 bp, Artificial
  CRISPR gRNA sequence
ccaccagtcctcagagctag

SEQ ID NO: 766974 - DNA, 20 bp, Artificial
  CRISPR gRNA sequence
caccagtcctcagagctaga

SEQ ID NO: 766975 - DNA, 20 bp, Artificial
  CRISPR gRNA sequence
cagagctagaaggcctctta

SEQ ID NO: 766976 - DNA, 20 bp, Artificial
  CRISPR gRNA sequence
aaggcctcttacggtacacc

SEQ ID NO: 766977 - DNA, 20 bp, Artificial
  CRISPR gRNA sequence
ctcttacggtacacctggtc

SEQ ID NO: 766978 - DNA, 20 bp, Artificial
  CRISPR gRNA sequence
ggtacacctggtccagcgcc

SEQ ID NO: 766979 - DNA, 20 bp, Artificial
  CRISPR gRNA sequence
cctggtccagcgcctagctc

SEQ ID NO: 766980 - DNA, 20 bp, Artificial
  CRISPR gRNA sequence
ctggtccagcgcctagctcc

SEQ ID NO: 766981 - DNA, 20 bp, Artificial
  CRISPR gRNA sequence
ctagctccaggcccattgta

SEQ ID NO: 766982 - DNA, 20 bp, Artificial
  CRISPR gRNA sequence
ctccaggcccattgtacaga

SEQ ID NO: 766983 - DNA, 20 bp, Artificial
  CRISPR gRNA sequence
ccattgtacagatggaaatc

SEQ ID NO: 766984 - DNA, 20 bp, Artificial
  CRISPR gRNA sequence
tacagatggaaatctggacc

SEQ ID NO: 766985 - DNA, 20 bp, Artificial
  CRISPR gRNA sequence
cagatggaaatctggaccca

SEQ ID NO: 766986 - DNA, 20 bp, Artificial
  CRISPR gRNA sequence
atggaaatctggacccagag

SEQ ID NO: 766987 - DNA, 20 bp, Artificial
  CRISPR gRNA sequence
gaaatctggacccagagtgg

SEQ ID NO: 766988 - DNA, 20 bp, Artificial
  CRISPR gRNA sequence
tctggacccagagtggtggc

SEQ ID NO: 766989 - DNA, 20 bp, Artificial
  CRISPR gRNA sequence
gacccagagtggtggccggc

SEQ ID NO: 766990 - DNA, 20 bp, Artificial
  CRISPR gRNA sequence
agagtggtggccggctggcc

SEQ ID NO: 766991 - DNA, 20 bp, Artificial
  CRISPR gRNA sequence
gagtggtggccggctggcca

SEQ ID NO: 766992 - DNA, 20 bp, Artificial
  CRISPR gRNA sequence
agtggtggccggctggccaa

SEQ ID NO: 766993 - DNA, 20 bp, Artificial
  CRISPR gRNA sequence
aagggcccacactcaattat

SEQ ID NO: 766994 - DNA, 20 bp, Artificial
  CRISPR gRNA sequence
cacactcaattatcagccac

SEQ ID NO: 766995 - DNA, 20 bp, Artificial
  CRISPR gRNA sequence
actcaattatcagccaccag

SEQ ID NO: 766996 - DNA, 20 bp, Artificial
  CRISPR gRNA sequence
caattatcagccaccagcag

SEQ ID NO: 766997 - DNA, 20 bp, Artificial
  CRISPR gRNA sequence
agccaccagcagaagtgact

SEQ ID NO: 766998 - DNA, 20 bp, Artificial
  CRISPR gRNA sequence
ccaccagcagaagtgactaa

SEQ ID NO: 766999 - DNA, 20 bp, Artificial
  CRISPR gRNA sequence
cagcagaagtgactaagagc

SEQ ID NO: 767000 - DNA, 20 bp, Artificial
  CRISPR gRNA sequence
tctcttcctcacttattgaa

SEQ ID NO: 767001 - DNA, 20 bp, Artificial
  CRISPR gRNA sequence
cacttattgaatggaatcac

SEQ ID NO: 767002 - DNA, 20 bp, Artificial
  CRISPR gRNA sequence
acttattgaatggaatcacc

SEQ ID NO: 767003 - DNA, 20 bp, Artificial
  CRISPR gRNA sequence
accaggctgccttgcctgcc

SEQ ID NO: 767004 - DNA, 20 bp, Artificial
  CRISPR gRNA sequence
ccaggctgccttgcctgccc

SEQ ID NO: 767005 - DNA, 20 bp, Artificial
  CRISPR gRNA sequence
caggctgccttgcctgccca

SEQ ID NO: 767006 - DNA, 20 bp, Artificial
  CRISPR gRNA sequence
tgccttgcctgcccagggta

SEQ ID NO: 767007 - DNA, 20 bp, Artificial
  CRISPR gRNA sequence
gcctgcccagggtacagcat

SEQ ID NO: 767008 - DNA, 20 bp, Artificial
  CRISPR gRNA sequence
cccagggtacagcatgagct

SEQ ID NO: 767009 - DNA, 20 bp, Artificial
  CRISPR gRNA sequence
agggtacagcatgagctcag

SEQ ID NO: 767010 - DNA, 20 bp, Artificial
  CRISPR gRNA sequence
tacagcatgagctcagaagc

SEQ ID NO: 767011 - DNA, 20 bp, Artificial
  CRISPR gRNA sequence
agcatgagctcagaagccag

SEQ ID NO: 767012 - DNA, 20 bp, Artificial
  CRISPR gRNA sequence
agctcagaagccagcagcct

SEQ ID NO: 767013 - DNA, 20 bp, Artificial
  CRISPR gRNA sequence
gctcagaagccagcagcctt

SEQ ID NO: 767014 - DNA, 20 bp, Artificial
  CRISPR gRNA sequence
gccttgctgaacacatgacc

SEQ ID NO: 767015 - DNA, 20 bp, Artificial
  CRISPR gRNA sequence
ttaaatgacttaacctattt

SEQ ID NO: 767016 - DNA, 20 bp, Artificial
  CRISPR gRNA sequence
ccaattccaaatctctaaaa

SEQ ID NO: 767017 - DNA, 20 bp, Artificial
  CRISPR gRNA sequence
caattccaaatctctaaaat

SEQ ID NO: 767018 - DNA, 20 bp, Artificial
  CRISPR gRNA sequence
aattccaaatctctaaaatg

SEQ ID NO: 767019 - DNA, 20 bp, Artificial
  CRISPR gRNA sequence
attccaaatctctaaaatgg

SEQ ID NO: 767020 - DNA, 20 bp, Artificial
  CRISPR gRNA sequence
gggtaacaatccctacccca

SEQ ID NO: 767021 - DNA, 20 bp, Artificial
  CRISPR gRNA sequence
ggtaacaatccctaccccac

SEQ ID NO: 767022 - DNA, 20 bp, Artificial
  CRISPR gRNA sequence
gtaacaatccctaccccaca

SEQ ID NO: 767023 - DNA, 20 bp, Artificial
  CRISPR gRNA sequence
ctaccccacagggctgctgt

SEQ ID NO: 767024 - DNA, 20 bp, Artificial
  CRISPR gRNA sequence
ggctgctgtgagaataaaat

SEQ ID NO: 767025 - DNA, 20 bp, Artificial
  CRISPR gRNA sequence
gtgagaataaaataagacaa

SEQ ID NO: 767026 - DNA, 20 bp, Artificial
  CRISPR gRNA sequence
gagaataaaataagacaata

SEQ ID NO: 767027 - DNA, 20 bp, Artificial
  CRISPR gRNA sequence
gaataaaataagacaataga

SEQ ID NO: 767028 - DNA, 20 bp, Artificial
  CRISPR gRNA sequence
ataaaataagacaatagaga

SEQ ID NO: 767029 - DNA, 20 bp, Artificial
  CRISPR gRNA sequence
aaaataagacaatagagaga

SEQ ID NO: 767030 - DNA, 20 bp, Artificial
  CRISPR gRNA sequence
aaataagacaatagagagag

SEQ ID NO: 767031 - DNA, 20 bp, Artificial
  CRISPR gRNA sequence
gacaatagagagagaggact

SEQ ID NO: 767032 - DNA, 20 bp, Artificial
  CRISPR gRNA sequence
acaatagagagagaggactt

SEQ ID NO: 767033 - DNA, 20 bp, Artificial
  CRISPR gRNA sequence
tagagagagaggacttagga

SEQ ID NO: 767034 - DNA, 20 bp, Artificial
  CRISPR gRNA sequence
agaggacttaggaaagtgcc

SEQ ID NO: 767035 - DNA, 20 bp, Artificial
  CRISPR gRNA sequence
agtgcccagtaccaaaactg

SEQ ID NO: 767036 - DNA, 20 bp, Artificial
  CRISPR gRNA sequence
attgctgttattattgccgc

SEQ ID NO: 767037 - DNA, 20 bp, Artificial
  CRISPR gRNA sequence
tgttattattgccgcaagca

SEQ ID NO: 767038 - DNA, 20 bp, Artificial
  CRISPR gRNA sequence
gttattattgccgcaagcat

SEQ ID NO: 767039 - DNA, 20 bp, Artificial
  CRISPR gRNA sequence
ttattattgccgcaagcatg

SEQ ID NO: 767040 - DNA, 20 bp, Artificial
  CRISPR gRNA sequence
attgccgcaagcatggggac

SEQ ID NO: 767041 - DNA, 20 bp, Artificial
  CRISPR gRNA sequence
ttgccgcaagcatggggaca

SEQ ID NO: 767042 - DNA, 20 bp, Artificial
  CRISPR gRNA sequence
agcatggggacaaggcctcc

SEQ ID NO: 767043 - DNA, 20 bp, Artificial
  CRISPR gRNA sequence
tggggacaaggcctcctaga

SEQ ID NO: 767044 - DNA, 20 bp, Artificial
  CRISPR gRNA sequence
ggggacaaggcctcctagat

SEQ ID NO: 767045 - DNA, 20 bp, Artificial
  CRISPR gRNA sequence
gggacaaggcctcctagatg

SEQ ID NO: 767046 - DNA, 20 bp, Artificial
  CRISPR gRNA sequence
ctagatggggcctctgcact

SEQ ID NO: 767047 - DNA, 20 bp, Artificial
  CRISPR gRNA sequence
tgcccctaccccactctccc

SEQ ID NO: 767048 - DNA, 20 bp, Artificial
  CRISPR gRNA sequence
ctaccccactctccctggcc

SEQ ID NO: 767049 - DNA, 20 bp, Artificial
  CRISPR gRNA sequence
ctggccaagacctcctctgt

SEQ ID NO: 767050 - DNA, 20 bp, Artificial
  CRISPR gRNA sequence
tggccaagacctcctctgtc

SEQ ID NO: 767051 - DNA, 20 bp, Artificial
  CRISPR gRNA sequence
cctctgtcaggccacacatc

SEQ ID NO: 767052 - DNA, 20 bp, Artificial
  CRISPR gRNA sequence
ctctgtcaggccacacatct

SEQ ID NO: 767053 - DNA, 20 bp, Artificial
  CRISPR gRNA sequence
aggccacacatctgggcctc

SEQ ID NO: 767054 - DNA, 20 bp, Artificial
  CRISPR gRNA sequence
ggccacacatctgggcctct

SEQ ID NO: 767055 - DNA, 20 bp, Artificial
  CRISPR gRNA sequence
ctgtatccctacttttcacc

SEQ ID NO: 767056 - DNA, 20 bp, Artificial
  CRISPR gRNA sequence
gtatccctacttttcaccta

SEQ ID NO: 767057 - DNA, 20 bp, Artificial
  CRISPR gRNA sequence
cttttcacctagagccctat

SEQ ID NO: 767058 - DNA, 20 bp, Artificial
  CRISPR gRNA sequence
ctagagccctatcagtgccc

SEQ ID NO: 767059 - DNA, 20 bp, Artificial
  CRISPR gRNA sequence
ctatcagtgccccagctcca

SEQ ID NO: 767060 - DNA, 20 bp, Artificial
  CRISPR gRNA sequence
tcagtgccccagctccaaag

SEQ ID NO: 767061 - DNA, 20 bp, Artificial
  CRISPR gRNA sequence
gcacaactcgactccatctc

SEQ ID NO: 767062 - DNA, 20 bp, Artificial
  CRISPR gRNA sequence
tctctggctctgactcattc

SEQ ID NO: 767063 - DNA, 20 bp, Artificial
  CRISPR gRNA sequence
ctggctctgactcattctag

SEQ ID NO: 767064 - DNA, 20 bp, Artificial
  CRISPR gRNA sequence
ctgactcattctagtggtcc

SEQ ID NO: 767065 - DNA, 20 bp, Artificial
  CRISPR gRNA sequence
tgactcattctagtggtcct

SEQ ID NO: 767066 - DNA, 20 bp, Artificial
  CRISPR gRNA sequence
cctgggccccttcctcttcg

SEQ ID NO: 767067 - DNA, 20 bp, Artificial
  CRISPR gRNA sequence
ccttcctcttcgcagatgct

SEQ ID NO: 767068 - DNA, 20 bp, Artificial
  CRISPR gRNA sequence
tcttcgcagatgcttggtca

SEQ ID NO: 767069 - DNA, 20 bp, Artificial
  CRISPR gRNA sequence
agatgcttggtcacagttcc

SEQ ID NO: 767070 - DNA, 20 bp, Artificial
  CRISPR gRNA sequence
gtcacagttccaagtaccat

SEQ ID NO: 767071 - DNA, 20 bp, Artificial
  CRISPR gRNA sequence
ctcctaccgtcctgctgcca

SEQ ID NO: 767072 - DNA, 20 bp, Artificial
  CRISPR gRNA sequence
cgtcctgctgccatagcccc

SEQ ID NO: 767073 - DNA, 20 bp, Artificial
  CRISPR gRNA sequence
tgctgccatagcccctagca

SEQ ID NO: 767074 - DNA, 20 bp, Artificial
  CRISPR gRNA sequence
ctgccatagcccctagcaca

SEQ ID NO: 767075 - DNA, 20 bp, Artificial
  CRISPR gRNA sequence
cctagcacagagcattccca

SEQ ID NO: 767076 - DNA, 20 bp, Artificial
  CRISPR gRNA sequence
ctagcacagagcattcccac

SEQ ID NO: 767077 - DNA, 20 bp, Artificial
  CRISPR gRNA sequence
tagcacagagcattcccaca

SEQ ID NO: 767078 - DNA, 20 bp, Artificial
  CRISPR gRNA sequence
cacattccaatgtctcccac

SEQ ID NO: 767079 - DNA, 20 bp, Artificial
  CRISPR gRNA sequence
acattccaatgtctcccaca

SEQ ID NO: 767080 - DNA, 20 bp, Artificial
  CRISPR gRNA sequence
ttccaatgtctcccacaagg

SEQ ID NO: 767081 - DNA, 20 bp, Artificial
  CRISPR gRNA sequence
tgtctcccacaaggcagccc

SEQ ID NO: 767082 - DNA, 20 bp, Artificial
  CRISPR gRNA sequence
cacaaggcagccccagttcc

SEQ ID NO: 767083 - DNA, 20 bp, Artificial
  CRISPR gRNA sequence
acaaggcagccccagttcct

SEQ ID NO: 767084 - DNA, 20 bp, Artificial
  CRISPR gRNA sequence
aaggcagccccagttcctag

SEQ ID NO: 767085 - DNA, 20 bp, Artificial
  CRISPR gRNA sequence
ctaggagcctgcattgcctc

SEQ ID NO: 767086 - DNA, 20 bp, Artificial
  CRISPR gRNA sequence
taggagcctgcattgcctct

SEQ ID NO: 767087 - DNA, 20 bp, Artificial
  CRISPR gRNA sequence
aggagcctgcattgcctcta

SEQ ID NO: 767088 - DNA, 20 bp, Artificial
  CRISPR gRNA sequence
gcattgcctctagggtaact

SEQ ID NO: 767089 - DNA, 20 bp, Artificial
  CRISPR gRNA sequence
cattgcctctagggtaactt

SEQ ID NO: 767090 - DNA, 20 bp, Artificial
  CRISPR gRNA sequence
aacttgggacccctgcctcc

SEQ ID NO: 767091 - DNA, 20 bp, Artificial
  CRISPR gRNA sequence
cttgggacccctgcctccca

SEQ ID NO: 767092 - DNA, 20 bp, Artificial
  CRISPR gRNA sequence
ggacccctgcctcccagaga

SEQ ID NO: 767093 - DNA, 20 bp, Artificial
  CRISPR gRNA sequence
acagtatctctccctgctcc

SEQ ID NO: 767094 - DNA, 20 bp, Artificial
  CRISPR gRNA sequence
cagtatctctccctgctcca

SEQ ID NO: 767095 - DNA, 20 bp, Artificial
  CRISPR gRNA sequence
tctccctgctccaaggctcc

SEQ ID NO: 767096 - DNA, 20 bp, Artificial
  CRISPR gRNA sequence
cctgctccaaggctcccagc

SEQ ID NO: 767097 - DNA, 20 bp, Artificial
  CRISPR gRNA sequence
gcttctcactccacttcccg

SEQ ID NO: 767098 - DNA, 20 bp, Artificial
  CRISPR gRNA sequence
cactccacttcccgcagatt

SEQ ID NO: 767099 - DNA, 20 bp, Artificial
  CRISPR gRNA sequence
cagattaagctccctatgcc

SEQ ID NO: 767100 - DNA, 20 bp, Artificial
  CRISPR gRNA sequence
gattaagctccctatgccta

SEQ ID NO: 767101 - DNA, 20 bp, Artificial
  CRISPR gRNA sequence
taagctccctatgcctagag

SEQ ID NO: 767102 - DNA, 20 bp, Artificial
  CRISPR gRNA sequence
aagctccctatgcctagaga

SEQ ID NO: 767103 - DNA, 20 bp, Artificial
  CRISPR gRNA sequence
tccctatgcctagagaaggt

SEQ ID NO: 767104 - DNA, 20 bp, Artificial
  CRISPR gRNA sequence
agagaaggtcagattcccaa

SEQ ID NO: 767105 - DNA, 20 bp, Artificial
  CRISPR gRNA sequence
ggtcagattcccaatggcat

SEQ ID NO: 767106 - DNA, 20 bp, Artificial
  CRISPR gRNA sequence
gtcagattcccaatggcata

SEQ ID NO: 767107 - DNA, 20 bp, Artificial
  CRISPR gRNA sequence
tcccaatggcataaggtgtg

SEQ ID NO: 767108 - DNA, 20 bp, Artificial
  CRISPR gRNA sequence
ccaatggcataaggtgtgtg

SEQ ID NO: 767109 - DNA, 20 bp, Artificial
  CRISPR gRNA sequence
atggcataaggtgtgtggag

SEQ ID NO: 767110 - DNA, 20 bp, Artificial
  CRISPR gRNA sequence
tggcataaggtgtgtggagc

SEQ ID NO: 767111 - DNA, 20 bp, Artificial
  CRISPR gRNA sequence
tggagcaggcattcattctc

SEQ ID NO: 767112 - DNA, 20 bp, Artificial
  CRISPR gRNA sequence
cattcattctctggaccaca

SEQ ID NO: 767113 - DNA, 20 bp, Artificial
  CRISPR gRNA sequence
ttcattctctggaccacaaa

SEQ ID NO: 767114 - DNA, 20 bp, Artificial
  CRISPR gRNA sequence
ttctctggaccacaaagaga

SEQ ID NO: 767115 - DNA, 20 bp, Artificial
  CRISPR gRNA sequence
ctggaccacaaagagaaaga

SEQ ID NO: 767116 - DNA, 20 bp, Artificial
  CRISPR gRNA sequence
tggaccacaaagagaaagaa

SEQ ID NO: 767117 - DNA, 20 bp, Artificial
  CRISPR gRNA sequence
ggaccacaaagagaaagaaa

SEQ ID NO: 767118 - DNA, 20 bp, Artificial
  CRISPR gRNA sequence
accacaaagagaaagaaagg

SEQ ID NO: 767119 - DNA, 20 bp, Artificial
  CRISPR gRNA sequence
caaagagaaagaaagggaga

SEQ ID NO: 767120 - DNA, 20 bp, Artificial
  CRISPR gRNA sequence
aaagagaaagaaagggagaa

SEQ ID NO: 767121 - DNA, 20 bp, Artificial
  CRISPR gRNA sequence
aagagaaagaaagggagaaa

SEQ ID NO: 767122 - DNA, 20 bp, Artificial
  CRISPR gRNA sequence
agagaaagaaagggagaaag

SEQ ID NO: 767123 - DNA, 20 bp, Artificial
  CRISPR gRNA sequence
gagaaagaaagggagaaagg

SEQ ID NO: 767124 - DNA, 20 bp, Artificial
  CRISPR gRNA sequence
aaagaaagggagaaaggggg

SEQ ID NO: 767125 - DNA, 20 bp, Artificial
  CRISPR gRNA sequence
aaagggagaaagggggcagc

SEQ ID NO: 767126 - DNA, 20 bp, Artificial
  CRISPR gRNA sequence
ggagaaagggggcagctggc

SEQ ID NO: 767127 - DNA, 20 bp, Artificial
  CRISPR gRNA sequence
gagaaagggggcagctggct

SEQ ID NO: 767128 - DNA, 20 bp, Artificial
  CRISPR gRNA sequence
gaaagggggcagctggctgg

SEQ ID NO: 767129 - DNA, 20 bp, Artificial
  CRISPR gRNA sequence
gggcagctggctgggagcac

SEQ ID NO: 767130 - DNA, 20 bp, Artificial
  CRISPR gRNA sequence
agctggctgggagcactggt

SEQ ID NO: 767131 - DNA, 20 bp, Artificial
  CRISPR gRNA sequence
ctgggagcactggtcagaac

SEQ ID NO: 767132 - DNA, 20 bp, Artificial
  CRISPR gRNA sequence
gggagcactggtcagaactg

SEQ ID NO: 767133 - DNA, 20 bp, Artificial
  CRISPR gRNA sequence
ggagcactggtcagaactgg

SEQ ID NO: 767134 - DNA, 20 bp, Artificial
  CRISPR gRNA sequence
gagcactggtcagaactgga

SEQ ID NO: 767135 - DNA, 20 bp, Artificial
  CRISPR gRNA sequence
cactggtcagaactggaggg

SEQ ID NO: 767136 - DNA, 20 bp, Artificial
  CRISPR gRNA sequence
ctggtcagaactggagggtg

SEQ ID NO: 767137 - DNA, 20 bp, Artificial
  CRISPR gRNA sequence
tggtcagaactggagggtgg

SEQ ID NO: 767138 - DNA, 20 bp, Artificial
  CRISPR gRNA sequence
ggtcagaactggagggtgga

SEQ ID NO: 767139 - DNA, 20 bp, Artificial
  CRISPR gRNA sequence
gtcagaactggagggtggag

SEQ ID NO: 767140 - DNA, 20 bp, Artificial
  CRISPR gRNA sequence
tcagaactggagggtggagg

SEQ ID NO: 767141 - DNA, 20 bp, Artificial
  CRISPR gRNA sequence
gagggtggagggggaactcc

SEQ ID NO: 767142 - DNA, 20 bp, Artificial
  CRISPR gRNA sequence
ggtggagggggaactcctgg

SEQ ID NO: 767143 - DNA, 20 bp, Artificial
  CRISPR gRNA sequence
gggggaactcctggaagccc

SEQ ID NO: 767144 - DNA, 20 bp, Artificial
  CRISPR gRNA sequence
ctggaagccccagcatgata

SEQ ID NO: 767145 - DNA, 20 bp, Artificial
  CRISPR gRNA sequence
agccccagcatgataaagtc

SEQ ID NO: 767146 - DNA, 20 bp, Artificial
  CRISPR gRNA sequence
gccccagcatgataaagtcc

SEQ ID NO: 767147 - DNA, 20 bp, Artificial
  CRISPR gRNA sequence
ccccagcatgataaagtcca

SEQ ID NO: 767148 - DNA, 20 bp, Artificial
  CRISPR gRNA sequence
catgataaagtccagggctc

SEQ ID NO: 767149 - DNA, 20 bp, Artificial
  CRISPR gRNA sequence
gataaagtccagggctctgg

SEQ ID NO: 767150 - DNA, 20 bp, Artificial
  CRISPR gRNA sequence
taaagtccagggctctggaa

SEQ ID NO: 767151 - DNA, 20 bp, Artificial
  CRISPR gRNA sequence
agtccagggctctggaagag

SEQ ID NO: 767152 - DNA, 20 bp, Artificial
  CRISPR gRNA sequence
ctctggaagagaagaactct

SEQ ID NO: 767153 - DNA, 20 bp, Artificial
  CRISPR gRNA sequence
gaagagaagaactctcagca

SEQ ID NO: 767154 - DNA, 20 bp, Artificial
  CRISPR gRNA sequence
aagagaagaactctcagcaa

SEQ ID NO: 767155 - DNA, 20 bp, Artificial
  CRISPR gRNA sequence
aaggccctgactatgctgtg

SEQ ID NO: 767156 - DNA, 20 bp, Artificial
  CRISPR gRNA sequence
aggccctgactatgctgtga

SEQ ID NO: 767157 - DNA, 20 bp, Artificial
  CRISPR gRNA sequence
gactatgctgtgaaggccac

SEQ ID NO: 767158 - DNA, 20 bp, Artificial
  CRISPR gRNA sequence
ctgtgaaggccactagtcac

SEQ ID NO: 767159 - DNA, 20 bp, Artificial
  CRISPR gRNA sequence
tgtgaaggccactagtcact

SEQ ID NO: 767160 - DNA, 20 bp, Artificial
  CRISPR gRNA sequence
ccactagtcactgggtcacc

SEQ ID NO: 767161 - DNA, 20 bp, Artificial
  CRISPR gRNA sequence
cactagtcactgggtcaccc

SEQ ID NO: 767162 - DNA, 20 bp, Artificial
  CRISPR gRNA sequence
agtcactgggtcacccaggt

SEQ ID NO: 767163 - DNA, 20 bp, Artificial
  CRISPR gRNA sequence
gtcactgggtcacccaggtc

SEQ ID NO: 767164 - DNA, 20 bp, Artificial
  CRISPR gRNA sequence
ggtcaggcctgccccttctc

SEQ ID NO: 767165 - DNA, 20 bp, Artificial
  CRISPR gRNA sequence
ctgccccttctctggttccc

SEQ ID NO: 767166 - DNA, 20 bp, Artificial
  CRISPR gRNA sequence
ccttctctggttccccagat

SEQ ID NO: 767167 - DNA, 20 bp, Artificial
  CRISPR gRNA sequence
tgagtcttccctgacttact

SEQ ID NO: 767168 - DNA, 20 bp, Artificial
  CRISPR gRNA sequence
gagtcttccctgacttacta

SEQ ID NO: 767169 - DNA, 20 bp, Artificial
  CRISPR gRNA sequence
gtcttccctgacttactaag

SEQ ID NO: 767170 - DNA, 20 bp, Artificial
  CRISPR gRNA sequence
tgacttactaaggagaccct

SEQ ID NO: 767171 - DNA, 20 bp, Artificial
  CRISPR gRNA sequence
agacccttggcacatcttac

SEQ ID NO: 767172 - DNA, 20 bp, Artificial
  CRISPR gRNA sequence
gacccttggcacatcttacc

SEQ ID NO: 767173 - DNA, 20 bp, Artificial
  CRISPR gRNA sequence
tggcacatcttaccgggctc

SEQ ID NO: 767174 - DNA, 20 bp, Artificial
  CRISPR gRNA sequence
acatcttaccgggctccaga

SEQ ID NO: 767175 - DNA, 20 bp, Artificial
  CRISPR gRNA sequence
atcttaccgggctccagaaa

SEQ ID NO: 767176 - DNA, 20 bp, Artificial
  CRISPR gRNA sequence
tcttaccgggctccagaaag

SEQ ID NO: 767177 - DNA, 20 bp, Artificial
  CRISPR gRNA sequence
cttaccgggctccagaaaga

SEQ ID NO: 767178 - DNA, 20 bp, Artificial
  CRISPR gRNA sequence
ttaccgggctccagaaagag

SEQ ID NO: 767179 - DNA, 20 bp, Artificial
  CRISPR gRNA sequence
gtaaaacctgtgcctacctc

SEQ ID NO: 767180 - DNA, 20 bp, Artificial
  CRISPR gRNA sequence
aaaacctgtgcctacctcca

SEQ ID NO: 767181 - DNA, 20 bp, Artificial
  CRISPR gRNA sequence
acctgtgcctacctccagag

SEQ ID NO: 767182 - DNA, 20 bp, Artificial
  CRISPR gRNA sequence
tgtgcctacctccagagcag

SEQ ID NO: 767183 - DNA, 20 bp, Artificial
  CRISPR gRNA sequence
tacctccagagcagcagaaa

SEQ ID NO: 767184 - DNA, 20 bp, Artificial
  CRISPR gRNA sequence
tccagagcagcagaaaaagc

SEQ ID NO: 767185 - DNA, 20 bp, Artificial
  CRISPR gRNA sequence
gcagcagaaaaagccagttc

SEQ ID NO: 767186 - DNA, 20 bp, Artificial
  CRISPR gRNA sequence
gcagaaaaagccagttctgg

SEQ ID NO: 767187 - DNA, 20 bp, Artificial
  CRISPR gRNA sequence
gaaaaagccagttctggaag

SEQ ID NO: 767188 - DNA, 20 bp, Artificial
  CRISPR gRNA sequence
ccagttctggaagcagacaa

SEQ ID NO: 767189 - DNA, 20 bp, Artificial
  CRISPR gRNA sequence
tctggaagcagacaacagcc

SEQ ID NO: 767190 - DNA, 20 bp, Artificial
  CRISPR gRNA sequence
agcccagctccaccatttgc

SEQ ID NO: 767191 - DNA, 20 bp, Artificial
  CRISPR gRNA sequence
atttgccggctgtgtgtctt

SEQ ID NO: 767192 - DNA, 20 bp, Artificial
  CRISPR gRNA sequence
tttgccggctgtgtgtcttt

SEQ ID NO: 767193 - DNA, 20 bp, Artificial
  CRISPR gRNA sequence
ggcatgtgacttaccctttc

SEQ ID NO: 767194 - DNA, 20 bp, Artificial
  CRISPR gRNA sequence
gcatgtgacttaccctttct

SEQ ID NO: 767195 - DNA, 20 bp, Artificial
  CRISPR gRNA sequence
gacttaccctttctgggcct

SEQ ID NO: 767196 - DNA, 20 bp, Artificial
  CRISPR gRNA sequence
cagtttccccaactgtacaa

SEQ ID NO: 767197 - DNA, 20 bp, Artificial
  CRISPR gRNA sequence
gttaatgataccctacctca

SEQ ID NO: 767198 - DNA, 20 bp, Artificial
  CRISPR gRNA sequence
ttaatgataccctacctcat

SEQ ID NO: 767199 - DNA, 20 bp, Artificial
  CRISPR gRNA sequence
ctacctcataggattactat

SEQ ID NO: 767200 - DNA, 20 bp, Artificial
  CRISPR gRNA sequence
tacctcataggattactatg

SEQ ID NO: 767201 - DNA, 20 bp, Artificial
  CRISPR gRNA sequence
gattactatgaggattacat

SEQ ID NO: 767202 - DNA, 20 bp, Artificial
  CRISPR gRNA sequence
tacatgagataatgtctatt

SEQ ID NO: 767203 - DNA, 20 bp, Artificial
  CRISPR gRNA sequence
gataatgtctatttagcctc

SEQ ID NO: 767204 - DNA, 20 bp, Artificial
  CRISPR gRNA sequence
gaaaacccaatgctcctatc

SEQ ID NO: 767205 - DNA, 20 bp, Artificial
  CRISPR gRNA sequence
gctcctatctggcacactgc

SEQ ID NO: 767206 - DNA, 20 bp, Artificial
  CRISPR gRNA sequence
ctcctatctggcacactgca

SEQ ID NO: 767207 - DNA, 20 bp, Artificial
  CRISPR gRNA sequence
tcctatctggcacactgcaa

SEQ ID NO: 767208 - DNA, 20 bp, Artificial
  CRISPR gRNA sequence
tatctggcacactgcaaggg

SEQ ID NO: 767209 - DNA, 20 bp, Artificial
  CRISPR gRNA sequence
ctggcacactgcaagggcgg

SEQ ID NO: 767210 - DNA, 20 bp, Artificial
  CRISPR gRNA sequence
cactgcaagggcggtagaac

SEQ ID NO: 767211 - DNA, 20 bp, Artificial
  CRISPR gRNA sequence
actgcaagggcggtagaact

SEQ ID NO: 767212 - DNA, 20 bp, Artificial
  CRISPR gRNA sequence
ctgcaagggcggtagaactg

SEQ ID NO: 767213 - DNA, 20 bp, Artificial
  CRISPR gRNA sequence
tgcaagggcggtagaactgg

SEQ ID NO: 767214 - DNA, 20 bp, Artificial
  CRISPR gRNA sequence
aagggcggtagaactggggg

SEQ ID NO: 767215 - DNA, 20 bp, Artificial
  CRISPR gRNA sequence
ggcggtagaactgggggtgg

SEQ ID NO: 767216 - DNA, 20 bp, Artificial
  CRISPR gRNA sequence
gcggtagaactgggggtggc

SEQ ID NO: 767217 - DNA, 20 bp, Artificial
  CRISPR gRNA sequence
tagaactgggggtggcaggc

SEQ ID NO: 767218 - DNA, 20 bp, Artificial
  CRISPR gRNA sequence
agaactgggggtggcaggca

SEQ ID NO: 767219 - DNA, 20 bp, Artificial
  CRISPR gRNA sequence
gaactgggggtggcaggcaa

SEQ ID NO: 767220 - DNA, 20 bp, Artificial
  CRISPR gRNA sequence
gggttgcataactgtacacg

SEQ ID NO: 767221 - DNA, 20 bp, Artificial
  CRISPR gRNA sequence
ctgtacacgtggcccccttc

SEQ ID NO: 767222 - DNA, 20 bp, Artificial
  CRISPR gRNA sequence
tgtacacgtggcccccttcc

SEQ ID NO: 767223 - DNA, 20 bp, Artificial
  CRISPR gRNA sequence
acgtggcccccttccaggtg

SEQ ID NO: 767224 - DNA, 20 bp, Artificial
  CRISPR gRNA sequence
cgtggcccccttccaggtgt

SEQ ID NO: 767225 - DNA, 20 bp, Artificial
  CRISPR gRNA sequence
gtggcccccttccaggtgtg

SEQ ID NO: 767226 - DNA, 20 bp, Artificial
  CRISPR gRNA sequence
ccaggtgtggggtccattct

SEQ ID NO: 767227 - DNA, 20 bp, Artificial
  CRISPR gRNA sequence
ggggtccattctgagccaac

SEQ ID NO: 767228 - DNA, 20 bp, Artificial
  CRISPR gRNA sequence
attctgagccaacaagacca

SEQ ID NO: 767229 - DNA, 20 bp, Artificial
  CRISPR gRNA sequence
ttctgagccaacaagaccaa

SEQ ID NO: 767230 - DNA, 20 bp, Artificial
  CRISPR gRNA sequence
gcaatttctcaaaaatcatg

SEQ ID NO: 767231 - DNA, 20 bp, Artificial
  CRISPR gRNA sequence
ttctcaaaaatcatgtggac

SEQ ID NO: 767232 - DNA, 20 bp, Artificial
  CRISPR gRNA sequence
tcacccctctccccctcccc

SEQ ID NO: 767233 - DNA, 20 bp, Artificial
  CRISPR gRNA sequence
cacccctctccccctcccct

SEQ ID NO: 767234 - DNA, 20 bp, Artificial
  CRISPR gRNA sequence
tctccccctcccctaggccc

SEQ ID NO: 767235 - DNA, 20 bp, Artificial
  CRISPR gRNA sequence
ctccccctcccctaggccct

SEQ ID NO: 767236 - DNA, 20 bp, Artificial
  CRISPR gRNA sequence
gtgtgccctcccccttttgc

SEQ ID NO: 767237 - DNA, 20 bp, Artificial
  CRISPR gRNA sequence
tgccctcccccttttgctgg

SEQ ID NO: 767238 - DNA, 20 bp, Artificial
  CRISPR gRNA sequence
cttccctaacactcctgccc

SEQ ID NO: 767239 - DNA, 20 bp, Artificial
  CRISPR gRNA sequence
ttccctaacactcctgccct

SEQ ID NO: 767240 - DNA, 20 bp, Artificial
  CRISPR gRNA sequence
tccctaacactcctgccctg

SEQ ID NO: 767241 - DNA, 20 bp, Artificial
  CRISPR gRNA sequence
acactcctgccctggggatg

SEQ ID NO: 767242 - DNA, 20 bp, Artificial
  CRISPR gRNA sequence
cactcctgccctggggatgt

SEQ ID NO: 767243 - DNA, 20 bp, Artificial
  CRISPR gRNA sequence
ctgccctggggatgtgggaa

SEQ ID NO: 767244 - DNA, 20 bp, Artificial
  CRISPR gRNA sequence
tgccctggggatgtgggaaa

SEQ ID NO: 767245 - DNA, 20 bp, Artificial
  CRISPR gRNA sequence
ggatgtgggaaaaggacaat

SEQ ID NO: 767246 - DNA, 20 bp, Artificial
  CRISPR gRNA sequence
tgtgggaaaaggacaatgag

SEQ ID NO: 767247 - DNA, 20 bp, Artificial
  CRISPR gRNA sequence
atgagaagtcgccacccact

SEQ ID NO: 767248 - DNA, 20 bp, Artificial
  CRISPR gRNA sequence
gagaagtcgccacccactca

SEQ ID NO: 767249 - DNA, 20 bp, Artificial
  CRISPR gRNA sequence
agaagtcgccacccactcag

SEQ ID NO: 767250 - DNA, 20 bp, Artificial
  CRISPR gRNA sequence
tcgccacccactcagaggat

SEQ ID NO: 767251 - DNA, 20 bp, Artificial
  CRISPR gRNA sequence
ccactcagaggataagctca

SEQ ID NO: 767252 - DNA, 20 bp, Artificial
  CRISPR gRNA sequence
cactcagaggataagctcat

SEQ ID NO: 767253 - DNA, 20 bp, Artificial
  CRISPR gRNA sequence
tcagaggataagctcatggg

SEQ ID NO: 767254 - DNA, 20 bp, Artificial
  CRISPR gRNA sequence
ctttccctgaccctatgact

SEQ ID NO: 767255 - DNA, 20 bp, Artificial
  CRISPR gRNA sequence
gaccctatgactcagatcca

SEQ ID NO: 767256 - DNA, 20 bp, Artificial
  CRISPR gRNA sequence
gactcagatccacagcttaa

SEQ ID NO: 767257 - DNA, 20 bp, Artificial
  CRISPR gRNA sequence
acagcttaacagcccccatg

SEQ ID NO: 767258 - DNA, 20 bp, Artificial
  CRISPR gRNA sequence
cccccatgtggtcataatct

SEQ ID NO: 767259 - DNA, 20 bp, Artificial
  CRISPR gRNA sequence
cccatgtggtcataatctca

SEQ ID NO: 767260 - DNA, 20 bp, Artificial
  CRISPR gRNA sequence
ccatgtggtcataatctcag

SEQ ID NO: 767261 - DNA, 20 bp, Artificial
  CRISPR gRNA sequence
tcataatctcagaggctgct

SEQ ID NO: 767262 - DNA, 20 bp, Artificial
  CRISPR gRNA sequence
tctcagaggctgcttggatt

SEQ ID NO: 767263 - DNA, 20 bp, Artificial
  CRISPR gRNA sequence
gatttggtcatttttctgca

SEQ ID NO: 767264 - DNA, 20 bp, Artificial
  CRISPR gRNA sequence
caaaccccgtatgtgcaacc

SEQ ID NO: 767265 - DNA, 20 bp, Artificial
  CRISPR gRNA sequence
atgtgcaaccaagtaccatc

SEQ ID NO: 767266 - DNA, 20 bp, Artificial
  CRISPR gRNA sequence
acttgttctacaacattttc

SEQ ID NO: 767267 - DNA, 20 bp, Artificial
  CRISPR gRNA sequence
cttgttctacaacattttct

SEQ ID NO: 767268 - DNA, 20 bp, Artificial
  CRISPR gRNA sequence
tgttctacaacattttctag

SEQ ID NO: 767269 - DNA, 20 bp, Artificial
  CRISPR gRNA sequence
acattttctaggagtctctt

SEQ ID NO: 767270 - DNA, 20 bp, Artificial
  CRISPR gRNA sequence
cattttctaggagtctcttt

SEQ ID NO: 767271 - DNA, 20 bp, Artificial
  CRISPR gRNA sequence
aggagtctctttaggtgctg

SEQ ID NO: 767272 - DNA, 20 bp, Artificial
  CRISPR gRNA sequence
tgctgtggaattccaactca

SEQ ID NO: 767273 - DNA, 20 bp, Artificial
  CRISPR gRNA sequence
actgcatctctgactccaaa

SEQ ID NO: 767274 - DNA, 20 bp, Artificial
  CRISPR gRNA sequence
tgactccaaacagcattgtc

SEQ ID NO: 767275 - DNA, 20 bp, Artificial
  CRISPR gRNA sequence
caaactcaaatcctactcca

SEQ ID NO: 767276 - DNA, 20 bp, Artificial
  CRISPR gRNA sequence
aaatcctactccaaagaaca

SEQ ID NO: 767277 - DNA, 20 bp, Artificial
  CRISPR gRNA sequence
agaacaaagatttacccctc

SEQ ID NO: 767278 - DNA, 20 bp, Artificial
  CRISPR gRNA sequence
aacaaagatttacccctcca

SEQ ID NO: 767279 - DNA, 20 bp, Artificial
  CRISPR gRNA sequence
aagatttacccctccagaga

SEQ ID NO: 767280 - DNA, 20 bp, Artificial
  CRISPR gRNA sequence
tacccctccagagaaagcca

SEQ ID NO: 767281 - DNA, 20 bp, Artificial
  CRISPR gRNA sequence
agaaagccaaagtttaatga

SEQ ID NO: 767282 - DNA, 20 bp, Artificial
  CRISPR gRNA sequence
gtttaatgatggaattctca

SEQ ID NO: 767283 - DNA, 20 bp, Artificial
  CRISPR gRNA sequence
tttaatgatggaattctcac

SEQ ID NO: 767284 - DNA, 20 bp, Artificial
  CRISPR gRNA sequence
aatgatggaattctcacagg

SEQ ID NO: 767285 - DNA, 20 bp, Artificial
  CRISPR gRNA sequence
ggaattctcacaggaagttt

SEQ ID NO: 767286 - DNA, 20 bp, Artificial
  CRISPR gRNA sequence
attctcacaggaagtttcag

SEQ ID NO: 767287 - DNA, 20 bp, Artificial
  CRISPR gRNA sequence
gtttcagaagtcaacctaat

SEQ ID NO: 767288 - DNA, 20 bp, Artificial
  CRISPR gRNA sequence
tttcagaagtcaacctaata

SEQ ID NO: 767289 - DNA, 20 bp, Artificial
  CRISPR gRNA sequence
aagtcaacctaataaggaca

SEQ ID NO: 767290 - DNA, 20 bp, Artificial
  CRISPR gRNA sequence
taataaggacacagacaccc

SEQ ID NO: 767291 - DNA, 20 bp, Artificial
  CRISPR gRNA sequence
ataaggacacagacacccca

SEQ ID NO: 767292 - DNA, 20 bp, Artificial
  CRISPR gRNA sequence
taaggacacagacaccccag

SEQ ID NO: 767293 - DNA, 20 bp, Artificial
  CRISPR gRNA sequence
caccccagaggactactttg

SEQ ID NO: 767294 - DNA, 20 bp, Artificial
  CRISPR gRNA sequence
accccagaggactactttga

SEQ ID NO: 767295 - DNA, 20 bp, Artificial
  CRISPR gRNA sequence
ccccagaggactactttgaa

SEQ ID NO: 767296 - DNA, 20 bp, Artificial
  CRISPR gRNA sequence
tgtcctttccataaatatta

SEQ ID NO: 767297 - DNA, 20 bp, Artificial
  CRISPR gRNA sequence
ccataaatattaaagcaccg

SEQ ID NO: 767298 - DNA, 20 bp, Artificial
  CRISPR gRNA sequence
aaatattaaagcaccgaagc

SEQ ID NO: 767299 - DNA, 20 bp, Artificial
  CRISPR gRNA sequence
aaagcaccgaagccagctgt

SEQ ID NO: 767300 - DNA, 20 bp, Artificial
  CRISPR gRNA sequence
aagcaccgaagccagctgtc

SEQ ID NO: 767301 - DNA, 20 bp, Artificial
  CRISPR gRNA sequence
gctgtcaggtatatgaacat

SEQ ID NO: 767302 - DNA, 20 bp, Artificial
  CRISPR gRNA sequence
gtatatgaacatgagacatt

SEQ ID NO: 767303 - DNA, 20 bp, Artificial
  CRISPR gRNA sequence
acattcagccaaccctccat

SEQ ID NO: 767304 - DNA, 20 bp, Artificial
  CRISPR gRNA sequence
cattcagccaaccctccatc

SEQ ID NO: 767305 - DNA, 20 bp, Artificial
  CRISPR gRNA sequence
tcagccaaccctccatcggg

SEQ ID NO: 767306 - DNA, 20 bp, Artificial
  CRISPR gRNA sequence
accctccatcgggtggtgcc

SEQ ID NO: 767307 - DNA, 20 bp, Artificial
  CRISPR gRNA sequence
tccatcgggtggtgcctgga

SEQ ID NO: 767308 - DNA, 20 bp, Artificial
  CRISPR gRNA sequence
catcgggtggtgcctggaca

SEQ ID NO: 767309 - DNA, 20 bp, Artificial
  CRISPR gRNA sequence
gtggtgcctggacagagctg

SEQ ID NO: 767310 - DNA, 20 bp, Artificial
  CRISPR gRNA sequence
ggtgcctggacagagctgaa

SEQ ID NO: 767311 - DNA, 20 bp, Artificial
  CRISPR gRNA sequence
gtgcctggacagagctgaag

SEQ ID NO: 767312 - DNA, 20 bp, Artificial
  CRISPR gRNA sequence
tgcctggacagagctgaaga

SEQ ID NO: 767313 - DNA, 20 bp, Artificial
  CRISPR gRNA sequence
gcctggacagagctgaagag

SEQ ID NO: 767314 - DNA, 20 bp, Artificial
  CRISPR gRNA sequence
ggacagagctgaagagggga

SEQ ID NO: 767315 - DNA, 20 bp, Artificial
  CRISPR gRNA sequence
gacagagctgaagaggggac

SEQ ID NO: 767316 - DNA, 20 bp, Artificial
  CRISPR gRNA sequence
agagctgaagaggggacagg

SEQ ID NO: 767317 - DNA, 20 bp, Artificial
  CRISPR gRNA sequence
gagctgaagaggggacagga

SEQ ID NO: 767318 - DNA, 20 bp, Artificial
  CRISPR gRNA sequence
agaggggacaggaaggaaaa

SEQ ID NO: 767319 - DNA, 20 bp, Artificial
  CRISPR gRNA sequence
gaggggacaggaaggaaaac

SEQ ID NO: 767320 - DNA, 20 bp, Artificial
  CRISPR gRNA sequence
aggggacaggaaggaaaaca

SEQ ID NO: 767321 - DNA, 20 bp, Artificial
  CRISPR gRNA sequence
aggaaggaaaacagggtcct

SEQ ID NO: 767322 - DNA, 20 bp, Artificial
  CRISPR gRNA sequence
tccaacaccccttctcacct

SEQ ID NO: 767323 - DNA, 20 bp, Artificial
  CRISPR gRNA sequence
acctgagacttgcattaaca

SEQ ID NO: 767324 - DNA, 20 bp, Artificial
  CRISPR gRNA sequence
cctgagacttgcattaacac

SEQ ID NO: 767325 - DNA, 20 bp, Artificial
  CRISPR gRNA sequence
acaggctccttacctctgac

SEQ ID NO: 767326 - DNA, 20 bp, Artificial
  CRISPR gRNA sequence
tctgacaagctcatgtctca

SEQ ID NO: 767327 - DNA, 20 bp, Artificial
  CRISPR gRNA sequence
caagctcatgtctcacagca

SEQ ID NO: 767328 - DNA, 20 bp, Artificial
  CRISPR gRNA sequence
aagctcatgtctcacagcac

SEQ ID NO: 767329 - DNA, 20 bp, Artificial
  CRISPR gRNA sequence
gctcatgtctcacagcacag

SEQ ID NO: 767330 - DNA, 20 bp, Artificial
  CRISPR gRNA sequence
tgtctcacagcacaggagtc

SEQ ID NO: 767331 - DNA, 20 bp, Artificial
  CRISPR gRNA sequence
tctcacagcacaggagtcta

SEQ ID NO: 767332 - DNA, 20 bp, Artificial
  CRISPR gRNA sequence
acagcacaggagtctagagt

SEQ ID NO: 767333 - DNA, 20 bp, Artificial
  CRISPR gRNA sequence
cacaggagtctagagtaagc

SEQ ID NO: 767334 - DNA, 20 bp, Artificial
  CRISPR gRNA sequence
ggagtctagagtaagctgga

SEQ ID NO: 767335 - DNA, 20 bp, Artificial
  CRISPR gRNA sequence
gtaagctggaaagcttactg

SEQ ID NO: 767336 - DNA, 20 bp, Artificial
  CRISPR gRNA sequence
taagctggaaagcttactgc

SEQ ID NO: 767337 - DNA, 20 bp, Artificial
  CRISPR gRNA sequence
gctggaaagcttactgcagg

SEQ ID NO: 767338 - DNA, 20 bp, Artificial
  CRISPR gRNA sequence
ctggaaagcttactgcaggc

SEQ ID NO: 767339 - DNA, 20 bp, Artificial
  CRISPR gRNA sequence
ggaaagcttactgcaggcag

SEQ ID NO: 767340 - DNA, 20 bp, Artificial
  CRISPR gRNA sequence
ctgcaggcaggagaaaccac

SEQ ID NO: 767341 - DNA, 20 bp, Artificial
  CRISPR gRNA sequence
gaaaccaccagtaatgccat

SEQ ID NO: 767342 - DNA, 20 bp, Artificial
  CRISPR gRNA sequence
aaaccaccagtaatgccata

SEQ ID NO: 767343 - DNA, 20 bp, Artificial
  CRISPR gRNA sequence
ccagtaatgccataaggaca

SEQ ID NO: 767344 - DNA, 20 bp, Artificial
  CRISPR gRNA sequence
gtaatgccataaggacatgg

SEQ ID NO: 767345 - DNA, 20 bp, Artificial
  CRISPR gRNA sequence
aaggacatggaagaactcca

SEQ ID NO: 767346 - DNA, 20 bp, Artificial
  CRISPR gRNA sequence
aggacatggaagaactccaa

SEQ ID NO: 767347 - DNA, 20 bp, Artificial
  CRISPR gRNA sequence
catggaagaactccaaaggt

SEQ ID NO: 767348 - DNA, 20 bp, Artificial
  CRISPR gRNA sequence
agaactccaaaggtcagtca

SEQ ID NO: 767349 - DNA, 20 bp, Artificial
  CRISPR gRNA sequence
gaactccaaaggtcagtcat

SEQ ID NO: 767350 - DNA, 20 bp, Artificial
  CRISPR gRNA sequence
gggaccctgactgcatcact

SEQ ID NO: 767351 - DNA, 20 bp, Artificial
  CRISPR gRNA sequence
ggaccctgactgcatcactg

SEQ ID NO: 767352 - DNA, 20 bp, Artificial
  CRISPR gRNA sequence
atcactgaggccacttaatg

SEQ ID NO: 767353 - DNA, 20 bp, Artificial
  CRISPR gRNA sequence
tcactgaggccacttaatgc

SEQ ID NO: 767354 - DNA, 20 bp, Artificial
  CRISPR gRNA sequence
ggccacttaatgcaggaacg

SEQ ID NO: 767355 - DNA, 20 bp, Artificial
  CRISPR gRNA sequence
ggaacgaagctctctcccgc

SEQ ID NO: 767356 - DNA, 20 bp, Artificial
  CRISPR gRNA sequence
ccccttgccatacaacccct

SEQ ID NO: 767357 - DNA, 20 bp, Artificial
  CRISPR gRNA sequence
aacccctcagaacaaaaact

SEQ ID NO: 767358 - DNA, 20 bp, Artificial
  CRISPR gRNA sequence
acccctcagaacaaaaactg

SEQ ID NO: 767359 - DNA, 20 bp, Artificial
  CRISPR gRNA sequence
agaacaaaaactgaggtcca

SEQ ID NO: 767360 - DNA, 20 bp, Artificial
  CRISPR gRNA sequence
gaacaaaaactgaggtccac

SEQ ID NO: 767361 - DNA, 20 bp, Artificial
  CRISPR gRNA sequence
aacaaaaactgaggtccaca

SEQ ID NO: 767362 - DNA, 20 bp, Artificial
  CRISPR gRNA sequence
aggtccacagggctgaccca

SEQ ID NO: 767363 - DNA, 20 bp, Artificial
  CRISPR gRNA sequence
agggctgacccaaagtcatg

SEQ ID NO: 767364 - DNA, 20 bp, Artificial
  CRISPR gRNA sequence
gggctgacccaaagtcatga

SEQ ID NO: 767365 - DNA, 20 bp, Artificial
  CRISPR gRNA sequence
aaggaaaatttcattcacat

SEQ ID NO: 767366 - DNA, 20 bp, Artificial
  CRISPR gRNA sequence
aggaaaatttcattcacatc

SEQ ID NO: 767367 - DNA, 20 bp, Artificial
  CRISPR gRNA sequence
tcattcacatcaggatactc

SEQ ID NO: 767368 - DNA, 20 bp, Artificial
  CRISPR gRNA sequence
tcacatcaggatactccagt

SEQ ID NO: 767369 - DNA, 20 bp, Artificial
  CRISPR gRNA sequence
aggatactccagtaagctga

SEQ ID NO: 767370 - DNA, 20 bp, Artificial
  CRISPR gRNA sequence
gtgacgtatgtaaatttcca

SEQ ID NO: 767371 - DNA, 20 bp, Artificial
  CRISPR gRNA sequence
atgtaaatttccacggtcaa

SEQ ID NO: 767372 - DNA, 20 bp, Artificial
  CRISPR gRNA sequence
ccacggtcaacagttaccct

SEQ ID NO: 767373 - DNA, 20 bp, Artificial
  CRISPR gRNA sequence
tcaacagttaccctaagtgt

SEQ ID NO: 767374 - DNA, 20 bp, Artificial
  CRISPR gRNA sequence
aagtgttagtgcttaatctc

SEQ ID NO: 767375 - DNA, 20 bp, Artificial
  CRISPR gRNA sequence
gtgcttaatctcaagaactc

SEQ ID NO: 767376 - DNA, 20 bp, Artificial
  CRISPR gRNA sequence
atctcaagaactccagatat

SEQ ID NO: 767377 - DNA, 20 bp, Artificial
  CRISPR gRNA sequence
tctcaagaactccagatatc

SEQ ID NO: 767378 - DNA, 20 bp, Artificial
  CRISPR gRNA sequence
ccaaaatactcccttgaaat

SEQ ID NO: 767379 - DNA, 20 bp, Artificial
  CRISPR gRNA sequence
atgagccacttcatacccta

SEQ ID NO: 767380 - DNA, 20 bp, Artificial
  CRISPR gRNA sequence
cttcataccctacagcccca

SEQ ID NO: 767381 - DNA, 20 bp, Artificial
  CRISPR gRNA sequence
cctccatcctgccctgcact

SEQ ID NO: 767382 - DNA, 20 bp, Artificial
  CRISPR gRNA sequence
atcctgccctgcactcagat

SEQ ID NO: 767383 - DNA, 20 bp, Artificial
  CRISPR gRNA sequence
ctcagatcagctcaacccat

SEQ ID NO: 767384 - DNA, 20 bp, Artificial
  CRISPR gRNA sequence
gatcagctcaacccatcgga

SEQ ID NO: 767385 - DNA, 20 bp, Artificial
  CRISPR gRNA sequence
atcagctcaacccatcggac

SEQ ID NO: 767386 - DNA, 20 bp, Artificial
  CRISPR gRNA sequence
ctcaacccatcggacaggtt

SEQ ID NO: 767387 - DNA, 20 bp, Artificial
  CRISPR gRNA sequence
atcggacaggtttagacttc

SEQ ID NO: 767388 - DNA, 20 bp, Artificial
  CRISPR gRNA sequence
acaggtttagacttcaagtt

SEQ ID NO: 767389 - DNA, 20 bp, Artificial
  CRISPR gRNA sequence
tagacttcaagtttagactt

SEQ ID NO: 767390 - DNA, 20 bp, Artificial
  CRISPR gRNA sequence
gtttagacttcagttcccct

SEQ ID NO: 767391 - DNA, 20 bp, Artificial
  CRISPR gRNA sequence
caaactgtcccacctatttg

SEQ ID NO: 767392 - DNA, 20 bp, Artificial
  CRISPR gRNA sequence
tttgcagtcccccacactac

SEQ ID NO: 767393 - DNA, 20 bp, Artificial
  CRISPR gRNA sequence
ttgcagtcccccacactaca

SEQ ID NO: 767394 - DNA, 20 bp, Artificial
  CRISPR gRNA sequence
cagtcccccacactacaagg

SEQ ID NO: 767395 - DNA, 20 bp, Artificial
  CRISPR gRNA sequence
agtcccccacactacaagga

SEQ ID NO: 767396 - DNA, 20 bp, Artificial
  CRISPR gRNA sequence
acactacaaggaaggctgca

SEQ ID NO: 767397 - DNA, 20 bp, Artificial
  CRISPR gRNA sequence
caaggaaggctgcacagcat

SEQ ID NO: 767398 - DNA, 20 bp, Artificial
  CRISPR gRNA sequence
ctgcacagcatcagatttcc

SEQ ID NO: 767399 - DNA, 20 bp, Artificial
  CRISPR gRNA sequence
tgcacagcatcagatttcct

SEQ ID NO: 767400 - DNA, 20 bp, Artificial
  CRISPR gRNA sequence
gcacagcatcagatttccta

SEQ ID NO: 767401 - DNA, 20 bp, Artificial
  CRISPR gRNA sequence
tcagatttcctagggacttc

SEQ ID NO: 767402 - DNA, 20 bp, Artificial
  CRISPR gRNA sequence
cagatttcctagggacttct

SEQ ID NO: 767403 - DNA, 20 bp, Artificial
  CRISPR gRNA sequence
gatttcctagggacttctgg

SEQ ID NO: 767404 - DNA, 20 bp, Artificial
  CRISPR gRNA sequence
atttcctagggacttctggg

SEQ ID NO: 767405 - DNA, 20 bp, Artificial
  CRISPR gRNA sequence
cctagggacttctgggaggc

SEQ ID NO: 767406 - DNA, 20 bp, Artificial
  CRISPR gRNA sequence
tagggacttctgggaggcca

SEQ ID NO: 767407 - DNA, 20 bp, Artificial
  CRISPR gRNA sequence
agggacttctgggaggccag

SEQ ID NO: 767408 - DNA, 20 bp, Artificial
  CRISPR gRNA sequence
gggacttctgggaggccaga

SEQ ID NO: 767409 - DNA, 20 bp, Artificial
  CRISPR gRNA sequence
tctgggaggccagagggaac

SEQ ID NO: 767410 - DNA, 20 bp, Artificial
  CRISPR gRNA sequence
tgggaggccagagggaacta

SEQ ID NO: 767411 - DNA, 20 bp, Artificial
  CRISPR gRNA sequence
gggaggccagagggaactag

SEQ ID NO: 767412 - DNA, 20 bp, Artificial
  CRISPR gRNA sequence
gaggccagagggaactagag

SEQ ID NO: 767413 - DNA, 20 bp, Artificial
  CRISPR gRNA sequence
aggccagagggaactagagg

SEQ ID NO: 767414 - DNA, 20 bp, Artificial
  CRISPR gRNA sequence
agaggaggccgcactaaata

SEQ ID NO: 767415 - DNA, 20 bp, Artificial
  CRISPR gRNA sequence
ctaaataaagaactctctta

SEQ ID NO: 767416 - DNA, 20 bp, Artificial
  CRISPR gRNA sequence
aaagaactctcttaaagaca

SEQ ID NO: 767417 - DNA, 20 bp, Artificial
  CRISPR gRNA sequence
gaactctcttaaagacaaag

SEQ ID NO: 767418 - DNA, 20 bp, Artificial
  CRISPR gRNA sequence
agcttcattactttctaata

SEQ ID NO: 767419 - DNA, 20 bp, Artificial
  CRISPR gRNA sequence
aatatagaaactaactgctg

SEQ ID NO: 767420 - DNA, 20 bp, Artificial
  CRISPR gRNA sequence
actgctgaagacatgcttat

SEQ ID NO: 767421 - DNA, 20 bp, Artificial
  CRISPR gRNA sequence
tgaagacatgcttataagaa

SEQ ID NO: 767422 - DNA, 20 bp, Artificial
  CRISPR gRNA sequence
gaagacatgcttataagaaa

SEQ ID NO: 767423 - DNA, 20 bp, Artificial
  CRISPR gRNA sequence
tgcttataagaaaaggaccc

SEQ ID NO: 767424 - DNA, 20 bp, Artificial
  CRISPR gRNA sequence
gcttataagaaaaggacccc

SEQ ID NO: 767425 - DNA, 20 bp, Artificial
  CRISPR gRNA sequence
aaggaccccgggctttaatg

SEQ ID NO: 767426 - DNA, 20 bp, Artificial
  CRISPR gRNA sequence
ggaccccgggctttaatgaa

SEQ ID NO: 767427 - DNA, 20 bp, Artificial
  CRISPR gRNA sequence
ccgggctttaatgaagagat

SEQ ID NO: 767428 - DNA, 20 bp, Artificial
  CRISPR gRNA sequence
aattatccacatccaatttg

SEQ ID NO: 767429 - DNA, 20 bp, Artificial
  CRISPR gRNA sequence
attatccacatccaatttga

SEQ ID NO: 767430 - DNA, 20 bp, Artificial
  CRISPR gRNA sequence
gtaaatcgtttttctaaatt

SEQ ID NO: 767431 - DNA, 20 bp, Artificial
  CRISPR gRNA sequence
atttgcttaatgttttccct

SEQ ID NO: 767432 - DNA, 20 bp, Artificial
  CRISPR gRNA sequence
ttaatgttttccctcagtga

SEQ ID NO: 767433 - DNA, 20 bp, Artificial
  CRISPR gRNA sequence
cagtgatagatcccatatct

SEQ ID NO: 767434 - DNA, 20 bp, Artificial
  CRISPR gRNA sequence
atctatcacgcttttctcat

SEQ ID NO: 767435 - DNA, 20 bp, Artificial
  CRISPR gRNA sequence
ctatcacgcttttctcatta

SEQ ID NO: 767436 - DNA, 20 bp, Artificial
  CRISPR gRNA sequence
tcacgcttttctcattagag

SEQ ID NO: 767437 - DNA, 20 bp, Artificial
  CRISPR gRNA sequence
cacgcttttctcattagagc

SEQ ID NO: 767438 - DNA, 20 bp, Artificial
  CRISPR gRNA sequence
ttttctcattagagcaggtt

SEQ ID NO: 767439 - DNA, 20 bp, Artificial
  CRISPR gRNA sequence
tcattagagcaggtttggct

SEQ ID NO: 767440 - DNA, 20 bp, Artificial
  CRISPR gRNA sequence
tagaaataaatcccctgcct

SEQ ID NO: 767441 - DNA, 20 bp, Artificial
  CRISPR gRNA sequence
agaaataaatcccctgcctt

SEQ ID NO: 767442 - DNA, 20 bp, Artificial
  CRISPR gRNA sequence
tgccaaacctgccaattcgc

SEQ ID NO: 767443 - DNA, 20 bp, Artificial
  CRISPR gRNA sequence
ctgccaattcgctagctaaa

SEQ ID NO: 767444 - DNA, 20 bp, Artificial
  CRISPR gRNA sequence
attcgctagctaaacggtcg

SEQ ID NO: 767445 - DNA, 20 bp, Artificial
  CRISPR gRNA sequence
ttcgctagctaaacggtcgc

SEQ ID NO: 767446 - DNA, 20 bp, Artificial
  CRISPR gRNA sequence
tcgctagctaaacggtcgca

SEQ ID NO: 767447 - DNA, 20 bp, Artificial
  CRISPR gRNA sequence
gctagctaaacggtcgcagg

SEQ ID NO: 767448 - DNA, 20 bp, Artificial
  CRISPR gRNA sequence
ctagctaaacggtcgcaggg

SEQ ID NO: 767449 - DNA, 20 bp, Artificial
  CRISPR gRNA sequence
tagctaaacggtcgcaggga

SEQ ID NO: 767450 - DNA, 20 bp, Artificial
  CRISPR gRNA sequence
aacggtcgcagggagggccc

SEQ ID NO: 767451 - DNA, 20 bp, Artificial
  CRISPR gRNA sequence
acggtcgcagggagggccct

SEQ ID NO: 767452 - DNA, 20 bp, Artificial
  CRISPR gRNA sequence
gcagggagggccctgggcgc

SEQ ID NO: 767453 - DNA, 20 bp, Artificial
  CRISPR gRNA sequence
gaattcaatcccctcccttc

SEQ ID NO: 767454 - DNA, 20 bp, Artificial
  CRISPR gRNA sequence
ccttctagtgtgcccccact

SEQ ID NO: 767455 - DNA, 20 bp, Artificial
  CRISPR gRNA sequence
cttctagtgtgcccccactc

SEQ ID NO: 767456 - DNA, 20 bp, Artificial
  CRISPR gRNA sequence
ttctagtgtgcccccactcg

SEQ ID NO: 767457 - DNA, 20 bp, Artificial
  CRISPR gRNA sequence
acctcaccccccacctccct

SEQ ID NO: 767458 - DNA, 20 bp, Artificial
  CRISPR gRNA sequence
cctcaccccccacctccctg

SEQ ID NO: 767459 - DNA, 20 bp, Artificial
  CRISPR gRNA sequence
ccacctccctgaggcttccc

SEQ ID NO: 767460 - DNA, 20 bp, Artificial
  CRISPR gRNA sequence
cccaacacctattcaccccg

SEQ ID NO: 767461 - DNA, 20 bp, Artificial
  CRISPR gRNA sequence
attcaccccgtggcccctgc

SEQ ID NO: 767462 - DNA, 20 bp, Artificial
  CRISPR gRNA sequence
ccgtctctacctgtccttcc

SEQ ID NO: 767463 - DNA, 20 bp, Artificial
  CRISPR gRNA sequence
ctgacccctcatgctgccca

SEQ ID NO: 767464 - DNA, 20 bp, Artificial
  CRISPR gRNA sequence
atgctgcccacggctgcctg

SEQ ID NO: 767465 - DNA, 20 bp, Artificial
  CRISPR gRNA sequence
ctgcccacggctgcctgtgg

SEQ ID NO: 767466 - DNA, 20 bp, Artificial
  CRISPR gRNA sequence
ggctgcctgtggaagtgcac

SEQ ID NO: 767467 - DNA, 20 bp, Artificial
  CRISPR gRNA sequence
cgcccacaccttcgccctgc

SEQ ID NO: 767468 - DNA, 20 bp, Artificial
  CRISPR gRNA sequence
gcccacaccttcgccctgct

SEQ ID NO: 767469 - DNA, 20 bp, Artificial
  CRISPR gRNA sequence
cttcgccctgctgggccctg

SEQ ID NO: 767470 - DNA, 20 bp, Artificial
  CRISPR gRNA sequence
tcgccctgctgggccctgca

SEQ ID NO: 767471 - DNA, 20 bp, Artificial
  CRISPR gRNA sequence
ccctgctgggccctgcagag

SEQ ID NO: 767472 - DNA, 20 bp, Artificial
  CRISPR gRNA sequence
cctccccgccgctcccctcc

SEQ ID NO: 767473 - DNA, 20 bp, Artificial
  CRISPR gRNA sequence
tccccgccgctcccctcccg

SEQ ID NO: 767474 - DNA, 20 bp, Artificial
  CRISPR gRNA sequence
cgccgctcccctcccggagc

SEQ ID NO: 767475 - DNA, 20 bp, Artificial
  CRISPR gRNA sequence
gccgctcccctcccggagct

SEQ ID NO: 767476 - DNA, 20 bp, Artificial
  CRISPR gRNA sequence
gagctgggcgttttcctctg

SEQ ID NO: 767477 - DNA, 20 bp, Artificial
  CRISPR gRNA sequence
agctgggcgttttcctctgc

SEQ ID NO: 767478 - DNA, 20 bp, Artificial
  CRISPR gRNA sequence
cgttttcctctgcaggaccc

SEQ ID NO: 767479 - DNA, 20 bp, Artificial
  CRISPR gRNA sequence
ccgagaccccgctaacctcc

SEQ ID NO: 767480 - DNA, 20 bp, Artificial
  CRISPR gRNA sequence
ccccgctaacctcccagcgc

SEQ ID NO: 767481 - DNA, 20 bp, Artificial
  CRISPR gRNA sequence
gctaacctcccagcgccggc

SEQ ID NO: 767482 - DNA, 20 bp, Artificial
  CRISPR gRNA sequence
aacctcccagcgccggccgg

SEQ ID NO: 767483 - DNA, 20 bp, Artificial
  CRISPR gRNA sequence
cgccggccggtggcttcgtt

SEQ ID NO: 767484 - DNA, 20 bp, Artificial
  CRISPR gRNA sequence
ggcttcgttaagcttcaaca

SEQ ID NO: 767485 - DNA, 20 bp, Artificial
  CRISPR gRNA sequence
gcttcgttaagcttcaacac

SEQ ID NO: 767486 - DNA, 20 bp, Artificial
  CRISPR gRNA sequence
cgttaagcttcaacacggga

SEQ ID NO: 767487 - DNA, 20 bp, Artificial
  CRISPR gRNA sequence
atctgcccccatgcccgctc

SEQ ID NO: 767488 - DNA, 20 bp, Artificial
  CRISPR gRNA sequence
ccccatgcccgctccagacc

SEQ ID NO: 767489 - DNA, 20 bp, Artificial
  CRISPR gRNA sequence
cccatgcccgctccagaccc

SEQ ID NO: 767490 - DNA, 20 bp, Artificial
  CRISPR gRNA sequence
ccatgcccgctccagacccg

SEQ ID NO: 767491 - DNA, 20 bp, Artificial
  CRISPR gRNA sequence
tccagacccggggcctgcaa

SEQ ID NO: 767492 - DNA, 20 bp, Artificial
  CRISPR gRNA sequence
caaaagcgcattcacccacc

SEQ ID NO: 767493 - DNA, 20 bp, Artificial
  CRISPR gRNA sequence
gcgcattcacccacccggcc

SEQ ID NO: 767494 - DNA, 20 bp, Artificial
  CRISPR gRNA sequence
cacccacccggcccggtccg

SEQ ID NO: 767495 - DNA, 20 bp, Artificial
  CRISPR gRNA sequence
ccggcccggtccgcagcttc

SEQ ID NO: 767496 - DNA, 20 bp, Artificial
  CRISPR gRNA sequence
cggcccggtccgcagcttcc

SEQ ID NO: 767497 - DNA, 20 bp, Artificial
  CRISPR gRNA sequence
ggcccggtccgcagcttccg

SEQ ID NO: 767498 - DNA, 20 bp, Artificial
  CRISPR gRNA sequence
tccgcagcttccggggtctg

SEQ ID NO: 767499 - DNA, 20 bp, Artificial
  CRISPR gRNA sequence
ccgcagcttccggggtctgc

SEQ ID NO: 767500 - DNA, 20 bp, Artificial
  CRISPR gRNA sequence
tccggggtctgcaggtccga

SEQ ID NO: 767501 - DNA, 20 bp, Artificial
  CRISPR gRNA sequence
tctgcaggtccgacggcgcc

SEQ ID NO: 767502 - DNA, 20 bp, Artificial
  CRISPR gRNA sequence
ctgcaggtccgacggcgccc

SEQ ID NO: 767503 - DNA, 20 bp, Artificial
  CRISPR gRNA sequence
gcccgggcccctctcaaccc

SEQ ID NO: 767504 - DNA, 20 bp, Artificial
  CRISPR gRNA sequence
cccgggcccctctcaacccg

SEQ ID NO: 767505 - DNA, 20 bp, Artificial
  CRISPR gRNA sequence
ggcccctctcaacccgagga

SEQ ID NO: 767506 - DNA, 20 bp, Artificial
  CRISPR gRNA sequence
gcccctctcaacccgaggaa

SEQ ID NO: 767507 - DNA, 20 bp, Artificial
  CRISPR gRNA sequence
cccctctcaacccgaggaaa

SEQ ID NO: 767508 - DNA, 20 bp, Artificial
  CRISPR gRNA sequence
ccctctcaacccgaggaaag

SEQ ID NO: 767509 - DNA, 20 bp, Artificial
  CRISPR gRNA sequence
cctctcaacccgaggaaagg

SEQ ID NO: 767510 - DNA, 20 bp, Artificial
  CRISPR gRNA sequence
ctctcaacccgaggaaaggg

SEQ ID NO: 767511 - DNA, 20 bp, Artificial
  CRISPR gRNA sequence
tcaacccgaggaaagggggg

SEQ ID NO: 767512 - DNA, 20 bp, Artificial
  CRISPR gRNA sequence
caacccgaggaaaggggggc

SEQ ID NO: 767513 - DNA, 20 bp, Artificial
  CRISPR gRNA sequence
aacccgaggaaaggggggcg

SEQ ID NO: 767514 - DNA, 20 bp, Artificial
  CRISPR gRNA sequence
ccgaggaaaggggggcgggg

SEQ ID NO: 767515 - DNA, 20 bp, Artificial
  CRISPR gRNA sequence
cgaggaaaggggggcggggt

SEQ ID NO: 767516 - DNA, 20 bp, Artificial
  CRISPR gRNA sequence
aaggggggcggggtaggatc

SEQ ID NO: 767517 - DNA, 20 bp, Artificial
  CRISPR gRNA sequence
aggggggcggggtaggatcc

SEQ ID NO: 767518 - DNA, 20 bp, Artificial
  CRISPR gRNA sequence
gggggcggggtaggatccgg

SEQ ID NO: 767519 - DNA, 20 bp, Artificial
  CRISPR gRNA sequence
gggtaggatccgggagcccc

SEQ ID NO: 767520 - DNA, 20 bp, Artificial
  CRISPR gRNA sequence
cgggagcccccagctctccg

SEQ ID NO: 767521 - DNA, 20 bp, Artificial
  CRISPR gRNA sequence
gggagcccccagctctccgc

SEQ ID NO: 767522 - DNA, 20 bp, Artificial
  CRISPR gRNA sequence
ccagctctccgcgggcccca

SEQ ID NO: 767523 - DNA, 20 bp, Artificial
  CRISPR gRNA sequence
tctccgcgggccccacagcc

SEQ ID NO: 767524 - DNA, 20 bp, Artificial
  CRISPR gRNA sequence
ctccgcgggccccacagccc

SEQ ID NO: 767525 - DNA, 20 bp, Artificial
  CRISPR gRNA sequence
tccgcgggccccacagccca

SEQ ID NO: 767526 - DNA, 20 bp, Artificial
  CRISPR gRNA sequence
gcgggccccacagcccaggg

SEQ ID NO: 767527 - DNA, 20 bp, Artificial
  CRISPR gRNA sequence
cgggccccacagcccagggc

SEQ ID NO: 767528 - DNA, 20 bp, Artificial
  CRISPR gRNA sequence
ggccccacagcccagggcag

SEQ ID NO: 767529 - DNA, 20 bp, Artificial
  CRISPR gRNA sequence
gccccacagcccagggcagg

SEQ ID NO: 767530 - DNA, 20 bp, Artificial
  CRISPR gRNA sequence
ccccacagcccagggcagga

SEQ ID NO: 767531 - DNA, 20 bp, Artificial
  CRISPR gRNA sequence
cccacagcccagggcaggag

SEQ ID NO: 767532 - DNA, 20 bp, Artificial
  CRISPR gRNA sequence
cagggcaggaggggcgcccg

SEQ ID NO: 767533 - DNA, 20 bp, Artificial
  CRISPR gRNA sequence
ggaggggcgcccgcggttcc

SEQ ID NO: 767534 - DNA, 20 bp, Artificial
  CRISPR gRNA sequence
gaggggcgcccgcggttccc

SEQ ID NO: 767535 - DNA, 20 bp, Artificial
  CRISPR gRNA sequence
ggttcccgggactcctgtgc

SEQ ID NO: 767536 - DNA, 20 bp, Artificial
  CRISPR gRNA sequence
gttcccgggactcctgtgcg

SEQ ID NO: 767537 - DNA, 20 bp, Artificial
  CRISPR gRNA sequence
ttcccgggactcctgtgcga

SEQ ID NO: 767538 - DNA, 20 bp, Artificial
  CRISPR gRNA sequence
tcccgggactcctgtgcgag

SEQ ID NO: 767539 - DNA, 20 bp, Artificial
  CRISPR gRNA sequence
cccgggactcctgtgcgagg

SEQ ID NO: 767540 - DNA, 20 bp, Artificial
  CRISPR gRNA sequence
ccgggactcctgtgcgaggg

SEQ ID NO: 767541 - DNA, 20 bp, Artificial
  CRISPR gRNA sequence
cctgtgcgaggggggccgcc

SEQ ID NO: 767542 - DNA, 20 bp, Artificial
  CRISPR gRNA sequence
cgaggggggccgcccggacc

SEQ ID NO: 767543 - DNA, 20 bp, Artificial
  CRISPR gRNA sequence
gaggggggccgcccggacct

SEQ ID NO: 767544 - DNA, 20 bp, Artificial
  CRISPR gRNA sequence
aggggggccgcccggacctg

SEQ ID NO: 767545 - DNA, 20 bp, Artificial
  CRISPR gRNA sequence
ggggggccgcccggacctgg

SEQ ID NO: 767546 - DNA, 20 bp, Artificial
  CRISPR gRNA sequence
ggggccgcccggacctgggg

SEQ ID NO: 767547 - DNA, 20 bp, Artificial
  CRISPR gRNA sequence
gggccgcccggacctggggg

SEQ ID NO: 767548 - DNA, 20 bp, Artificial
  CRISPR gRNA sequence
ggccgcccggacctggggga

SEQ ID NO: 767549 - DNA, 20 bp, Artificial
  CRISPR gRNA sequence
cgcccggacctgggggaggg

SEQ ID NO: 767550 - DNA, 20 bp, Artificial
  CRISPR gRNA sequence
gcccggacctgggggagggc

SEQ ID NO: 767551 - DNA, 20 bp, Artificial
  CRISPR gRNA sequence
cccggacctgggggagggca

SEQ ID NO: 767552 - DNA, 20 bp, Artificial
  CRISPR gRNA sequence
ccggacctgggggagggcag

SEQ ID NO: 767553 - DNA, 20 bp, Artificial
  CRISPR gRNA sequence
ggacctgggggagggcaggg

SEQ ID NO: 767554 - DNA, 20 bp, Artificial
  CRISPR gRNA sequence
cctgggggagggcaggggag

SEQ ID NO: 767555 - DNA, 20 bp, Artificial
  CRISPR gRNA sequence
ctgggggagggcaggggagc

SEQ ID NO: 767556 - DNA, 20 bp, Artificial
  CRISPR gRNA sequence
gggggagggcaggggagcag

SEQ ID NO: 767557 - DNA, 20 bp, Artificial
  CRISPR gRNA sequence
agggcaggggagcaggagcc

SEQ ID NO: 767558 - DNA, 20 bp, Artificial
  CRISPR gRNA sequence
ggcaggggagcaggagcccg

SEQ ID NO: 767559 - DNA, 20 bp, Artificial
  CRISPR gRNA sequence
gcaggggagcaggagcccgg

SEQ ID NO: 767560 - DNA, 20 bp, Artificial
  CRISPR gRNA sequence
caggggagcaggagcccgga

SEQ ID NO: 767561 - DNA, 20 bp, Artificial
  CRISPR gRNA sequence
gggagcaggagcccggaggg

SEQ ID NO: 767562 - DNA, 20 bp, Artificial
  CRISPR gRNA sequence
ggagcaggagcccggaggga

SEQ ID NO: 767563 - DNA, 20 bp, Artificial
  CRISPR gRNA sequence
cggagggaaggcgccctgct

SEQ ID NO: 767564 - DNA, 20 bp, Artificial
  CRISPR gRNA sequence
ggcgccctgctcagctcctg

SEQ ID NO: 767565 - DNA, 20 bp, Artificial
  CRISPR gRNA sequence
tgctcagctcctgcagccct

SEQ ID NO: 767566 - DNA, 20 bp, Artificial
  CRISPR gRNA sequence
tcagctcctgcagccctgag

SEQ ID NO: 767567 - DNA, 20 bp, Artificial
  CRISPR gRNA sequence
cagctcctgcagccctgagc

SEQ ID NO: 767568 - DNA, 20 bp, Artificial
  CRISPR gRNA sequence
cagccctgagcgggaacgtg

SEQ ID NO: 767569 - DNA, 20 bp, Artificial
  CRISPR gRNA sequence
cgggaacgtgcggacctccg

SEQ ID NO: 767570 - DNA, 20 bp, Artificial
  CRISPR gRNA sequence
gggaacgtgcggacctccgc

SEQ ID NO: 767571 - DNA, 20 bp, Artificial
  CRISPR gRNA sequence
gtgcggacctccgcgggatc

SEQ ID NO: 767572 - DNA, 20 bp, Artificial
  CRISPR gRNA sequence
tgcggacctccgcgggatcc

SEQ ID NO: 767573 - DNA, 20 bp, Artificial
  CRISPR gRNA sequence
acctccgcgggatccaggcc

SEQ ID NO: 767574 - DNA, 20 bp, Artificial
  CRISPR gRNA sequence
cgggatccaggcccggcccg

SEQ ID NO: 767575 - DNA, 20 bp, Artificial
  CRISPR gRNA sequence
gatccaggcccggcccgcag

SEQ ID NO: 767576 - DNA, 20 bp, Artificial
  CRISPR gRNA sequence
ggcccggcccgcagcagaca

SEQ ID NO: 767577 - DNA, 20 bp, Artificial
  CRISPR gRNA sequence
gcccggcccgcagcagacaa

SEQ ID NO: 767578 - DNA, 20 bp, Artificial
  CRISPR gRNA sequence
ccgcgccgcccgcgccacgc

SEQ ID NO: 767579 - DNA, 20 bp, Artificial
  CRISPR gRNA sequence
tcaccgcgccgcgccgactc

SEQ ID NO: 767580 - DNA, 20 bp, Artificial
  CRISPR gRNA sequence
caccgcgccgcgccgactct

SEQ ID NO: 767581 - DNA, 20 bp, Artificial
  CRISPR gRNA sequence
gccgcgccgactctgggact

SEQ ID NO: 767582 - DNA, 20 bp, Artificial
  CRISPR gRNA sequence
ccgcgccgactctgggactc

SEQ ID NO: 767583 - DNA, 20 bp, Artificial
  CRISPR gRNA sequence
cgcgccgactctgggactca

SEQ ID NO: 767584 - DNA, 20 bp, Artificial
  CRISPR gRNA sequence
gactctgggactcagggacg

SEQ ID NO: 767585 - DNA, 20 bp, Artificial
  CRISPR gRNA sequence
tgggactcagggacgcggcc

SEQ ID NO: 767586 - DNA, 20 bp, Artificial
  CRISPR gRNA sequence
ctcagggacgcggcccagcc

SEQ ID NO: 767587 - DNA, 20 bp, Artificial
  CRISPR gRNA sequence
ggacgcggcccagcctggct

SEQ ID NO: 767588 - DNA, 20 bp, Artificial
  CRISPR gRNA sequence
gcctggctcagtcgccgccg

SEQ ID NO: 767589 - DNA, 20 bp, Artificial
  CRISPR gRNA sequence
ggctcagtcgccgccgcagc

SEQ ID NO: 767590 - DNA, 20 bp, Artificial
  CRISPR gRNA sequence
gctcagtcgccgccgcagcg

SEQ ID NO: 767591 - DNA, 20 bp, Artificial
  CRISPR gRNA sequence
gtcgccgccgcagcgaggcc

SEQ ID NO: 767592 - DNA, 20 bp, Artificial
  CRISPR gRNA sequence
gcagcgaggcccggcccgaa

SEQ ID NO: 767593 - DNA, 20 bp, Artificial
  CRISPR gRNA sequence
cagcgaggcccggcccgaat

SEQ ID NO: 767594 - DNA, 20 bp, Artificial
  CRISPR gRNA sequence
agcgaggcccggcccgaatg

SEQ ID NO: 767595 - DNA, 20 bp, Artificial
  CRISPR gRNA sequence
gcgaggcccggcccgaatgg

SEQ ID NO: 767596 - DNA, 20 bp, Artificial
  CRISPR gRNA sequence
ggcccggcccgaatgggggc

SEQ ID NO: 767597 - DNA, 20 bp, Artificial
  CRISPR gRNA sequence
gcccggcccgaatgggggcc

SEQ ID NO: 767598 - DNA, 20 bp, Artificial
  CRISPR gRNA sequence
cccggcccgaatgggggccg

SEQ ID NO: 767599 - DNA, 20 bp, Artificial
  CRISPR gRNA sequence
ccggcccgaatgggggccgg

SEQ ID NO: 767600 - DNA, 20 bp, Artificial
  CRISPR gRNA sequence
gcccgaatgggggccggggg

SEQ ID NO: 767601 - DNA, 20 bp, Artificial
  CRISPR gRNA sequence
aatgggggccgggggcggcc

SEQ ID NO: 767602 - DNA, 20 bp, Artificial
  CRISPR gRNA sequence
atgggggccgggggcggccc

SEQ ID NO: 767603 - DNA, 20 bp, Artificial
  CRISPR gRNA sequence
tgggggccgggggcggcccg

SEQ ID NO: 767604 - DNA, 20 bp, Artificial
  CRISPR gRNA sequence
ggggccgggggcggcccggg

SEQ ID NO: 767605 - DNA, 20 bp, Artificial
  CRISPR gRNA sequence
gggggcggcccggggagtcc

SEQ ID NO: 767606 - DNA, 20 bp, Artificial
  CRISPR gRNA sequence
ggggcggcccggggagtccg

SEQ ID NO: 767607 - DNA, 20 bp, Artificial
  CRISPR gRNA sequence
gggcggcccggggagtccga

SEQ ID NO: 767608 - DNA, 20 bp, Artificial
  CRISPR gRNA sequence
ggcggcccggggagtccgag

SEQ ID NO: 767609 - DNA, 20 bp, Artificial
  CRISPR gRNA sequence
ggcccggggagtccgagggg

SEQ ID NO: 767610 - DNA, 20 bp, Artificial
  CRISPR gRNA sequence
gcccggggagtccgaggggc

SEQ ID NO: 767611 - DNA, 20 bp, Artificial
  CRISPR gRNA sequence
cccggggagtccgaggggcg

SEQ ID NO: 767612 - DNA, 20 bp, Artificial
  CRISPR gRNA sequence
ggggagtccgaggggcgggg

SEQ ID NO: 767613 - DNA, 20 bp, Artificial
  CRISPR gRNA sequence
gggagtccgaggggcggggc

SEQ ID NO: 767614 - DNA, 20 bp, Artificial
  CRISPR gRNA sequence
aggggcggggcgggccgcgc

SEQ ID NO: 767615 - DNA, 20 bp, Artificial
  CRISPR gRNA sequence
gggcggggcgggccgcgccg

SEQ ID NO: 767616 - DNA, 20 bp, Artificial
  CRISPR gRNA sequence
ccgcgccggagaatccgcct

SEQ ID NO: 767617 - DNA, 20 bp, Artificial
  CRISPR gRNA sequence
cgcgccggagaatccgcctg

SEQ ID NO: 767618 - DNA, 20 bp, Artificial
  CRISPR gRNA sequence
cggagaatccgcctgaggcc

SEQ ID NO: 767619 - DNA, 20 bp, Artificial
  CRISPR gRNA sequence
gaatccgcctgaggcccgga

SEQ ID NO: 767620 - DNA, 20 bp, Artificial
  CRISPR gRNA sequence
aatccgcctgaggcccggaa

SEQ ID NO: 767621 - DNA, 20 bp, Artificial
  CRISPR gRNA sequence
ccgcctgaggcccggaaagg

SEQ ID NO: 767622 - DNA, 20 bp, Artificial
  CRISPR gRNA sequence
gaggcccggaaaggcggctc

SEQ ID NO: 767623 - DNA, 20 bp, Artificial
  CRISPR gRNA sequence
ggcggctccggtgcgtccct

SEQ ID NO: 767624 - DNA, 20 bp, Artificial
  CRISPR gRNA sequence
gcggctccggtgcgtccctg

SEQ ID NO: 767625 - DNA, 20 bp, Artificial
  CRISPR gRNA sequence
ctccggtgcgtccctgaggc

SEQ ID NO: 767626 - DNA, 20 bp, Artificial
  CRISPR gRNA sequence
gtgcgtccctgaggccggat

SEQ ID NO: 767627 - DNA, 20 bp, Artificial
  CRISPR gRNA sequence
ctgaggccggattggccccg

SEQ ID NO: 767628 - DNA, 20 bp, Artificial
  CRISPR gRNA sequence
aggccggattggccccgcgg

SEQ ID NO: 767629 - DNA, 20 bp, Artificial
  CRISPR gRNA sequence
ccggattggccccgcggtgg

SEQ ID NO: 767630 - DNA, 20 bp, Artificial
  CRISPR gRNA sequence
cgcggtggcggctgctgacc

SEQ ID NO: 767631 - DNA, 20 bp, Artificial
  CRISPR gRNA sequence
gcggtggcggctgctgaccg

SEQ ID NO: 767632 - DNA, 20 bp, Artificial
  CRISPR gRNA sequence
gcggctgctgaccgaggcct

SEQ ID NO: 767633 - DNA, 20 bp, Artificial
  CRISPR gRNA sequence
ctgctgaccgaggcctgagc

SEQ ID NO: 767634 - DNA, 20 bp, Artificial
  CRISPR gRNA sequence
cgaggcctgagccagcccgc

SEQ ID NO: 767635 - DNA, 20 bp, Artificial
  CRISPR gRNA sequence
gaggcctgagccagcccgct

SEQ ID NO: 767636 - DNA, 20 bp, Artificial
  CRISPR gRNA sequence
gcctgagccagcccgctggg

SEQ ID NO: 767637 - DNA, 20 bp, Artificial
  CRISPR gRNA sequence
ctgagccagcccgctgggca

SEQ ID NO: 767638 - DNA, 20 bp, Artificial
  CRISPR gRNA sequence
agcccgctgggcagagcaca

SEQ ID NO: 767639 - DNA, 20 bp, Artificial
  CRISPR gRNA sequence
gctgggcagagcacacggcc

SEQ ID NO: 767640 - DNA, 20 bp, Artificial
  CRISPR gRNA sequence
cccccgccccgccccgcccc

SEQ ID NO: 767641 - DNA, 20 bp, Artificial
  CRISPR gRNA sequence
ccccgccccgccccgccccc

SEQ ID NO: 767642 - DNA, 20 bp, Artificial
  CRISPR gRNA sequence
gccgcctttccgggcctcag

SEQ ID NO: 767643 - DNA, 20 bp, Artificial
  CRISPR gRNA sequence
agccaggctgggccgcgtcc

SEQ ID NO: 767644 - DNA, 20 bp, Artificial
  CRISPR gRNA sequence
tgggccgcgtccctgagtcc

SEQ ID NO: 767645 - DNA, 20 bp, Artificial
  CRISPR gRNA sequence
cccagagtcggcgcggcgcg

SEQ ID NO: 767646 - DNA, 20 bp, Artificial
  CRISPR gRNA sequence
ctggcgtggcgcgggcggcg

SEQ ID NO: 767647 - DNA, 20 bp, Artificial
  CRISPR gRNA sequence
ttgtctgctgcgggccgggc

SEQ ID NO: 767648 - DNA, 20 bp, Artificial
  CRISPR gRNA sequence
ccgggcggcccccctcgcac

SEQ ID NO: 767649 - DNA, 20 bp, Artificial
  CRISPR gRNA sequence
ccgcggagagctgggggctc

SEQ ID NO: 767650 - DNA, 20 bp, Artificial
  CRISPR gRNA sequence
cctaccccgcccccctttcc

SEQ ID NO: 767651 - DNA, 20 bp, Artificial
  CRISPR gRNA sequence
cccggaagctgcggaccggg

SEQ ID NO: 767652 - DNA, 20 bp, Artificial
  CRISPR gRNA sequence
gaagctgcggaccgggccgg

SEQ ID NO: 767653 - DNA, 20 bp, Artificial
  CRISPR gRNA sequence
ctgcggaccgggccgggtgg

SEQ ID NO: 767654 - DNA, 20 bp, Artificial
  CRISPR gRNA sequence
tgaatgcgcttttgcaggcc

SEQ ID NO: 767655 - DNA, 20 bp, Artificial
  CRISPR gRNA sequence
ggccggcgctgggaggttag

SEQ ID NO: 767656 - DNA, 20 bp, Artificial
  CRISPR gRNA sequence
gctgggaggttagcggggtc

SEQ ID NO: 767657 - DNA, 20 bp, Artificial
  CRISPR gRNA sequence
gggagcggcggggagggaag

SEQ ID NO: 767658 - DNA, 20 bp, Artificial
  CRISPR gRNA sequence
aggcagccgtgggcagcatg

SEQ ID NO: 767659 - DNA, 20 bp, Artificial
  CRISPR gRNA sequence
gagacggctggcaggggcca

SEQ ID NO: 767660 - DNA, 20 bp, Artificial
  CRISPR gRNA sequence
cggctggcaggggccacggg

SEQ ID NO: 767661 - DNA, 20 bp, Artificial
  CRISPR gRNA sequence
ccacggggtgaataggtgtt

SEQ ID NO: 767662 - DNA, 20 bp, Artificial
  CRISPR gRNA sequence
ataggtgttgggggtgggga

SEQ ID NO: 767663 - DNA, 20 bp, Artificial
  CRISPR gRNA sequence
gttgggggtggggagggaat

SEQ ID NO: 767664 - DNA, 20 bp, Artificial
  CRISPR gRNA sequence
tgggaagcctcagggaggtg

SEQ ID NO: 767665 - DNA, 20 bp, Artificial
  CRISPR gRNA sequence
cagggaggtggggggtgagg

SEQ ID NO: 767666 - DNA, 20 bp, Artificial
  CRISPR gRNA sequence
ggtggagggaggtggggacc

SEQ ID NO: 767667 - DNA, 20 bp, Artificial
  CRISPR gRNA sequence
tgggggcacactagaaggga

SEQ ID NO: 767668 - DNA, 20 bp, Artificial
  CRISPR gRNA sequence
gcacactagaagggagggga

SEQ ID NO: 767669 - DNA, 20 bp, Artificial
  CRISPR gRNA sequence
tccctgcgaccgtttagcta

SEQ ID NO: 767670 - DNA, 20 bp, Artificial
  CRISPR gRNA sequence
aggtttggcagcctaaggca

SEQ ID NO: 767671 - DNA, 20 bp, Artificial
  CRISPR gRNA sequence
cgtgatagatgactcagata

SEQ ID NO: 767672 - DNA, 20 bp, Artificial
  CRISPR gRNA sequence
tgtgtgtgtgtgtgtgtgtg

SEQ ID NO: 767673 - DNA, 20 bp, Artificial
  CRISPR gRNA sequence
tgtgtgtgtgtggcgggtgg

SEQ ID NO: 767674 - DNA, 20 bp, Artificial
  CRISPR gRNA sequence
aaaaacgatttaccttcaaa

SEQ ID NO: 767675 - DNA, 20 bp, Artificial
  CRISPR gRNA sequence
gatttaccttcaaattggat

SEQ ID NO: 767676 - DNA, 20 bp, Artificial
  CRISPR gRNA sequence
ttggatgtggataattgtaa

SEQ ID NO: 767677 - DNA, 20 bp, Artificial
  CRISPR gRNA sequence
ctgatctcttcattaaagcc

SEQ ID NO: 767678 - DNA, 20 bp, Artificial
  CRISPR gRNA sequence
tgaagctgctttgtctttaa

SEQ ID NO: 767679 - DNA, 20 bp, Artificial
  CRISPR gRNA sequence
ttgaagtctaaacctgtccg

SEQ ID NO: 767680 - DNA, 20 bp, Artificial
  CRISPR gRNA sequence
gtccgatgggttgagctgat

SEQ ID NO: 767681 - DNA, 20 bp, Artificial
  CRISPR gRNA sequence
gagctgatctgagtgcaggg

SEQ ID NO: 767682 - DNA, 20 bp, Artificial
  CRISPR gRNA sequence
gatggagggctatggggctg

SEQ ID NO: 767683 - DNA, 20 bp, Artificial
  CRISPR gRNA sequence
tatgaagtggctcatttcaa

SEQ ID NO: 767684 - DNA, 20 bp, Artificial
  CRISPR gRNA sequence
gctcatttcaagggagtatt

SEQ ID NO: 767685 - DNA, 20 bp, Artificial
  CRISPR gRNA sequence
atttcaagggagtattttgg

SEQ ID NO: 767686 - DNA, 20 bp, Artificial
  CRISPR gRNA sequence
gagtacattttcctgatatc

SEQ ID NO: 767687 - DNA, 20 bp, Artificial
  CRISPR gRNA sequence
tgagattaagcactaacact

SEQ ID NO: 767688 - DNA, 20 bp, Artificial
  CRISPR gRNA sequence
atacgtcaccgtcagcttac

SEQ ID NO: 767689 - DNA, 20 bp, Artificial
  CRISPR gRNA sequence
gcttactggagtatcctgat

SEQ ID NO: 767690 - DNA, 20 bp, Artificial
  CRISPR gRNA sequence
tgaaattttccttcatgact

SEQ ID NO: 767691 - DNA, 20 bp, Artificial
  CRISPR gRNA sequence
ggacctcagtttttgttctg

SEQ ID NO: 767692 - DNA, 20 bp, Artificial
  CRISPR gRNA sequence
agtggcctcagtgatgcagt

SEQ ID NO: 767693 - DNA, 20 bp, Artificial
  CRISPR gRNA sequence
agggtcccatgactgacctt

SEQ ID NO: 767694 - DNA, 20 bp, Artificial
  CRISPR gRNA sequence
aatgcaagtctcaggtgaga

SEQ ID NO: 767695 - DNA, 20 bp, Artificial
  CRISPR gRNA sequence
tctcaggtgagaaggggtgt

SEQ ID NO: 767696 - DNA, 20 bp, Artificial
  CRISPR gRNA sequence
tgtccaggcaccacccgatg

SEQ ID NO: 767697 - DNA, 20 bp, Artificial
  CRISPR gRNA sequence
accacccgatggagggttgg

SEQ ID NO: 767698 - DNA, 20 bp, Artificial
  CRISPR gRNA sequence
gtcccttcaaagtagtcctc

SEQ ID NO: 767699 - DNA, 20 bp, Artificial
  CRISPR gRNA sequence
tgacttctgaaacttcctgt

SEQ ID NO: 767700 - DNA, 20 bp, Artificial
  CRISPR gRNA sequence
taaactttggctttctctgg

SEQ ID NO: 767701 - DNA, 20 bp, Artificial
  CRISPR gRNA sequence
aggggtaaatctttgttctt

SEQ ID NO: 767702 - DNA, 20 bp, Artificial
  CRISPR gRNA sequence
taaatctttgttctttggag

SEQ ID NO: 767703 - DNA, 20 bp, Artificial
  CRISPR gRNA sequence
tttgttctttggagtaggat

SEQ ID NO: 767704 - DNA, 20 bp, Artificial
  CRISPR gRNA sequence
aggagctggacaatgctgtt

SEQ ID NO: 767705 - DNA, 20 bp, Artificial
  CRISPR gRNA sequence
tgcagtgtgataagagagct

SEQ ID NO: 767706 - DNA, 20 bp, Artificial
  CRISPR gRNA sequence
gtgataagagagctgtgagt

SEQ ID NO: 767707 - DNA, 20 bp, Artificial
  CRISPR gRNA sequence
aaatgttgtagaacaagtgg

SEQ ID NO: 767708 - DNA, 20 bp, Artificial
  CRISPR gRNA sequence
atggtacttggttgcacata

SEQ ID NO: 767709 - DNA, 20 bp, Artificial
  CRISPR gRNA sequence
ttggttgcacatacggggtt

SEQ ID NO: 767710 - DNA, 20 bp, Artificial
  CRISPR gRNA sequence
cacatgggggctgttaagct

SEQ ID NO: 767711 - DNA, 20 bp, Artificial
  CRISPR gRNA sequence
ggggctgttaagctgtggat

SEQ ID NO: 767712 - DNA, 20 bp, Artificial
  CRISPR gRNA sequence
taagctgtggatctgagtca

SEQ ID NO: 767713 - DNA, 20 bp, Artificial
  CRISPR gRNA sequence
gaaagaggaaaaatggcaag

SEQ ID NO: 767714 - DNA, 20 bp, Artificial
  CRISPR gRNA sequence
actgcccatgagcttatcct

SEQ ID NO: 767715 - DNA, 20 bp, Artificial
  CRISPR gRNA sequence
cccatgagcttatcctctga

SEQ ID NO: 767716 - DNA, 20 bp, Artificial
  CRISPR gRNA sequence
ttttcccacatccccagggc

SEQ ID NO: 767717 - DNA, 20 bp, Artificial
  CRISPR gRNA sequence
agggcctaggggagggggag

SEQ ID NO: 767718 - DNA, 20 bp, Artificial
  CRISPR gRNA sequence
tgcctttggtcttgttggct

SEQ ID NO: 767719 - DNA, 20 bp, Artificial
  CRISPR gRNA sequence
cagtgtgccagataggagca

SEQ ID NO: 767720 - DNA, 20 bp, Artificial
  CRISPR gRNA sequence
agcattgggttttcaggttt

SEQ ID NO: 767721 - DNA, 20 bp, Artificial
  CRISPR gRNA sequence
ttgggttttcaggtttggga

SEQ ID NO: 767722 - DNA, 20 bp, Artificial
  CRISPR gRNA sequence
ttttcaggtttgggagtggg

SEQ ID NO: 767723 - DNA, 20 bp, Artificial
  CRISPR gRNA sequence
ctcatagtaatcctatgagg

SEQ ID NO: 767724 - DNA, 20 bp, Artificial
  CRISPR gRNA sequence
tggggaaactgaggcccaga

SEQ ID NO: 767725 - DNA, 20 bp, Artificial
  CRISPR gRNA sequence
ggagcccggtaagatgtgcc

SEQ ID NO: 767726 - DNA, 20 bp, Artificial
  CRISPR gRNA sequence
agagaaggggcaggcctgac

SEQ ID NO: 767727 - DNA, 20 bp, Artificial
  CRISPR gRNA sequence
gcatagtcagggcctttgct

SEQ ID NO: 767728 - DNA, 20 bp, Artificial
  CRISPR gRNA sequence
tttatcatgctggggcttcc

SEQ ID NO: 767729 - DNA, 20 bp, Artificial
  CRISPR gRNA sequence
ttctttctctttgtggtcca

SEQ ID NO: 767730 - DNA, 20 bp, Artificial
  CRISPR gRNA sequence
ttctctttgtggtccagaga

SEQ ID NO: 767731 - DNA, 20 bp, Artificial
  CRISPR gRNA sequence
tccacacaccttatgccatt

SEQ ID NO: 767732 - DNA, 20 bp, Artificial
  CRISPR gRNA sequence
ggagcttaatctgcgggaag

SEQ ID NO: 767733 - DNA, 20 bp, Artificial
  CRISPR gRNA sequence
agatactgtctctgggaggc

SEQ ID NO: 767734 - DNA, 20 bp, Artificial
  CRISPR gRNA sequence
ggctgccttgtgggagacat

SEQ ID NO: 767735 - DNA, 20 bp, Artificial
  CRISPR gRNA sequence
acattggaatgtgtccctgt

SEQ ID NO: 767736 - DNA, 20 bp, Artificial
  CRISPR gRNA sequence
aggaaggggcccaggaccac

SEQ ID NO: 767737 - DNA, 20 bp, Artificial
  CRISPR gRNA sequence
aggggcccaggaccactaga

SEQ ID NO: 767738 - DNA, 20 bp, Artificial
  CRISPR gRNA sequence
gaatgagtcagagccagaga

SEQ ID NO: 767739 - DNA, 20 bp, Artificial
  CRISPR gRNA sequence
agtcagagccagagatggag

SEQ ID NO: 767740 - DNA, 20 bp, Artificial
  CRISPR gRNA sequence
tagggctctaggtgaaaagt

SEQ ID NO: 767741 - DNA, 20 bp, Artificial
  CRISPR gRNA sequence
gtgaaaagtagggatacaga

SEQ ID NO: 767742 - DNA, 20 bp, Artificial
  CRISPR gRNA sequence
cagaggaggtcttggccagg

SEQ ID NO: 767743 - DNA, 20 bp, Artificial
  CRISPR gRNA sequence
gaggtcttggccagggagag

SEQ ID NO: 767744 - DNA, 20 bp, Artificial
  CRISPR gRNA sequence
ttattctcacagcagccctg

SEQ ID NO: 767745 - DNA, 20 bp, Artificial
  CRISPR gRNA sequence
tcacagcagccctgtggggt

SEQ ID NO: 767746 - DNA, 20 bp, Artificial
  CRISPR gRNA sequence
ttacccccattttagagatt

SEQ ID NO: 767747 - DNA, 20 bp, Artificial
  CRISPR gRNA sequence
cccattttagagatttggaa

SEQ ID NO: 767748 - DNA, 20 bp, Artificial
  CRISPR gRNA sequence
gttcagcaaggcatcggtgt

SEQ ID NO: 767749 - DNA, 20 bp, Artificial
  CRISPR gRNA sequence
cttctgctggtggctgataa

SEQ ID NO: 767750 - DNA, 20 bp, Artificial
  CRISPR gRNA sequence
ttggccagccggccaccact

SEQ ID NO: 767751 - DNA, 20 bp, Artificial
  CRISPR gRNA sequence
ggagattgctacactccgag

SEQ ID NO: 767752 - DNA, 20 bp, Artificial
  CRISPR gRNA sequence
ggtctggtgcttagatggag

SEQ ID NO: 767753 - DNA, 20 bp, Artificial
  CRISPR gRNA sequence
cttagatggagaggggtcgg

SEQ ID NO: 767754 - DNA, 20 bp, Artificial
  CRISPR gRNA sequence
ctgctaagctgagcctcttt

SEQ ID NO: 767755 - DNA, 20 bp, Artificial
  CRISPR gRNA sequence
tctttcagggtagaaaccaa

SEQ ID NO: 767756 - DNA, 20 bp, Artificial
  CRISPR gRNA sequence
tggagaaaatgcacccttcc

SEQ ID NO: 767757 - DNA, 20 bp, Artificial
  CRISPR gRNA sequence
agtctggaaaggcttctgga

SEQ ID NO: 767758 - DNA, 20 bp, Artificial
  CRISPR gRNA sequence
ggaaaggcttctggaaagga

SEQ ID NO: 767759 - DNA, 20 bp, Artificial
  CRISPR gRNA sequence
ctagcaggactcagcagata

SEQ ID NO: 767760 - DNA, 20 bp, Artificial
  CRISPR gRNA sequence
caggactcagcagatattga

SEQ ID NO: 767761 - DNA, 20 bp, Artificial
  CRISPR gRNA sequence
ggaagaactgattcctgctc

SEQ ID NO: 767762 - DNA, 20 bp, Artificial
  CRISPR gRNA sequence
aactgattcctgctcttggg

SEQ ID NO: 767763 - DNA, 20 bp, Artificial
  CRISPR gRNA sequence
tgggtgggatcacgggactg

SEQ ID NO: 767764 - DNA, 20 bp, Artificial
  CRISPR gRNA sequence
agttttgataattttgctca

SEQ ID NO: 767765 - DNA, 20 bp, Artificial
  CRISPR gRNA sequence
gagtcctataatcatcctat

SEQ ID NO: 767766 - DNA, 20 bp, Artificial
  CRISPR gRNA sequence
tgagcaaactgaggctcaga

SEQ ID NO: 767767 - DNA, 20 bp, Artificial
  CRISPR gRNA sequence
gtttcattactaggaagtga

SEQ ID NO: 767768 - DNA, 20 bp, Artificial
  CRISPR gRNA sequence
ttactaggaagtgacagagt

SEQ ID NO: 767769 - DNA, 20 bp, Artificial
  CRISPR gRNA sequence
catgcgatatggtcacagca

SEQ ID NO: 767770 - DNA, 20 bp, Artificial
  CRISPR gRNA sequence
gatgaagacccagaaaggca

SEQ ID NO: 767771 - DNA, 20 bp, Artificial
  CRISPR gRNA sequence
tggcctagggagcctggcaa

SEQ ID NO: 767772 - DNA, 20 bp, Artificial
  CRISPR gRNA sequence
acagagcctggtctaaagtc

SEQ ID NO: 767773 - DNA, 20 bp, Artificial
  CRISPR gRNA sequence
ccttttttcgttaattgcaa

SEQ ID NO: 767774 - DNA, 20 bp, Artificial
  CRISPR gRNA sequence
tcacccttattctgacactc

SEQ ID NO: 767775 - DNA, 20 bp, Artificial
  CRISPR gRNA sequence
tgcattcattcgttcactca

SEQ ID NO: 767776 - DNA, 20 bp, Artificial
  CRISPR gRNA sequence
attatgtgccaagccattgc

SEQ ID NO: 767777 - DNA, 20 bp, Artificial
  CRISPR gRNA sequence
gccaagccattgctagaatt

SEQ ID NO: 767778 - DNA, 20 bp, Artificial
  CRISPR gRNA sequence
tatatcatgaagaaaacaga

SEQ ID NO: 767779 - DNA, 20 bp, Artificial
  CRISPR gRNA sequence
aagaaaacagactgggtgca

SEQ ID NO: 767780 - DNA, 20 bp, Artificial
  CRISPR gRNA sequence
agactgggtgcaatgaatga

SEQ ID NO: 767781 - DNA, 20 bp, Artificial
  CRISPR gRNA sequence
atgaatgacagggtccttct

SEQ ID NO: 767782 - DNA, 20 bp, Artificial
  CRISPR gRNA sequence
ttttctgtcaaggtgaccct

SEQ ID NO: 767783 - DNA, 20 bp, Artificial
  CRISPR gRNA sequence
tccatgttttactgctataa

SEQ ID NO: 767784 - DNA, 20 bp, Artificial
  CRISPR gRNA sequence
ctataacagaataccacagc

SEQ ID NO: 767785 - DNA, 20 bp, Artificial
  CRISPR gRNA sequence
agtggcaattaaatttcaac

SEQ ID NO: 767786 - DNA, 20 bp, Artificial
  CRISPR gRNA sequence
caacactgtgaggtaggaaa

SEQ ID NO: 767787 - DNA, 20 bp, Artificial
  CRISPR gRNA sequence
caattattctggctgttgta

SEQ ID NO: 767788 - DNA, 20 bp, Artificial
  CRISPR gRNA sequence
atagagtatagattggagaa

SEQ ID NO: 767789 - DNA, 20 bp, Artificial
  CRISPR gRNA sequence
gtatagattggagaacagaa

SEQ ID NO: 767790 - DNA, 20 bp, Artificial
  CRISPR gRNA sequence
ggaagaccaggaagagaagc

SEQ ID NO: 767791 - DNA, 20 bp, Artificial
  CRISPR gRNA sequence
agatatagcagacatatttg

SEQ ID NO: 767792 - DNA, 20 bp, Artificial
  CRISPR gRNA sequence
ctatgtgtgcagcttgcttc

SEQ ID NO: 767793 - DNA, 20 bp, Artificial
  CRISPR gRNA sequence
ctctgcctctgttcatttgt

SEQ ID NO: 767794 - DNA, 20 bp, Artificial
  CRISPR gRNA sequence
tcttagtaatctcaacaaga

SEQ ID NO: 767795 - DNA, 20 bp, Artificial
  CRISPR gRNA sequence
ggctctggggaagtctctga

SEQ ID NO: 767796 - DNA, 20 bp, Artificial
  CRISPR gRNA sequence
gctcattctcgaactaatca

SEQ ID NO: 767797 - DNA, 20 bp, Artificial
  CRISPR gRNA sequence
gcatggactgggctccctgc

SEQ ID NO: 767798 - DNA, 20 bp, Artificial
  CRISPR gRNA sequence
agaccaagagaagggcactg

SEQ ID NO: 767799 - DNA, 20 bp, Artificial
  CRISPR gRNA sequence
cggagacgatctgctcggca

SEQ ID NO: 767800 - DNA, 20 bp, Artificial
  CRISPR gRNA sequence
aggagcagaagatgttaaga

SEQ ID NO: 767801 - DNA, 20 bp, Artificial
  CRISPR gRNA sequence
tgtatttgtcttctggcccc

SEQ ID NO: 767802 - DNA, 20 bp, Artificial
  CRISPR gRNA sequence
tgggattgcctgtcctggtg

SEQ ID NO: 767803 - DNA, 20 bp, Artificial
  CRISPR gRNA sequence
gtgtggggtgaacttggaga

SEQ ID NO: 767804 - DNA, 20 bp, Artificial
  CRISPR gRNA sequence
agaatctctgagaagctgtc

SEQ ID NO: 767805 - DNA, 20 bp, Artificial
  CRISPR gRNA sequence
agggatatttcaggccagtc

SEQ ID NO: 767806 - DNA, 20 bp, Artificial
  CRISPR gRNA sequence
caggccagtctagggtagaa

SEQ ID NO: 767807 - DNA, 20 bp, Artificial
  CRISPR gRNA sequence
ggtagaagagggttggacac

SEQ ID NO: 767808 - DNA, 20 bp, Artificial
  CRISPR gRNA sequence
ctgctgtgcacagattcaat

SEQ ID NO: 767809 - DNA, 20 bp, Artificial
  CRISPR gRNA sequence
tacctcccttgcctcctctc

SEQ ID NO: 767810 - DNA, 20 bp, Artificial
  CRISPR gRNA sequence
tcctgagtctcagcctctcc

SEQ ID NO: 767811 - DNA, 20 bp, Artificial
  CRISPR gRNA sequence
ctcctggagtcccatcttcc

SEQ ID NO: 767812 - DNA, 20 bp, Artificial
  CRISPR gRNA sequence
ctgagcctccccagccccca

SEQ ID NO: 767813 - DNA, 20 bp, Artificial
  CRISPR gRNA sequence
ctatttttaatatgaaaatg

SEQ ID NO: 767814 - DNA, 20 bp, Artificial
  CRISPR gRNA sequence
gttattaaatctctccatcc

SEQ ID NO: 767815 - DNA, 20 bp, Artificial
  CRISPR gRNA sequence
gaatttactcctcggtgaaa

SEQ ID NO: 767816 - DNA, 20 bp, Artificial
  CRISPR gRNA sequence
taataatagtacctacttca

SEQ ID NO: 767817 - DNA, 20 bp, Artificial
  CRISPR gRNA sequence
agaattgttgggaagcttaa

SEQ ID NO: 767818 - DNA, 20 bp, Artificial
  CRISPR gRNA sequence
agcaaaataatatatataac

SEQ ID NO: 767819 - DNA, 20 bp, Artificial
  CRISPR gRNA sequence
ataaacatacctcccaactt

SEQ ID NO: 767820 - DNA, 20 bp, Artificial
  CRISPR gRNA sequence
gagaatgagaacccctgtag

SEQ ID NO: 767821 - DNA, 20 bp, Artificial
  CRISPR gRNA sequence
gcatggccaatgcctggcat

SEQ ID NO: 767822 - DNA, 20 bp, Artificial
  CRISPR gRNA sequence
caatgcctggcatgtggatc

SEQ ID NO: 767823 - DNA, 20 bp, Artificial
  CRISPR gRNA sequence
ggatcatgaataagcatttg

SEQ ID NO: 767824 - DNA, 20 bp, Artificial
  CRISPR gRNA sequence
catgaataagcatttgttga

SEQ ID NO: 767825 - DNA, 20 bp, Artificial
  CRISPR gRNA sequence
aggcacttgcatggcttcac

SEQ ID NO: 767826 - DNA, 20 bp, Artificial
  CRISPR gRNA sequence
aagcttctcatgacagccct

SEQ ID NO: 767827 - DNA, 20 bp, Artificial
  CRISPR gRNA sequence
atgacagccctggggatgag

SEQ ID NO: 767828 - DNA, 20 bp, Artificial
  CRISPR gRNA sequence
atgagatgggtagatgggag

SEQ ID NO: 767829 - DNA, 20 bp, Artificial
  CRISPR gRNA sequence
acactcctaaccccggtgta

SEQ ID NO: 767830 - DNA, 20 bp, Artificial
  CRISPR gRNA sequence
taaccccggtgtactgaatg

SEQ ID NO: 767831 - DNA, 20 bp, Artificial
  CRISPR gRNA sequence
ccagacaccagcagagagag

SEQ ID NO: 767832 - DNA, 20 bp, Artificial
  CRISPR gRNA sequence
ctatgcaccagaacagtcaa

SEQ ID NO: 767833 - DNA, 20 bp, Artificial
  CRISPR gRNA sequence
agtacttcaaaagatcacga

SEQ ID NO: 767834 - DNA, 20 bp, Artificial
  CRISPR gRNA sequence
gccgacttatacacttaaac

SEQ ID NO: 767835 - DNA, 20 bp, Artificial
  CRISPR gRNA sequence
aaaaatgttgtggcagttgg

SEQ ID NO: 767836 - DNA, 20 bp, Artificial
  CRISPR gRNA sequence
gaggaatggactcagtttaa

SEQ ID NO: 767837 - DNA, 20 bp, Artificial
  CRISPR gRNA sequence
ctcagtttaactgggtgaaa

SEQ ID NO: 767838 - DNA, 20 bp, Artificial
  CRISPR gRNA sequence
cattctgaactccatcagaa

SEQ ID NO: 767839 - DNA, 20 bp, Artificial
  CRISPR gRNA sequence
cagaagaggatggcagaggt

SEQ ID NO: 767840 - DNA, 20 bp, Artificial
  CRISPR gRNA sequence
agaggtgtggattagcagca

SEQ ID NO: 767841 - DNA, 20 bp, Artificial
  CRISPR gRNA sequence
gtggattagcagcaatgagt

SEQ ID NO: 767842 - DNA, 20 bp, Artificial
  CRISPR gRNA sequence
agatttgatagtctgttatt

SEQ ID NO: 767843 - DNA, 20 bp, Artificial
  CRISPR gRNA sequence
tgttattttgggttattttg

SEQ ID NO: 767844 - DNA, 20 bp, Artificial
  CRISPR gRNA sequence
gactcattctgtgtggtcca

SEQ ID NO: 767845 - DNA, 20 bp, Artificial
  CRISPR gRNA sequence
tgaacgctgtccaaaagcaa

SEQ ID NO: 767846 - DNA, 20 bp, Artificial
  CRISPR gRNA sequence
gtggatagcccatgcaggcc

SEQ ID NO: 767847 - DNA, 20 bp, Artificial
  CRISPR gRNA sequence
acagagattgtgtgtatgcg

SEQ ID NO: 767848 - DNA, 20 bp, Artificial
  CRISPR gRNA sequence
attaatttctgcagtttccc

SEQ ID NO: 767849 - DNA, 20 bp, Artificial
  CRISPR gRNA sequence
ggttctgtcaccaccactgc

SEQ ID NO: 767850 - DNA, 20 bp, Artificial
  CRISPR gRNA sequence
agctgcagctcagtgtgtct

SEQ ID NO: 767851 - DNA, 20 bp, Artificial
  CRISPR gRNA sequence
agtccataggacattttggt

SEQ ID NO: 767852 - DNA, 20 bp, Artificial
  CRISPR gRNA sequence
ctgagcagtggcaatgctca

SEQ ID NO: 767853 - DNA, 20 bp, Artificial
  CRISPR gRNA sequence
ggaagagaaggagggaaagt

SEQ ID NO: 767854 - DNA, 20 bp, Artificial
  CRISPR gRNA sequence
agaaggagggaaagtaaggg

SEQ ID NO: 767855 - DNA, 20 bp, Artificial
  CRISPR gRNA sequence
tttctcacccatgtgaccat

SEQ ID NO: 767856 - DNA, 20 bp, Artificial
  CRISPR gRNA sequence
gggctgatactacagtccct

SEQ ID NO: 767857 - DNA, 20 bp, Artificial
  CRISPR gRNA sequence
gtctgctgctctgccgtcct

SEQ ID NO: 767858 - DNA, 20 bp, Artificial
  CRISPR gRNA sequence
cactcagctgcaagtaaggc

SEQ ID NO: 767859 - DNA, 20 bp, Artificial
  CRISPR gRNA sequence
ctgggatctgcagtcgttag

SEQ ID NO: 767860 - DNA, 20 bp, Artificial
  CRISPR gRNA sequence
gctatggaagaaggggagag

SEQ ID NO: 767861 - DNA, 20 bp, Artificial
  CRISPR gRNA sequence
tactcgggaggctgaggcag

SEQ ID NO: 767862 - DNA, 20 bp, Artificial
  CRISPR gRNA sequence
caggaggatcacttgagccc

SEQ ID NO: 767863 - DNA, 20 bp, Artificial
  CRISPR gRNA sequence
cacttgagcccaggagttac

SEQ ID NO: 767864 - DNA, 20 bp, Artificial
  CRISPR gRNA sequence
ccaggagttacaagggtgca

SEQ ID NO: 767865 - DNA, 20 bp, Artificial
  CRISPR gRNA sequence
tatgatggtaccactccagc

SEQ ID NO: 767866 - DNA, 20 bp, Artificial
  CRISPR gRNA sequence
gtctcttaaaaagggagaaa

SEQ ID NO: 767867 - DNA, 20 bp, Artificial
  CRISPR gRNA sequence
ctgtgaactggttaagcctt

SEQ ID NO: 767868 - DNA, 20 bp, Artificial
  CRISPR gRNA sequence
cacactttgggctcattttc

SEQ ID NO: 767869 - DNA, 20 bp, Artificial
  CRISPR gRNA sequence
gggctcattttctagaattc

SEQ ID NO: 767870 - DNA, 20 bp, Artificial
  CRISPR gRNA sequence
agacaggcagtgtcaggagg

SEQ ID NO: 767871 - DNA, 20 bp, Artificial
  CRISPR gRNA sequence
gtgtcaggaggacgggtctc

SEQ ID NO: 767872 - DNA, 20 bp, Artificial
  CRISPR gRNA sequence
cgggtctctggagttcagga

SEQ ID NO: 767873 - DNA, 20 bp, Artificial
  CRISPR gRNA sequence
ggagctgctcatgacttttc

SEQ ID NO: 767874 - DNA, 20 bp, Artificial
  CRISPR gRNA sequence
gacttttcagggatcatctc

SEQ ID NO: 767875 - DNA, 20 bp, Artificial
  CRISPR gRNA sequence
tgcatgtcccccttccctat

SEQ ID NO: 767876 - DNA, 20 bp, Artificial
  CRISPR gRNA sequence
ggaactccgtaagtagtgaa

SEQ ID NO: 767877 - DNA, 20 bp, Artificial
  CRISPR gRNA sequence
tgaaatgaattactaaagac

SEQ ID NO: 767878 - DNA, 20 bp, Artificial
  CRISPR gRNA sequence
tactaaagacatgaatgcat

SEQ ID NO: 767879 - DNA, 20 bp, Artificial
  CRISPR gRNA sequence
gcagcttgcttcaggcatag

SEQ ID NO: 767880 - DNA, 20 bp, Artificial
  CRISPR gRNA sequence
gttgcccaaggagcccctgc

SEQ ID NO: 767881 - DNA, 20 bp, Artificial
  CRISPR gRNA sequence
gcggggattgggaggaagta

SEQ ID NO: 767882 - DNA, 20 bp, Artificial
  CRISPR gRNA sequence
agtagggggttaggaggaag

SEQ ID NO: 767883 - DNA, 20 bp, Artificial
  CRISPR gRNA sequence
ttaggaggaagtggagtgat

SEQ ID NO: 767884 - DNA, 20 bp, Artificial
  CRISPR gRNA sequence
gccctgagcccaggtgcagt

SEQ ID NO: 767885 - DNA, 20 bp, Artificial
  CRISPR gRNA sequence
tagctttctgagggcacatc

SEQ ID NO: 767886 - DNA, 20 bp, Artificial
  CRISPR gRNA sequence
tccctgtggccctgcttctg

SEQ ID NO: 767887 - DNA, 20 bp, Artificial
  CRISPR gRNA sequence
gtggccctgcttctgcaggg

SEQ ID NO: 767888 - DNA, 20 bp, Artificial
  CRISPR gRNA sequence
ccgaaggtgctctgtggttt

SEQ ID NO: 767889 - DNA, 20 bp, Artificial
  CRISPR gRNA sequence
gagcaggaaggagaaggacg

SEQ ID NO: 767890 - DNA, 20 bp, Artificial
  CRISPR gRNA sequence
ctggcaggtgactcaccggg

SEQ ID NO: 767891 - DNA, 20 bp, Artificial
  CRISPR gRNA sequence
ctccagggcaggtcccggct

SEQ ID NO: 767892 - DNA, 20 bp, Artificial
  CRISPR gRNA sequence
gattcccctttgtggaaaac

SEQ ID NO: 767893 - DNA, 20 bp, Artificial
  CRISPR gRNA sequence
ttgtggaaaacatgggtgga

SEQ ID NO: 767894 - DNA, 20 bp, Artificial
  CRISPR gRNA sequence
ctgcgtggctccacgtggct

SEQ ID NO: 767895 - DNA, 20 bp, Artificial
  CRISPR gRNA sequence
ccaggcccagctgtcagcgt

SEQ ID NO: 767896 - DNA, 20 bp, Artificial
  CRISPR gRNA sequence
agctgtcagcgtaggggtct

SEQ ID NO: 767897 - DNA, 20 bp, Artificial
  CRISPR gRNA sequence
ttctctccagggcaggtttc

SEQ ID NO: 767898 - DNA, 20 bp, Artificial
  CRISPR gRNA sequence
cagggcaggtttccaggatc

SEQ ID NO: 767899 - DNA, 20 bp, Artificial
  CRISPR gRNA sequence
caggatccagagtctaggaa

SEQ ID NO: 767900 - DNA, 20 bp, Artificial
  CRISPR gRNA sequence
cagctcggccctgggagagc

SEQ ID NO: 767901 - DNA, 20 bp, Artificial
  CRISPR gRNA sequence
ctctgctccctgtacctgcc

SEQ ID NO: 767902 - DNA, 20 bp, Artificial
  CRISPR gRNA sequence
ctgtacctgcccagagtggc

SEQ ID NO: 767903 - DNA, 20 bp, Artificial
  CRISPR gRNA sequence
atgaaggagacaattatatg

SEQ ID NO: 767904 - DNA, 20 bp, Artificial
  CRISPR gRNA sequence
agacaattatatgaagagtc

SEQ ID NO: 767905 - DNA, 20 bp, Artificial
  CRISPR gRNA sequence
gagtcttgagtaccaggcag

SEQ ID NO: 767906 - DNA, 20 bp, Artificial
  CRISPR gRNA sequence
ttgagtaccaggcagaggaa

SEQ ID NO: 767907 - DNA, 20 bp, Artificial
  CRISPR gRNA sequence
aatggggtctgacttctata

SEQ ID NO: 767908 - DNA, 20 bp, Artificial
  CRISPR gRNA sequence
tcctaagagaaggcacctta

SEQ ID NO: 767909 - DNA, 20 bp, Artificial
  CRISPR gRNA sequence
gagcaagcagggccagtgag

SEQ ID NO: 767910 - DNA, 20 bp, Artificial
  CRISPR gRNA sequence
cagggccagtgaggggggtg

SEQ ID NO: 767911 - DNA, 20 bp, Artificial
  CRISPR gRNA sequence
cagtgaggggggtgatgggt

SEQ ID NO: 767912 - DNA, 20 bp, Artificial
  CRISPR gRNA sequence
gaagcttgagaagcagtgtg

SEQ ID NO: 767913 - DNA, 20 bp, Artificial
  CRISPR gRNA sequence
ccacaggccttggttctgtc

SEQ ID NO: 767914 - DNA, 20 bp, Artificial
  CRISPR gRNA sequence
taaagagaggcagggagatg

SEQ ID NO: 767915 - DNA, 20 bp, Artificial
  CRISPR gRNA sequence
ttagccctggtgcttcccgc

SEQ ID NO: 767916 - DNA, 20 bp, Artificial
  CRISPR gRNA sequence
gtcctgcaggcagctgcctg

SEQ ID NO: 767917 - DNA, 20 bp, Artificial
  CRISPR gRNA sequence
ctggatcttcctgtgggcct

SEQ ID NO: 767918 - DNA, 20 bp, Artificial
  CRISPR gRNA sequence
tcagggtggcccttgtgggg

SEQ ID NO: 767919 - DNA, 20 bp, Artificial
  CRISPR gRNA sequence
gtgcctgccaaaggtgcttt

SEQ ID NO: 767920 - DNA, 20 bp, Artificial
  CRISPR gRNA sequence
gggagagaaggggggctggc

SEQ ID NO: 767921 - DNA, 20 bp, Artificial
  CRISPR gRNA sequence
actcccttggcccagctgct

SEQ ID NO: 767922 - DNA, 20 bp, Artificial
  CRISPR gRNA sequence
tgctgggggtgtgtgtgtgt

SEQ ID NO: 767923 - DNA, 20 bp, Artificial
  CRISPR gRNA sequence
ggtgtgtgtgtgtaggagtg

SEQ ID NO: 767924 - DNA, 20 bp, Artificial
  CRISPR gRNA sequence
ggagtggagggtggcggggg

SEQ ID NO: 767925 - DNA, 20 bp, Artificial
  CRISPR gRNA sequence
ggggggcgggtgtgcctggc

SEQ ID NO: 767926 - DNA, 20 bp, Artificial
  CRISPR gRNA sequence
gtgtgcctggctgggattgg

SEQ ID NO: 767927 - DNA, 20 bp, Artificial
  CRISPR gRNA sequence
aaggattgaggctgggcgcc

SEQ ID NO: 767928 - DNA, 20 bp, Artificial
  CRISPR gRNA sequence
ttgaggctgggcgcctggaa

SEQ ID NO: 767929 - DNA, 20 bp, Artificial
  CRISPR gRNA sequence
tgatgaggtttgctccgtgg

SEQ ID NO: 767930 - DNA, 20 bp, Artificial
  CRISPR gRNA sequence
ggaagggtggaaaggtgtag

SEQ ID NO: 767931 - DNA, 20 bp, Artificial
  CRISPR gRNA sequence
ttttttttttttttttgaga

SEQ ID NO: 767932 - DNA, 20 bp, Artificial
  CRISPR gRNA sequence
tcttgcagtatcgcccagac

SEQ ID NO: 767933 - DNA, 20 bp, Artificial
  CRISPR gRNA sequence
ctcactacaacctccgcctc

SEQ ID NO: 767934 - DNA, 20 bp, Artificial
  CRISPR gRNA sequence
aattctcctgcctcagcctc

SEQ ID NO: 767935 - DNA, 20 bp, Artificial
  CRISPR gRNA sequence
gtttatatttttagtagaca

SEQ ID NO: 767936 - DNA, 20 bp, Artificial
  CRISPR gRNA sequence
acctcggcctcccaaagtgc

SEQ ID NO: 767937 - DNA, 20 bp, Artificial
  CRISPR gRNA sequence
aagtgttacagcctatctcc

SEQ ID NO: 767938 - DNA, 20 bp, Artificial
  CRISPR gRNA sequence
gacaaggtgtgtgcagcctg

SEQ ID NO: 767939 - DNA, 20 bp, Artificial
  CRISPR gRNA sequence
tgtgcagcctggagggtggc

SEQ ID NO: 767940 - DNA, 20 bp, Artificial
  CRISPR gRNA sequence
ggctgggattgggagcaggg

SEQ ID NO: 767941 - DNA, 20 bp, Artificial
  CRISPR gRNA sequence
ttgggagcagggctggattt

SEQ ID NO: 767942 - DNA, 20 bp, Artificial
  CRISPR gRNA sequence
cttccattttctctgcctca

SEQ ID NO: 767943 - DNA, 20 bp, Artificial
  CRISPR gRNA sequence
ccaccactataccttcctac

SEQ ID NO: 767944 - DNA, 20 bp, Artificial
  CRISPR gRNA sequence
tttatttttattttttgaga

SEQ ID NO: 767945 - DNA, 20 bp, Artificial
  CRISPR gRNA sequence
tctggctctgtcacccagtc

SEQ ID NO: 767946 - DNA, 20 bp, Artificial
  CRISPR gRNA sequence
cttactgcaacctctgcctc

SEQ ID NO: 767947 - DNA, 20 bp, Artificial
  CRISPR gRNA sequence
gcctcaccctcccaagtagc

SEQ ID NO: 767948 - DNA, 20 bp, Artificial
  CRISPR gRNA sequence
atttgtatttttagtagaga

SEQ ID NO: 767949 - DNA, 20 bp, Artificial
  CRISPR gRNA sequence
gcctcagcctcccaaagtgc

SEQ ID NO: 767950 - DNA, 20 bp, Artificial
  CRISPR gRNA sequence
tccagtctatgctgaggagc

SEQ ID NO: 767951 - DNA, 20 bp, Artificial
  CRISPR gRNA sequence
gtctatgctgaggagctaga

SEQ ID NO: 767952 - DNA, 20 bp, Artificial
  CRISPR gRNA sequence
acataccctcccatcagata

SEQ ID NO: 767953 - DNA, 20 bp, Artificial
  CRISPR gRNA sequence
cagtggctctcaactgcctt

SEQ ID NO: 767954 - DNA, 20 bp, Artificial
  CRISPR gRNA sequence
ttgcctcctcttccttatat

SEQ ID NO: 767955 - DNA, 20 bp, Artificial
  CRISPR gRNA sequence
gatactaacatcttagctga

SEQ ID NO: 767956 - DNA, 20 bp, Artificial
  CRISPR gRNA sequence
ctaacatcttagctgaaagg

SEQ ID NO: 767957 - DNA, 20 bp, Artificial
  CRISPR gRNA sequence
ttcctcagcagggggcccgg

SEQ ID NO: 767958 - DNA, 20 bp, Artificial
  CRISPR gRNA sequence
cagggggcccggtgggatat

SEQ ID NO: 767959 - DNA, 20 bp, Artificial
  CRISPR gRNA sequence
gtcggcggggcagccctggc

SEQ ID NO: 767960 - DNA, 20 bp, Artificial
  CRISPR gRNA sequence
gccctggcatgggtgtgcat

SEQ ID NO: 767961 - DNA, 20 bp, Artificial
  CRISPR gRNA sequence
tgtggttctgcctcacaggt

SEQ ID NO: 767962 - DNA, 20 bp, Artificial
  CRISPR gRNA sequence
gtgattgtggcagttgggga

SEQ ID NO: 767963 - DNA, 20 bp, Artificial
  CRISPR gRNA sequence
agggggtgcccacgcctgtt

SEQ ID NO: 767964 - DNA, 20 bp, Artificial
  CRISPR gRNA sequence
ccataccttacttccacctg

SEQ ID NO: 767965 - DNA, 20 bp, Artificial
  CRISPR gRNA sequence
cttgtctgtaaaatgggaac

SEQ ID NO: 767966 - DNA, 20 bp, Artificial
  CRISPR gRNA sequence
aaatgagatcgtgctatttc

SEQ ID NO: 767967 - DNA, 20 bp, Artificial
  CRISPR gRNA sequence
gcccctaaacgtctgcatga

SEQ ID NO: 767968 - DNA, 20 bp, Artificial
  CRISPR gRNA sequence
cttcctccctgttcaaagag

SEQ ID NO: 767969 - DNA, 20 bp, Artificial
  CRISPR gRNA sequence
gtaggtgcccaataactgtg

SEQ ID NO: 767970 - DNA, 20 bp, Artificial
  CRISPR gRNA sequence
tccgtggggaagacaaagct

SEQ ID NO: 767971 - DNA, 20 bp, Artificial
  CRISPR gRNA sequence
ctgatttctctagagcaaga

SEQ ID NO: 767972 - DNA, 20 bp, Artificial
  CRISPR gRNA sequence
agagcaagaaagggttttgt

SEQ ID NO: 767973 - DNA, 20 bp, Artificial
  CRISPR gRNA sequence
gagaactggcctggggcacc

SEQ ID NO: 767974 - DNA, 20 bp, Artificial
  CRISPR gRNA sequence
gtactgcaaagattatgata

SEQ ID NO: 767975 - DNA, 20 bp, Artificial
  CRISPR gRNA sequence
ctaaatgcaggaaaccttta

SEQ ID NO: 767976 - DNA, 20 bp, Artificial
  CRISPR gRNA sequence
aaggttgatcttcccacatt

SEQ ID NO: 767977 - DNA, 20 bp, Artificial
  CRISPR gRNA sequence
acacaatctaaccattaccg

SEQ ID NO: 767978 - DNA, 20 bp, Artificial
  CRISPR gRNA sequence
ttaccggagaatggtagtgc

SEQ ID NO: 767979 - DNA, 20 bp, Artificial
  CRISPR gRNA sequence
gaatggtagtgccagggtgg

SEQ ID NO: 767980 - DNA, 20 bp, Artificial
  CRISPR gRNA sequence
ctctttttttttttttgaga

SEQ ID NO: 767981 - DNA, 20 bp, Artificial
  CRISPR gRNA sequence
tggggtcttgctctgttgcc

SEQ ID NO: 767982 - DNA, 20 bp, Artificial
  CRISPR gRNA sequence
tcttgctctgttgccaagga

SEQ ID NO: 767983 - DNA, 20 bp, Artificial
  CRISPR gRNA sequence
aattctcctgcctcagcctc

SEQ ID NO: 767984 - DNA, 20 bp, Artificial
  CRISPR gRNA sequence
gcctcagcctcctgagtagc

SEQ ID NO: 767985 - DNA, 20 bp, Artificial
  CRISPR gRNA sequence
tggctattttttagtagagg

SEQ ID NO: 767986 - DNA, 20 bp, Artificial
  CRISPR gRNA sequence
gattccctcctaaataaacc

SEQ ID NO: 767987 - DNA, 20 bp, Artificial
  CRISPR gRNA sequence
tccagtctccacagaggagc

SEQ ID NO: 767988 - DNA, 20 bp, Artificial
  CRISPR gRNA sequence
gtctccacagaggagctaga

SEQ ID NO: 767989 - DNA, 20 bp, Artificial
  CRISPR gRNA sequence
ctcttcaagtcatctttggt

SEQ ID NO: 767990 - DNA, 20 bp, Artificial
  CRISPR gRNA sequence
tccacctgctgtttcctcta

SEQ ID NO: 767991 - DNA, 20 bp, Artificial
  CRISPR gRNA sequence
tcaccaccatatttaaaggt

SEQ ID NO: 767992 - DNA, 20 bp, Artificial
  CRISPR gRNA sequence
aaccactattgacatttttg

SEQ ID NO: 767993 - DNA, 20 bp, Artificial
  CRISPR gRNA sequence
taccttagtcacatgctgac

SEQ ID NO: 767994 - DNA, 20 bp, Artificial
  CRISPR gRNA sequence
cattaaaatgtaagttctgt

SEQ ID NO: 767995 - DNA, 20 bp, Artificial
  CRISPR gRNA sequence
ggtgctgactatattcttga

SEQ ID NO: 767996 - DNA, 20 bp, Artificial
  CRISPR gRNA sequence
tcctaagacaataaattact

SEQ ID NO: 767997 - DNA, 20 bp, Artificial
  CRISPR gRNA sequence
tgggtctcaggcctaaaagg

SEQ ID NO: 767998 - DNA, 20 bp, Artificial
  CRISPR gRNA sequence
aaggaggggtggacagggcc

SEQ ID NO: 767999 - DNA, 20 bp, Artificial
  CRISPR gRNA sequence
tcacctgcttcgtgagcatc

SEQ ID NO: 768000 - DNA, 20 bp, Artificial
  CRISPR gRNA sequence
ctgaggctgaggtgttctgg

SEQ ID NO: 768001 - DNA, 20 bp, Artificial
  CRISPR gRNA sequence
aggtgttctggcaggatggg

SEQ ID NO: 768002 - DNA, 20 bp, Artificial
  CRISPR gRNA sequence
tttgatgtgcacagcatcct

SEQ ID NO: 768003 - DNA, 20 bp, Artificial
  CRISPR gRNA sequence
acagcatcctgcgggtggtg

SEQ ID NO: 768004 - DNA, 20 bp, Artificial
  CRISPR gRNA sequence
tgcgcaaccccgtgctgcag

SEQ ID NO: 768005 - DNA, 20 bp, Artificial
  CRISPR gRNA sequence
taaatgtccccttgggggag

SEQ ID NO: 768006 - DNA, 20 bp, Artificial
  CRISPR gRNA sequence
ggggttctgcttctgtcggc

SEQ ID NO: 768007 - DNA, 20 bp, Artificial
  CRISPR gRNA sequence
gtcggcaggggttgggagct

SEQ ID NO: 768008 - DNA, 20 bp, Artificial
  CRISPR gRNA sequence
gagaaagataacggggaggt

SEQ ID NO: 768009 - DNA, 20 bp, Artificial
  CRISPR gRNA sequence
gaggtggggatgttcactgg

SEQ ID NO: 768010 - DNA, 20 bp, Artificial
  CRISPR gRNA sequence
aggctctggaagcctctggg

SEQ ID NO: 768011 - DNA, 20 bp, Artificial
  CRISPR gRNA sequence
tgggaagaatggagccacat

SEQ ID NO: 768012 - DNA, 20 bp, Artificial
  CRISPR gRNA sequence
agccacatctgggtcagcag

SEQ ID NO: 768013 - DNA, 20 bp, Artificial
  CRISPR gRNA sequence
cagaggggtgggcgaaggaa

SEQ ID NO: 768014 - DNA, 20 bp, Artificial
  CRISPR gRNA sequence
aaggaaaggagtcctgatgg

SEQ ID NO: 768015 - DNA, 20 bp, Artificial
  CRISPR gRNA sequence
tcaccagggctggagctggt

SEQ ID NO: 768016 - DNA, 20 bp, Artificial
  CRISPR gRNA sequence
acctgccccaggcctggccc

SEQ ID NO: 768017 - DNA, 20 bp, Artificial
  CRISPR gRNA sequence
attggggagactccatatct

SEQ ID NO: 768018 - DNA, 20 bp, Artificial
  CRISPR gRNA sequence
aagaaaataggaagatggaa

SEQ ID NO: 768019 - DNA, 20 bp, Artificial
  CRISPR gRNA sequence
aggaagatggaacagggtct

SEQ ID NO: 768020 - DNA, 20 bp, Artificial
  CRISPR gRNA sequence
ggtctgggaattgatggggg

SEQ ID NO: 768021 - DNA, 20 bp, Artificial
  CRISPR gRNA sequence
gggggaagagtttgggggac

SEQ ID NO: 768022 - DNA, 20 bp, Artificial
  CRISPR gRNA sequence
gggactcgggtggtagccta

SEQ ID NO: 768023 - DNA, 20 bp, Artificial
  CRISPR gRNA sequence
tcacctgcttcgtgagcatc

SEQ ID NO: 768024 - DNA, 20 bp, Artificial
  CRISPR gRNA sequence
ctgaggctgaggtgttctgg

SEQ ID NO: 768025 - DNA, 20 bp, Artificial
  CRISPR gRNA sequence
aggtgttctggcaggatggg

SEQ ID NO: 768026 - DNA, 20 bp, Artificial
  CRISPR gRNA sequence
tttgatgtgcacagcgtcct

SEQ ID NO: 768027 - DNA, 20 bp, Artificial
  CRISPR gRNA sequence
acagcgtcctgcgggtggtg

SEQ ID NO: 768028 - DNA, 20 bp, Artificial
  CRISPR gRNA sequence
tcctgcgggtggtgctgggt

SEQ ID NO: 768029 - DNA, 20 bp, Artificial
  CRISPR gRNA sequence
tgcgcaaccccgtgctgcag

SEQ ID NO: 768030 - DNA, 20 bp, Artificial
  CRISPR gRNA sequence
aacagctggggaaggacgga

SEQ ID NO: 768031 - DNA, 20 bp, Artificial
  CRISPR gRNA sequence
ctctttactggaccctaacg

SEQ ID NO: 768032 - DNA, 20 bp, Artificial
  CRISPR gRNA sequence
aacgtggaatttccataggt

SEQ ID NO: 768033 - DNA, 20 bp, Artificial
  CRISPR gRNA sequence
tttataatgtttgccttcct

SEQ ID NO: 768034 - DNA, 20 bp, Artificial
  CRISPR gRNA sequence
cgaaatttggaggcatgggc

SEQ ID NO: 768035 - DNA, 20 bp, Artificial
  CRISPR gRNA sequence
tgtggcccaggggacttggt

SEQ ID NO: 768036 - DNA, 20 bp, Artificial
  CRISPR gRNA sequence
gctttccagcaggaactcct

SEQ ID NO: 768037 - DNA, 20 bp, Artificial
  CRISPR gRNA sequence
ctgagtggtaggaaggtatt

SEQ ID NO: 768038 - DNA, 20 bp, Artificial
  CRISPR gRNA sequence
gcgccatctgattctgaagc

SEQ ID NO: 768039 - DNA, 20 bp, Artificial
  CRISPR gRNA sequence
ccctagttagtccccaacac

SEQ ID NO: 768040 - DNA, 20 bp, Artificial
  CRISPR gRNA sequence
gcgctccacccaggcagccg

SEQ ID NO: 768041 - DNA, 20 bp, Artificial
  CRISPR gRNA sequence
cgtgggcacctcttgtgcct

SEQ ID NO: 768042 - DNA, 20 bp, Artificial
  CRISPR gRNA sequence
cttgtgcctgagggtgtgaa

SEQ ID NO: 768043 - DNA, 20 bp, Artificial
  CRISPR gRNA sequence
ggcccgtcacatcgtctgct

SEQ ID NO: 768044 - DNA, 20 bp, Artificial
  CRISPR gRNA sequence
ccttcctgtgctctccagga

SEQ ID NO: 768045 - DNA, 20 bp, Artificial
  CRISPR gRNA sequence
agagtagctgccctgagctc

SEQ ID NO: 768046 - DNA, 20 bp, Artificial
  CRISPR gRNA sequence
cgaaaagaagaaatagaaga

SEQ ID NO: 768047 - DNA, 20 bp, Artificial
  CRISPR gRNA sequence
aagatagagtgatcttggca

SEQ ID NO: 768048 - DNA, 20 bp, Artificial
  CRISPR gRNA sequence
tatgaagctttcagaggagg

SEQ ID NO: 768049 - DNA, 20 bp, Artificial
  CRISPR gRNA sequence
tgggagctgagaaggccttg

SEQ ID NO: 768050 - DNA, 20 bp, Artificial
  CRISPR gRNA sequence
tgagaaggccttgaaggata

SEQ ID NO: 768051 - DNA, 20 bp, Artificial
  CRISPR gRNA sequence
catttgcaccctgggctgag

SEQ ID NO: 768052 - DNA, 20 bp, Artificial
  CRISPR gRNA sequence
atgctgtgcagaaaggactt

SEQ ID NO: 768053 - DNA, 20 bp, Artificial
  CRISPR gRNA sequence
agtataaatgtgattgcaaa

SEQ ID NO: 768054 - DNA, 20 bp, Artificial
  CRISPR gRNA sequence
gaaaattctctattttaaac

SEQ ID NO: 768055 - DNA, 20 bp, Artificial
  CRISPR gRNA sequence
cagcactttgggaggccaag

SEQ ID NO: 768056 - DNA, 20 bp, Artificial
  CRISPR gRNA sequence
actttgggaggccaaggcgg

SEQ ID NO: 768057 - DNA, 20 bp, Artificial
  CRISPR gRNA sequence
cgggtggatcacttgaggtc

SEQ ID NO: 768058 - DNA, 20 bp, Artificial
  CRISPR gRNA sequence
tacttgggaggctggggcaa

SEQ ID NO: 768059 - DNA, 20 bp, Artificial
  CRISPR gRNA sequence
cagtgtcactgcactccagc

SEQ ID NO: 768060 - DNA, 20 bp, Artificial
  CRISPR gRNA sequence
cacagcggctctcaatcttt

SEQ ID NO: 768061 - DNA, 20 bp, Artificial
  CRISPR gRNA sequence
gtcagacccttctttgaaaa

SEQ ID NO: 768062 - DNA, 20 bp, Artificial
  CRISPR gRNA sequence
gcagtttgcacataactctg

SEQ ID NO: 768063 - DNA, 20 bp, Artificial
  CRISPR gRNA sequence
ctgcctctctaaactcctcc

SEQ ID NO: 768064 - DNA, 20 bp, Artificial
  CRISPR gRNA sequence
gtgaggagatgagccatgat

SEQ ID NO: 768065 - DNA, 20 bp, Artificial
  CRISPR gRNA sequence
ttgtatcatgtcaaacattc

SEQ ID NO: 768066 - DNA, 20 bp, Artificial
  CRISPR gRNA sequence
ctgtgcagagcctcttggag

SEQ ID NO: 768067 - DNA, 20 bp, Artificial
  CRISPR gRNA sequence
tggcctgagcctgtcctttc

SEQ ID NO: 768068 - DNA, 20 bp, Artificial
  CRISPR gRNA sequence
ggaacatagagaccctctgc

SEQ ID NO: 768069 - DNA, 20 bp, Artificial
  CRISPR gRNA sequence
ctgctgtcagagccccatga

SEQ ID NO: 768070 - DNA, 20 bp, Artificial
  CRISPR gRNA sequence
gagccccatgatgggatttc

SEQ ID NO: 768071 - DNA, 20 bp, Artificial
  CRISPR gRNA sequence
tgttttttaatgtgtgctct

SEQ ID NO: 768072 - DNA, 20 bp, Artificial
  CRISPR gRNA sequence
tgcacacctctcttcatcac

SEQ ID NO: 768073 - DNA, 20 bp, Artificial
  CRISPR gRNA sequence
ctctcttcatcactggggtg

SEQ ID NO: 768074 - DNA, 20 bp, Artificial
  CRISPR gRNA sequence
tgcacgaggtgcatctatgc

SEQ ID NO: 768075 - DNA, 20 bp, Artificial
  CRISPR gRNA sequence
tgctggggtctctgccgcca

SEQ ID NO: 768076 - DNA, 20 bp, Artificial
  CRISPR gRNA sequence
ctgcagaagctgctgaggcc

SEQ ID NO: 768077 - DNA, 20 bp, Artificial
  CRISPR gRNA sequence
gacttctccctaggacccag

SEQ ID NO: 768078 - DNA, 20 bp, Artificial
  CRISPR gRNA sequence
tgggtgcaggggctgggcta

SEQ ID NO: 768079 - DNA, 20 bp, Artificial
  CRISPR gRNA sequence
ctagaggatggtatgtaaga

SEQ ID NO: 768080 - DNA, 20 bp, Artificial
  CRISPR gRNA sequence
gctcctggccctacccagct

SEQ ID NO: 768081 - DNA, 20 bp, Artificial
  CRISPR gRNA sequence
acattttctgtaaatggcca

SEQ ID NO: 768082 - DNA, 20 bp, Artificial
  CRISPR gRNA sequence
gtttgctgccttctgatcca

SEQ ID NO: 768083 - DNA, 20 bp, Artificial
  CRISPR gRNA sequence
aaagagggcctctggaggag

SEQ ID NO: 768084 - DNA, 20 bp, Artificial
  CRISPR gRNA sequence
ggtgaatattgagctaagca

SEQ ID NO: 768085 - DNA, 20 bp, Artificial
  CRISPR gRNA sequence
aggagccagttgcttctgga

SEQ ID NO: 768086 - DNA, 20 bp, Artificial
  CRISPR gRNA sequence
tgaagctgaggctcctacag

SEQ ID NO: 768087 - DNA, 20 bp, Artificial
  CRISPR gRNA sequence
tagaattagaaaacttaggg

SEQ ID NO: 768088 - DNA, 20 bp, Artificial
  CRISPR gRNA sequence
cagccaacttctagaggtcc

SEQ ID NO: 768089 - DNA, 20 bp, Artificial
  CRISPR gRNA sequence
tgaggcgtgtccacatcagc

SEQ ID NO: 768090 - DNA, 20 bp, Artificial
  CRISPR gRNA sequence
cacatcagccagggttgtat

SEQ ID NO: 768091 - DNA, 20 bp, Artificial
  CRISPR gRNA sequence
cagggttgtatcagggtttg

SEQ ID NO: 768092 - DNA, 20 bp, Artificial
  CRISPR gRNA sequence
tcatagtgttagggcccagt

SEQ ID NO: 768093 - DNA, 20 bp, Artificial
  CRISPR gRNA sequence
acattccccccagaggccct

SEQ ID NO: 768094 - DNA, 20 bp, Artificial
  CRISPR gRNA sequence
tcaaacagagctgtgaggag

SEQ ID NO: 768095 - DNA, 20 bp, Artificial
  CRISPR gRNA sequence
ctgtgaggaggagaatgcag

SEQ ID NO: 768096 - DNA, 20 bp, Artificial
  CRISPR gRNA sequence
gcatgcacacttatgtgtct

SEQ ID NO: 768097 - DNA, 20 bp, Artificial
  CRISPR gRNA sequence
gttgctgtctttgatgtcaa

SEQ ID NO: 768098 - DNA, 20 bp, Artificial
  CRISPR gRNA sequence
tgtcactttctagtgacaga

SEQ ID NO: 768099 - DNA, 20 bp, Artificial
  CRISPR gRNA sequence
gtgtgtgtgtgcagatgggg

SEQ ID NO: 768100 - DNA, 20 bp, Artificial
  CRISPR gRNA sequence
ggatttgtctgtgtgtgacc

SEQ ID NO: 768101 - DNA, 20 bp, Artificial
  CRISPR gRNA sequence
ctgtccatgtgcagatacca

SEQ ID NO: 768102 - DNA, 20 bp, Artificial
  CRISPR gRNA sequence
ccatgtgcagataccacagg

SEQ ID NO: 768103 - DNA, 20 bp, Artificial
  CRISPR gRNA sequence
gcagataccacaggatgaat

SEQ ID NO: 768104 - DNA, 20 bp, Artificial
  CRISPR gRNA sequence
ataccacaggatgaatgtgg

SEQ ID NO: 768105 - DNA, 20 bp, Artificial
  CRISPR gRNA sequence
gagtgtgactggaaggtggt

SEQ ID NO: 768106 - DNA, 20 bp, Artificial
  CRISPR gRNA sequence
tgtaaggccaagtgctacaa

SEQ ID NO: 768107 - DNA, 20 bp, Artificial
  CRISPR gRNA sequence
aggccaagtgctacaaaggg

SEQ ID NO: 768108 - DNA, 20 bp, Artificial
  CRISPR gRNA sequence
ccaggggcgtgcatggcact

SEQ ID NO: 768109 - DNA, 20 bp, Artificial
  CRISPR gRNA sequence
gggggtgatcgtgcctgcct

SEQ ID NO: 768110 - DNA, 20 bp, Artificial
  CRISPR gRNA sequence
gtgatcgtgcctgccttgga

SEQ ID NO: 768111 - DNA, 20 bp, Artificial
  CRISPR gRNA sequence
cagctgccatttgcggggct

SEQ ID NO: 768112 - DNA, 20 bp, Artificial
  CRISPR gRNA sequence
ctggcattggtgactggtaa

SEQ ID NO: 768113 - DNA, 20 bp, Artificial
  CRISPR gRNA sequence
aagtgggtgagaggacattg

SEQ ID NO: 768114 - DNA, 20 bp, Artificial
  CRISPR gRNA sequence
tgagaggacattggtgggtg

SEQ ID NO: 768115 - DNA, 20 bp, Artificial
  CRISPR gRNA sequence
tgggtggtgagttgaccctg

SEQ ID NO: 768116 - DNA, 20 bp, Artificial
  CRISPR gRNA sequence
tggtgggtaaacagatgcat

SEQ ID NO: 768117 - DNA, 20 bp, Artificial
  CRISPR gRNA sequence
aaacagatgcatgagagtag

SEQ ID NO: 768118 - DNA, 20 bp, Artificial
  CRISPR gRNA sequence
tagatgggtagtcagaggct

SEQ ID NO: 768119 - DNA, 20 bp, Artificial
  CRISPR gRNA sequence
ggttgggaaggagagggaag

SEQ ID NO: 768120 - DNA, 20 bp, Artificial
  CRISPR gRNA sequence
agtggtcagttggcagatag

SEQ ID NO: 768121 - DNA, 20 bp, Artificial
  CRISPR gRNA sequence
cttgtgaggtagacaggtgg

SEQ ID NO: 768122 - DNA, 20 bp, Artificial
  CRISPR gRNA sequence
ttggcagggctactgagcga

SEQ ID NO: 768123 - DNA, 20 bp, Artificial
  CRISPR gRNA sequence
cagggctactgagcgagcgg

SEQ ID NO: 768124 - DNA, 20 bp, Artificial
  CRISPR gRNA sequence
gcgagcggatgggtgaggtg

SEQ ID NO: 768125 - DNA, 20 bp, Artificial
  CRISPR gRNA sequence
gcggatgggtgaggtgatgg

SEQ ID NO: 768126 - DNA, 20 bp, Artificial
  CRISPR gRNA sequence
gatgggtgggtgggctggtg

SEQ ID NO: 768127 - DNA, 20 bp, Artificial
  CRISPR gRNA sequence
ggtgggctggtggagggtag

SEQ ID NO: 768128 - DNA, 20 bp, Artificial
  CRISPR gRNA sequence
ggtaggtggatggtctttgg

SEQ ID NO: 768129 - DNA, 20 bp, Artificial
  CRISPR gRNA sequence
tgtgtggcgggggctccagg

SEQ ID NO: 768130 - DNA, 20 bp, Artificial
  CRISPR gRNA sequence
tggcgggggctccaggttga

SEQ ID NO: 768131 - DNA, 20 bp, Artificial
  CRISPR gRNA sequence
gttgagtggatggtctttgg

SEQ ID NO: 768132 - DNA, 20 bp, Artificial
  CRISPR gRNA sequence
agtggatggtctttggctgg

SEQ ID NO: 768133 - DNA, 20 bp, Artificial
  CRISPR gRNA sequence
ggtgagtggtgggctccagg

SEQ ID NO: 768134 - DNA, 20 bp, Artificial
  CRISPR gRNA sequence
agtggtgggctccaggctgg

SEQ ID NO: 768135 - DNA, 20 bp, Artificial
  CRISPR gRNA sequence
gctgggtggatggtccttga

SEQ ID NO: 768136 - DNA, 20 bp, Artificial
  CRISPR gRNA sequence
ggtaagtggtgcactccagg

SEQ ID NO: 768137 - DNA, 20 bp, Artificial
  CRISPR gRNA sequence
agtggtgcactccaggctgg

SEQ ID NO: 768138 - DNA, 20 bp, Artificial
  CRISPR gRNA sequence
gctgggtggatggtctttgg

SEQ ID NO: 768139 - DNA, 20 bp, Artificial
  CRISPR gRNA sequence
ggtggatggtctttggctgg

SEQ ID NO: 768140 - DNA, 20 bp, Artificial
  CRISPR gRNA sequence
tgagtggtgggggcgccagg

SEQ ID NO: 768141 - DNA, 20 bp, Artificial
  CRISPR gRNA sequence
ccaggctgggtagtttttgg

SEQ ID NO: 768142 - DNA, 20 bp, Artificial
  CRISPR gRNA sequence
gctgggtagtttttggctgg

SEQ ID NO: 768143 - DNA, 20 bp, Artificial
  CRISPR gRNA sequence
gcaaaagatttttgtttatt

SEQ ID NO: 768144 - DNA, 20 bp, Artificial
  CRISPR gRNA sequence
cctttgcaggagctgaggac

SEQ ID NO: 768145 - DNA, 20 bp, Artificial
  CRISPR gRNA sequence
gggagaaggctccaagacag

SEQ ID NO: 768146 - DNA, 20 bp, Artificial
  CRISPR gRNA sequence
tgggaaaggagagaggactc

SEQ ID NO: 768147 - DNA, 20 bp, Artificial
  CRISPR gRNA sequence
ggccagatttgctgtaaggt

SEQ ID NO: 768148 - DNA, 20 bp, Artificial
  CRISPR gRNA sequence
actcagacctccccaccccg

SEQ ID NO: 768149 - DNA, 20 bp, Artificial
  CRISPR gRNA sequence
cggtgagtctgctctttgcc

SEQ ID NO: 768150 - DNA, 20 bp, Artificial
  CRISPR gRNA sequence
tgcccagagttaggcaggaa

SEQ ID NO: 768151 - DNA, 20 bp, Artificial
  CRISPR gRNA sequence
acctgattggccccacaccg

SEQ ID NO: 768152 - DNA, 20 bp, Artificial
  CRISPR gRNA sequence
gtggagtctggtggcttcct

SEQ ID NO: 768153 - DNA, 20 bp, Artificial
  CRISPR gRNA sequence
gagcaggggctccggagata

SEQ ID NO: 768154 - DNA, 20 bp, Artificial
  CRISPR gRNA sequence
gggctccggagatagggagt

SEQ ID NO: 768155 - DNA, 20 bp, Artificial
  CRISPR gRNA sequence
cctgctccatctcaggtaaa

SEQ ID NO: 768156 - DNA, 20 bp, Artificial
  CRISPR gRNA sequence
ggtttcctcttatgtaaaat

SEQ ID NO: 768157 - DNA, 20 bp, Artificial
  CRISPR gRNA sequence
atcacagattcataggttgt

SEQ ID NO: 768158 - DNA, 20 bp, Artificial
  CRISPR gRNA sequence
gtgccaagtgcttaatactc

SEQ ID NO: 768159 - DNA, 20 bp, Artificial
  CRISPR gRNA sequence
cagtaagctgggggcccagc

SEQ ID NO: 768160 - DNA, 20 bp, Artificial
  CRISPR gRNA sequence
aagctgggggcccagcttgg

SEQ ID NO: 768161 - DNA, 20 bp, Artificial
  CRISPR gRNA sequence
gtgcccatggccgactccca

SEQ ID NO: 768162 - DNA, 20 bp, Artificial
  CRISPR gRNA sequence
caggtttccgctgagccatt

SEQ ID NO: 768163 - DNA, 20 bp, Artificial
  CRISPR gRNA sequence
ggcaggcgtagagacagctc

SEQ ID NO: 768164 - DNA, 20 bp, Artificial
  CRISPR gRNA sequence
gatgtagttggcagaaggga

SEQ ID NO: 768165 - DNA, 20 bp, Artificial
  CRISPR gRNA sequence
agaagggagggagtgaggag

SEQ ID NO: 768166 - DNA, 20 bp, Artificial
  CRISPR gRNA sequence
gagggagtgaggagaagagt

SEQ ID NO: 768167 - DNA, 20 bp, Artificial
  CRISPR gRNA sequence
gaggagaagagtgtgggtga

SEQ ID NO: 768168 - DNA, 20 bp, Artificial
  CRISPR gRNA sequence
cagctggaggtggagggctc

SEQ ID NO: 768169 - DNA, 20 bp, Artificial
  CRISPR gRNA sequence
gaaaactaaggcccagagag

SEQ ID NO: 768170 - DNA, 20 bp, Artificial
  CRISPR gRNA sequence
gagaggagaatgacaagcca

SEQ ID NO: 768171 - DNA, 20 bp, Artificial
  CRISPR gRNA sequence
atctgtgtgtgagaggctga

SEQ ID NO: 768172 - DNA, 20 bp, Artificial
  CRISPR gRNA sequence
gtgtgtgagaggctgagagg

SEQ ID NO: 768173 - DNA, 20 bp, Artificial
  CRISPR gRNA sequence
cctggtgagatggcagaggg

SEQ ID NO: 768174 - DNA, 20 bp, Artificial
  CRISPR gRNA sequence
gacagaggcttaagcaggac

SEQ ID NO: 768175 - DNA, 20 bp, Artificial
  CRISPR gRNA sequence
tggagccaggttccacttac

SEQ ID NO: 768176 - DNA, 20 bp, Artificial
  CRISPR gRNA sequence
agccaagagggagagaaagg

SEQ ID NO: 768177 - DNA, 20 bp, Artificial
  CRISPR gRNA sequence
gatatgtttccttctagagc

SEQ ID NO: 768178 - DNA, 20 bp, Artificial
  CRISPR gRNA sequence
gaggctagaaaagtgttcag

SEQ ID NO: 768179 - DNA, 20 bp, Artificial
  CRISPR gRNA sequence
agccatgtccctggcgcaca

SEQ ID NO: 768180 - DNA, 20 bp, Artificial
  CRISPR gRNA sequence
gtcatttccttcctgttttt

SEQ ID NO: 768181 - DNA, 20 bp, Artificial
  CRISPR gRNA sequence
cagcactttgggaggccgag

SEQ ID NO: 768182 - DNA, 20 bp, Artificial
  CRISPR gRNA sequence
actttgggaggccgaggtgg

SEQ ID NO: 768183 - DNA, 20 bp, Artificial
  CRISPR gRNA sequence
tgggtggatcacttgaggtc

SEQ ID NO: 768184 - DNA, 20 bp, Artificial
  CRISPR gRNA sequence
tacttgggaagctgaggcgg

SEQ ID NO: 768185 - DNA, 20 bp, Artificial
  CRISPR gRNA sequence
aaaaagtcagcttggttttg

SEQ ID NO: 768186 - DNA, 20 bp, Artificial
  CRISPR gRNA sequence
ttggttttgaagagttgctg

SEQ ID NO: 768187 - DNA, 20 bp, Artificial
  CRISPR gRNA sequence
gagttgctggagaatgtggc

SEQ ID NO: 768188 - DNA, 20 bp, Artificial
  CRISPR gRNA sequence
ccagggacatacagagcccc

SEQ ID NO: 768189 - DNA, 20 bp, Artificial
  CRISPR gRNA sequence
ggacatacagagccccaaga

SEQ ID NO: 768190 - DNA, 20 bp, Artificial
  CRISPR gRNA sequence
tctccattcagcttcagatg

SEQ ID NO: 768191 - DNA, 20 bp, Artificial
  CRISPR gRNA sequence
attcagcttcagatgcagag

SEQ ID NO: 768192 - DNA, 20 bp, Artificial
  CRISPR gRNA sequence
tgcagagtggggtctgaaag

SEQ ID NO: 768193 - DNA, 20 bp, Artificial
  CRISPR gRNA sequence
gggtctgaaagatgagtctt

SEQ ID NO: 768194 - DNA, 20 bp, Artificial
  CRISPR gRNA sequence
gaaggctgcctgctggacga

SEQ ID NO: 768195 - DNA, 20 bp, Artificial
  CRISPR gRNA sequence
gggagttgggccaggccttg

SEQ ID NO: 768196 - DNA, 20 bp, Artificial
  CRISPR gRNA sequence
gttgggccaggccttggagg

SEQ ID NO: 768197 - DNA, 20 bp, Artificial
  CRISPR gRNA sequence
gccaggccttggagggtgga

SEQ ID NO: 768198 - DNA, 20 bp, Artificial
  CRISPR gRNA sequence
aaaagtgttgcacgtagagg

SEQ ID NO: 768199 - DNA, 20 bp, Artificial
  CRISPR gRNA sequence
gtgtatcgggctgtgggcct

SEQ ID NO: 768200 - DNA, 20 bp, Artificial
  CRISPR gRNA sequence
acaggtgggctccttctcca

SEQ ID NO: 768201 - DNA, 20 bp, Artificial
  CRISPR gRNA sequence
cagccctgcttccacctgca

SEQ ID NO: 768202 - DNA, 20 bp, Artificial
  CRISPR gRNA sequence
agtgcggcctcaacatctcc

SEQ ID NO: 768203 - DNA, 20 bp, Artificial
  CRISPR gRNA sequence
gctggtcacactggttctcc

SEQ ID NO: 768204 - DNA, 20 bp, Artificial
  CRISPR gRNA sequence
gggtctgtgatggggcccct

SEQ ID NO: 768205 - DNA, 20 bp, Artificial
  CRISPR gRNA sequence
cctctgtggctcaaggcttc

SEQ ID NO: 768206 - DNA, 20 bp, Artificial
  CRISPR gRNA sequence
cataattcttacccagagca

SEQ ID NO: 768207 - DNA, 20 bp, Artificial
  CRISPR gRNA sequence
atagcccctcgccacggcta

SEQ ID NO: 768208 - DNA, 20 bp, Artificial
  CRISPR gRNA sequence
gcctggggcagggcagggcc

SEQ ID NO: 768209 - DNA, 20 bp, Artificial
  CRISPR gRNA sequence
ggccagctcctggcctctgg

SEQ ID NO: 768210 - DNA, 20 bp, Artificial
  CRISPR gRNA sequence
ttcagacgttctgatgcctt

SEQ ID NO: 768211 - DNA, 20 bp, Artificial
  CRISPR gRNA sequence
atgtcatctctccctgcccc

SEQ ID NO: 768212 - DNA, 20 bp, Artificial
  CRISPR gRNA sequence
aatttaaatgtgggactcgg

SEQ ID NO: 768213 - DNA, 20 bp, Artificial
  CRISPR gRNA sequence
tcggagggattttgtaaact

SEQ ID NO: 768214 - DNA, 20 bp, Artificial
  CRISPR gRNA sequence
ctctgtgaagtgtttggaag

SEQ ID NO: 768215 - DNA, 20 bp, Artificial
  CRISPR gRNA sequence
gggccccaggactcaaccag

SEQ ID NO: 768216 - DNA, 20 bp, Artificial
  CRISPR gRNA sequence
tcaaccagcaggattctctc

SEQ ID NO: 768217 - DNA, 20 bp, Artificial
  CRISPR gRNA sequence
ctctcctggatgttgcaggc

SEQ ID NO: 768218 - DNA, 20 bp, Artificial
  CRISPR gRNA sequence
ccagcctgcaacatccagga

SEQ ID NO: 768219 - DNA, 20 bp, Artificial
  CRISPR gRNA sequence
ccaggagagaatcctgctgg

SEQ ID NO: 768220 - DNA, 20 bp, Artificial
  CRISPR gRNA sequence
ccccagtttacaaaatccct

SEQ ID NO: 768221 - DNA, 20 bp, Artificial
  CRISPR gRNA sequence
ggaaaagactgccccagccc

SEQ ID NO: 768222 - DNA, 20 bp, Artificial
  CRISPR gRNA sequence
ccccagaatagcaccatggt

SEQ ID NO: 768223 - DNA, 20 bp, Artificial
  CRISPR gRNA sequence
ttccgccccaaccccatgct

SEQ ID NO: 768224 - DNA, 20 bp, Artificial
  CRISPR gRNA sequence
cccaaccccatgctctgggt

SEQ ID NO: 768225 - DNA, 20 bp, Artificial
  CRISPR gRNA sequence
ccatgctctgggtaagaatt

SEQ ID NO: 768226 - DNA, 20 bp, Artificial
  CRISPR gRNA sequence
ctctgggtaagaattatggg

SEQ ID NO: 768227 - DNA, 20 bp, Artificial
  CRISPR gRNA sequence
gtaagaattatgggtgggat

SEQ ID NO: 768228 - DNA, 20 bp, Artificial
  CRISPR gRNA sequence
caggagccccctgcaaaccg

SEQ ID NO: 768229 - DNA, 20 bp, Artificial
  CRISPR gRNA sequence
gttagttgtctgtctcccag

SEQ ID NO: 768230 - DNA, 20 bp, Artificial
  CRISPR gRNA sequence
gtctgtctcccagctggatg

SEQ ID NO: 768231 - DNA, 20 bp, Artificial
  CRISPR gRNA sequence
agttgctcaataaacatcaa

SEQ ID NO: 768232 - DNA, 20 bp, Artificial
  CRISPR gRNA sequence
gctcaataaacatcaactga

SEQ ID NO: 768233 - DNA, 20 bp, Artificial
  CRISPR gRNA sequence
ccagcacatgcttccgtggg

SEQ ID NO: 768234 - DNA, 20 bp, Artificial
  CRISPR gRNA sequence
agctgtgcatgtggtgggcg

SEQ ID NO: 768235 - DNA, 20 bp, Artificial
  CRISPR gRNA sequence
ggccattggagaaacaaggc

SEQ ID NO: 768236 - DNA, 20 bp, Artificial
  CRISPR gRNA sequence
gtctttggtgaaataaggca

SEQ ID NO: 768237 - DNA, 20 bp, Artificial
  CRISPR gRNA sequence
aaggcagggggtcagtcagt

SEQ ID NO: 768238 - DNA, 20 bp, Artificial
  CRISPR gRNA sequence
tccacgcagcactggaagaa

SEQ ID NO: 768239 - DNA, 20 bp, Artificial
  CRISPR gRNA sequence
ctgtgaaataaggcagcagg

SEQ ID NO: 768240 - DNA, 20 bp, Artificial
  CRISPR gRNA sequence
tgacttagagaactaaggtt

SEQ ID NO: 768241 - DNA, 20 bp, Artificial
  CRISPR gRNA sequence
gtctataagaaaaaaggcag

SEQ ID NO: 768242 - DNA, 20 bp, Artificial
  CRISPR gRNA sequence
aaaaggcagcaggatgactt

SEQ ID NO: 768243 - DNA, 20 bp, Artificial
  CRISPR gRNA sequence
aaggagcccacctgtcagag

SEQ ID NO: 768244 - DNA, 20 bp, Artificial
  CRISPR gRNA sequence
gtgcagccccattgcagcca

SEQ ID NO: 768245 - DNA, 20 bp, Artificial
  CRISPR gRNA sequence
agagggtaggagctgtaggg

SEQ ID NO: 768246 - DNA, 20 bp, Artificial
  CRISPR gRNA sequence
gatgccagaagatctatttt

SEQ ID NO: 768247 - DNA, 20 bp, Artificial
  CRISPR gRNA sequence
acctggtcagacttcaagtg

SEQ ID NO: 768248 - DNA, 20 bp, Artificial
  CRISPR gRNA sequence
ccctccacactggtttccct

SEQ ID NO: 768249 - DNA, 20 bp, Artificial
  CRISPR gRNA sequence
accccactctgcatctgaag

SEQ ID NO: 768250 - DNA, 20 bp, Artificial
  CRISPR gRNA sequence
caggctgcctcaccaaggag

SEQ ID NO: 768251 - DNA, 20 bp, Artificial
  CRISPR gRNA sequence
ttttttttttttttttgaga

SEQ ID NO: 768252 - DNA, 20 bp, Artificial
  CRISPR gRNA sequence
tcttgctctgttgcccaggc

SEQ ID NO: 768253 - DNA, 20 bp, Artificial
  CRISPR gRNA sequence
gcctcagcttcccaagtagc

SEQ ID NO: 768254 - DNA, 20 bp, Artificial
  CRISPR gRNA sequence
ttttgtatttttagtagaga

SEQ ID NO: 768255 - DNA, 20 bp, Artificial
  CRISPR gRNA sequence
gaacacttttctagcctccc

SEQ ID NO: 768256 - DNA, 20 bp, Artificial
  CRISPR gRNA sequence
ctgagttagggctcatatgc

SEQ ID NO: 768257 - DNA, 20 bp, Artificial
  CRISPR gRNA sequence
tatgcctgggttctgaccaa

SEQ ID NO: 768258 - DNA, 20 bp, Artificial
  CRISPR gRNA sequence
acaaacagcctcttagacct

SEQ ID NO: 768259 - DNA, 20 bp, Artificial
  CRISPR gRNA sequence
aagcttgaagttgaagaggg

SEQ ID NO: 768260 - DNA, 20 bp, Artificial
  CRISPR gRNA sequence
ctcacactatcacaggaagg

SEQ ID NO: 768261 - DNA, 20 bp, Artificial
  CRISPR gRNA sequence
tgcttaagcctctgtcgtat

SEQ ID NO: 768262 - DNA, 20 bp, Artificial
  CRISPR gRNA sequence
gggcctcaggtcactagtga

SEQ ID NO: 768263 - DNA, 20 bp, Artificial
  CRISPR gRNA sequence
gtctttaccttctttgctgt

SEQ ID NO: 768264 - DNA, 20 bp, Artificial
  CRISPR gRNA sequence
ggaggaaccatgggaagtgg

SEQ ID NO: 768265 - DNA, 20 bp, Artificial
  CRISPR gRNA sequence
ccatgggaagtggtggggta

SEQ ID NO: 768266 - DNA, 20 bp, Artificial
  CRISPR gRNA sequence
gtagggagtcaggcagaggg

SEQ ID NO: 768267 - DNA, 20 bp, Artificial
  CRISPR gRNA sequence
gaaggggcgggacaagtcag

SEQ ID NO: 768268 - DNA, 20 bp, Artificial
  CRISPR gRNA sequence
gccttagttttctgcatcta

SEQ ID NO: 768269 - DNA, 20 bp, Artificial
  CRISPR gRNA sequence
ccctgagcccaatgtacaca

SEQ ID NO: 768270 - DNA, 20 bp, Artificial
  CRISPR gRNA sequence
caggtgggcctgggaccatg

SEQ ID NO: 768271 - DNA, 20 bp, Artificial
  CRISPR gRNA sequence
tacatctgcctctgagcatg

SEQ ID NO: 768272 - DNA, 20 bp, Artificial
  CRISPR gRNA sequence
acgctgggcaccaacaggca

SEQ ID NO: 768273 - DNA, 20 bp, Artificial
  CRISPR gRNA sequence
tctcctgcccttccttctgc

SEQ ID NO: 768274 - DNA, 20 bp, Artificial
  CRISPR gRNA sequence
gaaacctgcctctcccagcc

SEQ ID NO: 768275 - DNA, 20 bp, Artificial
  CRISPR gRNA sequence
ctcccagcccaggatcccct

SEQ ID NO: 768276 - DNA, 20 bp, Artificial
  CRISPR gRNA sequence
gccctctggtgccatcaggg

SEQ ID NO: 768277 - DNA, 20 bp, Artificial
  CRISPR gRNA sequence
tggtgccatcagggcagggt

SEQ ID NO: 768278 - DNA, 20 bp, Artificial
  CRISPR gRNA sequence
gcctaatagtaataggactc

SEQ ID NO: 768279 - DNA, 20 bp, Artificial
  CRISPR gRNA sequence
attaataattcaaacaacct

SEQ ID NO: 768280 - DNA, 20 bp, Artificial
  CRISPR gRNA sequence
acggtgtggggccaatcagg

SEQ ID NO: 768281 - DNA, 20 bp, Artificial
  CRISPR gRNA sequence
ggtggaatcggccctggcag

SEQ ID NO: 768282 - DNA, 20 bp, Artificial
  CRISPR gRNA sequence
aagccacacctgggagggaa

SEQ ID NO: 768283 - DNA, 20 bp, Artificial
  CRISPR gRNA sequence
tgggcaaagagcagactcac

SEQ ID NO: 768284 - DNA, 20 bp, Artificial
  CRISPR gRNA sequence
actcaccggggtggggaggt

SEQ ID NO: 768285 - DNA, 20 bp, Artificial
  CRISPR gRNA sequence
aatctggcccctccagatcc

SEQ ID NO: 768286 - DNA, 20 bp, Artificial
  CRISPR gRNA sequence
ctcctgcaaaggcaagaact

SEQ ID NO: 768287 - DNA, 20 bp, Artificial
  CRISPR gRNA sequence
atgccagcactttcccacct

SEQ ID NO: 768288 - DNA, 20 bp, Artificial
  CRISPR gRNA sequence
aggaagctggtgaacagggc

SEQ ID NO: 768289 - DNA, 20 bp, Artificial
  CRISPR gRNA sequence
ctgcggaccaaatgctagac

SEQ ID NO: 768290 - DNA, 20 bp, Artificial
  CRISPR gRNA sequence
caaagaccatccacccagcc

SEQ ID NO: 768291 - DNA, 20 bp, Artificial
  CRISPR gRNA sequence
tcatgcatctgtttacccac

SEQ ID NO: 768292 - DNA, 20 bp, Artificial
  CRISPR gRNA sequence
tcacccacagggcctctggg

SEQ ID NO: 768293 - DNA, 20 bp, Artificial
  CRISPR gRNA sequence
cctcactgggccctaacact

SEQ ID NO: 768294 - DNA, 20 bp, Artificial
  CRISPR gRNA sequence
aagggctgaagagcctgtgg

SEQ ID NO: 768295 - DNA, 20 bp, Artificial
  CRISPR gRNA sequence
ctatggctccctagtgactt

SEQ ID NO: 768296 - DNA, 20 bp, Artificial
  CRISPR gRNA sequence
ctggtgacatctcccattct

SEQ ID NO: 768297 - DNA, 20 bp, Artificial
  CRISPR gRNA sequence
tgatggtttttacatttgta

SEQ ID NO: 768298 - DNA, 20 bp, Artificial
  CRISPR gRNA sequence
ccatttacagaaaatgttcg

SEQ ID NO: 768299 - DNA, 20 bp, Artificial
  CRISPR gRNA sequence
gatgaggtcactgacggggc

SEQ ID NO: 768300 - DNA, 20 bp, Artificial
  CRISPR gRNA sequence
acggggctggagtgagggct

SEQ ID NO: 768301 - DNA, 20 bp, Artificial
  CRISPR gRNA sequence
gagggcttggagtttcccca

SEQ ID NO: 768302 - DNA, 20 bp, Artificial
  CRISPR gRNA sequence
gtctgcaggggccttgccag

SEQ ID NO: 768303 - DNA, 20 bp, Artificial
  CRISPR gRNA sequence
cttagagctgtcacgtcaag

SEQ ID NO: 768304 - DNA, 20 bp, Artificial
  CRISPR gRNA sequence
atgaagttgaggacccaaag

SEQ ID NO: 768305 - DNA, 20 bp, Artificial
  CRISPR gRNA sequence
agcccagcccctgcacccag

SEQ ID NO: 768306 - DNA, 20 bp, Artificial
  CRISPR gRNA sequence
agcatagatgcacctcgtgc

SEQ ID NO: 768307 - DNA, 20 bp, Artificial
  CRISPR gRNA sequence
gctctggccattggaagcac

SEQ ID NO: 768308 - DNA, 20 bp, Artificial
  CRISPR gRNA sequence
gccatggaaatactcaagca

SEQ ID NO: 768309 - DNA, 20 bp, Artificial
  CRISPR gRNA sequence
ccagctggaggactgaaagt

SEQ ID NO: 768310 - DNA, 20 bp, Artificial
  CRISPR gRNA sequence
aggactgaaagtctgaatcc

SEQ ID NO: 768311 - DNA, 20 bp, Artificial
  CRISPR gRNA sequence
attaggctgagaggccaaag

SEQ ID NO: 768312 - DNA, 20 bp, Artificial
  CRISPR gRNA sequence
ccaggtctacagacccacgg

SEQ ID NO: 768313 - DNA, 20 bp, Artificial
  CRISPR gRNA sequence
tagagaggcagcgaaccctc

SEQ ID NO: 768314 - DNA, 20 bp, Artificial
  CRISPR gRNA sequence
catttatccaattttcaaag

SEQ ID NO: 768315 - DNA, 20 bp, Artificial
  CRISPR gRNA sequence
tcttgctctgtcacccaggc

SEQ ID NO: 768316 - DNA, 20 bp, Artificial
  CRISPR gRNA sequence
ttttgtgttttcagtagaga

SEQ ID NO: 768317 - DNA, 20 bp, Artificial
  CRISPR gRNA sequence
gccttggcctcccaaagtgc

SEQ ID NO: 768318 - DNA, 20 bp, Artificial
  CRISPR gRNA sequence
agctactcaagtttaaaata

SEQ ID NO: 768319 - DNA, 20 bp, Artificial
  CRISPR gRNA sequence
cgcaaatatccagctcagcc

SEQ ID NO: 768320 - DNA, 20 bp, Artificial
  CRISPR gRNA sequence
tctcctggagagcacaggaa

SEQ ID NO: 768321 - DNA, 20 bp, Artificial
  CRISPR gRNA sequence
agtgttttccatcttgggga

SEQ ID NO: 768322 - DNA, 20 bp, Artificial
  CRISPR gRNA sequence
gaaacacgtaagagagaagg

SEQ ID NO: 768323 - DNA, 20 bp, Artificial
  CRISPR gRNA sequence
ggtctcaagagggagaggac

SEQ ID NO: 768324 - DNA, 20 bp, Artificial
  CRISPR gRNA sequence
gagggagaggacaggaataa

SEQ ID NO: 768325 - DNA, 20 bp, Artificial
  CRISPR gRNA sequence
tgcatgcagacctggaaact

SEQ ID NO: 768326 - DNA, 20 bp, Artificial
  CRISPR gRNA sequence
acttggggtgagatcagaac

SEQ ID NO: 768327 - DNA, 20 bp, Artificial
  CRISPR gRNA sequence
cagagactaacaatcactaa

SEQ ID NO: 768328 - DNA, 20 bp, Artificial
  CRISPR gRNA sequence
cctgcccatccaacggctgc

SEQ ID NO: 768329 - DNA, 20 bp, Artificial
  CRISPR gRNA sequence
gccagctgtcactcaggctt

SEQ ID NO: 768330 - DNA, 20 bp, Artificial
  CRISPR gRNA sequence
tcagatggcgcccactgacc

SEQ ID NO: 768331 - DNA, 20 bp, Artificial
  CRISPR gRNA sequence
aataccttcctaccactcag

SEQ ID NO: 768332 - DNA, 20 bp, Artificial
  CRISPR gRNA sequence
gccacaccttgtggctgccc

SEQ ID NO: 768333 - DNA, 20 bp, Artificial
  CRISPR gRNA sequence
tataaatggttcttatcagc

SEQ ID NO: 768334 - DNA, 20 bp, Artificial
  CRISPR gRNA sequence
tcccttaaggacttgtgggg

SEQ ID NO: 768335 - DNA, 20 bp, Artificial
  CRISPR gRNA sequence
gagcacctgaagtctatgaa

SEQ ID NO: 768336 - DNA, 20 bp, Artificial
  CRISPR gRNA sequence
aacctatggaaattccacgt

SEQ ID NO: 768337 - DNA, 20 bp, Artificial
  CRISPR gRNA sequence
acgttagggtccagtaaaga

SEQ ID NO: 768338 - DNA, 20 bp, Artificial
  CRISPR gRNA sequence
gtgcgcatcctgctgcagca

SEQ ID NO: 768339 - DNA, 20 bp, Artificial
  CRISPR gRNA sequence
ctgccagaacacctcagcct

SEQ ID NO: 768340 - DNA, 20 bp, Artificial
  CRISPR gRNA sequence
cgcaggtccttgttgggctc

SEQ ID NO: 768341 - DNA, 20 bp, Artificial
  CRISPR gRNA sequence
ctccagggtcatgctgggct

SEQ ID NO: 768342 - DNA, 20 bp, Artificial
  CRISPR gRNA sequence
agctggaggtgacagagggc

SEQ ID NO: 768343 - DNA, 20 bp, Artificial
  CRISPR gRNA sequence
gggcaatggcaggggaggaa

SEQ ID NO: 768344 - DNA, 20 bp, Artificial
  CRISPR gRNA sequence
gaggaaaaggatgcatgggg

SEQ ID NO: 768345 - DNA, 20 bp, Artificial
  CRISPR gRNA sequence
ggatgcatggggctgagtac

SEQ ID NO: 768346 - DNA, 20 bp, Artificial
  CRISPR gRNA sequence
ctgagtacaggaatcagcac

SEQ ID NO: 768347 - DNA, 20 bp, Artificial
  CRISPR gRNA sequence
ctgggagcagtggtgcagca

SEQ ID NO: 768348 - DNA, 20 bp, Artificial
  CRISPR gRNA sequence
agcagagggtgggctgcaga

SEQ ID NO: 768349 - DNA, 20 bp, Artificial
  CRISPR gRNA sequence
ggtgggctgcagagggaatg

SEQ ID NO: 768350 - DNA, 20 bp, Artificial
  CRISPR gRNA sequence
acggcagcgctgccgaaatc

SEQ ID NO: 768351 - DNA, 20 bp, Artificial
  CRISPR gRNA sequence
cacgcacgcgctgcagcctc

SEQ ID NO: 768352 - DNA, 20 bp, Artificial
  CRISPR gRNA sequence
tcgggggagaaggagcagcg

SEQ ID NO: 768353 - DNA, 20 bp, Artificial
  CRISPR gRNA sequence
ggtgcccactagggccacca

SEQ ID NO: 768354 - DNA, 20 bp, Artificial
  CRISPR gRNA sequence
acctccacggctcctggggg

SEQ ID NO: 768355 - DNA, 20 bp, Artificial
  CRISPR gRNA sequence
tgggggcggggtcagagggg

SEQ ID NO: 768356 - DNA, 20 bp, Artificial
  CRISPR gRNA sequence
gggactctctaggctaccac

SEQ ID NO: 768357 - DNA, 20 bp, Artificial
  CRISPR gRNA sequence
agtctgaggactctcagata

SEQ ID NO: 768358 - DNA, 20 bp, Artificial
  CRISPR gRNA sequence
tctgagaacaatcacagcag

SEQ ID NO: 768359 - DNA, 20 bp, Artificial
  CRISPR gRNA sequence
tctcaccagctccagccctg

SEQ ID NO: 768360 - DNA, 20 bp, Artificial
  CRISPR gRNA sequence
agcaacctgtggggcttctc

SEQ ID NO: 768361 - DNA, 20 bp, Artificial
  CRISPR gRNA sequence
gtgcgcatcctgctgcagca

SEQ ID NO: 768362 - DNA, 20 bp, Artificial
  CRISPR gRNA sequence
tttgcacccagcaccacccg

SEQ ID NO: 768363 - DNA, 20 bp, Artificial
  CRISPR gRNA sequence
ctgccagaacacctcagcct

SEQ ID NO: 768364 - DNA, 20 bp, Artificial
  CRISPR gRNA sequence
cgcaggtccttgttgggctc

SEQ ID NO: 768365 - DNA, 20 bp, Artificial
  CRISPR gRNA sequence
ctccagggtcatgctgggct

SEQ ID NO: 768366 - DNA, 20 bp, Artificial
  CRISPR gRNA sequence
agctggaggtgacagagggc

SEQ ID NO: 768367 - DNA, 20 bp, Artificial
  CRISPR gRNA sequence
gggcaatggcagaggacgaa

SEQ ID NO: 768368 - DNA, 20 bp, Artificial
  CRISPR gRNA sequence
gacgaaaaggatgcatgggg

SEQ ID NO: 768369 - DNA, 20 bp, Artificial
  CRISPR gRNA sequence
ggatgcatggggctgagtac

SEQ ID NO: 768370 - DNA, 20 bp, Artificial
  CRISPR gRNA sequence
ctgagtacaggaatcagcac

SEQ ID NO: 768371 - DNA, 20 bp, Artificial
  CRISPR gRNA sequence
ctgggagcagtggtgcagca

SEQ ID NO: 768372 - DNA, 20 bp, Artificial
  CRISPR gRNA sequence
agcagggggtgggctgcagg

SEQ ID NO: 768373 - DNA, 20 bp, Artificial
  CRISPR gRNA sequence
ggtgggctgcagggggaatg

SEQ ID NO: 768374 - DNA, 20 bp, Artificial
  CRISPR gRNA sequence
acggcagcgctgccgaaatc

SEQ ID NO: 768375 - DNA, 20 bp, Artificial
  CRISPR gRNA sequence
cacgcacgcgctgcagcctc

SEQ ID NO: 768376 - DNA, 20 bp, Artificial
  CRISPR gRNA sequence
tcaggggagaaggagcagca

SEQ ID NO: 768377 - DNA, 20 bp, Artificial
  CRISPR gRNA sequence
ggtgcccaccagtgccacca

SEQ ID NO: 768378 - DNA, 20 bp, Artificial
  CRISPR gRNA sequence
cctggacctccagggctcct

SEQ ID NO: 768379 - DNA, 20 bp, Artificial
  CRISPR gRNA sequence
ccagggctcctgggggtagg

SEQ ID NO: 768380 - DNA, 20 bp, Artificial
  CRISPR gRNA sequence
acatataagggggactgagg

SEQ ID NO: 768381 - DNA, 20 bp, Artificial
  CRISPR gRNA sequence
tcttaggacctcattcagtc

SEQ ID NO: 768382 - DNA, 20 bp, Artificial
  CRISPR gRNA sequence
gtaagtaatgttataaattg

SEQ ID NO: 768383 - DNA, 20 bp, Artificial
  CRISPR gRNA sequence
agtggtttctctggaggaga

SEQ ID NO: 768384 - DNA, 20 bp, Artificial
  CRISPR gRNA sequence
cgatttgtttttatacaaga

SEQ ID NO: 768385 - DNA, 20 bp, Artificial
  CRISPR gRNA sequence
caattaagctgaaatttata

SEQ ID NO: 768386 - DNA, 20 bp, Artificial
  CRISPR gRNA sequence
atgacttgaagagaccagtg

SEQ ID NO: 768387 - DNA, 20 bp, Artificial
  CRISPR gRNA sequence
tgaggaatctaactttttct

SEQ ID NO: 768388 - DNA, 20 bp, Artificial
  CRISPR gRNA sequence
taactttttctatgagtaat

SEQ ID NO: 768389 - DNA, 20 bp, Artificial
  CRISPR gRNA sequence
atgagtaatgggaatcactg

SEQ ID NO: 768390 - DNA, 20 bp, Artificial
  CRISPR gRNA sequence
gtgttttaatcacgcataat

SEQ ID NO: 768391 - DNA, 20 bp, Artificial
  CRISPR gRNA sequence
cagctgtccctgtaagaggt

SEQ ID NO: 768392 - DNA, 20 bp, Artificial
  CRISPR gRNA sequence
gtgagggtggtgtggcttca

SEQ ID NO: 768393 - DNA, 20 bp, Artificial
  CRISPR gRNA sequence
gtggtagtagagaagaagag

SEQ ID NO: 768394 - DNA, 20 bp, Artificial
  CRISPR gRNA sequence
gattcaaggtttatttagga

SEQ ID NO: 768395 - DNA, 20 bp, Artificial
  CRISPR gRNA sequence
ggaatcaacaggacttgctg

SEQ ID NO: 768396 - DNA, 20 bp, Artificial
  CRISPR gRNA sequence
ggcatgggaggccgaggcag

SEQ ID NO: 768397 - DNA, 20 bp, Artificial
  CRISPR gRNA sequence
acctctactaaaaaatagcc

SEQ ID NO: 768398 - DNA, 20 bp, Artificial
  CRISPR gRNA sequence
tactcaggaggctgaggcag

SEQ ID NO: 768399 - DNA, 20 bp, Artificial
  CRISPR gRNA sequence
caaccttgaaacaatgctaa

SEQ ID NO: 768400 - DNA, 20 bp, Artificial
  CRISPR gRNA sequence
ttatggttattatttttatt

SEQ ID NO: 768401 - DNA, 20 bp, Artificial
  CRISPR gRNA sequence
ctaaagttcttaagctagcc

SEQ ID NO: 768402 - DNA, 20 bp, Artificial
  CRISPR gRNA sequence
tcatgccctgtcagtcgaac

SEQ ID NO: 768403 - DNA, 20 bp, Artificial
  CRISPR gRNA sequence
cccttggaggggacatttgg

SEQ ID NO: 768404 - DNA, 20 bp, Artificial
  CRISPR gRNA sequence
ctagagaaatcagagcagcc

SEQ ID NO: 768405 - DNA, 20 bp, Artificial
  CRISPR gRNA sequence
ctcagagcagagatgctgat

SEQ ID NO: 768406 - DNA, 20 bp, Artificial
  CRISPR gRNA sequence
atgagaatttgaaatgtgat

SEQ ID NO: 768407 - DNA, 20 bp, Artificial
  CRISPR gRNA sequence
tattaaagtagctattatta

SEQ ID NO: 768408 - DNA, 20 bp, Artificial
  CRISPR gRNA sequence
tgtgccaagcaccgtgtggg

SEQ ID NO: 768409 - DNA, 20 bp, Artificial
  CRISPR gRNA sequence
caagcaaacgccaggtgggg

SEQ ID NO: 768410 - DNA, 20 bp, Artificial
  CRISPR gRNA sequence
caggtgggggcgaatctagg

SEQ ID NO: 768411 - DNA, 20 bp, Artificial
  CRISPR gRNA sequence
cagaataacgcagggaggcc

SEQ ID NO: 768412 - DNA, 20 bp, Artificial
  CRISPR gRNA sequence
gcaaagacctccacaaaata

SEQ ID NO: 768413 - DNA, 20 bp, Artificial
  CRISPR gRNA sequence
tggaggctaagaacagtaac

SEQ ID NO: 768414 - DNA, 20 bp, Artificial
  CRISPR gRNA sequence
acagtaacgtgagttgccta

SEQ ID NO: 768415 - DNA, 20 bp, Artificial
  CRISPR gRNA sequence
ttgcctcatctctcctggac

SEQ ID NO: 768416 - DNA, 20 bp, Artificial
  CRISPR gRNA sequence
tcccaccgggccccctgctg

SEQ ID NO: 768417 - DNA, 20 bp, Artificial
  CRISPR gRNA sequence
ttggtgacagatgcttggca

SEQ ID NO: 768418 - DNA, 20 bp, Artificial
  CRISPR gRNA sequence
gggaggcctgacagggaaga

SEQ ID NO: 768419 - DNA, 20 bp, Artificial
  CRISPR gRNA sequence
aagatggggtagggggcagc

SEQ ID NO: 768420 - DNA, 20 bp, Artificial
  CRISPR gRNA sequence
aggttggcttgctctggggc

SEQ ID NO: 768421 - DNA, 20 bp, Artificial
  CRISPR gRNA sequence
ttgagagccactgaagcttc

SEQ ID NO: 768422 - DNA, 20 bp, Artificial
  CRISPR gRNA sequence
ctccacccgctatctgatgg

SEQ ID NO: 768423 - DNA, 20 bp, Artificial
  CRISPR gRNA sequence
agggctttgagagaccagtg

SEQ ID NO: 768424 - DNA, 20 bp, Artificial
  CRISPR gRNA sequence
ttgagagaccagtgaggaat

SEQ ID NO: 768425 - DNA, 20 bp, Artificial
  CRISPR gRNA sequence
tgaggaatttgggtttttct

SEQ ID NO: 768426 - DNA, 20 bp, Artificial
  CRISPR gRNA sequence
tgggtttttctatgagtaat

SEQ ID NO: 768427 - DNA, 20 bp, Artificial
  CRISPR gRNA sequence
ctctagctcctcagcataga

SEQ ID NO: 768428 - DNA, 20 bp, Artificial
  CRISPR gRNA sequence
agttaagaggctatttcagg

SEQ ID NO: 768429 - DNA, 20 bp, Artificial
  CRISPR gRNA sequence
actttgggaggctgaggcag

SEQ ID NO: 768430 - DNA, 20 bp, Artificial
  CRISPR gRNA sequence
caggcgaatcacttgaagtc

SEQ ID NO: 768431 - DNA, 20 bp, Artificial
  CRISPR gRNA sequence
ctgtaatcccagctacttgg

SEQ ID NO: 768432 - DNA, 20 bp, Artificial
  CRISPR gRNA sequence
tacttgggagggtgaggcag

SEQ ID NO: 768433 - DNA, 20 bp, Artificial
  CRISPR gRNA sequence
ttgcaccactgcactccaga

SEQ ID NO: 768434 - DNA, 20 bp, Artificial
  CRISPR gRNA sequence
cctgtaggaaggtatagtgg

SEQ ID NO: 768435 - DNA, 20 bp, Artificial
  CRISPR gRNA sequence
agacaggagacaaagcatgt

SEQ ID NO: 768436 - DNA, 20 bp, Artificial
  CRISPR gRNA sequence
aagtgacagtatctgaggac

SEQ ID NO: 768437 - DNA, 20 bp, Artificial
  CRISPR gRNA sequence
gtggttttgagcctcagtga

SEQ ID NO: 768438 - DNA, 20 bp, Artificial
  CRISPR gRNA sequence
cactgaggcagagaaaatgg

SEQ ID NO: 768439 - DNA, 20 bp, Artificial
  CRISPR gRNA sequence
ttgcaaagaagcttctagga

SEQ ID NO: 768440 - DNA, 20 bp, Artificial
  CRISPR gRNA sequence
tttaggaggcgactaggtgt

SEQ ID NO: 768441 - DNA, 20 bp, Artificial
  CRISPR gRNA sequence
gcgactaggtgtatgagtgt

SEQ ID NO: 768442 - DNA, 20 bp, Artificial
  CRISPR gRNA sequence
gctagcttaacacatctgta

SEQ ID NO: 768443 - DNA, 20 bp, Artificial
  CRISPR gRNA sequence
agtggaagaggcaaggactt

SEQ ID NO: 768444 - DNA, 20 bp, Artificial
  CRISPR gRNA sequence
cttggggatgacctcaaggc

SEQ ID NO: 768445 - DNA, 20 bp, Artificial
  CRISPR gRNA sequence
cctcaaggctggagtcagga

SEQ ID NO: 768446 - DNA, 20 bp, Artificial
  CRISPR gRNA sequence
ctgcaggtcaggcctgagct

SEQ ID NO: 768447 - DNA, 20 bp, Artificial
  CRISPR gRNA sequence
aggctgcacacaccttgtcc

SEQ ID NO: 768448 - DNA, 20 bp, Artificial
  CRISPR gRNA sequence
gccaaccaacactgatcaac

SEQ ID NO: 768449 - DNA, 20 bp, Artificial
  CRISPR gRNA sequence
taaaaaattaaagcccatgg

SEQ ID NO: 768450 - DNA, 20 bp, Artificial
  CRISPR gRNA sequence
cagcactttgggaggccgag

SEQ ID NO: 768451 - DNA, 20 bp, Artificial
  CRISPR gRNA sequence
actttgggaggccgaggtgg

SEQ ID NO: 768452 - DNA, 20 bp, Artificial
  CRISPR gRNA sequence
ggtgggtggatcacgaggtc

SEQ ID NO: 768453 - DNA, 20 bp, Artificial
  CRISPR gRNA sequence
tactcaggaggctgaggcag

SEQ ID NO: 768454 - DNA, 20 bp, Artificial
  CRISPR gRNA sequence
cccaggaggcggaggttgta

SEQ ID NO: 768455 - DNA, 20 bp, Artificial
  CRISPR gRNA sequence
tgccagtcagcacagccaaa

SEQ ID NO: 768456 - DNA, 20 bp, Artificial
  CRISPR gRNA sequence
acccccagcagctgggccaa

SEQ ID NO: 768457 - DNA, 20 bp, Artificial
  CRISPR gRNA sequence
cctcaaagccttactgcctg

SEQ ID NO: 768458 - DNA, 20 bp, Artificial
  CRISPR gRNA sequence
ctgcgggaagcaccagggct

SEQ ID NO: 768459 - DNA, 20 bp, Artificial
  CRISPR gRNA sequence
cccagacagaaccaaggcct

SEQ ID NO: 768460 - DNA, 20 bp, Artificial
  CRISPR gRNA sequence
cttctcttaggacctaagac

SEQ ID NO: 768461 - DNA, 20 bp, Artificial
  CRISPR gRNA sequence
tttcattcctttcctagact

SEQ ID NO: 768462 - DNA, 20 bp, Artificial
  CRISPR gRNA sequence
cccagaagcaaagagaccag

SEQ ID NO: 768463 - DNA, 20 bp, Artificial
  CRISPR gRNA sequence
cagaaaggaagtgctccctg

SEQ ID NO: 768464 - DNA, 20 bp, Artificial
  CRISPR gRNA sequence
aagtgctccctggagaatgg

SEQ ID NO: 768465 - DNA, 20 bp, Artificial
  CRISPR gRNA sequence
cacccatgttttccacaaag

SEQ ID NO: 768466 - DNA, 20 bp, Artificial
  CRISPR gRNA sequence
tccccagccgggacctgccc

SEQ ID NO: 768467 - DNA, 20 bp, Artificial
  CRISPR gRNA sequence
agcatgtgccacccgtcccg

SEQ ID NO: 768468 - DNA, 20 bp, Artificial
  CRISPR gRNA sequence
ttcacagagcagcaggagag

SEQ ID NO: 768469 - DNA, 20 bp, Artificial
  CRISPR gRNA sequence
ggccaaaatgccctgggcct

SEQ ID NO: 768470 - DNA, 20 bp, Artificial
  CRISPR gRNA sequence
ctgggcctggggatgcccaa

SEQ ID NO: 768471 - DNA, 20 bp, Artificial
  CRISPR gRNA sequence
acttcccacaaagggacaaa

SEQ ID NO: 768472 - DNA, 20 bp, Artificial
  CRISPR gRNA sequence
tgaaaatgtcagacaagtcc

SEQ ID NO: 768473 - DNA, 20 bp, Artificial
  CRISPR gRNA sequence
tttctattgtctgcaaccga

SEQ ID NO: 768474 - DNA, 20 bp, Artificial
  CRISPR gRNA sequence
gtctgcaaccgaaggagtcc

SEQ ID NO: 768475 - DNA, 20 bp, Artificial
  CRISPR gRNA sequence
gtaattcatttcactactta

SEQ ID NO: 768476 - DNA, 20 bp, Artificial
  CRISPR gRNA sequence
ctatttatgatatggtcagg

SEQ ID NO: 768477 - DNA, 20 bp, Artificial
  CRISPR gRNA sequence
gcccctcagccagatcaccc

SEQ ID NO: 768478 - DNA, 20 bp, Artificial
  CRISPR gRNA sequence
tagaaaatgagcccaaagtg

SEQ ID NO: 768479 - DNA, 20 bp, Artificial
  CRISPR gRNA sequence
acctataaaagaaaagcttt

SEQ ID NO: 768480 - DNA, 20 bp, Artificial
  CRISPR gRNA sequence
ttttctccctttttaagaga

SEQ ID NO: 768481 - DNA, 20 bp, Artificial
  CRISPR gRNA sequence
tcccgctctgtcacccaggc

SEQ ID NO: 768482 - DNA, 20 bp, Artificial
  CRISPR gRNA sequence
gatcctcctgcctcagcctc

SEQ ID NO: 768483 - DNA, 20 bp, Artificial
  CRISPR gRNA sequence
gatcccagccttacttgcag

SEQ ID NO: 768484 - DNA, 20 bp, Artificial
  CRISPR gRNA sequence
tacactgatgtgtacagctt

SEQ ID NO: 768485 - DNA, 20 bp, Artificial
  CRISPR gRNA sequence
gagggactgtagtatcagcc

SEQ ID NO: 768486 - DNA, 20 bp, Artificial
  CRISPR gRNA sequence
ggatatacccagatggtcac

SEQ ID NO: 768487 - DNA, 20 bp, Artificial
  CRISPR gRNA sequence
cgaacaggagactatctcat

SEQ ID NO: 768488 - DNA, 20 bp, Artificial
  CRISPR gRNA sequence
agactatctcatcagagtca

SEQ ID NO: 768489 - DNA, 20 bp, Artificial
  CRISPR gRNA sequence
cccagctttggacaaatgtc

SEQ ID NO: 768490 - DNA, 20 bp, Artificial
  CRISPR gRNA sequence
agttcctactgagctcgact

SEQ ID NO: 768491 - DNA, 20 bp, Artificial
  CRISPR gRNA sequence
ggtggtgacagaaccaaagg

SEQ ID NO: 768492 - DNA, 20 bp, Artificial
  CRISPR gRNA sequence
atgtgaccccttggaccaca

SEQ ID NO: 768493 - DNA, 20 bp, Artificial
  CRISPR gRNA sequence
gaccccttggaccacacaga

SEQ ID NO: 768494 - DNA, 20 bp, Artificial
  CRISPR gRNA sequence
cctctgccatcctcttctga

SEQ ID NO: 768495 - DNA, 20 bp, Artificial
  CRISPR gRNA sequence
catcctcttctgatggagtt

SEQ ID NO: 768496 - DNA, 20 bp, Artificial
  CRISPR gRNA sequence
tgatggagttcagaatgggg

SEQ ID NO: 768497 - DNA, 20 bp, Artificial
  CRISPR gRNA sequence
cagaatggggaggagtttta

SEQ ID NO: 768498 - DNA, 20 bp, Artificial
  CRISPR gRNA sequence
ttccatttcacccagttaaa

SEQ ID NO: 768499 - DNA, 20 bp, Artificial
  CRISPR gRNA sequence
caatgctcaataatttgttg

SEQ ID NO: 768500 - DNA, 20 bp, Artificial
  CRISPR gRNA sequence
atttgttggtggattaaaaa

SEQ ID NO: 768501 - DNA, 20 bp, Artificial
  CRISPR gRNA sequence
gttggtggattaaaaaaaga

SEQ ID NO: 768502 - DNA, 20 bp, Artificial
  CRISPR gRNA sequence
gtggattaaaaaaagaatga

SEQ ID NO: 768503 - DNA, 20 bp, Artificial
  CRISPR gRNA sequence
tctcctctctctgctggtgt

SEQ ID NO: 768504 - DNA, 20 bp, Artificial
  CRISPR gRNA sequence
aaggtcctcagggagaggac

SEQ ID NO: 768505 - DNA, 20 bp, Artificial
  CRISPR gRNA sequence
gcccacagcaccatctgtcc

SEQ ID NO: 768506 - DNA, 20 bp, Artificial
  CRISPR gRNA sequence
ccatccaccattcagtacac

SEQ ID NO: 768507 - DNA, 20 bp, Artificial
  CRISPR gRNA sequence
ccattcagtacaccggggtt

SEQ ID NO: 768508 - DNA, 20 bp, Artificial
  CRISPR gRNA sequence
attggttccaggactttgtc

SEQ ID NO: 768509 - DNA, 20 bp, Artificial
  CRISPR gRNA sequence
gcattggccatgcatgcaat

SEQ ID NO: 768510 - DNA, 20 bp, Artificial
  CRISPR gRNA sequence
atgcaatatgaatggagatg

SEQ ID NO: 768511 - DNA, 20 bp, Artificial
  CRISPR gRNA sequence
acatataaatattcaactac

SEQ ID NO: 768512 - DNA, 20 bp, Artificial
  CRISPR gRNA sequence
attattatcctatttcaccg

SEQ ID NO: 768513 - DNA, 20 bp, Artificial
  CRISPR gRNA sequence
tttcaccgaggagtaaattc

SEQ ID NO: 768514 - DNA, 20 bp, Artificial
  CRISPR gRNA sequence
aaacaaatatatcattaaaa

SEQ ID NO: 768515 - DNA, 20 bp, Artificial
  CRISPR gRNA sequence
acatttatacaaggtattgt

SEQ ID NO: 768516 - DNA, 20 bp, Artificial
  CRISPR gRNA sequence
acgaggcagtaggcttaaac

SEQ ID NO: 768517 - DNA, 20 bp, Artificial
  CRISPR gRNA sequence
gtaggcttaaacctggatga

SEQ ID NO: 768518 - DNA, 20 bp, Artificial
  CRISPR gRNA sequence
tgagggacgtagatggggac

SEQ ID NO: 768519 - DNA, 20 bp, Artificial
  CRISPR gRNA sequence
gacgtagatggggactcgga

SEQ ID NO: 768520 - DNA, 20 bp, Artificial
  CRISPR gRNA sequence
ctgtgcacagcaggaaactg

SEQ ID NO: 768521 - DNA, 20 bp, Artificial
  CRISPR gRNA sequence
ccccactcagtgattagttc

SEQ ID NO: 768522 - DNA, 20 bp, Artificial
  CRISPR gRNA sequence
ttcttgttgagattactaag

SEQ ID NO: 768523 - DNA, 20 bp, Artificial
  CRISPR gRNA sequence
tgtctgctaccaacaatcta

SEQ ID NO: 768524 - DNA, 20 bp, Artificial
  CRISPR gRNA sequence
gaggcagagatggaagctag

SEQ ID NO: 768525 - DNA, 20 bp, Artificial
  CRISPR gRNA sequence
aagtcaccatcatctcttgc

SEQ ID NO: 768526 - DNA, 20 bp, Artificial
  CRISPR gRNA sequence
tctatactctatacaacagc

SEQ ID NO: 768527 - DNA, 20 bp, Artificial
  CRISPR gRNA sequence
gtttcttcttcctagatgac

SEQ ID NO: 768528 - DNA, 20 bp, Artificial
  CRISPR gRNA sequence
gctcacatgcccttccacaa

SEQ ID NO: 768529 - DNA, 20 bp, Artificial
  CRISPR gRNA sequence
aggtaacacctccatattct

SEQ ID NO: 768530 - DNA, 20 bp, Artificial
  CRISPR gRNA sequence
tagcaatggcttggcacata

SEQ ID NO: 768531 - DNA, 20 bp, Artificial
  CRISPR gRNA sequence
ggttctcaatgcacgattca

SEQ ID NO: 768532 - DNA, 20 bp, Artificial
  CRISPR gRNA sequence
atgcacgattcaatgagtga

SEQ ID NO: 768533 - DNA, 20 bp, Artificial
  CRISPR gRNA sequence
acgattcaatgagtgaacga

SEQ ID NO: 768534 - DNA, 20 bp, Artificial
  CRISPR gRNA sequence
atgtgtgtttagatagagag

SEQ ID NO: 768535 - DNA, 20 bp, Artificial
  CRISPR gRNA sequence
atagagagatggatagatat

SEQ ID NO: 768536 - DNA, 20 bp, Artificial
  CRISPR gRNA sequence
agagatggatagatatatgg

SEQ ID NO: 768537 - DNA, 20 bp, Artificial
  CRISPR gRNA sequence
atggatagatatatggatgg

SEQ ID NO: 768538 - DNA, 20 bp, Artificial
  CRISPR gRNA sequence
tggatgtttgtatatgggga

SEQ ID NO: 768539 - DNA, 20 bp, Artificial
  CRISPR gRNA sequence
tttgtatatggggaaaggat

SEQ ID NO: 768540 - DNA, 20 bp, Artificial
  CRISPR gRNA sequence
gggaaaggatctggatgcct

SEQ ID NO: 768541 - DNA, 20 bp, Artificial
  CRISPR gRNA sequence
aaggatctggatgcctgaga

SEQ ID NO: 768542 - DNA, 20 bp, Artificial
  CRISPR gRNA sequence
cctgagagtgaatgcaactc

SEQ ID NO: 768543 - DNA, 20 bp, Artificial
  CRISPR gRNA sequence
tgaatgcaactctggagtgt

SEQ ID NO: 768544 - DNA, 20 bp, Artificial
  CRISPR gRNA sequence
caactctggagtgtcagaat

SEQ ID NO: 768545 - DNA, 20 bp, Artificial
  CRISPR gRNA sequence
tggagtgtcagaataagggt

SEQ ID NO: 768546 - DNA, 20 bp, Artificial
  CRISPR gRNA sequence
aggccaaaccccttgccttt

SEQ ID NO: 768547 - DNA, 20 bp, Artificial
  CRISPR gRNA sequence
cttcatctcctcaaccatca

SEQ ID NO: 768548 - DNA, 20 bp, Artificial
  CRISPR gRNA sequence
agtgtttaagaagatgactt

SEQ ID NO: 768549 - DNA, 20 bp, Artificial
  CRISPR gRNA sequence
agtttgctcatttgtaaaat

SEQ ID NO: 768550 - DNA, 20 bp, Artificial
  CRISPR gRNA sequence
gattataaaccttaccctca

SEQ ID NO: 768551 - DNA, 20 bp, Artificial
  CRISPR gRNA sequence
cagcctcagaaaagagatgg

SEQ ID NO: 768552 - DNA, 20 bp, Artificial
  CRISPR gRNA sequence
aaaagagatgggagggtccc

SEQ ID NO: 768553 - DNA, 20 bp, Artificial
  CRISPR gRNA sequence
ccttcctttttcctgataat

SEQ ID NO: 768554 - DNA, 20 bp, Artificial
  CRISPR gRNA sequence
ccgtgatcccacccaagagc

SEQ ID NO: 768555 - DNA, 20 bp, Artificial
  CRISPR gRNA sequence
cctctccaagcgatttctgt

SEQ ID NO: 768556 - DNA, 20 bp, Artificial
  CRISPR gRNA sequence
gaggaggtccagccaaaaga

SEQ ID NO: 768557 - DNA, 20 bp, Artificial
  CRISPR gRNA sequence
aaagaagggatggcaacaag

SEQ ID NO: 768558 - DNA, 20 bp, Artificial
  CRISPR gRNA sequence
agaatagggagaggaaggaa

SEQ ID NO: 768559 - DNA, 20 bp, Artificial
  CRISPR gRNA sequence
accacatcagagcgcagatt

SEQ ID NO: 768560 - DNA, 20 bp, Artificial
  CRISPR gRNA sequence
ctgcattcactcaatatctg

SEQ ID NO: 768561 - DNA, 20 bp, Artificial
  CRISPR gRNA sequence
tttccagactgcactcaagg

SEQ ID NO: 768562 - DNA, 20 bp, Artificial
  CRISPR gRNA sequence
tctaagcaccagacccctct

SEQ ID NO: 768563 - DNA, 20 bp, Artificial
  CRISPR gRNA sequence
tacagatggaaatctggacc

SEQ ID NO: 768564 - DNA, 20 bp, Artificial
  CRISPR gRNA sequence
ctatctctcttcctcactta

SEQ ID NO: 768565 - DNA, 20 bp, Artificial
  CRISPR gRNA sequence
tctcttcctcacttattgaa

SEQ ID NO: 768566 - DNA, 20 bp, Artificial
  CRISPR gRNA sequence
accaggctgccttgcctgcc

SEQ ID NO: 768567 - DNA, 20 bp, Artificial
  CRISPR gRNA sequence
gagctcagaagccagcagcc

SEQ ID NO: 768568 - DNA, 20 bp, Artificial
  CRISPR gRNA sequence
caattccaaatctctaaaat

SEQ ID NO: 768569 - DNA, 20 bp, Artificial
  CRISPR gRNA sequence
ctaccccacagggctgctgt

SEQ ID NO: 768570 - DNA, 20 bp, Artificial
  CRISPR gRNA sequence
ctaggagcctgcattgcctc

SEQ ID NO: 768571 - DNA, 20 bp, Artificial
  CRISPR gRNA sequence
gggagcactggtcagaactg

SEQ ID NO: 768572 - DNA, 20 bp, Artificial
  CRISPR gRNA sequence
gctgtgaaggccactagtca

SEQ ID NO: 768573 - DNA, 20 bp, Artificial
  CRISPR gRNA sequence
ccccttctctggttccccag

SEQ ID NO: 768574 - DNA, 20 bp, Artificial
  CRISPR gRNA sequence
tcttaccgggctccagaaag

SEQ ID NO: 768575 - DNA, 20 bp, Artificial
  CRISPR gRNA sequence
gttaatgataccctacctca

SEQ ID NO: 768576 - DNA, 20 bp, Artificial
  CRISPR gRNA sequence
ctacctcataggattactat

SEQ ID NO: 768577 - DNA, 20 bp, Artificial
  CRISPR gRNA sequence
actgcaagggcggtagaact

SEQ ID NO: 768578 - DNA, 20 bp, Artificial
  CRISPR gRNA sequence
tagaactgggggtggcaggc

SEQ ID NO: 768579 - DNA, 20 bp, Artificial
  CRISPR gRNA sequence
acgtggcccccttccaggtg

SEQ ID NO: 768580 - DNA, 20 bp, Artificial
  CRISPR gRNA sequence
ctctccccctcccctaggcc

SEQ ID NO: 768581 - DNA, 20 bp, Artificial
  CRISPR gRNA sequence
ttccctaacactcctgccct

SEQ ID NO: 768582 - DNA, 20 bp, Artificial
  CRISPR gRNA sequence
gagaagtcgccacccactca

SEQ ID NO: 768583 - DNA, 20 bp, Artificial
  CRISPR gRNA sequence
gtcataatctcagaggctgc

SEQ ID NO: 768584 - DNA, 20 bp, Artificial
  CRISPR gRNA sequence
cttgttctacaacattttct

SEQ ID NO: 768585 - DNA, 20 bp, Artificial
  CRISPR gRNA sequence
aggagtctctttaggtgctg

SEQ ID NO: 768586 - DNA, 20 bp, Artificial
  CRISPR gRNA sequence
agaaagccaaagtttaatga

SEQ ID NO: 768587 - DNA, 20 bp, Artificial
  CRISPR gRNA sequence
gacattcagccaaccctcca

SEQ ID NO: 768588 - DNA, 20 bp, Artificial
  CRISPR gRNA sequence
agaggggacaggaaggaaaa

SEQ ID NO: 768589 - DNA, 20 bp, Artificial
  CRISPR gRNA sequence
aagctcatgtctcacagcac

SEQ ID NO: 768590 - DNA, 20 bp, Artificial
  CRISPR gRNA sequence
tgtctcacagcacaggagtc

SEQ ID NO: 768591 - DNA, 20 bp, Artificial
  CRISPR gRNA sequence
aaggaaaatttcattcacat

SEQ ID NO: 768592 - DNA, 20 bp, Artificial
  CRISPR gRNA sequence
ctcagtgatagatcccatat

SEQ ID NO: 768593 - DNA, 20 bp, Artificial
  CRISPR gRNA sequence
gcagggagggccctgggcgc

SEQ ID NO: 768594 - DNA, 20 bp, Artificial
  CRISPR gRNA sequence
ccttctagtgtgcccccact

SEQ ID NO: 768595 - DNA, 20 bp, Artificial
  CRISPR gRNA sequence
ccgtctctacctgtccttcc

SEQ ID NO: 768596 - DNA, 20 bp, Artificial
  CRISPR gRNA sequence
cttcgccctgctgggccctg

SEQ ID NO: 768597 - DNA, 20 bp, Artificial
  CRISPR gRNA sequence
ccggcccggtccgcagcttc

SEQ ID NO: 768598 - DNA, 20 bp, Artificial
  CRISPR gRNA sequence
tcaacccgaggaaagggggg

SEQ ID NO: 768599 - DNA, 20 bp, Artificial
  CRISPR gRNA sequence
ccgaggaaaggggggcgggg

SEQ ID NO: 768600 - DNA, 20 bp, Artificial
  CRISPR gRNA sequence
cgggaacgtgcggacctccg

SEQ ID NO: 768601 - DNA, 20 bp, Artificial
  CRISPR gRNA sequence
ccgccgcagcgaggcccggc

SEQ ID NO: 768602 - DNA, 20 bp, Artificial
  CRISPR gRNA sequence
tgggggccgggggcggcccg

SEQ ID NO: 768603 - DNA, 20 bp, Artificial
  CRISPR gRNA sequence
gggcggggcgggccgcgccg

SEQ ID NO: 768604 - DNA, 20 bp, Artificial
  CRISPR gRNA sequence
gctccggtgcgtccctgagg

SEQ ID NO: 768605 - DNA, 20 bp, Artificial
  CRISPR gRNA sequence
agccgcctttccgggcctca

SEQ ID NO: 768606 - DNA, 20 bp, Artificial
  CRISPR gRNA sequence
ggaccgggccgggtgggtga

SEQ ID NO: 768607 - DNA, 20 bp, Artificial
  CRISPR gRNA sequence
ggggcagatctgtcccgtgt

SEQ ID NO: 768608 - DNA, 20 bp, Artificial
  CRISPR gRNA sequence
agccgtgggcagcatgaggg

SEQ ID NO: 768609 - DNA, 20 bp, Artificial
  CRISPR gRNA sequence
gtggggagggaattgggatg

SEQ ID NO: 768610 - DNA, 20 bp, Artificial
  CRISPR gRNA sequence
agggaattgggatgggcagt

SEQ ID NO: 768611 - DNA, 20 bp, Artificial
  CRISPR gRNA sequence
gtgggggcacactagaaggg

SEQ ID NO: 768612 - DNA, 20 bp, Artificial
  CRISPR gRNA sequence
gcgcccagggccctccctgc

SEQ ID NO: 768613 - DNA, 20 bp, Artificial
  CRISPR gRNA sequence
accgtttagctagcgaattg

SEQ ID NO: 768614 - DNA, 20 bp, Artificial
  CRISPR gRNA sequence
caggtttggcagcctaaggc

SEQ ID NO: 768615 - DNA, 20 bp, Artificial
  CRISPR gRNA sequence
ttaagcaaatagtaaagcaa

SEQ ID NO: 768616 - DNA, 20 bp, Artificial
  CRISPR gRNA sequence
ttagttgtcttaatttagaa

SEQ ID NO: 768617 - DNA, 20 bp, Artificial
  CRISPR gRNA sequence
ttataagcatgtcttcagca

SEQ ID NO: 768618 - DNA, 20 bp, Artificial
  CRISPR gRNA sequence
tctatattagaaagtaatga

SEQ ID NO: 768619 - DNA, 20 bp, Artificial
  CRISPR gRNA sequence
gggggactgcaaataggtgg

SEQ ID NO: 768620 - DNA, 20 bp, Artificial
  CRISPR gRNA sequence
tttcctgatatctggagttc

SEQ ID NO: 768621 - DNA, 20 bp, Artificial
  CRISPR gRNA sequence
ggaaatttacatacgtcacc

SEQ ID NO: 768622 - DNA, 20 bp, Artificial
  CRISPR gRNA sequence
tttgggtcagccctgtggac

SEQ ID NO: 768623 - DNA, 20 bp, Artificial
  CRISPR gRNA sequence
gcaaggggacgctggcggga

SEQ ID NO: 768624 - DNA, 20 bp, Artificial
  CRISPR gRNA sequence
catgtccttatggcattact

SEQ ID NO: 768625 - DNA, 20 bp, Artificial
  CRISPR gRNA sequence
ggtggtttctcctgcctgca

SEQ ID NO: 768626 - DNA, 20 bp, Artificial
  CRISPR gRNA sequence
ctcctgcctgcagtaagctt

SEQ ID NO: 768627 - DNA, 20 bp, Artificial
  CRISPR gRNA sequence
agactcctgtgctgtgagac

SEQ ID NO: 768628 - DNA, 20 bp, Artificial
  CRISPR gRNA sequence
ggggtgttggaatctgagga

SEQ ID NO: 768629 - DNA, 20 bp, Artificial
  CRISPR gRNA sequence
tcatgttcatatacctgaca

SEQ ID NO: 768630 - DNA, 20 bp, Artificial
  CRISPR gRNA sequence
atatacctgacagctggctt

SEQ ID NO: 768631 - DNA, 20 bp, Artificial
  CRISPR gRNA sequence
tgagaattccatcattaaac

SEQ ID NO: 768632 - DNA, 20 bp, Artificial
  CRISPR gRNA sequence
gtaaatctttgttctttgga

SEQ ID NO: 768633 - DNA, 20 bp, Artificial
  CRISPR gRNA sequence
tttgttctttggagtaggat

SEQ ID NO: 768634 - DNA, 20 bp, Artificial
  CRISPR gRNA sequence
tttgacaaggagctggacaa

SEQ ID NO: 768635 - DNA, 20 bp, Artificial
  CRISPR gRNA sequence
atggtacttggttgcacata

SEQ ID NO: 768636 - DNA, 20 bp, Artificial
  CRISPR gRNA sequence
tgaccaaatccaagcagcct

SEQ ID NO: 768637 - DNA, 20 bp, Artificial
  CRISPR gRNA sequence
ggaggatgacgttactgccc

SEQ ID NO: 768638 - DNA, 20 bp, Artificial
  CRISPR gRNA sequence
agaggggtgaggactggtcc

SEQ ID NO: 768639 - DNA, 20 bp, Artificial
  CRISPR gRNA sequence
cagtgtgccagataggagca

SEQ ID NO: 768640 - DNA, 20 bp, Artificial
  CRISPR gRNA sequence
cagataggagcattgggttt

SEQ ID NO: 768641 - DNA, 20 bp, Artificial
  CRISPR gRNA sequence
aatggtggagctgggctgtt

SEQ ID NO: 768642 - DNA, 20 bp, Artificial
  CRISPR gRNA sequence
ggctgttgtctgcttccaga

SEQ ID NO: 768643 - DNA, 20 bp, Artificial
  CRISPR gRNA sequence
ctgctgctctggaggtaggc

SEQ ID NO: 768644 - DNA, 20 bp, Artificial
  CRISPR gRNA sequence
agccctggactttatcatgc

SEQ ID NO: 768645 - DNA, 20 bp, Artificial
  CRISPR gRNA sequence
tctgaccttctctaggcata

SEQ ID NO: 768646 - DNA, 20 bp, Artificial
  CRISPR gRNA sequence
ccatctaggaggccttgtcc

SEQ ID NO: 768647 - DNA, 20 bp, Artificial
  CRISPR gRNA sequence
gcaataataataattattac

SEQ ID NO: 768648 - DNA, 20 bp, Artificial
  CRISPR gRNA sequence
ctcacagcagccctgtgggg

SEQ ID NO: 768649 - DNA, 20 bp, Artificial
  CRISPR gRNA sequence
agggattgttacccccattt

SEQ ID NO: 768650 - DNA, 20 bp, Artificial
  CRISPR gRNA sequence
tgttcagcaaggcatcggtg

SEQ ID NO: 768651 - DNA, 20 bp, Artificial
  CRISPR gRNA sequence
caggattgaaacccaaggct

SEQ ID NO: 768652 - DNA, 20 bp, Artificial
  CRISPR gRNA sequence
cctgggcaggcaaggcagcc

SEQ ID NO: 768653 - DNA, 20 bp, Artificial
  CRISPR gRNA sequence
cagccggccaccactctggg

SEQ ID NO: 768654 - DNA, 20 bp, Artificial
  CRISPR gRNA sequence
cttctagctctgaggactgg

SEQ ID NO: 768655 - DNA, 20 bp, Artificial
  CRISPR gRNA sequence
gctacactccgagaggggtc

SEQ ID NO: 768656 - DNA, 20 bp, Artificial
  CRISPR gRNA sequence
cttccttgagtgcagtctgg

SEQ ID NO: 768657 - DNA, 20 bp, Artificial
  CRISPR gRNA sequence
tggaaaggcttctggaaagg

SEQ ID NO: 768658 - DNA, 20 bp, Artificial
  CRISPR gRNA sequence
ggaaaggataggatttccag

SEQ ID NO: 768659 - DNA, 20 bp, Artificial
  CRISPR gRNA sequence
tggacctcctctgggcccaa

SEQ ID NO: 768660 - DNA, 20 bp, Artificial
  CRISPR gRNA sequence
atttccacatgcatgtatag

SEQ ID NO: 768661 - DNA, 20 bp, Artificial
  CRISPR gRNA sequence
tagttccagggagaccttag

SEQ ID NO: 768662 - DNA, 20 bp, Artificial
  CRISPR gRNA sequence
actgtcctgactcacacaga

SEQ ID NO: 768663 - DNA, 20 bp, Artificial
  CRISPR gRNA sequence
gaaatcgcttggagaggaag

SEQ ID NO: 768664 - DNA, 20 bp, Artificial
  CRISPR gRNA sequence
acataaaaggcccaaactga

SEQ ID NO: 768665 - DNA, 20 bp, Artificial
  CRISPR gRNA sequence
gagcacctagtattaactag

SEQ ID NO: 768666 - DNA, 20 bp, Artificial
  CRISPR gRNA sequence
ctataatcatcctatgaggg

SEQ ID NO: 768667 - DNA, 20 bp, Artificial
  CRISPR gRNA sequence
gctcagagaggatattttca

SEQ ID NO: 768668 - DNA, 20 bp, Artificial
  CRISPR gRNA sequence
attactaggaagtgacagag

SEQ ID NO: 768669 - DNA, 20 bp, Artificial
  CRISPR gRNA sequence
actagtgctaacttcttcca

SEQ ID NO: 768670 - DNA, 20 bp, Artificial
  CRISPR gRNA sequence
aacttcttccatgaagcttc

SEQ ID NO: 768671 - DNA, 20 bp, Artificial
  CRISPR gRNA sequence
gatgaagacccagaaaggca

SEQ ID NO: 768672 - DNA, 20 bp, Artificial
  CRISPR gRNA sequence
gtccaggatatctctgttgt

SEQ ID NO: 768673 - DNA, 20 bp, Artificial
  CRISPR gRNA sequence
ttagagtggcagatctctta

SEQ ID NO: 768674 - DNA, 20 bp, Artificial
  CRISPR gRNA sequence
gtgttaccttttatcttagt

SEQ ID NO: 768675 - DNA, 20 bp, Artificial
  CRISPR gRNA sequence
atataaagaaaaaaaggtta

SEQ ID NO: 768676 - DNA, 20 bp, Artificial
  CRISPR gRNA sequence
agacagtatgggggcagcac

SEQ ID NO: 768677 - DNA, 20 bp, Artificial
  CRISPR gRNA sequence
cacaaggaaagtgaacagcc

SEQ ID NO: 768678 - DNA, 20 bp, Artificial
  CRISPR gRNA sequence
attgaaggcagtgatataat

SEQ ID NO: 768679 - DNA, 20 bp, Artificial
  CRISPR gRNA sequence
attctggctgttgtatagag

SEQ ID NO: 768680 - DNA, 20 bp, Artificial
  CRISPR gRNA sequence
gaaggtgaacagactggtga

SEQ ID NO: 768681 - DNA, 20 bp, Artificial
  CRISPR gRNA sequence
atttaagaaaaaaaaaaaag

SEQ ID NO: 768682 - DNA, 20 bp, Artificial
  CRISPR gRNA sequence
gtacctaggcagtctatgtg

SEQ ID NO: 768683 - DNA, 20 bp, Artificial
  CRISPR gRNA sequence
ctaggcagtctatgtgtgca

SEQ ID NO: 768684 - DNA, 20 bp, Artificial
  CRISPR gRNA sequence
gtgcagcttgcttcaggaat

SEQ ID NO: 768685 - DNA, 20 bp, Artificial
  CRISPR gRNA sequence
tcaggaataggggcttaaat

SEQ ID NO: 768686 - DNA, 20 bp, Artificial
  CRISPR gRNA sequence
gttttagggctctatatcct

SEQ ID NO: 768687 - DNA, 20 bp, Artificial
  CRISPR gRNA sequence
ttccatctctgcctctgttc

SEQ ID NO: 768688 - DNA, 20 bp, Artificial
  CRISPR gRNA sequence
tcatttgtttggatcaattc

SEQ ID NO: 768689 - DNA, 20 bp, Artificial
  CRISPR gRNA sequence
cagcaaggctctggggaagt

SEQ ID NO: 768690 - DNA, 20 bp, Artificial
  CRISPR gRNA sequence
tggggaagtctctgattggg

SEQ ID NO: 768691 - DNA, 20 bp, Artificial
  CRISPR gRNA sequence
aagtctctgattgggtgtgg

SEQ ID NO: 768692 - DNA, 20 bp, Artificial
  CRISPR gRNA sequence
aatcactgagtgggggcagg

SEQ ID NO: 768693 - DNA, 20 bp, Artificial
  CRISPR gRNA sequence
agaagatgttaagaaggaat

SEQ ID NO: 768694 - DNA, 20 bp, Artificial
  CRISPR gRNA sequence
ggccatacggggaggtgctc

SEQ ID NO: 768695 - DNA, 20 bp, Artificial
  CRISPR gRNA sequence
ctgtatttgtcttctggccc

SEQ ID NO: 768696 - DNA, 20 bp, Artificial
  CRISPR gRNA sequence
acacgtgggtcacagtattc

SEQ ID NO: 768697 - DNA, 20 bp, Artificial
  CRISPR gRNA sequence
ttccacagtttcctgctgtg

SEQ ID NO: 768698 - DNA, 20 bp, Artificial
  CRISPR gRNA sequence
agcctccccagcccccagtg

SEQ ID NO: 768699 - DNA, 20 bp, Artificial
  CRISPR gRNA sequence
gaatggcttgaccctttcat

SEQ ID NO: 768700 - DNA, 20 bp, Artificial
  CRISPR gRNA sequence
atattctattttaatgatat

SEQ ID NO: 768701 - DNA, 20 bp, Artificial
  CRISPR gRNA sequence
tctatttttaatatgaaaat

SEQ ID NO: 768702 - DNA, 20 bp, Artificial
  CRISPR gRNA sequence
cctacttcacagaattgttg

SEQ ID NO: 768703 - DNA, 20 bp, Artificial
  CRISPR gRNA sequence
atttagaacagagcctggtg

SEQ ID NO: 768704 - DNA, 20 bp, Artificial
  CRISPR gRNA sequence
ctgtagttgaatatttatat

SEQ ID NO: 768705 - DNA, 20 bp, Artificial
  CRISPR gRNA sequence
agacttgagacagggaaata

SEQ ID NO: 768706 - DNA, 20 bp, Artificial
  CRISPR gRNA sequence
accagttttatggggaagat

SEQ ID NO: 768707 - DNA, 20 bp, Artificial
  CRISPR gRNA sequence
agcccactagtaggcacttg

SEQ ID NO: 768708 - DNA, 20 bp, Artificial
  CRISPR gRNA sequence
aggcacttgcatggcttcac

SEQ ID NO: 768709 - DNA, 20 bp, Artificial
  CRISPR gRNA sequence
ttcttttcttgttcttctcc

SEQ ID NO: 768710 - DNA, 20 bp, Artificial
  CRISPR gRNA sequence
tggtccccagccagaagcag

SEQ ID NO: 768711 - DNA, 20 bp, Artificial
  CRISPR gRNA sequence
atccagggacagatggtgct

SEQ ID NO: 768712 - DNA, 20 bp, Artificial
  CRISPR gRNA sequence
gtggcagttggaggaatgga

SEQ ID NO: 768713 - DNA, 20 bp, Artificial
  CRISPR gRNA sequence
tcagaagaggatggcagagg

SEQ ID NO: 768714 - DNA, 20 bp, Artificial
  CRISPR gRNA sequence
agtgacttctgatggttggc

SEQ ID NO: 768715 - DNA, 20 bp, Artificial
  CRISPR gRNA sequence
caaggaagatcaaatacttg

SEQ ID NO: 768716 - DNA, 20 bp, Artificial
  CRISPR gRNA sequence
aatttgggctaagtataagg

SEQ ID NO: 768717 - DNA, 20 bp, Artificial
  CRISPR gRNA sequence
gcccatcacgggagggcaaa

SEQ ID NO: 768718 - DNA, 20 bp, Artificial
  CRISPR gRNA sequence
gatacttgatcattaatttc

SEQ ID NO: 768719 - DNA, 20 bp, Artificial
  CRISPR gRNA sequence
ggaactgatcttccccctcc

SEQ ID NO: 768720 - DNA, 20 bp, Artificial
  CRISPR gRNA sequence
ggtctccttgttatgtgtgt

SEQ ID NO: 768721 - DNA, 20 bp, Artificial
  CRISPR gRNA sequence
tttgagatacctattttaga

SEQ ID NO: 768722 - DNA, 20 bp, Artificial
  CRISPR gRNA sequence
gcaatgacttatgctggaag

SEQ ID NO: 768723 - DNA, 20 bp, Artificial
  CRISPR gRNA sequence
gaggggaaagggaggggagg

SEQ ID NO: 768724 - DNA, 20 bp, Artificial
  CRISPR gRNA sequence
agttacaagggtgcagtggg

SEQ ID NO: 768725 - DNA, 20 bp, Artificial
  CRISPR gRNA sequence
ggtgtaagtggacaacaact

SEQ ID NO: 768726 - DNA, 20 bp, Artificial
  CRISPR gRNA sequence
gccttaaggatatagtccct

SEQ ID NO: 768727 - DNA, 20 bp, Artificial
  CRISPR gRNA sequence
taaagttccactagcatcca

SEQ ID NO: 768728 - DNA, 20 bp, Artificial
  CRISPR gRNA sequence
agctcagagaagttgcctag

SEQ ID NO: 768729 - DNA, 20 bp, Artificial
  CRISPR gRNA sequence
ttactaaagacatgaatgca

SEQ ID NO: 768730 - DNA, 20 bp, Artificial
  CRISPR gRNA sequence
acaatagaaacttagttcaa

SEQ ID NO: 768731 - DNA, 20 bp, Artificial
  CRISPR gRNA sequence
aaactggtttaagggaaaaa

SEQ ID NO: 768732 - DNA, 20 bp, Artificial
  CRISPR gRNA sequence
atatctgggcggtctaggtc

SEQ ID NO: 768733 - DNA, 20 bp, Artificial
  CRISPR gRNA sequence
ctgggcggtctaggtctgca

SEQ ID NO: 768734 - DNA, 20 bp, Artificial
  CRISPR gRNA sequence
tgttgcccaaggagcccctg

SEQ ID NO: 768735 - DNA, 20 bp, Artificial
  CRISPR gRNA sequence
aggaggaagtggagtgatgt

SEQ ID NO: 768736 - DNA, 20 bp, Artificial
  CRISPR gRNA sequence
ggccctgagcccaggtgcag

SEQ ID NO: 768737 - DNA, 20 bp, Artificial
  CRISPR gRNA sequence
caggtgcagtctggatttgt

SEQ ID NO: 768738 - DNA, 20 bp, Artificial
  CRISPR gRNA sequence
tcttgggagcctccctgtgg

SEQ ID NO: 768739 - DNA, 20 bp, Artificial
  CRISPR gRNA sequence
tgtgaaagccgaaggtgctc

SEQ ID NO: 768740 - DNA, 20 bp, Artificial
  CRISPR gRNA sequence
agggcaggtcccggctgggg

SEQ ID NO: 768741 - DNA, 20 bp, Artificial
  CRISPR gRNA sequence
gccgtggactcttctggtct

SEQ ID NO: 768742 - DNA, 20 bp, Artificial
  CRISPR gRNA sequence
tctttgcttctgggctgtca

SEQ ID NO: 768743 - DNA, 20 bp, Artificial
  CRISPR gRNA sequence
tcaaactgcttctctccagg

SEQ ID NO: 768744 - DNA, 20 bp, Artificial
  CRISPR gRNA sequence
ttgagcaggggagggacatg

SEQ ID NO: 768745 - DNA, 20 bp, Artificial
  CRISPR gRNA sequence
gatgggtcagggtgggagat

SEQ ID NO: 768746 - DNA, 20 bp, Artificial
  CRISPR gRNA sequence
cgttcgttcatccttagccc

SEQ ID NO: 768747 - DNA, 20 bp, Artificial
  CRISPR gRNA sequence
caggatgtggtgcctgccaa

SEQ ID NO: 768748 - DNA, 20 bp, Artificial
  CRISPR gRNA sequence
gctgctgactcagcaggcag

SEQ ID NO: 768749 - DNA, 20 bp, Artificial
  CRISPR gRNA sequence
ctggaaaggaagtggctgct

SEQ ID NO: 768750 - DNA, 20 bp, Artificial
  CRISPR gRNA sequence
ggggggctggccaggatgca

SEQ ID NO: 768751 - DNA, 20 bp, Artificial
  CRISPR gRNA sequence
cggggggcgggtgtgcctgg

SEQ ID NO: 768752 - DNA, 20 bp, Artificial
  CRISPR gRNA sequence
ggtgtgcctggctgggattg

SEQ ID NO: 768753 - DNA, 20 bp, Artificial
  CRISPR gRNA sequence
ttgaggctagcagctgttga

SEQ ID NO: 768754 - DNA, 20 bp, Artificial
  CRISPR gRNA sequence
acattaacaaagtcacttat

SEQ ID NO: 768755 - DNA, 20 bp, Artificial
  CRISPR gRNA sequence
gcccagactggagtacagtg

SEQ ID NO: 768756 - DNA, 20 bp, Artificial
  CRISPR gRNA sequence
cctgagccaccacgcccagc

SEQ ID NO: 768757 - DNA, 20 bp, Artificial
  CRISPR gRNA sequence
gtttatatttttagtagaca

SEQ ID NO: 768758 - DNA, 20 bp, Artificial
  CRISPR gRNA sequence
cacctcggcctcccaaagtg

SEQ ID NO: 768759 - DNA, 20 bp, Artificial
  CRISPR gRNA sequence
atgagccaccacacccagcc

SEQ ID NO: 768760 - DNA, 20 bp, Artificial
  CRISPR gRNA sequence
tcagtgttggttggcataga

SEQ ID NO: 768761 - DNA, 20 bp, Artificial
  CRISPR gRNA sequence
gcttgatcaggacatggcac

SEQ ID NO: 768762 - DNA, 20 bp, Artificial
  CRISPR gRNA sequence
gtgtgcagcctggagggtgg

SEQ ID NO: 768763 - DNA, 20 bp, Artificial
  CRISPR gRNA sequence
tggctgggattgggagcagg

SEQ ID NO: 768764 - DNA, 20 bp, Artificial
  CRISPR gRNA sequence
gcctcctaaaactctgtcct

SEQ ID NO: 768765 - DNA, 20 bp, Artificial
  CRISPR gRNA sequence
agaagcttctttgcaaatac

SEQ ID NO: 768766 - DNA, 20 bp, Artificial
  CRISPR gRNA sequence
atactgtcacttttacccag

SEQ ID NO: 768767 - DNA, 20 bp, Artificial
  CRISPR gRNA sequence
ctggagtgcagtggtgcaat

SEQ ID NO: 768768 - DNA, 20 bp, Artificial
  CRISPR gRNA sequence
tgcctcaccctcccaagtag

SEQ ID NO: 768769 - DNA, 20 bp, Artificial
  CRISPR gRNA sequence
atttgtatttttagtagaga

SEQ ID NO: 768770 - DNA, 20 bp, Artificial
  CRISPR gRNA sequence
ggtcacaaactcctgacttc

SEQ ID NO: 768771 - DNA, 20 bp, Artificial
  CRISPR gRNA sequence
tgcctcagcctcccaaagtg

SEQ ID NO: 768772 - DNA, 20 bp, Artificial
  CRISPR gRNA sequence
gtctatgctgaggagctaga

SEQ ID NO: 768773 - DNA, 20 bp, Artificial
  CRISPR gRNA sequence
gtgggttttaaacattgtta

SEQ ID NO: 768774 - DNA, 20 bp, Artificial
  CRISPR gRNA sequence
aacattgttacctagattat

SEQ ID NO: 768775 - DNA, 20 bp, Artificial
  CRISPR gRNA sequence
tgtgtgattaaaatgctccc

SEQ ID NO: 768776 - DNA, 20 bp, Artificial
  CRISPR gRNA sequence
tcctcactggtctctcaaag

SEQ ID NO: 768777 - DNA, 20 bp, Artificial
  CRISPR gRNA sequence
agatagcgggtggaggtgct

SEQ ID NO: 768778 - DNA, 20 bp, Artificial
  CRISPR gRNA sequence
ccgtgtatttcccttattca

SEQ ID NO: 768779 - DNA, 20 bp, Artificial
  CRISPR gRNA sequence
tccctgccaagcatctgtca

SEQ ID NO: 768780 - DNA, 20 bp, Artificial
  CRISPR gRNA sequence
tggggacgggaggggaggga

SEQ ID NO: 768781 - DNA, 20 bp, Artificial
  CRISPR gRNA sequence
ggcctccctgcgttattctg

SEQ ID NO: 768782 - DNA, 20 bp, Artificial
  CRISPR gRNA sequence
tgcctagattcgcccccacc

SEQ ID NO: 768783 - DNA, 20 bp, Artificial
  CRISPR gRNA sequence
tagattcgcccccacctggc

SEQ ID NO: 768784 - DNA, 20 bp, Artificial
  CRISPR gRNA sequence
ttcgcccccacctggcgttt

SEQ ID NO: 768785 - DNA, 20 bp, Artificial
  CRISPR gRNA sequence
acgatgtgactctccccaca

SEQ ID NO: 768786 - DNA, 20 bp, Artificial
  CRISPR gRNA sequence
catcagcatctctgctctga

SEQ ID NO: 768787 - DNA, 20 bp, Artificial
  CRISPR gRNA sequence
cctgtctctacccacggctg

SEQ ID NO: 768788 - DNA, 20 bp, Artificial
  CRISPR gRNA sequence
ctgatttctctagagcaaga

SEQ ID NO: 768789 - DNA, 20 bp, Artificial
  CRISPR gRNA sequence
ggttttgtctgggtgactta

SEQ ID NO: 768790 - DNA, 20 bp, Artificial
  CRISPR gRNA sequence
gagaactggcctggggcacc

SEQ ID NO: 768791 - DNA, 20 bp, Artificial
  CRISPR gRNA sequence
gtttcagcaagagatccaag

SEQ ID NO: 768792 - DNA, 20 bp, Artificial
  CRISPR gRNA sequence
ttagagatctctaggtactg

SEQ ID NO: 768793 - DNA, 20 bp, Artificial
  CRISPR gRNA sequence
tgcaaagattatgatactga

SEQ ID NO: 768794 - DNA, 20 bp, Artificial
  CRISPR gRNA sequence
tgagtgctgtattcaattag

SEQ ID NO: 768795 - DNA, 20 bp, Artificial
  CRISPR gRNA sequence
tcttcccacattttgagtgt

SEQ ID NO: 768796 - DNA, 20 bp, Artificial
  CRISPR gRNA sequence
ggtagtgccagggtgggggg

SEQ ID NO: 768797 - DNA, 20 bp, Artificial
  CRISPR gRNA sequence
tgcctcagcctcctgagtag

SEQ ID NO: 768798 - DNA, 20 bp, Artificial
  CRISPR gRNA sequence
tggctattttttagtagagg

SEQ ID NO: 768799 - DNA, 20 bp, Artificial
  CRISPR gRNA sequence
tctgactcatcagcaagtcc

SEQ ID NO: 768800 - DNA, 20 bp, Artificial
  CRISPR gRNA sequence
gtctccacagaggagctaga

SEQ ID NO: 768801 - DNA, 20 bp, Artificial
  CRISPR gRNA sequence
gtgagttttaagcattgcta

SEQ ID NO: 768802 - DNA, 20 bp, Artificial
  CRISPR gRNA sequence
agcattgctactcagattat

SEQ ID NO: 768803 - DNA, 20 bp, Artificial
  CRISPR gRNA sequence
tgcgtgattaaaacactccc

SEQ ID NO: 768804 - DNA, 20 bp, Artificial
  CRISPR gRNA sequence
tcccattactcatagaaaaa

SEQ ID NO: 768805 - DNA, 20 bp, Artificial
  CRISPR gRNA sequence
ttgcctcagggccttccacc

SEQ ID NO: 768806 - DNA, 20 bp, Artificial
  CRISPR gRNA sequence
ctttttcattccctataaat

SEQ ID NO: 768807 - DNA, 20 bp, Artificial
  CRISPR gRNA sequence
ttccctataaatttcagctt

SEQ ID NO: 768808 - DNA, 20 bp, Artificial
  CRISPR gRNA sequence
ctttcttgtataaaaacaaa

SEQ ID NO: 768809 - DNA, 20 bp, Artificial
  CRISPR gRNA sequence
aagaaaaaaagaaaaagcac

SEQ ID NO: 768810 - DNA, 20 bp, Artificial
  CRISPR gRNA sequence
caggcaggtgtaaagtacct

SEQ ID NO: 768811 - DNA, 20 bp, Artificial
  CRISPR gRNA sequence
ctgccagatttttgaaaagc

SEQ ID NO: 768812 - DNA, 20 bp, Artificial
  CRISPR gRNA sequence
ctctgttgcatttctgactt

SEQ ID NO: 768813 - DNA, 20 bp, Artificial
  CRISPR gRNA sequence
gctgctccttctcccctgag

SEQ ID NO: 768814 - DNA, 20 bp, Artificial
  CRISPR gRNA sequence
cagataccaaacagctggtg

SEQ ID NO: 768815 - DNA, 20 bp, Artificial
  CRISPR gRNA sequence
gcgtgcgtgtggcggacgag

SEQ ID NO: 768816 - DNA, 20 bp, Artificial
  CRISPR gRNA sequence
tggcggacgagggcagcttc

SEQ ID NO: 768817 - DNA, 20 bp, Artificial
  CRISPR gRNA sequence
ttcacctgcttcgtgagcat

SEQ ID NO: 768818 - DNA, 20 bp, Artificial
  CRISPR gRNA sequence
cactgctcccagaaccccag

SEQ ID NO: 768819 - DNA, 20 bp, Artificial
  CRISPR gRNA sequence
cgtcgcagatggccaacgag

SEQ ID NO: 768820 - DNA, 20 bp, Artificial
  CRISPR gRNA sequence
gcagatggccaacgagcagg

SEQ ID NO: 768821 - DNA, 20 bp, Artificial
  CRISPR gRNA sequence
caccccagagaagccccaca

SEQ ID NO: 768822 - DNA, 20 bp, Artificial
  CRISPR gRNA sequence
cagagaagccccacaggttg

SEQ ID NO: 768823 - DNA, 20 bp, Artificial
  CRISPR gRNA sequence
gtccccttgggggagggggg

SEQ ID NO: 768824 - DNA, 20 bp, Artificial
  CRISPR gRNA sequence
gaaggaaaggagtcctgatg

SEQ ID NO: 768825 - DNA, 20 bp, Artificial
  CRISPR gRNA sequence
cacctgccccaggcctggcc

SEQ ID NO: 768826 - DNA, 20 bp, Artificial
  CRISPR gRNA sequence
gtcaggccaagacccacctg

SEQ ID NO: 768827 - DNA, 20 bp, Artificial
  CRISPR gRNA sequence
cacctgctgtgattgttctc

SEQ ID NO: 768828 - DNA, 20 bp, Artificial
  CRISPR gRNA sequence
tctgagagtcctcagactta

SEQ ID NO: 768829 - DNA, 20 bp, Artificial
  CRISPR gRNA sequence
ggtctgggaattgatggggg

SEQ ID NO: 768830 - DNA, 20 bp, Artificial
  CRISPR gRNA sequence
gctgctccttctcccccgag

SEQ ID NO: 768831 - DNA, 20 bp, Artificial
  CRISPR gRNA sequence
cagacaccaaacagctggtg

SEQ ID NO: 768832 - DNA, 20 bp, Artificial
  CRISPR gRNA sequence
gcgtgcgtgtggcggacgag

SEQ ID NO: 768833 - DNA, 20 bp, Artificial
  CRISPR gRNA sequence
tggcggacgagggcagcttc

SEQ ID NO: 768834 - DNA, 20 bp, Artificial
  CRISPR gRNA sequence
ttcacctgcttcgtgagcat

SEQ ID NO: 768835 - DNA, 20 bp, Artificial
  CRISPR gRNA sequence
cactgctcccagaaccccag

SEQ ID NO: 768836 - DNA, 20 bp, Artificial
  CRISPR gRNA sequence
cgtcgcagatggccaacgag

SEQ ID NO: 768837 - DNA, 20 bp, Artificial
  CRISPR gRNA sequence
gcagatggccaacgagcagg

SEQ ID NO: 768838 - DNA, 20 bp, Artificial
  CRISPR gRNA sequence
gaccctaacgtggaatttcc

SEQ ID NO: 768839 - DNA, 20 bp, Artificial
  CRISPR gRNA sequence
gagctgataagaaccattta

SEQ ID NO: 768840 - DNA, 20 bp, Artificial
  CRISPR gRNA sequence
tataatgtttgccttcctaa

SEQ ID NO: 768841 - DNA, 20 bp, Artificial
  CRISPR gRNA sequence
aagagtgcttttcgtggcac

SEQ ID NO: 768842 - DNA, 20 bp, Artificial
  CRISPR gRNA sequence
gcccaggggacttggtgtgg

SEQ ID NO: 768843 - DNA, 20 bp, Artificial
  CRISPR gRNA sequence
attctgggtcagtgggcgcc

SEQ ID NO: 768844 - DNA, 20 bp, Artificial
  CRISPR gRNA sequence
ccagatagaggccacccctt

SEQ ID NO: 768845 - DNA, 20 bp, Artificial
  CRISPR gRNA sequence
ccctttagtgattgttagtc

SEQ ID NO: 768846 - DNA, 20 bp, Artificial
  CRISPR gRNA sequence
tcaagagccgcagtctccat

SEQ ID NO: 768847 - DNA, 20 bp, Artificial
  CRISPR gRNA sequence
cagtatctctccctggccaa

SEQ ID NO: 768848 - DNA, 20 bp, Artificial
  CRISPR gRNA sequence
tgcacagtgaggtcaggaca

SEQ ID NO: 768849 - DNA, 20 bp, Artificial
  CRISPR gRNA sequence
atccaagttctgatctcacc

SEQ ID NO: 768850 - DNA, 20 bp, Artificial
  CRISPR gRNA sequence
gagccagggcccgtcacatc

SEQ ID NO: 768851 - DNA, 20 bp, Artificial
  CRISPR gRNA sequence
ctcactcctccttctctctt

SEQ ID NO: 768852 - DNA, 20 bp, Artificial
  CRISPR gRNA sequence
tgaccttttagagaacagca

SEQ ID NO: 768853 - DNA, 20 bp, Artificial
  CRISPR gRNA sequence
agtgatcttggcagaggata

SEQ ID NO: 768854 - DNA, 20 bp, Artificial
  CRISPR gRNA sequence
gaaaggacttatgagtataa

SEQ ID NO: 768855 - DNA, 20 bp, Artificial
  CRISPR gRNA sequence
tataaatgtgattgcaaaga

SEQ ID NO: 768856 - DNA, 20 bp, Artificial
  CRISPR gRNA sequence
acttgagtagctaacattta

SEQ ID NO: 768857 - DNA, 20 bp, Artificial
  CRISPR gRNA sequence
ttgggaggctggggcaagag

SEQ ID NO: 768858 - DNA, 20 bp, Artificial
  CRISPR gRNA sequence
aaataaataaaataaaaata

SEQ ID NO: 768859 - DNA, 20 bp, Artificial
  CRISPR gRNA sequence
attggataaatgatcaatgc

SEQ ID NO: 768860 - DNA, 20 bp, Artificial
  CRISPR gRNA sequence
ctccttcccaccagccagcc

SEQ ID NO: 768861 - DNA, 20 bp, Artificial
  CRISPR gRNA sequence
tttggagcccttggcctgta

SEQ ID NO: 768862 - DNA, 20 bp, Artificial
  CRISPR gRNA sequence
ttggcctgtattttgcttcg

SEQ ID NO: 768863 - DNA, 20 bp, Artificial
  CRISPR gRNA sequence
tttgtatcatgtcaaacatt

SEQ ID NO: 768864 - DNA, 20 bp, Artificial
  CRISPR gRNA sequence
gctgtgcagagcctcttgga

SEQ ID NO: 768865 - DNA, 20 bp, Artificial
  CRISPR gRNA sequence
taagggggaacatagagacc

SEQ ID NO: 768866 - DNA, 20 bp, Artificial
  CRISPR gRNA sequence
tctgctgtcagagccccatg

SEQ ID NO: 768867 - DNA, 20 bp, Artificial
  CRISPR gRNA sequence
gatgggatttccagggtggt

SEQ ID NO: 768868 - DNA, 20 bp, Artificial
  CRISPR gRNA sequence
atcactggggtgatggatcc

SEQ ID NO: 768869 - DNA, 20 bp, Artificial
  CRISPR gRNA sequence
gtgcttccaatggccagagc

SEQ ID NO: 768870 - DNA, 20 bp, Artificial
  CRISPR gRNA sequence
gaaagcagcactgtcttttg

SEQ ID NO: 768871 - DNA, 20 bp, Artificial
  CRISPR gRNA sequence
cagaacagctcctggcccta

SEQ ID NO: 768872 - DNA, 20 bp, Artificial
  CRISPR gRNA sequence
agctctaagaggaggggcct

SEQ ID NO: 768873 - DNA, 20 bp, Artificial
  CRISPR gRNA sequence
tctgtaaatggccagggagt

SEQ ID NO: 768874 - DNA, 20 bp, Artificial
  CRISPR gRNA sequence
ccacacaccatctctgttgc

SEQ ID NO: 768875 - DNA, 20 bp, Artificial
  CRISPR gRNA sequence
ttacaaatgtaaaaaccatc

SEQ ID NO: 768876 - DNA, 20 bp, Artificial
  CRISPR gRNA sequence
tgtacaaaaacaggccacaa

SEQ ID NO: 768877 - DNA, 20 bp, Artificial
  CRISPR gRNA sequence
gccagctttggcccatgggc

SEQ ID NO: 768878 - DNA, 20 bp, Artificial
  CRISPR gRNA sequence
tgcagaggctggaaggagcc

SEQ ID NO: 768879 - DNA, 20 bp, Artificial
  CRISPR gRNA sequence
ctggagagaatggttaggac

SEQ ID NO: 768880 - DNA, 20 bp, Artificial
  CRISPR gRNA sequence
aacttctagaggtccttgaa

SEQ ID NO: 768881 - DNA, 20 bp, Artificial
  CRISPR gRNA sequence
agaggtccttgaatcacgct

SEQ ID NO: 768882 - DNA, 20 bp, Artificial
  CRISPR gRNA sequence
cacatcagccagggttgtat

SEQ ID NO: 768883 - DNA, 20 bp, Artificial
  CRISPR gRNA sequence
aagggactgtaggaacttaa

SEQ ID NO: 768884 - DNA, 20 bp, Artificial
  CRISPR gRNA sequence
ctcattgcactgctggtggc

SEQ ID NO: 768885 - DNA, 20 bp, Artificial
  CRISPR gRNA sequence
agtgtgtgtgtgcagatggg

SEQ ID NO: 768886 - DNA, 20 bp, Artificial
  CRISPR gRNA sequence
gtgatcgtgcctgccttgga

SEQ ID NO: 768887 - DNA, 20 bp, Artificial
  CRISPR gRNA sequence
gtggtgggggcgccaggctg

SEQ ID NO: 768888 - DNA, 20 bp, Artificial
  CRISPR gRNA sequence
ggcccactcaggccctgttc

SEQ ID NO: 768889 - DNA, 20 bp, Artificial
  CRISPR gRNA sequence
gggaaagtgctggcatgaaa

SEQ ID NO: 768890 - DNA, 20 bp, Artificial
  CRISPR gRNA sequence
tggcatgaaaatgggcttgc

SEQ ID NO: 768891 - DNA, 20 bp, Artificial
  CRISPR gRNA sequence
aaaatgggcttgcaaaagat

SEQ ID NO: 768892 - DNA, 20 bp, Artificial
  CRISPR gRNA sequence
ggactctaggatctggaggg

SEQ ID NO: 768893 - DNA, 20 bp, Artificial
  CRISPR gRNA sequence
tggaggggccagatttgctg

SEQ ID NO: 768894 - DNA, 20 bp, Artificial
  CRISPR gRNA sequence
tcacccagttccctcccagg

SEQ ID NO: 768895 - DNA, 20 bp, Artificial
  CRISPR gRNA sequence
aacctttacccatctgccag

SEQ ID NO: 768896 - DNA, 20 bp, Artificial
  CRISPR gRNA sequence
catctgccagggccgattcc

SEQ ID NO: 768897 - DNA, 20 bp, Artificial
  CRISPR gRNA sequence
ggccccacaccgtggagtct

SEQ ID NO: 768898 - DNA, 20 bp, Artificial
  CRISPR gRNA sequence
gggctccggagatagggagt

SEQ ID NO: 768899 - DNA, 20 bp, Artificial
  CRISPR gRNA sequence
aaacagagtggccttgagca

SEQ ID NO: 768900 - DNA, 20 bp, Artificial
  CRISPR gRNA sequence
tgagcaagatgctttgcctc

SEQ ID NO: 768901 - DNA, 20 bp, Artificial
  CRISPR gRNA sequence
agatgctttgcctctctggc

SEQ ID NO: 768902 - DNA, 20 bp, Artificial
  CRISPR gRNA sequence
ttatgtaaaatgaggataat

SEQ ID NO: 768903 - DNA, 20 bp, Artificial
  CRISPR gRNA sequence
aggataatcacagattcata

SEQ ID NO: 768904 - DNA, 20 bp, Artificial
  CRISPR gRNA sequence
ctagtatcatatctagtgcc

SEQ ID NO: 768905 - DNA, 20 bp, Artificial
  CRISPR gRNA sequence
agtcctattactattaggca

SEQ ID NO: 768906 - DNA, 20 bp, Artificial
  CRISPR gRNA sequence
actgttctagttacagactg

SEQ ID NO: 768907 - DNA, 20 bp, Artificial
  CRISPR gRNA sequence
ggtgccttgctcctctgggc

SEQ ID NO: 768908 - DNA, 20 bp, Artificial
  CRISPR gRNA sequence
ctgccctgatggcaccagag

SEQ ID NO: 768909 - DNA, 20 bp, Artificial
  CRISPR gRNA sequence
atggcacagtaagctggggg

SEQ ID NO: 768910 - DNA, 20 bp, Artificial
  CRISPR gRNA sequence
gggatcctgggctgggagag

SEQ ID NO: 768911 - DNA, 20 bp, Artificial
  CRISPR gRNA sequence
acccccgcagaaggaagggc

SEQ ID NO: 768912 - DNA, 20 bp, Artificial
  CRISPR gRNA sequence
ctgcaaatctgccagcctcc

SEQ ID NO: 768913 - DNA, 20 bp, Artificial
  CRISPR gRNA sequence
gtggaactgggacctgggac

SEQ ID NO: 768914 - DNA, 20 bp, Artificial
  CRISPR gRNA sequence
agcaaagaaggtaaagacac

SEQ ID NO: 768915 - DNA, 20 bp, Artificial
  CRISPR gRNA sequence
tgatgggacccaaatacgac

SEQ ID NO: 768916 - DNA, 20 bp, Artificial
  CRISPR gRNA sequence
gacagaggcttaagcaggac

SEQ ID NO: 768917 - DNA, 20 bp, Artificial
  CRISPR gRNA sequence
ctggagccaggttccactta

SEQ ID NO: 768918 - DNA, 20 bp, Artificial
  CRISPR gRNA sequence
ggattctgccctcttcaact

SEQ ID NO: 768919 - DNA, 20 bp, Artificial
  CRISPR gRNA sequence
tttcactcctaggtctaaga

SEQ ID NO: 768920 - DNA, 20 bp, Artificial
  CRISPR gRNA sequence
aagagggagagaaaggaagg

SEQ ID NO: 768921 - DNA, 20 bp, Artificial
  CRISPR gRNA sequence
aggaaggatatgtttccttc

SEQ ID NO: 768922 - DNA, 20 bp, Artificial
  CRISPR gRNA sequence
gtggaagtagcctgcatcac

SEQ ID NO: 768923 - DNA, 20 bp, Artificial
  CRISPR gRNA sequence
caggagataggtcatttcct

SEQ ID NO: 768924 - DNA, 20 bp, Artificial
  CRISPR gRNA sequence
ggcagatggagataaaaagt

SEQ ID NO: 768925 - DNA, 20 bp, Artificial
  CRISPR gRNA sequence
tgggtggatcacttgaggtc

SEQ ID NO: 768926 - DNA, 20 bp, Artificial
  CRISPR gRNA sequence
gaggcagaggttgcagtgaa

SEQ ID NO: 768927 - DNA, 20 bp, Artificial
  CRISPR gRNA sequence
actccagcctgggcaacaga

SEQ ID NO: 768928 - DNA, 20 bp, Artificial
  CRISPR gRNA sequence
aaaaaaaaaaaaaaaaaaaa

SEQ ID NO: 768929 - DNA, 20 bp, Artificial
  CRISPR gRNA sequence
aaaaaaaaaaaaaaagtcag

SEQ ID NO: 768930 - DNA, 20 bp, Artificial
  CRISPR gRNA sequence
aatgtggcctggatgggcaa

SEQ ID NO: 768931 - DNA, 20 bp, Artificial
  CRISPR gRNA sequence
tggcctggatgggcaaacca

SEQ ID NO: 768932 - DNA, 20 bp, Artificial
  CRISPR gRNA sequence
cccttcttcccaagtctcca

SEQ ID NO: 768933 - DNA, 20 bp, Artificial
  CRISPR gRNA sequence
tccccacttgaagtctgacc

SEQ ID NO: 768934 - DNA, 20 bp, Artificial
  CRISPR gRNA sequence
cttgaagtctgaccaggtgc

SEQ ID NO: 768935 - DNA, 20 bp, Artificial
  CRISPR gRNA sequence
aaaatagatcttctggcatc

SEQ ID NO: 768936 - DNA, 20 bp, Artificial
  CRISPR gRNA sequence
cagccttatttctccaatgg

SEQ ID NO: 768937 - DNA, 20 bp, Artificial
  CRISPR gRNA sequence
acgatgcatagtcaccccgg

SEQ ID NO: 768938 - DNA, 20 bp, Artificial
  CRISPR gRNA sequence
acactagtgatcatgttcag

SEQ ID NO: 768939 - DNA, 20 bp, Artificial
  CRISPR gRNA sequence
aacatctcctggagtctaga

SEQ ID NO: 768940 - DNA, 20 bp, Artificial
  CRISPR gRNA sequence
ctgtgatggggcccctgggg

SEQ ID NO: 768941 - DNA, 20 bp, Artificial
  CRISPR gRNA sequence
ttttcatgtatccattcagt

SEQ ID NO: 768942 - DNA, 20 bp, Artificial
  CRISPR gRNA sequence
caactaactacactgcaccc

SEQ ID NO: 768943 - DNA, 20 bp, Artificial
  CRISPR gRNA sequence
tccacacctcctctgtggct

SEQ ID NO: 768944 - DNA, 20 bp, Artificial
  CRISPR gRNA sequence
ctggggcagggcagggccag

SEQ ID NO: 768945 - DNA, 20 bp, Artificial
  CRISPR gRNA sequence
tggggctggggcagtctttt

SEQ ID NO: 768946 - DNA, 20 bp, Artificial
  CRISPR gRNA sequence
taatttaaatgtgggactcg

SEQ ID NO: 768947 - DNA, 20 bp, Artificial
  CRISPR gRNA sequence
ggaaaataaatgtctttgta

SEQ ID NO: 768948 - DNA, 20 bp, Artificial
  CRISPR gRNA sequence
taaaaagctttttctctgtg

SEQ ID NO: 768949 - DNA, 20 bp, Artificial
  CRISPR gRNA sequence
tgggccccaggactcaacca

SEQ ID NO: 768950 - DNA, 20 bp, Artificial
  CRISPR gRNA sequence
tggttgagtcctggggccca

SEQ ID NO: 768951 - DNA, 20 bp, Artificial
  CRISPR gRNA sequence
ttccaaacacttcacagaga

SEQ ID NO: 768952 - DNA, 20 bp, Artificial
  CRISPR gRNA sequence
tattttccccaaaatatacc

SEQ ID NO: 768953 - DNA, 20 bp, Artificial
  CRISPR gRNA sequence
ggacagacattttggacacc

SEQ ID NO: 768954 - DNA, 20 bp, Artificial
  CRISPR gRNA sequence
gaggggctatgtccctctct

SEQ ID NO: 768955 - DNA, 20 bp, Artificial
  CRISPR gRNA sequence
ggagaaccagtgtgaccagc

SEQ ID NO: 768956 - DNA, 20 bp, Artificial
  CRISPR gRNA sequence
ggaggaaggaggggaaagga

SEQ ID NO: 768957 - DNA, 20 bp, Artificial
  CRISPR gRNA sequence
cactgtccctgtctgagaag

SEQ ID NO: 768958 - DNA, 20 bp, Artificial
  CRISPR gRNA sequence
agatgccagaagatctattt

SEQ ID NO: 768959 - DNA, 20 bp, Artificial
  CRISPR gRNA sequence
aacacttttcccttctcatc

SEQ ID NO: 768960 - DNA, 20 bp, Artificial
  CRISPR gRNA sequence
cttcccagtgtcccctccac

SEQ ID NO: 768961 - DNA, 20 bp, Artificial
  CRISPR gRNA sequence
caggggccctcctccttccc

SEQ ID NO: 768962 - DNA, 20 bp, Artificial
  CRISPR gRNA sequence
ctgaatggagacttgggaag

SEQ ID NO: 768963 - DNA, 20 bp, Artificial
  CRISPR gRNA sequence
ggagcagggttaggaagcaa

SEQ ID NO: 768964 - DNA, 20 bp, Artificial
  CRISPR gRNA sequence
aacctctgcctcccaggttc

SEQ ID NO: 768965 - DNA, 20 bp, Artificial
  CRISPR gRNA sequence
ggttcaagtgattctcccgc

SEQ ID NO: 768966 - DNA, 20 bp, Artificial
  CRISPR gRNA sequence
cgcctcagcttcccaagtag

SEQ ID NO: 768967 - DNA, 20 bp, Artificial
  CRISPR gRNA sequence
gcatgcaccaccacgcccgg

SEQ ID NO: 768968 - DNA, 20 bp, Artificial
  CRISPR gRNA sequence
ttttgtatttttagtagaga

SEQ ID NO: 768969 - DNA, 20 bp, Artificial
  CRISPR gRNA sequence
cacctcggcctcccaaagtg

SEQ ID NO: 768970 - DNA, 20 bp, Artificial
  CRISPR gRNA sequence
tgcccagctcttctatggtt

SEQ ID NO: 768971 - DNA, 20 bp, Artificial
  CRISPR gRNA sequence
agcctcttagacctaggagt

SEQ ID NO: 768972 - DNA, 20 bp, Artificial
  CRISPR gRNA sequence
gaacctggctccaggtcatc

SEQ ID NO: 768973 - DNA, 20 bp, Artificial
  CRISPR gRNA sequence
gctccaggtcatcagtggtt

SEQ ID NO: 768974 - DNA, 20 bp, Artificial
  CRISPR gRNA sequence
gaaggaggaataaactcctg

SEQ ID NO: 768975 - DNA, 20 bp, Artificial
  CRISPR gRNA sequence
ctttaccttctttgctgtca

SEQ ID NO: 768976 - DNA, 20 bp, Artificial
  CRISPR gRNA sequence
cccaggtcccagttccactc

SEQ ID NO: 768977 - DNA, 20 bp, Artificial
  CRISPR gRNA sequence
tgtcattctcctctctgggc

SEQ ID NO: 768978 - DNA, 20 bp, Artificial
  CRISPR gRNA sequence
gtgagaagctaaaggaggct

SEQ ID NO: 768979 - DNA, 20 bp, Artificial
  CRISPR gRNA sequence
gcacccacccaagctgggcc

SEQ ID NO: 768980 - DNA, 20 bp, Artificial
  CRISPR gRNA sequence
ctccctctccagtcacctga

SEQ ID NO: 768981 - DNA, 20 bp, Artificial
  CRISPR gRNA sequence
actagaacagtattgtctta

SEQ ID NO: 768982 - DNA, 20 bp, Artificial
  CRISPR gRNA sequence
aattcaaacaacctatgaat

SEQ ID NO: 768983 - DNA, 20 bp, Artificial
  CRISPR gRNA sequence
aagcatcttgctcaaggcca

SEQ ID NO: 768984 - DNA, 20 bp, Artificial
  CRISPR gRNA sequence
ctacccatctactctcatgc

SEQ ID NO: 768985 - DNA, 20 bp, Artificial
  CRISPR gRNA sequence
ccctcagccccgcaaatggc

SEQ ID NO: 768986 - DNA, 20 bp, Artificial
  CRISPR gRNA sequence
gcatgcctacatttgtgccg

SEQ ID NO: 768987 - DNA, 20 bp, Artificial
  CRISPR gRNA sequence
ctgcacatggacagacaggc

SEQ ID NO: 768988 - DNA, 20 bp, Artificial
  CRISPR gRNA sequence
ctgcattctcctcctcacag

SEQ ID NO: 768989 - DNA, 20 bp, Artificial
  CRISPR gRNA sequence
gctccctagtgactttagaa

SEQ ID NO: 768990 - DNA, 20 bp, Artificial
  CRISPR gRNA sequence
agtgactttagaataatgct

SEQ ID NO: 768991 - DNA, 20 bp, Artificial
  CRISPR gRNA sequence
aataatgcttcaagcttcaa

SEQ ID NO: 768992 - DNA, 20 bp, Artificial
  CRISPR gRNA sequence
aaggacctctagaagttggc

SEQ ID NO: 768993 - DNA, 20 bp, Artificial
  CRISPR gRNA sequence
tggctgctgcttaccctccc

SEQ ID NO: 768994 - DNA, 20 bp, Artificial
  CRISPR gRNA sequence
tctaattctactgtaggagc

SEQ ID NO: 768995 - DNA, 20 bp, Artificial
  CRISPR gRNA sequence
ccagcctctgcactaatgct

SEQ ID NO: 768996 - DNA, 20 bp, Artificial
  CRISPR gRNA sequence
tgctatcagtttcccaaatt

SEQ ID NO: 768997 - DNA, 20 bp, Artificial
  CRISPR gRNA sequence
tcctccagaggccctctttt

SEQ ID NO: 768998 - DNA, 20 bp, Artificial
  CRISPR gRNA sequence
actacagcccatgggccaaa

SEQ ID NO: 768999 - DNA, 20 bp, Artificial
  CRISPR gRNA sequence
tgggccaaagctggcttgtg

SEQ ID NO: 769000 - DNA, 20 bp, Artificial
  CRISPR gRNA sequence
tgtacagtccacaaactagt

SEQ ID NO: 769001 - DNA, 20 bp, Artificial
  CRISPR gRNA sequence
gtcactgacggggctggagt

SEQ ID NO: 769002 - DNA, 20 bp, Artificial
  CRISPR gRNA sequence
acggggctggagtgagggct

SEQ ID NO: 769003 - DNA, 20 bp, Artificial
  CRISPR gRNA sequence
aaaagcctgacaaaagacag

SEQ ID NO: 769004 - DNA, 20 bp, Artificial
  CRISPR gRNA sequence
cgatgcacacccagggcctc

SEQ ID NO: 769005 - DNA, 20 bp, Artificial
  CRISPR gRNA sequence
acaggctcaggccacgtctc

SEQ ID NO: 769006 - DNA, 20 bp, Artificial
  CRISPR gRNA sequence
gactgaaagtctgaatccca

SEQ ID NO: 769007 - DNA, 20 bp, Artificial
  CRISPR gRNA sequence
aattaggctgagaggccaaa

SEQ ID NO: 769008 - DNA, 20 bp, Artificial
  CRISPR gRNA sequence
ccaggtctacagacccacgg

SEQ ID NO: 769009 - DNA, 20 bp, Artificial
  CRISPR gRNA sequence
tcaaagaagggtctgacccc

SEQ ID NO: 769010 - DNA, 20 bp, Artificial
  CRISPR gRNA sequence
gttcccccttctctgtggac

SEQ ID NO: 769011 - DNA, 20 bp, Artificial
  CRISPR gRNA sequence
tcagtttcttcgtctgtgaa

SEQ ID NO: 769012 - DNA, 20 bp, Artificial
  CRISPR gRNA sequence
ccaccacgcccagctaattt

SEQ ID NO: 769013 - DNA, 20 bp, Artificial
  CRISPR gRNA sequence
ttttgtgttttcagtagaga

SEQ ID NO: 769014 - DNA, 20 bp, Artificial
  CRISPR gRNA sequence
cgccttggcctcccaaagtg

SEQ ID NO: 769015 - DNA, 20 bp, Artificial
  CRISPR gRNA sequence
tcactttaaatgttagctac

SEQ ID NO: 769016 - DNA, 20 bp, Artificial
  CRISPR gRNA sequence
actaccaccctccctcctct

SEQ ID NO: 769017 - DNA, 20 bp, Artificial
  CRISPR gRNA sequence
tcctggagagcacaggaagg

SEQ ID NO: 769018 - DNA, 20 bp, Artificial
  CRISPR gRNA sequence
cgatgtgacgggccctggct

SEQ ID NO: 769019 - DNA, 20 bp, Artificial
  CRISPR gRNA sequence
ctaaaggggtggcctctatc

SEQ ID NO: 769020 - DNA, 20 bp, Artificial
  CRISPR gRNA sequence
tagggagggccagctgtcac

SEQ ID NO: 769021 - DNA, 20 bp, Artificial
  CRISPR gRNA sequence
tgagcacctgaagtctatga

SEQ ID NO: 769022 - DNA, 20 bp, Artificial
  CRISPR gRNA sequence
tgttgggctccagggtcatg

SEQ ID NO: 769023 - DNA, 20 bp, Artificial
  CRISPR gRNA sequence
cttcggtgaaactgtgcacc

SEQ ID NO: 769024 - DNA, 20 bp, Artificial
  CRISPR gRNA sequence
attttcttcttagatgcaaa

SEQ ID NO: 769025 - DNA, 20 bp, Artificial
  CRISPR gRNA sequence
gatgtggctccattcttccc

SEQ ID NO: 769026 - DNA, 20 bp, Artificial
  CRISPR gRNA sequence
caggagagccttaagaaggc

SEQ ID NO: 769027 - DNA, 20 bp, Artificial
  CRISPR gRNA sequence
aggaggcaacttgctgttct

SEQ ID NO: 769028 - DNA, 20 bp, Artificial
  CRISPR gRNA sequence
tctgggagattgaaggtggg

SEQ ID NO: 769029 - DNA, 20 bp, Artificial
  CRISPR gRNA sequence
catttaagcaaagcaacctg

SEQ ID NO: 769030 - DNA, 20 bp, Artificial
  CRISPR gRNA sequence
tgttgggctccagggtcatg

SEQ ID NO: 769031 - DNA, 20 bp, Artificial
  CRISPR gRNA sequence
cctcagcaaagctgtgcacc

SEQ ID NO: 769032 - DNA, 20 bp, Artificial
  CRISPR gRNA sequence
gagagagagacaaatgggca

SEQ ID NO: 769033 - DNA, 20 bp, Artificial
  CRISPR gRNA sequence
agcaggttagtaagtaaagc

SEQ ID NO: 769034 - DNA, 20 bp, Artificial
  CRISPR gRNA sequence
tatccaccaaaaatgtcaat

SEQ ID NO: 769035 - DNA, 20 bp, Artificial
  CRISPR gRNA sequence
tctggaggagagagaatcac

SEQ ID NO: 769036 - DNA, 20 bp, Artificial
  CRISPR gRNA sequence
ttttttcttttcctaacgaa

SEQ ID NO: 769037 - DNA, 20 bp, Artificial
  CRISPR gRNA sequence
tcttttcctaacgaaacacg

SEQ ID NO: 769038 - DNA, 20 bp, Artificial
  CRISPR gRNA sequence
gagtaatgggaatcactggg

SEQ ID NO: 769039 - DNA, 20 bp, Artificial
  CRISPR gRNA sequence
atcacgcataatctgagtag

SEQ ID NO: 769040 - DNA, 20 bp, Artificial
  CRISPR gRNA sequence
caagggggaggccagttagg

SEQ ID NO: 769041 - DNA, 20 bp, Artificial
  CRISPR gRNA sequence
cctgtaagaggtgagggtgg

SEQ ID NO: 769042 - DNA, 20 bp, Artificial
  CRISPR gRNA sequence
tagtagagaagaagagaggg

SEQ ID NO: 769043 - DNA, 20 bp, Artificial
  CRISPR gRNA sequence
aagaagagagggatcagatt

SEQ ID NO: 769044 - DNA, 20 bp, Artificial
  CRISPR gRNA sequence
tcaggaggctgaggcaggag

SEQ ID NO: 769045 - DNA, 20 bp, Artificial
  CRISPR gRNA sequence
actaccattctccggtaatg

SEQ ID NO: 769046 - DNA, 20 bp, Artificial
  CRISPR gRNA sequence
tctccggtaatggttagatt

SEQ ID NO: 769047 - DNA, 20 bp, Artificial
  CRISPR gRNA sequence
aattgaatacagcactcatt

SEQ ID NO: 769048 - DNA, 20 bp, Artificial
  CRISPR gRNA sequence
ccacaagatggcgccagacc

SEQ ID NO: 769049 - DNA, 20 bp, Artificial
  CRISPR gRNA sequence
ttaaagtagctattattatt

SEQ ID NO: 769050 - DNA, 20 bp, Artificial
  CRISPR gRNA sequence
gcaccgtgtggggagagtca

SEQ ID NO: 769051 - DNA, 20 bp, Artificial
  CRISPR gRNA sequence
aatatgggatccagtcatgc

SEQ ID NO: 769052 - DNA, 20 bp, Artificial
  CRISPR gRNA sequence
gtatggccctgctagccaga

SEQ ID NO: 769053 - DNA, 20 bp, Artificial
  CRISPR gRNA sequence
tgctgaggaatcttggtgac

SEQ ID NO: 769054 - DNA, 20 bp, Artificial
  CRISPR gRNA sequence
aggcggcaagtgaaggcaag

SEQ ID NO: 769055 - DNA, 20 bp, Artificial
  CRISPR gRNA sequence
taaaggcagttgagagccac

SEQ ID NO: 769056 - DNA, 20 bp, Artificial
  CRISPR gRNA sequence
agggaaatacacggtcagag

SEQ ID NO: 769057 - DNA, 20 bp, Artificial
  CRISPR gRNA sequence
acggtcagagctgagcttca

SEQ ID NO: 769058 - DNA, 20 bp, Artificial
  CRISPR gRNA sequence
acccgctatctgatgggagg

SEQ ID NO: 769059 - DNA, 20 bp, Artificial
  CRISPR gRNA sequence
tatgtttcagccagatcaag

SEQ ID NO: 769060 - DNA, 20 bp, Artificial
  CRISPR gRNA sequence
ttgagagaccagtgaggaat

SEQ ID NO: 769061 - DNA, 20 bp, Artificial
  CRISPR gRNA sequence
atcacacataatctaggtaa

SEQ ID NO: 769062 - DNA, 20 bp, Artificial
  CRISPR gRNA sequence
actctagctcctcagcatag

SEQ ID NO: 769063 - DNA, 20 bp, Artificial
  CRISPR gRNA sequence
caggcgaatcacttgaagtc

SEQ ID NO: 769064 - DNA, 20 bp, Artificial
  CRISPR gRNA sequence
cttgaagtcaggagtttgtg

SEQ ID NO: 769065 - DNA, 20 bp, Artificial
  CRISPR gRNA sequence
gaggcagaggttgcagtaag

SEQ ID NO: 769066 - DNA, 20 bp, Artificial
  CRISPR gRNA sequence
gaaagagcagtcaggttggc

SEQ ID NO: 769067 - DNA, 20 bp, Artificial
  CRISPR gRNA sequence
gagaaaatggaagggttcag

SEQ ID NO: 769068 - DNA, 20 bp, Artificial
  CRISPR gRNA sequence
gaaatcagcagtatttgcaa

SEQ ID NO: 769069 - DNA, 20 bp, Artificial
  CRISPR gRNA sequence
ttgcaaagaagcttctagga

SEQ ID NO: 769070 - DNA, 20 bp, Artificial
  CRISPR gRNA sequence
aatgcagagagagaacattt

SEQ ID NO: 769071 - DNA, 20 bp, Artificial
  CRISPR gRNA sequence
acactgatcaacaagaatag

SEQ ID NO: 769072 - DNA, 20 bp, Artificial
  CRISPR gRNA sequence
ggtgggtggatcacgaggtc

SEQ ID NO: 769073 - DNA, 20 bp, Artificial
  CRISPR gRNA sequence
tcaggaggctgaggcaggag

SEQ ID NO: 769074 - DNA, 20 bp, Artificial
  CRISPR gRNA sequence
tgagcagccacttcctttcc

SEQ ID NO: 769075 - DNA, 20 bp, Artificial
  CRISPR gRNA sequence
gggctaaggatgaacgaacg

SEQ ID NO: 769076 - DNA, 20 bp, Artificial
  CRISPR gRNA sequence
gccgcctccctcactctcca

SEQ ID NO: 769077 - DNA, 20 bp, Artificial
  CRISPR gRNA sequence
ctcactctccacactgcttc

SEQ ID NO: 769078 - DNA, 20 bp, Artificial
  CRISPR gRNA sequence
cccatcacccccctcactgg

SEQ ID NO: 769079 - DNA, 20 bp, Artificial
  CRISPR gRNA sequence
caggctctcccagggccgag

SEQ ID NO: 769080 - DNA, 20 bp, Artificial
  CRISPR gRNA sequence
ggaaacctgccctggagaga

SEQ ID NO: 769081 - DNA, 20 bp, Artificial
  CRISPR gRNA sequence
ctgcgtaccaccccctccac

SEQ ID NO: 769082 - DNA, 20 bp, Artificial
  CRISPR gRNA sequence
tcccaaaaccacagagcacc

SEQ ID NO: 769083 - DNA, 20 bp, Artificial
  CRISPR gRNA sequence
aatcattttttttcccttaa

SEQ ID NO: 769084 - DNA, 20 bp, Artificial
  CRISPR gRNA sequence
ttcccttaaaccagtttgaa

SEQ ID NO: 769085 - DNA, 20 bp, Artificial
  CRISPR gRNA sequence
gtacacgtctgtcctcaagg

SEQ ID NO: 769086 - DNA, 20 bp, Artificial
  CRISPR gRNA sequence
gggacatgcagttagatcac

SEQ ID NO: 769087 - DNA, 20 bp, Artificial
  CRISPR gRNA sequence
agtgttcctacctataaaag

SEQ ID NO: 769088 - DNA, 20 bp, Artificial
  CRISPR gRNA sequence
agtggaactttatcagtact

SEQ ID NO: 769089 - DNA, 20 bp, Artificial
  CRISPR gRNA sequence
gctttcagggactatatcct

SEQ ID NO: 769090 - DNA, 20 bp, Artificial
  CRISPR gRNA sequence
gcaatgtgtacactgatgtg

SEQ ID NO: 769091 - DNA, 20 bp, Artificial
  CRISPR gRNA sequence
gtcaccgagtgatgcctgag

SEQ ID NO: 769092 - DNA, 20 bp, Artificial
  CRISPR gRNA sequence
aatgtcaagggtagaagtga

SEQ ID NO: 769093 - DNA, 20 bp, Artificial
  CRISPR gRNA sequence
tagaagtgaccaggcttggg

SEQ ID NO: 769094 - DNA, 20 bp, Artificial
  CRISPR gRNA sequence
gaaggtgtcaagagggcact

SEQ ID NO: 769095 - DNA, 20 bp, Artificial
  CRISPR gRNA sequence
acccaccgcatacacacaat

SEQ ID NO: 769096 - DNA, 20 bp, Artificial
  CRISPR gRNA sequence
atggcctgcatgggctatcc

SEQ ID NO: 769097 - DNA, 20 bp, Artificial
  CRISPR gRNA sequence
tgatggagttcagaatgggg

SEQ ID NO: 769098 - DNA, 20 bp, Artificial
  CRISPR gRNA sequence
catgaagttggccattttat

SEQ ID NO: 769099 - DNA, 20 bp, Artificial
  CRISPR gRNA sequence
acaatgctcaataatttgtt

SEQ ID NO: 769100 - DNA, 20 bp, Artificial
  CRISPR gRNA sequence
tcatccccagggctgtcatg

SEQ ID NO: 769101 - DNA, 20 bp, Artificial
  CRISPR gRNA sequence
agggctgtcatgagaagctt

SEQ ID NO: 769102 - DNA, 20 bp, Artificial
  CRISPR gRNA sequence
cattggttccaggactttgt

SEQ ID NO: 769103 - DNA, 20 bp, Artificial
  CRISPR gRNA sequence
gactttgtcaaggattaaga

SEQ ID NO: 769104 - DNA, 20 bp, Artificial
  CRISPR gRNA sequence
tgttcatttattcattcaac

SEQ ID NO: 769105 - DNA, 20 bp, Artificial
  CRISPR gRNA sequence
tctcattctcaagttgggag

SEQ ID NO: 769106 - DNA, 20 bp, Artificial
  CRISPR gRNA sequence
gttgggaggtatgtttatta

SEQ ID NO: 769107 - DNA, 20 bp, Artificial
  CRISPR gRNA sequence
tacccatgttatatatatta

SEQ ID NO: 769108 - DNA, 20 bp, Artificial
  CRISPR gRNA sequence
atcaaataataataacatag

SEQ ID NO: 769109 - DNA, 20 bp, Artificial
  CRISPR gRNA sequence
catgcaccaggctctgttct

SEQ ID NO: 769110 - DNA, 20 bp, Artificial
  CRISPR gRNA sequence
ttttacacatattaactcat

SEQ ID NO: 769111 - DNA, 20 bp, Artificial
  CRISPR gRNA sequence
gaggagtaaattcagggatg

SEQ ID NO: 769112 - DNA, 20 bp, Artificial
  CRISPR gRNA sequence
ggagagatttaataacttgc

SEQ ID NO: 769113 - DNA, 20 bp, Artificial
  CRISPR gRNA sequence
tttcatattaaaaatagaaa

SEQ ID NO: 769114 - DNA, 20 bp, Artificial
  CRISPR gRNA sequence
tatcattaaaatagaatatg

SEQ ID NO: 769115 - DNA, 20 bp, Artificial
  CRISPR gRNA sequence
ttgtgggaatggacgaggca

SEQ ID NO: 769116 - DNA, 20 bp, Artificial
  CRISPR gRNA sequence
gtgagggacgtagatgggga

SEQ ID NO: 769117 - DNA, 20 bp, Artificial
  CRISPR gRNA sequence
gactggcctgaaatatccct

SEQ ID NO: 769118 - DNA, 20 bp, Artificial
  CRISPR gRNA sequence
aaatatccctgacagcttct

SEQ ID NO: 769119 - DNA, 20 bp, Artificial
  CRISPR gRNA sequence
aaacctgccctgcccccact

SEQ ID NO: 769120 - DNA, 20 bp, Artificial
  CRISPR gRNA sequence
tcaaaaaagactctttcttg

SEQ ID NO: 769121 - DNA, 20 bp, Artificial
  CRISPR gRNA sequence
gtcttttttttttttcttaa

SEQ ID NO: 769122 - DNA, 20 bp, Artificial
  CRISPR gRNA sequence
tttttcttaaatgtgcttga

SEQ ID NO: 769123 - DNA, 20 bp, Artificial
  CRISPR gRNA sequence
ctatctccatttctctctac

SEQ ID NO: 769124 - DNA, 20 bp, Artificial
  CRISPR gRNA sequence
acttgcccctcaccacagtg

SEQ ID NO: 769125 - DNA, 20 bp, Artificial
  CRISPR gRNA sequence
cctcacagtgttgctgcaaa

SEQ ID NO: 769126 - DNA, 20 bp, Artificial
  CRISPR gRNA sequence
ttcttcttcctagatgacat

SEQ ID NO: 769127 - DNA, 20 bp, Artificial
  CRISPR gRNA sequence
ggtggggcctgtaagaagtg

SEQ ID NO: 769128 - DNA, 20 bp, Artificial
  CRISPR gRNA sequence
cctgtcattcattgcaccca

SEQ ID NO: 769129 - DNA, 20 bp, Artificial
  CRISPR gRNA sequence
cctccctgagaaggaaccac

SEQ ID NO: 769130 - DNA, 20 bp, Artificial
  CRISPR gRNA sequence
attgcatccttaattctagc

SEQ ID NO: 769131 - DNA, 20 bp, Artificial
  CRISPR gRNA sequence
gcacataatgggttctcaat

SEQ ID NO: 769132 - DNA, 20 bp, Artificial
  CRISPR gRNA sequence
gagtgaacgaatgaatgcat

SEQ ID NO: 769133 - DNA, 20 bp, Artificial
  CRISPR gRNA sequence
ggatagatatatggatggat

SEQ ID NO: 769134 - DNA, 20 bp, Artificial
  CRISPR gRNA sequence
tggagtgtcagaataagggt

SEQ ID NO: 769135 - DNA, 20 bp, Artificial
  CRISPR gRNA sequence
gaataagggtgagagtttgc

SEQ ID NO: 769136 - DNA, 20 bp, Artificial
  CRISPR gRNA sequence
gttttctacttgatacactt

SEQ ID NO: 769137 - DNA, 20 bp, Artificial
  CRISPR gRNA sequence
gttgggctggtgtaatcaca

SEQ ID NO: 769138 - DNA, 20 bp, Artificial
  CRISPR gRNA sequence
ttcatggaagaagttagcac

SEQ ID NO: 769139 - DNA, 20 bp, Artificial
  CRISPR gRNA sequence
tgaaaatatcctctctgagc

SEQ ID NO: 769140 - DNA, 20 bp, Artificial
  CRISPR gRNA sequence
cagtttgctcatttgtaaaa

SEQ ID NO: 769141 - DNA, 20 bp, Artificial
  CRISPR gRNA sequence
ttataaaccttaccctcata

SEQ ID NO: 769142 - DNA, 20 bp, Artificial
  CRISPR gRNA sequence
gagttccctgggaacagcct

SEQ ID NO: 769143 - DNA, 20 bp, Artificial
  CRISPR gRNA sequence
cctttttcctgataatctga

SEQ ID NO: 769144 - DNA, 20 bp, Artificial
  CRISPR gRNA sequence
ggaatcagttcttcctctcc

SEQ ID NO: 769145 - DNA, 20 bp, Artificial
  CRISPR gRNA sequence
cacatgagaccacatcagag

SEQ ID NO: 769146 - DNA, 20 bp, Artificial
  CRISPR gRNA sequence
cctccttgcctccaaattcc

SEQ ID NO: 769147 - DNA, 20 bp, Artificial
  CRISPR gRNA sequence
ggtttctaccctgaaagagg

SEQ ID NO: 769148 - DNA, 20 bp, Artificial
  CRISPR gRNA sequence
gagctcagaagccagcagcc

SEQ ID NO: 769149 - DNA, 20 bp, Artificial
  CRISPR gRNA sequence
atgccttgctgaacacatga

SEQ ID NO: 769150 - DNA, 20 bp, Artificial
  CRISPR gRNA sequence
ctgggccccttcctcttcgc

SEQ ID NO: 769151 - DNA, 20 bp, Artificial
  CRISPR gRNA sequence
gctccaaggctcccagcaag

SEQ ID NO: 769152 - DNA, 20 bp, Artificial
  CRISPR gRNA sequence
atgcttctcactccacttcc

SEQ ID NO: 769153 - DNA, 20 bp, Artificial
  CRISPR gRNA sequence
gctccctatgcctagagaag

SEQ ID NO: 769154 - DNA, 20 bp, Artificial
  CRISPR gRNA sequence
gtgacttaccctttctgggc

SEQ ID NO: 769155 - DNA, 20 bp, Artificial
  CRISPR gRNA sequence
tgttaatgataccctacctc

SEQ ID NO: 769156 - DNA, 20 bp, Artificial
  CRISPR gRNA sequence
cctacctcataggattacta

SEQ ID NO: 769157 - DNA, 20 bp, Artificial
  CRISPR gRNA sequence
ctgaccctatgactcagatc

SEQ ID NO: 769158 - DNA, 20 bp, Artificial
  CRISPR gRNA sequence
catgtggtcataatctcaga

SEQ ID NO: 769159 - DNA, 20 bp, Artificial
  CRISPR gRNA sequence
ggtcataatctcagaggctg

SEQ ID NO: 769160 - DNA, 20 bp, Artificial
  CRISPR gRNA sequence
tcaaatcctactccaaagaa

SEQ ID NO: 769161 - DNA, 20 bp, Artificial
  CRISPR gRNA sequence
tttacccctccagagaaagc

SEQ ID NO: 769162 - DNA, 20 bp, Artificial
  CRISPR gRNA sequence
ttaatgatggaattctcaca

SEQ ID NO: 769163 - DNA, 20 bp, Artificial
  CRISPR gRNA sequence
acaggaaggaaaacagggtc

SEQ ID NO: 769164 - DNA, 20 bp, Artificial
  CRISPR gRNA sequence
caggagtctagagtaagctg

SEQ ID NO: 769165 - DNA, 20 bp, Artificial
  CRISPR gRNA sequence
tcaacagttaccctaagtgt

SEQ ID NO: 769166 - DNA, 20 bp, Artificial
  CRISPR gRNA sequence
agatcagctcaacccatcgg

SEQ ID NO: 769167 - DNA, 20 bp, Artificial
  CRISPR gRNA sequence
ccatcggacaggtttagact

SEQ ID NO: 769168 - DNA, 20 bp, Artificial
  CRISPR gRNA sequence
tacaaggaaggctgcacagc

SEQ ID NO: 769169 - DNA, 20 bp, Artificial
  CRISPR gRNA sequence
aagaactctcttaaagacaa

SEQ ID NO: 769170 - DNA, 20 bp, Artificial
  CRISPR gRNA sequence
atagaaactaactgctgaag

SEQ ID NO: 769171 - DNA, 20 bp, Artificial
  CRISPR gRNA sequence
atgcttataagaaaaggacc

SEQ ID NO: 769172 - DNA, 20 bp, Artificial
  CRISPR gRNA sequence
ccacatccaatttgaaggta

SEQ ID NO: 769173 - DNA, 20 bp, Artificial
  CRISPR gRNA sequence
cacacacacacacaaatctt

SEQ ID NO: 769174 - DNA, 20 bp, Artificial
  CRISPR gRNA sequence
caaatcttttttgctttact

SEQ ID NO: 769175 - DNA, 20 bp, Artificial
  CRISPR gRNA sequence
tttttgctttactatttgct

SEQ ID NO: 769176 - DNA, 20 bp, Artificial
  CRISPR gRNA sequence
tcccatatctgagtcatcta

SEQ ID NO: 769177 - DNA, 20 bp, Artificial
  CRISPR gRNA sequence
atcacgcttttctcattaga

SEQ ID NO: 769178 - DNA, 20 bp, Artificial
  CRISPR gRNA sequence
gcttttctcattagagcagg

SEQ ID NO: 769179 - DNA, 20 bp, Artificial
  CRISPR gRNA sequence
cacctcaccccccacctccc

SEQ ID NO: 769180 - DNA, 20 bp, Artificial
  CRISPR gRNA sequence
gccgctcccctcccggagct

SEQ ID NO: 769181 - DNA, 20 bp, Artificial
  CRISPR gRNA sequence
ctaacctcccagcgccggcc

SEQ ID NO: 769182 - DNA, 20 bp, Artificial
  CRISPR gRNA sequence
agcgccggccggtggcttcg

SEQ ID NO: 769183 - DNA, 20 bp, Artificial
  CRISPR gRNA sequence
ttcacccacccggcccggtc

SEQ ID NO: 769184 - DNA, 20 bp, Artificial
  CRISPR gRNA sequence
ggctccggtgcgtccctgag

SEQ ID NO: 769185 - DNA, 20 bp, Artificial
  CRISPR gRNA sequence
ctaagccaaacctgctctaa

SEQ ID NO: 769186 - DNA, 20 bp, Artificial
  CRISPR gRNA sequence
ggggtgttagttgtcttaat

SEQ ID NO: 769187 - DNA, 20 bp, Artificial
  CRISPR gRNA sequence
ttcagcagttagtttctata

SEQ ID NO: 769188 - DNA, 20 bp, Artificial
  CRISPR gRNA sequence
ttgacttctgaaacttcctg

SEQ ID NO: 769189 - DNA, 20 bp, Artificial
  CRISPR gRNA sequence
cacagcacctaaagagactc

SEQ ID NO: 769190 - DNA, 20 bp, Artificial
  CRISPR gRNA sequence
atacggggtttggggtctgt

SEQ ID NO: 769191 - DNA, 20 bp, Artificial
  CRISPR gRNA sequence
ggactggtccacatgatttt

SEQ ID NO: 769192 - DNA, 20 bp, Artificial
  CRISPR gRNA sequence
ttgcctttggtcttgttggc

SEQ ID NO: 769193 - DNA, 20 bp, Artificial
  CRISPR gRNA sequence
acagttggggaaactgaggc

SEQ ID NO: 769194 - DNA, 20 bp, Artificial
  CRISPR gRNA sequence
tttctttctctttgtggtcc

SEQ ID NO: 769195 - DNA, 20 bp, Artificial
  CRISPR gRNA sequence
gaggaaggggcccaggacca

SEQ ID NO: 769196 - DNA, 20 bp, Artificial
  CRISPR gRNA sequence
taagctgagcctctttcagg

SEQ ID NO: 769197 - DNA, 20 bp, Artificial
  CRISPR gRNA sequence
catttaggcagatcacatct

SEQ ID NO: 769198 - DNA, 20 bp, Artificial
  CRISPR gRNA sequence
atactactgtcctgactcac

SEQ ID NO: 769199 - DNA, 20 bp, Artificial
  CRISPR gRNA sequence
atggttgaggagatgaagac

SEQ ID NO: 769200 - DNA, 20 bp, Artificial
  CRISPR gRNA sequence
tccttttttcgttaattgca

SEQ ID NO: 769201 - DNA, 20 bp, Artificial
  CRISPR gRNA sequence
aaaacagagaagtgtatcaa

SEQ ID NO: 769202 - DNA, 20 bp, Artificial
  CRISPR gRNA sequence
cattatgtgccaagccattg

SEQ ID NO: 769203 - DNA, 20 bp, Artificial
  CRISPR gRNA sequence
gggaggttctcatatatcat

SEQ ID NO: 769204 - DNA, 20 bp, Artificial
  CRISPR gRNA sequence
cttttctgtcaaggtgaccc

SEQ ID NO: 769205 - DNA, 20 bp, Artificial
  CRISPR gRNA sequence
gtccatgttttactgctata

SEQ ID NO: 769206 - DNA, 20 bp, Artificial
  CRISPR gRNA sequence
ccacagcctgggtaatatat

SEQ ID NO: 769207 - DNA, 20 bp, Artificial
  CRISPR gRNA sequence
gcacccatgtcatctaggaa

SEQ ID NO: 769208 - DNA, 20 bp, Artificial
  CRISPR gRNA sequence
tatagagtatagattggaga

SEQ ID NO: 769209 - DNA, 20 bp, Artificial
  CRISPR gRNA sequence
aggaagagaagcaggggtag

SEQ ID NO: 769210 - DNA, 20 bp, Artificial
  CRISPR gRNA sequence
gagtccttcagttacagata

SEQ ID NO: 769211 - DNA, 20 bp, Artificial
  CRISPR gRNA sequence
aaaactagctcaagcacatt

SEQ ID NO: 769212 - DNA, 20 bp, Artificial
  CRISPR gRNA sequence
atccttcttagtaatctcaa

SEQ ID NO: 769213 - DNA, 20 bp, Artificial
  CRISPR gRNA sequence
tagaccaagagaagggcact

SEQ ID NO: 769214 - DNA, 20 bp, Artificial
  CRISPR gRNA sequence
ggtgtggggtgaacttggag

SEQ ID NO: 769215 - DNA, 20 bp, Artificial
  CRISPR gRNA sequence
tctcctggagtcccatcttc

SEQ ID NO: 769216 - DNA, 20 bp, Artificial
  CRISPR gRNA sequence
ataataatagtacctacttc

SEQ ID NO: 769217 - DNA, 20 bp, Artificial
  CRISPR gRNA sequence
aataaacatacctcccaact

SEQ ID NO: 769218 - DNA, 20 bp, Artificial
  CRISPR gRNA sequence
cattaatttctgcagtttcc

SEQ ID NO: 769219 - DNA, 20 bp, Artificial
  CRISPR gRNA sequence
cttagttagttcagatgctg

SEQ ID NO: 769220 - DNA, 20 bp, Artificial
  CRISPR gRNA sequence
ggaccctgtctcttaaaaag

SEQ ID NO: 769221 - DNA, 20 bp, Artificial
  CRISPR gRNA sequence
ccacactttgggctcatttt

SEQ ID NO: 769222 - DNA, 20 bp, Artificial
  CRISPR gRNA sequence
ctgcatgtcccccttcccta

SEQ ID NO: 769223 - DNA, 20 bp, Artificial
  CRISPR gRNA sequence
gactccttcggttgcagaca

SEQ ID NO: 769224 - DNA, 20 bp, Artificial
  CRISPR gRNA sequence
gtcctaagagaaggcacctt

SEQ ID NO: 769225 - DNA, 20 bp, Artificial
  CRISPR gRNA sequence
tggaagggtggaaaggtgta

SEQ ID NO: 769226 - DNA, 20 bp, Artificial
  CRISPR gRNA sequence
cccagtgattcccattactc

SEQ ID NO: 769227 - DNA, 20 bp, Artificial
  CRISPR gRNA sequence
agtaggtgcccaataactgt

SEQ ID NO: 769228 - DNA, 20 bp, Artificial
  CRISPR gRNA sequence
ctgctctgatttctctagag

SEQ ID NO: 769229 - DNA, 20 bp, Artificial
  CRISPR gRNA sequence
cacacaatctaaccattacc

SEQ ID NO: 769230 - DNA, 20 bp, Artificial
  CRISPR gRNA sequence
cccagtgattcccattactc

SEQ ID NO: 769231 - DNA, 20 bp, Artificial
  CRISPR gRNA sequence
caaatcgtgtttcgttagga

SEQ ID NO: 769232 - DNA, 20 bp, Artificial
  CRISPR gRNA sequence
ttcgttaggaaaagaaaaaa

SEQ ID NO: 769233 - DNA, 20 bp, Artificial
  CRISPR gRNA sequence
gaaaagaaaaaaaaagaaaa

SEQ ID NO: 769234 - DNA, 20 bp, Artificial
  CRISPR gRNA sequence
cttgtgattctctctcctcc

SEQ ID NO: 769235 - DNA, 20 bp, Artificial
  CRISPR gRNA sequence
ataccttagtcacatgctga

SEQ ID NO: 769236 - DNA, 20 bp, Artificial
  CRISPR gRNA sequence
aagttgcctcctaatgatag

SEQ ID NO: 769237 - DNA, 20 bp, Artificial
  CRISPR gRNA sequence
tcactggaggggttgggggc

SEQ ID NO: 769238 - DNA, 20 bp, Artificial
  CRISPR gRNA sequence
aaggctctggaagcctctgg

SEQ ID NO: 769239 - DNA, 20 bp, Artificial
  CRISPR gRNA sequence
taatctgcttttgcatctaa

SEQ ID NO: 769240 - DNA, 20 bp, Artificial
  CRISPR gRNA sequence
atgctgttcacaggcgaaaa

SEQ ID NO: 769241 - DNA, 20 bp, Artificial
  CRISPR gRNA sequence
ctggatatttgcgatgctgt

SEQ ID NO: 769242 - DNA, 20 bp, Artificial
  CRISPR gRNA sequence
gagtataaatgtgattgcaa

SEQ ID NO: 769243 - DNA, 20 bp, Artificial
  CRISPR gRNA sequence
gagaatgtttatctcaccta

SEQ ID NO: 769244 - DNA, 20 bp, Artificial
  CRISPR gRNA sequence
ctacttgggaggctggggca

SEQ ID NO: 769245 - DNA, 20 bp, Artificial
  CRISPR gRNA sequence
gccaagcacatttcacagac

SEQ ID NO: 769246 - DNA, 20 bp, Artificial
  CRISPR gRNA sequence
agtgaggagatgagccatga

SEQ ID NO: 769247 - DNA, 20 bp, Artificial
  CRISPR gRNA sequence
agtttgctgccttctgatcc

SEQ ID NO: 769248 - DNA, 20 bp, Artificial
  CRISPR gRNA sequence
aggtgaatattgagctaagc

SEQ ID NO: 769249 - DNA, 20 bp, Artificial
  CRISPR gRNA sequence
aaggagccagttgcttctgg

SEQ ID NO: 769250 - DNA, 20 bp, Artificial
  CRISPR gRNA sequence
ctgaagctgaggctcctaca

SEQ ID NO: 769251 - DNA, 20 bp, Artificial
  CRISPR gRNA sequence
ctgaggctcctacagtagaa

SEQ ID NO: 769252 - DNA, 20 bp, Artificial
  CRISPR gRNA sequence
ggccctggctttcgtgtgct

SEQ ID NO: 769253 - DNA, 20 bp, Artificial
  CRISPR gRNA sequence
atcaaacagagctgtgagga

SEQ ID NO: 769254 - DNA, 20 bp, Artificial
  CRISPR gRNA sequence
ggttgtcccattctatagat

SEQ ID NO: 769255 - DNA, 20 bp, Artificial
  CRISPR gRNA sequence
agaaaactaaggcccagaga

SEQ ID NO: 769256 - DNA, 20 bp, Artificial
  CRISPR gRNA sequence
cccctccagagccaagaggg

SEQ ID NO: 769257 - DNA, 20 bp, Artificial
  CRISPR gRNA sequence
gagccctaactcaggggagg

SEQ ID NO: 769258 - DNA, 20 bp, Artificial
  CRISPR gRNA sequence
ggtcatttccttcctgtttt

SEQ ID NO: 769259 - DNA, 20 bp, Artificial
  CRISPR gRNA sequence
ctacttgggaagctgaggcg

SEQ ID NO: 769260 - DNA, 20 bp, Artificial
  CRISPR gRNA sequence
cttggttttgaagagttgct

SEQ ID NO: 769261 - DNA, 20 bp, Artificial
  CRISPR gRNA sequence
cccagggacatacagagccc

SEQ ID NO: 769262 - DNA, 20 bp, Artificial
  CRISPR gRNA sequence
catgaaatgaagatgatgga

SEQ ID NO: 769263 - DNA, 20 bp, Artificial
  CRISPR gRNA sequence
tcagccctgcttccacctgc

SEQ ID NO: 769264 - DNA, 20 bp, Artificial
  CRISPR gRNA sequence
catagcccctcgccacggct

SEQ ID NO: 769265 - DNA, 20 bp, Artificial
  CRISPR gRNA sequence
cctctggacctttcatagca

SEQ ID NO: 769266 - DNA, 20 bp, Artificial
  CRISPR gRNA sequence
cccagcctgcaacatccagg

SEQ ID NO: 769267 - DNA, 20 bp, Artificial
  CRISPR gRNA sequence
cctgcttccaaacacttcac

SEQ ID NO: 769268 - DNA, 20 bp, Artificial
  CRISPR gRNA sequence
aggaaaagactgccccagcc

SEQ ID NO: 769269 - DNA, 20 bp, Artificial
  CRISPR gRNA sequence
ccccaaccccatgctctggg

SEQ ID NO: 769270 - DNA, 20 bp, Artificial
  CRISPR gRNA sequence
tcaactgaatggatacatga

SEQ ID NO: 769271 - DNA, 20 bp, Artificial
  CRISPR gRNA sequence
gccgcactgtccctgtctga

SEQ ID NO: 769272 - DNA, 20 bp, Artificial
  CRISPR gRNA sequence
actagtgtatcacggccatt

SEQ ID NO: 769273 - DNA, 20 bp, Artificial
  CRISPR gRNA sequence
gtctgaatattgcatctttt

SEQ ID NO: 769274 - DNA, 20 bp, Artificial
  CRISPR gRNA sequence
tggtcagtgtactgtgtccc

SEQ ID NO: 769275 - DNA, 20 bp, Artificial
  CRISPR gRNA sequence
tggtctgttcattgtgtcta

SEQ ID NO: 769276 - DNA, 20 bp, Artificial
  CRISPR gRNA sequence
acttgggaatcatgtccatt

SEQ ID NO: 769277 - DNA, 20 bp, Artificial
  CRISPR gRNA sequence
tcatcttcatttcatgatgg

SEQ ID NO: 769278 - DNA, 20 bp, Artificial
  CRISPR gRNA sequence
aaagcttgaagttgaagagg

SEQ ID NO: 769279 - DNA, 20 bp, Artificial
  CRISPR gRNA sequence
ggccttagttttctgcatct

SEQ ID NO: 769280 - DNA, 20 bp, Artificial
  CRISPR gRNA sequence
ctacatctgcctctgagcat

SEQ ID NO: 769281 - DNA, 20 bp, Artificial
  CRISPR gRNA sequence
cacgctgggcaccaacaggc

SEQ ID NO: 769282 - DNA, 20 bp, Artificial
  CRISPR gRNA sequence
cagatgggtaaaggttggca

SEQ ID NO: 769283 - DNA, 20 bp, Artificial
  CRISPR gRNA sequence
gctcctgcaaaggcaagaac

SEQ ID NO: 769284 - DNA, 20 bp, Artificial
  CRISPR gRNA sequence
cacacacactcgttctgtca

SEQ ID NO: 769285 - DNA, 20 bp, Artificial
  CRISPR gRNA sequence
tctatggctccctagtgact

SEQ ID NO: 769286 - DNA, 20 bp, Artificial
  CRISPR gRNA sequence
catttactccctggccattt

SEQ ID NO: 769287 - DNA, 20 bp, Artificial
  CRISPR gRNA sequence
ccagtgatgaagagaggtgt

SEQ ID NO: 769288 - DNA, 20 bp, Artificial
  CRISPR gRNA sequence
ttacatttgccctgttcacc

SEQ ID NO: 769289 - DNA, 20 bp, Artificial
  CRISPR gRNA sequence
gaggactgaaagtctgaatc

SEQ ID NO: 769290 - DNA, 20 bp, Artificial
  CRISPR gRNA sequence
agtaggccagacctgctcta

SEQ ID NO: 769291 - DNA, 20 bp, Artificial
  CRISPR gRNA sequence
tagctactcaagtttaaaat

SEQ ID NO: 769292 - DNA, 20 bp, Artificial
  CRISPR gRNA sequence
ggccagctgtcactcaggct

SEQ ID NO: 769293 - DNA, 20 bp, Artificial
  CRISPR gRNA sequence
atcagatggcgcccactgac

SEQ ID NO: 769294 - DNA, 20 bp, Artificial
  CRISPR gRNA sequence
ggccacaccttgtggctgcc

SEQ ID NO: 769295 - DNA, 20 bp, Artificial
  CRISPR gRNA sequence
tcagaggggcagggtggtga

SEQ ID NO: 769296 - DNA, 20 bp, Artificial
  CRISPR gRNA sequence
gtcttaggacctcattcagt

SEQ ID NO: 769297 - DNA, 20 bp, Artificial
  CRISPR gRNA sequence
acaggtgccaagcataaaag

SEQ ID NO: 769298 - DNA, 20 bp, Artificial
  CRISPR gRNA sequence
tagtggtttctctggaggag

SEQ ID NO: 769299 - DNA, 20 bp, Artificial
  CRISPR gRNA sequence
aaacacgatttgtttttata

SEQ ID NO: 769300 - DNA, 20 bp, Artificial
  CRISPR gRNA sequence
acgatttgtttttatacaag

SEQ ID NO: 769301 - DNA, 20 bp, Artificial
  CRISPR gRNA sequence
ctactcaggaggctgaggca

SEQ ID NO: 769302 - DNA, 20 bp, Artificial
  CRISPR gRNA sequence
tcattaaaggtttcctgcat

SEQ ID NO: 769303 - DNA, 20 bp, Artificial
  CRISPR gRNA sequence
acaaaaccctttcttgctct

SEQ ID NO: 769304 - DNA, 20 bp, Artificial
  CRISPR gRNA sequence
tctcagagcagagatgctga

SEQ ID NO: 769305 - DNA, 20 bp, Artificial
  CRISPR gRNA sequence
ccaggtgggggcgaatctag

SEQ ID NO: 769306 - DNA, 20 bp, Artificial
  CRISPR gRNA sequence
agtcatgcagacgtttaggg

SEQ ID NO: 769307 - DNA, 20 bp, Artificial
  CRISPR gRNA sequence
gggggcgcacacagtgtatt

SEQ ID NO: 769308 - DNA, 20 bp, Artificial
  CRISPR gRNA sequence
tggaaggctgcccctgcctg

SEQ ID NO: 769309 - DNA, 20 bp, Artificial
  CRISPR gRNA sequence
ctacttgggagggtgaggca

SEQ ID NO: 769310 - DNA, 20 bp, Artificial
  CRISPR gRNA sequence
gtatctgaggacttgggtag

SEQ ID NO: 769311 - DNA, 20 bp, Artificial
  CRISPR gRNA sequence
ggtggagcattcactgaggc

SEQ ID NO: 769312 - DNA, 20 bp, Artificial
  CRISPR gRNA sequence
tgccaaccaacactgatcaa

SEQ ID NO: 769313 - DNA, 20 bp, Artificial
  CRISPR gRNA sequence
accaacactgatcaacaaga

SEQ ID NO: 769314 - DNA, 20 bp, Artificial
  CRISPR gRNA sequence
ctactcaggaggctgaggca

SEQ ID NO: 769315 - DNA, 20 bp, Artificial
  CRISPR gRNA sequence
gcctggaggagctgaggaca

SEQ ID NO: 769316 - DNA, 20 bp, Artificial
  CRISPR gRNA sequence
acaggagaaagagacagagc

SEQ ID NO: 769317 - DNA, 20 bp, Artificial
  CRISPR gRNA sequence
tcagaaaggaagtgctccct

SEQ ID NO: 769318 - DNA, 20 bp, Artificial
  CRISPR gRNA sequence
agatgacccaagatgtgccc

SEQ ID NO: 769319 - DNA, 20 bp, Artificial
  CRISPR gRNA sequence
ccacaaagggacaaaaaggg

SEQ ID NO: 769320 - DNA, 20 bp, Artificial
  CRISPR gRNA sequence
agccagatcaccctggaatt

SEQ ID NO: 769321 - DNA, 20 bp, Artificial
  CRISPR gRNA sequence
gctcagtgttcctacctata

SEQ ID NO: 769322 - DNA, 20 bp, Artificial
  CRISPR gRNA sequence
aaatgcacaaagtgactgtg

SEQ ID NO: 769323 - DNA, 20 bp, Artificial
  CRISPR gRNA sequence
tacccagatggtcacatggg

SEQ ID NO: 769324 - DNA, 20 bp, Artificial
  CRISPR gRNA sequence
gaacaaattctggggaaact

SEQ ID NO: 769325 - DNA, 20 bp, Artificial
  CRISPR gRNA sequence
catgtgaccccttggaccac

SEQ ID NO: 769326 - DNA, 20 bp, Artificial
  CRISPR gRNA sequence
ccatcctcttctgatggagt

SEQ ID NO: 769327 - DNA, 20 bp, Artificial
  CRISPR gRNA sequence
aatttgttggtggattaaaa

SEQ ID NO: 769328 - DNA, 20 bp, Artificial
  CRISPR gRNA sequence
accaatcaactggagaagaa

SEQ ID NO: 769329 - DNA, 20 bp, Artificial
  CRISPR gRNA sequence
catgcaatatgaatggagat

SEQ ID NO: 769330 - DNA, 20 bp, Artificial
  CRISPR gRNA sequence
cccacattttcatattaaaa

SEQ ID NO: 769331 - DNA, 20 bp, Artificial
  CRISPR gRNA sequence
gaaacaaatatatcattaaa

SEQ ID NO: 769332 - DNA, 20 bp, Artificial
  CRISPR gRNA sequence
tgttacaagacctggctcat

SEQ ID NO: 769333 - DNA, 20 bp, Artificial
  CRISPR gRNA sequence
cccccactcagtgattagtt

SEQ ID NO: 769334 - DNA, 20 bp, Artificial
  CRISPR gRNA sequence
gtgtctgctaccaacaatct

SEQ ID NO: 769335 - DNA, 20 bp, Artificial
  CRISPR gRNA sequence
atctatactctatacaacag

SEQ ID NO: 769336 - DNA, 20 bp, Artificial
  CRISPR gRNA sequence
atattctgagggtcaccttg

SEQ ID NO: 769337 - DNA, 20 bp, Artificial
  CRISPR gRNA sequence
gtgaatgcaactctggagtg

SEQ ID NO: 769338 - DNA, 20 bp, Artificial
  CRISPR gRNA sequence
tctataaatgggcagcagcc

SEQ ID NO: 769339 - DNA, 20 bp, Artificial
  CRISPR gRNA sequence
aaaagaagggatggcaacaa

SEQ ID NO: 769340 - DNA, 20 bp, Artificial
  CRISPR gRNA sequence
cctaccccacagggctgctg

SEQ ID NO: 769341 - DNA, 20 bp, Artificial
  CRISPR gRNA sequence
ccctgctccaaggctcccag

SEQ ID NO: 769342 - DNA, 20 bp, Artificial
  CRISPR gRNA sequence
attcattctctggaccacaa

SEQ ID NO: 769343 - DNA, 20 bp, Artificial
  CRISPR gRNA sequence
attctctggaccacaaagag

SEQ ID NO: 769344 - DNA, 20 bp, Artificial
  CRISPR gRNA sequence
gaccacaaagagaaagaaag

SEQ ID NO: 769345 - DNA, 20 bp, Artificial
  CRISPR gRNA sequence
ttggcacatcttaccgggct

SEQ ID NO: 769346 - DNA, 20 bp, Artificial
  CRISPR gRNA sequence
ctgtgcctacctccagagca

SEQ ID NO: 769347 - DNA, 20 bp, Artificial
  CRISPR gRNA sequence
gaacaaagatttacccctcc

SEQ ID NO: 769348 - DNA, 20 bp, Artificial
  CRISPR gRNA sequence
tggaaagcttactgcaggca

SEQ ID NO: 769349 - DNA, 20 bp, Artificial
  CRISPR gRNA sequence
cagcttcattactttctaat

SEQ ID NO: 769350 - DNA, 20 bp, Artificial
  CRISPR gRNA sequence
aactgctgaagacatgctta

SEQ ID NO: 769351 - DNA, 20 bp, Artificial
  CRISPR gRNA sequence
ctcattagagcaggtttggc

SEQ ID NO: 769352 - DNA, 20 bp, Artificial
  CRISPR gRNA sequence
ggggcggggcgggccgcgcc

SEQ ID NO: 769353 - DNA, 20 bp, Artificial
  CRISPR gRNA sequence
gggtctcgggtcctgcagag

SEQ ID NO: 769354 - DNA, 20 bp, Artificial
  CRISPR gRNA sequence
tatgggatctatcactgagg

SEQ ID NO: 769355 - DNA, 20 bp, Artificial
  CRISPR gRNA sequence
tgttagttgtcttaatttag

SEQ ID NO: 769356 - DNA, 20 bp, Artificial
  CRISPR gRNA sequence
gaatttacatgttcatagtt

SEQ ID NO: 769357 - DNA, 20 bp, Artificial
  CRISPR gRNA sequence
acagagaagtgtatcaagta

SEQ ID NO: 769358 - DNA, 20 bp, Artificial
  CRISPR gRNA sequence
aggttctcatatatcatgaa

SEQ ID NO: 769359 - DNA, 20 bp, Artificial
  CRISPR gRNA sequence
tccttcagttacagataata

SEQ ID NO: 769360 - DNA, 20 bp, Artificial
  CRISPR gRNA sequence
ccttgtataaatgtgtacca

SEQ ID NO: 769361 - DNA, 20 bp, Artificial
  CRISPR gRNA sequence
gcctggtgcatggctttcaa

SEQ ID NO: 769362 - DNA, 20 bp, Artificial
  CRISPR gRNA sequence
gtaacaaatgaaatatcctg

SEQ ID NO: 769363 - DNA, 20 bp, Artificial
  CRISPR gRNA sequence
ggatgagattcccctttgtg

SEQ ID NO: 769364 - DNA, 20 bp, Artificial
  CRISPR gRNA sequence
tcatacacctagtcgcctcc

SEQ ID NO: 769365 - DNA, 20 bp, Artificial
  CRISPR gRNA sequence
tccaccctgtcactgaggct

SEQ ID NO: 769366 - DNA, 20 bp, Artificial
  CRISPR gRNA sequence
gtgattcccattactcatag

SEQ ID NO: 769367 - DNA, 20 bp, Artificial
  CRISPR gRNA sequence
ctactcagattatgcgtgat

SEQ ID NO: 769368 - DNA, 20 bp, Artificial
  CRISPR gRNA sequence
acgggtattctttcttgtat

SEQ ID NO: 769369 - DNA, 20 bp, Artificial
  CRISPR gRNA sequence
cccaccccttccccaagatg

SEQ ID NO: 769370 - DNA, 20 bp, Artificial
  CRISPR gRNA sequence
ggtgaaaccctgtctctact

SEQ ID NO: 769371 - DNA, 20 bp, Artificial
  CRISPR gRNA sequence
tggtaaccctttacaaatgt

SEQ ID NO: 769372 - DNA, 20 bp, Artificial
  CRISPR gRNA sequence
cactagtttgtggactgtac

SEQ ID NO: 769373 - DNA, 20 bp, Artificial
  CRISPR gRNA sequence
aggctcctacagtagaatta

SEQ ID NO: 769374 - DNA, 20 bp, Artificial
  CRISPR gRNA sequence
tgtcccattctatagatgca

SEQ ID NO: 769375 - DNA, 20 bp, Artificial
  CRISPR gRNA sequence
agtgtgagcataggtaatcg

SEQ ID NO: 769376 - DNA, 20 bp, Artificial
  CRISPR gRNA sequence
ccctgtctctactaaaaata

SEQ ID NO: 769377 - DNA, 20 bp, Artificial
  CRISPR gRNA sequence
cacattctccagcaactctt

SEQ ID NO: 769378 - DNA, 20 bp, Artificial
  CRISPR gRNA sequence
tctatggttatttgattctg

SEQ ID NO: 769379 - DNA, 20 bp, Artificial
  CRISPR gRNA sequence
ccagtcacctgaaagagctt

SEQ ID NO: 769380 - DNA, 20 bp, Artificial
  CRISPR gRNA sequence
agcccaccactcacccagcc

SEQ ID NO: 769381 - DNA, 20 bp, Artificial
  CRISPR gRNA sequence
gtgtgtggcccacgatgcct

SEQ ID NO: 769382 - DNA, 20 bp, Artificial
  CRISPR gRNA sequence
ccttcaataggcactgctgg

SEQ ID NO: 769383 - DNA, 20 bp, Artificial
  CRISPR gRNA sequence
catccacagagcacacatta

SEQ ID NO: 769384 - DNA, 20 bp, Artificial
  CRISPR gRNA sequence
caagaggagaaccagacaga

SEQ ID NO: 769385 - DNA, 20 bp, Artificial
  CRISPR gRNA sequence
ataatctgagtagcaatgct

SEQ ID NO: 769386 - DNA, 20 bp, Artificial
  CRISPR gRNA sequence
aacctggtaagtcacccaga

SEQ ID NO: 769387 - DNA, 20 bp, Artificial
  CRISPR gRNA sequence
ataatctaggtaacaatgtt

SEQ ID NO: 769388 - DNA, 20 bp, Artificial
  CRISPR gRNA sequence
ttctccttcctgctctatcc

SEQ ID NO: 769389 - DNA, 20 bp, Artificial
  CRISPR gRNA sequence
caagaaaagaagtgcatttt

SEQ ID NO: 769390 - DNA, 20 bp, Artificial
  CRISPR gRNA sequence
ataatctaccatcttcccca

SEQ ID NO: 769391 - DNA, 20 bp, Artificial
  CRISPR gRNA sequence
ggccagaagacaaatacagt

SEQ ID NO: 769392 - DNA, 20 bp, Artificial
  CRISPR gRNA sequence
gctagaaggatatagagccc

SEQ ID NO: 769393 - DNA, 20 bp, Artificial
  CRISPR gRNA sequence
gtggtattctgttatagcag

SEQ ID NO: 769394 - DNA, 20 bp, Artificial
  CRISPR gRNA sequence
tttgcaattaacgaaaaaag

SEQ ID NO: 769395 - DNA, 20 bp, Artificial
  CRISPR gRNA sequence
gactcaatgagcaaaattat

SEQ ID NO: 769396 - DNA, 20 bp, Artificial
  CRISPR gRNA sequence
agaggcatgtgcaggggctg

SEQ ID NO: 769397 - DNA, 20 bp, Artificial
  CRISPR gRNA sequence
cttaggaaagtgcccagtac

SEQ ID NO: 769398 - DNA, 20 bp, Artificial
  CRISPR gRNA sequence
ccgggctccagaaagagggg

SEQ ID NO: 769399 - DNA, 20 bp, Artificial
  CRISPR gRNA sequence
ccctacccactcccaaacct

SEQ ID NO: 769400 - DNA, 20 bp, Artificial
  CRISPR gRNA sequence
gctgaagaggggacaggaag

SEQ ID NO: 769401 - DNA, 20 bp, Artificial
  CRISPR gRNA sequence
gccatacaacccctcagaac

SEQ ID NO: 769402 - DNA, 20 bp, Artificial
  CRISPR gRNA sequence
ggggcggggcggggcggggg

SEQ ID NO: 769403 - DNA, 20 bp, Artificial
  CRISPR gRNA sequence
tgcccagcgggctggctcag

SEQ ID NO: 769404 - DNA, 20 bp, Artificial
  CRISPR gRNA sequence
cccagcgggctggctcaggc

SEQ ID NO: 769405 - DNA, 20 bp, Artificial
  CRISPR gRNA sequence
gctcaggcctcggtcagcag

SEQ ID NO: 769406 - DNA, 20 bp, Artificial
  CRISPR gRNA sequence
aggcctcggtcagcagccgc

SEQ ID NO: 769407 - DNA, 20 bp, Artificial
  CRISPR gRNA sequence
ggtcagcagccgccaccgcg

SEQ ID NO: 769408 - DNA, 20 bp, Artificial
  CRISPR gRNA sequence
agggacgcaccggagccgcc

SEQ ID NO: 769409 - DNA, 20 bp, Artificial
  CRISPR gRNA sequence
tccgggcctcaggcggattc

SEQ ID NO: 769410 - DNA, 20 bp, Artificial
  CRISPR gRNA sequence
ccgggcctcaggcggattct

SEQ ID NO: 769411 - DNA, 20 bp, Artificial
  CRISPR gRNA sequence
cgggcctcaggcggattctc

SEQ ID NO: 769412 - DNA, 20 bp, Artificial
  CRISPR gRNA sequence
aggcggattctccggcgcgg

SEQ ID NO: 769413 - DNA, 20 bp, Artificial
  CRISPR gRNA sequence
tccggcgcggcccgccccgc

SEQ ID NO: 769414 - DNA, 20 bp, Artificial
  CRISPR gRNA sequence
cggcgcggcccgccccgccc

SEQ ID NO: 769415 - DNA, 20 bp, Artificial
  CRISPR gRNA sequence
ggactccccgggccgccccc

SEQ ID NO: 769416 - DNA, 20 bp, Artificial
  CRISPR gRNA sequence
cccgggccgcccccggcccc

SEQ ID NO: 769417 - DNA, 20 bp, Artificial
  CRISPR gRNA sequence
gggccgggcctcgctgcggc

SEQ ID NO: 769418 - DNA, 20 bp, Artificial
  CRISPR gRNA sequence
gctgcggcggcgactgagcc

SEQ ID NO: 769419 - DNA, 20 bp, Artificial
  CRISPR gRNA sequence
cggcggcgactgagccaggc

SEQ ID NO: 769420 - DNA, 20 bp, Artificial
  CRISPR gRNA sequence
agccaggctgggccgcgtcc

SEQ ID NO: 769421 - DNA, 20 bp, Artificial
  CRISPR gRNA sequence
ggccgcgtccctgagtccca

SEQ ID NO: 769422 - DNA, 20 bp, Artificial
  CRISPR gRNA sequence
agtcccagagtcggcgcggc

SEQ ID NO: 769423 - DNA, 20 bp, Artificial
  CRISPR gRNA sequence
gcgtggcgcgggcggcgcgg

SEQ ID NO: 769424 - DNA, 20 bp, Artificial
  CRISPR gRNA sequence
tgtctgctgcgggccgggcc

SEQ ID NO: 769425 - DNA, 20 bp, Artificial
  CRISPR gRNA sequence
gtctgctgcgggccgggcct

SEQ ID NO: 769426 - DNA, 20 bp, Artificial
  CRISPR gRNA sequence
tctgctgcgggccgggcctg

SEQ ID NO: 769427 - DNA, 20 bp, Artificial
  CRISPR gRNA sequence
ctgcgggccgggcctggatc

SEQ ID NO: 769428 - DNA, 20 bp, Artificial
  CRISPR gRNA sequence
cgggccgggcctggatcccg

SEQ ID NO: 769429 - DNA, 20 bp, Artificial
  CRISPR gRNA sequence
gatcccgcggaggtccgcac

SEQ ID NO: 769430 - DNA, 20 bp, Artificial
  CRISPR gRNA sequence
ccgctcagggctgcaggagc

SEQ ID NO: 769431 - DNA, 20 bp, Artificial
  CRISPR gRNA sequence
agggctgcaggagctgagca

SEQ ID NO: 769432 - DNA, 20 bp, Artificial
  CRISPR gRNA sequence
caggagctgagcagggcgcc

SEQ ID NO: 769433 - DNA, 20 bp, Artificial
  CRISPR gRNA sequence
agcagggcgccttccctccg

SEQ ID NO: 769434 - DNA, 20 bp, Artificial
  CRISPR gRNA sequence
ccctccgggctcctgctccc

SEQ ID NO: 769435 - DNA, 20 bp, Artificial
  CRISPR gRNA sequence
cctccgggctcctgctcccc

SEQ ID NO: 769436 - DNA, 20 bp, Artificial
  CRISPR gRNA sequence
cgggctcctgctcccctgcc

SEQ ID NO: 769437 - DNA, 20 bp, Artificial
  CRISPR gRNA sequence
ctgctcccctgccctccccc

SEQ ID NO: 769438 - DNA, 20 bp, Artificial
  CRISPR gRNA sequence
ctcccctgccctcccccagg

SEQ ID NO: 769439 - DNA, 20 bp, Artificial
  CRISPR gRNA sequence
ccctgccctcccccaggtcc

SEQ ID NO: 769440 - DNA, 20 bp, Artificial
  CRISPR gRNA sequence
ccctcccccaggtccgggcg

SEQ ID NO: 769441 - DNA, 20 bp, Artificial
  CRISPR gRNA sequence
ccccaggtccgggcggcccc

SEQ ID NO: 769442 - DNA, 20 bp, Artificial
  CRISPR gRNA sequence
gcacaggagtcccgggaacc

SEQ ID NO: 769443 - DNA, 20 bp, Artificial
  CRISPR gRNA sequence
ctgccctgggctgtggggcc

SEQ ID NO: 769444 - DNA, 20 bp, Artificial
  CRISPR gRNA sequence
ccctgggctgtggggcccgc

SEQ ID NO: 769445 - DNA, 20 bp, Artificial
  CRISPR gRNA sequence
ggctgtggggcccgcggaga

SEQ ID NO: 769446 - DNA, 20 bp, Artificial
  CRISPR gRNA sequence
tggggcccgcggagagctgg

SEQ ID NO: 769447 - DNA, 20 bp, Artificial
  CRISPR gRNA sequence
ggggctcccggatcctaccc

SEQ ID NO: 769448 - DNA, 20 bp, Artificial
  CRISPR gRNA sequence
ccggatcctaccccgccccc

SEQ ID NO: 769449 - DNA, 20 bp, Artificial
  CRISPR gRNA sequence
ccccgcccccctttcctcgg

SEQ ID NO: 769450 - DNA, 20 bp, Artificial
  CRISPR gRNA sequence
tcctcgggttgagaggggcc

SEQ ID NO: 769451 - DNA, 20 bp, Artificial
  CRISPR gRNA sequence
cctcgggttgagaggggccc

SEQ ID NO: 769452 - DNA, 20 bp, Artificial
  CRISPR gRNA sequence
ctcgggttgagaggggcccg

SEQ ID NO: 769453 - DNA, 20 bp, Artificial
  CRISPR gRNA sequence
gggttgagaggggcccgggc

SEQ ID NO: 769454 - DNA, 20 bp, Artificial
  CRISPR gRNA sequence
agaggggcccgggcgccgtc

SEQ ID NO: 769455 - DNA, 20 bp, Artificial
  CRISPR gRNA sequence
cagaccccggaagctgcgga

SEQ ID NO: 769456 - DNA, 20 bp, Artificial
  CRISPR gRNA sequence
cggaccgggccgggtgggtg

SEQ ID NO: 769457 - DNA, 20 bp, Artificial
  CRISPR gRNA sequence
ttgcaggccccgggtctgga

SEQ ID NO: 769458 - DNA, 20 bp, Artificial
  CRISPR gRNA sequence
tgcaggccccgggtctggag

SEQ ID NO: 769459 - DNA, 20 bp, Artificial
  CRISPR gRNA sequence
gcaggccccgggtctggagc

SEQ ID NO: 769460 - DNA, 20 bp, Artificial
  CRISPR gRNA sequence
caggccccgggtctggagcg

SEQ ID NO: 769461 - DNA, 20 bp, Artificial
  CRISPR gRNA sequence
gagcgggcatgggggcagat

SEQ ID NO: 769462 - DNA, 20 bp, Artificial
  CRISPR gRNA sequence
tcccgtgttgaagcttaacg

SEQ ID NO: 769463 - DNA, 20 bp, Artificial
  CRISPR gRNA sequence
aagcttaacgaagccaccgg

SEQ ID NO: 769464 - DNA, 20 bp, Artificial
  CRISPR gRNA sequence
aacgaagccaccggccggcg

SEQ ID NO: 769465 - DNA, 20 bp, Artificial
  CRISPR gRNA sequence
acgaagccaccggccggcgc

SEQ ID NO: 769466 - DNA, 20 bp, Artificial
  CRISPR gRNA sequence
ggaggttagcggggtctcgg

SEQ ID NO: 769467 - DNA, 20 bp, Artificial
  CRISPR gRNA sequence
gcggggtctcgggtcctgca

SEQ ID NO: 769468 - DNA, 20 bp, Artificial
  CRISPR gRNA sequence
gggtcctgcagaggaaaacg

SEQ ID NO: 769469 - DNA, 20 bp, Artificial
  CRISPR gRNA sequence
cagaggaaaacgcccagctc

SEQ ID NO: 769470 - DNA, 20 bp, Artificial
  CRISPR gRNA sequence
cgggaggggagcggcgggga

SEQ ID NO: 769471 - DNA, 20 bp, Artificial
  CRISPR gRNA sequence
ggcgtgtccactctgcaggg

SEQ ID NO: 769472 - DNA, 20 bp, Artificial
  CRISPR gRNA sequence
tgcagggcccagcagggcga

SEQ ID NO: 769473 - DNA, 20 bp, Artificial
  CRISPR gRNA sequence
cagggcccagcagggcgaag

SEQ ID NO: 769474 - DNA, 20 bp, Artificial
  CRISPR gRNA sequence
gtgcacttccacaggcagcc

SEQ ID NO: 769475 - DNA, 20 bp, Artificial
  CRISPR gRNA sequence
ccacaggcagccgtgggcag

SEQ ID NO: 769476 - DNA, 20 bp, Artificial
  CRISPR gRNA sequence
cacaggcagccgtgggcagc

SEQ ID NO: 769477 - DNA, 20 bp, Artificial
  CRISPR gRNA sequence
cgggaaggacaggtagagac

SEQ ID NO: 769478 - DNA, 20 bp, Artificial
  CRISPR gRNA sequence
gcaggggccacggggtgaat

SEQ ID NO: 769479 - DNA, 20 bp, Artificial
  CRISPR gRNA sequence
ggggtggggagggaattggg

SEQ ID NO: 769480 - DNA, 20 bp, Artificial
  CRISPR gRNA sequence
ggatgggcagtttgggcttg

SEQ ID NO: 769481 - DNA, 20 bp, Artificial
  CRISPR gRNA sequence
gggcttgggaagcctcaggg

SEQ ID NO: 769482 - DNA, 20 bp, Artificial
  CRISPR gRNA sequence
ggcttgggaagcctcaggga

SEQ ID NO: 769483 - DNA, 20 bp, Artificial
  CRISPR gRNA sequence
gggaagcctcagggaggtgg

SEQ ID NO: 769484 - DNA, 20 bp, Artificial
  CRISPR gRNA sequence
ggaagcctcagggaggtggg

SEQ ID NO: 769485 - DNA, 20 bp, Artificial
  CRISPR gRNA sequence
agggaggtggggggtgaggt

SEQ ID NO: 769486 - DNA, 20 bp, Artificial
  CRISPR gRNA sequence
gaagggaggggattgaattc

SEQ ID NO: 769487 - DNA, 20 bp, Artificial
  CRISPR gRNA sequence
aattccagcgcccagggccc

SEQ ID NO: 769488 - DNA, 20 bp, Artificial
  CRISPR gRNA sequence
cagcgcccagggccctccct

SEQ ID NO: 769489 - DNA, 20 bp, Artificial
  CRISPR gRNA sequence
cctgcgaccgtttagctagc

SEQ ID NO: 769490 - DNA, 20 bp, Artificial
  CRISPR gRNA sequence
cgaccgtttagctagcgaat

SEQ ID NO: 769491 - DNA, 20 bp, Artificial
  CRISPR gRNA sequence
agctagcgaattggcaggtt

SEQ ID NO: 769492 - DNA, 20 bp, Artificial
  CRISPR gRNA sequence
gctagcgaattggcaggttt

SEQ ID NO: 769493 - DNA, 20 bp, Artificial
  CRISPR gRNA sequence
gcgaattggcaggtttggca

SEQ ID NO: 769494 - DNA, 20 bp, Artificial
  CRISPR gRNA sequence
gcaggtttggcagcctaagg

SEQ ID NO: 769495 - DNA, 20 bp, Artificial
  CRISPR gRNA sequence
ggcagcctaaggcaggggat

SEQ ID NO: 769496 - DNA, 20 bp, Artificial
  CRISPR gRNA sequence
gcagcctaaggcaggggatt

SEQ ID NO: 769497 - DNA, 20 bp, Artificial
  CRISPR gRNA sequence
aggcaggggatttatttcta

SEQ ID NO: 769498 - DNA, 20 bp, Artificial
  CRISPR gRNA sequence
atttctaagccaaacctgct

SEQ ID NO: 769499 - DNA, 20 bp, Artificial
  CRISPR gRNA sequence
tttctaagccaaacctgctc

SEQ ID NO: 769500 - DNA, 20 bp, Artificial
  CRISPR gRNA sequence
ctaagccaaacctgctctaa

SEQ ID NO: 769501 - DNA, 20 bp, Artificial
  CRISPR gRNA sequence
taagccaaacctgctctaat

SEQ ID NO: 769502 - DNA, 20 bp, Artificial
  CRISPR gRNA sequence
agccaaacctgctctaatga

SEQ ID NO: 769503 - DNA, 20 bp, Artificial
  CRISPR gRNA sequence
ctctaatgagaaaagcgtga

SEQ ID NO: 769504 - DNA, 20 bp, Artificial
  CRISPR gRNA sequence
taatgagaaaagcgtgatag

SEQ ID NO: 769505 - DNA, 20 bp, Artificial
  CRISPR gRNA sequence
atgagaaaagcgtgatagat

SEQ ID NO: 769506 - DNA, 20 bp, Artificial
  CRISPR gRNA sequence
agatatgggatctatcactg

SEQ ID NO: 769507 - DNA, 20 bp, Artificial
  CRISPR gRNA sequence
tcactgagggaaaacattaa

SEQ ID NO: 769508 - DNA, 20 bp, Artificial
  CRISPR gRNA sequence
agggaaaacattaagcaaat

SEQ ID NO: 769509 - DNA, 20 bp, Artificial
  CRISPR gRNA sequence
agcaaatagtaaagcaaaaa

SEQ ID NO: 769510 - DNA, 20 bp, Artificial
  CRISPR gRNA sequence
gtgtgtgtgtgtgtgtgtgt

SEQ ID NO: 769511 - DNA, 20 bp, Artificial
  CRISPR gRNA sequence
tgtgtgtgtgtgtgtgtgtg

SEQ ID NO: 769512 - DNA, 20 bp, Artificial
  CRISPR gRNA sequence
gttgtcttaatttagaaaaa

SEQ ID NO: 769513 - DNA, 20 bp, Artificial
  CRISPR gRNA sequence
tcttaatttagaaaaacgat

SEQ ID NO: 769514 - DNA, 20 bp, Artificial
  CRISPR gRNA sequence
aatttagaaaaacgatttac

SEQ ID NO: 769515 - DNA, 20 bp, Artificial
  CRISPR gRNA sequence
atttagaaaaacgatttacc

SEQ ID NO: 769516 - DNA, 20 bp, Artificial
  CRISPR gRNA sequence
agaaaaacgatttaccttca

SEQ ID NO: 769517 - DNA, 20 bp, Artificial
  CRISPR gRNA sequence
gaaaaacgatttaccttcaa

SEQ ID NO: 769518 - DNA, 20 bp, Artificial
  CRISPR gRNA sequence
accttcaaattggatgtgga

SEQ ID NO: 769519 - DNA, 20 bp, Artificial
  CRISPR gRNA sequence
ccttcaaattggatgtggat

SEQ ID NO: 769520 - DNA, 20 bp, Artificial
  CRISPR gRNA sequence
caaattggatgtggataatt

SEQ ID NO: 769521 - DNA, 20 bp, Artificial
  CRISPR gRNA sequence
aaattggatgtggataattg

SEQ ID NO: 769522 - DNA, 20 bp, Artificial
  CRISPR gRNA sequence
gatgtggataattgtaaatg

SEQ ID NO: 769523 - DNA, 20 bp, Artificial
  CRISPR gRNA sequence
taaatgagtctgatctcttc

SEQ ID NO: 769524 - DNA, 20 bp, Artificial
  CRISPR gRNA sequence
atctcttcattaaagcccgg

SEQ ID NO: 769525 - DNA, 20 bp, Artificial
  CRISPR gRNA sequence
ttcattaaagcccggggtcc

SEQ ID NO: 769526 - DNA, 20 bp, Artificial
  CRISPR gRNA sequence
cattaaagcccggggtcctt

SEQ ID NO: 769527 - DNA, 20 bp, Artificial
  CRISPR gRNA sequence
attaaagcccggggtccttt

SEQ ID NO: 769528 - DNA, 20 bp, Artificial
  CRISPR gRNA sequence
aagcccggggtccttttctt

SEQ ID NO: 769529 - DNA, 20 bp, Artificial
  CRISPR gRNA sequence
ttcttataagcatgtcttca

SEQ ID NO: 769530 - DNA, 20 bp, Artificial
  CRISPR gRNA sequence
tcttataagcatgtcttcag

SEQ ID NO: 769531 - DNA, 20 bp, Artificial
  CRISPR gRNA sequence
cttataagcatgtcttcagc

SEQ ID NO: 769532 - DNA, 20 bp, Artificial
  CRISPR gRNA sequence
ttataagcatgtcttcagca

SEQ ID NO: 769533 - DNA, 20 bp, Artificial
  CRISPR gRNA sequence
ataagcatgtcttcagcagt

SEQ ID NO: 769534 - DNA, 20 bp, Artificial
  CRISPR gRNA sequence
taagcatgtcttcagcagtt

SEQ ID NO: 769535 - DNA, 20 bp, Artificial
  CRISPR gRNA sequence
cagcagttagtttctatatt

SEQ ID NO: 769536 - DNA, 20 bp, Artificial
  CRISPR gRNA sequence
agcagttagtttctatatta

SEQ ID NO: 769537 - DNA, 20 bp, Artificial
  CRISPR gRNA sequence
gtttctatattagaaagtaa

SEQ ID NO: 769538 - DNA, 20 bp, Artificial
  CRISPR gRNA sequence
ctatattagaaagtaatgaa

SEQ ID NO: 769539 - DNA, 20 bp, Artificial
  CRISPR gRNA sequence
tatattagaaagtaatgaag

SEQ ID NO: 769540 - DNA, 20 bp, Artificial
  CRISPR gRNA sequence
tattagaaagtaatgaagct

SEQ ID NO: 769541 - DNA, 20 bp, Artificial
  CRISPR gRNA sequence
gaaagtaatgaagctgcttt

SEQ ID NO: 769542 - DNA, 20 bp, Artificial
  CRISPR gRNA sequence
ctttgtctttaagagagttc

SEQ ID NO: 769543 - DNA, 20 bp, Artificial
  CRISPR gRNA sequence
tgtctttaagagagttcttt

SEQ ID NO: 769544 - DNA, 20 bp, Artificial
  CRISPR gRNA sequence
gtctttaagagagttcttta

SEQ ID NO: 769545 - DNA, 20 bp, Artificial
  CRISPR gRNA sequence
tctttaagagagttctttat

SEQ ID NO: 769546 - DNA, 20 bp, Artificial
  CRISPR gRNA sequence
taagagagttctttatttag

SEQ ID NO: 769547 - DNA, 20 bp, Artificial
  CRISPR gRNA sequence
aagagagttctttatttagt

SEQ ID NO: 769548 - DNA, 20 bp, Artificial
  CRISPR gRNA sequence
agagagttctttatttagtg

SEQ ID NO: 769549 - DNA, 20 bp, Artificial
  CRISPR gRNA sequence
tttatttagtgcggcctcct

SEQ ID NO: 769550 - DNA, 20 bp, Artificial
  CRISPR gRNA sequence
tatttagtgcggcctcctct

SEQ ID NO: 769551 - DNA, 20 bp, Artificial
  CRISPR gRNA sequence
atttagtgcggcctcctcta

SEQ ID NO: 769552 - DNA, 20 bp, Artificial
  CRISPR gRNA sequence
tttagtgcggcctcctctag

SEQ ID NO: 769553 - DNA, 20 bp, Artificial
  CRISPR gRNA sequence
agtgcggcctcctctagttc

SEQ ID NO: 769554 - DNA, 20 bp, Artificial
  CRISPR gRNA sequence
gtgcggcctcctctagttcc

SEQ ID NO: 769555 - DNA, 20 bp, Artificial
  CRISPR gRNA sequence
ctctagttccctctggcctc

SEQ ID NO: 769556 - DNA, 20 bp, Artificial
  CRISPR gRNA sequence
tagttccctctggcctccca

SEQ ID NO: 769557 - DNA, 20 bp, Artificial
  CRISPR gRNA sequence
gttccctctggcctcccaga

SEQ ID NO: 769558 - DNA, 20 bp, Artificial
  CRISPR gRNA sequence
cctctggcctcccagaagtc

SEQ ID NO: 769559 - DNA, 20 bp, Artificial
  CRISPR gRNA sequence
tggcctcccagaagtcccta

SEQ ID NO: 769560 - DNA, 20 bp, Artificial
  CRISPR gRNA sequence
gcctcccagaagtccctagg

SEQ ID NO: 769561 - DNA, 20 bp, Artificial
  CRISPR gRNA sequence
ccagaagtccctaggaaatc

SEQ ID NO: 769562 - DNA, 20 bp, Artificial
  CRISPR gRNA sequence
ggaaatctgatgctgtgcag

SEQ ID NO: 769563 - DNA, 20 bp, Artificial
  CRISPR gRNA sequence
atgctgtgcagccttccttg

SEQ ID NO: 769564 - DNA, 20 bp, Artificial
  CRISPR gRNA sequence
tgcagccttccttgtagtgt

SEQ ID NO: 769565 - DNA, 20 bp, Artificial
  CRISPR gRNA sequence
ccttgtagtgtgggggactg

SEQ ID NO: 769566 - DNA, 20 bp, Artificial
  CRISPR gRNA sequence
cttgtagtgtgggggactgc

SEQ ID NO: 769567 - DNA, 20 bp, Artificial
  CRISPR gRNA sequence
gtagtgtgggggactgcaaa

SEQ ID NO: 769568 - DNA, 20 bp, Artificial
  CRISPR gRNA sequence
tagtgtgggggactgcaaat

SEQ ID NO: 769569 - DNA, 20 bp, Artificial
  CRISPR gRNA sequence
caaataggtgggacagtttg

SEQ ID NO: 769570 - DNA, 20 bp, Artificial
  CRISPR gRNA sequence
gaggctgaggggaactgaag

SEQ ID NO: 769571 - DNA, 20 bp, Artificial
  CRISPR gRNA sequence
aggctgaggggaactgaagt

SEQ ID NO: 769572 - DNA, 20 bp, Artificial
  CRISPR gRNA sequence
aggggaactgaagtctaaac

SEQ ID NO: 769573 - DNA, 20 bp, Artificial
  CRISPR gRNA sequence
aagtctaaacttgaagtcta

SEQ ID NO: 769574 - DNA, 20 bp, Artificial
  CRISPR gRNA sequence
aacttgaagtctaaacctgt

SEQ ID NO: 769575 - DNA, 20 bp, Artificial
  CRISPR gRNA sequence
gaagtctaaacctgtccgat

SEQ ID NO: 769576 - DNA, 20 bp, Artificial
  CRISPR gRNA sequence
aagtctaaacctgtccgatg

SEQ ID NO: 769577 - DNA, 20 bp, Artificial
  CRISPR gRNA sequence
aacctgtccgatgggttgag

SEQ ID NO: 769578 - DNA, 20 bp, Artificial
  CRISPR gRNA sequence
tccgatgggttgagctgatc

SEQ ID NO: 769579 - DNA, 20 bp, Artificial
  CRISPR gRNA sequence
agctgatctgagtgcagggc

SEQ ID NO: 769580 - DNA, 20 bp, Artificial
  CRISPR gRNA sequence
atctgagtgcagggcaggat

SEQ ID NO: 769581 - DNA, 20 bp, Artificial
  CRISPR gRNA sequence
agtgcagggcaggatggagg

SEQ ID NO: 769582 - DNA, 20 bp, Artificial
  CRISPR gRNA sequence
tggggctgtagggtatgaag

SEQ ID NO: 769583 - DNA, 20 bp, Artificial
  CRISPR gRNA sequence
tagggtatgaagtggctcat

SEQ ID NO: 769584 - DNA, 20 bp, Artificial
  CRISPR gRNA sequence
atttcaagggagtattttgg

SEQ ID NO: 769585 - DNA, 20 bp, Artificial
  CRISPR gRNA sequence
caagggagtattttgggtga

SEQ ID NO: 769586 - DNA, 20 bp, Artificial
  CRISPR gRNA sequence
aagggagtattttgggtgag

SEQ ID NO: 769587 - DNA, 20 bp, Artificial
  CRISPR gRNA sequence
tgggtgagtacattttcctg

SEQ ID NO: 769588 - DNA, 20 bp, Artificial
  CRISPR gRNA sequence
gggtgagtacattttcctga

SEQ ID NO: 769589 - DNA, 20 bp, Artificial
  CRISPR gRNA sequence
ggtgagtacattttcctgat

SEQ ID NO: 769590 - DNA, 20 bp, Artificial
  CRISPR gRNA sequence
tcctgatatctggagttctt

SEQ ID NO: 769591 - DNA, 20 bp, Artificial
  CRISPR gRNA sequence
cctgatatctggagttcttg

SEQ ID NO: 769592 - DNA, 20 bp, Artificial
  CRISPR gRNA sequence
ctgatatctggagttcttga

SEQ ID NO: 769593 - DNA, 20 bp, Artificial
  CRISPR gRNA sequence
atatctggagttcttgagat

SEQ ID NO: 769594 - DNA, 20 bp, Artificial
  CRISPR gRNA sequence
gagttcttgagattaagcac

SEQ ID NO: 769595 - DNA, 20 bp, Artificial
  CRISPR gRNA sequence
ttgagattaagcactaacac

SEQ ID NO: 769596 - DNA, 20 bp, Artificial
  CRISPR gRNA sequence
gagattaagcactaacactt

SEQ ID NO: 769597 - DNA, 20 bp, Artificial
  CRISPR gRNA sequence
agattaagcactaacactta

SEQ ID NO: 769598 - DNA, 20 bp, Artificial
  CRISPR gRNA sequence
agcactaacacttagggtaa

SEQ ID NO: 769599 - DNA, 20 bp, Artificial
  CRISPR gRNA sequence
acacttagggtaactgttga

SEQ ID NO: 769600 - DNA, 20 bp, Artificial
  CRISPR gRNA sequence
agggtaactgttgaccgtgg

SEQ ID NO: 769601 - DNA, 20 bp, Artificial
  CRISPR gRNA sequence
gggtaactgttgaccgtgga

SEQ ID NO: 769602 - DNA, 20 bp, Artificial
  CRISPR gRNA sequence
ttgaccgtggaaatttacat

SEQ ID NO: 769603 - DNA, 20 bp, Artificial
  CRISPR gRNA sequence
accgtggaaatttacatacg

SEQ ID NO: 769604 - DNA, 20 bp, Artificial
  CRISPR gRNA sequence
acatacgtcaccgtcagctt

SEQ ID NO: 769605 - DNA, 20 bp, Artificial
  CRISPR gRNA sequence
catacgtcaccgtcagctta

SEQ ID NO: 769606 - DNA, 20 bp, Artificial
  CRISPR gRNA sequence
actggagtatcctgatgtga

SEQ ID NO: 769607 - DNA, 20 bp, Artificial
  CRISPR gRNA sequence
ctggagtatcctgatgtgaa

SEQ ID NO: 769608 - DNA, 20 bp, Artificial
  CRISPR gRNA sequence
gagtatcctgatgtgaatga

SEQ ID NO: 769609 - DNA, 20 bp, Artificial
  CRISPR gRNA sequence
atgtgaatgaaattttcctt

SEQ ID NO: 769610 - DNA, 20 bp, Artificial
  CRISPR gRNA sequence
tccttcatgactttgggtca

SEQ ID NO: 769611 - DNA, 20 bp, Artificial
  CRISPR gRNA sequence
ccttcatgactttgggtcag

SEQ ID NO: 769612 - DNA, 20 bp, Artificial
  CRISPR gRNA sequence
cttcatgactttgggtcagc

SEQ ID NO: 769613 - DNA, 20 bp, Artificial
  CRISPR gRNA sequence
catgactttgggtcagccct

SEQ ID NO: 769614 - DNA, 20 bp, Artificial
  CRISPR gRNA sequence
atgactttgggtcagccctg

SEQ ID NO: 769615 - DNA, 20 bp, Artificial
  CRISPR gRNA sequence
tgggtcagccctgtggacct

SEQ ID NO: 769616 - DNA, 20 bp, Artificial
  CRISPR gRNA sequence
gggtcagccctgtggacctc

SEQ ID NO: 769617 - DNA, 20 bp, Artificial
  CRISPR gRNA sequence
ggtcagccctgtggacctca

SEQ ID NO: 769618 - DNA, 20 bp, Artificial
  CRISPR gRNA sequence
tggacctcagtttttgttct

SEQ ID NO: 769619 - DNA, 20 bp, Artificial
  CRISPR gRNA sequence
agtttttgttctgaggggtt

SEQ ID NO: 769620 - DNA, 20 bp, Artificial
  CRISPR gRNA sequence
ttgttctgaggggttgtatg

SEQ ID NO: 769621 - DNA, 20 bp, Artificial
  CRISPR gRNA sequence
tgttctgaggggttgtatgg

SEQ ID NO: 769622 - DNA, 20 bp, Artificial
  CRISPR gRNA sequence
gttctgaggggttgtatggc

SEQ ID NO: 769623 - DNA, 20 bp, Artificial
  CRISPR gRNA sequence
ttctgaggggttgtatggca

SEQ ID NO: 769624 - DNA, 20 bp, Artificial
  CRISPR gRNA sequence
tgaggggttgtatggcaagg

SEQ ID NO: 769625 - DNA, 20 bp, Artificial
  CRISPR gRNA sequence
aggggttgtatggcaagggg

SEQ ID NO: 769626 - DNA, 20 bp, Artificial
  CRISPR gRNA sequence
tatggcaaggggacgctggc

SEQ ID NO: 769627 - DNA, 20 bp, Artificial
  CRISPR gRNA sequence
gcgggagagagcttcgttcc

SEQ ID NO: 769628 - DNA, 20 bp, Artificial
  CRISPR gRNA sequence
cgttcctgcattaagtggcc

SEQ ID NO: 769629 - DNA, 20 bp, Artificial
  CRISPR gRNA sequence
gttcctgcattaagtggcct

SEQ ID NO: 769630 - DNA, 20 bp, Artificial
  CRISPR gRNA sequence
ctgcattaagtggcctcagt

SEQ ID NO: 769631 - DNA, 20 bp, Artificial
  CRISPR gRNA sequence
cattaagtggcctcagtgat

SEQ ID NO: 769632 - DNA, 20 bp, Artificial
  CRISPR gRNA sequence
agtggcctcagtgatgcagt

SEQ ID NO: 769633 - DNA, 20 bp, Artificial
  CRISPR gRNA sequence
agtgatgcagtcagggtccc

SEQ ID NO: 769634 - DNA, 20 bp, Artificial
  CRISPR gRNA sequence
acctttggagttcttccatg

SEQ ID NO: 769635 - DNA, 20 bp, Artificial
  CRISPR gRNA sequence
tggagttcttccatgtcctt

SEQ ID NO: 769636 - DNA, 20 bp, Artificial
  CRISPR gRNA sequence
ggagttcttccatgtcctta

SEQ ID NO: 769637 - DNA, 20 bp, Artificial
  CRISPR gRNA sequence
gagttcttccatgtccttat

SEQ ID NO: 769638 - DNA, 20 bp, Artificial
  CRISPR gRNA sequence
ttccatgtccttatggcatt

SEQ ID NO: 769639 - DNA, 20 bp, Artificial
  CRISPR gRNA sequence
ccatgtccttatggcattac

SEQ ID NO: 769640 - DNA, 20 bp, Artificial
  CRISPR gRNA sequence
catgtccttatggcattact

SEQ ID NO: 769641 - DNA, 20 bp, Artificial
  CRISPR gRNA sequence
atggcattactggtggtttc

SEQ ID NO: 769642 - DNA, 20 bp, Artificial
  CRISPR gRNA sequence
tggcattactggtggtttct

SEQ ID NO: 769643 - DNA, 20 bp, Artificial
  CRISPR gRNA sequence
ctggtggtttctcctgcctg

SEQ ID NO: 769644 - DNA, 20 bp, Artificial
  CRISPR gRNA sequence
gtggtttctcctgcctgcag

SEQ ID NO: 769645 - DNA, 20 bp, Artificial
  CRISPR gRNA sequence
ctcctgcctgcagtaagctt

SEQ ID NO: 769646 - DNA, 20 bp, Artificial
  CRISPR gRNA sequence
tcctgcctgcagtaagcttt

SEQ ID NO: 769647 - DNA, 20 bp, Artificial
  CRISPR gRNA sequence
ctgcctgcagtaagctttcc

SEQ ID NO: 769648 - DNA, 20 bp, Artificial
  CRISPR gRNA sequence
cctgcagtaagctttccagc

SEQ ID NO: 769649 - DNA, 20 bp, Artificial
  CRISPR gRNA sequence
cagtaagctttccagcttac

SEQ ID NO: 769650 - DNA, 20 bp, Artificial
  CRISPR gRNA sequence
tccagcttactctagactcc

SEQ ID NO: 769651 - DNA, 20 bp, Artificial
  CRISPR gRNA sequence
ccagcttactctagactcct

SEQ ID NO: 769652 - DNA, 20 bp, Artificial
  CRISPR gRNA sequence
cagcttactctagactcctg

SEQ ID NO: 769653 - DNA, 20 bp, Artificial
  CRISPR gRNA sequence
actctagactcctgtgctgt

SEQ ID NO: 769654 - DNA, 20 bp, Artificial
  CRISPR gRNA sequence
ctctagactcctgtgctgtg

SEQ ID NO: 769655 - DNA, 20 bp, Artificial
  CRISPR gRNA sequence
tagactcctgtgctgtgaga

SEQ ID NO: 769656 - DNA, 20 bp, Artificial
  CRISPR gRNA sequence
gactcctgtgctgtgagaca

SEQ ID NO: 769657 - DNA, 20 bp, Artificial
  CRISPR gRNA sequence
ctgtgctgtgagacatgagc

SEQ ID NO: 769658 - DNA, 20 bp, Artificial
  CRISPR gRNA sequence
tgctgtgagacatgagcttg

SEQ ID NO: 769659 - DNA, 20 bp, Artificial
  CRISPR gRNA sequence
tgagacatgagcttgtcaga

SEQ ID NO: 769660 - DNA, 20 bp, Artificial
  CRISPR gRNA sequence
gtcagaggtaaggagcctgt

SEQ ID NO: 769661 - DNA, 20 bp, Artificial
  CRISPR gRNA sequence
tcagaggtaaggagcctgtg

SEQ ID NO: 769662 - DNA, 20 bp, Artificial
  CRISPR gRNA sequence
tgttaatgcaagtctcaggt

SEQ ID NO: 769663 - DNA, 20 bp, Artificial
  CRISPR gRNA sequence
atgcaagtctcaggtgagaa

SEQ ID NO: 769664 - DNA, 20 bp, Artificial
  CRISPR gRNA sequence
aggtgagaaggggtgttgga

SEQ ID NO: 769665 - DNA, 20 bp, Artificial
  CRISPR gRNA sequence
gaatctgaggaccctgtttt

SEQ ID NO: 769666 - DNA, 20 bp, Artificial
  CRISPR gRNA sequence
aggaccctgttttccttcct

SEQ ID NO: 769667 - DNA, 20 bp, Artificial
  CRISPR gRNA sequence
ttttccttcctgtcccctct

SEQ ID NO: 769668 - DNA, 20 bp, Artificial
  CRISPR gRNA sequence
tccttcctgtcccctcttca

SEQ ID NO: 769669 - DNA, 20 bp, Artificial
  CRISPR gRNA sequence
ccttcctgtcccctcttcag

SEQ ID NO: 769670 - DNA, 20 bp, Artificial
  CRISPR gRNA sequence
cttcctgtcccctcttcagc

SEQ ID NO: 769671 - DNA, 20 bp, Artificial
  CRISPR gRNA sequence
cctgtcccctcttcagctct

SEQ ID NO: 769672 - DNA, 20 bp, Artificial
  CRISPR gRNA sequence
ctgtcccctcttcagctctg

SEQ ID NO: 769673 - DNA, 20 bp, Artificial
  CRISPR gRNA sequence
tcccctcttcagctctgtcc

SEQ ID NO: 769674 - DNA, 20 bp, Artificial
  CRISPR gRNA sequence
ttcagctctgtccaggcacc

SEQ ID NO: 769675 - DNA, 20 bp, Artificial
  CRISPR gRNA sequence
cagctctgtccaggcaccac

SEQ ID NO: 769676 - DNA, 20 bp, Artificial
  CRISPR gRNA sequence
agctctgtccaggcaccacc

SEQ ID NO: 769677 - DNA, 20 bp, Artificial
  CRISPR gRNA sequence
tgtccaggcaccacccgatg

SEQ ID NO: 769678 - DNA, 20 bp, Artificial
  CRISPR gRNA sequence
tccaggcaccacccgatgga

SEQ ID NO: 769679 - DNA, 20 bp, Artificial
  CRISPR gRNA sequence
gctgaatgtctcatgttcat

SEQ ID NO: 769680 - DNA, 20 bp, Artificial
  CRISPR gRNA sequence
aatgtctcatgttcatatac

SEQ ID NO: 769681 - DNA, 20 bp, Artificial
  CRISPR gRNA sequence
atgttcatatacctgacagc

SEQ ID NO: 769682 - DNA, 20 bp, Artificial
  CRISPR gRNA sequence
atatacctgacagctggctt

SEQ ID NO: 769683 - DNA, 20 bp, Artificial
  CRISPR gRNA sequence
acagctggcttcggtgcttt

SEQ ID NO: 769684 - DNA, 20 bp, Artificial
  CRISPR gRNA sequence
gcttcggtgctttaatattt

SEQ ID NO: 769685 - DNA, 20 bp, Artificial
  CRISPR gRNA sequence
cggtgctttaatatttatgg

SEQ ID NO: 769686 - DNA, 20 bp, Artificial
  CRISPR gRNA sequence
ggtgctttaatatttatgga

SEQ ID NO: 769687 - DNA, 20 bp, Artificial
  CRISPR gRNA sequence
taatatttatggaaaggaca

SEQ ID NO: 769688 - DNA, 20 bp, Artificial
  CRISPR gRNA sequence
aatatttatggaaaggacag

SEQ ID NO: 769689 - DNA, 20 bp, Artificial
  CRISPR gRNA sequence
atatttatggaaaggacagt

SEQ ID NO: 769690 - DNA, 20 bp, Artificial
  CRISPR gRNA sequence
atggaaaggacagttataga

SEQ ID NO: 769691 - DNA, 20 bp, Artificial
  CRISPR gRNA sequence
tggaaaggacagttatagaa

SEQ ID NO: 769692 - DNA, 20 bp, Artificial
  CRISPR gRNA sequence
tagaagtgtggtcccttcaa

SEQ ID NO: 769693 - DNA, 20 bp, Artificial
  CRISPR gRNA sequence
caaagtagtcctctggggtg

SEQ ID NO: 769694 - DNA, 20 bp, Artificial
  CRISPR gRNA sequence
aaagtagtcctctggggtgt

SEQ ID NO: 769695 - DNA, 20 bp, Artificial
  CRISPR gRNA sequence
tggggtgtctgtgtccttat

SEQ ID NO: 769696 - DNA, 20 bp, Artificial
  CRISPR gRNA sequence
gggtgtctgtgtccttatta

SEQ ID NO: 769697 - DNA, 20 bp, Artificial
  CRISPR gRNA sequence
tgtccttattaggttgactt

SEQ ID NO: 769698 - DNA, 20 bp, Artificial
  CRISPR gRNA sequence
attaggttgacttctgaaac

SEQ ID NO: 769699 - DNA, 20 bp, Artificial
  CRISPR gRNA sequence
ttaggttgacttctgaaact

SEQ ID NO: 769700 - DNA, 20 bp, Artificial
  CRISPR gRNA sequence
ggttgacttctgaaacttcc

SEQ ID NO: 769701 - DNA, 20 bp, Artificial
  CRISPR gRNA sequence
acttctgaaacttcctgtga

SEQ ID NO: 769702 - DNA, 20 bp, Artificial
  CRISPR gRNA sequence
ctgaaacttcctgtgagaat

SEQ ID NO: 769703 - DNA, 20 bp, Artificial
  CRISPR gRNA sequence
tgaaacttcctgtgagaatt

SEQ ID NO: 769704 - DNA, 20 bp, Artificial
  CRISPR gRNA sequence
aaacttcctgtgagaattcc

SEQ ID NO: 769705 - DNA, 20 bp, Artificial
  CRISPR gRNA sequence
cctgtgagaattccatcatt

SEQ ID NO: 769706 - DNA, 20 bp, Artificial
  CRISPR gRNA sequence
ctgtgagaattccatcatta

SEQ ID NO: 769707 - DNA, 20 bp, Artificial
  CRISPR gRNA sequence
tgagaattccatcattaaac

SEQ ID NO: 769708 - DNA, 20 bp, Artificial
  CRISPR gRNA sequence
catcattaaactttggcttt

SEQ ID NO: 769709 - DNA, 20 bp, Artificial
  CRISPR gRNA sequence
aactttggctttctctggag

SEQ ID NO: 769710 - DNA, 20 bp, Artificial
  CRISPR gRNA sequence
tggctttctctggaggggta

SEQ ID NO: 769711 - DNA, 20 bp, Artificial
  CRISPR gRNA sequence
ggctttctctggaggggtaa

SEQ ID NO: 769712 - DNA, 20 bp, Artificial
  CRISPR gRNA sequence
gctttctctggaggggtaaa

SEQ ID NO: 769713 - DNA, 20 bp, Artificial
  CRISPR gRNA sequence
tctctggaggggtaaatctt

SEQ ID NO: 769714 - DNA, 20 bp, Artificial
  CRISPR gRNA sequence
ctctggaggggtaaatcttt

SEQ ID NO: 769715 - DNA, 20 bp, Artificial
  CRISPR gRNA sequence
tctggaggggtaaatctttg

SEQ ID NO: 769716 - DNA, 20 bp, Artificial
  CRISPR gRNA sequence
tggaggggtaaatctttgtt

SEQ ID NO: 769717 - DNA, 20 bp, Artificial
  CRISPR gRNA sequence
gaggggtaaatctttgttct

SEQ ID NO: 769718 - DNA, 20 bp, Artificial
  CRISPR gRNA sequence
tgttctttggagtaggattt

SEQ ID NO: 769719 - DNA, 20 bp, Artificial
  CRISPR gRNA sequence
gttctttggagtaggatttg

SEQ ID NO: 769720 - DNA, 20 bp, Artificial
  CRISPR gRNA sequence
ttctttggagtaggatttga

SEQ ID NO: 769721 - DNA, 20 bp, Artificial
  CRISPR gRNA sequence
tttggagtaggatttgagtt

SEQ ID NO: 769722 - DNA, 20 bp, Artificial
  CRISPR gRNA sequence
tggagtaggatttgagtttg

SEQ ID NO: 769723 - DNA, 20 bp, Artificial
  CRISPR gRNA sequence
ggagtaggatttgagtttga

SEQ ID NO: 769724 - DNA, 20 bp, Artificial
  CRISPR gRNA sequence
gagtaggatttgagtttgac

SEQ ID NO: 769725 - DNA, 20 bp, Artificial
  CRISPR gRNA sequence
gagtttgacaaggagctgga

SEQ ID NO: 769726 - DNA, 20 bp, Artificial
  CRISPR gRNA sequence
agtttgacaaggagctggac

SEQ ID NO: 769727 - DNA, 20 bp, Artificial
  CRISPR gRNA sequence
gacaaggagctggacaatgc

SEQ ID NO: 769728 - DNA, 20 bp, Artificial
  CRISPR gRNA sequence
acaaggagctggacaatgct

SEQ ID NO: 769729 - DNA, 20 bp, Artificial
  CRISPR gRNA sequence
gacaatgctgtttggagtca

SEQ ID NO: 769730 - DNA, 20 bp, Artificial
  CRISPR gRNA sequence
tttggagtcagagatgcagt

SEQ ID NO: 769731 - DNA, 20 bp, Artificial
  CRISPR gRNA sequence
ggagtcagagatgcagtgtg

SEQ ID NO: 769732 - DNA, 20 bp, Artificial
  CRISPR gRNA sequence
gagtcagagatgcagtgtga

SEQ ID NO: 769733 - DNA, 20 bp, Artificial
  CRISPR gRNA sequence
tgagttggaattccacagca

SEQ ID NO: 769734 - DNA, 20 bp, Artificial
  CRISPR gRNA sequence
gaattccacagcacctaaag

SEQ ID NO: 769735 - DNA, 20 bp, Artificial
  CRISPR gRNA sequence
cacagcacctaaagagactc

SEQ ID NO: 769736 - DNA, 20 bp, Artificial
  CRISPR gRNA sequence
aagagactcctagaaaatgt

SEQ ID NO: 769737 - DNA, 20 bp, Artificial
  CRISPR gRNA sequence
ctagaaaatgttgtagaaca

SEQ ID NO: 769738 - DNA, 20 bp, Artificial
  CRISPR gRNA sequence
gaaaatgttgtagaacaagt

SEQ ID NO: 769739 - DNA, 20 bp, Artificial
  CRISPR gRNA sequence
tagaacaagtggctggatgg

SEQ ID NO: 769740 - DNA, 20 bp, Artificial
  CRISPR gRNA sequence
gatggtacttggttgcacat

SEQ ID NO: 769741 - DNA, 20 bp, Artificial
  CRISPR gRNA sequence
ggttgcacatacggggtttg

SEQ ID NO: 769742 - DNA, 20 bp, Artificial
  CRISPR gRNA sequence
gttgcacatacggggtttgg

SEQ ID NO: 769743 - DNA, 20 bp, Artificial
  CRISPR gRNA sequence
cacatacggggtttggggtc

SEQ ID NO: 769744 - DNA, 20 bp, Artificial
  CRISPR gRNA sequence
ggggtctgtgcagaaaaatg

SEQ ID NO: 769745 - DNA, 20 bp, Artificial
  CRISPR gRNA sequence
gggtctgtgcagaaaaatga

SEQ ID NO: 769746 - DNA, 20 bp, Artificial
  CRISPR gRNA sequence
tgcagaaaaatgaccaaatc

SEQ ID NO: 769747 - DNA, 20 bp, Artificial
  CRISPR gRNA sequence
tgagattatgaccacatggg

SEQ ID NO: 769748 - DNA, 20 bp, Artificial
  CRISPR gRNA sequence
agattatgaccacatggggg

SEQ ID NO: 769749 - DNA, 20 bp, Artificial
  CRISPR gRNA sequence
tgaccacatgggggctgtta

SEQ ID NO: 769750 - DNA, 20 bp, Artificial
  CRISPR gRNA sequence
ttaagctgtggatctgagtc

SEQ ID NO: 769751 - DNA, 20 bp, Artificial
  CRISPR gRNA sequence
agctgtggatctgagtcata

SEQ ID NO: 769752 - DNA, 20 bp, Artificial
  CRISPR gRNA sequence
tggatctgagtcatagggtc

SEQ ID NO: 769753 - DNA, 20 bp, Artificial
  CRISPR gRNA sequence
agtcatagggtcagggaaag

SEQ ID NO: 769754 - DNA, 20 bp, Artificial
  CRISPR gRNA sequence
ctgcccatgagcttatcctc

SEQ ID NO: 769755 - DNA, 20 bp, Artificial
  CRISPR gRNA sequence
cccatgagcttatcctctga

SEQ ID NO: 769756 - DNA, 20 bp, Artificial
  CRISPR gRNA sequence
atcctctgagtgggtggcga

SEQ ID NO: 769757 - DNA, 20 bp, Artificial
  CRISPR gRNA sequence
tcctctgagtgggtggcgac

SEQ ID NO: 769758 - DNA, 20 bp, Artificial
  CRISPR gRNA sequence
tgagtgggtggcgacttctc

SEQ ID NO: 769759 - DNA, 20 bp, Artificial
  CRISPR gRNA sequence
agtgggtggcgacttctcat

SEQ ID NO: 769760 - DNA, 20 bp, Artificial
  CRISPR gRNA sequence
ctcattgtccttttcccaca

SEQ ID NO: 769761 - DNA, 20 bp, Artificial
  CRISPR gRNA sequence
tcattgtccttttcccacat

SEQ ID NO: 769762 - DNA, 20 bp, Artificial
  CRISPR gRNA sequence
attgtccttttcccacatcc

SEQ ID NO: 769763 - DNA, 20 bp, Artificial
  CRISPR gRNA sequence
tccttttcccacatccccag

SEQ ID NO: 769764 - DNA, 20 bp, Artificial
  CRISPR gRNA sequence
ttcccacatccccagggcag

SEQ ID NO: 769765 - DNA, 20 bp, Artificial
  CRISPR gRNA sequence
tcccacatccccagggcagg

SEQ ID NO: 769766 - DNA, 20 bp, Artificial
  CRISPR gRNA sequence
cccacatccccagggcagga

SEQ ID NO: 769767 - DNA, 20 bp, Artificial
  CRISPR gRNA sequence
ccacatccccagggcaggag

SEQ ID NO: 769768 - DNA, 20 bp, Artificial
  CRISPR gRNA sequence
gggaagtccaccagcaaaag

SEQ ID NO: 769769 - DNA, 20 bp, Artificial
  CRISPR gRNA sequence
ggggagggggagaggggtga

SEQ ID NO: 769770 - DNA, 20 bp, Artificial
  CRISPR gRNA sequence
gtccacatgatttttgagaa

SEQ ID NO: 769771 - DNA, 20 bp, Artificial
  CRISPR gRNA sequence
ttgagaaattgcctttggtc

SEQ ID NO: 769772 - DNA, 20 bp, Artificial
  CRISPR gRNA sequence
tgagaaattgcctttggtct

SEQ ID NO: 769773 - DNA, 20 bp, Artificial
  CRISPR gRNA sequence
gagaaattgcctttggtctt

SEQ ID NO: 769774 - DNA, 20 bp, Artificial
  CRISPR gRNA sequence
agaaattgcctttggtcttg

SEQ ID NO: 769775 - DNA, 20 bp, Artificial
  CRISPR gRNA sequence
cctttggtcttgttggctca

SEQ ID NO: 769776 - DNA, 20 bp, Artificial
  CRISPR gRNA sequence
tggtcttgttggctcagaat

SEQ ID NO: 769777 - DNA, 20 bp, Artificial
  CRISPR gRNA sequence
ggtcttgttggctcagaatg

SEQ ID NO: 769778 - DNA, 20 bp, Artificial
  CRISPR gRNA sequence
gtcttgttggctcagaatgg

SEQ ID NO: 769779 - DNA, 20 bp, Artificial
  CRISPR gRNA sequence
gttggctcagaatggacccc

SEQ ID NO: 769780 - DNA, 20 bp, Artificial
  CRISPR gRNA sequence
ttggctcagaatggacccca

SEQ ID NO: 769781 - DNA, 20 bp, Artificial
  CRISPR gRNA sequence
gctcagaatggaccccacac

SEQ ID NO: 769782 - DNA, 20 bp, Artificial
  CRISPR gRNA sequence
agaatggaccccacacctgg

SEQ ID NO: 769783 - DNA, 20 bp, Artificial
  CRISPR gRNA sequence
gaagggggccacgtgtacag

SEQ ID NO: 769784 - DNA, 20 bp, Artificial
  CRISPR gRNA sequence
tgcaacccttgcctgccacc

SEQ ID NO: 769785 - DNA, 20 bp, Artificial
  CRISPR gRNA sequence
gcctgccacccccagttcta

SEQ ID NO: 769786 - DNA, 20 bp, Artificial
  CRISPR gRNA sequence
cctgccacccccagttctac

SEQ ID NO: 769787 - DNA, 20 bp, Artificial
  CRISPR gRNA sequence
ccacccccagttctaccgcc

SEQ ID NO: 769788 - DNA, 20 bp, Artificial
  CRISPR gRNA sequence
taccgcccttgcagtgtgcc

SEQ ID NO: 769789 - DNA, 20 bp, Artificial
  CRISPR gRNA sequence
ccgcccttgcagtgtgccag

SEQ ID NO: 769790 - DNA, 20 bp, Artificial
  CRISPR gRNA sequence
gcagtgtgccagataggagc

SEQ ID NO: 769791 - DNA, 20 bp, Artificial
  CRISPR gRNA sequence
cagtgtgccagataggagca

SEQ ID NO: 769792 - DNA, 20 bp, Artificial
  CRISPR gRNA sequence
ggttttcaggtttgggagtg

SEQ ID NO: 769793 - DNA, 20 bp, Artificial
  CRISPR gRNA sequence
tcaggtttgggagtgggtag

SEQ ID NO: 769794 - DNA, 20 bp, Artificial
  CRISPR gRNA sequence
caggtttgggagtgggtagg

SEQ ID NO: 769795 - DNA, 20 bp, Artificial
  CRISPR gRNA sequence
aggtttgggagtgggtaggg

SEQ ID NO: 769796 - DNA, 20 bp, Artificial
  CRISPR gRNA sequence
gggagtgggtagggttgtgc

SEQ ID NO: 769797 - DNA, 20 bp, Artificial
  CRISPR gRNA sequence
ggagtgggtagggttgtgct

SEQ ID NO: 769798 - DNA, 20 bp, Artificial
  CRISPR gRNA sequence
tgctggaggctaaatagaca

SEQ ID NO: 769799 - DNA, 20 bp, Artificial
  CRISPR gRNA sequence
gaggctaaatagacattatc

SEQ ID NO: 769800 - DNA, 20 bp, Artificial
  CRISPR gRNA sequence
aatagacattatctcatgta

SEQ ID NO: 769801 - DNA, 20 bp, Artificial
  CRISPR gRNA sequence
tctcatgtaatcctcatagt

SEQ ID NO: 769802 - DNA, 20 bp, Artificial
  CRISPR gRNA sequence
atgtaatcctcatagtaatc

SEQ ID NO: 769803 - DNA, 20 bp, Artificial
  CRISPR gRNA sequence
atagtaatcctatgaggtag

SEQ ID NO: 769804 - DNA, 20 bp, Artificial
  CRISPR gRNA sequence
tgaggtagggtatcattaac

SEQ ID NO: 769805 - DNA, 20 bp, Artificial
  CRISPR gRNA sequence
acaccattgtacagttgggg

SEQ ID NO: 769806 - DNA, 20 bp, Artificial
  CRISPR gRNA sequence
tacagttggggaaactgagg

SEQ ID NO: 769807 - DNA, 20 bp, Artificial
  CRISPR gRNA sequence
gggaaactgaggcccagaaa

SEQ ID NO: 769808 - DNA, 20 bp, Artificial
  CRISPR gRNA sequence
aggcccagaaagggtaagtc

SEQ ID NO: 769809 - DNA, 20 bp, Artificial
  CRISPR gRNA sequence
ggctgttgtctgcttccaga

SEQ ID NO: 769810 - DNA, 20 bp, Artificial
  CRISPR gRNA sequence
ttgtctgcttccagaactgg

SEQ ID NO: 769811 - DNA, 20 bp, Artificial
  CRISPR gRNA sequence
tctgcttccagaactggctt

SEQ ID NO: 769812 - DNA, 20 bp, Artificial
  CRISPR gRNA sequence
cttccagaactggctttttc

SEQ ID NO: 769813 - DNA, 20 bp, Artificial
  CRISPR gRNA sequence
ccagaactggctttttctgc

SEQ ID NO: 769814 - DNA, 20 bp, Artificial
  CRISPR gRNA sequence
cagaactggctttttctgct

SEQ ID NO: 769815 - DNA, 20 bp, Artificial
  CRISPR gRNA sequence
gctttttctgctgctctgga

SEQ ID NO: 769816 - DNA, 20 bp, Artificial
  CRISPR gRNA sequence
tttctgctgctctggaggta

SEQ ID NO: 769817 - DNA, 20 bp, Artificial
  CRISPR gRNA sequence
ttctgctgctctggaggtag

SEQ ID NO: 769818 - DNA, 20 bp, Artificial
  CRISPR gRNA sequence
tctgctgctctggaggtagg

SEQ ID NO: 769819 - DNA, 20 bp, Artificial
  CRISPR gRNA sequence
ctgctgctctggaggtaggc

SEQ ID NO: 769820 - DNA, 20 bp, Artificial
  CRISPR gRNA sequence
tgctgctctggaggtaggca

SEQ ID NO: 769821 - DNA, 20 bp, Artificial
  CRISPR gRNA sequence
ctgctctggaggtaggcaca

SEQ ID NO: 769822 - DNA, 20 bp, Artificial
  CRISPR gRNA sequence
ctctggaggtaggcacaggt

SEQ ID NO: 769823 - DNA, 20 bp, Artificial
  CRISPR gRNA sequence
tggaggtaggcacaggtttt

SEQ ID NO: 769824 - DNA, 20 bp, Artificial
  CRISPR gRNA sequence
gaggtaggcacaggttttac

SEQ ID NO: 769825 - DNA, 20 bp, Artificial
  CRISPR gRNA sequence
tacccctctttctggagccc

SEQ ID NO: 769826 - DNA, 20 bp, Artificial
  CRISPR gRNA sequence
acccctctttctggagcccg

SEQ ID NO: 769827 - DNA, 20 bp, Artificial
  CRISPR gRNA sequence
cccctctttctggagcccgg

SEQ ID NO: 769828 - DNA, 20 bp, Artificial
  CRISPR gRNA sequence
tttctggagcccggtaagat

SEQ ID NO: 769829 - DNA, 20 bp, Artificial
  CRISPR gRNA sequence
tctggagcccggtaagatgt

SEQ ID NO: 769830 - DNA, 20 bp, Artificial
  CRISPR gRNA sequence
ctggagcccggtaagatgtg

SEQ ID NO: 769831 - DNA, 20 bp, Artificial
  CRISPR gRNA sequence
tggagcccggtaagatgtgc

SEQ ID NO: 769832 - DNA, 20 bp, Artificial
  CRISPR gRNA sequence
gagcccggtaagatgtgcca

SEQ ID NO: 769833 - DNA, 20 bp, Artificial
  CRISPR gRNA sequence
cttagtaagtcagggaagac

SEQ ID NO: 769834 - DNA, 20 bp, Artificial
  CRISPR gRNA sequence
agtaagtcagggaagactca

SEQ ID NO: 769835 - DNA, 20 bp, Artificial
  CRISPR gRNA sequence
gtaagtcagggaagactcat

SEQ ID NO: 769836 - DNA, 20 bp, Artificial
  CRISPR gRNA sequence
atctggggaaccagagaagg

SEQ ID NO: 769837 - DNA, 20 bp, Artificial
  CRISPR gRNA sequence
gggaaccagagaaggggcag

SEQ ID NO: 769838 - DNA, 20 bp, Artificial
  CRISPR gRNA sequence
acctgggtgacccagtgact

SEQ ID NO: 769839 - DNA, 20 bp, Artificial
  CRISPR gRNA sequence
ggtgacccagtgactagtgg

SEQ ID NO: 769840 - DNA, 20 bp, Artificial
  CRISPR gRNA sequence
gtggccttcacagcatagtc

SEQ ID NO: 769841 - DNA, 20 bp, Artificial
  CRISPR gRNA sequence
cacagcatagtcagggcctt

SEQ ID NO: 769842 - DNA, 20 bp, Artificial
  CRISPR gRNA sequence
acagcatagtcagggccttt

SEQ ID NO: 769843 - DNA, 20 bp, Artificial
  CRISPR gRNA sequence
tgctgagagttcttctcttc

SEQ ID NO: 769844 - DNA, 20 bp, Artificial
  CRISPR gRNA sequence
gctgagagttcttctcttcc

SEQ ID NO: 769845 - DNA, 20 bp, Artificial
  CRISPR gRNA sequence
ctgagagttcttctcttcca

SEQ ID NO: 769846 - DNA, 20 bp, Artificial
  CRISPR gRNA sequence
agagttcttctcttccagag

SEQ ID NO: 769847 - DNA, 20 bp, Artificial
  CRISPR gRNA sequence
ttctcttccagagccctgga

SEQ ID NO: 769848 - DNA, 20 bp, Artificial
  CRISPR gRNA sequence
ctcttccagagccctggact

SEQ ID NO: 769849 - DNA, 20 bp, Artificial
  CRISPR gRNA sequence
tcttccagagccctggactt

SEQ ID NO: 769850 - DNA, 20 bp, Artificial
  CRISPR gRNA sequence
ttccagagccctggacttta

SEQ ID NO: 769851 - DNA, 20 bp, Artificial
  CRISPR gRNA sequence
ccagagccctggactttatc

SEQ ID NO: 769852 - DNA, 20 bp, Artificial
  CRISPR gRNA sequence
cagagccctggactttatca

SEQ ID NO: 769853 - DNA, 20 bp, Artificial
  CRISPR gRNA sequence
gactttatcatgctggggct

SEQ ID NO: 769854 - DNA, 20 bp, Artificial
  CRISPR gRNA sequence
tatcatgctggggcttccag

SEQ ID NO: 769855 - DNA, 20 bp, Artificial
  CRISPR gRNA sequence
atcatgctggggcttccagg

SEQ ID NO: 769856 - DNA, 20 bp, Artificial
  CRISPR gRNA sequence
tcatgctggggcttccagga

SEQ ID NO: 769857 - DNA, 20 bp, Artificial
  CRISPR gRNA sequence
gggcttccaggagttccccc

SEQ ID NO: 769858 - DNA, 20 bp, Artificial
  CRISPR gRNA sequence
ccaggagttccccctccacc

SEQ ID NO: 769859 - DNA, 20 bp, Artificial
  CRISPR gRNA sequence
caggagttccccctccaccc

SEQ ID NO: 769860 - DNA, 20 bp, Artificial
  CRISPR gRNA sequence
cccctccaccctccagttct

SEQ ID NO: 769861 - DNA, 20 bp, Artificial
  CRISPR gRNA sequence
caccctccagttctgaccag

SEQ ID NO: 769862 - DNA, 20 bp, Artificial
  CRISPR gRNA sequence
cagttctgaccagtgctccc

SEQ ID NO: 769863 - DNA, 20 bp, Artificial
  CRISPR gRNA sequence
tgaccagtgctcccagccag

SEQ ID NO: 769864 - DNA, 20 bp, Artificial
  CRISPR gRNA sequence
accagtgctcccagccagct

SEQ ID NO: 769865 - DNA, 20 bp, Artificial
  CRISPR gRNA sequence
ccagccagctgccccctttc

SEQ ID NO: 769866 - DNA, 20 bp, Artificial
  CRISPR gRNA sequence
ccccctttctccctttcttt

SEQ ID NO: 769867 - DNA, 20 bp, Artificial
  CRISPR gRNA sequence
tctccctttctttctctttg

SEQ ID NO: 769868 - DNA, 20 bp, Artificial
  CRISPR gRNA sequence
ctccctttctttctctttgt

SEQ ID NO: 769869 - DNA, 20 bp, Artificial
  CRISPR gRNA sequence
tccctttctttctctttgtg

SEQ ID NO: 769870 - DNA, 20 bp, Artificial
  CRISPR gRNA sequence
cctttctttctctttgtggt

SEQ ID NO: 769871 - DNA, 20 bp, Artificial
  CRISPR gRNA sequence
tctttctctttgtggtccag

SEQ ID NO: 769872 - DNA, 20 bp, Artificial
  CRISPR gRNA sequence
ctttctctttgtggtccaga

SEQ ID NO: 769873 - DNA, 20 bp, Artificial
  CRISPR gRNA sequence
tttctctttgtggtccagag

SEQ ID NO: 769874 - DNA, 20 bp, Artificial
  CRISPR gRNA sequence
tctctttgtggtccagagaa

SEQ ID NO: 769875 - DNA, 20 bp, Artificial
  CRISPR gRNA sequence
ctctttgtggtccagagaat

SEQ ID NO: 769876 - DNA, 20 bp, Artificial
  CRISPR gRNA sequence
tctttgtggtccagagaatg

SEQ ID NO: 769877 - DNA, 20 bp, Artificial
  CRISPR gRNA sequence
tttgtggtccagagaatgaa

SEQ ID NO: 769878 - DNA, 20 bp, Artificial
  CRISPR gRNA sequence
tgtggtccagagaatgaatg

SEQ ID NO: 769879 - DNA, 20 bp, Artificial
  CRISPR gRNA sequence
gtggtccagagaatgaatgc

SEQ ID NO: 769880 - DNA, 20 bp, Artificial
  CRISPR gRNA sequence
tggtccagagaatgaatgcc

SEQ ID NO: 769881 - DNA, 20 bp, Artificial
  CRISPR gRNA sequence
ctccacacaccttatgccat

SEQ ID NO: 769882 - DNA, 20 bp, Artificial
  CRISPR gRNA sequence
cacacaccttatgccattgg

SEQ ID NO: 769883 - DNA, 20 bp, Artificial
  CRISPR gRNA sequence
atgccattgggaatctgacc

SEQ ID NO: 769884 - DNA, 20 bp, Artificial
  CRISPR gRNA sequence
tgccattgggaatctgacct

SEQ ID NO: 769885 - DNA, 20 bp, Artificial
  CRISPR gRNA sequence
ggaatctgaccttctctagg

SEQ ID NO: 769886 - DNA, 20 bp, Artificial
  CRISPR gRNA sequence
accttctctaggcataggga

SEQ ID NO: 769887 - DNA, 20 bp, Artificial
  CRISPR gRNA sequence
ctctaggcatagggagctta

SEQ ID NO: 769888 - DNA, 20 bp, Artificial
  CRISPR gRNA sequence
tctaggcatagggagcttaa

SEQ ID NO: 769889 - DNA, 20 bp, Artificial
  CRISPR gRNA sequence
taggcatagggagcttaatc

SEQ ID NO: 769890 - DNA, 20 bp, Artificial
  CRISPR gRNA sequence
ggcatagggagcttaatctg

SEQ ID NO: 769891 - DNA, 20 bp, Artificial
  CRISPR gRNA sequence
aatctgcgggaagtggagtg

SEQ ID NO: 769892 - DNA, 20 bp, Artificial
  CRISPR gRNA sequence
atctgcgggaagtggagtga

SEQ ID NO: 769893 - DNA, 20 bp, Artificial
  CRISPR gRNA sequence
cgggaagtggagtgagaagc

SEQ ID NO: 769894 - DNA, 20 bp, Artificial
  CRISPR gRNA sequence
cttgctgggagccttggagc

SEQ ID NO: 769895 - DNA, 20 bp, Artificial
  CRISPR gRNA sequence
ttgctgggagccttggagca

SEQ ID NO: 769896 - DNA, 20 bp, Artificial
  CRISPR gRNA sequence
gctgggagccttggagcagg

SEQ ID NO: 769897 - DNA, 20 bp, Artificial
  CRISPR gRNA sequence
ctgggagccttggagcaggg

SEQ ID NO: 769898 - DNA, 20 bp, Artificial
  CRISPR gRNA sequence
ggagccttggagcagggaga

SEQ ID NO: 769899 - DNA, 20 bp, Artificial
  CRISPR gRNA sequence
ggagcagggagagatactgt

SEQ ID NO: 769900 - DNA, 20 bp, Artificial
  CRISPR gRNA sequence
gagcagggagagatactgtc

SEQ ID NO: 769901 - DNA, 20 bp, Artificial
  CRISPR gRNA sequence
tctctgggaggcaggggtcc

SEQ ID NO: 769902 - DNA, 20 bp, Artificial
  CRISPR gRNA sequence
tgggaggcaggggtcccaag

SEQ ID NO: 769903 - DNA, 20 bp, Artificial
  CRISPR gRNA sequence
ggaggcaggggtcccaagtt

SEQ ID NO: 769904 - DNA, 20 bp, Artificial
  CRISPR gRNA sequence
ccctagaggcaatgcaggct

SEQ ID NO: 769905 - DNA, 20 bp, Artificial
  CRISPR gRNA sequence
gaggcaatgcaggctcctag

SEQ ID NO: 769906 - DNA, 20 bp, Artificial
  CRISPR gRNA sequence
ctaggaactggggctgcctt

SEQ ID NO: 769907 - DNA, 20 bp, Artificial
  CRISPR gRNA sequence
ggaactggggctgccttgtg

SEQ ID NO: 769908 - DNA, 20 bp, Artificial
  CRISPR gRNA sequence
gggctgccttgtgggagaca

SEQ ID NO: 769909 - DNA, 20 bp, Artificial
  CRISPR gRNA sequence
ccttgtgggagacattggaa

SEQ ID NO: 769910 - DNA, 20 bp, Artificial
  CRISPR gRNA sequence
gtgggagacattggaatgtg

SEQ ID NO: 769911 - DNA, 20 bp, Artificial
  CRISPR gRNA sequence
tgggagacattggaatgtgt

SEQ ID NO: 769912 - DNA, 20 bp, Artificial
  CRISPR gRNA sequence
gaatgtgtccctgtgggaat

SEQ ID NO: 769913 - DNA, 20 bp, Artificial
  CRISPR gRNA sequence
tgggaatgctctgtgctagg

SEQ ID NO: 769914 - DNA, 20 bp, Artificial
  CRISPR gRNA sequence
tgtgctaggggctatggcag

SEQ ID NO: 769915 - DNA, 20 bp, Artificial
  CRISPR gRNA sequence
tgctaggggctatggcagca

SEQ ID NO: 769916 - DNA, 20 bp, Artificial
  CRISPR gRNA sequence
ggggctatggcagcaggacg

SEQ ID NO: 769917 - DNA, 20 bp, Artificial
  CRISPR gRNA sequence
tggcagcaggacggtaggag

SEQ ID NO: 769918 - DNA, 20 bp, Artificial
  CRISPR gRNA sequence
atggtacttggaactgtgac

SEQ ID NO: 769919 - DNA, 20 bp, Artificial
  CRISPR gRNA sequence
ggaactgtgaccaagcatct

SEQ ID NO: 769920 - DNA, 20 bp, Artificial
  CRISPR gRNA sequence
gaactgtgaccaagcatctg

SEQ ID NO: 769921 - DNA, 20 bp, Artificial
  CRISPR gRNA sequence
tgaccaagcatctgcgaaga

SEQ ID NO: 769922 - DNA, 20 bp, Artificial
  CRISPR gRNA sequence
cgaagaggaaggggcccagg

SEQ ID NO: 769923 - DNA, 20 bp, Artificial
  CRISPR gRNA sequence
gaatgagtcagagccagaga

SEQ ID NO: 769924 - DNA, 20 bp, Artificial
  CRISPR gRNA sequence
tgcatttgctactttggagc

SEQ ID NO: 769925 - DNA, 20 bp, Artificial
  CRISPR gRNA sequence
gctactttggagctggggca

SEQ ID NO: 769926 - DNA, 20 bp, Artificial
  CRISPR gRNA sequence
ctactttggagctggggcac

SEQ ID NO: 769927 - DNA, 20 bp, Artificial
  CRISPR gRNA sequence
ctttggagctggggcactga

SEQ ID NO: 769928 - DNA, 20 bp, Artificial
  CRISPR gRNA sequence
tggagctggggcactgatag

SEQ ID NO: 769929 - DNA, 20 bp, Artificial
  CRISPR gRNA sequence
ggagctggggcactgatagg

SEQ ID NO: 769930 - DNA, 20 bp, Artificial
  CRISPR gRNA sequence
gagctggggcactgataggg

SEQ ID NO: 769931 - DNA, 20 bp, Artificial
  CRISPR gRNA sequence
gggcactgatagggctctag

SEQ ID NO: 769932 - DNA, 20 bp, Artificial
  CRISPR gRNA sequence
atagggctctaggtgaaaag

SEQ ID NO: 769933 - DNA, 20 bp, Artificial
  CRISPR gRNA sequence
taggtgaaaagtagggatac

SEQ ID NO: 769934 - DNA, 20 bp, Artificial
  CRISPR gRNA sequence
ggtgaaaagtagggatacag

SEQ ID NO: 769935 - DNA, 20 bp, Artificial
  CRISPR gRNA sequence
acagaggaggtcttggccag

SEQ ID NO: 769936 - DNA, 20 bp, Artificial
  CRISPR gRNA sequence
ggccagggagagtggggtag

SEQ ID NO: 769937 - DNA, 20 bp, Artificial
  CRISPR gRNA sequence
gccagggagagtggggtagg

SEQ ID NO: 769938 - DNA, 20 bp, Artificial
  CRISPR gRNA sequence
gctcagtgcagaggccccat

SEQ ID NO: 769939 - DNA, 20 bp, Artificial
  CRISPR gRNA sequence
agtgcagaggccccatctag

SEQ ID NO: 769940 - DNA, 20 bp, Artificial
  CRISPR gRNA sequence
ggaggccttgtccccatgct

SEQ ID NO: 769941 - DNA, 20 bp, Artificial
  CRISPR gRNA sequence
gtccccatgcttgcggcaat

SEQ ID NO: 769942 - DNA, 20 bp, Artificial
  CRISPR gRNA sequence
tccccatgcttgcggcaata

SEQ ID NO: 769943 - DNA, 20 bp, Artificial
  CRISPR gRNA sequence
gcggcaataataacagcaat

SEQ ID NO: 769944 - DNA, 20 bp, Artificial
  CRISPR gRNA sequence
cggcaataataacagcaata

SEQ ID NO: 769945 - DNA, 20 bp, Artificial
  CRISPR gRNA sequence
ttactgcagttttggtactg

SEQ ID NO: 769946 - DNA, 20 bp, Artificial
  CRISPR gRNA sequence
ctgcagttttggtactgggc

SEQ ID NO: 769947 - DNA, 20 bp, Artificial
  CRISPR gRNA sequence
cagttttggtactgggcact

SEQ ID NO: 769948 - DNA, 20 bp, Artificial
  CRISPR gRNA sequence
tggtactgggcactttccta

SEQ ID NO: 769949 - DNA, 20 bp, Artificial
  CRISPR gRNA sequence
ggtactgggcactttcctaa

SEQ ID NO: 769950 - DNA, 20 bp, Artificial
  CRISPR gRNA sequence
gtactgggcactttcctaag

SEQ ID NO: 769951 - DNA, 20 bp, Artificial
  CRISPR gRNA sequence
ggcactttcctaagtcctct

SEQ ID NO: 769952 - DNA, 20 bp, Artificial
  CRISPR gRNA sequence
tcctaagtcctctctctcta

SEQ ID NO: 769953 - DNA, 20 bp, Artificial
  CRISPR gRNA sequence
cctaagtcctctctctctat

SEQ ID NO: 769954 - DNA, 20 bp, Artificial
  CRISPR gRNA sequence
ctaagtcctctctctctatt

SEQ ID NO: 769955 - DNA, 20 bp, Artificial
  CRISPR gRNA sequence
agtcctctctctctattgtc

SEQ ID NO: 769956 - DNA, 20 bp, Artificial
  CRISPR gRNA sequence
tctctctattgtcttatttt

SEQ ID NO: 769957 - DNA, 20 bp, Artificial
  CRISPR gRNA sequence
tctctattgtcttattttat

SEQ ID NO: 769958 - DNA, 20 bp, Artificial
  CRISPR gRNA sequence
tctattgtcttattttattc

SEQ ID NO: 769959 - DNA, 20 bp, Artificial
  CRISPR gRNA sequence
tattgtcttattttattctc

SEQ ID NO: 769960 - DNA, 20 bp, Artificial
  CRISPR gRNA sequence
ttgtcttattttattctcac

SEQ ID NO: 769961 - DNA, 20 bp, Artificial
  CRISPR gRNA sequence
tcttattttattctcacagc

SEQ ID NO: 769962 - DNA, 20 bp, Artificial
  CRISPR gRNA sequence
attttattctcacagcagcc

SEQ ID NO: 769963 - DNA, 20 bp, Artificial
  CRISPR gRNA sequence
ttttattctcacagcagccc

SEQ ID NO: 769964 - DNA, 20 bp, Artificial
  CRISPR gRNA sequence
tattctcacagcagccctgt

SEQ ID NO: 769965 - DNA, 20 bp, Artificial
  CRISPR gRNA sequence
attctcacagcagccctgtg

SEQ ID NO: 769966 - DNA, 20 bp, Artificial
  CRISPR gRNA sequence
ttctcacagcagccctgtgg

SEQ ID NO: 769967 - DNA, 20 bp, Artificial
  CRISPR gRNA sequence
tcacagcagccctgtggggt

SEQ ID NO: 769968 - DNA, 20 bp, Artificial
  CRISPR gRNA sequence
acagcagccctgtggggtag

SEQ ID NO: 769969 - DNA, 20 bp, Artificial
  CRISPR gRNA sequence
tggggtagggattgttaccc

SEQ ID NO: 769970 - DNA, 20 bp, Artificial
  CRISPR gRNA sequence
ttacccccattttagagatt

SEQ ID NO: 769971 - DNA, 20 bp, Artificial
  CRISPR gRNA sequence
cccccattttagagatttgg

SEQ ID NO: 769972 - DNA, 20 bp, Artificial
  CRISPR gRNA sequence
tagagatttggaattgggtc

SEQ ID NO: 769973 - DNA, 20 bp, Artificial
  CRISPR gRNA sequence
agagatttggaattgggtct

SEQ ID NO: 769974 - DNA, 20 bp, Artificial
  CRISPR gRNA sequence
gagatttggaattgggtctc

SEQ ID NO: 769975 - DNA, 20 bp, Artificial
  CRISPR gRNA sequence
ggaattgggtctcaaatagg

SEQ ID NO: 769976 - DNA, 20 bp, Artificial
  CRISPR gRNA sequence
gaattgggtctcaaataggt

SEQ ID NO: 769977 - DNA, 20 bp, Artificial
  CRISPR gRNA sequence
ggtctcaaataggttaagtc

SEQ ID NO: 769978 - DNA, 20 bp, Artificial
  CRISPR gRNA sequence
aaataggttaagtcatttaa

SEQ ID NO: 769979 - DNA, 20 bp, Artificial
  CRISPR gRNA sequence
agtcatttaaacttggtcat

SEQ ID NO: 769980 - DNA, 20 bp, Artificial
  CRISPR gRNA sequence
aaacttggtcatgtgttcag

SEQ ID NO: 769981 - DNA, 20 bp, Artificial
  CRISPR gRNA sequence
aacttggtcatgtgttcagc

SEQ ID NO: 769982 - DNA, 20 bp, Artificial
  CRISPR gRNA sequence
ggtcatgtgttcagcaaggc

SEQ ID NO: 769983 - DNA, 20 bp, Artificial
  CRISPR gRNA sequence
gtcatgtgttcagcaaggca

SEQ ID NO: 769984 - DNA, 20 bp, Artificial
  CRISPR gRNA sequence
agcaaggcatcggtgtcagg

SEQ ID NO: 769985 - DNA, 20 bp, Artificial
  CRISPR gRNA sequence
aaacccaaggctgctggctt

SEQ ID NO: 769986 - DNA, 20 bp, Artificial
  CRISPR gRNA sequence
ctggcttctgagctcatgct

SEQ ID NO: 769987 - DNA, 20 bp, Artificial
  CRISPR gRNA sequence
gcttctgagctcatgctgta

SEQ ID NO: 769988 - DNA, 20 bp, Artificial
  CRISPR gRNA sequence
ctgagctcatgctgtaccct

SEQ ID NO: 769989 - DNA, 20 bp, Artificial
  CRISPR gRNA sequence
tgagctcatgctgtaccctg

SEQ ID NO: 769990 - DNA, 20 bp, Artificial
  CRISPR gRNA sequence
agctcatgctgtaccctggg

SEQ ID NO: 769991 - DNA, 20 bp, Artificial
  CRISPR gRNA sequence
atgctgtaccctgggcaggc

SEQ ID NO: 769992 - DNA, 20 bp, Artificial
  CRISPR gRNA sequence
taccctgggcaggcaaggca

SEQ ID NO: 769993 - DNA, 20 bp, Artificial
  CRISPR gRNA sequence
ggcaggcaaggcagcctggt

SEQ ID NO: 769994 - DNA, 20 bp, Artificial
  CRISPR gRNA sequence
gtgattccattcaataagtg

SEQ ID NO: 769995 - DNA, 20 bp, Artificial
  CRISPR gRNA sequence
cattcaataagtgaggaaga

SEQ ID NO: 769996 - DNA, 20 bp, Artificial
  CRISPR gRNA sequence
aataagtgaggaagagagat

SEQ ID NO: 769997 - DNA, 20 bp, Artificial
  CRISPR gRNA sequence
gctcttagtcacttctgctg

SEQ ID NO: 769998 - DNA, 20 bp, Artificial
  CRISPR gRNA sequence
ttagtcacttctgctggtgg

SEQ ID NO: 769999 - DNA, 20 bp, Artificial
  CRISPR gRNA sequence
agtcacttctgctggtggct

SEQ ID NO: 770000 - DNA, 20 bp, Artificial
  CRISPR gRNA sequence
gtcacttctgctggtggctg

SEQ ID NO: 770001 - DNA, 20 bp, Artificial
  CRISPR gRNA sequence
ctgctggtggctgataattg

SEQ ID NO: 770002 - DNA, 20 bp, Artificial
  CRISPR gRNA sequence
tgctggtggctgataattga

SEQ ID NO: 770003 - DNA, 20 bp, Artificial
  CRISPR gRNA sequence
ctggtggctgataattgagt

SEQ ID NO: 770004 - DNA, 20 bp, Artificial
  CRISPR gRNA sequence
gtggctgataattgagtgtg

SEQ ID NO: 770005 - DNA, 20 bp, Artificial
  CRISPR gRNA sequence
ataattgagtgtgggccctt

SEQ ID NO: 770006 - DNA, 20 bp, Artificial
  CRISPR gRNA sequence
agtgtgggcccttggccagc

SEQ ID NO: 770007 - DNA, 20 bp, Artificial
  CRISPR gRNA sequence
ggccagccggccaccactct

SEQ ID NO: 770008 - DNA, 20 bp, Artificial
  CRISPR gRNA sequence
gccagccggccaccactctg

SEQ ID NO: 770009 - DNA, 20 bp, Artificial
  CRISPR gRNA sequence
tgggtccagatttccatctg

SEQ ID NO: 770010 - DNA, 20 bp, Artificial
  CRISPR gRNA sequence
ggtccagatttccatctgta

SEQ ID NO: 770011 - DNA, 20 bp, Artificial
  CRISPR gRNA sequence
ccatctgtacaatgggcctg

SEQ ID NO: 770012 - DNA, 20 bp, Artificial
  CRISPR gRNA sequence
catctgtacaatgggcctgg

SEQ ID NO: 770013 - DNA, 20 bp, Artificial
  CRISPR gRNA sequence
tacaatgggcctggagctag

SEQ ID NO: 770014 - DNA, 20 bp, Artificial
  CRISPR gRNA sequence
gagctaggcgctggaccagg

SEQ ID NO: 770015 - DNA, 20 bp, Artificial
  CRISPR gRNA sequence
ggcgctggaccaggtgtacc

SEQ ID NO: 770016 - DNA, 20 bp, Artificial
  CRISPR gRNA sequence
gaccaggtgtaccgtaagag

SEQ ID NO: 770017 - DNA, 20 bp, Artificial
  CRISPR gRNA sequence
ctagctctgaggactggtgg

SEQ ID NO: 770018 - DNA, 20 bp, Artificial
  CRISPR gRNA sequence
tagctctgaggactggtgga

SEQ ID NO: 770019 - DNA, 20 bp, Artificial
  CRISPR gRNA sequence
gctctgaggactggtggaga

SEQ ID NO: 770020 - DNA, 20 bp, Artificial
  CRISPR gRNA sequence
tgaggactggtggagattgc

SEQ ID NO: 770021 - DNA, 20 bp, Artificial
  CRISPR gRNA sequence
aggactggtggagattgcta

SEQ ID NO: 770022 - DNA, 20 bp, Artificial
  CRISPR gRNA sequence
gtggagattgctacactccg

SEQ ID NO: 770023 - DNA, 20 bp, Artificial
  CRISPR gRNA sequence
ctacactccgagaggggtct

SEQ ID NO: 770024 - DNA, 20 bp, Artificial
  CRISPR gRNA sequence
cactccgagaggggtctggt

SEQ ID NO: 770025 - DNA, 20 bp, Artificial
  CRISPR gRNA sequence
cgagaggggtctggtgctta

SEQ ID NO: 770026 - DNA, 20 bp, Artificial
  CRISPR gRNA sequence
gtgcttagatggagaggggt

SEQ ID NO: 770027 - DNA, 20 bp, Artificial
  CRISPR gRNA sequence
agatggagaggggtcggcag

SEQ ID NO: 770028 - DNA, 20 bp, Artificial
  CRISPR gRNA sequence
gatggagaggggtcggcaga

SEQ ID NO: 770029 - DNA, 20 bp, Artificial
  CRISPR gRNA sequence
ttctgctaagctgagcctct

SEQ ID NO: 770030 - DNA, 20 bp, Artificial
  CRISPR gRNA sequence
tgctaagctgagcctctttc

SEQ ID NO: 770031 - DNA, 20 bp, Artificial
  CRISPR gRNA sequence
ctaagctgagcctctttcag

SEQ ID NO: 770032 - DNA, 20 bp, Artificial
  CRISPR gRNA sequence
agctgagcctctttcagggt

SEQ ID NO: 770033 - DNA, 20 bp, Artificial
  CRISPR gRNA sequence
agcctctttcagggtagaaa

SEQ ID NO: 770034 - DNA, 20 bp, Artificial
  CRISPR gRNA sequence
tttcagggtagaaaccaaag

SEQ ID NO: 770035 - DNA, 20 bp, Artificial
  CRISPR gRNA sequence
tcagggtagaaaccaaagga

SEQ ID NO: 770036 - DNA, 20 bp, Artificial
  CRISPR gRNA sequence
cagggtagaaaccaaaggaa

SEQ ID NO: 770037 - DNA, 20 bp, Artificial
  CRISPR gRNA sequence
agggtagaaaccaaaggaat

SEQ ID NO: 770038 - DNA, 20 bp, Artificial
  CRISPR gRNA sequence
ggaggcaaggaggcatttag

SEQ ID NO: 770039 - DNA, 20 bp, Artificial
  CRISPR gRNA sequence
gaggcaaggaggcatttagg

SEQ ID NO: 770040 - DNA, 20 bp, Artificial
  CRISPR gRNA sequence
aggcagatcacatctggaga

SEQ ID NO: 770041 - DNA, 20 bp, Artificial
  CRISPR gRNA sequence
ggcagatcacatctggagaa

SEQ ID NO: 770042 - DNA, 20 bp, Artificial
  CRISPR gRNA sequence
gagaaaatgcacccttcctt

SEQ ID NO: 770043 - DNA, 20 bp, Artificial
  CRISPR gRNA sequence
ccttgagtgcagtctggaaa

SEQ ID NO: 770044 - DNA, 20 bp, Artificial
  CRISPR gRNA sequence
cttgagtgcagtctggaaag

SEQ ID NO: 770045 - DNA, 20 bp, Artificial
  CRISPR gRNA sequence
gagtgcagtctggaaaggct

SEQ ID NO: 770046 - DNA, 20 bp, Artificial
  CRISPR gRNA sequence
agtgcagtctggaaaggctt

SEQ ID NO: 770047 - DNA, 20 bp, Artificial
  CRISPR gRNA sequence
gaaaggcttctggaaaggat

SEQ ID NO: 770048 - DNA, 20 bp, Artificial
  CRISPR gRNA sequence
ctggaaaggataggatttcc

SEQ ID NO: 770049 - DNA, 20 bp, Artificial
  CRISPR gRNA sequence
tggaaaggataggatttcca

SEQ ID NO: 770050 - DNA, 20 bp, Artificial
  CRISPR gRNA sequence
gaaaggataggatttccaga

SEQ ID NO: 770051 - DNA, 20 bp, Artificial
  CRISPR gRNA sequence
ccagatatgtttaggtgggc

SEQ ID NO: 770052 - DNA, 20 bp, Artificial
  CRISPR gRNA sequence
cagatatgtttaggtgggca

SEQ ID NO: 770053 - DNA, 20 bp, Artificial
  CRISPR gRNA sequence
aggtgggcacctagcaggac

SEQ ID NO: 770054 - DNA, 20 bp, Artificial
  CRISPR gRNA sequence
ggtgggcacctagcaggact

SEQ ID NO: 770055 - DNA, 20 bp, Artificial
  CRISPR gRNA sequence
gcaggactcagcagatattg

SEQ ID NO: 770056 - DNA, 20 bp, Artificial
  CRISPR gRNA sequence
agcagatattgagtgaatgc

SEQ ID NO: 770057 - DNA, 20 bp, Artificial
  CRISPR gRNA sequence
agtgaatgcagatgtgtgtg

SEQ ID NO: 770058 - DNA, 20 bp, Artificial
  CRISPR gRNA sequence
ggcctgccagtgtctgaccc

SEQ ID NO: 770059 - DNA, 20 bp, Artificial
  CRISPR gRNA sequence
ccagtgtctgacccgaaatc

SEQ ID NO: 770060 - DNA, 20 bp, Artificial
  CRISPR gRNA sequence
acccgaaatctgcgctctga

SEQ ID NO: 770061 - DNA, 20 bp, Artificial
  CRISPR gRNA sequence
cgctctgatgtggtctcatg

SEQ ID NO: 770062 - DNA, 20 bp, Artificial
  CRISPR gRNA sequence
tgatgtggtctcatgtgctc

SEQ ID NO: 770063 - DNA, 20 bp, Artificial
  CRISPR gRNA sequence
atgtggtctcatgtgctctc

SEQ ID NO: 770064 - DNA, 20 bp, Artificial
  CRISPR gRNA sequence
atgtgctctcatccctttcc

SEQ ID NO: 770065 - DNA, 20 bp, Artificial
  CRISPR gRNA sequence
tcatccctttccttcctctc

SEQ ID NO: 770066 - DNA, 20 bp, Artificial
  CRISPR gRNA sequence
atccctttccttcctctccc

SEQ ID NO: 770067 - DNA, 20 bp, Artificial
  CRISPR gRNA sequence
tccttcctctccctattctc

SEQ ID NO: 770068 - DNA, 20 bp, Artificial
  CRISPR gRNA sequence
ccttcctctccctattctcc

SEQ ID NO: 770069 - DNA, 20 bp, Artificial
  CRISPR gRNA sequence
cttcctctccctattctcct

SEQ ID NO: 770070 - DNA, 20 bp, Artificial
  CRISPR gRNA sequence
cctctccctattctccttgt

SEQ ID NO: 770071 - DNA, 20 bp, Artificial
  CRISPR gRNA sequence
ctctccctattctccttgtt

SEQ ID NO: 770072 - DNA, 20 bp, Artificial
  CRISPR gRNA sequence
tccctattctccttgttgcc

SEQ ID NO: 770073 - DNA, 20 bp, Artificial
  CRISPR gRNA sequence
cctattctccttgttgccat

SEQ ID NO: 770074 - DNA, 20 bp, Artificial
  CRISPR gRNA sequence
ttctccttgttgccatccct

SEQ ID NO: 770075 - DNA, 20 bp, Artificial
  CRISPR gRNA sequence
tccttgttgccatcccttct

SEQ ID NO: 770076 - DNA, 20 bp, Artificial
  CRISPR gRNA sequence
cttgttgccatcccttcttt

SEQ ID NO: 770077 - DNA, 20 bp, Artificial
  CRISPR gRNA sequence
gttgccatcccttcttttgg

SEQ ID NO: 770078 - DNA, 20 bp, Artificial
  CRISPR gRNA sequence
ttgccatcccttcttttggc

SEQ ID NO: 770079 - DNA, 20 bp, Artificial
  CRISPR gRNA sequence
ccatcccttcttttggctgg

SEQ ID NO: 770080 - DNA, 20 bp, Artificial
  CRISPR gRNA sequence
cttttggctggacctcctct

SEQ ID NO: 770081 - DNA, 20 bp, Artificial
  CRISPR gRNA sequence
ttttggctggacctcctctg

SEQ ID NO: 770082 - DNA, 20 bp, Artificial
  CRISPR gRNA sequence
ttggctggacctcctctggg

SEQ ID NO: 770083 - DNA, 20 bp, Artificial
  CRISPR gRNA sequence
tggctggacctcctctgggc

SEQ ID NO: 770084 - DNA, 20 bp, Artificial
  CRISPR gRNA sequence
ggctggacctcctctgggcc

SEQ ID NO: 770085 - DNA, 20 bp, Artificial
  CRISPR gRNA sequence
gctggacctcctctgggccc

SEQ ID NO: 770086 - DNA, 20 bp, Artificial
  CRISPR gRNA sequence
gacctcctctgggcccaatg

SEQ ID NO: 770087 - DNA, 20 bp, Artificial
  CRISPR gRNA sequence
ctctgggcccaatgtagctt

SEQ ID NO: 770088 - DNA, 20 bp, Artificial
  CRISPR gRNA sequence
tgggcccaatgtagctttca

SEQ ID NO: 770089 - DNA, 20 bp, Artificial
  CRISPR gRNA sequence
ggcccaatgtagctttcact

SEQ ID NO: 770090 - DNA, 20 bp, Artificial
  CRISPR gRNA sequence
tcacttttttcagggctctg

SEQ ID NO: 770091 - DNA, 20 bp, Artificial
  CRISPR gRNA sequence
cacttttttcagggctctgt

SEQ ID NO: 770092 - DNA, 20 bp, Artificial
  CRISPR gRNA sequence
acttttttcagggctctgtg

SEQ ID NO: 770093 - DNA, 20 bp, Artificial
  CRISPR gRNA sequence
ttttcagggctctgtgcctc

SEQ ID NO: 770094 - DNA, 20 bp, Artificial
  CRISPR gRNA sequence
tttcagggctctgtgcctcc

SEQ ID NO: 770095 - DNA, 20 bp, Artificial
  CRISPR gRNA sequence
ttcagggctctgtgcctcct

SEQ ID NO: 770096 - DNA, 20 bp, Artificial
  CRISPR gRNA sequence
tcagggctctgtgcctcctg

SEQ ID NO: 770097 - DNA, 20 bp, Artificial
  CRISPR gRNA sequence
cagggctctgtgcctcctgt

SEQ ID NO: 770098 - DNA, 20 bp, Artificial
  CRISPR gRNA sequence
agggctctgtgcctcctgtg

SEQ ID NO: 770099 - DNA, 20 bp, Artificial
  CRISPR gRNA sequence
tgtgcctcctgtgtgtgtgt

SEQ ID NO: 770100 - DNA, 20 bp, Artificial
  CRISPR gRNA sequence
tgcctcctgtgtgtgtgtgt

SEQ ID NO: 770101 - DNA, 20 bp, Artificial
  CRISPR gRNA sequence
ctgtgtgtgtgtgtgtgtgt

SEQ ID NO: 770102 - DNA, 20 bp, Artificial
  CRISPR gRNA sequence
tgtgtgtgtgtgtgtgtgtg

SEQ ID NO: 770103 - DNA, 20 bp, Artificial
  CRISPR gRNA sequence
ccacatgcatgtataggtca

SEQ ID NO: 770104 - DNA, 20 bp, Artificial
  CRISPR gRNA sequence
cacatgcatgtataggtcag

SEQ ID NO: 770105 - DNA, 20 bp, Artificial
  CRISPR gRNA sequence
tgcagcccctgcacatgcct

SEQ ID NO: 770106 - DNA, 20 bp, Artificial
  CRISPR gRNA sequence
gcagcccctgcacatgcctc

SEQ ID NO: 770107 - DNA, 20 bp, Artificial
  CRISPR gRNA sequence
cagcccctgcacatgcctct

SEQ ID NO: 770108 - DNA, 20 bp, Artificial
  CRISPR gRNA sequence
cacatgcctctagttccagg

SEQ ID NO: 770109 - DNA, 20 bp, Artificial
  CRISPR gRNA sequence
tagttccagggagaccttag

SEQ ID NO: 770110 - DNA, 20 bp, Artificial
  CRISPR gRNA sequence
gttccagggagaccttagcc

SEQ ID NO: 770111 - DNA, 20 bp, Artificial
  CRISPR gRNA sequence
cagggagaccttagccctgc

SEQ ID NO: 770112 - DNA, 20 bp, Artificial
  CRISPR gRNA sequence
agccctgctttgctggccag

SEQ ID NO: 770113 - DNA, 20 bp, Artificial
  CRISPR gRNA sequence
gccctgctttgctggccagc

SEQ ID NO: 770114 - DNA, 20 bp, Artificial
  CRISPR gRNA sequence
ctttgctggccagccctgat

SEQ ID NO: 770115 - DNA, 20 bp, Artificial
  CRISPR gRNA sequence
tgctggccagccctgatgac

SEQ ID NO: 770116 - DNA, 20 bp, Artificial
  CRISPR gRNA sequence
gctggccagccctgatgaca

SEQ ID NO: 770117 - DNA, 20 bp, Artificial
  CRISPR gRNA sequence
ctggccagccctgatgacat

SEQ ID NO: 770118 - DNA, 20 bp, Artificial
  CRISPR gRNA sequence
gccagccctgatgacatact

SEQ ID NO: 770119 - DNA, 20 bp, Artificial
  CRISPR gRNA sequence
atgacatactactgtcctga

SEQ ID NO: 770120 - DNA, 20 bp, Artificial
  CRISPR gRNA sequence
ctgtcctgactcacacagaa

SEQ ID NO: 770121 - DNA, 20 bp, Artificial
  CRISPR gRNA sequence
tcctgactcacacagaaatc

SEQ ID NO: 770122 - DNA, 20 bp, Artificial
  CRISPR gRNA sequence
actcacacagaaatcgcttg

SEQ ID NO: 770123 - DNA, 20 bp, Artificial
  CRISPR gRNA sequence
acacagaaatcgcttggaga

SEQ ID NO: 770124 - DNA, 20 bp, Artificial
  CRISPR gRNA sequence
ggagaggaagaactgattcc

SEQ ID NO: 770125 - DNA, 20 bp, Artificial
  CRISPR gRNA sequence
gagaggaagaactgattcct

SEQ ID NO: 770126 - DNA, 20 bp, Artificial
  CRISPR gRNA sequence
attcctgctcttgggtggga

SEQ ID NO: 770127 - DNA, 20 bp, Artificial
  CRISPR gRNA sequence
ctgctcttgggtgggatcac

SEQ ID NO: 770128 - DNA, 20 bp, Artificial
  CRISPR gRNA sequence
ctcttgggtgggatcacggg

SEQ ID NO: 770129 - DNA, 20 bp, Artificial
  CRISPR gRNA sequence
ttgggtgggatcacgggact

SEQ ID NO: 770130 - DNA, 20 bp, Artificial
  CRISPR gRNA sequence
gggtgggatcacgggactgg

SEQ ID NO: 770131 - DNA, 20 bp, Artificial
  CRISPR gRNA sequence
ggtgggatcacgggactggg

SEQ ID NO: 770132 - DNA, 20 bp, Artificial
  CRISPR gRNA sequence
gggagtggtgcccagtggac

SEQ ID NO: 770133 - DNA, 20 bp, Artificial
  CRISPR gRNA sequence
gaacataaaaggcccaaact

SEQ ID NO: 770134 - DNA, 20 bp, Artificial
  CRISPR gRNA sequence
aacataaaaggcccaaactg

SEQ ID NO: 770135 - DNA, 20 bp, Artificial
  CRISPR gRNA sequence
actcagattatcaggaaaaa

SEQ ID NO: 770136 - DNA, 20 bp, Artificial
  CRISPR gRNA sequence
agattatcaggaaaaaggaa

SEQ ID NO: 770137 - DNA, 20 bp, Artificial
  CRISPR gRNA sequence
tcaggaaaaaggaaggcaaa

SEQ ID NO: 770138 - DNA, 20 bp, Artificial
  CRISPR gRNA sequence
ttcccagggaactctaggga

SEQ ID NO: 770139 - DNA, 20 bp, Artificial
  CRISPR gRNA sequence
ccagggaactctagggaccc

SEQ ID NO: 770140 - DNA, 20 bp, Artificial
  CRISPR gRNA sequence
tagggaccctcccatctctt

SEQ ID NO: 770141 - DNA, 20 bp, Artificial
  CRISPR gRNA sequence
gggaccctcccatctctttt

SEQ ID NO: 770142 - DNA, 20 bp, Artificial
  CRISPR gRNA sequence
ccatctcttttctgaggctg

SEQ ID NO: 770143 - DNA, 20 bp, Artificial
  CRISPR gRNA sequence
ttttctgaggctgctgccca

SEQ ID NO: 770144 - DNA, 20 bp, Artificial
  CRISPR gRNA sequence
ttctgaggctgctgcccatt

SEQ ID NO: 770145 - DNA, 20 bp, Artificial
  CRISPR gRNA sequence
tctgaggctgctgcccattt

SEQ ID NO: 770146 - DNA, 20 bp, Artificial
  CRISPR gRNA sequence
ctgaggctgctgcccattta

SEQ ID NO: 770147 - DNA, 20 bp, Artificial
  CRISPR gRNA sequence
tgaggctgctgcccatttat

SEQ ID NO: 770148 - DNA, 20 bp, Artificial
  CRISPR gRNA sequence
aggctgctgcccatttatag

SEQ ID NO: 770149 - DNA, 20 bp, Artificial
  CRISPR gRNA sequence
ctgcccatttatagagcacc

SEQ ID NO: 770150 - DNA, 20 bp, Artificial
  CRISPR gRNA sequence
cccatttatagagcacctag

SEQ ID NO: 770151 - DNA, 20 bp, Artificial
  CRISPR gRNA sequence
atagagcacctagtattaac

SEQ ID NO: 770152 - DNA, 20 bp, Artificial
  CRISPR gRNA sequence
tagagcacctagtattaact

SEQ ID NO: 770153 - DNA, 20 bp, Artificial
  CRISPR gRNA sequence
gtattaactaggtcagtttt

SEQ ID NO: 770154 - DNA, 20 bp, Artificial
  CRISPR gRNA sequence
actaggtcagttttgataat

SEQ ID NO: 770155 - DNA, 20 bp, Artificial
  CRISPR gRNA sequence
ggtcagttttgataattttg

SEQ ID NO: 770156 - DNA, 20 bp, Artificial
  CRISPR gRNA sequence
tgataattttgctcattgag

SEQ ID NO: 770157 - DNA, 20 bp, Artificial
  CRISPR gRNA sequence
gataattttgctcattgagt

SEQ ID NO: 770158 - DNA, 20 bp, Artificial
  CRISPR gRNA sequence
ataattttgctcattgagtc

SEQ ID NO: 770159 - DNA, 20 bp, Artificial
  CRISPR gRNA sequence
tgctcattgagtcctataat

SEQ ID NO: 770160 - DNA, 20 bp, Artificial
  CRISPR gRNA sequence
gctcattgagtcctataatc

SEQ ID NO: 770161 - DNA, 20 bp, Artificial
  CRISPR gRNA sequence
ctcattgagtcctataatca

SEQ ID NO: 770162 - DNA, 20 bp, Artificial
  CRISPR gRNA sequence
attgagtcctataatcatcc

SEQ ID NO: 770163 - DNA, 20 bp, Artificial
  CRISPR gRNA sequence
agtcctataatcatcctatg

SEQ ID NO: 770164 - DNA, 20 bp, Artificial
  CRISPR gRNA sequence
taatcatcctatgagggtaa

SEQ ID NO: 770165 - DNA, 20 bp, Artificial
  CRISPR gRNA sequence
tgagggtaaggtttataatc

SEQ ID NO: 770166 - DNA, 20 bp, Artificial
  CRISPR gRNA sequence
ataatccccattttacaaat

SEQ ID NO: 770167 - DNA, 20 bp, Artificial
  CRISPR gRNA sequence
taatccccattttacaaatg

SEQ ID NO: 770168 - DNA, 20 bp, Artificial
  CRISPR gRNA sequence
tacaaatgagcaaactgagg

SEQ ID NO: 770169 - DNA, 20 bp, Artificial
  CRISPR gRNA sequence
acaaatgagcaaactgaggc

SEQ ID NO: 770170 - DNA, 20 bp, Artificial
  CRISPR gRNA sequence
caaatgagcaaactgaggct

SEQ ID NO: 770171 - DNA, 20 bp, Artificial
  CRISPR gRNA sequence
aggctcagagaggatatttt

SEQ ID NO: 770172 - DNA, 20 bp, Artificial
  CRISPR gRNA sequence
agagaggatattttcataaa

SEQ ID NO: 770173 - DNA, 20 bp, Artificial
  CRISPR gRNA sequence
tcataaagtttcattactag

SEQ ID NO: 770174 - DNA, 20 bp, Artificial
  CRISPR gRNA sequence
cataaagtttcattactagg

SEQ ID NO: 770175 - DNA, 20 bp, Artificial
  CRISPR gRNA sequence
ataaagtttcattactagga

SEQ ID NO: 770176 - DNA, 20 bp, Artificial
  CRISPR gRNA sequence
cattactaggaagtgacaga

SEQ ID NO: 770177 - DNA, 20 bp, Artificial
  CRISPR gRNA sequence
attactaggaagtgacagag

SEQ ID NO: 770178 - DNA, 20 bp, Artificial
  CRISPR gRNA sequence
ctaggaagtgacagagtctg

SEQ ID NO: 770179 - DNA, 20 bp, Artificial
  CRISPR gRNA sequence
ggaagtgacagagtctggat

SEQ ID NO: 770180 - DNA, 20 bp, Artificial
  CRISPR gRNA sequence
gatttgaacctgtctctcca

SEQ ID NO: 770181 - DNA, 20 bp, Artificial
  CRISPR gRNA sequence
gaacctgtctctccaactcc

SEQ ID NO: 770182 - DNA, 20 bp, Artificial
  CRISPR gRNA sequence
aacctgtctctccaactcca

SEQ ID NO: 770183 - DNA, 20 bp, Artificial
  CRISPR gRNA sequence
tctctccaactccaaagtca

SEQ ID NO: 770184 - DNA, 20 bp, Artificial
  CRISPR gRNA sequence
tccaactccaaagtcatctt

SEQ ID NO: 770185 - DNA, 20 bp, Artificial
  CRISPR gRNA sequence
caactccaaagtcatcttct

SEQ ID NO: 770186 - DNA, 20 bp, Artificial
  CRISPR gRNA sequence
caaagtcatcttcttaaaca

SEQ ID NO: 770187 - DNA, 20 bp, Artificial
  CRISPR gRNA sequence
cttaaacactagtgctaact

SEQ ID NO: 770188 - DNA, 20 bp, Artificial
  CRISPR gRNA sequence
ttaaacactagtgctaactt

SEQ ID NO: 770189 - DNA, 20 bp, Artificial
  CRISPR gRNA sequence
aaacactagtgctaacttct

SEQ ID NO: 770190 - DNA, 20 bp, Artificial
  CRISPR gRNA sequence
aacactagtgctaacttctt

SEQ ID NO: 770191 - DNA, 20 bp, Artificial
  CRISPR gRNA sequence
gtgctaacttcttccatgaa

SEQ ID NO: 770192 - DNA, 20 bp, Artificial
  CRISPR gRNA sequence
acttcttccatgaagcttct

SEQ ID NO: 770193 - DNA, 20 bp, Artificial
  CRISPR gRNA sequence
cttccatgaagcttcttgtg

SEQ ID NO: 770194 - DNA, 20 bp, Artificial
  CRISPR gRNA sequence
ttccatgaagcttcttgtga

SEQ ID NO: 770195 - DNA, 20 bp, Artificial
  CRISPR gRNA sequence
ccatgaagcttcttgtgatt

SEQ ID NO: 770196 - DNA, 20 bp, Artificial
  CRISPR gRNA sequence
catgaagcttcttgtgatta

SEQ ID NO: 770197 - DNA, 20 bp, Artificial
  CRISPR gRNA sequence
cttgtgattacaccagccca

SEQ ID NO: 770198 - DNA, 20 bp, Artificial
  CRISPR gRNA sequence
ttgtgattacaccagcccaa

SEQ ID NO: 770199 - DNA, 20 bp, Artificial
  CRISPR gRNA sequence
gtgattacaccagcccaaca

SEQ ID NO: 770200 - DNA, 20 bp, Artificial
  CRISPR gRNA sequence
tgattacaccagcccaacat

SEQ ID NO: 770201 - DNA, 20 bp, Artificial
  CRISPR gRNA sequence
caccagcccaacatgcgata

SEQ ID NO: 770202 - DNA, 20 bp, Artificial
  CRISPR gRNA sequence
tgatggttgaggagatgaag

SEQ ID NO: 770203 - DNA, 20 bp, Artificial
  CRISPR gRNA sequence
gatggttgaggagatgaaga

SEQ ID NO: 770204 - DNA, 20 bp, Artificial
  CRISPR gRNA sequence
atggttgaggagatgaagac

SEQ ID NO: 770205 - DNA, 20 bp, Artificial
  CRISPR gRNA sequence
aggagatgaagacccagaaa

SEQ ID NO: 770206 - DNA, 20 bp, Artificial
  CRISPR gRNA sequence
ggcctagggagcctggcaag

SEQ ID NO: 770207 - DNA, 20 bp, Artificial
  CRISPR gRNA sequence
gcctagggagcctggcaagt

SEQ ID NO: 770208 - DNA, 20 bp, Artificial
  CRISPR gRNA sequence
gggagcctggcaagtgagtg

SEQ ID NO: 770209 - DNA, 20 bp, Artificial
  CRISPR gRNA sequence
gcaagtgagtgacagagcct

SEQ ID NO: 770210 - DNA, 20 bp, Artificial
  CRISPR gRNA sequence
gtctaaagtccaggatatct

SEQ ID NO: 770211 - DNA, 20 bp, Artificial
  CRISPR gRNA sequence
aagtccaggatatctctgtt

SEQ ID NO: 770212 - DNA, 20 bp, Artificial
  CRISPR gRNA sequence
tgttgttgctgttttccttt

SEQ ID NO: 770213 - DNA, 20 bp, Artificial
  CRISPR gRNA sequence
ttgttgctgttttccttttt

SEQ ID NO: 770214 - DNA, 20 bp, Artificial
  CRISPR gRNA sequence
ttgctgttttccttttttcg

SEQ ID NO: 770215 - DNA, 20 bp, Artificial
  CRISPR gRNA sequence
ctgttttccttttttcgtta

SEQ ID NO: 770216 - DNA, 20 bp, Artificial
  CRISPR gRNA sequence
ttttccttttttcgttaatt

SEQ ID NO: 770217 - DNA, 20 bp, Artificial
  CRISPR gRNA sequence
tccttttttcgttaattgca

SEQ ID NO: 770218 - DNA, 20 bp, Artificial
  CRISPR gRNA sequence
ccttttttcgttaattgcaa

SEQ ID NO: 770219 - DNA, 20 bp, Artificial
  CRISPR gRNA sequence
cttttttcgttaattgcaaa

SEQ ID NO: 770220 - DNA, 20 bp, Artificial
  CRISPR gRNA sequence
ttttcgttaattgcaaaaga

SEQ ID NO: 770221 - DNA, 20 bp, Artificial
  CRISPR gRNA sequence
tttcgttaattgcaaaagaa

SEQ ID NO: 770222 - DNA, 20 bp, Artificial
  CRISPR gRNA sequence
ttcgttaattgcaaaagaat

SEQ ID NO: 770223 - DNA, 20 bp, Artificial
  CRISPR gRNA sequence
tcgttaattgcaaaagaatt

SEQ ID NO: 770224 - DNA, 20 bp, Artificial
  CRISPR gRNA sequence
cgttaattgcaaaagaattt

SEQ ID NO: 770225 - DNA, 20 bp, Artificial
  CRISPR gRNA sequence
gttaattgcaaaagaattta

SEQ ID NO: 770226 - DNA, 20 bp, Artificial
  CRISPR gRNA sequence
attgcaaaagaatttacatg

SEQ ID NO: 770227 - DNA, 20 bp, Artificial
  CRISPR gRNA sequence
caaaagaatttacatgttca

SEQ ID NO: 770228 - DNA, 20 bp, Artificial
  CRISPR gRNA sequence
acatgttcatagttaaaaac

SEQ ID NO: 770229 - DNA, 20 bp, Artificial
  CRISPR gRNA sequence
catgttcatagttaaaaaca

SEQ ID NO: 770230 - DNA, 20 bp, Artificial
  CRISPR gRNA sequence
atagttaaaaacagagaagt

SEQ ID NO: 770231 - DNA, 20 bp, Artificial
  CRISPR gRNA sequence
aaaacagagaagtgtatcaa

SEQ ID NO: 770232 - DNA, 20 bp, Artificial
  CRISPR gRNA sequence
tcacccttattctgacactc

SEQ ID NO: 770233 - DNA, 20 bp, Artificial
  CRISPR gRNA sequence
acccttattctgacactcca

SEQ ID NO: 770234 - DNA, 20 bp, Artificial
  CRISPR gRNA sequence
attctgacactccagagttg

SEQ ID NO: 770235 - DNA, 20 bp, Artificial
  CRISPR gRNA sequence
ttctgacactccagagttgc

SEQ ID NO: 770236 - DNA, 20 bp, Artificial
  CRISPR gRNA sequence
tgacactccagagttgcatt

SEQ ID NO: 770237 - DNA, 20 bp, Artificial
  CRISPR gRNA sequence
acactccagagttgcattca

SEQ ID NO: 770238 - DNA, 20 bp, Artificial
  CRISPR gRNA sequence
cagagttgcattcactctca

SEQ ID NO: 770239 - DNA, 20 bp, Artificial
  CRISPR gRNA sequence
cattcactctcaggcatcca

SEQ ID NO: 770240 - DNA, 20 bp, Artificial
  CRISPR gRNA sequence
actctcaggcatccagatcc

SEQ ID NO: 770241 - DNA, 20 bp, Artificial
  CRISPR gRNA sequence
tcaggcatccagatcctttc

SEQ ID NO: 770242 - DNA, 20 bp, Artificial
  CRISPR gRNA sequence
aggcatccagatcctttccc

SEQ ID NO: 770243 - DNA, 20 bp, Artificial
  CRISPR gRNA sequence
tccccatatacaaacatcca

SEQ ID NO: 770244 - DNA, 20 bp, Artificial
  CRISPR gRNA sequence
ccccatatacaaacatccat

SEQ ID NO: 770245 - DNA, 20 bp, Artificial
  CRISPR gRNA sequence
cccatatacaaacatccatc

SEQ ID NO: 770246 - DNA, 20 bp, Artificial
  CRISPR gRNA sequence
tccatctctctatctaaaca

SEQ ID NO: 770247 - DNA, 20 bp, Artificial
  CRISPR gRNA sequence
tctatctaaacacacatgca

SEQ ID NO: 770248 - DNA, 20 bp, Artificial
  CRISPR gRNA sequence
tatctaaacacacatgcatt

SEQ ID NO: 770249 - DNA, 20 bp, Artificial
  CRISPR gRNA sequence
tctaaacacacatgcattca

SEQ ID NO: 770250 - DNA, 20 bp, Artificial
  CRISPR gRNA sequence
aacacacatgcattcattcg

SEQ ID NO: 770251 - DNA, 20 bp, Artificial
  CRISPR gRNA sequence
attcgttcactcattgaatc

SEQ ID NO: 770252 - DNA, 20 bp, Artificial
  CRISPR gRNA sequence
gttcactcattgaatcgtgc

SEQ ID NO: 770253 - DNA, 20 bp, Artificial
  CRISPR gRNA sequence
actcattgaatcgtgcattg

SEQ ID NO: 770254 - DNA, 20 bp, Artificial
  CRISPR gRNA sequence
attgaatcgtgcattgagaa

SEQ ID NO: 770255 - DNA, 20 bp, Artificial
  CRISPR gRNA sequence
aatcgtgcattgagaaccca

SEQ ID NO: 770256 - DNA, 20 bp, Artificial
  CRISPR gRNA sequence
agaacccattatgtgccaag

SEQ ID NO: 770257 - DNA, 20 bp, Artificial
  CRISPR gRNA sequence
tgtgccaagccattgctaga

SEQ ID NO: 770258 - DNA, 20 bp, Artificial
  CRISPR gRNA sequence
ctagaattaaggatgcaata

SEQ ID NO: 770259 - DNA, 20 bp, Artificial
  CRISPR gRNA sequence
gaattaaggatgcaatagtt

SEQ ID NO: 770260 - DNA, 20 bp, Artificial
  CRISPR gRNA sequence
aggatgcaatagttaaataa

SEQ ID NO: 770261 - DNA, 20 bp, Artificial
  CRISPR gRNA sequence
aataaagcagatgtggttcc

SEQ ID NO: 770262 - DNA, 20 bp, Artificial
  CRISPR gRNA sequence
cttctcagggaggttctcat

SEQ ID NO: 770263 - DNA, 20 bp, Artificial
  CRISPR gRNA sequence
ctcagggaggttctcatata

SEQ ID NO: 770264 - DNA, 20 bp, Artificial
  CRISPR gRNA sequence
tcagggaggttctcatatat

SEQ ID NO: 770265 - DNA, 20 bp, Artificial
  CRISPR gRNA sequence
agggaggttctcatatatca

SEQ ID NO: 770266 - DNA, 20 bp, Artificial
  CRISPR gRNA sequence
tcatatatcatgaagaaaac

SEQ ID NO: 770267 - DNA, 20 bp, Artificial
  CRISPR gRNA sequence
atatatcatgaagaaaacag

SEQ ID NO: 770268 - DNA, 20 bp, Artificial
  CRISPR gRNA sequence
ggtgcaatgaatgacagggt

SEQ ID NO: 770269 - DNA, 20 bp, Artificial
  CRISPR gRNA sequence
cttagagtggcagatctctt

SEQ ID NO: 770270 - DNA, 20 bp, Artificial
  CRISPR gRNA sequence
ttagagtggcagatctctta

SEQ ID NO: 770271 - DNA, 20 bp, Artificial
  CRISPR gRNA sequence
agagtggcagatctcttacc

SEQ ID NO: 770272 - DNA, 20 bp, Artificial
  CRISPR gRNA sequence
gagtggcagatctcttacct

SEQ ID NO: 770273 - DNA, 20 bp, Artificial
  CRISPR gRNA sequence
ttacctggcttttctgtcaa

SEQ ID NO: 770274 - DNA, 20 bp, Artificial
  CRISPR gRNA sequence
acctggcttttctgtcaagg

SEQ ID NO: 770275 - DNA, 20 bp, Artificial
  CRISPR gRNA sequence
cctggcttttctgtcaaggt

SEQ ID NO: 770276 - DNA, 20 bp, Artificial
  CRISPR gRNA sequence
gcttttctgtcaaggtgacc

SEQ ID NO: 770277 - DNA, 20 bp, Artificial
  CRISPR gRNA sequence
ttctgtcaaggtgaccctca

SEQ ID NO: 770278 - DNA, 20 bp, Artificial
  CRISPR gRNA sequence
tctgtcaaggtgaccctcag

SEQ ID NO: 770279 - DNA, 20 bp, Artificial
  CRISPR gRNA sequence
ctgtcaaggtgaccctcaga

SEQ ID NO: 770280 - DNA, 20 bp, Artificial
  CRISPR gRNA sequence
tgtcaaggtgaccctcagaa

SEQ ID NO: 770281 - DNA, 20 bp, Artificial
  CRISPR gRNA sequence
tcaaggtgaccctcagaata

SEQ ID NO: 770282 - DNA, 20 bp, Artificial
  CRISPR gRNA sequence
agaatatggaggtgttacct

SEQ ID NO: 770283 - DNA, 20 bp, Artificial
  CRISPR gRNA sequence
ccttttatcttagtccatgt

SEQ ID NO: 770284 - DNA, 20 bp, Artificial
  CRISPR gRNA sequence
ttatcttagtccatgtttta

SEQ ID NO: 770285 - DNA, 20 bp, Artificial
  CRISPR gRNA sequence
tatcttagtccatgttttac

SEQ ID NO: 770286 - DNA, 20 bp, Artificial
  CRISPR gRNA sequence
atcttagtccatgttttact

SEQ ID NO: 770287 - DNA, 20 bp, Artificial
  CRISPR gRNA sequence
tcttagtccatgttttactg

SEQ ID NO: 770288 - DNA, 20 bp, Artificial
  CRISPR gRNA sequence
agtccatgttttactgctat

SEQ ID NO: 770289 - DNA, 20 bp, Artificial
  CRISPR gRNA sequence
gtccatgttttactgctata

SEQ ID NO: 770290 - DNA, 20 bp, Artificial
  CRISPR gRNA sequence
tactgctataacagaatacc

SEQ ID NO: 770291 - DNA, 20 bp, Artificial
  CRISPR gRNA sequence
actgctataacagaatacca

SEQ ID NO: 770292 - DNA, 20 bp, Artificial
  CRISPR gRNA sequence
ctgctataacagaataccac

SEQ ID NO: 770293 - DNA, 20 bp, Artificial
  CRISPR gRNA sequence
ctataacagaataccacagc

SEQ ID NO: 770294 - DNA, 20 bp, Artificial
  CRISPR gRNA sequence
taacagaataccacagcctg

SEQ ID NO: 770295 - DNA, 20 bp, Artificial
  CRISPR gRNA sequence
ggtaatatataaagaaaaaa

SEQ ID NO: 770296 - DNA, 20 bp, Artificial
  CRISPR gRNA sequence
tttggcttgtagttctggag

SEQ ID NO: 770297 - DNA, 20 bp, Artificial
  CRISPR gRNA sequence
ggcttgtagttctggagact

SEQ ID NO: 770298 - DNA, 20 bp, Artificial
  CRISPR gRNA sequence
gcttgtagttctggagactg

SEQ ID NO: 770299 - DNA, 20 bp, Artificial
  CRISPR gRNA sequence
gtagttctggagactgggaa

SEQ ID NO: 770300 - DNA, 20 bp, Artificial
  CRISPR gRNA sequence
tagttctggagactgggaag

SEQ ID NO: 770301 - DNA, 20 bp, Artificial
  CRISPR gRNA sequence
tggagactgggaagtccaag

SEQ ID NO: 770302 - DNA, 20 bp, Artificial
  CRISPR gRNA sequence
gagactgggaagtccaaggg

SEQ ID NO: 770303 - DNA, 20 bp, Artificial
  CRISPR gRNA sequence
ggaagtccaagggcatggtg

SEQ ID NO: 770304 - DNA, 20 bp, Artificial
  CRISPR gRNA sequence
gcatctggcgagggccttct

SEQ ID NO: 770305 - DNA, 20 bp, Artificial
  CRISPR gRNA sequence
gcgagggccttcttgctgca

SEQ ID NO: 770306 - DNA, 20 bp, Artificial
  CRISPR gRNA sequence
cttgctgcattatcctattg

SEQ ID NO: 770307 - DNA, 20 bp, Artificial
  CRISPR gRNA sequence
ttgctgcattatcctattgt

SEQ ID NO: 770308 - DNA, 20 bp, Artificial
  CRISPR gRNA sequence
gctgcattatcctattgtgg

SEQ ID NO: 770309 - DNA, 20 bp, Artificial
  CRISPR gRNA sequence
ctgcattatcctattgtgga

SEQ ID NO: 770310 - DNA, 20 bp, Artificial
  CRISPR gRNA sequence
cattatcctattgtggaagg

SEQ ID NO: 770311 - DNA, 20 bp, Artificial
  CRISPR gRNA sequence
tcctattgtggaagggcatg

SEQ ID NO: 770312 - DNA, 20 bp, Artificial
  CRISPR gRNA sequence
ttgtggaagggcatgtgagc

SEQ ID NO: 770313 - DNA, 20 bp, Artificial
  CRISPR gRNA sequence
tggaagggcatgtgagcgtg

SEQ ID NO: 770314 - DNA, 20 bp, Artificial
  CRISPR gRNA sequence
acgcttttatcaggagccca

SEQ ID NO: 770315 - DNA, 20 bp, Artificial
  CRISPR gRNA sequence
cgcttttatcaggagcccac

SEQ ID NO: 770316 - DNA, 20 bp, Artificial
  CRISPR gRNA sequence
ttatcaggagcccacttttc

SEQ ID NO: 770317 - DNA, 20 bp, Artificial
  CRISPR gRNA sequence
tatcaggagcccacttttcc

SEQ ID NO: 770318 - DNA, 20 bp, Artificial
  CRISPR gRNA sequence
atcaggagcccacttttcct

SEQ ID NO: 770319 - DNA, 20 bp, Artificial
  CRISPR gRNA sequence
tcaggagcccacttttcctg

SEQ ID NO: 770320 - DNA, 20 bp, Artificial
  CRISPR gRNA sequence
ttcctgtgataacagcatta

SEQ ID NO: 770321 - DNA, 20 bp, Artificial
  CRISPR gRNA sequence
tcctgtgataacagcattaa

SEQ ID NO: 770322 - DNA, 20 bp, Artificial
  CRISPR gRNA sequence
cctgtgataacagcattaat

SEQ ID NO: 770323 - DNA, 20 bp, Artificial
  CRISPR gRNA sequence
ctgtgataacagcattaatc

SEQ ID NO: 770324 - DNA, 20 bp, Artificial
  CRISPR gRNA sequence
tgataacagcattaatctct

SEQ ID NO: 770325 - DNA, 20 bp, Artificial
  CRISPR gRNA sequence
atctcttcacttcttacagg

SEQ ID NO: 770326 - DNA, 20 bp, Artificial
  CRISPR gRNA sequence
ttcacttcttacaggcccca

SEQ ID NO: 770327 - DNA, 20 bp, Artificial
  CRISPR gRNA sequence
cacttcttacaggccccacc

SEQ ID NO: 770328 - DNA, 20 bp, Artificial
  CRISPR gRNA sequence
acttcttacaggccccacct

SEQ ID NO: 770329 - DNA, 20 bp, Artificial
  CRISPR gRNA sequence
cttacaggccccacctctta

SEQ ID NO: 770330 - DNA, 20 bp, Artificial
  CRISPR gRNA sequence
ttacaggccccacctcttaa

SEQ ID NO: 770331 - DNA, 20 bp, Artificial
  CRISPR gRNA sequence
acaggccccacctcttaata

SEQ ID NO: 770332 - DNA, 20 bp, Artificial
  CRISPR gRNA sequence
caggccccacctcttaatac

SEQ ID NO: 770333 - DNA, 20 bp, Artificial
  CRISPR gRNA sequence
ttaatactgttacagtggca

SEQ ID NO: 770334 - DNA, 20 bp, Artificial
  CRISPR gRNA sequence
aatactgttacagtggcaat

SEQ ID NO: 770335 - DNA, 20 bp, Artificial
  CRISPR gRNA sequence
atactgttacagtggcaatt

SEQ ID NO: 770336 - DNA, 20 bp, Artificial
  CRISPR gRNA sequence
ttacagtggcaattaaattt

SEQ ID NO: 770337 - DNA, 20 bp, Artificial
  CRISPR gRNA sequence
cagtggcaattaaatttcaa

SEQ ID NO: 770338 - DNA, 20 bp, Artificial
  CRISPR gRNA sequence
aatttcaacatgagtcttaa

SEQ ID NO: 770339 - DNA, 20 bp, Artificial
  CRISPR gRNA sequence
caacatgagtcttaaagcac

SEQ ID NO: 770340 - DNA, 20 bp, Artificial
  CRISPR gRNA sequence
aacatgagtcttaaagcacc

SEQ ID NO: 770341 - DNA, 20 bp, Artificial
  CRISPR gRNA sequence
aaagcacccatgtcatctag

SEQ ID NO: 770342 - DNA, 20 bp, Artificial
  CRISPR gRNA sequence
aagcacccatgtcatctagg

SEQ ID NO: 770343 - DNA, 20 bp, Artificial
  CRISPR gRNA sequence
ggaagaagaaactgtatttg

SEQ ID NO: 770344 - DNA, 20 bp, Artificial
  CRISPR gRNA sequence
tatttgcagcaacactgtga

SEQ ID NO: 770345 - DNA, 20 bp, Artificial
  CRISPR gRNA sequence
gcagcaacactgtgaggtag

SEQ ID NO: 770346 - DNA, 20 bp, Artificial
  CRISPR gRNA sequence
cagcaacactgtgaggtagg

SEQ ID NO: 770347 - DNA, 20 bp, Artificial
  CRISPR gRNA sequence
tgaggtaggaaagggagtcc

SEQ ID NO: 770348 - DNA, 20 bp, Artificial
  CRISPR gRNA sequence
tgttgtaggaactggaagca

SEQ ID NO: 770349 - DNA, 20 bp, Artificial
  CRISPR gRNA sequence
taggaactggaagcagccca

SEQ ID NO: 770350 - DNA, 20 bp, Artificial
  CRISPR gRNA sequence
gaagcagcccactgtggtga

SEQ ID NO: 770351 - DNA, 20 bp, Artificial
  CRISPR gRNA sequence
tggtgaggggcaagtaggaa

SEQ ID NO: 770352 - DNA, 20 bp, Artificial
  CRISPR gRNA sequence
ggcaggtgggcagggccagg

SEQ ID NO: 770353 - DNA, 20 bp, Artificial
  CRISPR gRNA sequence
tgtaggctatggaggagctg

SEQ ID NO: 770354 - DNA, 20 bp, Artificial
  CRISPR gRNA sequence
taggctatggaggagctgcg

SEQ ID NO: 770355 - DNA, 20 bp, Artificial
  CRISPR gRNA sequence
tggaggagctgcgatcttat

SEQ ID NO: 770356 - DNA, 20 bp, Artificial
  CRISPR gRNA sequence
cgatcttatcacaaggaaag

SEQ ID NO: 770357 - DNA, 20 bp, Artificial
  CRISPR gRNA sequence
atcacaaggaaagtgaacag

SEQ ID NO: 770358 - DNA, 20 bp, Artificial
  CRISPR gRNA sequence
tcacaaggaaagtgaacagc

SEQ ID NO: 770359 - DNA, 20 bp, Artificial
  CRISPR gRNA sequence
tgattaactattgaaggcag

SEQ ID NO: 770360 - DNA, 20 bp, Artificial
  CRISPR gRNA sequence
actattgaaggcagtgatat

SEQ ID NO: 770361 - DNA, 20 bp, Artificial
  CRISPR gRNA sequence
ttgaaggcagtgatataatt

SEQ ID NO: 770362 - DNA, 20 bp, Artificial
  CRISPR gRNA sequence
aaggcagtgatataatttat

SEQ ID NO: 770363 - DNA, 20 bp, Artificial
  CRISPR gRNA sequence
atgcttttatattaatagca

SEQ ID NO: 770364 - DNA, 20 bp, Artificial
  CRISPR gRNA sequence
tgcttttatattaatagcaa

SEQ ID NO: 770365 - DNA, 20 bp, Artificial
  CRISPR gRNA sequence
ttatattaatagcaattatt

SEQ ID NO: 770366 - DNA, 20 bp, Artificial
  CRISPR gRNA sequence
tatattaatagcaattattc

SEQ ID NO: 770367 - DNA, 20 bp, Artificial
  CRISPR gRNA sequence
atattaatagcaattattct

SEQ ID NO: 770368 - DNA, 20 bp, Artificial
  CRISPR gRNA sequence
tattaatagcaattattctg

SEQ ID NO: 770369 - DNA, 20 bp, Artificial
  CRISPR gRNA sequence
atagcaattattctggctgt

SEQ ID NO: 770370 - DNA, 20 bp, Artificial
  CRISPR gRNA sequence
ttctggctgttgtatagagt

SEQ ID NO: 770371 - DNA, 20 bp, Artificial
  CRISPR gRNA sequence
tggctgttgtatagagtata

SEQ ID NO: 770372 - DNA, 20 bp, Artificial
  CRISPR gRNA sequence
gctgttgtatagagtataga

SEQ ID NO: 770373 - DNA, 20 bp, Artificial
  CRISPR gRNA sequence
ttgtatagagtatagattgg

SEQ ID NO: 770374 - DNA, 20 bp, Artificial
  CRISPR gRNA sequence
tatagagtatagattggaga

SEQ ID NO: 770375 - DNA, 20 bp, Artificial
  CRISPR gRNA sequence
gagaacagaattgggtgggg

SEQ ID NO: 770376 - DNA, 20 bp, Artificial
  CRISPR gRNA sequence
ggtgggggaactagagaagg

SEQ ID NO: 770377 - DNA, 20 bp, Artificial
  CRISPR gRNA sequence
gagaaggtgaacagactggt

SEQ ID NO: 770378 - DNA, 20 bp, Artificial
  CRISPR gRNA sequence
gtgaagaggcttttatagtt

SEQ ID NO: 770379 - DNA, 20 bp, Artificial
  CRISPR gRNA sequence
ttatagttatccaggcaaga

SEQ ID NO: 770380 - DNA, 20 bp, Artificial
  CRISPR gRNA sequence
tatagttatccaggcaagag

SEQ ID NO: 770381 - DNA, 20 bp, Artificial
  CRISPR gRNA sequence
atagttatccaggcaagaga

SEQ ID NO: 770382 - DNA, 20 bp, Artificial
  CRISPR gRNA sequence
tagttatccaggcaagagat

SEQ ID NO: 770383 - DNA, 20 bp, Artificial
  CRISPR gRNA sequence
tccaggcaagagatgatggt

SEQ ID NO: 770384 - DNA, 20 bp, Artificial
  CRISPR gRNA sequence
ggaagaccaggaagagaagc

SEQ ID NO: 770385 - DNA, 20 bp, Artificial
  CRISPR gRNA sequence
gaagaccaggaagagaagca

SEQ ID NO: 770386 - DNA, 20 bp, Artificial
  CRISPR gRNA sequence
gaggagtccttcagttacag

SEQ ID NO: 770387 - DNA, 20 bp, Artificial
  CRISPR gRNA sequence
aggagtccttcagttacaga

SEQ ID NO: 770388 - DNA, 20 bp, Artificial
  CRISPR gRNA sequence
cagttacagataatagaaaa

SEQ ID NO: 770389 - DNA, 20 bp, Artificial
  CRISPR gRNA sequence
agttacagataatagaaaac

SEQ ID NO: 770390 - DNA, 20 bp, Artificial
  CRISPR gRNA sequence
cagataatagaaaactagct

SEQ ID NO: 770391 - DNA, 20 bp, Artificial
  CRISPR gRNA sequence
gctcaagcacatttaagaaa

SEQ ID NO: 770392 - DNA, 20 bp, Artificial
  CRISPR gRNA sequence
aagcacatttaagaaaaaaa

SEQ ID NO: 770393 - DNA, 20 bp, Artificial
  CRISPR gRNA sequence
aagaaaaaaaaaaaagactt

SEQ ID NO: 770394 - DNA, 20 bp, Artificial
  CRISPR gRNA sequence
agaaaaaaaaaaaagacttg

SEQ ID NO: 770395 - DNA, 20 bp, Artificial
  CRISPR gRNA sequence
gtttaagtacctaggcagtc

SEQ ID NO: 770396 - DNA, 20 bp, Artificial
  CRISPR gRNA sequence
tttaagtacctaggcagtct

SEQ ID NO: 770397 - DNA, 20 bp, Artificial
  CRISPR gRNA sequence
aagtacctaggcagtctatg

SEQ ID NO: 770398 - DNA, 20 bp, Artificial
  CRISPR gRNA sequence
agtacctaggcagtctatgt

SEQ ID NO: 770399 - DNA, 20 bp, Artificial
  CRISPR gRNA sequence
ggcagtctatgtgtgcagct

SEQ ID NO: 770400 - DNA, 20 bp, Artificial
  CRISPR gRNA sequence
tgtgtgcagcttgcttcagg

SEQ ID NO: 770401 - DNA, 20 bp, Artificial
  CRISPR gRNA sequence
gcttcaggaataggggctta

SEQ ID NO: 770402 - DNA, 20 bp, Artificial
  CRISPR gRNA sequence
cttcaggaataggggcttaa

SEQ ID NO: 770403 - DNA, 20 bp, Artificial
  CRISPR gRNA sequence
caggaataggggcttaaatg

SEQ ID NO: 770404 - DNA, 20 bp, Artificial
  CRISPR gRNA sequence
aggaataggggcttaaatga

SEQ ID NO: 770405 - DNA, 20 bp, Artificial
  CRISPR gRNA sequence
aaatgatggttttagggctc

SEQ ID NO: 770406 - DNA, 20 bp, Artificial
  CRISPR gRNA sequence
aatgatggttttagggctct

SEQ ID NO: 770407 - DNA, 20 bp, Artificial
  CRISPR gRNA sequence
tagggctctatatccttcta

SEQ ID NO: 770408 - DNA, 20 bp, Artificial
  CRISPR gRNA sequence
agggctctatatccttctag

SEQ ID NO: 770409 - DNA, 20 bp, Artificial
  CRISPR gRNA sequence
gggctctatatccttctagc

SEQ ID NO: 770410 - DNA, 20 bp, Artificial
  CRISPR gRNA sequence
tatatccttctagcttccat

SEQ ID NO: 770411 - DNA, 20 bp, Artificial
  CRISPR gRNA sequence
tatccttctagcttccatct

SEQ ID NO: 770412 - DNA, 20 bp, Artificial
  CRISPR gRNA sequence
ctagcttccatctctgcctc

SEQ ID NO: 770413 - DNA, 20 bp, Artificial
  CRISPR gRNA sequence
tagcttccatctctgcctct

SEQ ID NO: 770414 - DNA, 20 bp, Artificial
  CRISPR gRNA sequence
gcttccatctctgcctctgt

SEQ ID NO: 770415 - DNA, 20 bp, Artificial
  CRISPR gRNA sequence
ccatctctgcctctgttcat

SEQ ID NO: 770416 - DNA, 20 bp, Artificial
  CRISPR gRNA sequence
catctctgcctctgttcatt

SEQ ID NO: 770417 - DNA, 20 bp, Artificial
  CRISPR gRNA sequence
tgcctctgttcatttgtttg

SEQ ID NO: 770418 - DNA, 20 bp, Artificial
  CRISPR gRNA sequence
cctctgttcatttgtttgga

SEQ ID NO: 770419 - DNA, 20 bp, Artificial
  CRISPR gRNA sequence
tgttcatttgtttggatcaa

SEQ ID NO: 770420 - DNA, 20 bp, Artificial
  CRISPR gRNA sequence
ttcatttgtttggatcaatt

SEQ ID NO: 770421 - DNA, 20 bp, Artificial
  CRISPR gRNA sequence
atttgtttggatcaattctt

SEQ ID NO: 770422 - DNA, 20 bp, Artificial
  CRISPR gRNA sequence
gtttggatcaattctttaga

SEQ ID NO: 770423 - DNA, 20 bp, Artificial
  CRISPR gRNA sequence
tttggatcaattctttagat

SEQ ID NO: 770424 - DNA, 20 bp, Artificial
  CRISPR gRNA sequence
ggatcaattctttagattgt

SEQ ID NO: 770425 - DNA, 20 bp, Artificial
  CRISPR gRNA sequence
gatcaattctttagattgtt

SEQ ID NO: 770426 - DNA, 20 bp, Artificial
  CRISPR gRNA sequence
tttagattgttggtagcaga

SEQ ID NO: 770427 - DNA, 20 bp, Artificial
  CRISPR gRNA sequence
tagattgttggtagcagaca

SEQ ID NO: 770428 - DNA, 20 bp, Artificial
  CRISPR gRNA sequence
agattgttggtagcagacac

SEQ ID NO: 770429 - DNA, 20 bp, Artificial
  CRISPR gRNA sequence
gattgttggtagcagacaca

SEQ ID NO: 770430 - DNA, 20 bp, Artificial
  CRISPR gRNA sequence
ttggtagcagacacatttat

SEQ ID NO: 770431 - DNA, 20 bp, Artificial
  CRISPR gRNA sequence
gtagcagacacatttattgc

SEQ ID NO: 770432 - DNA, 20 bp, Artificial
  CRISPR gRNA sequence
attgctaacagtcccagacc

SEQ ID NO: 770433 - DNA, 20 bp, Artificial
  CRISPR gRNA sequence
ttgctaacagtcccagaccg

SEQ ID NO: 770434 - DNA, 20 bp, Artificial
  CRISPR gRNA sequence
ctaacagtcccagaccgtat

SEQ ID NO: 770435 - DNA, 20 bp, Artificial
  CRISPR gRNA sequence
acagtcccagaccgtatcct

SEQ ID NO: 770436 - DNA, 20 bp, Artificial
  CRISPR gRNA sequence
cttagtaatctcaacaagaa

SEQ ID NO: 770437 - DNA, 20 bp, Artificial
  CRISPR gRNA sequence
ttagtaatctcaacaagaaa

SEQ ID NO: 770438 - DNA, 20 bp, Artificial
  CRISPR gRNA sequence
agtaatctcaacaagaaaga

SEQ ID NO: 770439 - DNA, 20 bp, Artificial
  CRISPR gRNA sequence
gtaatctcaacaagaaagag

SEQ ID NO: 770440 - DNA, 20 bp, Artificial
  CRISPR gRNA sequence
aacaagaaagagtctttttt

SEQ ID NO: 770441 - DNA, 20 bp, Artificial
  CRISPR gRNA sequence
ttttgatggctgcagcagca

SEQ ID NO: 770442 - DNA, 20 bp, Artificial
  CRISPR gRNA sequence
tttgatggctgcagcagcaa

SEQ ID NO: 770443 - DNA, 20 bp, Artificial
  CRISPR gRNA sequence
ttgatggctgcagcagcaag

SEQ ID NO: 770444 - DNA, 20 bp, Artificial
  CRISPR gRNA sequence
tgatggctgcagcagcaagg

SEQ ID NO: 770445 - DNA, 20 bp, Artificial
  CRISPR gRNA sequence
gatggctgcagcagcaaggc

SEQ ID NO: 770446 - DNA, 20 bp, Artificial
  CRISPR gRNA sequence
atggctgcagcagcaaggct

SEQ ID NO: 770447 - DNA, 20 bp, Artificial
  CRISPR gRNA sequence
cagcagcaaggctctgggga

SEQ ID NO: 770448 - DNA, 20 bp, Artificial
  CRISPR gRNA sequence
tggggaagtctctgattggg

SEQ ID NO: 770449 - DNA, 20 bp, Artificial
  CRISPR gRNA sequence
gggaagtctctgattgggtg

SEQ ID NO: 770450 - DNA, 20 bp, Artificial
  CRISPR gRNA sequence
tgattgggtgtggcttggct

SEQ ID NO: 770451 - DNA, 20 bp, Artificial
  CRISPR gRNA sequence
attgggtgtggcttggctta

SEQ ID NO: 770452 - DNA, 20 bp, Artificial
  CRISPR gRNA sequence
ggtgtggcttggcttacagc

SEQ ID NO: 770453 - DNA, 20 bp, Artificial
  CRISPR gRNA sequence
ggcttacagctcattctcga

SEQ ID NO: 770454 - DNA, 20 bp, Artificial
  CRISPR gRNA sequence
gcttacagctcattctcgaa

SEQ ID NO: 770455 - DNA, 20 bp, Artificial
  CRISPR gRNA sequence
acagctcattctcgaactaa

SEQ ID NO: 770456 - DNA, 20 bp, Artificial
  CRISPR gRNA sequence
cagctcattctcgaactaat

SEQ ID NO: 770457 - DNA, 20 bp, Artificial
  CRISPR gRNA sequence
attctcgaactaatcactga

SEQ ID NO: 770458 - DNA, 20 bp, Artificial
  CRISPR gRNA sequence
tcgaactaatcactgagtgg

SEQ ID NO: 770459 - DNA, 20 bp, Artificial
  CRISPR gRNA sequence
gaactaatcactgagtgggg

SEQ ID NO: 770460 - DNA, 20 bp, Artificial
  CRISPR gRNA sequence
atcactgagtgggggcaggg

SEQ ID NO: 770461 - DNA, 20 bp, Artificial
  CRISPR gRNA sequence
agtgggggcagggcaggttt

SEQ ID NO: 770462 - DNA, 20 bp, Artificial
  CRISPR gRNA sequence
ctccatgagccaggtcttgt

SEQ ID NO: 770463 - DNA, 20 bp, Artificial
  CRISPR gRNA sequence
tccatgagccaggtcttgta

SEQ ID NO: 770464 - DNA, 20 bp, Artificial
  CRISPR gRNA sequence
catgagccaggtcttgtaac

SEQ ID NO: 770465 - DNA, 20 bp, Artificial
  CRISPR gRNA sequence
gtaacatgcccaggccctag

SEQ ID NO: 770466 - DNA, 20 bp, Artificial
  CRISPR gRNA sequence
taacatgcccaggccctagg

SEQ ID NO: 770467 - DNA, 20 bp, Artificial
  CRISPR gRNA sequence
ggctgggaggacagctccac

SEQ ID NO: 770468 - DNA, 20 bp, Artificial
  CRISPR gRNA sequence
ggaggacagctccaccagta

SEQ ID NO: 770469 - DNA, 20 bp, Artificial
  CRISPR gRNA sequence
caccagtacagcatggactg

SEQ ID NO: 770470 - DNA, 20 bp, Artificial
  CRISPR gRNA sequence
ggctccctgcaggagtgcgg

SEQ ID NO: 770471 - DNA, 20 bp, Artificial
  CRISPR gRNA sequence
cctgcaggagtgcggagcct

SEQ ID NO: 770472 - DNA, 20 bp, Artificial
  CRISPR gRNA sequence
caggagtgcggagccttgct

SEQ ID NO: 770473 - DNA, 20 bp, Artificial
  CRISPR gRNA sequence
gctaccagaaggggccagca

SEQ ID NO: 770474 - DNA, 20 bp, Artificial
  CRISPR gRNA sequence
ctaccagaaggggccagcat

SEQ ID NO: 770475 - DNA, 20 bp, Artificial
  CRISPR gRNA sequence
ccagaaggggccagcataga

SEQ ID NO: 770476 - DNA, 20 bp, Artificial
  CRISPR gRNA sequence
tagaataaaggacatggagc

SEQ ID NO: 770477 - DNA, 20 bp, Artificial
  CRISPR gRNA sequence
tgttaagactagctaccaaa

SEQ ID NO: 770478 - DNA, 20 bp, Artificial
  CRISPR gRNA sequence
agactagctaccaaagacgg

SEQ ID NO: 770479 - DNA, 20 bp, Artificial
  CRISPR gRNA sequence
gctaccaaagacggagacga

SEQ ID NO: 770480 - DNA, 20 bp, Artificial
  CRISPR gRNA sequence
ccaaagacggagacgatctg

SEQ ID NO: 770481 - DNA, 20 bp, Artificial
  CRISPR gRNA sequence
ctcggcattgaatttgcctc

SEQ ID NO: 770482 - DNA, 20 bp, Artificial
  CRISPR gRNA sequence
ggcattgaatttgcctcttt

SEQ ID NO: 770483 - DNA, 20 bp, Artificial
  CRISPR gRNA sequence
aatttgcctctttgtcaagg

SEQ ID NO: 770484 - DNA, 20 bp, Artificial
  CRISPR gRNA sequence
gcctctttgtcaaggaaaga

SEQ ID NO: 770485 - DNA, 20 bp, Artificial
  CRISPR gRNA sequence
cctctttgtcaaggaaagaa

SEQ ID NO: 770486 - DNA, 20 bp, Artificial
  CRISPR gRNA sequence
tttgtcaaggaaagaaggag

SEQ ID NO: 770487 - DNA, 20 bp, Artificial
  CRISPR gRNA sequence
tgtcaaggaaagaaggagca

SEQ ID NO: 770488 - DNA, 20 bp, Artificial
  CRISPR gRNA sequence
gtcaaggaaagaaggagcag

SEQ ID NO: 770489 - DNA, 20 bp, Artificial
  CRISPR gRNA sequence
tcaaggaaagaaggagcaga

SEQ ID NO: 770490 - DNA, 20 bp, Artificial
  CRISPR gRNA sequence
agaaggaattgaagtttagg

SEQ ID NO: 770491 - DNA, 20 bp, Artificial
  CRISPR gRNA sequence
aagtttaggccatacgggga

SEQ ID NO: 770492 - DNA, 20 bp, Artificial
  CRISPR gRNA sequence
aggccatacggggaggtgct

SEQ ID NO: 770493 - DNA, 20 bp, Artificial
  CRISPR gRNA sequence
ggccatacggggaggtgctc

SEQ ID NO: 770494 - DNA, 20 bp, Artificial
  CRISPR gRNA sequence
atctgttttaactgtatttg

SEQ ID NO: 770495 - DNA, 20 bp, Artificial
  CRISPR gRNA sequence
ttttaactgtatttgtcttc

SEQ ID NO: 770496 - DNA, 20 bp, Artificial
  CRISPR gRNA sequence
taactgtatttgtcttctgg

SEQ ID NO: 770497 - DNA, 20 bp, Artificial
  CRISPR gRNA sequence
aactgtatttgtcttctggc

SEQ ID NO: 770498 - DNA, 20 bp, Artificial
  CRISPR gRNA sequence
actgtatttgtcttctggcc

SEQ ID NO: 770499 - DNA, 20 bp, Artificial
  CRISPR gRNA sequence
tatttgtcttctggcccctg

SEQ ID NO: 770500 - DNA, 20 bp, Artificial
  CRISPR gRNA sequence
gtcttctggcccctgggatt

SEQ ID NO: 770501 - DNA, 20 bp, Artificial
  CRISPR gRNA sequence
tcttctggcccctgggattg

SEQ ID NO: 770502 - DNA, 20 bp, Artificial
  CRISPR gRNA sequence
ctggcccctgggattgcctg

SEQ ID NO: 770503 - DNA, 20 bp, Artificial
  CRISPR gRNA sequence
tggcccctgggattgcctgt

SEQ ID NO: 770504 - DNA, 20 bp, Artificial
  CRISPR gRNA sequence
gcccctgggattgcctgtcc

SEQ ID NO: 770505 - DNA, 20 bp, Artificial
  CRISPR gRNA sequence
ggattgcctgtcctggtgtg

SEQ ID NO: 770506 - DNA, 20 bp, Artificial
  CRISPR gRNA sequence
cctgtcctggtgtggggtga

SEQ ID NO: 770507 - DNA, 20 bp, Artificial
  CRISPR gRNA sequence
tcctggtgtggggtgaactt

SEQ ID NO: 770508 - DNA, 20 bp, Artificial
  CRISPR gRNA sequence
gtgtggggtgaacttggaga

SEQ ID NO: 770509 - DNA, 20 bp, Artificial
  CRISPR gRNA sequence
ggagacagaatctctgagaa

SEQ ID NO: 770510 - DNA, 20 bp, Artificial
  CRISPR gRNA sequence
gagacagaatctctgagaag

SEQ ID NO: 770511 - DNA, 20 bp, Artificial
  CRISPR gRNA sequence
tgagaagctgtcagggatat

SEQ ID NO: 770512 - DNA, 20 bp, Artificial
  CRISPR gRNA sequence
agaagctgtcagggatattt

SEQ ID NO: 770513 - DNA, 20 bp, Artificial
  CRISPR gRNA sequence
tcagggatatttcaggccag

SEQ ID NO: 770514 - DNA, 20 bp, Artificial
  CRISPR gRNA sequence
caggccagtctagggtagaa

SEQ ID NO: 770515 - DNA, 20 bp, Artificial
  CRISPR gRNA sequence
aggccagtctagggtagaag

SEQ ID NO: 770516 - DNA, 20 bp, Artificial
  CRISPR gRNA sequence
gggtagaagagggttggaca

SEQ ID NO: 770517 - DNA, 20 bp, Artificial
  CRISPR gRNA sequence
gacacgtgggtcacagtatt

SEQ ID NO: 770518 - DNA, 20 bp, Artificial
  CRISPR gRNA sequence
cacagtttcctgctgtgcac

SEQ ID NO: 770519 - DNA, 20 bp, Artificial
  CRISPR gRNA sequence
cctgctgtgcacagattcaa

SEQ ID NO: 770520 - DNA, 20 bp, Artificial
  CRISPR gRNA sequence
ctgctgtgcacagattcaat

SEQ ID NO: 770521 - DNA, 20 bp, Artificial
  CRISPR gRNA sequence
ctgtgcacagattcaatccg

SEQ ID NO: 770522 - DNA, 20 bp, Artificial
  CRISPR gRNA sequence
tgcacagattcaatccgagt

SEQ ID NO: 770523 - DNA, 20 bp, Artificial
  CRISPR gRNA sequence
aatccgagtccccatctacg

SEQ ID NO: 770524 - DNA, 20 bp, Artificial
  CRISPR gRNA sequence
cgtccctcactacctccctt

SEQ ID NO: 770525 - DNA, 20 bp, Artificial
  CRISPR gRNA sequence
actacctcccttgcctcctc

SEQ ID NO: 770526 - DNA, 20 bp, Artificial
  CRISPR gRNA sequence
cctcccttgcctcctctcct

SEQ ID NO: 770527 - DNA, 20 bp, Artificial
  CRISPR gRNA sequence
ccttgcctcctctcctgagt

SEQ ID NO: 770528 - DNA, 20 bp, Artificial
  CRISPR gRNA sequence
gcctcctctcctgagtctca

SEQ ID NO: 770529 - DNA, 20 bp, Artificial
  CRISPR gRNA sequence
cctcctctcctgagtctcag

SEQ ID NO: 770530 - DNA, 20 bp, Artificial
  CRISPR gRNA sequence
ctctcctgagtctcagcctc

SEQ ID NO: 770531 - DNA, 20 bp, Artificial
  CRISPR gRNA sequence
tcctgagtctcagcctctcc

SEQ ID NO: 770532 - DNA, 20 bp, Artificial
  CRISPR gRNA sequence
ctgagtctcagcctctcctg

SEQ ID NO: 770533 - DNA, 20 bp, Artificial
  CRISPR gRNA sequence
agtctcagcctctcctggag

SEQ ID NO: 770534 - DNA, 20 bp, Artificial
  CRISPR gRNA sequence
agcctctcctggagtcccat

SEQ ID NO: 770535 - DNA, 20 bp, Artificial
  CRISPR gRNA sequence
tcctggagtcccatcttccc

SEQ ID NO: 770536 - DNA, 20 bp, Artificial
  CRISPR gRNA sequence
ctggagtcccatcttcccag

SEQ ID NO: 770537 - DNA, 20 bp, Artificial
  CRISPR gRNA sequence
gagtcccatcttcccagaat

SEQ ID NO: 770538 - DNA, 20 bp, Artificial
  CRISPR gRNA sequence
cccagaatatgctgtggaca

SEQ ID NO: 770539 - DNA, 20 bp, Artificial
  CRISPR gRNA sequence
ccagaatatgctgtggacat

SEQ ID NO: 770540 - DNA, 20 bp, Artificial
  CRISPR gRNA sequence
tggacatctcctcttctgtg

SEQ ID NO: 770541 - DNA, 20 bp, Artificial
  CRISPR gRNA sequence
ctcttctgtgacttttcatg

SEQ ID NO: 770542 - DNA, 20 bp, Artificial
  CRISPR gRNA sequence
ttctgtgacttttcatgctg

SEQ ID NO: 770543 - DNA, 20 bp, Artificial
  CRISPR gRNA sequence
ctgtgacttttcatgctgtc

SEQ ID NO: 770544 - DNA, 20 bp, Artificial
  CRISPR gRNA sequence
tgtgacttttcatgctgtcc

SEQ ID NO: 770545 - DNA, 20 bp, Artificial
  CRISPR gRNA sequence
tgacttttcatgctgtcccc

SEQ ID NO: 770546 - DNA, 20 bp, Artificial
  CRISPR gRNA sequence
ttcatgctgtcccctccgcc

SEQ ID NO: 770547 - DNA, 20 bp, Artificial
  CRISPR gRNA sequence
tcatgctgtcccctccgcca

SEQ ID NO: 770548 - DNA, 20 bp, Artificial
  CRISPR gRNA sequence
catgctgtcccctccgccag

SEQ ID NO: 770549 - DNA, 20 bp, Artificial
  CRISPR gRNA sequence
atgctgtcccctccgccaga

SEQ ID NO: 770550 - DNA, 20 bp, Artificial
  CRISPR gRNA sequence
tcccctccgccagatagccg

SEQ ID NO: 770551 - DNA, 20 bp, Artificial
  CRISPR gRNA sequence
cgccagatagccgagatgtc

SEQ ID NO: 770552 - DNA, 20 bp, Artificial
  CRISPR gRNA sequence
ctcctctgtgcagtccttac

SEQ ID NO: 770553 - DNA, 20 bp, Artificial
  CRISPR gRNA sequence
ctctgtgcagtccttactga

SEQ ID NO: 770554 - DNA, 20 bp, Artificial
  CRISPR gRNA sequence
tgtgcagtccttactgagcc

SEQ ID NO: 770555 - DNA, 20 bp, Artificial
  CRISPR gRNA sequence
tgcagtccttactgagcctc

SEQ ID NO: 770556 - DNA, 20 bp, Artificial
  CRISPR gRNA sequence
actgagcctccccagccccc

SEQ ID NO: 770557 - DNA, 20 bp, Artificial
  CRISPR gRNA sequence
ctgagcctccccagccccca

SEQ ID NO: 770558 - DNA, 20 bp, Artificial
  CRISPR gRNA sequence
agcctccccagcccccagtg

SEQ ID NO: 770559 - DNA, 20 bp, Artificial
  CRISPR gRNA sequence
cccagcccccagtgaatggc

SEQ ID NO: 770560 - DNA, 20 bp, Artificial
  CRISPR gRNA sequence
gaccctttcatccaggttta

SEQ ID NO: 770561 - DNA, 20 bp, Artificial
  CRISPR gRNA sequence
accctttcatccaggtttaa

SEQ ID NO: 770562 - DNA, 20 bp, Artificial
  CRISPR gRNA sequence
tcatccaggtttaagcctac

SEQ ID NO: 770563 - DNA, 20 bp, Artificial
  CRISPR gRNA sequence
catccaggtttaagcctact

SEQ ID NO: 770564 - DNA, 20 bp, Artificial
  CRISPR gRNA sequence
atccaggtttaagcctactg

SEQ ID NO: 770565 - DNA, 20 bp, Artificial
  CRISPR gRNA sequence
aagcctactgcctcgtccat

SEQ ID NO: 770566 - DNA, 20 bp, Artificial
  CRISPR gRNA sequence
agcctactgcctcgtccatt

SEQ ID NO: 770567 - DNA, 20 bp, Artificial
  CRISPR gRNA sequence
ctgcctcgtccattcccaca

SEQ ID NO: 770568 - DNA, 20 bp, Artificial
  CRISPR gRNA sequence
cctcgtccattcccacaata

SEQ ID NO: 770569 - DNA, 20 bp, Artificial
  CRISPR gRNA sequence
gtccattcccacaatacctt

SEQ ID NO: 770570 - DNA, 20 bp, Artificial
  CRISPR gRNA sequence
ccacaataccttgtataaat

SEQ ID NO: 770571 - DNA, 20 bp, Artificial
  CRISPR gRNA sequence
gtataaatgtgtaccaaaaa

SEQ ID NO: 770572 - DNA, 20 bp, Artificial
  CRISPR gRNA sequence
tataaatgtgtaccaaaaaa

SEQ ID NO: 770573 - DNA, 20 bp, Artificial
  CRISPR gRNA sequence
gtcatattctattttaatga

SEQ ID NO: 770574 - DNA, 20 bp, Artificial
  CRISPR gRNA sequence
tattttaatgatatatttgt

SEQ ID NO: 770575 - DNA, 20 bp, Artificial
  CRISPR gRNA sequence
ttttaatgatatatttgttt

SEQ ID NO: 770576 - DNA, 20 bp, Artificial
  CRISPR gRNA sequence
taatgatatatttgtttcct

SEQ ID NO: 770577 - DNA, 20 bp, Artificial
  CRISPR gRNA sequence
aatgatatatttgtttccta

SEQ ID NO: 770578 - DNA, 20 bp, Artificial
  CRISPR gRNA sequence
atgatatatttgtttcctaa

SEQ ID NO: 770579 - DNA, 20 bp, Artificial
  CRISPR gRNA sequence
gtttcctaaaccttttttct

SEQ ID NO: 770580 - DNA, 20 bp, Artificial
  CRISPR gRNA sequence
tttcctaaaccttttttcta

SEQ ID NO: 770581 - DNA, 20 bp, Artificial
  CRISPR gRNA sequence
cctaaaccttttttctattt

SEQ ID NO: 770582 - DNA, 20 bp, Artificial
  CRISPR gRNA sequence
ctaaaccttttttctatttt

SEQ ID NO: 770583 - DNA, 20 bp, Artificial
  CRISPR gRNA sequence
aaccttttttctatttttaa

SEQ ID NO: 770584 - DNA, 20 bp, Artificial
  CRISPR gRNA sequence
ttttctatttttaatatgaa

SEQ ID NO: 770585 - DNA, 20 bp, Artificial
  CRISPR gRNA sequence
tttctatttttaatatgaaa

SEQ ID NO: 770586 - DNA, 20 bp, Artificial
  CRISPR gRNA sequence
ttctatttttaatatgaaaa

SEQ ID NO: 770587 - DNA, 20 bp, Artificial
  CRISPR gRNA sequence
tctatttttaatatgaaaat

SEQ ID NO: 770588 - DNA, 20 bp, Artificial
  CRISPR gRNA sequence
ctatttttaatatgaaaatg

SEQ ID NO: 770589 - DNA, 20 bp, Artificial
  CRISPR gRNA sequence
tatttttaatatgaaaatgt

SEQ ID NO: 770590 - DNA, 20 bp, Artificial
  CRISPR gRNA sequence
tttttaatatgaaaatgtgg

SEQ ID NO: 770591 - DNA, 20 bp, Artificial
  CRISPR gRNA sequence
ttaatatgaaaatgtgggat

SEQ ID NO: 770592 - DNA, 20 bp, Artificial
  CRISPR gRNA sequence
taatatgaaaatgtgggatt

SEQ ID NO: 770593 - DNA, 20 bp, Artificial
  CRISPR gRNA sequence
aatatgaaaatgtgggattt

SEQ ID NO: 770594 - DNA, 20 bp, Artificial
  CRISPR gRNA sequence
atatgaaaatgtgggatttt

SEQ ID NO: 770595 - DNA, 20 bp, Artificial
  CRISPR gRNA sequence
taaatatgccatttagcagc

SEQ ID NO: 770596 - DNA, 20 bp, Artificial
  CRISPR gRNA sequence
aaatatgccatttagcagct

SEQ ID NO: 770597 - DNA, 20 bp, Artificial
  CRISPR gRNA sequence
aatatgccatttagcagctc

SEQ ID NO: 770598 - DNA, 20 bp, Artificial
  CRISPR gRNA sequence
agcagctctgtaatcttgag

SEQ ID NO: 770599 - DNA, 20 bp, Artificial
  CRISPR gRNA sequence
gcagctctgtaatcttgagc

SEQ ID NO: 770600 - DNA, 20 bp, Artificial
  CRISPR gRNA sequence
tgtaatcttgagcaagttat

SEQ ID NO: 770601 - DNA, 20 bp, Artificial
  CRISPR gRNA sequence
taatcttgagcaagttatta

SEQ ID NO: 770602 - DNA, 20 bp, Artificial
  CRISPR gRNA sequence
gagcaagttattaaatctct

SEQ ID NO: 770603 - DNA, 20 bp, Artificial
  CRISPR gRNA sequence
agcaagttattaaatctctc

SEQ ID NO: 770604 - DNA, 20 bp, Artificial
  CRISPR gRNA sequence
ttaaatctctccatccctga

SEQ ID NO: 770605 - DNA, 20 bp, Artificial
  CRISPR gRNA sequence
aatctctccatccctgaatt

SEQ ID NO: 770606 - DNA, 20 bp, Artificial
  CRISPR gRNA sequence
tccatccctgaatttactcc

SEQ ID NO: 770607 - DNA, 20 bp, Artificial
  CRISPR gRNA sequence
catccctgaatttactcctc

SEQ ID NO: 770608 - DNA, 20 bp, Artificial
  CRISPR gRNA sequence
aatttactcctcggtgaaat

SEQ ID NO: 770609 - DNA, 20 bp, Artificial
  CRISPR gRNA sequence
actcctcggtgaaataggat

SEQ ID NO: 770610 - DNA, 20 bp, Artificial
  CRISPR gRNA sequence
ctcctcggtgaaataggata

SEQ ID NO: 770611 - DNA, 20 bp, Artificial
  CRISPR gRNA sequence
ctcggtgaaataggataata

SEQ ID NO: 770612 - DNA, 20 bp, Artificial
  CRISPR gRNA sequence
ggtgaaataggataataata

SEQ ID NO: 770613 - DNA, 20 bp, Artificial
  CRISPR gRNA sequence
cttcacagaattgttgggaa

SEQ ID NO: 770614 - DNA, 20 bp, Artificial
  CRISPR gRNA sequence
cacagaattgttgggaagct

SEQ ID NO: 770615 - DNA, 20 bp, Artificial
  CRISPR gRNA sequence
acagaattgttgggaagctt

SEQ ID NO: 770616 - DNA, 20 bp, Artificial
  CRISPR gRNA sequence
ttgggaagcttaaatgagtt

SEQ ID NO: 770617 - DNA, 20 bp, Artificial
  CRISPR gRNA sequence
ggaagcttaaatgagttaat

SEQ ID NO: 770618 - DNA, 20 bp, Artificial
  CRISPR gRNA sequence
aaatgagttaatatgtgtaa

SEQ ID NO: 770619 - DNA, 20 bp, Artificial
  CRISPR gRNA sequence
aatgagttaatatgtgtaaa

SEQ ID NO: 770620 - DNA, 20 bp, Artificial
  CRISPR gRNA sequence
atatgtgtaaaagcatttag

SEQ ID NO: 770621 - DNA, 20 bp, Artificial
  CRISPR gRNA sequence
agaacagagcctggtgcatg

SEQ ID NO: 770622 - DNA, 20 bp, Artificial
  CRISPR gRNA sequence
gaacagagcctggtgcatgg

SEQ ID NO: 770623 - DNA, 20 bp, Artificial
  CRISPR gRNA sequence
gtgcatggctttcaacaaaa

SEQ ID NO: 770624 - DNA, 20 bp, Artificial
  CRISPR gRNA sequence
tcaacaaaactggcctatgt

SEQ ID NO: 770625 - DNA, 20 bp, Artificial
  CRISPR gRNA sequence
caacaaaactggcctatgtt

SEQ ID NO: 770626 - DNA, 20 bp, Artificial
  CRISPR gRNA sequence
aacaaaactggcctatgtta

SEQ ID NO: 770627 - DNA, 20 bp, Artificial
  CRISPR gRNA sequence
gcctatgttattattatttg

SEQ ID NO: 770628 - DNA, 20 bp, Artificial
  CRISPR gRNA sequence
tgttattattatttgataaa

SEQ ID NO: 770629 - DNA, 20 bp, Artificial
  CRISPR gRNA sequence
ttattatttgataaaagcaa

SEQ ID NO: 770630 - DNA, 20 bp, Artificial
  CRISPR gRNA sequence
ttatttgataaaagcaaaat

SEQ ID NO: 770631 - DNA, 20 bp, Artificial
  CRISPR gRNA sequence
tttgataaaagcaaaataat

SEQ ID NO: 770632 - DNA, 20 bp, Artificial
  CRISPR gRNA sequence
gataaaagcaaaataatata

SEQ ID NO: 770633 - DNA, 20 bp, Artificial
  CRISPR gRNA sequence
ataaaagcaaaataatatat

SEQ ID NO: 770634 - DNA, 20 bp, Artificial
  CRISPR gRNA sequence
ttgaagcataataataaaca

SEQ ID NO: 770635 - DNA, 20 bp, Artificial
  CRISPR gRNA sequence
tgaagcataataataaacat

SEQ ID NO: 770636 - DNA, 20 bp, Artificial
  CRISPR gRNA sequence
gaagcataataataaacata

SEQ ID NO: 770637 - DNA, 20 bp, Artificial
  CRISPR gRNA sequence
aagcataataataaacatac

SEQ ID NO: 770638 - DNA, 20 bp, Artificial
  CRISPR gRNA sequence
ccaacttgagaatgagaacc

SEQ ID NO: 770639 - DNA, 20 bp, Artificial
  CRISPR gRNA sequence
gagaatgagaacccctgtag

SEQ ID NO: 770640 - DNA, 20 bp, Artificial
  CRISPR gRNA sequence
agaatgagaacccctgtagt

SEQ ID NO: 770641 - DNA, 20 bp, Artificial
  CRISPR gRNA sequence
tagttgaatatttatatgta

SEQ ID NO: 770642 - DNA, 20 bp, Artificial
  CRISPR gRNA sequence
aatatttatatgtacgattc

SEQ ID NO: 770643 - DNA, 20 bp, Artificial
  CRISPR gRNA sequence
atatgtacgattcttcatct

SEQ ID NO: 770644 - DNA, 20 bp, Artificial
  CRISPR gRNA sequence
tatgtacgattcttcatctc

SEQ ID NO: 770645 - DNA, 20 bp, Artificial
  CRISPR gRNA sequence
ttcatctccattcatattgc

SEQ ID NO: 770646 - DNA, 20 bp, Artificial
  CRISPR gRNA sequence
catctccattcatattgcat

SEQ ID NO: 770647 - DNA, 20 bp, Artificial
  CRISPR gRNA sequence
atctccattcatattgcatg

SEQ ID NO: 770648 - DNA, 20 bp, Artificial
  CRISPR gRNA sequence
cattcatattgcatgcatgg

SEQ ID NO: 770649 - DNA, 20 bp, Artificial
  CRISPR gRNA sequence
atattgcatgcatggccaat

SEQ ID NO: 770650 - DNA, 20 bp, Artificial
  CRISPR gRNA sequence
catgcatggccaatgcctgg

SEQ ID NO: 770651 - DNA, 20 bp, Artificial
  CRISPR gRNA sequence
gcatgtggatcatgaataag

SEQ ID NO: 770652 - DNA, 20 bp, Artificial
  CRISPR gRNA sequence
gttgaatgaataaatgaaca

SEQ ID NO: 770653 - DNA, 20 bp, Artificial
  CRISPR gRNA sequence
ttgaatgaataaatgaacaa

SEQ ID NO: 770654 - DNA, 20 bp, Artificial
  CRISPR gRNA sequence
aatgaataaatgaacaaatg

SEQ ID NO: 770655 - DNA, 20 bp, Artificial
  CRISPR gRNA sequence
gagacagggaaataaccagt

SEQ ID NO: 770656 - DNA, 20 bp, Artificial
  CRISPR gRNA sequence
agacagggaaataaccagtt

SEQ ID NO: 770657 - DNA, 20 bp, Artificial
  CRISPR gRNA sequence
tatggggaagatggtagatt

SEQ ID NO: 770658 - DNA, 20 bp, Artificial
  CRISPR gRNA sequence
atggggaagatggtagatta

SEQ ID NO: 770659 - DNA, 20 bp, Artificial
  CRISPR gRNA sequence
tggggaagatggtagattat

SEQ ID NO: 770660 - DNA, 20 bp, Artificial
  CRISPR gRNA sequence
tgggaacaacagatcgataa

SEQ ID NO: 770661 - DNA, 20 bp, Artificial
  CRISPR gRNA sequence
gttcttaatccttgacaaag

SEQ ID NO: 770662 - DNA, 20 bp, Artificial
  CRISPR gRNA sequence
ttcttaatccttgacaaagt

SEQ ID NO: 770663 - DNA, 20 bp, Artificial
  CRISPR gRNA sequence
ttaatccttgacaaagtcct

SEQ ID NO: 770664 - DNA, 20 bp, Artificial
  CRISPR gRNA sequence
aatccttgacaaagtcctgg

SEQ ID NO: 770665 - DNA, 20 bp, Artificial
  CRISPR gRNA sequence
atccttgacaaagtcctgga

SEQ ID NO: 770666 - DNA, 20 bp, Artificial
  CRISPR gRNA sequence
gacaaagtcctggaaccaat

SEQ ID NO: 770667 - DNA, 20 bp, Artificial
  CRISPR gRNA sequence
acaaagtcctggaaccaatg

SEQ ID NO: 770668 - DNA, 20 bp, Artificial
  CRISPR gRNA sequence
gaaccaatgagcacttgaag

SEQ ID NO: 770669 - DNA, 20 bp, Artificial
  CRISPR gRNA sequence
gaagaagagcccactagtag

SEQ ID NO: 770670 - DNA, 20 bp, Artificial
  CRISPR gRNA sequence
aagaagagcccactagtagg

SEQ ID NO: 770671 - DNA, 20 bp, Artificial
  CRISPR gRNA sequence
gtaggcacttgcatggcttc

SEQ ID NO: 770672 - DNA, 20 bp, Artificial
  CRISPR gRNA sequence
gcatggcttcactggggttt

SEQ ID NO: 770673 - DNA, 20 bp, Artificial
  CRISPR gRNA sequence
catggcttcactggggtttt

SEQ ID NO: 770674 - DNA, 20 bp, Artificial
  CRISPR gRNA sequence
cactggggttttgaaaatgc

SEQ ID NO: 770675 - DNA, 20 bp, Artificial
  CRISPR gRNA sequence
actggggttttgaaaatgca

SEQ ID NO: 770676 - DNA, 20 bp, Artificial
  CRISPR gRNA sequence
gggttttgaaaatgcacttc

SEQ ID NO: 770677 - DNA, 20 bp, Artificial
  CRISPR gRNA sequence
tgaaaatgcacttcttttct

SEQ ID NO: 770678 - DNA, 20 bp, Artificial
  CRISPR gRNA sequence
gaaaatgcacttcttttctt

SEQ ID NO: 770679 - DNA, 20 bp, Artificial
  CRISPR gRNA sequence
aaaatgcacttcttttcttg

SEQ ID NO: 770680 - DNA, 20 bp, Artificial
  CRISPR gRNA sequence
cttttcttgttcttctccag

SEQ ID NO: 770681 - DNA, 20 bp, Artificial
  CRISPR gRNA sequence
ttttcttgttcttctccagt

SEQ ID NO: 770682 - DNA, 20 bp, Artificial
  CRISPR gRNA sequence
ttcttgttcttctccagttg

SEQ ID NO: 770683 - DNA, 20 bp, Artificial
  CRISPR gRNA sequence
tcttgttcttctccagttga

SEQ ID NO: 770684 - DNA, 20 bp, Artificial
  CRISPR gRNA sequence
cttgttcttctccagttgat

SEQ ID NO: 770685 - DNA, 20 bp, Artificial
  CRISPR gRNA sequence
ttgttcttctccagttgatt

SEQ ID NO: 770686 - DNA, 20 bp, Artificial
  CRISPR gRNA sequence
gttcttctccagttgattgg

SEQ ID NO: 770687 - DNA, 20 bp, Artificial
  CRISPR gRNA sequence
ttcttctccagttgattggt

SEQ ID NO: 770688 - DNA, 20 bp, Artificial
  CRISPR gRNA sequence
ttctccagttgattggtccc

SEQ ID NO: 770689 - DNA, 20 bp, Artificial
  CRISPR gRNA sequence
ctccagttgattggtcccca

SEQ ID NO: 770690 - DNA, 20 bp, Artificial
  CRISPR gRNA sequence
tccagttgattggtccccag

SEQ ID NO: 770691 - DNA, 20 bp, Artificial
  CRISPR gRNA sequence
cagttgattggtccccagcc

SEQ ID NO: 770692 - DNA, 20 bp, Artificial
  CRISPR gRNA sequence
attggtccccagccagaagc

SEQ ID NO: 770693 - DNA, 20 bp, Artificial
  CRISPR gRNA sequence
gtccccagccagaagcagtg

SEQ ID NO: 770694 - DNA, 20 bp, Artificial
  CRISPR gRNA sequence
ctcatgacagccctggggat

SEQ ID NO: 770695 - DNA, 20 bp, Artificial
  CRISPR gRNA sequence
tcatgacagccctggggatg

SEQ ID NO: 770696 - DNA, 20 bp, Artificial
  CRISPR gRNA sequence
atgacagccctggggatgag

SEQ ID NO: 770697 - DNA, 20 bp, Artificial
  CRISPR gRNA sequence
gggatgagatgggtagatgg

SEQ ID NO: 770698 - DNA, 20 bp, Artificial
  CRISPR gRNA sequence
ggtagcagcacaggtaggaa

SEQ ID NO: 770699 - DNA, 20 bp, Artificial
  CRISPR gRNA sequence
ctaaccccggtgtactgaat

SEQ ID NO: 770700 - DNA, 20 bp, Artificial
  CRISPR gRNA sequence
accccggtgtactgaatggt

SEQ ID NO: 770701 - DNA, 20 bp, Artificial
  CRISPR gRNA sequence
aatggtggatggacattgat

SEQ ID NO: 770702 - DNA, 20 bp, Artificial
  CRISPR gRNA sequence
atcatccagggacagatggt

SEQ ID NO: 770703 - DNA, 20 bp, Artificial
  CRISPR gRNA sequence
tgggctttcctattcctgtc

SEQ ID NO: 770704 - DNA, 20 bp, Artificial
  CRISPR gRNA sequence
tcctattcctgtcctctccc

SEQ ID NO: 770705 - DNA, 20 bp, Artificial
  CRISPR gRNA sequence
cctattcctgtcctctccct

SEQ ID NO: 770706 - DNA, 20 bp, Artificial
  CRISPR gRNA sequence
ctattcctgtcctctccctg

SEQ ID NO: 770707 - DNA, 20 bp, Artificial
  CRISPR gRNA sequence
ttcctgtcctctccctgagg

SEQ ID NO: 770708 - DNA, 20 bp, Artificial
  CRISPR gRNA sequence
ctgtcctctccctgaggacc

SEQ ID NO: 770709 - DNA, 20 bp, Artificial
  CRISPR gRNA sequence
tcctctccctgaggaccttg

SEQ ID NO: 770710 - DNA, 20 bp, Artificial
  CRISPR gRNA sequence
tccctgaggaccttgatgac

SEQ ID NO: 770711 - DNA, 20 bp, Artificial
  CRISPR gRNA sequence
cctgaggaccttgatgacac

SEQ ID NO: 770712 - DNA, 20 bp, Artificial
  CRISPR gRNA sequence
aggaccttgatgacacccag

SEQ ID NO: 770713 - DNA, 20 bp, Artificial
  CRISPR gRNA sequence
gatgacacccagacaccagc

SEQ ID NO: 770714 - DNA, 20 bp, Artificial
  CRISPR gRNA sequence
atgacacccagacaccagca

SEQ ID NO: 770715 - DNA, 20 bp, Artificial
  CRISPR gRNA sequence
ttcagatgatattcattcat

SEQ ID NO: 770716 - DNA, 20 bp, Artificial
  CRISPR gRNA sequence
tcagatgatattcattcatt

SEQ ID NO: 770717 - DNA, 20 bp, Artificial
  CRISPR gRNA sequence
cagatgatattcattcattc

SEQ ID NO: 770718 - DNA, 20 bp, Artificial
  CRISPR gRNA sequence
agatgatattcattcattct

SEQ ID NO: 770719 - DNA, 20 bp, Artificial
  CRISPR gRNA sequence
attcattctttttttaatcc

SEQ ID NO: 770720 - DNA, 20 bp, Artificial
  CRISPR gRNA sequence
attctttttttaatccacca

SEQ ID NO: 770721 - DNA, 20 bp, Artificial
  CRISPR gRNA sequence
tttttttaatccaccaacaa

SEQ ID NO: 770722 - DNA, 20 bp, Artificial
  CRISPR gRNA sequence
tttttaatccaccaacaaat

SEQ ID NO: 770723 - DNA, 20 bp, Artificial
  CRISPR gRNA sequence
ttttaatccaccaacaaatt

SEQ ID NO: 770724 - DNA, 20 bp, Artificial
  CRISPR gRNA sequence
tttaatccaccaacaaatta

SEQ ID NO: 770725 - DNA, 20 bp, Artificial
  CRISPR gRNA sequence
ttaatccaccaacaaattat

SEQ ID NO: 770726 - DNA, 20 bp, Artificial
  CRISPR gRNA sequence
taatccaccaacaaattatt

SEQ ID NO: 770727 - DNA, 20 bp, Artificial
  CRISPR gRNA sequence
aatccaccaacaaattattg

SEQ ID NO: 770728 - DNA, 20 bp, Artificial
  CRISPR gRNA sequence
atccaccaacaaattattga

SEQ ID NO: 770729 - DNA, 20 bp, Artificial
  CRISPR gRNA sequence
ttgagcattgtctatgcacc

SEQ ID NO: 770730 - DNA, 20 bp, Artificial
  CRISPR gRNA sequence
agcattgtctatgcaccaga

SEQ ID NO: 770731 - DNA, 20 bp, Artificial
  CRISPR gRNA sequence
tctatgcaccagaacagtca

SEQ ID NO: 770732 - DNA, 20 bp, Artificial
  CRISPR gRNA sequence
tgcaccagaacagtcaaaag

SEQ ID NO: 770733 - DNA, 20 bp, Artificial
  CRISPR gRNA sequence
caaaagatcacgacagggtt

SEQ ID NO: 770734 - DNA, 20 bp, Artificial
  CRISPR gRNA sequence
aaaagatcacgacagggtta

SEQ ID NO: 770735 - DNA, 20 bp, Artificial
  CRISPR gRNA sequence
cacagcattgtaaatatagt

SEQ ID NO: 770736 - DNA, 20 bp, Artificial
  CRISPR gRNA sequence
taaatatagttaatgctgcc

SEQ ID NO: 770737 - DNA, 20 bp, Artificial
  CRISPR gRNA sequence
atgctgccgacttatacact

SEQ ID NO: 770738 - DNA, 20 bp, Artificial
  CRISPR gRNA sequence
ccgacttatacacttaaacc

SEQ ID NO: 770739 - DNA, 20 bp, Artificial
  CRISPR gRNA sequence
atacacttaaacctggataa

SEQ ID NO: 770740 - DNA, 20 bp, Artificial
  CRISPR gRNA sequence
tacacttaaacctggataaa

SEQ ID NO: 770741 - DNA, 20 bp, Artificial
  CRISPR gRNA sequence
aaacctggataaaatggcca

SEQ ID NO: 770742 - DNA, 20 bp, Artificial
  CRISPR gRNA sequence
aacctggataaaatggccaa

SEQ ID NO: 770743 - DNA, 20 bp, Artificial
  CRISPR gRNA sequence
gataaaatggccaacttcat

SEQ ID NO: 770744 - DNA, 20 bp, Artificial
  CRISPR gRNA sequence
catgttatatatattttaca

SEQ ID NO: 770745 - DNA, 20 bp, Artificial
  CRISPR gRNA sequence
atgttatatatattttacaa

SEQ ID NO: 770746 - DNA, 20 bp, Artificial
  CRISPR gRNA sequence
tatatattttacaacaatga

SEQ ID NO: 770747 - DNA, 20 bp, Artificial
  CRISPR gRNA sequence
tacaacaatgaaaaaaatgt

SEQ ID NO: 770748 - DNA, 20 bp, Artificial
  CRISPR gRNA sequence
acaacaatgaaaaaaatgtt

SEQ ID NO: 770749 - DNA, 20 bp, Artificial
  CRISPR gRNA sequence
caacaatgaaaaaaatgttg

SEQ ID NO: 770750 - DNA, 20 bp, Artificial
  CRISPR gRNA sequence
tggcagttggaggaatggac

SEQ ID NO: 770751 - DNA, 20 bp, Artificial
  CRISPR gRNA sequence
gaggaatggactcagtttaa

SEQ ID NO: 770752 - DNA, 20 bp, Artificial
  CRISPR gRNA sequence
agtttaactgggtgaaatgg

SEQ ID NO: 770753 - DNA, 20 bp, Artificial
  CRISPR gRNA sequence
aactgggtgaaatggaatag

SEQ ID NO: 770754 - DNA, 20 bp, Artificial
  CRISPR gRNA sequence
actgggtgaaatggaatagt

SEQ ID NO: 770755 - DNA, 20 bp, Artificial
  CRISPR gRNA sequence
ggtgaaatggaatagtaaca

SEQ ID NO: 770756 - DNA, 20 bp, Artificial
  CRISPR gRNA sequence
taaaactcctccccattctg

SEQ ID NO: 770757 - DNA, 20 bp, Artificial
  CRISPR gRNA sequence
ctccccattctgaactccat

SEQ ID NO: 770758 - DNA, 20 bp, Artificial
  CRISPR gRNA sequence
cccattctgaactccatcag

SEQ ID NO: 770759 - DNA, 20 bp, Artificial
  CRISPR gRNA sequence
tgaactccatcagaagagga

SEQ ID NO: 770760 - DNA, 20 bp, Artificial
  CRISPR gRNA sequence
aactccatcagaagaggatg

SEQ ID NO: 770761 - DNA, 20 bp, Artificial
  CRISPR gRNA sequence
catcagaagaggatggcaga

SEQ ID NO: 770762 - DNA, 20 bp, Artificial
  CRISPR gRNA sequence
gcagcaatgagtgtgagtga

SEQ ID NO: 770763 - DNA, 20 bp, Artificial
  CRISPR gRNA sequence
ctgatggttggctacagatt

SEQ ID NO: 770764 - DNA, 20 bp, Artificial
  CRISPR gRNA sequence
tgatggttggctacagattt

SEQ ID NO: 770765 - DNA, 20 bp, Artificial
  CRISPR gRNA sequence
atggttggctacagatttga

SEQ ID NO: 770766 - DNA, 20 bp, Artificial
  CRISPR gRNA sequence
gctacagatttgatagtctg

SEQ ID NO: 770767 - DNA, 20 bp, Artificial
  CRISPR gRNA sequence
cagatttgatagtctgttat

SEQ ID NO: 770768 - DNA, 20 bp, Artificial
  CRISPR gRNA sequence
gatagtctgttattttgggt

SEQ ID NO: 770769 - DNA, 20 bp, Artificial
  CRISPR gRNA sequence
atagtctgttattttgggtt

SEQ ID NO: 770770 - DNA, 20 bp, Artificial
  CRISPR gRNA sequence
ttattttgggttattttggt

SEQ ID NO: 770771 - DNA, 20 bp, Artificial
  CRISPR gRNA sequence
ttttgggttattttggtgaa

SEQ ID NO: 770772 - DNA, 20 bp, Artificial
  CRISPR gRNA sequence
tgggttattttggtgaatgg

SEQ ID NO: 770773 - DNA, 20 bp, Artificial
  CRISPR gRNA sequence
gggttattttggtgaatggt

SEQ ID NO: 770774 - DNA, 20 bp, Artificial
  CRISPR gRNA sequence
ggttattttggtgaatggtg

SEQ ID NO: 770775 - DNA, 20 bp, Artificial
  CRISPR gRNA sequence
ttttggtgaatggtgtgaca

SEQ ID NO: 770776 - DNA, 20 bp, Artificial
  CRISPR gRNA sequence
tggtgaatggtgtgacatgg

SEQ ID NO: 770777 - DNA, 20 bp, Artificial
  CRISPR gRNA sequence
ggtgaatggtgtgacatggc

SEQ ID NO: 770778 - DNA, 20 bp, Artificial
  CRISPR gRNA sequence
gtgaatggtgtgacatggct

SEQ ID NO: 770779 - DNA, 20 bp, Artificial
  CRISPR gRNA sequence
ctcaatggtgacttcgtcaa

SEQ ID NO: 770780 - DNA, 20 bp, Artificial
  CRISPR gRNA sequence
aatggtgacttcgtcaagga

SEQ ID NO: 770781 - DNA, 20 bp, Artificial
  CRISPR gRNA sequence
cgtcaaggaagatcaaatac

SEQ ID NO: 770782 - DNA, 20 bp, Artificial
  CRISPR gRNA sequence
gtcaaggaagatcaaatact

SEQ ID NO: 770783 - DNA, 20 bp, Artificial
  CRISPR gRNA sequence
gcagggctttgataaggaag

SEQ ID NO: 770784 - DNA, 20 bp, Artificial
  CRISPR gRNA sequence
cagggctttgataaggaagg

SEQ ID NO: 770785 - DNA, 20 bp, Artificial
  CRISPR gRNA sequence
tgataaggaagggggcagac

SEQ ID NO: 770786 - DNA, 20 bp, Artificial
  CRISPR gRNA sequence
gataaggaagggggcagact

SEQ ID NO: 770787 - DNA, 20 bp, Artificial
  CRISPR gRNA sequence
ataaggaagggggcagactc

SEQ ID NO: 770788 - DNA, 20 bp, Artificial
  CRISPR gRNA sequence
attctgtgtggtccaagggg

SEQ ID NO: 770789 - DNA, 20 bp, Artificial
  CRISPR gRNA sequence
tgtgtggtccaaggggtcac

SEQ ID NO: 770790 - DNA, 20 bp, Artificial
  CRISPR gRNA sequence
tgtggtccaaggggtcacat

SEQ ID NO: 770791 - DNA, 20 bp, Artificial
  CRISPR gRNA sequence
ttgtgggctgtattgggaga

SEQ ID NO: 770792 - DNA, 20 bp, Artificial
  CRISPR gRNA sequence
tgggctgtattgggagacaa

SEQ ID NO: 770793 - DNA, 20 bp, Artificial
  CRISPR gRNA sequence
tattgggagacaaatttggg

SEQ ID NO: 770794 - DNA, 20 bp, Artificial
  CRISPR gRNA sequence
ggagacaaatttgggctaag

SEQ ID NO: 770795 - DNA, 20 bp, Artificial
  CRISPR gRNA sequence
gggctaagtataaggtagag

SEQ ID NO: 770796 - DNA, 20 bp, Artificial
  CRISPR gRNA sequence
ggctaagtataaggtagagc

SEQ ID NO: 770797 - DNA, 20 bp, Artificial
  CRISPR gRNA sequence
agtataaggtagagcttctc

SEQ ID NO: 770798 - DNA, 20 bp, Artificial
  CRISPR gRNA sequence
ctcaccgatgaacgctgtcc

SEQ ID NO: 770799 - DNA, 20 bp, Artificial
  CRISPR gRNA sequence
tcaccgatgaacgctgtcca

SEQ ID NO: 770800 - DNA, 20 bp, Artificial
  CRISPR gRNA sequence
accgatgaacgctgtccaaa

SEQ ID NO: 770801 - DNA, 20 bp, Artificial
  CRISPR gRNA sequence
tccaaaagcaagtggatagc

SEQ ID NO: 770802 - DNA, 20 bp, Artificial
  CRISPR gRNA sequence
tgtgtatgcggtgggtgggg

SEQ ID NO: 770803 - DNA, 20 bp, Artificial
  CRISPR gRNA sequence
cctgttctgatacttgatca

SEQ ID NO: 770804 - DNA, 20 bp, Artificial
  CRISPR gRNA sequence
ttctgatacttgatcattaa

SEQ ID NO: 770805 - DNA, 20 bp, Artificial
  CRISPR gRNA sequence
tgatacttgatcattaattt

SEQ ID NO: 770806 - DNA, 20 bp, Artificial
  CRISPR gRNA sequence
atacttgatcattaatttct

SEQ ID NO: 770807 - DNA, 20 bp, Artificial
  CRISPR gRNA sequence
gatcattaatttctgcagtt

SEQ ID NO: 770808 - DNA, 20 bp, Artificial
  CRISPR gRNA sequence
atcattaatttctgcagttt

SEQ ID NO: 770809 - DNA, 20 bp, Artificial
  CRISPR gRNA sequence
atttctgcagtttccccaga

SEQ ID NO: 770810 - DNA, 20 bp, Artificial
  CRISPR gRNA sequence
ctgcagtttccccagaattt

SEQ ID NO: 770811 - DNA, 20 bp, Artificial
  CRISPR gRNA sequence
tgcagtttccccagaatttg

SEQ ID NO: 770812 - DNA, 20 bp, Artificial
  CRISPR gRNA sequence
cagtttccccagaatttgtt

SEQ ID NO: 770813 - DNA, 20 bp, Artificial
  CRISPR gRNA sequence
ccccagaatttgttctcatg

SEQ ID NO: 770814 - DNA, 20 bp, Artificial
  CRISPR gRNA sequence
cccagaatttgttctcatgg

SEQ ID NO: 770815 - DNA, 20 bp, Artificial
  CRISPR gRNA sequence
gttctcatggcatcatctcc

SEQ ID NO: 770816 - DNA, 20 bp, Artificial
  CRISPR gRNA sequence
ttctcatggcatcatctccc

SEQ ID NO: 770817 - DNA, 20 bp, Artificial
  CRISPR gRNA sequence
tcatggcatcatctccctca

SEQ ID NO: 770818 - DNA, 20 bp, Artificial
  CRISPR gRNA sequence
atggcatcatctccctcagt

SEQ ID NO: 770819 - DNA, 20 bp, Artificial
  CRISPR gRNA sequence
cctcagtgaccccacctttg

SEQ ID NO: 770820 - DNA, 20 bp, Artificial
  CRISPR gRNA sequence
agtgaccccacctttggttc

SEQ ID NO: 770821 - DNA, 20 bp, Artificial
  CRISPR gRNA sequence
tggttctgtcaccaccactg

SEQ ID NO: 770822 - DNA, 20 bp, Artificial
  CRISPR gRNA sequence
ggttctgtcaccaccactgc

SEQ ID NO: 770823 - DNA, 20 bp, Artificial
  CRISPR gRNA sequence
gttctgtcaccaccactgca

SEQ ID NO: 770824 - DNA, 20 bp, Artificial
  CRISPR gRNA sequence
tgtcaccaccactgcacgaa

SEQ ID NO: 770825 - DNA, 20 bp, Artificial
  CRISPR gRNA sequence
tcaccaccactgcacgaatg

SEQ ID NO: 770826 - DNA, 20 bp, Artificial
  CRISPR gRNA sequence
cacgaatgactgccatgtcc

SEQ ID NO: 770827 - DNA, 20 bp, Artificial
  CRISPR gRNA sequence
ccatgtccctctgttctgag

SEQ ID NO: 770828 - DNA, 20 bp, Artificial
  CRISPR gRNA sequence
tgttctgagctgcagctcag

SEQ ID NO: 770829 - DNA, 20 bp, Artificial
  CRISPR gRNA sequence
ttctgagctgcagctcagtg

SEQ ID NO: 770830 - DNA, 20 bp, Artificial
  CRISPR gRNA sequence
tgagctgcagctcagtgtgt

SEQ ID NO: 770831 - DNA, 20 bp, Artificial
  CRISPR gRNA sequence
agctgcagctcagtgtgtct

SEQ ID NO: 770832 - DNA, 20 bp, Artificial
  CRISPR gRNA sequence
cagctcagtgtgtctgggag

SEQ ID NO: 770833 - DNA, 20 bp, Artificial
  CRISPR gRNA sequence
agtgtgtctgggagtccata

SEQ ID NO: 770834 - DNA, 20 bp, Artificial
  CRISPR gRNA sequence
ggagtccataggacattttg

SEQ ID NO: 770835 - DNA, 20 bp, Artificial
  CRISPR gRNA sequence
tggtgtggatgatccatagt

SEQ ID NO: 770836 - DNA, 20 bp, Artificial
  CRISPR gRNA sequence
ggtgtggatgatccatagtc

SEQ ID NO: 770837 - DNA, 20 bp, Artificial
  CRISPR gRNA sequence
gtgtggatgatccatagtcg

SEQ ID NO: 770838 - DNA, 20 bp, Artificial
  CRISPR gRNA sequence
agtaggaactgatcttcccc

SEQ ID NO: 770839 - DNA, 20 bp, Artificial
  CRISPR gRNA sequence
atcttccccctccacgtgct

SEQ ID NO: 770840 - DNA, 20 bp, Artificial
  CRISPR gRNA sequence
ccccctccacgtgcttcatc

SEQ ID NO: 770841 - DNA, 20 bp, Artificial
  CRISPR gRNA sequence
cccctccacgtgcttcatct

SEQ ID NO: 770842 - DNA, 20 bp, Artificial
  CRISPR gRNA sequence
cacgtgcttcatctccaggt

SEQ ID NO: 770843 - DNA, 20 bp, Artificial
  CRISPR gRNA sequence
catctccaggtctccttgtt

SEQ ID NO: 770844 - DNA, 20 bp, Artificial
  CRISPR gRNA sequence
atctccaggtctccttgtta

SEQ ID NO: 770845 - DNA, 20 bp, Artificial
  CRISPR gRNA sequence
caggtctccttgttatgtgt

SEQ ID NO: 770846 - DNA, 20 bp, Artificial
  CRISPR gRNA sequence
cttgttatgtgtgtccatgt

SEQ ID NO: 770847 - DNA, 20 bp, Artificial
  CRISPR gRNA sequence
gttatgtgtgtccatgtttg

SEQ ID NO: 770848 - DNA, 20 bp, Artificial
  CRISPR gRNA sequence
ttatgtgtgtccatgtttgc

SEQ ID NO: 770849 - DNA, 20 bp, Artificial
  CRISPR gRNA sequence
tgtgtgtccatgtttgccca

SEQ ID NO: 770850 - DNA, 20 bp, Artificial
  CRISPR gRNA sequence
gcccattgctcaagccttca

SEQ ID NO: 770851 - DNA, 20 bp, Artificial
  CRISPR gRNA sequence
cccattgctcaagccttcag

SEQ ID NO: 770852 - DNA, 20 bp, Artificial
  CRISPR gRNA sequence
ctcaagccttcagtgccctc

SEQ ID NO: 770853 - DNA, 20 bp, Artificial
  CRISPR gRNA sequence
aagccttcagtgccctcttg

SEQ ID NO: 770854 - DNA, 20 bp, Artificial
  CRISPR gRNA sequence
cagtgccctcttgacacctt

SEQ ID NO: 770855 - DNA, 20 bp, Artificial
  CRISPR gRNA sequence
agtgccctcttgacaccttc

SEQ ID NO: 770856 - DNA, 20 bp, Artificial
  CRISPR gRNA sequence
ttgacaccttcagcccctcc

SEQ ID NO: 770857 - DNA, 20 bp, Artificial
  CRISPR gRNA sequence
gacaccttcagcccctccct

SEQ ID NO: 770858 - DNA, 20 bp, Artificial
  CRISPR gRNA sequence
acaccttcagcccctccctc

SEQ ID NO: 770859 - DNA, 20 bp, Artificial
  CRISPR gRNA sequence
cagcccctccctcaatacaa

SEQ ID NO: 770860 - DNA, 20 bp, Artificial
  CRISPR gRNA sequence
agcccctccctcaatacaaa

SEQ ID NO: 770861 - DNA, 20 bp, Artificial
  CRISPR gRNA sequence
cctcaatacaaacagtcccc

SEQ ID NO: 770862 - DNA, 20 bp, Artificial
  CRISPR gRNA sequence
aatacaaacagtccccaagc

SEQ ID NO: 770863 - DNA, 20 bp, Artificial
  CRISPR gRNA sequence
gtcacttctacccttgacat

SEQ ID NO: 770864 - DNA, 20 bp, Artificial
  CRISPR gRNA sequence
ctacccttgacatttgtcca

SEQ ID NO: 770865 - DNA, 20 bp, Artificial
  CRISPR gRNA sequence
tacccttgacatttgtccaa

SEQ ID NO: 770866 - DNA, 20 bp, Artificial
  CRISPR gRNA sequence
cccttgacatttgtccaaag

SEQ ID NO: 770867 - DNA, 20 bp, Artificial
  CRISPR gRNA sequence
gacatttgtccaaagctggg

SEQ ID NO: 770868 - DNA, 20 bp, Artificial
  CRISPR gRNA sequence
acatttgtccaaagctgggc

SEQ ID NO: 770869 - DNA, 20 bp, Artificial
  CRISPR gRNA sequence
gtccaaagctgggctcaggc

SEQ ID NO: 770870 - DNA, 20 bp, Artificial
  CRISPR gRNA sequence
tccaaagctgggctcaggca

SEQ ID NO: 770871 - DNA, 20 bp, Artificial
  CRISPR gRNA sequence
ggctcaggcatcactcggtg

SEQ ID NO: 770872 - DNA, 20 bp, Artificial
  CRISPR gRNA sequence
aggcatcactcggtgactct

SEQ ID NO: 770873 - DNA, 20 bp, Artificial
  CRISPR gRNA sequence
ggtgactctgatgagatagt

SEQ ID NO: 770874 - DNA, 20 bp, Artificial
  CRISPR gRNA sequence
tgatgagatagtctcctgtt

SEQ ID NO: 770875 - DNA, 20 bp, Artificial
  CRISPR gRNA sequence
atgagatagtctcctgttcg

SEQ ID NO: 770876 - DNA, 20 bp, Artificial
  CRISPR gRNA sequence
ctgttcgtattttgagatac

SEQ ID NO: 770877 - DNA, 20 bp, Artificial
  CRISPR gRNA sequence
ttcgtattttgagataccta

SEQ ID NO: 770878 - DNA, 20 bp, Artificial
  CRISPR gRNA sequence
gtattttgagatacctattt

SEQ ID NO: 770879 - DNA, 20 bp, Artificial
  CRISPR gRNA sequence
tgagatacctattttagatg

SEQ ID NO: 770880 - DNA, 20 bp, Artificial
  CRISPR gRNA sequence
gagatacctattttagatgt

SEQ ID NO: 770881 - DNA, 20 bp, Artificial
  CRISPR gRNA sequence
agatacctattttagatgtg

SEQ ID NO: 770882 - DNA, 20 bp, Artificial
  CRISPR gRNA sequence
ttttagatgtggtttccttt

SEQ ID NO: 770883 - DNA, 20 bp, Artificial
  CRISPR gRNA sequence
tagatgtggtttccttttgt

SEQ ID NO: 770884 - DNA, 20 bp, Artificial
  CRISPR gRNA sequence
agatgtggtttccttttgtg

SEQ ID NO: 770885 - DNA, 20 bp, Artificial
  CRISPR gRNA sequence
gatgtggtttccttttgtgg

SEQ ID NO: 770886 - DNA, 20 bp, Artificial
  CRISPR gRNA sequence
ccttttgtggctctgagcag

SEQ ID NO: 770887 - DNA, 20 bp, Artificial
  CRISPR gRNA sequence
cttttgtggctctgagcagt

SEQ ID NO: 770888 - DNA, 20 bp, Artificial
  CRISPR gRNA sequence
ttgtggctctgagcagtggc

SEQ ID NO: 770889 - DNA, 20 bp, Artificial
  CRISPR gRNA sequence
tgtggctctgagcagtggca

SEQ ID NO: 770890 - DNA, 20 bp, Artificial
  CRISPR gRNA sequence
gtggctctgagcagtggcaa

SEQ ID NO: 770891 - DNA, 20 bp, Artificial
  CRISPR gRNA sequence
tggctctgagcagtggcaat

SEQ ID NO: 770892 - DNA, 20 bp, Artificial
  CRISPR gRNA sequence
tgagcagtggcaatgctcat

SEQ ID NO: 770893 - DNA, 20 bp, Artificial
  CRISPR gRNA sequence
agcagtggcaatgctcatcg

SEQ ID NO: 770894 - DNA, 20 bp, Artificial
  CRISPR gRNA sequence
atcgggtacggagacgggga

SEQ ID NO: 770895 - DNA, 20 bp, Artificial
  CRISPR gRNA sequence
cttagttagttcagatgctg

SEQ ID NO: 770896 - DNA, 20 bp, Artificial
  CRISPR gRNA sequence
agttagttcagatgctgtaa

SEQ ID NO: 770897 - DNA, 20 bp, Artificial
  CRISPR gRNA sequence
gttagttcagatgctgtaag

SEQ ID NO: 770898 - DNA, 20 bp, Artificial
  CRISPR gRNA sequence
gttcagatgctgtaagaaag

SEQ ID NO: 770899 - DNA, 20 bp, Artificial
  CRISPR gRNA sequence
agatgctgtaagaaaggccc

SEQ ID NO: 770900 - DNA, 20 bp, Artificial
  CRISPR gRNA sequence
taagaaaggcccaaaatagc

SEQ ID NO: 770901 - DNA, 20 bp, Artificial
  CRISPR gRNA sequence
atgctggaagagatgtttat

SEQ ID NO: 770902 - DNA, 20 bp, Artificial
  CRISPR gRNA sequence
tgctggaagagatgtttatt

SEQ ID NO: 770903 - DNA, 20 bp, Artificial
  CRISPR gRNA sequence
gaagagatgtttatttctca

SEQ ID NO: 770904 - DNA, 20 bp, Artificial
  CRISPR gRNA sequence
atttctcacccatgtgacca

SEQ ID NO: 770905 - DNA, 20 bp, Artificial
  CRISPR gRNA sequence
tttctcacccatgtgaccat

SEQ ID NO: 770906 - DNA, 20 bp, Artificial
  CRISPR gRNA sequence
ctcacccatgtgaccatctg

SEQ ID NO: 770907 - DNA, 20 bp, Artificial
  CRISPR gRNA sequence
tcacccatgtgaccatctgg

SEQ ID NO: 770908 - DNA, 20 bp, Artificial
  CRISPR gRNA sequence
acccatgtgaccatctgggt

SEQ ID NO: 770909 - DNA, 20 bp, Artificial
  CRISPR gRNA sequence
ggtatatccagggctgatac

SEQ ID NO: 770910 - DNA, 20 bp, Artificial
  CRISPR gRNA sequence
atactacagtccctcagggt

SEQ ID NO: 770911 - DNA, 20 bp, Artificial
  CRISPR gRNA sequence
cagtccctcagggttcttct

SEQ ID NO: 770912 - DNA, 20 bp, Artificial
  CRISPR gRNA sequence
agggttcttctgtctgctgc

SEQ ID NO: 770913 - DNA, 20 bp, Artificial
  CRISPR gRNA sequence
ttctgtctgctgctctgccg

SEQ ID NO: 770914 - DNA, 20 bp, Artificial
  CRISPR gRNA sequence
ctgtctgctgctctgccgtc

SEQ ID NO: 770915 - DNA, 20 bp, Artificial
  CRISPR gRNA sequence
tgtctgctgctctgccgtcc

SEQ ID NO: 770916 - DNA, 20 bp, Artificial
  CRISPR gRNA sequence
tctgctgctctgccgtcctc

SEQ ID NO: 770917 - DNA, 20 bp, Artificial
  CRISPR gRNA sequence
ctgctctgccgtcctcaggg

SEQ ID NO: 770918 - DNA, 20 bp, Artificial
  CRISPR gRNA sequence
ctctgccgtcctcagggtgt

SEQ ID NO: 770919 - DNA, 20 bp, Artificial
  CRISPR gRNA sequence
tgccgtcctcagggtgttgc

SEQ ID NO: 770920 - DNA, 20 bp, Artificial
  CRISPR gRNA sequence
ccgtcctcagggtgttgcct

SEQ ID NO: 770921 - DNA, 20 bp, Artificial
  CRISPR gRNA sequence
agggtgttgcctttggcagt

SEQ ID NO: 770922 - DNA, 20 bp, Artificial
  CRISPR gRNA sequence
cctttggcagtatgatcgcc

SEQ ID NO: 770923 - DNA, 20 bp, Artificial
  CRISPR gRNA sequence
tggcagtatgatcgccacac

SEQ ID NO: 770924 - DNA, 20 bp, Artificial
  CRISPR gRNA sequence
ggcagtatgatcgccacaca

SEQ ID NO: 770925 - DNA, 20 bp, Artificial
  CRISPR gRNA sequence
gcagtatgatcgccacacac

SEQ ID NO: 770926 - DNA, 20 bp, Artificial
  CRISPR gRNA sequence
tgttccagccagtgggaagg

SEQ ID NO: 770927 - DNA, 20 bp, Artificial
  CRISPR gRNA sequence
cagccagtgggaagggggag

SEQ ID NO: 770928 - DNA, 20 bp, Artificial
  CRISPR gRNA sequence
ctctctttcagggcatgacc

SEQ ID NO: 770929 - DNA, 20 bp, Artificial
  CRISPR gRNA sequence
tctctttcagggcatgaccc

SEQ ID NO: 770930 - DNA, 20 bp, Artificial
  CRISPR gRNA sequence
tctttcagggcatgacccag

SEQ ID NO: 770931 - DNA, 20 bp, Artificial
  CRISPR gRNA sequence
tttcagggcatgacccagaa

SEQ ID NO: 770932 - DNA, 20 bp, Artificial
  CRISPR gRNA sequence
tcagggcatgacccagaagc

SEQ ID NO: 770933 - DNA, 20 bp, Artificial
  CRISPR gRNA sequence
cagggcatgacccagaagct

SEQ ID NO: 770934 - DNA, 20 bp, Artificial
  CRISPR gRNA sequence
agggcatgacccagaagctg

SEQ ID NO: 770935 - DNA, 20 bp, Artificial
  CRISPR gRNA sequence
tacacatcagtgtacacatt

SEQ ID NO: 770936 - DNA, 20 bp, Artificial
  CRISPR gRNA sequence
catggccacactcagctgca

SEQ ID NO: 770937 - DNA, 20 bp, Artificial
  CRISPR gRNA sequence
agctgcaagtaaggctggga

SEQ ID NO: 770938 - DNA, 20 bp, Artificial
  CRISPR gRNA sequence
caagtaaggctgggatctgc

SEQ ID NO: 770939 - DNA, 20 bp, Artificial
  CRISPR gRNA sequence
ggatctgcagtcgttagctg

SEQ ID NO: 770940 - DNA, 20 bp, Artificial
  CRISPR gRNA sequence
cagtcgttagctgagtggcc

SEQ ID NO: 770941 - DNA, 20 bp, Artificial
  CRISPR gRNA sequence
gctgagtggccgtgtgccta

SEQ ID NO: 770942 - DNA, 20 bp, Artificial
  CRISPR gRNA sequence
agtggccgtgtgcctaacta

SEQ ID NO: 770943 - DNA, 20 bp, Artificial
  CRISPR gRNA sequence
actaaaaatgctatggaaga

SEQ ID NO: 770944 - DNA, 20 bp, Artificial
  CRISPR gRNA sequence
aaaatgctatggaagaaggg

SEQ ID NO: 770945 - DNA, 20 bp, Artificial
  CRISPR gRNA sequence
tggaagaaggggagagctgg

SEQ ID NO: 770946 - DNA, 20 bp, Artificial
  CRISPR gRNA sequence
ggtgtgctggcagcacctgt

SEQ ID NO: 770947 - DNA, 20 bp, Artificial
  CRISPR gRNA sequence
gcagcacctgtagtccctgt

SEQ ID NO: 770948 - DNA, 20 bp, Artificial
  CRISPR gRNA sequence
tagtccctgttactcgggag

SEQ ID NO: 770949 - DNA, 20 bp, Artificial
  CRISPR gRNA sequence
ttactcgggaggctgaggca

SEQ ID NO: 770950 - DNA, 20 bp, Artificial
  CRISPR gRNA sequence
ctcgggaggctgaggcagga

SEQ ID NO: 770951 - DNA, 20 bp, Artificial
  CRISPR gRNA sequence
gggaggctgaggcaggagga

SEQ ID NO: 770952 - DNA, 20 bp, Artificial
  CRISPR gRNA sequence
aggcaggaggatcacttgag

SEQ ID NO: 770953 - DNA, 20 bp, Artificial
  CRISPR gRNA sequence
gagcccaggagttacaaggg

SEQ ID NO: 770954 - DNA, 20 bp, Artificial
  CRISPR gRNA sequence
agcccaggagttacaagggt

SEQ ID NO: 770955 - DNA, 20 bp, Artificial
  CRISPR gRNA sequence
caagggtgcagtgggttctg

SEQ ID NO: 770956 - DNA, 20 bp, Artificial
  CRISPR gRNA sequence
tgattgcaccactgaactat

SEQ ID NO: 770957 - DNA, 20 bp, Artificial
  CRISPR gRNA sequence
attgcaccactgaactatga

SEQ ID NO: 770958 - DNA, 20 bp, Artificial
  CRISPR gRNA sequence
caccactgaactatgatggt

SEQ ID NO: 770959 - DNA, 20 bp, Artificial
  CRISPR gRNA sequence
aactatgatggtaccactcc

SEQ ID NO: 770960 - DNA, 20 bp, Artificial
  CRISPR gRNA sequence
tgatggtaccactccagcct

SEQ ID NO: 770961 - DNA, 20 bp, Artificial
  CRISPR gRNA sequence
cagcctgggtgacagagcgg

SEQ ID NO: 770962 - DNA, 20 bp, Artificial
  CRISPR gRNA sequence
ggtgacagagcgggaccctg

SEQ ID NO: 770963 - DNA, 20 bp, Artificial
  CRISPR gRNA sequence
tctcttaaaaagggagaaaa

SEQ ID NO: 770964 - DNA, 20 bp, Artificial
  CRISPR gRNA sequence
ttaaaaagggagaaaatggg

SEQ ID NO: 770965 - DNA, 20 bp, Artificial
  CRISPR gRNA sequence
aaaaagggagaaaatgggtg

SEQ ID NO: 770966 - DNA, 20 bp, Artificial
  CRISPR gRNA sequence
aaaagggagaaaatgggtgt

SEQ ID NO: 770967 - DNA, 20 bp, Artificial
  CRISPR gRNA sequence
gcagtttctgccacagtcac

SEQ ID NO: 770968 - DNA, 20 bp, Artificial
  CRISPR gRNA sequence
ctgccacagtcactttgtgc

SEQ ID NO: 770969 - DNA, 20 bp, Artificial
  CRISPR gRNA sequence
tgccacagtcactttgtgca

SEQ ID NO: 770970 - DNA, 20 bp, Artificial
  CRISPR gRNA sequence
ccacagtcactttgtgcatt

SEQ ID NO: 770971 - DNA, 20 bp, Artificial
  CRISPR gRNA sequence
tgtgcatttcagtgggaact

SEQ ID NO: 770972 - DNA, 20 bp, Artificial
  CRISPR gRNA sequence
gtgcatttcagtgggaactg

SEQ ID NO: 770973 - DNA, 20 bp, Artificial
  CRISPR gRNA sequence
tgcatttcagtgggaactgt

SEQ ID NO: 770974 - DNA, 20 bp, Artificial
  CRISPR gRNA sequence
cagtgggaactgtgtggctg

SEQ ID NO: 770975 - DNA, 20 bp, Artificial
  CRISPR gRNA sequence
agtgggaactgtgtggctgt

SEQ ID NO: 770976 - DNA, 20 bp, Artificial
  CRISPR gRNA sequence
tgtggctgtgaactggttaa

SEQ ID NO: 770977 - DNA, 20 bp, Artificial
  CRISPR gRNA sequence
tgaactggttaagccttaag

SEQ ID NO: 770978 - DNA, 20 bp, Artificial
  CRISPR gRNA sequence
gttaagccttaaggatatag

SEQ ID NO: 770979 - DNA, 20 bp, Artificial
  CRISPR gRNA sequence
agccttaaggatatagtccc

SEQ ID NO: 770980 - DNA, 20 bp, Artificial
  CRISPR gRNA sequence
aaggatatagtccctgaaag

SEQ ID NO: 770981 - DNA, 20 bp, Artificial
  CRISPR gRNA sequence
aggatatagtccctgaaagc

SEQ ID NO: 770982 - DNA, 20 bp, Artificial
  CRISPR gRNA sequence
aaagcttcaagtactgataa

SEQ ID NO: 770983 - DNA, 20 bp, Artificial
  CRISPR gRNA sequence
caagtactgataaagttcca

SEQ ID NO: 770984 - DNA, 20 bp, Artificial
  CRISPR gRNA sequence
aagtactgataaagttccac

SEQ ID NO: 770985 - DNA, 20 bp, Artificial
  CRISPR gRNA sequence
ataaagttccactagcatcc

SEQ ID NO: 770986 - DNA, 20 bp, Artificial
  CRISPR gRNA sequence
cactagcatccacaaagctt

SEQ ID NO: 770987 - DNA, 20 bp, Artificial
  CRISPR gRNA sequence
gcatccacaaagcttttctt

SEQ ID NO: 770988 - DNA, 20 bp, Artificial
  CRISPR gRNA sequence
ttcttttataggtaggaaca

SEQ ID NO: 770989 - DNA, 20 bp, Artificial
  CRISPR gRNA sequence
tcttttataggtaggaacac

SEQ ID NO: 770990 - DNA, 20 bp, Artificial
  CRISPR gRNA sequence
cttttataggtaggaacact

SEQ ID NO: 770991 - DNA, 20 bp, Artificial
  CRISPR gRNA sequence
ttttataggtaggaacactg

SEQ ID NO: 770992 - DNA, 20 bp, Artificial
  CRISPR gRNA sequence
ttataggtaggaacactgag

SEQ ID NO: 770993 - DNA, 20 bp, Artificial
  CRISPR gRNA sequence
tataggtaggaacactgagc

SEQ ID NO: 770994 - DNA, 20 bp, Artificial
  CRISPR gRNA sequence
ataggtaggaacactgagct

SEQ ID NO: 770995 - DNA, 20 bp, Artificial
  CRISPR gRNA sequence
taggtaggaacactgagctc

SEQ ID NO: 770996 - DNA, 20 bp, Artificial
  CRISPR gRNA sequence
agctcagagaagttgcctag

SEQ ID NO: 770997 - DNA, 20 bp, Artificial
  CRISPR gRNA sequence
agagaagttgcctagttaag

SEQ ID NO: 770998 - DNA, 20 bp, Artificial
  CRISPR gRNA sequence
cctagttaagattgcataac

SEQ ID NO: 770999 - DNA, 20 bp, Artificial
  CRISPR gRNA sequence
gttaagattgcataacaaag

SEQ ID NO: 771000 - DNA, 20 bp, Artificial
  CRISPR gRNA sequence
agattgcataacaaagtgtc

SEQ ID NO: 771001 - DNA, 20 bp, Artificial
  CRISPR gRNA sequence
cataacaaagtgtcagagct

SEQ ID NO: 771002 - DNA, 20 bp, Artificial
  CRISPR gRNA sequence
ggaccagaaccccacacttt

SEQ ID NO: 771003 - DNA, 20 bp, Artificial
  CRISPR gRNA sequence
tgggctcattttctagaatt

SEQ ID NO: 771004 - DNA, 20 bp, Artificial
  CRISPR gRNA sequence
gggctcattttctagaattc

SEQ ID NO: 771005 - DNA, 20 bp, Artificial
  CRISPR gRNA sequence
ggctcattttctagaattcc

SEQ ID NO: 771006 - DNA, 20 bp, Artificial
  CRISPR gRNA sequence
attttctagaattccagggt

SEQ ID NO: 771007 - DNA, 20 bp, Artificial
  CRISPR gRNA sequence
tctagaattccagggtgatc

SEQ ID NO: 771008 - DNA, 20 bp, Artificial
  CRISPR gRNA sequence
ctagaattccagggtgatct

SEQ ID NO: 771009 - DNA, 20 bp, Artificial
  CRISPR gRNA sequence
tagaattccagggtgatctg

SEQ ID NO: 771010 - DNA, 20 bp, Artificial
  CRISPR gRNA sequence
gaattccagggtgatctggc

SEQ ID NO: 771011 - DNA, 20 bp, Artificial
  CRISPR gRNA sequence
cagggtgatctggctgaggg

SEQ ID NO: 771012 - DNA, 20 bp, Artificial
  CRISPR gRNA sequence
gctgaggggcagacaggcag

SEQ ID NO: 771013 - DNA, 20 bp, Artificial
  CRISPR gRNA sequence
aggggcagacaggcagtgtc

SEQ ID NO: 771014 - DNA, 20 bp, Artificial
  CRISPR gRNA sequence
tggagttcaggaaagggtta

SEQ ID NO: 771015 - DNA, 20 bp, Artificial
  CRISPR gRNA sequence
gagttcaggaaagggttacc

SEQ ID NO: 771016 - DNA, 20 bp, Artificial
  CRISPR gRNA sequence
aggaaagggttacctttccc

SEQ ID NO: 771017 - DNA, 20 bp, Artificial
  CRISPR gRNA sequence
cctttcccagcgcggctacc

SEQ ID NO: 771018 - DNA, 20 bp, Artificial
  CRISPR gRNA sequence
tcccagcgcggctacctggg

SEQ ID NO: 771019 - DNA, 20 bp, Artificial
  CRISPR gRNA sequence
cccagcgcggctacctgggg

SEQ ID NO: 771020 - DNA, 20 bp, Artificial
  CRISPR gRNA sequence
ccagcgcggctacctgggga

SEQ ID NO: 771021 - DNA, 20 bp, Artificial
  CRISPR gRNA sequence
cctggggagctgctcatgac

SEQ ID NO: 771022 - DNA, 20 bp, Artificial
  CRISPR gRNA sequence
gggagctgctcatgactttt

SEQ ID NO: 771023 - DNA, 20 bp, Artificial
  CRISPR gRNA sequence
ctcatgacttttcagggatc

SEQ ID NO: 771024 - DNA, 20 bp, Artificial
  CRISPR gRNA sequence
atgacttttcagggatcatc

SEQ ID NO: 771025 - DNA, 20 bp, Artificial
  CRISPR gRNA sequence
ttcagggatcatctctgggg

SEQ ID NO: 771026 - DNA, 20 bp, Artificial
  CRISPR gRNA sequence
tcagggatcatctctggggt

SEQ ID NO: 771027 - DNA, 20 bp, Artificial
  CRISPR gRNA sequence
cagggatcatctctggggtt

SEQ ID NO: 771028 - DNA, 20 bp, Artificial
  CRISPR gRNA sequence
agggatcatctctggggtta

SEQ ID NO: 771029 - DNA, 20 bp, Artificial
  CRISPR gRNA sequence
tggggttatcatgcctctga

SEQ ID NO: 771030 - DNA, 20 bp, Artificial
  CRISPR gRNA sequence
gggttatcatgcctctgagg

SEQ ID NO: 771031 - DNA, 20 bp, Artificial
  CRISPR gRNA sequence
tcatgcctctgaggtgcctc

SEQ ID NO: 771032 - DNA, 20 bp, Artificial
  CRISPR gRNA sequence
tgaggtgcctccaattcgcc

SEQ ID NO: 771033 - DNA, 20 bp, Artificial
  CRISPR gRNA sequence
aggtgcctccaattcgccct

SEQ ID NO: 771034 - DNA, 20 bp, Artificial
  CRISPR gRNA sequence
caattcgccctgaccatatc

SEQ ID NO: 771035 - DNA, 20 bp, Artificial
  CRISPR gRNA sequence
gccctgaccatatcataaat

SEQ ID NO: 771036 - DNA, 20 bp, Artificial
  CRISPR gRNA sequence
accatatcataaatagtata

SEQ ID NO: 771037 - DNA, 20 bp, Artificial
  CRISPR gRNA sequence
taccaaactgcagtgatcta

SEQ ID NO: 771038 - DNA, 20 bp, Artificial
  CRISPR gRNA sequence
cagtgatctaactgcatgtc

SEQ ID NO: 771039 - DNA, 20 bp, Artificial
  CRISPR gRNA sequence
actgcatgtcccccttccct

SEQ ID NO: 771040 - DNA, 20 bp, Artificial
  CRISPR gRNA sequence
catgtcccccttccctatta

SEQ ID NO: 771041 - DNA, 20 bp, Artificial
  CRISPR gRNA sequence
ccctattagaatctgctcct

SEQ ID NO: 771042 - DNA, 20 bp, Artificial
  CRISPR gRNA sequence
cctattagaatctgctcctt

SEQ ID NO: 771043 - DNA, 20 bp, Artificial
  CRISPR gRNA sequence
ttagaatctgctccttgagg

SEQ ID NO: 771044 - DNA, 20 bp, Artificial
  CRISPR gRNA sequence
gaatctgctccttgaggaca

SEQ ID NO: 771045 - DNA, 20 bp, Artificial
  CRISPR gRNA sequence
ctccttgaggacagacgtgt

SEQ ID NO: 771046 - DNA, 20 bp, Artificial
  CRISPR gRNA sequence
cttgaggacagacgtgtacc

SEQ ID NO: 771047 - DNA, 20 bp, Artificial
  CRISPR gRNA sequence
gaggacagacgtgtacctta

SEQ ID NO: 771048 - DNA, 20 bp, Artificial
  CRISPR gRNA sequence
aggacagacgtgtaccttag

SEQ ID NO: 771049 - DNA, 20 bp, Artificial
  CRISPR gRNA sequence
agttatctctctgcccctag

SEQ ID NO: 771050 - DNA, 20 bp, Artificial
  CRISPR gRNA sequence
gttatctctctgcccctagt

SEQ ID NO: 771051 - DNA, 20 bp, Artificial
  CRISPR gRNA sequence
tctctctgcccctagtacgt

SEQ ID NO: 771052 - DNA, 20 bp, Artificial
  CRISPR gRNA sequence
tctgcccctagtacgtccct

SEQ ID NO: 771053 - DNA, 20 bp, Artificial
  CRISPR gRNA sequence
tgcccctagtacgtccctac

SEQ ID NO: 771054 - DNA, 20 bp, Artificial
  CRISPR gRNA sequence
cccctagtacgtccctacca

SEQ ID NO: 771055 - DNA, 20 bp, Artificial
  CRISPR gRNA sequence
gtacgtccctaccaggaact

SEQ ID NO: 771056 - DNA, 20 bp, Artificial
  CRISPR gRNA sequence
ccaggaactccgtaagtagt

SEQ ID NO: 771057 - DNA, 20 bp, Artificial
  CRISPR gRNA sequence
cgtaagtagtgaaatgaatt

SEQ ID NO: 771058 - DNA, 20 bp, Artificial
  CRISPR gRNA sequence
ctaaagacatgaatgcatgt

SEQ ID NO: 771059 - DNA, 20 bp, Artificial
  CRISPR gRNA sequence
aagacatgaatgcatgtgga

SEQ ID NO: 771060 - DNA, 20 bp, Artificial
  CRISPR gRNA sequence
aaggactccttcggttgcag

SEQ ID NO: 771061 - DNA, 20 bp, Artificial
  CRISPR gRNA sequence
cttcggttgcagacaataga

SEQ ID NO: 771062 - DNA, 20 bp, Artificial
  CRISPR gRNA sequence
cggttgcagacaatagaaac

SEQ ID NO: 771063 - DNA, 20 bp, Artificial
  CRISPR gRNA sequence
ggttgcagacaatagaaact

SEQ ID NO: 771064 - DNA, 20 bp, Artificial
  CRISPR gRNA sequence
cagacaatagaaacttagtt

SEQ ID NO: 771065 - DNA, 20 bp, Artificial
  CRISPR gRNA sequence
agttcaaactggtttaaggg

SEQ ID NO: 771066 - DNA, 20 bp, Artificial
  CRISPR gRNA sequence
gttcaaactggtttaaggga

SEQ ID NO: 771067 - DNA, 20 bp, Artificial
  CRISPR gRNA sequence
aaactggtttaagggaaaaa

SEQ ID NO: 771068 - DNA, 20 bp, Artificial
  CRISPR gRNA sequence
gtttaagggaaaaaaaatga

SEQ ID NO: 771069 - DNA, 20 bp, Artificial
  CRISPR gRNA sequence
aagggaaaaaaaatgattgg

SEQ ID NO: 771070 - DNA, 20 bp, Artificial
  CRISPR gRNA sequence
agggaaaaaaaatgattggc

SEQ ID NO: 771071 - DNA, 20 bp, Artificial
  CRISPR gRNA sequence
gctcaaatatctgggcggtc

SEQ ID NO: 771072 - DNA, 20 bp, Artificial
  CRISPR gRNA sequence
aaatatctgggcggtctagg

SEQ ID NO: 771073 - DNA, 20 bp, Artificial
  CRISPR gRNA sequence
ggcggtctaggtctgcagct

SEQ ID NO: 771074 - DNA, 20 bp, Artificial
  CRISPR gRNA sequence
ggtctgcagcttgcttcagg

SEQ ID NO: 771075 - DNA, 20 bp, Artificial
  CRISPR gRNA sequence
cagcttgcttcaggcatagc

SEQ ID NO: 771076 - DNA, 20 bp, Artificial
  CRISPR gRNA sequence
gcttcaggcatagctggatc

SEQ ID NO: 771077 - DNA, 20 bp, Artificial
  CRISPR gRNA sequence
cttcaggcatagctggatcc

SEQ ID NO: 771078 - DNA, 20 bp, Artificial
  CRISPR gRNA sequence
caggcatagctggatccagg

SEQ ID NO: 771079 - DNA, 20 bp, Artificial
  CRISPR gRNA sequence
aggcatagctggatccaggg

SEQ ID NO: 771080 - DNA, 20 bp, Artificial
  CRISPR gRNA sequence
gatccagggacttgtctgac

SEQ ID NO: 771081 - DNA, 20 bp, Artificial
  CRISPR gRNA sequence
gtctgacattttcagaactt

SEQ ID NO: 771082 - DNA, 20 bp, Artificial
  CRISPR gRNA sequence
tctgacattttcagaacttt

SEQ ID NO: 771083 - DNA, 20 bp, Artificial
  CRISPR gRNA sequence
acattttcagaactttgtgt

SEQ ID NO: 771084 - DNA, 20 bp, Artificial
  CRISPR gRNA sequence
tcagaactttgtgtctttct

SEQ ID NO: 771085 - DNA, 20 bp, Artificial
  CRISPR gRNA sequence
cagaactttgtgtctttctg

SEQ ID NO: 771086 - DNA, 20 bp, Artificial
  CRISPR gRNA sequence
agaactttgtgtctttctga

SEQ ID NO: 771087 - DNA, 20 bp, Artificial
  CRISPR gRNA sequence
tgtgtctttctgaccctttt

SEQ ID NO: 771088 - DNA, 20 bp, Artificial
  CRISPR gRNA sequence
gtgtctttctgacccttttt

SEQ ID NO: 771089 - DNA, 20 bp, Artificial
  CRISPR gRNA sequence
tgtctttctgaccctttttg

SEQ ID NO: 771090 - DNA, 20 bp, Artificial
  CRISPR gRNA sequence
tctgaccctttttgtccctt

SEQ ID NO: 771091 - DNA, 20 bp, Artificial
  CRISPR gRNA sequence
ctgaccctttttgtcccttt

SEQ ID NO: 771092 - DNA, 20 bp, Artificial
  CRISPR gRNA sequence
tgaccctttttgtccctttg

SEQ ID NO: 771093 - DNA, 20 bp, Artificial
  CRISPR gRNA sequence
accctttttgtccctttgtg

SEQ ID NO: 771094 - DNA, 20 bp, Artificial
  CRISPR gRNA sequence
tttgtccctttgtgggaagt

SEQ ID NO: 771095 - DNA, 20 bp, Artificial
  CRISPR gRNA sequence
ttgtccctttgtgggaagtg

SEQ ID NO: 771096 - DNA, 20 bp, Artificial
  CRISPR gRNA sequence
tgtccctttgtgggaagtgt

SEQ ID NO: 771097 - DNA, 20 bp, Artificial
  CRISPR gRNA sequence
gtccctttgtgggaagtgtt

SEQ ID NO: 771098 - DNA, 20 bp, Artificial
  CRISPR gRNA sequence
tccctttgtgggaagtgttg

SEQ ID NO: 771099 - DNA, 20 bp, Artificial
  CRISPR gRNA sequence
tgtgggaagtgttgcccaag

SEQ ID NO: 771100 - DNA, 20 bp, Artificial
  CRISPR gRNA sequence
gtgggaagtgttgcccaagg

SEQ ID NO: 771101 - DNA, 20 bp, Artificial
  CRISPR gRNA sequence
tgggaagtgttgcccaagga

SEQ ID NO: 771102 - DNA, 20 bp, Artificial
  CRISPR gRNA sequence
cccaaggagcccctgcgggg

SEQ ID NO: 771103 - DNA, 20 bp, Artificial
  CRISPR gRNA sequence
cggggattgggaggaagtag

SEQ ID NO: 771104 - DNA, 20 bp, Artificial
  CRISPR gRNA sequence
ggaggaagtagggggttagg

SEQ ID NO: 771105 - DNA, 20 bp, Artificial
  CRISPR gRNA sequence
ggaggaagtggagtgatgtg

SEQ ID NO: 771106 - DNA, 20 bp, Artificial
  CRISPR gRNA sequence
tggtggggggcaaggagacc

SEQ ID NO: 771107 - DNA, 20 bp, Artificial
  CRISPR gRNA sequence
ttgggcatccccaggcccag

SEQ ID NO: 771108 - DNA, 20 bp, Artificial
  CRISPR gRNA sequence
gggcatccccaggcccaggg

SEQ ID NO: 771109 - DNA, 20 bp, Artificial
  CRISPR gRNA sequence
ggcatccccaggcccagggc

SEQ ID NO: 771110 - DNA, 20 bp, Artificial
  CRISPR gRNA sequence
tggccctgagcccaggtgca

SEQ ID NO: 771111 - DNA, 20 bp, Artificial
  CRISPR gRNA sequence
ggccctgagcccaggtgcag

SEQ ID NO: 771112 - DNA, 20 bp, Artificial
  CRISPR gRNA sequence
gccctgagcccaggtgcagt

SEQ ID NO: 771113 - DNA, 20 bp, Artificial
  CRISPR gRNA sequence
agcccaggtgcagtctggat

SEQ ID NO: 771114 - DNA, 20 bp, Artificial
  CRISPR gRNA sequence
gatttgttgtagctttctga

SEQ ID NO: 771115 - DNA, 20 bp, Artificial
  CRISPR gRNA sequence
gttgtagctttctgagggca

SEQ ID NO: 771116 - DNA, 20 bp, Artificial
  CRISPR gRNA sequence
ttgtagctttctgagggcac

SEQ ID NO: 771117 - DNA, 20 bp, Artificial
  CRISPR gRNA sequence
tagctttctgagggcacatc

SEQ ID NO: 771118 - DNA, 20 bp, Artificial
  CRISPR gRNA sequence
tctgagggcacatcttgggt

SEQ ID NO: 771119 - DNA, 20 bp, Artificial
  CRISPR gRNA sequence
ctgagggcacatcttgggtc

SEQ ID NO: 771120 - DNA, 20 bp, Artificial
  CRISPR gRNA sequence
tgagggcacatcttgggtca

SEQ ID NO: 771121 - DNA, 20 bp, Artificial
  CRISPR gRNA sequence
agggcacatcttgggtcatc

SEQ ID NO: 771122 - DNA, 20 bp, Artificial
  CRISPR gRNA sequence
gggtcatctcttgggagcct

SEQ ID NO: 771123 - DNA, 20 bp, Artificial
  CRISPR gRNA sequence
ggtcatctcttgggagcctc

SEQ ID NO: 771124 - DNA, 20 bp, Artificial
  CRISPR gRNA sequence
ttgggagcctccctgtggcc

SEQ ID NO: 771125 - DNA, 20 bp, Artificial
  CRISPR gRNA sequence
gggagcctccctgtggccct

SEQ ID NO: 771126 - DNA, 20 bp, Artificial
  CRISPR gRNA sequence
ggagcctccctgtggccctg

SEQ ID NO: 771127 - DNA, 20 bp, Artificial
  CRISPR gRNA sequence
cctgtggccctgcttctgca

SEQ ID NO: 771128 - DNA, 20 bp, Artificial
  CRISPR gRNA sequence
tggccctgcttctgcagggt

SEQ ID NO: 771129 - DNA, 20 bp, Artificial
  CRISPR gRNA sequence
cttctgcagggttggatgcc

SEQ ID NO: 771130 - DNA, 20 bp, Artificial
  CRISPR gRNA sequence
ctgcagggttggatgccctt

SEQ ID NO: 771131 - DNA, 20 bp, Artificial
  CRISPR gRNA sequence
tgcagggttggatgcccttg

SEQ ID NO: 771132 - DNA, 20 bp, Artificial
  CRISPR gRNA sequence
cagggttggatgcccttgct

SEQ ID NO: 771133 - DNA, 20 bp, Artificial
  CRISPR gRNA sequence
gatgcccttgctgtacctta

SEQ ID NO: 771134 - DNA, 20 bp, Artificial
  CRISPR gRNA sequence
gctgtaccttaggctgagga

SEQ ID NO: 771135 - DNA, 20 bp, Artificial
  CRISPR gRNA sequence
ctgtaccttaggctgaggac

SEQ ID NO: 771136 - DNA, 20 bp, Artificial
  CRISPR gRNA sequence
taccttaggctgaggacagc

SEQ ID NO: 771137 - DNA, 20 bp, Artificial
  CRISPR gRNA sequence
aggctgaggacagcctgacc

SEQ ID NO: 771138 - DNA, 20 bp, Artificial
  CRISPR gRNA sequence
ggctgaggacagcctgaccc

SEQ ID NO: 771139 - DNA, 20 bp, Artificial
  CRISPR gRNA sequence
aggacagcctgacccctctc

SEQ ID NO: 771140 - DNA, 20 bp, Artificial
  CRISPR gRNA sequence
acccctctctcctgctgctc

SEQ ID NO: 771141 - DNA, 20 bp, Artificial
  CRISPR gRNA sequence
tctcctgctgctctgtgaaa

SEQ ID NO: 771142 - DNA, 20 bp, Artificial
  CRISPR gRNA sequence
tcctgctgctctgtgaaagc

SEQ ID NO: 771143 - DNA, 20 bp, Artificial
  CRISPR gRNA sequence
ctgctgctctgtgaaagccg

SEQ ID NO: 771144 - DNA, 20 bp, Artificial
  CRISPR gRNA sequence
ctgctctgtgaaagccgaag

SEQ ID NO: 771145 - DNA, 20 bp, Artificial
  CRISPR gRNA sequence
ctctgtgaaagccgaaggtg

SEQ ID NO: 771146 - DNA, 20 bp, Artificial
  CRISPR gRNA sequence
tgtgaaagccgaaggtgctc

SEQ ID NO: 771147 - DNA, 20 bp, Artificial
  CRISPR gRNA sequence
tgaaagccgaaggtgctctg

SEQ ID NO: 771148 - DNA, 20 bp, Artificial
  CRISPR gRNA sequence
tgtggttttgggatagagca

SEQ ID NO: 771149 - DNA, 20 bp, Artificial
  CRISPR gRNA sequence
tggttttgggatagagcagg

SEQ ID NO: 771150 - DNA, 20 bp, Artificial
  CRISPR gRNA sequence
tgggatagagcaggaaggag

SEQ ID NO: 771151 - DNA, 20 bp, Artificial
  CRISPR gRNA sequence
gggatagagcaggaaggaga

SEQ ID NO: 771152 - DNA, 20 bp, Artificial
  CRISPR gRNA sequence
ggatagagcaggaaggagaa

SEQ ID NO: 771153 - DNA, 20 bp, Artificial
  CRISPR gRNA sequence
gcaggtgactcaccgggacg

SEQ ID NO: 771154 - DNA, 20 bp, Artificial
  CRISPR gRNA sequence
accgggacgggtggcacatg

SEQ ID NO: 771155 - DNA, 20 bp, Artificial
  CRISPR gRNA sequence
actccagggcaggtcccggc

SEQ ID NO: 771156 - DNA, 20 bp, Artificial
  CRISPR gRNA sequence
cagggcaggtcccggctggg

SEQ ID NO: 771157 - DNA, 20 bp, Artificial
  CRISPR gRNA sequence
gggatgagattcccctttgt

SEQ ID NO: 771158 - DNA, 20 bp, Artificial
  CRISPR gRNA sequence
ccctttgtggaaaacatggg

SEQ ID NO: 771159 - DNA, 20 bp, Artificial
  CRISPR gRNA sequence
tgtggaaaacatgggtggag

SEQ ID NO: 771160 - DNA, 20 bp, Artificial
  CRISPR gRNA sequence
gtggaaaacatgggtggagg

SEQ ID NO: 771161 - DNA, 20 bp, Artificial
  CRISPR gRNA sequence
tggaaaacatgggtggaggg

SEQ ID NO: 771162 - DNA, 20 bp, Artificial
  CRISPR gRNA sequence
cgtggctccacgtggctctg

SEQ ID NO: 771163 - DNA, 20 bp, Artificial
  CRISPR gRNA sequence
cacgtggctctgggtcccgg

SEQ ID NO: 771164 - DNA, 20 bp, Artificial
  CRISPR gRNA sequence
tgggtcccgggccgaccagc

SEQ ID NO: 771165 - DNA, 20 bp, Artificial
  CRISPR gRNA sequence
ggtcccgggccgaccagctc

SEQ ID NO: 771166 - DNA, 20 bp, Artificial
  CRISPR gRNA sequence
tgtgttcacaggacactctc

SEQ ID NO: 771167 - DNA, 20 bp, Artificial
  CRISPR gRNA sequence
tgttcacaggacactctccc

SEQ ID NO: 771168 - DNA, 20 bp, Artificial
  CRISPR gRNA sequence
acaggacactctcccattct

SEQ ID NO: 771169 - DNA, 20 bp, Artificial
  CRISPR gRNA sequence
tcccattctccagggagcac

SEQ ID NO: 771170 - DNA, 20 bp, Artificial
  CRISPR gRNA sequence
ccattctccagggagcactt

SEQ ID NO: 771171 - DNA, 20 bp, Artificial
  CRISPR gRNA sequence
tccagggagcacttcctttc

SEQ ID NO: 771172 - DNA, 20 bp, Artificial
  CRISPR gRNA sequence
cagggagcacttcctttctg

SEQ ID NO: 771173 - DNA, 20 bp, Artificial
  CRISPR gRNA sequence
cctttctgagctctgtctct

SEQ ID NO: 771174 - DNA, 20 bp, Artificial
  CRISPR gRNA sequence
ctttctgagctctgtctctt

SEQ ID NO: 771175 - DNA, 20 bp, Artificial
  CRISPR gRNA sequence
tctgagctctgtctctttct

SEQ ID NO: 771176 - DNA, 20 bp, Artificial
  CRISPR gRNA sequence
ctgagctctgtctctttctc

SEQ ID NO: 771177 - DNA, 20 bp, Artificial
  CRISPR gRNA sequence
tgagctctgtctctttctcc

SEQ ID NO: 771178 - DNA, 20 bp, Artificial
  CRISPR gRNA sequence
agctctgtctctttctcctg

SEQ ID NO: 771179 - DNA, 20 bp, Artificial
  CRISPR gRNA sequence
tgtctctttctcctgtcctc

SEQ ID NO: 771180 - DNA, 20 bp, Artificial
  CRISPR gRNA sequence
tctctttctcctgtcctcag

SEQ ID NO: 771181 - DNA, 20 bp, Artificial
  CRISPR gRNA sequence
tttctcctgtcctcagctcc

SEQ ID NO: 771182 - DNA, 20 bp, Artificial
  CRISPR gRNA sequence
tctcctgtcctcagctcctc

SEQ ID NO: 771183 - DNA, 20 bp, Artificial
  CRISPR gRNA sequence
ctcctgtcctcagctcctcc

SEQ ID NO: 771184 - DNA, 20 bp, Artificial
  CRISPR gRNA sequence
tcctgtcctcagctcctcca

SEQ ID NO: 771185 - DNA, 20 bp, Artificial
  CRISPR gRNA sequence
ctgtcctcagctcctccagg

SEQ ID NO: 771186 - DNA, 20 bp, Artificial
  CRISPR gRNA sequence
tcctcagctcctccaggccc

SEQ ID NO: 771187 - DNA, 20 bp, Artificial
  CRISPR gRNA sequence
agctcctccaggcccagctg

SEQ ID NO: 771188 - DNA, 20 bp, Artificial
  CRISPR gRNA sequence
ctccaggcccagctgtcagc

SEQ ID NO: 771189 - DNA, 20 bp, Artificial
  CRISPR gRNA sequence
caggcccagctgtcagcgta

SEQ ID NO: 771190 - DNA, 20 bp, Artificial
  CRISPR gRNA sequence
tcagcgtaggggtctctggg

SEQ ID NO: 771191 - DNA, 20 bp, Artificial
  CRISPR gRNA sequence
tgggtgccgtggactcttct

SEQ ID NO: 771192 - DNA, 20 bp, Artificial
  CRISPR gRNA sequence
ggtgccgtggactcttctgg

SEQ ID NO: 771193 - DNA, 20 bp, Artificial
  CRISPR gRNA sequence
ttctggtctctttgcttctg

SEQ ID NO: 771194 - DNA, 20 bp, Artificial
  CRISPR gRNA sequence
ctggtctctttgcttctggg

SEQ ID NO: 771195 - DNA, 20 bp, Artificial
  CRISPR gRNA sequence
tggtctctttgcttctgggc

SEQ ID NO: 771196 - DNA, 20 bp, Artificial
  CRISPR gRNA sequence
gtctctttgcttctgggctg

SEQ ID NO: 771197 - DNA, 20 bp, Artificial
  CRISPR gRNA sequence
tttgcttctgggctgtcaaa

SEQ ID NO: 771198 - DNA, 20 bp, Artificial
  CRISPR gRNA sequence
tgcttctgggctgtcaaact

SEQ ID NO: 771199 - DNA, 20 bp, Artificial
  CRISPR gRNA sequence
gcttctgggctgtcaaactg

SEQ ID NO: 771200 - DNA, 20 bp, Artificial
  CRISPR gRNA sequence
cttctgggctgtcaaactgc

SEQ ID NO: 771201 - DNA, 20 bp, Artificial
  CRISPR gRNA sequence
ctgggctgtcaaactgcttc

SEQ ID NO: 771202 - DNA, 20 bp, Artificial
  CRISPR gRNA sequence
tgggctgtcaaactgcttct

SEQ ID NO: 771203 - DNA, 20 bp, Artificial
  CRISPR gRNA sequence
ggctgtcaaactgcttctct

SEQ ID NO: 771204 - DNA, 20 bp, Artificial
  CRISPR gRNA sequence
tcaaactgcttctctccagg

SEQ ID NO: 771205 - DNA, 20 bp, Artificial
  CRISPR gRNA sequence
cttctctccagggcaggttt

SEQ ID NO: 771206 - DNA, 20 bp, Artificial
  CRISPR gRNA sequence
ctctccagggcaggtttcca

SEQ ID NO: 771207 - DNA, 20 bp, Artificial
  CRISPR gRNA sequence
tctccagggcaggtttccag

SEQ ID NO: 771208 - DNA, 20 bp, Artificial
  CRISPR gRNA sequence
tccagggcaggtttccagga

SEQ ID NO: 771209 - DNA, 20 bp, Artificial
  CRISPR gRNA sequence
cagggcaggtttccaggatc

SEQ ID NO: 771210 - DNA, 20 bp, Artificial
  CRISPR gRNA sequence
ccaggatccagagtctagga

SEQ ID NO: 771211 - DNA, 20 bp, Artificial
  CRISPR gRNA sequence
caggatccagagtctaggaa

SEQ ID NO: 771212 - DNA, 20 bp, Artificial
  CRISPR gRNA sequence
ggaaaggaatgaaagggagc

SEQ ID NO: 771213 - DNA, 20 bp, Artificial
  CRISPR gRNA sequence
gaagtccctcatcttccctc

SEQ ID NO: 771214 - DNA, 20 bp, Artificial
  CRISPR gRNA sequence
atcttccctctggagggaag

SEQ ID NO: 771215 - DNA, 20 bp, Artificial
  CRISPR gRNA sequence
ccctctggagggaagcgcag

SEQ ID NO: 771216 - DNA, 20 bp, Artificial
  CRISPR gRNA sequence
cctctggagggaagcgcagc

SEQ ID NO: 771217 - DNA, 20 bp, Artificial
  CRISPR gRNA sequence
tggagggaagcgcagctcgg

SEQ ID NO: 771218 - DNA, 20 bp, Artificial
  CRISPR gRNA sequence
gagggaagcgcagctcggcc

SEQ ID NO: 771219 - DNA, 20 bp, Artificial
  CRISPR gRNA sequence
ggccctgggagagcctgggt

SEQ ID NO: 771220 - DNA, 20 bp, Artificial
  CRISPR gRNA sequence
ggagagcctgggtaggtctg

SEQ ID NO: 771221 - DNA, 20 bp, Artificial
  CRISPR gRNA sequence
ggtaggtctgatcaggggag

SEQ ID NO: 771222 - DNA, 20 bp, Artificial
  CRISPR gRNA sequence
atcaggggaggtgccctctg

SEQ ID NO: 771223 - DNA, 20 bp, Artificial
  CRISPR gRNA sequence
tgctccctgtacctgcccag

SEQ ID NO: 771224 - DNA, 20 bp, Artificial
  CRISPR gRNA sequence
ctccctgtacctgcccagag

SEQ ID NO: 771225 - DNA, 20 bp, Artificial
  CRISPR gRNA sequence
cctgtacctgcccagagtgg

SEQ ID NO: 771226 - DNA, 20 bp, Artificial
  CRISPR gRNA sequence
tacctgcccagagtggcagg

SEQ ID NO: 771227 - DNA, 20 bp, Artificial
  CRISPR gRNA sequence
cccagagtggcaggaattag

SEQ ID NO: 771228 - DNA, 20 bp, Artificial
  CRISPR gRNA sequence
gcctgatatatgaaggagac

SEQ ID NO: 771229 - DNA, 20 bp, Artificial
  CRISPR gRNA sequence
atatatgaaggagacaatta

SEQ ID NO: 771230 - DNA, 20 bp, Artificial
  CRISPR gRNA sequence
tatgaagagtcttgagtacc

SEQ ID NO: 771231 - DNA, 20 bp, Artificial
  CRISPR gRNA sequence
gagtaccaggcagaggaatg

SEQ ID NO: 771232 - DNA, 20 bp, Artificial
  CRISPR gRNA sequence
agtaccaggcagaggaatgg

SEQ ID NO: 771233 - DNA, 20 bp, Artificial
  CRISPR gRNA sequence
acttctatagtgaatgggga

SEQ ID NO: 771234 - DNA, 20 bp, Artificial
  CRISPR gRNA sequence
ctatagtgaatggggagcca

SEQ ID NO: 771235 - DNA, 20 bp, Artificial
  CRISPR gRNA sequence
tatagtgaatggggagccat

SEQ ID NO: 771236 - DNA, 20 bp, Artificial
  CRISPR gRNA sequence
tagtgaatggggagccatgg

SEQ ID NO: 771237 - DNA, 20 bp, Artificial
  CRISPR gRNA sequence
ttgagcaggggagggacatg

SEQ ID NO: 771238 - DNA, 20 bp, Artificial
  CRISPR gRNA sequence
gagcaggggagggacatgag

SEQ ID NO: 771239 - DNA, 20 bp, Artificial
  CRISPR gRNA sequence
agcaggggagggacatgagc

SEQ ID NO: 771240 - DNA, 20 bp, Artificial
  CRISPR gRNA sequence
ctgtcttaggtcctaagaga

SEQ ID NO: 771241 - DNA, 20 bp, Artificial
  CRISPR gRNA sequence
tcttaggtcctaagagaagg

SEQ ID NO: 771242 - DNA, 20 bp, Artificial
  CRISPR gRNA sequence
aggtcctaagagaaggcacc

SEQ ID NO: 771243 - DNA, 20 bp, Artificial
  CRISPR gRNA sequence
ggtcctaagagaaggcacct

SEQ ID NO: 771244 - DNA, 20 bp, Artificial
  CRISPR gRNA sequence
agagaaggcaccttagagaa

SEQ ID NO: 771245 - DNA, 20 bp, Artificial
  CRISPR gRNA sequence
agagaatggggctggcaggg

SEQ ID NO: 771246 - DNA, 20 bp, Artificial
  CRISPR gRNA sequence
gagaatggggctggcaggga

SEQ ID NO: 771247 - DNA, 20 bp, Artificial
  CRISPR gRNA sequence
gcagggaaagagaggagcaa

SEQ ID NO: 771248 - DNA, 20 bp, Artificial
  CRISPR gRNA sequence
gagaagcagtgtggagagtg

SEQ ID NO: 771249 - DNA, 20 bp, Artificial
  CRISPR gRNA sequence
agaagcagtgtggagagtga

SEQ ID NO: 771250 - DNA, 20 bp, Artificial
  CRISPR gRNA sequence
ggttctgtctggggttaaag

SEQ ID NO: 771251 - DNA, 20 bp, Artificial
  CRISPR gRNA sequence
gttctgtctggggttaaaga

SEQ ID NO: 771252 - DNA, 20 bp, Artificial
  CRISPR gRNA sequence
tgtctggggttaaagagagg

SEQ ID NO: 771253 - DNA, 20 bp, Artificial
  CRISPR gRNA sequence
tctggggttaaagagaggca

SEQ ID NO: 771254 - DNA, 20 bp, Artificial
  CRISPR gRNA sequence
gggttaaagagaggcaggga

SEQ ID NO: 771255 - DNA, 20 bp, Artificial
  CRISPR gRNA sequence
aagagaggcagggagatgtg

SEQ ID NO: 771256 - DNA, 20 bp, Artificial
  CRISPR gRNA sequence
ggcgttcgttcatccttagc

SEQ ID NO: 771257 - DNA, 20 bp, Artificial
  CRISPR gRNA sequence
gttcatccttagccctggtg

SEQ ID NO: 771258 - DNA, 20 bp, Artificial
  CRISPR gRNA sequence
atccttagccctggtgcttc

SEQ ID NO: 771259 - DNA, 20 bp, Artificial
  CRISPR gRNA sequence
agccctggtgcttcccgcag

SEQ ID NO: 771260 - DNA, 20 bp, Artificial
  CRISPR gRNA sequence
gccctggtgcttcccgcagg

SEQ ID NO: 771261 - DNA, 20 bp, Artificial
  CRISPR gRNA sequence
gtgcttcccgcaggggttgg

SEQ ID NO: 771262 - DNA, 20 bp, Artificial
  CRISPR gRNA sequence
cccgcaggggttgggcaggt

SEQ ID NO: 771263 - DNA, 20 bp, Artificial
  CRISPR gRNA sequence
ccgcaggggttgggcaggtc

SEQ ID NO: 771264 - DNA, 20 bp, Artificial
  CRISPR gRNA sequence
ggcaggtcctgcaggcagct

SEQ ID NO: 771265 - DNA, 20 bp, Artificial
  CRISPR gRNA sequence
caggcagctgcctgctggat

SEQ ID NO: 771266 - DNA, 20 bp, Artificial
  CRISPR gRNA sequence
cctgctggatcttcctgtgg

SEQ ID NO: 771267 - DNA, 20 bp, Artificial
  CRISPR gRNA sequence
ctggatcttcctgtgggcct

SEQ ID NO: 771268 - DNA, 20 bp, Artificial
  CRISPR gRNA sequence
gatcttcctgtgggcctcag

SEQ ID NO: 771269 - DNA, 20 bp, Artificial
  CRISPR gRNA sequence
cctgtgggcctcagggtggc

SEQ ID NO: 771270 - DNA, 20 bp, Artificial
  CRISPR gRNA sequence
ctgtgggcctcagggtggcc

SEQ ID NO: 771271 - DNA, 20 bp, Artificial
  CRISPR gRNA sequence
tgggcctcagggtggccctt

SEQ ID NO: 771272 - DNA, 20 bp, Artificial
  CRISPR gRNA sequence
agggtggcccttgtggggca

SEQ ID NO: 771273 - DNA, 20 bp, Artificial
  CRISPR gRNA sequence
gtggggcaggatgtggtgcc

SEQ ID NO: 771274 - DNA, 20 bp, Artificial
  CRISPR gRNA sequence
tggggcaggatgtggtgcct

SEQ ID NO: 771275 - DNA, 20 bp, Artificial
  CRISPR gRNA sequence
ccaaaggtgctttatgaatg

SEQ ID NO: 771276 - DNA, 20 bp, Artificial
  CRISPR gRNA sequence
tatgaatggagccggggaag

SEQ ID NO: 771277 - DNA, 20 bp, Artificial
  CRISPR gRNA sequence
atgaatggagccggggaagg

SEQ ID NO: 771278 - DNA, 20 bp, Artificial
  CRISPR gRNA sequence
tgaatggagccggggaaggc

SEQ ID NO: 771279 - DNA, 20 bp, Artificial
  CRISPR gRNA sequence
ctgactcagcaggcagtaag

SEQ ID NO: 771280 - DNA, 20 bp, Artificial
  CRISPR gRNA sequence
actcagcaggcagtaaggct

SEQ ID NO: 771281 - DNA, 20 bp, Artificial
  CRISPR gRNA sequence
agcaggcagtaaggctttga

SEQ ID NO: 771282 - DNA, 20 bp, Artificial
  CRISPR gRNA sequence
tgaggccggaagcgtctgga

SEQ ID NO: 771283 - DNA, 20 bp, Artificial
  CRISPR gRNA sequence
gaggccggaagcgtctggaa

SEQ ID NO: 771284 - DNA, 20 bp, Artificial
  CRISPR gRNA sequence
aggccggaagcgtctggaaa

SEQ ID NO: 771285 - DNA, 20 bp, Artificial
  CRISPR gRNA sequence
gaaaggaagtggctgctcag

SEQ ID NO: 771286 - DNA, 20 bp, Artificial
  CRISPR gRNA sequence
ctcagggcttccccactgta

SEQ ID NO: 771287 - DNA, 20 bp, Artificial
  CRISPR gRNA sequence
agggcttccccactgtagac

SEQ ID NO: 771288 - DNA, 20 bp, Artificial
  CRISPR gRNA sequence
ccccactgtagacagctggg

SEQ ID NO: 771289 - DNA, 20 bp, Artificial
  CRISPR gRNA sequence
cccactgtagacagctggga

SEQ ID NO: 771290 - DNA, 20 bp, Artificial
  CRISPR gRNA sequence
tagacagctgggagagaagg

SEQ ID NO: 771291 - DNA, 20 bp, Artificial
  CRISPR gRNA sequence
ggagagaaggggggctggcc

SEQ ID NO: 771292 - DNA, 20 bp, Artificial
  CRISPR gRNA sequence
gccaggatgcacatggtttg

SEQ ID NO: 771293 - DNA, 20 bp, Artificial
  CRISPR gRNA sequence
ggctgagggactcccttggc

SEQ ID NO: 771294 - DNA, 20 bp, Artificial
  CRISPR gRNA sequence
gctgagggactcccttggcc

SEQ ID NO: 771295 - DNA, 20 bp, Artificial
  CRISPR gRNA sequence
agggactcccttggcccagc

SEQ ID NO: 771296 - DNA, 20 bp, Artificial
  CRISPR gRNA sequence
ccttggcccagctgctgggg

SEQ ID NO: 771297 - DNA, 20 bp, Artificial
  CRISPR gRNA sequence
ggcccagctgctgggggtgt

SEQ ID NO: 771298 - DNA, 20 bp, Artificial
  CRISPR gRNA sequence
gcccagctgctgggggtgtg

SEQ ID NO: 771299 - DNA, 20 bp, Artificial
  CRISPR gRNA sequence
ctgggggtgtgtgtgtgtag

SEQ ID NO: 771300 - DNA, 20 bp, Artificial
  CRISPR gRNA sequence
ggggtgtgtgtgtgtaggag

SEQ ID NO: 771301 - DNA, 20 bp, Artificial
  CRISPR gRNA sequence
gctgggattggaaggattga

SEQ ID NO: 771302 - DNA, 20 bp, Artificial
  CRISPR gRNA sequence
ggattggaaggattgaggct

SEQ ID NO: 771303 - DNA, 20 bp, Artificial
  CRISPR gRNA sequence
gaaggattgaggctgggcgc

SEQ ID NO: 771304 - DNA, 20 bp, Artificial
  CRISPR gRNA sequence
aggctgggcgcctggaatgg

SEQ ID NO: 771305 - DNA, 20 bp, Artificial
  CRISPR gRNA sequence
ggcgcctggaatggaattga

SEQ ID NO: 771306 - DNA, 20 bp, Artificial
  CRISPR gRNA sequence
gaatggaattgaggctagca

SEQ ID NO: 771307 - DNA, 20 bp, Artificial
  CRISPR gRNA sequence
aggctagcagctgttgatga

SEQ ID NO: 771308 - DNA, 20 bp, Artificial
  CRISPR gRNA sequence
gcagctgttgatgaggtttg

SEQ ID NO: 771309 - DNA, 20 bp, Artificial
  CRISPR gRNA sequence
ttgatgaggtttgctccgtg

SEQ ID NO: 771310 - DNA, 20 bp, Artificial
  CRISPR gRNA sequence
atgaggtttgctccgtggaa

SEQ ID NO: 771311 - DNA, 20 bp, Artificial
  CRISPR gRNA sequence
gctccgtggaagggtggaaa

SEQ ID NO: 771312 - DNA, 20 bp, Artificial
  CRISPR gRNA sequence
ctccgtggaagggtggaaag

SEQ ID NO: 771313 - DNA, 20 bp, Artificial
  CRISPR gRNA sequence
cgtggaagggtggaaaggtg

SEQ ID NO: 771314 - DNA, 20 bp, Artificial
  CRISPR gRNA sequence
gactctttttggctgtgctg

SEQ ID NO: 771315 - DNA, 20 bp, Artificial
  CRISPR gRNA sequence
tttttggctgtgctgactgg

SEQ ID NO: 771316 - DNA, 20 bp, Artificial
  CRISPR gRNA sequence
tttggctgtgctgactggca

SEQ ID NO: 771317 - DNA, 20 bp, Artificial
  CRISPR gRNA sequence
ttggctgtgctgactggcaa

SEQ ID NO: 771318 - DNA, 20 bp, Artificial
  CRISPR gRNA sequence
tggctgtgctgactggcaaa

SEQ ID NO: 771319 - DNA, 20 bp, Artificial
  CRISPR gRNA sequence
ggctgtgctgactggcaaat

SEQ ID NO: 771320 - DNA, 20 bp, Artificial
  CRISPR gRNA sequence
gctgtgctgactggcaaatt

SEQ ID NO: 771321 - DNA, 20 bp, Artificial
  CRISPR gRNA sequence
tgctgactggcaaattactt

SEQ ID NO: 771322 - DNA, 20 bp, Artificial
  CRISPR gRNA sequence
actggcaaattacttgacat

SEQ ID NO: 771323 - DNA, 20 bp, Artificial
  CRISPR gRNA sequence
gcaaattacttgacattaac

SEQ ID NO: 771324 - DNA, 20 bp, Artificial
  CRISPR gRNA sequence
cttgacattaacaaagtcac

SEQ ID NO: 771325 - DNA, 20 bp, Artificial
  CRISPR gRNA sequence
gacattaacaaagtcactta

SEQ ID NO: 771326 - DNA, 20 bp, Artificial
  CRISPR gRNA sequence
acattaacaaagtcacttat

SEQ ID NO: 771327 - DNA, 20 bp, Artificial
  CRISPR gRNA sequence
acaaagtcacttatctgggc

SEQ ID NO: 771328 - DNA, 20 bp, Artificial
  CRISPR gRNA sequence
atctgggctttaattttttt

SEQ ID NO: 771329 - DNA, 20 bp, Artificial
  CRISPR gRNA sequence
tctgggctttaatttttttt

SEQ ID NO: 771330 - DNA, 20 bp, Artificial
  CRISPR gRNA sequence
ggctttaatttttttttttt

SEQ ID NO: 771331 - DNA, 20 bp, Artificial
  CRISPR gRNA sequence
taattttttttttttttttt

SEQ ID NO: 771332 - DNA, 20 bp, Artificial
  CRISPR gRNA sequence
aatttttttttttttttttt

SEQ ID NO: 771333 - DNA, 20 bp, Artificial
  CRISPR gRNA sequence
attttttttttttttttttt

SEQ ID NO: 771334 - DNA, 20 bp, Artificial
  CRISPR gRNA sequence
ttttttttttttttttgaga

SEQ ID NO: 771335 - DNA, 20 bp, Artificial
  CRISPR gRNA sequence
tttttttttttttttgagac

SEQ ID NO: 771336 - DNA, 20 bp, Artificial
  CRISPR gRNA sequence
ttttttttttttttgagaca

SEQ ID NO: 771337 - DNA, 20 bp, Artificial
  CRISPR gRNA sequence
tttttttttttttgagacag

SEQ ID NO: 771338 - DNA, 20 bp, Artificial
  CRISPR gRNA sequence
ttttttttttttgagacaga

SEQ ID NO: 771339 - DNA, 20 bp, Artificial
  CRISPR gRNA sequence
tttttttttttgagacagag

SEQ ID NO: 771340 - DNA, 20 bp, Artificial
  CRISPR gRNA sequence
ttttttttttgagacagagt

SEQ ID NO: 771341 - DNA, 20 bp, Artificial
  CRISPR gRNA sequence
tttttttttgagacagagtc

SEQ ID NO: 771342 - DNA, 20 bp, Artificial
  CRISPR gRNA sequence
ttttttttgagacagagtct

SEQ ID NO: 771343 - DNA, 20 bp, Artificial
  CRISPR gRNA sequence
tttttttgagacagagtctt

SEQ ID NO: 771344 - DNA, 20 bp, Artificial
  CRISPR gRNA sequence
ttttttgagacagagtcttg

SEQ ID NO: 771345 - DNA, 20 bp, Artificial
  CRISPR gRNA sequence
tttttgagacagagtcttgc

SEQ ID NO: 771346 - DNA, 20 bp, Artificial
  CRISPR gRNA sequence
ttttgagacagagtcttgca

SEQ ID NO: 771347 - DNA, 20 bp, Artificial
  CRISPR gRNA sequence
tttgagacagagtcttgcag

SEQ ID NO: 771348 - DNA, 20 bp, Artificial
  CRISPR gRNA sequence
ttgagacagagtcttgcagt

SEQ ID NO: 771349 - DNA, 20 bp, Artificial
  CRISPR gRNA sequence
tgagacagagtcttgcagta

SEQ ID NO: 771350 - DNA, 20 bp, Artificial
  CRISPR gRNA sequence
gagacagagtcttgcagtat

SEQ ID NO: 771351 - DNA, 20 bp, Artificial
  CRISPR gRNA sequence
agacagagtcttgcagtatc

SEQ ID NO: 771352 - DNA, 20 bp, Artificial
  CRISPR gRNA sequence
gcagtatcgcccagactgga

SEQ ID NO: 771353 - DNA, 20 bp, Artificial
  CRISPR gRNA sequence
cagtatcgcccagactggag

SEQ ID NO: 771354 - DNA, 20 bp, Artificial
  CRISPR gRNA sequence
gagtacagtggcgcgatttc

SEQ ID NO: 771355 - DNA, 20 bp, Artificial
  CRISPR gRNA sequence
ccactcactacaacctccgc

SEQ ID NO: 771356 - DNA, 20 bp, Artificial
  CRISPR gRNA sequence
cactcactacaacctccgcc

SEQ ID NO: 771357 - DNA, 20 bp, Artificial
  CRISPR gRNA sequence
actacaacctccgcctcctg

SEQ ID NO: 771358 - DNA, 20 bp, Artificial
  CRISPR gRNA sequence
caacctccgcctcctgggtt

SEQ ID NO: 771359 - DNA, 20 bp, Artificial
  CRISPR gRNA sequence
cgcctcctgggttcaagcaa

SEQ ID NO: 771360 - DNA, 20 bp, Artificial
  CRISPR gRNA sequence
ctgggttcaagcaattctcc

SEQ ID NO: 771361 - DNA, 20 bp, Artificial
  CRISPR gRNA sequence
ggttcaagcaattctcctgc

SEQ ID NO: 771362 - DNA, 20 bp, Artificial
  CRISPR gRNA sequence
aagcaattctcctgcctcag

SEQ ID NO: 771363 - DNA, 20 bp, Artificial
  CRISPR gRNA sequence
tcctgcctcagcctcctgag

SEQ ID NO: 771364 - DNA, 20 bp, Artificial
  CRISPR gRNA sequence
ctgcctcagcctcctgagta

SEQ ID NO: 771365 - DNA, 20 bp, Artificial
  CRISPR gRNA sequence
cctcagcctcctgagtagct

SEQ ID NO: 771366 - DNA, 20 bp, Artificial
  CRISPR gRNA sequence
agcctcctgagtagctggta

SEQ ID NO: 771367 - DNA, 20 bp, Artificial
  CRISPR gRNA sequence
ctgagtagctggtattacag

SEQ ID NO: 771368 - DNA, 20 bp, Artificial
  CRISPR gRNA sequence
agtagctggtattacaggcc

SEQ ID NO: 771369 - DNA, 20 bp, Artificial
  CRISPR gRNA sequence
gtattacaggcctgagccac

SEQ ID NO: 771370 - DNA, 20 bp, Artificial
  CRISPR gRNA sequence
caggcctgagccaccacgcc

SEQ ID NO: 771371 - DNA, 20 bp, Artificial
  CRISPR gRNA sequence
agccaccacgcccagctaat

SEQ ID NO: 771372 - DNA, 20 bp, Artificial
  CRISPR gRNA sequence
atgtttatatttttagtaga

SEQ ID NO: 771373 - DNA, 20 bp, Artificial
  CRISPR gRNA sequence
atatttttagtagacacagg

SEQ ID NO: 771374 - DNA, 20 bp, Artificial
  CRISPR gRNA sequence
tatttttagtagacacaggg

SEQ ID NO: 771375 - DNA, 20 bp, Artificial
  CRISPR gRNA sequence
ttagtagacacagggtttca

SEQ ID NO: 771376 - DNA, 20 bp, Artificial
  CRISPR gRNA sequence
tagtagacacagggtttcac

SEQ ID NO: 771377 - DNA, 20 bp, Artificial
  CRISPR gRNA sequence
agtagacacagggtttcacc

SEQ ID NO: 771378 - DNA, 20 bp, Artificial
  CRISPR gRNA sequence
gtagacacagggtttcacca

SEQ ID NO: 771379 - DNA, 20 bp, Artificial
  CRISPR gRNA sequence
caccatgttggtcaggctgg

SEQ ID NO: 771380 - DNA, 20 bp, Artificial
  CRISPR gRNA sequence
accatgttggtcaggctggt

SEQ ID NO: 771381 - DNA, 20 bp, Artificial
  CRISPR gRNA sequence
gtcaggctggtctcaaactc

SEQ ID NO: 771382 - DNA, 20 bp, Artificial
  CRISPR gRNA sequence
gtctcaaactcctgacctcg

SEQ ID NO: 771383 - DNA, 20 bp, Artificial
  CRISPR gRNA sequence
aaactcctgacctcgtgatc

SEQ ID NO: 771384 - DNA, 20 bp, Artificial
  CRISPR gRNA sequence
ctgacctcgtgatccaccca

SEQ ID NO: 771385 - DNA, 20 bp, Artificial
  CRISPR gRNA sequence
acctcgtgatccacccacct

SEQ ID NO: 771386 - DNA, 20 bp, Artificial
  CRISPR gRNA sequence
gtgatccacccacctcggcc

SEQ ID NO: 771387 - DNA, 20 bp, Artificial
  CRISPR gRNA sequence
ggcctcccaaagtgctggga

SEQ ID NO: 771388 - DNA, 20 bp, Artificial
  CRISPR gRNA sequence
ccaaagtgctgggattacag

SEQ ID NO: 771389 - DNA, 20 bp, Artificial
  CRISPR gRNA sequence
ggattacaggcatgagccac

SEQ ID NO: 771390 - DNA, 20 bp, Artificial
  CRISPR gRNA sequence
caggcatgagccaccacacc

SEQ ID NO: 771391 - DNA, 20 bp, Artificial
  CRISPR gRNA sequence
taattttttaaagtcctgca

SEQ ID NO: 771392 - DNA, 20 bp, Artificial
  CRISPR gRNA sequence
aattttttaaagtcctgcaa

SEQ ID NO: 771393 - DNA, 20 bp, Artificial
  CRISPR gRNA sequence
attttttaaagtcctgcaaa

SEQ ID NO: 771394 - DNA, 20 bp, Artificial
  CRISPR gRNA sequence
tttaaagtcctgcaaaaata

SEQ ID NO: 771395 - DNA, 20 bp, Artificial
  CRISPR gRNA sequence
ttaaagtcctgcaaaaatag

SEQ ID NO: 771396 - DNA, 20 bp, Artificial
  CRISPR gRNA sequence
taaagtcctgcaaaaatagg

SEQ ID NO: 771397 - DNA, 20 bp, Artificial
  CRISPR gRNA sequence
aaagtcctgcaaaaatagga

SEQ ID NO: 771398 - DNA, 20 bp, Artificial
  CRISPR gRNA sequence
aagtcctgcaaaaataggac

SEQ ID NO: 771399 - DNA, 20 bp, Artificial
  CRISPR gRNA sequence
caaaaataggaccaagtgtt

SEQ ID NO: 771400 - DNA, 20 bp, Artificial
  CRISPR gRNA sequence
cagcctatctcccagggtat

SEQ ID NO: 771401 - DNA, 20 bp, Artificial
  CRISPR gRNA sequence
tctcccagggtattaggagg

SEQ ID NO: 771402 - DNA, 20 bp, Artificial
  CRISPR gRNA sequence
ccagggtattaggaggacgt

SEQ ID NO: 771403 - DNA, 20 bp, Artificial
  CRISPR gRNA sequence
ggaggacgtgaaatcatttc

SEQ ID NO: 771404 - DNA, 20 bp, Artificial
  CRISPR gRNA sequence
ctattcttgttgatcagtgt

SEQ ID NO: 771405 - DNA, 20 bp, Artificial
  CRISPR gRNA sequence
tattcttgttgatcagtgtt

SEQ ID NO: 771406 - DNA, 20 bp, Artificial
  CRISPR gRNA sequence
ttcttgttgatcagtgttgg

SEQ ID NO: 771407 - DNA, 20 bp, Artificial
  CRISPR gRNA sequence
ttgttgatcagtgttggttg

SEQ ID NO: 771408 - DNA, 20 bp, Artificial
  CRISPR gRNA sequence
gttgatcagtgttggttggc

SEQ ID NO: 771409 - DNA, 20 bp, Artificial
  CRISPR gRNA sequence
ttgatcagtgttggttggca

SEQ ID NO: 771410 - DNA, 20 bp, Artificial
  CRISPR gRNA sequence
atcagtgttggttggcatag

SEQ ID NO: 771411 - DNA, 20 bp, Artificial
  CRISPR gRNA sequence
gttggcatagatgtggcttg

SEQ ID NO: 771412 - DNA, 20 bp, Artificial
  CRISPR gRNA sequence
gcatagatgtggcttgatca

SEQ ID NO: 771413 - DNA, 20 bp, Artificial
  CRISPR gRNA sequence
gatcaggacatggcacaaat

SEQ ID NO: 771414 - DNA, 20 bp, Artificial
  CRISPR gRNA sequence
atcaggacatggcacaaatg

SEQ ID NO: 771415 - DNA, 20 bp, Artificial
  CRISPR gRNA sequence
aggcagcagctgtgggactc

SEQ ID NO: 771416 - DNA, 20 bp, Artificial
  CRISPR gRNA sequence
ggcagcagctgtgggactca

SEQ ID NO: 771417 - DNA, 20 bp, Artificial
  CRISPR gRNA sequence
tgggactcagggacaaggtg

SEQ ID NO: 771418 - DNA, 20 bp, Artificial
  CRISPR gRNA sequence
agggacaaggtgtgtgcagc

SEQ ID NO: 771419 - DNA, 20 bp, Artificial
  CRISPR gRNA sequence
gagggtggctgggattggga

SEQ ID NO: 771420 - DNA, 20 bp, Artificial
  CRISPR gRNA sequence
ggattgggagcagggctgga

SEQ ID NO: 771421 - DNA, 20 bp, Artificial
  CRISPR gRNA sequence
ggagcagggctggatttagg

SEQ ID NO: 771422 - DNA, 20 bp, Artificial
  CRISPR gRNA sequence
gatttagggatgtctgccct

SEQ ID NO: 771423 - DNA, 20 bp, Artificial
  CRISPR gRNA sequence
agggatgtctgcccttctca

SEQ ID NO: 771424 - DNA, 20 bp, Artificial
  CRISPR gRNA sequence
gggatgtctgcccttctcat

SEQ ID NO: 771425 - DNA, 20 bp, Artificial
  CRISPR gRNA sequence
cccttctcatccccagctca

SEQ ID NO: 771426 - DNA, 20 bp, Artificial
  CRISPR gRNA sequence
ctcatccccagctcaggcct

SEQ ID NO: 771427 - DNA, 20 bp, Artificial
  CRISPR gRNA sequence
tcatccccagctcaggcctg

SEQ ID NO: 771428 - DNA, 20 bp, Artificial
  CRISPR gRNA sequence
atccccagctcaggcctgac

SEQ ID NO: 771429 - DNA, 20 bp, Artificial
  CRISPR gRNA sequence
aggcctgacctgcagccaca

SEQ ID NO: 771430 - DNA, 20 bp, Artificial
  CRISPR gRNA sequence
acctgcagccacagacttgc

SEQ ID NO: 771431 - DNA, 20 bp, Artificial
  CRISPR gRNA sequence
cagccacagacttgcctctt

SEQ ID NO: 771432 - DNA, 20 bp, Artificial
  CRISPR gRNA sequence
gcctcttactcagtcctgac

SEQ ID NO: 771433 - DNA, 20 bp, Artificial
  CRISPR gRNA sequence
cctcttactcagtcctgact

SEQ ID NO: 771434 - DNA, 20 bp, Artificial
  CRISPR gRNA sequence
ttactcagtcctgactccag

SEQ ID NO: 771435 - DNA, 20 bp, Artificial
  CRISPR gRNA sequence
actcagtcctgactccagcc

SEQ ID NO: 771436 - DNA, 20 bp, Artificial
  CRISPR gRNA sequence
ctcagtcctgactccagcct

SEQ ID NO: 771437 - DNA, 20 bp, Artificial
  CRISPR gRNA sequence
agtcctgactccagccttga

SEQ ID NO: 771438 - DNA, 20 bp, Artificial
  CRISPR gRNA sequence
actccagccttgaggtcatc

SEQ ID NO: 771439 - DNA, 20 bp, Artificial
  CRISPR gRNA sequence
cagccttgaggtcatcccca

SEQ ID NO: 771440 - DNA, 20 bp, Artificial
  CRISPR gRNA sequence
gaggtcatccccaagtcctt

SEQ ID NO: 771441 - DNA, 20 bp, Artificial
  CRISPR gRNA sequence
aggtcatccccaagtccttg

SEQ ID NO: 771442 - DNA, 20 bp, Artificial
  CRISPR gRNA sequence
gcctcttccacttctgatct

SEQ ID NO: 771443 - DNA, 20 bp, Artificial
  CRISPR gRNA sequence
cctcttccacttctgatctg

SEQ ID NO: 771444 - DNA, 20 bp, Artificial
  CRISPR gRNA sequence
ttccacttctgatctgtctt

SEQ ID NO: 771445 - DNA, 20 bp, Artificial
  CRISPR gRNA sequence
ccacttctgatctgtcttgg

SEQ ID NO: 771446 - DNA, 20 bp, Artificial
  CRISPR gRNA sequence
cacttctgatctgtcttggt

SEQ ID NO: 771447 - DNA, 20 bp, Artificial
  CRISPR gRNA sequence
ctgatctgtcttggtcactc

SEQ ID NO: 771448 - DNA, 20 bp, Artificial
  CRISPR gRNA sequence
tgatctgtcttggtcactca

SEQ ID NO: 771449 - DNA, 20 bp, Artificial
  CRISPR gRNA sequence
atctgtcttggtcactcaat

SEQ ID NO: 771450 - DNA, 20 bp, Artificial
  CRISPR gRNA sequence
tcttggtcactcaatacaga

SEQ ID NO: 771451 - DNA, 20 bp, Artificial
  CRISPR gRNA sequence
ggtcactcaatacagatgtg

SEQ ID NO: 771452 - DNA, 20 bp, Artificial
  CRISPR gRNA sequence
gtcactcaatacagatgtgt

SEQ ID NO: 771453 - DNA, 20 bp, Artificial
  CRISPR gRNA sequence
aatacagatgtgttaagcta

SEQ ID NO: 771454 - DNA, 20 bp, Artificial
  CRISPR gRNA sequence
agctagcaaatgttctctct

SEQ ID NO: 771455 - DNA, 20 bp, Artificial
  CRISPR gRNA sequence
gcaaatgttctctctctgca

SEQ ID NO: 771456 - DNA, 20 bp, Artificial
  CRISPR gRNA sequence
tctctctgcattcccacact

SEQ ID NO: 771457 - DNA, 20 bp, Artificial
  CRISPR gRNA sequence
tctctgcattcccacactca

SEQ ID NO: 771458 - DNA, 20 bp, Artificial
  CRISPR gRNA sequence
tctgcattcccacactcata

SEQ ID NO: 771459 - DNA, 20 bp, Artificial
  CRISPR gRNA sequence
tgcattcccacactcataca

SEQ ID NO: 771460 - DNA, 20 bp, Artificial
  CRISPR gRNA sequence
cattcccacactcatacacc

SEQ ID NO: 771461 - DNA, 20 bp, Artificial
  CRISPR gRNA sequence
ccacactcatacacctagtc

SEQ ID NO: 771462 - DNA, 20 bp, Artificial
  CRISPR gRNA sequence
atacacctagtcgcctccta

SEQ ID NO: 771463 - DNA, 20 bp, Artificial
  CRISPR gRNA sequence
gtcgcctcctaaaactctgt

SEQ ID NO: 771464 - DNA, 20 bp, Artificial
  CRISPR gRNA sequence
ctaaaactctgtcctagaag

SEQ ID NO: 771465 - DNA, 20 bp, Artificial
  CRISPR gRNA sequence
aaactctgtcctagaagctt

SEQ ID NO: 771466 - DNA, 20 bp, Artificial
  CRISPR gRNA sequence
tgtcctagaagcttctttgc

SEQ ID NO: 771467 - DNA, 20 bp, Artificial
  CRISPR gRNA sequence
tcctagaagcttctttgcaa

SEQ ID NO: 771468 - DNA, 20 bp, Artificial
  CRISPR gRNA sequence
gaagcttctttgcaaatact

SEQ ID NO: 771469 - DNA, 20 bp, Artificial
  CRISPR gRNA sequence
ctttgcaaatactgctgatt

SEQ ID NO: 771470 - DNA, 20 bp, Artificial
  CRISPR gRNA sequence
tttgcaaatactgctgattt

SEQ ID NO: 771471 - DNA, 20 bp, Artificial
  CRISPR gRNA sequence
tgcaaatactgctgatttca

SEQ ID NO: 771472 - DNA, 20 bp, Artificial
  CRISPR gRNA sequence
gcaaatactgctgatttcac

SEQ ID NO: 771473 - DNA, 20 bp, Artificial
  CRISPR gRNA sequence
caaatactgctgatttcaca

SEQ ID NO: 771474 - DNA, 20 bp, Artificial
  CRISPR gRNA sequence
ctgatttcacacaagctata

SEQ ID NO: 771475 - DNA, 20 bp, Artificial
  CRISPR gRNA sequence
atttcacacaagctatactg

SEQ ID NO: 771476 - DNA, 20 bp, Artificial
  CRISPR gRNA sequence
cacacaagctatactgaacc

SEQ ID NO: 771477 - DNA, 20 bp, Artificial
  CRISPR gRNA sequence
acacaagctatactgaaccc

SEQ ID NO: 771478 - DNA, 20 bp, Artificial
  CRISPR gRNA sequence
tactgaacccttccattttc

SEQ ID NO: 771479 - DNA, 20 bp, Artificial
  CRISPR gRNA sequence
aacccttccattttctctgc

SEQ ID NO: 771480 - DNA, 20 bp, Artificial
  CRISPR gRNA sequence
ccattttctctgcctcagtg

SEQ ID NO: 771481 - DNA, 20 bp, Artificial
  CRISPR gRNA sequence
cattttctctgcctcagtga

SEQ ID NO: 771482 - DNA, 20 bp, Artificial
  CRISPR gRNA sequence
tctctgcctcagtgaatgct

SEQ ID NO: 771483 - DNA, 20 bp, Artificial
  CRISPR gRNA sequence
ctctgcctcagtgaatgctc

SEQ ID NO: 771484 - DNA, 20 bp, Artificial
  CRISPR gRNA sequence
tctgcctcagtgaatgctcc

SEQ ID NO: 771485 - DNA, 20 bp, Artificial
  CRISPR gRNA sequence
tgcctcagtgaatgctccac

SEQ ID NO: 771486 - DNA, 20 bp, Artificial
  CRISPR gRNA sequence
cctcagtgaatgctccaccc

SEQ ID NO: 771487 - DNA, 20 bp, Artificial
  CRISPR gRNA sequence
agtgaatgctccaccctgtc

SEQ ID NO: 771488 - DNA, 20 bp, Artificial
  CRISPR gRNA sequence
caccctgtcactgaggctca

SEQ ID NO: 771489 - DNA, 20 bp, Artificial
  CRISPR gRNA sequence
tcactgaggctcaaaaccac

SEQ ID NO: 771490 - DNA, 20 bp, Artificial
  CRISPR gRNA sequence
aggctcaaaaccacggccaa

SEQ ID NO: 771491 - DNA, 20 bp, Artificial
  CRISPR gRNA sequence
aaaaccacggccaacctgac

SEQ ID NO: 771492 - DNA, 20 bp, Artificial
  CRISPR gRNA sequence
actgctctttctctctaccc

SEQ ID NO: 771493 - DNA, 20 bp, Artificial
  CRISPR gRNA sequence
ctctttctctctacccaagt

SEQ ID NO: 771494 - DNA, 20 bp, Artificial
  CRISPR gRNA sequence
tttctctctacccaagtcct

SEQ ID NO: 771495 - DNA, 20 bp, Artificial
  CRISPR gRNA sequence
tctctctacccaagtcctca

SEQ ID NO: 771496 - DNA, 20 bp, Artificial
  CRISPR gRNA sequence
ctctctacccaagtcctcag

SEQ ID NO: 771497 - DNA, 20 bp, Artificial
  CRISPR gRNA sequence
tctctacccaagtcctcaga

SEQ ID NO: 771498 - DNA, 20 bp, Artificial
  CRISPR gRNA sequence
tctacccaagtcctcagata

SEQ ID NO: 771499 - DNA, 20 bp, Artificial
  CRISPR gRNA sequence
tacccaagtcctcagatact

SEQ ID NO: 771500 - DNA, 20 bp, Artificial
  CRISPR gRNA sequence
cccaagtcctcagatactgt

SEQ ID NO: 771501 - DNA, 20 bp, Artificial
  CRISPR gRNA sequence
agatactgtcacttttaccc

SEQ ID NO: 771502 - DNA, 20 bp, Artificial
  CRISPR gRNA sequence
tcacttttacccagacatgc

SEQ ID NO: 771503 - DNA, 20 bp, Artificial
  CRISPR gRNA sequence
ttacccagacatgctttgtc

SEQ ID NO: 771504 - DNA, 20 bp, Artificial
  CRISPR gRNA sequence
tacccagacatgctttgtct

SEQ ID NO: 771505 - DNA, 20 bp, Artificial
  CRISPR gRNA sequence
acccagacatgctttgtctc

SEQ ID NO: 771506 - DNA, 20 bp, Artificial
  CRISPR gRNA sequence
cccagacatgctttgtctcc

SEQ ID NO: 771507 - DNA, 20 bp, Artificial
  CRISPR gRNA sequence
tgtctcctgtctggcccttc

SEQ ID NO: 771508 - DNA, 20 bp, Artificial
  CRISPR gRNA sequence
gtctcctgtctggcccttca

SEQ ID NO: 771509 - DNA, 20 bp, Artificial
  CRISPR gRNA sequence
tctcctgtctggcccttcat

SEQ ID NO: 771510 - DNA, 20 bp, Artificial
  CRISPR gRNA sequence
ctgtctggcccttcatttat

SEQ ID NO: 771511 - DNA, 20 bp, Artificial
  CRISPR gRNA sequence
tctggcccttcatttattcc

SEQ ID NO: 771512 - DNA, 20 bp, Artificial
  CRISPR gRNA sequence
gcccttcatttattccacca

SEQ ID NO: 771513 - DNA, 20 bp, Artificial
  CRISPR gRNA sequence
catttattccaccactatac

SEQ ID NO: 771514 - DNA, 20 bp, Artificial
  CRISPR gRNA sequence
atttattccaccactatacc

SEQ ID NO: 771515 - DNA, 20 bp, Artificial
  CRISPR gRNA sequence
attccaccactataccttcc

SEQ ID NO: 771516 - DNA, 20 bp, Artificial
  CRISPR gRNA sequence
ttccaccactataccttcct

SEQ ID NO: 771517 - DNA, 20 bp, Artificial
  CRISPR gRNA sequence
caccactataccttcctaca

SEQ ID NO: 771518 - DNA, 20 bp, Artificial
  CRISPR gRNA sequence
taccttcctacagggatggc

SEQ ID NO: 771519 - DNA, 20 bp, Artificial
  CRISPR gRNA sequence
cctacagggatggctatatt

SEQ ID NO: 771520 - DNA, 20 bp, Artificial
  CRISPR gRNA sequence
ctacagggatggctatatta

SEQ ID NO: 771521 - DNA, 20 bp, Artificial
  CRISPR gRNA sequence
cagggatggctatattagcc

SEQ ID NO: 771522 - DNA, 20 bp, Artificial
  CRISPR gRNA sequence
tattagcctctttttttatt

SEQ ID NO: 771523 - DNA, 20 bp, Artificial
  CRISPR gRNA sequence
gcctctttttttatttttat

SEQ ID NO: 771524 - DNA, 20 bp, Artificial
  CRISPR gRNA sequence
tttttttatttttatttttt

SEQ ID NO: 771525 - DNA, 20 bp, Artificial
  CRISPR gRNA sequence
tttttatttttattttttga

SEQ ID NO: 771526 - DNA, 20 bp, Artificial
  CRISPR gRNA sequence
ttttatttttattttttgag

SEQ ID NO: 771527 - DNA, 20 bp, Artificial
  CRISPR gRNA sequence
tttatttttattttttgaga

SEQ ID NO: 771528 - DNA, 20 bp, Artificial
  CRISPR gRNA sequence
ttatttttattttttgagat

SEQ ID NO: 771529 - DNA, 20 bp, Artificial
  CRISPR gRNA sequence
tatttttattttttgagatc

SEQ ID NO: 771530 - DNA, 20 bp, Artificial
  CRISPR gRNA sequence
atttttattttttgagatcg

SEQ ID NO: 771531 - DNA, 20 bp, Artificial
  CRISPR gRNA sequence
tttttattttttgagatcga

SEQ ID NO: 771532 - DNA, 20 bp, Artificial
  CRISPR gRNA sequence
ttattttttgagatcgagtc

SEQ ID NO: 771533 - DNA, 20 bp, Artificial
  CRISPR gRNA sequence
tattttttgagatcgagtct

SEQ ID NO: 771534 - DNA, 20 bp, Artificial
  CRISPR gRNA sequence
attttttgagatcgagtctg

SEQ ID NO: 771535 - DNA, 20 bp, Artificial
  CRISPR gRNA sequence
ttttttgagatcgagtctgg

SEQ ID NO: 771536 - DNA, 20 bp, Artificial
  CRISPR gRNA sequence
tttgagatcgagtctggctc

SEQ ID NO: 771537 - DNA, 20 bp, Artificial
  CRISPR gRNA sequence
ttgagatcgagtctggctct

SEQ ID NO: 771538 - DNA, 20 bp, Artificial
  CRISPR gRNA sequence
tgagatcgagtctggctctg

SEQ ID NO: 771539 - DNA, 20 bp, Artificial
  CRISPR gRNA sequence
gagatcgagtctggctctgt

SEQ ID NO: 771540 - DNA, 20 bp, Artificial
  CRISPR gRNA sequence
agatcgagtctggctctgtc

SEQ ID NO: 771541 - DNA, 20 bp, Artificial
  CRISPR gRNA sequence
gctctgtcacccagtctgga

SEQ ID NO: 771542 - DNA, 20 bp, Artificial
  CRISPR gRNA sequence
tgtcacccagtctggagtgc

SEQ ID NO: 771543 - DNA, 20 bp, Artificial
  CRISPR gRNA sequence
tcacccagtctggagtgcag

SEQ ID NO: 771544 - DNA, 20 bp, Artificial
  CRISPR gRNA sequence
gagtgcagtggtgcaatctt

SEQ ID NO: 771545 - DNA, 20 bp, Artificial
  CRISPR gRNA sequence
ggcttactgcaacctctgcc

SEQ ID NO: 771546 - DNA, 20 bp, Artificial
  CRISPR gRNA sequence
gcttactgcaacctctgcct

SEQ ID NO: 771547 - DNA, 20 bp, Artificial
  CRISPR gRNA sequence
actgcaacctctgcctcctg

SEQ ID NO: 771548 - DNA, 20 bp, Artificial
  CRISPR gRNA sequence
ctgcaacctctgcctcctgg

SEQ ID NO: 771549 - DNA, 20 bp, Artificial
  CRISPR gRNA sequence
caacctctgcctcctgggtt

SEQ ID NO: 771550 - DNA, 20 bp, Artificial
  CRISPR gRNA sequence
tgcctcctgggttctagcaa

SEQ ID NO: 771551 - DNA, 20 bp, Artificial
  CRISPR gRNA sequence
cctcctgggttctagcaatt

SEQ ID NO: 771552 - DNA, 20 bp, Artificial
  CRISPR gRNA sequence
ctgggttctagcaattctcc

SEQ ID NO: 771553 - DNA, 20 bp, Artificial
  CRISPR gRNA sequence
ggttctagcaattctcctgc

SEQ ID NO: 771554 - DNA, 20 bp, Artificial
  CRISPR gRNA sequence
tagcaattctcctgcctcac

SEQ ID NO: 771555 - DNA, 20 bp, Artificial
  CRISPR gRNA sequence
gcaattctcctgcctcaccc

SEQ ID NO: 771556 - DNA, 20 bp, Artificial
  CRISPR gRNA sequence
tcctgcctcaccctcccaag

SEQ ID NO: 771557 - DNA, 20 bp, Artificial
  CRISPR gRNA sequence
ctgcctcaccctcccaagta

SEQ ID NO: 771558 - DNA, 20 bp, Artificial
  CRISPR gRNA sequence
cctcaccctcccaagtagct

SEQ ID NO: 771559 - DNA, 20 bp, Artificial
  CRISPR gRNA sequence
accctcccaagtagctggga

SEQ ID NO: 771560 - DNA, 20 bp, Artificial
  CRISPR gRNA sequence
ccaagtagctgggattacag

SEQ ID NO: 771561 - DNA, 20 bp, Artificial
  CRISPR gRNA sequence
ggattacaggtgcccaccac

SEQ ID NO: 771562 - DNA, 20 bp, Artificial
  CRISPR gRNA sequence
caggtgcccaccaccatgcc

SEQ ID NO: 771563 - DNA, 20 bp, Artificial
  CRISPR gRNA sequence
attatttgtatttttagtag

SEQ ID NO: 771564 - DNA, 20 bp, Artificial
  CRISPR gRNA sequence
tttgtatttttagtagagat

SEQ ID NO: 771565 - DNA, 20 bp, Artificial
  CRISPR gRNA sequence
gtatttttagtagagatggg

SEQ ID NO: 771566 - DNA, 20 bp, Artificial
  CRISPR gRNA sequence
tatttttagtagagatgggg

SEQ ID NO: 771567 - DNA, 20 bp, Artificial
  CRISPR gRNA sequence
ttagtagagatggggtttca

SEQ ID NO: 771568 - DNA, 20 bp, Artificial
  CRISPR gRNA sequence
tagtagagatggggtttcac

SEQ ID NO: 771569 - DNA, 20 bp, Artificial
  CRISPR gRNA sequence
agtagagatggggtttcacc

SEQ ID NO: 771570 - DNA, 20 bp, Artificial
  CRISPR gRNA sequence
gtagagatggggtttcacca

SEQ ID NO: 771571 - DNA, 20 bp, Artificial
  CRISPR gRNA sequence
caccatgttgttcaaaccgg

SEQ ID NO: 771572 - DNA, 20 bp, Artificial
  CRISPR gRNA sequence
accatgttgttcaaaccggt

SEQ ID NO: 771573 - DNA, 20 bp, Artificial
  CRISPR gRNA sequence
ttcaaaccggtcacaaactc

SEQ ID NO: 771574 - DNA, 20 bp, Artificial
  CRISPR gRNA sequence
aaaccggtcacaaactcctg

SEQ ID NO: 771575 - DNA, 20 bp, Artificial
  CRISPR gRNA sequence
ctgacttcaagtgattcgcc

SEQ ID NO: 771576 - DNA, 20 bp, Artificial
  CRISPR gRNA sequence
acttcaagtgattcgcctgc

SEQ ID NO: 771577 - DNA, 20 bp, Artificial
  CRISPR gRNA sequence
caagtgattcgcctgcctca

SEQ ID NO: 771578 - DNA, 20 bp, Artificial
  CRISPR gRNA sequence
aagtgattcgcctgcctcag

SEQ ID NO: 771579 - DNA, 20 bp, Artificial
  CRISPR gRNA sequence
gcctgcctcagcctcccaaa

SEQ ID NO: 771580 - DNA, 20 bp, Artificial
  CRISPR gRNA sequence
cctcagcctcccaaagtgct

SEQ ID NO: 771581 - DNA, 20 bp, Artificial
  CRISPR gRNA sequence
agcctcccaaagtgctggga

SEQ ID NO: 771582 - DNA, 20 bp, Artificial
  CRISPR gRNA sequence
ccaaagtgctgggattacag

SEQ ID NO: 771583 - DNA, 20 bp, Artificial
  CRISPR gRNA sequence
ggattacaggcatgagccac

SEQ ID NO: 771584 - DNA, 20 bp, Artificial
  CRISPR gRNA sequence
caggcatgagccactgcact

SEQ ID NO: 771585 - DNA, 20 bp, Artificial
  CRISPR gRNA sequence
cactcagcctgaaatagcct

SEQ ID NO: 771586 - DNA, 20 bp, Artificial
  CRISPR gRNA sequence
agcctgaaatagcctcttaa

SEQ ID NO: 771587 - DNA, 20 bp, Artificial
  CRISPR gRNA sequence
aaatagcctcttaactggcc

SEQ ID NO: 771588 - DNA, 20 bp, Artificial
  CRISPR gRNA sequence
ttaactggcctctcccttgc

SEQ ID NO: 771589 - DNA, 20 bp, Artificial
  CRISPR gRNA sequence
aactggcctctcccttgccc

SEQ ID NO: 771590 - DNA, 20 bp, Artificial
  CRISPR gRNA sequence
actggcctctcccttgccct

SEQ ID NO: 771591 - DNA, 20 bp, Artificial
  CRISPR gRNA sequence
gcctctcccttgccctgata

SEQ ID NO: 771592 - DNA, 20 bp, Artificial
  CRISPR gRNA sequence
tcccttgccctgatacaatc

SEQ ID NO: 771593 - DNA, 20 bp, Artificial
  CRISPR gRNA sequence
ccttgccctgatacaatcca

SEQ ID NO: 771594 - DNA, 20 bp, Artificial
  CRISPR gRNA sequence
gccctgatacaatccagtct

SEQ ID NO: 771595 - DNA, 20 bp, Artificial
  CRISPR gRNA sequence
ccctgatacaatccagtcta

SEQ ID NO: 771596 - DNA, 20 bp, Artificial
  CRISPR gRNA sequence
atacaatccagtctatgctg

SEQ ID NO: 771597 - DNA, 20 bp, Artificial
  CRISPR gRNA sequence
tgctgaggagctagagtggg

SEQ ID NO: 771598 - DNA, 20 bp, Artificial
  CRISPR gRNA sequence
aggagctagagtgggtttta

SEQ ID NO: 771599 - DNA, 20 bp, Artificial
  CRISPR gRNA sequence
gagtgggttttaaacattgt

SEQ ID NO: 771600 - DNA, 20 bp, Artificial
  CRISPR gRNA sequence
taaacattgttacctagatt

SEQ ID NO: 771601 - DNA, 20 bp, Artificial
  CRISPR gRNA sequence
aaacattgttacctagatta

SEQ ID NO: 771602 - DNA, 20 bp, Artificial
  CRISPR gRNA sequence
aacattgttacctagattat

SEQ ID NO: 771603 - DNA, 20 bp, Artificial
  CRISPR gRNA sequence
ttacctagattatgtgtgat

SEQ ID NO: 771604 - DNA, 20 bp, Artificial
  CRISPR gRNA sequence
cctagattatgtgtgattaa

SEQ ID NO: 771605 - DNA, 20 bp, Artificial
  CRISPR gRNA sequence
gattatgtgtgattaaaatg

SEQ ID NO: 771606 - DNA, 20 bp, Artificial
  CRISPR gRNA sequence
tgtgtgattaaaatgctccc

SEQ ID NO: 771607 - DNA, 20 bp, Artificial
  CRISPR gRNA sequence
aaatgctccccagtgattcc

SEQ ID NO: 771608 - DNA, 20 bp, Artificial
  CRISPR gRNA sequence
cccagtgattcccattactc

SEQ ID NO: 771609 - DNA, 20 bp, Artificial
  CRISPR gRNA sequence
ccattactcatagaaaaacc

SEQ ID NO: 771610 - DNA, 20 bp, Artificial
  CRISPR gRNA sequence
ctcatagaaaaacccaaatt

SEQ ID NO: 771611 - DNA, 20 bp, Artificial
  CRISPR gRNA sequence
atagaaaaacccaaattcct

SEQ ID NO: 771612 - DNA, 20 bp, Artificial
  CRISPR gRNA sequence
ctcactggtctctcaaagcc

SEQ ID NO: 771613 - DNA, 20 bp, Artificial
  CRISPR gRNA sequence
actggtctctcaaagccctg

SEQ ID NO: 771614 - DNA, 20 bp, Artificial
  CRISPR gRNA sequence
gtctctcaaagccctgcttg

SEQ ID NO: 771615 - DNA, 20 bp, Artificial
  CRISPR gRNA sequence
tcaaagccctgcttgatctg

SEQ ID NO: 771616 - DNA, 20 bp, Artificial
  CRISPR gRNA sequence
aaagccctgcttgatctggc

SEQ ID NO: 771617 - DNA, 20 bp, Artificial
  CRISPR gRNA sequence
cttgatctggctgaaacata

SEQ ID NO: 771618 - DNA, 20 bp, Artificial
  CRISPR gRNA sequence
gatctggctgaaacataccc

SEQ ID NO: 771619 - DNA, 20 bp, Artificial
  CRISPR gRNA sequence
atctggctgaaacataccct

SEQ ID NO: 771620 - DNA, 20 bp, Artificial
  CRISPR gRNA sequence
gctgaaacataccctcccat

SEQ ID NO: 771621 - DNA, 20 bp, Artificial
  CRISPR gRNA sequence
aaacataccctcccatcaga

SEQ ID NO: 771622 - DNA, 20 bp, Artificial
  CRISPR gRNA sequence
ccatcagatagcgggtggag

SEQ ID NO: 771623 - DNA, 20 bp, Artificial
  CRISPR gRNA sequence
tcagattaatcttcatgaag

SEQ ID NO: 771624 - DNA, 20 bp, Artificial
  CRISPR gRNA sequence
atcttcatgaagctcagctc

SEQ ID NO: 771625 - DNA, 20 bp, Artificial
  CRISPR gRNA sequence
catgaagctcagctctgacc

SEQ ID NO: 771626 - DNA, 20 bp, Artificial
  CRISPR gRNA sequence
atgaagctcagctctgaccg

SEQ ID NO: 771627 - DNA, 20 bp, Artificial
  CRISPR gRNA sequence
agctctgaccgtgtatttcc

SEQ ID NO: 771628 - DNA, 20 bp, Artificial
  CRISPR gRNA sequence
tgaccgtgtatttcccttat

SEQ ID NO: 771629 - DNA, 20 bp, Artificial
  CRISPR gRNA sequence
accgtgtatttcccttattc

SEQ ID NO: 771630 - DNA, 20 bp, Artificial
  CRISPR gRNA sequence
cccttattcaggaagcttca

SEQ ID NO: 771631 - DNA, 20 bp, Artificial
  CRISPR gRNA sequence
ccttattcaggaagcttcag

SEQ ID NO: 771632 - DNA, 20 bp, Artificial
  CRISPR gRNA sequence
attcaggaagcttcagtggc

SEQ ID NO: 771633 - DNA, 20 bp, Artificial
  CRISPR gRNA sequence
ttcaggaagcttcagtggct

SEQ ID NO: 771634 - DNA, 20 bp, Artificial
  CRISPR gRNA sequence
aggaagcttcagtggctctc

SEQ ID NO: 771635 - DNA, 20 bp, Artificial
  CRISPR gRNA sequence
cagtggctctcaactgcctt

SEQ ID NO: 771636 - DNA, 20 bp, Artificial
  CRISPR gRNA sequence
agtggctctcaactgccttt

SEQ ID NO: 771637 - DNA, 20 bp, Artificial
  CRISPR gRNA sequence
tcaactgcctttaggataca

SEQ ID NO: 771638 - DNA, 20 bp, Artificial
  CRISPR gRNA sequence
aactgcctttaggatacatt

SEQ ID NO: 771639 - DNA, 20 bp, Artificial
  CRISPR gRNA sequence
cctttaggatacatttcaca

SEQ ID NO: 771640 - DNA, 20 bp, Artificial
  CRISPR gRNA sequence
taggatacatttcacacctg

SEQ ID NO: 771641 - DNA, 20 bp, Artificial
  CRISPR gRNA sequence
aggatacatttcacacctgt

SEQ ID NO: 771642 - DNA, 20 bp, Artificial
  CRISPR gRNA sequence
ggatacatttcacacctgtc

SEQ ID NO: 771643 - DNA, 20 bp, Artificial
  CRISPR gRNA sequence
cacacctgtcagcccatctc

SEQ ID NO: 771644 - DNA, 20 bp, Artificial
  CRISPR gRNA sequence
acacctgtcagcccatctct

SEQ ID NO: 771645 - DNA, 20 bp, Artificial
  CRISPR gRNA sequence
tcagcccatctctaagtctg

SEQ ID NO: 771646 - DNA, 20 bp, Artificial
  CRISPR gRNA sequence
taagtctggcccccacagga

SEQ ID NO: 771647 - DNA, 20 bp, Artificial
  CRISPR gRNA sequence
agtctggcccccacaggagc

SEQ ID NO: 771648 - DNA, 20 bp, Artificial
  CRISPR gRNA sequence
gcccccacaggagctcctgc

SEQ ID NO: 771649 - DNA, 20 bp, Artificial
  CRISPR gRNA sequence
ctgctctgccctaccagcta

SEQ ID NO: 771650 - DNA, 20 bp, Artificial
  CRISPR gRNA sequence
ctctgccctaccagctactg

SEQ ID NO: 771651 - DNA, 20 bp, Artificial
  CRISPR gRNA sequence
tgccctaccagctactgtct

SEQ ID NO: 771652 - DNA, 20 bp, Artificial
  CRISPR gRNA sequence
ccctaccagctactgtctgc

SEQ ID NO: 771653 - DNA, 20 bp, Artificial
  CRISPR gRNA sequence
ccagctactgtctgccaaat

SEQ ID NO: 771654 - DNA, 20 bp, Artificial
  CRISPR gRNA sequence
ctgtctgccaaattgatctg

SEQ ID NO: 771655 - DNA, 20 bp, Artificial
  CRISPR gRNA sequence
tctgccaaattgatctgcac

SEQ ID NO: 771656 - DNA, 20 bp, Artificial
  CRISPR gRNA sequence
ccaaattgatctgcacacat

SEQ ID NO: 771657 - DNA, 20 bp, Artificial
  CRISPR gRNA sequence
atctgcacacatcctagccc

SEQ ID NO: 771658 - DNA, 20 bp, Artificial
  CRISPR gRNA sequence
cacacatcctagccccagag

SEQ ID NO: 771659 - DNA, 20 bp, Artificial
  CRISPR gRNA sequence
gccccagagcaagccaacct

SEQ ID NO: 771660 - DNA, 20 bp, Artificial
  CRISPR gRNA sequence
gccttcacttgccgccttgc

SEQ ID NO: 771661 - DNA, 20 bp, Artificial
  CRISPR gRNA sequence
ccttcacttgccgccttgcc

SEQ ID NO: 771662 - DNA, 20 bp, Artificial
  CRISPR gRNA sequence
cacttgccgccttgcctcct

SEQ ID NO: 771663 - DNA, 20 bp, Artificial
  CRISPR gRNA sequence
acttgccgccttgcctcctc

SEQ ID NO: 771664 - DNA, 20 bp, Artificial
  CRISPR gRNA sequence
gccgccttgcctcctcttcc

SEQ ID NO: 771665 - DNA, 20 bp, Artificial
  CRISPR gRNA sequence
ccgccttgcctcctcttcct

SEQ ID NO: 771666 - DNA, 20 bp, Artificial
  CRISPR gRNA sequence
gcctcctcttccttatattt

SEQ ID NO: 771667 - DNA, 20 bp, Artificial
  CRISPR gRNA sequence
cctcctcttccttatatttg

SEQ ID NO: 771668 - DNA, 20 bp, Artificial
  CRISPR gRNA sequence
ctcttccttatatttggata

SEQ ID NO: 771669 - DNA, 20 bp, Artificial
  CRISPR gRNA sequence
ttccttatatttggatacta

SEQ ID NO: 771670 - DNA, 20 bp, Artificial
  CRISPR gRNA sequence
ccttatatttggatactaac

SEQ ID NO: 771671 - DNA, 20 bp, Artificial
  CRISPR gRNA sequence
cttatatttggatactaaca

SEQ ID NO: 771672 - DNA, 20 bp, Artificial
  CRISPR gRNA sequence
atatttggatactaacatct

SEQ ID NO: 771673 - DNA, 20 bp, Artificial
  CRISPR gRNA sequence
tatttggatactaacatctt

SEQ ID NO: 771674 - DNA, 20 bp, Artificial
  CRISPR gRNA sequence
ggatactaacatcttagctg

SEQ ID NO: 771675 - DNA, 20 bp, Artificial
  CRISPR gRNA sequence
gatactaacatcttagctga

SEQ ID NO: 771676 - DNA, 20 bp, Artificial
  CRISPR gRNA sequence
acatcttagctgaaagggtg

SEQ ID NO: 771677 - DNA, 20 bp, Artificial
  CRISPR gRNA sequence
agctgaaagggtggatccca

SEQ ID NO: 771678 - DNA, 20 bp, Artificial
  CRISPR gRNA sequence
gctgaaagggtggatcccag

SEQ ID NO: 771679 - DNA, 20 bp, Artificial
  CRISPR gRNA sequence
aaagggtggatcccagctgc

SEQ ID NO: 771680 - DNA, 20 bp, Artificial
  CRISPR gRNA sequence
ccccctaccccatcttccct

SEQ ID NO: 771681 - DNA, 20 bp, Artificial
  CRISPR gRNA sequence
ccccatcttccctgtcaggc

SEQ ID NO: 771682 - DNA, 20 bp, Artificial
  CRISPR gRNA sequence
ccctgtcaggcctccccagg

SEQ ID NO: 771683 - DNA, 20 bp, Artificial
  CRISPR gRNA sequence
cctgtcaggcctccccaggg

SEQ ID NO: 771684 - DNA, 20 bp, Artificial
  CRISPR gRNA sequence
tcaggcctccccagggactc

SEQ ID NO: 771685 - DNA, 20 bp, Artificial
  CRISPR gRNA sequence
cccagggactccctgccaag

SEQ ID NO: 771686 - DNA, 20 bp, Artificial
  CRISPR gRNA sequence
cctgccaagcatctgtcacc

SEQ ID NO: 771687 - DNA, 20 bp, Artificial
  CRISPR gRNA sequence
ccaagcatctgtcaccaaga

SEQ ID NO: 771688 - DNA, 20 bp, Artificial
  CRISPR gRNA sequence
tcaccaagattcctcagcag

SEQ ID NO: 771689 - DNA, 20 bp, Artificial
  CRISPR gRNA sequence
ctcagcagggggcccggtgg

SEQ ID NO: 771690 - DNA, 20 bp, Artificial
  CRISPR gRNA sequence
agcagggggcccggtgggat

SEQ ID NO: 771691 - DNA, 20 bp, Artificial
  CRISPR gRNA sequence
ccagtgggcagttgcagcct

SEQ ID NO: 771692 - DNA, 20 bp, Artificial
  CRISPR gRNA sequence
cagccttccccactctggtc

SEQ ID NO: 771693 - DNA, 20 bp, Artificial
  CRISPR gRNA sequence
ccccactctggtccaggaga

SEQ ID NO: 771694 - DNA, 20 bp, Artificial
  CRISPR gRNA sequence
cccactctggtccaggagag

SEQ ID NO: 771695 - DNA, 20 bp, Artificial
  CRISPR gRNA sequence
tggtccaggagagatgaggc

SEQ ID NO: 771696 - DNA, 20 bp, Artificial
  CRISPR gRNA sequence
gtccaggagagatgaggcaa

SEQ ID NO: 771697 - DNA, 20 bp, Artificial
  CRISPR gRNA sequence
gggagaacctttggagacaa

SEQ ID NO: 771698 - DNA, 20 bp, Artificial
  CRISPR gRNA sequence
tggagacaaaggccttgcgt

SEQ ID NO: 771699 - DNA, 20 bp, Artificial
  CRISPR gRNA sequence
ggagacaaaggccttgcgtc

SEQ ID NO: 771700 - DNA, 20 bp, Artificial
  CRISPR gRNA sequence
gagacaaaggccttgcgtcc

SEQ ID NO: 771701 - DNA, 20 bp, Artificial
  CRISPR gRNA sequence
gcgtcctctttctcccaggc

SEQ ID NO: 771702 - DNA, 20 bp, Artificial
  CRISPR gRNA sequence
cgtcctctttctcccaggca

SEQ ID NO: 771703 - DNA, 20 bp, Artificial
  CRISPR gRNA sequence
tttctcccaggcaggggcag

SEQ ID NO: 771704 - DNA, 20 bp, Artificial
  CRISPR gRNA sequence
tctcccaggcaggggcagcc

SEQ ID NO: 771705 - DNA, 20 bp, Artificial
  CRISPR gRNA sequence
ctcccaggcaggggcagcct

SEQ ID NO: 771706 - DNA, 20 bp, Artificial
  CRISPR gRNA sequence
tcccaggcaggggcagcctt

SEQ ID NO: 771707 - DNA, 20 bp, Artificial
  CRISPR gRNA sequence
ccaggcaggggcagccttcc

SEQ ID NO: 771708 - DNA, 20 bp, Artificial
  CRISPR gRNA sequence
ccaccacggggagcccagct

SEQ ID NO: 771709 - DNA, 20 bp, Artificial
  CRISPR gRNA sequence
caccacggggagcccagctg

SEQ ID NO: 771710 - DNA, 20 bp, Artificial
  CRISPR gRNA sequence
tcagccgcctcacaggaaga

SEQ ID NO: 771711 - DNA, 20 bp, Artificial
  CRISPR gRNA sequence
acaggaagatgctgcgtcgg

SEQ ID NO: 771712 - DNA, 20 bp, Artificial
  CRISPR gRNA sequence
cgtcggcggggcagccctgg

SEQ ID NO: 771713 - DNA, 20 bp, Artificial
  CRISPR gRNA sequence
gcatgggtgtgcatgtgggt

SEQ ID NO: 771714 - DNA, 20 bp, Artificial
  CRISPR gRNA sequence
ggagcactgtggttctgcct

SEQ ID NO: 771715 - DNA, 20 bp, Artificial
  CRISPR gRNA sequence
tggttctgcctcacaggtga

SEQ ID NO: 771716 - DNA, 20 bp, Artificial
  CRISPR gRNA sequence
tgcctcacaggtgagggtag

SEQ ID NO: 771717 - DNA, 20 bp, Artificial
  CRISPR gRNA sequence
cctcacaggtgagggtagca

SEQ ID NO: 771718 - DNA, 20 bp, Artificial
  CRISPR gRNA sequence
acaggtgagggtagcagcat

SEQ ID NO: 771719 - DNA, 20 bp, Artificial
  CRISPR gRNA sequence
tggcagttggggagggggtg

SEQ ID NO: 771720 - DNA, 20 bp, Artificial
  CRISPR gRNA sequence
gggagggggtgcccacgcct

SEQ ID NO: 771721 - DNA, 20 bp, Artificial
  CRISPR gRNA sequence
ttaggggtcctgccaagcca

SEQ ID NO: 771722 - DNA, 20 bp, Artificial
  CRISPR gRNA sequence
ggggtcctgccaagccagct

SEQ ID NO: 771723 - DNA, 20 bp, Artificial
  CRISPR gRNA sequence
ccaagccagctctggctagc

SEQ ID NO: 771724 - DNA, 20 bp, Artificial
  CRISPR gRNA sequence
tggctagcagggccatacct

SEQ ID NO: 771725 - DNA, 20 bp, Artificial
  CRISPR gRNA sequence
gctagcagggccatacctta

SEQ ID NO: 771726 - DNA, 20 bp, Artificial
  CRISPR gRNA sequence
gcagggccataccttacttc

SEQ ID NO: 771727 - DNA, 20 bp, Artificial
  CRISPR gRNA sequence
acttccacctgtgggatcca

SEQ ID NO: 771728 - DNA, 20 bp, Artificial
  CRISPR gRNA sequence
cttccacctgtgggatccag

SEQ ID NO: 771729 - DNA, 20 bp, Artificial
  CRISPR gRNA sequence
ccacctgtgggatccagtag

SEQ ID NO: 771730 - DNA, 20 bp, Artificial
  CRISPR gRNA sequence
cacctgtgggatccagtagg

SEQ ID NO: 771731 - DNA, 20 bp, Artificial
  CRISPR gRNA sequence
tgggatccagtaggcaactc

SEQ ID NO: 771732 - DNA, 20 bp, Artificial
  CRISPR gRNA sequence
acgttactgttcttagcctc

SEQ ID NO: 771733 - DNA, 20 bp, Artificial
  CRISPR gRNA sequence
ctgttcttagcctccatttc

SEQ ID NO: 771734 - DNA, 20 bp, Artificial
  CRISPR gRNA sequence
ttcttagcctccatttcctt

SEQ ID NO: 771735 - DNA, 20 bp, Artificial
  CRISPR gRNA sequence
ttagcctccatttccttgtc

SEQ ID NO: 771736 - DNA, 20 bp, Artificial
  CRISPR gRNA sequence
agcctccatttccttgtctg

SEQ ID NO: 771737 - DNA, 20 bp, Artificial
  CRISPR gRNA sequence
gcctccatttccttgtctgt

SEQ ID NO: 771738 - DNA, 20 bp, Artificial
  CRISPR gRNA sequence
catttccttgtctgtaaaat

SEQ ID NO: 771739 - DNA, 20 bp, Artificial
  CRISPR gRNA sequence
ccttgtctgtaaaatgggaa

SEQ ID NO: 771740 - DNA, 20 bp, Artificial
  CRISPR gRNA sequence
cttgtctgtaaaatgggaac

SEQ ID NO: 771741 - DNA, 20 bp, Artificial
  CRISPR gRNA sequence
gtctgtaaaatgggaacatg

SEQ ID NO: 771742 - DNA, 20 bp, Artificial
  CRISPR gRNA sequence
tctgtaaaatgggaacatga

SEQ ID NO: 771743 - DNA, 20 bp, Artificial
  CRISPR gRNA sequence
taaaatgggaacatgagtgc

SEQ ID NO: 771744 - DNA, 20 bp, Artificial
  CRISPR gRNA sequence
aatgagatcgtgctatttct

SEQ ID NO: 771745 - DNA, 20 bp, Artificial
  CRISPR gRNA sequence
tttcttgaatacactgtgtg

SEQ ID NO: 771746 - DNA, 20 bp, Artificial
  CRISPR gRNA sequence
cttgaatacactgtgtgcgc

SEQ ID NO: 771747 - DNA, 20 bp, Artificial
  CRISPR gRNA sequence
ttgaatacactgtgtgcgcc

SEQ ID NO: 771748 - DNA, 20 bp, Artificial
  CRISPR gRNA sequence
gaatacactgtgtgcgcccc

SEQ ID NO: 771749 - DNA, 20 bp, Artificial
  CRISPR gRNA sequence
aatacactgtgtgcgccccc

SEQ ID NO: 771750 - DNA, 20 bp, Artificial
  CRISPR gRNA sequence
tgtgcgccccctcccaggac

SEQ ID NO: 771751 - DNA, 20 bp, Artificial
  CRISPR gRNA sequence
ccaggacctttccacttgct

SEQ ID NO: 771752 - DNA, 20 bp, Artificial
  CRISPR gRNA sequence
tccacttgctctttcctctg

SEQ ID NO: 771753 - DNA, 20 bp, Artificial
  CRISPR gRNA sequence
ccacttgctctttcctctgc

SEQ ID NO: 771754 - DNA, 20 bp, Artificial
  CRISPR gRNA sequence
cacttgctctttcctctgcc

SEQ ID NO: 771755 - DNA, 20 bp, Artificial
  CRISPR gRNA sequence
gctctttcctctgcctggaa

SEQ ID NO: 771756 - DNA, 20 bp, Artificial
  CRISPR gRNA sequence
ctctttcctctgcctggaac

SEQ ID NO: 771757 - DNA, 20 bp, Artificial
  CRISPR gRNA sequence
tttcctctgcctggaacttt

SEQ ID NO: 771758 - DNA, 20 bp, Artificial
  CRISPR gRNA sequence
tcctctgcctggaactttct

SEQ ID NO: 771759 - DNA, 20 bp, Artificial
  CRISPR gRNA sequence
cctctgcctggaactttctg

SEQ ID NO: 771760 - DNA, 20 bp, Artificial
  CRISPR gRNA sequence
ctctgcctggaactttctgc

SEQ ID NO: 771761 - DNA, 20 bp, Artificial
  CRISPR gRNA sequence
tgcctggaactttctgcccc

SEQ ID NO: 771762 - DNA, 20 bp, Artificial
  CRISPR gRNA sequence
cctggaactttctgccccta

SEQ ID NO: 771763 - DNA, 20 bp, Artificial
  CRISPR gRNA sequence
gaactttctgcccctaaacg

SEQ ID NO: 771764 - DNA, 20 bp, Artificial
  CRISPR gRNA sequence
tctgcccctaaacgtctgca

SEQ ID NO: 771765 - DNA, 20 bp, Artificial
  CRISPR gRNA sequence
ctgcccctaaacgtctgcat

SEQ ID NO: 771766 - DNA, 20 bp, Artificial
  CRISPR gRNA sequence
tgcccctaaacgtctgcatg

SEQ ID NO: 771767 - DNA, 20 bp, Artificial
  CRISPR gRNA sequence
cccctaaacgtctgcatgac

SEQ ID NO: 771768 - DNA, 20 bp, Artificial
  CRISPR gRNA sequence
aacgtctgcatgactggatc

SEQ ID NO: 771769 - DNA, 20 bp, Artificial
  CRISPR gRNA sequence
catgactggatcccatattt

SEQ ID NO: 771770 - DNA, 20 bp, Artificial
  CRISPR gRNA sequence
gatcccatattttgtggagg

SEQ ID NO: 771771 - DNA, 20 bp, Artificial
  CRISPR gRNA sequence
tgtggaggtctttgctcaat

SEQ ID NO: 771772 - DNA, 20 bp, Artificial
  CRISPR gRNA sequence
gtggaggtctttgctcaatg

SEQ ID NO: 771773 - DNA, 20 bp, Artificial
  CRISPR gRNA sequence
tggaggtctttgctcaatgt

SEQ ID NO: 771774 - DNA, 20 bp, Artificial
  CRISPR gRNA sequence
tgctcaatgtcacctcctct

SEQ ID NO: 771775 - DNA, 20 bp, Artificial
  CRISPR gRNA sequence
gctcaatgtcacctcctctc

SEQ ID NO: 771776 - DNA, 20 bp, Artificial
  CRISPR gRNA sequence
ctcaatgtcacctcctctca

SEQ ID NO: 771777 - DNA, 20 bp, Artificial
  CRISPR gRNA sequence
aatgtcacctcctctcaagg

SEQ ID NO: 771778 - DNA, 20 bp, Artificial
  CRISPR gRNA sequence
ctctcaaggctctcctagct

SEQ ID NO: 771779 - DNA, 20 bp, Artificial
  CRISPR gRNA sequence
tcaaggctctcctagctccc

SEQ ID NO: 771780 - DNA, 20 bp, Artificial
  CRISPR gRNA sequence
aaggctctcctagctccctt

SEQ ID NO: 771781 - DNA, 20 bp, Artificial
  CRISPR gRNA sequence
tcctagctcccttgtataaa

SEQ ID NO: 771782 - DNA, 20 bp, Artificial
  CRISPR gRNA sequence
ctagctcccttgtataaaat

SEQ ID NO: 771783 - DNA, 20 bp, Artificial
  CRISPR gRNA sequence
gctcccttgtataaaatagc

SEQ ID NO: 771784 - DNA, 20 bp, Artificial
  CRISPR gRNA sequence
ccttgtataaaatagcacac

SEQ ID NO: 771785 - DNA, 20 bp, Artificial
  CRISPR gRNA sequence
gtataaaatagcacacctcc

SEQ ID NO: 771786 - DNA, 20 bp, Artificial
  CRISPR gRNA sequence
tataaaatagcacacctccg

SEQ ID NO: 771787 - DNA, 20 bp, Artificial
  CRISPR gRNA sequence
cgctcctccctccctatccc

SEQ ID NO: 771788 - DNA, 20 bp, Artificial
  CRISPR gRNA sequence
ctccctccctatccctggcc

SEQ ID NO: 771789 - DNA, 20 bp, Artificial
  CRISPR gRNA sequence
cctccctatccctggcctcc

SEQ ID NO: 771790 - DNA, 20 bp, Artificial
  CRISPR gRNA sequence
cctatccctggcctccctgc

SEQ ID NO: 771791 - DNA, 20 bp, Artificial
  CRISPR gRNA sequence
tccctggcctccctgcgtta

SEQ ID NO: 771792 - DNA, 20 bp, Artificial
  CRISPR gRNA sequence
gcctccctgcgttattctgc

SEQ ID NO: 771793 - DNA, 20 bp, Artificial
  CRISPR gRNA sequence
cctgcgttattctgcctaga

SEQ ID NO: 771794 - DNA, 20 bp, Artificial
  CRISPR gRNA sequence
cgttattctgcctagattcg

SEQ ID NO: 771795 - DNA, 20 bp, Artificial
  CRISPR gRNA sequence
ttctgcctagattcgccccc

SEQ ID NO: 771796 - DNA, 20 bp, Artificial
  CRISPR gRNA sequence
tgcctagattcgcccccacc

SEQ ID NO: 771797 - DNA, 20 bp, Artificial
  CRISPR gRNA sequence
cctagattcgcccccacctg

SEQ ID NO: 771798 - DNA, 20 bp, Artificial
  CRISPR gRNA sequence
gattcgcccccacctggcgt

SEQ ID NO: 771799 - DNA, 20 bp, Artificial
  CRISPR gRNA sequence
gcccccacctggcgtttgct

SEQ ID NO: 771800 - DNA, 20 bp, Artificial
  CRISPR gRNA sequence
gcgtttgcttgcttcctccc

SEQ ID NO: 771801 - DNA, 20 bp, Artificial
  CRISPR gRNA sequence
gcttgcttcctccctgttca

SEQ ID NO: 771802 - DNA, 20 bp, Artificial
  CRISPR gRNA sequence
cttgcttcctccctgttcaa

SEQ ID NO: 771803 - DNA, 20 bp, Artificial
  CRISPR gRNA sequence
gcttcctccctgttcaaaga

SEQ ID NO: 771804 - DNA, 20 bp, Artificial
  CRISPR gRNA sequence
cttcctccctgttcaaagag

SEQ ID NO: 771805 - DNA, 20 bp, Artificial
  CRISPR gRNA sequence
cctccctgttcaaagagcag

SEQ ID NO: 771806 - DNA, 20 bp, Artificial
  CRISPR gRNA sequence
ctccctgttcaaagagcagg

SEQ ID NO: 771807 - DNA, 20 bp, Artificial
  CRISPR gRNA sequence
cctgttcaaagagcagggtc

SEQ ID NO: 771808 - DNA, 20 bp, Artificial
  CRISPR gRNA sequence
ttcaaagagcagggtccatc

SEQ ID NO: 771809 - DNA, 20 bp, Artificial
  CRISPR gRNA sequence
aaagagcagggtccatctca

SEQ ID NO: 771810 - DNA, 20 bp, Artificial
  CRISPR gRNA sequence
agggccagagcggctgttgc

SEQ ID NO: 771811 - DNA, 20 bp, Artificial
  CRISPR gRNA sequence
ttgcatagtaggtgcccaat

SEQ ID NO: 771812 - DNA, 20 bp, Artificial
  CRISPR gRNA sequence
catagtaggtgcccaataac

SEQ ID NO: 771813 - DNA, 20 bp, Artificial
  CRISPR gRNA sequence
tgtagaataaacgatgtgac

SEQ ID NO: 771814 - DNA, 20 bp, Artificial
  CRISPR gRNA sequence
tccccacacggtgcttggca

SEQ ID NO: 771815 - DNA, 20 bp, Artificial
  CRISPR gRNA sequence
cccacacggtgcttggcaca

SEQ ID NO: 771816 - DNA, 20 bp, Artificial
  CRISPR gRNA sequence
ggcacacaggaagcactcaa

SEQ ID NO: 771817 - DNA, 20 bp, Artificial
  CRISPR gRNA sequence
gcacacaggaagcactcaat

SEQ ID NO: 771818 - DNA, 20 bp, Artificial
  CRISPR gRNA sequence
aataataatagctactttaa

SEQ ID NO: 771819 - DNA, 20 bp, Artificial
  CRISPR gRNA sequence
ctttaataacaatatcctca

SEQ ID NO: 771820 - DNA, 20 bp, Artificial
  CRISPR gRNA sequence
taataacaatatcctcatca

SEQ ID NO: 771821 - DNA, 20 bp, Artificial
  CRISPR gRNA sequence
aataacaatatcctcatcac

SEQ ID NO: 771822 - DNA, 20 bp, Artificial
  CRISPR gRNA sequence
ataacaatatcctcatcaca

SEQ ID NO: 771823 - DNA, 20 bp, Artificial
  CRISPR gRNA sequence
atcacatttcaaattctcat

SEQ ID NO: 771824 - DNA, 20 bp, Artificial
  CRISPR gRNA sequence
caaattctcatcagcatctc

SEQ ID NO: 771825 - DNA, 20 bp, Artificial
  CRISPR gRNA sequence
aaattctcatcagcatctct

SEQ ID NO: 771826 - DNA, 20 bp, Artificial
  CRISPR gRNA sequence
tcatcagcatctctgctctg

SEQ ID NO: 771827 - DNA, 20 bp, Artificial
  CRISPR gRNA sequence
atcagcatctctgctctgag

SEQ ID NO: 771828 - DNA, 20 bp, Artificial
  CRISPR gRNA sequence
tgctctgagacggcttcctc

SEQ ID NO: 771829 - DNA, 20 bp, Artificial
  CRISPR gRNA sequence
ctctgagacggcttcctccg

SEQ ID NO: 771830 - DNA, 20 bp, Artificial
  CRISPR gRNA sequence
tgagacggcttcctccgtgg

SEQ ID NO: 771831 - DNA, 20 bp, Artificial
  CRISPR gRNA sequence
agacggcttcctccgtgggg

SEQ ID NO: 771832 - DNA, 20 bp, Artificial
  CRISPR gRNA sequence
cctccgtggggaagacaaag

SEQ ID NO: 771833 - DNA, 20 bp, Artificial
  CRISPR gRNA sequence
ctccgtggggaagacaaagc

SEQ ID NO: 771834 - DNA, 20 bp, Artificial
  CRISPR gRNA sequence
cgtggggaagacaaagctga

SEQ ID NO: 771835 - DNA, 20 bp, Artificial
  CRISPR gRNA sequence
agggtctggcgccatcttgt

SEQ ID NO: 771836 - DNA, 20 bp, Artificial
  CRISPR gRNA sequence
gcgccatcttgtggccataa

SEQ ID NO: 771837 - DNA, 20 bp, Artificial
  CRISPR gRNA sequence
gtggccataaagaagtgcct

SEQ ID NO: 771838 - DNA, 20 bp, Artificial
  CRISPR gRNA sequence
tggccataaagaagtgcctg

SEQ ID NO: 771839 - DNA, 20 bp, Artificial
  CRISPR gRNA sequence
tctctacccacggctgctct

SEQ ID NO: 771840 - DNA, 20 bp, Artificial
  CRISPR gRNA sequence
tacccacggctgctctgatt

SEQ ID NO: 771841 - DNA, 20 bp, Artificial
  CRISPR gRNA sequence
cccacggctgctctgatttc

SEQ ID NO: 771842 - DNA, 20 bp, Artificial
  CRISPR gRNA sequence
ctctgatttctctagagcaa

SEQ ID NO: 771843 - DNA, 20 bp, Artificial
  CRISPR gRNA sequence
tgatttctctagagcaagaa

SEQ ID NO: 771844 - DNA, 20 bp, Artificial
  CRISPR gRNA sequence
atttctctagagcaagaaag

SEQ ID NO: 771845 - DNA, 20 bp, Artificial
  CRISPR gRNA sequence
ctctagagcaagaaagggtt

SEQ ID NO: 771846 - DNA, 20 bp, Artificial
  CRISPR gRNA sequence
tctagagcaagaaagggttt

SEQ ID NO: 771847 - DNA, 20 bp, Artificial
  CRISPR gRNA sequence
tagagcaagaaagggttttg

SEQ ID NO: 771848 - DNA, 20 bp, Artificial
  CRISPR gRNA sequence
gagcaagaaagggttttgtc

SEQ ID NO: 771849 - DNA, 20 bp, Artificial
  CRISPR gRNA sequence
tgtctgggtgacttaccagg

SEQ ID NO: 771850 - DNA, 20 bp, Artificial
  CRISPR gRNA sequence
gtctgggtgacttaccaggt

SEQ ID NO: 771851 - DNA, 20 bp, Artificial
  CRISPR gRNA sequence
tctgggtgacttaccaggtt

SEQ ID NO: 771852 - DNA, 20 bp, Artificial
  CRISPR gRNA sequence
ggtgacttaccaggtttcat

SEQ ID NO: 771853 - DNA, 20 bp, Artificial
  CRISPR gRNA sequence
accaggtttcattcccccaa

SEQ ID NO: 771854 - DNA, 20 bp, Artificial
  CRISPR gRNA sequence
ccaggtttcattcccccaaa

SEQ ID NO: 771855 - DNA, 20 bp, Artificial
  CRISPR gRNA sequence
cattcccccaaatgtcccct

SEQ ID NO: 771856 - DNA, 20 bp, Artificial
  CRISPR gRNA sequence
attcccccaaatgtcccctc

SEQ ID NO: 771857 - DNA, 20 bp, Artificial
  CRISPR gRNA sequence
ccccaaatgtcccctccaag

SEQ ID NO: 771858 - DNA, 20 bp, Artificial
  CRISPR gRNA sequence
caaggggcaccctggttcga

SEQ ID NO: 771859 - DNA, 20 bp, Artificial
  CRISPR gRNA sequence
gttcgactgacagggcatga

SEQ ID NO: 771860 - DNA, 20 bp, Artificial
  CRISPR gRNA sequence
gactgacagggcatgagaac

SEQ ID NO: 771861 - DNA, 20 bp, Artificial
  CRISPR gRNA sequence
acagggcatgagaactggcc

SEQ ID NO: 771862 - DNA, 20 bp, Artificial
  CRISPR gRNA sequence
gcctggggcaccaggggttt

SEQ ID NO: 771863 - DNA, 20 bp, Artificial
  CRISPR gRNA sequence
gggcaccaggggtttcagca

SEQ ID NO: 771864 - DNA, 20 bp, Artificial
  CRISPR gRNA sequence
cagcaagagatccaaggcta

SEQ ID NO: 771865 - DNA, 20 bp, Artificial
  CRISPR gRNA sequence
agcaagagatccaaggctag

SEQ ID NO: 771866 - DNA, 20 bp, Artificial
  CRISPR gRNA sequence
gcttaagaactttagagatc

SEQ ID NO: 771867 - DNA, 20 bp, Artificial
  CRISPR gRNA sequence
aagaactttagagatctcta

SEQ ID NO: 771868 - DNA, 20 bp, Artificial
  CRISPR gRNA sequence
agaactttagagatctctag

SEQ ID NO: 771869 - DNA, 20 bp, Artificial
  CRISPR gRNA sequence
tagagatctctaggtactgc

SEQ ID NO: 771870 - DNA, 20 bp, Artificial
  CRISPR gRNA sequence
agagatctctaggtactgca

SEQ ID NO: 771871 - DNA, 20 bp, Artificial
  CRISPR gRNA sequence
gagatctctaggtactgcaa

SEQ ID NO: 771872 - DNA, 20 bp, Artificial
  CRISPR gRNA sequence
taggtactgcaaagattatg

SEQ ID NO: 771873 - DNA, 20 bp, Artificial
  CRISPR gRNA sequence
ggtactgcaaagattatgat

SEQ ID NO: 771874 - DNA, 20 bp, Artificial
  CRISPR gRNA sequence
caaagattatgatactgagt

SEQ ID NO: 771875 - DNA, 20 bp, Artificial
  CRISPR gRNA sequence
tgatactgagtatgattcac

SEQ ID NO: 771876 - DNA, 20 bp, Artificial
  CRISPR gRNA sequence
agtatgattcacaataaaaa

SEQ ID NO: 771877 - DNA, 20 bp, Artificial
  CRISPR gRNA sequence
acaataaaaataataaccat

SEQ ID NO: 771878 - DNA, 20 bp, Artificial
  CRISPR gRNA sequence
tttttctaaatgcaggaaac

SEQ ID NO: 771879 - DNA, 20 bp, Artificial
  CRISPR gRNA sequence
ttctaaatgcaggaaacctt

SEQ ID NO: 771880 - DNA, 20 bp, Artificial
  CRISPR gRNA sequence
tctaaatgcaggaaaccttt

SEQ ID NO: 771881 - DNA, 20 bp, Artificial
  CRISPR gRNA sequence
ctaaatgcaggaaaccttta

SEQ ID NO: 771882 - DNA, 20 bp, Artificial
  CRISPR gRNA sequence
taaatgcaggaaacctttaa

SEQ ID NO: 771883 - DNA, 20 bp, Artificial
  CRISPR gRNA sequence
aatgcaggaaacctttaatg

SEQ ID NO: 771884 - DNA, 20 bp, Artificial
  CRISPR gRNA sequence
taatgagtgctgtattcaat

SEQ ID NO: 771885 - DNA, 20 bp, Artificial
  CRISPR gRNA sequence
aatgagtgctgtattcaatt

SEQ ID NO: 771886 - DNA, 20 bp, Artificial
  CRISPR gRNA sequence
atgagtgctgtattcaatta

SEQ ID NO: 771887 - DNA, 20 bp, Artificial
  CRISPR gRNA sequence
tattcaattagcattgtttc

SEQ ID NO: 771888 - DNA, 20 bp, Artificial
  CRISPR gRNA sequence
aattagcattgtttcaaggt

SEQ ID NO: 771889 - DNA, 20 bp, Artificial
  CRISPR gRNA sequence
gcattgtttcaaggttgatc

SEQ ID NO: 771890 - DNA, 20 bp, Artificial
  CRISPR gRNA sequence
tttcaaggttgatcttccca

SEQ ID NO: 771891 - DNA, 20 bp, Artificial
  CRISPR gRNA sequence
caaggttgatcttcccacat

SEQ ID NO: 771892 - DNA, 20 bp, Artificial
  CRISPR gRNA sequence
aaggttgatcttcccacatt

SEQ ID NO: 771893 - DNA, 20 bp, Artificial
  CRISPR gRNA sequence
atcttcccacattttgagtg

SEQ ID NO: 771894 - DNA, 20 bp, Artificial
  CRISPR gRNA sequence
cccacattttgagtgtgcct

SEQ ID NO: 771895 - DNA, 20 bp, Artificial
  CRISPR gRNA sequence
ccacattttgagtgtgcctg

SEQ ID NO: 771896 - DNA, 20 bp, Artificial
  CRISPR gRNA sequence
tgagtgtgcctgctttgcta

SEQ ID NO: 771897 - DNA, 20 bp, Artificial
  CRISPR gRNA sequence
gagtgtgcctgctttgctag

SEQ ID NO: 771898 - DNA, 20 bp, Artificial
  CRISPR gRNA sequence
agtgtgcctgctttgctagt

SEQ ID NO: 771899 - DNA, 20 bp, Artificial
  CRISPR gRNA sequence
ctttgctagtgctcgaagca

SEQ ID NO: 771900 - DNA, 20 bp, Artificial
  CRISPR gRNA sequence
tgctagtgctcgaagcacac

SEQ ID NO: 771901 - DNA, 20 bp, Artificial
  CRISPR gRNA sequence
gctagtgctcgaagcacaca

SEQ ID NO: 771902 - DNA, 20 bp, Artificial
  CRISPR gRNA sequence
ctagtgctcgaagcacacaa

SEQ ID NO: 771903 - DNA, 20 bp, Artificial
  CRISPR gRNA sequence
gtgctcgaagcacacaatct

SEQ ID NO: 771904 - DNA, 20 bp, Artificial
  CRISPR gRNA sequence
gaagcacacaatctaaccat

SEQ ID NO: 771905 - DNA, 20 bp, Artificial
  CRISPR gRNA sequence
accattaccggagaatggta

SEQ ID NO: 771906 - DNA, 20 bp, Artificial
  CRISPR gRNA sequence
ccggagaatggtagtgccag

SEQ ID NO: 771907 - DNA, 20 bp, Artificial
  CRISPR gRNA sequence
gcttcccctcctcccctcct

SEQ ID NO: 771908 - DNA, 20 bp, Artificial
  CRISPR gRNA sequence
cccctcctcccctcctcctc

SEQ ID NO: 771909 - DNA, 20 bp, Artificial
  CRISPR gRNA sequence
ccctcctcccctcctcctcc

SEQ ID NO: 771910 - DNA, 20 bp, Artificial
  CRISPR gRNA sequence
ctcccctcctcctcctcctc

SEQ ID NO: 771911 - DNA, 20 bp, Artificial
  CRISPR gRNA sequence
ccctcctcctcctcctcttt

SEQ ID NO: 771912 - DNA, 20 bp, Artificial
  CRISPR gRNA sequence
ctcctcctcctctttttttt

SEQ ID NO: 771913 - DNA, 20 bp, Artificial
  CRISPR gRNA sequence
ctcctcctcttttttttttt

SEQ ID NO: 771914 - DNA, 20 bp, Artificial
  CRISPR gRNA sequence
ctcctctttttttttttttg

SEQ ID NO: 771915 - DNA, 20 bp, Artificial
  CRISPR gRNA sequence
ctctttttttttttttgaga

SEQ ID NO: 771916 - DNA, 20 bp, Artificial
  CRISPR gRNA sequence
tttttttttttttgagatgg

SEQ ID NO: 771917 - DNA, 20 bp, Artificial
  CRISPR gRNA sequence
tttttttttttgagatgggg

SEQ ID NO: 771918 - DNA, 20 bp, Artificial
  CRISPR gRNA sequence
ttttttttttgagatggggt

SEQ ID NO: 771919 - DNA, 20 bp, Artificial
  CRISPR gRNA sequence
tttttttttgagatggggtc

SEQ ID NO: 771920 - DNA, 20 bp, Artificial
  CRISPR gRNA sequence
ttttttttgagatggggtct

SEQ ID NO: 771921 - DNA, 20 bp, Artificial
  CRISPR gRNA sequence
tttttttgagatggggtctt

SEQ ID NO: 771922 - DNA, 20 bp, Artificial
  CRISPR gRNA sequence
ttttttgagatggggtcttg

SEQ ID NO: 771923 - DNA, 20 bp, Artificial
  CRISPR gRNA sequence
tttttgagatggggtcttgc

SEQ ID NO: 771924 - DNA, 20 bp, Artificial
  CRISPR gRNA sequence
ttttgagatggggtcttgct

SEQ ID NO: 771925 - DNA, 20 bp, Artificial
  CRISPR gRNA sequence
tttgagatggggtcttgctc

SEQ ID NO: 771926 - DNA, 20 bp, Artificial
  CRISPR gRNA sequence
ttgagatggggtcttgctct

SEQ ID NO: 771927 - DNA, 20 bp, Artificial
  CRISPR gRNA sequence
tgagatggggtcttgctctg

SEQ ID NO: 771928 - DNA, 20 bp, Artificial
  CRISPR gRNA sequence
gagatggggtcttgctctgt

SEQ ID NO: 771929 - DNA, 20 bp, Artificial
  CRISPR gRNA sequence
agatggggtcttgctctgtt

SEQ ID NO: 771930 - DNA, 20 bp, Artificial
  CRISPR gRNA sequence
gctctgttgccaaggatgga

SEQ ID NO: 771931 - DNA, 20 bp, Artificial
  CRISPR gRNA sequence
ctctgttgccaaggatggag

SEQ ID NO: 771932 - DNA, 20 bp, Artificial
  CRISPR gRNA sequence
tgttgccaaggatggagtgc

SEQ ID NO: 771933 - DNA, 20 bp, Artificial
  CRISPR gRNA sequence
ttgccaaggatggagtgcag

SEQ ID NO: 771934 - DNA, 20 bp, Artificial
  CRISPR gRNA sequence
ccaaggatggagtgcagtgg

SEQ ID NO: 771935 - DNA, 20 bp, Artificial
  CRISPR gRNA sequence
ggctcactgcaacctccacc

SEQ ID NO: 771936 - DNA, 20 bp, Artificial
  CRISPR gRNA sequence
actgcaacctccacctccca

SEQ ID NO: 771937 - DNA, 20 bp, Artificial
  CRISPR gRNA sequence
caacctccacctcccaggtt

SEQ ID NO: 771938 - DNA, 20 bp, Artificial
  CRISPR gRNA sequence
cacctcccaggttcaagcaa

SEQ ID NO: 771939 - DNA, 20 bp, Artificial
  CRISPR gRNA sequence
ccaggttcaagcaattctcc

SEQ ID NO: 771940 - DNA, 20 bp, Artificial
  CRISPR gRNA sequence
aagcaattctcctgcctcag

SEQ ID NO: 771941 - DNA, 20 bp, Artificial
  CRISPR gRNA sequence
tcctgcctcagcctcctgag

SEQ ID NO: 771942 - DNA, 20 bp, Artificial
  CRISPR gRNA sequence
ctgcctcagcctcctgagta

SEQ ID NO: 771943 - DNA, 20 bp, Artificial
  CRISPR gRNA sequence
cctcagcctcctgagtagct

SEQ ID NO: 771944 - DNA, 20 bp, Artificial
  CRISPR gRNA sequence
agcctcctgagtagctggga

SEQ ID NO: 771945 - DNA, 20 bp, Artificial
  CRISPR gRNA sequence
ctgagtagctgggattacag

SEQ ID NO: 771946 - DNA, 20 bp, Artificial
  CRISPR gRNA sequence
agtagctgggattacaggtg

SEQ ID NO: 771947 - DNA, 20 bp, Artificial
  CRISPR gRNA sequence
ggattacaggtgtgttccac

SEQ ID NO: 771948 - DNA, 20 bp, Artificial
  CRISPR gRNA sequence
caggtgtgttccaccacccc

SEQ ID NO: 771949 - DNA, 20 bp, Artificial
  CRISPR gRNA sequence
caccacccctggctattttt

SEQ ID NO: 771950 - DNA, 20 bp, Artificial
  CRISPR gRNA sequence
gctattttttagtagaggtg

SEQ ID NO: 771951 - DNA, 20 bp, Artificial
  CRISPR gRNA sequence
ttttttagtagaggtggggt

SEQ ID NO: 771952 - DNA, 20 bp, Artificial
  CRISPR gRNA sequence
tttagtagaggtggggtttc

SEQ ID NO: 771953 - DNA, 20 bp, Artificial
  CRISPR gRNA sequence
ttagtagaggtggggtttca

SEQ ID NO: 771954 - DNA, 20 bp, Artificial
  CRISPR gRNA sequence
tagtagaggtggggtttcac

SEQ ID NO: 771955 - DNA, 20 bp, Artificial
  CRISPR gRNA sequence
agtagaggtggggtttcacc

SEQ ID NO: 771956 - DNA, 20 bp, Artificial
  CRISPR gRNA sequence
gtagaggtggggtttcacca

SEQ ID NO: 771957 - DNA, 20 bp, Artificial
  CRISPR gRNA sequence
caccatatctgctaggctgg

SEQ ID NO: 771958 - DNA, 20 bp, Artificial
  CRISPR gRNA sequence
accatatctgctaggctggt

SEQ ID NO: 771959 - DNA, 20 bp, Artificial
  CRISPR gRNA sequence
ctaggctggtctcgaacgcc

SEQ ID NO: 771960 - DNA, 20 bp, Artificial
  CRISPR gRNA sequence
ggctggtctcgaacgcctga

SEQ ID NO: 771961 - DNA, 20 bp, Artificial
  CRISPR gRNA sequence
gtctcgaacgcctgacctca

SEQ ID NO: 771962 - DNA, 20 bp, Artificial
  CRISPR gRNA sequence
gaacgcctgacctcaggtga

SEQ ID NO: 771963 - DNA, 20 bp, Artificial
  CRISPR gRNA sequence
acctcaggtgatccacctgc

SEQ ID NO: 771964 - DNA, 20 bp, Artificial
  CRISPR gRNA sequence
aggtgatccacctgcctcgg

SEQ ID NO: 771965 - DNA, 20 bp, Artificial
  CRISPR gRNA sequence
cctcggcctcccatgccggg

SEQ ID NO: 771966 - DNA, 20 bp, Artificial
  CRISPR gRNA sequence
ggcctcccatgccgggcctt

SEQ ID NO: 771967 - DNA, 20 bp, Artificial
  CRISPR gRNA sequence
ccatgccgggccttttcccc

SEQ ID NO: 771968 - DNA, 20 bp, Artificial
  CRISPR gRNA sequence
ttcccctcacttctgactca

SEQ ID NO: 771969 - DNA, 20 bp, Artificial
  CRISPR gRNA sequence
tcccctcacttctgactcat

SEQ ID NO: 771970 - DNA, 20 bp, Artificial
  CRISPR gRNA sequence
cccctcacttctgactcatc

SEQ ID NO: 771971 - DNA, 20 bp, Artificial
  CRISPR gRNA sequence
ccctcacttctgactcatca

SEQ ID NO: 771972 - DNA, 20 bp, Artificial
  CRISPR gRNA sequence
acttctgactcatcagcaag

SEQ ID NO: 771973 - DNA, 20 bp, Artificial
  CRISPR gRNA sequence
ctgactcatcagcaagtcct

SEQ ID NO: 771974 - DNA, 20 bp, Artificial
  CRISPR gRNA sequence
tgactcatcagcaagtcctg

SEQ ID NO: 771975 - DNA, 20 bp, Artificial
  CRISPR gRNA sequence
actcatcagcaagtcctgtt

SEQ ID NO: 771976 - DNA, 20 bp, Artificial
  CRISPR gRNA sequence
atcagcaagtcctgttgatt

SEQ ID NO: 771977 - DNA, 20 bp, Artificial
  CRISPR gRNA sequence
ttgattccctcctaaataaa

SEQ ID NO: 771978 - DNA, 20 bp, Artificial
  CRISPR gRNA sequence
attccctcctaaataaacct

SEQ ID NO: 771979 - DNA, 20 bp, Artificial
  CRISPR gRNA sequence
cctcctaaataaaccttgaa

SEQ ID NO: 771980 - DNA, 20 bp, Artificial
  CRISPR gRNA sequence
ctaaataaaccttgaatctg

SEQ ID NO: 771981 - DNA, 20 bp, Artificial
  CRISPR gRNA sequence
aataaaccttgaatctgatc

SEQ ID NO: 771982 - DNA, 20 bp, Artificial
  CRISPR gRNA sequence
gaatctgatccctctcttct

SEQ ID NO: 771983 - DNA, 20 bp, Artificial
  CRISPR gRNA sequence
aatctgatccctctcttctt

SEQ ID NO: 771984 - DNA, 20 bp, Artificial
  CRISPR gRNA sequence
atccctctcttcttctctac

SEQ ID NO: 771985 - DNA, 20 bp, Artificial
  CRISPR gRNA sequence
tcttcttctctactaccacc

SEQ ID NO: 771986 - DNA, 20 bp, Artificial
  CRISPR gRNA sequence
ttcttctctactaccaccct

SEQ ID NO: 771987 - DNA, 20 bp, Artificial
  CRISPR gRNA sequence
cttctctactaccacccttt

SEQ ID NO: 771988 - DNA, 20 bp, Artificial
  CRISPR gRNA sequence
ttctctactaccaccctttg

SEQ ID NO: 771989 - DNA, 20 bp, Artificial
  CRISPR gRNA sequence
ctctactaccaccctttgaa

SEQ ID NO: 771990 - DNA, 20 bp, Artificial
  CRISPR gRNA sequence
tctactaccaccctttgaag

SEQ ID NO: 771991 - DNA, 20 bp, Artificial
  CRISPR gRNA sequence
tactaccaccctttgaagcc

SEQ ID NO: 771992 - DNA, 20 bp, Artificial
  CRISPR gRNA sequence
ctaccaccctttgaagccac

SEQ ID NO: 771993 - DNA, 20 bp, Artificial
  CRISPR gRNA sequence
ccaccctttgaagccacacc

SEQ ID NO: 771994 - DNA, 20 bp, Artificial
  CRISPR gRNA sequence
tgaagccacaccaccctcac

SEQ ID NO: 771995 - DNA, 20 bp, Artificial
  CRISPR gRNA sequence
gaagccacaccaccctcacc

SEQ ID NO: 771996 - DNA, 20 bp, Artificial
  CRISPR gRNA sequence
aagccacaccaccctcacct

SEQ ID NO: 771997 - DNA, 20 bp, Artificial
  CRISPR gRNA sequence
acctcttacagggacagctg

SEQ ID NO: 771998 - DNA, 20 bp, Artificial
  CRISPR gRNA sequence
ttacagggacagctgaaacc

SEQ ID NO: 771999 - DNA, 20 bp, Artificial
  CRISPR gRNA sequence
acagggacagctgaaaccgc

SEQ ID NO: 772000 - DNA, 20 bp, Artificial
  CRISPR gRNA sequence
cagggacagctgaaaccgcc

SEQ ID NO: 772001 - DNA, 20 bp, Artificial
  CRISPR gRNA sequence
aaaccgcccctaactggcct

SEQ ID NO: 772002 - DNA, 20 bp, Artificial
  CRISPR gRNA sequence
actggcctcccccttgccct

SEQ ID NO: 772003 - DNA, 20 bp, Artificial
  CRISPR gRNA sequence
gcctcccccttgccctgcca

SEQ ID NO: 772004 - DNA, 20 bp, Artificial
  CRISPR gRNA sequence
ccccttgccctgccacagtc

SEQ ID NO: 772005 - DNA, 20 bp, Artificial
  CRISPR gRNA sequence
gccctgccacagtccagtct

SEQ ID NO: 772006 - DNA, 20 bp, Artificial
  CRISPR gRNA sequence
ccctgccacagtccagtctc

SEQ ID NO: 772007 - DNA, 20 bp, Artificial
  CRISPR gRNA sequence
ccacagtccagtctccacag

SEQ ID NO: 772008 - DNA, 20 bp, Artificial
  CRISPR gRNA sequence
cacagaggagctagagtgag

SEQ ID NO: 772009 - DNA, 20 bp, Artificial
  CRISPR gRNA sequence
gagtgagttttaagcattgc

SEQ ID NO: 772010 - DNA, 20 bp, Artificial
  CRISPR gRNA sequence
taagcattgctactcagatt

SEQ ID NO: 772011 - DNA, 20 bp, Artificial
  CRISPR gRNA sequence
aagcattgctactcagatta

SEQ ID NO: 772012 - DNA, 20 bp, Artificial
  CRISPR gRNA sequence
agcattgctactcagattat

SEQ ID NO: 772013 - DNA, 20 bp, Artificial
  CRISPR gRNA sequence
ctactcagattatgcgtgat

SEQ ID NO: 772014 - DNA, 20 bp, Artificial
  CRISPR gRNA sequence
ctcagattatgcgtgattaa

SEQ ID NO: 772015 - DNA, 20 bp, Artificial
  CRISPR gRNA sequence
agattatgcgtgattaaaac

SEQ ID NO: 772016 - DNA, 20 bp, Artificial
  CRISPR gRNA sequence
tgcgtgattaaaacactccc

SEQ ID NO: 772017 - DNA, 20 bp, Artificial
  CRISPR gRNA sequence
aaacactccccagtgattcc

SEQ ID NO: 772018 - DNA, 20 bp, Artificial
  CRISPR gRNA sequence
cccagtgattcccattactc

SEQ ID NO: 772019 - DNA, 20 bp, Artificial
  CRISPR gRNA sequence
ccattactcatagaaaaagt

SEQ ID NO: 772020 - DNA, 20 bp, Artificial
  CRISPR gRNA sequence
ctcatagaaaaagttagatt

SEQ ID NO: 772021 - DNA, 20 bp, Artificial
  CRISPR gRNA sequence
atagaaaaagttagattcct

SEQ ID NO: 772022 - DNA, 20 bp, Artificial
  CRISPR gRNA sequence
gattcctcactggtctcttc

SEQ ID NO: 772023 - DNA, 20 bp, Artificial
  CRISPR gRNA sequence
ctcactggtctcttcaagtc

SEQ ID NO: 772024 - DNA, 20 bp, Artificial
  CRISPR gRNA sequence
actggtctcttcaagtcatc

SEQ ID NO: 772025 - DNA, 20 bp, Artificial
  CRISPR gRNA sequence
gtctcttcaagtcatctttg

SEQ ID NO: 772026 - DNA, 20 bp, Artificial
  CRISPR gRNA sequence
ttcaagtcatctttggtctg

SEQ ID NO: 772027 - DNA, 20 bp, Artificial
  CRISPR gRNA sequence
caagtcatctttggtctggg

SEQ ID NO: 772028 - DNA, 20 bp, Artificial
  CRISPR gRNA sequence
aagtcatctttggtctgggt

SEQ ID NO: 772029 - DNA, 20 bp, Artificial
  CRISPR gRNA sequence
tggtctgggtgggacatgcc

SEQ ID NO: 772030 - DNA, 20 bp, Artificial
  CRISPR gRNA sequence
ggtctgggtgggacatgccc

SEQ ID NO: 772031 - DNA, 20 bp, Artificial
  CRISPR gRNA sequence
gtctgggtgggacatgccct

SEQ ID NO: 772032 - DNA, 20 bp, Artificial
  CRISPR gRNA sequence
ggtgggacatgccctcccat

SEQ ID NO: 772033 - DNA, 20 bp, Artificial
  CRISPR gRNA sequence
ccatcagatgtgtctgccac

SEQ ID NO: 772034 - DNA, 20 bp, Artificial
  CRISPR gRNA sequence
ccacactggacgctccccga

SEQ ID NO: 772035 - DNA, 20 bp, Artificial
  CRISPR gRNA sequence
gacgctccccgatattttca

SEQ ID NO: 772036 - DNA, 20 bp, Artificial
  CRISPR gRNA sequence
cccgatattttcacacagca

SEQ ID NO: 772037 - DNA, 20 bp, Artificial
  CRISPR gRNA sequence
tcacacagcaaggccagtct

SEQ ID NO: 772038 - DNA, 20 bp, Artificial
  CRISPR gRNA sequence
cacacagcaaggccagtctt

SEQ ID NO: 772039 - DNA, 20 bp, Artificial
  CRISPR gRNA sequence
acacagcaaggccagtcttg

SEQ ID NO: 772040 - DNA, 20 bp, Artificial
  CRISPR gRNA sequence
gcctcagggccttccacctg

SEQ ID NO: 772041 - DNA, 20 bp, Artificial
  CRISPR gRNA sequence
cctcagggccttccacctgc

SEQ ID NO: 772042 - DNA, 20 bp, Artificial
  CRISPR gRNA sequence
agggccttccacctgctgtt

SEQ ID NO: 772043 - DNA, 20 bp, Artificial
  CRISPR gRNA sequence
ccacctgctgtttcctctac

SEQ ID NO: 772044 - DNA, 20 bp, Artificial
  CRISPR gRNA sequence
cacctgctgtttcctctacg

SEQ ID NO: 772045 - DNA, 20 bp, Artificial
  CRISPR gRNA sequence
ctgtttcctctacggggttc

SEQ ID NO: 772046 - DNA, 20 bp, Artificial
  CRISPR gRNA sequence
tttcctctacggggttctct

SEQ ID NO: 772047 - DNA, 20 bp, Artificial
  CRISPR gRNA sequence
cctctacggggttctctgta

SEQ ID NO: 772048 - DNA, 20 bp, Artificial
  CRISPR gRNA sequence
ctctacggggttctctgtat

SEQ ID NO: 772049 - DNA, 20 bp, Artificial
  CRISPR gRNA sequence
tacggggttctctgtatgtc

SEQ ID NO: 772050 - DNA, 20 bp, Artificial
  CRISPR gRNA sequence
cggggttctctgtatgtcag

SEQ ID NO: 772051 - DNA, 20 bp, Artificial
  CRISPR gRNA sequence
tctgtatgtcagctcttttt

SEQ ID NO: 772052 - DNA, 20 bp, Artificial
  CRISPR gRNA sequence
tgtatgtcagctctttttca

SEQ ID NO: 772053 - DNA, 20 bp, Artificial
  CRISPR gRNA sequence
tatgtcagctctttttcatt

SEQ ID NO: 772054 - DNA, 20 bp, Artificial
  CRISPR gRNA sequence
tttttcattccctataaatt

SEQ ID NO: 772055 - DNA, 20 bp, Artificial
  CRISPR gRNA sequence
tttcattccctataaatttc

SEQ ID NO: 772056 - DNA, 20 bp, Artificial
  CRISPR gRNA sequence
ttcattccctataaatttca

SEQ ID NO: 772057 - DNA, 20 bp, Artificial
  CRISPR gRNA sequence
tcattccctataaatttcag

SEQ ID NO: 772058 - DNA, 20 bp, Artificial
  CRISPR gRNA sequence
cattccctataaatttcagc

SEQ ID NO: 772059 - DNA, 20 bp, Artificial
  CRISPR gRNA sequence
attccctataaatttcagct

SEQ ID NO: 772060 - DNA, 20 bp, Artificial
  CRISPR gRNA sequence
cctataaatttcagcttaat

SEQ ID NO: 772061 - DNA, 20 bp, Artificial
  CRISPR gRNA sequence
taaatttcagcttaattgct

SEQ ID NO: 772062 - DNA, 20 bp, Artificial
  CRISPR gRNA sequence
cagcttaattgctttaaaga

SEQ ID NO: 772063 - DNA, 20 bp, Artificial
  CRISPR gRNA sequence
agcttaattgctttaaagag

SEQ ID NO: 772064 - DNA, 20 bp, Artificial
  CRISPR gRNA sequence
aattgctttaaagagcatgt

SEQ ID NO: 772065 - DNA, 20 bp, Artificial
  CRISPR gRNA sequence
attgctttaaagagcatgtg

SEQ ID NO: 772066 - DNA, 20 bp, Artificial
  CRISPR gRNA sequence
ctttaaagagcatgtgcctc

SEQ ID NO: 772067 - DNA, 20 bp, Artificial
  CRISPR gRNA sequence
taaagagcatgtgcctcacc

SEQ ID NO: 772068 - DNA, 20 bp, Artificial
  CRISPR gRNA sequence
aaagagcatgtgcctcacca

SEQ ID NO: 772069 - DNA, 20 bp, Artificial
  CRISPR gRNA sequence
aagagcatgtgcctcaccac

SEQ ID NO: 772070 - DNA, 20 bp, Artificial
  CRISPR gRNA sequence
accaccatatttaaaggtac

SEQ ID NO: 772071 - DNA, 20 bp, Artificial
  CRISPR gRNA sequence
aaaggtacgggtattctttc

SEQ ID NO: 772072 - DNA, 20 bp, Artificial
  CRISPR gRNA sequence
aaggtacgggtattctttct

SEQ ID NO: 772073 - DNA, 20 bp, Artificial
  CRISPR gRNA sequence
tttcttgtataaaaacaaat

SEQ ID NO: 772074 - DNA, 20 bp, Artificial
  CRISPR gRNA sequence
tcttgtataaaaacaaatcg

SEQ ID NO: 772075 - DNA, 20 bp, Artificial
  CRISPR gRNA sequence
cttgtataaaaacaaatcgt

SEQ ID NO: 772076 - DNA, 20 bp, Artificial
  CRISPR gRNA sequence
ttgtataaaaacaaatcgtg

SEQ ID NO: 772077 - DNA, 20 bp, Artificial
  CRISPR gRNA sequence
gtataaaaacaaatcgtgtt

SEQ ID NO: 772078 - DNA, 20 bp, Artificial
  CRISPR gRNA sequence
tataaaaacaaatcgtgttt

SEQ ID NO: 772079 - DNA, 20 bp, Artificial
  CRISPR gRNA sequence
cgttaggaaaagaaaaaaaa

SEQ ID NO: 772080 - DNA, 20 bp, Artificial
  CRISPR gRNA sequence
gttaggaaaagaaaaaaaaa

SEQ ID NO: 772081 - DNA, 20 bp, Artificial
  CRISPR gRNA sequence
ggaaaagaaaaaaaaagaaa

SEQ ID NO: 772082 - DNA, 20 bp, Artificial
  CRISPR gRNA sequence
gtgattctctctcctccaga

SEQ ID NO: 772083 - DNA, 20 bp, Artificial
  CRISPR gRNA sequence
tgattctctctcctccagag

SEQ ID NO: 772084 - DNA, 20 bp, Artificial
  CRISPR gRNA sequence
tctctcctccagagaaacca

SEQ ID NO: 772085 - DNA, 20 bp, Artificial
  CRISPR gRNA sequence
tctcctccagagaaaccact

SEQ ID NO: 772086 - DNA, 20 bp, Artificial
  CRISPR gRNA sequence
tcctccagagaaaccactat

SEQ ID NO: 772087 - DNA, 20 bp, Artificial
  CRISPR gRNA sequence
ctccagagaaaccactattg

SEQ ID NO: 772088 - DNA, 20 bp, Artificial
  CRISPR gRNA sequence
cagagaaaccactattgaca

SEQ ID NO: 772089 - DNA, 20 bp, Artificial
  CRISPR gRNA sequence
ttgacatttttggtggatac

SEQ ID NO: 772090 - DNA, 20 bp, Artificial
  CRISPR gRNA sequence
acatttttggtggatacttt

SEQ ID NO: 772091 - DNA, 20 bp, Artificial
  CRISPR gRNA sequence
ttggtggatacttttttgga

SEQ ID NO: 772092 - DNA, 20 bp, Artificial
  CRISPR gRNA sequence
tggtggatacttttttggac

SEQ ID NO: 772093 - DNA, 20 bp, Artificial
  CRISPR gRNA sequence
ggtggatacttttttggact

SEQ ID NO: 772094 - DNA, 20 bp, Artificial
  CRISPR gRNA sequence
gtggatacttttttggactc

SEQ ID NO: 772095 - DNA, 20 bp, Artificial
  CRISPR gRNA sequence
ttttggactccccaatttat

SEQ ID NO: 772096 - DNA, 20 bp, Artificial
  CRISPR gRNA sequence
tttggactccccaatttata

SEQ ID NO: 772097 - DNA, 20 bp, Artificial
  CRISPR gRNA sequence
ttggactccccaatttataa

SEQ ID NO: 772098 - DNA, 20 bp, Artificial
  CRISPR gRNA sequence
tggactccccaatttataac

SEQ ID NO: 772099 - DNA, 20 bp, Artificial
  CRISPR gRNA sequence
ggactccccaatttataaca

SEQ ID NO: 772100 - DNA, 20 bp, Artificial
  CRISPR gRNA sequence
gactccccaatttataacat

SEQ ID NO: 772101 - DNA, 20 bp, Artificial
  CRISPR gRNA sequence
cccaatttataacattactt

SEQ ID NO: 772102 - DNA, 20 bp, Artificial
  CRISPR gRNA sequence
ataacattacttacgctcat

SEQ ID NO: 772103 - DNA, 20 bp, Artificial
  CRISPR gRNA sequence
taacattacttacgctcatg

SEQ ID NO: 772104 - DNA, 20 bp, Artificial
  CRISPR gRNA sequence
cttacgctcatggggaaatg

SEQ ID NO: 772105 - DNA, 20 bp, Artificial
  CRISPR gRNA sequence
acgctcatggggaaatgcac

SEQ ID NO: 772106 - DNA, 20 bp, Artificial
  CRISPR gRNA sequence
cgctcatggggaaatgcaca

SEQ ID NO: 772107 - DNA, 20 bp, Artificial
  CRISPR gRNA sequence
atggggaaatgcacatggtg

SEQ ID NO: 772108 - DNA, 20 bp, Artificial
  CRISPR gRNA sequence
ccagatttttgaaaagctgt

SEQ ID NO: 772109 - DNA, 20 bp, Artificial
  CRISPR gRNA sequence
ttgaaaagctgttgctttac

SEQ ID NO: 772110 - DNA, 20 bp, Artificial
  CRISPR gRNA sequence
tgaaaagctgttgctttact

SEQ ID NO: 772111 - DNA, 20 bp, Artificial
  CRISPR gRNA sequence
gaaaagctgttgctttactt

SEQ ID NO: 772112 - DNA, 20 bp, Artificial
  CRISPR gRNA sequence
aaaagctgttgctttactta

SEQ ID NO: 772113 - DNA, 20 bp, Artificial
  CRISPR gRNA sequence
ttgctttacttactaacctg

SEQ ID NO: 772114 - DNA, 20 bp, Artificial
  CRISPR gRNA sequence
ctttacttactaacctgctg

SEQ ID NO: 772115 - DNA, 20 bp, Artificial
  CRISPR gRNA sequence
tacttactaacctgctggct

SEQ ID NO: 772116 - DNA, 20 bp, Artificial
  CRISPR gRNA sequence
acttactaacctgctggctc

SEQ ID NO: 772117 - DNA, 20 bp, Artificial
  CRISPR gRNA sequence
cttactaacctgctggctcc

SEQ ID NO: 772118 - DNA, 20 bp, Artificial
  CRISPR gRNA sequence
actaacctgctggctccttt

SEQ ID NO: 772119 - DNA, 20 bp, Artificial
  CRISPR gRNA sequence
ctaacctgctggctcctttt

SEQ ID NO: 772120 - DNA, 20 bp, Artificial
  CRISPR gRNA sequence
acctgctggctccttttcct

SEQ ID NO: 772121 - DNA, 20 bp, Artificial
  CRISPR gRNA sequence
ctggctccttttcctcacat

SEQ ID NO: 772122 - DNA, 20 bp, Artificial
  CRISPR gRNA sequence
gctccttttcctcacatacc

SEQ ID NO: 772123 - DNA, 20 bp, Artificial
  CRISPR gRNA sequence
cttttcctcacataccttag

SEQ ID NO: 772124 - DNA, 20 bp, Artificial
  CRISPR gRNA sequence
ttcctcacataccttagtca

SEQ ID NO: 772125 - DNA, 20 bp, Artificial
  CRISPR gRNA sequence
tcctcacataccttagtcac

SEQ ID NO: 772126 - DNA, 20 bp, Artificial
  CRISPR gRNA sequence
cctcacataccttagtcaca

SEQ ID NO: 772127 - DNA, 20 bp, Artificial
  CRISPR gRNA sequence
ctcacataccttagtcacat

SEQ ID NO: 772128 - DNA, 20 bp, Artificial
  CRISPR gRNA sequence
acataccttagtcacatgct

SEQ ID NO: 772129 - DNA, 20 bp, Artificial
  CRISPR gRNA sequence
agtcacatgctgacgagaat

SEQ ID NO: 772130 - DNA, 20 bp, Artificial
  CRISPR gRNA sequence
gtcacatgctgacgagaatc

SEQ ID NO: 772131 - DNA, 20 bp, Artificial
  CRISPR gRNA sequence
acgagaatctgtgtgcccat

SEQ ID NO: 772132 - DNA, 20 bp, Artificial
  CRISPR gRNA sequence
tgtgcccatttgtctctctc

SEQ ID NO: 772133 - DNA, 20 bp, Artificial
  CRISPR gRNA sequence
gtctctctctcccattaaaa

SEQ ID NO: 772134 - DNA, 20 bp, Artificial
  CRISPR gRNA sequence
tctctctctcccattaaaat

SEQ ID NO: 772135 - DNA, 20 bp, Artificial
  CRISPR gRNA sequence
tctctcccattaaaatgtaa

SEQ ID NO: 772136 - DNA, 20 bp, Artificial
  CRISPR gRNA sequence
tctcccattaaaatgtaagt

SEQ ID NO: 772137 - DNA, 20 bp, Artificial
  CRISPR gRNA sequence
tcccattaaaatgtaagttc

SEQ ID NO: 772138 - DNA, 20 bp, Artificial
  CRISPR gRNA sequence
ccattaaaatgtaagttctg

SEQ ID NO: 772139 - DNA, 20 bp, Artificial
  CRISPR gRNA sequence
aaatgtaagttctgtgggga

SEQ ID NO: 772140 - DNA, 20 bp, Artificial
  CRISPR gRNA sequence
tgtggggatgtgaccgtagt

SEQ ID NO: 772141 - DNA, 20 bp, Artificial
  CRISPR gRNA sequence
tggggatgtgaccgtagtat

SEQ ID NO: 772142 - DNA, 20 bp, Artificial
  CRISPR gRNA sequence
ctctctgttgcatttctgac

SEQ ID NO: 772143 - DNA, 20 bp, Artificial
  CRISPR gRNA sequence
tctgttgcatttctgacttt

SEQ ID NO: 772144 - DNA, 20 bp, Artificial
  CRISPR gRNA sequence
tgttgcatttctgactttta

SEQ ID NO: 772145 - DNA, 20 bp, Artificial
  CRISPR gRNA sequence
ttgcatttctgacttttatg

SEQ ID NO: 772146 - DNA, 20 bp, Artificial
  CRISPR gRNA sequence
catttctgacttttatgctt

SEQ ID NO: 772147 - DNA, 20 bp, Artificial
  CRISPR gRNA sequence
ctgacttttatgcttggcac

SEQ ID NO: 772148 - DNA, 20 bp, Artificial
  CRISPR gRNA sequence
tgacttttatgcttggcacc

SEQ ID NO: 772149 - DNA, 20 bp, Artificial
  CRISPR gRNA sequence
acttttatgcttggcacctg

SEQ ID NO: 772150 - DNA, 20 bp, Artificial
  CRISPR gRNA sequence
ttatgcttggcacctgtagg

SEQ ID NO: 772151 - DNA, 20 bp, Artificial
  CRISPR gRNA sequence
tatgcttggcacctgtaggt

SEQ ID NO: 772152 - DNA, 20 bp, Artificial
  CRISPR gRNA sequence
atgcttggcacctgtaggtg

SEQ ID NO: 772153 - DNA, 20 bp, Artificial
  CRISPR gRNA sequence
tgcttggcacctgtaggtgc

SEQ ID NO: 772154 - DNA, 20 bp, Artificial
  CRISPR gRNA sequence
ggcacctgtaggtgctgact

SEQ ID NO: 772155 - DNA, 20 bp, Artificial
  CRISPR gRNA sequence
gcacctgtaggtgctgacta

SEQ ID NO: 772156 - DNA, 20 bp, Artificial
  CRISPR gRNA sequence
taggtgctgactatattctt

SEQ ID NO: 772157 - DNA, 20 bp, Artificial
  CRISPR gRNA sequence
actatattcttgactgaatg

SEQ ID NO: 772158 - DNA, 20 bp, Artificial
  CRISPR gRNA sequence
tattcttgactgaatgaggt

SEQ ID NO: 772159 - DNA, 20 bp, Artificial
  CRISPR gRNA sequence
ttgactgaatgaggtcctaa

SEQ ID NO: 772160 - DNA, 20 bp, Artificial
  CRISPR gRNA sequence
gactgaatgaggtcctaaga

SEQ ID NO: 772161 - DNA, 20 bp, Artificial
  CRISPR gRNA sequence
actgaatgaggtcctaagac

SEQ ID NO: 772162 - DNA, 20 bp, Artificial
  CRISPR gRNA sequence
aatgaggtcctaagacaata

SEQ ID NO: 772163 - DNA, 20 bp, Artificial
  CRISPR gRNA sequence
agacaataaattactttggg

SEQ ID NO: 772164 - DNA, 20 bp, Artificial
  CRISPR gRNA sequence
ctttgggtctcaggcctaaa

SEQ ID NO: 772165 - DNA, 20 bp, Artificial
  CRISPR gRNA sequence
tgggtctcaggcctaaaagg

SEQ ID NO: 772166 - DNA, 20 bp, Artificial
  CRISPR gRNA sequence
gggtctcaggcctaaaagga

SEQ ID NO: 772167 - DNA, 20 bp, Artificial
  CRISPR gRNA sequence
ggtctcaggcctaaaaggag

SEQ ID NO: 772168 - DNA, 20 bp, Artificial
  CRISPR gRNA sequence
aggcctaaaaggaggggtgg

SEQ ID NO: 772169 - DNA, 20 bp, Artificial
  CRISPR gRNA sequence
aaaggaggggtggacagggc

SEQ ID NO: 772170 - DNA, 20 bp, Artificial
  CRISPR gRNA sequence
gggttagcaggggcagggag

SEQ ID NO: 772171 - DNA, 20 bp, Artificial
  CRISPR gRNA sequence
gcaggggcagggagcgggac

SEQ ID NO: 772172 - DNA, 20 bp, Artificial
  CRISPR gRNA sequence
gggaggcccacccctcctca

SEQ ID NO: 772173 - DNA, 20 bp, Artificial
  CRISPR gRNA sequence
ctcagtcccccttatatgtt

SEQ ID NO: 772174 - DNA, 20 bp, Artificial
  CRISPR gRNA sequence
agtcccccttatatgttctc

SEQ ID NO: 772175 - DNA, 20 bp, Artificial
  CRISPR gRNA sequence
atatgttctccactccccct

SEQ ID NO: 772176 - DNA, 20 bp, Artificial
  CRISPR gRNA sequence
tatgttctccactcccccta

SEQ ID NO: 772177 - DNA, 20 bp, Artificial
  CRISPR gRNA sequence
tccactccccctacccccag

SEQ ID NO: 772178 - DNA, 20 bp, Artificial
  CRISPR gRNA sequence
cactccccctacccccagga

SEQ ID NO: 772179 - DNA, 20 bp, Artificial
  CRISPR gRNA sequence
cccctacccccaggagccct

SEQ ID NO: 772180 - DNA, 20 bp, Artificial
  CRISPR gRNA sequence
cccccaggagccctggaggt

SEQ ID NO: 772181 - DNA, 20 bp, Artificial
  CRISPR gRNA sequence
gaggtccaggtccctgaaga

SEQ ID NO: 772182 - DNA, 20 bp, Artificial
  CRISPR gRNA sequence
aagacccagtggtggcactg

SEQ ID NO: 772183 - DNA, 20 bp, Artificial
  CRISPR gRNA sequence
gtgggcaccgatgccaccct

SEQ ID NO: 772184 - DNA, 20 bp, Artificial
  CRISPR gRNA sequence
tgctgctccttctcccctga

SEQ ID NO: 772185 - DNA, 20 bp, Artificial
  CRISPR gRNA sequence
ctccttctcccctgagcctg

SEQ ID NO: 772186 - DNA, 20 bp, Artificial
  CRISPR gRNA sequence
cttctcccctgagcctggct

SEQ ID NO: 772187 - DNA, 20 bp, Artificial
  CRISPR gRNA sequence
ctcccctgagcctggcttca

SEQ ID NO: 772188 - DNA, 20 bp, Artificial
  CRISPR gRNA sequence
tcccctgagcctggcttcag

SEQ ID NO: 772189 - DNA, 20 bp, Artificial
  CRISPR gRNA sequence
ccctgagcctggcttcagcc

SEQ ID NO: 772190 - DNA, 20 bp, Artificial
  CRISPR gRNA sequence
agcctggcttcagcctggca

SEQ ID NO: 772191 - DNA, 20 bp, Artificial
  CRISPR gRNA sequence
gcttcagcctggcacagctc

SEQ ID NO: 772192 - DNA, 20 bp, Artificial
  CRISPR gRNA sequence
cagcctggcacagctcaacc

SEQ ID NO: 772193 - DNA, 20 bp, Artificial
  CRISPR gRNA sequence
agcctggcacagctcaacct

SEQ ID NO: 772194 - DNA, 20 bp, Artificial
  CRISPR gRNA sequence
gcacagctcaacctcatctg

SEQ ID NO: 772195 - DNA, 20 bp, Artificial
  CRISPR gRNA sequence
aacctcatctggcagctgac

SEQ ID NO: 772196 - DNA, 20 bp, Artificial
  CRISPR gRNA sequence
atctggcagctgacagatac

SEQ ID NO: 772197 - DNA, 20 bp, Artificial
  CRISPR gRNA sequence
gcagctgacagataccaaac

SEQ ID NO: 772198 - DNA, 20 bp, Artificial
  CRISPR gRNA sequence
acagataccaaacagctggt

SEQ ID NO: 772199 - DNA, 20 bp, Artificial
  CRISPR gRNA sequence
gtgcacagctttgctgaggg

SEQ ID NO: 772200 - DNA, 20 bp, Artificial
  CRISPR gRNA sequence
tgctgagggccaggaccagg

SEQ ID NO: 772201 - DNA, 20 bp, Artificial
  CRISPR gRNA sequence
gctgagggccaggaccaggg

SEQ ID NO: 772202 - DNA, 20 bp, Artificial
  CRISPR gRNA sequence
ctgagggccaggaccagggc

SEQ ID NO: 772203 - DNA, 20 bp, Artificial
  CRISPR gRNA sequence
agggccaggaccagggcagc

SEQ ID NO: 772204 - DNA, 20 bp, Artificial
  CRISPR gRNA sequence
tgccaaccgcacggccctct

SEQ ID NO: 772205 - DNA, 20 bp, Artificial
  CRISPR gRNA sequence
ttcccggacctgctggcaca

SEQ ID NO: 772206 - DNA, 20 bp, Artificial
  CRISPR gRNA sequence
cccggacctgctggcacagg

SEQ ID NO: 772207 - DNA, 20 bp, Artificial
  CRISPR gRNA sequence
ccggacctgctggcacaggg

SEQ ID NO: 772208 - DNA, 20 bp, Artificial
  CRISPR gRNA sequence
ctggcacagggcaacgcatc

SEQ ID NO: 772209 - DNA, 20 bp, Artificial
  CRISPR gRNA sequence
gcacagggcaacgcatccct

SEQ ID NO: 772210 - DNA, 20 bp, Artificial
  CRISPR gRNA sequence
aggctgcagcgcgtgcgtgt

SEQ ID NO: 772211 - DNA, 20 bp, Artificial
  CRISPR gRNA sequence
cagcgcgtgcgtgtggcgga

SEQ ID NO: 772212 - DNA, 20 bp, Artificial
  CRISPR gRNA sequence
cacctgcttcgtgagcatcc

SEQ ID NO: 772213 - DNA, 20 bp, Artificial
  CRISPR gRNA sequence
acctgcttcgtgagcatccg

SEQ ID NO: 772214 - DNA, 20 bp, Artificial
  CRISPR gRNA sequence
cttcgtgagcatccgggatt

SEQ ID NO: 772215 - DNA, 20 bp, Artificial
  CRISPR gRNA sequence
cgtgagcatccgggatttcg

SEQ ID NO: 772216 - DNA, 20 bp, Artificial
  CRISPR gRNA sequence
gtgagcatccgggatttcgg

SEQ ID NO: 772217 - DNA, 20 bp, Artificial
  CRISPR gRNA sequence
cggcagcgctgccgtcagcc

SEQ ID NO: 772218 - DNA, 20 bp, Artificial
  CRISPR gRNA sequence
ggcagcgctgccgtcagcct

SEQ ID NO: 772219 - DNA, 20 bp, Artificial
  CRISPR gRNA sequence
ccgtcagcctgcaggtggcc

SEQ ID NO: 772220 - DNA, 20 bp, Artificial
  CRISPR gRNA sequence
caggtggccggtgagcacca

SEQ ID NO: 772221 - DNA, 20 bp, Artificial
  CRISPR gRNA sequence
ccccttagttcaccctccat

SEQ ID NO: 772222 - DNA, 20 bp, Artificial
  CRISPR gRNA sequence
cccttagttcaccctccatt

SEQ ID NO: 772223 - DNA, 20 bp, Artificial
  CRISPR gRNA sequence
agttcaccctccattccccc

SEQ ID NO: 772224 - DNA, 20 bp, Artificial
  CRISPR gRNA sequence
gttcaccctccattccccct

SEQ ID NO: 772225 - DNA, 20 bp, Artificial
  CRISPR gRNA sequence
accctccattccccctgcag

SEQ ID NO: 772226 - DNA, 20 bp, Artificial
  CRISPR gRNA sequence
cattccccctgcagcccacc

SEQ ID NO: 772227 - DNA, 20 bp, Artificial
  CRISPR gRNA sequence
cccctgcagcccaccccctg

SEQ ID NO: 772228 - DNA, 20 bp, Artificial
  CRISPR gRNA sequence
cagcccaccccctgctgcac

SEQ ID NO: 772229 - DNA, 20 bp, Artificial
  CRISPR gRNA sequence
ctgcaccactgctcccagaa

SEQ ID NO: 772230 - DNA, 20 bp, Artificial
  CRISPR gRNA sequence
caccactgctcccagaaccc

SEQ ID NO: 772231 - DNA, 20 bp, Artificial
  CRISPR gRNA sequence
ctcccagaaccccagtgctg

SEQ ID NO: 772232 - DNA, 20 bp, Artificial
  CRISPR gRNA sequence
ccagaaccccagtgctgatt

SEQ ID NO: 772233 - DNA, 20 bp, Artificial
  CRISPR gRNA sequence
attcctgtactcagccccat

SEQ ID NO: 772234 - DNA, 20 bp, Artificial
  CRISPR gRNA sequence
ctgtactcagccccatgcat

SEQ ID NO: 772235 - DNA, 20 bp, Artificial
  CRISPR gRNA sequence
tactcagccccatgcatcct

SEQ ID NO: 772236 - DNA, 20 bp, Artificial
  CRISPR gRNA sequence
agccccatgcatccttttcg

SEQ ID NO: 772237 - DNA, 20 bp, Artificial
  CRISPR gRNA sequence
ttcgtcctctgccattgccc

SEQ ID NO: 772238 - DNA, 20 bp, Artificial
  CRISPR gRNA sequence
tcgtcctctgccattgccct

SEQ ID NO: 772239 - DNA, 20 bp, Artificial
  CRISPR gRNA sequence
cgtcctctgccattgccctg

SEQ ID NO: 772240 - DNA, 20 bp, Artificial
  CRISPR gRNA sequence
gtcctctgccattgccctgc

SEQ ID NO: 772241 - DNA, 20 bp, Artificial
  CRISPR gRNA sequence
tgccattgccctgcccttga

SEQ ID NO: 772242 - DNA, 20 bp, Artificial
  CRISPR gRNA sequence
ccattgccctgcccttgacc

SEQ ID NO: 772243 - DNA, 20 bp, Artificial
  CRISPR gRNA sequence
ccctgcccttgacccctgcc

SEQ ID NO: 772244 - DNA, 20 bp, Artificial
  CRISPR gRNA sequence
cccttgacccctgccctctg

SEQ ID NO: 772245 - DNA, 20 bp, Artificial
  CRISPR gRNA sequence
gacccctgccctctgtcacc

SEQ ID NO: 772246 - DNA, 20 bp, Artificial
  CRISPR gRNA sequence
acccctgccctctgtcacct

SEQ ID NO: 772247 - DNA, 20 bp, Artificial
  CRISPR gRNA sequence
ccctctgtcacctccagctc

SEQ ID NO: 772248 - DNA, 20 bp, Artificial
  CRISPR gRNA sequence
tgtcacctccagctccctac

SEQ ID NO: 772249 - DNA, 20 bp, Artificial
  CRISPR gRNA sequence
tcacctccagctccctactc

SEQ ID NO: 772250 - DNA, 20 bp, Artificial
  CRISPR gRNA sequence
cagctccctactcgaagccc

SEQ ID NO: 772251 - DNA, 20 bp, Artificial
  CRISPR gRNA sequence
cctactcgaagcccagcatg

SEQ ID NO: 772252 - DNA, 20 bp, Artificial
  CRISPR gRNA sequence
ctcgaagcccagcatgaccc

SEQ ID NO: 772253 - DNA, 20 bp, Artificial
  CRISPR gRNA sequence
gaagcccagcatgaccctgg

SEQ ID NO: 772254 - DNA, 20 bp, Artificial
  CRISPR gRNA sequence
gagcccaacaaggacctgcg

SEQ ID NO: 772255 - DNA, 20 bp, Artificial
  CRISPR gRNA sequence
cggccaggggacacggtgac

SEQ ID NO: 772256 - DNA, 20 bp, Artificial
  CRISPR gRNA sequence
cagctaccagggctaccctg

SEQ ID NO: 772257 - DNA, 20 bp, Artificial
  CRISPR gRNA sequence
ccagggctaccctgaggctg

SEQ ID NO: 772258 - DNA, 20 bp, Artificial
  CRISPR gRNA sequence
ccctgaggctgaggtgttct

SEQ ID NO: 772259 - DNA, 20 bp, Artificial
  CRISPR gRNA sequence
aggctgaggtgttctggcag

SEQ ID NO: 772260 - DNA, 20 bp, Artificial
  CRISPR gRNA sequence
aggtgttctggcaggatggg

SEQ ID NO: 772261 - DNA, 20 bp, Artificial
  CRISPR gRNA sequence
tggcaggatgggcagggtgt

SEQ ID NO: 772262 - DNA, 20 bp, Artificial
  CRISPR gRNA sequence
gcaggatgggcagggtgtgc

SEQ ID NO: 772263 - DNA, 20 bp, Artificial
  CRISPR gRNA sequence
actggcaacgtgaccacgtc

SEQ ID NO: 772264 - DNA, 20 bp, Artificial
  CRISPR gRNA sequence
gcaacgtgaccacgtcgcag

SEQ ID NO: 772265 - DNA, 20 bp, Artificial
  CRISPR gRNA sequence
gtttgatgtgcacagcatcc

SEQ ID NO: 772266 - DNA, 20 bp, Artificial
  CRISPR gRNA sequence
tttgatgtgcacagcatcct

SEQ ID NO: 772267 - DNA, 20 bp, Artificial
  CRISPR gRNA sequence
gatgtgcacagcatcctgcg

SEQ ID NO: 772268 - DNA, 20 bp, Artificial
  CRISPR gRNA sequence
atgtgcacagcatcctgcgg

SEQ ID NO: 772269 - DNA, 20 bp, Artificial
  CRISPR gRNA sequence
cgggtggtgctgggtgcaaa

SEQ ID NO: 772270 - DNA, 20 bp, Artificial
  CRISPR gRNA sequence
ggtgcaaatggcacctacag

SEQ ID NO: 772271 - DNA, 20 bp, Artificial
  CRISPR gRNA sequence
cagctgcctggtgcgcaacc

SEQ ID NO: 772272 - DNA, 20 bp, Artificial
  CRISPR gRNA sequence
cctggtgcgcaaccccgtgc

SEQ ID NO: 772273 - DNA, 20 bp, Artificial
  CRISPR gRNA sequence
gtgcgcaaccccgtgctgca

SEQ ID NO: 772274 - DNA, 20 bp, Artificial
  CRISPR gRNA sequence
cagcaggatgcgcacagctc

SEQ ID NO: 772275 - DNA, 20 bp, Artificial
  CRISPR gRNA sequence
tgtcaccatcacaccccaga

SEQ ID NO: 772276 - DNA, 20 bp, Artificial
  CRISPR gRNA sequence
tcaccatcacaccccagaga

SEQ ID NO: 772277 - DNA, 20 bp, Artificial
  CRISPR gRNA sequence
ctttgcttaaatgtcccctt

SEQ ID NO: 772278 - DNA, 20 bp, Artificial
  CRISPR gRNA sequence
tgcttaaatgtccccttggg

SEQ ID NO: 772279 - DNA, 20 bp, Artificial
  CRISPR gRNA sequence
gcttaaatgtccccttgggg

SEQ ID NO: 772280 - DNA, 20 bp, Artificial
  CRISPR gRNA sequence
cttaaatgtccccttggggg

SEQ ID NO: 772281 - DNA, 20 bp, Artificial
  CRISPR gRNA sequence
aaatgtccccttgggggagg

SEQ ID NO: 772282 - DNA, 20 bp, Artificial
  CRISPR gRNA sequence
aatgtccccttgggggaggg

SEQ ID NO: 772283 - DNA, 20 bp, Artificial
  CRISPR gRNA sequence
gggggaggggggttctgctt

SEQ ID NO: 772284 - DNA, 20 bp, Artificial
  CRISPR gRNA sequence
ggggaggggggttctgcttc

SEQ ID NO: 772285 - DNA, 20 bp, Artificial
  CRISPR gRNA sequence
tgcttctgtcggcaggggtt

SEQ ID NO: 772286 - DNA, 20 bp, Artificial
  CRISPR gRNA sequence
cttctgtcggcaggggttgg

SEQ ID NO: 772287 - DNA, 20 bp, Artificial
  CRISPR gRNA sequence
ctgtcggcaggggttgggag

SEQ ID NO: 772288 - DNA, 20 bp, Artificial
  CRISPR gRNA sequence
tgtcggcaggggttgggagc

SEQ ID NO: 772289 - DNA, 20 bp, Artificial
  CRISPR gRNA sequence
tcggcaggggttgggagctc

SEQ ID NO: 772290 - DNA, 20 bp, Artificial
  CRISPR gRNA sequence
ggagctccgaatctggcccc

SEQ ID NO: 772291 - DNA, 20 bp, Artificial
  CRISPR gRNA sequence
cgaatctggccccaccttca

SEQ ID NO: 772292 - DNA, 20 bp, Artificial
  CRISPR gRNA sequence
gccccaccttcaatctccca

SEQ ID NO: 772293 - DNA, 20 bp, Artificial
  CRISPR gRNA sequence
caatctcccagaacagcaag

SEQ ID NO: 772294 - DNA, 20 bp, Artificial
  CRISPR gRNA sequence
aatctcccagaacagcaagt

SEQ ID NO: 772295 - DNA, 20 bp, Artificial
  CRISPR gRNA sequence
ccagaacagcaagttgcctc

SEQ ID NO: 772296 - DNA, 20 bp, Artificial
  CRISPR gRNA sequence
cctcctaatgatagggagaa

SEQ ID NO: 772297 - DNA, 20 bp, Artificial
  CRISPR gRNA sequence
ctaatgatagggagaaagat

SEQ ID NO: 772298 - DNA, 20 bp, Artificial
  CRISPR gRNA sequence
atgatagggagaaagataac

SEQ ID NO: 772299 - DNA, 20 bp, Artificial
  CRISPR gRNA sequence
actggaggggttgggggcgg

SEQ ID NO: 772300 - DNA, 20 bp, Artificial
  CRISPR gRNA sequence
gaggggttgggggcggagaa

SEQ ID NO: 772301 - DNA, 20 bp, Artificial
  CRISPR gRNA sequence
ggggcggagaaatcacaggc

SEQ ID NO: 772302 - DNA, 20 bp, Artificial
  CRISPR gRNA sequence
cttaaggctctcctgacttc

SEQ ID NO: 772303 - DNA, 20 bp, Artificial
  CRISPR gRNA sequence
ttaaggctctcctgacttca

SEQ ID NO: 772304 - DNA, 20 bp, Artificial
  CRISPR gRNA sequence
aaggctctcctgacttcaag

SEQ ID NO: 772305 - DNA, 20 bp, Artificial
  CRISPR gRNA sequence
aggctctcctgacttcaagg

SEQ ID NO: 772306 - DNA, 20 bp, Artificial
  CRISPR gRNA sequence
tcctgacttcaaggctctgg

SEQ ID NO: 772307 - DNA, 20 bp, Artificial
  CRISPR gRNA sequence
ctgacttcaaggctctggaa

SEQ ID NO: 772308 - DNA, 20 bp, Artificial
  CRISPR gRNA sequence
acttcaaggctctggaagcc

SEQ ID NO: 772309 - DNA, 20 bp, Artificial
  CRISPR gRNA sequence
caaggctctggaagcctctg

SEQ ID NO: 772310 - DNA, 20 bp, Artificial
  CRISPR gRNA sequence
aaggctctggaagcctctgg

SEQ ID NO: 772311 - DNA, 20 bp, Artificial
  CRISPR gRNA sequence
tggaagcctctgggaagaat

SEQ ID NO: 772312 - DNA, 20 bp, Artificial
  CRISPR gRNA sequence
gaagcctctgggaagaatgg

SEQ ID NO: 772313 - DNA, 20 bp, Artificial
  CRISPR gRNA sequence
tgggaagaatggagccacat

SEQ ID NO: 772314 - DNA, 20 bp, Artificial
  CRISPR gRNA sequence
ggaagaatggagccacatct

SEQ ID NO: 772315 - DNA, 20 bp, Artificial
  CRISPR gRNA sequence
ggtcagcagaggggtgggcg

SEQ ID NO: 772316 - DNA, 20 bp, Artificial
  CRISPR gRNA sequence
atggcaggattcaccagggc

SEQ ID NO: 772317 - DNA, 20 bp, Artificial
  CRISPR gRNA sequence
accagggctggagctggtga

SEQ ID NO: 772318 - DNA, 20 bp, Artificial
  CRISPR gRNA sequence
gagctggtgagagtcacctg

SEQ ID NO: 772319 - DNA, 20 bp, Artificial
  CRISPR gRNA sequence
gtgagagtcacctgccccag

SEQ ID NO: 772320 - DNA, 20 bp, Artificial
  CRISPR gRNA sequence
ccccaggcctggccctggga

SEQ ID NO: 772321 - DNA, 20 bp, Artificial
  CRISPR gRNA sequence
gccctgggattggtctggtc

SEQ ID NO: 772322 - DNA, 20 bp, Artificial
  CRISPR gRNA sequence
ggattggtctggtcaggcca

SEQ ID NO: 772323 - DNA, 20 bp, Artificial
  CRISPR gRNA sequence
gtctggtcaggccaagaccc

SEQ ID NO: 772324 - DNA, 20 bp, Artificial
  CRISPR gRNA sequence
gtcaggccaagacccacctg

SEQ ID NO: 772325 - DNA, 20 bp, Artificial
  CRISPR gRNA sequence
ctgtgattgttctcagaaga

SEQ ID NO: 772326 - DNA, 20 bp, Artificial
  CRISPR gRNA sequence
tgattgttctcagaagattg

SEQ ID NO: 772327 - DNA, 20 bp, Artificial
  CRISPR gRNA sequence
ttctcagaagattggggaga

SEQ ID NO: 772328 - DNA, 20 bp, Artificial
  CRISPR gRNA sequence
tcagaagattggggagactc

SEQ ID NO: 772329 - DNA, 20 bp, Artificial
  CRISPR gRNA sequence
agaagattggggagactcca

SEQ ID NO: 772330 - DNA, 20 bp, Artificial
  CRISPR gRNA sequence
gggagactccatatctgaga

SEQ ID NO: 772331 - DNA, 20 bp, Artificial
  CRISPR gRNA sequence
catatctgagagtcctcaga

SEQ ID NO: 772332 - DNA, 20 bp, Artificial
  CRISPR gRNA sequence
agagtcctcagacttaatct

SEQ ID NO: 772333 - DNA, 20 bp, Artificial
  CRISPR gRNA sequence
agacttaatctgcttttgca

SEQ ID NO: 772334 - DNA, 20 bp, Artificial
  CRISPR gRNA sequence
aatctgcttttgcatctaag

SEQ ID NO: 772335 - DNA, 20 bp, Artificial
  CRISPR gRNA sequence
atctgcttttgcatctaaga

SEQ ID NO: 772336 - DNA, 20 bp, Artificial
  CRISPR gRNA sequence
cttttgcatctaagaagaaa

SEQ ID NO: 772337 - DNA, 20 bp, Artificial
  CRISPR gRNA sequence
ttgcatctaagaagaaaata

SEQ ID NO: 772338 - DNA, 20 bp, Artificial
  CRISPR gRNA sequence
tgcatctaagaagaaaatag

SEQ ID NO: 772339 - DNA, 20 bp, Artificial
  CRISPR gRNA sequence
gcatctaagaagaaaatagg

SEQ ID NO: 772340 - DNA, 20 bp, Artificial
  CRISPR gRNA sequence
catctaagaagaaaatagga

SEQ ID NO: 772341 - DNA, 20 bp, Artificial
  CRISPR gRNA sequence
agaagaaaataggaagatgg

SEQ ID NO: 772342 - DNA, 20 bp, Artificial
  CRISPR gRNA sequence
ggaattgatgggggaagagt

SEQ ID NO: 772343 - DNA, 20 bp, Artificial
  CRISPR gRNA sequence
atgggggaagagtttggggg

SEQ ID NO: 772344 - DNA, 20 bp, Artificial
  CRISPR gRNA sequence
gggggactcgggtggtagcc

SEQ ID NO: 772345 - DNA, 20 bp, Artificial
  CRISPR gRNA sequence
ggggactcgggtggtagcct

SEQ ID NO: 772346 - DNA, 20 bp, Artificial
  CRISPR gRNA sequence
gggtggtagcctagagagtc

SEQ ID NO: 772347 - DNA, 20 bp, Artificial
  CRISPR gRNA sequence
gagagtcccatttctcctca

SEQ ID NO: 772348 - DNA, 20 bp, Artificial
  CRISPR gRNA sequence
ctcctcaccaccctgcccct

SEQ ID NO: 772349 - DNA, 20 bp, Artificial
  CRISPR gRNA sequence
tcctcaccaccctgcccctc

SEQ ID NO: 772350 - DNA, 20 bp, Artificial
  CRISPR gRNA sequence
ctcaccaccctgcccctctg

SEQ ID NO: 772351 - DNA, 20 bp, Artificial
  CRISPR gRNA sequence
accaccctgcccctctgacc

SEQ ID NO: 772352 - DNA, 20 bp, Artificial
  CRISPR gRNA sequence
cccctctgaccccgccccca

SEQ ID NO: 772353 - DNA, 20 bp, Artificial
  CRISPR gRNA sequence
tgaccccgcccccaggagcc

SEQ ID NO: 772354 - DNA, 20 bp, Artificial
  CRISPR gRNA sequence
accccgcccccaggagccgt

SEQ ID NO: 772355 - DNA, 20 bp, Artificial
  CRISPR gRNA sequence
aggacccggtggtggcccta

SEQ ID NO: 772356 - DNA, 20 bp, Artificial
  CRISPR gRNA sequence
gtgggcaccgatgccaccct

SEQ ID NO: 772357 - DNA, 20 bp, Artificial
  CRISPR gRNA sequence
cgctgctccttctcccccga

SEQ ID NO: 772358 - DNA, 20 bp, Artificial
  CRISPR gRNA sequence
ctccttctcccccgagcctg

SEQ ID NO: 772359 - DNA, 20 bp, Artificial
  CRISPR gRNA sequence
cttctcccccgagcctggct

SEQ ID NO: 772360 - DNA, 20 bp, Artificial
  CRISPR gRNA sequence
ctcccccgagcctggcttca

SEQ ID NO: 772361 - DNA, 20 bp, Artificial
  CRISPR gRNA sequence
tcccccgagcctggcttcag

SEQ ID NO: 772362 - DNA, 20 bp, Artificial
  CRISPR gRNA sequence
ccccgagcctggcttcagcc

SEQ ID NO: 772363 - DNA, 20 bp, Artificial
  CRISPR gRNA sequence
gcttcagcctggcacagctc

SEQ ID NO: 772364 - DNA, 20 bp, Artificial
  CRISPR gRNA sequence
cagcctggcacagctcaacc

SEQ ID NO: 772365 - DNA, 20 bp, Artificial
  CRISPR gRNA sequence
agcctggcacagctcaacct

SEQ ID NO: 772366 - DNA, 20 bp, Artificial
  CRISPR gRNA sequence
gcacagctcaacctcatctg

SEQ ID NO: 772367 - DNA, 20 bp, Artificial
  CRISPR gRNA sequence
aacctcatctggcagctgac

SEQ ID NO: 772368 - DNA, 20 bp, Artificial
  CRISPR gRNA sequence
atctggcagctgacagacac

SEQ ID NO: 772369 - DNA, 20 bp, Artificial
  CRISPR gRNA sequence
gcagctgacagacaccaaac

SEQ ID NO: 772370 - DNA, 20 bp, Artificial
  CRISPR gRNA sequence
acagacaccaaacagctggt

SEQ ID NO: 772371 - DNA, 20 bp, Artificial
  CRISPR gRNA sequence
gtgcacagtttcaccgaagg

SEQ ID NO: 772372 - DNA, 20 bp, Artificial
  CRISPR gRNA sequence
caccgaaggccgggaccagg

SEQ ID NO: 772373 - DNA, 20 bp, Artificial
  CRISPR gRNA sequence
accgaaggccgggaccaggg

SEQ ID NO: 772374 - DNA, 20 bp, Artificial
  CRISPR gRNA sequence
tgccaaccgcacggccctct

SEQ ID NO: 772375 - DNA, 20 bp, Artificial
  CRISPR gRNA sequence
ttcccggacctgctggcaca

SEQ ID NO: 772376 - DNA, 20 bp, Artificial
  CRISPR gRNA sequence
cccggacctgctggcacaag

SEQ ID NO: 772377 - DNA, 20 bp, Artificial
  CRISPR gRNA sequence
ccggacctgctggcacaagg

SEQ ID NO: 772378 - DNA, 20 bp, Artificial
  CRISPR gRNA sequence
ctggcacaaggcaatgcatc

SEQ ID NO: 772379 - DNA, 20 bp, Artificial
  CRISPR gRNA sequence
gcacaaggcaatgcatccct

SEQ ID NO: 772380 - DNA, 20 bp, Artificial
  CRISPR gRNA sequence
aggctgcagcgcgtgcgtgt

SEQ ID NO: 772381 - DNA, 20 bp, Artificial
  CRISPR gRNA sequence
cagcgcgtgcgtgtggcgga

SEQ ID NO: 772382 - DNA, 20 bp, Artificial
  CRISPR gRNA sequence
cacctgcttcgtgagcatcc

SEQ ID NO: 772383 - DNA, 20 bp, Artificial
  CRISPR gRNA sequence
acctgcttcgtgagcatccg

SEQ ID NO: 772384 - DNA, 20 bp, Artificial
  CRISPR gRNA sequence
cttcgtgagcatccgggatt

SEQ ID NO: 772385 - DNA, 20 bp, Artificial
  CRISPR gRNA sequence
cgtgagcatccgggatttcg

SEQ ID NO: 772386 - DNA, 20 bp, Artificial
  CRISPR gRNA sequence
gtgagcatccgggatttcgg

SEQ ID NO: 772387 - DNA, 20 bp, Artificial
  CRISPR gRNA sequence
cggcagcgctgccgtcagcc

SEQ ID NO: 772388 - DNA, 20 bp, Artificial
  CRISPR gRNA sequence
ggcagcgctgccgtcagcct

SEQ ID NO: 772389 - DNA, 20 bp, Artificial
  CRISPR gRNA sequence
ccgtcagcctgcaggtggcc

SEQ ID NO: 772390 - DNA, 20 bp, Artificial
  CRISPR gRNA sequence
caggtggccggtgagcacca

SEQ ID NO: 772391 - DNA, 20 bp, Artificial
  CRISPR gRNA sequence
ccccttggttcaccctccat

SEQ ID NO: 772392 - DNA, 20 bp, Artificial
  CRISPR gRNA sequence
cccttggttcaccctccatt

SEQ ID NO: 772393 - DNA, 20 bp, Artificial
  CRISPR gRNA sequence
ggttcaccctccattccctc

SEQ ID NO: 772394 - DNA, 20 bp, Artificial
  CRISPR gRNA sequence
gttcaccctccattccctct

SEQ ID NO: 772395 - DNA, 20 bp, Artificial
  CRISPR gRNA sequence
accctccattccctctgcag

SEQ ID NO: 772396 - DNA, 20 bp, Artificial
  CRISPR gRNA sequence
cattccctctgcagcccacc

SEQ ID NO: 772397 - DNA, 20 bp, Artificial
  CRISPR gRNA sequence
cctctgcagcccaccctctg

SEQ ID NO: 772398 - DNA, 20 bp, Artificial
  CRISPR gRNA sequence
tgcagcccaccctctgctgc

SEQ ID NO: 772399 - DNA, 20 bp, Artificial
  CRISPR gRNA sequence
cagcccaccctctgctgcac

SEQ ID NO: 772400 - DNA, 20 bp, Artificial
  CRISPR gRNA sequence
tgctgcaccactgctcccag

SEQ ID NO: 772401 - DNA, 20 bp, Artificial
  CRISPR gRNA sequence
ctgcaccactgctcccagaa

SEQ ID NO: 772402 - DNA, 20 bp, Artificial
  CRISPR gRNA sequence
caccactgctcccagaaccc

SEQ ID NO: 772403 - DNA, 20 bp, Artificial
  CRISPR gRNA sequence
ctcccagaaccccagtgctg

SEQ ID NO: 772404 - DNA, 20 bp, Artificial
  CRISPR gRNA sequence
ccagaaccccagtgctgatt

SEQ ID NO: 772405 - DNA, 20 bp, Artificial
  CRISPR gRNA sequence
attcctgtactcagccccat

SEQ ID NO: 772406 - DNA, 20 bp, Artificial
  CRISPR gRNA sequence
ctgtactcagccccatgcat

SEQ ID NO: 772407 - DNA, 20 bp, Artificial
  CRISPR gRNA sequence
tactcagccccatgcatcct

SEQ ID NO: 772408 - DNA, 20 bp, Artificial
  CRISPR gRNA sequence
agccccatgcatccttttcc

SEQ ID NO: 772409 - DNA, 20 bp, Artificial
  CRISPR gRNA sequence
ttcctcccctgccattgccc

SEQ ID NO: 772410 - DNA, 20 bp, Artificial
  CRISPR gRNA sequence
tcctcccctgccattgccct

SEQ ID NO: 772411 - DNA, 20 bp, Artificial
  CRISPR gRNA sequence
cctcccctgccattgccctg

SEQ ID NO: 772412 - DNA, 20 bp, Artificial
  CRISPR gRNA sequence
ctcccctgccattgccctgc

SEQ ID NO: 772413 - DNA, 20 bp, Artificial
  CRISPR gRNA sequence
ccctgccattgccctgccct

SEQ ID NO: 772414 - DNA, 20 bp, Artificial
  CRISPR gRNA sequence
ccattgccctgcccttgacc

SEQ ID NO: 772415 - DNA, 20 bp, Artificial
  CRISPR gRNA sequence
ccctgcccttgacccctgcc

SEQ ID NO: 772416 - DNA, 20 bp, Artificial
  CRISPR gRNA sequence
cccttgacccctgccctctg

SEQ ID NO: 772417 - DNA, 20 bp, Artificial
  CRISPR gRNA sequence
gacccctgccctctgtcacc

SEQ ID NO: 772418 - DNA, 20 bp, Artificial
  CRISPR gRNA sequence
acccctgccctctgtcacct

SEQ ID NO: 772419 - DNA, 20 bp, Artificial
  CRISPR gRNA sequence
ccctctgtcacctccagctc

SEQ ID NO: 772420 - DNA, 20 bp, Artificial
  CRISPR gRNA sequence
tgtcacctccagctccctac

SEQ ID NO: 772421 - DNA, 20 bp, Artificial
  CRISPR gRNA sequence
tcacctccagctccctactc

SEQ ID NO: 772422 - DNA, 20 bp, Artificial
  CRISPR gRNA sequence
cagctccctactcgaagccc

SEQ ID NO: 772423 - DNA, 20 bp, Artificial
  CRISPR gRNA sequence
cctactcgaagcccagcatg

SEQ ID NO: 772424 - DNA, 20 bp, Artificial
  CRISPR gRNA sequence
ctcgaagcccagcatgaccc

SEQ ID NO: 772425 - DNA, 20 bp, Artificial
  CRISPR gRNA sequence
gaagcccagcatgaccctgg

SEQ ID NO: 772426 - DNA, 20 bp, Artificial
  CRISPR gRNA sequence
gagcccaacaaggacctgcg

SEQ ID NO: 772427 - DNA, 20 bp, Artificial
  CRISPR gRNA sequence
cggccaggggacacggtgac

SEQ ID NO: 772428 - DNA, 20 bp, Artificial
  CRISPR gRNA sequence
cagctaccggggctaccctg

SEQ ID NO: 772429 - DNA, 20 bp, Artificial
  CRISPR gRNA sequence
ccggggctaccctgaggctg

SEQ ID NO: 772430 - DNA, 20 bp, Artificial
  CRISPR gRNA sequence
ccctgaggctgaggtgttct

SEQ ID NO: 772431 - DNA, 20 bp, Artificial
  CRISPR gRNA sequence
aggctgaggtgttctggcag

SEQ ID NO: 772432 - DNA, 20 bp, Artificial
  CRISPR gRNA sequence
aggtgttctggcaggatggg

SEQ ID NO: 772433 - DNA, 20 bp, Artificial
  CRISPR gRNA sequence
tggcaggatgggcagggtgt

SEQ ID NO: 772434 - DNA, 20 bp, Artificial
  CRISPR gRNA sequence
gcaggatgggcagggtgtgc

SEQ ID NO: 772435 - DNA, 20 bp, Artificial
  CRISPR gRNA sequence
actggcaacgtgaccacgtc

SEQ ID NO: 772436 - DNA, 20 bp, Artificial
  CRISPR gRNA sequence
gcaacgtgaccacgtcgcag

SEQ ID NO: 772437 - DNA, 20 bp, Artificial
  CRISPR gRNA sequence
gtttgatgtgcacagcgtcc

SEQ ID NO: 772438 - DNA, 20 bp, Artificial
  CRISPR gRNA sequence
tttgatgtgcacagcgtcct

SEQ ID NO: 772439 - DNA, 20 bp, Artificial
  CRISPR gRNA sequence
gatgtgcacagcgtcctgcg

SEQ ID NO: 772440 - DNA, 20 bp, Artificial
  CRISPR gRNA sequence
atgtgcacagcgtcctgcgg

SEQ ID NO: 772441 - DNA, 20 bp, Artificial
  CRISPR gRNA sequence
cgggtggtgctgggtgcgaa

SEQ ID NO: 772442 - DNA, 20 bp, Artificial
  CRISPR gRNA sequence
ggtgcgaatggcacctacag

SEQ ID NO: 772443 - DNA, 20 bp, Artificial
  CRISPR gRNA sequence
cagctgcctggtgcgcaacc

SEQ ID NO: 772444 - DNA, 20 bp, Artificial
  CRISPR gRNA sequence
cctggtgcgcaaccccgtgc

SEQ ID NO: 772445 - DNA, 20 bp, Artificial
  CRISPR gRNA sequence
gtgcgcaaccccgtgctgca

SEQ ID NO: 772446 - DNA, 20 bp, Artificial
  CRISPR gRNA sequence
cagcaggatgcgcacggctc

SEQ ID NO: 772447 - DNA, 20 bp, Artificial
  CRISPR gRNA sequence
tgtcaccatcacaggtaagg

SEQ ID NO: 772448 - DNA, 20 bp, Artificial
  CRISPR gRNA sequence
tcaccatcacaggtaagggc

SEQ ID NO: 772449 - DNA, 20 bp, Artificial
  CRISPR gRNA sequence
gggaaggacggagcgagtaa

SEQ ID NO: 772450 - DNA, 20 bp, Artificial
  CRISPR gRNA sequence
cctctttactggaccctaac

SEQ ID NO: 772451 - DNA, 20 bp, Artificial
  CRISPR gRNA sequence
tttactggaccctaacgtgg

SEQ ID NO: 772452 - DNA, 20 bp, Artificial
  CRISPR gRNA sequence
tactggaccctaacgtggaa

SEQ ID NO: 772453 - DNA, 20 bp, Artificial
  CRISPR gRNA sequence
actggaccctaacgtggaat

SEQ ID NO: 772454 - DNA, 20 bp, Artificial
  CRISPR gRNA sequence
ctggaccctaacgtggaatt

SEQ ID NO: 772455 - DNA, 20 bp, Artificial
  CRISPR gRNA sequence
gaccctaacgtggaatttcc

SEQ ID NO: 772456 - DNA, 20 bp, Artificial
  CRISPR gRNA sequence
acgtggaatttccataggtt

SEQ ID NO: 772457 - DNA, 20 bp, Artificial
  CRISPR gRNA sequence
ccataggtttgggtggccag

SEQ ID NO: 772458 - DNA, 20 bp, Artificial
  CRISPR gRNA sequence
cataggtttgggtggccaga

SEQ ID NO: 772459 - DNA, 20 bp, Artificial
  CRISPR gRNA sequence
gggtggccagaagactttca

SEQ ID NO: 772460 - DNA, 20 bp, Artificial
  CRISPR gRNA sequence
ggtggccagaagactttcaa

SEQ ID NO: 772461 - DNA, 20 bp, Artificial
  CRISPR gRNA sequence
tcaaaatccctttcatagac

SEQ ID NO: 772462 - DNA, 20 bp, Artificial
  CRISPR gRNA sequence
caaaatccctttcatagact

SEQ ID NO: 772463 - DNA, 20 bp, Artificial
  CRISPR gRNA sequence
aaaatccctttcatagactt

SEQ ID NO: 772464 - DNA, 20 bp, Artificial
  CRISPR gRNA sequence
tcatagacttcaggtgctca

SEQ ID NO: 772465 - DNA, 20 bp, Artificial
  CRISPR gRNA sequence
catagacttcaggtgctcac

SEQ ID NO: 772466 - DNA, 20 bp, Artificial
  CRISPR gRNA sequence
atagacttcaggtgctcaca

SEQ ID NO: 772467 - DNA, 20 bp, Artificial
  CRISPR gRNA sequence
caggtgctcacactcttccc

SEQ ID NO: 772468 - DNA, 20 bp, Artificial
  CRISPR gRNA sequence
aggtgctcacactcttcccc

SEQ ID NO: 772469 - DNA, 20 bp, Artificial
  CRISPR gRNA sequence
acactcttccccacaagtcc

SEQ ID NO: 772470 - DNA, 20 bp, Artificial
  CRISPR gRNA sequence
ttccccacaagtccttaagg

SEQ ID NO: 772471 - DNA, 20 bp, Artificial
  CRISPR gRNA sequence
ccccacaagtccttaaggga

SEQ ID NO: 772472 - DNA, 20 bp, Artificial
  CRISPR gRNA sequence
cccacaagtccttaagggac

SEQ ID NO: 772473 - DNA, 20 bp, Artificial
  CRISPR gRNA sequence
aagggactcgagctgataag

SEQ ID NO: 772474 - DNA, 20 bp, Artificial
  CRISPR gRNA sequence
agggactcgagctgataaga

SEQ ID NO: 772475 - DNA, 20 bp, Artificial
  CRISPR gRNA sequence
gagctgataagaaccattta

SEQ ID NO: 772476 - DNA, 20 bp, Artificial
  CRISPR gRNA sequence
ataagaaccatttataatgt

SEQ ID NO: 772477 - DNA, 20 bp, Artificial
  CRISPR gRNA sequence
ataatgtttgccttcctaag

SEQ ID NO: 772478 - DNA, 20 bp, Artificial
  CRISPR gRNA sequence
taatgtttgccttcctaaga

SEQ ID NO: 772479 - DNA, 20 bp, Artificial
  CRISPR gRNA sequence
gccttcctaagagtgctttt

SEQ ID NO: 772480 - DNA, 20 bp, Artificial
  CRISPR gRNA sequence
ccttcctaagagtgcttttc

SEQ ID NO: 772481 - DNA, 20 bp, Artificial
  CRISPR gRNA sequence
cctaagagtgcttttcgtgg

SEQ ID NO: 772482 - DNA, 20 bp, Artificial
  CRISPR gRNA sequence
ctaagagtgcttttcgtggc

SEQ ID NO: 772483 - DNA, 20 bp, Artificial
  CRISPR gRNA sequence
agagtgcttttcgtggcact

SEQ ID NO: 772484 - DNA, 20 bp, Artificial
  CRISPR gRNA sequence
ttcgtggcacttatgcttct

SEQ ID NO: 772485 - DNA, 20 bp, Artificial
  CRISPR gRNA sequence
tcgtggcacttatgcttctt

SEQ ID NO: 772486 - DNA, 20 bp, Artificial
  CRISPR gRNA sequence
cgtggcacttatgcttctta

SEQ ID NO: 772487 - DNA, 20 bp, Artificial
  CRISPR gRNA sequence
gtggcacttatgcttcttat

SEQ ID NO: 772488 - DNA, 20 bp, Artificial
  CRISPR gRNA sequence
atgcttcttatgcagaggac

SEQ ID NO: 772489 - DNA, 20 bp, Artificial
  CRISPR gRNA sequence
tgcttcttatgcagaggaca

SEQ ID NO: 772490 - DNA, 20 bp, Artificial
  CRISPR gRNA sequence
cttatgcagaggacaaggta

SEQ ID NO: 772491 - DNA, 20 bp, Artificial
  CRISPR gRNA sequence
ttatgcagaggacaaggtac

SEQ ID NO: 772492 - DNA, 20 bp, Artificial
  CRISPR gRNA sequence
atgcagaggacaaggtacct

SEQ ID NO: 772493 - DNA, 20 bp, Artificial
  CRISPR gRNA sequence
tgcagaggacaaggtacctg

SEQ ID NO: 772494 - DNA, 20 bp, Artificial
  CRISPR gRNA sequence
cccgaaatttggaggcatgg

SEQ ID NO: 772495 - DNA, 20 bp, Artificial
  CRISPR gRNA sequence
ggaggcatgggcaggaattc

SEQ ID NO: 772496 - DNA, 20 bp, Artificial
  CRISPR gRNA sequence
gaggcatgggcaggaattct

SEQ ID NO: 772497 - DNA, 20 bp, Artificial
  CRISPR gRNA sequence
tggggcagccacaaggtgtg

SEQ ID NO: 772498 - DNA, 20 bp, Artificial
  CRISPR gRNA sequence
gggcagccacaaggtgtggc

SEQ ID NO: 772499 - DNA, 20 bp, Artificial
  CRISPR gRNA sequence
ggtgtgggtgtgctttccag

SEQ ID NO: 772500 - DNA, 20 bp, Artificial
  CRISPR gRNA sequence
gtgtgggtgtgctttccagc

SEQ ID NO: 772501 - DNA, 20 bp, Artificial
  CRISPR gRNA sequence
tccagcaggaactcctctga

SEQ ID NO: 772502 - DNA, 20 bp, Artificial
  CRISPR gRNA sequence
ccagcaggaactcctctgag

SEQ ID NO: 772503 - DNA, 20 bp, Artificial
  CRISPR gRNA sequence
cagcaggaactcctctgagt

SEQ ID NO: 772504 - DNA, 20 bp, Artificial
  CRISPR gRNA sequence
ctctgagtggtaggaaggta

SEQ ID NO: 772505 - DNA, 20 bp, Artificial
  CRISPR gRNA sequence
tgagtggtaggaaggtattc

SEQ ID NO: 772506 - DNA, 20 bp, Artificial
  CRISPR gRNA sequence
agtggtaggaaggtattctg

SEQ ID NO: 772507 - DNA, 20 bp, Artificial
  CRISPR gRNA sequence
tgggtcagtgggcgccatct

SEQ ID NO: 772508 - DNA, 20 bp, Artificial
  CRISPR gRNA sequence
ggtcagtgggcgccatctga

SEQ ID NO: 772509 - DNA, 20 bp, Artificial
  CRISPR gRNA sequence
attctgaagcctgagtgaca

SEQ ID NO: 772510 - DNA, 20 bp, Artificial
  CRISPR gRNA sequence
tgaagcctgagtgacagctg

SEQ ID NO: 772511 - DNA, 20 bp, Artificial
  CRISPR gRNA sequence
aagcctgagtgacagctggc

SEQ ID NO: 772512 - DNA, 20 bp, Artificial
  CRISPR gRNA sequence
agtgacagctggccctccct

SEQ ID NO: 772513 - DNA, 20 bp, Artificial
  CRISPR gRNA sequence
gccctccctagttagtcccc

SEQ ID NO: 772514 - DNA, 20 bp, Artificial
  CRISPR gRNA sequence
cctagttagtccccaacacc

SEQ ID NO: 772515 - DNA, 20 bp, Artificial
  CRISPR gRNA sequence
gttagtccccaacacctgag

SEQ ID NO: 772516 - DNA, 20 bp, Artificial
  CRISPR gRNA sequence
gtccccaacacctgagtcaa

SEQ ID NO: 772517 - DNA, 20 bp, Artificial
  CRISPR gRNA sequence
agtcaacgtcagctcttctt

SEQ ID NO: 772518 - DNA, 20 bp, Artificial
  CRISPR gRNA sequence
ttcttcctgcagacttgcgc

SEQ ID NO: 772519 - DNA, 20 bp, Artificial
  CRISPR gRNA sequence
cttcctgcagacttgcgctc

SEQ ID NO: 772520 - DNA, 20 bp, Artificial
  CRISPR gRNA sequence
ttcctgcagacttgcgctcc

SEQ ID NO: 772521 - DNA, 20 bp, Artificial
  CRISPR gRNA sequence
cctgcagacttgcgctccac

SEQ ID NO: 772522 - DNA, 20 bp, Artificial
  CRISPR gRNA sequence
ctgcagacttgcgctccacc

SEQ ID NO: 772523 - DNA, 20 bp, Artificial
  CRISPR gRNA sequence
cagacttgcgctccacccag

SEQ ID NO: 772524 - DNA, 20 bp, Artificial
  CRISPR gRNA sequence
gcgctccacccaggcagccg

SEQ ID NO: 772525 - DNA, 20 bp, Artificial
  CRISPR gRNA sequence
cgctccacccaggcagccgt

SEQ ID NO: 772526 - DNA, 20 bp, Artificial
  CRISPR gRNA sequence
cacccaggcagccgttggat

SEQ ID NO: 772527 - DNA, 20 bp, Artificial
  CRISPR gRNA sequence
gatgggcaggggctgtctct

SEQ ID NO: 772528 - DNA, 20 bp, Artificial
  CRISPR gRNA sequence
tctctgctgcccccgtgtgg

SEQ ID NO: 772529 - DNA, 20 bp, Artificial
  CRISPR gRNA sequence
tgctgcccccgtgtggtcaa

SEQ ID NO: 772530 - DNA, 20 bp, Artificial
  CRISPR gRNA sequence
ctgcccccgtgtggtcaaac

SEQ ID NO: 772531 - DNA, 20 bp, Artificial
  CRISPR gRNA sequence
cccccgtgtggtcaaacacc

SEQ ID NO: 772532 - DNA, 20 bp, Artificial
  CRISPR gRNA sequence
tagtgattgttagtctctgg

SEQ ID NO: 772533 - DNA, 20 bp, Artificial
  CRISPR gRNA sequence
agtgattgttagtctctggt

SEQ ID NO: 772534 - DNA, 20 bp, Artificial
  CRISPR gRNA sequence
gtgattgttagtctctggtt

SEQ ID NO: 772535 - DNA, 20 bp, Artificial
  CRISPR gRNA sequence
ttagtctctggtttccaggt

SEQ ID NO: 772536 - DNA, 20 bp, Artificial
  CRISPR gRNA sequence
gtctctggtttccaggttct

SEQ ID NO: 772537 - DNA, 20 bp, Artificial
  CRISPR gRNA sequence
tggtttccaggttctagcct

SEQ ID NO: 772538 - DNA, 20 bp, Artificial
  CRISPR gRNA sequence
gtttccaggttctagcctcg

SEQ ID NO: 772539 - DNA, 20 bp, Artificial
  CRISPR gRNA sequence
ccaggttctagcctcgtggg

SEQ ID NO: 772540 - DNA, 20 bp, Artificial
  CRISPR gRNA sequence
caggttctagcctcgtgggc

SEQ ID NO: 772541 - DNA, 20 bp, Artificial
  CRISPR gRNA sequence
tagcctcgtgggcacctctt

SEQ ID NO: 772542 - DNA, 20 bp, Artificial
  CRISPR gRNA sequence
gcctcgtgggcacctcttgt

SEQ ID NO: 772543 - DNA, 20 bp, Artificial
  CRISPR gRNA sequence
gtgggcacctcttgtgcctg

SEQ ID NO: 772544 - DNA, 20 bp, Artificial
  CRISPR gRNA sequence
ttgtgcctgagggtgtgaag

SEQ ID NO: 772545 - DNA, 20 bp, Artificial
  CRISPR gRNA sequence
gtgcctgagggtgtgaagag

SEQ ID NO: 772546 - DNA, 20 bp, Artificial
  CRISPR gRNA sequence
tgcctgagggtgtgaagagg

SEQ ID NO: 772547 - DNA, 20 bp, Artificial
  CRISPR gRNA sequence
agggtgtgaagagggttgag

SEQ ID NO: 772548 - DNA, 20 bp, Artificial
  CRISPR gRNA sequence
aggtcaagagccgcagtctc

SEQ ID NO: 772549 - DNA, 20 bp, Artificial
  CRISPR gRNA sequence
catctgtgtttggccctgag

SEQ ID NO: 772550 - DNA, 20 bp, Artificial
  CRISPR gRNA sequence
tgtttggccctgagaggcct

SEQ ID NO: 772551 - DNA, 20 bp, Artificial
  CRISPR gRNA sequence
ggccctgagaggcctctggt

SEQ ID NO: 772552 - DNA, 20 bp, Artificial
  CRISPR gRNA sequence
gccctgagaggcctctggtc

SEQ ID NO: 772553 - DNA, 20 bp, Artificial
  CRISPR gRNA sequence
agaggcctctggtcagtcac

SEQ ID NO: 772554 - DNA, 20 bp, Artificial
  CRISPR gRNA sequence
tggtcagtcacttcctgggc

SEQ ID NO: 772555 - DNA, 20 bp, Artificial
  CRISPR gRNA sequence
gtcagtcacttcctgggccg

SEQ ID NO: 772556 - DNA, 20 bp, Artificial
  CRISPR gRNA sequence
cctgggccgacgtgctcagt

SEQ ID NO: 772557 - DNA, 20 bp, Artificial
  CRISPR gRNA sequence
ctgggccgacgtgctcagtc

SEQ ID NO: 772558 - DNA, 20 bp, Artificial
  CRISPR gRNA sequence
ggccgacgtgctcagtctgg

SEQ ID NO: 772559 - DNA, 20 bp, Artificial
  CRISPR gRNA sequence
agtctggctcttcagtatct

SEQ ID NO: 772560 - DNA, 20 bp, Artificial
  CRISPR gRNA sequence
gctcttcagtatctctccct

SEQ ID NO: 772561 - DNA, 20 bp, Artificial
  CRISPR gRNA sequence
ttcagtatctctccctggcc

SEQ ID NO: 772562 - DNA, 20 bp, Artificial
  CRISPR gRNA sequence
cagtatctctccctggccaa

SEQ ID NO: 772563 - DNA, 20 bp, Artificial
  CRISPR gRNA sequence
agtatctctccctggccaac

SEQ ID NO: 772564 - DNA, 20 bp, Artificial
  CRISPR gRNA sequence
tccctggccaactgagcttt

SEQ ID NO: 772565 - DNA, 20 bp, Artificial
  CRISPR gRNA sequence
cctggccaactgagctttcc

SEQ ID NO: 772566 - DNA, 20 bp, Artificial
  CRISPR gRNA sequence
gccaactgagctttcccagg

SEQ ID NO: 772567 - DNA, 20 bp, Artificial
  CRISPR gRNA sequence
agctttcccagggacctcgc

SEQ ID NO: 772568 - DNA, 20 bp, Artificial
  CRISPR gRNA sequence
tcccagggacctcgccctgg

SEQ ID NO: 772569 - DNA, 20 bp, Artificial
  CRISPR gRNA sequence
cccagggacctcgccctggt

SEQ ID NO: 772570 - DNA, 20 bp, Artificial
  CRISPR gRNA sequence
ccagggacctcgccctggtg

SEQ ID NO: 772571 - DNA, 20 bp, Artificial
  CRISPR gRNA sequence
gccctggtgcacagtgaggt

SEQ ID NO: 772572 - DNA, 20 bp, Artificial
  CRISPR gRNA sequence
gtgcacagtgaggtcaggac

SEQ ID NO: 772573 - DNA, 20 bp, Artificial
  CRISPR gRNA sequence
tgtctgtctggttctcctct

SEQ ID NO: 772574 - DNA, 20 bp, Artificial
  CRISPR gRNA sequence
gtctgtctggttctcctctt

SEQ ID NO: 772575 - DNA, 20 bp, Artificial
  CRISPR gRNA sequence
tctgtctggttctcctcttg

SEQ ID NO: 772576 - DNA, 20 bp, Artificial
  CRISPR gRNA sequence
tctggttctcctcttgtctt

SEQ ID NO: 772577 - DNA, 20 bp, Artificial
  CRISPR gRNA sequence
gttctcctcttgtcttctga

SEQ ID NO: 772578 - DNA, 20 bp, Artificial
  CRISPR gRNA sequence
tcctcttgtcttctgatgac

SEQ ID NO: 772579 - DNA, 20 bp, Artificial
  CRISPR gRNA sequence
ctcttgtcttctgatgactt

SEQ ID NO: 772580 - DNA, 20 bp, Artificial
  CRISPR gRNA sequence
ttgtcttctgatgacttcca

SEQ ID NO: 772581 - DNA, 20 bp, Artificial
  CRISPR gRNA sequence
gtcttctgatgacttccatc

SEQ ID NO: 772582 - DNA, 20 bp, Artificial
  CRISPR gRNA sequence
tcttctgatgacttccatct

SEQ ID NO: 772583 - DNA, 20 bp, Artificial
  CRISPR gRNA sequence
ctgatgacttccatctgccc

SEQ ID NO: 772584 - DNA, 20 bp, Artificial
  CRISPR gRNA sequence
tgatgacttccatctgcccc

SEQ ID NO: 772585 - DNA, 20 bp, Artificial
  CRISPR gRNA sequence
atgacttccatctgcccctc

SEQ ID NO: 772586 - DNA, 20 bp, Artificial
  CRISPR gRNA sequence
ccatctgcccctcagcccat

SEQ ID NO: 772587 - DNA, 20 bp, Artificial
  CRISPR gRNA sequence
catctgcccctcagcccatc

SEQ ID NO: 772588 - DNA, 20 bp, Artificial
  CRISPR gRNA sequence
cccctcagcccatccaagtt

SEQ ID NO: 772589 - DNA, 20 bp, Artificial
  CRISPR gRNA sequence
agcccatccaagttctgatc

SEQ ID NO: 772590 - DNA, 20 bp, Artificial
  CRISPR gRNA sequence
tgatctcaccccaagtttcc

SEQ ID NO: 772591 - DNA, 20 bp, Artificial
  CRISPR gRNA sequence
atctcaccccaagtttccag

SEQ ID NO: 772592 - DNA, 20 bp, Artificial
  CRISPR gRNA sequence
accccaagtttccaggtctg

SEQ ID NO: 772593 - DNA, 20 bp, Artificial
  CRISPR gRNA sequence
ccaggtctgcatgcacctca

SEQ ID NO: 772594 - DNA, 20 bp, Artificial
  CRISPR gRNA sequence
caggtctgcatgcacctcag

SEQ ID NO: 772595 - DNA, 20 bp, Artificial
  CRISPR gRNA sequence
catgcacctcaggactcact

SEQ ID NO: 772596 - DNA, 20 bp, Artificial
  CRISPR gRNA sequence
aggactcacttattcctgtc

SEQ ID NO: 772597 - DNA, 20 bp, Artificial
  CRISPR gRNA sequence
acttattcctgtcctctccc

SEQ ID NO: 772598 - DNA, 20 bp, Artificial
  CRISPR gRNA sequence
attcctgtcctctccctctt

SEQ ID NO: 772599 - DNA, 20 bp, Artificial
  CRISPR gRNA sequence
ttcctgtcctctccctcttg

SEQ ID NO: 772600 - DNA, 20 bp, Artificial
  CRISPR gRNA sequence
ctgtcctctccctcttgaga

SEQ ID NO: 772601 - DNA, 20 bp, Artificial
  CRISPR gRNA sequence
tcctctccctcttgagacct

SEQ ID NO: 772602 - DNA, 20 bp, Artificial
  CRISPR gRNA sequence
tccctcttgagacctatgtg

SEQ ID NO: 772603 - DNA, 20 bp, Artificial
  CRISPR gRNA sequence
cctcttgagacctatgtggt

SEQ ID NO: 772604 - DNA, 20 bp, Artificial
  CRISPR gRNA sequence
ttgagacctatgtggtcccc

SEQ ID NO: 772605 - DNA, 20 bp, Artificial
  CRISPR gRNA sequence
gagacctatgtggtccccac

SEQ ID NO: 772606 - DNA, 20 bp, Artificial
  CRISPR gRNA sequence
agacctatgtggtccccact

SEQ ID NO: 772607 - DNA, 20 bp, Artificial
  CRISPR gRNA sequence
tgtggtccccacttctgaca

SEQ ID NO: 772608 - DNA, 20 bp, Artificial
  CRISPR gRNA sequence
ctgacaagctcggagccagg

SEQ ID NO: 772609 - DNA, 20 bp, Artificial
  CRISPR gRNA sequence
tgacaagctcggagccaggg

SEQ ID NO: 772610 - DNA, 20 bp, Artificial
  CRISPR gRNA sequence
acaagctcggagccagggcc

SEQ ID NO: 772611 - DNA, 20 bp, Artificial
  CRISPR gRNA sequence
ggagccagggcccgtcacat

SEQ ID NO: 772612 - DNA, 20 bp, Artificial
  CRISPR gRNA sequence
cttggagttcaggctcactc

SEQ ID NO: 772613 - DNA, 20 bp, Artificial
  CRISPR gRNA sequence
ggagttcaggctcactcctc

SEQ ID NO: 772614 - DNA, 20 bp, Artificial
  CRISPR gRNA sequence
gagttcaggctcactcctcc

SEQ ID NO: 772615 - DNA, 20 bp, Artificial
  CRISPR gRNA sequence
aggctcactcctccttctct

SEQ ID NO: 772616 - DNA, 20 bp, Artificial
  CRISPR gRNA sequence
actcctccttctctcttacg

SEQ ID NO: 772617 - DNA, 20 bp, Artificial
  CRISPR gRNA sequence
ctccttctctcttacgtgtt

SEQ ID NO: 772618 - DNA, 20 bp, Artificial
  CRISPR gRNA sequence
cttctctcttacgtgtttcc

SEQ ID NO: 772619 - DNA, 20 bp, Artificial
  CRISPR gRNA sequence
ctctcttacgtgtttccttc

SEQ ID NO: 772620 - DNA, 20 bp, Artificial
  CRISPR gRNA sequence
tctcttacgtgtttccttct

SEQ ID NO: 772621 - DNA, 20 bp, Artificial
  CRISPR gRNA sequence
tcttacgtgtttccttctgg

SEQ ID NO: 772622 - DNA, 20 bp, Artificial
  CRISPR gRNA sequence
ttacgtgtttccttctggca

SEQ ID NO: 772623 - DNA, 20 bp, Artificial
  CRISPR gRNA sequence
acgtgtttccttctggcaag

SEQ ID NO: 772624 - DNA, 20 bp, Artificial
  CRISPR gRNA sequence
cgtgtttccttctggcaagg

SEQ ID NO: 772625 - DNA, 20 bp, Artificial
  CRISPR gRNA sequence
ccttctggcaaggttgtgct

SEQ ID NO: 772626 - DNA, 20 bp, Artificial
  CRISPR gRNA sequence
cttctggcaaggttgtgctc

SEQ ID NO: 772627 - DNA, 20 bp, Artificial
  CRISPR gRNA sequence
ctggcaaggttgtgctcctt

SEQ ID NO: 772628 - DNA, 20 bp, Artificial
  CRISPR gRNA sequence
tggcaaggttgtgctccttc

SEQ ID NO: 772629 - DNA, 20 bp, Artificial
  CRISPR gRNA sequence
gcaaggttgtgctccttctg

SEQ ID NO: 772630 - DNA, 20 bp, Artificial
  CRISPR gRNA sequence
tgctccttctgcccacccct

SEQ ID NO: 772631 - DNA, 20 bp, Artificial
  CRISPR gRNA sequence
cttctgcccaccccttcccc

SEQ ID NO: 772632 - DNA, 20 bp, Artificial
  CRISPR gRNA sequence
ctgcccaccccttccccaag

SEQ ID NO: 772633 - DNA, 20 bp, Artificial
  CRISPR gRNA sequence
tgcccaccccttccccaaga

SEQ ID NO: 772634 - DNA, 20 bp, Artificial
  CRISPR gRNA sequence
cccaccccttccccaagatg

SEQ ID NO: 772635 - DNA, 20 bp, Artificial
  CRISPR gRNA sequence
ccccaagatggaaaacactc

SEQ ID NO: 772636 - DNA, 20 bp, Artificial
  CRISPR gRNA sequence
cccaagatggaaaacactcc

SEQ ID NO: 772637 - DNA, 20 bp, Artificial
  CRISPR gRNA sequence
ccttcctgtgctctccagga

SEQ ID NO: 772638 - DNA, 20 bp, Artificial
  CRISPR gRNA sequence
cctgtgctctccaggagaga

SEQ ID NO: 772639 - DNA, 20 bp, Artificial
  CRISPR gRNA sequence
ctgtgctctccaggagagag

SEQ ID NO: 772640 - DNA, 20 bp, Artificial
  CRISPR gRNA sequence
tgctctccaggagagagtag

SEQ ID NO: 772641 - DNA, 20 bp, Artificial
  CRISPR gRNA sequence
tccaggagagagtagctgcc

SEQ ID NO: 772642 - DNA, 20 bp, Artificial
  CRISPR gRNA sequence
caggagagagtagctgccct

SEQ ID NO: 772643 - DNA, 20 bp, Artificial
  CRISPR gRNA sequence
ccctgagctcttgaatgttc

SEQ ID NO: 772644 - DNA, 20 bp, Artificial
  CRISPR gRNA sequence
agctcttgaatgttctgaga

SEQ ID NO: 772645 - DNA, 20 bp, Artificial
  CRISPR gRNA sequence
ttgaatgttctgagacatgt

SEQ ID NO: 772646 - DNA, 20 bp, Artificial
  CRISPR gRNA sequence
gaatgttctgagacatgtcc

SEQ ID NO: 772647 - DNA, 20 bp, Artificial
  CRISPR gRNA sequence
aatgttctgagacatgtcct

SEQ ID NO: 772648 - DNA, 20 bp, Artificial
  CRISPR gRNA sequence
tgagacatgtccttgacctt

SEQ ID NO: 772649 - DNA, 20 bp, Artificial
  CRISPR gRNA sequence
agacatgtccttgacctttt

SEQ ID NO: 772650 - DNA, 20 bp, Artificial
  CRISPR gRNA sequence
gaccttttagagaacagcat

SEQ ID NO: 772651 - DNA, 20 bp, Artificial
  CRISPR gRNA sequence
accttttagagaacagcata

SEQ ID NO: 772652 - DNA, 20 bp, Artificial
  CRISPR gRNA sequence
ttagagaacagcatatggtt

SEQ ID NO: 772653 - DNA, 20 bp, Artificial
  CRISPR gRNA sequence
tagagaacagcatatggttt

SEQ ID NO: 772654 - DNA, 20 bp, Artificial
  CRISPR gRNA sequence
agagaacagcatatggtttg

SEQ ID NO: 772655 - DNA, 20 bp, Artificial
  CRISPR gRNA sequence
gagaacagcatatggtttgg

SEQ ID NO: 772656 - DNA, 20 bp, Artificial
  CRISPR gRNA sequence
ggtggtgaaaatgctgttca

SEQ ID NO: 772657 - DNA, 20 bp, Artificial
  CRISPR gRNA sequence
gtggtgaaaatgctgttcac

SEQ ID NO: 772658 - DNA, 20 bp, Artificial
  CRISPR gRNA sequence
ttcacaggcgaaaagaagaa

SEQ ID NO: 772659 - DNA, 20 bp, Artificial
  CRISPR gRNA sequence
acaggcgaaaagaagaaata

SEQ ID NO: 772660 - DNA, 20 bp, Artificial
  CRISPR gRNA sequence
ggcagaggatatgaagcttt

SEQ ID NO: 772661 - DNA, 20 bp, Artificial
  CRISPR gRNA sequence
gcagaggatatgaagctttc

SEQ ID NO: 772662 - DNA, 20 bp, Artificial
  CRISPR gRNA sequence
tcagaggagggagggtggta

SEQ ID NO: 772663 - DNA, 20 bp, Artificial
  CRISPR gRNA sequence
cagaggagggagggtggtag

SEQ ID NO: 772664 - DNA, 20 bp, Artificial
  CRISPR gRNA sequence
agaggagggagggtggtagt

SEQ ID NO: 772665 - DNA, 20 bp, Artificial
  CRISPR gRNA sequence
caggggcaaatgggagctga

SEQ ID NO: 772666 - DNA, 20 bp, Artificial
  CRISPR gRNA sequence
agaaggccttgaaggataag

SEQ ID NO: 772667 - DNA, 20 bp, Artificial
  CRISPR gRNA sequence
gaaggataaggggtctttgt

SEQ ID NO: 772668 - DNA, 20 bp, Artificial
  CRISPR gRNA sequence
aaggataaggggtctttgtg

SEQ ID NO: 772669 - DNA, 20 bp, Artificial
  CRISPR gRNA sequence
tgtggtcatttgcaccctgg

SEQ ID NO: 772670 - DNA, 20 bp, Artificial
  CRISPR gRNA sequence
gtggtcatttgcaccctggg

SEQ ID NO: 772671 - DNA, 20 bp, Artificial
  CRISPR gRNA sequence
tggtcatttgcaccctgggc

SEQ ID NO: 772672 - DNA, 20 bp, Artificial
  CRISPR gRNA sequence
gcaccctgggctgagctgga

SEQ ID NO: 772673 - DNA, 20 bp, Artificial
  CRISPR gRNA sequence
caccctgggctgagctggat

SEQ ID NO: 772674 - DNA, 20 bp, Artificial
  CRISPR gRNA sequence
ggctgagctggatatttgcg

SEQ ID NO: 772675 - DNA, 20 bp, Artificial
  CRISPR gRNA sequence
agctggatatttgcgatgct

SEQ ID NO: 772676 - DNA, 20 bp, Artificial
  CRISPR gRNA sequence
gatatttgcgatgctgtgca

SEQ ID NO: 772677 - DNA, 20 bp, Artificial
  CRISPR gRNA sequence
gcgatgctgtgcagaaagga

SEQ ID NO: 772678 - DNA, 20 bp, Artificial
  CRISPR gRNA sequence
cgatgctgtgcagaaaggac

SEQ ID NO: 772679 - DNA, 20 bp, Artificial
  CRISPR gRNA sequence
tgcagaaaggacttatgagt

SEQ ID NO: 772680 - DNA, 20 bp, Artificial
  CRISPR gRNA sequence
atgagtataaatgtgattgc

SEQ ID NO: 772681 - DNA, 20 bp, Artificial
  CRISPR gRNA sequence
tgagtataaatgtgattgca

SEQ ID NO: 772682 - DNA, 20 bp, Artificial
  CRISPR gRNA sequence
caaagagaatgtttatctca

SEQ ID NO: 772683 - DNA, 20 bp, Artificial
  CRISPR gRNA sequence
atctcacctaagagaaaatt

SEQ ID NO: 772684 - DNA, 20 bp, Artificial
  CRISPR gRNA sequence
tctcacctaagagaaaattc

SEQ ID NO: 772685 - DNA, 20 bp, Artificial
  CRISPR gRNA sequence
acctaagagaaaattctcta

SEQ ID NO: 772686 - DNA, 20 bp, Artificial
  CRISPR gRNA sequence
agagaaaattctctatttta

SEQ ID NO: 772687 - DNA, 20 bp, Artificial
  CRISPR gRNA sequence
tctattttaaacttgagtag

SEQ ID NO: 772688 - DNA, 20 bp, Artificial
  CRISPR gRNA sequence
tattttaaacttgagtagct

SEQ ID NO: 772689 - DNA, 20 bp, Artificial
  CRISPR gRNA sequence
ttttaaacttgagtagctaa

SEQ ID NO: 772690 - DNA, 20 bp, Artificial
  CRISPR gRNA sequence
taaacttgagtagctaacat

SEQ ID NO: 772691 - DNA, 20 bp, Artificial
  CRISPR gRNA sequence
aaacttgagtagctaacatt

SEQ ID NO: 772692 - DNA, 20 bp, Artificial
  CRISPR gRNA sequence
aacttgagtagctaacattt

SEQ ID NO: 772693 - DNA, 20 bp, Artificial
  CRISPR gRNA sequence
gagtagctaacatttaaagt

SEQ ID NO: 772694 - DNA, 20 bp, Artificial
  CRISPR gRNA sequence
agtagctaacatttaaagtg

SEQ ID NO: 772695 - DNA, 20 bp, Artificial
  CRISPR gRNA sequence
acatttaaagtgatttcaaa

SEQ ID NO: 772696 - DNA, 20 bp, Artificial
  CRISPR gRNA sequence
aaagtgatttcaaaaaaatt

SEQ ID NO: 772697 - DNA, 20 bp, Artificial
  CRISPR gRNA sequence
aagtgatttcaaaaaaattt

SEQ ID NO: 772698 - DNA, 20 bp, Artificial
  CRISPR gRNA sequence
caaaaaaatttagggctggg

SEQ ID NO: 772699 - DNA, 20 bp, Artificial
  CRISPR gRNA sequence
aaaaaaatttagggctgggc

SEQ ID NO: 772700 - DNA, 20 bp, Artificial
  CRISPR gRNA sequence
agggctgggcatggtggctc

SEQ ID NO: 772701 - DNA, 20 bp, Artificial
  CRISPR gRNA sequence
gggctgggcatggtggctca

SEQ ID NO: 772702 - DNA, 20 bp, Artificial
  CRISPR gRNA sequence
ggcatggtggctcacacctg

SEQ ID NO: 772703 - DNA, 20 bp, Artificial
  CRISPR gRNA sequence
acacctgtaatcccagcact

SEQ ID NO: 772704 - DNA, 20 bp, Artificial
  CRISPR gRNA sequence
taatcccagcactttgggag

SEQ ID NO: 772705 - DNA, 20 bp, Artificial
  CRISPR gRNA sequence
tgggaggccaaggcgggtgg

SEQ ID NO: 772706 - DNA, 20 bp, Artificial
  CRISPR gRNA sequence
gggaggccaaggcgggtgga

SEQ ID NO: 772707 - DNA, 20 bp, Artificial
  CRISPR gRNA sequence
ggaggccaaggcgggtggat

SEQ ID NO: 772708 - DNA, 20 bp, Artificial
  CRISPR gRNA sequence
gaggtcaggagttcgagacc

SEQ ID NO: 772709 - DNA, 20 bp, Artificial
  CRISPR gRNA sequence
aggtcaggagttcgagacca

SEQ ID NO: 772710 - DNA, 20 bp, Artificial
  CRISPR gRNA sequence
gagaccagcctgatcagcat

SEQ ID NO: 772711 - DNA, 20 bp, Artificial
  CRISPR gRNA sequence
atcagcatggtgaaaccctg

SEQ ID NO: 772712 - DNA, 20 bp, Artificial
  CRISPR gRNA sequence
tctctactgaaaacacaaaa

SEQ ID NO: 772713 - DNA, 20 bp, Artificial
  CRISPR gRNA sequence
tactgaaaacacaaaaatta

SEQ ID NO: 772714 - DNA, 20 bp, Artificial
  CRISPR gRNA sequence
ctgaaaacacaaaaattagc

SEQ ID NO: 772715 - DNA, 20 bp, Artificial
  CRISPR gRNA sequence
aaaacacaaaaattagctgg

SEQ ID NO: 772716 - DNA, 20 bp, Artificial
  CRISPR gRNA sequence
gctgggcgtggtggcatgca

SEQ ID NO: 772717 - DNA, 20 bp, Artificial
  CRISPR gRNA sequence
ggcgtggtggcatgcacctg

SEQ ID NO: 772718 - DNA, 20 bp, Artificial
  CRISPR gRNA sequence
tggtcccagctacttgggag

SEQ ID NO: 772719 - DNA, 20 bp, Artificial
  CRISPR gRNA sequence
cttgggaggctggggcaaga

SEQ ID NO: 772720 - DNA, 20 bp, Artificial
  CRISPR gRNA sequence
gggaggctggggcaagagaa

SEQ ID NO: 772721 - DNA, 20 bp, Artificial
  CRISPR gRNA sequence
ggaggctggggcaagagaat

SEQ ID NO: 772722 - DNA, 20 bp, Artificial
  CRISPR gRNA sequence
gggcaagagaattgcttgaa

SEQ ID NO: 772723 - DNA, 20 bp, Artificial
  CRISPR gRNA sequence
cttgaacctgggaggcggag

SEQ ID NO: 772724 - DNA, 20 bp, Artificial
  CRISPR gRNA sequence
gaacctgggaggcggaggtt

SEQ ID NO: 772725 - DNA, 20 bp, Artificial
  CRISPR gRNA sequence
aacctgggaggcggaggttg

SEQ ID NO: 772726 - DNA, 20 bp, Artificial
  CRISPR gRNA sequence
ggaggcggaggttgcagtga

SEQ ID NO: 772727 - DNA, 20 bp, Artificial
  CRISPR gRNA sequence
cagtgagccgagacagtgtc

SEQ ID NO: 772728 - DNA, 20 bp, Artificial
  CRISPR gRNA sequence
cactccagcctgggtgacag

SEQ ID NO: 772729 - DNA, 20 bp, Artificial
  CRISPR gRNA sequence
cagcctgggtgacagagcaa

SEQ ID NO: 772730 - DNA, 20 bp, Artificial
  CRISPR gRNA sequence
ggtgacagagcaagacactg

SEQ ID NO: 772731 - DNA, 20 bp, Artificial
  CRISPR gRNA sequence
tctcaaaaaataaataaaat

SEQ ID NO: 772732 - DNA, 20 bp, Artificial
  CRISPR gRNA sequence
aaaaaataaataaaataaaa

SEQ ID NO: 772733 - DNA, 20 bp, Artificial
  CRISPR gRNA sequence
cattgaggccattgttgcca

SEQ ID NO: 772734 - DNA, 20 bp, Artificial
  CRISPR gRNA sequence
attgaggccattgttgccaa

SEQ ID NO: 772735 - DNA, 20 bp, Artificial
  CRISPR gRNA sequence
aggccattgttgccaagcac

SEQ ID NO: 772736 - DNA, 20 bp, Artificial
  CRISPR gRNA sequence
ttgccaagcacatttcacag

SEQ ID NO: 772737 - DNA, 20 bp, Artificial
  CRISPR gRNA sequence
ccaagcacatttcacagacg

SEQ ID NO: 772738 - DNA, 20 bp, Artificial
  CRISPR gRNA sequence
cacagacgaagaaactgagg

SEQ ID NO: 772739 - DNA, 20 bp, Artificial
  CRISPR gRNA sequence
acagacgaagaaactgaggt

SEQ ID NO: 772740 - DNA, 20 bp, Artificial
  CRISPR gRNA sequence
aggtccacagagaaggggga

SEQ ID NO: 772741 - DNA, 20 bp, Artificial
  CRISPR gRNA sequence
tcccaaggtcacagactggc

SEQ ID NO: 772742 - DNA, 20 bp, Artificial
  CRISPR gRNA sequence
cccaaggtcacagactggca

SEQ ID NO: 772743 - DNA, 20 bp, Artificial
  CRISPR gRNA sequence
ccaaggtcacagactggcac

SEQ ID NO: 772744 - DNA, 20 bp, Artificial
  CRISPR gRNA sequence
gcacagcggctctcaatctt

SEQ ID NO: 772745 - DNA, 20 bp, Artificial
  CRISPR gRNA sequence
tcaatctttgggggtcagac

SEQ ID NO: 772746 - DNA, 20 bp, Artificial
  CRISPR gRNA sequence
aatctttgggggtcagaccc

SEQ ID NO: 772747 - DNA, 20 bp, Artificial
  CRISPR gRNA sequence
tgggggtcagacccttcttt

SEQ ID NO: 772748 - DNA, 20 bp, Artificial
  CRISPR gRNA sequence
gggggtcagacccttctttg

SEQ ID NO: 772749 - DNA, 20 bp, Artificial
  CRISPR gRNA sequence
ggggtcagacccttctttga

SEQ ID NO: 772750 - DNA, 20 bp, Artificial
  CRISPR gRNA sequence
ctttgaaaattggataaatg

SEQ ID NO: 772751 - DNA, 20 bp, Artificial
  CRISPR gRNA sequence
tttgaaaattggataaatga

SEQ ID NO: 772752 - DNA, 20 bp, Artificial
  CRISPR gRNA sequence
tgaaaattggataaatgatc

SEQ ID NO: 772753 - DNA, 20 bp, Artificial
  CRISPR gRNA sequence
gaaaattggataaatgatca

SEQ ID NO: 772754 - DNA, 20 bp, Artificial
  CRISPR gRNA sequence
aaaattggataaatgatcaa

SEQ ID NO: 772755 - DNA, 20 bp, Artificial
  CRISPR gRNA sequence
gataaatgatcaatgcagca

SEQ ID NO: 772756 - DNA, 20 bp, Artificial
  CRISPR gRNA sequence
gcacataactctggagggtt

SEQ ID NO: 772757 - DNA, 20 bp, Artificial
  CRISPR gRNA sequence
cacataactctggagggttc

SEQ ID NO: 772758 - DNA, 20 bp, Artificial
  CRISPR gRNA sequence
tggagggttcgctgcctctc

SEQ ID NO: 772759 - DNA, 20 bp, Artificial
  CRISPR gRNA sequence
gagggttcgctgcctctcta

SEQ ID NO: 772760 - DNA, 20 bp, Artificial
  CRISPR gRNA sequence
gctgcctctctaaactcctc

SEQ ID NO: 772761 - DNA, 20 bp, Artificial
  CRISPR gRNA sequence
cctctctaaactcctccgtg

SEQ ID NO: 772762 - DNA, 20 bp, Artificial
  CRISPR gRNA sequence
tctaaactcctccgtgggtc

SEQ ID NO: 772763 - DNA, 20 bp, Artificial
  CRISPR gRNA sequence
taaactcctccgtgggtctg

SEQ ID NO: 772764 - DNA, 20 bp, Artificial
  CRISPR gRNA sequence
aactcctccgtgggtctgta

SEQ ID NO: 772765 - DNA, 20 bp, Artificial
  CRISPR gRNA sequence
ctccgtgggtctgtagacct

SEQ ID NO: 772766 - DNA, 20 bp, Artificial
  CRISPR gRNA sequence
cgtgggtctgtagacctggg

SEQ ID NO: 772767 - DNA, 20 bp, Artificial
  CRISPR gRNA sequence
tagacctgggctccagtgcc

SEQ ID NO: 772768 - DNA, 20 bp, Artificial
  CRISPR gRNA sequence
ggctccagtgccctgcagtg

SEQ ID NO: 772769 - DNA, 20 bp, Artificial
  CRISPR gRNA sequence
cagtgccctgcagtgaggag

SEQ ID NO: 772770 - DNA, 20 bp, Artificial
  CRISPR gRNA sequence
cagtgaggagatgagccatg

SEQ ID NO: 772771 - DNA, 20 bp, Artificial
  CRISPR gRNA sequence
tggcctctcagcctaatttc

SEQ ID NO: 772772 - DNA, 20 bp, Artificial
  CRISPR gRNA sequence
ggcctctcagcctaatttcc

SEQ ID NO: 772773 - DNA, 20 bp, Artificial
  CRISPR gRNA sequence
gcctctcagcctaatttcct

SEQ ID NO: 772774 - DNA, 20 bp, Artificial
  CRISPR gRNA sequence
tcagcctaatttcctctcct

SEQ ID NO: 772775 - DNA, 20 bp, Artificial
  CRISPR gRNA sequence
agcctaatttcctctccttc

SEQ ID NO: 772776 - DNA, 20 bp, Artificial
  CRISPR gRNA sequence
atttcctctccttcccacca

SEQ ID NO: 772777 - DNA, 20 bp, Artificial
  CRISPR gRNA sequence
cctctccttcccaccagcca

SEQ ID NO: 772778 - DNA, 20 bp, Artificial
  CRISPR gRNA sequence
ctctccttcccaccagccag

SEQ ID NO: 772779 - DNA, 20 bp, Artificial
  CRISPR gRNA sequence
tccttcccaccagccagcct

SEQ ID NO: 772780 - DNA, 20 bp, Artificial
  CRISPR gRNA sequence
cttcccaccagccagcctcc

SEQ ID NO: 772781 - DNA, 20 bp, Artificial
  CRISPR gRNA sequence
cccaccagccagcctcctgt

SEQ ID NO: 772782 - DNA, 20 bp, Artificial
  CRISPR gRNA sequence
ccaccagccagcctcctgtt

SEQ ID NO: 772783 - DNA, 20 bp, Artificial
  CRISPR gRNA sequence
ctgtttctgttagagcaggt

SEQ ID NO: 772784 - DNA, 20 bp, Artificial
  CRISPR gRNA sequence
tttctgttagagcaggtctg

SEQ ID NO: 772785 - DNA, 20 bp, Artificial
  CRISPR gRNA sequence
ctgttagagcaggtctggcc

SEQ ID NO: 772786 - DNA, 20 bp, Artificial
  CRISPR gRNA sequence
tgttagagcaggtctggcct

SEQ ID NO: 772787 - DNA, 20 bp, Artificial
  CRISPR gRNA sequence
ttagagcaggtctggcctac

SEQ ID NO: 772788 - DNA, 20 bp, Artificial
  CRISPR gRNA sequence
gagcaggtctggcctacttt

SEQ ID NO: 772789 - DNA, 20 bp, Artificial
  CRISPR gRNA sequence
gcctactttggagcccttgg

SEQ ID NO: 772790 - DNA, 20 bp, Artificial
  CRISPR gRNA sequence
ctttggagcccttggcctgt

SEQ ID NO: 772791 - DNA, 20 bp, Artificial
  CRISPR gRNA sequence
tggagcccttggcctgtatt

SEQ ID NO: 772792 - DNA, 20 bp, Artificial
  CRISPR gRNA sequence
ggagcccttggcctgtattt

SEQ ID NO: 772793 - DNA, 20 bp, Artificial
  CRISPR gRNA sequence
gagcccttggcctgtatttt

SEQ ID NO: 772794 - DNA, 20 bp, Artificial
  CRISPR gRNA sequence
ggcctgtattttgcttcggg

SEQ ID NO: 772795 - DNA, 20 bp, Artificial
  CRISPR gRNA sequence
gcctgtattttgcttcgggc

SEQ ID NO: 772796 - DNA, 20 bp, Artificial
  CRISPR gRNA sequence
tattttgcttcgggcagctt

SEQ ID NO: 772797 - DNA, 20 bp, Artificial
  CRISPR gRNA sequence
tgcttcgggcagctttgtat

SEQ ID NO: 772798 - DNA, 20 bp, Artificial
  CRISPR gRNA sequence
gcttcgggcagctttgtatc

SEQ ID NO: 772799 - DNA, 20 bp, Artificial
  CRISPR gRNA sequence
cttcgggcagctttgtatca

SEQ ID NO: 772800 - DNA, 20 bp, Artificial
  CRISPR gRNA sequence
cgggcagctttgtatcatgt

SEQ ID NO: 772801 - DNA, 20 bp, Artificial
  CRISPR gRNA sequence
gggcagctttgtatcatgtc

SEQ ID NO: 772802 - DNA, 20 bp, Artificial
  CRISPR gRNA sequence
tgtatcatgtcaaacattct

SEQ ID NO: 772803 - DNA, 20 bp, Artificial
  CRISPR gRNA sequence
gtatcatgtcaaacattctg

SEQ ID NO: 772804 - DNA, 20 bp, Artificial
  CRISPR gRNA sequence
tatcatgtcaaacattctgg

SEQ ID NO: 772805 - DNA, 20 bp, Artificial
  CRISPR gRNA sequence
tgggattcagactttcagtc

SEQ ID NO: 772806 - DNA, 20 bp, Artificial
  CRISPR gRNA sequence
ggattcagactttcagtcct

SEQ ID NO: 772807 - DNA, 20 bp, Artificial
  CRISPR gRNA sequence
agactttcagtcctccagct

SEQ ID NO: 772808 - DNA, 20 bp, Artificial
  CRISPR gRNA sequence
tcagtcctccagctggtctc

SEQ ID NO: 772809 - DNA, 20 bp, Artificial
  CRISPR gRNA sequence
cagtcctccagctggtctct

SEQ ID NO: 772810 - DNA, 20 bp, Artificial
  CRISPR gRNA sequence
agtcctccagctggtctctc

SEQ ID NO: 772811 - DNA, 20 bp, Artificial
  CRISPR gRNA sequence
cagctggtctctcccgtacc

SEQ ID NO: 772812 - DNA, 20 bp, Artificial
  CRISPR gRNA sequence
gtctctcccgtacctgatga

SEQ ID NO: 772813 - DNA, 20 bp, Artificial
  CRISPR gRNA sequence
tcccgtacctgatgaagtta

SEQ ID NO: 772814 - DNA, 20 bp, Artificial
  CRISPR gRNA sequence
ccgtacctgatgaagttagt

SEQ ID NO: 772815 - DNA, 20 bp, Artificial
  CRISPR gRNA sequence
atgaagttagtgaagttgtg

SEQ ID NO: 772816 - DNA, 20 bp, Artificial
  CRISPR gRNA sequence
gtgaagttgtgtgctgtgca

SEQ ID NO: 772817 - DNA, 20 bp, Artificial
  CRISPR gRNA sequence
tgtgctgtgcagagcctctt

SEQ ID NO: 772818 - DNA, 20 bp, Artificial
  CRISPR gRNA sequence
tgcagagcctcttggagggg

SEQ ID NO: 772819 - DNA, 20 bp, Artificial
  CRISPR gRNA sequence
ttggagggggatttatggag

SEQ ID NO: 772820 - DNA, 20 bp, Artificial
  CRISPR gRNA sequence
ggagggggatttatggagca

SEQ ID NO: 772821 - DNA, 20 bp, Artificial
  CRISPR gRNA sequence
gagggggatttatggagcaa

SEQ ID NO: 772822 - DNA, 20 bp, Artificial
  CRISPR gRNA sequence
atggagcaagccctagagac

SEQ ID NO: 772823 - DNA, 20 bp, Artificial
  CRISPR gRNA sequence
tggagcaagccctagagacg

SEQ ID NO: 772824 - DNA, 20 bp, Artificial
  CRISPR gRNA sequence
gagacgtggcctgagcctgt

SEQ ID NO: 772825 - DNA, 20 bp, Artificial
  CRISPR gRNA sequence
agcctgtcctttcttgggtg

SEQ ID NO: 772826 - DNA, 20 bp, Artificial
  CRISPR gRNA sequence
tcctttcttgggtgaacagg

SEQ ID NO: 772827 - DNA, 20 bp, Artificial
  CRISPR gRNA sequence
tcttgggtgaacagggcaaa

SEQ ID NO: 772828 - DNA, 20 bp, Artificial
  CRISPR gRNA sequence
cttgggtgaacagggcaaat

SEQ ID NO: 772829 - DNA, 20 bp, Artificial
  CRISPR gRNA sequence
ttgggtgaacagggcaaatg

SEQ ID NO: 772830 - DNA, 20 bp, Artificial
  CRISPR gRNA sequence
gggtgaacagggcaaatgta

SEQ ID NO: 772831 - DNA, 20 bp, Artificial
  CRISPR gRNA sequence
ggtgaacagggcaaatgtaa

SEQ ID NO: 772832 - DNA, 20 bp, Artificial
  CRISPR gRNA sequence
gtgttccagggacaccacca

SEQ ID NO: 772833 - DNA, 20 bp, Artificial
  CRISPR gRNA sequence
tgttccagggacaccaccag

SEQ ID NO: 772834 - DNA, 20 bp, Artificial
  CRISPR gRNA sequence
cagggacaccaccagttaag

SEQ ID NO: 772835 - DNA, 20 bp, Artificial
  CRISPR gRNA sequence
agggggaacatagagaccct

SEQ ID NO: 772836 - DNA, 20 bp, Artificial
  CRISPR gRNA sequence
tgcttgagtatttccatggc

SEQ ID NO: 772837 - DNA, 20 bp, Artificial
  CRISPR gRNA sequence
cttgagtatttccatggctc

SEQ ID NO: 772838 - DNA, 20 bp, Artificial
  CRISPR gRNA sequence
gagtatttccatggctctgc

SEQ ID NO: 772839 - DNA, 20 bp, Artificial
  CRISPR gRNA sequence
agtatttccatggctctgcc

SEQ ID NO: 772840 - DNA, 20 bp, Artificial
  CRISPR gRNA sequence
ccatggctctgccccctcct

SEQ ID NO: 772841 - DNA, 20 bp, Artificial
  CRISPR gRNA sequence
catggctctgccccctcctc

SEQ ID NO: 772842 - DNA, 20 bp, Artificial
  CRISPR gRNA sequence
tgccccctcctctgctgtca

SEQ ID NO: 772843 - DNA, 20 bp, Artificial
  CRISPR gRNA sequence
ccccctcctctgctgtcaga

SEQ ID NO: 772844 - DNA, 20 bp, Artificial
  CRISPR gRNA sequence
ctctgctgtcagagccccat

SEQ ID NO: 772845 - DNA, 20 bp, Artificial
  CRISPR gRNA sequence
tgctgtcagagccccatgat

SEQ ID NO: 772846 - DNA, 20 bp, Artificial
  CRISPR gRNA sequence
ctgtcagagccccatgatgg

SEQ ID NO: 772847 - DNA, 20 bp, Artificial
  CRISPR gRNA sequence
tcagagccccatgatgggat

SEQ ID NO: 772848 - DNA, 20 bp, Artificial
  CRISPR gRNA sequence
ccagggtggttattgttttt

SEQ ID NO: 772849 - DNA, 20 bp, Artificial
  CRISPR gRNA sequence
cagggtggttattgtttttt

SEQ ID NO: 772850 - DNA, 20 bp, Artificial
  CRISPR gRNA sequence
ttgttttttaatgtgtgctc

SEQ ID NO: 772851 - DNA, 20 bp, Artificial
  CRISPR gRNA sequence
ttttttaatgtgtgctctgt

SEQ ID NO: 772852 - DNA, 20 bp, Artificial
  CRISPR gRNA sequence
tttaatgtgtgctctgtgga

SEQ ID NO: 772853 - DNA, 20 bp, Artificial
  CRISPR gRNA sequence
ttaatgtgtgctctgtggat

SEQ ID NO: 772854 - DNA, 20 bp, Artificial
  CRISPR gRNA sequence
taatgtgtgctctgtggatg

SEQ ID NO: 772855 - DNA, 20 bp, Artificial
  CRISPR gRNA sequence
aatgtgtgctctgtggatgg

SEQ ID NO: 772856 - DNA, 20 bp, Artificial
  CRISPR gRNA sequence
atgtgtgctctgtggatggg

SEQ ID NO: 772857 - DNA, 20 bp, Artificial
  CRISPR gRNA sequence
tgtggatgggccctcttggc

SEQ ID NO: 772858 - DNA, 20 bp, Artificial
  CRISPR gRNA sequence
tggatgggccctcttggcca

SEQ ID NO: 772859 - DNA, 20 bp, Artificial
  CRISPR gRNA sequence
ttggccacatcagctgctgc

SEQ ID NO: 772860 - DNA, 20 bp, Artificial
  CRISPR gRNA sequence
ggccacatcagctgctgccc

SEQ ID NO: 772861 - DNA, 20 bp, Artificial
  CRISPR gRNA sequence
gccacatcagctgctgccct

SEQ ID NO: 772862 - DNA, 20 bp, Artificial
  CRISPR gRNA sequence
ctgccctccttttctgcaca

SEQ ID NO: 772863 - DNA, 20 bp, Artificial
  CRISPR gRNA sequence
ccctccttttctgcacacct

SEQ ID NO: 772864 - DNA, 20 bp, Artificial
  CRISPR gRNA sequence
cttttctgcacacctctctt

SEQ ID NO: 772865 - DNA, 20 bp, Artificial
  CRISPR gRNA sequence
ttctgcacacctctcttcat

SEQ ID NO: 772866 - DNA, 20 bp, Artificial
  CRISPR gRNA sequence
tctgcacacctctcttcatc

SEQ ID NO: 772867 - DNA, 20 bp, Artificial
  CRISPR gRNA sequence
ctgcacacctctcttcatca

SEQ ID NO: 772868 - DNA, 20 bp, Artificial
  CRISPR gRNA sequence
tgcacacctctcttcatcac

SEQ ID NO: 772869 - DNA, 20 bp, Artificial
  CRISPR gRNA sequence
cacacctctcttcatcactg

SEQ ID NO: 772870 - DNA, 20 bp, Artificial
  CRISPR gRNA sequence
tcttcatcactggggtgatg

SEQ ID NO: 772871 - DNA, 20 bp, Artificial
  CRISPR gRNA sequence
ttcatcactggggtgatgga

SEQ ID NO: 772872 - DNA, 20 bp, Artificial
  CRISPR gRNA sequence
catcactggggtgatggatc

SEQ ID NO: 772873 - DNA, 20 bp, Artificial
  CRISPR gRNA sequence
atcactggggtgatggatcc

SEQ ID NO: 772874 - DNA, 20 bp, Artificial
  CRISPR gRNA sequence
gggtgatggatccctgtgct

SEQ ID NO: 772875 - DNA, 20 bp, Artificial
  CRISPR gRNA sequence
tgcttccaatggccagagca

SEQ ID NO: 772876 - DNA, 20 bp, Artificial
  CRISPR gRNA sequence
ccaatggccagagcagcagt

SEQ ID NO: 772877 - DNA, 20 bp, Artificial
  CRISPR gRNA sequence
caatggccagagcagcagtt

SEQ ID NO: 772878 - DNA, 20 bp, Artificial
  CRISPR gRNA sequence
tgccagcagtgcctattgaa

SEQ ID NO: 772879 - DNA, 20 bp, Artificial
  CRISPR gRNA sequence
gccagcagtgcctattgaag

SEQ ID NO: 772880 - DNA, 20 bp, Artificial
  CRISPR gRNA sequence
ccagcagtgcctattgaagg

SEQ ID NO: 772881 - DNA, 20 bp, Artificial
  CRISPR gRNA sequence
ttgaaggtgacatctgcaga

SEQ ID NO: 772882 - DNA, 20 bp, Artificial
  CRISPR gRNA sequence
aaggtgacatctgcagatcc

SEQ ID NO: 772883 - DNA, 20 bp, Artificial
  CRISPR gRNA sequence
cagatccatgcacgaggtgc

SEQ ID NO: 772884 - DNA, 20 bp, Artificial
  CRISPR gRNA sequence
tgctggggtctctgccgcca

SEQ ID NO: 772885 - DNA, 20 bp, Artificial
  CRISPR gRNA sequence
gggtctctgccgccaaaggg

SEQ ID NO: 772886 - DNA, 20 bp, Artificial
  CRISPR gRNA sequence
tgccgccaaagggtccatag

SEQ ID NO: 772887 - DNA, 20 bp, Artificial
  CRISPR gRNA sequence
ccgccaaagggtccatagca

SEQ ID NO: 772888 - DNA, 20 bp, Artificial
  CRISPR gRNA sequence
cactgacagggcctcctgca

SEQ ID NO: 772889 - DNA, 20 bp, Artificial
  CRISPR gRNA sequence
acagggcctcctgcagaagc

SEQ ID NO: 772890 - DNA, 20 bp, Artificial
  CRISPR gRNA sequence
ctgcagaagctgctgaggcc

SEQ ID NO: 772891 - DNA, 20 bp, Artificial
  CRISPR gRNA sequence
cagaagctgctgaggccctg

SEQ ID NO: 772892 - DNA, 20 bp, Artificial
  CRISPR gRNA sequence
ctgaggccctgggtgtgcat

SEQ ID NO: 772893 - DNA, 20 bp, Artificial
  CRISPR gRNA sequence
aggccctgggtgtgcatcgt

SEQ ID NO: 772894 - DNA, 20 bp, Artificial
  CRISPR gRNA sequence
ggtgtgcatcgtctccagac

SEQ ID NO: 772895 - DNA, 20 bp, Artificial
  CRISPR gRNA sequence
cagacagcaaaggaaagcag

SEQ ID NO: 772896 - DNA, 20 bp, Artificial
  CRISPR gRNA sequence
tcttttgtcaggcttttcct

SEQ ID NO: 772897 - DNA, 20 bp, Artificial
  CRISPR gRNA sequence
ttgtcaggcttttcctctca

SEQ ID NO: 772898 - DNA, 20 bp, Artificial
  CRISPR gRNA sequence
tgtcaggcttttcctctcaa

SEQ ID NO: 772899 - DNA, 20 bp, Artificial
  CRISPR gRNA sequence
gtcaggcttttcctctcaag

SEQ ID NO: 772900 - DNA, 20 bp, Artificial
  CRISPR gRNA sequence
tcaggcttttcctctcaaga

SEQ ID NO: 772901 - DNA, 20 bp, Artificial
  CRISPR gRNA sequence
ttcctctcaagacttctccc

SEQ ID NO: 772902 - DNA, 20 bp, Artificial
  CRISPR gRNA sequence
tcctctcaagacttctccct

SEQ ID NO: 772903 - DNA, 20 bp, Artificial
  CRISPR gRNA sequence
cctctcaagacttctcccta

SEQ ID NO: 772904 - DNA, 20 bp, Artificial
  CRISPR gRNA sequence
ctctcaagacttctccctag

SEQ ID NO: 772905 - DNA, 20 bp, Artificial
  CRISPR gRNA sequence
tcaagacttctccctaggac

SEQ ID NO: 772906 - DNA, 20 bp, Artificial
  CRISPR gRNA sequence
aagacttctccctaggaccc

SEQ ID NO: 772907 - DNA, 20 bp, Artificial
  CRISPR gRNA sequence
ctccctaggacccagctggg

SEQ ID NO: 772908 - DNA, 20 bp, Artificial
  CRISPR gRNA sequence
tccctaggacccagctgggt

SEQ ID NO: 772909 - DNA, 20 bp, Artificial
  CRISPR gRNA sequence
cctaggacccagctgggtgc

SEQ ID NO: 772910 - DNA, 20 bp, Artificial
  CRISPR gRNA sequence
ggacccagctgggtgcaggg

SEQ ID NO: 772911 - DNA, 20 bp, Artificial
  CRISPR gRNA sequence
ggtgcaggggctgggctaga

SEQ ID NO: 772912 - DNA, 20 bp, Artificial
  CRISPR gRNA sequence
ggctagaggatggtatgtaa

SEQ ID NO: 772913 - DNA, 20 bp, Artificial
  CRISPR gRNA sequence
gaggatggtatgtaagatgg

SEQ ID NO: 772914 - DNA, 20 bp, Artificial
  CRISPR gRNA sequence
tgctcagaacagctcctggc

SEQ ID NO: 772915 - DNA, 20 bp, Artificial
  CRISPR gRNA sequence
agaacagctcctggccctac

SEQ ID NO: 772916 - DNA, 20 bp, Artificial
  CRISPR gRNA sequence
ctggccctacccagctttgg

SEQ ID NO: 772917 - DNA, 20 bp, Artificial
  CRISPR gRNA sequence
gccctacccagctttgggtc

SEQ ID NO: 772918 - DNA, 20 bp, Artificial
  CRISPR gRNA sequence
cccagctttgggtcctcaac

SEQ ID NO: 772919 - DNA, 20 bp, Artificial
  CRISPR gRNA sequence
tgggtcctcaacttcatccc

SEQ ID NO: 772920 - DNA, 20 bp, Artificial
  CRISPR gRNA sequence
gggtcctcaacttcatccct

SEQ ID NO: 772921 - DNA, 20 bp, Artificial
  CRISPR gRNA sequence
ggtcctcaacttcatccctc

SEQ ID NO: 772922 - DNA, 20 bp, Artificial
  CRISPR gRNA sequence
aacttcatccctcttgacgt

SEQ ID NO: 772923 - DNA, 20 bp, Artificial
  CRISPR gRNA sequence
catccctcttgacgtgacag

SEQ ID NO: 772924 - DNA, 20 bp, Artificial
  CRISPR gRNA sequence
atccctcttgacgtgacagc

SEQ ID NO: 772925 - DNA, 20 bp, Artificial
  CRISPR gRNA sequence
ttgacgtgacagctctaaga

SEQ ID NO: 772926 - DNA, 20 bp, Artificial
  CRISPR gRNA sequence
gacgtgacagctctaagagg

SEQ ID NO: 772927 - DNA, 20 bp, Artificial
  CRISPR gRNA sequence
acgtgacagctctaagagga

SEQ ID NO: 772928 - DNA, 20 bp, Artificial
  CRISPR gRNA sequence
taagaggaggggcctcagtg

SEQ ID NO: 772929 - DNA, 20 bp, Artificial
  CRISPR gRNA sequence
agaggaggggcctcagtgtt

SEQ ID NO: 772930 - DNA, 20 bp, Artificial
  CRISPR gRNA sequence
agtgtttcatgttaatatcc

SEQ ID NO: 772931 - DNA, 20 bp, Artificial
  CRISPR gRNA sequence
catgttaatatccccctggc

SEQ ID NO: 772932 - DNA, 20 bp, Artificial
  CRISPR gRNA sequence
atgttaatatccccctggca

SEQ ID NO: 772933 - DNA, 20 bp, Artificial
  CRISPR gRNA sequence
atatccccctggcaaggccc

SEQ ID NO: 772934 - DNA, 20 bp, Artificial
  CRISPR gRNA sequence
gcaaggcccctgcagaccta

SEQ ID NO: 772935 - DNA, 20 bp, Artificial
  CRISPR gRNA sequence
cagacctacctgactccttg

SEQ ID NO: 772936 - DNA, 20 bp, Artificial
  CRISPR gRNA sequence
cctgactccttggggaaact

SEQ ID NO: 772937 - DNA, 20 bp, Artificial
  CRISPR gRNA sequence
actccttggggaaactccaa

SEQ ID NO: 772938 - DNA, 20 bp, Artificial
  CRISPR gRNA sequence
cttggggaaactccaagccc

SEQ ID NO: 772939 - DNA, 20 bp, Artificial
  CRISPR gRNA sequence
ggggaaactccaagccctca

SEQ ID NO: 772940 - DNA, 20 bp, Artificial
  CRISPR gRNA sequence
gggaaactccaagccctcac

SEQ ID NO: 772941 - DNA, 20 bp, Artificial
  CRISPR gRNA sequence
caagccctcactccagcccc

SEQ ID NO: 772942 - DNA, 20 bp, Artificial
  CRISPR gRNA sequence
actccagccccgtcagtgac

SEQ ID NO: 772943 - DNA, 20 bp, Artificial
  CRISPR gRNA sequence
cagccccgtcagtgacctca

SEQ ID NO: 772944 - DNA, 20 bp, Artificial
  CRISPR gRNA sequence
atctgtatgtaggactcagc

SEQ ID NO: 772945 - DNA, 20 bp, Artificial
  CRISPR gRNA sequence
tatgtaggactcagcgaaca

SEQ ID NO: 772946 - DNA, 20 bp, Artificial
  CRISPR gRNA sequence
agcgaacattttctgtaaat

SEQ ID NO: 772947 - DNA, 20 bp, Artificial
  CRISPR gRNA sequence
tctgtaaatggccagggagt

SEQ ID NO: 772948 - DNA, 20 bp, Artificial
  CRISPR gRNA sequence
ctgtaaatggccagggagta

SEQ ID NO: 772949 - DNA, 20 bp, Artificial
  CRISPR gRNA sequence
tgtaaatggccagggagtaa

SEQ ID NO: 772950 - DNA, 20 bp, Artificial
  CRISPR gRNA sequence
taaatggccagggagtaaat

SEQ ID NO: 772951 - DNA, 20 bp, Artificial
  CRISPR gRNA sequence
ttaggcatcgtgggccacac

SEQ ID NO: 772952 - DNA, 20 bp, Artificial
  CRISPR gRNA sequence
taggcatcgtgggccacaca

SEQ ID NO: 772953 - DNA, 20 bp, Artificial
  CRISPR gRNA sequence
aggcatcgtgggccacacac

SEQ ID NO: 772954 - DNA, 20 bp, Artificial
  CRISPR gRNA sequence
ggcatcgtgggccacacacc

SEQ ID NO: 772955 - DNA, 20 bp, Artificial
  CRISPR gRNA sequence
tgttgctgctgcttctcctt

SEQ ID NO: 772956 - DNA, 20 bp, Artificial
  CRISPR gRNA sequence
ttgctgctgcttctccttct

SEQ ID NO: 772957 - DNA, 20 bp, Artificial
  CRISPR gRNA sequence
ctgctgcttctccttctgtt

SEQ ID NO: 772958 - DNA, 20 bp, Artificial
  CRISPR gRNA sequence
ctgcttctccttctgttcct

SEQ ID NO: 772959 - DNA, 20 bp, Artificial
  CRISPR gRNA sequence
cttctccttctgttcctcct

SEQ ID NO: 772960 - DNA, 20 bp, Artificial
  CRISPR gRNA sequence
ctccttctgttcctcctccg

SEQ ID NO: 772961 - DNA, 20 bp, Artificial
  CRISPR gRNA sequence
tccttctgttcctcctccgc

SEQ ID NO: 772962 - DNA, 20 bp, Artificial
  CRISPR gRNA sequence
cttctgttcctcctccgcct

SEQ ID NO: 772963 - DNA, 20 bp, Artificial
  CRISPR gRNA sequence
ctgttcctcctccgccttcc

SEQ ID NO: 772964 - DNA, 20 bp, Artificial
  CRISPR gRNA sequence
tgttcctcctccgccttccc

SEQ ID NO: 772965 - DNA, 20 bp, Artificial
  CRISPR gRNA sequence
ttcctcctccgccttccccc

SEQ ID NO: 772966 - DNA, 20 bp, Artificial
  CRISPR gRNA sequence
ctcctccgccttcccccatc

SEQ ID NO: 772967 - DNA, 20 bp, Artificial
  CRISPR gRNA sequence
ctccgccttcccccatcttt

SEQ ID NO: 772968 - DNA, 20 bp, Artificial
  CRISPR gRNA sequence
cgccttcccccatctttttt

SEQ ID NO: 772969 - DNA, 20 bp, Artificial
  CRISPR gRNA sequence
cccccatctttttttggtaa

SEQ ID NO: 772970 - DNA, 20 bp, Artificial
  CRISPR gRNA sequence
ccccatctttttttggtaac

SEQ ID NO: 772971 - DNA, 20 bp, Artificial
  CRISPR gRNA sequence
tttttggtaaccctttacaa

SEQ ID NO: 772972 - DNA, 20 bp, Artificial
  CRISPR gRNA sequence
ttttggtaaccctttacaaa

SEQ ID NO: 772973 - DNA, 20 bp, Artificial
  CRISPR gRNA sequence
tttggtaaccctttacaaat

SEQ ID NO: 772974 - DNA, 20 bp, Artificial
  CRISPR gRNA sequence
ttggtaaccctttacaaatg

SEQ ID NO: 772975 - DNA, 20 bp, Artificial
  CRISPR gRNA sequence
tggtaaccctttacaaatgt

SEQ ID NO: 772976 - DNA, 20 bp, Artificial
  CRISPR gRNA sequence
ggtaaccctttacaaatgta

SEQ ID NO: 772977 - DNA, 20 bp, Artificial
  CRISPR gRNA sequence
gtaaccctttacaaatgtaa

SEQ ID NO: 772978 - DNA, 20 bp, Artificial
  CRISPR gRNA sequence
tacaaatgtaaaaaccatca

SEQ ID NO: 772979 - DNA, 20 bp, Artificial
  CRISPR gRNA sequence
acaaatgtaaaaaccatcac

SEQ ID NO: 772980 - DNA, 20 bp, Artificial
  CRISPR gRNA sequence
caaatgtaaaaaccatcact

SEQ ID NO: 772981 - DNA, 20 bp, Artificial
  CRISPR gRNA sequence
gtttgtggactgtacaaaaa

SEQ ID NO: 772982 - DNA, 20 bp, Artificial
  CRISPR gRNA sequence
gtggactgtacaaaaacagg

SEQ ID NO: 772983 - DNA, 20 bp, Artificial
  CRISPR gRNA sequence
tggactgtacaaaaacaggc

SEQ ID NO: 772984 - DNA, 20 bp, Artificial
  CRISPR gRNA sequence
tacaaaaacaggccacaagc

SEQ ID NO: 772985 - DNA, 20 bp, Artificial
  CRISPR gRNA sequence
tggcccatgggctgtagttt

SEQ ID NO: 772986 - DNA, 20 bp, Artificial
  CRISPR gRNA sequence
ggcccatgggctgtagtttg

SEQ ID NO: 772987 - DNA, 20 bp, Artificial
  CRISPR gRNA sequence
gcccatgggctgtagtttgc

SEQ ID NO: 772988 - DNA, 20 bp, Artificial
  CRISPR gRNA sequence
tagtttgctgccttctgatc

SEQ ID NO: 772989 - DNA, 20 bp, Artificial
  CRISPR gRNA sequence
gctgccttctgatccataga

SEQ ID NO: 772990 - DNA, 20 bp, Artificial
  CRISPR gRNA sequence
ctgccttctgatccatagaa

SEQ ID NO: 772991 - DNA, 20 bp, Artificial
  CRISPR gRNA sequence
ccttctgatccatagaatgg

SEQ ID NO: 772992 - DNA, 20 bp, Artificial
  CRISPR gRNA sequence
ctgatccatagaatgggaga

SEQ ID NO: 772993 - DNA, 20 bp, Artificial
  CRISPR gRNA sequence
tgatccatagaatgggagat

SEQ ID NO: 772994 - DNA, 20 bp, Artificial
  CRISPR gRNA sequence
atccatagaatgggagatgt

SEQ ID NO: 772995 - DNA, 20 bp, Artificial
  CRISPR gRNA sequence
aagcagtcaaaagagggcct

SEQ ID NO: 772996 - DNA, 20 bp, Artificial
  CRISPR gRNA sequence
tggaggaggtgaatattgag

SEQ ID NO: 772997 - DNA, 20 bp, Artificial
  CRISPR gRNA sequence
gaggaggtgaatattgagct

SEQ ID NO: 772998 - DNA, 20 bp, Artificial
  CRISPR gRNA sequence
agctaagcagagaatttggg

SEQ ID NO: 772999 - DNA, 20 bp, Artificial
  CRISPR gRNA sequence
agcagagaatttgggaaact

SEQ ID NO: 773000 - DNA, 20 bp, Artificial
  CRISPR gRNA sequence
gggaaactgatagcattagt

SEQ ID NO: 773001 - DNA, 20 bp, Artificial
  CRISPR gRNA sequence
ggaaactgatagcattagtg

SEQ ID NO: 773002 - DNA, 20 bp, Artificial
  CRISPR gRNA sequence
atagcattagtgcagaggct

SEQ ID NO: 773003 - DNA, 20 bp, Artificial
  CRISPR gRNA sequence
gtgcagaggctggaaggagc

SEQ ID NO: 773004 - DNA, 20 bp, Artificial
  CRISPR gRNA sequence
gaaggagccagttgcttctg

SEQ ID NO: 773005 - DNA, 20 bp, Artificial
  CRISPR gRNA sequence
cttctggagagaatggttag

SEQ ID NO: 773006 - DNA, 20 bp, Artificial
  CRISPR gRNA sequence
ctggagagaatggttaggac

SEQ ID NO: 773007 - DNA, 20 bp, Artificial
  CRISPR gRNA sequence
tggagagaatggttaggaca

SEQ ID NO: 773008 - DNA, 20 bp, Artificial
  CRISPR gRNA sequence
gagagaatggttaggacacc

SEQ ID NO: 773009 - DNA, 20 bp, Artificial
  CRISPR gRNA sequence
ggacaccagtttggctgaag

SEQ ID NO: 773010 - DNA, 20 bp, Artificial
  CRISPR gRNA sequence
ggctgaagctgaggctccta

SEQ ID NO: 773011 - DNA, 20 bp, Artificial
  CRISPR gRNA sequence
gctgaagctgaggctcctac

SEQ ID NO: 773012 - DNA, 20 bp, Artificial
  CRISPR gRNA sequence
aagctgaggctcctacagta

SEQ ID NO: 773013 - DNA, 20 bp, Artificial
  CRISPR gRNA sequence
aggctcctacagtagaatta

SEQ ID NO: 773014 - DNA, 20 bp, Artificial
  CRISPR gRNA sequence
ctacagtagaattagaaaac

SEQ ID NO: 773015 - DNA, 20 bp, Artificial
  CRISPR gRNA sequence
cagtagaattagaaaactta

SEQ ID NO: 773016 - DNA, 20 bp, Artificial
  CRISPR gRNA sequence
gaaaacttaggggagggtaa

SEQ ID NO: 773017 - DNA, 20 bp, Artificial
  CRISPR gRNA sequence
aggggagggtaagcagcagc

SEQ ID NO: 773018 - DNA, 20 bp, Artificial
  CRISPR gRNA sequence
ggggagggtaagcagcagcc

SEQ ID NO: 773019 - DNA, 20 bp, Artificial
  CRISPR gRNA sequence
ctagaggtccttgaatcacg

SEQ ID NO: 773020 - DNA, 20 bp, Artificial
  CRISPR gRNA sequence
tagaggtccttgaatcacgc

SEQ ID NO: 773021 - DNA, 20 bp, Artificial
  CRISPR gRNA sequence
gaggtccttgaatcacgctt

SEQ ID NO: 773022 - DNA, 20 bp, Artificial
  CRISPR gRNA sequence
gaatcacgcttgaagcttga

SEQ ID NO: 773023 - DNA, 20 bp, Artificial
  CRISPR gRNA sequence
aatcacgcttgaagcttgaa

SEQ ID NO: 773024 - DNA, 20 bp, Artificial
  CRISPR gRNA sequence
gaagcttgaagcattattct

SEQ ID NO: 773025 - DNA, 20 bp, Artificial
  CRISPR gRNA sequence
aagcttgaagcattattcta

SEQ ID NO: 773026 - DNA, 20 bp, Artificial
  CRISPR gRNA sequence
gaagcattattctaaagtca

SEQ ID NO: 773027 - DNA, 20 bp, Artificial
  CRISPR gRNA sequence
aagcattattctaaagtcac

SEQ ID NO: 773028 - DNA, 20 bp, Artificial
  CRISPR gRNA sequence
ttctaaagtcactagggagc

SEQ ID NO: 773029 - DNA, 20 bp, Artificial
  CRISPR gRNA sequence
taaagtcactagggagccat

SEQ ID NO: 773030 - DNA, 20 bp, Artificial
  CRISPR gRNA sequence
aagtcactagggagccatag

SEQ ID NO: 773031 - DNA, 20 bp, Artificial
  CRISPR gRNA sequence
gggagccatagaaggtactt

SEQ ID NO: 773032 - DNA, 20 bp, Artificial
  CRISPR gRNA sequence
gagcatcaattcaaccacag

SEQ ID NO: 773033 - DNA, 20 bp, Artificial
  CRISPR gRNA sequence
agcatcaattcaaccacagg

SEQ ID NO: 773034 - DNA, 20 bp, Artificial
  CRISPR gRNA sequence
aaccacaggctcttcagccc

SEQ ID NO: 773035 - DNA, 20 bp, Artificial
  CRISPR gRNA sequence
ttcagcccttcctggttgag

SEQ ID NO: 773036 - DNA, 20 bp, Artificial
  CRISPR gRNA sequence
cagcccttcctggttgaggc

SEQ ID NO: 773037 - DNA, 20 bp, Artificial
  CRISPR gRNA sequence
agcccttcctggttgaggcg

SEQ ID NO: 773038 - DNA, 20 bp, Artificial
  CRISPR gRNA sequence
cctggttgaggcgtgtccac

SEQ ID NO: 773039 - DNA, 20 bp, Artificial
  CRISPR gRNA sequence
ctggttgaggcgtgtccaca

SEQ ID NO: 773040 - DNA, 20 bp, Artificial
  CRISPR gRNA sequence
gttgaggcgtgtccacatca

SEQ ID NO: 773041 - DNA, 20 bp, Artificial
  CRISPR gRNA sequence
aggcgtgtccacatcagcca

SEQ ID NO: 773042 - DNA, 20 bp, Artificial
  CRISPR gRNA sequence
tatcagggtttggggagtgt

SEQ ID NO: 773043 - DNA, 20 bp, Artificial
  CRISPR gRNA sequence
ggggagtgtatggcgaaggg

SEQ ID NO: 773044 - DNA, 20 bp, Artificial
  CRISPR gRNA sequence
gggagtgtatggcgaaggga

SEQ ID NO: 773045 - DNA, 20 bp, Artificial
  CRISPR gRNA sequence
taggaacttaagtgagcttt

SEQ ID NO: 773046 - DNA, 20 bp, Artificial
  CRISPR gRNA sequence
aagtgagctttattcatagt

SEQ ID NO: 773047 - DNA, 20 bp, Artificial
  CRISPR gRNA sequence
agtgagctttattcatagtg

SEQ ID NO: 773048 - DNA, 20 bp, Artificial
  CRISPR gRNA sequence
tattcatagtgttagggccc

SEQ ID NO: 773049 - DNA, 20 bp, Artificial
  CRISPR gRNA sequence
attcatagtgttagggccca

SEQ ID NO: 773050 - DNA, 20 bp, Artificial
  CRISPR gRNA sequence
ttcatagtgttagggcccag

SEQ ID NO: 773051 - DNA, 20 bp, Artificial
  CRISPR gRNA sequence
atagtgttagggcccagtga

SEQ ID NO: 773052 - DNA, 20 bp, Artificial
  CRISPR gRNA sequence
gggcccagtgagggtgggag

SEQ ID NO: 773053 - DNA, 20 bp, Artificial
  CRISPR gRNA sequence
ttcacacttggagccaatgg

SEQ ID NO: 773054 - DNA, 20 bp, Artificial
  CRISPR gRNA sequence
acacttggagccaatggtgc

SEQ ID NO: 773055 - DNA, 20 bp, Artificial
  CRISPR gRNA sequence
ggagccaatggtgctgtcct

SEQ ID NO: 773056 - DNA, 20 bp, Artificial
  CRISPR gRNA sequence
gagccaatggtgctgtcctc

SEQ ID NO: 773057 - DNA, 20 bp, Artificial
  CRISPR gRNA sequence
tcctccgggacatggggcca

SEQ ID NO: 773058 - DNA, 20 bp, Artificial
  CRISPR gRNA sequence
cgggacatggggccaggcat

SEQ ID NO: 773059 - DNA, 20 bp, Artificial
  CRISPR gRNA sequence
actgttgctacttttcctct

SEQ ID NO: 773060 - DNA, 20 bp, Artificial
  CRISPR gRNA sequence
ttgctacttttcctctcagg

SEQ ID NO: 773061 - DNA, 20 bp, Artificial
  CRISPR gRNA sequence
ctacttttcctctcagggca

SEQ ID NO: 773062 - DNA, 20 bp, Artificial
  CRISPR gRNA sequence
cttttcctctcagggcagcc

SEQ ID NO: 773063 - DNA, 20 bp, Artificial
  CRISPR gRNA sequence
ttcctctcagggcagcctat

SEQ ID NO: 773064 - DNA, 20 bp, Artificial
  CRISPR gRNA sequence
tcctctcagggcagcctatg

SEQ ID NO: 773065 - DNA, 20 bp, Artificial
  CRISPR gRNA sequence
cctctcagggcagcctatga

SEQ ID NO: 773066 - DNA, 20 bp, Artificial
  CRISPR gRNA sequence
ctctcagggcagcctatgac

SEQ ID NO: 773067 - DNA, 20 bp, Artificial
  CRISPR gRNA sequence
tcagggcagcctatgacatt

SEQ ID NO: 773068 - DNA, 20 bp, Artificial
  CRISPR gRNA sequence
agggcagcctatgacattcc

SEQ ID NO: 773069 - DNA, 20 bp, Artificial
  CRISPR gRNA sequence
tgacattccccccagaggcc

SEQ ID NO: 773070 - DNA, 20 bp, Artificial
  CRISPR gRNA sequence
cccccagaggccctgtgggt

SEQ ID NO: 773071 - DNA, 20 bp, Artificial
  CRISPR gRNA sequence
tgggtgaccgtggggctgtc

SEQ ID NO: 773072 - DNA, 20 bp, Artificial
  CRISPR gRNA sequence
tctgtctgtctcattgcact

SEQ ID NO: 773073 - DNA, 20 bp, Artificial
  CRISPR gRNA sequence
tctgtctcattgcactgctg

SEQ ID NO: 773074 - DNA, 20 bp, Artificial
  CRISPR gRNA sequence
tctcattgcactgctggtgg

SEQ ID NO: 773075 - DNA, 20 bp, Artificial
  CRISPR gRNA sequence
attgcactgctggtggccct

SEQ ID NO: 773076 - DNA, 20 bp, Artificial
  CRISPR gRNA sequence
cactgctggtggccctggct

SEQ ID NO: 773077 - DNA, 20 bp, Artificial
  CRISPR gRNA sequence
ctggtggccctggctttcgt

SEQ ID NO: 773078 - DNA, 20 bp, Artificial
  CRISPR gRNA sequence
gtggccctggctttcgtgtg

SEQ ID NO: 773079 - DNA, 20 bp, Artificial
  CRISPR gRNA sequence
gctttcgtgtgctggagaaa

SEQ ID NO: 773080 - DNA, 20 bp, Artificial
  CRISPR gRNA sequence
tcgtgtgctggagaaagatc

SEQ ID NO: 773081 - DNA, 20 bp, Artificial
  CRISPR gRNA sequence
cgtgtgctggagaaagatca

SEQ ID NO: 773082 - DNA, 20 bp, Artificial
  CRISPR gRNA sequence
gtgtgctggagaaagatcaa

SEQ ID NO: 773083 - DNA, 20 bp, Artificial
  CRISPR gRNA sequence
gagaaagatcaaacagagct

SEQ ID NO: 773084 - DNA, 20 bp, Artificial
  CRISPR gRNA sequence
tgaggaggagaatgcaggtg

SEQ ID NO: 773085 - DNA, 20 bp, Artificial
  CRISPR gRNA sequence
atgtgtcttggggtatgttg

SEQ ID NO: 773086 - DNA, 20 bp, Artificial
  CRISPR gRNA sequence
tgtgtcttggggtatgttgc

SEQ ID NO: 773087 - DNA, 20 bp, Artificial
  CRISPR gRNA sequence
ggggtatgttgctgtctttg

SEQ ID NO: 773088 - DNA, 20 bp, Artificial
  CRISPR gRNA sequence
gggtatgttgctgtctttga

SEQ ID NO: 773089 - DNA, 20 bp, Artificial
  CRISPR gRNA sequence
ctgtctttgatgtcaataga

SEQ ID NO: 773090 - DNA, 20 bp, Artificial
  CRISPR gRNA sequence
tctttgatgtcaatagagtg

SEQ ID NO: 773091 - DNA, 20 bp, Artificial
  CRISPR gRNA sequence
tgatgtcaatagagtgtcac

SEQ ID NO: 773092 - DNA, 20 bp, Artificial
  CRISPR gRNA sequence
gatgtcaatagagtgtcact

SEQ ID NO: 773093 - DNA, 20 bp, Artificial
  CRISPR gRNA sequence
atgtcaatagagtgtcactt

SEQ ID NO: 773094 - DNA, 20 bp, Artificial
  CRISPR gRNA sequence
tctagtgacagaacgagtgt

SEQ ID NO: 773095 - DNA, 20 bp, Artificial
  CRISPR gRNA sequence
ctagtgacagaacgagtgtg

SEQ ID NO: 773096 - DNA, 20 bp, Artificial
  CRISPR gRNA sequence
tagtgacagaacgagtgtgt

SEQ ID NO: 773097 - DNA, 20 bp, Artificial
  CRISPR gRNA sequence
gtgacagaacgagtgtgtgt

SEQ ID NO: 773098 - DNA, 20 bp, Artificial
  CRISPR gRNA sequence
gatttgtctgtgtgtgacct

SEQ ID NO: 773099 - DNA, 20 bp, Artificial
  CRISPR gRNA sequence
gtctgtgtgtgaccttgagt

SEQ ID NO: 773100 - DNA, 20 bp, Artificial
  CRISPR gRNA sequence
tctgtgtgtgaccttgagtc

SEQ ID NO: 773101 - DNA, 20 bp, Artificial
  CRISPR gRNA sequence
tgtgtgaccttgagtctacg

SEQ ID NO: 773102 - DNA, 20 bp, Artificial
  CRISPR gRNA sequence
gagtctacgtcttgtgtgtg

SEQ ID NO: 773103 - DNA, 20 bp, Artificial
  CRISPR gRNA sequence
agtctacgtcttgtgtgtgt

SEQ ID NO: 773104 - DNA, 20 bp, Artificial
  CRISPR gRNA sequence
cgtcttgtgtgtgtgaacaa

SEQ ID NO: 773105 - DNA, 20 bp, Artificial
  CRISPR gRNA sequence
gtgtgtgtgaacaagcgtga

SEQ ID NO: 773106 - DNA, 20 bp, Artificial
  CRISPR gRNA sequence
tgtgtgtgaacaagcgtgag

SEQ ID NO: 773107 - DNA, 20 bp, Artificial
  CRISPR gRNA sequence
tctgtccatgtgcagatacc

SEQ ID NO: 773108 - DNA, 20 bp, Artificial
  CRISPR gRNA sequence
tccatgtgcagataccacag

SEQ ID NO: 773109 - DNA, 20 bp, Artificial
  CRISPR gRNA sequence
gaaggtggtgggagtgtaag

SEQ ID NO: 773110 - DNA, 20 bp, Artificial
  CRISPR gRNA sequence
caaagggatgagtgtgtgcc

SEQ ID NO: 773111 - DNA, 20 bp, Artificial
  CRISPR gRNA sequence
tgaaagtgtaagtcagtcac

SEQ ID NO: 773112 - DNA, 20 bp, Artificial
  CRISPR gRNA sequence
tgcggcacaaatgtaggcat

SEQ ID NO: 773113 - DNA, 20 bp, Artificial
  CRISPR gRNA sequence
ggggtgatcgtgcctgcctt

SEQ ID NO: 773114 - DNA, 20 bp, Artificial
  CRISPR gRNA sequence
ccttggagtgagtttgaagc

SEQ ID NO: 773115 - DNA, 20 bp, Artificial
  CRISPR gRNA sequence
ggagtgagtttgaagcagct

SEQ ID NO: 773116 - DNA, 20 bp, Artificial
  CRISPR gRNA sequence
gagtgagtttgaagcagctg

SEQ ID NO: 773117 - DNA, 20 bp, Artificial
  CRISPR gRNA sequence
gaagcagctgccatttgcgg

SEQ ID NO: 773118 - DNA, 20 bp, Artificial
  CRISPR gRNA sequence
aagcagctgccatttgcggg

SEQ ID NO: 773119 - DNA, 20 bp, Artificial
  CRISPR gRNA sequence
ccatttgcggggctgagggt

SEQ ID NO: 773120 - DNA, 20 bp, Artificial
  CRISPR gRNA sequence
gcggggctgagggtcagccc

SEQ ID NO: 773121 - DNA, 20 bp, Artificial
  CRISPR gRNA sequence
cggggctgagggtcagcccg

SEQ ID NO: 773122 - DNA, 20 bp, Artificial
  CRISPR gRNA sequence
agggtcagcccgagctggca

SEQ ID NO: 773123 - DNA, 20 bp, Artificial
  CRISPR gRNA sequence
gcattggtgactggtaagtg

SEQ ID NO: 773124 - DNA, 20 bp, Artificial
  CRISPR gRNA sequence
gtgactggtaagtgggtgag

SEQ ID NO: 773125 - DNA, 20 bp, Artificial
  CRISPR gRNA sequence
gtaagtgggtgagaggacat

SEQ ID NO: 773126 - DNA, 20 bp, Artificial
  CRISPR gRNA sequence
gtgggtggtgagttgaccct

SEQ ID NO: 773127 - DNA, 20 bp, Artificial
  CRISPR gRNA sequence
accctggtgggtaaacagat

SEQ ID NO: 773128 - DNA, 20 bp, Artificial
  CRISPR gRNA sequence
gtgggtaaacagatgcatga

SEQ ID NO: 773129 - DNA, 20 bp, Artificial
  CRISPR gRNA sequence
gggatggctggaggttggga

SEQ ID NO: 773130 - DNA, 20 bp, Artificial
  CRISPR gRNA sequence
gaggttgggaaggagaggga

SEQ ID NO: 773131 - DNA, 20 bp, Artificial
  CRISPR gRNA sequence
ggaaggagagggaagaagag

SEQ ID NO: 773132 - DNA, 20 bp, Artificial
  CRISPR gRNA sequence
gcagataggtgagtacttgt

SEQ ID NO: 773133 - DNA, 20 bp, Artificial
  CRISPR gRNA sequence
gtgaggtagacaggtggaag

SEQ ID NO: 773134 - DNA, 20 bp, Artificial
  CRISPR gRNA sequence
tgaggtagacaggtggaagg

SEQ ID NO: 773135 - DNA, 20 bp, Artificial
  CRISPR gRNA sequence
gttggttacatctgttggag

SEQ ID NO: 773136 - DNA, 20 bp, Artificial
  CRISPR gRNA sequence
gttacatctgttggaggttg

SEQ ID NO: 773137 - DNA, 20 bp, Artificial
  CRISPR gRNA sequence
catctgttggaggttgatgg

SEQ ID NO: 773138 - DNA, 20 bp, Artificial
  CRISPR gRNA sequence
ttggaggttgatggttggca

SEQ ID NO: 773139 - DNA, 20 bp, Artificial
  CRISPR gRNA sequence
gaggttgatggttggcaggg

SEQ ID NO: 773140 - DNA, 20 bp, Artificial
  CRISPR gRNA sequence
atggttggcagggctactga

SEQ ID NO: 773141 - DNA, 20 bp, Artificial
  CRISPR gRNA sequence
gcagggctactgagcgagcg

SEQ ID NO: 773142 - DNA, 20 bp, Artificial
  CRISPR gRNA sequence
ctgagcgagcggatgggtga

SEQ ID NO: 773143 - DNA, 20 bp, Artificial
  CRISPR gRNA sequence
agcgagcggatgggtgaggt

SEQ ID NO: 773144 - DNA, 20 bp, Artificial
  CRISPR gRNA sequence
gtggagggtaggtggatggt

SEQ ID NO: 773145 - DNA, 20 bp, Artificial
  CRISPR gRNA sequence
tggctgggtgtgtggcgggg

SEQ ID NO: 773146 - DNA, 20 bp, Artificial
  CRISPR gRNA sequence
ggctgggtgtgtggcggggg

SEQ ID NO: 773147 - DNA, 20 bp, Artificial
  CRISPR gRNA sequence
gctgggtgtgtggcgggggc

SEQ ID NO: 773148 - DNA, 20 bp, Artificial
  CRISPR gRNA sequence
ggtgtgtggcgggggctcca

SEQ ID NO: 773149 - DNA, 20 bp, Artificial
  CRISPR gRNA sequence
caggttgagtggatggtctt

SEQ ID NO: 773150 - DNA, 20 bp, Artificial
  CRISPR gRNA sequence
agtggatggtctttggctgg

SEQ ID NO: 773151 - DNA, 20 bp, Artificial
  CRISPR gRNA sequence
tggctgggtgagtggtgggc

SEQ ID NO: 773152 - DNA, 20 bp, Artificial
  CRISPR gRNA sequence
ggctgggtgagtggtgggct

SEQ ID NO: 773153 - DNA, 20 bp, Artificial
  CRISPR gRNA sequence
gctgggtgagtggtgggctc

SEQ ID NO: 773154 - DNA, 20 bp, Artificial
  CRISPR gRNA sequence
ggtgagtggtgggctccagg

SEQ ID NO: 773155 - DNA, 20 bp, Artificial
  CRISPR gRNA sequence
caggctgggtggatggtcct

SEQ ID NO: 773156 - DNA, 20 bp, Artificial
  CRISPR gRNA sequence
ggtggatggtccttgactgg

SEQ ID NO: 773157 - DNA, 20 bp, Artificial
  CRISPR gRNA sequence
gactgggtaagtggtgcact

SEQ ID NO: 773158 - DNA, 20 bp, Artificial
  CRISPR gRNA sequence
actgggtaagtggtgcactc

SEQ ID NO: 773159 - DNA, 20 bp, Artificial
  CRISPR gRNA sequence
ggtaagtggtgcactccagg

SEQ ID NO: 773160 - DNA, 20 bp, Artificial
  CRISPR gRNA sequence
caggctgggtggatggtctt

SEQ ID NO: 773161 - DNA, 20 bp, Artificial
  CRISPR gRNA sequence
ggtggatggtctttggctgg

SEQ ID NO: 773162 - DNA, 20 bp, Artificial
  CRISPR gRNA sequence
tggctgggtgagtggtgggg

SEQ ID NO: 773163 - DNA, 20 bp, Artificial
  CRISPR gRNA sequence
ggctgggtgagtggtggggg

SEQ ID NO: 773164 - DNA, 20 bp, Artificial
  CRISPR gRNA sequence
gctgggtgagtggtgggggc

SEQ ID NO: 773165 - DNA, 20 bp, Artificial
  CRISPR gRNA sequence
ggtgagtggtgggggcgcca

SEQ ID NO: 773166 - DNA, 20 bp, Artificial
  CRISPR gRNA sequence
ggtagtttttggctgggtga

SEQ ID NO: 773167 - DNA, 20 bp, Artificial
  CRISPR gRNA sequence
ttggctgggtgagtggtggg

SEQ ID NO: 773168 - DNA, 20 bp, Artificial
  CRISPR gRNA sequence
tggctgggtgagtggtgggc

SEQ ID NO: 773169 - DNA, 20 bp, Artificial
  CRISPR gRNA sequence
ggctgggtgagtggtgggct

SEQ ID NO: 773170 - DNA, 20 bp, Artificial
  CRISPR gRNA sequence
gctgggtgagtggtgggctc

SEQ ID NO: 773171 - DNA, 20 bp, Artificial
  CRISPR gRNA sequence
ggtgagtggtgggctccagg

SEQ ID NO: 773172 - DNA, 20 bp, Artificial
  CRISPR gRNA sequence
caggctgggagccccttcat

SEQ ID NO: 773173 - DNA, 20 bp, Artificial
  CRISPR gRNA sequence
ggagccccttcatgttgtca

SEQ ID NO: 773174 - DNA, 20 bp, Artificial
  CRISPR gRNA sequence
catgttgtcacaggctcggc

SEQ ID NO: 773175 - DNA, 20 bp, Artificial
  CRISPR gRNA sequence
atgttgtcacaggctcggct

SEQ ID NO: 773176 - DNA, 20 bp, Artificial
  CRISPR gRNA sequence
tcacaggctcggctctgctg

SEQ ID NO: 773177 - DNA, 20 bp, Artificial
  CRISPR gRNA sequence
ggctctgctgtgctctgctc

SEQ ID NO: 773178 - DNA, 20 bp, Artificial
  CRISPR gRNA sequence
tgctgtgctctgctctcggg

SEQ ID NO: 773179 - DNA, 20 bp, Artificial
  CRISPR gRNA sequence
ctgtgctctgctctcgggct

SEQ ID NO: 773180 - DNA, 20 bp, Artificial
  CRISPR gRNA sequence
tgctctgctctcgggctcta

SEQ ID NO: 773181 - DNA, 20 bp, Artificial
  CRISPR gRNA sequence
tgctctcgggctctaacccg

SEQ ID NO: 773182 - DNA, 20 bp, Artificial
  CRISPR gRNA sequence
ctctcgggctctaacccgtg

SEQ ID NO: 773183 - DNA, 20 bp, Artificial
  CRISPR gRNA sequence
tcgggctctaacccgtgtct

SEQ ID NO: 773184 - DNA, 20 bp, Artificial
  CRISPR gRNA sequence
gggctctaacccgtgtctag

SEQ ID NO: 773185 - DNA, 20 bp, Artificial
  CRISPR gRNA sequence
taacccgtgtctagcatttg

SEQ ID NO: 773186 - DNA, 20 bp, Artificial
  CRISPR gRNA sequence
acccgtgtctagcatttggt

SEQ ID NO: 773187 - DNA, 20 bp, Artificial
  CRISPR gRNA sequence
gcatttggtccgcaggtcag

SEQ ID NO: 773188 - DNA, 20 bp, Artificial
  CRISPR gRNA sequence
ggtccgcaggtcaggcccac

SEQ ID NO: 773189 - DNA, 20 bp, Artificial
  CRISPR gRNA sequence
gtccgcaggtcaggcccact

SEQ ID NO: 773190 - DNA, 20 bp, Artificial
  CRISPR gRNA sequence
aggccctgttcaccagcttc

SEQ ID NO: 773191 - DNA, 20 bp, Artificial
  CRISPR gRNA sequence
ttcaccagcttcctgcactc

SEQ ID NO: 773192 - DNA, 20 bp, Artificial
  CRISPR gRNA sequence
accagcttcctgcactctca

SEQ ID NO: 773193 - DNA, 20 bp, Artificial
  CRISPR gRNA sequence
cctgcactctcaggtgggaa

SEQ ID NO: 773194 - DNA, 20 bp, Artificial
  CRISPR gRNA sequence
ctgcactctcaggtgggaaa

SEQ ID NO: 773195 - DNA, 20 bp, Artificial
  CRISPR gRNA sequence
cactctcaggtgggaaagtg

SEQ ID NO: 773196 - DNA, 20 bp, Artificial
  CRISPR gRNA sequence
tcaggtgggaaagtgctggc

SEQ ID NO: 773197 - DNA, 20 bp, Artificial
  CRISPR gRNA sequence
aggtgggaaagtgctggcat

SEQ ID NO: 773198 - DNA, 20 bp, Artificial
  CRISPR gRNA sequence
gcatgaaaatgggcttgcaa

SEQ ID NO: 773199 - DNA, 20 bp, Artificial
  CRISPR gRNA sequence
gcaaaagatttttgtttatt

SEQ ID NO: 773200 - DNA, 20 bp, Artificial
  CRISPR gRNA sequence
caaaagatttttgtttattc

SEQ ID NO: 773201 - DNA, 20 bp, Artificial
  CRISPR gRNA sequence
ttgtttattctgagttcttg

SEQ ID NO: 773202 - DNA, 20 bp, Artificial
  CRISPR gRNA sequence
tgtttattctgagttcttgc

SEQ ID NO: 773203 - DNA, 20 bp, Artificial
  CRISPR gRNA sequence
gtttattctgagttcttgcc

SEQ ID NO: 773204 - DNA, 20 bp, Artificial
  CRISPR gRNA sequence
tttattctgagttcttgcct

SEQ ID NO: 773205 - DNA, 20 bp, Artificial
  CRISPR gRNA sequence
attctgagttcttgcctttg

SEQ ID NO: 773206 - DNA, 20 bp, Artificial
  CRISPR gRNA sequence
ttctgagttcttgcctttgc

SEQ ID NO: 773207 - DNA, 20 bp, Artificial
  CRISPR gRNA sequence
tgagttcttgcctttgcagg

SEQ ID NO: 773208 - DNA, 20 bp, Artificial
  CRISPR gRNA sequence
agttcttgcctttgcaggag

SEQ ID NO: 773209 - DNA, 20 bp, Artificial
  CRISPR gRNA sequence
ttgcctttgcaggagctgag

SEQ ID NO: 773210 - DNA, 20 bp, Artificial
  CRISPR gRNA sequence
gcctttgcaggagctgagga

SEQ ID NO: 773211 - DNA, 20 bp, Artificial
  CRISPR gRNA sequence
cctttgcaggagctgaggac

SEQ ID NO: 773212 - DNA, 20 bp, Artificial
  CRISPR gRNA sequence
tgcaggagctgaggaccagg

SEQ ID NO: 773213 - DNA, 20 bp, Artificial
  CRISPR gRNA sequence
gcaggagctgaggaccagga

SEQ ID NO: 773214 - DNA, 20 bp, Artificial
  CRISPR gRNA sequence
caggagctgaggaccaggat

SEQ ID NO: 773215 - DNA, 20 bp, Artificial
  CRISPR gRNA sequence
aggaccaggatggggaggga

SEQ ID NO: 773216 - DNA, 20 bp, Artificial
  CRISPR gRNA sequence
caagacaggtgagtctgaac

SEQ ID NO: 773217 - DNA, 20 bp, Artificial
  CRISPR gRNA sequence
aacttggagctggccctctt

SEQ ID NO: 773218 - DNA, 20 bp, Artificial
  CRISPR gRNA sequence
ggagctggccctcttggctg

SEQ ID NO: 773219 - DNA, 20 bp, Artificial
  CRISPR gRNA sequence
gagctggccctcttggctgg

SEQ ID NO: 773220 - DNA, 20 bp, Artificial
  CRISPR gRNA sequence
gccctcttggctgggagagg

SEQ ID NO: 773221 - DNA, 20 bp, Artificial
  CRISPR gRNA sequence
ttggctgggagagggacata

SEQ ID NO: 773222 - DNA, 20 bp, Artificial
  CRISPR gRNA sequence
ggctgggagagggacatatg

SEQ ID NO: 773223 - DNA, 20 bp, Artificial
  CRISPR gRNA sequence
gctgggagagggacatatgg

SEQ ID NO: 773224 - DNA, 20 bp, Artificial
  CRISPR gRNA sequence
ggagagggacatatgggaaa

SEQ ID NO: 773225 - DNA, 20 bp, Artificial
  CRISPR gRNA sequence
taggatctggaggggccaga

SEQ ID NO: 773226 - DNA, 20 bp, Artificial
  CRISPR gRNA sequence
ggatctggaggggccagatt

SEQ ID NO: 773227 - DNA, 20 bp, Artificial
  CRISPR gRNA sequence
gaggggccagatttgctgta

SEQ ID NO: 773228 - DNA, 20 bp, Artificial
  CRISPR gRNA sequence
gctgtaaggtttgaatgaaa

SEQ ID NO: 773229 - DNA, 20 bp, Artificial
  CRISPR gRNA sequence
ctgtaaggtttgaatgaaat

SEQ ID NO: 773230 - DNA, 20 bp, Artificial
  CRISPR gRNA sequence
taaggtttgaatgaaatgtg

SEQ ID NO: 773231 - DNA, 20 bp, Artificial
  CRISPR gRNA sequence
gaatgaaatgtgttctgtgg

SEQ ID NO: 773232 - DNA, 20 bp, Artificial
  CRISPR gRNA sequence
aatgaaatgtgttctgtgga

SEQ ID NO: 773233 - DNA, 20 bp, Artificial
  CRISPR gRNA sequence
tgtggactcagacctcccca

SEQ ID NO: 773234 - DNA, 20 bp, Artificial
  CRISPR gRNA sequence
tggactcagacctccccacc

SEQ ID NO: 773235 - DNA, 20 bp, Artificial
  CRISPR gRNA sequence
agacctccccaccccggtga

SEQ ID NO: 773236 - DNA, 20 bp, Artificial
  CRISPR gRNA sequence
cccaccccggtgagtctgct

SEQ ID NO: 773237 - DNA, 20 bp, Artificial
  CRISPR gRNA sequence
ctctttgcccagagttaggc

SEQ ID NO: 773238 - DNA, 20 bp, Artificial
  CRISPR gRNA sequence
tttgcccagagttaggcagg

SEQ ID NO: 773239 - DNA, 20 bp, Artificial
  CRISPR gRNA sequence
tgcccagagttaggcaggaa

SEQ ID NO: 773240 - DNA, 20 bp, Artificial
  CRISPR gRNA sequence
gcccagagttaggcaggaag

SEQ ID NO: 773241 - DNA, 20 bp, Artificial
  CRISPR gRNA sequence
cccagagttaggcaggaagt

SEQ ID NO: 773242 - DNA, 20 bp, Artificial
  CRISPR gRNA sequence
ggcaggaagtggatcaccca

SEQ ID NO: 773243 - DNA, 20 bp, Artificial
  CRISPR gRNA sequence
cctcccaggtgtggcttcat

SEQ ID NO: 773244 - DNA, 20 bp, Artificial
  CRISPR gRNA sequence
ccaggtgtggcttcatttct

SEQ ID NO: 773245 - DNA, 20 bp, Artificial
  CRISPR gRNA sequence
catttctcctgccaaccttt

SEQ ID NO: 773246 - DNA, 20 bp, Artificial
  CRISPR gRNA sequence
atttctcctgccaaccttta

SEQ ID NO: 773247 - DNA, 20 bp, Artificial
  CRISPR gRNA sequence
ctcctgccaacctttaccca

SEQ ID NO: 773248 - DNA, 20 bp, Artificial
  CRISPR gRNA sequence
tcctgccaacctttacccat

SEQ ID NO: 773249 - DNA, 20 bp, Artificial
  CRISPR gRNA sequence
ctgccaacctttacccatct

SEQ ID NO: 773250 - DNA, 20 bp, Artificial
  CRISPR gRNA sequence
ccaacctttacccatctgcc

SEQ ID NO: 773251 - DNA, 20 bp, Artificial
  CRISPR gRNA sequence
tacccatctgccagggccga

SEQ ID NO: 773252 - DNA, 20 bp, Artificial
  CRISPR gRNA sequence
acccatctgccagggccgat

SEQ ID NO: 773253 - DNA, 20 bp, Artificial
  CRISPR gRNA sequence
cccatctgccagggccgatt

SEQ ID NO: 773254 - DNA, 20 bp, Artificial
  CRISPR gRNA sequence
ccagggccgattccacctga

SEQ ID NO: 773255 - DNA, 20 bp, Artificial
  CRISPR gRNA sequence
cacctgattggccccacacc

SEQ ID NO: 773256 - DNA, 20 bp, Artificial
  CRISPR gRNA sequence
attggccccacaccgtggag

SEQ ID NO: 773257 - DNA, 20 bp, Artificial
  CRISPR gRNA sequence
gccccacaccgtggagtctg

SEQ ID NO: 773258 - DNA, 20 bp, Artificial
  CRISPR gRNA sequence
gtggcttcctaggggtggga

SEQ ID NO: 773259 - DNA, 20 bp, Artificial
  CRISPR gRNA sequence
cctaggggtgggagcagggg

SEQ ID NO: 773260 - DNA, 20 bp, Artificial
  CRISPR gRNA sequence
ctaggggtgggagcaggggc

SEQ ID NO: 773261 - DNA, 20 bp, Artificial
  CRISPR gRNA sequence
ggggtgggagcaggggctcc

SEQ ID NO: 773262 - DNA, 20 bp, Artificial
  CRISPR gRNA sequence
cggagatagggagtctgggt

SEQ ID NO: 773263 - DNA, 20 bp, Artificial
  CRISPR gRNA sequence
ggtttaagttcctgctccat

SEQ ID NO: 773264 - DNA, 20 bp, Artificial
  CRISPR gRNA sequence
aagttcctgctccatctcag

SEQ ID NO: 773265 - DNA, 20 bp, Artificial
  CRISPR gRNA sequence
agttcctgctccatctcagg

SEQ ID NO: 773266 - DNA, 20 bp, Artificial
  CRISPR gRNA sequence
ctgctccatctcaggtaaac

SEQ ID NO: 773267 - DNA, 20 bp, Artificial
  CRISPR gRNA sequence
ctccatctcaggtaaacaga

SEQ ID NO: 773268 - DNA, 20 bp, Artificial
  CRISPR gRNA sequence
catctcaggtaaacagagtg

SEQ ID NO: 773269 - DNA, 20 bp, Artificial
  CRISPR gRNA sequence
aggtaaacagagtggccttg

SEQ ID NO: 773270 - DNA, 20 bp, Artificial
  CRISPR gRNA sequence
gagcaagatgctttgcctct

SEQ ID NO: 773271 - DNA, 20 bp, Artificial
  CRISPR gRNA sequence
agcaagatgctttgcctctc

SEQ ID NO: 773272 - DNA, 20 bp, Artificial
  CRISPR gRNA sequence
tgcctctctggcttcggttt

SEQ ID NO: 773273 - DNA, 20 bp, Artificial
  CRISPR gRNA sequence
gcctctctggcttcggtttc

SEQ ID NO: 773274 - DNA, 20 bp, Artificial
  CRISPR gRNA sequence
cctctctggcttcggtttcc

SEQ ID NO: 773275 - DNA, 20 bp, Artificial
  CRISPR gRNA sequence
tctggcttcggtttcctctt

SEQ ID NO: 773276 - DNA, 20 bp, Artificial
  CRISPR gRNA sequence
tggcttcggtttcctcttat

SEQ ID NO: 773277 - DNA, 20 bp, Artificial
  CRISPR gRNA sequence
gcttcggtttcctcttatgt

SEQ ID NO: 773278 - DNA, 20 bp, Artificial
  CRISPR gRNA sequence
cggtttcctcttatgtaaaa

SEQ ID NO: 773279 - DNA, 20 bp, Artificial
  CRISPR gRNA sequence
ggtttcctcttatgtaaaat

SEQ ID NO: 773280 - DNA, 20 bp, Artificial
  CRISPR gRNA sequence
cctcttatgtaaaatgagga

SEQ ID NO: 773281 - DNA, 20 bp, Artificial
  CRISPR gRNA sequence
ctcttatgtaaaatgaggat

SEQ ID NO: 773282 - DNA, 20 bp, Artificial
  CRISPR gRNA sequence
ttatgtaaaatgaggataat

SEQ ID NO: 773283 - DNA, 20 bp, Artificial
  CRISPR gRNA sequence
atgtaaaatgaggataatca

SEQ ID NO: 773284 - DNA, 20 bp, Artificial
  CRISPR gRNA sequence
tgtaaaatgaggataatcac

SEQ ID NO: 773285 - DNA, 20 bp, Artificial
  CRISPR gRNA sequence
ataggttgtttgaattatta

SEQ ID NO: 773286 - DNA, 20 bp, Artificial
  CRISPR gRNA sequence
tttgaattattaattgagat

SEQ ID NO: 773287 - DNA, 20 bp, Artificial
  CRISPR gRNA sequence
gaattattaattgagataat

SEQ ID NO: 773288 - DNA, 20 bp, Artificial
  CRISPR gRNA sequence
aattattaattgagataatg

SEQ ID NO: 773289 - DNA, 20 bp, Artificial
  CRISPR gRNA sequence
ttaattgagataatgtatat

SEQ ID NO: 773290 - DNA, 20 bp, Artificial
  CRISPR gRNA sequence
attgagataatgtatataaa

SEQ ID NO: 773291 - DNA, 20 bp, Artificial
  CRISPR gRNA sequence
agataatgtatataaaggac

SEQ ID NO: 773292 - DNA, 20 bp, Artificial
  CRISPR gRNA sequence
gtatcatatctagtgccaag

SEQ ID NO: 773293 - DNA, 20 bp, Artificial
  CRISPR gRNA sequence
gtgccaagtgcttaatactc

SEQ ID NO: 773294 - DNA, 20 bp, Artificial
  CRISPR gRNA sequence
aatactctggagtcctatta

SEQ ID NO: 773295 - DNA, 20 bp, Artificial
  CRISPR gRNA sequence
atactctggagtcctattac

SEQ ID NO: 773296 - DNA, 20 bp, Artificial
  CRISPR gRNA sequence
tggagtcctattactattag

SEQ ID NO: 773297 - DNA, 20 bp, Artificial
  CRISPR gRNA sequence
gagtcctattactattaggc

SEQ ID NO: 773298 - DNA, 20 bp, Artificial
  CRISPR gRNA sequence
ttactattaggcaaacagct

SEQ ID NO: 773299 - DNA, 20 bp, Artificial
  CRISPR gRNA sequence
ctattaggcaaacagcttaa

SEQ ID NO: 773300 - DNA, 20 bp, Artificial
  CRISPR gRNA sequence
ttaggcaaacagcttaagac

SEQ ID NO: 773301 - DNA, 20 bp, Artificial
  CRISPR gRNA sequence
ggcaaacagcttaagacaat

SEQ ID NO: 773302 - DNA, 20 bp, Artificial
  CRISPR gRNA sequence
aagacaatactgttctagtt

SEQ ID NO: 773303 - DNA, 20 bp, Artificial
  CRISPR gRNA sequence
agacaatactgttctagtta

SEQ ID NO: 773304 - DNA, 20 bp, Artificial
  CRISPR gRNA sequence
ttctagttacagactgtgta

SEQ ID NO: 773305 - DNA, 20 bp, Artificial
  CRISPR gRNA sequence
tagttacagactgtgtagct

SEQ ID NO: 773306 - DNA, 20 bp, Artificial
  CRISPR gRNA sequence
gttacagactgtgtagcttt

SEQ ID NO: 773307 - DNA, 20 bp, Artificial
  CRISPR gRNA sequence
cagactgtgtagctttgggc

SEQ ID NO: 773308 - DNA, 20 bp, Artificial
  CRISPR gRNA sequence
tgtagctttgggcaaggtgc

SEQ ID NO: 773309 - DNA, 20 bp, Artificial
  CRISPR gRNA sequence
tgggcaaggtgccttgctcc

SEQ ID NO: 773310 - DNA, 20 bp, Artificial
  CRISPR gRNA sequence
gggcaaggtgccttgctcct

SEQ ID NO: 773311 - DNA, 20 bp, Artificial
  CRISPR gRNA sequence
ggcaaggtgccttgctcctc

SEQ ID NO: 773312 - DNA, 20 bp, Artificial
  CRISPR gRNA sequence
gctcctctgggcatcagttt

SEQ ID NO: 773313 - DNA, 20 bp, Artificial
  CRISPR gRNA sequence
ctcctctgggcatcagtttc

SEQ ID NO: 773314 - DNA, 20 bp, Artificial
  CRISPR gRNA sequence
ctctgggcatcagtttccca

SEQ ID NO: 773315 - DNA, 20 bp, Artificial
  CRISPR gRNA sequence
tgggcatcagtttcccatct

SEQ ID NO: 773316 - DNA, 20 bp, Artificial
  CRISPR gRNA sequence
ggcatcagtttcccatctgt

SEQ ID NO: 773317 - DNA, 20 bp, Artificial
  CRISPR gRNA sequence
cccatctgtaaaatgtcatc

SEQ ID NO: 773318 - DNA, 20 bp, Artificial
  CRISPR gRNA sequence
ccatctgtaaaatgtcatcc

SEQ ID NO: 773319 - DNA, 20 bp, Artificial
  CRISPR gRNA sequence
taaaatgtcatcctgaccct

SEQ ID NO: 773320 - DNA, 20 bp, Artificial
  CRISPR gRNA sequence
accctgccctgatggcacca

SEQ ID NO: 773321 - DNA, 20 bp, Artificial
  CRISPR gRNA sequence
ccctgatggcaccagagggc

SEQ ID NO: 773322 - DNA, 20 bp, Artificial
  CRISPR gRNA sequence
atggcaccagagggctgttt

SEQ ID NO: 773323 - DNA, 20 bp, Artificial
  CRISPR gRNA sequence
ttttgaagctctttcaggtg

SEQ ID NO: 773324 - DNA, 20 bp, Artificial
  CRISPR gRNA sequence
tgaagctctttcaggtgact

SEQ ID NO: 773325 - DNA, 20 bp, Artificial
  CRISPR gRNA sequence
gaagctctttcaggtgactg

SEQ ID NO: 773326 - DNA, 20 bp, Artificial
  CRISPR gRNA sequence
aagctctttcaggtgactgg

SEQ ID NO: 773327 - DNA, 20 bp, Artificial
  CRISPR gRNA sequence
tttcaggtgactggagaggg

SEQ ID NO: 773328 - DNA, 20 bp, Artificial
  CRISPR gRNA sequence
tcaggtgactggagagggag

SEQ ID NO: 773329 - DNA, 20 bp, Artificial
  CRISPR gRNA sequence
caggtgactggagagggagg

SEQ ID NO: 773330 - DNA, 20 bp, Artificial
  CRISPR gRNA sequence
aggtgactggagagggaggt

SEQ ID NO: 773331 - DNA, 20 bp, Artificial
  CRISPR gRNA sequence
gagagggaggtacttgcaaa

SEQ ID NO: 773332 - DNA, 20 bp, Artificial
  CRISPR gRNA sequence
gcaaaggacataggagcatg

SEQ ID NO: 773333 - DNA, 20 bp, Artificial
  CRISPR gRNA sequence
caaaggacataggagcatgg

SEQ ID NO: 773334 - DNA, 20 bp, Artificial
  CRISPR gRNA sequence
ggggcccagcttgggtgggt

SEQ ID NO: 773335 - DNA, 20 bp, Artificial
  CRISPR gRNA sequence
gggtgggtgccaaggcactg

SEQ ID NO: 773336 - DNA, 20 bp, Artificial
  CRISPR gRNA sequence
ggtgggtgccaaggcactgg

SEQ ID NO: 773337 - DNA, 20 bp, Artificial
  CRISPR gRNA sequence
gtgcccatggccgactccca

SEQ ID NO: 773338 - DNA, 20 bp, Artificial
  CRISPR gRNA sequence
ccaggggatcctgggctggg

SEQ ID NO: 773339 - DNA, 20 bp, Artificial
  CRISPR gRNA sequence
ggctgggagaggcaggtttc

SEQ ID NO: 773340 - DNA, 20 bp, Artificial
  CRISPR gRNA sequence
ggagaggcaggtttccgctg

SEQ ID NO: 773341 - DNA, 20 bp, Artificial
  CRISPR gRNA sequence
ccgctgagccatttgggatg

SEQ ID NO: 773342 - DNA, 20 bp, Artificial
  CRISPR gRNA sequence
cgctgagccatttgggatgg

SEQ ID NO: 773343 - DNA, 20 bp, Artificial
  CRISPR gRNA sequence
agccatttgggatggttcca

SEQ ID NO: 773344 - DNA, 20 bp, Artificial
  CRISPR gRNA sequence
gggatggttccagttaatgc

SEQ ID NO: 773345 - DNA, 20 bp, Artificial
  CRISPR gRNA sequence
ggatggttccagttaatgcc

SEQ ID NO: 773346 - DNA, 20 bp, Artificial
  CRISPR gRNA sequence
cagttaatgccagttccctc

SEQ ID NO: 773347 - DNA, 20 bp, Artificial
  CRISPR gRNA sequence
atgccagttccctccccacc

SEQ ID NO: 773348 - DNA, 20 bp, Artificial
  CRISPR gRNA sequence
cctccccacccccgcagaag

SEQ ID NO: 773349 - DNA, 20 bp, Artificial
  CRISPR gRNA sequence
cccacccccgcagaaggaag

SEQ ID NO: 773350 - DNA, 20 bp, Artificial
  CRISPR gRNA sequence
acacttggggactgctataa

SEQ ID NO: 773351 - DNA, 20 bp, Artificial
  CRISPR gRNA sequence
ggggactgctataaattatg

SEQ ID NO: 773352 - DNA, 20 bp, Artificial
  CRISPR gRNA sequence
gggactgctataaattatgc

SEQ ID NO: 773353 - DNA, 20 bp, Artificial
  CRISPR gRNA sequence
ctataaattatgccaattaa

SEQ ID NO: 773354 - DNA, 20 bp, Artificial
  CRISPR gRNA sequence
taaattatgccaattaattc

SEQ ID NO: 773355 - DNA, 20 bp, Artificial
  CRISPR gRNA sequence
tgccaattaattctttgcct

SEQ ID NO: 773356 - DNA, 20 bp, Artificial
  CRISPR gRNA sequence
attctttgcctgttggtgcc

SEQ ID NO: 773357 - DNA, 20 bp, Artificial
  CRISPR gRNA sequence
tttgcctgttggtgcccagc

SEQ ID NO: 773358 - DNA, 20 bp, Artificial
  CRISPR gRNA sequence
tgcctgttggtgcccagcgt

SEQ ID NO: 773359 - DNA, 20 bp, Artificial
  CRISPR gRNA sequence
gcctgttggtgcccagcgtg

SEQ ID NO: 773360 - DNA, 20 bp, Artificial
  CRISPR gRNA sequence
cctgttggtgcccagcgtgg

SEQ ID NO: 773361 - DNA, 20 bp, Artificial
  CRISPR gRNA sequence
ttggtgcccagcgtggcagg

SEQ ID NO: 773362 - DNA, 20 bp, Artificial
  CRISPR gRNA sequence
gtgcccagcgtggcaggcgt

SEQ ID NO: 773363 - DNA, 20 bp, Artificial
  CRISPR gRNA sequence
tgggatcagacctcattctt

SEQ ID NO: 773364 - DNA, 20 bp, Artificial
  CRISPR gRNA sequence
ggatcagacctcattcttca

SEQ ID NO: 773365 - DNA, 20 bp, Artificial
  CRISPR gRNA sequence
attcttcatgctcagaggca

SEQ ID NO: 773366 - DNA, 20 bp, Artificial
  CRISPR gRNA sequence
ttcatgctcagaggcagatg

SEQ ID NO: 773367 - DNA, 20 bp, Artificial
  CRISPR gRNA sequence
catgctcagaggcagatgta

SEQ ID NO: 773368 - DNA, 20 bp, Artificial
  CRISPR gRNA sequence
atgctcagaggcagatgtag

SEQ ID NO: 773369 - DNA, 20 bp, Artificial
  CRISPR gRNA sequence
agaggcagatgtagttggca

SEQ ID NO: 773370 - DNA, 20 bp, Artificial
  CRISPR gRNA sequence
gcagaagggagggagtgagg

SEQ ID NO: 773371 - DNA, 20 bp, Artificial
  CRISPR gRNA sequence
gtcagtctcattccacatgg

SEQ ID NO: 773372 - DNA, 20 bp, Artificial
  CRISPR gRNA sequence
attccacatggtcccaggcc

SEQ ID NO: 773373 - DNA, 20 bp, Artificial
  CRISPR gRNA sequence
cacatggtcccaggcccacc

SEQ ID NO: 773374 - DNA, 20 bp, Artificial
  CRISPR gRNA sequence
caaatctgccagcctccttt

SEQ ID NO: 773375 - DNA, 20 bp, Artificial
  CRISPR gRNA sequence
ccagcctcctttagcttctc

SEQ ID NO: 773376 - DNA, 20 bp, Artificial
  CRISPR gRNA sequence
ctttagcttctcacatcacc

SEQ ID NO: 773377 - DNA, 20 bp, Artificial
  CRISPR gRNA sequence
tagcttctcacatcaccctg

SEQ ID NO: 773378 - DNA, 20 bp, Artificial
  CRISPR gRNA sequence
agcttctcacatcaccctgt

SEQ ID NO: 773379 - DNA, 20 bp, Artificial
  CRISPR gRNA sequence
gcttctcacatcaccctgtg

SEQ ID NO: 773380 - DNA, 20 bp, Artificial
  CRISPR gRNA sequence
ctcacatcaccctgtgtgta

SEQ ID NO: 773381 - DNA, 20 bp, Artificial
  CRISPR gRNA sequence
tcacatcaccctgtgtgtac

SEQ ID NO: 773382 - DNA, 20 bp, Artificial
  CRISPR gRNA sequence
acatcaccctgtgtgtacat

SEQ ID NO: 773383 - DNA, 20 bp, Artificial
  CRISPR gRNA sequence
tgtgtacattgggctcaggg

SEQ ID NO: 773384 - DNA, 20 bp, Artificial
  CRISPR gRNA sequence
ggctcagggcacttccgcat

SEQ ID NO: 773385 - DNA, 20 bp, Artificial
  CRISPR gRNA sequence
agggcacttccgcatctcca

SEQ ID NO: 773386 - DNA, 20 bp, Artificial
  CRISPR gRNA sequence
ccgcatctccagctggaggt

SEQ ID NO: 773387 - DNA, 20 bp, Artificial
  CRISPR gRNA sequence
cgcatctccagctggaggtg

SEQ ID NO: 773388 - DNA, 20 bp, Artificial
  CRISPR gRNA sequence
cagctggaggtggagggctc

SEQ ID NO: 773389 - DNA, 20 bp, Artificial
  CRISPR gRNA sequence
gaggtggagggctcgagggt

SEQ ID NO: 773390 - DNA, 20 bp, Artificial
  CRISPR gRNA sequence
gagggttgtcccattctata

SEQ ID NO: 773391 - DNA, 20 bp, Artificial
  CRISPR gRNA sequence
tcccattctatagatgcaga

SEQ ID NO: 773392 - DNA, 20 bp, Artificial
  CRISPR gRNA sequence
tatagatgcagaaaactaag

SEQ ID NO: 773393 - DNA, 20 bp, Artificial
  CRISPR gRNA sequence
tagatgcagaaaactaaggc

SEQ ID NO: 773394 - DNA, 20 bp, Artificial
  CRISPR gRNA sequence
aggcccagagaggagaatga

SEQ ID NO: 773395 - DNA, 20 bp, Artificial
  CRISPR gRNA sequence
ggacctgggactggggcttg

SEQ ID NO: 773396 - DNA, 20 bp, Artificial
  CRISPR gRNA sequence
ggactggggcttgggacagc

SEQ ID NO: 773397 - DNA, 20 bp, Artificial
  CRISPR gRNA sequence
gggcttgggacagcaaccta

SEQ ID NO: 773398 - DNA, 20 bp, Artificial
  CRISPR gRNA sequence
gggacagcaacctagggccc

SEQ ID NO: 773399 - DNA, 20 bp, Artificial
  CRISPR gRNA sequence
ggacagcaacctagggcccc

SEQ ID NO: 773400 - DNA, 20 bp, Artificial
  CRISPR gRNA sequence
gggccccttcccttgtgcta

SEQ ID NO: 773401 - DNA, 20 bp, Artificial
  CRISPR gRNA sequence
cccttgtgctatgaagtggt

SEQ ID NO: 773402 - DNA, 20 bp, Artificial
  CRISPR gRNA sequence
ccttgtgctatgaagtggtc

SEQ ID NO: 773403 - DNA, 20 bp, Artificial
  CRISPR gRNA sequence
gtgctatgaagtggtcccac

SEQ ID NO: 773404 - DNA, 20 bp, Artificial
  CRISPR gRNA sequence
tgctatgaagtggtcccact

SEQ ID NO: 773405 - DNA, 20 bp, Artificial
  CRISPR gRNA sequence
tgaagtggtcccactctgct

SEQ ID NO: 773406 - DNA, 20 bp, Artificial
  CRISPR gRNA sequence
tgctgacttgtcccgcccct

SEQ ID NO: 773407 - DNA, 20 bp, Artificial
  CRISPR gRNA sequence
ctgacttgtcccgccccttc

SEQ ID NO: 773408 - DNA, 20 bp, Artificial
  CRISPR gRNA sequence
acttgtcccgccccttccag

SEQ ID NO: 773409 - DNA, 20 bp, Artificial
  CRISPR gRNA sequence
gtcccgccccttccagccct

SEQ ID NO: 773410 - DNA, 20 bp, Artificial
  CRISPR gRNA sequence
tcccgccccttccagccctc

SEQ ID NO: 773411 - DNA, 20 bp, Artificial
  CRISPR gRNA sequence
ccagccctcactcctccctc

SEQ ID NO: 773412 - DNA, 20 bp, Artificial
  CRISPR gRNA sequence
cagccctcactcctccctct

SEQ ID NO: 773413 - DNA, 20 bp, Artificial
  CRISPR gRNA sequence
actcctccctctgcctgact

SEQ ID NO: 773414 - DNA, 20 bp, Artificial
  CRISPR gRNA sequence
ctccctctgcctgactccct

SEQ ID NO: 773415 - DNA, 20 bp, Artificial
  CRISPR gRNA sequence
cctctgcctgactccctacc

SEQ ID NO: 773416 - DNA, 20 bp, Artificial
  CRISPR gRNA sequence
tgcctgactccctaccccac

SEQ ID NO: 773417 - DNA, 20 bp, Artificial
  CRISPR gRNA sequence
cctgactccctaccccacca

SEQ ID NO: 773418 - DNA, 20 bp, Artificial
  CRISPR gRNA sequence
actccctaccccaccacttc

SEQ ID NO: 773419 - DNA, 20 bp, Artificial
  CRISPR gRNA sequence
cctaccccaccacttcccat

SEQ ID NO: 773420 - DNA, 20 bp, Artificial
  CRISPR gRNA sequence
ccccaccacttcccatggtt

SEQ ID NO: 773421 - DNA, 20 bp, Artificial
  CRISPR gRNA sequence
cccatggttcctccctcacc

SEQ ID NO: 773422 - DNA, 20 bp, Artificial
  CRISPR gRNA sequence
ccatggttcctccctcaccg

SEQ ID NO: 773423 - DNA, 20 bp, Artificial
  CRISPR gRNA sequence
ctccctcaccgtgtgcgcct

SEQ ID NO: 773424 - DNA, 20 bp, Artificial
  CRISPR gRNA sequence
cctcaccgtgtgcgccttcc

SEQ ID NO: 773425 - DNA, 20 bp, Artificial
  CRISPR gRNA sequence
accgtgtgcgccttcctttt

SEQ ID NO: 773426 - DNA, 20 bp, Artificial
  CRISPR gRNA sequence
cctttttttacagccctgca

SEQ ID NO: 773427 - DNA, 20 bp, Artificial
  CRISPR gRNA sequence
ctttttttacagccctgcag

SEQ ID NO: 773428 - DNA, 20 bp, Artificial
  CRISPR gRNA sequence
tttttacagccctgcagcct

SEQ ID NO: 773429 - DNA, 20 bp, Artificial
  CRISPR gRNA sequence
ttttacagccctgcagcctc

SEQ ID NO: 773430 - DNA, 20 bp, Artificial
  CRISPR gRNA sequence
tttacagccctgcagcctct

SEQ ID NO: 773431 - DNA, 20 bp, Artificial
  CRISPR gRNA sequence
ttacagccctgcagcctctg

SEQ ID NO: 773432 - DNA, 20 bp, Artificial
  CRISPR gRNA sequence
tacagccctgcagcctctga

SEQ ID NO: 773433 - DNA, 20 bp, Artificial
  CRISPR gRNA sequence
acagccctgcagcctctgaa

SEQ ID NO: 773434 - DNA, 20 bp, Artificial
  CRISPR gRNA sequence
cagccctgcagcctctgaaa

SEQ ID NO: 773435 - DNA, 20 bp, Artificial
  CRISPR gRNA sequence
cagcctctgaaacactctga

SEQ ID NO: 773436 - DNA, 20 bp, Artificial
  CRISPR gRNA sequence
tgaaacactctgacagcaaa

SEQ ID NO: 773437 - DNA, 20 bp, Artificial
  CRISPR gRNA sequence
aaacactctgacagcaaaga

SEQ ID NO: 773438 - DNA, 20 bp, Artificial
  CRISPR gRNA sequence
tgacagcaaagaaggtaaag

SEQ ID NO: 773439 - DNA, 20 bp, Artificial
  CRISPR gRNA sequence
acagcaaagaaggtaaagac

SEQ ID NO: 773440 - DNA, 20 bp, Artificial
  CRISPR gRNA sequence
ggcttgaggttgtgtctgtg

SEQ ID NO: 773441 - DNA, 20 bp, Artificial
  CRISPR gRNA sequence
gaggttgtgtctgtgtatgc

SEQ ID NO: 773442 - DNA, 20 bp, Artificial
  CRISPR gRNA sequence
aggttgtgtctgtgtatgca

SEQ ID NO: 773443 - DNA, 20 bp, Artificial
  CRISPR gRNA sequence
tgtctgtgtatgcacacatc

SEQ ID NO: 773444 - DNA, 20 bp, Artificial
  CRISPR gRNA sequence
tgtatgcacacatctgtgtg

SEQ ID NO: 773445 - DNA, 20 bp, Artificial
  CRISPR gRNA sequence
tgtgtgagaggctgagaggg

SEQ ID NO: 773446 - DNA, 20 bp, Artificial
  CRISPR gRNA sequence
agagggtgggtaggcatcat

SEQ ID NO: 773447 - DNA, 20 bp, Artificial
  CRISPR gRNA sequence
tcactagtgacctgaggccc

SEQ ID NO: 773448 - DNA, 20 bp, Artificial
  CRISPR gRNA sequence
cactagtgacctgaggcccc

SEQ ID NO: 773449 - DNA, 20 bp, Artificial
  CRISPR gRNA sequence
actagtgacctgaggccccc

SEQ ID NO: 773450 - DNA, 20 bp, Artificial
  CRISPR gRNA sequence
gtgacctgaggccccctctg

SEQ ID NO: 773451 - DNA, 20 bp, Artificial
  CRISPR gRNA sequence
aggccccctctgcagaagag

SEQ ID NO: 773452 - DNA, 20 bp, Artificial
  CRISPR gRNA sequence
tgcagaagagcagcctcaac

SEQ ID NO: 773453 - DNA, 20 bp, Artificial
  CRISPR gRNA sequence
cagaagagcagcctcaactt

SEQ ID NO: 773454 - DNA, 20 bp, Artificial
  CRISPR gRNA sequence
aacttccccctggtgagatg

SEQ ID NO: 773455 - DNA, 20 bp, Artificial
  CRISPR gRNA sequence
ccccctggtgagatggcaga

SEQ ID NO: 773456 - DNA, 20 bp, Artificial
  CRISPR gRNA sequence
cccctggtgagatggcagag

SEQ ID NO: 773457 - DNA, 20 bp, Artificial
  CRISPR gRNA sequence
gtgagatggcagagggctga

SEQ ID NO: 773458 - DNA, 20 bp, Artificial
  CRISPR gRNA sequence
agtaaccaaggtcccagctg

SEQ ID NO: 773459 - DNA, 20 bp, Artificial
  CRISPR gRNA sequence
ctctgatgggacccaaatac

SEQ ID NO: 773460 - DNA, 20 bp, Artificial
  CRISPR gRNA sequence
tgatgggacccaaatacgac

SEQ ID NO: 773461 - DNA, 20 bp, Artificial
  CRISPR gRNA sequence
atgggacccaaatacgacag

SEQ ID NO: 773462 - DNA, 20 bp, Artificial
  CRISPR gRNA sequence
aagcaggacaggagtttatt

SEQ ID NO: 773463 - DNA, 20 bp, Artificial
  CRISPR gRNA sequence
agcaggacaggagtttattc

SEQ ID NO: 773464 - DNA, 20 bp, Artificial
  CRISPR gRNA sequence
attcctccttcctgtgatag

SEQ ID NO: 773465 - DNA, 20 bp, Artificial
  CRISPR gRNA sequence
ttcctccttcctgtgatagt

SEQ ID NO: 773466 - DNA, 20 bp, Artificial
  CRISPR gRNA sequence
ctccttcctgtgatagtgtg

SEQ ID NO: 773467 - DNA, 20 bp, Artificial
  CRISPR gRNA sequence
cttcctgtgatagtgtgagc

SEQ ID NO: 773468 - DNA, 20 bp, Artificial
  CRISPR gRNA sequence
cctgtgatagtgtgagcata

SEQ ID NO: 773469 - DNA, 20 bp, Artificial
  CRISPR gRNA sequence
ctgtgatagtgtgagcatag

SEQ ID NO: 773470 - DNA, 20 bp, Artificial
  CRISPR gRNA sequence
tgatagtgtgagcataggta

SEQ ID NO: 773471 - DNA, 20 bp, Artificial
  CRISPR gRNA sequence
atgacctggagccaggttcc

SEQ ID NO: 773472 - DNA, 20 bp, Artificial
  CRISPR gRNA sequence
gagccaggttccacttacct

SEQ ID NO: 773473 - DNA, 20 bp, Artificial
  CRISPR gRNA sequence
cacttacctggattctgccc

SEQ ID NO: 773474 - DNA, 20 bp, Artificial
  CRISPR gRNA sequence
acctggattctgccctcttc

SEQ ID NO: 773475 - DNA, 20 bp, Artificial
  CRISPR gRNA sequence
cctggattctgccctcttca

SEQ ID NO: 773476 - DNA, 20 bp, Artificial
  CRISPR gRNA sequence
gattctgccctcttcaactt

SEQ ID NO: 773477 - DNA, 20 bp, Artificial
  CRISPR gRNA sequence
tgccctcttcaacttcaagc

SEQ ID NO: 773478 - DNA, 20 bp, Artificial
  CRISPR gRNA sequence
ccctcttcaacttcaagctt

SEQ ID NO: 773479 - DNA, 20 bp, Artificial
  CRISPR gRNA sequence
ttcaacttcaagctttcact

SEQ ID NO: 773480 - DNA, 20 bp, Artificial
  CRISPR gRNA sequence
caacttcaagctttcactcc

SEQ ID NO: 773481 - DNA, 20 bp, Artificial
  CRISPR gRNA sequence
aacttcaagctttcactcct

SEQ ID NO: 773482 - DNA, 20 bp, Artificial
  CRISPR gRNA sequence
caagctttcactcctaggtc

SEQ ID NO: 773483 - DNA, 20 bp, Artificial
  CRISPR gRNA sequence
aagctttcactcctaggtct

SEQ ID NO: 773484 - DNA, 20 bp, Artificial
  CRISPR gRNA sequence
tcactcctaggtctaagagg

SEQ ID NO: 773485 - DNA, 20 bp, Artificial
  CRISPR gRNA sequence
cactcctaggtctaagaggc

SEQ ID NO: 773486 - DNA, 20 bp, Artificial
  CRISPR gRNA sequence
actcctaggtctaagaggct

SEQ ID NO: 773487 - DNA, 20 bp, Artificial
  CRISPR gRNA sequence
ctaggtctaagaggctgttt

SEQ ID NO: 773488 - DNA, 20 bp, Artificial
  CRISPR gRNA sequence
ggtctaagaggctgtttgtg

SEQ ID NO: 773489 - DNA, 20 bp, Artificial
  CRISPR gRNA sequence
agaggctgtttgtgctccca

SEQ ID NO: 773490 - DNA, 20 bp, Artificial
  CRISPR gRNA sequence
tttgtgctcccacgccccct

SEQ ID NO: 773491 - DNA, 20 bp, Artificial
  CRISPR gRNA sequence
gtgctcccacgccccctcca

SEQ ID NO: 773492 - DNA, 20 bp, Artificial
  CRISPR gRNA sequence
tgctcccacgccccctccag

SEQ ID NO: 773493 - DNA, 20 bp, Artificial
  CRISPR gRNA sequence
ccacgccccctccagagcca

SEQ ID NO: 773494 - DNA, 20 bp, Artificial
  CRISPR gRNA sequence
cagagccaagagggagagaa

SEQ ID NO: 773495 - DNA, 20 bp, Artificial
  CRISPR gRNA sequence
ccttctagagcttgagtgga

SEQ ID NO: 773496 - DNA, 20 bp, Artificial
  CRISPR gRNA sequence
cttctagagcttgagtggaa

SEQ ID NO: 773497 - DNA, 20 bp, Artificial
  CRISPR gRNA sequence
ctagagcttgagtggaagta

SEQ ID NO: 773498 - DNA, 20 bp, Artificial
  CRISPR gRNA sequence
tagagcttgagtggaagtag

SEQ ID NO: 773499 - DNA, 20 bp, Artificial
  CRISPR gRNA sequence
gagcttgagtggaagtagcc

SEQ ID NO: 773500 - DNA, 20 bp, Artificial
  CRISPR gRNA sequence
gagtggaagtagcctgcatc

SEQ ID NO: 773501 - DNA, 20 bp, Artificial
  CRISPR gRNA sequence
agtggaagtagcctgcatca

SEQ ID NO: 773502 - DNA, 20 bp, Artificial
  CRISPR gRNA sequence
catcacttccgcttacattc

SEQ ID NO: 773503 - DNA, 20 bp, Artificial
  CRISPR gRNA sequence
ccgcttacattccattggtc

SEQ ID NO: 773504 - DNA, 20 bp, Artificial
  CRISPR gRNA sequence
cgcttacattccattggtca

SEQ ID NO: 773505 - DNA, 20 bp, Artificial
  CRISPR gRNA sequence
acattccattggtcagaacc

SEQ ID NO: 773506 - DNA, 20 bp, Artificial
  CRISPR gRNA sequence
cattccattggtcagaaccc

SEQ ID NO: 773507 - DNA, 20 bp, Artificial
  CRISPR gRNA sequence
cattggtcagaacccaggca

SEQ ID NO: 773508 - DNA, 20 bp, Artificial
  CRISPR gRNA sequence
gtcagaacccaggcatatga

SEQ ID NO: 773509 - DNA, 20 bp, Artificial
  CRISPR gRNA sequence
actcaggggaggctagaaaa

SEQ ID NO: 773510 - DNA, 20 bp, Artificial
  CRISPR gRNA sequence
aggggaggctagaaaagtgt

SEQ ID NO: 773511 - DNA, 20 bp, Artificial
  CRISPR gRNA sequence
gaaaagtgttcagctgggta

SEQ ID NO: 773512 - DNA, 20 bp, Artificial
  CRISPR gRNA sequence
agctgggtagccatgtccct

SEQ ID NO: 773513 - DNA, 20 bp, Artificial
  CRISPR gRNA sequence
ggtagccatgtccctggcgc

SEQ ID NO: 773514 - DNA, 20 bp, Artificial
  CRISPR gRNA sequence
gcgcacagtgggtggttagt

SEQ ID NO: 773515 - DNA, 20 bp, Artificial
  CRISPR gRNA sequence
gtaaatgtccatagtcatta

SEQ ID NO: 773516 - DNA, 20 bp, Artificial
  CRISPR gRNA sequence
ttgggcctattgttataatg

SEQ ID NO: 773517 - DNA, 20 bp, Artificial
  CRISPR gRNA sequence
ggcctattgttataatgtca

SEQ ID NO: 773518 - DNA, 20 bp, Artificial
  CRISPR gRNA sequence
ttgttataatgtcagtgatg

SEQ ID NO: 773519 - DNA, 20 bp, Artificial
  CRISPR gRNA sequence
ttataatgtcagtgatgaca

SEQ ID NO: 773520 - DNA, 20 bp, Artificial
  CRISPR gRNA sequence
taatgtcagtgatgacattt

SEQ ID NO: 773521 - DNA, 20 bp, Artificial
  CRISPR gRNA sequence
ggaaatacaggagataggtc

SEQ ID NO: 773522 - DNA, 20 bp, Artificial
  CRISPR gRNA sequence
gaaatacaggagataggtca

SEQ ID NO: 773523 - DNA, 20 bp, Artificial
  CRISPR gRNA sequence
ccttcctgtttttcagaatc

SEQ ID NO: 773524 - DNA, 20 bp, Artificial
  CRISPR gRNA sequence
cttcctgtttttcagaatca

SEQ ID NO: 773525 - DNA, 20 bp, Artificial
  CRISPR gRNA sequence
cctgtttttcagaatcaaat

SEQ ID NO: 773526 - DNA, 20 bp, Artificial
  CRISPR gRNA sequence
ctgtttttcagaatcaaata

SEQ ID NO: 773527 - DNA, 20 bp, Artificial
  CRISPR gRNA sequence
tttttcagaatcaaataacc

SEQ ID NO: 773528 - DNA, 20 bp, Artificial
  CRISPR gRNA sequence
ttcagaatcaaataaccata

SEQ ID NO: 773529 - DNA, 20 bp, Artificial
  CRISPR gRNA sequence
tcagaatcaaataaccatag

SEQ ID NO: 773530 - DNA, 20 bp, Artificial
  CRISPR gRNA sequence
cagaatcaaataaccataga

SEQ ID NO: 773531 - DNA, 20 bp, Artificial
  CRISPR gRNA sequence
agaatcaaataaccatagaa

SEQ ID NO: 773532 - DNA, 20 bp, Artificial
  CRISPR gRNA sequence
ggcagatggagataaaaagt

SEQ ID NO: 773533 - DNA, 20 bp, Artificial
  CRISPR gRNA sequence
aggccaggcatggtacttca

SEQ ID NO: 773534 - DNA, 20 bp, Artificial
  CRISPR gRNA sequence
ggccaggcatggtacttcac

SEQ ID NO: 773535 - DNA, 20 bp, Artificial
  CRISPR gRNA sequence
cacacctgtaatctcagcac

SEQ ID NO: 773536 - DNA, 20 bp, Artificial
  CRISPR gRNA sequence
acacctgtaatctcagcact

SEQ ID NO: 773537 - DNA, 20 bp, Artificial
  CRISPR gRNA sequence
taatctcagcactttgggag

SEQ ID NO: 773538 - DNA, 20 bp, Artificial
  CRISPR gRNA sequence
agcactttgggaggccgagg

SEQ ID NO: 773539 - DNA, 20 bp, Artificial
  CRISPR gRNA sequence
tgggaggccgaggtgggtgg

SEQ ID NO: 773540 - DNA, 20 bp, Artificial
  CRISPR gRNA sequence
gggaggccgaggtgggtgga

SEQ ID NO: 773541 - DNA, 20 bp, Artificial
  CRISPR gRNA sequence
ggaggccgaggtgggtggat

SEQ ID NO: 773542 - DNA, 20 bp, Artificial
  CRISPR gRNA sequence
gaggtcaggagtttgagacc

SEQ ID NO: 773543 - DNA, 20 bp, Artificial
  CRISPR gRNA sequence
aggtcaggagtttgagacca

SEQ ID NO: 773544 - DNA, 20 bp, Artificial
  CRISPR gRNA sequence
gagaccagcctggccaacat

SEQ ID NO: 773545 - DNA, 20 bp, Artificial
  CRISPR gRNA sequence
agaccagcctggccaacatg

SEQ ID NO: 773546 - DNA, 20 bp, Artificial
  CRISPR gRNA sequence
gccaacatggtgaaaccctg

SEQ ID NO: 773547 - DNA, 20 bp, Artificial
  CRISPR gRNA sequence
tctctactaaaaatacaaaa

SEQ ID NO: 773548 - DNA, 20 bp, Artificial
  CRISPR gRNA sequence
tactaaaaatacaaaactta

SEQ ID NO: 773549 - DNA, 20 bp, Artificial
  CRISPR gRNA sequence
ctaaaaatacaaaacttagc

SEQ ID NO: 773550 - DNA, 20 bp, Artificial
  CRISPR gRNA sequence
aaaatacaaaacttagccgg

SEQ ID NO: 773551 - DNA, 20 bp, Artificial
  CRISPR gRNA sequence
agccgggcgtggtggtgcat

SEQ ID NO: 773552 - DNA, 20 bp, Artificial
  CRISPR gRNA sequence
gccgggcgtggtggtgcatg

SEQ ID NO: 773553 - DNA, 20 bp, Artificial
  CRISPR gRNA sequence
taatcccagctacttgggaa

SEQ ID NO: 773554 - DNA, 20 bp, Artificial
  CRISPR gRNA sequence
cttgggaagctgaggcggga

SEQ ID NO: 773555 - DNA, 20 bp, Artificial
  CRISPR gRNA sequence
gggaagctgaggcgggagaa

SEQ ID NO: 773556 - DNA, 20 bp, Artificial
  CRISPR gRNA sequence
ggaagctgaggcgggagaat

SEQ ID NO: 773557 - DNA, 20 bp, Artificial
  CRISPR gRNA sequence
aggcgggagaatcacttgaa

SEQ ID NO: 773558 - DNA, 20 bp, Artificial
  CRISPR gRNA sequence
gaacctgggaggcagaggtt

SEQ ID NO: 773559 - DNA, 20 bp, Artificial
  CRISPR gRNA sequence
aacctgggaggcagaggttg

SEQ ID NO: 773560 - DNA, 20 bp, Artificial
  CRISPR gRNA sequence
ggaggcagaggttgcagtga

SEQ ID NO: 773561 - DNA, 20 bp, Artificial
  CRISPR gRNA sequence
cagtgaactgagattgcacc

SEQ ID NO: 773562 - DNA, 20 bp, Artificial
  CRISPR gRNA sequence
agattgcacctgtgcactcc

SEQ ID NO: 773563 - DNA, 20 bp, Artificial
  CRISPR gRNA sequence
cacctgtgcactccagcctg

SEQ ID NO: 773564 - DNA, 20 bp, Artificial
  CRISPR gRNA sequence
tgcactccagcctgggcaac

SEQ ID NO: 773565 - DNA, 20 bp, Artificial
  CRISPR gRNA sequence
cagcctgggcaacagagcaa

SEQ ID NO: 773566 - DNA, 20 bp, Artificial
  CRISPR gRNA sequence
ggcaacagagcaagattcca

SEQ ID NO: 773567 - DNA, 20 bp, Artificial
  CRISPR gRNA sequence
catctcaaaaaaaaaaaaaa

SEQ ID NO: 773568 - DNA, 20 bp, Artificial
  CRISPR gRNA sequence
aaaaaaaaaaaaaaaaaaaa

SEQ ID NO: 773569 - DNA, 20 bp, Artificial
  CRISPR gRNA sequence
ggttttgaagagttgctgga

SEQ ID NO: 773570 - DNA, 20 bp, Artificial
  CRISPR gRNA sequence
gttttgaagagttgctggag

SEQ ID NO: 773571 - DNA, 20 bp, Artificial
  CRISPR gRNA sequence
tgaagagttgctggagaatg

SEQ ID NO: 773572 - DNA, 20 bp, Artificial
  CRISPR gRNA sequence
gaagagttgctggagaatgt

SEQ ID NO: 773573 - DNA, 20 bp, Artificial
  CRISPR gRNA sequence
aagagttgctggagaatgtg

SEQ ID NO: 773574 - DNA, 20 bp, Artificial
  CRISPR gRNA sequence
ctggagaatgtggcctggat

SEQ ID NO: 773575 - DNA, 20 bp, Artificial
  CRISPR gRNA sequence
gagaatgtggcctggatggg

SEQ ID NO: 773576 - DNA, 20 bp, Artificial
  CRISPR gRNA sequence
gatgggcaaaccagtttgct

SEQ ID NO: 773577 - DNA, 20 bp, Artificial
  CRISPR gRNA sequence
gcttcctaaccctgctcctt

SEQ ID NO: 773578 - DNA, 20 bp, Artificial
  CRISPR gRNA sequence
cttcctaaccctgctccttg

SEQ ID NO: 773579 - DNA, 20 bp, Artificial
  CRISPR gRNA sequence
cctaaccctgctccttggtg

SEQ ID NO: 773580 - DNA, 20 bp, Artificial
  CRISPR gRNA sequence
ctaaccctgctccttggtga

SEQ ID NO: 773581 - DNA, 20 bp, Artificial
  CRISPR gRNA sequence
accctgctccttggtgaggc

SEQ ID NO: 773582 - DNA, 20 bp, Artificial
  CRISPR gRNA sequence
ctccttggtgaggcagcctg

SEQ ID NO: 773583 - DNA, 20 bp, Artificial
  CRISPR gRNA sequence
cttggtgaggcagcctgccc

SEQ ID NO: 773584 - DNA, 20 bp, Artificial
  CRISPR gRNA sequence
ggtgaggcagcctgccccct

SEQ ID NO: 773585 - DNA, 20 bp, Artificial
  CRISPR gRNA sequence
gtgaggcagcctgccccctc

SEQ ID NO: 773586 - DNA, 20 bp, Artificial
  CRISPR gRNA sequence
ccccctcagtctctggccat

SEQ ID NO: 773587 - DNA, 20 bp, Artificial
  CRISPR gRNA sequence
agtctctggccatgctggac

SEQ ID NO: 773588 - DNA, 20 bp, Artificial
  CRISPR gRNA sequence
tggccatgctggacaaccac

SEQ ID NO: 773589 - DNA, 20 bp, Artificial
  CRISPR gRNA sequence
gccatgctggacaaccacag

SEQ ID NO: 773590 - DNA, 20 bp, Artificial
  CRISPR gRNA sequence
gacaaccacagaggcagtgc

SEQ ID NO: 773591 - DNA, 20 bp, Artificial
  CRISPR gRNA sequence
ttctcctctccccagggaca

SEQ ID NO: 773592 - DNA, 20 bp, Artificial
  CRISPR gRNA sequence
ctcctctccccagggacata

SEQ ID NO: 773593 - DNA, 20 bp, Artificial
  CRISPR gRNA sequence
tcctctccccagggacatac

SEQ ID NO: 773594 - DNA, 20 bp, Artificial
  CRISPR gRNA sequence
ctctccccagggacatacag

SEQ ID NO: 773595 - DNA, 20 bp, Artificial
  CRISPR gRNA sequence
tccccagggacatacagagc

SEQ ID NO: 773596 - DNA, 20 bp, Artificial
  CRISPR gRNA sequence
cccagggacatacagagccc

SEQ ID NO: 773597 - DNA, 20 bp, Artificial
  CRISPR gRNA sequence
cttcccaagtctccattcag

SEQ ID NO: 773598 - DNA, 20 bp, Artificial
  CRISPR gRNA sequence
ttcccaagtctccattcagc

SEQ ID NO: 773599 - DNA, 20 bp, Artificial
  CRISPR gRNA sequence
cccaagtctccattcagctt

SEQ ID NO: 773600 - DNA, 20 bp, Artificial
  CRISPR gRNA sequence
ccaagtctccattcagcttc

SEQ ID NO: 773601 - DNA, 20 bp, Artificial
  CRISPR gRNA sequence
cattcagcttcagatgcaga

SEQ ID NO: 773602 - DNA, 20 bp, Artificial
  CRISPR gRNA sequence
agcttcagatgcagagtggg

SEQ ID NO: 773603 - DNA, 20 bp, Artificial
  CRISPR gRNA sequence
cagatgcagagtggggtctg

SEQ ID NO: 773604 - DNA, 20 bp, Artificial
  CRISPR gRNA sequence
agatgcagagtggggtctga

SEQ ID NO: 773605 - DNA, 20 bp, Artificial
  CRISPR gRNA sequence
aaagatgagtctttgggatg

SEQ ID NO: 773606 - DNA, 20 bp, Artificial
  CRISPR gRNA sequence
tgggatggccctccacatgg

SEQ ID NO: 773607 - DNA, 20 bp, Artificial
  CRISPR gRNA sequence
gggatggccctccacatgga

SEQ ID NO: 773608 - DNA, 20 bp, Artificial
  CRISPR gRNA sequence
ggatggccctccacatggag

SEQ ID NO: 773609 - DNA, 20 bp, Artificial
  CRISPR gRNA sequence
cacatggagacaggaagccc

SEQ ID NO: 773610 - DNA, 20 bp, Artificial
  CRISPR gRNA sequence
ccgtgtcactctcagggaaa

SEQ ID NO: 773611 - DNA, 20 bp, Artificial
  CRISPR gRNA sequence
tcagggaaaccagtgtggag

SEQ ID NO: 773612 - DNA, 20 bp, Artificial
  CRISPR gRNA sequence
agggaaaccagtgtggaggg

SEQ ID NO: 773613 - DNA, 20 bp, Artificial
  CRISPR gRNA sequence
ggaaggctgcctgctggacg

SEQ ID NO: 773614 - DNA, 20 bp, Artificial
  CRISPR gRNA sequence
cctgctggacgagggagttg

SEQ ID NO: 773615 - DNA, 20 bp, Artificial
  CRISPR gRNA sequence
ctggacgagggagttgggcc

SEQ ID NO: 773616 - DNA, 20 bp, Artificial
  CRISPR gRNA sequence
gacgagggagttgggccagg

SEQ ID NO: 773617 - DNA, 20 bp, Artificial
  CRISPR gRNA sequence
ggccaggccttggagggtgg

SEQ ID NO: 773618 - DNA, 20 bp, Artificial
  CRISPR gRNA sequence
ggagggtggatgggatggac

SEQ ID NO: 773619 - DNA, 20 bp, Artificial
  CRISPR gRNA sequence
gagggtggatgggatggaca

SEQ ID NO: 773620 - DNA, 20 bp, Artificial
  CRISPR gRNA sequence
cacgtagagggagagtggag

SEQ ID NO: 773621 - DNA, 20 bp, Artificial
  CRISPR gRNA sequence
tgggcctgtgggtactgaga

SEQ ID NO: 773622 - DNA, 20 bp, Artificial
  CRISPR gRNA sequence
tgggtactgagagggggctg

SEQ ID NO: 773623 - DNA, 20 bp, Artificial
  CRISPR gRNA sequence
agagggggctgcgtgaggtg

SEQ ID NO: 773624 - DNA, 20 bp, Artificial
  CRISPR gRNA sequence
cgtgaggtggtccccctcag

SEQ ID NO: 773625 - DNA, 20 bp, Artificial
  CRISPR gRNA sequence
aggtgccccggcgtgcctgg

SEQ ID NO: 773626 - DNA, 20 bp, Artificial
  CRISPR gRNA sequence
gcacctgcatctgtgtctgg

SEQ ID NO: 773627 - DNA, 20 bp, Artificial
  CRISPR gRNA sequence
catctgtgtctgggcctcca

SEQ ID NO: 773628 - DNA, 20 bp, Artificial
  CRISPR gRNA sequence
tgtctgggcctccagggccg

SEQ ID NO: 773629 - DNA, 20 bp, Artificial
  CRISPR gRNA sequence
ggcctccagggccgtggtca

SEQ ID NO: 773630 - DNA, 20 bp, Artificial
  CRISPR gRNA sequence
cagggccgtggtcagcacgg

SEQ ID NO: 773631 - DNA, 20 bp, Artificial
  CRISPR gRNA sequence
tccgttgggctgctgtctca

SEQ ID NO: 773632 - DNA, 20 bp, Artificial
  CRISPR gRNA sequence
ggctgctgtctcacacacac

SEQ ID NO: 773633 - DNA, 20 bp, Artificial
  CRISPR gRNA sequence
ctgtctcacacacactcccc

SEQ ID NO: 773634 - DNA, 20 bp, Artificial
  CRISPR gRNA sequence
tctcacacacactccccact

SEQ ID NO: 773635 - DNA, 20 bp, Artificial
  CRISPR gRNA sequence
acacacactccccacttgaa

SEQ ID NO: 773636 - DNA, 20 bp, Artificial
  CRISPR gRNA sequence
cccacttgaagtctgaccag

SEQ ID NO: 773637 - DNA, 20 bp, Artificial
  CRISPR gRNA sequence
gaagtctgaccaggtgcttg

SEQ ID NO: 773638 - DNA, 20 bp, Artificial
  CRISPR gRNA sequence
aagtctgaccaggtgcttgg

SEQ ID NO: 773639 - DNA, 20 bp, Artificial
  CRISPR gRNA sequence
accaggtgcttgggcttctg

SEQ ID NO: 773640 - DNA, 20 bp, Artificial
  CRISPR gRNA sequence
gggcttctggcataatccca

SEQ ID NO: 773641 - DNA, 20 bp, Artificial
  CRISPR gRNA sequence
ggcttctggcataatcccaa

SEQ ID NO: 773642 - DNA, 20 bp, Artificial
  CRISPR gRNA sequence
ctggcataatcccaaaaata

SEQ ID NO: 773643 - DNA, 20 bp, Artificial
  CRISPR gRNA sequence
tggcataatcccaaaaatag

SEQ ID NO: 773644 - DNA, 20 bp, Artificial
  CRISPR gRNA sequence
gcataatcccaaaaatagat

SEQ ID NO: 773645 - DNA, 20 bp, Artificial
  CRISPR gRNA sequence
ctggcatctaatgcttttcc

SEQ ID NO: 773646 - DNA, 20 bp, Artificial
  CRISPR gRNA sequence
tggcatctaatgcttttccc

SEQ ID NO: 773647 - DNA, 20 bp, Artificial
  CRISPR gRNA sequence
gcatctaatgcttttccctt

SEQ ID NO: 773648 - DNA, 20 bp, Artificial
  CRISPR gRNA sequence
atgcttttcccttccctttt

SEQ ID NO: 773649 - DNA, 20 bp, Artificial
  CRISPR gRNA sequence
ttcccttcccttttttttct

SEQ ID NO: 773650 - DNA, 20 bp, Artificial
  CRISPR gRNA sequence
tcccttcccttttttttctt

SEQ ID NO: 773651 - DNA, 20 bp, Artificial
  CRISPR gRNA sequence
cccttcccttttttttcttc

SEQ ID NO: 773652 - DNA, 20 bp, Artificial
  CRISPR gRNA sequence
ccttcccttttttttcttcc

SEQ ID NO: 773653 - DNA, 20 bp, Artificial
  CRISPR gRNA sequence
cccttttttttcttcccatc

SEQ ID NO: 773654 - DNA, 20 bp, Artificial
  CRISPR gRNA sequence
ccttttttttcttcccatca

SEQ ID NO: 773655 - DNA, 20 bp, Artificial
  CRISPR gRNA sequence
ttttttcttcccatcatgaa

SEQ ID NO: 773656 - DNA, 20 bp, Artificial
  CRISPR gRNA sequence
tttttcttcccatcatgaaa

SEQ ID NO: 773657 - DNA, 20 bp, Artificial
  CRISPR gRNA sequence
ttttcttcccatcatgaaat

SEQ ID NO: 773658 - DNA, 20 bp, Artificial
  CRISPR gRNA sequence
tttcttcccatcatgaaatg

SEQ ID NO: 773659 - DNA, 20 bp, Artificial
  CRISPR gRNA sequence
ttcttcccatcatgaaatga

SEQ ID NO: 773660 - DNA, 20 bp, Artificial
  CRISPR gRNA sequence
tcttcccatcatgaaatgaa

SEQ ID NO: 773661 - DNA, 20 bp, Artificial
  CRISPR gRNA sequence
cttcccatcatgaaatgaag

SEQ ID NO: 773662 - DNA, 20 bp, Artificial
  CRISPR gRNA sequence
ttcccatcatgaaatgaaga

SEQ ID NO: 773663 - DNA, 20 bp, Artificial
  CRISPR gRNA sequence
cccatcatgaaatgaagatg

SEQ ID NO: 773664 - DNA, 20 bp, Artificial
  CRISPR gRNA sequence
ccatcatgaaatgaagatga

SEQ ID NO: 773665 - DNA, 20 bp, Artificial
  CRISPR gRNA sequence
accatgaggaccagggagct

SEQ ID NO: 773666 - DNA, 20 bp, Artificial
  CRISPR gRNA sequence
ctacccctccctacagctcc

SEQ ID NO: 773667 - DNA, 20 bp, Artificial
  CRISPR gRNA sequence
cccctccctacagctcctac

SEQ ID NO: 773668 - DNA, 20 bp, Artificial
  CRISPR gRNA sequence
cctacagctcctaccctctg

SEQ ID NO: 773669 - DNA, 20 bp, Artificial
  CRISPR gRNA sequence
cagctcctaccctctggctg

SEQ ID NO: 773670 - DNA, 20 bp, Artificial
  CRISPR gRNA sequence
ctaccctctggctgcaatgg

SEQ ID NO: 773671 - DNA, 20 bp, Artificial
  CRISPR gRNA sequence
ccctctggctgcaatggggc

SEQ ID NO: 773672 - DNA, 20 bp, Artificial
  CRISPR gRNA sequence
tggctgcaatggggctgcac

SEQ ID NO: 773673 - DNA, 20 bp, Artificial
  CRISPR gRNA sequence
gctgcaatggggctgcactg

SEQ ID NO: 773674 - DNA, 20 bp, Artificial
  CRISPR gRNA sequence
caatggggctgcactgtgag

SEQ ID NO: 773675 - DNA, 20 bp, Artificial
  CRISPR gRNA sequence
cactgtgagccctgccccca

SEQ ID NO: 773676 - DNA, 20 bp, Artificial
  CRISPR gRNA sequence
tgagccctgcccccaacaga

SEQ ID NO: 773677 - DNA, 20 bp, Artificial
  CRISPR gRNA sequence
cccccaacagatgcatcctg

SEQ ID NO: 773678 - DNA, 20 bp, Artificial
  CRISPR gRNA sequence
ctctgacaggtgggctcctt

SEQ ID NO: 773679 - DNA, 20 bp, Artificial
  CRISPR gRNA sequence
tgacaggtgggctccttctc

SEQ ID NO: 773680 - DNA, 20 bp, Artificial
  CRISPR gRNA sequence
acaggtgggctccttctcca

SEQ ID NO: 773681 - DNA, 20 bp, Artificial
  CRISPR gRNA sequence
cttctccaaaggatgcgata

SEQ ID NO: 773682 - DNA, 20 bp, Artificial
  CRISPR gRNA sequence
ctccaaaggatgcgatacac

SEQ ID NO: 773683 - DNA, 20 bp, Artificial
  CRISPR gRNA sequence
tccaaaggatgcgatacaca

SEQ ID NO: 773684 - DNA, 20 bp, Artificial
  CRISPR gRNA sequence
caaaggatgcgatacacaga

SEQ ID NO: 773685 - DNA, 20 bp, Artificial
  CRISPR gRNA sequence
tgcagccttatttctccaat

SEQ ID NO: 773686 - DNA, 20 bp, Artificial
  CRISPR gRNA sequence
atttctccaatggacatgat

SEQ ID NO: 773687 - DNA, 20 bp, Artificial
  CRISPR gRNA sequence
tttctccaatggacatgatt

SEQ ID NO: 773688 - DNA, 20 bp, Artificial
  CRISPR gRNA sequence
ctccaatggacatgattccc

SEQ ID NO: 773689 - DNA, 20 bp, Artificial
  CRISPR gRNA sequence
tccaatggacatgattccca

SEQ ID NO: 773690 - DNA, 20 bp, Artificial
  CRISPR gRNA sequence
caatggacatgattcccaag

SEQ ID NO: 773691 - DNA, 20 bp, Artificial
  CRISPR gRNA sequence
ccaagtcatcctgctgcctt

SEQ ID NO: 773692 - DNA, 20 bp, Artificial
  CRISPR gRNA sequence
ctgccttttttcttatagac

SEQ ID NO: 773693 - DNA, 20 bp, Artificial
  CRISPR gRNA sequence
ccttttttcttatagacaca

SEQ ID NO: 773694 - DNA, 20 bp, Artificial
  CRISPR gRNA sequence
ttttcttatagacacaatga

SEQ ID NO: 773695 - DNA, 20 bp, Artificial
  CRISPR gRNA sequence
tttcttatagacacaatgaa

SEQ ID NO: 773696 - DNA, 20 bp, Artificial
  CRISPR gRNA sequence
ttcttatagacacaatgaac

SEQ ID NO: 773697 - DNA, 20 bp, Artificial
  CRISPR gRNA sequence
tcttatagacacaatgaaca

SEQ ID NO: 773698 - DNA, 20 bp, Artificial
  CRISPR gRNA sequence
cttatagacacaatgaacag

SEQ ID NO: 773699 - DNA, 20 bp, Artificial
  CRISPR gRNA sequence
ttatagacacaatgaacaga

SEQ ID NO: 773700 - DNA, 20 bp, Artificial
  CRISPR gRNA sequence
atagacacaatgaacagacc

SEQ ID NO: 773701 - DNA, 20 bp, Artificial
  CRISPR gRNA sequence
tagacacaatgaacagacca

SEQ ID NO: 773702 - DNA, 20 bp, Artificial
  CRISPR gRNA sequence
agttctctaagtcatcctgc

SEQ ID NO: 773703 - DNA, 20 bp, Artificial
  CRISPR gRNA sequence
gttctctaagtcatcctgcc

SEQ ID NO: 773704 - DNA, 20 bp, Artificial
  CRISPR gRNA sequence
tctaagtcatcctgcctgct

SEQ ID NO: 773705 - DNA, 20 bp, Artificial
  CRISPR gRNA sequence
taagtcatcctgcctgctgc

SEQ ID NO: 773706 - DNA, 20 bp, Artificial
  CRISPR gRNA sequence
agtcatcctgcctgctgcct

SEQ ID NO: 773707 - DNA, 20 bp, Artificial
  CRISPR gRNA sequence
cctgctgccttatttcacag

SEQ ID NO: 773708 - DNA, 20 bp, Artificial
  CRISPR gRNA sequence
ctgccttatttcacagtaca

SEQ ID NO: 773709 - DNA, 20 bp, Artificial
  CRISPR gRNA sequence
ccttatttcacagtacatac

SEQ ID NO: 773710 - DNA, 20 bp, Artificial
  CRISPR gRNA sequence
atttcacagtacatacattt

SEQ ID NO: 773711 - DNA, 20 bp, Artificial
  CRISPR gRNA sequence
tttcacagtacatacatttc

SEQ ID NO: 773712 - DNA, 20 bp, Artificial
  CRISPR gRNA sequence
cacagtacatacatttctta

SEQ ID NO: 773713 - DNA, 20 bp, Artificial
  CRISPR gRNA sequence
acagtacatacatttcttag

SEQ ID NO: 773714 - DNA, 20 bp, Artificial
  CRISPR gRNA sequence
cttagggacacagtacactg

SEQ ID NO: 773715 - DNA, 20 bp, Artificial
  CRISPR gRNA sequence
ttagggacacagtacactga

SEQ ID NO: 773716 - DNA, 20 bp, Artificial
  CRISPR gRNA sequence
agggacacagtacactgacc

SEQ ID NO: 773717 - DNA, 20 bp, Artificial
  CRISPR gRNA sequence
gggacacagtacactgacca

SEQ ID NO: 773718 - DNA, 20 bp, Artificial
  CRISPR gRNA sequence
accacatcaccaccctcttc

SEQ ID NO: 773719 - DNA, 20 bp, Artificial
  CRISPR gRNA sequence
ttcttccagtgctgcgtgga

SEQ ID NO: 773720 - DNA, 20 bp, Artificial
  CRISPR gRNA sequence
cttccagtgctgcgtggacc

SEQ ID NO: 773721 - DNA, 20 bp, Artificial
  CRISPR gRNA sequence
ttccagtgctgcgtggacca

SEQ ID NO: 773722 - DNA, 20 bp, Artificial
  CRISPR gRNA sequence
ccagtgctgcgtggaccatc

SEQ ID NO: 773723 - DNA, 20 bp, Artificial
  CRISPR gRNA sequence
cagtgctgcgtggaccatct

SEQ ID NO: 773724 - DNA, 20 bp, Artificial
  CRISPR gRNA sequence
cgtggaccatctggctgcct

SEQ ID NO: 773725 - DNA, 20 bp, Artificial
  CRISPR gRNA sequence
gctgccttttttctccaaaa

SEQ ID NO: 773726 - DNA, 20 bp, Artificial
  CRISPR gRNA sequence
ccttttttctccaaaagatg

SEQ ID NO: 773727 - DNA, 20 bp, Artificial
  CRISPR gRNA sequence
ttttctccaaaagatgcaat

SEQ ID NO: 773728 - DNA, 20 bp, Artificial
  CRISPR gRNA sequence
tttctccaaaagatgcaata

SEQ ID NO: 773729 - DNA, 20 bp, Artificial
  CRISPR gRNA sequence
ttctccaaaagatgcaatat

SEQ ID NO: 773730 - DNA, 20 bp, Artificial
  CRISPR gRNA sequence
tctccaaaagatgcaatatt

SEQ ID NO: 773731 - DNA, 20 bp, Artificial
  CRISPR gRNA sequence
ctccaaaagatgcaatattc

SEQ ID NO: 773732 - DNA, 20 bp, Artificial
  CRISPR gRNA sequence
tccaaaagatgcaatattca

SEQ ID NO: 773733 - DNA, 20 bp, Artificial
  CRISPR gRNA sequence
caaaagatgcaatattcaga

SEQ ID NO: 773734 - DNA, 20 bp, Artificial
  CRISPR gRNA sequence
agactgactgaccccctgcc

SEQ ID NO: 773735 - DNA, 20 bp, Artificial
  CRISPR gRNA sequence
actgaccccctgccttattt

SEQ ID NO: 773736 - DNA, 20 bp, Artificial
  CRISPR gRNA sequence
accccctgccttatttcacc

SEQ ID NO: 773737 - DNA, 20 bp, Artificial
  CRISPR gRNA sequence
ccttatttcaccaaagacac

SEQ ID NO: 773738 - DNA, 20 bp, Artificial
  CRISPR gRNA sequence
atttcaccaaagacacgatg

SEQ ID NO: 773739 - DNA, 20 bp, Artificial
  CRISPR gRNA sequence
tttcaccaaagacacgatgc

SEQ ID NO: 773740 - DNA, 20 bp, Artificial
  CRISPR gRNA sequence
caccaaagacacgatgcata

SEQ ID NO: 773741 - DNA, 20 bp, Artificial
  CRISPR gRNA sequence
accaaagacacgatgcatag

SEQ ID NO: 773742 - DNA, 20 bp, Artificial
  CRISPR gRNA sequence
gtttctccaatggccgtgat

SEQ ID NO: 773743 - DNA, 20 bp, Artificial
  CRISPR gRNA sequence
tttctccaatggccgtgata

SEQ ID NO: 773744 - DNA, 20 bp, Artificial
  CRISPR gRNA sequence
ctccaatggccgtgatacac

SEQ ID NO: 773745 - DNA, 20 bp, Artificial
  CRISPR gRNA sequence
tccaatggccgtgatacact

SEQ ID NO: 773746 - DNA, 20 bp, Artificial
  CRISPR gRNA sequence
caatggccgtgatacactag

SEQ ID NO: 773747 - DNA, 20 bp, Artificial
  CRISPR gRNA sequence
gtgatcatgttcagccctgc

SEQ ID NO: 773748 - DNA, 20 bp, Artificial
  CRISPR gRNA sequence
agccctgcttccacctgcat

SEQ ID NO: 773749 - DNA, 20 bp, Artificial
  CRISPR gRNA sequence
cttccacctgcatagaatct

SEQ ID NO: 773750 - DNA, 20 bp, Artificial
  CRISPR gRNA sequence
ccacctgcatagaatctttt

SEQ ID NO: 773751 - DNA, 20 bp, Artificial
  CRISPR gRNA sequence
cacctgcatagaatcttttc

SEQ ID NO: 773752 - DNA, 20 bp, Artificial
  CRISPR gRNA sequence
catagaatcttttcttctca

SEQ ID NO: 773753 - DNA, 20 bp, Artificial
  CRISPR gRNA sequence
ttcttctcagacagggacag

SEQ ID NO: 773754 - DNA, 20 bp, Artificial
  CRISPR gRNA sequence
tcttctcagacagggacagt

SEQ ID NO: 773755 - DNA, 20 bp, Artificial
  CRISPR gRNA sequence
cttctcagacagggacagtg

SEQ ID NO: 773756 - DNA, 20 bp, Artificial
  CRISPR gRNA sequence
ttctcagacagggacagtgc

SEQ ID NO: 773757 - DNA, 20 bp, Artificial
  CRISPR gRNA sequence
ctcagacagggacagtgcgg

SEQ ID NO: 773758 - DNA, 20 bp, Artificial
  CRISPR gRNA sequence
tcagacagggacagtgcggc

SEQ ID NO: 773759 - DNA, 20 bp, Artificial
  CRISPR gRNA sequence
agacagggacagtgcggcct

SEQ ID NO: 773760 - DNA, 20 bp, Artificial
  CRISPR gRNA sequence
aacatctcctggagtctaga

SEQ ID NO: 773761 - DNA, 20 bp, Artificial
  CRISPR gRNA sequence
ctggagtctagaagctgttt

SEQ ID NO: 773762 - DNA, 20 bp, Artificial
  CRISPR gRNA sequence
gagtctagaagctgtttcct

SEQ ID NO: 773763 - DNA, 20 bp, Artificial
  CRISPR gRNA sequence
gaagctgtttcctttcccct

SEQ ID NO: 773764 - DNA, 20 bp, Artificial
  CRISPR gRNA sequence
tttcctttcccctccttcct

SEQ ID NO: 773765 - DNA, 20 bp, Artificial
  CRISPR gRNA sequence
cctttcccctccttcctcct

SEQ ID NO: 773766 - DNA, 20 bp, Artificial
  CRISPR gRNA sequence
ctttcccctccttcctcctc

SEQ ID NO: 773767 - DNA, 20 bp, Artificial
  CRISPR gRNA sequence
tcccctccttcctcctcttg

SEQ ID NO: 773768 - DNA, 20 bp, Artificial
  CRISPR gRNA sequence
cccctccttcctcctcttgc

SEQ ID NO: 773769 - DNA, 20 bp, Artificial
  CRISPR gRNA sequence
ccctccttcctcctcttgct

SEQ ID NO: 773770 - DNA, 20 bp, Artificial
  CRISPR gRNA sequence
cttcctcctcttgctctagc

SEQ ID NO: 773771 - DNA, 20 bp, Artificial
  CRISPR gRNA sequence
cctcctcttgctctagcctt

SEQ ID NO: 773772 - DNA, 20 bp, Artificial
  CRISPR gRNA sequence
ctcctcttgctctagcctta

SEQ ID NO: 773773 - DNA, 20 bp, Artificial
  CRISPR gRNA sequence
ctcttgctctagccttaata

SEQ ID NO: 773774 - DNA, 20 bp, Artificial
  CRISPR gRNA sequence
ttgctctagccttaatactg

SEQ ID NO: 773775 - DNA, 20 bp, Artificial
  CRISPR gRNA sequence
gctctagccttaatactggc

SEQ ID NO: 773776 - DNA, 20 bp, Artificial
  CRISPR gRNA sequence
ctctagccttaatactggcc

SEQ ID NO: 773777 - DNA, 20 bp, Artificial
  CRISPR gRNA sequence
tagccttaatactggccttt

SEQ ID NO: 773778 - DNA, 20 bp, Artificial
  CRISPR gRNA sequence
gccttaatactggccttttc

SEQ ID NO: 773779 - DNA, 20 bp, Artificial
  CRISPR gRNA sequence
aatactggccttttccctcc

SEQ ID NO: 773780 - DNA, 20 bp, Artificial
  CRISPR gRNA sequence
atactggccttttccctccc

SEQ ID NO: 773781 - DNA, 20 bp, Artificial
  CRISPR gRNA sequence
gccttttccctccctgcccc

SEQ ID NO: 773782 - DNA, 20 bp, Artificial
  CRISPR gRNA sequence
ttccctccctgccccaagtg

SEQ ID NO: 773783 - DNA, 20 bp, Artificial
  CRISPR gRNA sequence
tccctccctgccccaagtga

SEQ ID NO: 773784 - DNA, 20 bp, Artificial
  CRISPR gRNA sequence
ccctccctgccccaagtgaa

SEQ ID NO: 773785 - DNA, 20 bp, Artificial
  CRISPR gRNA sequence
cctccctgccccaagtgaag

SEQ ID NO: 773786 - DNA, 20 bp, Artificial
  CRISPR gRNA sequence
cctgccccaagtgaagacag

SEQ ID NO: 773787 - DNA, 20 bp, Artificial
  CRISPR gRNA sequence
ccccaagtgaagacagggca

SEQ ID NO: 773788 - DNA, 20 bp, Artificial
  CRISPR gRNA sequence
tgcgcccaccacatgcacag

SEQ ID NO: 773789 - DNA, 20 bp, Artificial
  CRISPR gRNA sequence
cgcccaccacatgcacagct

SEQ ID NO: 773790 - DNA, 20 bp, Artificial
  CRISPR gRNA sequence
tgcatggagacctgcaggtg

SEQ ID NO: 773791 - DNA, 20 bp, Artificial
  CRISPR gRNA sequence
caggtgcacgtgctggaaca

SEQ ID NO: 773792 - DNA, 20 bp, Artificial
  CRISPR gRNA sequence
gaacacgtgtggttcccccc

SEQ ID NO: 773793 - DNA, 20 bp, Artificial
  CRISPR gRNA sequence
ccccctggcccagcctcctc

SEQ ID NO: 773794 - DNA, 20 bp, Artificial
  CRISPR gRNA sequence
gcccagcctcctctgcagtg

SEQ ID NO: 773795 - DNA, 20 bp, Artificial
  CRISPR gRNA sequence
ctctgcagtgcccctctccc

SEQ ID NO: 773796 - DNA, 20 bp, Artificial
  CRISPR gRNA sequence
tgcagtgcccctctcccctg

SEQ ID NO: 773797 - DNA, 20 bp, Artificial
  CRISPR gRNA sequence
cagtgcccctctcccctgcc

SEQ ID NO: 773798 - DNA, 20 bp, Artificial
  CRISPR gRNA sequence
tcccctgcccatcctcccca

SEQ ID NO: 773799 - DNA, 20 bp, Artificial
  CRISPR gRNA sequence
ccctgcccatcctccccacg

SEQ ID NO: 773800 - DNA, 20 bp, Artificial
  CRISPR gRNA sequence
cccatcctccccacggaagc

SEQ ID NO: 773801 - DNA, 20 bp, Artificial
  CRISPR gRNA sequence
cccacggaagcatgtgctgg

SEQ ID NO: 773802 - DNA, 20 bp, Artificial
  CRISPR gRNA sequence
gtcacactggttctccaggg

SEQ ID NO: 773803 - DNA, 20 bp, Artificial
  CRISPR gRNA sequence
gttctccaggggtctgtgat

SEQ ID NO: 773804 - DNA, 20 bp, Artificial
  CRISPR gRNA sequence
tccaggggtctgtgatgggg

SEQ ID NO: 773805 - DNA, 20 bp, Artificial
  CRISPR gRNA sequence
caggggtctgtgatggggcc

SEQ ID NO: 773806 - DNA, 20 bp, Artificial
  CRISPR gRNA sequence
tgatggggcccctgggggtc

SEQ ID NO: 773807 - DNA, 20 bp, Artificial
  CRISPR gRNA sequence
ggggtcagcttctgtccctc

SEQ ID NO: 773808 - DNA, 20 bp, Artificial
  CRISPR gRNA sequence
ctgtccctctgccttctcac

SEQ ID NO: 773809 - DNA, 20 bp, Artificial
  CRISPR gRNA sequence
tgtccctctgccttctcacc

SEQ ID NO: 773810 - DNA, 20 bp, Artificial
  CRISPR gRNA sequence
tccctctgccttctcacctc

SEQ ID NO: 773811 - DNA, 20 bp, Artificial
  CRISPR gRNA sequence
tgccttctcacctctttgtt

SEQ ID NO: 773812 - DNA, 20 bp, Artificial
  CRISPR gRNA sequence
ccttctcacctctttgttcc

SEQ ID NO: 773813 - DNA, 20 bp, Artificial
  CRISPR gRNA sequence
ctcacctctttgttcctttc

SEQ ID NO: 773814 - DNA, 20 bp, Artificial
  CRISPR gRNA sequence
tcacctctttgttcctttct

SEQ ID NO: 773815 - DNA, 20 bp, Artificial
  CRISPR gRNA sequence
acctctttgttcctttcttt

SEQ ID NO: 773816 - DNA, 20 bp, Artificial
  CRISPR gRNA sequence
tttgttcctttcttttcatg

SEQ ID NO: 773817 - DNA, 20 bp, Artificial
  CRISPR gRNA sequence
tgttcctttcttttcatgta

SEQ ID NO: 773818 - DNA, 20 bp, Artificial
  CRISPR gRNA sequence
gttcctttcttttcatgtat

SEQ ID NO: 773819 - DNA, 20 bp, Artificial
  CRISPR gRNA sequence
ttcctttcttttcatgtatc

SEQ ID NO: 773820 - DNA, 20 bp, Artificial
  CRISPR gRNA sequence
ctttcttttcatgtatccat

SEQ ID NO: 773821 - DNA, 20 bp, Artificial
  CRISPR gRNA sequence
tcttttcatgtatccattca

SEQ ID NO: 773822 - DNA, 20 bp, Artificial
  CRISPR gRNA sequence
cttttcatgtatccattcag

SEQ ID NO: 773823 - DNA, 20 bp, Artificial
  CRISPR gRNA sequence
ttttcatgtatccattcagt

SEQ ID NO: 773824 - DNA, 20 bp, Artificial
  CRISPR gRNA sequence
ttcatgtatccattcagttg

SEQ ID NO: 773825 - DNA, 20 bp, Artificial
  CRISPR gRNA sequence
tcatgtatccattcagttga

SEQ ID NO: 773826 - DNA, 20 bp, Artificial
  CRISPR gRNA sequence
catgtatccattcagttgat

SEQ ID NO: 773827 - DNA, 20 bp, Artificial
  CRISPR gRNA sequence
atgtatccattcagttgatg

SEQ ID NO: 773828 - DNA, 20 bp, Artificial
  CRISPR gRNA sequence
agttgatgtttattgagcaa

SEQ ID NO: 773829 - DNA, 20 bp, Artificial
  CRISPR gRNA sequence
atgtttattgagcaactaca

SEQ ID NO: 773830 - DNA, 20 bp, Artificial
  CRISPR gRNA sequence
attgagcaactacagatgtc

SEQ ID NO: 773831 - DNA, 20 bp, Artificial
  CRISPR gRNA sequence
ttgagcaactacagatgtca

SEQ ID NO: 773832 - DNA, 20 bp, Artificial
  CRISPR gRNA sequence
agcaactacagatgtcagca

SEQ ID NO: 773833 - DNA, 20 bp, Artificial
  CRISPR gRNA sequence
cagatgtcagcactgtgtta

SEQ ID NO: 773834 - DNA, 20 bp, Artificial
  CRISPR gRNA sequence
tgttaggtgctgggggccct

SEQ ID NO: 773835 - DNA, 20 bp, Artificial
  CRISPR gRNA sequence
ggtgctgggggccctgcgtg

SEQ ID NO: 773836 - DNA, 20 bp, Artificial
  CRISPR gRNA sequence
ggggccctgcgtgggaagat

SEQ ID NO: 773837 - DNA, 20 bp, Artificial
  CRISPR gRNA sequence
cgtgggaagataaagttcct

SEQ ID NO: 773838 - DNA, 20 bp, Artificial
  CRISPR gRNA sequence
ctccctcaaggactccccat

SEQ ID NO: 773839 - DNA, 20 bp, Artificial
  CRISPR gRNA sequence
cctcaaggactccccatcca

SEQ ID NO: 773840 - DNA, 20 bp, Artificial
  CRISPR gRNA sequence
aaggactccccatccagctg

SEQ ID NO: 773841 - DNA, 20 bp, Artificial
  CRISPR gRNA sequence
cccatccagctgggagacag

SEQ ID NO: 773842 - DNA, 20 bp, Artificial
  CRISPR gRNA sequence
ggagacagacaactaactac

SEQ ID NO: 773843 - DNA, 20 bp, Artificial
  CRISPR gRNA sequence
actacactgcaccctgcggt

SEQ ID NO: 773844 - DNA, 20 bp, Artificial
  CRISPR gRNA sequence
cactgcaccctgcggtttgc

SEQ ID NO: 773845 - DNA, 20 bp, Artificial
  CRISPR gRNA sequence
caccctgcggtttgcagggg

SEQ ID NO: 773846 - DNA, 20 bp, Artificial
  CRISPR gRNA sequence
cggtttgcagggggctcctg

SEQ ID NO: 773847 - DNA, 20 bp, Artificial
  CRISPR gRNA sequence
gcagggggctcctgcctggc

SEQ ID NO: 773848 - DNA, 20 bp, Artificial
  CRISPR gRNA sequence
cagggggctcctgcctggct

SEQ ID NO: 773849 - DNA, 20 bp, Artificial
  CRISPR gRNA sequence
ctgcctggctccctgctcca

SEQ ID NO: 773850 - DNA, 20 bp, Artificial
  CRISPR gRNA sequence
cctggctccctgctccacac

SEQ ID NO: 773851 - DNA, 20 bp, Artificial
  CRISPR gRNA sequence
gctccctgctccacacctcc

SEQ ID NO: 773852 - DNA, 20 bp, Artificial
  CRISPR gRNA sequence
cctgctccacacctcctctg

SEQ ID NO: 773853 - DNA, 20 bp, Artificial
  CRISPR gRNA sequence
ctccacacctcctctgtggc

SEQ ID NO: 773854 - DNA, 20 bp, Artificial
  CRISPR gRNA sequence
cacacctcctctgtggctca

SEQ ID NO: 773855 - DNA, 20 bp, Artificial
  CRISPR gRNA sequence
ctctgtggctcaaggcttcc

SEQ ID NO: 773856 - DNA, 20 bp, Artificial
  CRISPR gRNA sequence
tgtggctcaaggcttcctgg

SEQ ID NO: 773857 - DNA, 20 bp, Artificial
  CRISPR gRNA sequence
tggctcaaggcttcctggat

SEQ ID NO: 773858 - DNA, 20 bp, Artificial
  CRISPR gRNA sequence
aaggcttcctggatacctca

SEQ ID NO: 773859 - DNA, 20 bp, Artificial
  CRISPR gRNA sequence
cctggatacctcacccccat

SEQ ID NO: 773860 - DNA, 20 bp, Artificial
  CRISPR gRNA sequence
ctggatacctcacccccatc

SEQ ID NO: 773861 - DNA, 20 bp, Artificial
  CRISPR gRNA sequence
gatacctcacccccatccca

SEQ ID NO: 773862 - DNA, 20 bp, Artificial
  CRISPR gRNA sequence
acccccatcccacccataat

SEQ ID NO: 773863 - DNA, 20 bp, Artificial
  CRISPR gRNA sequence
ttacccagagcatggggttg

SEQ ID NO: 773864 - DNA, 20 bp, Artificial
  CRISPR gRNA sequence
acccagagcatggggttggg

SEQ ID NO: 773865 - DNA, 20 bp, Artificial
  CRISPR gRNA sequence
cccagagcatggggttgggg

SEQ ID NO: 773866 - DNA, 20 bp, Artificial
  CRISPR gRNA sequence
gggcggaaacctggagagag

SEQ ID NO: 773867 - DNA, 20 bp, Artificial
  CRISPR gRNA sequence
gagagagggacatagcccct

SEQ ID NO: 773868 - DNA, 20 bp, Artificial
  CRISPR gRNA sequence
gccacggctagagaatctgg

SEQ ID NO: 773869 - DNA, 20 bp, Artificial
  CRISPR gRNA sequence
gagaatctggtggtgtccaa

SEQ ID NO: 773870 - DNA, 20 bp, Artificial
  CRISPR gRNA sequence
gtggtgtccaaaatgtctgt

SEQ ID NO: 773871 - DNA, 20 bp, Artificial
  CRISPR gRNA sequence
tccaggtgtgggcaggtggg

SEQ ID NO: 773872 - DNA, 20 bp, Artificial
  CRISPR gRNA sequence
tggacctttcatagcagcag

SEQ ID NO: 773873 - DNA, 20 bp, Artificial
  CRISPR gRNA sequence
gacctttcatagcagcagaa

SEQ ID NO: 773874 - DNA, 20 bp, Artificial
  CRISPR gRNA sequence
tcatagcagcagaaaaggca

SEQ ID NO: 773875 - DNA, 20 bp, Artificial
  CRISPR gRNA sequence
catagcagcagaaaaggcag

SEQ ID NO: 773876 - DNA, 20 bp, Artificial
  CRISPR gRNA sequence
atagcagcagaaaaggcaga

SEQ ID NO: 773877 - DNA, 20 bp, Artificial
  CRISPR gRNA sequence
gggcagggcagggccaggaa

SEQ ID NO: 773878 - DNA, 20 bp, Artificial
  CRISPR gRNA sequence
tggggacaccgaggggactg

SEQ ID NO: 773879 - DNA, 20 bp, Artificial
  CRISPR gRNA sequence
ggggacaccgaggggactgc

SEQ ID NO: 773880 - DNA, 20 bp, Artificial
  CRISPR gRNA sequence
gggacaccgaggggactgcc

SEQ ID NO: 773881 - DNA, 20 bp, Artificial
  CRISPR gRNA sequence
ccccccacccccaccatggt

SEQ ID NO: 773882 - DNA, 20 bp, Artificial
  CRISPR gRNA sequence
ttctggggctggggcagtct

SEQ ID NO: 773883 - DNA, 20 bp, Artificial
  CRISPR gRNA sequence
tggggctggggcagtctttt

SEQ ID NO: 773884 - DNA, 20 bp, Artificial
  CRISPR gRNA sequence
gggctggggcagtcttttcc

SEQ ID NO: 773885 - DNA, 20 bp, Artificial
  CRISPR gRNA sequence
gggcagtcttttcctggctt

SEQ ID NO: 773886 - DNA, 20 bp, Artificial
  CRISPR gRNA sequence
ttcctggcttgcctctggcc

SEQ ID NO: 773887 - DNA, 20 bp, Artificial
  CRISPR gRNA sequence
tcctggcttgcctctggcca

SEQ ID NO: 773888 - DNA, 20 bp, Artificial
  CRISPR gRNA sequence
cctggcttgcctctggccag

SEQ ID NO: 773889 - DNA, 20 bp, Artificial
  CRISPR gRNA sequence
ctggcttgcctctggccagc

SEQ ID NO: 773890 - DNA, 20 bp, Artificial
  CRISPR gRNA sequence
gcttgcctctggccagctcc

SEQ ID NO: 773891 - DNA, 20 bp, Artificial
  CRISPR gRNA sequence
gcctctggccagctcctggc

SEQ ID NO: 773892 - DNA, 20 bp, Artificial
  CRISPR gRNA sequence
cctctggccagctcctggcc

SEQ ID NO: 773893 - DNA, 20 bp, Artificial
  CRISPR gRNA sequence
tggccagctcctggcctctg

SEQ ID NO: 773894 - DNA, 20 bp, Artificial
  CRISPR gRNA sequence
gccagctcctggcctctggt

SEQ ID NO: 773895 - DNA, 20 bp, Artificial
  CRISPR gRNA sequence
ctggcctctggtagagtgag

SEQ ID NO: 773896 - DNA, 20 bp, Artificial
  CRISPR gRNA sequence
gcctctggtagagtgagact

SEQ ID NO: 773897 - DNA, 20 bp, Artificial
  CRISPR gRNA sequence
tggtagagtgagacttcaga

SEQ ID NO: 773898 - DNA, 20 bp, Artificial
  CRISPR gRNA sequence
gtagagtgagacttcagacg

SEQ ID NO: 773899 - DNA, 20 bp, Artificial
  CRISPR gRNA sequence
cagacgttctgatgccttcc

SEQ ID NO: 773900 - DNA, 20 bp, Artificial
  CRISPR gRNA sequence
agacgttctgatgccttccg

SEQ ID NO: 773901 - DNA, 20 bp, Artificial
  CRISPR gRNA sequence
tgatgccttccggatgtcat

SEQ ID NO: 773902 - DNA, 20 bp, Artificial
  CRISPR gRNA sequence
atgccttccggatgtcatct

SEQ ID NO: 773903 - DNA, 20 bp, Artificial
  CRISPR gRNA sequence
ccggatgtcatctctccctg

SEQ ID NO: 773904 - DNA, 20 bp, Artificial
  CRISPR gRNA sequence
cggatgtcatctctccctgc

SEQ ID NO: 773905 - DNA, 20 bp, Artificial
  CRISPR gRNA sequence
tccctgccccaggaatggaa

SEQ ID NO: 773906 - DNA, 20 bp, Artificial
  CRISPR gRNA sequence
cctgccccaggaatggaaga

SEQ ID NO: 773907 - DNA, 20 bp, Artificial
  CRISPR gRNA sequence
ccccaggaatggaagatgtg

SEQ ID NO: 773908 - DNA, 20 bp, Artificial
  CRISPR gRNA sequence
ctaatttaaatgtgggactc

SEQ ID NO: 773909 - DNA, 20 bp, Artificial
  CRISPR gRNA sequence
taatttaaatgtgggactcg

SEQ ID NO: 773910 - DNA, 20 bp, Artificial
  CRISPR gRNA sequence
atttaaatgtgggactcgga

SEQ ID NO: 773911 - DNA, 20 bp, Artificial
  CRISPR gRNA sequence
aaatgtgggactcggaggga

SEQ ID NO: 773912 - DNA, 20 bp, Artificial
  CRISPR gRNA sequence
aatgtgggactcggagggat

SEQ ID NO: 773913 - DNA, 20 bp, Artificial
  CRISPR gRNA sequence
ggagggattttgtaaactgg

SEQ ID NO: 773914 - DNA, 20 bp, Artificial
  CRISPR gRNA sequence
tgtaaactgggggtatattt

SEQ ID NO: 773915 - DNA, 20 bp, Artificial
  CRISPR gRNA sequence
gtaaactgggggtatatttt

SEQ ID NO: 773916 - DNA, 20 bp, Artificial
  CRISPR gRNA sequence
taaactgggggtatattttg

SEQ ID NO: 773917 - DNA, 20 bp, Artificial
  CRISPR gRNA sequence
ggggtatattttggggaaaa

SEQ ID NO: 773918 - DNA, 20 bp, Artificial
  CRISPR gRNA sequence
tggggaaaataaatgtcttt

SEQ ID NO: 773919 - DNA, 20 bp, Artificial
  CRISPR gRNA sequence
ggggaaaataaatgtctttg

SEQ ID NO: 773920 - DNA, 20 bp, Artificial
  CRISPR gRNA sequence
gggaaaataaatgtctttgt

SEQ ID NO: 773921 - DNA, 20 bp, Artificial
  CRISPR gRNA sequence
tgtaaaaagctttttctctg

SEQ ID NO: 773922 - DNA, 20 bp, Artificial
  CRISPR gRNA sequence
gtaaaaagctttttctctgt

SEQ ID NO: 773923 - DNA, 20 bp, Artificial
  CRISPR gRNA sequence
taaaaagctttttctctgtg

SEQ ID NO: 773924 - DNA, 20 bp, Artificial
  CRISPR gRNA sequence
tttctctgtgaagtgtttgg

SEQ ID NO: 773925 - DNA, 20 bp, Artificial
  CRISPR gRNA sequence
ttctctgtgaagtgtttgga

SEQ ID NO: 773926 - DNA, 20 bp, Artificial
  CRISPR gRNA sequence
tctctgtgaagtgtttggaa

SEQ ID NO: 773927 - DNA, 20 bp, Artificial
  CRISPR gRNA sequence
ctctgtgaagtgtttggaag

SEQ ID NO: 773928 - DNA, 20 bp, Artificial
  CRISPR gRNA sequence
tctgtgaagtgtttggaagc

SEQ ID NO: 773929 - DNA, 20 bp, Artificial
  CRISPR gRNA sequence
tgtgaagtgtttggaagcag

SEQ ID NO: 773930 - DNA, 20 bp, Artificial
  CRISPR gRNA sequence
tgaagtgtttggaagcaggg

SEQ ID NO: 773931 - DNA, 20 bp, Artificial
  CRISPR gRNA sequence
ggaagcagggtgggccccag

SEQ ID NO: 773932 - DNA, 20 bp, Artificial
  CRISPR gRNA sequence
gaagcagggtgggccccagg

SEQ ID NO: 773933 - DNA, 20 bp, Artificial
  CRISPR gRNA sequence
aaccagcaggattctctcct

SEQ ID NO: 773934 - DNA, 20 bp, Artificial
  CRISPR gRNA sequence
tctcctggatgttgcaggct

SEQ ID NO: 773935 - DNA, 20 bp, Artificial
  CRISPR gRNA sequence
tcctggatgttgcaggctgg

SEQ ID NO: 773936 - DNA, 20 bp, Artificial
  CRISPR gRNA sequence
ctggatgttgcaggctgggg

SEQ ID NO: 773937 - DNA, 20 bp, Artificial
  CRISPR gRNA sequence
gatgttgcaggctggggtag

SEQ ID NO: 773938 - DNA, 20 bp, Artificial
  CRISPR gRNA sequence
caggctggggtagggaagcc

SEQ ID NO: 773939 - DNA, 20 bp, Artificial
  CRISPR gRNA sequence
gggtagggaagcctggccct

SEQ ID NO: 773940 - DNA, 20 bp, Artificial
  CRISPR gRNA sequence
ccctaccccagcctgcaaca

SEQ ID NO: 773941 - DNA, 20 bp, Artificial
  CRISPR gRNA sequence
cctaccccagcctgcaacat

SEQ ID NO: 773942 - DNA, 20 bp, Artificial
  CRISPR gRNA sequence
ccccagcctgcaacatccag

SEQ ID NO: 773943 - DNA, 20 bp, Artificial
  CRISPR gRNA sequence
caacatccaggagagaatcc

SEQ ID NO: 773944 - DNA, 20 bp, Artificial
  CRISPR gRNA sequence
ctggttgagtcctggggccc

SEQ ID NO: 773945 - DNA, 20 bp, Artificial
  CRISPR gRNA sequence
gttgagtcctggggcccacc

SEQ ID NO: 773946 - DNA, 20 bp, Artificial
  CRISPR gRNA sequence
agtcctggggcccaccctgc

SEQ ID NO: 773947 - DNA, 20 bp, Artificial
  CRISPR gRNA sequence
gggcccaccctgcttccaaa

SEQ ID NO: 773948 - DNA, 20 bp, Artificial
  CRISPR gRNA sequence
cttccaaacacttcacagag

SEQ ID NO: 773949 - DNA, 20 bp, Artificial
  CRISPR gRNA sequence
ccaaacacttcacagagaaa

SEQ ID NO: 773950 - DNA, 20 bp, Artificial
  CRISPR gRNA sequence
caaacacttcacagagaaaa

SEQ ID NO: 773951 - DNA, 20 bp, Artificial
  CRISPR gRNA sequence
cacagagaaaaagcttttta

SEQ ID NO: 773952 - DNA, 20 bp, Artificial
  CRISPR gRNA sequence
acagagaaaaagctttttac

SEQ ID NO: 773953 - DNA, 20 bp, Artificial
  CRISPR gRNA sequence
tttacaaagacatttatttt

SEQ ID NO: 773954 - DNA, 20 bp, Artificial
  CRISPR gRNA sequence
ttacaaagacatttattttc

SEQ ID NO: 773955 - DNA, 20 bp, Artificial
  CRISPR gRNA sequence
tacaaagacatttattttcc

SEQ ID NO: 773956 - DNA, 20 bp, Artificial
  CRISPR gRNA sequence
acaaagacatttattttccc

SEQ ID NO: 773957 - DNA, 20 bp, Artificial
  CRISPR gRNA sequence
caaagacatttattttcccc

SEQ ID NO: 773958 - DNA, 20 bp, Artificial
  CRISPR gRNA sequence
attttccccaaaatataccc

SEQ ID NO: 773959 - DNA, 20 bp, Artificial
  CRISPR gRNA sequence
ttttccccaaaatatacccc

SEQ ID NO: 773960 - DNA, 20 bp, Artificial
  CRISPR gRNA sequence
tccccaaaatatacccccag

SEQ ID NO: 773961 - DNA, 20 bp, Artificial
  CRISPR gRNA sequence
ccccaaaatatacccccagt

SEQ ID NO: 773962 - DNA, 20 bp, Artificial
  CRISPR gRNA sequence
cccaaaatatacccccagtt

SEQ ID NO: 773963 - DNA, 20 bp, Artificial
  CRISPR gRNA sequence
acaaaatccctccgagtccc

SEQ ID NO: 773964 - DNA, 20 bp, Artificial
  CRISPR gRNA sequence
caaaatccctccgagtccca

SEQ ID NO: 773965 - DNA, 20 bp, Artificial
  CRISPR gRNA sequence
cgagtcccacatttaaatta

SEQ ID NO: 773966 - DNA, 20 bp, Artificial
  CRISPR gRNA sequence
aaattagaagtcctcacatc

SEQ ID NO: 773967 - DNA, 20 bp, Artificial
  CRISPR gRNA sequence
aattagaagtcctcacatct

SEQ ID NO: 773968 - DNA, 20 bp, Artificial
  CRISPR gRNA sequence
gaagtcctcacatcttccat

SEQ ID NO: 773969 - DNA, 20 bp, Artificial
  CRISPR gRNA sequence
acatcttccattcctggggc

SEQ ID NO: 773970 - DNA, 20 bp, Artificial
  CRISPR gRNA sequence
ccattcctggggcagggaga

SEQ ID NO: 773971 - DNA, 20 bp, Artificial
  CRISPR gRNA sequence
cattcctggggcagggagag

SEQ ID NO: 773972 - DNA, 20 bp, Artificial
  CRISPR gRNA sequence
ctggggcagggagagatgac

SEQ ID NO: 773973 - DNA, 20 bp, Artificial
  CRISPR gRNA sequence
gggcagggagagatgacatc

SEQ ID NO: 773974 - DNA, 20 bp, Artificial
  CRISPR gRNA sequence
aagtctcactctaccagagg

SEQ ID NO: 773975 - DNA, 20 bp, Artificial
  CRISPR gRNA sequence
actctaccagaggccaggag

SEQ ID NO: 773976 - DNA, 20 bp, Artificial
  CRISPR gRNA sequence
taccagaggccaggagctgg

SEQ ID NO: 773977 - DNA, 20 bp, Artificial
  CRISPR gRNA sequence
ccagaggccaggagctggcc

SEQ ID NO: 773978 - DNA, 20 bp, Artificial
  CRISPR gRNA sequence
gccagaggcaagccaggaaa

SEQ ID NO: 773979 - DNA, 20 bp, Artificial
  CRISPR gRNA sequence
ccccagccccagaatagcac

SEQ ID NO: 773980 - DNA, 20 bp, Artificial
  CRISPR gRNA sequence
ggtgtccccaaagcattcct

SEQ ID NO: 773981 - DNA, 20 bp, Artificial
  CRISPR gRNA sequence
ctggccctgccctgccccag

SEQ ID NO: 773982 - DNA, 20 bp, Artificial
  CRISPR gRNA sequence
gccctgccctgccccaggct

SEQ ID NO: 773983 - DNA, 20 bp, Artificial
  CRISPR gRNA sequence
ccctgccccaggctctgcct

SEQ ID NO: 773984 - DNA, 20 bp, Artificial
  CRISPR gRNA sequence
ccccaggctctgccttttct

SEQ ID NO: 773985 - DNA, 20 bp, Artificial
  CRISPR gRNA sequence
tgccttttctgctgctatga

SEQ ID NO: 773986 - DNA, 20 bp, Artificial
  CRISPR gRNA sequence
ccttttctgctgctatgaaa

SEQ ID NO: 773987 - DNA, 20 bp, Artificial
  CRISPR gRNA sequence
ttctgctgctatgaaaggtc

SEQ ID NO: 773988 - DNA, 20 bp, Artificial
  CRISPR gRNA sequence
tctgctgctatgaaaggtcc

SEQ ID NO: 773989 - DNA, 20 bp, Artificial
  CRISPR gRNA sequence
ctgctgctatgaaaggtcca

SEQ ID NO: 773990 - DNA, 20 bp, Artificial
  CRISPR gRNA sequence
tgctgctatgaaaggtccag

SEQ ID NO: 773991 - DNA, 20 bp, Artificial
  CRISPR gRNA sequence
ctgctatgaaaggtccagag

SEQ ID NO: 773992 - DNA, 20 bp, Artificial
  CRISPR gRNA sequence
ctatgaaaggtccagagggc

SEQ ID NO: 773993 - DNA, 20 bp, Artificial
  CRISPR gRNA sequence
tgaaaggtccagagggcctt

SEQ ID NO: 773994 - DNA, 20 bp, Artificial
  CRISPR gRNA sequence
ggtgcctgcccacctgccca

SEQ ID NO: 773995 - DNA, 20 bp, Artificial
  CRISPR gRNA sequence
gtgcctgcccacctgcccac

SEQ ID NO: 773996 - DNA, 20 bp, Artificial
  CRISPR gRNA sequence
cccacctgcccacacctgga

SEQ ID NO: 773997 - DNA, 20 bp, Artificial
  CRISPR gRNA sequence
cccacacctggacagacatt

SEQ ID NO: 773998 - DNA, 20 bp, Artificial
  CRISPR gRNA sequence
gacagacattttggacacca

SEQ ID NO: 773999 - DNA, 20 bp, Artificial
  CRISPR gRNA sequence
tggacaccaccagattctct

SEQ ID NO: 774000 - DNA, 20 bp, Artificial
  CRISPR gRNA sequence
ggacaccaccagattctcta

SEQ ID NO: 774001 - DNA, 20 bp, Artificial
  CRISPR gRNA sequence
gacaccaccagattctctag

SEQ ID NO: 774002 - DNA, 20 bp, Artificial
  CRISPR gRNA sequence
tctagccgtggcgaggggct

SEQ ID NO: 774003 - DNA, 20 bp, Artificial
  CRISPR gRNA sequence
tagccgtggcgaggggctat

SEQ ID NO: 774004 - DNA, 20 bp, Artificial
  CRISPR gRNA sequence
gccgtggcgaggggctatgt

SEQ ID NO: 774005 - DNA, 20 bp, Artificial
  CRISPR gRNA sequence
tgtccctctctccaggtttc

SEQ ID NO: 774006 - DNA, 20 bp, Artificial
  CRISPR gRNA sequence
tctccaggtttccgccccaa

SEQ ID NO: 774007 - DNA, 20 bp, Artificial
  CRISPR gRNA sequence
tccaggtttccgccccaacc

SEQ ID NO: 774008 - DNA, 20 bp, Artificial
  CRISPR gRNA sequence
caggtttccgccccaacccc

SEQ ID NO: 774009 - DNA, 20 bp, Artificial
  CRISPR gRNA sequence
ccgccccaaccccatgctct

SEQ ID NO: 774010 - DNA, 20 bp, Artificial
  CRISPR gRNA sequence
cgccccaaccccatgctctg

SEQ ID NO: 774011 - DNA, 20 bp, Artificial
  CRISPR gRNA sequence
tgggtaagaattatgggtgg

SEQ ID NO: 774012 - DNA, 20 bp, Artificial
  CRISPR gRNA sequence
ggtaagaattatgggtggga

SEQ ID NO: 774013 - DNA, 20 bp, Artificial
  CRISPR gRNA sequence
tgggtgggatgggggtgagg

SEQ ID NO: 774014 - DNA, 20 bp, Artificial
  CRISPR gRNA sequence
gagccacagaggaggtgtgg

SEQ ID NO: 774015 - DNA, 20 bp, Artificial
  CRISPR gRNA sequence
agccacagaggaggtgtgga

SEQ ID NO: 774016 - DNA, 20 bp, Artificial
  CRISPR gRNA sequence
caaaccgcagggtgcagtgt

SEQ ID NO: 774017 - DNA, 20 bp, Artificial
  CRISPR gRNA sequence
gttgtctgtctcccagctgg

SEQ ID NO: 774018 - DNA, 20 bp, Artificial
  CRISPR gRNA sequence
tctgtctcccagctggatgg

SEQ ID NO: 774019 - DNA, 20 bp, Artificial
  CRISPR gRNA sequence
tctcccagctggatggggag

SEQ ID NO: 774020 - DNA, 20 bp, Artificial
  CRISPR gRNA sequence
ccagctggatggggagtcct

SEQ ID NO: 774021 - DNA, 20 bp, Artificial
  CRISPR gRNA sequence
gatggggagtccttgaggga

SEQ ID NO: 774022 - DNA, 20 bp, Artificial
  CRISPR gRNA sequence
gagggaggaactttatcttc

SEQ ID NO: 774023 - DNA, 20 bp, Artificial
  CRISPR gRNA sequence
agggaggaactttatcttcc

SEQ ID NO: 774024 - DNA, 20 bp, Artificial
  CRISPR gRNA sequence
tatcttcccacgcagggccc

SEQ ID NO: 774025 - DNA, 20 bp, Artificial
  CRISPR gRNA sequence
atcttcccacgcagggcccc

SEQ ID NO: 774026 - DNA, 20 bp, Artificial
  CRISPR gRNA sequence
tcttcccacgcagggccccc

SEQ ID NO: 774027 - DNA, 20 bp, Artificial
  CRISPR gRNA sequence
cccacgcagggcccccagca

SEQ ID NO: 774028 - DNA, 20 bp, Artificial
  CRISPR gRNA sequence
ccacgcagggcccccagcac

SEQ ID NO: 774029 - DNA, 20 bp, Artificial
  CRISPR gRNA sequence
acacagtgctgacatctgta

SEQ ID NO: 774030 - DNA, 20 bp, Artificial
  CRISPR gRNA sequence
acatctgtagttgctcaata

SEQ ID NO: 774031 - DNA, 20 bp, Artificial
  CRISPR gRNA sequence
tagttgctcaataaacatca

SEQ ID NO: 774032 - DNA, 20 bp, Artificial
  CRISPR gRNA sequence
ctcaataaacatcaactgaa

SEQ ID NO: 774033 - DNA, 20 bp, Artificial
  CRISPR gRNA sequence
aataaacatcaactgaatgg

SEQ ID NO: 774034 - DNA, 20 bp, Artificial
  CRISPR gRNA sequence
aatggatacatgaaaagaaa

SEQ ID NO: 774035 - DNA, 20 bp, Artificial
  CRISPR gRNA sequence
acccccaggggccccatcac

SEQ ID NO: 774036 - DNA, 20 bp, Artificial
  CRISPR gRNA sequence
gagaaccagtgtgaccagca

SEQ ID NO: 774037 - DNA, 20 bp, Artificial
  CRISPR gRNA sequence
ccgtggggaggatgggcagg

SEQ ID NO: 774038 - DNA, 20 bp, Artificial
  CRISPR gRNA sequence
cgtggggaggatgggcaggg

SEQ ID NO: 774039 - DNA, 20 bp, Artificial
  CRISPR gRNA sequence
cagaggaggctgggccaggg

SEQ ID NO: 774040 - DNA, 20 bp, Artificial
  CRISPR gRNA sequence
ggccaggggggaaccacacg

SEQ ID NO: 774041 - DNA, 20 bp, Artificial
  CRISPR gRNA sequence
cagcacgtgcacctgcaggt

SEQ ID NO: 774042 - DNA, 20 bp, Artificial
  CRISPR gRNA sequence
caggtctccatgcacagctg

SEQ ID NO: 774043 - DNA, 20 bp, Artificial
  CRISPR gRNA sequence
catgcacagctgtgcatgtg

SEQ ID NO: 774044 - DNA, 20 bp, Artificial
  CRISPR gRNA sequence
tgcatgtggtgggcgcagag

SEQ ID NO: 774045 - DNA, 20 bp, Artificial
  CRISPR gRNA sequence
tcttcacttggggcagggag

SEQ ID NO: 774046 - DNA, 20 bp, Artificial
  CRISPR gRNA sequence
cacttggggcagggagggaa

SEQ ID NO: 774047 - DNA, 20 bp, Artificial
  CRISPR gRNA sequence
acttggggcagggagggaaa

SEQ ID NO: 774048 - DNA, 20 bp, Artificial
  CRISPR gRNA sequence
ggggcagggagggaaaaggc

SEQ ID NO: 774049 - DNA, 20 bp, Artificial
  CRISPR gRNA sequence
gggcagggagggaaaaggcc

SEQ ID NO: 774050 - DNA, 20 bp, Artificial
  CRISPR gRNA sequence
aggctagagcaagaggagga

SEQ ID NO: 774051 - DNA, 20 bp, Artificial
  CRISPR gRNA sequence
gagcaagaggaggaaggagg

SEQ ID NO: 774052 - DNA, 20 bp, Artificial
  CRISPR gRNA sequence
ctagactccaggagatgttg

SEQ ID NO: 774053 - DNA, 20 bp, Artificial
  CRISPR gRNA sequence
tagactccaggagatgttga

SEQ ID NO: 774054 - DNA, 20 bp, Artificial
  CRISPR gRNA sequence
gactccaggagatgttgagg

SEQ ID NO: 774055 - DNA, 20 bp, Artificial
  CRISPR gRNA sequence
caggagatgttgaggccgca

SEQ ID NO: 774056 - DNA, 20 bp, Artificial
  CRISPR gRNA sequence
aggccgcactgtccctgtct

SEQ ID NO: 774057 - DNA, 20 bp, Artificial
  CRISPR gRNA sequence
tccctgtctgagaagaaaag

SEQ ID NO: 774058 - DNA, 20 bp, Artificial
  CRISPR gRNA sequence
tctgagaagaaaagattcta

SEQ ID NO: 774059 - DNA, 20 bp, Artificial
  CRISPR gRNA sequence
agaagaaaagattctatgca

SEQ ID NO: 774060 - DNA, 20 bp, Artificial
  CRISPR gRNA sequence
tatgcaggtggaagcagggc

SEQ ID NO: 774061 - DNA, 20 bp, Artificial
  CRISPR gRNA sequence
tgcaggtggaagcagggctg

SEQ ID NO: 774062 - DNA, 20 bp, Artificial
  CRISPR gRNA sequence
aacatgatcactagtgtatc

SEQ ID NO: 774063 - DNA, 20 bp, Artificial
  CRISPR gRNA sequence
gtgtatcacggccattggag

SEQ ID NO: 774064 - DNA, 20 bp, Artificial
  CRISPR gRNA sequence
gagaaacaaggccggggtga

SEQ ID NO: 774065 - DNA, 20 bp, Artificial
  CRISPR gRNA sequence
tgcatcgtgtctttggtgaa

SEQ ID NO: 774066 - DNA, 20 bp, Artificial
  CRISPR gRNA sequence
tggtgaaataaggcaggggg

SEQ ID NO: 774067 - DNA, 20 bp, Artificial
  CRISPR gRNA sequence
ggtgaaataaggcagggggt

SEQ ID NO: 774068 - DNA, 20 bp, Artificial
  CRISPR gRNA sequence
gtgaaataaggcagggggtc

SEQ ID NO: 774069 - DNA, 20 bp, Artificial
  CRISPR gRNA sequence
aatattgcatcttttggaga

SEQ ID NO: 774070 - DNA, 20 bp, Artificial
  CRISPR gRNA sequence
catcttttggagaaaaaagg

SEQ ID NO: 774071 - DNA, 20 bp, Artificial
  CRISPR gRNA sequence
ttggagaaaaaaggcagcca

SEQ ID NO: 774072 - DNA, 20 bp, Artificial
  CRISPR gRNA sequence
tggagaaaaaaggcagccag

SEQ ID NO: 774073 - DNA, 20 bp, Artificial
  CRISPR gRNA sequence
ggagaaaaaaggcagccaga

SEQ ID NO: 774074 - DNA, 20 bp, Artificial
  CRISPR gRNA sequence
gagaaaaaaggcagccagat

SEQ ID NO: 774075 - DNA, 20 bp, Artificial
  CRISPR gRNA sequence
gaagaagagggtggtgatgt

SEQ ID NO: 774076 - DNA, 20 bp, Artificial
  CRISPR gRNA sequence
tgtccctaagaaatgtatgt

SEQ ID NO: 774077 - DNA, 20 bp, Artificial
  CRISPR gRNA sequence
agaaatgtatgtactgtgaa

SEQ ID NO: 774078 - DNA, 20 bp, Artificial
  CRISPR gRNA sequence
tgaaataaggcagcaggcag

SEQ ID NO: 774079 - DNA, 20 bp, Artificial
  CRISPR gRNA sequence
agagaactaaggttgtgggt

SEQ ID NO: 774080 - DNA, 20 bp, Artificial
  CRISPR gRNA sequence
gagaactaaggttgtgggtg

SEQ ID NO: 774081 - DNA, 20 bp, Artificial
  CRISPR gRNA sequence
aggttgtgggtggtctgttc

SEQ ID NO: 774082 - DNA, 20 bp, Artificial
  CRISPR gRNA sequence
tgggtggtctgttcattgtg

SEQ ID NO: 774083 - DNA, 20 bp, Artificial
  CRISPR gRNA sequence
ttcattgtgtctataagaaa

SEQ ID NO: 774084 - DNA, 20 bp, Artificial
  CRISPR gRNA sequence
attgtgtctataagaaaaaa

SEQ ID NO: 774085 - DNA, 20 bp, Artificial
  CRISPR gRNA sequence
tgtctataagaaaaaaggca

SEQ ID NO: 774086 - DNA, 20 bp, Artificial
  CRISPR gRNA sequence
taagaaaaaaggcagcagga

SEQ ID NO: 774087 - DNA, 20 bp, Artificial
  CRISPR gRNA sequence
gggaatcatgtccattggag

SEQ ID NO: 774088 - DNA, 20 bp, Artificial
  CRISPR gRNA sequence
ggaatcatgtccattggaga

SEQ ID NO: 774089 - DNA, 20 bp, Artificial
  CRISPR gRNA sequence
gagaaataaggctgcacagt

SEQ ID NO: 774090 - DNA, 20 bp, Artificial
  CRISPR gRNA sequence
cacagtggtctgtgtatcgc

SEQ ID NO: 774091 - DNA, 20 bp, Artificial
  CRISPR gRNA sequence
tgtatcgcatcctttggaga

SEQ ID NO: 774092 - DNA, 20 bp, Artificial
  CRISPR gRNA sequence
tggagaaggagcccacctgt

SEQ ID NO: 774093 - DNA, 20 bp, Artificial
  CRISPR gRNA sequence
ggagaaggagcccacctgtc

SEQ ID NO: 774094 - DNA, 20 bp, Artificial
  CRISPR gRNA sequence
gagaaggagcccacctgtca

SEQ ID NO: 774095 - DNA, 20 bp, Artificial
  CRISPR gRNA sequence
tcagagcaggatgcatctgt

SEQ ID NO: 774096 - DNA, 20 bp, Artificial
  CRISPR gRNA sequence
ttgggggcagggctcacagt

SEQ ID NO: 774097 - DNA, 20 bp, Artificial
  CRISPR gRNA sequence
ggggcagggctcacagtgca

SEQ ID NO: 774098 - DNA, 20 bp, Artificial
  CRISPR gRNA sequence
acagtgcagccccattgcag

SEQ ID NO: 774099 - DNA, 20 bp, Artificial
  CRISPR gRNA sequence
cagccagagggtaggagctg

SEQ ID NO: 774100 - DNA, 20 bp, Artificial
  CRISPR gRNA sequence
tagggaggggtagcagctcc

SEQ ID NO: 774101 - DNA, 20 bp, Artificial
  CRISPR gRNA sequence
cctggtcctcatggtcaggc

SEQ ID NO: 774102 - DNA, 20 bp, Artificial
  CRISPR gRNA sequence
gtcctcatggtcaggctatt

SEQ ID NO: 774103 - DNA, 20 bp, Artificial
  CRISPR gRNA sequence
atggtcaggctatttcttgt

SEQ ID NO: 774104 - DNA, 20 bp, Artificial
  CRISPR gRNA sequence
tttcttgtccatcatcttca

SEQ ID NO: 774105 - DNA, 20 bp, Artificial
  CRISPR gRNA sequence
cttgtccatcatcttcattt

SEQ ID NO: 774106 - DNA, 20 bp, Artificial
  CRISPR gRNA sequence
ttgtccatcatcttcatttc

SEQ ID NO: 774107 - DNA, 20 bp, Artificial
  CRISPR gRNA sequence
gtccatcatcttcatttcat

SEQ ID NO: 774108 - DNA, 20 bp, Artificial
  CRISPR gRNA sequence
tccatcatcttcatttcatg

SEQ ID NO: 774109 - DNA, 20 bp, Artificial
  CRISPR gRNA sequence
catttcatgatgggaagaaa

SEQ ID NO: 774110 - DNA, 20 bp, Artificial
  CRISPR gRNA sequence
atttcatgatgggaagaaaa

SEQ ID NO: 774111 - DNA, 20 bp, Artificial
  CRISPR gRNA sequence
catgatgggaagaaaaaaaa

SEQ ID NO: 774112 - DNA, 20 bp, Artificial
  CRISPR gRNA sequence
atgatgggaagaaaaaaaag

SEQ ID NO: 774113 - DNA, 20 bp, Artificial
  CRISPR gRNA sequence
gatgccagaagatctatttt

SEQ ID NO: 774114 - DNA, 20 bp, Artificial
  CRISPR gRNA sequence
tttttgggattatgccagaa

SEQ ID NO: 774115 - DNA, 20 bp, Artificial
  CRISPR gRNA sequence
ttgggattatgccagaagcc

SEQ ID NO: 774116 - DNA, 20 bp, Artificial
  CRISPR gRNA sequence
tgggattatgccagaagccc

SEQ ID NO: 774117 - DNA, 20 bp, Artificial
  CRISPR gRNA sequence
gggattatgccagaagccca

SEQ ID NO: 774118 - DNA, 20 bp, Artificial
  CRISPR gRNA sequence
ggattatgccagaagcccaa

SEQ ID NO: 774119 - DNA, 20 bp, Artificial
  CRISPR gRNA sequence
tgccagaagcccaagcacct

SEQ ID NO: 774120 - DNA, 20 bp, Artificial
  CRISPR gRNA sequence
gtcagacttcaagtggggag

SEQ ID NO: 774121 - DNA, 20 bp, Artificial
  CRISPR gRNA sequence
caagtggggagtgtgtgtga

SEQ ID NO: 774122 - DNA, 20 bp, Artificial
  CRISPR gRNA sequence
aagtggggagtgtgtgtgag

SEQ ID NO: 774123 - DNA, 20 bp, Artificial
  CRISPR gRNA sequence
accacggccctggaggccca

SEQ ID NO: 774124 - DNA, 20 bp, Artificial
  CRISPR gRNA sequence
gaggcccagacacagatgca

SEQ ID NO: 774125 - DNA, 20 bp, Artificial
  CRISPR gRNA sequence
agggggaccacctcacgcag

SEQ ID NO: 774126 - DNA, 20 bp, Artificial
  CRISPR gRNA sequence
acgcagccccctctcagtac

SEQ ID NO: 774127 - DNA, 20 bp, Artificial
  CRISPR gRNA sequence
tcagtacccacaggcccaca

SEQ ID NO: 774128 - DNA, 20 bp, Artificial
  CRISPR gRNA sequence
agtacccacaggcccacagc

SEQ ID NO: 774129 - DNA, 20 bp, Artificial
  CRISPR gRNA sequence
ccctccactctccctctacg

SEQ ID NO: 774130 - DNA, 20 bp, Artificial
  CRISPR gRNA sequence
cctccactctccctctacgt

SEQ ID NO: 774131 - DNA, 20 bp, Artificial
  CRISPR gRNA sequence
cactctccctctacgtgcaa

SEQ ID NO: 774132 - DNA, 20 bp, Artificial
  CRISPR gRNA sequence
tccctctacgtgcaacactt

SEQ ID NO: 774133 - DNA, 20 bp, Artificial
  CRISPR gRNA sequence
cctctacgtgcaacactttt

SEQ ID NO: 774134 - DNA, 20 bp, Artificial
  CRISPR gRNA sequence
tacgtgcaacacttttccct

SEQ ID NO: 774135 - DNA, 20 bp, Artificial
  CRISPR gRNA sequence
cgtgcaacacttttcccttc

SEQ ID NO: 774136 - DNA, 20 bp, Artificial
  CRISPR gRNA sequence
ttcccttctcatctcctgtt

SEQ ID NO: 774137 - DNA, 20 bp, Artificial
  CRISPR gRNA sequence
tcccttctcatctcctgttt

SEQ ID NO: 774138 - DNA, 20 bp, Artificial
  CRISPR gRNA sequence
cccttctcatctcctgtttg

SEQ ID NO: 774139 - DNA, 20 bp, Artificial
  CRISPR gRNA sequence
ccttctcatctcctgtttgt

SEQ ID NO: 774140 - DNA, 20 bp, Artificial
  CRISPR gRNA sequence
ctcatctcctgtttgtccat

SEQ ID NO: 774141 - DNA, 20 bp, Artificial
  CRISPR gRNA sequence
tcatctcctgtttgtccatc

SEQ ID NO: 774142 - DNA, 20 bp, Artificial
  CRISPR gRNA sequence
atctcctgtttgtccatccc

SEQ ID NO: 774143 - DNA, 20 bp, Artificial
  CRISPR gRNA sequence
ctgtttgtccatcccatcca

SEQ ID NO: 774144 - DNA, 20 bp, Artificial
  CRISPR gRNA sequence
tttgtccatcccatccaccc

SEQ ID NO: 774145 - DNA, 20 bp, Artificial
  CRISPR gRNA sequence
gtccatcccatccaccctcc

SEQ ID NO: 774146 - DNA, 20 bp, Artificial
  CRISPR gRNA sequence
tccatcccatccaccctcca

SEQ ID NO: 774147 - DNA, 20 bp, Artificial
  CRISPR gRNA sequence
caaggcctggcccaactccc

SEQ ID NO: 774148 - DNA, 20 bp, Artificial
  CRISPR gRNA sequence
gcccaactccctcgtccagc

SEQ ID NO: 774149 - DNA, 20 bp, Artificial
  CRISPR gRNA sequence
cctcgtccagcaggcagcct

SEQ ID NO: 774150 - DNA, 20 bp, Artificial
  CRISPR gRNA sequence
gtccagcaggcagccttccc

SEQ ID NO: 774151 - DNA, 20 bp, Artificial
  CRISPR gRNA sequence
cccagtgtcccctccacact

SEQ ID NO: 774152 - DNA, 20 bp, Artificial
  CRISPR gRNA sequence
ccagtgtcccctccacactg

SEQ ID NO: 774153 - DNA, 20 bp, Artificial
  CRISPR gRNA sequence
cacactggtttccctgagag

SEQ ID NO: 774154 - DNA, 20 bp, Artificial
  CRISPR gRNA sequence
gtttccctgagagtgacacg

SEQ ID NO: 774155 - DNA, 20 bp, Artificial
  CRISPR gRNA sequence
ccctgagagtgacacggcag

SEQ ID NO: 774156 - DNA, 20 bp, Artificial
  CRISPR gRNA sequence
cctgagagtgacacggcagg

SEQ ID NO: 774157 - DNA, 20 bp, Artificial
  CRISPR gRNA sequence
agagtgacacggcaggggcc

SEQ ID NO: 774158 - DNA, 20 bp, Artificial
  CRISPR gRNA sequence
ctccttcccttgggcttcct

SEQ ID NO: 774159 - DNA, 20 bp, Artificial
  CRISPR gRNA sequence
cttcccttgggcttcctgtc

SEQ ID NO: 774160 - DNA, 20 bp, Artificial
  CRISPR gRNA sequence
cccttgggcttcctgtctcc

SEQ ID NO: 774161 - DNA, 20 bp, Artificial
  CRISPR gRNA sequence
ccttgggcttcctgtctcca

SEQ ID NO: 774162 - DNA, 20 bp, Artificial
  CRISPR gRNA sequence
gggcttcctgtctccatgtg

SEQ ID NO: 774163 - DNA, 20 bp, Artificial
  CRISPR gRNA sequence
ggcttcctgtctccatgtgg

SEQ ID NO: 774164 - DNA, 20 bp, Artificial
  CRISPR gRNA sequence
cctgtctccatgtggagggc

SEQ ID NO: 774165 - DNA, 20 bp, Artificial
  CRISPR gRNA sequence
ctgtctccatgtggagggcc

SEQ ID NO: 774166 - DNA, 20 bp, Artificial
  CRISPR gRNA sequence
tctccatgtggagggccatc

SEQ ID NO: 774167 - DNA, 20 bp, Artificial
  CRISPR gRNA sequence
catgtggagggccatcccaa

SEQ ID NO: 774168 - DNA, 20 bp, Artificial
  CRISPR gRNA sequence
atctttcagaccccactctg

SEQ ID NO: 774169 - DNA, 20 bp, Artificial
  CRISPR gRNA sequence
tcagaccccactctgcatct

SEQ ID NO: 774170 - DNA, 20 bp, Artificial
  CRISPR gRNA sequence
cagaccccactctgcatctg

SEQ ID NO: 774171 - DNA, 20 bp, Artificial
  CRISPR gRNA sequence
agaccccactctgcatctga

SEQ ID NO: 774172 - DNA, 20 bp, Artificial
  CRISPR gRNA sequence
tgcatctgaagctgaatgga

SEQ ID NO: 774173 - DNA, 20 bp, Artificial
  CRISPR gRNA sequence
catctgaagctgaatggaga

SEQ ID NO: 774174 - DNA, 20 bp, Artificial
  CRISPR gRNA sequence
aagctgaatggagacttggg

SEQ ID NO: 774175 - DNA, 20 bp, Artificial
  CRISPR gRNA sequence
aatggagacttgggaagaag

SEQ ID NO: 774176 - DNA, 20 bp, Artificial
  CRISPR gRNA sequence
gggaagaagggcttgggccc

SEQ ID NO: 774177 - DNA, 20 bp, Artificial
  CRISPR gRNA sequence
ggaagaagggcttgggccct

SEQ ID NO: 774178 - DNA, 20 bp, Artificial
  CRISPR gRNA sequence
gggcccttcccctgccctct

SEQ ID NO: 774179 - DNA, 20 bp, Artificial
  CRISPR gRNA sequence
ggcccttcccctgccctctc

SEQ ID NO: 774180 - DNA, 20 bp, Artificial
  CRISPR gRNA sequence
cccctgccctctccctcacc

SEQ ID NO: 774181 - DNA, 20 bp, Artificial
  CRISPR gRNA sequence
ccctgccctctccctcaccc

SEQ ID NO: 774182 - DNA, 20 bp, Artificial
  CRISPR gRNA sequence
ccctctccctcacccattct

SEQ ID NO: 774183 - DNA, 20 bp, Artificial
  CRISPR gRNA sequence
tccctcacccattcttgggg

SEQ ID NO: 774184 - DNA, 20 bp, Artificial
  CRISPR gRNA sequence
cctcacccattcttggggct

SEQ ID NO: 774185 - DNA, 20 bp, Artificial
  CRISPR gRNA sequence
acccattcttggggctctgt

SEQ ID NO: 774186 - DNA, 20 bp, Artificial
  CRISPR gRNA sequence
ttggggctctgtatgtccct

SEQ ID NO: 774187 - DNA, 20 bp, Artificial
  CRISPR gRNA sequence
ggggctctgtatgtccctgg

SEQ ID NO: 774188 - DNA, 20 bp, Artificial
  CRISPR gRNA sequence
gggctctgtatgtccctggg

SEQ ID NO: 774189 - DNA, 20 bp, Artificial
  CRISPR gRNA sequence
tgtatgtccctggggagagg

SEQ ID NO: 774190 - DNA, 20 bp, Artificial
  CRISPR gRNA sequence
tatgtccctggggagaggag

SEQ ID NO: 774191 - DNA, 20 bp, Artificial
  CRISPR gRNA sequence
gggagaggagaagagctccc

SEQ ID NO: 774192 - DNA, 20 bp, Artificial
  CRISPR gRNA sequence
ccccatctgggcactgcctc

SEQ ID NO: 774193 - DNA, 20 bp, Artificial
  CRISPR gRNA sequence
ggcactgcctctgtggttgt

SEQ ID NO: 774194 - DNA, 20 bp, Artificial
  CRISPR gRNA sequence
cctctgtggttgtccagcat

SEQ ID NO: 774195 - DNA, 20 bp, Artificial
  CRISPR gRNA sequence
tgtggttgtccagcatggcc

SEQ ID NO: 774196 - DNA, 20 bp, Artificial
  CRISPR gRNA sequence
tggttgtccagcatggccag

SEQ ID NO: 774197 - DNA, 20 bp, Artificial
  CRISPR gRNA sequence
tccagcatggccagagactg

SEQ ID NO: 774198 - DNA, 20 bp, Artificial
  CRISPR gRNA sequence
agggggcaggctgcctcacc

SEQ ID NO: 774199 - DNA, 20 bp, Artificial
  CRISPR gRNA sequence
cctcaccaaggagcagggtt

SEQ ID NO: 774200 - DNA, 20 bp, Artificial
  CRISPR gRNA sequence
accaaggagcagggttagga

SEQ ID NO: 774201 - DNA, 20 bp, Artificial
  CRISPR gRNA sequence
ggaagcaaactggtttgccc

SEQ ID NO: 774202 - DNA, 20 bp, Artificial
  CRISPR gRNA sequence
gtttgcccatccaggccaca

SEQ ID NO: 774203 - DNA, 20 bp, Artificial
  CRISPR gRNA sequence
gcccatccaggccacattct

SEQ ID NO: 774204 - DNA, 20 bp, Artificial
  CRISPR gRNA sequence
cccatccaggccacattctc

SEQ ID NO: 774205 - DNA, 20 bp, Artificial
  CRISPR gRNA sequence
tccagcaactcttcaaaacc

SEQ ID NO: 774206 - DNA, 20 bp, Artificial
  CRISPR gRNA sequence
cagcaactcttcaaaaccaa

SEQ ID NO: 774207 - DNA, 20 bp, Artificial
  CRISPR gRNA sequence
ttcaaaaccaagctgacttt

SEQ ID NO: 774208 - DNA, 20 bp, Artificial
  CRISPR gRNA sequence
caaaaccaagctgacttttt

SEQ ID NO: 774209 - DNA, 20 bp, Artificial
  CRISPR gRNA sequence
aaaaccaagctgactttttt

SEQ ID NO: 774210 - DNA, 20 bp, Artificial
  CRISPR gRNA sequence
actttttttttttttttttt

SEQ ID NO: 774211 - DNA, 20 bp, Artificial
  CRISPR gRNA sequence
ttttttttttttttttttga

SEQ ID NO: 774212 - DNA, 20 bp, Artificial
  CRISPR gRNA sequence
tttttttttttttttttgag

SEQ ID NO: 774213 - DNA, 20 bp, Artificial
  CRISPR gRNA sequence
ttttttttttttttttgaga

SEQ ID NO: 774214 - DNA, 20 bp, Artificial
  CRISPR gRNA sequence
tttttttttttttttgagat

SEQ ID NO: 774215 - DNA, 20 bp, Artificial
  CRISPR gRNA sequence
ttttttttttttttgagatg

SEQ ID NO: 774216 - DNA, 20 bp, Artificial
  CRISPR gRNA sequence
tttttttttttttgagatgg

SEQ ID NO: 774217 - DNA, 20 bp, Artificial
  CRISPR gRNA sequence
ttttttttttttgagatgga

SEQ ID NO: 774218 - DNA, 20 bp, Artificial
  CRISPR gRNA sequence
tttttttttttgagatggaa

SEQ ID NO: 774219 - DNA, 20 bp, Artificial
  CRISPR gRNA sequence
ttttttttttgagatggaat

SEQ ID NO: 774220 - DNA, 20 bp, Artificial
  CRISPR gRNA sequence
tttttttttgagatggaatc

SEQ ID NO: 774221 - DNA, 20 bp, Artificial
  CRISPR gRNA sequence
ttttttttgagatggaatct

SEQ ID NO: 774222 - DNA, 20 bp, Artificial
  CRISPR gRNA sequence
tttttttgagatggaatctt

SEQ ID NO: 774223 - DNA, 20 bp, Artificial
  CRISPR gRNA sequence
ttttttgagatggaatcttg

SEQ ID NO: 774224 - DNA, 20 bp, Artificial
  CRISPR gRNA sequence
tttttgagatggaatcttgc

SEQ ID NO: 774225 - DNA, 20 bp, Artificial
  CRISPR gRNA sequence
ttttgagatggaatcttgct

SEQ ID NO: 774226 - DNA, 20 bp, Artificial
  CRISPR gRNA sequence
tttgagatggaatcttgctc

SEQ ID NO: 774227 - DNA, 20 bp, Artificial
  CRISPR gRNA sequence
ttgagatggaatcttgctct

SEQ ID NO: 774228 - DNA, 20 bp, Artificial
  CRISPR gRNA sequence
tgagatggaatcttgctctg

SEQ ID NO: 774229 - DNA, 20 bp, Artificial
  CRISPR gRNA sequence
gagatggaatcttgctctgt

SEQ ID NO: 774230 - DNA, 20 bp, Artificial
  CRISPR gRNA sequence
agatggaatcttgctctgtt

SEQ ID NO: 774231 - DNA, 20 bp, Artificial
  CRISPR gRNA sequence
gctctgttgcccaggctgga

SEQ ID NO: 774232 - DNA, 20 bp, Artificial
  CRISPR gRNA sequence
ctctgttgcccaggctggag

SEQ ID NO: 774233 - DNA, 20 bp, Artificial
  CRISPR gRNA sequence
tgttgcccaggctggagtgc

SEQ ID NO: 774234 - DNA, 20 bp, Artificial
  CRISPR gRNA sequence
ttgcccaggctggagtgcac

SEQ ID NO: 774235 - DNA, 20 bp, Artificial
  CRISPR gRNA sequence
cccaggctggagtgcacagg

SEQ ID NO: 774236 - DNA, 20 bp, Artificial
  CRISPR gRNA sequence
gagtgcacaggtgcaatctc

SEQ ID NO: 774237 - DNA, 20 bp, Artificial
  CRISPR gRNA sequence
agttcactgcaacctctgcc

SEQ ID NO: 774238 - DNA, 20 bp, Artificial
  CRISPR gRNA sequence
actgcaacctctgcctccca

SEQ ID NO: 774239 - DNA, 20 bp, Artificial
  CRISPR gRNA sequence
caacctctgcctcccaggtt

SEQ ID NO: 774240 - DNA, 20 bp, Artificial
  CRISPR gRNA sequence
tgcctcccaggttcaagtga

SEQ ID NO: 774241 - DNA, 20 bp, Artificial
  CRISPR gRNA sequence
cctcccaggttcaagtgatt

SEQ ID NO: 774242 - DNA, 20 bp, Artificial
  CRISPR gRNA sequence
ccaggttcaagtgattctcc

SEQ ID NO: 774243 - DNA, 20 bp, Artificial
  CRISPR gRNA sequence
aagtgattctcccgcctcag

SEQ ID NO: 774244 - DNA, 20 bp, Artificial
  CRISPR gRNA sequence
tcccgcctcagcttcccaag

SEQ ID NO: 774245 - DNA, 20 bp, Artificial
  CRISPR gRNA sequence
ccgcctcagcttcccaagta

SEQ ID NO: 774246 - DNA, 20 bp, Artificial
  CRISPR gRNA sequence
agcttcccaagtagctggga

SEQ ID NO: 774247 - DNA, 20 bp, Artificial
  CRISPR gRNA sequence
cccaagtagctgggattaca

SEQ ID NO: 774248 - DNA, 20 bp, Artificial
  CRISPR gRNA sequence
ccaagtagctgggattacag

SEQ ID NO: 774249 - DNA, 20 bp, Artificial
  CRISPR gRNA sequence
ggattacaggcatgcaccac

SEQ ID NO: 774250 - DNA, 20 bp, Artificial
  CRISPR gRNA sequence
caggcatgcaccaccacgcc

SEQ ID NO: 774251 - DNA, 20 bp, Artificial
  CRISPR gRNA sequence
agttttgtatttttagtaga

SEQ ID NO: 774252 - DNA, 20 bp, Artificial
  CRISPR gRNA sequence
tgtatttttagtagagacag

SEQ ID NO: 774253 - DNA, 20 bp, Artificial
  CRISPR gRNA sequence
gtatttttagtagagacagg

SEQ ID NO: 774254 - DNA, 20 bp, Artificial
  CRISPR gRNA sequence
tatttttagtagagacaggg

SEQ ID NO: 774255 - DNA, 20 bp, Artificial
  CRISPR gRNA sequence
ttagtagagacagggtttca

SEQ ID NO: 774256 - DNA, 20 bp, Artificial
  CRISPR gRNA sequence
tagtagagacagggtttcac

SEQ ID NO: 774257 - DNA, 20 bp, Artificial
  CRISPR gRNA sequence
agtagagacagggtttcacc

SEQ ID NO: 774258 - DNA, 20 bp, Artificial
  CRISPR gRNA sequence
gtagagacagggtttcacca

SEQ ID NO: 774259 - DNA, 20 bp, Artificial
  CRISPR gRNA sequence
caccatgttggccaggctgg

SEQ ID NO: 774260 - DNA, 20 bp, Artificial
  CRISPR gRNA sequence
accatgttggccaggctggt

SEQ ID NO: 774261 - DNA, 20 bp, Artificial
  CRISPR gRNA sequence
gccaggctggtctcaaactc

SEQ ID NO: 774262 - DNA, 20 bp, Artificial
  CRISPR gRNA sequence
gtctcaaactcctgacctca

SEQ ID NO: 774263 - DNA, 20 bp, Artificial
  CRISPR gRNA sequence
aaactcctgacctcaagtga

SEQ ID NO: 774264 - DNA, 20 bp, Artificial
  CRISPR gRNA sequence
ctgacctcaagtgatccacc

SEQ ID NO: 774265 - DNA, 20 bp, Artificial
  CRISPR gRNA sequence
acctcaagtgatccacccac

SEQ ID NO: 774266 - DNA, 20 bp, Artificial
  CRISPR gRNA sequence
aagtgatccacccacctcgg

SEQ ID NO: 774267 - DNA, 20 bp, Artificial
  CRISPR gRNA sequence
ggcctcccaaagtgctgaga

SEQ ID NO: 774268 - DNA, 20 bp, Artificial
  CRISPR gRNA sequence
ccaaagtgctgagattacag

SEQ ID NO: 774269 - DNA, 20 bp, Artificial
  CRISPR gRNA sequence
agattacaggtgtgaagtac

SEQ ID NO: 774270 - DNA, 20 bp, Artificial
  CRISPR gRNA sequence
caggtgtgaagtaccatgcc

SEQ ID NO: 774271 - DNA, 20 bp, Artificial
  CRISPR gRNA sequence
gcctaagctgacacttttta

SEQ ID NO: 774272 - DNA, 20 bp, Artificial
  CRISPR gRNA sequence
agctgacactttttatctcc

SEQ ID NO: 774273 - DNA, 20 bp, Artificial
  CRISPR gRNA sequence
acactttttatctccatctg

SEQ ID NO: 774274 - DNA, 20 bp, Artificial
  CRISPR gRNA sequence
tttatctccatctgcccagc

SEQ ID NO: 774275 - DNA, 20 bp, Artificial
  CRISPR gRNA sequence
ttatctccatctgcccagct

SEQ ID NO: 774276 - DNA, 20 bp, Artificial
  CRISPR gRNA sequence
tatctccatctgcccagctc

SEQ ID NO: 774277 - DNA, 20 bp, Artificial
  CRISPR gRNA sequence
atctccatctgcccagctct

SEQ ID NO: 774278 - DNA, 20 bp, Artificial
  CRISPR gRNA sequence
tctccatctgcccagctctt

SEQ ID NO: 774279 - DNA, 20 bp, Artificial
  CRISPR gRNA sequence
catctgcccagctcttctat

SEQ ID NO: 774280 - DNA, 20 bp, Artificial
  CRISPR gRNA sequence
cccagctcttctatggttat

SEQ ID NO: 774281 - DNA, 20 bp, Artificial
  CRISPR gRNA sequence
ttctatggttatttgattct

SEQ ID NO: 774282 - DNA, 20 bp, Artificial
  CRISPR gRNA sequence
ctatggttatttgattctga

SEQ ID NO: 774283 - DNA, 20 bp, Artificial
  CRISPR gRNA sequence
tatggttatttgattctgaa

SEQ ID NO: 774284 - DNA, 20 bp, Artificial
  CRISPR gRNA sequence
tggttatttgattctgaaaa

SEQ ID NO: 774285 - DNA, 20 bp, Artificial
  CRISPR gRNA sequence
tttgattctgaaaaacagga

SEQ ID NO: 774286 - DNA, 20 bp, Artificial
  CRISPR gRNA sequence
gattctgaaaaacaggaagg

SEQ ID NO: 774287 - DNA, 20 bp, Artificial
  CRISPR gRNA sequence
attctgaaaaacaggaagga

SEQ ID NO: 774288 - DNA, 20 bp, Artificial
  CRISPR gRNA sequence
tgaaaaacaggaaggaaatg

SEQ ID NO: 774289 - DNA, 20 bp, Artificial
  CRISPR gRNA sequence
aaaaacaggaaggaaatgac

SEQ ID NO: 774290 - DNA, 20 bp, Artificial
  CRISPR gRNA sequence
tctcctgtatttccaaatgt

SEQ ID NO: 774291 - DNA, 20 bp, Artificial
  CRISPR gRNA sequence
ctgtatttccaaatgtcatc

SEQ ID NO: 774292 - DNA, 20 bp, Artificial
  CRISPR gRNA sequence
tatttccaaatgtcatcact

SEQ ID NO: 774293 - DNA, 20 bp, Artificial
  CRISPR gRNA sequence
ccaaatgtcatcactgacat

SEQ ID NO: 774294 - DNA, 20 bp, Artificial
  CRISPR gRNA sequence
caaatgtcatcactgacatt

SEQ ID NO: 774295 - DNA, 20 bp, Artificial
  CRISPR gRNA sequence
acattataacaataggccca

SEQ ID NO: 774296 - DNA, 20 bp, Artificial
  CRISPR gRNA sequence
taacaataggcccaataatg

SEQ ID NO: 774297 - DNA, 20 bp, Artificial
  CRISPR gRNA sequence
tggacatttactaaccaccc

SEQ ID NO: 774298 - DNA, 20 bp, Artificial
  CRISPR gRNA sequence
actaaccacccactgtgcgc

SEQ ID NO: 774299 - DNA, 20 bp, Artificial
  CRISPR gRNA sequence
ctaaccacccactgtgcgcc

SEQ ID NO: 774300 - DNA, 20 bp, Artificial
  CRISPR gRNA sequence
accacccactgtgcgccagg

SEQ ID NO: 774301 - DNA, 20 bp, Artificial
  CRISPR gRNA sequence
tgcgccagggacatggctac

SEQ ID NO: 774302 - DNA, 20 bp, Artificial
  CRISPR gRNA sequence
cccagctgaacacttttcta

SEQ ID NO: 774303 - DNA, 20 bp, Artificial
  CRISPR gRNA sequence
aacacttttctagcctcccc

SEQ ID NO: 774304 - DNA, 20 bp, Artificial
  CRISPR gRNA sequence
ttctagcctcccctgagtta

SEQ ID NO: 774305 - DNA, 20 bp, Artificial
  CRISPR gRNA sequence
tctagcctcccctgagttag

SEQ ID NO: 774306 - DNA, 20 bp, Artificial
  CRISPR gRNA sequence
ctagcctcccctgagttagg

SEQ ID NO: 774307 - DNA, 20 bp, Artificial
  CRISPR gRNA sequence
tagcctcccctgagttaggg

SEQ ID NO: 774308 - DNA, 20 bp, Artificial
  CRISPR gRNA sequence
gcctcccctgagttagggct

SEQ ID NO: 774309 - DNA, 20 bp, Artificial
  CRISPR gRNA sequence
ccctgagttagggctcatat

SEQ ID NO: 774310 - DNA, 20 bp, Artificial
  CRISPR gRNA sequence
agttagggctcatatgcctg

SEQ ID NO: 774311 - DNA, 20 bp, Artificial
  CRISPR gRNA sequence
gggctcatatgcctgggttc

SEQ ID NO: 774312 - DNA, 20 bp, Artificial
  CRISPR gRNA sequence
atatgcctgggttctgacca

SEQ ID NO: 774313 - DNA, 20 bp, Artificial
  CRISPR gRNA sequence
ggttctgaccaatggaatgt

SEQ ID NO: 774314 - DNA, 20 bp, Artificial
  CRISPR gRNA sequence
tgaccaatggaatgtaagcg

SEQ ID NO: 774315 - DNA, 20 bp, Artificial
  CRISPR gRNA sequence
accaatggaatgtaagcgga

SEQ ID NO: 774316 - DNA, 20 bp, Artificial
  CRISPR gRNA sequence
cttccactcaagctctagaa

SEQ ID NO: 774317 - DNA, 20 bp, Artificial
  CRISPR gRNA sequence
ccactcaagctctagaagga

SEQ ID NO: 774318 - DNA, 20 bp, Artificial
  CRISPR gRNA sequence
cactcaagctctagaaggaa

SEQ ID NO: 774319 - DNA, 20 bp, Artificial
  CRISPR gRNA sequence
aagctctagaaggaaacata

SEQ ID NO: 774320 - DNA, 20 bp, Artificial
  CRISPR gRNA sequence
tagaaggaaacatatccttc

SEQ ID NO: 774321 - DNA, 20 bp, Artificial
  CRISPR gRNA sequence
gaaggaaacatatccttcct

SEQ ID NO: 774322 - DNA, 20 bp, Artificial
  CRISPR gRNA sequence
cctttctctccctcttggct

SEQ ID NO: 774323 - DNA, 20 bp, Artificial
  CRISPR gRNA sequence
ctttctctccctcttggctc

SEQ ID NO: 774324 - DNA, 20 bp, Artificial
  CRISPR gRNA sequence
tctctccctcttggctctgg

SEQ ID NO: 774325 - DNA, 20 bp, Artificial
  CRISPR gRNA sequence
ctctccctcttggctctgga

SEQ ID NO: 774326 - DNA, 20 bp, Artificial
  CRISPR gRNA sequence
tctccctcttggctctggag

SEQ ID NO: 774327 - DNA, 20 bp, Artificial
  CRISPR gRNA sequence
tccctcttggctctggaggg

SEQ ID NO: 774328 - DNA, 20 bp, Artificial
  CRISPR gRNA sequence
cctcttggctctggaggggg

SEQ ID NO: 774329 - DNA, 20 bp, Artificial
  CRISPR gRNA sequence
ttggctctggagggggcgtg

SEQ ID NO: 774330 - DNA, 20 bp, Artificial
  CRISPR gRNA sequence
ggctctggagggggcgtggg

SEQ ID NO: 774331 - DNA, 20 bp, Artificial
  CRISPR gRNA sequence
gctctggagggggcgtggga

SEQ ID NO: 774332 - DNA, 20 bp, Artificial
  CRISPR gRNA sequence
tggagggggcgtgggagcac

SEQ ID NO: 774333 - DNA, 20 bp, Artificial
  CRISPR gRNA sequence
gagggggcgtgggagcacaa

SEQ ID NO: 774334 - DNA, 20 bp, Artificial
  CRISPR gRNA sequence
ttagacctaggagtgaaagc

SEQ ID NO: 774335 - DNA, 20 bp, Artificial
  CRISPR gRNA sequence
agacctaggagtgaaagctt

SEQ ID NO: 774336 - DNA, 20 bp, Artificial
  CRISPR gRNA sequence
gacctaggagtgaaagcttg

SEQ ID NO: 774337 - DNA, 20 bp, Artificial
  CRISPR gRNA sequence
ggagtgaaagcttgaagttg

SEQ ID NO: 774338 - DNA, 20 bp, Artificial
  CRISPR gRNA sequence
gaagttgaagagggcagaat

SEQ ID NO: 774339 - DNA, 20 bp, Artificial
  CRISPR gRNA sequence
aagttgaagagggcagaatc

SEQ ID NO: 774340 - DNA, 20 bp, Artificial
  CRISPR gRNA sequence
aagagggcagaatccaggta

SEQ ID NO: 774341 - DNA, 20 bp, Artificial
  CRISPR gRNA sequence
gctccaggtcatcagtggtt

SEQ ID NO: 774342 - DNA, 20 bp, Artificial
  CRISPR gRNA sequence
caggtcatcagtggttttac

SEQ ID NO: 774343 - DNA, 20 bp, Artificial
  CRISPR gRNA sequence
tacgattacctatgctcaca

SEQ ID NO: 774344 - DNA, 20 bp, Artificial
  CRISPR gRNA sequence
acgattacctatgctcacac

SEQ ID NO: 774345 - DNA, 20 bp, Artificial
  CRISPR gRNA sequence
cgattacctatgctcacact

SEQ ID NO: 774346 - DNA, 20 bp, Artificial
  CRISPR gRNA sequence
cctatgctcacactatcaca

SEQ ID NO: 774347 - DNA, 20 bp, Artificial
  CRISPR gRNA sequence
tgctcacactatcacaggaa

SEQ ID NO: 774348 - DNA, 20 bp, Artificial
  CRISPR gRNA sequence
acactatcacaggaaggagg

SEQ ID NO: 774349 - DNA, 20 bp, Artificial
  CRISPR gRNA sequence
tcacaggaaggaggaataaa

SEQ ID NO: 774350 - DNA, 20 bp, Artificial
  CRISPR gRNA sequence
ctgtcctgcttaagcctctg

SEQ ID NO: 774351 - DNA, 20 bp, Artificial
  CRISPR gRNA sequence
tcctgcttaagcctctgtcg

SEQ ID NO: 774352 - DNA, 20 bp, Artificial
  CRISPR gRNA sequence
cttaagcctctgtcgtattt

SEQ ID NO: 774353 - DNA, 20 bp, Artificial
  CRISPR gRNA sequence
aagcctctgtcgtatttggg

SEQ ID NO: 774354 - DNA, 20 bp, Artificial
  CRISPR gRNA sequence
agcctctgtcgtatttgggt

SEQ ID NO: 774355 - DNA, 20 bp, Artificial
  CRISPR gRNA sequence
tgtcgtatttgggtcccatc

SEQ ID NO: 774356 - DNA, 20 bp, Artificial
  CRISPR gRNA sequence
tcgtatttgggtcccatcag

SEQ ID NO: 774357 - DNA, 20 bp, Artificial
  CRISPR gRNA sequence
gggtcccatcagagcagctg

SEQ ID NO: 774358 - DNA, 20 bp, Artificial
  CRISPR gRNA sequence
ggtcccatcagagcagctgg

SEQ ID NO: 774359 - DNA, 20 bp, Artificial
  CRISPR gRNA sequence
ggaccttggttactcagccc

SEQ ID NO: 774360 - DNA, 20 bp, Artificial
  CRISPR gRNA sequence
ggttactcagccctctgcca

SEQ ID NO: 774361 - DNA, 20 bp, Artificial
  CRISPR gRNA sequence
gttactcagccctctgccat

SEQ ID NO: 774362 - DNA, 20 bp, Artificial
  CRISPR gRNA sequence
ctcagccctctgccatctca

SEQ ID NO: 774363 - DNA, 20 bp, Artificial
  CRISPR gRNA sequence
agccctctgccatctcacca

SEQ ID NO: 774364 - DNA, 20 bp, Artificial
  CRISPR gRNA sequence
tgccatctcaccagggggaa

SEQ ID NO: 774365 - DNA, 20 bp, Artificial
  CRISPR gRNA sequence
ccatctcaccagggggaagt

SEQ ID NO: 774366 - DNA, 20 bp, Artificial
  CRISPR gRNA sequence
accagggggaagttgaggct

SEQ ID NO: 774367 - DNA, 20 bp, Artificial
  CRISPR gRNA sequence
aggctgctcttctgcagagg

SEQ ID NO: 774368 - DNA, 20 bp, Artificial
  CRISPR gRNA sequence
ctcttctgcagagggggcct

SEQ ID NO: 774369 - DNA, 20 bp, Artificial
  CRISPR gRNA sequence
ttctgcagagggggcctcag

SEQ ID NO: 774370 - DNA, 20 bp, Artificial
  CRISPR gRNA sequence
ctgcagagggggcctcaggt

SEQ ID NO: 774371 - DNA, 20 bp, Artificial
  CRISPR gRNA sequence
tgcagagggggcctcaggtc

SEQ ID NO: 774372 - DNA, 20 bp, Artificial
  CRISPR gRNA sequence
cagagggggcctcaggtcac

SEQ ID NO: 774373 - DNA, 20 bp, Artificial
  CRISPR gRNA sequence
aggtcactagtgaaaggatg

SEQ ID NO: 774374 - DNA, 20 bp, Artificial
  CRISPR gRNA sequence
gtgaaaggatgatgcctacc

SEQ ID NO: 774375 - DNA, 20 bp, Artificial
  CRISPR gRNA sequence
cccaccctctcagcctctca

SEQ ID NO: 774376 - DNA, 20 bp, Artificial
  CRISPR gRNA sequence
tcagcctctcacacacagat

SEQ ID NO: 774377 - DNA, 20 bp, Artificial
  CRISPR gRNA sequence
agcctctcacacacagatgt

SEQ ID NO: 774378 - DNA, 20 bp, Artificial
  CRISPR gRNA sequence
tcacacacagatgtgtgcat

SEQ ID NO: 774379 - DNA, 20 bp, Artificial
  CRISPR gRNA sequence
acacacagatgtgtgcatac

SEQ ID NO: 774380 - DNA, 20 bp, Artificial
  CRISPR gRNA sequence
aagcccaggtgtctttacct

SEQ ID NO: 774381 - DNA, 20 bp, Artificial
  CRISPR gRNA sequence
taccttctttgctgtcagag

SEQ ID NO: 774382 - DNA, 20 bp, Artificial
  CRISPR gRNA sequence
accttctttgctgtcagagt

SEQ ID NO: 774383 - DNA, 20 bp, Artificial
  CRISPR gRNA sequence
ccttctttgctgtcagagtg

SEQ ID NO: 774384 - DNA, 20 bp, Artificial
  CRISPR gRNA sequence
ctttgctgtcagagtgtttc

SEQ ID NO: 774385 - DNA, 20 bp, Artificial
  CRISPR gRNA sequence
tttgctgtcagagtgtttca

SEQ ID NO: 774386 - DNA, 20 bp, Artificial
  CRISPR gRNA sequence
tgctgtcagagtgtttcaga

SEQ ID NO: 774387 - DNA, 20 bp, Artificial
  CRISPR gRNA sequence
gctgtcagagtgtttcagag

SEQ ID NO: 774388 - DNA, 20 bp, Artificial
  CRISPR gRNA sequence
ctgtcagagtgtttcagagg

SEQ ID NO: 774389 - DNA, 20 bp, Artificial
  CRISPR gRNA sequence
tcagagtgtttcagaggctg

SEQ ID NO: 774390 - DNA, 20 bp, Artificial
  CRISPR gRNA sequence
cagaggctgcagggctgtaa

SEQ ID NO: 774391 - DNA, 20 bp, Artificial
  CRISPR gRNA sequence
agaggctgcagggctgtaaa

SEQ ID NO: 774392 - DNA, 20 bp, Artificial
  CRISPR gRNA sequence
cagggctgtaaaaaaaggaa

SEQ ID NO: 774393 - DNA, 20 bp, Artificial
  CRISPR gRNA sequence
taaaaaaaggaaggcgcaca

SEQ ID NO: 774394 - DNA, 20 bp, Artificial
  CRISPR gRNA sequence
gaaggggcgggacaagtcag

SEQ ID NO: 774395 - DNA, 20 bp, Artificial
  CRISPR gRNA sequence
catagcacaagggaaggggc

SEQ ID NO: 774396 - DNA, 20 bp, Artificial
  CRISPR gRNA sequence
atagcacaagggaaggggcc

SEQ ID NO: 774397 - DNA, 20 bp, Artificial
  CRISPR gRNA sequence
ggttgctgtcccaagcccca

SEQ ID NO: 774398 - DNA, 20 bp, Artificial
  CRISPR gRNA sequence
ctgtcccaagccccagtccc

SEQ ID NO: 774399 - DNA, 20 bp, Artificial
  CRISPR gRNA sequence
tcccaagccccagtcccagg

SEQ ID NO: 774400 - DNA, 20 bp, Artificial
  CRISPR gRNA sequence
cactctgtggcttgtcattc

SEQ ID NO: 774401 - DNA, 20 bp, Artificial
  CRISPR gRNA sequence
tgtggcttgtcattctcctc

SEQ ID NO: 774402 - DNA, 20 bp, Artificial
  CRISPR gRNA sequence
tggcttgtcattctcctctc

SEQ ID NO: 774403 - DNA, 20 bp, Artificial
  CRISPR gRNA sequence
gtcattctcctctctgggcc

SEQ ID NO: 774404 - DNA, 20 bp, Artificial
  CRISPR gRNA sequence
tcattctcctctctgggcct

SEQ ID NO: 774405 - DNA, 20 bp, Artificial
  CRISPR gRNA sequence
tcctctctgggccttagttt

SEQ ID NO: 774406 - DNA, 20 bp, Artificial
  CRISPR gRNA sequence
ctctctgggccttagttttc

SEQ ID NO: 774407 - DNA, 20 bp, Artificial
  CRISPR gRNA sequence
tctgggccttagttttctgc

SEQ ID NO: 774408 - DNA, 20 bp, Artificial
  CRISPR gRNA sequence
tgggccttagttttctgcat

SEQ ID NO: 774409 - DNA, 20 bp, Artificial
  CRISPR gRNA sequence
ggccttagttttctgcatct

SEQ ID NO: 774410 - DNA, 20 bp, Artificial
  CRISPR gRNA sequence
agttttctgcatctatagaa

SEQ ID NO: 774411 - DNA, 20 bp, Artificial
  CRISPR gRNA sequence
gttttctgcatctatagaat

SEQ ID NO: 774412 - DNA, 20 bp, Artificial
  CRISPR gRNA sequence
tctgcatctatagaatggga

SEQ ID NO: 774413 - DNA, 20 bp, Artificial
  CRISPR gRNA sequence
ctgcatctatagaatgggac

SEQ ID NO: 774414 - DNA, 20 bp, Artificial
  CRISPR gRNA sequence
tgcatctatagaatgggaca

SEQ ID NO: 774415 - DNA, 20 bp, Artificial
  CRISPR gRNA sequence
catctatagaatgggacaac

SEQ ID NO: 774416 - DNA, 20 bp, Artificial
  CRISPR gRNA sequence
tagaatgggacaaccctcga

SEQ ID NO: 774417 - DNA, 20 bp, Artificial
  CRISPR gRNA sequence
gagccctccacctccagctg

SEQ ID NO: 774418 - DNA, 20 bp, Artificial
  CRISPR gRNA sequence
cacctccagctggagatgcg

SEQ ID NO: 774419 - DNA, 20 bp, Artificial
  CRISPR gRNA sequence
cagctggagatgcggaagtg

SEQ ID NO: 774420 - DNA, 20 bp, Artificial
  CRISPR gRNA sequence
gagatgcggaagtgccctga

SEQ ID NO: 774421 - DNA, 20 bp, Artificial
  CRISPR gRNA sequence
agcccaatgtacacacaggg

SEQ ID NO: 774422 - DNA, 20 bp, Artificial
  CRISPR gRNA sequence
aaggaggctggcagatttgc

SEQ ID NO: 774423 - DNA, 20 bp, Artificial
  CRISPR gRNA sequence
gcagatttgcaggtgggcct

SEQ ID NO: 774424 - DNA, 20 bp, Artificial
  CRISPR gRNA sequence
gcaggtgggcctgggaccat

SEQ ID NO: 774425 - DNA, 20 bp, Artificial
  CRISPR gRNA sequence
caggtgggcctgggaccatg

SEQ ID NO: 774426 - DNA, 20 bp, Artificial
  CRISPR gRNA sequence
ggaccatgtggaatgagact

SEQ ID NO: 774427 - DNA, 20 bp, Artificial
  CRISPR gRNA sequence
accaactccatcacccacac

SEQ ID NO: 774428 - DNA, 20 bp, Artificial
  CRISPR gRNA sequence
catcacccacactcttctcc

SEQ ID NO: 774429 - DNA, 20 bp, Artificial
  CRISPR gRNA sequence
ttctcctcactccctccctt

SEQ ID NO: 774430 - DNA, 20 bp, Artificial
  CRISPR gRNA sequence
ctcctcactccctcccttct

SEQ ID NO: 774431 - DNA, 20 bp, Artificial
  CRISPR gRNA sequence
tcctcactccctcccttctg

SEQ ID NO: 774432 - DNA, 20 bp, Artificial
  CRISPR gRNA sequence
ctcactccctcccttctgcc

SEQ ID NO: 774433 - DNA, 20 bp, Artificial
  CRISPR gRNA sequence
actccctcccttctgccaac

SEQ ID NO: 774434 - DNA, 20 bp, Artificial
  CRISPR gRNA sequence
cctcccttctgccaactaca

SEQ ID NO: 774435 - DNA, 20 bp, Artificial
  CRISPR gRNA sequence
ccttctgccaactacatctg

SEQ ID NO: 774436 - DNA, 20 bp, Artificial
  CRISPR gRNA sequence
ctgccaactacatctgcctc

SEQ ID NO: 774437 - DNA, 20 bp, Artificial
  CRISPR gRNA sequence
tgccaactacatctgcctct

SEQ ID NO: 774438 - DNA, 20 bp, Artificial
  CRISPR gRNA sequence
ccaactacatctgcctctga

SEQ ID NO: 774439 - DNA, 20 bp, Artificial
  CRISPR gRNA sequence
catctgcctctgagcatgaa

SEQ ID NO: 774440 - DNA, 20 bp, Artificial
  CRISPR gRNA sequence
cctctgagcatgaagaatga

SEQ ID NO: 774441 - DNA, 20 bp, Artificial
  CRISPR gRNA sequence
tgagcatgaagaatgaggtc

SEQ ID NO: 774442 - DNA, 20 bp, Artificial
  CRISPR gRNA sequence
agcatgaagaatgaggtctg

SEQ ID NO: 774443 - DNA, 20 bp, Artificial
  CRISPR gRNA sequence
atcccagagctgtctctacg

SEQ ID NO: 774444 - DNA, 20 bp, Artificial
  CRISPR gRNA sequence
tctctacgcctgccacgctg

SEQ ID NO: 774445 - DNA, 20 bp, Artificial
  CRISPR gRNA sequence
tacgcctgccacgctgggca

SEQ ID NO: 774446 - DNA, 20 bp, Artificial
  CRISPR gRNA sequence
cgcctgccacgctgggcacc

SEQ ID NO: 774447 - DNA, 20 bp, Artificial
  CRISPR gRNA sequence
ccacgctgggcaccaacagg

SEQ ID NO: 774448 - DNA, 20 bp, Artificial
  CRISPR gRNA sequence
ggcaccaacaggcaaagaat

SEQ ID NO: 774449 - DNA, 20 bp, Artificial
  CRISPR gRNA sequence
attggcataatttatagcag

SEQ ID NO: 774450 - DNA, 20 bp, Artificial
  CRISPR gRNA sequence
gcataatttatagcagtccc

SEQ ID NO: 774451 - DNA, 20 bp, Artificial
  CRISPR gRNA sequence
atagcagtccccaagtgtca

SEQ ID NO: 774452 - DNA, 20 bp, Artificial
  CRISPR gRNA sequence
tagcagtccccaagtgtcaa

SEQ ID NO: 774453 - DNA, 20 bp, Artificial
  CRISPR gRNA sequence
ctgcccttccttctgcgggg

SEQ ID NO: 774454 - DNA, 20 bp, Artificial
  CRISPR gRNA sequence
cccttccttctgcgggggtg

SEQ ID NO: 774455 - DNA, 20 bp, Artificial
  CRISPR gRNA sequence
ccttctgcgggggtggggag

SEQ ID NO: 774456 - DNA, 20 bp, Artificial
  CRISPR gRNA sequence
cttctgcgggggtggggagg

SEQ ID NO: 774457 - DNA, 20 bp, Artificial
  CRISPR gRNA sequence
ctgcgggggtggggagggaa

SEQ ID NO: 774458 - DNA, 20 bp, Artificial
  CRISPR gRNA sequence
tgcgggggtggggagggaac

SEQ ID NO: 774459 - DNA, 20 bp, Artificial
  CRISPR gRNA sequence
cgggggtggggagggaactg

SEQ ID NO: 774460 - DNA, 20 bp, Artificial
  CRISPR gRNA sequence
gcattaactggaaccatccc

SEQ ID NO: 774461 - DNA, 20 bp, Artificial
  CRISPR gRNA sequence
actggaaccatcccaaatgg

SEQ ID NO: 774462 - DNA, 20 bp, Artificial
  CRISPR gRNA sequence
gaaccatcccaaatggctca

SEQ ID NO: 774463 - DNA, 20 bp, Artificial
  CRISPR gRNA sequence
agcggaaacctgcctctccc

SEQ ID NO: 774464 - DNA, 20 bp, Artificial
  CRISPR gRNA sequence
cctctcccagcccaggatcc

SEQ ID NO: 774465 - DNA, 20 bp, Artificial
  CRISPR gRNA sequence
tcccagcccaggatcccctg

SEQ ID NO: 774466 - DNA, 20 bp, Artificial
  CRISPR gRNA sequence
ccagcccaggatcccctggg

SEQ ID NO: 774467 - DNA, 20 bp, Artificial
  CRISPR gRNA sequence
ggagtcggccatgggcacca

SEQ ID NO: 774468 - DNA, 20 bp, Artificial
  CRISPR gRNA sequence
ggcacccacccaagctgggc

SEQ ID NO: 774469 - DNA, 20 bp, Artificial
  CRISPR gRNA sequence
gcacccacccaagctgggcc

SEQ ID NO: 774470 - DNA, 20 bp, Artificial
  CRISPR gRNA sequence
ggcccccagcttactgtgcc

SEQ ID NO: 774471 - DNA, 20 bp, Artificial
  CRISPR gRNA sequence
actgtgccatgctcctatgt

SEQ ID NO: 774472 - DNA, 20 bp, Artificial
  CRISPR gRNA sequence
ctgtgccatgctcctatgtc

SEQ ID NO: 774473 - DNA, 20 bp, Artificial
  CRISPR gRNA sequence
tgccatgctcctatgtcctt

SEQ ID NO: 774474 - DNA, 20 bp, Artificial
  CRISPR gRNA sequence
ctatgtcctttgcaagtacc

SEQ ID NO: 774475 - DNA, 20 bp, Artificial
  CRISPR gRNA sequence
tgtcctttgcaagtacctcc

SEQ ID NO: 774476 - DNA, 20 bp, Artificial
  CRISPR gRNA sequence
tgcaagtacctccctctcca

SEQ ID NO: 774477 - DNA, 20 bp, Artificial
  CRISPR gRNA sequence
gcaagtacctccctctccag

SEQ ID NO: 774478 - DNA, 20 bp, Artificial
  CRISPR gRNA sequence
caagtacctccctctccagt

SEQ ID NO: 774479 - DNA, 20 bp, Artificial
  CRISPR gRNA sequence
cctctccagtcacctgaaag

SEQ ID NO: 774480 - DNA, 20 bp, Artificial
  CRISPR gRNA sequence
tccagtcacctgaaagagct

SEQ ID NO: 774481 - DNA, 20 bp, Artificial
  CRISPR gRNA sequence
cagtcacctgaaagagcttc

SEQ ID NO: 774482 - DNA, 20 bp, Artificial
  CRISPR gRNA sequence
aaagagcttcaaaacagccc

SEQ ID NO: 774483 - DNA, 20 bp, Artificial
  CRISPR gRNA sequence
caaaacagccctctggtgcc

SEQ ID NO: 774484 - DNA, 20 bp, Artificial
  CRISPR gRNA sequence
aaaacagccctctggtgcca

SEQ ID NO: 774485 - DNA, 20 bp, Artificial
  CRISPR gRNA sequence
tggtgccatcagggcagggt

SEQ ID NO: 774486 - DNA, 20 bp, Artificial
  CRISPR gRNA sequence
gtgccatcagggcagggtca

SEQ ID NO: 774487 - DNA, 20 bp, Artificial
  CRISPR gRNA sequence
tacagatgggaaactgatgc

SEQ ID NO: 774488 - DNA, 20 bp, Artificial
  CRISPR gRNA sequence
acagatgggaaactgatgcc

SEQ ID NO: 774489 - DNA, 20 bp, Artificial
  CRISPR gRNA sequence
cagatgggaaactgatgccc

SEQ ID NO: 774490 - DNA, 20 bp, Artificial
  CRISPR gRNA sequence
atgcccagaggagcaaggca

SEQ ID NO: 774491 - DNA, 20 bp, Artificial
  CRISPR gRNA sequence
gcccaaagctacacagtctg

SEQ ID NO: 774492 - DNA, 20 bp, Artificial
  CRISPR gRNA sequence
cccaaagctacacagtctgt

SEQ ID NO: 774493 - DNA, 20 bp, Artificial
  CRISPR gRNA sequence
cacagtctgtaactagaaca

SEQ ID NO: 774494 - DNA, 20 bp, Artificial
  CRISPR gRNA sequence
taactagaacagtattgtct

SEQ ID NO: 774495 - DNA, 20 bp, Artificial
  CRISPR gRNA sequence
gaacagtattgtcttaagct

SEQ ID NO: 774496 - DNA, 20 bp, Artificial
  CRISPR gRNA sequence
tcttaagctgtttgcctaat

SEQ ID NO: 774497 - DNA, 20 bp, Artificial
  CRISPR gRNA sequence
aagctgtttgcctaatagta

SEQ ID NO: 774498 - DNA, 20 bp, Artificial
  CRISPR gRNA sequence
agctgtttgcctaatagtaa

SEQ ID NO: 774499 - DNA, 20 bp, Artificial
  CRISPR gRNA sequence
tttgcctaatagtaatagga

SEQ ID NO: 774500 - DNA, 20 bp, Artificial
  CRISPR gRNA sequence
gcctaatagtaataggactc

SEQ ID NO: 774501 - DNA, 20 bp, Artificial
  CRISPR gRNA sequence
cctaatagtaataggactcc

SEQ ID NO: 774502 - DNA, 20 bp, Artificial
  CRISPR gRNA sequence
atagtaataggactccagag

SEQ ID NO: 774503 - DNA, 20 bp, Artificial
  CRISPR gRNA sequence
cagagtattaagcacttggc

SEQ ID NO: 774504 - DNA, 20 bp, Artificial
  CRISPR gRNA sequence
agcacttggcactagatatg

SEQ ID NO: 774505 - DNA, 20 bp, Artificial
  CRISPR gRNA sequence
ggcactagatatgatactag

SEQ ID NO: 774506 - DNA, 20 bp, Artificial
  CRISPR gRNA sequence
gcactagatatgatactagg

SEQ ID NO: 774507 - DNA, 20 bp, Artificial
  CRISPR gRNA sequence
gatatgatactaggtccttt

SEQ ID NO: 774508 - DNA, 20 bp, Artificial
  CRISPR gRNA sequence
ggtcctttatatacattatc

SEQ ID NO: 774509 - DNA, 20 bp, Artificial
  CRISPR gRNA sequence
tatatacattatctcaatta

SEQ ID NO: 774510 - DNA, 20 bp, Artificial
  CRISPR gRNA sequence
atatacattatctcaattaa

SEQ ID NO: 774511 - DNA, 20 bp, Artificial
  CRISPR gRNA sequence
tatacattatctcaattaat

SEQ ID NO: 774512 - DNA, 20 bp, Artificial
  CRISPR gRNA sequence
tctcaattaataattcaaac

SEQ ID NO: 774513 - DNA, 20 bp, Artificial
  CRISPR gRNA sequence
aattaataattcaaacaacc

SEQ ID NO: 774514 - DNA, 20 bp, Artificial
  CRISPR gRNA sequence
ataattcaaacaacctatga

SEQ ID NO: 774515 - DNA, 20 bp, Artificial
  CRISPR gRNA sequence
aaacaacctatgaatctgtg

SEQ ID NO: 774516 - DNA, 20 bp, Artificial
  CRISPR gRNA sequence
tgaatctgtgattatcctca

SEQ ID NO: 774517 - DNA, 20 bp, Artificial
  CRISPR gRNA sequence
tgattatcctcattttacat

SEQ ID NO: 774518 - DNA, 20 bp, Artificial
  CRISPR gRNA sequence
tcctcattttacataagagg

SEQ ID NO: 774519 - DNA, 20 bp, Artificial
  CRISPR gRNA sequence
attttacataagaggaaacc

SEQ ID NO: 774520 - DNA, 20 bp, Artificial
  CRISPR gRNA sequence
tacataagaggaaaccgaag

SEQ ID NO: 774521 - DNA, 20 bp, Artificial
  CRISPR gRNA sequence
acataagaggaaaccgaagc

SEQ ID NO: 774522 - DNA, 20 bp, Artificial
  CRISPR gRNA sequence
cataagaggaaaccgaagcc

SEQ ID NO: 774523 - DNA, 20 bp, Artificial
  CRISPR gRNA sequence
gctcaaggccactctgttta

SEQ ID NO: 774524 - DNA, 20 bp, Artificial
  CRISPR gRNA sequence
ctcaaggccactctgtttac

SEQ ID NO: 774525 - DNA, 20 bp, Artificial
  CRISPR gRNA sequence
aaggccactctgtttacctg

SEQ ID NO: 774526 - DNA, 20 bp, Artificial
  CRISPR gRNA sequence
tgtttacctgagatggagca

SEQ ID NO: 774527 - DNA, 20 bp, Artificial
  CRISPR gRNA sequence
tttacctgagatggagcagg

SEQ ID NO: 774528 - DNA, 20 bp, Artificial
  CRISPR gRNA sequence
acctgagatggagcaggaac

SEQ ID NO: 774529 - DNA, 20 bp, Artificial
  CRISPR gRNA sequence
cctgagatggagcaggaact

SEQ ID NO: 774530 - DNA, 20 bp, Artificial
  CRISPR gRNA sequence
agatggagcaggaacttaaa

SEQ ID NO: 774531 - DNA, 20 bp, Artificial
  CRISPR gRNA sequence
aaacccagactccctatctc

SEQ ID NO: 774532 - DNA, 20 bp, Artificial
  CRISPR gRNA sequence
aacccagactccctatctcc

SEQ ID NO: 774533 - DNA, 20 bp, Artificial
  CRISPR gRNA sequence
cctatctccggagcccctgc

SEQ ID NO: 774534 - DNA, 20 bp, Artificial
  CRISPR gRNA sequence
tctccggagcccctgctccc

SEQ ID NO: 774535 - DNA, 20 bp, Artificial
  CRISPR gRNA sequence
cggagcccctgctcccaccc

SEQ ID NO: 774536 - DNA, 20 bp, Artificial
  CRISPR gRNA sequence
ctcccacccctaggaagcca

SEQ ID NO: 774537 - DNA, 20 bp, Artificial
  CRISPR gRNA sequence
ccacccctaggaagccacca

SEQ ID NO: 774538 - DNA, 20 bp, Artificial
  CRISPR gRNA sequence
ggaagccaccagactccacg

SEQ ID NO: 774539 - DNA, 20 bp, Artificial
  CRISPR gRNA sequence
cacggtgtggggccaatcag

SEQ ID NO: 774540 - DNA, 20 bp, Artificial
  CRISPR gRNA sequence
gcagatgggtaaaggttggc

SEQ ID NO: 774541 - DNA, 20 bp, Artificial
  CRISPR gRNA sequence
gcaggagaaatgaagccaca

SEQ ID NO: 774542 - DNA, 20 bp, Artificial
  CRISPR gRNA sequence
ggagggaactgggtgatcca

SEQ ID NO: 774543 - DNA, 20 bp, Artificial
  CRISPR gRNA sequence
ggtgatccacttcctgccta

SEQ ID NO: 774544 - DNA, 20 bp, Artificial
  CRISPR gRNA sequence
cctgcctaactctgggcaaa

SEQ ID NO: 774545 - DNA, 20 bp, Artificial
  CRISPR gRNA sequence
ctgcctaactctgggcaaag

SEQ ID NO: 774546 - DNA, 20 bp, Artificial
  CRISPR gRNA sequence
cctaactctgggcaaagagc

SEQ ID NO: 774547 - DNA, 20 bp, Artificial
  CRISPR gRNA sequence
actctgggcaaagagcagac

SEQ ID NO: 774548 - DNA, 20 bp, Artificial
  CRISPR gRNA sequence
tgggcaaagagcagactcac

SEQ ID NO: 774549 - DNA, 20 bp, Artificial
  CRISPR gRNA sequence
ggcaaagagcagactcaccg

SEQ ID NO: 774550 - DNA, 20 bp, Artificial
  CRISPR gRNA sequence
accggggtggggaggtctga

SEQ ID NO: 774551 - DNA, 20 bp, Artificial
  CRISPR gRNA sequence
agtccacagaacacatttca

SEQ ID NO: 774552 - DNA, 20 bp, Artificial
  CRISPR gRNA sequence
cattcaaaccttacagcaaa

SEQ ID NO: 774553 - DNA, 20 bp, Artificial
  CRISPR gRNA sequence
attcaaaccttacagcaaat

SEQ ID NO: 774554 - DNA, 20 bp, Artificial
  CRISPR gRNA sequence
aaaccttacagcaaatctgg

SEQ ID NO: 774555 - DNA, 20 bp, Artificial
  CRISPR gRNA sequence
acagcaaatctggcccctcc

SEQ ID NO: 774556 - DNA, 20 bp, Artificial
  CRISPR gRNA sequence
cagcaaatctggcccctcca

SEQ ID NO: 774557 - DNA, 20 bp, Artificial
  CRISPR gRNA sequence
gcccctccagatcctagagt

SEQ ID NO: 774558 - DNA, 20 bp, Artificial
  CRISPR gRNA sequence
cagatcctagagtcctctct

SEQ ID NO: 774559 - DNA, 20 bp, Artificial
  CRISPR gRNA sequence
gagtcctctctcctttccca

SEQ ID NO: 774560 - DNA, 20 bp, Artificial
  CRISPR gRNA sequence
tctcctttcccatatgtccc

SEQ ID NO: 774561 - DNA, 20 bp, Artificial
  CRISPR gRNA sequence
tcctttcccatatgtccctc

SEQ ID NO: 774562 - DNA, 20 bp, Artificial
  CRISPR gRNA sequence
ctttcccatatgtccctctc

SEQ ID NO: 774563 - DNA, 20 bp, Artificial
  CRISPR gRNA sequence
tcccatatgtccctctccca

SEQ ID NO: 774564 - DNA, 20 bp, Artificial
  CRISPR gRNA sequence
cccatatgtccctctcccag

SEQ ID NO: 774565 - DNA, 20 bp, Artificial
  CRISPR gRNA sequence
ccatatgtccctctcccagc

SEQ ID NO: 774566 - DNA, 20 bp, Artificial
  CRISPR gRNA sequence
tcccagccaagagggccagc

SEQ ID NO: 774567 - DNA, 20 bp, Artificial
  CRISPR gRNA sequence
ccagccaagagggccagctc

SEQ ID NO: 774568 - DNA, 20 bp, Artificial
  CRISPR gRNA sequence
caagttcagactcacctgtc

SEQ ID NO: 774569 - DNA, 20 bp, Artificial
  CRISPR gRNA sequence
agactcacctgtcttggagc

SEQ ID NO: 774570 - DNA, 20 bp, Artificial
  CRISPR gRNA sequence
acctgtcttggagccttctc

SEQ ID NO: 774571 - DNA, 20 bp, Artificial
  CRISPR gRNA sequence
tcttggagccttctccctcc

SEQ ID NO: 774572 - DNA, 20 bp, Artificial
  CRISPR gRNA sequence
ggagccttctccctccccat

SEQ ID NO: 774573 - DNA, 20 bp, Artificial
  CRISPR gRNA sequence
gagccttctccctccccatc

SEQ ID NO: 774574 - DNA, 20 bp, Artificial
  CRISPR gRNA sequence
ctccctccccatcctggtcc

SEQ ID NO: 774575 - DNA, 20 bp, Artificial
  CRISPR gRNA sequence
tccctccccatcctggtcct

SEQ ID NO: 774576 - DNA, 20 bp, Artificial
  CRISPR gRNA sequence
cctccccatcctggtcctca

SEQ ID NO: 774577 - DNA, 20 bp, Artificial
  CRISPR gRNA sequence
cccatcctggtcctcagctc

SEQ ID NO: 774578 - DNA, 20 bp, Artificial
  CRISPR gRNA sequence
gtcctcagctcctgcaaagg

SEQ ID NO: 774579 - DNA, 20 bp, Artificial
  CRISPR gRNA sequence
agctcctgcaaaggcaagaa

SEQ ID NO: 774580 - DNA, 20 bp, Artificial
  CRISPR gRNA sequence
ctgcaaaggcaagaactcag

SEQ ID NO: 774581 - DNA, 20 bp, Artificial
  CRISPR gRNA sequence
caaaggcaagaactcagaat

SEQ ID NO: 774582 - DNA, 20 bp, Artificial
  CRISPR gRNA sequence
agaataaacaaaaatctttt

SEQ ID NO: 774583 - DNA, 20 bp, Artificial
  CRISPR gRNA sequence
ttgcaagcccattttcatgc

SEQ ID NO: 774584 - DNA, 20 bp, Artificial
  CRISPR gRNA sequence
tgcaagcccattttcatgcc

SEQ ID NO: 774585 - DNA, 20 bp, Artificial
  CRISPR gRNA sequence
gcaagcccattttcatgcca

SEQ ID NO: 774586 - DNA, 20 bp, Artificial
  CRISPR gRNA sequence
caagcccattttcatgccag

SEQ ID NO: 774587 - DNA, 20 bp, Artificial
  CRISPR gRNA sequence
tcatgccagcactttcccac

SEQ ID NO: 774588 - DNA, 20 bp, Artificial
  CRISPR gRNA sequence
catgccagcactttcccacc

SEQ ID NO: 774589 - DNA, 20 bp, Artificial
  CRISPR gRNA sequence
atgccagcactttcccacct

SEQ ID NO: 774590 - DNA, 20 bp, Artificial
  CRISPR gRNA sequence
tcccacctgagagtgcagga

SEQ ID NO: 774591 - DNA, 20 bp, Artificial
  CRISPR gRNA sequence
cccacctgagagtgcaggaa

SEQ ID NO: 774592 - DNA, 20 bp, Artificial
  CRISPR gRNA sequence
ccacctgagagtgcaggaag

SEQ ID NO: 774593 - DNA, 20 bp, Artificial
  CRISPR gRNA sequence
agagtgcaggaagctggtga

SEQ ID NO: 774594 - DNA, 20 bp, Artificial
  CRISPR gRNA sequence
gtgaacagggcctgagtggg

SEQ ID NO: 774595 - DNA, 20 bp, Artificial
  CRISPR gRNA sequence
agtgggcctgacctgcggac

SEQ ID NO: 774596 - DNA, 20 bp, Artificial
  CRISPR gRNA sequence
acctgcggaccaaatgctag

SEQ ID NO: 774597 - DNA, 20 bp, Artificial
  CRISPR gRNA sequence
cggaccaaatgctagacacg

SEQ ID NO: 774598 - DNA, 20 bp, Artificial
  CRISPR gRNA sequence
gacacgggttagagcccgag

SEQ ID NO: 774599 - DNA, 20 bp, Artificial
  CRISPR gRNA sequence
gagcccgagagcagagcaca

SEQ ID NO: 774600 - DNA, 20 bp, Artificial
  CRISPR gRNA sequence
tgacaacatgaaggggctcc

SEQ ID NO: 774601 - DNA, 20 bp, Artificial
  CRISPR gRNA sequence
ccagcctggagcccaccact

SEQ ID NO: 774602 - DNA, 20 bp, Artificial
  CRISPR gRNA sequence
gagcccaccactcacccagc

SEQ ID NO: 774603 - DNA, 20 bp, Artificial
  CRISPR gRNA sequence
acccagccaaaaactaccca

SEQ ID NO: 774604 - DNA, 20 bp, Artificial
  CRISPR gRNA sequence
cccagcctggcgcccccacc

SEQ ID NO: 774605 - DNA, 20 bp, Artificial
  CRISPR gRNA sequence
gcgcccccaccactcaccca

SEQ ID NO: 774606 - DNA, 20 bp, Artificial
  CRISPR gRNA sequence
acccagccaaagaccatcca

SEQ ID NO: 774607 - DNA, 20 bp, Artificial
  CRISPR gRNA sequence
gagtgcaccacttacccagt

SEQ ID NO: 774608 - DNA, 20 bp, Artificial
  CRISPR gRNA sequence
acccagtcaaggaccatcca

SEQ ID NO: 774609 - DNA, 20 bp, Artificial
  CRISPR gRNA sequence
cccagtcaaggaccatccac

SEQ ID NO: 774610 - DNA, 20 bp, Artificial
  CRISPR gRNA sequence
gagcccaccactcacccagc

SEQ ID NO: 774611 - DNA, 20 bp, Artificial
  CRISPR gRNA sequence
acccagccaaagaccatcca

SEQ ID NO: 774612 - DNA, 20 bp, Artificial
  CRISPR gRNA sequence
aacctggagcccccgccaca

SEQ ID NO: 774613 - DNA, 20 bp, Artificial
  CRISPR gRNA sequence
gagcccccgccacacaccca

SEQ ID NO: 774614 - DNA, 20 bp, Artificial
  CRISPR gRNA sequence
ccctccaccagcccacccac

SEQ ID NO: 774615 - DNA, 20 bp, Artificial
  CRISPR gRNA sequence
caccagcccacccacccatc

SEQ ID NO: 774616 - DNA, 20 bp, Artificial
  CRISPR gRNA sequence
acccatccgctcgctcagta

SEQ ID NO: 774617 - DNA, 20 bp, Artificial
  CRISPR gRNA sequence
gctcagtagccctgccaacc

SEQ ID NO: 774618 - DNA, 20 bp, Artificial
  CRISPR gRNA sequence
agtagccctgccaaccatca

SEQ ID NO: 774619 - DNA, 20 bp, Artificial
  CRISPR gRNA sequence
ccaaccatcaacctccaaca

SEQ ID NO: 774620 - DNA, 20 bp, Artificial
  CRISPR gRNA sequence
caacagatgtaaccaaccag

SEQ ID NO: 774621 - DNA, 20 bp, Artificial
  CRISPR gRNA sequence
cctgctcatccttccacctg

SEQ ID NO: 774622 - DNA, 20 bp, Artificial
  CRISPR gRNA sequence
ctcatccttccacctgtcta

SEQ ID NO: 774623 - DNA, 20 bp, Artificial
  CRISPR gRNA sequence
atccttccacctgtctacct

SEQ ID NO: 774624 - DNA, 20 bp, Artificial
  CRISPR gRNA sequence
ccacctgtctacctcacaag

SEQ ID NO: 774625 - DNA, 20 bp, Artificial
  CRISPR gRNA sequence
cacctgtctacctcacaagt

SEQ ID NO: 774626 - DNA, 20 bp, Artificial
  CRISPR gRNA sequence
tctacctcacaagtactcac

SEQ ID NO: 774627 - DNA, 20 bp, Artificial
  CRISPR gRNA sequence
cctcacaagtactcacctat

SEQ ID NO: 774628 - DNA, 20 bp, Artificial
  CRISPR gRNA sequence
acaagtactcacctatctgc

SEQ ID NO: 774629 - DNA, 20 bp, Artificial
  CRISPR gRNA sequence
acctatctgccaactgacca

SEQ ID NO: 774630 - DNA, 20 bp, Artificial
  CRISPR gRNA sequence
tctgccaactgaccactctt

SEQ ID NO: 774631 - DNA, 20 bp, Artificial
  CRISPR gRNA sequence
ccaactgaccactcttcttc

SEQ ID NO: 774632 - DNA, 20 bp, Artificial
  CRISPR gRNA sequence
accactcttcttccctctcc

SEQ ID NO: 774633 - DNA, 20 bp, Artificial
  CRISPR gRNA sequence
ttcttccctctccttcccaa

SEQ ID NO: 774634 - DNA, 20 bp, Artificial
  CRISPR gRNA sequence
cttccctctccttcccaacc

SEQ ID NO: 774635 - DNA, 20 bp, Artificial
  CRISPR gRNA sequence
ttccctctccttcccaacct

SEQ ID NO: 774636 - DNA, 20 bp, Artificial
  CRISPR gRNA sequence
ccctctccttcccaacctcc

SEQ ID NO: 774637 - DNA, 20 bp, Artificial
  CRISPR gRNA sequence
cctctccttcccaacctcca

SEQ ID NO: 774638 - DNA, 20 bp, Artificial
  CRISPR gRNA sequence
tccttcccaacctccagcca

SEQ ID NO: 774639 - DNA, 20 bp, Artificial
  CRISPR gRNA sequence
cttcccaacctccagccatc

SEQ ID NO: 774640 - DNA, 20 bp, Artificial
  CRISPR gRNA sequence
cccaacctccagccatcccc

SEQ ID NO: 774641 - DNA, 20 bp, Artificial
  CRISPR gRNA sequence
ccaacctccagccatcccca

SEQ ID NO: 774642 - DNA, 20 bp, Artificial
  CRISPR gRNA sequence
cagccatccccagcctctga

SEQ ID NO: 774643 - DNA, 20 bp, Artificial
  CRISPR gRNA sequence
tgactacccatctactctca

SEQ ID NO: 774644 - DNA, 20 bp, Artificial
  CRISPR gRNA sequence
actacccatctactctcatg

SEQ ID NO: 774645 - DNA, 20 bp, Artificial
  CRISPR gRNA sequence
cccatctactctcatgcatc

SEQ ID NO: 774646 - DNA, 20 bp, Artificial
  CRISPR gRNA sequence
ctctcatgcatctgtttacc

SEQ ID NO: 774647 - DNA, 20 bp, Artificial
  CRISPR gRNA sequence
tcatgcatctgtttacccac

SEQ ID NO: 774648 - DNA, 20 bp, Artificial
  CRISPR gRNA sequence
atgcatctgtttacccacca

SEQ ID NO: 774649 - DNA, 20 bp, Artificial
  CRISPR gRNA sequence
tttacccaccagggtcaact

SEQ ID NO: 774650 - DNA, 20 bp, Artificial
  CRISPR gRNA sequence
acccaccagggtcaactcac

SEQ ID NO: 774651 - DNA, 20 bp, Artificial
  CRISPR gRNA sequence
cccaccagggtcaactcacc

SEQ ID NO: 774652 - DNA, 20 bp, Artificial
  CRISPR gRNA sequence
accacccaccaatgtcctct

SEQ ID NO: 774653 - DNA, 20 bp, Artificial
  CRISPR gRNA sequence
tcacccacttaccagtcacc

SEQ ID NO: 774654 - DNA, 20 bp, Artificial
  CRISPR gRNA sequence
acccacttaccagtcaccaa

SEQ ID NO: 774655 - DNA, 20 bp, Artificial
  CRISPR gRNA sequence
accagtcaccaatgccagct

SEQ ID NO: 774656 - DNA, 20 bp, Artificial
  CRISPR gRNA sequence
ccagtcaccaatgccagctc

SEQ ID NO: 774657 - DNA, 20 bp, Artificial
  CRISPR gRNA sequence
gggctgaccctcagccccgc

SEQ ID NO: 774658 - DNA, 20 bp, Artificial
  CRISPR gRNA sequence
accctcagccccgcaaatgg

SEQ ID NO: 774659 - DNA, 20 bp, Artificial
  CRISPR gRNA sequence
agccccgcaaatggcagctg

SEQ ID NO: 774660 - DNA, 20 bp, Artificial
  CRISPR gRNA sequence
cttcaaactcactccaaggc

SEQ ID NO: 774661 - DNA, 20 bp, Artificial
  CRISPR gRNA sequence
caaactcactccaaggcagg

SEQ ID NO: 774662 - DNA, 20 bp, Artificial
  CRISPR gRNA sequence
aaactcactccaaggcaggc

SEQ ID NO: 774663 - DNA, 20 bp, Artificial
  CRISPR gRNA sequence
actccaaggcaggcacgatc

SEQ ID NO: 774664 - DNA, 20 bp, Artificial
  CRISPR gRNA sequence
caaggcaggcacgatcaccc

SEQ ID NO: 774665 - DNA, 20 bp, Artificial
  CRISPR gRNA sequence
gcatgcctacatttgtgccg

SEQ ID NO: 774666 - DNA, 20 bp, Artificial
  CRISPR gRNA sequence
catttgtgccgcacagcttc

SEQ ID NO: 774667 - DNA, 20 bp, Artificial
  CRISPR gRNA sequence
gtgccgcacagcttccatgc

SEQ ID NO: 774668 - DNA, 20 bp, Artificial
  CRISPR gRNA sequence
tgccgcacagcttccatgct

SEQ ID NO: 774669 - DNA, 20 bp, Artificial
  CRISPR gRNA sequence
ccatgctctggcctgctctc

SEQ ID NO: 774670 - DNA, 20 bp, Artificial
  CRISPR gRNA sequence
catgctctggcctgctctct

SEQ ID NO: 774671 - DNA, 20 bp, Artificial
  CRISPR gRNA sequence
tggcctgctctctcacacac

SEQ ID NO: 774672 - DNA, 20 bp, Artificial
  CRISPR gRNA sequence
gcctgctctctcacacacac

SEQ ID NO: 774673 - DNA, 20 bp, Artificial
  CRISPR gRNA sequence
ctctctcacacacacgtgac

SEQ ID NO: 774674 - DNA, 20 bp, Artificial
  CRISPR gRNA sequence
tctcacacacacgtgactga

SEQ ID NO: 774675 - DNA, 20 bp, Artificial
  CRISPR gRNA sequence
tcacacacacgtgactgact

SEQ ID NO: 774676 - DNA, 20 bp, Artificial
  CRISPR gRNA sequence
acacacacgtgactgactta

SEQ ID NO: 774677 - DNA, 20 bp, Artificial
  CRISPR gRNA sequence
acttacactttcacaggcac

SEQ ID NO: 774678 - DNA, 20 bp, Artificial
  CRISPR gRNA sequence
acactttcacaggcacactt

SEQ ID NO: 774679 - DNA, 20 bp, Artificial
  CRISPR gRNA sequence
cactttcacaggcacacttg

SEQ ID NO: 774680 - DNA, 20 bp, Artificial
  CRISPR gRNA sequence
tcacaggcacacttgttggc

SEQ ID NO: 774681 - DNA, 20 bp, Artificial
  CRISPR gRNA sequence
cacaggcacacttgttggca

SEQ ID NO: 774682 - DNA, 20 bp, Artificial
  CRISPR gRNA sequence
acaggcacacttgttggcac

SEQ ID NO: 774683 - DNA, 20 bp, Artificial
  CRISPR gRNA sequence
gttggcacacactcatccct

SEQ ID NO: 774684 - DNA, 20 bp, Artificial
  CRISPR gRNA sequence
ttggcacacactcatccctt

SEQ ID NO: 774685 - DNA, 20 bp, Artificial
  CRISPR gRNA sequence
gcacacactcatccctttgt

SEQ ID NO: 774686 - DNA, 20 bp, Artificial
  CRISPR gRNA sequence
atccctttgtagcacttggc

SEQ ID NO: 774687 - DNA, 20 bp, Artificial
  CRISPR gRNA sequence
tgtagcacttggccttacac

SEQ ID NO: 774688 - DNA, 20 bp, Artificial
  CRISPR gRNA sequence
gtagcacttggccttacact

SEQ ID NO: 774689 - DNA, 20 bp, Artificial
  CRISPR gRNA sequence
tagcacttggccttacactc

SEQ ID NO: 774690 - DNA, 20 bp, Artificial
  CRISPR gRNA sequence
ggccttacactcccaccacc

SEQ ID NO: 774691 - DNA, 20 bp, Artificial
  CRISPR gRNA sequence
gccttacactcccaccacct

SEQ ID NO: 774692 - DNA, 20 bp, Artificial
  CRISPR gRNA sequence
acactcccaccaccttccag

SEQ ID NO: 774693 - DNA, 20 bp, Artificial
  CRISPR gRNA sequence
cactcccaccaccttccagt

SEQ ID NO: 774694 - DNA, 20 bp, Artificial
  CRISPR gRNA sequence
ccaccaccttccagtcacac

SEQ ID NO: 774695 - DNA, 20 bp, Artificial
  CRISPR gRNA sequence
ccagtcacactcatccacat

SEQ ID NO: 774696 - DNA, 20 bp, Artificial
  CRISPR gRNA sequence
cagtcacactcatccacatt
